United States Patent 12,297,428 (COMPOSITIONS FOR IDENTIFICATION OF MEMBRANE TARGETS FOR ENHANCEMENT OF T CELL ACTIVITY AGAINST CANCER) - sequence listing, part 2

SEQ ID NO: 19002 - DNA, 20 bp, Artificial Sequence
  sgRNA
  Emp2_16
gaggccgctgatgaaagtga

SEQ ID NO: 19003 - DNA, 20 bp, Artificial Sequence
  sgRNA
  Emp2_17
acaggacatgagctggatga

SEQ ID NO: 19004 - DNA, 20 bp, Artificial Sequence
  sgRNA
  Emp2_18
cgtagctgccttcttgcagt

SEQ ID NO: 19005 - DNA, 20 bp, Artificial Sequence
  sgRNA
  Emp2_19
acctctctccctgcttgagg

SEQ ID NO: 19006 - DNA, 20 bp, Artificial Sequence
  sgRNA
  Emp2_20
accttcaaacgcttcagggc

SEQ ID NO: 19007 - DNA, 20 bp, Artificial Sequence
  sgRNA
  Emp3_1
caactctacaccatgcggcg

SEQ ID NO: 19008 - DNA, 20 bp, Artificial Sequence
  sgRNA
  Emp3_2
attctcactgacgttactgc

SEQ ID NO: 19009 - DNA, 20 bp, Artificial Sequence
  sgRNA
  Emp3_3
acctgtggtatgactgcacg

SEQ ID NO: 19010 - DNA, 20 bp, Artificial Sequence
  sgRNA
  Emp3_4
ggatgagagacagcaccatg

SEQ ID NO: 19011 - DNA, 20 bp, Artificial Sequence
  sgRNA
  Emp3_5
gcactgtctacatccacctg

SEQ ID NO: 19012 - DNA, 20 bp, Artificial Sequence
  sgRNA
  Emp3_6
tgttccaactctacaccatg

SEQ ID NO: 19013 - DNA, 20 bp, Artificial Sequence
  sgRNA
  Emp3_7
cttcggttactgcttcgccc

SEQ ID NO: 19014 - DNA, 20 bp, Artificial Sequence
  sgRNA
  Emp3_8
catctatgccatccacaccg

SEQ ID NO: 19015 - DNA, 20 bp, Artificial Sequence
  sgRNA
  Emp3_9
gatggcatagatgagtgccc

SEQ ID NO: 19016 - DNA, 20 bp, Artificial Sequence
  sgRNA
  Emp3_10
gatgagagacagcaccatga

SEQ ID NO: 19017 - DNA, 20 bp, Artificial Sequence
  sgRNA
  Emp3_11
ggaacaccaccactcaaaca

SEQ ID NO: 19018 - DNA, 20 bp, Artificial Sequence
  sgRNA
  Emp3_12
gcaggcccatgtttgagtgg

SEQ ID NO: 19019 - DNA, 20 bp, Artificial Sequence
  sgRNA
  Emp3_13
gggcagagaccaccaacagg

SEQ ID NO: 19020 - DNA, 20 bp, Artificial Sequence
  sgRNA
  Emp3_14
gtgccgctgaccagagcgag

SEQ ID NO: 19021 - DNA, 20 bp, Artificial Sequence
  sgRNA
  Emp3_15
gacaagaatgaggatgtgga

SEQ ID NO: 19022 - DNA, 20 bp, Artificial Sequence
  sgRNA
  Emp3_16
ggagggcagagaccaccaac

SEQ ID NO: 19023 - DNA, 20 bp, Artificial Sequence
  sgRNA
  Emp3_17
gtgcttggccaggatctcct

SEQ ID NO: 19024 - DNA, 20 bp, Artificial Sequence
  sgRNA
  Emp3_18
tttccactcgctctggtcag

SEQ ID NO: 19025 - DNA, 20 bp, Artificial Sequence
  sgRNA
  Emp3_19
ggtgcaaagctggcagaggc

SEQ ID NO: 19026 - DNA, 20 bp, Artificial Sequence
  sgRNA
  Emp3_20
gcagtcataccacaggttca

SEQ ID NO: 19027 - DNA, 20 bp, Artificial Sequence
  sgRNA
  Eng_1
tcagggacatgagtagcacg

SEQ ID NO: 19028 - DNA, 20 bp, Artificial Sequence
  sgRNA
  Eng_2
caagtgcaatgggatttccg

SEQ ID NO: 19029 - DNA, 20 bp, Artificial Sequence
  sgRNA
  Eng_3
cacaccccaaggcctgatag

SEQ ID NO: 19030 - DNA, 20 bp, Artificial Sequence
  sgRNA
  Eng_4
gtggttgatgtcgatgaacc

SEQ ID NO: 19031 - DNA, 20 bp, Artificial Sequence
  sgRNA
  Eng_5
gcaactcagttccatcatta

SEQ ID NO: 19032 - DNA, 20 bp, Artificial Sequence
  sgRNA
  Eng_6
acatgggcgccacacttgaa

SEQ ID NO: 19033 - DNA, 20 bp, Artificial Sequence
  sgRNA
  Eng_7
cgtcaggctcaccaccactt

SEQ ID NO: 19034 - DNA, 20 bp, Artificial Sequence
  sgRNA
  Eng_8
acagcctgtggaccccacaa

SEQ ID NO: 19035 - DNA, 20 bp, Artificial Sequence
  sgRNA
  Eng_9
agtagcgcctactccagctg

SEQ ID NO: 19036 - DNA, 20 bp, Artificial Sequence
  sgRNA
  Eng_10
aaggtgatacccagtacaga

SEQ ID NO: 19037 - DNA, 20 bp, Artificial Sequence
  sgRNA
  Eng_11
gagcagggccccaatcagga

SEQ ID NO: 19038 - DNA, 20 bp, Artificial Sequence
  sgRNA
  Eng_12
gtggacttcacgcacagcat

SEQ ID NO: 19039 - DNA, 20 bp, Artificial Sequence
  sgRNA
  Eng_13
gtcgaggatctgtttcctgg

SEQ ID NO: 19040 - DNA, 20 bp, Artificial Sequence
  sgRNA
  Eng_14
aggccagcaggccttcgtac

SEQ ID NO: 19041 - DNA, 20 bp, Artificial Sequence
  sgRNA
  Eng_15
caggaaacagatcctcgact

SEQ ID NO: 19042 - DNA, 20 bp, Artificial Sequence
  sgRNA
  Eng_16
catcacctcgatagcagcac

SEQ ID NO: 19043 - DNA, 20 bp, Artificial Sequence
  sgRNA
  Eng_17
ccatcattacggtcaccgtc

SEQ ID NO: 19044 - DNA, 20 bp, Artificial Sequence
  sgRNA
  Eng_18
gagctcccagacacacccca

SEQ ID NO: 19045 - DNA, 20 bp, Artificial Sequence
  sgRNA
  Eng_19
ccagatggcagctatctagc

SEQ ID NO: 19046 - DNA, 20 bp, Artificial Sequence
  sgRNA
  Eng_20
gcttcctggaaagatcttga

SEQ ID NO: 19047 - DNA, 20 bp, Artificial Sequence
  sgRNA
  Enpep_1
tagatgaggccgatagtagg

SEQ ID NO: 19048 - DNA, 20 bp, Artificial Sequence
  sgRNA
  Enpep_2
gggagtcgtcctcttgcacg

SEQ ID NO: 19049 - DNA, 20 bp, Artificial Sequence
  sgRNA
  Enpep_3
tgttgggttcgtcgaaacaa

SEQ ID NO: 19050 - DNA, 20 bp, Artificial Sequence
  sgRNA
  Enpep_4
gggagcaggtaccaattcga

SEQ ID NO: 19051 - DNA, 20 bp, Artificial Sequence
  sgRNA
  Enpep_5
aaaacttgaccggtcagcag

SEQ ID NO: 19052 - DNA, 20 bp, Artificial Sequence
  sgRNA
  Enpep_6
tccagttcactacgacctgg

SEQ ID NO: 19053 - DNA, 20 bp, Artificial Sequence
  sgRNA
  Enpep_7
gctttacgaccccctactat

SEQ ID NO: 19054 - DNA, 20 bp, Artificial Sequence
  sgRNA
  Enpep_8
cggtgaagaacaacatcgag

SEQ ID NO: 19055 - DNA, 20 bp, Artificial Sequence
  sgRNA
  Enpep_9
cttcgaagactacttcgcta

SEQ ID NO: 19056 - DNA, 20 bp, Artificial Sequence
  sgRNA
  Enpep_10
gatgaaatgactctctccca

SEQ ID NO: 19057 - DNA, 20 bp, Artificial Sequence
  sgRNA
  Enpep_11
gcttcgttcttcgagttctt

SEQ ID NO: 19058 - DNA, 20 bp, Artificial Sequence
  sgRNA
  Enpep_12
ttgcagtgaatcccaaaagt

SEQ ID NO: 19059 - DNA, 20 bp, Artificial Sequence
  sgRNA
  Enpep_13
cctgatgtcttcacatccag

SEQ ID NO: 19060 - DNA, 20 bp, Artificial Sequence
  sgRNA
  Enpep_14
ccatcccagcaaatctgcaa

SEQ ID NO: 19061 - DNA, 20 bp, Artificial Sequence
  sgRNA
  Enpep_15
aacgtgggattggatagccg

SEQ ID NO: 19062 - DNA, 20 bp, Artificial Sequence
  sgRNA
  Enpep_16
actctggcaatgaggcagcg

SEQ ID NO: 19063 - DNA, 20 bp, Artificial Sequence
  sgRNA
  Enpep_17
gtataagaagcaggagtacg

SEQ ID NO: 19064 - DNA, 20 bp, Artificial Sequence
  sgRNA
  Enpep_18
ttacaaaaccacctacatgg

SEQ ID NO: 19065 - DNA, 20 bp, Artificial Sequence
  sgRNA
  Enpep_19
cgaatcctaagatagaggcc

SEQ ID NO: 19066 - DNA, 20 bp, Artificial Sequence
  sgRNA
  Enpep_20
cttccactcacagtgaccac

SEQ ID NO: 19067 - DNA, 20 bp, Artificial Sequence
  sgRNA
  Enpp1_1
tacaacgcaagttgccactg

SEQ ID NO: 19068 - DNA, 20 bp, Artificial Sequence
  sgRNA
  Enpp1_2
ggtgaccgctaatcatcagg

SEQ ID NO: 19069 - DNA, 20 bp, Artificial Sequence
  sgRNA
  Enpp1_3
atgtgaaagcatcgataccc

SEQ ID NO: 19070 - DNA, 20 bp, Artificial Sequence
  sgRNA
  Enpp1_4
aacgtcttggtagggtacat

SEQ ID NO: 19071 - DNA, 20 bp, Artificial Sequence
  sgRNA
  Enpp1_5
atatgactgtaccctacggg

SEQ ID NO: 19072 - DNA, 20 bp, Artificial Sequence
  sgRNA
  Enpp1_6
tctaaggcggagcactccaa

SEQ ID NO: 19073 - DNA, 20 bp, Artificial Sequence
  sgRNA
  Enpp1_7
ccatcagcatgccgaccagg

SEQ ID NO: 19074 - DNA, 20 bp, Artificial Sequence
  sgRNA
  Enpp1_8
gtaagctgaggactctaagg

SEQ ID NO: 19075 - DNA, 20 bp, Artificial Sequence
  sgRNA
  Enpp1_9
tttcccgctgacccgtgccg

SEQ ID NO: 19076 - DNA, 20 bp, Artificial Sequence
  sgRNA
  Enpp1_10
atgggcatacctttgcagta

SEQ ID NO: 19077 - DNA, 20 bp, Artificial Sequence
  sgRNA
  Enpp1_11
gattcttcagggcattcaca

SEQ ID NO: 19078 - DNA, 20 bp, Artificial Sequence
  sgRNA
  Enpp1_12
acatggaccagtcagcagcg

SEQ ID NO: 19079 - DNA, 20 bp, Artificial Sequence
  sgRNA
  Enpp1_13
gaaggtgtaagacgcccaga

SEQ ID NO: 19080 - DNA, 20 bp, Artificial Sequence
  sgRNA
  Enpp1_14
gctgctggagtagacagacg

SEQ ID NO: 19081 - DNA, 20 bp, Artificial Sequence
  sgRNA
  Enpp1_15
aaatcaacatccaatgacct

SEQ ID NO: 19082 - DNA, 20 bp, Artificial Sequence
  sgRNA
  Enpp1_16
cttgacctcctgatgattag

SEQ ID NO: 19083 - DNA, 20 bp, Artificial Sequence
  sgRNA
  Enpp1_17
tcagcaccatgcttgaaggc

SEQ ID NO: 19084 - DNA, 20 bp, Artificial Sequence
  sgRNA
  Enpp1_18
tgagcccctgaccttctacc

SEQ ID NO: 19085 - DNA, 20 bp, Artificial Sequence
  sgRNA
  Enpp1_19
gtacagctctcaatgttatc

SEQ ID NO: 19086 - DNA, 20 bp, Artificial Sequence
  sgRNA
  Enpp1_20
gcacgctccgccttctccag

SEQ ID NO: 19087 - DNA, 20 bp, Artificial Sequence
  sgRNA
  Enpp4_1
tgttatagacttgacccctg

SEQ ID NO: 19088 - DNA, 20 bp, Artificial Sequence
  sgRNA
  Enpp4_2
aaggataccagaagtaaccg

SEQ ID NO: 19089 - DNA, 20 bp, Artificial Sequence
  sgRNA
  Enpp4_3
tgatcattacaagcgatcat

SEQ ID NO: 19090 - DNA, 20 bp, Artificial Sequence
  sgRNA
  Enpp4_4
gactgggtaacgttaccaca

SEQ ID NO: 19091 - DNA, 20 bp, Artificial Sequence
  sgRNA
  Enpp4_5
agataaagaaaacatgcgcc

SEQ ID NO: 19092 - DNA, 20 bp, Artificial Sequence
  sgRNA
  Enpp4_6
gcagagcaccatcaacactg

SEQ ID NO: 19093 - DNA, 20 bp, Artificial Sequence
  sgRNA
  Enpp4_7
ttcccaatagagcgctgcaa

SEQ ID NO: 19094 - DNA, 20 bp, Artificial Sequence
  sgRNA
  Enpp4_8
ggcttatatgaggaaagcca

SEQ ID NO: 19095 - DNA, 20 bp, Artificial Sequence
  sgRNA
  Enpp4_9
gcagggaattatcatagcca

SEQ ID NO: 19096 - DNA, 20 bp, Artificial Sequence
  sgRNA
  Enpp4_10
gctgaattcgactgctgtgt

SEQ ID NO: 19097 - DNA, 20 bp, Artificial Sequence
  sgRNA
  Enpp4_11
attaatctcccagaagccat

SEQ ID NO: 19098 - DNA, 20 bp, Artificial Sequence
  sgRNA
  Enpp4_12
tccgctccattccaccaaaa

SEQ ID NO: 19099 - DNA, 20 bp, Artificial Sequence
  sgRNA
  Enpp4_13
gtagtttgaacggtcgatgc

SEQ ID NO: 19100 - DNA, 20 bp, Artificial Sequence
  sgRNA
  Enpp4_14
gcgctgcaaaggtgactggt

SEQ ID NO: 19101 - DNA, 20 bp, Artificial Sequence
  sgRNA
  Enpp4_15
ggtcaagcgctgccgctatg

SEQ ID NO: 19102 - DNA, 20 bp, Artificial Sequence
  sgRNA
  Enpp4_16
gtgacaagtccccaaaacaa

SEQ ID NO: 19103 - DNA, 20 bp, Artificial Sequence
  sgRNA
  Enpp4_17
aaacgggtgcatactaggca

SEQ ID NO: 19104 - DNA, 20 bp, Artificial Sequence
  sgRNA
  Enpp4_18
tgggaagaaccagatgtaag

SEQ ID NO: 19105 - DNA, 20 bp, Artificial Sequence
  sgRNA
  Enpp4_19
gctgctatagttcataaaat

SEQ ID NO: 19106 - DNA, 20 bp, Artificial Sequence
  sgRNA
  Enpp4_20
acaagcacttggtatgactg

SEQ ID NO: 19107 - DNA, 20 bp, Artificial Sequence
  sgRNA
  Enpp5_1
aataggtcgggaaactatcg

SEQ ID NO: 19108 - DNA, 20 bp, Artificial Sequence
  sgRNA
  Enpp5_2
tgggaagaacccgatgacac

SEQ ID NO: 19109 - DNA, 20 bp, Artificial Sequence
  sgRNA
  Enpp5_3
tcatcgtcacgagcgaccat

SEQ ID NO: 19110 - DNA, 20 bp, Artificial Sequence
  sgRNA
  Enpp5_4
cgttagattaggatgggcac

SEQ ID NO: 19111 - DNA, 20 bp, Artificial Sequence
  sgRNA
  Enpp5_5
tcatcggccacagctacgat

SEQ ID NO: 19112 - DNA, 20 bp, Artificial Sequence
  sgRNA
  Enpp5_6
atagaccgttagattaggat

SEQ ID NO: 19113 - DNA, 20 bp, Artificial Sequence
  sgRNA
  Enpp5_7
ctaatgcattatcataacca

SEQ ID NO: 19114 - DNA, 20 bp, Artificial Sequence
  sgRNA
  Enpp5_8
tcgtagctgtggccgatgaa

SEQ ID NO: 19115 - DNA, 20 bp, Artificial Sequence
  sgRNA
  Enpp5_9
cggtgcccatcctaatctaa

SEQ ID NO: 19116 - DNA, 20 bp, Artificial Sequence
  sgRNA
  Enpp5_10
gaaataacagaccccatgag

SEQ ID NO: 19117 - DNA, 20 bp, Artificial Sequence
  sgRNA
  Enpp5_11
tctaacggtctataaaaagg

SEQ ID NO: 19118 - DNA, 20 bp, Artificial Sequence
  sgRNA
  Enpp5_12
tccttgggagtgacaaacca

SEQ ID NO: 19119 - DNA, 20 bp, Artificial Sequence
  sgRNA
  Enpp5_13
gctgccatcctgccaaaaga

SEQ ID NO: 19120 - DNA, 20 bp, Artificial Sequence
  sgRNA
  Enpp5_14
gcatactttacaatataggc

SEQ ID NO: 19121 - DNA, 20 bp, Artificial Sequence
  sgRNA
  Enpp5_15
gtagagaaaacggagccgaa

SEQ ID NO: 19122 - DNA, 20 bp, Artificial Sequence
  sgRNA
  Enpp5_16
ggcagggcatgctagtggcg

SEQ ID NO: 19123 - DNA, 20 bp, Artificial Sequence
  sgRNA
  Enpp5_17
tcttggcagcatcatagcta

SEQ ID NO: 19124 - DNA, 20 bp, Artificial Sequence
  sgRNA
  Enpp5_18
ataaatatccatgtgctcca

SEQ ID NO: 19125 - DNA, 20 bp, Artificial Sequence
  sgRNA
  Enpp5_19
ttatcagataccctaacttg

SEQ ID NO: 19126 - DNA, 20 bp, Artificial Sequence
  sgRNA
  Enpp5_20
tagccagtgtgcaagacgca

SEQ ID NO: 19127 - DNA, 20 bp, Artificial Sequence
  sgRNA
  Enpp6_1
gatgatcggcaactacatgt

SEQ ID NO: 19128 - DNA, 20 bp, Artificial Sequence
  sgRNA
  Enpp6_2
tgtgaacagaggcgtcaaag

SEQ ID NO: 19129 - DNA, 20 bp, Artificial Sequence
  sgRNA
  Enpp6_3
ctgcagcaagtgaaagaccg

SEQ ID NO: 19130 - DNA, 20 bp, Artificial Sequence
  sgRNA
  Enpp6_4
atatggctgctagatccgct

SEQ ID NO: 19131 - DNA, 20 bp, Artificial Sequence
  sgRNA
  Enpp6_5
caacaccaggagcttccggt

SEQ ID NO: 19132 - DNA, 20 bp, Artificial Sequence
  sgRNA
  Enpp6_6
tgcagcaagtgaaagaccga

SEQ ID NO: 19133 - DNA, 20 bp, Artificial Sequence
  sgRNA
  Enpp6_7
tcgctcagactacatcagtg

SEQ ID NO: 19134 - DNA, 20 bp, Artificial Sequence
  sgRNA
  Enpp6_8
agctgctccaatcagatccg

SEQ ID NO: 19135 - DNA, 20 bp, Artificial Sequence
  sgRNA
  Enpp6_9
tctgacccgttccaccacag

SEQ ID NO: 19136 - DNA, 20 bp, Artificial Sequence
  sgRNA
  Enpp6_10
atatcacaaactccgcacag

SEQ ID NO: 19137 - DNA, 20 bp, Artificial Sequence
  sgRNA
  Enpp6_11
tgtgaggtccaccagatgat

SEQ ID NO: 19138 - DNA, 20 bp, Artificial Sequence
  sgRNA
  Enpp6_12
tgtagttgccgatcatctgg

SEQ ID NO: 19139 - DNA, 20 bp, Artificial Sequence
  sgRNA
  Enpp6_13
gcaacaccaggagcttccgg

SEQ ID NO: 19140 - DNA, 20 bp, Artificial Sequence
  sgRNA
  Enpp6_14
ccatccttcatcagccacca

SEQ ID NO: 19141 - DNA, 20 bp, Artificial Sequence
  sgRNA
  Enpp6_15
tcatcctcttctcagaccat

SEQ ID NO: 19142 - DNA, 20 bp, Artificial Sequence
  sgRNA
  Enpp6_16
ttctgacccgttccaccaca

SEQ ID NO: 19143 - DNA, 20 bp, Artificial Sequence
  sgRNA
  Enpp6_17
cccgtgctgttcatccaaaa

SEQ ID NO: 19144 - DNA, 20 bp, Artificial Sequence
  sgRNA
  Enpp6_18
catgatgttgtagacatcca

SEQ ID NO: 19145 - DNA, 20 bp, Artificial Sequence
  sgRNA
  Enpp6_19
ttcatcagagtgatccacag

SEQ ID NO: 19146 - DNA, 20 bp, Artificial Sequence
  sgRNA
  Enpp6_20
gtggggtgatgcctgcgacg

SEQ ID NO: 19147 - DNA, 20 bp, Artificial Sequence
  sgRNA
  Entpd1_1
tttggcgctttggatctcgg

SEQ ID NO: 19148 - DNA, 20 bp, Artificial Sequence
  sgRNA
  Entpd1_2
gttaatagtaatccacccat

SEQ ID NO: 19149 - DNA, 20 bp, Artificial Sequence
  sgRNA
  Entpd1_3
gcaattccgtctctatggcg

SEQ ID NO: 19150 - DNA, 20 bp, Artificial Sequence
  sgRNA
  Entpd1_4
tatagtcctcgccatagaga

SEQ ID NO: 19151 - DNA, 20 bp, Artificial Sequence
  sgRNA
  Entpd1_5
gtgtcattctccttctcggc

SEQ ID NO: 19152 - DNA, 20 bp, Artificial Sequence
  sgRNA
  Entpd1_6
agatcaaagacagcaacgcg

SEQ ID NO: 19153 - DNA, 20 bp, Artificial Sequence
  sgRNA
  Entpd1_7
cgtatcctgggttaaagcat

SEQ ID NO: 19154 - DNA, 20 bp, Artificial Sequence
  sgRNA
  Entpd1_8
tttgatcagtttcgaatcca

SEQ ID NO: 19155 - DNA, 20 bp, Artificial Sequence
  sgRNA
  Entpd1_9
gccgagatccaaagcgccaa

SEQ ID NO: 19156 - DNA, 20 bp, Artificial Sequence
  sgRNA
  Entpd1_10
gctcagaaaacagatgaaat

SEQ ID NO: 19157 - DNA, 20 bp, Artificial Sequence
  sgRNA
  Entpd1_11
tcgtatcctgggttaaagca

SEQ ID NO: 19158 - DNA, 20 bp, Artificial Sequence
  sgRNA
  Entpd1_12
cctgatccttcccatagcac

SEQ ID NO: 19159 - DNA, 20 bp, Artificial Sequence
  sgRNA
  Entpd1_13
atgggattgtgttggatgcg

SEQ ID NO: 19160 - DNA, 20 bp, Artificial Sequence
  sgRNA
  Entpd1_14
ctttaacccaggatacgaga

SEQ ID NO: 19161 - DNA, 20 bp, Artificial Sequence
  sgRNA
  Entpd1_15
tctctggcagaaactggcca

SEQ ID NO: 19162 - DNA, 20 bp, Artificial Sequence
  sgRNA
  Entpd1_16
ggtggacagttccatgcatt

SEQ ID NO: 19163 - DNA, 20 bp, Artificial Sequence
  sgRNA
  Entpd1_17
agctacccctttgacttcca

SEQ ID NO: 19164 - DNA, 20 bp, Artificial Sequence
  sgRNA
  Entpd1_18
acagttccatgcattcggcc

SEQ ID NO: 19165 - DNA, 20 bp, Artificial Sequence
  sgRNA
  Entpd1_19
tggatgaagtcatcactgag

SEQ ID NO: 19166 - DNA, 20 bp, Artificial Sequence
  sgRNA
  Entpd1_20
ggttaaagcatgggtcctta

SEQ ID NO: 19167 - DNA, 20 bp, Artificial Sequence
  sgRNA
  Entpd3_1
ccactgtctacgtgtatcag

SEQ ID NO: 19168 - DNA, 20 bp, Artificial Sequence
  sgRNA
  Entpd3_2
cctgtggtgtcgactccgtg

SEQ ID NO: 19169 - DNA, 20 bp, Artificial Sequence
  sgRNA
  Entpd3_3
ctttagtatacagtcctcaa

SEQ ID NO: 19170 - DNA, 20 bp, Artificial Sequence
  sgRNA
  Entpd3_4
gctgccaaacacatggccca

SEQ ID NO: 19171 - DNA, 20 bp, Artificial Sequence
  sgRNA
  Entpd3_5
gatttgatgagacgtatgcc

SEQ ID NO: 19172 - DNA, 20 bp, Artificial Sequence
  sgRNA
  Entpd3_6
gcagagaaggagaataacac

SEQ ID NO: 19173 - DNA, 20 bp, Artificial Sequence
  sgRNA
  Entpd3_7
ccagatatccttcgtggccg

SEQ ID NO: 19174 - DNA, 20 bp, Artificial Sequence
  sgRNA
  Entpd3_8
aggactcccataaacaccgg

SEQ ID NO: 19175 - DNA, 20 bp, Artificial Sequence
  sgRNA
  Entpd3_9
tgtatccatttacgagcaag

SEQ ID NO: 19176 - DNA, 20 bp, Artificial Sequence
  sgRNA
  Entpd3_10
ggatccacccgcatttacct

SEQ ID NO: 19177 - DNA, 20 bp, Artificial Sequence
  sgRNA
  Entpd3_11
ggtaaatgcgggtggatccg

SEQ ID NO: 19178 - DNA, 20 bp, Artificial Sequence
  sgRNA
  Entpd3_12
tgtagccctgagggtagcag

SEQ ID NO: 19179 - DNA, 20 bp, Artificial Sequence
  sgRNA
  Entpd3_13
atacacgtagacagtggttc

SEQ ID NO: 19180 - DNA, 20 bp, Artificial Sequence
  sgRNA
  Entpd3_14
tttaccagcccaaggttcaa

SEQ ID NO: 19181 - DNA, 20 bp, Artificial Sequence
  sgRNA
  Entpd3_15
acttccagctgggatctggt

SEQ ID NO: 19182 - DNA, 20 bp, Artificial Sequence
  sgRNA
  Entpd3_16
gccaggactcccataaacac

SEQ ID NO: 19183 - DNA, 20 bp, Artificial Sequence
  sgRNA
  Entpd3_17
cttcattctggccatagcac

SEQ ID NO: 19184 - DNA, 20 bp, Artificial Sequence
  sgRNA
  Entpd3_18
tgtctacgtgtatcagtggc

SEQ ID NO: 19185 - DNA, 20 bp, Artificial Sequence
  sgRNA
  Entpd3_19
gtaaatgccatcaaaggaac

SEQ ID NO: 19186 - DNA, 20 bp, Artificial Sequence
  sgRNA
  Entpd3_20
ctgtagctcccaggtaaatg

SEQ ID NO: 19187 - DNA, 20 bp, Artificial Sequence
  sgRNA
  Epcam_1
cggagtccgaagaaccgaca

SEQ ID NO: 19188 - DNA, 20 bp, Artificial Sequence
  sgRNA
  Epcam_2
gggcgatccagaacaacgat

SEQ ID NO: 19189 - DNA, 20 bp, Artificial Sequence
  sgRNA
  Epcam_3
gataacattattctcatact

SEQ ID NO: 19190 - DNA, 20 bp, Artificial Sequence
  sgRNA
  Epcam_4
gcaagctctgatggtcgtag

SEQ ID NO: 19191 - DNA, 20 bp, Artificial Sequence
  sgRNA
  Epcam_5
tgtcattagcagtcatcgcg

SEQ ID NO: 19192 - DNA, 20 bp, Artificial Sequence
  sgRNA
  Epcam_6
agtaaatcagagtctgcccg

SEQ ID NO: 19193 - DNA, 20 bp, Artificial Sequence
  sgRNA
  Epcam_7
gttgacacaccagcacgtgg

SEQ ID NO: 19194 - DNA, 20 bp, Artificial Sequence
  sgRNA
  Epcam_8
gagcaggagcccgaacgcga

SEQ ID NO: 19195 - DNA, 20 bp, Artificial Sequence
  sgRNA
  Epcam_9
gcacccgagttctccatgca

SEQ ID NO: 19196 - DNA, 20 bp, Artificial Sequence
  sgRNA
  Epcam_10
gttcgggctcctgctcgcgg

SEQ ID NO: 19197 - DNA, 20 bp, Artificial Sequence
  sgRNA
  Epcam_11
ggaggaggataaagcccgaa

SEQ ID NO: 19198 - DNA, 20 bp, Artificial Sequence
  sgRNA
  Epcam_12
gatcatcgctgtcattgtgg

SEQ ID NO: 19199 - DNA, 20 bp, Artificial Sequence
  sgRNA
  Epcam_13
accccgactgcgacgagcag

SEQ ID NO: 19200 - DNA, 20 bp, Artificial Sequence
  sgRNA
  Epcam_14
cgagcaggagcccgaacgcg

SEQ ID NO: 19201 - DNA, 20 bp, Artificial Sequence
  sgRNA
  Epcam_15
ccgaagaaccgacaaggaca

SEQ ID NO: 19202 - DNA, 20 bp, Artificial Sequence
  sgRNA
  Epcam_16
gcaacggcaccgccacgtgc

SEQ ID NO: 19203 - DNA, 20 bp, Artificial Sequence
  sgRNA
  Epcam_17
ggtccatgctcttagaagaa

SEQ ID NO: 19204 - DNA, 20 bp, Artificial Sequence
  sgRNA
  Epcam_18
gttgttctggatcgcccctt

SEQ ID NO: 19205 - DNA, 20 bp, Artificial Sequence
  sgRNA
  Epcam_19
tcagaaaacacaagacgacg

SEQ ID NO: 19206 - DNA, 20 bp, Artificial Sequence
  sgRNA
  Epcam_20
tgctggtgtgtcaacaccgc

SEQ ID NO: 19207 - DNA, 20 bp, Artificial Sequence
  sgRNA
  Epgn_1
tggacatttaacaacaccga

SEQ ID NO: 19208 - DNA, 20 bp, Artificial Sequence
  sgRNA
  Epgn_2
tggcttgcttcagctcatgg

SEQ ID NO: 19209 - DNA, 20 bp, Artificial Sequence
  sgRNA
  Epgn_3
attacgcacctttgaacaag

SEQ ID NO: 19210 - DNA, 20 bp, Artificial Sequence
  sgRNA
  Epgn_4
ctattatggtcttccagaca

SEQ ID NO: 19211 - DNA, 20 bp, Artificial Sequence
  sgRNA
  Epgn_5
cctacatcatctgctctgga

SEQ ID NO: 19212 - DNA, 20 bp, Artificial Sequence
  sgRNA
  Epgn_6
attgcgattgggattggcgt

SEQ ID NO: 19213 - DNA, 20 bp, Artificial Sequence
  sgRNA
  Epgn_7
gaccctaacttcgtatgctg

SEQ ID NO: 19214 - DNA, 20 bp, Artificial Sequence
  sgRNA
  Epgn_8
atccacagcatacgaagtta

SEQ ID NO: 19215 - DNA, 20 bp, Artificial Sequence
  sgRNA
  Epgn_9
tctgctgtgctgtgctagga

SEQ ID NO: 19216 - DNA, 20 bp, Artificial Sequence
  sgRNA
  Epgn_10
tatgaaaaatacattgcgat

SEQ ID NO: 19217 - DNA, 20 bp, Artificial Sequence
  sgRNA
  Epgn_11
cctccagagcagatgatgta

SEQ ID NO: 19218 - DNA, 20 bp, Artificial Sequence
  sgRNA
  Epgn_12
tctattgctacataagaaaa

SEQ ID NO: 19219 - DNA, 20 bp, Artificial Sequence
  sgRNA
  Epgn_13
agcactgagcgaagaagcag

SEQ ID NO: 19220 - DNA, 20 bp, Artificial Sequence
  sgRNA
  Epgn_14
gaagttctctcatccttgtc

SEQ ID NO: 19221 - DNA, 20 bp, Artificial Sequence
  sgRNA
  Epgn_15
gcacagcacagcagagcaac

SEQ ID NO: 19222 - DNA, 20 bp, Artificial Sequence
  sgRNA
  Epgn_16
ctctgctgtgctgtgctagg

SEQ ID NO: 19223 - DNA, 20 bp, Artificial Sequence
  sgRNA
  Epgn_17
atgaaaaatacattgcgatt

SEQ ID NO: 19224 - DNA, 20 bp, Artificial Sequence
  sgRNA
  Epgn_18
tgagagaacttcagagctac

SEQ ID NO: 19225 - DNA, 20 bp, Artificial Sequence
  sgRNA
  Epgn_19
ccctacatcatctgctctgg

SEQ ID NO: 19226 - DNA, 20 bp, Artificial Sequence
  sgRNA
  Epgn_20
tcaccctacatcatctgctc

SEQ ID NO: 19227 - DNA, 20 bp, Artificial Sequence
  sgRNA
  Epha1_1
ccatgatatcagatacagcg

SEQ ID NO: 19228 - DNA, 20 bp, Artificial Sequence
  sgRNA
  Epha1_2
gctgtggctaaaaccctatg

SEQ ID NO: 19229 - DNA, 20 bp, Artificial Sequence
  sgRNA
  Epha1_3
aagctaagtagaggccacgg

SEQ ID NO: 19230 - DNA, 20 bp, Artificial Sequence
  sgRNA
  Epha1_4
agaatggcaccagatggtgt

SEQ ID NO: 19231 - DNA, 20 bp, Artificial Sequence
  sgRNA
  Epha1_5
ggaagcttcacgcatctacg

SEQ ID NO: 19232 - DNA, 20 bp, Artificial Sequence
  sgRNA
  Epha1_6
cgctccaattggatctaccg

SEQ ID NO: 19233 - DNA, 20 bp, Artificial Sequence
  sgRNA
  Epha1_7
tgcgtgaagcttcctctccg

SEQ ID NO: 19234 - DNA, 20 bp, Artificial Sequence
  sgRNA
  Epha1_8
gagtttggtgaagtgtatcg

SEQ ID NO: 19235 - DNA, 20 bp, Artificial Sequence
  sgRNA
  Epha1_9
tggtgtccagcccagccgaa

SEQ ID NO: 19236 - DNA, 20 bp, Artificial Sequence
  sgRNA
  Epha1_10
ttactgacccccattcccta

SEQ ID NO: 19237 - DNA, 20 bp, Artificial Sequence
  sgRNA
  Epha1_11
ggctgtggtgaagatccgat

SEQ ID NO: 19238 - DNA, 20 bp, Artificial Sequence
  sgRNA
  Epha1_12
ctagcgccacacaggaaccc

SEQ ID NO: 19239 - DNA, 20 bp, Artificial Sequence
  sgRNA
  Epha1_13
ccgacgacctttgttccaaa

SEQ ID NO: 19240 - DNA, 20 bp, Artificial Sequence
  sgRNA
  Epha1_14
gaaactcttacagtcccgca

SEQ ID NO: 19241 - DNA, 20 bp, Artificial Sequence
  sgRNA
  Epha1_15
tccactcgatagaaaccagt

SEQ ID NO: 19242 - DNA, 20 bp, Artificial Sequence
  sgRNA
  Epha1_16
ccccagaagctattgcccat

SEQ ID NO: 19243 - DNA, 20 bp, Artificial Sequence
  sgRNA
  Epha1_17
gctttacagagccagatgcc

SEQ ID NO: 19244 - DNA, 20 bp, Artificial Sequence
  sgRNA
  Epha1_18
gtttccagaagcctgaccgg

SEQ ID NO: 19245 - DNA, 20 bp, Artificial Sequence
  sgRNA
  Epha1_19
aaggtctctttgcatcccag

SEQ ID NO: 19246 - DNA, 20 bp, Artificial Sequence
  sgRNA
  Epha1_20
ctctccgcggtagatccaat

SEQ ID NO: 19247 - DNA, 20 bp, Artificial Sequence
  sgRNA
  Epha10_1
gcgatggtgtcaatcttgcg

SEQ ID NO: 19248 - DNA, 20 bp, Artificial Sequence
  sgRNA
  Epha10_2
gcttcacgcagggtgacctg

SEQ ID NO: 19249 - DNA, 20 bp, Artificial Sequence
  sgRNA
  Epha10_3
gactgcactgccaagcactg

SEQ ID NO: 19250 - DNA, 20 bp, Artificial Sequence
  sgRNA
  Epha10_4
cagacaggctggatcagccg

SEQ ID NO: 19251 - DNA, 20 bp, Artificial Sequence
  sgRNA
  Epha10_5
gagatgggctacgttcaccg

SEQ ID NO: 19252 - DNA, 20 bp, Artificial Sequence
  sgRNA
  Epha10_6
actcgagtgctacaactaca

SEQ ID NO: 19253 - DNA, 20 bp, Artificial Sequence
  sgRNA
  Epha10_7
tgaaatccgcagggaccgcg

SEQ ID NO: 19254 - DNA, 20 bp, Artificial Sequence
  sgRNA
  Epha10_8
ggtcggttgcctcctaggcg

SEQ ID NO: 19255 - DNA, 20 bp, Artificial Sequence
  sgRNA
  Epha10_9
actcagtgacaatcatcaag

SEQ ID NO: 19256 - DNA, 20 bp, Artificial Sequence
  sgRNA
  Epha10_10
atacgctttggggctccacg

SEQ ID NO: 19257 - DNA, 20 bp, Artificial Sequence
  sgRNA
  Epha10_11
ggaagaggatgaaatccgca

SEQ ID NO: 19258 - DNA, 20 bp, Artificial Sequence
  sgRNA
  Epha10_12
gtaccaagtgtgcaacgtgc

SEQ ID NO: 19259 - DNA, 20 bp, Artificial Sequence
  sgRNA
  Epha10_13
ccacttcctttgccatcgca

SEQ ID NO: 19260 - DNA, 20 bp, Artificial Sequence
  sgRNA
  Epha10_14
gcacccacggagccaaagga

SEQ ID NO: 19261 - DNA, 20 bp, Artificial Sequence
  sgRNA
  Epha10_15
gcctgagacgccgttgagcg

SEQ ID NO: 19262 - DNA, 20 bp, Artificial Sequence
  sgRNA
  Epha10_16
gacaccttgtaaaaccctgg

SEQ ID NO: 19263 - DNA, 20 bp, Artificial Sequence
  sgRNA
  Epha10_17
gcgcaggtcacagtgtccac

SEQ ID NO: 19264 - DNA, 20 bp, Artificial Sequence
  sgRNA
  Epha10_18
cacagtgtccaccggacccg

SEQ ID NO: 19265 - DNA, 20 bp, Artificial Sequence
  sgRNA
  Epha10_19
aagatctctggctttgggcg

SEQ ID NO: 19266 - DNA, 20 bp, Artificial Sequence
  sgRNA
  Epha10_20
cggtcgccaggaactgcccg

SEQ ID NO: 19267 - DNA, 20 bp, Artificial Sequence
  sgRNA
  Epha2_1
cttcttgtagtagacgcgaa

SEQ ID NO: 19268 - DNA, 20 bp, Artificial Sequence
  sgRNA
  Epha2_2
cgagatccacccatcctgtg

SEQ ID NO: 19269 - DNA, 20 bp, Artificial Sequence
  sgRNA
  Epha2_3
cgtgtgcaagacatggacag

SEQ ID NO: 19270 - DNA, 20 bp, Artificial Sequence
  sgRNA
  Epha2_4
tgtttggttaatactgacgc

SEQ ID NO: 19271 - DNA, 20 bp, Artificial Sequence
  sgRNA
  Epha2_5
ctgggaactgtcaaaccacg

SEQ ID NO: 19272 - DNA, 20 bp, Artificial Sequence
  sgRNA
  Epha2_6
tcacggagaagccttccgtg

SEQ ID NO: 19273 - DNA, 20 bp, Artificial Sequence
  sgRNA
  Epha2_7
gttgacgaggatgttgcggg

SEQ ID NO: 19274 - DNA, 20 bp, Artificial Sequence
  sgRNA
  Epha2_8
ccagccactcggacaccgta

SEQ ID NO: 19275 - DNA, 20 bp, Artificial Sequence
  sgRNA
  Epha2_9
ggaaaaacggacatcctcag

SEQ ID NO: 19276 - DNA, 20 bp, Artificial Sequence
  sgRNA
  Epha2_10
cagctataatgtgcgccgca

SEQ ID NO: 19277 - DNA, 20 bp, Artificial Sequence
  sgRNA
  Epha2_11
tattcgatggacagccccag

SEQ ID NO: 19278 - DNA, 20 bp, Artificial Sequence
  sgRNA
  Epha2_12
aatggccgtgaggtagttgg

SEQ ID NO: 19279 - DNA, 20 bp, Artificial Sequence
  sgRNA
  Epha2_13
gctgaccgtgatctcgtcag

SEQ ID NO: 19280 - DNA, 20 bp, Artificial Sequence
  sgRNA
  Epha2_14
ccttccgtacggtgtccgag

SEQ ID NO: 19281 - DNA, 20 bp, Artificial Sequence
  sgRNA
  Epha2_15
cgatacacaacccctggcca

SEQ ID NO: 19282 - DNA, 20 bp, Artificial Sequence
  sgRNA
  Epha2_16
attgcgtgcttcgacagcga

SEQ ID NO: 19283 - DNA, 20 bp, Artificial Sequence
  sgRNA
  Epha2_17
ggagggagtccccttccgta

SEQ ID NO: 19284 - DNA, 20 bp, Artificial Sequence
  sgRNA
  Epha2_18
ggacgctgaaggcatcctcg

SEQ ID NO: 19285 - DNA, 20 bp, Artificial Sequence
  sgRNA
  Epha2_19
gactgtaacagcttcccggg

SEQ ID NO: 19286 - DNA, 20 bp, Artificial Sequence
  sgRNA
  Epha2_20
gcataccctgccatccacag

SEQ ID NO: 19287 - DNA, 20 bp, Artificial Sequence
  sgRNA
  Epha3_1
actccagtccaggataaccg

SEQ ID NO: 19288 - DNA, 20 bp, Artificial Sequence
  sgRNA
  Epha3_2
agcagttcatgagttcgcga

SEQ ID NO: 19289 - DNA, 20 bp, Artificial Sequence
  sgRNA
  Epha3_3
acagccaaaataattggctg

SEQ ID NO: 19290 - DNA, 20 bp, Artificial Sequence
  sgRNA
  Epha3_4
ctgactgcggcatactgtct

SEQ ID NO: 19291 - DNA, 20 bp, Artificial Sequence
  sgRNA
  Epha3_5
ccatgatgctcgcttcaccg

SEQ ID NO: 19292 - DNA, 20 bp, Artificial Sequence
  sgRNA
  Epha3_6
tcatacctgatgctatccca

SEQ ID NO: 19293 - DNA, 20 bp, Artificial Sequence
  sgRNA
  Epha3_7
gcttggactcaccaacacca

SEQ ID NO: 19294 - DNA, 20 bp, Artificial Sequence
  sgRNA
  Epha3_8
ggatctcctacccatcccat

SEQ ID NO: 19295 - DNA, 20 bp, Artificial Sequence
  sgRNA
  Epha3_9
aatccgagctcggacagcag

SEQ ID NO: 19296 - DNA, 20 bp, Artificial Sequence
  sgRNA
  Epha3_10
caagaaccggaacatccaaa

SEQ ID NO: 19297 - DNA, 20 bp, Artificial Sequence
  sgRNA
  Epha3_11
ttgcaagtccccaaaaccaa

SEQ ID NO: 19298 - DNA, 20 bp, Artificial Sequence
  sgRNA
  Epha3_12
tagtgacaacgccttccagt

SEQ ID NO: 19299 - DNA, 20 bp, Artificial Sequence
  sgRNA
  Epha3_13
ttgtcgaccaggcttctaca

SEQ ID NO: 19300 - DNA, 20 bp, Artificial Sequence
  sgRNA
  Epha3_14
gatgtactgcagcacagaag

SEQ ID NO: 19301 - DNA, 20 bp, Artificial Sequence
  sgRNA
  Epha3_15
agaagctgcttacacaacca

SEQ ID NO: 19302 - DNA, 20 bp, Artificial Sequence
  sgRNA
  Epha3_16
atatgtatgtggatcaacat

SEQ ID NO: 19303 - DNA, 20 bp, Artificial Sequence
  sgRNA
  Epha3_17
attaacagcatcgatctcaa

SEQ ID NO: 19304 - DNA, 20 bp, Artificial Sequence
  sgRNA
  Epha3_18
ccatcccaacatcatccgac

SEQ ID NO: 19305 - DNA, 20 bp, Artificial Sequence
  sgRNA
  Epha3_19
tttcactcagatggatctcg

SEQ ID NO: 19306 - DNA, 20 bp, Artificial Sequence
  sgRNA
  Epha3_20
gaattgagtttagttcaggg

SEQ ID NO: 19307 - DNA, 20 bp, Artificial Sequence
  sgRNA
  Epha4_1
tgactggatcacccgcgaag

SEQ ID NO: 19308 - DNA, 20 bp, Artificial Sequence
  sgRNA
  Epha4_2
aaactgggctagatttcgaa

SEQ ID NO: 19309 - DNA, 20 bp, Artificial Sequence
  sgRNA
  Epha4_3
tcaggacatttcttacaacg

SEQ ID NO: 19310 - DNA, 20 bp, Artificial Sequence
  sgRNA
  Epha4_4
tgacaaccaaccaagcaggt

SEQ ID NO: 19311 - DNA, 20 bp, Artificial Sequence
  sgRNA
  Epha4_5
ggctcgcacgtgaaaaacat

SEQ ID NO: 19312 - DNA, 20 bp, Artificial Sequence
  sgRNA
  Epha4_6
aggagcctcgaacttccacc

SEQ ID NO: 19313 - DNA, 20 bp, Artificial Sequence
  sgRNA
  Epha4_7
tagtggactccacttccaca

SEQ ID NO: 19314 - DNA, 20 bp, Artificial Sequence
  sgRNA
  Epha4_8
ttgcaagtccccatgacgcc

SEQ ID NO: 19315 - DNA, 20 bp, Artificial Sequence
  sgRNA
  Epha4_9
ctatgagtcggacaacgaca

SEQ ID NO: 19316 - DNA, 20 bp, Artificial Sequence
  sgRNA
  Epha4_10
aggacaacttcacggccgcc

SEQ ID NO: 19317 - DNA, 20 bp, Artificial Sequence
  sgRNA
  Epha4_11
ggaatttgcgacgctgtcac

SEQ ID NO: 19318 - DNA, 20 bp, Artificial Sequence
  sgRNA
  Epha4_12
ctggaaccagatcgaccaaa

SEQ ID NO: 19319 - DNA, 20 bp, Artificial Sequence
  sgRNA
  Epha4_13
ttctagtgtcgtgtacccgg

SEQ ID NO: 19320 - DNA, 20 bp, Artificial Sequence
  sgRNA
  Epha4_14
ccagctgaatgactgtaaag

SEQ ID NO: 19321 - DNA, 20 bp, Artificial Sequence
  sgRNA
  Epha4_15
tgatcaaagccatcgaggaa

SEQ ID NO: 19322 - DNA, 20 bp, Artificial Sequence
  sgRNA
  Epha4_16
gtccagcattaactgatgga

SEQ ID NO: 19323 - DNA, 20 bp, Artificial Sequence
  sgRNA
  Epha4_17
ggagcctcgaacttccacca

SEQ ID NO: 19324 - DNA, 20 bp, Artificial Sequence
  sgRNA
  Epha4_18
gtttcctgataccattactg

SEQ ID NO: 19325 - DNA, 20 bp, Artificial Sequence
  sgRNA
  Epha4_19
ccacccaaacataatccacc

SEQ ID NO: 19326 - DNA, 20 bp, Artificial Sequence
  sgRNA
  Epha4_20
cagctggtgggcatgctccg

SEQ ID NO: 19327 - DNA, 20 bp, Artificial Sequence
  sgRNA
  Epha5_1
acatttgagatggcattccg

SEQ ID NO: 19328 - DNA, 20 bp, Artificial Sequence
  sgRNA
  Epha5_2
ttatggagagagaccctact

SEQ ID NO: 19329 - DNA, 20 bp, Artificial Sequence
  sgRNA
  Epha5_3
ccaaacatcatccatctaga

SEQ ID NO: 19330 - DNA, 20 bp, Artificial Sequence
  sgRNA
  Epha5_4
gagaccagtattacagccga

SEQ ID NO: 19331 - DNA, 20 bp, Artificial Sequence
  sgRNA
  Epha5_5
ccataatacttgcttcaccc

SEQ ID NO: 19332 - DNA, 20 bp, Artificial Sequence
  sgRNA
  Epha5_6
tctgcaccttcatctcttga

SEQ ID NO: 19333 - DNA, 20 bp, Artificial Sequence
  sgRNA
  Epha5_7
tgaggcagcctacaccacaa

SEQ ID NO: 19334 - DNA, 20 bp, Artificial Sequence
  sgRNA
  Epha5_8
tgtcatgaaactgaatacag

SEQ ID NO: 19335 - DNA, 20 bp, Artificial Sequence
  sgRNA
  Epha5_9
tctggggcctacagatcagt

SEQ ID NO: 19336 - DNA, 20 bp, Artificial Sequence
  sgRNA
  Epha5_10
gccaagtgtcttactacaga

SEQ ID NO: 19337 - DNA, 20 bp, Artificial Sequence
  sgRNA
  Epha5_11
gtctgactttggactttcca

SEQ ID NO: 19338 - DNA, 20 bp, Artificial Sequence
  sgRNA
  Epha5_12
atacagttcaatggacgctg

SEQ ID NO: 19339 - DNA, 20 bp, Artificial Sequence
  sgRNA
  Epha5_13
gcacgtagcccatgtcagaa

SEQ ID NO: 19340 - DNA, 20 bp, Artificial Sequence
  sgRNA
  Epha5_14
tggatgggcaacagcgcaca

SEQ ID NO: 19341 - DNA, 20 bp, Artificial Sequence
  sgRNA
  Epha5_15
taggtccaccatcatgacag

SEQ ID NO: 19342 - DNA, 20 bp, Artificial Sequence
  sgRNA
  Epha5_16
ataattggctgttgaccagt

SEQ ID NO: 19343 - DNA, 20 bp, Artificial Sequence
  sgRNA
  Epha5_17
aatcagatggactgccccgg

SEQ ID NO: 19344 - DNA, 20 bp, Artificial Sequence
  sgRNA
  Epha5_18
agattcatcacagttgttag

SEQ ID NO: 19345 - DNA, 20 bp, Artificial Sequence
  sgRNA
  Epha5_19
ataagtgtgcggatcaatat

SEQ ID NO: 19346 - DNA, 20 bp, Artificial Sequence
  sgRNA
  Epha5_20
agatgcattgcagtgctgaa

SEQ ID NO: 19347 - DNA, 20 bp, Artificial Sequence
  sgRNA
  Epha6_1
acagtgactacagatcacga

SEQ ID NO: 19348 - DNA, 20 bp, Artificial Sequence
  sgRNA
  Epha6_2
tagaatccgatgaatcccat

SEQ ID NO: 19349 - DNA, 20 bp, Artificial Sequence
  sgRNA
  Epha6_3
tccacacagctcaacctacg

SEQ ID NO: 19350 - DNA, 20 bp, Artificial Sequence
  sgRNA
  Epha6_4
aggtgttcctagtagcgtgg

SEQ ID NO: 19351 - DNA, 20 bp, Artificial Sequence
  sgRNA
  Epha6_5
ttcatcgagatcttgccgcg

SEQ ID NO: 19352 - DNA, 20 bp, Artificial Sequence
  sgRNA
  Epha6_6
gatattcaggaacatcacca

SEQ ID NO: 19353 - DNA, 20 bp, Artificial Sequence
  sgRNA
  Epha6_7
actcaacactgaaatccgtg

SEQ ID NO: 19354 - DNA, 20 bp, Artificial Sequence
  sgRNA
  Epha6_8
ctgcagatacaccttccaag

SEQ ID NO: 19355 - DNA, 20 bp, Artificial Sequence
  sgRNA
  Epha6_9
tctcctcagccagtgacgcg

SEQ ID NO: 19356 - DNA, 20 bp, Artificial Sequence
  sgRNA
  Epha6_10
taagagagtgaatcccccga

SEQ ID NO: 19357 - DNA, 20 bp, Artificial Sequence
  sgRNA
  Epha6_11
ggattgtaacagcatcccat

SEQ ID NO: 19358 - DNA, 20 bp, Artificial Sequence
  sgRNA
  Epha6_12
gcccacccagtgacacagga

SEQ ID NO: 19359 - DNA, 20 bp, Artificial Sequence
  sgRNA
  Epha6_13
gtactgggaaatgtccaacc

SEQ ID NO: 19360 - DNA, 20 bp, Artificial Sequence
  sgRNA
  Epha6_14
gggattgtaacagcatccca

SEQ ID NO: 19361 - DNA, 20 bp, Artificial Sequence
  sgRNA
  Epha6_15
gttcaccagtatgttcctcg

SEQ ID NO: 19362 - DNA, 20 bp, Artificial Sequence
  sgRNA
  Epha6_16
aaaaatgccccttcaccgtg

SEQ ID NO: 19363 - DNA, 20 bp, Artificial Sequence
  sgRNA
  Epha6_17
tgttcttcctcatcactggg

SEQ ID NO: 19364 - DNA, 20 bp, Artificial Sequence
  sgRNA
  Epha6_18
ccacttcaccgtcatccagt

SEQ ID NO: 19365 - DNA, 20 bp, Artificial Sequence
  sgRNA
  Epha6_19
ttacaagtccccaagaccca

SEQ ID NO: 19366 - DNA, 20 bp, Artificial Sequence
  sgRNA
  Epha6_20
tgggctccattccaaaataa

SEQ ID NO: 19367 - DNA, 20 bp, Artificial Sequence
  sgRNA
  Epha7_1
agtcctccggctgacaacgg

SEQ ID NO: 19368 - DNA, 20 bp, Artificial Sequence
  sgRNA
  Epha7_2
cccacggacctcgactaagg

SEQ ID NO: 19369 - DNA, 20 bp, Artificial Sequence
  sgRNA
  Epha7_3
tatgaaacagactacgacac

SEQ ID NO: 19370 - DNA, 20 bp, Artificial Sequence
  sgRNA
  Epha7_4
gggttggacaacgagaacac

SEQ ID NO: 19371 - DNA, 20 bp, Artificial Sequence
  sgRNA
  Epha7_5
tatccaatgttacttccgca

SEQ ID NO: 19372 - DNA, 20 bp, Artificial Sequence
  sgRNA
  Epha7_6
ttgttggcagaaagatcggg

SEQ ID NO: 19373 - DNA, 20 bp, Artificial Sequence
  sgRNA
  Epha7_7
atgactccactcacttgcga

SEQ ID NO: 19374 - DNA, 20 bp, Artificial Sequence
  sgRNA
  Epha7_8
gcacaaatgttgcatttaca

SEQ ID NO: 19375 - DNA, 20 bp, Artificial Sequence
  sgRNA
  Epha7_9
tgttgagaggtattgccgct

SEQ ID NO: 19376 - DNA, 20 bp, Artificial Sequence
  sgRNA
  Epha7_10
ttacaactcactcgagtcag

SEQ ID NO: 19377 - DNA, 20 bp, Artificial Sequence
  sgRNA
  Epha7_11
gtgccatgcggaagtaacat

SEQ ID NO: 19378 - DNA, 20 bp, Artificial Sequence
  sgRNA
  Epha7_12
tgtaggggcttgcatagcat

SEQ ID NO: 19379 - DNA, 20 bp, Artificial Sequence
  sgRNA
  Epha7_13
agctgtccatcaattcgcca

SEQ ID NO: 19380 - DNA, 20 bp, Artificial Sequence
  sgRNA
  Epha7_14
agaacactggagatcctgag

SEQ ID NO: 19381 - DNA, 20 bp, Artificial Sequence
  sgRNA
  Epha7_15
gctgggcaatccatgggcgc

SEQ ID NO: 19382 - DNA, 20 bp, Artificial Sequence
  sgRNA
  Epha7_16
gcttgatgttgccacacttg

SEQ ID NO: 19383 - DNA, 20 bp, Artificial Sequence
  sgRNA
  Epha7_17
tttcttcccccgttgtcagc

SEQ ID NO: 19384 - DNA, 20 bp, Artificial Sequence
  sgRNA
  Epha7_18
gtgtggcaacatcaagccta

SEQ ID NO: 19385 - DNA, 20 bp, Artificial Sequence
  sgRNA
  Epha7_19
gtggtcgtttgaaacttccg

SEQ ID NO: 19386 - DNA, 20 bp, Artificial Sequence
  sgRNA
  Epha7_20
catgactccactcacttgcg

SEQ ID NO: 19387 - DNA, 20 bp, Artificial Sequence
  sgRNA
  Epha8_1
gcctcgaacctcaaccagcg

SEQ ID NO: 19388 - DNA, 20 bp, Artificial Sequence
  sgRNA
  Epha8_2
atggtccgagtgtcgtagcg

SEQ ID NO: 19389 - DNA, 20 bp, Artificial Sequence
  sgRNA
  Epha8_3
gttgactgcctcgatccaga

SEQ ID NO: 19390 - DNA, 20 bp, Artificial Sequence
  sgRNA
  Epha8_4
caagattgacaccatcgcgg

SEQ ID NO: 19391 - DNA, 20 bp, Artificial Sequence
  sgRNA
  Epha8_5
tgacctcagctactaccgcg

SEQ ID NO: 19392 - DNA, 20 bp, Artificial Sequence
  sgRNA
  Epha8_6
tgactgcaatagcatcccag

SEQ ID NO: 19393 - DNA, 20 bp, Artificial Sequence
  sgRNA
  Epha8_7
gatgctattgcagtcacgca

SEQ ID NO: 19394 - DNA, 20 bp, Artificial Sequence
  sgRNA
  Epha8_8
ctgcacacgcacttgccgat

SEQ ID NO: 19395 - DNA, 20 bp, Artificial Sequence
  sgRNA
  Epha8_9
gtacgtgtggatgggccgga

SEQ ID NO: 19396 - DNA, 20 bp, Artificial Sequence
  sgRNA
  Epha8_10
gcgctaccgggaccacttcg

SEQ ID NO: 19397 - DNA, 20 bp, Artificial Sequence
  sgRNA
  Epha8_11
ctcacgacatgagcgaagcg

SEQ ID NO: 19398 - DNA, 20 bp, Artificial Sequence
  sgRNA
  Epha8_12
gcgacaagacttcttgagcg

SEQ ID NO: 19399 - DNA, 20 bp, Artificial Sequence
  sgRNA
  Epha8_13
cgatggtccgagtgtcgtag

SEQ ID NO: 19400 - DNA, 20 bp, Artificial Sequence
  sgRNA
  Epha8_14
tgagccagccccagtctccg

SEQ ID NO: 19401 - DNA, 20 bp, Artificial Sequence
  sgRNA
  Epha8_15
tgtcaggcagatccagacga

SEQ ID NO: 19402 - DNA, 20 bp, Artificial Sequence
  sgRNA
  Epha8_16
tttctgggaacttccccggg

SEQ ID NO: 19403 - DNA, 20 bp, Artificial Sequence
  sgRNA
  Epha8_17
ctacaagaagtgccccgcca

SEQ ID NO: 19404 - DNA, 20 bp, Artificial Sequence
  sgRNA
  Epha8_18
cctaacatcatccgccttga

SEQ ID NO: 19405 - DNA, 20 bp, Artificial Sequence
  sgRNA
  Epha8_19
tagaagccgcgcttgctgag

SEQ ID NO: 19406 - DNA, 20 bp, Artificial Sequence
  sgRNA
  Epha8_20
tgcaggtacctaacacccct

SEQ ID NO: 19407 - DNA, 20 bp, Artificial Sequence
  sgRNA
  Ephb1_1
gtgttgtagcctgtcctgcg

SEQ ID NO: 19408 - DNA, 20 bp, Artificial Sequence
  sgRNA
  Ephb1_2
gatagatgtctcattcacga

SEQ ID NO: 19409 - DNA, 20 bp, Artificial Sequence
  sgRNA
  Ephb1_3
cagcacgtatcgatgggcta

SEQ ID NO: 19410 - DNA, 20 bp, Artificial Sequence
  sgRNA
  Ephb1_4
tcatccaataaggctcccca

SEQ ID NO: 19411 - DNA, 20 bp, Artificial Sequence
  sgRNA
  Ephb1_5
tgacatttcgaggacccgat

SEQ ID NO: 19412 - DNA, 20 bp, Artificial Sequence
  sgRNA
  Ephb1_6
acttagccagtcatccacgg

SEQ ID NO: 19413 - DNA, 20 bp, Artificial Sequence
  sgRNA
  Ephb1_7
ggtactcagagaaacagcgt

SEQ ID NO: 19414 - DNA, 20 bp, Artificial Sequence
  sgRNA
  Ephb1_8
ccaacacagcacgtatcgat

SEQ ID NO: 19415 - DNA, 20 bp, Artificial Sequence
  sgRNA
  Ephb1_9
gctgccgagccagcaatcag

SEQ ID NO: 19416 - DNA, 20 bp, Artificial Sequence
  sgRNA
  Ephb1_10
ccaggtgcgagctcgaaccg

SEQ ID NO: 19417 - DNA, 20 bp, Artificial Sequence
  sgRNA
  Ephb1_11
gttccggatcatcttgtcca

SEQ ID NO: 19418 - DNA, 20 bp, Artificial Sequence
  sgRNA
  Ephb1_12
aggttacccctattctcagg

SEQ ID NO: 19419 - DNA, 20 bp, Artificial Sequence
  sgRNA
  Ephb1_13
aaggttgatgaaagtcaaca

SEQ ID NO: 19420 - DNA, 20 bp, Artificial Sequence
  sgRNA
  Ephb1_14
gaacttgccatagccagcca

SEQ ID NO: 19421 - DNA, 20 bp, Artificial Sequence
  sgRNA
  Ephb1_15
gggatagagcggtcaagcag

SEQ ID NO: 19422 - DNA, 20 bp, Artificial Sequence
  sgRNA
  Ephb1_16
cctcagccggagcaacccaa

SEQ ID NO: 19423 - DNA, 20 bp, Artificial Sequence
  sgRNA
  Ephb1_17
gcacacttggtaagtacgga

SEQ ID NO: 19424 - DNA, 20 bp, Artificial Sequence
  sgRNA
  Ephb1_18
ccagatgaaccagtcaccat

SEQ ID NO: 19425 - DNA, 20 bp, Artificial Sequence
  sgRNA
  Ephb1_19
gctgggcagtccataggagg

SEQ ID NO: 19426 - DNA, 20 bp, Artificial Sequence
  sgRNA
  Ephb1_20
cttcacggcctttaccaccg

SEQ ID NO: 19427 - DNA, 20 bp, Artificial Sequence
  sgRNA
  Ephb2_1
agcaggtgatcggagcaggt

SEQ ID NO: 19428 - DNA, 20 bp, Artificial Sequence
  sgRNA
  Ephb2_2
catcaaactctactgtaacg

SEQ ID NO: 19429 - DNA, 20 bp, Artificial Sequence
  sgRNA
  Ephb2_3
ttgtgcaaggcatgtctaag

SEQ ID NO: 19430 - DNA, 20 bp, Artificial Sequence
  sgRNA
  Ephb2_4
aggtcactgatgtagatgcg

SEQ ID NO: 19431 - DNA, 20 bp, Artificial Sequence
  sgRNA
  Ephb2_5
accaaattcatccggcgccg

SEQ ID NO: 19432 - DNA, 20 bp, Artificial Sequence
  sgRNA
  Ephb2_6
ccagtaccggaaattcacct

SEQ ID NO: 19433 - DNA, 20 bp, Artificial Sequence
  sgRNA
  Ephb2_7
gatgaggaagactaagccgg

SEQ ID NO: 19434 - DNA, 20 bp, Artificial Sequence
  sgRNA
  Ephb2_8
gtagcgcccatagcctgcaa

SEQ ID NO: 19435 - DNA, 20 bp, Artificial Sequence
  sgRNA
  Ephb2_9
ccaactggatggagaatccg

SEQ ID NO: 19436 - DNA, 20 bp, Artificial Sequence
  sgRNA
  Ephb2_10
tcccagccagaccagcccaa

SEQ ID NO: 19437 - DNA, 20 bp, Artificial Sequence
  sgRNA
  Ephb2_11
ccgagaacttcatctccacg

SEQ ID NO: 19438 - DNA, 20 bp, Artificial Sequence
  sgRNA
  Ephb2_12
atgccgcaacggctactaca

SEQ ID NO: 19439 - DNA, 20 bp, Artificial Sequence
  sgRNA
  Ephb2_13
ggtgaatttccggtactgga

SEQ ID NO: 19440 - DNA, 20 bp, Artificial Sequence
  sgRNA
  Ephb2_14
gatggactctacgacagcaa

SEQ ID NO: 19441 - DNA, 20 bp, Artificial Sequence
  sgRNA
  Ephb2_15
ggtatcgtgcggtccagcag

SEQ ID NO: 19442 - DNA, 20 bp, Artificial Sequence
  sgRNA
  Ephb2_16
atacacggagaaacagcgcc

SEQ ID NO: 19443 - DNA, 20 bp, Artificial Sequence
  sgRNA
  Ephb2_17
gagaacggcaccgtctgccg

SEQ ID NO: 19444 - DNA, 20 bp, Artificial Sequence
  sgRNA
  Ephb2_18
tggtgacaaccccttccaga

SEQ ID NO: 19445 - DNA, 20 bp, Artificial Sequence
  sgRNA
  Ephb2_19
gcaagagctgtggctccggc

SEQ ID NO: 19446 - DNA, 20 bp, Artificial Sequence
  sgRNA
  Ephb2_20
atgttcacagaggcgaactg

SEQ ID NO: 19447 - DNA, 20 bp, Artificial Sequence
  sgRNA
  Ephb3_1
acaacgtagagtttgtacct

SEQ ID NO: 19448 - DNA, 20 bp, Artificial Sequence
  sgRNA
  Ephb3_2
ctaccgtgcagactcagact

SEQ ID NO: 19449 - DNA, 20 bp, Artificial Sequence
  sgRNA
  Ephb3_3
tgtgtcctgtgtcaagatcg

SEQ ID NO: 19450 - DNA, 20 bp, Artificial Sequence
  sgRNA
  Ephb3_4
cccggacctgaactacgtag

SEQ ID NO: 19451 - DNA, 20 bp, Artificial Sequence
  sgRNA
  Ephb3_5
actccattcgaggattagcg

SEQ ID NO: 19452 - DNA, 20 bp, Artificial Sequence
  sgRNA
  Ephb3_6
ggcagacgtaaacttccgat

SEQ ID NO: 19453 - DNA, 20 bp, Artificial Sequence
  sgRNA
  Ephb3_7
tagccacgaacacctcccgg

SEQ ID NO: 19454 - DNA, 20 bp, Artificial Sequence
  sgRNA
  Ephb3_8
tctcgtccgccaaggtcccg

SEQ ID NO: 19455 - DNA, 20 bp, Artificial Sequence
  sgRNA
  Ephb3_9
acattggagatcacaccccg

SEQ ID NO: 19456 - DNA, 20 bp, Artificial Sequence
  sgRNA
  Ephb3_10
cggccgagtctgagtctgca

SEQ ID NO: 19457 - DNA, 20 bp, Artificial Sequence
  sgRNA
  Ephb3_11
gcacccccagagcggcctaa

SEQ ID NO: 19458 - DNA, 20 bp, Artificial Sequence
  sgRNA
  Ephb3_12
ggaagtccagcgcgtctacg

SEQ ID NO: 19459 - DNA, 20 bp, Artificial Sequence
  sgRNA
  Ephb3_13
ttatctgcaagaagtgccgt

SEQ ID NO: 19460 - DNA, 20 bp, Artificial Sequence
  sgRNA
  Ephb3_14
cattacacacctgatacgtg

SEQ ID NO: 19461 - DNA, 20 bp, Artificial Sequence
  sgRNA
  Ephb3_15
gagtttggggaagtgtgccg

SEQ ID NO: 19462 - DNA, 20 bp, Artificial Sequence
  sgRNA
  Ephb3_16
gttatctgcaagaagtgccg

SEQ ID NO: 19463 - DNA, 20 bp, Artificial Sequence
  sgRNA
  Ephb3_17
ttatacgaccttcacgacag

SEQ ID NO: 19464 - DNA, 20 bp, Artificial Sequence
  sgRNA
  Ephb3_18
cccaatataatccgtctaga

SEQ ID NO: 19465 - DNA, 20 bp, Artificial Sequence
  sgRNA
  Ephb3_19
ttacggacagtatagccacc

SEQ ID NO: 19466 - DNA, 20 bp, Artificial Sequence
  sgRNA
  Ephb3_20
cttgtggtctcaaactcagc

SEQ ID NO: 19467 - DNA, 20 bp, Artificial Sequence
  sgRNA
  Ephb4_1
ggcagcgtacagcataagtg

SEQ ID NO: 19468 - DNA, 20 bp, Artificial Sequence
  sgRNA
  Ephb4_2
ggtaatacccaattcgacac

SEQ ID NO: 19469 - DNA, 20 bp, Artificial Sequence
  sgRNA
  Ephb4_3
acattgacaggctcaaaagg

SEQ ID NO: 19470 - DNA, 20 bp, Artificial Sequence
  sgRNA
  Ephb4_4
agcgtatcgtggcatacacg

SEQ ID NO: 19471 - DNA, 20 bp, Artificial Sequence
  sgRNA
  Ephb4_5
gcacggtccgaggctggcta

SEQ ID NO: 19472 - DNA, 20 bp, Artificial Sequence
  sgRNA
  Ephb4_6
catcatggtgaagcgtatcg

SEQ ID NO: 19473 - DNA, 20 bp, Artificial Sequence
  sgRNA
  Ephb4_7
agccaggtaccgcatgcccg

SEQ ID NO: 19474 - DNA, 20 bp, Artificial Sequence
  sgRNA
  Ephb4_8
cggatgtcagacactgcagg

SEQ ID NO: 19475 - DNA, 20 bp, Artificial Sequence
  sgRNA
  Ephb4_9
cgttctccatgaattccgtg

SEQ ID NO: 19476 - DNA, 20 bp, Artificial Sequence
  sgRNA
  Ephb4_10
tggcctctccagattcttgg

SEQ ID NO: 19477 - DNA, 20 bp, Artificial Sequence
  sgRNA
  Ephb4_11
gatctgactgaccacctcaa

SEQ ID NO: 19478 - DNA, 20 bp, Artificial Sequence
  sgRNA
  Ephb4_12
gaaatgggtgacttaccctc

SEQ ID NO: 19479 - DNA, 20 bp, Artificial Sequence
  sgRNA
  Ephb4_13
gagttcggcgaggtgtgccg

SEQ ID NO: 19480 - DNA, 20 bp, Artificial Sequence
  sgRNA
  Ephb4_14
gagcgaagctgatacggcca

SEQ ID NO: 19481 - DNA, 20 bp, Artificial Sequence
  sgRNA
  Ephb4_15
agtgctccccttgagtccgg

SEQ ID NO: 19482 - DNA, 20 bp, Artificial Sequence
  sgRNA
  Ephb4_16
ttgagtactcggataagcat

SEQ ID NO: 19483 - DNA, 20 bp, Artificial Sequence
  sgRNA
  Ephb4_17
acttccccgagacggtgcct

SEQ ID NO: 19484 - DNA, 20 bp, Artificial Sequence
  sgRNA
  Ephb4_18
gcacagcgtccgcacctatg

SEQ ID NO: 19485 - DNA, 20 bp, Artificial Sequence
  sgRNA
  Ephb4_19
accctctgctccaagaagcg

SEQ ID NO: 19486 - DNA, 20 bp, Artificial Sequence
  sgRNA
  Ephb4_20
gcgtacctggaccagatagc

SEQ ID NO: 19487 - DNA, 20 bp, Artificial Sequence
  sgRNA
  Ephb6_1
agagtcgagtgttagttggg

SEQ ID NO: 19488 - DNA, 20 bp, Artificial Sequence
  sgRNA
  Ephb6_2
acacactttgtggaacggcg

SEQ ID NO: 19489 - DNA, 20 bp, Artificial Sequence
  sgRNA
  Ephb6_3
agggctcaaccgtgtcacag

SEQ ID NO: 19490 - DNA, 20 bp, Artificial Sequence
  sgRNA
  Ephb6_4
acctcaaaccatagctcccg

SEQ ID NO: 19491 - DNA, 20 bp, Artificial Sequence
  sgRNA
  Ephb6_5
tttggtcctctcactcagcg

SEQ ID NO: 19492 - DNA, 20 bp, Artificial Sequence
  sgRNA
  Ephb6_6
atgtctccaaggcttctaca

SEQ ID NO: 19493 - DNA, 20 bp, Artificial Sequence
  sgRNA
  Ephb6_7
gcatcagtagatgtagtcca

SEQ ID NO: 19494 - DNA, 20 bp, Artificial Sequence
  sgRNA
  Ephb6_8
gcatttcgacccccgccaga

SEQ ID NO: 19495 - DNA, 20 bp, Artificial Sequence
  sgRNA
  Ephb6_9
cttcaccctttactaccggc

SEQ ID NO: 19496 - DNA, 20 bp, Artificial Sequence
  sgRNA
  Ephb6_10
gcttccagagaagctgtcct

SEQ ID NO: 19497 - DNA, 20 bp, Artificial Sequence
  sgRNA
  Ephb6_11
ggggatgtgtcgccgctgca

SEQ ID NO: 19498 - DNA, 20 bp, Artificial Sequence
  sgRNA
  Ephb6_12
tgtgctagtgaatagccacc

SEQ ID NO: 19499 - DNA, 20 bp, Artificial Sequence
  sgRNA
  Ephb6_13
agacggccccgacagtattg

SEQ ID NO: 19500 - DNA, 20 bp, Artificial Sequence
  sgRNA
  Ephb6_14
gcttgtctccacgagcaggc

SEQ ID NO: 19501 - DNA, 20 bp, Artificial Sequence
  sgRNA
  Ephb6_15
tcctttggagaagtgcgtcg

SEQ ID NO: 19502 - DNA, 20 bp, Artificial Sequence
  sgRNA
  Ephb6_16
gccaggccgcaatactgtcg

SEQ ID NO: 19503 - DNA, 20 bp, Artificial Sequence
  sgRNA
  Ephb6_17
caggatggaaccaatcacca

SEQ ID NO: 19504 - DNA, 20 bp, Artificial Sequence
  sgRNA
  Ephb6_18
gatgacagccagtacagtga

SEQ ID NO: 19505 - DNA, 20 bp, Artificial Sequence
  sgRNA
  Ephb6_19
agttctgtcagcaccatgac

SEQ ID NO: 19506 - DNA, 20 bp, Artificial Sequence
  sgRNA
  Ephb6_20
agaagagcttgactgccaca

SEQ ID NO: 19507 - DNA, 20 bp, Artificial Sequence
  sgRNA
  Epor_1
gcgtcactactgaccgctag

SEQ ID NO: 19508 - DNA, 20 bp, Artificial Sequence
  sgRNA
  Epor_2
gtccacttcatatcggatgt

SEQ ID NO: 19509 - DNA, 20 bp, Artificial Sequence
  sgRNA
  Epor_3
agcgtgatggttgtctgtgg

SEQ ID NO: 19510 - DNA, 20 bp, Artificial Sequence
  sgRNA
  Epor_4
tggatgatgcggtgatagcg

SEQ ID NO: 19511 - DNA, 20 bp, Artificial Sequence
  sgRNA
  Epor_5
gggcccttactggagccggt

SEQ ID NO: 19512 - DNA, 20 bp, Artificial Sequence
  sgRNA
  Epor_6
ggccatcagatgagtccccg

SEQ ID NO: 19513 - DNA, 20 bp, Artificial Sequence
  sgRNA
  Epor_7
cagtgaacaccagaaacgca

SEQ ID NO: 19514 - DNA, 20 bp, Artificial Sequence
  sgRNA
  Epor_8
tgggcatgctcactgcccac

SEQ ID NO: 19515 - DNA, 20 bp, Artificial Sequence
  sgRNA
  Epor_9
tgtgttctgagcaacctgcg

SEQ ID NO: 19516 - DNA, 20 bp, Artificial Sequence
  sgRNA
  Epor_10
ggtcctctcagagccacgct

SEQ ID NO: 19517 - DNA, 20 bp, Artificial Sequence
  sgRNA
  Epor_11
cttgaagtacctataccttg

SEQ ID NO: 19518 - DNA, 20 bp, Artificial Sequence
  sgRNA
  Epor_12
tcaacagattacagttcggg

SEQ ID NO: 19519 - DNA, 20 bp, Artificial Sequence
  sgRNA
  Epor_13
ggacaaggctgttctcatag

SEQ ID NO: 19520 - DNA, 20 bp, Artificial Sequence
  sgRNA
  Epor_14
ggtgaagcacagaagttctt

SEQ ID NO: 19521 - DNA, 20 bp, Artificial Sequence
  sgRNA
  Epor_15
ccgacacgtccacttcatat

SEQ ID NO: 19522 - DNA, 20 bp, Artificial Sequence
  sgRNA
  Epor_16
ggatccacctgcccacctag

SEQ ID NO: 19523 - DNA, 20 bp, Artificial Sequence
  sgRNA
  Epor_17
tctgtgcttcacccaacgct

SEQ ID NO: 19524 - DNA, 20 bp, Artificial Sequence
  sgRNA
  Epor_18
gaatccgctgaagctcggct

SEQ ID NO: 19525 - DNA, 20 bp, Artificial Sequence
  sgRNA
  Epor_19
caccaagtcttccaagcgtt

SEQ ID NO: 19526 - DNA, 20 bp, Artificial Sequence
  sgRNA
  Epor_20
tatgaagtggacgtgtcggc

SEQ ID NO: 19527 - DNA, 20 bp, Artificial Sequence
  sgRNA
  Eqtn_1
aaggccagtgggcttaccgt

SEQ ID NO: 19528 - DNA, 20 bp, Artificial Sequence
  sgRNA
  Eqtn_2
ccaaaatgcaggtatattgg

SEQ ID NO: 19529 - DNA, 20 bp, Artificial Sequence
  sgRNA
  Eqtn_3
tcatctgaaagtgtcacacc

SEQ ID NO: 19530 - DNA, 20 bp, Artificial Sequence
  sgRNA
  Eqtn_4
agacaaactgtcagagctcg

SEQ ID NO: 19531 - DNA, 20 bp, Artificial Sequence
  sgRNA
  Eqtn_5
gagcctgcagaaaaatccat

SEQ ID NO: 19532 - DNA, 20 bp, Artificial Sequence
  sgRNA
  Eqtn_6
gtagactgataatgtctggg

SEQ ID NO: 19533 - DNA, 20 bp, Artificial Sequence
  sgRNA
  Eqtn_7
gtatctgacacaccttctgt

SEQ ID NO: 19534 - DNA, 20 bp, Artificial Sequence
  sgRNA
  Eqtn_8
ggcaaagcagaatatcaaga

SEQ ID NO: 19535 - DNA, 20 bp, Artificial Sequence
  sgRNA
  Eqtn_9
tcttcttctccactggcagt

SEQ ID NO: 19536 - DNA, 20 bp, Artificial Sequence
  sgRNA
  Eqtn_10
tcttacttccatccaacaga

SEQ ID NO: 19537 - DNA, 20 bp, Artificial Sequence
  sgRNA
  Eqtn_11
tctcattcattgcctgcata

SEQ ID NO: 19538 - DNA, 20 bp, Artificial Sequence
  sgRNA
  Eqtn_12
tcaagctgaagttaatgctg

SEQ ID NO: 19539 - DNA, 20 bp, Artificial Sequence
  sgRNA
  Eqtn_13
tcaacgatgagctccttacc

SEQ ID NO: 19540 - DNA, 20 bp, Artificial Sequence
  sgRNA
  Eqtn_14
ggaatcttgtctcctcagga

SEQ ID NO: 19541 - DNA, 20 bp, Artificial Sequence
  sgRNA
  Eqtn_15
gccagcaaaccaactgccag

SEQ ID NO: 19542 - DNA, 20 bp, Artificial Sequence
  sgRNA
  Eqtn_16
tgtgactgccacaactaacc

SEQ ID NO: 19543 - DNA, 20 bp, Artificial Sequence
  sgRNA
  Eqtn_17
tgcccagctgttgttgaaca

SEQ ID NO: 19544 - DNA, 20 bp, Artificial Sequence
  sgRNA
  Eqtn_18
gtagcattcaaatctgaggc

SEQ ID NO: 19545 - DNA, 20 bp, Artificial Sequence
  sgRNA
  Eqtn_19
atactccatcaacccagagc

SEQ ID NO: 19546 - DNA, 20 bp, Artificial Sequence
  sgRNA
  Eqtn_20
gataatattgtccaaaatgc

SEQ ID NO: 19547 - DNA, 20 bp, Artificial Sequence
  sgRNA
  Erbb2_1
ttggaatcctaatcaaacga

SEQ ID NO: 19548 - DNA, 20 bp, Artificial Sequence
  sgRNA
  Erbb2_2
ctgtcccccgaacaaccaag

SEQ ID NO: 19549 - DNA, 20 bp, Artificial Sequence
  sgRNA
  Erbb2_3
ctgactgcagttgacacact

SEQ ID NO: 19550 - DNA, 20 bp, Artificial Sequence
  sgRNA
  Erbb2_4
tcaatgagtaagcaccactg

SEQ ID NO: 19551 - DNA, 20 bp, Artificial Sequence
  sgRNA
  Erbb2_5
cctccgtaagaataaccagc

SEQ ID NO: 19552 - DNA, 20 bp, Artificial Sequence
  sgRNA
  Erbb2_6
acgtagccatcagtctcggg

SEQ ID NO: 19553 - DNA, 20 bp, Artificial Sequence
  sgRNA
  Erbb2_7
tttggggccaaaccttacga

SEQ ID NO: 19554 - DNA, 20 bp, Artificial Sequence
  sgRNA
  Erbb2_8
gcagtgggacgtgtttcact

SEQ ID NO: 19555 - DNA, 20 bp, Artificial Sequence
  sgRNA
  Erbb2_9
gtgtcagcctcaaaacagct

SEQ ID NO: 19556 - DNA, 20 bp, Artificial Sequence
  sgRNA
  Erbb2_10
gagtccatgctcaaccctga

SEQ ID NO: 19557 - DNA, 20 bp, Artificial Sequence
  sgRNA
  Erbb2_11
gggcatggagcacctccgag

SEQ ID NO: 19558 - DNA, 20 bp, Artificial Sequence
  sgRNA
  Erbb2_12
ttggggccaaaccttacgat

SEQ ID NO: 19559 - DNA, 20 bp, Artificial Sequence
  sgRNA
  Erbb2_13
agaattctcccgtatggcaa

SEQ ID NO: 19560 - DNA, 20 bp, Artificial Sequence
  sgRNA
  Erbb2_14
ttaccgacttcgggctggca

SEQ ID NO: 19561 - DNA, 20 bp, Artificial Sequence
  sgRNA
  Erbb2_15
gtaactcactgtgtgcccgt

SEQ ID NO: 19562 - DNA, 20 bp, Artificial Sequence
  sgRNA
  Erbb2_16
tgaaacacgtcccactgcag

SEQ ID NO: 19563 - DNA, 20 bp, Artificial Sequence
  sgRNA
  Erbb2_17
gttgttcctgatcatagtgg

SEQ ID NO: 19564 - DNA, 20 bp, Artificial Sequence
  sgRNA
  Erbb2_18
ccgcagacaccgcagctcgt

SEQ ID NO: 19565 - DNA, 20 bp, Artificial Sequence
  sgRNA
  Erbb2_19
cggtggtgacgttgtccaaa

SEQ ID NO: 19566 - DNA, 20 bp, Artificial Sequence
  sgRNA
  Erbb2_20
agttctggtcccagtaatag

SEQ ID NO: 19567 - DNA, 20 bp, Artificial Sequence
  sgRNA
  Erbb3_1
gcccttacctaacctccgag

SEQ ID NO: 19568 - DNA, 20 bp, Artificial Sequence
  sgRNA
  Erbb3_2
tccaacctgacgaccatcgg

SEQ ID NO: 19569 - DNA, 20 bp, Artificial Sequence
  sgRNA
  Erbb3_3
ctagggtatgtattacctcg

SEQ ID NO: 19570 - DNA, 20 bp, Artificial Sequence
  sgRNA
  Erbb3_4
tggactctagcaatatcgat

SEQ ID NO: 19571 - DNA, 20 bp, Artificial Sequence
  sgRNA
  Erbb3_5
actggaccagacttctgcgg

SEQ ID NO: 19572 - DNA, 20 bp, Artificial Sequence
  sgRNA
  Erbb3_6
tggaagccgctaccagaccg

SEQ ID NO: 19573 - DNA, 20 bp, Artificial Sequence
  sgRNA
  Erbb3_7
agtaactgcttgtcatctgg

SEQ ID NO: 19574 - DNA, 20 bp, Artificial Sequence
  sgRNA
  Erbb3_8
cctaacctccgagtggtccg

SEQ ID NO: 19575 - DNA, 20 bp, Artificial Sequence
  sgRNA
  Erbb3_9
ggcgcatcgagcacaagcgt

SEQ ID NO: 19576 - DNA, 20 bp, Artificial Sequence
  sgRNA
  Erbb3_10
gcagcgaccgttacactgag

SEQ ID NO: 19577 - DNA, 20 bp, Artificial Sequence
  sgRNA
  Erbb3_11
gtcttgtcgaaactacagcc

SEQ ID NO: 19578 - DNA, 20 bp, Artificial Sequence
  sgRNA
  Erbb3_12
ggacctcgacctagacgtgg

SEQ ID NO: 19579 - DNA, 20 bp, Artificial Sequence
  sgRNA
  Erbb3_13
tagtggtgaagaacaacggg

SEQ ID NO: 19580 - DNA, 20 bp, Artificial Sequence
  sgRNA
  Erbb3_14
catagctgcataatcccctc

SEQ ID NO: 19581 - DNA, 20 bp, Artificial Sequence
  sgRNA
  Erbb3_15
gcaggctgtgtcgctgcgaa

SEQ ID NO: 19582 - DNA, 20 bp, Artificial Sequence
  sgRNA
  Erbb3_16
atgagacgctacttggagcg

SEQ ID NO: 19583 - DNA, 20 bp, Artificial Sequence
  sgRNA
  Erbb3_17
gacaagacaagcactgacca

SEQ ID NO: 19584 - DNA, 20 bp, Artificial Sequence
  sgRNA
  Erbb3_18
ggggaacccaggtctacgat

SEQ ID NO: 19585 - DNA, 20 bp, Artificial Sequence
  sgRNA
  Erbb3_19
ggccgggtaagcgttcctgt

SEQ ID NO: 19586 - DNA, 20 bp, Artificial Sequence
  sgRNA
  Erbb3_20
catatcaagtatcagtacgg

SEQ ID NO: 19587 - DNA, 20 bp, Artificial Sequence
  sgRNA
  Erbb4_1
atggcagcagtcactaacgt

SEQ ID NO: 19588 - DNA, 20 bp, Artificial Sequence
  sgRNA
  Erbb4_2
gtagagcccttaactcccag

SEQ ID NO: 19589 - DNA, 20 bp, Artificial Sequence
  sgRNA
  Erbb4_3
ttgctgatcctcaaacaaca

SEQ ID NO: 19590 - DNA, 20 bp, Artificial Sequence
  sgRNA
  Erbb4_4
aaagaaatgtacccgcagga

SEQ ID NO: 19591 - DNA, 20 bp, Artificial Sequence
  sgRNA
  Erbb4_5
gtatagtgtcagcataacat

SEQ ID NO: 19592 - DNA, 20 bp, Artificial Sequence
  sgRNA
  Erbb4_6
gttacgcagctgatgccgca

SEQ ID NO: 19593 - DNA, 20 bp, Artificial Sequence
  sgRNA
  Erbb4_7
tggcagcagtcactaacgta

SEQ ID NO: 19594 - DNA, 20 bp, Artificial Sequence
  sgRNA
  Erbb4_8
gcttcagcgagaactccgag

SEQ ID NO: 19595 - DNA, 20 bp, Artificial Sequence
  sgRNA
  Erbb4_9
acaccttcgccaatgccttg

SEQ ID NO: 19596 - DNA, 20 bp, Artificial Sequence
  sgRNA
  Erbb4_10
ccaataggcgaactaggtgt

SEQ ID NO: 19597 - DNA, 20 bp, Artificial Sequence
  sgRNA
  Erbb4_11
gctactgtcctcttggacat

SEQ ID NO: 19598 - DNA, 20 bp, Artificial Sequence
  sgRNA
  Erbb4_12
gccccagaacggaatcctcg

SEQ ID NO: 19599 - DNA, 20 bp, Artificial Sequence
  sgRNA
  Erbb4_13
acatcaatagtgcagatggg

SEQ ID NO: 19600 - DNA, 20 bp, Artificial Sequence
  sgRNA
  Erbb4_14
tcttcatccagttctcctcg

SEQ ID NO: 19601 - DNA, 20 bp, Artificial Sequence
  sgRNA
  Erbb4_15
catgtactctgcactcccca

SEQ ID NO: 19602 - DNA, 20 bp, Artificial Sequence
  sgRNA
  Erbb4_16
agaactccactgattgcagc

SEQ ID NO: 19603 - DNA, 20 bp, Artificial Sequence
  sgRNA
  Erbb4_17
agagtcatgttggaaggcca

SEQ ID NO: 19604 - DNA, 20 bp, Artificial Sequence
  sgRNA
  Erbb4_18
tgaaacagtgaaaatccctg

SEQ ID NO: 19605 - DNA, 20 bp, Artificial Sequence
  sgRNA
  Erbb4_19
caaatactatgaaaactgcg

SEQ ID NO: 19606 - DNA, 20 bp, Artificial Sequence
  sgRNA
  Erbb4_20
gactcagacacactcccaat

SEQ ID NO: 19607 - DNA, 20 bp, Artificial Sequence
  sgRNA
  Ereg_1
gatggaagacgatccccgtg

SEQ ID NO: 19608 - DNA, 20 bp, Artificial Sequence
  sgRNA
  Ereg_2
aagtgtagttctgacatgga

SEQ ID NO: 19609 - DNA, 20 bp, Artificial Sequence
  sgRNA
  Ereg_3
tggccagtgcatctacctgg

SEQ ID NO: 19610 - DNA, 20 bp, Artificial Sequence
  sgRNA
  Ereg_4
agatgtgaagtgggctacac

SEQ ID NO: 19611 - DNA, 20 bp, Artificial Sequence
  sgRNA
  Ereg_5
gcaacgtattctttgctcaa

SEQ ID NO: 19612 - DNA, 20 bp, Artificial Sequence
  sgRNA
  Ereg_6
gcgtcaagacccaagaggca

SEQ ID NO: 19613 - DNA, 20 bp, Artificial Sequence
  sgRNA
  Ereg_7
gaaatagtatatgcatccag

SEQ ID NO: 19614 - DNA, 20 bp, Artificial Sequence
  sgRNA
  Ereg_8
atgcatcccaggagaatccg

SEQ ID NO: 19615 - DNA, 20 bp, Artificial Sequence
  sgRNA
  Ereg_9
aagcagcgtcaagacccaag

SEQ ID NO: 19616 - DNA, 20 bp, Artificial Sequence
  sgRNA
  Ereg_10
gcatggccagtgcatctacc

SEQ ID NO: 19617 - DNA, 20 bp, Artificial Sequence
  sgRNA
  Ereg_11
tcgaaaaagtaaaaaatcga

SEQ ID NO: 19618 - DNA, 20 bp, Artificial Sequence
  sgRNA
  Ereg_12
atctgcacttgagccacacg

SEQ ID NO: 19619 - DNA, 20 bp, Artificial Sequence
  sgRNA
  Ereg_13
gataactgcctgtagaaggt

SEQ ID NO: 19620 - DNA, 20 bp, Artificial Sequence
  sgRNA
  Ereg_14
atttctctctcatgtccacc

SEQ ID NO: 19621 - DNA, 20 bp, Artificial Sequence
  sgRNA
  Ereg_15
atatgagagagtgacctcag

SEQ ID NO: 19622 - DNA, 20 bp, Artificial Sequence
  sgRNA
  Ereg_16
agttatcctcggattctcct

SEQ ID NO: 19623 - DNA, 20 bp, Artificial Sequence
  sgRNA
  Ereg_17
taatctgcacttgagccaca

SEQ ID NO: 19624 - DNA, 20 bp, Artificial Sequence
  sgRNA
  Ereg_18
ctgtttctcatcataaccgc

SEQ ID NO: 19625 - DNA, 20 bp, Artificial Sequence
  sgRNA
  Ereg_19
gattctcctgggatgcatga

SEQ ID NO: 19626 - DNA, 20 bp, Artificial Sequence
  sgRNA
  Ereg_20
cgtattctttgctcaagggt

SEQ ID NO: 19627 - DNA, 20 bp, Artificial Sequence
  sgRNA
  Ermap_1
tcctgcaaatcagtaatgtg

SEQ ID NO: 19628 - DNA, 20 bp, Artificial Sequence
  sgRNA
  Ermap_2
gtcacttactcagttcactc

SEQ ID NO: 19629 - DNA, 20 bp, Artificial Sequence
  sgRNA
  Ermap_3
cggacacctacctcgcaccc

SEQ ID NO: 19630 - DNA, 20 bp, Artificial Sequence
  sgRNA
  Ermap_4
cagcatcatagcccttcacg

SEQ ID NO: 19631 - DNA, 20 bp, Artificial Sequence
  sgRNA
  Ermap_5
gctgctgtatgagcaagcga

SEQ ID NO: 19632 - DNA, 20 bp, Artificial Sequence
  sgRNA
  Ermap_6
gccccgacagattattgcca

SEQ ID NO: 19633 - DNA, 20 bp, Artificial Sequence
  sgRNA
  Ermap_7
gccatggcaataatctgtcg

SEQ ID NO: 19634 - DNA, 20 bp, Artificial Sequence
  sgRNA
  Ermap_8
agacaacgtgaccctgcagg

SEQ ID NO: 19635 - DNA, 20 bp, Artificial Sequence
  sgRNA
  Ermap_9
tggcttgtgcgacagagccg

SEQ ID NO: 19636 - DNA, 20 bp, Artificial Sequence
  sgRNA
  Ermap_10
tgagtaccatgttaggccag

SEQ ID NO: 19637 - DNA, 20 bp, Artificial Sequence
  sgRNA
  Ermap_11
gatccctacatccacgtgaa

SEQ ID NO: 19638 - DNA, 20 bp, Artificial Sequence
  sgRNA
  Ermap_12
gacctgatgccagaatataa

SEQ ID NO: 19639 - DNA, 20 bp, Artificial Sequence
  sgRNA
  Ermap_13
ctaacacctgaacaggcggc

SEQ ID NO: 19640 - DNA, 20 bp, Artificial Sequence
  sgRNA
  Ermap_14
aactcatcctgtctgaggat

SEQ ID NO: 19641 - DNA, 20 bp, Artificial Sequence
  sgRNA
  Ermap_15
gggacacgtctccattagca

SEQ ID NO: 19642 - DNA, 20 bp, Artificial Sequence
  sgRNA
  Ermap_16
tcgattgtccccaaacaaga

SEQ ID NO: 19643 - DNA, 20 bp, Artificial Sequence
  sgRNA
  Ermap_17
gttggctgtgtccctaagag

SEQ ID NO: 19644 - DNA, 20 bp, Artificial Sequence
  sgRNA
  Ermap_18
gcggctaaagaaacatgtgg

SEQ ID NO: 19645 - DNA, 20 bp, Artificial Sequence
  sgRNA
  Ermap_19
gctgtatgagcaagcgatgg

SEQ ID NO: 19646 - DNA, 20 bp, Artificial Sequence
  sgRNA
  Ermap_20
gagctgctgtgtcaatcagt

SEQ ID NO: 19647 - DNA, 20 bp, Artificial Sequence
  sgRNA
  Ermp1_1
gcatctccgtagatatacag

SEQ ID NO: 19648 - DNA, 20 bp, Artificial Sequence
  sgRNA
  Ermp1_2
attgcgtacccttctcgtgt

SEQ ID NO: 19649 - DNA, 20 bp, Artificial Sequence
  sgRNA
  Ermp1_3
gatgttgagtaataaaacca

SEQ ID NO: 19650 - DNA, 20 bp, Artificial Sequence
  sgRNA
  Ermp1_4
tggtgctgagccggacctcg

SEQ ID NO: 19651 - DNA, 20 bp, Artificial Sequence
  sgRNA
  Ermp1_5
agtgcactggaagataccaa

SEQ ID NO: 19652 - DNA, 20 bp, Artificial Sequence
  sgRNA
  Ermp1_6
gttggtccaggcttacgttt

SEQ ID NO: 19653 - DNA, 20 bp, Artificial Sequence
  sgRNA
  Ermp1_7
cttccccaggtacagaacca

SEQ ID NO: 19654 - DNA, 20 bp, Artificial Sequence
  sgRNA
  Ermp1_8
ggtgggccgctgtatatcta

SEQ ID NO: 19655 - DNA, 20 bp, Artificial Sequence
  sgRNA
  Ermp1_9
tcaatgctaaaggaaccggt

SEQ ID NO: 19656 - DNA, 20 bp, Artificial Sequence
  sgRNA
  Ermp1_10
gggaagacggagaacggcgg

SEQ ID NO: 19657 - DNA, 20 bp, Artificial Sequence
  sgRNA
  Ermp1_11
gctcgaatcaaactggccca

SEQ ID NO: 19658 - DNA, 20 bp, Artificial Sequence
  sgRNA
  Ermp1_12
tcagcgcaggaggatgcgaa

SEQ ID NO: 19659 - DNA, 20 bp, Artificial Sequence
  sgRNA
  Ermp1_13
gcagactcggctccatcccg

SEQ ID NO: 19660 - DNA, 20 bp, Artificial Sequence
  sgRNA
  Ermp1_14
actggtcctttccttcggcg

SEQ ID NO: 19661 - DNA, 20 bp, Artificial Sequence
  sgRNA
  Ermp1_15
aaggatcaacactttcccag

SEQ ID NO: 19662 - DNA, 20 bp, Artificial Sequence
  sgRNA
  Ermp1_16
acacaagtctgaaatgagca

SEQ ID NO: 19663 - DNA, 20 bp, Artificial Sequence
  sgRNA
  Ermp1_17
attctgaagtcggtgtcaga

SEQ ID NO: 19664 - DNA, 20 bp, Artificial Sequence
  sgRNA
  Ermp1_18
ggatcatcacacagacagcc

SEQ ID NO: 19665 - DNA, 20 bp, Artificial Sequence
  sgRNA
  Ermp1_19
aggatgcgaagggcgtcggg

SEQ ID NO: 19666 - DNA, 20 bp, Artificial Sequence
  sgRNA
  Ermp1_20
gagccaccacagaggcaaaa

SEQ ID NO: 19667 - DNA, 20 bp, Artificial Sequence
  sgRNA
  Esam_1
acctactgctcagtaccagt

SEQ ID NO: 19668 - DNA, 20 bp, Artificial Sequence
  sgRNA
  Esam_2
tctgcacattgacagaacag

SEQ ID NO: 19669 - DNA, 20 bp, Artificial Sequence
  sgRNA
  Esam_3
ggagtcatgacaaataaacc

SEQ ID NO: 19670 - DNA, 20 bp, Artificial Sequence
  sgRNA
  Esam_4
gtcgtggtcccacccccggg

SEQ ID NO: 19671 - DNA, 20 bp, Artificial Sequence
  sgRNA
  Esam_5
tccaatttgttgaggcccgg

SEQ ID NO: 19672 - DNA, 20 bp, Artificial Sequence
  sgRNA
  Esam_6
ggtgggggttcatctaccct

SEQ ID NO: 19673 - DNA, 20 bp, Artificial Sequence
  sgRNA
  Esam_7
gtgccatcgtgtaccaggcg

SEQ ID NO: 19674 - DNA, 20 bp, Artificial Sequence
  sgRNA
  Esam_8
gcagacatagactccagaca

SEQ ID NO: 19675 - DNA, 20 bp, Artificial Sequence
  sgRNA
  Esam_9
gggtacaccctgtaaactac

SEQ ID NO: 19676 - DNA, 20 bp, Artificial Sequence
  sgRNA
  Esam_10
tcttctgctctgagccgcat

SEQ ID NO: 19677 - DNA, 20 bp, Artificial Sequence
  sgRNA
  Esam_11
gtcctcaccaagactgccca

SEQ ID NO: 19678 - DNA, 20 bp, Artificial Sequence
  sgRNA
  Esam_12
gtcacattggtcccgacata

SEQ ID NO: 19679 - DNA, 20 bp, Artificial Sequence
  sgRNA
  Esam_13
gctccccgcctggtacacga

SEQ ID NO: 19680 - DNA, 20 bp, Artificial Sequence
  sgRNA
  Esam_14
gcagaagaagaaaccccacc

SEQ ID NO: 19681 - DNA, 20 bp, Artificial Sequence
  sgRNA
  Esam_15
ttacagggtgtaccctatgt

SEQ ID NO: 19682 - DNA, 20 bp, Artificial Sequence
  sgRNA
  Esam_16
cgtgcaactccatctgagct

SEQ ID NO: 19683 - DNA, 20 bp, Artificial Sequence
  sgRNA
  Esam_17
ccgcctggtacacgatggca

SEQ ID NO: 19684 - DNA, 20 bp, Artificial Sequence
  sgRNA
  Esam_18
aacaaattggaagcggtaga

SEQ ID NO: 19685 - DNA, 20 bp, Artificial Sequence
  sgRNA
  Esam_19
ccagcgccggagcaagacct

SEQ ID NO: 19686 - DNA, 20 bp, Artificial Sequence
  sgRNA
  Esam_20
gcttccaatttgttgaggcc

SEQ ID NO: 19687 - DNA, 20 bp, Artificial Sequence
  sgRNA
  Esyt3_1
tgaatgacacgaccagtggg

SEQ ID NO: 19688 - DNA, 20 bp, Artificial Sequence
  sgRNA
  Esyt3_2
acacggacaaacgcaaccgg

SEQ ID NO: 19689 - DNA, 20 bp, Artificial Sequence
  sgRNA
  Esyt3_3
tgagcttgacgtatgaagaa

SEQ ID NO: 19690 - DNA, 20 bp, Artificial Sequence
  sgRNA
  Esyt3_4
gacaacttcctagggctcgg

SEQ ID NO: 19691 - DNA, 20 bp, Artificial Sequence
  sgRNA
  Esyt3_5
ccaacctgctggacatgccg

SEQ ID NO: 19692 - DNA, 20 bp, Artificial Sequence
  sgRNA
  Esyt3_6
ttatggtgtacgaggtacct

SEQ ID NO: 19693 - DNA, 20 bp, Artificial Sequence
  sgRNA
  Esyt3_7
ttaacaccatgcaccagcag

SEQ ID NO: 19694 - DNA, 20 bp, Artificial Sequence
  sgRNA
  Esyt3_8
agaacacctggctccacaca

SEQ ID NO: 19695 - DNA, 20 bp, Artificial Sequence
  sgRNA
  Esyt3_9
gcaggtagatgcggacgtag

SEQ ID NO: 19696 - DNA, 20 bp, Artificial Sequence
  sgRNA
  Esyt3_10
gccaccttcttgatgaacag

SEQ ID NO: 19697 - DNA, 20 bp, Artificial Sequence
  sgRNA
  Esyt3_11
cattctctaagaagaccacg

SEQ ID NO: 19698 - DNA, 20 bp, Artificial Sequence
  sgRNA
  Esyt3_12
cggggactgtgagatcagcg

SEQ ID NO: 19699 - DNA, 20 bp, Artificial Sequence
  sgRNA
  Esyt3_13
gtggaacttcagaagatccg

SEQ ID NO: 19700 - DNA, 20 bp, Artificial Sequence
  sgRNA
  Esyt3_14
attcgcatggccactcacga

SEQ ID NO: 19701 - DNA, 20 bp, Artificial Sequence
  sgRNA
  Esyt3_15
gcgccaccacatccagagca

SEQ ID NO: 19702 - DNA, 20 bp, Artificial Sequence
  sgRNA
  Esyt3_16
tggacagcctcatctccatg

SEQ ID NO: 19703 - DNA, 20 bp, Artificial Sequence
  sgRNA
  Esyt3_17
gaacctatgcctgagcccca

SEQ ID NO: 19704 - DNA, 20 bp, Artificial Sequence
  sgRNA
  Esyt3_18
gctctcgtccctccacacgt

SEQ ID NO: 19705 - DNA, 20 bp, Artificial Sequence
  sgRNA
  Esyt3_19
gcaaggccttcgtttagggg

SEQ ID NO: 19706 - DNA, 20 bp, Artificial Sequence
  sgRNA
  Esyt3_20
tcttcacaggcacagtcaca

SEQ ID NO: 19707 - DNA, 20 bp, Artificial Sequence
  sgRNA
  Eva1c_1
cgaagtggtaattatcgacg

SEQ ID NO: 19708 - DNA, 20 bp, Artificial Sequence
  sgRNA
  Eva1c_2
tataatcacctaccgaaggg

SEQ ID NO: 19709 - DNA, 20 bp, Artificial Sequence
  sgRNA
  Eva1c_3
agttcccaagaacatactca

SEQ ID NO: 19710 - DNA, 20 bp, Artificial Sequence
  sgRNA
  Eva1c_4
agactcggctattgaccagg

SEQ ID NO: 19711 - DNA, 20 bp, Artificial Sequence
  sgRNA
  Eva1c_5
gcttctatagagctataggc

SEQ ID NO: 19712 - DNA, 20 bp, Artificial Sequence
  sgRNA
  Eva1c_6
ggtataacattcaacccaag

SEQ ID NO: 19713 - DNA, 20 bp, Artificial Sequence
  sgRNA
  Eva1c_7
attctgcgccgattggggcg

SEQ ID NO: 19714 - DNA, 20 bp, Artificial Sequence
  sgRNA
  Eva1c_8
tctgcgcctgttctactgca

SEQ ID NO: 19715 - DNA, 20 bp, Artificial Sequence
  sgRNA
  Eva1c_9
gcacaaccctcgacccgctt

SEQ ID NO: 19716 - DNA, 20 bp, Artificial Sequence
  sgRNA
  Eva1c_10
cttgcccataaaatgccgac

SEQ ID NO: 19717 - DNA, 20 bp, Artificial Sequence
  sgRNA
  Eva1c_11
atagtccccgtcacaggcat

SEQ ID NO: 19718 - DNA, 20 bp, Artificial Sequence
  sgRNA
  Eva1c_12
attcaacccaagcgggtcga

SEQ ID NO: 19719 - DNA, 20 bp, Artificial Sequence
  sgRNA
  Eva1c_13
aatcctttccgccagctcgg

SEQ ID NO: 19720 - DNA, 20 bp, Artificial Sequence
  sgRNA
  Eva1c_14
acaggacaccctgatgacca

SEQ ID NO: 19721 - DNA, 20 bp, Artificial Sequence
  sgRNA
  Eva1c_15
ctcggattcgcagtttcccg

SEQ ID NO: 19722 - DNA, 20 bp, Artificial Sequence
  sgRNA
  Eva1c_16
agagaaatcggtgagcgcgg

SEQ ID NO: 19723 - DNA, 20 bp, Artificial Sequence
  sgRNA
  Eva1c_17
tcctcactccccaggaacgt

SEQ ID NO: 19724 - DNA, 20 bp, Artificial Sequence
  sgRNA
  Eva1c_18
ctcgggaaactgcgaatccg

SEQ ID NO: 19725 - DNA, 20 bp, Artificial Sequence
  sgRNA
  Eva1c_19
gaggatggacgatcacacat

SEQ ID NO: 19726 - DNA, 20 bp, Artificial Sequence
  sgRNA
  Eva1c_20
ctttacaagtcctgtccagg

SEQ ID NO: 19727 - DNA, 20 bp, Artificial Sequence
  sgRNA
  Evc2_1
cctttccctcaatgaccaag

SEQ ID NO: 19728 - DNA, 20 bp, Artificial Sequence
  sgRNA
  Evc2_2
gatatttcaagagaagcccg

SEQ ID NO: 19729 - DNA, 20 bp, Artificial Sequence
  sgRNA
  Evc2_3
accagagattaataaccagg

SEQ ID NO: 19730 - DNA, 20 bp, Artificial Sequence
  sgRNA
  Evc2_4
ccttactctggaccaagccg

SEQ ID NO: 19731 - DNA, 20 bp, Artificial Sequence
  sgRNA
  Evc2_5
tgttgaagagagttagcgag

SEQ ID NO: 19732 - DNA, 20 bp, Artificial Sequence
  sgRNA
  Evc2_6
gctgctgcaacactcgtgca

SEQ ID NO: 19733 - DNA, 20 bp, Artificial Sequence
  sgRNA
  Evc2_7
gcgacacagtcaggacccgg

SEQ ID NO: 19734 - DNA, 20 bp, Artificial Sequence
  sgRNA
  Evc2_8
cggacccgagcccagtacca

SEQ ID NO: 19735 - DNA, 20 bp, Artificial Sequence
  sgRNA
  Evc2_9
gcaagactactctaaaacac

SEQ ID NO: 19736 - DNA, 20 bp, Artificial Sequence
  sgRNA
  Evc2_10
gcaagaaagctgcgttccaa

SEQ ID NO: 19737 - DNA, 20 bp, Artificial Sequence
  sgRNA
  Evc2_11
gtaccattgtcatccttgag

SEQ ID NO: 19738 - DNA, 20 bp, Artificial Sequence
  sgRNA
  Evc2_12
acccctcgccaagaagaaca

SEQ ID NO: 19739 - DNA, 20 bp, Artificial Sequence
  sgRNA
  Evc2_13
acgttcctgcagctcctcca

SEQ ID NO: 19740 - DNA, 20 bp, Artificial Sequence
  sgRNA
  Evc2_14
gctgagatggtatcgcttgg

SEQ ID NO: 19741 - DNA, 20 bp, Artificial Sequence
  sgRNA
  Evc2_15
gcagttccagaaggtggccc

SEQ ID NO: 19742 - DNA, 20 bp, Artificial Sequence
  sgRNA
  Evc2_16
tcgcccttcacctctgctaa

SEQ ID NO: 19743 - DNA, 20 bp, Artificial Sequence
  sgRNA
  Evc2_17
ctagcacgagcaggttcgaa

SEQ ID NO: 19744 - DNA, 20 bp, Artificial Sequence
  sgRNA
  Evc2_18
gcgaggggtcgatgtctgca

SEQ ID NO: 19745 - DNA, 20 bp, Artificial Sequence
  sgRNA
  Evc2_19
catctccctcctcctgaccg

SEQ ID NO: 19746 - DNA, 20 bp, Artificial Sequence
  sgRNA
  Evc2_20
gttcagggcttgccgcagga

SEQ ID NO: 19747 - DNA, 20 bp, Artificial Sequence
  sgRNA
  Evi2_1
tcagttgtaacatataacga

SEQ ID NO: 19748 - DNA, 20 bp, Artificial Sequence
  sgRNA
  Evi2_2
ggcacattaaatgagtcagg

SEQ ID NO: 19749 - DNA, 20 bp, Artificial Sequence
  sgRNA
  Evi2_3
aatccccaaccatctccaga

SEQ ID NO: 19750 - DNA, 20 bp, Artificial Sequence
  sgRNA
  Evi2_4
ggtggttctgaagtgagtgg

SEQ ID NO: 19751 - DNA, 20 bp, Artificial Sequence
  sgRNA
  Evi2_5
atatggcagcaattgcattg

SEQ ID NO: 19752 - DNA, 20 bp, Artificial Sequence
  sgRNA
  Evi2_6
caatcaagagtcggcccacg

SEQ ID NO: 19753 - DNA, 20 bp, Artificial Sequence
  sgRNA
  Evi2_7
aggtttgtgttattgtcact

SEQ ID NO: 19754 - DNA, 20 bp, Artificial Sequence
  sgRNA
  Evi2_8
gcagttcctttgccacttgg

SEQ ID NO: 19755 - DNA, 20 bp, Artificial Sequence
  sgRNA
  Evi2_9
ataaaatctcctgctgacag

SEQ ID NO: 19756 - DNA, 20 bp, Artificial Sequence
  sgRNA
  Evi2_10
tttaatgtgcctctgtcagc

SEQ ID NO: 19757 - DNA, 20 bp, Artificial Sequence
  sgRNA
  Evi2_11
cagtgacactgctagcccac

SEQ ID NO: 19758 - DNA, 20 bp, Artificial Sequence
  sgRNA
  Evi2_12
cttggtggttctgaagtgag

SEQ ID NO: 19759 - DNA, 20 bp, Artificial Sequence
  sgRNA
  Evi2_13
ctcacttcagaaccaccaag

SEQ ID NO: 19760 - DNA, 20 bp, Artificial Sequence
  sgRNA
  Evi2_14
tcagaaccaccaagtggcaa

SEQ ID NO: 19761 - DNA, 20 bp, Artificial Sequence
  sgRNA
  Evi2_15
tcatccaaatcaagaagggg

SEQ ID NO: 19762 - DNA, 20 bp, Artificial Sequence
  sgRNA
  Evi2_16
ggtaggtctccatttgctga

SEQ ID NO: 19763 - DNA, 20 bp, Artificial Sequence
  sgRNA
  Evi2_17
agtgctgatgggtcaacagt

SEQ ID NO: 19764 - DNA, 20 bp, Artificial Sequence
  sgRNA
  Evi2_18
tttcctgatgacaacagtgt

SEQ ID NO: 19765 - DNA, 20 bp, Artificial Sequence
  sgRNA
  Evi2_19
ttatgagtagactctacttc

SEQ ID NO: 19766 - DNA, 20 bp, Artificial Sequence
  sgRNA
  Evi2_20
agaccatctggagatggttg

SEQ ID NO: 19767 - DNA, 20 bp, Artificial Sequence
  sgRNA
  Evi2a_1
attctgattactggaacctg

SEQ ID NO: 19768 - DNA, 20 bp, Artificial Sequence
  sgRNA
  Evi2a_2
atgtggaagctaaaggcaca

SEQ ID NO: 19769 - DNA, 20 bp, Artificial Sequence
  sgRNA
  Evi2a_3
ggcgctcaccttgtgaccca

SEQ ID NO: 19770 - DNA, 20 bp, Artificial Sequence
  sgRNA
  Evi2a_4
cagcagagatcaaaagtcag

SEQ ID NO: 19771 - DNA, 20 bp, Artificial Sequence
  sgRNA
  Evi2a_5
agaaagtcaccgttgctccg

SEQ ID NO: 19772 - DNA, 20 bp, Artificial Sequence
  sgRNA
  Evi2a_6
aagtaggcaagcgccagccg

SEQ ID NO: 19773 - DNA, 20 bp, Artificial Sequence
  sgRNA
  Evi2a_7
gcacaccaggagattgcaat

SEQ ID NO: 19774 - DNA, 20 bp, Artificial Sequence
  sgRNA
  Evi2a_8
tgaggagaacaccagcaaca

SEQ ID NO: 19775 - DNA, 20 bp, Artificial Sequence
  sgRNA
  Evi2a_9
aggtttgtgttattgtcact

SEQ ID NO: 19776 - DNA, 20 bp, Artificial Sequence
  sgRNA
  Evi2a_10
gtgactttctggcaagtagt

SEQ ID NO: 19777 - DNA, 20 bp, Artificial Sequence
  sgRNA
  Evi2a_11
aagcgccagccgcggagcaa

SEQ ID NO: 19778 - DNA, 20 bp, Artificial Sequence
  sgRNA
  Evi2a_12
caccaggagattgcaatagg

SEQ ID NO: 19779 - DNA, 20 bp, Artificial Sequence
  sgRNA
  Evi2a_13
ggacacttggaaaagagcaa

SEQ ID NO: 19780 - DNA, 20 bp, Artificial Sequence
  sgRNA
  Evi2a_14
acagcagagatcaaaagtca

SEQ ID NO: 19781 - DNA, 20 bp, Artificial Sequence
  sgRNA
  Evi2a_15
cagtgacactgctagcccac

SEQ ID NO: 19782 - DNA, 20 bp, Artificial Sequence
  sgRNA
  Evi2a_16
tcagggggaaacgtttaaaa

SEQ ID NO: 19783 - DNA, 20 bp, Artificial Sequence
  sgRNA
  Evi2a_17
cctttgtgctccatacctac

SEQ ID NO: 19784 - DNA, 20 bp, Artificial Sequence
  sgRNA
  Evi2a_18
tttcctgatgacaacagtgt

SEQ ID NO: 19785 - DNA, 20 bp, Artificial Sequence
  sgRNA
  Evi2a_19
tcttgttccagaagacgacg

SEQ ID NO: 19786 - DNA, 20 bp, Artificial Sequence
  sgRNA
  Evi2a_20
tggtgtgcttacagcagcca

SEQ ID NO: 19787 - DNA, 20 bp, Artificial Sequence
  sgRNA
  Evi2b_1
ctcacttcagaaccaccaag

SEQ ID NO: 19788 - DNA, 20 bp, Artificial Sequence
  sgRNA
  Evi2b_2
ctatactcatgattatactg

SEQ ID NO: 19789 - DNA, 20 bp, Artificial Sequence
  sgRNA
  Evi2b_3
ggataacatcagagagagtg

SEQ ID NO: 19790 - DNA, 20 bp, Artificial Sequence
  sgRNA
  Evi2b_4
gaattataggtagaaggtga

SEQ ID NO: 19791 - DNA, 20 bp, Artificial Sequence
  sgRNA
  Evi2b_5
tcagttgtaacatataacga

SEQ ID NO: 19792 - DNA, 20 bp, Artificial Sequence
  sgRNA
  Evi2b_6
ggcacattaaatgagtcagg

SEQ ID NO: 19793 - DNA, 20 bp, Artificial Sequence
  sgRNA
  Evi2b_7
aatccccaaccatctccaga

SEQ ID NO: 19794 - DNA, 20 bp, Artificial Sequence
  sgRNA
  Evi2b_8
ggtggttctgaagtgagtgg

SEQ ID NO: 19795 - DNA, 20 bp, Artificial Sequence
  sgRNA
  Evi2b_9
atatggcagcaattgcattg

SEQ ID NO: 19796 - DNA, 20 bp, Artificial Sequence
  sgRNA
  Evi2b_10
caatcaagagtcggcccacg

SEQ ID NO: 19797 - DNA, 20 bp, Artificial Sequence
  sgRNA
  Evi2b_11
gcagttcctttgccacttgg

SEQ ID NO: 19798 - DNA, 20 bp, Artificial Sequence
  sgRNA
  Evi2b_12
ataaaatctcctgctgacag

SEQ ID NO: 19799 - DNA, 20 bp, Artificial Sequence
  sgRNA
  Evi2b_13
tttaatgtgcctctgtcagc

SEQ ID NO: 19800 - DNA, 20 bp, Artificial Sequence
  sgRNA
  Evi2b_14
cttggtggttctgaagtgag

SEQ ID NO: 19801 - DNA, 20 bp, Artificial Sequence
  sgRNA
  Evi2b_15
tcagaaccaccaagtggcaa

SEQ ID NO: 19802 - DNA, 20 bp, Artificial Sequence
  sgRNA
  Evi2b_16
tcatccaaatcaagaagggg

SEQ ID NO: 19803 - DNA, 20 bp, Artificial Sequence
  sgRNA
  Evi2b_17
ggtaggtctccatttgctga

SEQ ID NO: 19804 - DNA, 20 bp, Artificial Sequence
  sgRNA
  Evi2b_18
agtgctgatgggtcaacagt

SEQ ID NO: 19805 - DNA, 20 bp, Artificial Sequence
  sgRNA
  Evi2b_19
ttctcatccaaatcaagaag

SEQ ID NO: 19806 - DNA, 20 bp, Artificial Sequence
  sgRNA
  Evi2b_20
ttatgagtagactctacttc

SEQ ID NO: 19807 - DNA, 20 bp, Artificial Sequence
  sgRNA
  F11r_1
aggtggccagaactacgggg

SEQ ID NO: 19808 - DNA, 20 bp, Artificial Sequence
  sgRNA
  F11r_2
gtggagtggaagttcgtcca

SEQ ID NO: 19809 - DNA, 20 bp, Artificial Sequence
  sgRNA
  F11r_3
ttgaaccaggaatattcaga

SEQ ID NO: 19810 - DNA, 20 bp, Artificial Sequence
  sgRNA
  F11r_4
cactattgatccaaagtcgg

SEQ ID NO: 19811 - DNA, 20 bp, Artificial Sequence
  sgRNA
  F11r_5
ggacgaacttccactccact

SEQ ID NO: 19812 - DNA, 20 bp, Artificial Sequence
  sgRNA
  F11r_6
tggcttctcctctccccgag

SEQ ID NO: 19813 - DNA, 20 bp, Artificial Sequence
  sgRNA
  F11r_7
gttcagttctgtgacccgga

SEQ ID NO: 19814 - DNA, 20 bp, Artificial Sequence
  sgRNA
  F11r_8
gtatacttgcatggtctccg

SEQ ID NO: 19815 - DNA, 20 bp, Artificial Sequence
  sgRNA
  F11r_9
tttcctcccggctttcccct

SEQ ID NO: 19816 - DNA, 20 bp, Artificial Sequence
  sgRNA
  F11r_10
gtagtattcaccactatcaa

SEQ ID NO: 19817 - DNA, 20 bp, Artificial Sequence
  sgRNA
  F11r_11
ggctctttggtacaaggcaa

SEQ ID NO: 19818 - DNA, 20 bp, Artificial Sequence
  sgRNA
  F11r_12
ggaaggtggccagaactacg

SEQ ID NO: 19819 - DNA, 20 bp, Artificial Sequence
  sgRNA
  F11r_13
tcactattgatccaaagtcg

SEQ ID NO: 19820 - DNA, 20 bp, Artificial Sequence
  sgRNA
  F11r_14
acgaacttccactccactcg

SEQ ID NO: 19821 - DNA, 20 bp, Artificial Sequence
  sgRNA
  F11r_15
tagtggtgaatactactgcc

SEQ ID NO: 19822 - DNA, 20 bp, Artificial Sequence
  sgRNA
  F11r_16
cctcacttcgagtactgggc

SEQ ID NO: 19823 - DNA, 20 bp, Artificial Sequence
  sgRNA
  F11r_17
gtaggtgcaggtcaatttga

SEQ ID NO: 19824 - DNA, 20 bp, Artificial Sequence
  sgRNA
  F11r_18
ggatatcccgtccttgaacc

SEQ ID NO: 19825 - DNA, 20 bp, Artificial Sequence
  sgRNA
  F11r_19
ctgtaaatgaccttcttacc

SEQ ID NO: 19826 - DNA, 20 bp, Artificial Sequence
  sgRNA
  F11r_20
cactatcaaaggctgtcacg

SEQ ID NO: 19827 - DNA, 20 bp, Artificial Sequence
  sgRNA
  F2r_1
gttcccgtaaaacgctgcgg

SEQ ID NO: 19828 - DNA, 20 bp, Artificial Sequence
  sgRNA
  F2r_2
gattccttagaaagaatgag

SEQ ID NO: 19829 - DNA, 20 bp, Artificial Sequence
  sgRNA
  F2r_3
ggttctcactgaggacgtcg

SEQ ID NO: 19830 - DNA, 20 bp, Artificial Sequence
  sgRNA
  F2r_4
agtagtagctgatcttgaag

SEQ ID NO: 19831 - DNA, 20 bp, Artificial Sequence
  sgRNA
  F2r_5
gcgacgatcagcaagcgccg

SEQ ID NO: 19832 - DNA, 20 bp, Artificial Sequence
  sgRNA
  F2r_6
gcgatggccaggacgttcag

SEQ ID NO: 19833 - DNA, 20 bp, Artificial Sequence
  sgRNA
  F2r_7
ggatcggatacaccaccgcc

SEQ ID NO: 19834 - DNA, 20 bp, Artificial Sequence
  sgRNA
  F2r_8
gcatgaagagcgtcagccag

SEQ ID NO: 19835 - DNA, 20 bp, Artificial Sequence
  sgRNA
  F2r_9
gctcctccgcggttgccaac

SEQ ID NO: 19836 - DNA, 20 bp, Artificial Sequence
  sgRNA
  F2r_10
cttgctccggttggcaaccg

SEQ ID NO: 19837 - DNA, 20 bp, Artificial Sequence
  sgRNA
  F2r_11
ggggctggtcagatatccgg

SEQ ID NO: 19838 - DNA, 20 bp, Artificial Sequence
  sgRNA
  F2r_12
agactgccctaccctccagc

SEQ ID NO: 19839 - DNA, 20 bp, Artificial Sequence
  sgRNA
  F2r_13
tgtgccgttgatcgtttcca

SEQ ID NO: 19840 - DNA, 20 bp, Artificial Sequence
  sgRNA
  F2r_14
gaggcgtcctcggagatgaa

SEQ ID NO: 19841 - DNA, 20 bp, Artificial Sequence
  sgRNA
  F2r_15
gcgtcctcggagatgaaggg

SEQ ID NO: 19842 - DNA, 20 bp, Artificial Sequence
  sgRNA
  F2r_16
cagaccgtggaaacgatcaa

SEQ ID NO: 19843 - DNA, 20 bp, Artificial Sequence
  sgRNA
  F2r_17
actacttctccggcactgat

SEQ ID NO: 19844 - DNA, 20 bp, Artificial Sequence
  sgRNA
  F2r_18
aatgaaagcgtcctgctgga

SEQ ID NO: 19845 - DNA, 20 bp, Artificial Sequence
  sgRNA
  F2r_19
aacacaatcgtgtacacgga

SEQ ID NO: 19846 - DNA, 20 bp, Artificial Sequence
  sgRNA
  F2r_20
tgacggtcataagcattgac

SEQ ID NO: 19847 - DNA, 20 bp, Artificial Sequence
  sgRNA
  F2rl1_1
tggcaacaactgggtctacg

SEQ ID NO: 19848 - DNA, 20 bp, Artificial Sequence
  sgRNA
  F2rl1_2
tggccatgtaaatcacggcg

SEQ ID NO: 19849 - DNA, 20 bp, Artificial Sequence
  sgRNA
  F2rl1_3
tgggtgatcgtgaaccccat

SEQ ID NO: 19850 - DNA, 20 bp, Artificial Sequence
  sgRNA
  F2rl1_4
cttcatgacatacaaaggga

SEQ ID NO: 19851 - DNA, 20 bp, Artificial Sequence
  sgRNA
  F2rl1_5
gttggccatgtaaatcacgg

SEQ ID NO: 19852 - DNA, 20 bp, Artificial Sequence
  sgRNA
  F2rl1_6
tctgcttcatgacatacaaa

SEQ ID NO: 19853 - DNA, 20 bp, Artificial Sequence
  sgRNA
  F2rl1_7
gttcatccatagcagaagag

SEQ ID NO: 19854 - DNA, 20 bp, Artificial Sequence
  sgRNA
  F2rl1_8
gattgccaaggagacgccaa

SEQ ID NO: 19855 - DNA, 20 bp, Artificial Sequence
  sgRNA
  F2rl1_9
ggacgcagagaactcatcga

SEQ ID NO: 19856 - DNA, 20 bp, Artificial Sequence
  sgRNA
  F2rl1_10
ggtccggctgcaggagaccg

SEQ ID NO: 19857 - DNA, 20 bp, Artificial Sequence
  sgRNA
  F2rl1_11
gccaatgagcaccttgcaca

SEQ ID NO: 19858 - DNA, 20 bp, Artificial Sequence
  sgRNA
  F2rl1_12
cgtcttgatcatgagcacgt

SEQ ID NO: 19859 - DNA, 20 bp, Artificial Sequence
  sgRNA
  F2rl1_13
ggagaccgaggccgccagaa

SEQ ID NO: 19860 - DNA, 20 bp, Artificial Sequence
  sgRNA
  F2rl1_14
gatgaagtacatggccagca

SEQ ID NO: 19861 - DNA, 20 bp, Artificial Sequence
  sgRNA
  F2rl1_15
atttcctaatcaaaacccag

SEQ ID NO: 19862 - DNA, 20 bp, Artificial Sequence
  sgRNA
  F2rl1_16
tcggaaaaggaagatccaga

SEQ ID NO: 19863 - DNA, 20 bp, Artificial Sequence
  sgRNA
  F2rl1_17
tttgcatgcgattcacagtg

SEQ ID NO: 19864 - DNA, 20 bp, Artificial Sequence
  sgRNA
  F2rl1_18
aataatgcactacgagcaga

SEQ ID NO: 19865 - DNA, 20 bp, Artificial Sequence
  sgRNA
  F2rl1_19
gtacctctgcacgctgaggc

SEQ ID NO: 19866 - DNA, 20 bp, Artificial Sequence
  sgRNA
  F2rl1_20
gagacaaagtaatagacaaa

SEQ ID NO: 19867 - DNA, 20 bp, Artificial Sequence
  sgRNA
  F2rl2_1
ccttaaggagagtttccaca

SEQ ID NO: 19868 - DNA, 20 bp, Artificial Sequence
  sgRNA
  F2rl2_2
tatttggcgaggtcacgtgc

SEQ ID NO: 19869 - DNA, 20 bp, Artificial Sequence
  sgRNA
  F2rl2_3
cacgtgaataatgctaccat

SEQ ID NO: 19870 - DNA, 20 bp, Artificial Sequence
  sgRNA
  F2rl2_4
agccctctatgtcagaaagt

SEQ ID NO: 19871 - DNA, 20 bp, Artificial Sequence
  sgRNA
  F2rl2_5
gttgccgtagaaaacaaccg

SEQ ID NO: 19872 - DNA, 20 bp, Artificial Sequence
  sgRNA
  F2rl2_6
ggtcacgtgccggatcacca

SEQ ID NO: 19873 - DNA, 20 bp, Artificial Sequence
  sgRNA
  F2rl2_7
gacgaagtagtagaatcgga

SEQ ID NO: 19874 - DNA, 20 bp, Artificial Sequence
  sgRNA
  F2rl2_8
aagatcgcctaccatctcaa

SEQ ID NO: 19875 - DNA, 20 bp, Artificial Sequence
  sgRNA
  F2rl2_9
ggaacttctcaggtatccta

SEQ ID NO: 19876 - DNA, 20 bp, Artificial Sequence
  sgRNA
  F2rl2_10
tataaaagcggagtgtcccg

SEQ ID NO: 19877 - DNA, 20 bp, Artificial Sequence
  sgRNA
  F2rl2_11
tggtgatctcggagtggacg

SEQ ID NO: 19878 - DNA, 20 bp, Artificial Sequence
  sgRNA
  F2rl2_12
agccaccacaactataaaag

SEQ ID NO: 19879 - DNA, 20 bp, Artificial Sequence
  sgRNA
  F2rl2_13
catcaaccgctacctggcca

SEQ ID NO: 19880 - DNA, 20 bp, Artificial Sequence
  sgRNA
  F2rl2_14
gatatggctgggctacatca

SEQ ID NO: 19881 - DNA, 20 bp, Artificial Sequence
  sgRNA
  F2rl2_15
gtacaccaaccacaaacagc

SEQ ID NO: 19882 - DNA, 20 bp, Artificial Sequence
  sgRNA
  F2rl2_16
aggagacgaagtagtagaat

SEQ ID NO: 19883 - DNA, 20 bp, Artificial Sequence
  sgRNA
  F2rl2_17
caacaactgggtatttggcg

SEQ ID NO: 19884 - DNA, 20 bp, Artificial Sequence
  sgRNA
  F2rl2_18
acagaaaaggagatctgcga

SEQ ID NO: 19885 - DNA, 20 bp, Artificial Sequence
  sgRNA
  F2rl2_19
cgcacgcgtcaacgacatcg

SEQ ID NO: 19886 - DNA, 20 bp, Artificial Sequence
  sgRNA
  F2rl2_20
tccttatcttggttgcagct

SEQ ID NO: 19887 - DNA, 20 bp, Artificial Sequence
  sgRNA
  F2rl3_1
tcagacaagcctaatccacg

SEQ ID NO: 19888 - DNA, 20 bp, Artificial Sequence
  sgRNA
  F2rl3_2
gcaacactgaaccatacatg

SEQ ID NO: 19889 - DNA, 20 bp, Artificial Sequence
  sgRNA
  F2rl3_3
gggcaggtaccagcctcgtg

SEQ ID NO: 19890 - DNA, 20 bp, Artificial Sequence
  sgRNA
  F2rl3_4
agaatggtggatggcaggcg

SEQ ID NO: 19891 - DNA, 20 bp, Artificial Sequence
  sgRNA
  F2rl3_5
gatgatgtagagagtaccag

SEQ ID NO: 19892 - DNA, 20 bp, Artificial Sequence
  sgRNA
  F2rl3_6
cgactggcttaccacttgcg

SEQ ID NO: 19893 - DNA, 20 bp, Artificial Sequence
  sgRNA
  F2rl3_7
atcatgacacagcatgcgat

SEQ ID NO: 19894 - DNA, 20 bp, Artificial Sequence
  sgRNA
  F2rl3_8
agcaccaaaggatacagcag

SEQ ID NO: 19895 - DNA, 20 bp, Artificial Sequence
  sgRNA
  F2rl3_9
cgttggcacagaatttgccc

SEQ ID NO: 19896 - DNA, 20 bp, Artificial Sequence
  sgRNA
  F2rl3_10
agttctactgtgggacccag

SEQ ID NO: 19897 - DNA, 20 bp, Artificial Sequence
  sgRNA
  F2rl3_11
tctgctcatgaacctggcag

SEQ ID NO: 19898 - DNA, 20 bp, Artificial Sequence
  sgRNA
  F2rl3_12
tcgttggcacagaatttgcc

SEQ ID NO: 19899 - DNA, 20 bp, Artificial Sequence
  sgRNA
  F2rl3_13
gtatggttcagtgttgctgc

SEQ ID NO: 19900 - DNA, 20 bp, Artificial Sequence
  sgRNA
  F2rl3_14
aatttgcccgggtagcctcg

SEQ ID NO: 19901 - DNA, 20 bp, Artificial Sequence
  sgRNA
  F2rl3_15
tggtgaggctgcctgccggg

SEQ ID NO: 19902 - DNA, 20 bp, Artificial Sequence
  sgRNA
  F2rl3_16
cattggccgccagtgcacga

SEQ ID NO: 19903 - DNA, 20 bp, Artificial Sequence
  sgRNA
  F2rl3_17
atcggagccagctaatcgga

SEQ ID NO: 19904 - DNA, 20 bp, Artificial Sequence
  sgRNA
  F2rl3_18
tgactgagcagacctcccac

SEQ ID NO: 19905 - DNA, 20 bp, Artificial Sequence
  sgRNA
  F2rl3_19
ccttgcctctcactctgcat

SEQ ID NO: 19906 - DNA, 20 bp, Artificial Sequence
  sgRNA
  F2rl3_20
ctgtggggctgcctgccaat

SEQ ID NO: 19907 - DNA, 20 bp, Artificial Sequence
  sgRNA
  F3_1
gaggtcgcactcggtgtctg

SEQ ID NO: 19908 - DNA, 20 bp, Artificial Sequence
  sgRNA
  F3_2
agatggtagaaaactgaacg

SEQ ID NO: 19909 - DNA, 20 bp, Artificial Sequence
  sgRNA
  F3_3
catgaactgagttcctccgt

SEQ ID NO: 19910 - DNA, 20 bp, Artificial Sequence
  sgRNA
  F3_4
tcggtaaggtaaaaactttg

SEQ ID NO: 19911 - DNA, 20 bp, Artificial Sequence
  sgRNA
  F3_5
cctctatgccaagcgcgacg

SEQ ID NO: 19912 - DNA, 20 bp, Artificial Sequence
  sgRNA
  F3_6
gtacagtgtgcaccgagcaa

SEQ ID NO: 19913 - DNA, 20 bp, Artificial Sequence
  sgRNA
  F3_7
cttgccaaagacttgccgca

SEQ ID NO: 19914 - DNA, 20 bp, Artificial Sequence
  sgRNA
  F3_8
cctcacagacgagatcgtga

SEQ ID NO: 19915 - DNA, 20 bp, Artificial Sequence
  sgRNA
  F3_9
cctccccatgaatcacaagt

SEQ ID NO: 19916 - DNA, 20 bp, Artificial Sequence
  sgRNA
  F3_10
tttggggcgtttgtaaatgg

SEQ ID NO: 19917 - DNA, 20 bp, Artificial Sequence
  sgRNA
  F3_11
gctgaattactggctgtcca

SEQ ID NO: 19918 - DNA, 20 bp, Artificial Sequence
  sgRNA
  F3_12
gctggagtaacaggccatga

SEQ ID NO: 19919 - DNA, 20 bp, Artificial Sequence
  sgRNA
  F3_13
cctcctcctccaggtgaccg

SEQ ID NO: 19920 - DNA, 20 bp, Artificial Sequence
  sgRNA
  F3_14
gcaggcagtgtgagcgttag

SEQ ID NO: 19921 - DNA, 20 bp, Artificial Sequence
  sgRNA
  F3_15
gcttgcacagagatatggac

SEQ ID NO: 19922 - DNA, 20 bp, Artificial Sequence
  sgRNA
  F3_16
tcttccctttctgtcccgct

SEQ ID NO: 19923 - DNA, 20 bp, Artificial Sequence
  sgRNA
  F3_17
aggaggcagccgagaaacgt

SEQ ID NO: 19924 - DNA, 20 bp, Artificial Sequence
  sgRNA
  F3_18
tgggcgcgagagccgctagg

SEQ ID NO: 19925 - DNA, 20 bp, Artificial Sequence
  sgRNA
  F3_19
ttatcggaaaggctcaagca

SEQ ID NO: 19926 - DNA, 20 bp, Artificial Sequence
  sgRNA
  F3_20
gaactgtgcaacatggagcg

SEQ ID NO: 19927 - DNA, 20 bp, Artificial Sequence
  sgRNA
  Faim2_1
agacttactggggtccacgt

SEQ ID NO: 19928 - DNA, 20 bp, Artificial Sequence
  sgRNA
  Faim2_2
acctggacagcatcccagtg

SEQ ID NO: 19929 - DNA, 20 bp, Artificial Sequence
  sgRNA
  Faim2_3
gactatgtccaggctaaccc

SEQ ID NO: 19930 - DNA, 20 bp, Artificial Sequence
  sgRNA
  Faim2_4
tcagcagaatcaggttccaa

SEQ ID NO: 19931 - DNA, 20 bp, Artificial Sequence
  sgRNA
  Faim2_5
tcgacactcgctgagccccg

SEQ ID NO: 19932 - DNA, 20 bp, Artificial Sequence
  sgRNA
  Faim2_6
aatgctcgtgatgtcctgcg

SEQ ID NO: 19933 - DNA, 20 bp, Artificial Sequence
  sgRNA
  Faim2_7
ccagtacagcatagaccgcg

SEQ ID NO: 19934 - DNA, 20 bp, Artificial Sequence
  sgRNA
  Faim2_8
gggatgaccagaaagttcgt

SEQ ID NO: 19935 - DNA, 20 bp, Artificial Sequence
  sgRNA
  Faim2_9
aggacgcccagtaccagccg

SEQ ID NO: 19936 - DNA, 20 bp, Artificial Sequence
  sgRNA
  Faim2_10
aactgaagatggtgaccgag

SEQ ID NO: 19937 - DNA, 20 bp, Artificial Sequence
  sgRNA
  Faim2_11
gcatttcaccaccttcagct

SEQ ID NO: 19938 - DNA, 20 bp, Artificial Sequence
  sgRNA
  Faim2_12
agtgaggtaggccatggaca

SEQ ID NO: 19939 - DNA, 20 bp, Artificial Sequence
  sgRNA
  Faim2_13
tcgtcggctcttcatcagaa

SEQ ID NO: 19940 - DNA, 20 bp, Artificial Sequence
  sgRNA
  Faim2_14
gcacagctgttgggccctgg

SEQ ID NO: 19941 - DNA, 20 bp, Artificial Sequence
  sgRNA
  Faim2_15
acaaggcccccgggactgag

SEQ ID NO: 19942 - DNA, 20 bp, Artificial Sequence
  sgRNA
  Faim2_16
ggttggtgccaaaaagctgc

SEQ ID NO: 19943 - DNA, 20 bp, Artificial Sequence
  sgRNA
  Faim2_17
cagcagctggaccaatagga

SEQ ID NO: 19944 - DNA, 20 bp, Artificial Sequence
  sgRNA
  Faim2_18
gaggtggcctcctcatagga

SEQ ID NO: 19945 - DNA, 20 bp, Artificial Sequence
  sgRNA
  Faim2_19
gctgctggtgaccttggctg

SEQ ID NO: 19946 - DNA, 20 bp, Artificial Sequence
  sgRNA
  Faim2_20
gcatagaccgcgtggagcca

SEQ ID NO: 19947 - DNA, 20 bp, Artificial Sequence
  sgRNA
  Fam171a1_1
acaagaatttagctcccggg

SEQ ID NO: 19948 - DNA, 20 bp, Artificial Sequence
  sgRNA
  Fam171a1_2
ggacattaccacgtatcaca

SEQ ID NO: 19949 - DNA, 20 bp, Artificial Sequence
  sgRNA
  Fam171a1_3
cggggcagagtttggcacgt

SEQ ID NO: 19950 - DNA, 20 bp, Artificial Sequence
  sgRNA
  Fam171a1_4
atgcctatgtcgcagcatgg

SEQ ID NO: 19951 - DNA, 20 bp, Artificial Sequence
  sgRNA
  Fam171a1_5
gggagacaaaccatgcccga

SEQ ID NO: 19952 - DNA, 20 bp, Artificial Sequence
  sgRNA
  Fam171a1_6
catccaatcctcgcaagtaa

SEQ ID NO: 19953 - DNA, 20 bp, Artificial Sequence
  sgRNA
  Fam171a1_7
cctggcaatgatgactacag

SEQ ID NO: 19954 - DNA, 20 bp, Artificial Sequence
  sgRNA
  Fam171a1_8
gctcggctgccacgtttgga

SEQ ID NO: 19955 - DNA, 20 bp, Artificial Sequence
  sgRNA
  Fam171a1_9
gctgctgtcccacaaagaag

SEQ ID NO: 19956 - DNA, 20 bp, Artificial Sequence
  sgRNA
  Fam171a1_10
tttgataacttaacgccaag

SEQ ID NO: 19957 - DNA, 20 bp, Artificial Sequence
  sgRNA
  Fam171a1_11
tttggctcaaatgaacagcg

SEQ ID NO: 19958 - DNA, 20 bp, Artificial Sequence
  sgRNA
  Fam171a1_12
agggagacaaaccatgcccg

SEQ ID NO: 19959 - DNA, 20 bp, Artificial Sequence
  sgRNA
  Fam171a1_13
agccacggtctgcacccccg

SEQ ID NO: 19960 - DNA, 20 bp, Artificial Sequence
  sgRNA
  Fam171a1_14
gctgcacactcactgccgct

SEQ ID NO: 19961 - DNA, 20 bp, Artificial Sequence
  sgRNA
  Fam171a1_15
gggaacgtctgaagttcgtt

SEQ ID NO: 19962 - DNA, 20 bp, Artificial Sequence
  sgRNA
  Fam171a1_16
tcaatgagcgcatctgcgat

SEQ ID NO: 19963 - DNA, 20 bp, Artificial Sequence
  sgRNA
  Fam171a1_17
gaggctggctcacatacgag

SEQ ID NO: 19964 - DNA, 20 bp, Artificial Sequence
  sgRNA
  Fam171a1_18
acgtgccaaactctgccccg

SEQ ID NO: 19965 - DNA, 20 bp, Artificial Sequence
  sgRNA
  Fam171a1_19
aggaaggcagtcagctcacg

SEQ ID NO: 19966 - DNA, 20 bp, Artificial Sequence
  sgRNA
  Fam171a1_20
ataagccgaagagtcaccag

SEQ ID NO: 19967 - DNA, 20 bp, Artificial Sequence
  sgRNA
  Fam171a2_1
cccgagacttagcatcctcg

SEQ ID NO: 19968 - DNA, 20 bp, Artificial Sequence
  sgRNA
  Fam171a2_2
gtggcccagataatggtcga

SEQ ID NO: 19969 - DNA, 20 bp, Artificial Sequence
  sgRNA
  Fam171a2_3
ggtacccaggcggtaactga

SEQ ID NO: 19970 - DNA, 20 bp, Artificial Sequence
  sgRNA
  Fam171a2_4
ctgtgggtacgaaatggcac

SEQ ID NO: 19971 - DNA, 20 bp, Artificial Sequence
  sgRNA
  Fam171a2_5
gctttgggcttcgctcacac

SEQ ID NO: 19972 - DNA, 20 bp, Artificial Sequence
  sgRNA
  Fam171a2_6
acggaagaagtcatcccgcg

SEQ ID NO: 19973 - DNA, 20 bp, Artificial Sequence
  sgRNA
  Fam171a2_7
cgattcgctcaccagcccgg

SEQ ID NO: 19974 - DNA, 20 bp, Artificial Sequence
  sgRNA
  Fam171a2_8
tgaattggaacgtccgtcca

SEQ ID NO: 19975 - DNA, 20 bp, Artificial Sequence
  sgRNA
  Fam171a2_9
agggatacgaaccaggcgcg

SEQ ID NO: 19976 - DNA, 20 bp, Artificial Sequence
  sgRNA
  Fam171a2_10
agttgtcctccggcgagcag

SEQ ID NO: 19977 - DNA, 20 bp, Artificial Sequence
  sgRNA
  Fam171a2_11
taatggtcgaaggatggcgg

SEQ ID NO: 19978 - DNA, 20 bp, Artificial Sequence
  sgRNA
  Fam171a2_12
gatctcgtttgttgtccgag

SEQ ID NO: 19979 - DNA, 20 bp, Artificial Sequence
  sgRNA
  Fam171a2_13
gcagcagcgccagtgagctg

SEQ ID NO: 19980 - DNA, 20 bp, Artificial Sequence
  sgRNA
  Fam171a2_14
gcaccagcattccagcctgg

SEQ ID NO: 19981 - DNA, 20 bp, Artificial Sequence
  sgRNA
  Fam171a2_15
tcctacatcgacctgcaggc

SEQ ID NO: 19982 - DNA, 20 bp, Artificial Sequence
  sgRNA
  Fam171a2_16
gctacccagtaccctagctg

SEQ ID NO: 19983 - DNA, 20 bp, Artificial Sequence
  sgRNA
  Fam171a2_17
tacgtcgtcgggagaccccg

SEQ ID NO: 19984 - DNA, 20 bp, Artificial Sequence
  sgRNA
  Fam171a2_18
tcaacggtgcgggcaccagg

SEQ ID NO: 19985 - DNA, 20 bp, Artificial Sequence
  sgRNA
  Fam171a2_19
tcaactccatctcatctgcg

SEQ ID NO: 19986 - DNA, 20 bp, Artificial Sequence
  sgRNA
  Fam171a2_20
gctggtactacggactcaga

SEQ ID NO: 19987 - DNA, 20 bp, Artificial Sequence
  sgRNA
  Fam171b_1
gttccttacagccatattag

SEQ ID NO: 19988 - DNA, 20 bp, Artificial Sequence
  sgRNA
  Fam171b_2
ggaccgaagaggtctatggg

SEQ ID NO: 19989 - DNA, 20 bp, Artificial Sequence
  sgRNA
  Fam171b_3
aaaggaaaccacaaaaacgg

SEQ ID NO: 19990 - DNA, 20 bp, Artificial Sequence
  sgRNA
  Fam171b_4
ttcagcataaatacggacac

SEQ ID NO: 19991 - DNA, 20 bp, Artificial Sequence
  sgRNA
  Fam171b_5
tcttgagcgtcacctagcga

SEQ ID NO: 19992 - DNA, 20 bp, Artificial Sequence
  sgRNA
  Fam171b_6
ttgagcgtcacctagcgacg

SEQ ID NO: 19993 - DNA, 20 bp, Artificial Sequence
  sgRNA
  Fam171b_7
gcctcaatgcgggatcctcg

SEQ ID NO: 19994 - DNA, 20 bp, Artificial Sequence
  sgRNA
  Fam171b_8
gtagatgtgcatgagctgct

SEQ ID NO: 19995 - DNA, 20 bp, Artificial Sequence
  sgRNA
  Fam171b_9
tctgccactttaccaagaaa

SEQ ID NO: 19996 - DNA, 20 bp, Artificial Sequence
  sgRNA
  Fam171b_10
ttcctggagactcttccccg

SEQ ID NO: 19997 - DNA, 20 bp, Artificial Sequence
  sgRNA
  Fam171b_11
aaccaccgtctgctcccccg

SEQ ID NO: 19998 - DNA, 20 bp, Artificial Sequence
  sgRNA
  Fam171b_12
ccgctgtgctgctgaaggcg

SEQ ID NO: 19999 - DNA, 20 bp, Artificial Sequence
  sgRNA
  Fam171b_13
gagttcggctctagcggccg

SEQ ID NO: 20000 - DNA, 20 bp, Artificial Sequence
  sgRNA
  Fam171b_14
aggcaagcctccgcatccca

SEQ ID NO: 20001 - DNA, 20 bp, Artificial Sequence
  sgRNA
  Fam171b_15
ggacgatcgtcatcatcatt

SEQ ID NO: 20002 - DNA, 20 bp, Artificial Sequence
  sgRNA
  Fam171b_16
gttaacaaacacctccacaa

SEQ ID NO: 20003 - DNA, 20 bp, Artificial Sequence
  sgRNA
  Fam171b_17
taacatctggaagaagcgag

SEQ ID NO: 20004 - DNA, 20 bp, Artificial Sequence
  sgRNA
  Fam171b_18
attggtctatggccaattga

SEQ ID NO: 20005 - DNA, 20 bp, Artificial Sequence
  sgRNA
  Fam171b_19
acgtcttgacatctctgccg

SEQ ID NO: 20006 - DNA, 20 bp, Artificial Sequence
  sgRNA
  Fam171b_20
cattgaggcacatcttagaa

SEQ ID NO: 20007 - DNA, 20 bp, Artificial Sequence
  sgRNA
  Fam174a_1
cgccccggacccgctcagag

SEQ ID NO: 20008 - DNA, 20 bp, Artificial Sequence
  sgRNA
  Fam174a_2
ctgaggcggacggcctcgaa

SEQ ID NO: 20009 - DNA, 20 bp, Artificial Sequence
  sgRNA
  Fam174a_3
agtccaagtctcccaagccc

SEQ ID NO: 20010 - DNA, 20 bp, Artificial Sequence
  sgRNA
  Fam174a_4
gcgacaaacccatgacccag

SEQ ID NO: 20011 - DNA, 20 bp, Artificial Sequence
  sgRNA
  Fam174a_5
ccgcaatgacagcatccccg

SEQ ID NO: 20012 - DNA, 20 bp, Artificial Sequence
  sgRNA
  Fam174a_6
gggcagcaacaacaacacga

SEQ ID NO: 20013 - DNA, 20 bp, Artificial Sequence
  sgRNA
  Fam174a_7
ggaagcggcgacagcgtgtg

SEQ ID NO: 20014 - DNA, 20 bp, Artificial Sequence
  sgRNA
  Fam174a_8
acctccctgaccaccatcga

SEQ ID NO: 20015 - DNA, 20 bp, Artificial Sequence
  sgRNA
  Fam174a_9
gcgggccctgaccgtgttgg

SEQ ID NO: 20016 - DNA, 20 bp, Artificial Sequence
  sgRNA
  Fam174a_10
cacgaagtacaccagcaccg

SEQ ID NO: 20017 - DNA, 20 bp, Artificial Sequence
  sgRNA
  Fam174a_11
gacggcctcgaagggaaggc

SEQ ID NO: 20018 - DNA, 20 bp, Artificial Sequence
  sgRNA
  Fam174a_12
gccgcaatgacagcatcccc

SEQ ID NO: 20019 - DNA, 20 bp, Artificial Sequence
  sgRNA
  Fam174a_13
cgacaaacccatgacccagc

SEQ ID NO: 20020 - DNA, 20 bp, Artificial Sequence
  sgRNA
  Fam174a_14
acttcgtggtcaggaccgtc

SEQ ID NO: 20021 - DNA, 20 bp, Artificial Sequence
  sgRNA
  Fam174a_15
ggcgctcaccaccaccaaca

SEQ ID NO: 20022 - DNA, 20 bp, Artificial Sequence
  sgRNA
  Fam174a_16
atgacagcatccccggggcg

SEQ ID NO: 20023 - DNA, 20 bp, Artificial Sequence
  sgRNA
  Fam174a_17
ttgttgctgcccgctctgag

SEQ ID NO: 20024 - DNA, 20 bp, Artificial Sequence
  sgRNA
  Fam174a_18
ggtaccgtcgatggtggtca

SEQ ID NO: 20025 - DNA, 20 bp, Artificial Sequence
  sgRNA
  Fam174a_19
gttggtggtggtgagcgccg

SEQ ID NO: 20026 - DNA, 20 bp, Artificial Sequence
  sgRNA
  Fam174a_20
acgctgtcgccgcttcctcc

SEQ ID NO: 20027 - DNA, 20 bp, Artificial Sequence
  sgRNA
  Fam174b_1
atcaccgtcgccttcagggt

SEQ ID NO: 20028 - DNA, 20 bp, Artificial Sequence
  sgRNA
  Fam174b_2
caacagcagcgtcgacgcgg

SEQ ID NO: 20029 - DNA, 20 bp, Artificial Sequence
  sgRNA
  Fam174b_3
ccagctgggatccggcatgg

SEQ ID NO: 20030 - DNA, 20 bp, Artificial Sequence
  sgRNA
  Fam174b_4
cggactcggctctgcgagcg

SEQ ID NO: 20031 - DNA, 20 bp, Artificial Sequence
  sgRNA
  Fam174b_5
ccatttccacacgttccgca

SEQ ID NO: 20032 - DNA, 20 bp, Artificial Sequence
  sgRNA
  Fam174b_6
gtagcattcccgggaccggg

SEQ ID NO: 20033 - DNA, 20 bp, Artificial Sequence
  sgRNA
  Fam174b_7
catttccacacgttccgcag

SEQ ID NO: 20034 - DNA, 20 bp, Artificial Sequence
  sgRNA
  Fam174b_8
ggactcggctctgcgagcga

SEQ ID NO: 20035 - DNA, 20 bp, Artificial Sequence
  sgRNA
  Fam174b_9
tcgcagagccgagtccgctt

SEQ ID NO: 20036 - DNA, 20 bp, Artificial Sequence
  sgRNA
  Fam174b_10
cctgcctaccctgaaggcga

SEQ ID NO: 20037 - DNA, 20 bp, Artificial Sequence
  sgRNA
  Fam174b_11
gcagaacaccagcctccgcc

SEQ ID NO: 20038 - DNA, 20 bp, Artificial Sequence
  sgRNA
  Fam174b_12
atcgtcctcctcattcagtg

SEQ ID NO: 20039 - DNA, 20 bp, Artificial Sequence
  sgRNA
  Fam174b_13
ctccaacagcagcgtcgacg

SEQ ID NO: 20040 - DNA, 20 bp, Artificial Sequence
  sgRNA
  Fam174b_14
tcgtgacctgcctaccctga

SEQ ID NO: 20041 - DNA, 20 bp, Artificial Sequence
  sgRNA
  Fam174b_15
gctgctgcgcgtcttcaggt

SEQ ID NO: 20042 - DNA, 20 bp, Artificial Sequence
  sgRNA
  Fam174b_16
cctgaaggcgacggtgatcg

SEQ ID NO: 20043 - DNA, 20 bp, Artificial Sequence
  sgRNA
  Fam174b_17
aggcaggtcacgaagcagac

SEQ ID NO: 20044 - DNA, 20 bp, Artificial Sequence
  sgRNA
  Fam174b_18
gccatttccacacgttccgc

SEQ ID NO: 20045 - DNA, 20 bp, Artificial Sequence
  sgRNA
  Fam174b_19
tcatcgtcctcctcattcag

SEQ ID NO: 20046 - DNA, 20 bp, Artificial Sequence
  sgRNA
  Fam174b_20
aatggccccactgaatgagg

SEQ ID NO: 20047 - DNA, 20 bp, Artificial Sequence
  sgRNA
  Fam187b_1
caacggttacaatcttgcca

SEQ ID NO: 20048 - DNA, 20 bp, Artificial Sequence
  sgRNA
  Fam187b_2
aaagacaaagtacggctggt

SEQ ID NO: 20049 - DNA, 20 bp, Artificial Sequence
  sgRNA
  Fam187b_3
aaaaataccaaagtgctttg

SEQ ID NO: 20050 - DNA, 20 bp, Artificial Sequence
  sgRNA
  Fam187b_4
gacctgggccaagagcccat

SEQ ID NO: 20051 - DNA, 20 bp, Artificial Sequence
  sgRNA
  Fam187b_5
ggtaccctgtgacaccgcca

SEQ ID NO: 20052 - DNA, 20 bp, Artificial Sequence
  sgRNA
  Fam187b_6
tctaggctactgctatgtgg

SEQ ID NO: 20053 - DNA, 20 bp, Artificial Sequence
  sgRNA
  Fam187b_7
gtaactaccccaaagcactt

SEQ ID NO: 20054 - DNA, 20 bp, Artificial Sequence
  sgRNA
  Fam187b_8
catgccacgcatacaaacct

SEQ ID NO: 20055 - DNA, 20 bp, Artificial Sequence
  sgRNA
  Fam187b_9
gcactatctccgatacaaac

SEQ ID NO: 20056 - DNA, 20 bp, Artificial Sequence
  sgRNA
  Fam187b_10
gcattggtagaggcccgtgt

SEQ ID NO: 20057 - DNA, 20 bp, Artificial Sequence
  sgRNA
  Fam187b_11
tatgtgtcaaagacaaagta

SEQ ID NO: 20058 - DNA, 20 bp, Artificial Sequence
  sgRNA
  Fam187b_12
acttgtccaggcattggtag

SEQ ID NO: 20059 - DNA, 20 bp, Artificial Sequence
  sgRNA
  Fam187b_13
aataaggcctgagatgcagg

SEQ ID NO: 20060 - DNA, 20 bp, Artificial Sequence
  sgRNA
  Fam187b_14
ggataatcacaaggcccgtt

SEQ ID NO: 20061 - DNA, 20 bp, Artificial Sequence
  sgRNA
  Fam187b_15
ccttgtgattatccaggcag

SEQ ID NO: 20062 - DNA, 20 bp, Artificial Sequence
  sgRNA
  Fam187b_16
tgtcaaagacaaagtacggc

SEQ ID NO: 20063 - DNA, 20 bp, Artificial Sequence
  sgRNA
  Fam187b_17
tcaactccaagcctgatggg

SEQ ID NO: 20064 - DNA, 20 bp, Artificial Sequence
  sgRNA
  Fam187b_18
gctggtcctgccatgtcaga

SEQ ID NO: 20065 - DNA, 20 bp, Artificial Sequence
  sgRNA
  Fam187b_19
gtagatggatgcgaagggac

SEQ ID NO: 20066 - DNA, 20 bp, Artificial Sequence
  sgRNA
  Fam187b_20
ccccacaagtagagcccaca

SEQ ID NO: 20067 - DNA, 20 bp, Artificial Sequence
  sgRNA
  Fam189b_1
ctgatgggctagagcccccg

SEQ ID NO: 20068 - DNA, 20 bp, Artificial Sequence
  sgRNA
  Fam189b_2
gggcagtcagtaggatacaa

SEQ ID NO: 20069 - DNA, 20 bp, Artificial Sequence
  sgRNA
  Fam189b_3
gaagcggccattcactctag

SEQ ID NO: 20070 - DNA, 20 bp, Artificial Sequence
  sgRNA
  Fam189b_4
cacagcagacaatagcagag

SEQ ID NO: 20071 - DNA, 20 bp, Artificial Sequence
  sgRNA
  Fam189b_5
gcgagcacgtagcaacttgg

SEQ ID NO: 20072 - DNA, 20 bp, Artificial Sequence
  sgRNA
  Fam189b_6
gcggaagagcacataatcga

SEQ ID NO: 20073 - DNA, 20 bp, Artificial Sequence
  sgRNA
  Fam189b_7
ccacctgtgatgaagccaga

SEQ ID NO: 20074 - DNA, 20 bp, Artificial Sequence
  sgRNA
  Fam189b_8
aataggagcgggcagcccgt

SEQ ID NO: 20075 - DNA, 20 bp, Artificial Sequence
  sgRNA
  Fam189b_9
tgacggcctcgtaagaaggg

SEQ ID NO: 20076 - DNA, 20 bp, Artificial Sequence
  sgRNA
  Fam189b_10
tgactgccccccttcttacg

SEQ ID NO: 20077 - DNA, 20 bp, Artificial Sequence
  sgRNA
  Fam189b_11
tttgaccctcagcttcacga

SEQ ID NO: 20078 - DNA, 20 bp, Artificial Sequence
  sgRNA
  Fam189b_12
tcatgcctgctggaactcca

SEQ ID NO: 20079 - DNA, 20 bp, Artificial Sequence
  sgRNA
  Fam189b_13
ggcagacaagagtcgcctta

SEQ ID NO: 20080 - DNA, 20 bp, Artificial Sequence
  sgRNA
  Fam189b_14
aggcgaggatgtacacgcca

SEQ ID NO: 20081 - DNA, 20 bp, Artificial Sequence
  sgRNA
  Fam189b_15
ggacctcttgatgctctcgg

SEQ ID NO: 20082 - DNA, 20 bp, Artificial Sequence
  sgRNA
  Fam189b_16
ggaaacgagtgactaggccc

SEQ ID NO: 20083 - DNA, 20 bp, Artificial Sequence
  sgRNA
  Fam189b_17
ccaccaccgagagcatcaag

SEQ ID NO: 20084 - DNA, 20 bp, Artificial Sequence
  sgRNA
  Fam189b_18
gcctgagactgaccgttcag

SEQ ID NO: 20085 - DNA, 20 bp, Artificial Sequence
  sgRNA
  Fam189b_19
gcacaggctcagcttggcag

SEQ ID NO: 20086 - DNA, 20 bp, Artificial Sequence
  sgRNA
  Fam189b_20
catgacggcctcgtaagaag

SEQ ID NO: 20087 - DNA, 20 bp, Artificial Sequence
  sgRNA
  Fap_1
accacctaccctcaccacgt

SEQ ID NO: 20088 - DNA, 20 bp, Artificial Sequence
  sgRNA
  Fap_2
atgcactcgtctgctatggt

SEQ ID NO: 20089 - DNA, 20 bp, Artificial Sequence
  sgRNA
  Fap_3
aatgctattcaaattacaag

SEQ ID NO: 20090 - DNA, 20 bp, Artificial Sequence
  sgRNA
  Fap_4
catagatactgaattggacg

SEQ ID NO: 20091 - DNA, 20 bp, Artificial Sequence
  sgRNA
  Fap_5
gtaacacacttcttgctcgg

SEQ ID NO: 20092 - DNA, 20 bp, Artificial Sequence
  sgRNA
  Fap_6
tggtactctgaccagaacca

SEQ ID NO: 20093 - DNA, 20 bp, Artificial Sequence
  sgRNA
  Fap_7
atagatactgaattggacga

SEQ ID NO: 20094 - DNA, 20 bp, Artificial Sequence
  sgRNA
  Fap_8
agtgccccgaccatctacca

SEQ ID NO: 20095 - DNA, 20 bp, Artificial Sequence
  sgRNA
  Fap_9
acagtgaatcctgtgttacg

SEQ ID NO: 20096 - DNA, 20 bp, Artificial Sequence
  sgRNA
  Fap_10
gattgtcgtcctttgttggg

SEQ ID NO: 20097 - DNA, 20 bp, Artificial Sequence
  sgRNA
  Fap_11
gcatgccgtgtatcgaaaac

SEQ ID NO: 20098 - DNA, 20 bp, Artificial Sequence
  sgRNA
  Fap_12
agcgcccagatgatatacca

SEQ ID NO: 20099 - DNA, 20 bp, Artificial Sequence
  sgRNA
  Fap_13
caccacctaccctcaccacg

SEQ ID NO: 20100 - DNA, 20 bp, Artificial Sequence
  sgRNA
  Fap_14
gtgaacgagtatgcttgcag

SEQ ID NO: 20101 - DNA, 20 bp, Artificial Sequence
  sgRNA
  Fap_15
tcattgccctggtagatggt

SEQ ID NO: 20102 - DNA, 20 bp, Artificial Sequence
  sgRNA
  Fap_16
catacacttgaattagcaaa

SEQ ID NO: 20103 - DNA, 20 bp, Artificial Sequence
  sgRNA
  Fap_17
acttatctcgcaagtaagga

SEQ ID NO: 20104 - DNA, 20 bp, Artificial Sequence
  sgRNA
  Fap_18
aagaccagttccagatgcaa

SEQ ID NO: 20105 - DNA, 20 bp, Artificial Sequence
  sgRNA
  Fap_19
acaataaaaacacgaacaac

SEQ ID NO: 20106 - DNA, 20 bp, Artificial Sequence
  sgRNA
  Fap_20
tatctatgctggtcgcctgt

SEQ ID NO: 20107 - DNA, 20 bp, Artificial Sequence
  sgRNA
  Fas_1
cagttaagagttcatactca

SEQ ID NO: 20108 - DNA, 20 bp, Artificial Sequence
  sgRNA
  Fas_2
tatttatatatcgaaagtac

SEQ ID NO: 20109 - DNA, 20 bp, Artificial Sequence
  sgRNA
  Fas_3
catttgcatactcacacgac

SEQ ID NO: 20110 - DNA, 20 bp, Artificial Sequence
  sgRNA
  Fas_4
gaggactgcaaaatgaatgg

SEQ ID NO: 20111 - DNA, 20 bp, Artificial Sequence
  sgRNA
  Fas_5
ggttgctgtgcacggctcaa

SEQ ID NO: 20112 - DNA, 20 bp, Artificial Sequence
  sgRNA
  Fas_6
gcatatcaagatttaatcaa

SEQ ID NO: 20113 - DNA, 20 bp, Artificial Sequence
  sgRNA
  Fas_7
gtattgctggttgctgtgca

SEQ ID NO: 20114 - DNA, 20 bp, Artificial Sequence
  sgRNA
  Fas_8
tgtgctggtaccaatctcat

SEQ ID NO: 20115 - DNA, 20 bp, Artificial Sequence
  sgRNA
  Fas_9
ggaaaatcaaccccagacac

SEQ ID NO: 20116 - DNA, 20 bp, Artificial Sequence
  sgRNA
  Fas_10
ggagaatcgcagtagaagtc

SEQ ID NO: 20117 - DNA, 20 bp, Artificial Sequence
  sgRNA
  Fas_11
tctgtgcatggggcgcaggt

SEQ ID NO: 20118 - DNA, 20 bp, Artificial Sequence
  sgRNA
  Fas_12
tcgagaaaataacatcaagg

SEQ ID NO: 20119 - DNA, 20 bp, Artificial Sequence
  sgRNA
  Fas_13
tgaggactgcaaaatgaatg

SEQ ID NO: 20120 - DNA, 20 bp, Artificial Sequence
  sgRNA
  Fas_14
cctgcgccccatgcacagaa

SEQ ID NO: 20121 - DNA, 20 bp, Artificial Sequence
  sgRNA
  Fas_15
catcactcttcccatgagat

SEQ ID NO: 20122 - DNA, 20 bp, Artificial Sequence
  sgRNA
  Fas_16
tctccgagagtttaaagctg

SEQ ID NO: 20123 - DNA, 20 bp, Artificial Sequence
  sgRNA
  Fas_17
tcagaaggattatatcaagg

SEQ ID NO: 20124 - DNA, 20 bp, Artificial Sequence
  sgRNA
  Fas_18
atttcaggacatggtccaga

SEQ ID NO: 20125 - DNA, 20 bp, Artificial Sequence
  sgRNA
  Fas_19
gcacttggtattctgggtca

SEQ ID NO: 20126 - DNA, 20 bp, Artificial Sequence
  sgRNA
  Fas_20
acactctgcgatgaagagca

SEQ ID NO: 20127 - DNA, 20 bp, Artificial Sequence
  sgRNA
  Fasl_1
aggaccacaacacaaatctg

SEQ ID NO: 20128 - DNA, 20 bp, Artificial Sequence
  sgRNA
  Fasl_2
cttcactccagagatcagag

SEQ ID NO: 20129 - DNA, 20 bp, Artificial Sequence
  sgRNA
  Fasl_3
cctctgaaaaaaaagagccg

SEQ ID NO: 20130 - DNA, 20 bp, Artificial Sequence
  sgRNA
  Fasl_4
ggaactggcagaactccgtg

SEQ ID NO: 20131 - DNA, 20 bp, Artificial Sequence
  sgRNA
  Fasl_5
agaaccatgaaaaataccac

SEQ ID NO: 20132 - DNA, 20 bp, Artificial Sequence
  sgRNA
  Fasl_6
ctaggcccacaagatggaca

SEQ ID NO: 20133 - DNA, 20 bp, Artificial Sequence
  sgRNA
  Fasl_7
ggttgttgcaagactgaccc

SEQ ID NO: 20134 - DNA, 20 bp, Artificial Sequence
  sgRNA
  Fasl_8
ctgaccccggaagtatactt

SEQ ID NO: 20135 - DNA, 20 bp, Artificial Sequence
  sgRNA
  Fasl_9
gaggaactctaagtatcctg

SEQ ID NO: 20136 - DNA, 20 bp, Artificial Sequence
  sgRNA
  Fasl_10
ggcccacagcagctacctgg

SEQ ID NO: 20137 - DNA, 20 bp, Artificial Sequence
  sgRNA
  Fasl_11
tatgtgtcttcccattccag

SEQ ID NO: 20138 - DNA, 20 bp, Artificial Sequence
  sgRNA
  Fasl_12
gccttgtgatcaacgaaact

SEQ ID NO: 20139 - DNA, 20 bp, Artificial Sequence
  sgRNA
  Fasl_13
tgaggatctggtgctaatgg

SEQ ID NO: 20140 - DNA, 20 bp, Artificial Sequence
  sgRNA
  Fasl_14
ggagtgaagtataagaaagg

SEQ ID NO: 20141 - DNA, 20 bp, Artificial Sequence
  sgRNA
  Fasl_15
taagattgaatactgccccc

SEQ ID NO: 20142 - DNA, 20 bp, Artificial Sequence
  sgRNA
  Fasl_16
ctgtctacccagaagatctg

SEQ ID NO: 20143 - DNA, 20 bp, Artificial Sequence
  sgRNA
  Fasl_17
agagggatggaccttgagtg

SEQ ID NO: 20144 - DNA, 20 bp, Artificial Sequence
  sgRNA
  Fasl_18
cacaaatctgtggctaccgg

SEQ ID NO: 20145 - DNA, 20 bp, Artificial Sequence
  sgRNA
  Fasl_19
ggtagtggtgacacaggtgg

SEQ ID NO: 20146 - DNA, 20 bp, Artificial Sequence
  sgRNA
  Fasl_20
atgtgtcttcccattccaga

SEQ ID NO: 20147 - DNA, 20 bp, Artificial Sequence
  sgRNA
  Fat1_1
gtgcgcgcccatcataaccg

SEQ ID NO: 20148 - DNA, 20 bp, Artificial Sequence
  sgRNA
  Fat1_2
acgacctcggtataccccag

SEQ ID NO: 20149 - DNA, 20 bp, Artificial Sequence
  sgRNA
  Fat1_3
acggtcaaacggtatcccgg

SEQ ID NO: 20150 - DNA, 20 bp, Artificial Sequence
  sgRNA
  Fat1_4
tccgtcgctcgaatcaccag

SEQ ID NO: 20151 - DNA, 20 bp, Artificial Sequence
  sgRNA
  Fat1_5
gcgcgtacatgacaaccgcg

SEQ ID NO: 20152 - DNA, 20 bp, Artificial Sequence
  sgRNA
  Fat1_6
cctctaccgcgtcatagccg

SEQ ID NO: 20153 - DNA, 20 bp, Artificial Sequence
  sgRNA
  Fat1_7
tccgctggtgattcgagcga

SEQ ID NO: 20154 - DNA, 20 bp, Artificial Sequence
  sgRNA
  Fat1_8
ctatcggtgccgcagtcacg

SEQ ID NO: 20155 - DNA, 20 bp, Artificial Sequence
  sgRNA
  Fat1_9
gcagcacaggatcttcgtaa

SEQ ID NO: 20156 - DNA, 20 bp, Artificial Sequence
  sgRNA
  Fat1_10
gtttcgctcaaccaagtacg

SEQ ID NO: 20157 - DNA, 20 bp, Artificial Sequence
  sgRNA
  Fat1_11
gccgttatacatcaacctaa

SEQ ID NO: 20158 - DNA, 20 bp, Artificial Sequence
  sgRNA
  Fat1_12
ccacgagtattacctgaccg

SEQ ID NO: 20159 - DNA, 20 bp, Artificial Sequence
  sgRNA
  Fat1_13
gatgagcgactacgagagcg

SEQ ID NO: 20160 - DNA, 20 bp, Artificial Sequence
  sgRNA
  Fat1_14
gcacgggcatcgaaaagccg

SEQ ID NO: 20161 - DNA, 20 bp, Artificial Sequence
  sgRNA
  Fat1_15
cagccctctggggtataccg

SEQ ID NO: 20162 - DNA, 20 bp, Artificial Sequence
  sgRNA
  Fat1_16
ggccagtccgatgttccacg

SEQ ID NO: 20163 - DNA, 20 bp, Artificial Sequence
  sgRNA
  Fat1_17
ggtaaaggagaacctcccgg

SEQ ID NO: 20164 - DNA, 20 bp, Artificial Sequence
  sgRNA
  Fat1_18
gtaaaggagaacctcccggt

SEQ ID NO: 20165 - DNA, 20 bp, Artificial Sequence
  sgRNA
  Fat1_19
ggagctctcctacagcatcg

SEQ ID NO: 20166 - DNA, 20 bp, Artificial Sequence
  sgRNA
  Fat1_20
aggtctctgcaagaaagccg

SEQ ID NO: 20167 - DNA, 20 bp, Artificial Sequence
  sgRNA
  Fat2_1
ctactcagtagactcgaccg

SEQ ID NO: 20168 - DNA, 20 bp, Artificial Sequence
  sgRNA
  Fat2_2
gtgtccggctacacatcgag

SEQ ID NO: 20169 - DNA, 20 bp, Artificial Sequence
  sgRNA
  Fat2_3
tgaccctcaccaatgctacg

SEQ ID NO: 20170 - DNA, 20 bp, Artificial Sequence
  sgRNA
  Fat2_4
ctcaactaagacttccactg

SEQ ID NO: 20171 - DNA, 20 bp, Artificial Sequence
  sgRNA
  Fat2_5
ttaaacaagtatcggccacg

SEQ ID NO: 20172 - DNA, 20 bp, Artificial Sequence
  sgRNA
  Fat2_6
gccattatcgatttcccgac

SEQ ID NO: 20173 - DNA, 20 bp, Artificial Sequence
  sgRNA
  Fat2_7
aatgctacgcggcttccagg

SEQ ID NO: 20174 - DNA, 20 bp, Artificial Sequence
  sgRNA
  Fat2_8
tagtcttcagaagcaaaccg

SEQ ID NO: 20175 - DNA, 20 bp, Artificial Sequence
  sgRNA
  Fat2_9
ggtgaaggaccctcgctccg

SEQ ID NO: 20176 - DNA, 20 bp, Artificial Sequence
  sgRNA
  Fat2_10
agagctccagtacttcctac

SEQ ID NO: 20177 - DNA, 20 bp, Artificial Sequence
  sgRNA
  Fat2_11
catactctctgcatggaccg

SEQ ID NO: 20178 - DNA, 20 bp, Artificial Sequence
  sgRNA
  Fat2_12
gtaccgggacctcggagcga

SEQ ID NO: 20179 - DNA, 20 bp, Artificial Sequence
  sgRNA
  Fat2_13
ccatgactaacacttctacg

SEQ ID NO: 20180 - DNA, 20 bp, Artificial Sequence
  sgRNA
  Fat2_14
ggctccacataaattaccaa

SEQ ID NO: 20181 - DNA, 20 bp, Artificial Sequence
  sgRNA
  Fat2_15
cttcaatgatctcttccgca

SEQ ID NO: 20182 - DNA, 20 bp, Artificial Sequence
  sgRNA
  Fat2_16
cgagctcctcccaactacga

SEQ ID NO: 20183 - DNA, 20 bp, Artificial Sequence
  sgRNA
  Fat2_17
agtgggatggaggatggccg

SEQ ID NO: 20184 - DNA, 20 bp, Artificial Sequence
  sgRNA
  Fat2_18
ggggtggtgttcattaacat

SEQ ID NO: 20185 - DNA, 20 bp, Artificial Sequence
  sgRNA
  Fat2_19
gcaggtgtgctgcaaaccag

SEQ ID NO: 20186 - DNA, 20 bp, Artificial Sequence
  sgRNA
  Fat2_20
aagccgcgtagcattggtga

SEQ ID NO: 20187 - DNA, 20 bp, Artificial Sequence
  sgRNA
  Fat3_1
gtgacaatcagacctgaccg

SEQ ID NO: 20188 - DNA, 20 bp, Artificial Sequence
  sgRNA
  Fat3_2
caaagtaaccgagattgtag

SEQ ID NO: 20189 - DNA, 20 bp, Artificial Sequence
  sgRNA
  Fat3_3
acgagacaatcataatggag

SEQ ID NO: 20190 - DNA, 20 bp, Artificial Sequence
  sgRNA
  Fat3_4
acttctggtgtatcagattg

SEQ ID NO: 20191 - DNA, 20 bp, Artificial Sequence
  sgRNA
  Fat3_5
ggttattcacgtccgagcca

SEQ ID NO: 20192 - DNA, 20 bp, Artificial Sequence
  sgRNA
  Fat3_6
tgatgttaacgacaaccccc

SEQ ID NO: 20193 - DNA, 20 bp, Artificial Sequence
  sgRNA
  Fat3_7
tgagctgattaaaaaccggg

SEQ ID NO: 20194 - DNA, 20 bp, Artificial Sequence
  sgRNA
  Fat3_8
tttgctcatgaggtgtaccg

SEQ ID NO: 20195 - DNA, 20 bp, Artificial Sequence
  sgRNA
  Fat3_9
tagacatcttggctgaaccg

SEQ ID NO: 20196 - DNA, 20 bp, Artificial Sequence
  sgRNA
  Fat3_10
cgcacgttcctatagaaacg

SEQ ID NO: 20197 - DNA, 20 bp, Artificial Sequence
  sgRNA
  Fat3_11
gtatggggacccccaatcag

SEQ ID NO: 20198 - DNA, 20 bp, Artificial Sequence
  sgRNA
  Fat3_12
tgtctagccaccggaagcag

SEQ ID NO: 20199 - DNA, 20 bp, Artificial Sequence
  sgRNA
  Fat3_13
tttaagatcgaaccagtcct

SEQ ID NO: 20200 - DNA, 20 bp, Artificial Sequence
  sgRNA
  Fat3_14
gtactatttacaatatcgga

SEQ ID NO: 20201 - DNA, 20 bp, Artificial Sequence
  sgRNA
  Fat3_15
ggacacatcttcaaagcgga

SEQ ID NO: 20202 - DNA, 20 bp, Artificial Sequence
  sgRNA
  Fat3_16
ctggggacacatcttcaaag

SEQ ID NO: 20203 - DNA, 20 bp, Artificial Sequence
  sgRNA
  Fat3_17
cgttcacctcactttcatgg

SEQ ID NO: 20204 - DNA, 20 bp, Artificial Sequence
  sgRNA
  Fat3_18
cctcctttcccacatatgag

SEQ ID NO: 20205 - DNA, 20 bp, Artificial Sequence
  sgRNA
  Fat3_19
ataaaatgctgtattccaac

SEQ ID NO: 20206 - DNA, 20 bp, Artificial Sequence
  sgRNA
  Fat3_20
tttaaccatgacggtgacca

SEQ ID NO: 20207 - DNA, 20 bp, Artificial Sequence
  sgRNA
  Fat4_1
gacatcgtggacgatcgagg

SEQ ID NO: 20208 - DNA, 20 bp, Artificial Sequence
  sgRNA
  Fat4_2
cagttatctcatcactaccg

SEQ ID NO: 20209 - DNA, 20 bp, Artificial Sequence
  sgRNA
  Fat4_3
gggatgtcgaaagagtacac

SEQ ID NO: 20210 - DNA, 20 bp, Artificial Sequence
  sgRNA
  Fat4_4
attagatcctatgtccgcgt

SEQ ID NO: 20211 - DNA, 20 bp, Artificial Sequence
  sgRNA
  Fat4_5
ctcggtctcggataactccg

SEQ ID NO: 20212 - DNA, 20 bp, Artificial Sequence
  sgRNA
  Fat4_6
tgaaggtgaccacgatcgaa

SEQ ID NO: 20213 - DNA, 20 bp, Artificial Sequence
  sgRNA
  Fat4_7
tgtctgttggaaacaccggt

SEQ ID NO: 20214 - DNA, 20 bp, Artificial Sequence
  sgRNA
  Fat4_8
gtttgatcagatttcctacg

SEQ ID NO: 20215 - DNA, 20 bp, Artificial Sequence
  sgRNA
  Fat4_9
gccgatgtcagagtccgtgg

SEQ ID NO: 20216 - DNA, 20 bp, Artificial Sequence
  sgRNA
  Fat4_10
actagtgatgatctgtcccg

SEQ ID NO: 20217 - DNA, 20 bp, Artificial Sequence
  sgRNA
  Fat4_11
ggttgtgcttagaacgccag

SEQ ID NO: 20218 - DNA, 20 bp, Artificial Sequence
  sgRNA
  Fat4_12
atccaccgaagcatagcgcg

SEQ ID NO: 20219 - DNA, 20 bp, Artificial Sequence
  sgRNA
  Fat4_13
agatatcaatgacaacccac

SEQ ID NO: 20220 - DNA, 20 bp, Artificial Sequence
  sgRNA
  Fat4_14
cttgctgctcaaagaccgga

SEQ ID NO: 20221 - DNA, 20 bp, Artificial Sequence
  sgRNA
  Fat4_15
ccactcacgtagctccccgg

SEQ ID NO: 20222 - DNA, 20 bp, Artificial Sequence
  sgRNA
  Fat4_16
tgttaatcgcgaacagggcg

SEQ ID NO: 20223 - DNA, 20 bp, Artificial Sequence
  sgRNA
  Fat4_17
atcatccaacagatgccccg

SEQ ID NO: 20224 - DNA, 20 bp, Artificial Sequence
  sgRNA
  Fat4_18
ctgtacttaacagttccgtt

SEQ ID NO: 20225 - DNA, 20 bp, Artificial Sequence
  sgRNA
  Fat4_19
tatgggtgatgttggaaccg

SEQ ID NO: 20226 - DNA, 20 bp, Artificial Sequence
  sgRNA
  Fat4_20
gattctatgcaaccagtgca

SEQ ID NO: 20227 - DNA, 20 bp, Artificial Sequence
  sgRNA
  Fcamr_1
caggacccatctctacaatg

SEQ ID NO: 20228 - DNA, 20 bp, Artificial Sequence
  sgRNA
  Fcamr_2
gaggggtcatggatgaacct

SEQ ID NO: 20229 - DNA, 20 bp, Artificial Sequence
  sgRNA
  Fcamr_3
acagtgtgacagatccacaa

SEQ ID NO: 20230 - DNA, 20 bp, Artificial Sequence
  sgRNA
  Fcamr_4
ttcggtctcctatgccacag

SEQ ID NO: 20231 - DNA, 20 bp, Artificial Sequence
  sgRNA
  Fcamr_5
gtagctctacccgaaaggca

SEQ ID NO: 20232 - DNA, 20 bp, Artificial Sequence
  sgRNA
  Fcamr_6
agctggtgataactcctcca

SEQ ID NO: 20233 - DNA, 20 bp, Artificial Sequence
  sgRNA
  Fcamr_7
aagaaaatactggtgccgcc

SEQ ID NO: 20234 - DNA, 20 bp, Artificial Sequence
  sgRNA
  Fcamr_8
agcatgtccagcacaacaca

SEQ ID NO: 20235 - DNA, 20 bp, Artificial Sequence
  sgRNA
  Fcamr_9
tccacaatggagaccccagg

SEQ ID NO: 20236 - DNA, 20 bp, Artificial Sequence
  sgRNA
  Fcamr_10
ttgttcactgggcttagctg

SEQ ID NO: 20237 - DNA, 20 bp, Artificial Sequence
  sgRNA
  Fcamr_11
gctgggtagctctacccgaa

SEQ ID NO: 20238 - DNA, 20 bp, Artificial Sequence
  sgRNA
  Fcamr_12
ccttcactcgtggtaacact

SEQ ID NO: 20239 - DNA, 20 bp, Artificial Sequence
  sgRNA
  Fcamr_13
gtaaagtcccacgtcaccca

SEQ ID NO: 20240 - DNA, 20 bp, Artificial Sequence
  sgRNA
  Fcamr_14
acaaatgctgcactccctgg

SEQ ID NO: 20241 - DNA, 20 bp, Artificial Sequence
  sgRNA
  Fcamr_15
ccttgacagaaacccacaca

SEQ ID NO: 20242 - DNA, 20 bp, Artificial Sequence
  sgRNA
  Fcamr_16
gacctgcagccaaagacaag

SEQ ID NO: 20243 - DNA, 20 bp, Artificial Sequence
  sgRNA
  Fcamr_17
gtgttaccacgagtgaagga

SEQ ID NO: 20244 - DNA, 20 bp, Artificial Sequence
  sgRNA
  Fcamr_18
acactcaccctgactaccgt

SEQ ID NO: 20245 - DNA, 20 bp, Artificial Sequence
  sgRNA
  Fcamr_19
gtgttcccagtcaccagtcg

SEQ ID NO: 20246 - DNA, 20 bp, Artificial Sequence
  sgRNA
  Fcamr_20
acagaaggtcacattccaga

SEQ ID NO: 20247 - DNA, 20 bp, Artificial Sequence
  sgRNA
  Fcer1a_1
gtgtacttgaatgtaacgca

SEQ ID NO: 20248 - DNA, 20 bp, Artificial Sequence
  sgRNA
  Fcer1a_2
gaagaactggaatgtccgca

SEQ ID NO: 20249 - DNA, 20 bp, Artificial Sequence
  sgRNA
  Fcer1a_3
gtaaatattctaatccatgg

SEQ ID NO: 20250 - DNA, 20 bp, Artificial Sequence
  sgRNA
  Fcer1a_4
agtgccaccgttcaagacag

SEQ ID NO: 20251 - DNA, 20 bp, Artificial Sequence
  sgRNA
  Fcer1a_5
gctgacatggtcttagtcca

SEQ ID NO: 20252 - DNA, 20 bp, Artificial Sequence
  sgRNA
  Fcer1a_6
gcctaagatagcccttgcag

SEQ ID NO: 20253 - DNA, 20 bp, Artificial Sequence
  sgRNA
  Fcer1a_7
acagaatcgccaccaacaat

SEQ ID NO: 20254 - DNA, 20 bp, Artificial Sequence
  sgRNA
  Fcer1a_8
tgcgttacattcaagtacac

SEQ ID NO: 20255 - DNA, 20 bp, Artificial Sequence
  sgRNA
  Fcer1a_9
gagccccgtctccattagag

SEQ ID NO: 20256 - DNA, 20 bp, Artificial Sequence
  sgRNA
  Fcer1a_10
ggtcagtacagatttctcag

SEQ ID NO: 20257 - DNA, 20 bp, Artificial Sequence
  sgRNA
  Fcer1a_11
tggcctctctaatggagacg

SEQ ID NO: 20258 - DNA, 20 bp, Artificial Sequence
  sgRNA
  Fcer1a_12
gccatggcatctgatgtcaa

SEQ ID NO: 20259 - DNA, 20 bp, Artificial Sequence
  sgRNA
  Fcer1a_13
tgaagagttcacctcagaga

SEQ ID NO: 20260 - DNA, 20 bp, Artificial Sequence
  sgRNA
  Fcer1a_14
aagatagcccttgcagtggt

SEQ ID NO: 20261 - DNA, 20 bp, Artificial Sequence
  sgRNA
  Fcer1a_15
ttctgtttgctgtggacacg

SEQ ID NO: 20262 - DNA, 20 bp, Artificial Sequence
  sgRNA
  Fcer1a_16
gaggccacactgaatgacag

SEQ ID NO: 20263 - DNA, 20 bp, Artificial Sequence
  sgRNA
  Fcer1a_17
ttgacatcagatgccatggc

SEQ ID NO: 20264 - DNA, 20 bp, Artificial Sequence
  sgRNA
  Fcer1a_18
ccatgtcagcagatgtctga

SEQ ID NO: 20265 - DNA, 20 bp, Artificial Sequence
  sgRNA
  Fcer1a_19
cctcagagacggtaccattg

SEQ ID NO: 20266 - DNA, 20 bp, Artificial Sequence
  sgRNA
  Fcer1a_20
agtggcacctaccactgcaa

SEQ ID NO: 20267 - DNA, 20 bp, Artificial Sequence
  sgRNA
  Fcgr1_1
agagtaccatatagcaaggg

SEQ ID NO: 20268 - DNA, 20 bp, Artificial Sequence
  sgRNA
  Fcgr1_2
tgggatgctataactaggcg

SEQ ID NO: 20269 - DNA, 20 bp, Artificial Sequence
  sgRNA
  Fcgr1_3
tggaaaatactgacccatgg

SEQ ID NO: 20270 - DNA, 20 bp, Artificial Sequence
  sgRNA
  Fcgr1_4
gaataaactggtgtacaatg

SEQ ID NO: 20271 - DNA, 20 bp, Artificial Sequence
  sgRNA
  Fcgr1_5
gcctagttatagcatcccag

SEQ ID NO: 20272 - DNA, 20 bp, Artificial Sequence
  sgRNA
  Fcgr1_6
ctactggtgtgaggtagcca

SEQ ID NO: 20273 - DNA, 20 bp, Artificial Sequence
  sgRNA
  Fcgr1_7
acaccaaaagaagcgcccga

SEQ ID NO: 20274 - DNA, 20 bp, Artificial Sequence
  sgRNA
  Fcgr1_8
gtgtcatctcccttcccgga

SEQ ID NO: 20275 - DNA, 20 bp, Artificial Sequence
  sgRNA
  Fcgr1_9
ctcagagtaccatatagcaa

SEQ ID NO: 20276 - DNA, 20 bp, Artificial Sequence
  sgRNA
  Fcgr1_10
acactcctgcagatgtgtag

SEQ ID NO: 20277 - DNA, 20 bp, Artificial Sequence
  sgRNA
  Fcgr1_11
cttcacttctccttctacgt

SEQ ID NO: 20278 - DNA, 20 bp, Artificial Sequence
  sgRNA
  Fcgr1_12
gccccagtactgtcactggg

SEQ ID NO: 20279 - DNA, 20 bp, Artificial Sequence
  sgRNA
  Fcgr1_13
gcttcacttctccttctacg

SEQ ID NO: 20280 - DNA, 20 bp, Artificial Sequence
  sgRNA
  Fcgr1_14
aaaaccaacctgagtcacag

SEQ ID NO: 20281 - DNA, 20 bp, Artificial Sequence
  sgRNA
  Fcgr1_15
tccacacaatggtttatcaa

SEQ ID NO: 20282 - DNA, 20 bp, Artificial Sequence
  sgRNA
  Fcgr1_16
tccgtgacacctcaaggcca

SEQ ID NO: 20283 - DNA, 20 bp, Artificial Sequence
  sgRNA
  Fcgr1_17
tttcagcaagttagaagcga

SEQ ID NO: 20284 - DNA, 20 bp, Artificial Sequence
  sgRNA
  Fcgr1_18
tggtgtggtctggctcgcag

SEQ ID NO: 20285 - DNA, 20 bp, Artificial Sequence
  sgRNA
  Fcgr1_19
ccagctttggagatgacatg

SEQ ID NO: 20286 - DNA, 20 bp, Artificial Sequence
  sgRNA
  Fcgr1_20
ttctctatgtgaaaatacac

SEQ ID NO: 20287 - DNA, 20 bp, Artificial Sequence
  sgRNA
  Fcgr2b_1
aggtcccgacttacttagca

SEQ ID NO: 20288 - DNA, 20 bp, Artificial Sequence
  sgRNA
  Fcgr2b_2
cggtgacactgacatgcgaa

SEQ ID NO: 20289 - DNA, 20 bp, Artificial Sequence
  sgRNA
  Fcgr2b_3
ttccagaaacaccagctgag

SEQ ID NO: 20290 - DNA, 20 bp, Artificial Sequence
  sgRNA
  Fcgr2b_4
actgcaaaggaagtctagga

SEQ ID NO: 20291 - DNA, 20 bp, Artificial Sequence
  sgRNA
  Fcgr2b_5
aatgggagaaacccttccag

SEQ ID NO: 20292 - DNA, 20 bp, Artificial Sequence
  sgRNA
  Fcgr2b_6
tggtcaaactcgagcccccg

SEQ ID NO: 20293 - DNA, 20 bp, Artificial Sequence
  sgRNA
  Fcgr2b_7
tctcaagcatcccgaagccc

SEQ ID NO: 20294 - DNA, 20 bp, Artificial Sequence
  sgRNA
  Fcgr2b_8
cagtccagttgctctccatg

SEQ ID NO: 20295 - DNA, 20 bp, Artificial Sequence
  sgRNA
  Fcgr2b_9
cttgagcacctggatccacg

SEQ ID NO: 20296 - DNA, 20 bp, Artificial Sequence
  sgRNA
  Fcgr2b_10
ggatactaggataataacaa

SEQ ID NO: 20297 - DNA, 20 bp, Artificial Sequence
  sgRNA
  Fcgr2b_11
ggaagaagctgccaaaactg

SEQ ID NO: 20298 - DNA, 20 bp, Artificial Sequence
  sgRNA
  Fcgr2b_12
acaggcactgagcccccaga

SEQ ID NO: 20299 - DNA, 20 bp, Artificial Sequence
  sgRNA
  Fcgr2b_13
acaaagtccgtgagaacaca

SEQ ID NO: 20300 - DNA, 20 bp, Artificial Sequence
  sgRNA
  Fcgr2b_14
gcagcttcttccagatcagg

SEQ ID NO: 20301 - DNA, 20 bp, Artificial Sequence
  sgRNA
  Fcgr2b_15
gccgttcctactgatcccca

SEQ ID NO: 20302 - DNA, 20 bp, Artificial Sequence
  sgRNA
  Fcgr2b_16
ttgagcacctggatccacgg

SEQ ID NO: 20303 - DNA, 20 bp, Artificial Sequence
  sgRNA
  Fcgr2b_17
ctacccagtggttccacaat

SEQ ID NO: 20304 - DNA, 20 bp, Artificial Sequence
  sgRNA
  Fcgr2b_18
cccagtggttccacaatggg

SEQ ID NO: 20305 - DNA, 20 bp, Artificial Sequence
  sgRNA
  Fcgr2b_19
cttgttggctccagtccaga

SEQ ID NO: 20306 - DNA, 20 bp, Artificial Sequence
  sgRNA
  Fcgr2b_20
gcagccacaattgtcaatac

SEQ ID NO: 20307 - DNA, 20 bp, Artificial Sequence
  sgRNA
  Fcgr3_1
tggtgacactgatgtgcgaa

SEQ ID NO: 20308 - DNA, 20 bp, Artificial Sequence
  sgRNA
  Fcgr3_2
atgcacactctggaagccaa

SEQ ID NO: 20309 - DNA, 20 bp, Artificial Sequence
  sgRNA
  Fcgr3_3
tggtgaaactggacccccca

SEQ ID NO: 20310 - DNA, 20 bp, Artificial Sequence
  sgRNA
  Fcgr3_4
tgctgctccagacccctcag

SEQ ID NO: 20311 - DNA, 20 bp, Artificial Sequence
  sgRNA
  Fcgr3_5
ggagaaatcttcaaaccccg

SEQ ID NO: 20312 - DNA, 20 bp, Artificial Sequence
  sgRNA
  Fcgr3_6
gagaaatcttcaaaccccga

SEQ ID NO: 20313 - DNA, 20 bp, Artificial Sequence
  sgRNA
  Fcgr3_7
cttcctccagtaatccctcg

SEQ ID NO: 20314 - DNA, 20 bp, Artificial Sequence
  sgRNA
  Fcgr3_8
ggattggacctggctccgga

SEQ ID NO: 20315 - DNA, 20 bp, Artificial Sequence
  sgRNA
  Fcgr3_9
aaaccccgagggattactgg

SEQ ID NO: 20316 - DNA, 20 bp, Artificial Sequence
  sgRNA
  Fcgr3_10
ccgtgtccactgcaaacagg

SEQ ID NO: 20317 - DNA, 20 bp, Artificial Sequence
  sgRNA
  Fcgr3_11
gacttcctccagtaatccct

SEQ ID NO: 20318 - DNA, 20 bp, Artificial Sequence
  sgRNA
  Fcgr3_12
tccacaactggagttccatc

SEQ ID NO: 20319 - DNA, 20 bp, Artificial Sequence
  sgRNA
  Fcgr3_13
tccagtttcaccacagcctt

SEQ ID NO: 20320 - DNA, 20 bp, Artificial Sequence
  sgRNA
  Fcgr3_14
tgagcacctggatccatggg

SEQ ID NO: 20321 - DNA, 20 bp, Artificial Sequence
  sgRNA
  Fcgr3_15
aaacaggaggcacatcacta

SEQ ID NO: 20322 - DNA, 20 bp, Artificial Sequence
  sgRNA
  Fcgr3_16
actgagtagaagagttccca

SEQ ID NO: 20323 - DNA, 20 bp, Artificial Sequence
  sgRNA
  Fcgr3_17
gtggtaccagactagagaga

SEQ ID NO: 20324 - DNA, 20 bp, Artificial Sequence
  sgRNA
  Fcgr3_18
gatgtgcctcctgtttgcag

SEQ ID NO: 20325 - DNA, 20 bp, Artificial Sequence
  sgRNA
  Fcgr3_19
tttgtagtgatgatacctca

SEQ ID NO: 20326 - DNA, 20 bp, Artificial Sequence
  sgRNA
  Fcgr3_20
ttccagaaacacccgctgag

SEQ ID NO: 20327 - DNA, 20 bp, Artificial Sequence
  sgRNA
  Fcgr4_1
acttgatagaattgtcctcg

SEQ ID NO: 20328 - DNA, 20 bp, Artificial Sequence
  sgRNA
  Fcgr4_2
tatggacctctagttgcact

SEQ ID NO: 20329 - DNA, 20 bp, Artificial Sequence
  sgRNA
  Fcgr4_3
gcaaaacagacctgtacgga

SEQ ID NO: 20330 - DNA, 20 bp, Artificial Sequence
  sgRNA
  Fcgr4_4
ggtgaacctagaccccaagt

SEQ ID NO: 20331 - DNA, 20 bp, Artificial Sequence
  sgRNA
  Fcgr4_5
gtgcaactagaggtccatat

SEQ ID NO: 20332 - DNA, 20 bp, Artificial Sequence
  sgRNA
  Fcgr4_6
cttgatagaattgtcctcgg

SEQ ID NO: 20333 - DNA, 20 bp, Artificial Sequence
  sgRNA
  Fcgr4_7
ctccatccatgtttccaccg

SEQ ID NO: 20334 - DNA, 20 bp, Artificial Sequence
  sgRNA
  Fcgr4_8
ccaaggcactttctcccccg

SEQ ID NO: 20335 - DNA, 20 bp, Artificial Sequence
  sgRNA
  Fcgr4_9
ccgaggacaattctatcaag

SEQ ID NO: 20336 - DNA, 20 bp, Artificial Sequence
  sgRNA
  Fcgr4_10
gaaagtgccttggcatctga

SEQ ID NO: 20337 - DNA, 20 bp, Artificial Sequence
  sgRNA
  Fcgr4_11
aaggtcacctatttacagaa

SEQ ID NO: 20338 - DNA, 20 bp, Artificial Sequence
  sgRNA
  Fcgr4_12
gcctttgccgttctgtaaat

SEQ ID NO: 20339 - DNA, 20 bp, Artificial Sequence
  sgRNA
  Fcgr4_13
gttggcaaaacagacctgta

SEQ ID NO: 20340 - DNA, 20 bp, Artificial Sequence
  sgRNA
  Fcgr4_14
tggtgaacctagaccccaag

SEQ ID NO: 20341 - DNA, 20 bp, Artificial Sequence
  sgRNA
  Fcgr4_15
gcatcctttcgtataagcct

SEQ ID NO: 20342 - DNA, 20 bp, Artificial Sequence
  sgRNA
  Fcgr4_16
tattgcttcagaccactaag

SEQ ID NO: 20343 - DNA, 20 bp, Artificial Sequence
  sgRNA
  Fcgr4_17
caaacaagagtcctatcagc

SEQ ID NO: 20344 - DNA, 20 bp, Artificial Sequence
  sgRNA
  Fcgr4_18
agtgcaactagaggtccata

SEQ ID NO: 20345 - DNA, 20 bp, Artificial Sequence
  sgRNA
  Fcgr4_19
gctactactaccaacagctc

SEQ ID NO: 20346 - DNA, 20 bp, Artificial Sequence
  sgRNA
  Fcgr4_20
gaggggtcttcaaagtcctg

SEQ ID NO: 20347 - DNA, 20 bp, Artificial Sequence
  sgRNA
  Fcgrt_1
aagaatcggcaattggactg

SEQ ID NO: 20348 - DNA, 20 bp, Artificial Sequence
  sgRNA
  Fcgrt_2
gggcactgaggaattatccg

SEQ ID NO: 20349 - DNA, 20 bp, Artificial Sequence
  sgRNA
  Fcgrt_3
cgtgagatgatacatcagtg

SEQ ID NO: 20350 - DNA, 20 bp, Artificial Sequence
  sgRNA
  Fcgrt_4
aggtggcctagcagtcgctc

SEQ ID NO: 20351 - DNA, 20 bp, Artificial Sequence
  sgRNA
  Fcgrt_5
cctccagcaatgaccatgcg

SEQ ID NO: 20352 - DNA, 20 bp, Artificial Sequence
  sgRNA
  Fcgrt_6
atcggaacttgagctccggt

SEQ ID NO: 20353 - DNA, 20 bp, Artificial Sequence
  sgRNA
  Fcgrt_7
gccttcaggcgcatagacgg

SEQ ID NO: 20354 - DNA, 20 bp, Artificial Sequence
  sgRNA
  Fcgrt_8
gcaccattatcaatgtcaag

SEQ ID NO: 20355 - DNA, 20 bp, Artificial Sequence
  sgRNA
  Fcgrt_9
ccttccactccaggttccgt

SEQ ID NO: 20356 - DNA, 20 bp, Artificial Sequence
  sgRNA
  Fcgrt_10
ctagcccattgcgcaggaat

SEQ ID NO: 20357 - DNA, 20 bp, Artificial Sequence
  sgRNA
  Fcgrt_11
gctgggctgtgaactggcct

SEQ ID NO: 20358 - DNA, 20 bp, Artificial Sequence
  sgRNA
  Fcgrt_12
gccgctgagagaaagccatg

SEQ ID NO: 20359 - DNA, 20 bp, Artificial Sequence
  sgRNA
  Fcgrt_13
tcattgctggaggtcaaacg

SEQ ID NO: 20360 - DNA, 20 bp, Artificial Sequence
  sgRNA
  Fcgrt_14
ggaaaggcatttgcaccttg

SEQ ID NO: 20361 - DNA, 20 bp, Artificial Sequence
  sgRNA
  Fcgrt_15
cagcctgtagcccagaaaga

SEQ ID NO: 20362 - DNA, 20 bp, Artificial Sequence
  sgRNA
  Fcgrt_16
gtagaaggagaaagcagcac

SEQ ID NO: 20363 - DNA, 20 bp, Artificial Sequence
  sgRNA
  Fcgrt_17
gaaagcagcacaggtcagca

SEQ ID NO: 20364 - DNA, 20 bp, Artificial Sequence
  sgRNA
  Fcgrt_18
cggaaatcgttgctaatctg

SEQ ID NO: 20365 - DNA, 20 bp, Artificial Sequence
  sgRNA
  Fcgrt_19
gcaggcggtgtgctgttgtg

SEQ ID NO: 20366 - DNA, 20 bp, Artificial Sequence
  sgRNA
  Fcgrt_20
attgagggcaaacacagccg

SEQ ID NO: 20367 - DNA, 20 bp, Artificial Sequence
  sgRNA
  Fcrl1_1
gctcggttgatagagtcact

SEQ ID NO: 20368 - DNA, 20 bp, Artificial Sequence
  sgRNA
  Fcrl1_2
ttgaagacacggcccccagg

SEQ ID NO: 20369 - DNA, 20 bp, Artificial Sequence
  sgRNA
  Fcrl1_3
tgctgatcaatattactgtg

SEQ ID NO: 20370 - DNA, 20 bp, Artificial Sequence
  sgRNA
  Fcrl1_4
agtccccaaacgtaaggaca

SEQ ID NO: 20371 - DNA, 20 bp, Artificial Sequence
  sgRNA
  Fcrl1_5
ggatgctcaccagctcactg

SEQ ID NO: 20372 - DNA, 20 bp, Artificial Sequence
  sgRNA
  Fcrl1_6
tgctggttccagcacctgcg

SEQ ID NO: 20373 - DNA, 20 bp, Artificial Sequence
  sgRNA
  Fcrl1_7
gctctaccgtgtgaacctgc

SEQ ID NO: 20374 - DNA, 20 bp, Artificial Sequence
  sgRNA
  Fcrl1_8
aaggatgctcctcctccaga

SEQ ID NO: 20375 - DNA, 20 bp, Artificial Sequence
  sgRNA
  Fcrl1_9
atatgtgcaatgtttatcct

SEQ ID NO: 20376 - DNA, 20 bp, Artificial Sequence
  sgRNA
  Fcrl1_10
tattactgtgcggctaacga

SEQ ID NO: 20377 - DNA, 20 bp, Artificial Sequence
  sgRNA
  Fcrl1_11
tggcttagaatagagtccag

SEQ ID NO: 20378 - DNA, 20 bp, Artificial Sequence
  sgRNA
  Fcrl1_12
tctccttaggactcactggg

SEQ ID NO: 20379 - DNA, 20 bp, Artificial Sequence
  sgRNA
  Fcrl1_13
tctggtgtaccacaccccgc

SEQ ID NO: 20380 - DNA, 20 bp, Artificial Sequence
  sgRNA
  Fcrl1_14
gtaaggacagggcgagacac

SEQ ID NO: 20381 - DNA, 20 bp, Artificial Sequence
  sgRNA
  Fcrl1_15
tggctcctgctactgatctg

SEQ ID NO: 20382 - DNA, 20 bp, Artificial Sequence
  sgRNA
  Fcrl1_16
caagctggtcctcatctgct

SEQ ID NO: 20383 - DNA, 20 bp, Artificial Sequence
  sgRNA
  Fcrl1_17
gtagcaaaatattaaggcca

SEQ ID NO: 20384 - DNA, 20 bp, Artificial Sequence
  sgRNA
  Fcrl1_18
acagggtgcccaacgaagtg

SEQ ID NO: 20385 - DNA, 20 bp, Artificial Sequence
  sgRNA
  Fcrl1_19
gagtccccaaacgtaaggac

SEQ ID NO: 20386 - DNA, 20 bp, Artificial Sequence
  sgRNA
  Fcrl1_20
gctcagcatgtgaggacaca

SEQ ID NO: 20387 - DNA, 20 bp, Artificial Sequence
  sgRNA
  Fcrl5_1
catgctcggaagtaagctgt

SEQ ID NO: 20388 - DNA, 20 bp, Artificial Sequence
  sgRNA
  Fcrl5_2
gagctgggtctgacacgtca

SEQ ID NO: 20389 - DNA, 20 bp, Artificial Sequence
  sgRNA
  Fcrl5_3
aggtgaacatcagtgacgca

SEQ ID NO: 20390 - DNA, 20 bp, Artificial Sequence
  sgRNA
  Fcrl5_4
gtcaaagagataccagtgca

SEQ ID NO: 20391 - DNA, 20 bp, Artificial Sequence
  sgRNA
  Fcrl5_5
gagtatagagctattcccca

SEQ ID NO: 20392 - DNA, 20 bp, Artificial Sequence
  sgRNA
  Fcrl5_6
gctggtacgttgtaataggt

SEQ ID NO: 20393 - DNA, 20 bp, Artificial Sequence
  sgRNA
  Fcrl5_7
ggcaggaatgtgaaactccg

SEQ ID NO: 20394 - DNA, 20 bp, Artificial Sequence
  sgRNA
  Fcrl5_8
catctgtgtgaacaccacac

SEQ ID NO: 20395 - DNA, 20 bp, Artificial Sequence
  sgRNA
  Fcrl5_9
ctttgactcttcagtccata

SEQ ID NO: 20396 - DNA, 20 bp, Artificial Sequence
  sgRNA
  Fcrl5_10
ggagatcttgaattctgcgt

SEQ ID NO: 20397 - DNA, 20 bp, Artificial Sequence
  sgRNA
  Fcrl5_11
ggtgaacatcagtgacgcag

SEQ ID NO: 20398 - DNA, 20 bp, Artificial Sequence
  sgRNA
  Fcrl5_12
cttcattgtcaatcccagag

SEQ ID NO: 20399 - DNA, 20 bp, Artificial Sequence
  sgRNA
  Fcrl5_13
atgccctgctgacaaagctt

SEQ ID NO: 20400 - DNA, 20 bp, Artificial Sequence
  sgRNA
  Fcrl5_14
catcatcccagcctcaaagt

SEQ ID NO: 20401 - DNA, 20 bp, Artificial Sequence
  sgRNA
  Fcrl5_15
ttataccaggagaatttgag

SEQ ID NO: 20402 - DNA, 20 bp, Artificial Sequence
  sgRNA
  Fcrl5_16
ccctgctgacaaagcttcgg

SEQ ID NO: 20403 - DNA, 20 bp, Artificial Sequence
  sgRNA
  Fcrl5_17
tctccttcaaacacagcagg

SEQ ID NO: 20404 - DNA, 20 bp, Artificial Sequence
  sgRNA
  Fcrl5_18
cgaaagaaagtggtccatgg

SEQ ID NO: 20405 - DNA, 20 bp, Artificial Sequence
  sgRNA
  Fcrl5_19
cgtgcaaatctgaaggacaa

SEQ ID NO: 20406 - DNA, 20 bp, Artificial Sequence
  sgRNA
  Fcrl5_20
acttcattgtcaatcccaga

SEQ ID NO: 20407 - DNA, 20 bp, Artificial Sequence
  sgRNA
  Fcrl6_1
gctgtaaagttggattcttg

SEQ ID NO: 20408 - DNA, 20 bp, Artificial Sequence
  sgRNA
  Fcrl6_2
gaatgagtaaaagattggaa

SEQ ID NO: 20409 - DNA, 20 bp, Artificial Sequence
  sgRNA
  Fcrl6_3
agaaatcctagggaaacccc

SEQ ID NO: 20410 - DNA, 20 bp, Artificial Sequence
  sgRNA
  Fcrl6_4
acaaccatgtcattcaagac

SEQ ID NO: 20411 - DNA, 20 bp, Artificial Sequence
  sgRNA
  Fcrl6_5
tgagctcaagaagttcccct

SEQ ID NO: 20412 - DNA, 20 bp, Artificial Sequence
  sgRNA
  Fcrl6_6
acattaatggagaaatccta

SEQ ID NO: 20413 - DNA, 20 bp, Artificial Sequence
  sgRNA
  Fcrl6_7
attcaccaattcagagacga

SEQ ID NO: 20414 - DNA, 20 bp, Artificial Sequence
  sgRNA
  Fcrl6_8
actccactctgcctttactg

SEQ ID NO: 20415 - DNA, 20 bp, Artificial Sequence
  sgRNA
  Fcrl6_9
cctgaagtgtaccataaagg

SEQ ID NO: 20416 - DNA, 20 bp, Artificial Sequence
  sgRNA
  Fcrl6_10
tcatgttgcagagtgagcac

SEQ ID NO: 20417 - DNA, 20 bp, Artificial Sequence
  sgRNA
  Fcrl6_11
ctacctgcaagcctgcttgg

SEQ ID NO: 20418 - DNA, 20 bp, Artificial Sequence
  sgRNA
  Fcrl6_12
cctcagtgtccaccatacac

SEQ ID NO: 20419 - DNA, 20 bp, Artificial Sequence
  sgRNA
  Fcrl6_13
ttgcagagtgagcacaggat

SEQ ID NO: 20420 - DNA, 20 bp, Artificial Sequence
  sgRNA
  Fcrl6_14
actctgcctttactgaggcg

SEQ ID NO: 20421 - DNA, 20 bp, Artificial Sequence
  sgRNA
  Fcrl6_15
tcgcctcagtaaaggcagag

SEQ ID NO: 20422 - DNA, 20 bp, Artificial Sequence
  sgRNA
  Fcrl6_16
gctctgccagagggagccag

SEQ ID NO: 20423 - DNA, 20 bp, Artificial Sequence
  sgRNA
  Fcrl6_17
cttctgcagaaaatactgag

SEQ ID NO: 20424 - DNA, 20 bp, Artificial Sequence
  sgRNA
  Fcrl6_18
ccacctttatggtacacttc

SEQ ID NO: 20425 - DNA, 20 bp, Artificial Sequence
  sgRNA
  Fcrl6_19
gaagccactaaccttgctgt

SEQ ID NO: 20426 - DNA, 20 bp, Artificial Sequence
  sgRNA
  Fcrl6_20
gggaaacccctggctccctc

SEQ ID NO: 20427 - DNA, 20 bp, Artificial Sequence
  sgRNA
  Ffar1_1
agtgagtcgcagtttagcgt

SEQ ID NO: 20428 - DNA, 20 bp, Artificial Sequence
  sgRNA
  Ffar1_2
tcgggtaccaagccatccgg

SEQ ID NO: 20429 - DNA, 20 bp, Artificial Sequence
  sgRNA
  Ffar1_3
agtgggccaaggcaaagact

SEQ ID NO: 20430 - DNA, 20 bp, Artificial Sequence
  sgRNA
  Ffar1_4
caatggaaagcccagcgcaa

SEQ ID NO: 20431 - DNA, 20 bp, Artificial Sequence
  sgRNA
  Ffar1_5
gctcaggcctgagccacaaa

SEQ ID NO: 20432 - DNA, 20 bp, Artificial Sequence
  sgRNA
  Ffar1_6
gctcaggcctgagcgcacca

SEQ ID NO: 20433 - DNA, 20 bp, Artificial Sequence
  sgRNA
  Ffar1_7
ttgaacttgttagccatccg

SEQ ID NO: 20434 - DNA, 20 bp, Artificial Sequence
  sgRNA
  Ffar1_8
gctcccctctacgcaggcgg

SEQ ID NO: 20435 - DNA, 20 bp, Artificial Sequence
  sgRNA
  Ffar1_9
ggaagcctccgcctgcgtag

SEQ ID NO: 20436 - DNA, 20 bp, Artificial Sequence
  sgRNA
  Ffar1_10
gccacattggaggcattata

SEQ ID NO: 20437 - DNA, 20 bp, Artificial Sequence
  sgRNA
  Ffar1_11
ccaagtagccagtgaccagt

SEQ ID NO: 20438 - DNA, 20 bp, Artificial Sequence
  sgRNA
  Ffar1_12
cggatggcttggtacccgaa

SEQ ID NO: 20439 - DNA, 20 bp, Artificial Sequence
  sgRNA
  Ffar1_13
gagtgtggtactcaacccac

SEQ ID NO: 20440 - DNA, 20 bp, Artificial Sequence
  sgRNA
  Ffar1_14
ggaatagcggggcctccgga

SEQ ID NO: 20441 - DNA, 20 bp, Artificial Sequence
  sgRNA
  Ffar1_15
cgaaggggaaggcagccccc

SEQ ID NO: 20442 - DNA, 20 bp, Artificial Sequence
  sgRNA
  Ffar1_16
tccggaagtctccaagccaa

SEQ ID NO: 20443 - DNA, 20 bp, Artificial Sequence
  sgRNA
  Ffar1_17
ggaagttaggactcatcaca

SEQ ID NO: 20444 - DNA, 20 bp, Artificial Sequence
  sgRNA
  Ffar1_18
tgtgtgacgaggactcaaag

SEQ ID NO: 20445 - DNA, 20 bp, Artificial Sequence
  sgRNA
  Ffar1_19
ccaggcttccaggcagaccg

SEQ ID NO: 20446 - DNA, 20 bp, Artificial Sequence
  sgRNA
  Ffar1_20
aagcctccgcctgcgtagag

SEQ ID NO: 20447 - DNA, 20 bp, Artificial Sequence
  sgRNA
  Ffar2_1
gcgcgcacacgatctttggt

SEQ ID NO: 20448 - DNA, 20 bp, Artificial Sequence
  sgRNA
  Ffar2_2
gctcacgcagccccacgttg

SEQ ID NO: 20449 - DNA, 20 bp, Artificial Sequence
  sgRNA
  Ffar2_3
tgcagtacaagttatcccgc

SEQ ID NO: 20450 - DNA, 20 bp, Artificial Sequence
  sgRNA
  Ffar2_4
cctgcttaatctgaccctgg

SEQ ID NO: 20451 - DNA, 20 bp, Artificial Sequence
  sgRNA
  Ffar2_5
gcagcgatcactccatacag

SEQ ID NO: 20452 - DNA, 20 bp, Artificial Sequence
  sgRNA
  Ffar2_6
cgatctttggtaggtaccag

SEQ ID NO: 20453 - DNA, 20 bp, Artificial Sequence
  sgRNA
  Ffar2_7
gcaccgggaaggccactccc

SEQ ID NO: 20454 - DNA, 20 bp, Artificial Sequence
  sgRNA
  Ffar2_8
gctgcttccacgatccggaa

SEQ ID NO: 20455 - DNA, 20 bp, Artificial Sequence
  sgRNA
  Ffar2_9
tgctgcttccacgatccgga

SEQ ID NO: 20456 - DNA, 20 bp, Artificial Sequence
  sgRNA
  Ffar2_10
gcaacaggagcaagtccgcc

SEQ ID NO: 20457 - DNA, 20 bp, Artificial Sequence
  sgRNA
  Ffar2_11
gtactgaacgatgatgacga

SEQ ID NO: 20458 - DNA, 20 bp, Artificial Sequence
  sgRNA
  Ffar2_12
gcacagttccttgatcctca

SEQ ID NO: 20459 - DNA, 20 bp, Artificial Sequence
  sgRNA
  Ffar2_13
acagcctccacccgccacga

SEQ ID NO: 20460 - DNA, 20 bp, Artificial Sequence
  sgRNA
  Ffar2_14
ccagggtcagattaagcagg

SEQ ID NO: 20461 - DNA, 20 bp, Artificial Sequence
  sgRNA
  Ffar2_15
ctacaacatgtcccacctgg

SEQ ID NO: 20462 - DNA, 20 bp, Artificial Sequence
  sgRNA
  Ffar2_16
tgaggcagagcccctcgtgg

SEQ ID NO: 20463 - DNA, 20 bp, Artificial Sequence
  sgRNA
  Ffar2_17
aggcacagctccagtcgtac

SEQ ID NO: 20464 - DNA, 20 bp, Artificial Sequence
  sgRNA
  Ffar2_18
gcagcatctactgcagcacg

SEQ ID NO: 20465 - DNA, 20 bp, Artificial Sequence
  sgRNA
  Ffar2_19
gtatggagtgatcgctgctc

SEQ ID NO: 20466 - DNA, 20 bp, Artificial Sequence
  sgRNA
  Ffar2_20
ggagcccagtaagaaagatg

SEQ ID NO: 20467 - DNA, 20 bp, Artificial Sequence
  sgRNA
  Ffar3_1
tgagcgtggcctatccactg

SEQ ID NO: 20468 - DNA, 20 bp, Artificial Sequence
  sgRNA
  Ffar3_2
ggtgtggatactgagccggg

SEQ ID NO: 20469 - DNA, 20 bp, Artificial Sequence
  sgRNA
  Ffar3_3
gaaatgcaacctacagccag

SEQ ID NO: 20470 - DNA, 20 bp, Artificial Sequence
  sgRNA
  Ffar3_4
cctgcctgtacgactagaga

SEQ ID NO: 20471 - DNA, 20 bp, Artificial Sequence
  sgRNA
  Ffar3_5
ttatcctcttgcgccggcgc

SEQ ID NO: 20472 - DNA, 20 bp, Artificial Sequence
  sgRNA
  Ffar3_6
gtcccacgaggaacaccaac

SEQ ID NO: 20473 - DNA, 20 bp, Artificial Sequence
  sgRNA
  Ffar3_7
gctgacatagcccaccacat

SEQ ID NO: 20474 - DNA, 20 bp, Artificial Sequence
  sgRNA
  Ffar3_8
ccccaggagttgatgaaagt

SEQ ID NO: 20475 - DNA, 20 bp, Artificial Sequence
  sgRNA
  Ffar3_9
ctgctacctggaattccggg

SEQ ID NO: 20476 - DNA, 20 bp, Artificial Sequence
  sgRNA
  Ffar3_10
gccccattatcctcttgcgc

SEQ ID NO: 20477 - DNA, 20 bp, Artificial Sequence
  sgRNA
  Ffar3_11
tgtggtacaaaacccggccc

SEQ ID NO: 20478 - DNA, 20 bp, Artificial Sequence
  sgRNA
  Ffar3_12
cctccaccatgcgaaacggc

SEQ ID NO: 20479 - DNA, 20 bp, Artificial Sequence
  sgRNA
  Ffar3_13
gctgcctccaccatgcgaaa

SEQ ID NO: 20480 - DNA, 20 bp, Artificial Sequence
  sgRNA
  Ffar3_14
ggaaatgcaacctacagcca

SEQ ID NO: 20481 - DNA, 20 bp, Artificial Sequence
  sgRNA
  Ffar3_15
gttcgatgctcaccgccgtc

SEQ ID NO: 20482 - DNA, 20 bp, Artificial Sequence
  sgRNA
  Ffar3_16
acagccatctctagtcgtac

SEQ ID NO: 20483 - DNA, 20 bp, Artificial Sequence
  sgRNA
  Ffar3_17
cgttgagggggagtcccacg

SEQ ID NO: 20484 - DNA, 20 bp, Artificial Sequence
  sgRNA
  Ffar3_18
cttgcccacgaagaccacca

SEQ ID NO: 20485 - DNA, 20 bp, Artificial Sequence
  sgRNA
  Ffar3_19
tgtacgactagagatggctg

SEQ ID NO: 20486 - DNA, 20 bp, Artificial Sequence
  sgRNA
  Ffar3_20
caagctgcgccgacgcccag

SEQ ID NO: 20487 - DNA, 20 bp, Artificial Sequence
  sgRNA
  Ffar4_1
agcgcacgacgagcactaga

SEQ ID NO: 20488 - DNA, 20 bp, Artificial Sequence
  sgRNA
  Ffar4_2
cgacgctcaacaccaaccgg

SEQ ID NO: 20489 - DNA, 20 bp, Artificial Sequence
  sgRNA
  Ffar4_3
ttggattggcccaaccgcat

SEQ ID NO: 20490 - DNA, 20 bp, Artificial Sequence
  sgRNA
  Ffar4_4
cagcgtcacgatcctcacac

SEQ ID NO: 20491 - DNA, 20 bp, Artificial Sequence
  sgRNA
  Ffar4_5
ggtgctcaacctcttctgcg

SEQ ID NO: 20492 - DNA, 20 bp, Artificial Sequence
  sgRNA
  Ffar4_6
cacgatcctcacactggccg

SEQ ID NO: 20493 - DNA, 20 bp, Artificial Sequence
  sgRNA
  Ffar4_7
cttgatccaaaacttccggc

SEQ ID NO: 20494 - DNA, 20 bp, Artificial Sequence
  sgRNA
  Ffar4_8
tgtcgctgttcaggaacgaa

SEQ ID NO: 20495 - DNA, 20 bp, Artificial Sequence
  sgRNA
  Ffar4_9
gcgacatgttgtacagtatg

SEQ ID NO: 20496 - DNA, 20 bp, Artificial Sequence
  sgRNA
  Ffar4_10
ggtgcgattgacttggtcca

SEQ ID NO: 20497 - DNA, 20 bp, Artificial Sequence
  sgRNA
  Ffar4_11
ccatgagcaggaagagcgtg

SEQ ID NO: 20498 - DNA, 20 bp, Artificial Sequence
  sgRNA
  Ffar4_12
ggaagagcgtgcggaagagt

SEQ ID NO: 20499 - DNA, 20 bp, Artificial Sequence
  sgRNA
  Ffar4_13
gccagatgaccaggtcctgc

SEQ ID NO: 20500 - DNA, 20 bp, Artificial Sequence
  sgRNA
  Ffar4_14
catgcgctccaggctgaccg

SEQ ID NO: 20501 - DNA, 20 bp, Artificial Sequence
  sgRNA
  Ffar4_15
cctgagtgtgcacagacgac

SEQ ID NO: 20502 - DNA, 20 bp, Artificial Sequence
  sgRNA
  Ffar4_16
tgagatttctcctatgcggt

SEQ ID NO: 20503 - DNA, 20 bp, Artificial Sequence
  sgRNA
  Ffar4_17
ccacgacgctcaacaccaac

SEQ ID NO: 20504 - DNA, 20 bp, Artificial Sequence
  sgRNA
  Ffar4_18
tcatcacgtagaagagcagg

SEQ ID NO: 20505 - DNA, 20 bp, Artificial Sequence
  sgRNA
  Ffar4_19
ggaaattccgatttgcacat

SEQ ID NO: 20506 - DNA, 20 bp, Artificial Sequence
  sgRNA
  Ffar4_20
ttctacgtgatgacaatgag

SEQ ID NO: 20507 - DNA, 20 bp, Artificial Sequence
  sgRNA
  Fgfr1_1
tggagttaataccaccgaca

SEQ ID NO: 20508 - DNA, 20 bp, Artificial Sequence
  sgRNA
  Fgfr1_2
gcatcgtggagaatgagtat

SEQ ID NO: 20509 - DNA, 20 bp, Artificial Sequence
  sgRNA
  Fgfr1_3
tctccgagatcagatccgac

SEQ ID NO: 20510 - DNA, 20 bp, Artificial Sequence
  sgRNA
  Fgfr1_4
tctcgtggcagctcccagcg

SEQ ID NO: 20511 - DNA, 20 bp, Artificial Sequence
  sgRNA
  Fgfr1_5
gatcattatctactgcaccg

SEQ ID NO: 20512 - DNA, 20 bp, Artificial Sequence
  sgRNA
  Fgfr1_6
ttaggcaaaccacttggcga

SEQ ID NO: 20513 - DNA, 20 bp, Artificial Sequence
  sgRNA
  Fgfr1_7
gcaaccgtacccgcatcaca

SEQ ID NO: 20514 - DNA, 20 bp, Artificial Sequence
  sgRNA
  Fgfr1_8
gtgaagctaaccagtctgcg

SEQ ID NO: 20515 - DNA, 20 bp, Artificial Sequence
  sgRNA
  Fgfr1_9
acaacaccaaaccaaaccgt

SEQ ID NO: 20516 - DNA, 20 bp, Artificial Sequence
  sgRNA
  Fgfr1_10
gggagtatctacaggcccgg

SEQ ID NO: 20517 - DNA, 20 bp, Artificial Sequence
  sgRNA
  Fgfr1_11
gctgaaggagggtcatcgaa

SEQ ID NO: 20518 - DNA, 20 bp, Artificial Sequence
  sgRNA
  Fgfr1_12
atccattatgatgctccagg

SEQ ID NO: 20519 - DNA, 20 bp, Artificial Sequence
  sgRNA
  Fgfr1_13
tccaccaactgcttgaacgt

SEQ ID NO: 20520 - DNA, 20 bp, Artificial Sequence
  sgRNA
  Fgfr1_14
taaccccagccacaaccccg

SEQ ID NO: 20521 - DNA, 20 bp, Artificial Sequence
  sgRNA
  Fgfr1_15
gctgcagcagccacccacaa

SEQ ID NO: 20522 - DNA, 20 bp, Artificial Sequence
  sgRNA
  Fgfr1_16
taggtggtatcgctgccaga

SEQ ID NO: 20523 - DNA, 20 bp, Artificial Sequence
  sgRNA
  Fgfr1_17
cagtgcatccatgaactctg

SEQ ID NO: 20524 - DNA, 20 bp, Artificial Sequence
  sgRNA
  Fgfr1_18
tctgtggtgccttctgacaa

SEQ ID NO: 20525 - DNA, 20 bp, Artificial Sequence
  sgRNA
  Fgfr1_19
gctcccagcggggatcctca

SEQ ID NO: 20526 - DNA, 20 bp, Artificial Sequence
  sgRNA
  Fgfr1_20
ccttgtagcctccaattcgg

SEQ ID NO: 20527 - DNA, 20 bp, Artificial Sequence
  sgRNA
  Fgfr2_1
caactctagcgattccccgg

SEQ ID NO: 20528 - DNA, 20 bp, Artificial Sequence
  sgRNA
  Fgfr2_2
ggagacccctgctagcatcg

SEQ ID NO: 20529 - DNA, 20 bp, Artificial Sequence
  sgRNA
  Fgfr2_3
ggtgccacacctagagactc

SEQ ID NO: 20530 - DNA, 20 bp, Artificial Sequence
  sgRNA
  Fgfr2_4
ggccgccggtgttaacacca

SEQ ID NO: 20531 - DNA, 20 bp, Artificial Sequence
  sgRNA
  Fgfr2_5
gggctcggaggtattcccgg

SEQ ID NO: 20532 - DNA, 20 bp, Artificial Sequence
  sgRNA
  Fgfr2_6
cgttgttatcctcaccagcg

SEQ ID NO: 20533 - DNA, 20 bp, Artificial Sequence
  sgRNA
  Fgfr2_7
gcaactctagcgattccccg

SEQ ID NO: 20534 - DNA, 20 bp, Artificial Sequence
  sgRNA
  Fgfr2_8
cttagtccaactgatcacgg

SEQ ID NO: 20535 - DNA, 20 bp, Artificial Sequence
  sgRNA
  Fgfr2_9
gggaatacctccgagcccgg

SEQ ID NO: 20536 - DNA, 20 bp, Artificial Sequence
  sgRNA
  Fgfr2_10
gattccccccagccggacag

SEQ ID NO: 20537 - DNA, 20 bp, Artificial Sequence
  sgRNA
  Fgfr2_11
tgacattaaccgtgtccccg

SEQ ID NO: 20538 - DNA, 20 bp, Artificial Sequence
  sgRNA
  Fgfr2_12
gcctgcaaatgcctccacgg

SEQ ID NO: 20539 - DNA, 20 bp, Artificial Sequence
  sgRNA
  Fgfr2_13
gttctcactgacaacgtctt

SEQ ID NO: 20540 - DNA, 20 bp, Artificial Sequence
  sgRNA
  Fgfr2_14
gctggctctgttcaatgtga

SEQ ID NO: 20541 - DNA, 20 bp, Artificial Sequence
  sgRNA
  Fgfr2_15
acccaaggaggcggtcaccg

SEQ ID NO: 20542 - DNA, 20 bp, Artificial Sequence
  sgRNA
  Fgfr2_16
tgaaggtcatctgctcctcg

SEQ ID NO: 20543 - DNA, 20 bp, Artificial Sequence
  sgRNA
  Fgfr2_17
tattcaactatgacgtagag

SEQ ID NO: 20544 - DNA, 20 bp, Artificial Sequence
  sgRNA
  Fgfr2_18
gataccactttagaaccaga

SEQ ID NO: 20545 - DNA, 20 bp, Artificial Sequence
  sgRNA
  Fgfr2_19
ggtgtcctgcacctaccagc

SEQ ID NO: 20546 - DNA, 20 bp, Artificial Sequence
  sgRNA
  Fgfr2_20
gcagtaaatacgggcctgat

SEQ ID NO: 20547 - DNA, 20 bp, Artificial Sequence
  sgRNA
  Fgfr3_1
gtatagttgccacgatcgga

SEQ ID NO: 20548 - DNA, 20 bp, Artificial Sequence
  sgRNA
  Fgfr3_2
gaggctggcagcgtgtacgc

SEQ ID NO: 20549 - DNA, 20 bp, Artificial Sequence
  sgRNA
  Fgfr3_3
tgacaaggacctgtcggacc

SEQ ID NO: 20550 - DNA, 20 bp, Artificial Sequence
  sgRNA
  Fgfr3_4
tctgttacctgtcgcttaag

SEQ ID NO: 20551 - DNA, 20 bp, Artificial Sequence
  sgRNA
  Fgfr3_5
gaatggcaaagaattccgag

SEQ ID NO: 20552 - DNA, 20 bp, Artificial Sequence
  sgRNA
  Fgfr3_6
gttgaaagagggccaccgca

SEQ ID NO: 20553 - DNA, 20 bp, Artificial Sequence
  sgRNA
  Fgfr3_7
atgtcacctttgaggacgcg

SEQ ID NO: 20554 - DNA, 20 bp, Artificial Sequence
  sgRNA
  Fgfr3_8
ccaggtccacccagtaacgg

SEQ ID NO: 20555 - DNA, 20 bp, Artificial Sequence
  sgRNA
  Fgfr3_9
cgtgctagtgttctgcgtgg

SEQ ID NO: 20556 - DNA, 20 bp, Artificial Sequence
  sgRNA
  Fgfr3_10
tctcagataccaggtccgac

SEQ ID NO: 20557 - DNA, 20 bp, Artificial Sequence
  sgRNA
  Fgfr3_11
cgagtactgctcaaacggca

SEQ ID NO: 20558 - DNA, 20 bp, Artificial Sequence
  sgRNA
  Fgfr3_12
gtagacccctgcatcttcgt

SEQ ID NO: 20559 - DNA, 20 bp, Artificial Sequence
  sgRNA
  Fgfr3_13
ccagcgtaaagatctcccag

SEQ ID NO: 20560 - DNA, 20 bp, Artificial Sequence
  sgRNA
  Fgfr3_14
agaatggcaaagaattccga

SEQ ID NO: 20561 - DNA, 20 bp, Artificial Sequence
  sgRNA
  Fgfr3_15
agccaccaatttcataggcg

SEQ ID NO: 20562 - DNA, 20 bp, Artificial Sequence
  sgRNA
  Fgfr3_16
ggctccttattggactcgcc

SEQ ID NO: 20563 - DNA, 20 bp, Artificial Sequence
  sgRNA
  Fgfr3_17
gtatcacagctgccaccacc

SEQ ID NO: 20564 - DNA, 20 bp, Artificial Sequence
  sgRNA
  Fgfr3_18
actactcctttgatgcctgc

SEQ ID NO: 20565 - DNA, 20 bp, Artificial Sequence
  sgRNA
  Fgfr3_19
tgtcgagccaccaatttcat

SEQ ID NO: 20566 - DNA, 20 bp, Artificial Sequence
  sgRNA
  Fgfr3_20
gcagcgagttgtgcggagag

SEQ ID NO: 20567 - DNA, 20 bp, Artificial Sequence
  sgRNA
  Fgfr4_1
caacgtaagattgtgtacga

SEQ ID NO: 20568 - DNA, 20 bp, Artificial Sequence
  sgRNA
  Fgfr4_2
ttgtacgtaggggaaaccgt

SEQ ID NO: 20569 - DNA, 20 bp, Artificial Sequence
  sgRNA
  Fgfr4_3
ggatggacaggccttccacg

SEQ ID NO: 20570 - DNA, 20 bp, Artificial Sequence
  sgRNA
  Fgfr4_4
gacttgccgatgatacaccc

SEQ ID NO: 20571 - DNA, 20 bp, Artificial Sequence
  sgRNA
  Fgfr4_5
gtaccagtgacgaccacgct

SEQ ID NO: 20572 - DNA, 20 bp, Artificial Sequence
  sgRNA
  Fgfr4_6
gggcacggaggaattcccga

SEQ ID NO: 20573 - DNA, 20 bp, Artificial Sequence
  sgRNA
  Fgfr4_7
gcatctgctgggcgagtacg

SEQ ID NO: 20574 - DNA, 20 bp, Artificial Sequence
  sgRNA
  Fgfr4_8
gcctttcctaccagtcagcg

SEQ ID NO: 20575 - DNA, 20 bp, Artificial Sequence
  sgRNA
  Fgfr4_9
ggtcgtcactggtacaaaga

SEQ ID NO: 20576 - DNA, 20 bp, Artificial Sequence
  sgRNA
  Fgfr4_10
agtggtccttcgctgctccg

SEQ ID NO: 20577 - DNA, 20 bp, Artificial Sequence
  sgRNA
  Fgfr4_11
gctcctccaccggaatgcca

SEQ ID NO: 20578 - DNA, 20 bp, Artificial Sequence
  sgRNA
  Fgfr4_12
ccaaagcagccctcacccag

SEQ ID NO: 20579 - DNA, 20 bp, Artificial Sequence
  sgRNA
  Fgfr4_13
cactctggtgtgtgtacacg

SEQ ID NO: 20580 - DNA, 20 bp, Artificial Sequence
  sgRNA
  Fgfr4_14
gtgtatgtgccacggtccga

SEQ ID NO: 20581 - DNA, 20 bp, Artificial Sequence
  sgRNA
  Fgfr4_15
acgcccagccccacatacag

SEQ ID NO: 20582 - DNA, 20 bp, Artificial Sequence
  sgRNA
  Fgfr4_16
gagacggacacctcgcacca

SEQ ID NO: 20583 - DNA, 20 bp, Artificial Sequence
  sgRNA
  Fgfr4_17
ctccaatacgattctccccg

SEQ ID NO: 20584 - DNA, 20 bp, Artificial Sequence
  sgRNA
  Fgfr4_18
gcccgaccaaaccagcaccg

SEQ ID NO: 20585 - DNA, 20 bp, Artificial Sequence
  sgRNA
  Fgfr4_19
aatttgacagtattcccggc

SEQ ID NO: 20586 - DNA, 20 bp, Artificial Sequence
  sgRNA
  Fgfr4_20
aattcccaaagcggatcgag

SEQ ID NO: 20587 - DNA, 20 bp, Artificial Sequence
  sgRNA
  Fgfrl1_1
gatggccgcacaatccacag

SEQ ID NO: 20588 - DNA, 20 bp, Artificial Sequence
  sgRNA
  Fgfrl1_2
cgtgaccacacatcacccgt

SEQ ID NO: 20589 - DNA, 20 bp, Artificial Sequence
  sgRNA
  Fgfrl1_3
agcccatggtatttgcacct

SEQ ID NO: 20590 - DNA, 20 bp, Artificial Sequence
  sgRNA
  Fgfrl1_4
cacgtgccgtgtatctaaca

SEQ ID NO: 20591 - DNA, 20 bp, Artificial Sequence
  sgRNA
  Fgfrl1_5
catatgcccacagccaatga

SEQ ID NO: 20592 - DNA, 20 bp, Artificial Sequence
  sgRNA
  Fgfrl1_6
tggccccccgaagaaccacc

SEQ ID NO: 20593 - DNA, 20 bp, Artificial Sequence
  sgRNA
  Fgfrl1_7
gctattgggggccctcccgt

SEQ ID NO: 20594 - DNA, 20 bp, Artificial Sequence
  sgRNA
  Fgfrl1_8
agtccaccgttgtgttcaca

SEQ ID NO: 20595 - DNA, 20 bp, Artificial Sequence
  sgRNA
  Fgfrl1_9
gcggccatctttggtccaca

SEQ ID NO: 20596 - DNA, 20 bp, Artificial Sequence
  sgRNA
  Fgfrl1_10
gctcatctctcgggcccgcc

SEQ ID NO: 20597 - DNA, 20 bp, Artificial Sequence
  sgRNA
  Fgfrl1_11
tgccgtgtatctaacaaggc

SEQ ID NO: 20598 - DNA, 20 bp, Artificial Sequence
  sgRNA
  Fgfrl1_12
gacacaccctgtgaacacaa

SEQ ID NO: 20599 - DNA, 20 bp, Artificial Sequence
  sgRNA
  Fgfrl1_13
ggccttgcacacataaacac

SEQ ID NO: 20600 - DNA, 20 bp, Artificial Sequence
  sgRNA
  Fgfrl1_14
tgaggcgccgagtgattgca

SEQ ID NO: 20601 - DNA, 20 bp, Artificial Sequence
  sgRNA
  Fgfrl1_15
gggacatcccgagaacgcag

SEQ ID NO: 20602 - DNA, 20 bp, Artificial Sequence
  sgRNA
  Fgfrl1_16
actcggcgcctcatcttgga

SEQ ID NO: 20603 - DNA, 20 bp, Artificial Sequence
  sgRNA
  Fgfrl1_17
gctacggaaactgtagccca

SEQ ID NO: 20604 - DNA, 20 bp, Artificial Sequence
  sgRNA
  Fgfrl1_18
cgcttccgtgtgctgcccca

SEQ ID NO: 20605 - DNA, 20 bp, Artificial Sequence
  sgRNA
  Fgfrl1_19
caccggccttgttagataca

SEQ ID NO: 20606 - DNA, 20 bp, Artificial Sequence
  sgRNA
  Fgfrl1_20
gctggtgctgtcttcatcct

SEQ ID NO: 20607 - DNA, 20 bp, Artificial Sequence
  sgRNA
  Fkrp_1
gctggacttgaccttcgccg

SEQ ID NO: 20608 - DNA, 20 bp, Artificial Sequence
  sgRNA
  Fkrp_2
ccaatggcagaagtccggcg

SEQ ID NO: 20609 - DNA, 20 bp, Artificial Sequence
  sgRNA
  Fkrp_3
ccatccaaagcgtcgcagcg

SEQ ID NO: 20610 - DNA, 20 bp, Artificial Sequence
  sgRNA
  Fkrp_4
cacaaactcggtggctacgt

SEQ ID NO: 20611 - DNA, 20 bp, Artificial Sequence
  sgRNA
  Fkrp_5
ctgtcaagcttaagagtgcg

SEQ ID NO: 20612 - DNA, 20 bp, Artificial Sequence
  sgRNA
  Fkrp_6
ctcaaattcccgaatcagga

SEQ ID NO: 20613 - DNA, 20 bp, Artificial Sequence
  sgRNA
  Fkrp_7
acttcagctccaggaagcgg

SEQ ID NO: 20614 - DNA, 20 bp, Artificial Sequence
  sgRNA
  Fkrp_8
gatctacgtcgtagtcccaa

SEQ ID NO: 20615 - DNA, 20 bp, Artificial Sequence
  sgRNA
  Fkrp_9
ccacggcgacatcatccctt

SEQ ID NO: 20616 - DNA, 20 bp, Artificial Sequence
  sgRNA
  Fkrp_10
gcggccctcatacaggtagg

SEQ ID NO: 20617 - DNA, 20 bp, Artificial Sequence
  sgRNA
  Fkrp_11
acacccgcctacctgtatga

SEQ ID NO: 20618 - DNA, 20 bp, Artificial Sequence
  sgRNA
  Fkrp_12
cgccatccaaagcgtcgcag

SEQ ID NO: 20619 - DNA, 20 bp, Artificial Sequence
  sgRNA
  Fkrp_13
tgtgccatgaaacccgcaaa

SEQ ID NO: 20620 - DNA, 20 bp, Artificial Sequence
  sgRNA
  Fkrp_14
ggctcggtagtggatgaacg

SEQ ID NO: 20621 - DNA, 20 bp, Artificial Sequence
  sgRNA
  Fkrp_15
tcagagctaggcaccgcgct

SEQ ID NO: 20622 - DNA, 20 bp, Artificial Sequence
  sgRNA
  Fkrp_16
gcgcgagactgcgcgctacg

SEQ ID NO: 20623 - DNA, 20 bp, Artificial Sequence
  sgRNA
  Fkrp_17
cctccaccattcgctccagg

SEQ ID NO: 20624 - DNA, 20 bp, Artificial Sequence
  sgRNA
  Fkrp_18
ttggtcataaccccattgcg

SEQ ID NO: 20625 - DNA, 20 bp, Artificial Sequence
  sgRNA
  Fkrp_19
gcgctcgttgggaatccgtc

SEQ ID NO: 20626 - DNA, 20 bp, Artificial Sequence
  sgRNA
  Fkrp_20
ctgggaactcaacatcctgc

SEQ ID NO: 20627 - DNA, 20 bp, Artificial Sequence
  sgRNA
  Flrt1_1
ctccaacattgactacccca

SEQ ID NO: 20628 - DNA, 20 bp, Artificial Sequence
  sgRNA
  Flrt1_2
tgctatcgatgacctccgtg

SEQ ID NO: 20629 - DNA, 20 bp, Artificial Sequence
  sgRNA
  Flrt1_3
gacccttgaatgcgtgcagg

SEQ ID NO: 20630 - DNA, 20 bp, Artificial Sequence
  sgRNA
  Flrt1_4
gtcgctagtacggaactcgc

SEQ ID NO: 20631 - DNA, 20 bp, Artificial Sequence
  sgRNA
  Flrt1_5
gctgcagtggtcaatgtgcg

SEQ ID NO: 20632 - DNA, 20 bp, Artificial Sequence
  sgRNA
  Flrt1_6
gctacgtctgggccatagcc

SEQ ID NO: 20633 - DNA, 20 bp, Artificial Sequence
  sgRNA
  Flrt1_7
gcgctgggcagattaagggg

SEQ ID NO: 20634 - DNA, 20 bp, Artificial Sequence
  sgRNA
  Flrt1_8
gtactagcgacagctccgtg

SEQ ID NO: 20635 - DNA, 20 bp, Artificial Sequence
  sgRNA
  Flrt1_9
attggctatggcaccacacg

SEQ ID NO: 20636 - DNA, 20 bp, Artificial Sequence
  sgRNA
  Flrt1_10
ggttacagccacagaaccag

SEQ ID NO: 20637 - DNA, 20 bp, Artificial Sequence
  sgRNA
  Flrt1_11
agaatgctggccctatggcg

SEQ ID NO: 20638 - DNA, 20 bp, Artificial Sequence
  sgRNA
  Flrt1_12
cagactctatccgaatcaca

SEQ ID NO: 20639 - DNA, 20 bp, Artificial Sequence
  sgRNA
  Flrt1_13
gctcattgccttcctcacgg

SEQ ID NO: 20640 - DNA, 20 bp, Artificial Sequence
  sgRNA
  Flrt1_14
ccaccaataatcccagccag

SEQ ID NO: 20641 - DNA, 20 bp, Artificial Sequence
  sgRNA
  Flrt1_15
ataacagagaccctggtgca

SEQ ID NO: 20642 - DNA, 20 bp, Artificial Sequence
  sgRNA
  Flrt1_16
ttgccgacgacaccttcagc

SEQ ID NO: 20643 - DNA, 20 bp, Artificial Sequence
  sgRNA
  Flrt1_17
ggttccccaggtcatcaaac

SEQ ID NO: 20644 - DNA, 20 bp, Artificial Sequence
  sgRNA
  Flrt1_18
cgagctgctgacccgagaga

SEQ ID NO: 20645 - DNA, 20 bp, Artificial Sequence
  sgRNA
  Flrt1_19
gatggatgagtgctttgagg

SEQ ID NO: 20646 - DNA, 20 bp, Artificial Sequence
  sgRNA
  Flrt1_20
caacccgtaccgctccaaag

SEQ ID NO: 20647 - DNA, 20 bp, Artificial Sequence
  sgRNA
  Flrt2_1
gatggtgggaagtttcgatg

SEQ ID NO: 20648 - DNA, 20 bp, Artificial Sequence
  sgRNA
  Flrt2_2
cacgcacgttgagagaagaa

SEQ ID NO: 20649 - DNA, 20 bp, Artificial Sequence
  sgRNA
  Flrt2_3
cagctacgaatgttaactca

SEQ ID NO: 20650 - DNA, 20 bp, Artificial Sequence
  sgRNA
  Flrt2_4
gggaatcttctgaccaacaa

SEQ ID NO: 20651 - DNA, 20 bp, Artificial Sequence
  sgRNA
  Flrt2_5
tcatggggaactcatccaac

SEQ ID NO: 20652 - DNA, 20 bp, Artificial Sequence
  sgRNA
  Flrt2_6
agtgcctcttgggatcccgg

SEQ ID NO: 20653 - DNA, 20 bp, Artificial Sequence
  sgRNA
  Flrt2_7
tgtcacagcggcatacacta

SEQ ID NO: 20654 - DNA, 20 bp, Artificial Sequence
  sgRNA
  Flrt2_8
gcctgatcagatgcgtacct

SEQ ID NO: 20655 - DNA, 20 bp, Artificial Sequence
  sgRNA
  Flrt2_9
tgtctgatatgacggcaatt

SEQ ID NO: 20656 - DNA, 20 bp, Artificial Sequence
  sgRNA
  Flrt2_10
cagaagtggaaatacaaccg

SEQ ID NO: 20657 - DNA, 20 bp, Artificial Sequence
  sgRNA
  Flrt2_11
ccttcttctctcaacgtgcg

SEQ ID NO: 20658 - DNA, 20 bp, Artificial Sequence
  sgRNA
  Flrt2_12
gtttgaggctaatcgcctcc

SEQ ID NO: 20659 - DNA, 20 bp, Artificial Sequence
  sgRNA
  Flrt2_13
tctgccatcccaatcaggga

SEQ ID NO: 20660 - DNA, 20 bp, Artificial Sequence
  sgRNA
  Flrt2_14
atatggagttgtcgtccagg

SEQ ID NO: 20661 - DNA, 20 bp, Artificial Sequence
  sgRNA
  Flrt2_15
actccctgacagccatcccg

SEQ ID NO: 20662 - DNA, 20 bp, Artificial Sequence
  sgRNA
  Flrt2_16
ggtggtagcctccgaacaga

SEQ ID NO: 20663 - DNA, 20 bp, Artificial Sequence
  sgRNA
  Flrt2_17
acctgaaacaactcactgcg

SEQ ID NO: 20664 - DNA, 20 bp, Artificial Sequence
  sgRNA
  Flrt2_18
ggaagataccatctgttcgg

SEQ ID NO: 20665 - DNA, 20 bp, Artificial Sequence
  sgRNA
  Flrt2_19
ggtttgcgaaggctgtcaat

SEQ ID NO: 20666 - DNA, 20 bp, Artificial Sequence
  sgRNA
  Flrt2_20
atacttcgattcaagtcagc

SEQ ID NO: 20667 - DNA, 20 bp, Artificial Sequence
  sgRNA
  Flrt3_1
tcggctgttagcatcgaaga

SEQ ID NO: 20668 - DNA, 20 bp, Artificial Sequence
  sgRNA
  Flrt3_2
tctctgacatccattccagt

SEQ ID NO: 20669 - DNA, 20 bp, Artificial Sequence
  sgRNA
  Flrt3_3
tcaagacaaccatatcaacc

SEQ ID NO: 20670 - DNA, 20 bp, Artificial Sequence
  sgRNA
  Flrt3_4
ggaattcatctaaactgttg

SEQ ID NO: 20671 - DNA, 20 bp, Artificial Sequence
  sgRNA
  Flrt3_5
gtttgggtctcaatacaaac

SEQ ID NO: 20672 - DNA, 20 bp, Artificial Sequence
  sgRNA
  Flrt3_6
tgtcaaggaattcctcacca

SEQ ID NO: 20673 - DNA, 20 bp, Artificial Sequence
  sgRNA
  Flrt3_7
ggggttgtacattcgaagag

SEQ ID NO: 20674 - DNA, 20 bp, Artificial Sequence
  sgRNA
  Flrt3_8
gagatgggttcattgcttat

SEQ ID NO: 20675 - DNA, 20 bp, Artificial Sequence
  sgRNA
  Flrt3_9
tacagattcatcccattcgg

SEQ ID NO: 20676 - DNA, 20 bp, Artificial Sequence
  sgRNA
  Flrt3_10
gcatcctccggaattcccac

SEQ ID NO: 20677 - DNA, 20 bp, Artificial Sequence
  sgRNA
  Flrt3_11
ggttactactgctctcactg

SEQ ID NO: 20678 - DNA, 20 bp, Artificial Sequence
  sgRNA
  Flrt3_12
gggtgattcaggttctaggg

SEQ ID NO: 20679 - DNA, 20 bp, Artificial Sequence
  sgRNA
  Flrt3_13
ggtccttgatagccattcca

SEQ ID NO: 20680 - DNA, 20 bp, Artificial Sequence
  sgRNA
  Flrt3_14
cacaccatatttcctccgaa

SEQ ID NO: 20681 - DNA, 20 bp, Artificial Sequence
  sgRNA
  Flrt3_15
gtatctggaagagttacact

SEQ ID NO: 20682 - DNA, 20 bp, Artificial Sequence
  sgRNA
  Flrt3_16
ccaacacaccaaagcaagga

SEQ ID NO: 20683 - DNA, 20 bp, Artificial Sequence
  sgRNA
  Flrt3_17
gactattgaggaattacgcc

SEQ ID NO: 20684 - DNA, 20 bp, Artificial Sequence
  sgRNA
  Flrt3_18
cgactcagctggcttaaact

SEQ ID NO: 20685 - DNA, 20 bp, Artificial Sequence
  sgRNA
  Flrt3_19
atagtcctgggcaagccccc

SEQ ID NO: 20686 - DNA, 20 bp, Artificial Sequence
  sgRNA
  Flrt3_20
caccttagcacaatcccggg

SEQ ID NO: 20687 - DNA, 20 bp, Artificial Sequence
  sgRNA
  Flt1_1
agtgatggagtaatcttgag

SEQ ID NO: 20688 - DNA, 20 bp, Artificial Sequence
  sgRNA
  Flt1_2
cctcgtattgagctccgtgg

SEQ ID NO: 20689 - DNA, 20 bp, Artificial Sequence
  sgRNA
  Flt1_3
cttaccatacacatgcacgg

SEQ ID NO: 20690 - DNA, 20 bp, Artificial Sequence
  sgRNA
  Flt1_4
tctattgtaggcaaatcgct

SEQ ID NO: 20691 - DNA, 20 bp, Artificial Sequence
  sgRNA
  Flt1_5
acccccagactacaactccg

SEQ ID NO: 20692 - DNA, 20 bp, Artificial Sequence
  sgRNA
  Flt1_6
gtacaggtgcccgttgacgg

SEQ ID NO: 20693 - DNA, 20 bp, Artificial Sequence
  sgRNA
  Flt1_7
tcttcgaagtagatgtaggg

SEQ ID NO: 20694 - DNA, 20 bp, Artificial Sequence
  sgRNA
  Flt1_8
gcttcaagccaacgtccaac

SEQ ID NO: 20695 - DNA, 20 bp, Artificial Sequence
  sgRNA
  Flt1_9
tgatgggcaaagaataacat

SEQ ID NO: 20696 - DNA, 20 bp, Artificial Sequence
  sgRNA
  Flt1_10
agcccacctctctatccgct

SEQ ID NO: 20697 - DNA, 20 bp, Artificial Sequence
  sgRNA
  Flt1_11
gccacgtgattgttggccga

SEQ ID NO: 20698 - DNA, 20 bp, Artificial Sequence
  sgRNA
  Flt1_12
tatcaaagatgtgacaaccg

SEQ ID NO: 20699 - DNA, 20 bp, Artificial Sequence
  sgRNA
  Flt1_13
gcaccgtgtatggcatccct

SEQ ID NO: 20700 - DNA, 20 bp, Artificial Sequence
  sgRNA
  Flt1_14
tccctcggccaacaatcacg

SEQ ID NO: 20701 - DNA, 20 bp, Artificial Sequence
  sgRNA
  Flt1_15
tgttattctttgcccatcag

SEQ ID NO: 20702 - DNA, 20 bp, Artificial Sequence
  sgRNA
  Flt1_16
ttaagaaatcacccacctgc

SEQ ID NO: 20703 - DNA, 20 bp, Artificial Sequence
  sgRNA
  Flt1_17
cactttcatggacagccgat

SEQ ID NO: 20704 - DNA, 20 bp, Artificial Sequence
  sgRNA
  Flt1_18
cagcgcgtaaggcaagaccg

SEQ ID NO: 20705 - DNA, 20 bp, Artificial Sequence
  sgRNA
  Flt1_19
gctgagcatcactcccccat

SEQ ID NO: 20706 - DNA, 20 bp, Artificial Sequence
  sgRNA
  Flt1_20
aggcatgcggatgagaaccc

SEQ ID NO: 20707 - DNA, 20 bp, Artificial Sequence
  sgRNA
  Flt3_1
cagtactctaaatatgagtg

SEQ ID NO: 20708 - DNA, 20 bp, Artificial Sequence
  sgRNA
  Flt3_2
cccactttcaggaataactg

SEQ ID NO: 20709 - DNA, 20 bp, Artificial Sequence
  sgRNA
  Flt3_3
tccacgtgcatcggattcgt

SEQ ID NO: 20710 - DNA, 20 bp, Artificial Sequence
  sgRNA
  Flt3_4
ctatgaatatgaccttaagt

SEQ ID NO: 20711 - DNA, 20 bp, Artificial Sequence
  sgRNA
  Flt3_5
gatcttcaccaccttcccgt

SEQ ID NO: 20712 - DNA, 20 bp, Artificial Sequence
  sgRNA
  Flt3_6
gtagaagtactcgttatcca

SEQ ID NO: 20713 - DNA, 20 bp, Artificial Sequence
  sgRNA
  Flt3_7
ggaatgtgttggtcacccac

SEQ ID NO: 20714 - DNA, 20 bp, Artificial Sequence
  sgRNA
  Flt3_8
tagcgtcgacaggaatgcca

SEQ ID NO: 20715 - DNA, 20 bp, Artificial Sequence
  sgRNA
  Flt3_9
cctttgctttgcgtaccaag

SEQ ID NO: 20716 - DNA, 20 bp, Artificial Sequence
  sgRNA
  Flt3_10
tttactaatgccataggccg

SEQ ID NO: 20717 - DNA, 20 bp, Artificial Sequence
  sgRNA
  Flt3_11
aagtgcagctcgccacccca

SEQ ID NO: 20718 - DNA, 20 bp, Artificial Sequence
  sgRNA
  Flt3_12
agactcggccacctccacgg

SEQ ID NO: 20719 - DNA, 20 bp, Artificial Sequence
  sgRNA
  Flt3_13
catccatctaccaaaacagg

SEQ ID NO: 20720 - DNA, 20 bp, Artificial Sequence
  sgRNA
  Flt3_14
ggtctctgtcacgttcaaga

SEQ ID NO: 20721 - DNA, 20 bp, Artificial Sequence
  sgRNA
  Flt3_15
ttatagaagttagcgtcgac

SEQ ID NO: 20722 - DNA, 20 bp, Artificial Sequence
  sgRNA
  Flt3_16
ggtgctctgcagctcccaca

SEQ ID NO: 20723 - DNA, 20 bp, Artificial Sequence
  sgRNA
  Flt3_17
agatcttcaccaccttcccg

SEQ ID NO: 20724 - DNA, 20 bp, Artificial Sequence
  sgRNA
  Flt3_18
gagtactgctcgacacccac

SEQ ID NO: 20725 - DNA, 20 bp, Artificial Sequence
  sgRNA
  Flt3_19
gccttacacctgatccacaa

SEQ ID NO: 20726 - DNA, 20 bp, Artificial Sequence
  sgRNA
  Flt3_20
gctggaagacaaagccctgg

SEQ ID NO: 20727 - DNA, 20 bp, Artificial Sequence
  sgRNA
  Flt3l_1
taaagattacccagtcactg

SEQ ID NO: 20728 - DNA, 20 bp, Artificial Sequence
  sgRNA
  Flt3l_2
gctaacctggaaggtacatg

SEQ ID NO: 20729 - DNA, 20 bp, Artificial Sequence
  sgRNA
  Flt3l_3
gcaccgagagaaattctggc

SEQ ID NO: 20730 - DNA, 20 bp, Artificial Sequence
  sgRNA
  Flt3l_4
cagttgctctatccagcgct

SEQ ID NO: 20731 - DNA, 20 bp, Artificial Sequence
  sgRNA
  Flt3l_5
tggcaggccttcccgataca

SEQ ID NO: 20732 - DNA, 20 bp, Artificial Sequence
  sgRNA
  Flt3l_6
gaatttctctcggtgcctgg

SEQ ID NO: 20733 - DNA, 20 bp, Artificial Sequence
  sgRNA
  Flt3l_7
cgaatcgcagacattctggt

SEQ ID NO: 20734 - DNA, 20 bp, Artificial Sequence
  sgRNA
  Flt3l_8
ggctaggaagaggctccaca

SEQ ID NO: 20735 - DNA, 20 bp, Artificial Sequence
  sgRNA
  Flt3l_9
gatagagcaactgaagactg

SEQ ID NO: 20736 - DNA, 20 bp, Artificial Sequence
  sgRNA
  Flt3l_10
ttgccagcgaaggccccagg

SEQ ID NO: 20737 - DNA, 20 bp, Artificial Sequence
  sgRNA
  Flt3l_11
ccgaggctctgggagctccg

SEQ ID NO: 20738 - DNA, 20 bp, Artificial Sequence
  sgRNA
  Flt3l_12
gctgctgctgcctctcacac

SEQ ID NO: 20739 - DNA, 20 bp, Artificial Sequence
  sgRNA
  Flt3l_13
acacacagttagcaaggctg

SEQ ID NO: 20740 - DNA, 20 bp, Artificial Sequence
  sgRNA
  Flt3l_14
agcaacagctgcctgggccg

SEQ ID NO: 20741 - DNA, 20 bp, Artificial Sequence
  sgRNA
  Flt3l_15
gcaggtgtccttcaggaggt

SEQ ID NO: 20742 - DNA, 20 bp, Artificial Sequence
  sgRNA
  Flt3l_16
cagcactgtcatctctgccg

SEQ ID NO: 20743 - DNA, 20 bp, Artificial Sequence
  sgRNA
  Flt3l_17
gctgctgagtccttgcctgc

SEQ ID NO: 20744 - DNA, 20 bp, Artificial Sequence
  sgRNA
  Flt3l_18
tcccatagccctagaagcca

SEQ ID NO: 20745 - DNA, 20 bp, Artificial Sequence
  sgRNA
  Flt3l_19
ggacccctcatgcctgtgac

SEQ ID NO: 20746 - DNA, 20 bp, Artificial Sequence
  sgRNA
  Flt3l_20
tgtgtgaagtgccaactagt

SEQ ID NO: 20747 - DNA, 20 bp, Artificial Sequence
  sgRNA
  Flt4_1
agctgtccagactctcgatg

SEQ ID NO: 20748 - DNA, 20 bp, Artificial Sequence
  sgRNA
  Flt4_2
cagtttgaatatcccccgag

SEQ ID NO: 20749 - DNA, 20 bp, Artificial Sequence
  sgRNA
  Flt4_3
ctcacctcttacaaacacat

SEQ ID NO: 20750 - DNA, 20 bp, Artificial Sequence
  sgRNA
  Flt4_4
gggtctacactctcgccctg

SEQ ID NO: 20751 - DNA, 20 bp, Artificial Sequence
  sgRNA
  Flt4_5
catcggcaaccatctcaacg

SEQ ID NO: 20752 - DNA, 20 bp, Artificial Sequence
  sgRNA
  Flt4_6
ggacggtttcagtatcgagt

SEQ ID NO: 20753 - DNA, 20 bp, Artificial Sequence
  sgRNA
  Flt4_7
ccttcgactgggattatcca

SEQ ID NO: 20754 - DNA, 20 bp, Artificial Sequence
  sgRNA
  Flt4_8
gcttggtgcacgcccctagg

SEQ ID NO: 20755 - DNA, 20 bp, Artificial Sequence
  sgRNA
  Flt4_9
cctccaaaggcacctccccg

SEQ ID NO: 20756 - DNA, 20 bp, Artificial Sequence
  sgRNA
  Flt4_10
ggacacgttcaacccctacg

SEQ ID NO: 20757 - DNA, 20 bp, Artificial Sequence
  sgRNA
  Flt4_11
tgccctttcggacatagtcg

SEQ ID NO: 20758 - DNA, 20 bp, Artificial Sequence
  sgRNA
  Flt4_12
gcacatgcgctccagccacc

SEQ ID NO: 20759 - DNA, 20 bp, Artificial Sequence
  sgRNA
  Flt4_13
gctgtaccccaagaagtcaa

SEQ ID NO: 20760 - DNA, 20 bp, Artificial Sequence
  sgRNA
  Flt4_14
actccacgatcaccatgaga

SEQ ID NO: 20761 - DNA, 20 bp, Artificial Sequence
  sgRNA
  Flt4_15
gatgtgcacgacgaagagat

SEQ ID NO: 20762 - DNA, 20 bp, Artificial Sequence
  sgRNA
  Flt4_16
gctggcagcttatcccccac

SEQ ID NO: 20763 - DNA, 20 bp, Artificial Sequence
  sgRNA
  Flt4_17
cgaggtgcaacctttccctg

SEQ ID NO: 20764 - DNA, 20 bp, Artificial Sequence
  sgRNA
  Flt4_18
gactcgatactgaaaccgtc

SEQ ID NO: 20765 - DNA, 20 bp, Artificial Sequence
  sgRNA
  Flt4_19
ggtgctcaaagaggtgaccg

SEQ ID NO: 20766 - DNA, 20 bp, Artificial Sequence
  sgRNA
  Flt4_20
aggaggtactgaccacaggt

SEQ ID NO: 20767 - DNA, 20 bp, Artificial Sequence
  sgRNA
  Flvcr1_1
cttgggtccaaaccataccg

SEQ ID NO: 20768 - DNA, 20 bp, Artificial Sequence
  sgRNA
  Flvcr1_2
aacagactataatagtccag

SEQ ID NO: 20769 - DNA, 20 bp, Artificial Sequence
  sgRNA
  Flvcr1_3
ggatctacccgactatcaac

SEQ ID NO: 20770 - DNA, 20 bp, Artificial Sequence
  sgRNA
  Flvcr1_4
acaccacgatgatgtacccg

SEQ ID NO: 20771 - DNA, 20 bp, Artificial Sequence
  sgRNA
  Flvcr1_5
gccgcaagccctgatagcgg

SEQ ID NO: 20772 - DNA, 20 bp, Artificial Sequence
  sgRNA
  Flvcr1_6
gcaagccctgatagcggcgg

SEQ ID NO: 20773 - DNA, 20 bp, Artificial Sequence
  sgRNA
  Flvcr1_7
cgtgttcgaggacttctacg

SEQ ID NO: 20774 - DNA, 20 bp, Artificial Sequence
  sgRNA
  Flvcr1_8
atgactggttacctcccgct

SEQ ID NO: 20775 - DNA, 20 bp, Artificial Sequence
  sgRNA
  Flvcr1_9
ttcacattcacactgaacct

SEQ ID NO: 20776 - DNA, 20 bp, Artificial Sequence
  sgRNA
  Flvcr1_10
agtgatggtgtctatacagt

SEQ ID NO: 20777 - DNA, 20 bp, Artificial Sequence
  sgRNA
  Flvcr1_11
gcgcgcttggtaccgcaaaa

SEQ ID NO: 20778 - DNA, 20 bp, Artificial Sequence
  sgRNA
  Flvcr1_12
agcagcaccacgaagcgcct

SEQ ID NO: 20779 - DNA, 20 bp, Artificial Sequence
  sgRNA
  Flvcr1_13
gacagccagttgatgtgcag

SEQ ID NO: 20780 - DNA, 20 bp, Artificial Sequence
  sgRNA
  Flvcr1_14
tgtaggagtactcttcaggg

SEQ ID NO: 20781 - DNA, 20 bp, Artificial Sequence
  sgRNA
  Flvcr1_15
ggataccttccagtgcccaa

SEQ ID NO: 20782 - DNA, 20 bp, Artificial Sequence
  sgRNA
  Flvcr1_16
gaaggcacaatataaacacc

SEQ ID NO: 20783 - DNA, 20 bp, Artificial Sequence
  sgRNA
  Flvcr1_17
gctgtactggatccactgga

SEQ ID NO: 20784 - DNA, 20 bp, Artificial Sequence
  sgRNA
  Flvcr1_18
tgtcgccgctgcacatcaac

SEQ ID NO: 20785 - DNA, 20 bp, Artificial Sequence
  sgRNA
  Flvcr1_19
tgttgatgttatgagccagg

SEQ ID NO: 20786 - DNA, 20 bp, Artificial Sequence
  sgRNA
  Flvcr1_20
tcaagtgcggcagcgtgcag

SEQ ID NO: 20787 - DNA, 20 bp, Artificial Sequence
  sgRNA
  Flvcr2_1
ctatgatgggtcaaaccgct

SEQ ID NO: 20788 - DNA, 20 bp, Artificial Sequence
  sgRNA
  Flvcr2_2
ggtacccaacatcaaagacc

SEQ ID NO: 20789 - DNA, 20 bp, Artificial Sequence
  sgRNA
  Flvcr2_3
agtcatgatatacactacca

SEQ ID NO: 20790 - DNA, 20 bp, Artificial Sequence
  sgRNA
  Flvcr2_4
gcacatggacagccaatcaa

SEQ ID NO: 20791 - DNA, 20 bp, Artificial Sequence
  sgRNA
  Flvcr2_5
ggtttcaacagcctgctccg

SEQ ID NO: 20792 - DNA, 20 bp, Artificial Sequence
  sgRNA
  Flvcr2_6
tggaattccgactctggcgc

SEQ ID NO: 20793 - DNA, 20 bp, Artificial Sequence
  sgRNA
  Flvcr2_7
gtgtatatcatgactctggt

SEQ ID NO: 20794 - DNA, 20 bp, Artificial Sequence
  sgRNA
  Flvcr2_8
cttcgaaccatcgctatcac

SEQ ID NO: 20795 - DNA, 20 bp, Artificial Sequence
  sgRNA
  Flvcr2_9
acagcaaactcaaaccccag

SEQ ID NO: 20796 - DNA, 20 bp, Artificial Sequence
  sgRNA
  Flvcr2_10
catgccctcacgcattgctt

SEQ ID NO: 20797 - DNA, 20 bp, Artificial Sequence
  sgRNA
  Flvcr2_11
aaacattcctgcaatgacga

SEQ ID NO: 20798 - DNA, 20 bp, Artificial Sequence
  sgRNA
  Flvcr2_12
acaaccatggaaccatgttt

SEQ ID NO: 20799 - DNA, 20 bp, Artificial Sequence
  sgRNA
  Flvcr2_13
gccttccagtggattcagta

SEQ ID NO: 20800 - DNA, 20 bp, Artificial Sequence
  sgRNA
  Flvcr2_14
tttgacccatcatagtagct

SEQ ID NO: 20801 - DNA, 20 bp, Artificial Sequence
  sgRNA
  Flvcr2_15
tgaccagcagcacgaagttg

SEQ ID NO: 20802 - DNA, 20 bp, Artificial Sequence
  sgRNA
  Flvcr2_16
atgttgggtaccagaacagg

SEQ ID NO: 20803 - DNA, 20 bp, Artificial Sequence
  sgRNA
  Flvcr2_17
ttagagctgatccaagggca

SEQ ID NO: 20804 - DNA, 20 bp, Artificial Sequence
  sgRNA
  Flvcr2_18
tgttgggtaccagaacagga

SEQ ID NO: 20805 - DNA, 20 bp, Artificial Sequence
  sgRNA
  Flvcr2_19
ggacagccaatcaatggcaa

SEQ ID NO: 20806 - DNA, 20 bp, Artificial Sequence
  sgRNA
  Flvcr2_20
cacagcaaactcaaacccca

SEQ ID NO: 20807 - DNA, 20 bp, Artificial Sequence
  sgRNA
  Fndc4_1
tgcagcgacagaatggcccg

SEQ ID NO: 20808 - DNA, 20 bp, Artificial Sequence
  sgRNA
  Fndc4_2
gtcacattcacaggagaggg

SEQ ID NO: 20809 - DNA, 20 bp, Artificial Sequence
  sgRNA
  Fndc4_3
cttcttaggtgatattacag

SEQ ID NO: 20810 - DNA, 20 bp, Artificial Sequence
  sgRNA
  Fndc4_4
gtgtcctgggacgttccaga

SEQ ID NO: 20811 - DNA, 20 bp, Artificial Sequence
  sgRNA
  Fndc4_5
gtgcacttccgcacgctcaa

SEQ ID NO: 20812 - DNA, 20 bp, Artificial Sequence
  sgRNA
  Fndc4_6
gcacgctcaagggttctgac

SEQ ID NO: 20813 - DNA, 20 bp, Artificial Sequence
  sgRNA
  Fndc4_7
agagcggccattgcagacag

SEQ ID NO: 20814 - DNA, 20 bp, Artificial Sequence
  sgRNA
  Fndc4_8
ggtcacagctgaccagcagg

SEQ ID NO: 20815 - DNA, 20 bp, Artificial Sequence
  sgRNA
  Fndc4_9
ttccccatatctgagtccca

SEQ ID NO: 20816 - DNA, 20 bp, Artificial Sequence
  sgRNA
  Fndc4_10
gttaggagcatcggcctccg

SEQ ID NO: 20817 - DNA, 20 bp, Artificial Sequence
  sgRNA
  Fndc4_11
cgactccaacaacaacccca

SEQ ID NO: 20818 - DNA, 20 bp, Artificial Sequence
  sgRNA
  Fndc4_12
tggaacgtcccaggacacag

SEQ ID NO: 20819 - DNA, 20 bp, Artificial Sequence
  sgRNA
  Fndc4_13
gtttccaccgagttcgctgg

SEQ ID NO: 20820 - DNA, 20 bp, Artificial Sequence
  sgRNA
  Fndc4_14
attacagtggagggtctgga

SEQ ID NO: 20821 - DNA, 20 bp, Artificial Sequence
  sgRNA
  Fndc4_15
ggaagtcgtcatcattgtag

SEQ ID NO: 20822 - DNA, 20 bp, Artificial Sequence
  sgRNA
  Fndc4_16
cctggactggagctgttgga

SEQ ID NO: 20823 - DNA, 20 bp, Artificial Sequence
  sgRNA
  Fndc4_17
acaacaaccccaaggagaag

SEQ ID NO: 20824 - DNA, 20 bp, Artificial Sequence
  sgRNA
  Fndc4_18
tgagtgaccgtcacattcac

SEQ ID NO: 20825 - DNA, 20 bp, Artificial Sequence
  sgRNA
  Fndc4_19
ggcccctccagcgaactcgg

SEQ ID NO: 20826 - DNA, 20 bp, Artificial Sequence
  sgRNA
  Fndc4_20
gctgaccagcaggaggaccg

SEQ ID NO: 20827 - DNA, 20 bp, Artificial Sequence
  sgRNA
  Fndc5_1
gctcttcaagaccccacgcg

SEQ ID NO: 20828 - DNA, 20 bp, Artificial Sequence
  sgRNA
  Fndc5_2
gatgctccggttcattcagg

SEQ ID NO: 20829 - DNA, 20 bp, Artificial Sequence
  sgRNA
  Fndc5_3
caggacatcccagctgacca

SEQ ID NO: 20830 - DNA, 20 bp, Artificial Sequence
  sgRNA
  Fndc5_4
gccggacggtcacgttcaca

SEQ ID NO: 20831 - DNA, 20 bp, Artificial Sequence
  sgRNA
  Fndc5_5
cctcaaggccaactctgccg

SEQ ID NO: 20832 - DNA, 20 bp, Artificial Sequence
  sgRNA
  Fndc5_6
gttggccttgaggtgccgga

SEQ ID NO: 20833 - DNA, 20 bp, Artificial Sequence
  sgRNA
  Fndc5_7
ccggacggtcacgttcacag

SEQ ID NO: 20834 - DNA, 20 bp, Artificial Sequence
  sgRNA
  Fndc5_8
agacgcagcctagccacagg

SEQ ID NO: 20835 - DNA, 20 bp, Artificial Sequence
  sgRNA
  Fndc5_9
tcacgttcacaggggctgag

SEQ ID NO: 20836 - DNA, 20 bp, Artificial Sequence
  sgRNA
  Fndc5_10
aggctgcgtctgcttcgcgc

SEQ ID NO: 20837 - DNA, 20 bp, Artificial Sequence
  sgRNA
  Fndc5_11
ggtcccagagagcgcaggac

SEQ ID NO: 20838 - DNA, 20 bp, Artificial Sequence
  sgRNA
  Fndc5_12
ccttgatgatatcatactgg

SEQ ID NO: 20839 - DNA, 20 bp, Artificial Sequence
  sgRNA
  Fndc5_13
ggtcagctgggatgtcctgg

SEQ ID NO: 20840 - DNA, 20 bp, Artificial Sequence
  sgRNA
  Fndc5_14
ggatggagatggcctgcaca

SEQ ID NO: 20841 - DNA, 20 bp, Artificial Sequence
  sgRNA
  Fndc5_15
agcacaccggagcatcaggg

SEQ ID NO: 20842 - DNA, 20 bp, Artificial Sequence
  sgRNA
  Fndc5_16
aggaggtgaacaccaccacc

SEQ ID NO: 20843 - DNA, 20 bp, Artificial Sequence
  sgRNA
  Fndc5_17
gtgcaggccatctccatcca

SEQ ID NO: 20844 - DNA, 20 bp, Artificial Sequence
  sgRNA
  Fndc5_18
agaaggatgtgcggatgctc

SEQ ID NO: 20845 - DNA, 20 bp, Artificial Sequence
  sgRNA
  Fndc5_19
cgtggggtcttgaagagcac

SEQ ID NO: 20846 - DNA, 20 bp, Artificial Sequence
  sgRNA
  Fndc5_20
gaaccagcagctgcgaacgg

SEQ ID NO: 20847 - DNA, 20 bp, Artificial Sequence
  sgRNA
  Fndc9_1
accaccgaggttcgtgacag

SEQ ID NO: 20848 - DNA, 20 bp, Artificial Sequence
  sgRNA
  Fndc9_2
tggtaatagtcctccaagca

SEQ ID NO: 20849 - DNA, 20 bp, Artificial Sequence
  sgRNA
  Fndc9_3
tggtacagtagtgactatac

SEQ ID NO: 20850 - DNA, 20 bp, Artificial Sequence
  sgRNA
  Fndc9_4
cgtgatggaagttatagcgc

SEQ ID NO: 20851 - DNA, 20 bp, Artificial Sequence
  sgRNA
  Fndc9_5
ccggctctgtaagaccaccg

SEQ ID NO: 20852 - DNA, 20 bp, Artificial Sequence
  sgRNA
  Fndc9_6
gcctccgctgtcacgaacct

SEQ ID NO: 20853 - DNA, 20 bp, Artificial Sequence
  sgRNA
  Fndc9_7
gcgctataacttccatcacg

SEQ ID NO: 20854 - DNA, 20 bp, Artificial Sequence
  sgRNA
  Fndc9_8
actgccacgaaagaactcag

SEQ ID NO: 20855 - DNA, 20 bp, Artificial Sequence
  sgRNA
  Fndc9_9
gggccatcttaccaacccat

SEQ ID NO: 20856 - DNA, 20 bp, Artificial Sequence
  sgRNA
  Fndc9_10
catcatctcctggtcaccct

SEQ ID NO: 20857 - DNA, 20 bp, Artificial Sequence
  sgRNA
  Fndc9_11
agtgaggcagtatggccggt

SEQ ID NO: 20858 - DNA, 20 bp, Artificial Sequence
  sgRNA
  Fndc9_12
attggcttcctccatttggc

SEQ ID NO: 20859 - DNA, 20 bp, Artificial Sequence
  sgRNA
  Fndc9_13
ttcgtggcagttcctccagg

SEQ ID NO: 20860 - DNA, 20 bp, Artificial Sequence
  sgRNA
  Fndc9_14
ctatagtgaggcagtatggc

SEQ ID NO: 20861 - DNA, 20 bp, Artificial Sequence
  sgRNA
  Fndc9_15
atattatgtacaggcccaac

SEQ ID NO: 20862 - DNA, 20 bp, Artificial Sequence
  sgRNA
  Fndc9_16
acagtagtgactatacggga

SEQ ID NO: 20863 - DNA, 20 bp, Artificial Sequence
  sgRNA
  Fndc9_17
gcacccaaagagaaatctgg

SEQ ID NO: 20864 - DNA, 20 bp, Artificial Sequence
  sgRNA
  Fndc9_18
agaaatctgggggtccacca

SEQ ID NO: 20865 - DNA, 20 bp, Artificial Sequence
  sgRNA
  Fndc9_19
gatacagaggaagtagagag

SEQ ID NO: 20866 - DNA, 20 bp, Artificial Sequence
  sgRNA
  Fndc9_20
catccaggatgccttagagg

SEQ ID NO: 20867 - DNA, 20 bp, Artificial Sequence
  sgRNA
  Folh1_1
gcaaatgcaccataccaaag

SEQ ID NO: 20868 - DNA, 20 bp, Artificial Sequence
  sgRNA
  Folh1_2
tctggataggacttcaccgc

SEQ ID NO: 20869 - DNA, 20 bp, Artificial Sequence
  sgRNA
  Folh1_3
attaaaagtgccttacaacg

SEQ ID NO: 20870 - DNA, 20 bp, Artificial Sequence
  sgRNA
  Folh1_4
aggacagcaagacatcgtaa

SEQ ID NO: 20871 - DNA, 20 bp, Artificial Sequence
  sgRNA
  Folh1_5
ttatctgaacagccaccccc

SEQ ID NO: 20872 - DNA, 20 bp, Artificial Sequence
  sgRNA
  Folh1_6
actgcaggacagagactccg

SEQ ID NO: 20873 - DNA, 20 bp, Artificial Sequence
  sgRNA
  Folh1_7
ttaaaagtgccttacaacgt

SEQ ID NO: 20874 - DNA, 20 bp, Artificial Sequence
  sgRNA
  Folh1_8
tgtgcatcatcatatccaat

SEQ ID NO: 20875 - DNA, 20 bp, Artificial Sequence
  sgRNA
  Folh1_9
agtattcctgtccatcctat

SEQ ID NO: 20876 - DNA, 20 bp, Artificial Sequence
  sgRNA
  Folh1_10
ttaccagtagcttcattgga

SEQ ID NO: 20877 - DNA, 20 bp, Artificial Sequence
  sgRNA
  Folh1_11
ccagcaccagtgtcccaaca

SEQ ID NO: 20878 - DNA, 20 bp, Artificial Sequence
  sgRNA
  Folh1_12
ggacagcaagacatcgtaat

SEQ ID NO: 20879 - DNA, 20 bp, Artificial Sequence
  sgRNA
  Folh1_13
ggtggcattgaccctcagag

SEQ ID NO: 20880 - DNA, 20 bp, Artificial Sequence
  sgRNA
  Folh1_14
gcaggaacaaagtagtcagc

SEQ ID NO: 20881 - DNA, 20 bp, Artificial Sequence
  sgRNA
  Folh1_15
tggttctactgagtgggcag

SEQ ID NO: 20882 - DNA, 20 bp, Artificial Sequence
  sgRNA
  Folh1_16
tttcacacggacaccacact

SEQ ID NO: 20883 - DNA, 20 bp, Artificial Sequence
  sgRNA
  Folh1_17
tcagagctacagcataactt

SEQ ID NO: 20884 - DNA, 20 bp, Artificial Sequence
  sgRNA
  Folh1_18
gcggtgaagtcctatccaga

SEQ ID NO: 20885 - DNA, 20 bp, Artificial Sequence
  sgRNA
  Folh1_19
tgaagtcctatccagatggc

SEQ ID NO: 20886 - DNA, 20 bp, Artificial Sequence
  sgRNA
  Folh1_20
cccttccagctactgtcagg

SEQ ID NO: 20887 - DNA, 20 bp, Artificial Sequence
  sgRNA
  Folr1_1
gacaatttacacgaccaggt

SEQ ID NO: 20888 - DNA, 20 bp, Artificial Sequence
  sgRNA
  Folr1_2
agttcggggaacactcatag

SEQ ID NO: 20889 - DNA, 20 bp, Artificial Sequence
  sgRNA
  Folr1_3
ccagttgaaccggtacaggt

SEQ ID NO: 20890 - DNA, 20 bp, Artificial Sequence
  sgRNA
  Folr1_4
ctccacctactccttacccg

SEQ ID NO: 20891 - DNA, 20 bp, Artificial Sequence
  sgRNA
  Folr1_5
ggtcgtgtaaattgtcctca

SEQ ID NO: 20892 - DNA, 20 bp, Artificial Sequence
  sgRNA
  Folr1_6
gatcacccagagcagcacta

SEQ ID NO: 20893 - DNA, 20 bp, Artificial Sequence
  sgRNA
  Folr1_7
agtggcgaggttctatgccg

SEQ ID NO: 20894 - DNA, 20 bp, Artificial Sequence
  sgRNA
  Folr1_8
agctcagcaactacagtcga

SEQ ID NO: 20895 - DNA, 20 bp, Artificial Sequence
  sgRNA
  Folr1_9
ggttccagttgaaccggtac

SEQ ID NO: 20896 - DNA, 20 bp, Artificial Sequence
  sgRNA
  Folr1_10
tatgagtgttccccgaactt

SEQ ID NO: 20897 - DNA, 20 bp, Artificial Sequence
  sgRNA
  Folr1_11
acctcgccacttcctcgttg

SEQ ID NO: 20898 - DNA, 20 bp, Artificial Sequence
  sgRNA
  Folr1_12
tgacagtcctctttgcacag

SEQ ID NO: 20899 - DNA, 20 bp, Artificial Sequence
  sgRNA
  Folr1_13
atgtggttcgacccagccca

SEQ ID NO: 20900 - DNA, 20 bp, Artificial Sequence
  sgRNA
  Folr1_14
ctgttccacgaacacaagcc

SEQ ID NO: 20901 - DNA, 20 bp, Artificial Sequence
  sgRNA
  Folr1_15
gggcaaccccaacgaggaag

SEQ ID NO: 20902 - DNA, 20 bp, Artificial Sequence
  sgRNA
  Folr1_16
tgatgttcccctgtgcaaag

SEQ ID NO: 20903 - DNA, 20 bp, Artificial Sequence
  sgRNA
  Folr1_17
ctgacagtcctctttgcaca

SEQ ID NO: 20904 - DNA, 20 bp, Artificial Sequence
  sgRNA
  Folr1_18
gggcataacgagtgtcctgt

SEQ ID NO: 20905 - DNA, 20 bp, Artificial Sequence
  sgRNA
  Folr1_19
accccaacgaggaagtggcg

SEQ ID NO: 20906 - DNA, 20 bp, Artificial Sequence
  sgRNA
  Folr1_20
ggatggcaggaggctcccac

SEQ ID NO: 20907 - DNA, 20 bp, Artificial Sequence
  sgRNA
  Folr2_1
catccatgcaaacgttgagt

SEQ ID NO: 20908 - DNA, 20 bp, Artificial Sequence
  sgRNA
  Folr2_2
ctcccgtctgtacttcaact

SEQ ID NO: 20909 - DNA, 20 bp, Artificial Sequence
  sgRNA
  Folr2_3
aacgctctttacgccaactc

SEQ ID NO: 20910 - DNA, 20 bp, Artificial Sequence
  sgRNA
  Folr2_4
gagagactggcataaaggct

SEQ ID NO: 20911 - DNA, 20 bp, Artificial Sequence
  sgRNA
  Folr2_5
acaccagccagcctttgcga

SEQ ID NO: 20912 - DNA, 20 bp, Artificial Sequence
  sgRNA
  Folr2_6
atgtggtttgactcaaccca

SEQ ID NO: 20913 - DNA, 20 bp, Artificial Sequence
  sgRNA
  Folr2_7
agacctactcaacgtttgca

SEQ ID NO: 20914 - DNA, 20 bp, Artificial Sequence
  sgRNA
  Folr2_8
gagccataatgacagcactg

SEQ ID NO: 20915 - DNA, 20 bp, Artificial Sequence
  sgRNA
  Folr2_9
gactccagagaccctcgcaa

SEQ ID NO: 20916 - DNA, 20 bp, Artificial Sequence
  sgRNA
  Folr2_10
gtagtactcaaacgtgtgac

SEQ ID NO: 20917 - DNA, 20 bp, Artificial Sequence
  sgRNA
  Folr2_11
gcaggtaaaggaggtacgac

SEQ ID NO: 20918 - DNA, 20 bp, Artificial Sequence
  sgRNA
  Folr2_12
gatcccagttgaagtacaga

SEQ ID NO: 20919 - DNA, 20 bp, Artificial Sequence
  sgRNA
  Folr2_13
tgacagtcctctttgcataa

SEQ ID NO: 20920 - DNA, 20 bp, Artificial Sequence
  sgRNA
  Folr2_14
tacatggtcacaacaggcag

SEQ ID NO: 20921 - DNA, 20 bp, Artificial Sequence
  sgRNA
  Folr2_15
tagtactcaaacgtgtgaca

SEQ ID NO: 20922 - DNA, 20 bp, Artificial Sequence
  sgRNA
  Folr2_16
cttgctggatccaaggccca

SEQ ID NO: 20923 - DNA, 20 bp, Artificial Sequence
  sgRNA
  Folr2_17
ggtcatgcagcttgtcctcg

SEQ ID NO: 20924 - DNA, 20 bp, Artificial Sequence
  sgRNA
  Folr2_18
agaggactgtcaccagtggt

SEQ ID NO: 20925 - DNA, 20 bp, Artificial Sequence
  sgRNA
  Folr2_19
ggagccataatgacagcact

SEQ ID NO: 20926 - DNA, 20 bp, Artificial Sequence
  sgRNA
  Folr2_20
gggcaatccgaatgaggacg

SEQ ID NO: 20927 - DNA, 20 bp, Artificial Sequence
  sgRNA
  Fpr-rs3_1
accattgagatgatgtgtag

SEQ ID NO: 20928 - DNA, 20 bp, Artificial Sequence
  sgRNA
  Fpr-rs3_2
agccaggttcagataacaga

SEQ ID NO: 20929 - DNA, 20 bp, Artificial Sequence
  sgRNA
  Fpr-rs3_3
ggtgattctgaacccatact

SEQ ID NO: 20930 - DNA, 20 bp, Artificial Sequence
  sgRNA
  Fpr-rs3_4
cggcaatgaaggacatgggt

SEQ ID NO: 20931 - DNA, 20 bp, Artificial Sequence
  sgRNA
  Fpr-rs3_5
ccacttctgagccattcagt

SEQ ID NO: 20932 - DNA, 20 bp, Artificial Sequence
  sgRNA
  Fpr-rs3_6
cagtgagaacacgtaaagga

SEQ ID NO: 20933 - DNA, 20 bp, Artificial Sequence
  sgRNA
  Fpr-rs3_7
gaagactcagtcctaagcag

SEQ ID NO: 20934 - DNA, 20 bp, Artificial Sequence
  sgRNA
  Fpr-rs3_8
tggagagaactatcactgag

SEQ ID NO: 20935 - DNA, 20 bp, Artificial Sequence
  sgRNA
  Fpr-rs3_9
gagaacacgtaaaggacggc

SEQ ID NO: 20936 - DNA, 20 bp, Artificial Sequence
  sgRNA
  Fpr-rs3_10
cagacggcaatgaaggacat

SEQ ID NO: 20937 - DNA, 20 bp, Artificial Sequence
  sgRNA
  Fpr-rs3_11
gttgaacccagcaagcacac

SEQ ID NO: 20938 - DNA, 20 bp, Artificial Sequence
  sgRNA
  Fpr-rs3_12
acagcagtgagaacacgtaa

SEQ ID NO: 20939 - DNA, 20 bp, Artificial Sequence
  sgRNA
  Fpr-rs3_13
gcccattacctagcacacca

SEQ ID NO: 20940 - DNA, 20 bp, Artificial Sequence
  sgRNA
  Fpr-rs3_14
attaccgtgagcacagcaac

SEQ ID NO: 20941 - DNA, 20 bp, Artificial Sequence
  sgRNA
  Fpr-rs3_15
acacctttaattgctcctca

SEQ ID NO: 20942 - DNA, 20 bp, Artificial Sequence
  sgRNA
  Fpr-rs3_16
atctgtggttgcaaaccctg

SEQ ID NO: 20943 - DNA, 20 bp, Artificial Sequence
  sgRNA
  Fpr-rs3_17
accactacacatcatctcaa

SEQ ID NO: 20944 - DNA, 20 bp, Artificial Sequence
  sgRNA
  Fpr-rs3_18
ttgggtggctgggttccgga

SEQ ID NO: 20945 - DNA, 20 bp, Artificial Sequence
  sgRNA
  Fpr-rs3_19
aactcctccatcccactgaa

SEQ ID NO: 20946 - DNA, 20 bp, Artificial Sequence
  sgRNA
  Fpr-rs3_20
ctaccacctccagagttcta

SEQ ID NO: 20947 - DNA, 20 bp, Artificial Sequence
  sgRNA
  Fpr-rs4_1
caagttcagataagagacag

SEQ ID NO: 20948 - DNA, 20 bp, Artificial Sequence
  sgRNA
  Fpr-rs4_2
ctacagtgagagatgcaaga

SEQ ID NO: 20949 - DNA, 20 bp, Artificial Sequence
  sgRNA
  Fpr-rs4_3
taaagagaaccactaatgag

SEQ ID NO: 20950 - DNA, 20 bp, Artificial Sequence
  sgRNA
  Fpr-rs4_4
ggtgattctgagaccatact

SEQ ID NO: 20951 - DNA, 20 bp, Artificial Sequence
  sgRNA
  Fpr-rs4_5
gcccattacctagaacaccg

SEQ ID NO: 20952 - DNA, 20 bp, Artificial Sequence
  sgRNA
  Fpr-rs4_6
tctgtatgccagtctagaga

SEQ ID NO: 20953 - DNA, 20 bp, Artificial Sequence
  sgRNA
  Fpr-rs4_7
ctaccacctcaagagttcta

SEQ ID NO: 20954 - DNA, 20 bp, Artificial Sequence
  sgRNA
  Fpr-rs4_8
acaacttctgatccattcag

SEQ ID NO: 20955 - DNA, 20 bp, Artificial Sequence
  sgRNA
  Fpr-rs4_9
ggttaacccagcaaatacct

SEQ ID NO: 20956 - DNA, 20 bp, Artificial Sequence
  sgRNA
  Fpr-rs4_10
gcagctgttaaaggaagcca

SEQ ID NO: 20957 - DNA, 20 bp, Artificial Sequence
  sgRNA
  Fpr-rs4_11
gatccatagaactcttgagg

SEQ ID NO: 20958 - DNA, 20 bp, Artificial Sequence
  sgRNA
  Fpr-rs4_12
aggaaactgctacagcagtg

SEQ ID NO: 20959 - DNA, 20 bp, Artificial Sequence
  sgRNA
  Fpr-rs4_13
tctatggatcctctcattag

SEQ ID NO: 20960 - DNA, 20 bp, Artificial Sequence
  sgRNA
  Fpr-rs4_14
ttgggtggctgggttccaga

SEQ ID NO: 20961 - DNA, 20 bp, Artificial Sequence
  sgRNA
  Fpr-rs4_15
aaagcataattaattgaaaa

SEQ ID NO: 20962 - DNA, 20 bp, Artificial Sequence
  sgRNA
  Fpr-rs4_16
tctgagaccatactgggcac

SEQ ID NO: 20963 - DNA, 20 bp, Artificial Sequence
  sgRNA
  Fpr-rs4_17
ttaggaagatacttacaaaa

SEQ ID NO: 20964 - DNA, 20 bp, Artificial Sequence
  sgRNA
  Fpr-rs4_18
gcagatagcaatgaaagaca

SEQ ID NO: 20965 - DNA, 20 bp, Artificial Sequence
  sgRNA
  Fpr-rs4_19
ctctgtatgccagtctagag

SEQ ID NO: 20966 - DNA, 20 bp, Artificial Sequence
  sgRNA
  Fpr-rs4_20
ggaatcatcaatttcattat

SEQ ID NO: 20967 - DNA, 20 bp, Artificial Sequence
  sgRNA
  Fpr-rs6_1
gtagtcacgaagatacaatg

SEQ ID NO: 20968 - DNA, 20 bp, Artificial Sequence
  sgRNA
  Fpr-rs6_2
gaagatacatataactctgg

SEQ ID NO: 20969 - DNA, 20 bp, Artificial Sequence
  sgRNA
  Fpr-rs6_3
gaatcatcgaactgtgaatg

SEQ ID NO: 20970 - DNA, 20 bp, Artificial Sequence
  sgRNA
  Fpr-rs6_4
gaagccaataatgaaactga

SEQ ID NO: 20971 - DNA, 20 bp, Artificial Sequence
  sgRNA
  Fpr-rs6_5
cacagaataatattgacacg

SEQ ID NO: 20972 - DNA, 20 bp, Artificial Sequence
  sgRNA
  Fpr-rs6_6
ctacagtgaaagatgaaagt

SEQ ID NO: 20973 - DNA, 20 bp, Artificial Sequence
  sgRNA
  Fpr-rs6_7
gtaaccatcagtttcattat

SEQ ID NO: 20974 - DNA, 20 bp, Artificial Sequence
  sgRNA
  Fpr-rs6_8
gatacatataactctggagg

SEQ ID NO: 20975 - DNA, 20 bp, Artificial Sequence
  sgRNA
  Fpr-rs6_9
aagaaattgctacagcagtg

SEQ ID NO: 20976 - DNA, 20 bp, Artificial Sequence
  sgRNA
  Fpr-rs6_10
attgtctgacttctcttaca

SEQ ID NO: 20977 - DNA, 20 bp, Artificial Sequence
  sgRNA
  Fpr-rs6_11
acagaataatattgacacgt

SEQ ID NO: 20978 - DNA, 20 bp, Artificial Sequence
  sgRNA
  Fpr-rs6_12
aacacaaatacaacgatcca

SEQ ID NO: 20979 - DNA, 20 bp, Artificial Sequence
  sgRNA
  Fpr-rs6_13
ggtgaacacagcaagcactc

SEQ ID NO: 20980 - DNA, 20 bp, Artificial Sequence
  sgRNA
  Fpr-rs6_14
gtggcaacgaaagtgatctt

SEQ ID NO: 20981 - DNA, 20 bp, Artificial Sequence
  sgRNA
  Fpr-rs6_15
tgtcatctgttatggactca

SEQ ID NO: 20982 - DNA, 20 bp, Artificial Sequence
  sgRNA
  Fpr-rs6_16
tcagggctgagtcctccctc

SEQ ID NO: 20983 - DNA, 20 bp, Artificial Sequence
  sgRNA
  Fpr-rs6_17
tctttgtgaagacaagtttc

SEQ ID NO: 20984 - DNA, 20 bp, Artificial Sequence
  sgRNA
  Fpr-rs6_18
cgaaagtgatctttggagct

SEQ ID NO: 20985 - DNA, 20 bp, Artificial Sequence
  sgRNA
  Fpr-rs6_19
ttgtcacagtgtgtgtcatc

SEQ ID NO: 20986 - DNA, 20 bp, Artificial Sequence
  sgRNA
  Fpr-rs6_20
atcttcattgtcatctgtta

SEQ ID NO: 20987 - DNA, 20 bp, Artificial Sequence
  sgRNA
  Fpr-rs7_1
catgtttacctgctcctcag

SEQ ID NO: 20988 - DNA, 20 bp, Artificial Sequence
  sgRNA
  Fpr-rs7_2
gtaaccctcagtttcattgt

SEQ ID NO: 20989 - DNA, 20 bp, Artificial Sequence
  sgRNA
  Fpr-rs7_3
cacagaataatattgacgcg

SEQ ID NO: 20990 - DNA, 20 bp, Artificial Sequence
  sgRNA
  Fpr-rs7_4
acatgtttacctgctcctca

SEQ ID NO: 20991 - DNA, 20 bp, Artificial Sequence
  sgRNA
  Fpr-rs7_5
tgaagccaacaatgaaactg

SEQ ID NO: 20992 - DNA, 20 bp, Artificial Sequence
  sgRNA
  Fpr-rs7_6
gtagtcaagaagaaaaaatg

SEQ ID NO: 20993 - DNA, 20 bp, Artificial Sequence
  sgRNA
  Fpr-rs7_7
tcagggctgaatcctccctc

SEQ ID NO: 20994 - DNA, 20 bp, Artificial Sequence
  sgRNA
  Fpr-rs7_8
aagaaaatgctacagcagtg

SEQ ID NO: 20995 - DNA, 20 bp, Artificial Sequence
  sgRNA
  Fpr-rs7_9
gaagccaacaatgaaactga

SEQ ID NO: 20996 - DNA, 20 bp, Artificial Sequence
  sgRNA
  Fpr-rs7_10
gatacatataactctggatg

SEQ ID NO: 20997 - DNA, 20 bp, Artificial Sequence
  sgRNA
  Fpr-rs7_11
ggtgaacccagcaagcactc

SEQ ID NO: 20998 - DNA, 20 bp, Artificial Sequence
  sgRNA
  Fpr-rs7_12
aggaggccagagtgcttgct

SEQ ID NO: 20999 - DNA, 20 bp, Artificial Sequence
  sgRNA
  Fpr-rs7_13
cagggctgaatcctccctca

SEQ ID NO: 21000 - DNA, 20 bp, Artificial Sequence
  sgRNA
  Fpr-rs7_14
atcgaactgtgaatctggca

SEQ ID NO: 21001 - DNA, 20 bp, Artificial Sequence
  sgRNA
  Fpr-rs7_15
ttgtcacagtatgtgtcatc

SEQ ID NO: 21002 - DNA, 20 bp, Artificial Sequence
  sgRNA
  Fpr-rs7_16
aacacaaatacagcgatcca

SEQ ID NO: 21003 - DNA, 20 bp, Artificial Sequence
  sgRNA
  Fpr-rs7_17
acagaataatattgacgcgt

SEQ ID NO: 21004 - DNA, 20 bp, Artificial Sequence
  sgRNA
  Fpr-rs7_18
tctggcaaggaaagtgattt

SEQ ID NO: 21005 - DNA, 20 bp, Artificial Sequence
  sgRNA
  Fpr-rs7_19
ggctgcaacccctgaggagc

SEQ ID NO: 21006 - DNA, 20 bp, Artificial Sequence
  sgRNA
  Fpr-rs7_20
atcttcattgtcatctgcta

SEQ ID NO: 21007 - DNA, 20 bp, Artificial Sequence
  sgRNA
  Fpr1_1
agaaggtaatcatcgtaccc

SEQ ID NO: 21008 - DNA, 20 bp, Artificial Sequence
  sgRNA
  Fpr1_2
tggtgacagtgtgtttcatg

SEQ ID NO: 21009 - DNA, 20 bp, Artificial Sequence
  sgRNA
  Fpr1_3
ggcaatgtaaaatggcaaag

SEQ ID NO: 21010 - DNA, 20 bp, Artificial Sequence
  sgRNA
  Fpr1_4
gatgcagaacacaaatacag

SEQ ID NO: 21011 - DNA, 20 bp, Artificial Sequence
  sgRNA
  Fpr1_5
gtactttcgacttctccccc

SEQ ID NO: 21012 - DNA, 20 bp, Artificial Sequence
  sgRNA
  Fpr1_6
aggagagaacccgcaaagga

SEQ ID NO: 21013 - DNA, 20 bp, Artificial Sequence
  sgRNA
  Fpr1_7
gcaaatggcaacaatggaca

SEQ ID NO: 21014 - DNA, 20 bp, Artificial Sequence
  sgRNA
  Fpr1_8
tcttggctaggctcacagtg

SEQ ID NO: 21015 - DNA, 20 bp, Artificial Sequence
  sgRNA
  Fpr1_9
cagctgttgaagaaagccaa

SEQ ID NO: 21016 - DNA, 20 bp, Artificial Sequence
  sgRNA
  Fpr1_10
ccaaagatcctgtagagaag

SEQ ID NO: 21017 - DNA, 20 bp, Artificial Sequence
  sgRNA
  Fpr1_11
gcatggtcatgggaggacat

SEQ ID NO: 21018 - DNA, 20 bp, Artificial Sequence
  sgRNA
  Fpr1_12
tcactgtcagaggaatcatc

SEQ ID NO: 21019 - DNA, 20 bp, Artificial Sequence
  sgRNA
  Fpr1_13
ccattgttgccatttgctat

SEQ ID NO: 21020 - DNA, 20 bp, Artificial Sequence
  sgRNA
  Fpr1_14
ggttattaacccatagcaaa

SEQ ID NO: 21021 - DNA, 20 bp, Artificial Sequence
  sgRNA
  Fpr1_15
ccacaatccaagtccgtgaa

SEQ ID NO: 21022 - DNA, 20 bp, Artificial Sequence
  sgRNA
  Fpr1_16
ctaatagtagacttggacca

SEQ ID NO: 21023 - DNA, 20 bp, Artificial Sequence
  sgRNA
  Fpr1_17
caacgggctcgtgatctggg

SEQ ID NO: 21024 - DNA, 20 bp, Artificial Sequence
  sgRNA
  Fpr1_18
ttgcacatgaaccaaccaaa

SEQ ID NO: 21025 - DNA, 20 bp, Artificial Sequence
  sgRNA
  Fpr1_19
acaaaggagagaacccgcaa

SEQ ID NO: 21026 - DNA, 20 bp, Artificial Sequence
  sgRNA
  Fpr1_20
ctggtgcccatttcaagtag

SEQ ID NO: 21027 - DNA, 20 bp, Artificial Sequence
  sgRNA
  Fpr2_1
caaacagcaacaattgacat

SEQ ID NO: 21028 - DNA, 20 bp, Artificial Sequence
  sgRNA
  Fpr2_2
gatgcagaacacaaatgcag

SEQ ID NO: 21029 - DNA, 20 bp, Artificial Sequence
  sgRNA
  Fpr2_3
actactgttagaattcctgg

SEQ ID NO: 21030 - DNA, 20 bp, Artificial Sequence
  sgRNA
  Fpr2_4
agaatcagagcaaaaatcca

SEQ ID NO: 21031 - DNA, 20 bp, Artificial Sequence
  sgRNA
  Fpr2_5
tctctcaagactataaggca

SEQ ID NO: 21032 - DNA, 20 bp, Artificial Sequence
  sgRNA
  Fpr2_6
tttaactcaatgtctgcagg

SEQ ID NO: 21033 - DNA, 20 bp, Artificial Sequence
  sgRNA
  Fpr2_7
tttaaagagacattgcttag

SEQ ID NO: 21034 - DNA, 20 bp, Artificial Sequence
  sgRNA
  Fpr2_8
agggctctctcaagactata

SEQ ID NO: 21035 - DNA, 20 bp, Artificial Sequence
  sgRNA
  Fpr2_9
aggaagccacaactgctgta

SEQ ID NO: 21036 - DNA, 20 bp, Artificial Sequence
  sgRNA
  Fpr2_10
ttgaccagaatcctcactca

SEQ ID NO: 21037 - DNA, 20 bp, Artificial Sequence
  sgRNA
  Fpr2_11
cccatgaaaacatagagcat

SEQ ID NO: 21038 - DNA, 20 bp, Artificial Sequence
  sgRNA
  Fpr2_12
aaaagggccacaagctgaaa

SEQ ID NO: 21039 - DNA, 20 bp, Artificial Sequence
  sgRNA
  Fpr2_13
actgctgtaaggactcgtaa

SEQ ID NO: 21040 - DNA, 20 bp, Artificial Sequence
  sgRNA
  Fpr2_14
gcaaacagcaacaattgaca

SEQ ID NO: 21041 - DNA, 20 bp, Artificial Sequence
  sgRNA
  Fpr2_15
ctgtaaggactcgtaaagga

SEQ ID NO: 21042 - DNA, 20 bp, Artificial Sequence
  sgRNA
  Fpr2_16
tgttaacccaacaagctcat

SEQ ID NO: 21043 - DNA, 20 bp, Artificial Sequence
  sgRNA
  Fpr2_17
gggaaaccagcagataaaga

SEQ ID NO: 21044 - DNA, 20 bp, Artificial Sequence
  sgRNA
  Fpr2_18
ctctctcaagactataaggc

SEQ ID NO: 21045 - DNA, 20 bp, Artificial Sequence
  sgRNA
  Fpr2_19
gcctttaactcaatgtctgc

SEQ ID NO: 21046 - DNA, 20 bp, Artificial Sequence
  sgRNA
  Fpr2_20
tttgaccagaatcctcactc

SEQ ID NO: 21047 - DNA, 20 bp, Artificial Sequence
  sgRNA
  Fpr3_1
tcacgtttgtaacaactaga

SEQ ID NO: 21048 - DNA, 20 bp, Artificial Sequence
  sgRNA
  Fpr3_2
gggaaatggactagtgatct

SEQ ID NO: 21049 - DNA, 20 bp, Artificial Sequence
  sgRNA
  Fpr3_3
tacagttagagatgctagag

SEQ ID NO: 21050 - DNA, 20 bp, Artificial Sequence
  sgRNA
  Fpr3_4
caacaaccacatttctagcc

SEQ ID NO: 21051 - DNA, 20 bp, Artificial Sequence
  sgRNA
  Fpr3_5
ctatgattctaccatctcca

SEQ ID NO: 21052 - DNA, 20 bp, Artificial Sequence
  sgRNA
  Fpr3_6
ctacagttagagatgctaga

SEQ ID NO: 21053 - DNA, 20 bp, Artificial Sequence
  sgRNA
  Fpr3_7
gtagttataaaattattggc

SEQ ID NO: 21054 - DNA, 20 bp, Artificial Sequence
  sgRNA
  Fpr3_8
ctgtaagaactcggaaagga

SEQ ID NO: 21055 - DNA, 20 bp, Artificial Sequence
  sgRNA
  Fpr3_9
actcctgtaagaactcggaa

SEQ ID NO: 21056 - DNA, 20 bp, Artificial Sequence
  sgRNA
  Fpr3_10
ggggcaactctgttgaggaa

SEQ ID NO: 21057 - DNA, 20 bp, Artificial Sequence
  sgRNA
  Fpr3_11
tgagaggatccacagaaccc

SEQ ID NO: 21058 - DNA, 20 bp, Artificial Sequence
  sgRNA
  Fpr3_12
agtgatgagtccatagcaga

SEQ ID NO: 21059 - DNA, 20 bp, Artificial Sequence
  sgRNA
  Fpr3_13
cgtcctttccgagttcttac

SEQ ID NO: 21060 - DNA, 20 bp, Artificial Sequence
  sgRNA
  Fpr3_14
agattgagctttgtatcctg

SEQ ID NO: 21061 - DNA, 20 bp, Artificial Sequence
  sgRNA
  Fpr3_15
ccacaactcctgtaagaact

SEQ ID NO: 21062 - DNA, 20 bp, Artificial Sequence
  sgRNA
  Fpr3_16
tgtgagcctggctagaaatg

SEQ ID NO: 21063 - DNA, 20 bp, Artificial Sequence
  sgRNA
  Fpr3_17
aggacggctggaattaacaa

SEQ ID NO: 21064 - DNA, 20 bp, Artificial Sequence
  sgRNA
  Fpr3_18
gcagatggcaacaaaggaca

SEQ ID NO: 21065 - DNA, 20 bp, Artificial Sequence
  sgRNA
  Fpr3_19
aggaaaccaacagataaaga

SEQ ID NO: 21066 - DNA, 20 bp, Artificial Sequence
  sgRNA
  Fpr3_20
gtccatttcccagcacacca

SEQ ID NO: 21067 - DNA, 20 bp, Artificial Sequence
  sgRNA
  Fras1_1
tggtgggtgtgcttacaacg

SEQ ID NO: 21068 - DNA, 20 bp, Artificial Sequence
  sgRNA
  Fras1_2
ccccacttggcaataaaccg

SEQ ID NO: 21069 - DNA, 20 bp, Artificial Sequence
  sgRNA
  Fras1_3
actggggctgaataacactt

SEQ ID NO: 21070 - DNA, 20 bp, Artificial Sequence
  sgRNA
  Fras1_4
ctgaagagtacgccatacag

SEQ ID NO: 21071 - DNA, 20 bp, Artificial Sequence
  sgRNA
  Fras1_5
tcttgctgactatgaccacg

SEQ ID NO: 21072 - DNA, 20 bp, Artificial Sequence
  sgRNA
  Fras1_6
cagtatgttgacattgcgca

SEQ ID NO: 21073 - DNA, 20 bp, Artificial Sequence
  sgRNA
  Fras1_7
gggactctctgccttcacga

SEQ ID NO: 21074 - DNA, 20 bp, Artificial Sequence
  sgRNA
  Fras1_8
ggggccgcgcatcatccaca

SEQ ID NO: 21075 - DNA, 20 bp, Artificial Sequence
  sgRNA
  Fras1_9
cattcacgaccacatcctgc

SEQ ID NO: 21076 - DNA, 20 bp, Artificial Sequence
  sgRNA
  Fras1_10
acatactgagtgacaatgaa

SEQ ID NO: 21077 - DNA, 20 bp, Artificial Sequence
  sgRNA
  Fras1_11
atatcgaaagtttcaccgtg

SEQ ID NO: 21078 - DNA, 20 bp, Artificial Sequence
  sgRNA
  Fras1_12
catgaaggaacggtgcagcg

SEQ ID NO: 21079 - DNA, 20 bp, Artificial Sequence
  sgRNA
  Fras1_13
actgccatatagatatcacc

SEQ ID NO: 21080 - DNA, 20 bp, Artificial Sequence
  sgRNA
  Fras1_14
cggccccttgtgcagaaccg

SEQ ID NO: 21081 - DNA, 20 bp, Artificial Sequence
  sgRNA
  Fras1_15
cgttgtagatcgtccccgta

SEQ ID NO: 21082 - DNA, 20 bp, Artificial Sequence
  sgRNA
  Fras1_16
gatttccaagaggatggcca

SEQ ID NO: 21083 - DNA, 20 bp, Artificial Sequence
  sgRNA
  Fras1_17
gatccgactttaagtccaga

SEQ ID NO: 21084 - DNA, 20 bp, Artificial Sequence
  sgRNA
  Fras1_18
tgacatggacgagctctcgg

SEQ ID NO: 21085 - DNA, 20 bp, Artificial Sequence
  sgRNA
  Fras1_19
ataacgtcagcgagaaggcg

SEQ ID NO: 21086 - DNA, 20 bp, Artificial Sequence
  sgRNA
  Fras1_20
tgtccccatcagagaaccga

SEQ ID NO: 21087 - DNA, 20 bp, Artificial Sequence
  sgRNA
  Frem2_1
aatttcctactggaatagcg

SEQ ID NO: 21088 - DNA, 20 bp, Artificial Sequence
  sgRNA
  Frem2_2
ttggagtgcacggatcgaag

SEQ ID NO: 21089 - DNA, 20 bp, Artificial Sequence
  sgRNA
  Frem2_3
ggtcgagctgcattcgcgag

SEQ ID NO: 21090 - DNA, 20 bp, Artificial Sequence
  sgRNA
  Frem2_4
tgggagaacccagaataaca

SEQ ID NO: 21091 - DNA, 20 bp, Artificial Sequence
  sgRNA
  Frem2_5
aattgaagtaatcttcgacg

SEQ ID NO: 21092 - DNA, 20 bp, Artificial Sequence
  sgRNA
  Frem2_6
ccagtgttgacaatctcggg

SEQ ID NO: 21093 - DNA, 20 bp, Artificial Sequence
  sgRNA
  Frem2_7
tgagaccgaggagtgccgcg

SEQ ID NO: 21094 - DNA, 20 bp, Artificial Sequence
  sgRNA
  Frem2_8
agccagacttcgcgaccgaa

SEQ ID NO: 21095 - DNA, 20 bp, Artificial Sequence
  sgRNA
  Frem2_9
gtttaacgccaaactggcag

SEQ ID NO: 21096 - DNA, 20 bp, Artificial Sequence
  sgRNA
  Frem2_10
gtgttggcgttcaggaccgg

SEQ ID NO: 21097 - DNA, 20 bp, Artificial Sequence
  sgRNA
  Frem2_11
tggtcgagctgcattcgcga

SEQ ID NO: 21098 - DNA, 20 bp, Artificial Sequence
  sgRNA
  Frem2_12
tcgagtttcaagtcaccgat

SEQ ID NO: 21099 - DNA, 20 bp, Artificial Sequence
  sgRNA
  Frem2_13
ggagtaccagtatcactcag

SEQ ID NO: 21100 - DNA, 20 bp, Artificial Sequence
  sgRNA
  Frem2_14
tgaaggagttctccgtaacg

SEQ ID NO: 21101 - DNA, 20 bp, Artificial Sequence
  sgRNA
  Frem2_15
gttcactccgtataaggcgg

SEQ ID NO: 21102 - DNA, 20 bp, Artificial Sequence
  sgRNA
  Frem2_16
agagtgcgcatcctgagcga

SEQ ID NO: 21103 - DNA, 20 bp, Artificial Sequence
  sgRNA
  Frem2_17
gccacatgcaaatatctgga

SEQ ID NO: 21104 - DNA, 20 bp, Artificial Sequence
  sgRNA
  Frem2_18
tttgcgtgcgactatggccc

SEQ ID NO: 21105 - DNA, 20 bp, Artificial Sequence
  sgRNA
  Frem2_19
ccttgacattcgattccaac

SEQ ID NO: 21106 - DNA, 20 bp, Artificial Sequence
  sgRNA
  Frem2_20
tgctgatgccgacattccca

SEQ ID NO: 21107 - DNA, 20 bp, Artificial Sequence
  sgRNA
  Frrs1_1
gctttaggtgtcgtaaaggg

SEQ ID NO: 21108 - DNA, 20 bp, Artificial Sequence
  sgRNA
  Frrs1_2
tcagtgatggttgaaatgag

SEQ ID NO: 21109 - DNA, 20 bp, Artificial Sequence
  sgRNA
  Frrs1_3
caggactccaatgctgaccg

SEQ ID NO: 21110 - DNA, 20 bp, Artificial Sequence
  sgRNA
  Frrs1_4
cagaaatcgtatgtgatctg

SEQ ID NO: 21111 - DNA, 20 bp, Artificial Sequence
  sgRNA
  Frrs1_5
gcaggctaccacccgtacct

SEQ ID NO: 21112 - DNA, 20 bp, Artificial Sequence
  sgRNA
  Frrs1_6
ttatcaggaccaccatttag

SEQ ID NO: 21113 - DNA, 20 bp, Artificial Sequence
  sgRNA
  Frrs1_7
gcagaaggcccgtctcacga

SEQ ID NO: 21114 - DNA, 20 bp, Artificial Sequence
  sgRNA
  Frrs1_8
ctgtacaaccgaggtacggg

SEQ ID NO: 21115 - DNA, 20 bp, Artificial Sequence
  sgRNA
  Frrs1_9
aggtcatcactgtacaaccg

SEQ ID NO: 21116 - DNA, 20 bp, Artificial Sequence
  sgRNA
  Frrs1_10
gtttgtggcatggatgacca

SEQ ID NO: 21117 - DNA, 20 bp, Artificial Sequence
  sgRNA
  Frrs1_11
gattagctgtgagtcataca

SEQ ID NO: 21118 - DNA, 20 bp, Artificial Sequence
  sgRNA
  Frrs1_12
cagaagacctacgcaatgat

SEQ ID NO: 21119 - DNA, 20 bp, Artificial Sequence
  sgRNA
  Frrs1_13
aggtggcgttgtcaaaggtt

SEQ ID NO: 21120 - DNA, 20 bp, Artificial Sequence
  sgRNA
  Frrs1_14
gagtgaaggagccaatagga

SEQ ID NO: 21121 - DNA, 20 bp, Artificial Sequence
  sgRNA
  Frrs1_15
agttcagtgccttcgagtgt

SEQ ID NO: 21122 - DNA, 20 bp, Artificial Sequence
  sgRNA
  Frrs1_16
gtagctttaggtgtcgtaaa

SEQ ID NO: 21123 - DNA, 20 bp, Artificial Sequence
  sgRNA
  Frrs1_17
cagcctccgcggtacacaaa

SEQ ID NO: 21124 - DNA, 20 bp, Artificial Sequence
  sgRNA
  Frrs1_18
ggcaaagtaccaatgtcctg

SEQ ID NO: 21125 - DNA, 20 bp, Artificial Sequence
  sgRNA
  Frrs1_19
agagtgaaggagccaatagg

SEQ ID NO: 21126 - DNA, 20 bp, Artificial Sequence
  sgRNA
  Frrs1_20
aggcaatcacaaggacactg

SEQ ID NO: 21127 - DNA, 20 bp, Artificial Sequence
  sgRNA
  Fshr_1
tcttacagatatcggagact

SEQ ID NO: 21128 - DNA, 20 bp, Artificial Sequence
  sgRNA
  Fshr_2
atccatgtgaagacatcatg

SEQ ID NO: 21129 - DNA, 20 bp, Artificial Sequence
  sgRNA
  Fshr_3
aggttacacataaggaaccg

SEQ ID NO: 21130 - DNA, 20 bp, Artificial Sequence
  sgRNA
  Fshr_4
acagttcaatggcgttccgg

SEQ ID NO: 21131 - DNA, 20 bp, Artificial Sequence
  sgRNA
  Fshr_5
gctgtgtcattgctctaaca

SEQ ID NO: 21132 - DNA, 20 bp, Artificial Sequence
  sgRNA
  Fshr_6
tttcaccaagaacttccgca

SEQ ID NO: 21133 - DNA, 20 bp, Artificial Sequence
  sgRNA
  Fshr_7
tcaggacgaagaagtccctg

SEQ ID NO: 21134 - DNA, 20 bp, Artificial Sequence
  sgRNA
  Fshr_8
aatacaaactcactgtgccc

SEQ ID NO: 21135 - DNA, 20 bp, Artificial Sequence
  sgRNA
  Fshr_9
gccttggacacagtgatgag

SEQ ID NO: 21136 - DNA, 20 bp, Artificial Sequence
  sgRNA
  Fshr_10
tgacaaacttgtctagacta

SEQ ID NO: 21137 - DNA, 20 bp, Artificial Sequence
  sgRNA
  Fshr_11
aatcttggtgtctcttgacg

SEQ ID NO: 21138 - DNA, 20 bp, Artificial Sequence
  sgRNA
  Fshr_12
aaagggctgtcgatatccat

SEQ ID NO: 21139 - DNA, 20 bp, Artificial Sequence
  sgRNA
  Fshr_13
gtagatgatgaacccagtta

SEQ ID NO: 21140 - DNA, 20 bp, Artificial Sequence
  sgRNA
  Fshr_14
gtagctactgatgccaaaga

SEQ ID NO: 21141 - DNA, 20 bp, Artificial Sequence
  sgRNA
  Fshr_15
cttagtatggatatcaactg

SEQ ID NO: 21142 - DNA, 20 bp, Artificial Sequence
  sgRNA
  Fshr_16
gcaccatgatgctggcagca

SEQ ID NO: 21143 - DNA, 20 bp, Artificial Sequence
  sgRNA
  Fshr_17
gtgcctttgcaaactggagg

SEQ ID NO: 21144 - DNA, 20 bp, Artificial Sequence
  sgRNA
  Fshr_18
ttctaagccatggttgggca

SEQ ID NO: 21145 - DNA, 20 bp, Artificial Sequence
  sgRNA
  Fshr_19
agattccgcccgacctcccc

SEQ ID NO: 21146 - DNA, 20 bp, Artificial Sequence
  sgRNA
  Fshr_20
tcaccttgctatcttggcag

SEQ ID NO: 21147 - DNA, 20 bp, Artificial Sequence
  sgRNA
  Furin_1
accctgtcttacaatcgccg

SEQ ID NO: 21148 - DNA, 20 bp, Artificial Sequence
  sgRNA
  Furin_2
acagcccgtagccatacgaa

SEQ ID NO: 21149 - DNA, 20 bp, Artificial Sequence
  sgRNA
  Furin_3
gggcacattgccgaactgtg

SEQ ID NO: 21150 - DNA, 20 bp, Artificial Sequence
  sgRNA
  Furin_4
acaatgcccgaattggaggt

SEQ ID NO: 21151 - DNA, 20 bp, Artificial Sequence
  sgRNA
  Furin_5
ggtggatagccaggtcaccg

SEQ ID NO: 21152 - DNA, 20 bp, Artificial Sequence
  sgRNA
  Furin_6
cgtcctcctctgagtccgat

SEQ ID NO: 21153 - DNA, 20 bp, Artificial Sequence
  sgRNA
  Furin_7
gcatggcactcgctgtgccg

SEQ ID NO: 21154 - DNA, 20 bp, Artificial Sequence
  sgRNA
  Furin_8
gttggcctctcacctgcccg

SEQ ID NO: 21155 - DNA, 20 bp, Artificial Sequence
  sgRNA
  Furin_9
gctgatgattgggctaccaa

SEQ ID NO: 21156 - DNA, 20 bp, Artificial Sequence
  sgRNA
  Furin_10
tgattgggctaccaacggcg

SEQ ID NO: 21157 - DNA, 20 bp, Artificial Sequence
  sgRNA
  Furin_11
ggacgtgtatcaggagccca

SEQ ID NO: 21158 - DNA, 20 bp, Artificial Sequence
  sgRNA
  Furin_12
gcaatgataccagctgccaa

SEQ ID NO: 21159 - DNA, 20 bp, Artificial Sequence
  sgRNA
  Furin_13
aggtgtagagagcccctcgg

SEQ ID NO: 21160 - DNA, 20 bp, Artificial Sequence
  sgRNA
  Furin_14
tcggactcagaggaggacga

SEQ ID NO: 21161 - DNA, 20 bp, Artificial Sequence
  sgRNA
  Furin_15
gcgagacctgaatgtgaagg

SEQ ID NO: 21162 - DNA, 20 bp, Artificial Sequence
  sgRNA
  Furin_16
tctaggacccattcgccagc

SEQ ID NO: 21163 - DNA, 20 bp, Artificial Sequence
  sgRNA
  Furin_17
tctacacctccagaaagcag

SEQ ID NO: 21164 - DNA, 20 bp, Artificial Sequence
  sgRNA
  Furin_18
gcggcacagccggctacaga

SEQ ID NO: 21165 - DNA, 20 bp, Artificial Sequence
  sgRNA
  Furin_19
gcctcatgtgccacttgcca

SEQ ID NO: 21166 - DNA, 20 bp, Artificial Sequence
  sgRNA
  Furin_20
ggtgcggatgttggatggcg

SEQ ID NO: 21167 - DNA, 20 bp, Artificial Sequence
  sgRNA
  Fzd1_1
agcccgctagcccaacgccg

SEQ ID NO: 21168 - DNA, 20 bp, Artificial Sequence
  sgRNA
  Fzd1_2
accagtaatccgcagcacgg

SEQ ID NO: 21169 - DNA, 20 bp, Artificial Sequence
  sgRNA
  Fzd1_3
tcacgtacctagtggacatg

SEQ ID NO: 21170 - DNA, 20 bp, Artificial Sequence
  sgRNA
  Fzd1_4
gctgggccacacgaatcagg

SEQ ID NO: 21171 - DNA, 20 bp, Artificial Sequence
  sgRNA
  Fzd1_5
agtaatccgcagcacggcgg

SEQ ID NO: 21172 - DNA, 20 bp, Artificial Sequence
  sgRNA
  Fzd1_6
acttgtcgttgcacaccacc

SEQ ID NO: 21173 - DNA, 20 bp, Artificial Sequence
  sgRNA
  Fzd1_7
gtggatggcgacgtactgag

SEQ ID NO: 21174 - DNA, 20 bp, Artificial Sequence
  sgRNA
  Fzd1_8
gctgattgtgggcatcacat

SEQ ID NO: 21175 - DNA, 20 bp, Artificial Sequence
  sgRNA
  Fzd1_9
ggcttaccaacagcaaacag

SEQ ID NO: 21176 - DNA, 20 bp, Artificial Sequence
  sgRNA
  Fzd1_10
tcagtacgtcgccatccacc

SEQ ID NO: 21177 - DNA, 20 bp, Artificial Sequence
  sgRNA
  Fzd1_11
taaaccttggtgggttcgca

SEQ ID NO: 21178 - DNA, 20 bp, Artificial Sequence
  sgRNA
  Fzd1_12
gagcaccgtgaagagcgtgg

SEQ ID NO: 21179 - DNA, 20 bp, Artificial Sequence
  sgRNA
  Fzd1_13
gcttaccaacagcaaacagg

SEQ ID NO: 21180 - DNA, 20 bp, Artificial Sequence
  sgRNA
  Fzd1_14
gtatttccatttagccgcct

SEQ ID NO: 21181 - DNA, 20 bp, Artificial Sequence
  sgRNA
  Fzd1_15
gcaagacactgaattcctgg

SEQ ID NO: 21182 - DNA, 20 bp, Artificial Sequence
  sgRNA
  Fzd1_16
gcgctcccactggtcccgaa

SEQ ID NO: 21183 - DNA, 20 bp, Artificial Sequence
  sgRNA
  Fzd1_17
gctcatgtacttcgggccag

SEQ ID NO: 21184 - DNA, 20 bp, Artificial Sequence
  sgRNA
  Fzd1_18
tacgcgatgtccgtgcacag

SEQ ID NO: 21185 - DNA, 20 bp, Artificial Sequence
  sgRNA
  Fzd1_19
agtccttctcccccagaaag

SEQ ID NO: 21186 - DNA, 20 bp, Artificial Sequence
  sgRNA
  Fzd1_20
gtccggctgttacacagcgg

SEQ ID NO: 21187 - DNA, 20 bp, Artificial Sequence
  sgRNA
  Fzd10_1
gggtcacgagaaccagcgcg

SEQ ID NO: 21188 - DNA, 20 bp, Artificial Sequence
  sgRNA
  Fzd10_2
ggaagatgataggacgttcg

SEQ ID NO: 21189 - DNA, 20 bp, Artificial Sequence
  sgRNA
  Fzd10_3
ggtactttactacttcggca

SEQ ID NO: 21190 - DNA, 20 bp, Artificial Sequence
  sgRNA
  Fzd10_4
gagcacccactaaaggacgg

SEQ ID NO: 21191 - DNA, 20 bp, Artificial Sequence
  sgRNA
  Fzd10_5
ggctttattccacatccgga

SEQ ID NO: 21192 - DNA, 20 bp, Artificial Sequence
  sgRNA
  Fzd10_6
gctggcacttgccgtctcca

SEQ ID NO: 21193 - DNA, 20 bp, Artificial Sequence
  sgRNA
  Fzd10_7
ggctaaagagaaaaagccgg

SEQ ID NO: 21194 - DNA, 20 bp, Artificial Sequence
  sgRNA
  Fzd10_8
gcgcaccgctttgcactccg

SEQ ID NO: 21195 - DNA, 20 bp, Artificial Sequence
  sgRNA
  Fzd10_9
gatcttggtgatgcgcaggg

SEQ ID NO: 21196 - DNA, 20 bp, Artificial Sequence
  sgRNA
  Fzd10_10
tggcagccgtactccacgag

SEQ ID NO: 21197 - DNA, 20 bp, Artificial Sequence
  sgRNA
  Fzd10_11
tagccgatgtccttgcacat

SEQ ID NO: 21198 - DNA, 20 bp, Artificial Sequence
  sgRNA
  Fzd10_12
ctggcttgctacctagtcat

SEQ ID NO: 21199 - DNA, 20 bp, Artificial Sequence
  sgRNA
  Fzd10_13
tcacgagaaccagcgcgagg

SEQ ID NO: 21200 - DNA, 20 bp, Artificial Sequence
  sgRNA
  Fzd10_14
gcgaacacaggaagaagcga

SEQ ID NO: 21201 - DNA, 20 bp, Artificial Sequence
  sgRNA
  Fzd10_15
ccacatggtggaacttgcct

SEQ ID NO: 21202 - DNA, 20 bp, Artificial Sequence
  sgRNA
  Fzd10_16
gaggaaacatgccagagccc

SEQ ID NO: 21203 - DNA, 20 bp, Artificial Sequence
  sgRNA
  Fzd10_17
tgggcgcgtacagcgaacac

SEQ ID NO: 21204 - DNA, 20 bp, Artificial Sequence
  sgRNA
  Fzd10_18
tgttgggtgcctccatgcac

SEQ ID NO: 21205 - DNA, 20 bp, Artificial Sequence
  sgRNA
  Fzd10_19
ggcaacacgtatgcagccgg

SEQ ID NO: 21206 - DNA, 20 bp, Artificial Sequence
  sgRNA
  Fzd10_20
acatgggaatctccaccggc

SEQ ID NO: 21207 - DNA, 20 bp, Artificial Sequence
  sgRNA
  Fzd2_1
agaggacggttatcgcacgg

SEQ ID NO: 21208 - DNA, 20 bp, Artificial Sequence
  sgRNA
  Fzd2_2
caggagctccgtcctccgag

SEQ ID NO: 21209 - DNA, 20 bp, Artificial Sequence
  sgRNA
  Fzd2_3
cctgtgctccatgtacgcgc

SEQ ID NO: 21210 - DNA, 20 bp, Artificial Sequence
  sgRNA
  Fzd2_4
cggaccggcccagttccacg

SEQ ID NO: 21211 - DNA, 20 bp, Artificial Sequence
  sgRNA
  Fzd2_5
aatagcctggacccgctgcg

SEQ ID NO: 21212 - DNA, 20 bp, Artificial Sequence
  sgRNA
  Fzd2_6
gcatttcccgcgtcacggcg

SEQ ID NO: 21213 - DNA, 20 bp, Artificial Sequence
  sgRNA
  Fzd2_7
cgtgggccagaaccactcgg

SEQ ID NO: 21214 - DNA, 20 bp, Artificial Sequence
  sgRNA
  Fzd2_8
gtgaagtcgggcgacatgcg

SEQ ID NO: 21215 - DNA, 20 bp, Artificial Sequence
  sgRNA
  Fzd2_9
gcaagacactgcactcgtgg

SEQ ID NO: 21216 - DNA, 20 bp, Artificial Sequence
  sgRNA
  Fzd2_10
gacggcaccttgaggacgcg

SEQ ID NO: 21217 - DNA, 20 bp, Artificial Sequence
  sgRNA
  Fzd2_11
gctcatcgtgggcatcacgt

SEQ ID NO: 21218 - DNA, 20 bp, Artificial Sequence
  sgRNA
  Fzd2_12
atcgacggcgacctgctgag

SEQ ID NO: 21219 - DNA, 20 bp, Artificial Sequence
  sgRNA
  Fzd2_13
aatgagcgcttctcagagga

SEQ ID NO: 21220 - DNA, 20 bp, Artificial Sequence
  sgRNA
  Fzd2_14
ctcttcgtatacctgttcat

SEQ ID NO: 21221 - DNA, 20 bp, Artificial Sequence
  sgRNA
  Fzd2_15
ggtgcatcagttctacccgc

SEQ ID NO: 21222 - DNA, 20 bp, Artificial Sequence
  sgRNA
  Fzd2_16
cttcgttctccaggagcgcg

SEQ ID NO: 21223 - DNA, 20 bp, Artificial Sequence
  sgRNA
  Fzd2_17
ctgcatgtccactaaatagg

SEQ ID NO: 21224 - DNA, 20 bp, Artificial Sequence
  sgRNA
  Fzd2_18
ctcagaggacggttatcgca

SEQ ID NO: 21225 - DNA, 20 bp, Artificial Sequence
  sgRNA
  Fzd2_19
tgctccagagtggcgtaacg

SEQ ID NO: 21226 - DNA, 20 bp, Artificial Sequence
  sgRNA
  Fzd2_20
agcgatttcgctacccagag

SEQ ID NO: 21227 - DNA, 20 bp, Artificial Sequence
  sgRNA
  Fzd3_1
ggatgatagttagagttccg

SEQ ID NO: 21228 - DNA, 20 bp, Artificial Sequence
  sgRNA
  Fzd3_2
aggcacgctgacacagccta

SEQ ID NO: 21229 - DNA, 20 bp, Artificial Sequence
  sgRNA
  Fzd3_3
tatggctggcagtgtatggt

SEQ ID NO: 21230 - DNA, 20 bp, Artificial Sequence
  sgRNA
  Fzd3_4
ttacaaccaagagtggcaca

SEQ ID NO: 21231 - DNA, 20 bp, Artificial Sequence
  sgRNA
  Fzd3_5
ttaatgcatcaacgtcgtag

SEQ ID NO: 21232 - DNA, 20 bp, Artificial Sequence
  sgRNA
  Fzd3_6
gatagtgaatgagagccggc

SEQ ID NO: 21233 - DNA, 20 bp, Artificial Sequence
  sgRNA
  Fzd3_7
cttccaacccaaaatataga

SEQ ID NO: 21234 - DNA, 20 bp, Artificial Sequence
  sgRNA
  Fzd3_8
ttagcagctgtgccaaagtg

SEQ ID NO: 21235 - DNA, 20 bp, Artificial Sequence
  sgRNA
  Fzd3_9
gcttctttggtcatccacca

SEQ ID NO: 21236 - DNA, 20 bp, Artificial Sequence
  sgRNA
  Fzd3_10
gtgccactcttggttgtaat

SEQ ID NO: 21237 - DNA, 20 bp, Artificial Sequence
  sgRNA
  Fzd3_11
actaccacatacaggcagag

SEQ ID NO: 21238 - DNA, 20 bp, Artificial Sequence
  sgRNA
  Fzd3_12
ctgcagttaccgaggaatgg

SEQ ID NO: 21239 - DNA, 20 bp, Artificial Sequence
  sgRNA
  Fzd3_13
acagactgcagctttagcaa

SEQ ID NO: 21240 - DNA, 20 bp, Artificial Sequence
  sgRNA
  Fzd3_14
gggtaattcttaccatcaca

SEQ ID NO: 21241 - DNA, 20 bp, Artificial Sequence
  sgRNA
  Fzd3_15
acaatctcgcacgtgcagaa

SEQ ID NO: 21242 - DNA, 20 bp, Artificial Sequence
  sgRNA
  Fzd3_16
tacactccctgcagttaccg

SEQ ID NO: 21243 - DNA, 20 bp, Artificial Sequence
  sgRNA
  Fzd3_17
tccattcctcggtaactgca

SEQ ID NO: 21244 - DNA, 20 bp, Artificial Sequence
  sgRNA
  Fzd3_18
tggagatgtttggtgtcccg

SEQ ID NO: 21245 - DNA, 20 bp, Artificial Sequence
  sgRNA
  Fzd3_19
tgagccatatccccgacttg

SEQ ID NO: 21246 - DNA, 20 bp, Artificial Sequence
  sgRNA
  Fzd3_20
atgttgtctcccagatgccg

SEQ ID NO: 21247 - DNA, 20 bp, Artificial Sequence
  sgRNA
  Fzd4_1
ttggcacataaaccgaacaa

SEQ ID NO: 21248 - DNA, 20 bp, Artificial Sequence
  sgRNA
  Fzd4_2
ggttctggcacatggcgatg

SEQ ID NO: 21249 - DNA, 20 bp, Artificial Sequence
  sgRNA
  Fzd4_3
acatactgagaaatatgatg

SEQ ID NO: 21250 - DNA, 20 bp, Artificial Sequence
  sgRNA
  Fzd4_4
ctggtccttccatgcacatg

SEQ ID NO: 21251 - DNA, 20 bp, Artificial Sequence
  sgRNA
  Fzd4_5
tcttggtcacgttgtagccg

SEQ ID NO: 21252 - DNA, 20 bp, Artificial Sequence
  sgRNA
  Fzd4_6
gagaagatcaacatccccat

SEQ ID NO: 21253 - DNA, 20 bp, Artificial Sequence
  sgRNA
  Fzd4_7
ccttcccagaattcaccaat

SEQ ID NO: 21254 - DNA, 20 bp, Artificial Sequence
  sgRNA
  Fzd4_8
gcaaaagtgttctaaccgat

SEQ ID NO: 21255 - DNA, 20 bp, Artificial Sequence
  sgRNA
  Fzd4_9
ggaacgctgttcattgcggc

SEQ ID NO: 21256 - DNA, 20 bp, Artificial Sequence
  sgRNA
  Fzd4_10
ttcacgccgctcatccagta

SEQ ID NO: 21257 - DNA, 20 bp, Artificial Sequence
  sgRNA
  Fzd4_11
gaaaggcacatgccaccgca

SEQ ID NO: 21258 - DNA, 20 bp, Artificial Sequence
  sgRNA
  Fzd4_12
ggtccaatcttcaaaaagac

SEQ ID NO: 21259 - DNA, 20 bp, Artificial Sequence
  sgRNA
  Fzd4_13
gagcagccgtactggatgag

SEQ ID NO: 21260 - DNA, 20 bp, Artificial Sequence
  sgRNA
  Fzd4_14
ttatttccacatcgcagcct

SEQ ID NO: 21261 - DNA, 20 bp, Artificial Sequence
  sgRNA
  Fzd4_15
tggaacgctgttcattgcgg

SEQ ID NO: 21262 - DNA, 20 bp, Artificial Sequence
  sgRNA
  Fzd4_16
tcgtccccgaaccccagtgt

SEQ ID NO: 21263 - DNA, 20 bp, Artificial Sequence
  sgRNA
  Fzd4_17
cctggatgaatcaatcagga

SEQ ID NO: 21264 - DNA, 20 bp, Artificial Sequence
  sgRNA
  Fzd4_18
ccgtgaactccttagctgag

SEQ ID NO: 21265 - DNA, 20 bp, Artificial Sequence
  sgRNA
  Fzd4_19
gaaagttgtcagctgcagct

SEQ ID NO: 21266 - DNA, 20 bp, Artificial Sequence
  sgRNA
  Fzd4_20
tgctcctgcggccgacactg

SEQ ID NO: 21267 - DNA, 20 bp, Artificial Sequence
  sgRNA
  Fzd5_1
ccagttcaaccatgacacgc

SEQ ID NO: 21268 - DNA, 20 bp, Artificial Sequence
  sgRNA
  Fzd5_2
ggaatcgttccatgtcaatg

SEQ ID NO: 21269 - DNA, 20 bp, Artificial Sequence
  sgRNA
  Fzd5_3
gtcacacccactctacaaca

SEQ ID NO: 21270 - DNA, 20 bp, Artificial Sequence
  sgRNA
  Fzd5_4
gtactgtgcataacctgcga

SEQ ID NO: 21271 - DNA, 20 bp, Artificial Sequence
  sgRNA
  Fzd5_5
agacaaccgtgcacagcgca

SEQ ID NO: 21272 - DNA, 20 bp, Artificial Sequence
  sgRNA
  Fzd5_6
gagaagctcatgatccgcat

SEQ ID NO: 21273 - DNA, 20 bp, Artificial Sequence
  sgRNA
  Fzd5_7
atccggagcgtcatcaagca

SEQ ID NO: 21274 - DNA, 20 bp, Artificial Sequence
  sgRNA
  Fzd5_8
ctaccagccgtccttcagcc

SEQ ID NO: 21275 - DNA, 20 bp, Artificial Sequence
  sgRNA
  Fzd5_9
cagtactcgggtttggcgcg

SEQ ID NO: 21276 - DNA, 20 bp, Artificial Sequence
  sgRNA
  Fzd5_10
gtgcgcaccttgttgtagag

SEQ ID NO: 21277 - DNA, 20 bp, Artificial Sequence
  sgRNA
  Fzd5_11
ggaagagcgtgcccaccaac

SEQ ID NO: 21278 - DNA, 20 bp, Artificial Sequence
  sgRNA
  Fzd5_12
caaaacctgaactcactacg

SEQ ID NO: 21279 - DNA, 20 bp, Artificial Sequence
  sgRNA
  Fzd5_13
catagcagatgccagccact

SEQ ID NO: 21280 - DNA, 20 bp, Artificial Sequence
  sgRNA
  Fzd5_14
gcttgatgacgctccggatg

SEQ ID NO: 21281 - DNA, 20 bp, Artificial Sequence
  sgRNA
  Fzd5_15
gcactaccgggagagctggg

SEQ ID NO: 21282 - DNA, 20 bp, Artificial Sequence
  sgRNA
  Fzd5_16
acacggatgggcctcccgag

SEQ ID NO: 21283 - DNA, 20 bp, Artificial Sequence
  sgRNA
  Fzd5_17
tcaggttgtagccgatgcct

SEQ ID NO: 21284 - DNA, 20 bp, Artificial Sequence
  sgRNA
  Fzd5_18
tgctgctgcagctctcggcg

SEQ ID NO: 21285 - DNA, 20 bp, Artificial Sequence
  sgRNA
  Fzd5_19
cggccaagtgcccaactgcg

SEQ ID NO: 21286 - DNA, 20 bp, Artificial Sequence
  sgRNA
  Fzd5_20
ctggtgctgtacctgttggt

SEQ ID NO: 21287 - DNA, 20 bp, Artificial Sequence
  sgRNA
  Fzd6_1
ctattgaacaaaaagcagtg

SEQ ID NO: 21288 - DNA, 20 bp, Artificial Sequence
  sgRNA
  Fzd6_2
aaagcaccttaggacttccg

SEQ ID NO: 21289 - DNA, 20 bp, Artificial Sequence
  sgRNA
  Fzd6_3
acagcccaacaaatacgcag

SEQ ID NO: 21290 - DNA, 20 bp, Artificial Sequence
  sgRNA
  Fzd6_4
aaagaataaggcttgcagtg

SEQ ID NO: 21291 - DNA, 20 bp, Artificial Sequence
  sgRNA
  Fzd6_5
gggtgattctcaccattacg

SEQ ID NO: 21292 - DNA, 20 bp, Artificial Sequence
  sgRNA
  Fzd6_6
aatgcacgccaacagaaacg

SEQ ID NO: 21293 - DNA, 20 bp, Artificial Sequence
  sgRNA
  Fzd6_7
aggctgtgtcctcttacgag

SEQ ID NO: 21294 - DNA, 20 bp, Artificial Sequence
  sgRNA
  Fzd6_8
gttgaaggagacaacattag

SEQ ID NO: 21295 - DNA, 20 bp, Artificial Sequence
  sgRNA
  Fzd6_9
ggttccatgccgttgcctgg

SEQ ID NO: 21296 - DNA, 20 bp, Artificial Sequence
  sgRNA
  Fzd6_10
agaagaagcatggcgcacca

SEQ ID NO: 21297 - DNA, 20 bp, Artificial Sequence
  sgRNA
  Fzd6_11
gcggtttcgcttaaagaacc

SEQ ID NO: 21298 - DNA, 20 bp, Artificial Sequence
  sgRNA
  Fzd6_12
cagaaggacgaagtagcgag

SEQ ID NO: 21299 - DNA, 20 bp, Artificial Sequence
  sgRNA
  Fzd6_13
tctccttcaggccgcccgct

SEQ ID NO: 21300 - DNA, 20 bp, Artificial Sequence
  sgRNA
  Fzd6_14
ttacaatggctggcaccgtg

SEQ ID NO: 21301 - DNA, 20 bp, Artificial Sequence
  sgRNA
  Fzd6_15
gggactgtggggaatctgca

SEQ ID NO: 21302 - DNA, 20 bp, Artificial Sequence
  sgRNA
  Fzd6_16
aggagatgatgccggctaag

SEQ ID NO: 21303 - DNA, 20 bp, Artificial Sequence
  sgRNA
  Fzd6_17
gtctgctcgtccctctttga

SEQ ID NO: 21304 - DNA, 20 bp, Artificial Sequence
  sgRNA
  Fzd6_18
acgttcttccctaacctgat

SEQ ID NO: 21305 - DNA, 20 bp, Artificial Sequence
  sgRNA
  Fzd6_19
aggactcttgcagcactcgg

SEQ ID NO: 21306 - DNA, 20 bp, Artificial Sequence
  sgRNA
  Fzd6_20
ggcagctaagaaccacgtaa

SEQ ID NO: 21307 - DNA, 20 bp, Artificial Sequence
  sgRNA
  Fzd7_1
ggacgatggctaccgcacgg

SEQ ID NO: 21308 - DNA, 20 bp, Artificial Sequence
  sgRNA
  Fzd7_2
gtggggcagaacacgtccga

SEQ ID NO: 21309 - DNA, 20 bp, Artificial Sequence
  sgRNA
  Fzd7_3
gctgggccacacgaaccaag

SEQ ID NO: 21310 - DNA, 20 bp, Artificial Sequence
  sgRNA
  Fzd7_4
gctggcgcggacacgagaag

SEQ ID NO: 21311 - DNA, 20 bp, Artificial Sequence
  sgRNA
  Fzd7_5
ctcggacgatggctaccgca

SEQ ID NO: 21312 - DNA, 20 bp, Artificial Sequence
  sgRNA
  Fzd7_6
agtcacgctcacctaggaag

SEQ ID NO: 21313 - DNA, 20 bp, Artificial Sequence
  sgRNA
  Fzd7_7
gtactttcatctggccgcgt

SEQ ID NO: 21314 - DNA, 20 bp, Artificial Sequence
  sgRNA
  Fzd7_8
gaacacgtccgacggctccg

SEQ ID NO: 21315 - DNA, 20 bp, Artificial Sequence
  sgRNA
  Fzd7_9
ggaaggacgtcccgatgaag

SEQ ID NO: 21316 - DNA, 20 bp, Artificial Sequence
  sgRNA
  Fzd7_10
gtagcaggccaacacgatgg

SEQ ID NO: 21317 - DNA, 20 bp, Artificial Sequence
  sgRNA
  Fzd7_11
cgtcttcagcgtgctctaca

SEQ ID NO: 21318 - DNA, 20 bp, Artificial Sequence
  sgRNA
  Fzd7_12
gcgacccatcatcttcctgt

SEQ ID NO: 21319 - DNA, 20 bp, Artificial Sequence
  sgRNA
  Fzd7_13
ccatgaagtagcaacccgac

SEQ ID NO: 21320 - DNA, 20 bp, Artificial Sequence
  sgRNA
  Fzd7_14
taggcgatatccgtgcacaa

SEQ ID NO: 21321 - DNA, 20 bp, Artificial Sequence
  sgRNA
  Fzd7_15
tctagtgtggatgcattgcg

SEQ ID NO: 21322 - DNA, 20 bp, Artificial Sequence
  sgRNA
  Fzd7_16
tggtcgagcacggtgcacac

SEQ ID NO: 21323 - DNA, 20 bp, Artificial Sequence
  sgRNA
  Fzd7_17
gagaagctgatggtgcgcat

SEQ ID NO: 21324 - DNA, 20 bp, Artificial Sequence
  sgRNA
  Fzd7_18
tcgcacaaggaacggcacgg

SEQ ID NO: 21325 - DNA, 20 bp, Artificial Sequence
  sgRNA
  Fzd7_19
aaagtagcaggccaacacga

SEQ ID NO: 21326 - DNA, 20 bp, Artificial Sequence
  sgRNA
  Fzd7_20
gagcaccgtgaagagcgtcg

SEQ ID NO: 21327 - DNA, 20 bp, Artificial Sequence
  sgRNA
  Fzd8_1
taaagcgctccatatcgatg

SEQ ID NO: 21328 - DNA, 20 bp, Artificial Sequence
  sgRNA
  Fzd8_2
cagaaagaacttgaggtccg

SEQ ID NO: 21329 - DNA, 20 bp, Artificial Sequence
  sgRNA
  Fzd8_3
gcaaccgatcgcagcgcatg

SEQ ID NO: 21330 - DNA, 20 bp, Artificial Sequence
  sgRNA
  Fzd8_4
gggtaatcctgtcgctcacg

SEQ ID NO: 21331 - DNA, 20 bp, Artificial Sequence
  sgRNA
  Fzd8_5
gtcttgacgcggttgtagag

SEQ ID NO: 21332 - DNA, 20 bp, Artificial Sequence
  sgRNA
  Fzd8_6
gcacaagccacgcggccagg

SEQ ID NO: 21333 - DNA, 20 bp, Artificial Sequence
  sgRNA
  Fzd8_7
cgatctggccggtcttgacg

SEQ ID NO: 21334 - DNA, 20 bp, Artificial Sequence
  sgRNA
  Fzd8_8
gcacggtgaagaggcccaag

SEQ ID NO: 21335 - DNA, 20 bp, Artificial Sequence
  sgRNA
  Fzd8_9
gttgcaggtcccgaaggcat

SEQ ID NO: 21336 - DNA, 20 bp, Artificial Sequence
  sgRNA
  Fzd8_10
gaaaaggcaggcgacaacga

SEQ ID NO: 21337 - DNA, 20 bp, Artificial Sequence
  sgRNA
  Fzd8_11
caaccgcaccgacctcacca

SEQ ID NO: 21338 - DNA, 20 bp, Artificial Sequence
  sgRNA
  Fzd8_12
gctgagcgccagcaccgcga

SEQ ID NO: 21339 - DNA, 20 bp, Artificial Sequence
  sgRNA
  Fzd8_13
gacgctgggcacaagccacg

SEQ ID NO: 21340 - DNA, 20 bp, Artificial Sequence
  sgRNA
  Fzd8_14
agtacttccacctggccgcg

SEQ ID NO: 21341 - DNA, 20 bp, Artificial Sequence
  sgRNA
  Fzd8_15
tatggagcgctttaagtacc

SEQ ID NO: 21342 - DNA, 20 bp, Artificial Sequence
  sgRNA
  Fzd8_16
gcacaaccgaccgcgctggg

SEQ ID NO: 21343 - DNA, 20 bp, Artificial Sequence
  sgRNA
  Fzd8_17
acacgctcaccatgggcgcg

SEQ ID NO: 21344 - DNA, 20 bp, Artificial Sequence
  sgRNA
  Fzd8_18
ggctcgcaggcccgattacg

SEQ ID NO: 21345 - DNA, 20 bp, Artificial Sequence
  sgRNA
  Fzd8_19
gcgctgtagcaccgccaagg

SEQ ID NO: 21346 - DNA, 20 bp, Artificial Sequence
  sgRNA
  Fzd8_20
cagagccttgacaacctacg

SEQ ID NO: 21347 - DNA, 20 bp, Artificial Sequence
  sgRNA
  Fzd9_1
cccgcacgcactctgtatgg

SEQ ID NO: 21348 - DNA, 20 bp, Artificial Sequence
  sgRNA
  Fzd9_2
gacctggtcggtgcacattg

SEQ ID NO: 21349 - DNA, 20 bp, Artificial Sequence
  sgRNA
  Fzd9_3
gagtgtggcatgcgaccagg

SEQ ID NO: 21350 - DNA, 20 bp, Artificial Sequence
  sgRNA
  Fzd9_4
tacttccacatggcagcgtg

SEQ ID NO: 21351 - DNA, 20 bp, Artificial Sequence
  sgRNA
  Fzd9_5
gcgcgataaggacttcgcgc

SEQ ID NO: 21352 - DNA, 20 bp, Artificial Sequence
  sgRNA
  Fzd9_6
agtcatgtgcaagaccaccg

SEQ ID NO: 21353 - DNA, 20 bp, Artificial Sequence
  sgRNA
  Fzd9_7
gtggcagccgtactgcacga

SEQ ID NO: 21354 - DNA, 20 bp, Artificial Sequence
  sgRNA
  Fzd9_8
agagactgctcgctgccagg

SEQ ID NO: 21355 - DNA, 20 bp, Artificial Sequence
  sgRNA
  Fzd9_9
ggccacgctccggatcgaag

SEQ ID NO: 21356 - DNA, 20 bp, Artificial Sequence
  sgRNA
  Fzd9_10
gcaggccccacgctgccatg

SEQ ID NO: 21357 - DNA, 20 bp, Artificial Sequence
  sgRNA
  Fzd9_11
ggaaccggtgaggctccagc

SEQ ID NO: 21358 - DNA, 20 bp, Artificial Sequence
  sgRNA
  Fzd9_12
ggccgcttcgatccggagcg

SEQ ID NO: 21359 - DNA, 20 bp, Artificial Sequence
  sgRNA
  Fzd9_13
actgctgccaccgtgcctgg

SEQ ID NO: 21360 - DNA, 20 bp, Artificial Sequence
  sgRNA
  Fzd9_14
tcatgtgcaagaccaccgtg

SEQ ID NO: 21361 - DNA, 20 bp, Artificial Sequence
  sgRNA
  Fzd9_15
ttcgatccggagcgtggccg

SEQ ID NO: 21362 - DNA, 20 bp, Artificial Sequence
  sgRNA
  Fzd9_16
cctggggctgaatctcccgg

SEQ ID NO: 21363 - DNA, 20 bp, Artificial Sequence
  sgRNA
  Fzd9_17
aacgtagcagacaatgacgc

SEQ ID NO: 21364 - DNA, 20 bp, Artificial Sequence
  sgRNA
  Fzd9_18
ctgccactacaaagccccca

SEQ ID NO: 21365 - DNA, 20 bp, Artificial Sequence
  sgRNA
  Fzd9_19
tcacggcagctacttccaca

SEQ ID NO: 21366 - DNA, 20 bp, Artificial Sequence
  sgRNA
  Fzd9_20
gccagcactcaaaactatcg

SEQ ID NO: 21367 - DNA, 20 bp, Artificial Sequence
  sgRNA
  Gabbr1_1
acggcgtgcagtatacatcg

SEQ ID NO: 21368 - DNA, 20 bp, Artificial Sequence
  sgRNA
  Gabbr1_2
aagagaaacttaccgaacgt

SEQ ID NO: 21369 - DNA, 20 bp, Artificial Sequence
  sgRNA
  Gabbr1_3
ggatgtgtccgaaagaacgt

SEQ ID NO: 21370 - DNA, 20 bp, Artificial Sequence
  sgRNA
  Gabbr1_4
gttcagcatgacaatctccg

SEQ ID NO: 21371 - DNA, 20 bp, Artificial Sequence
  sgRNA
  Gabbr1_5
ggtcacatcggaaatccacc

SEQ ID NO: 21372 - DNA, 20 bp, Artificial Sequence
  sgRNA
  Gabbr1_6
gatcagagaagagttaccag

SEQ ID NO: 21373 - DNA, 20 bp, Artificial Sequence
  sgRNA
  Gabbr1_7
tcagacccccaacgtcacct

SEQ ID NO: 21374 - DNA, 20 bp, Artificial Sequence
  sgRNA
  Gabbr1_8
gcttgagctcgtagtccggc

SEQ ID NO: 21375 - DNA, 20 bp, Artificial Sequence
  sgRNA
  Gabbr1_9
tgtgtgccggggcgaacgcg

SEQ ID NO: 21376 - DNA, 20 bp, Artificial Sequence
  sgRNA
  Gabbr1_10
atgtctggtttctcatcggg

SEQ ID NO: 21377 - DNA, 20 bp, Artificial Sequence
  sgRNA
  Gabbr1_11
acgcttatcgagcagctaca

SEQ ID NO: 21378 - DNA, 20 bp, Artificial Sequence
  sgRNA
  Gabbr1_12
tcacagctaagccggtcagg

SEQ ID NO: 21379 - DNA, 20 bp, Artificial Sequence
  sgRNA
  Gabbr1_13
cagccttgtcaaaccgacag

SEQ ID NO: 21380 - DNA, 20 bp, Artificial Sequence
  sgRNA
  Gabbr1_14
ggatcagagaagagttacca

SEQ ID NO: 21381 - DNA, 20 bp, Artificial Sequence
  sgRNA
  Gabbr1_15
gtcacatcggaaatccaccc

SEQ ID NO: 21382 - DNA, 20 bp, Artificial Sequence
  sgRNA
  Gabbr1_16
gtgaaactcttcgaaaagtg

SEQ ID NO: 21383 - DNA, 20 bp, Artificial Sequence
  sgRNA
  Gabbr1_17
tattcaatctcatagtccac

SEQ ID NO: 21384 - DNA, 20 bp, Artificial Sequence
  sgRNA
  Gabbr1_18
gagattgaatatgtgtgccg

SEQ ID NO: 21385 - DNA, 20 bp, Artificial Sequence
  sgRNA
  Gabbr1_19
atcaagatcatcctcatgcc

SEQ ID NO: 21386 - DNA, 20 bp, Artificial Sequence
  sgRNA
  Gabbr1_20
gaacggcgtgcagtatacat

SEQ ID NO: 21387 - DNA, 20 bp, Artificial Sequence
  sgRNA
  Gabbr2_1
cctgcgactctacgacaccg

SEQ ID NO: 21388 - DNA, 20 bp, Artificial Sequence
  sgRNA
  Gabbr2_2
catggaaggctacatcggag

SEQ ID NO: 21389 - DNA, 20 bp, Artificial Sequence
  sgRNA
  Gabbr2_3
gctgacaggatgctatacag

SEQ ID NO: 21390 - DNA, 20 bp, Artificial Sequence
  sgRNA
  Gabbr2_4
cttatccgcaagaacaggcg

SEQ ID NO: 21391 - DNA, 20 bp, Artificial Sequence
  sgRNA
  Gabbr2_5
gcattgtctacgcctacaag

SEQ ID NO: 21392 - DNA, 20 bp, Artificial Sequence
  sgRNA
  Gabbr2_6
gacggtgccctcagacaacg

SEQ ID NO: 21393 - DNA, 20 bp, Artificial Sequence
  sgRNA
  Gabbr2_7
gcgtccacgcctccaatgga

SEQ ID NO: 21394 - DNA, 20 bp, Artificial Sequence
  sgRNA
  Gabbr2_8
tgatcttcattcgtaggcgg

SEQ ID NO: 21395 - DNA, 20 bp, Artificial Sequence
  sgRNA
  Gabbr2_9
cgatggctagctccacggcg

SEQ ID NO: 21396 - DNA, 20 bp, Artificial Sequence
  sgRNA
  Gabbr2_10
ccacgcctccaatggacggg

SEQ ID NO: 21397 - DNA, 20 bp, Artificial Sequence
  sgRNA
  Gabbr2_11
ggcattgtctacgcctacaa

SEQ ID NO: 21398 - DNA, 20 bp, Artificial Sequence
  sgRNA
  Gabbr2_12
tcaagttgtgttccggaacg

SEQ ID NO: 21399 - DNA, 20 bp, Artificial Sequence
  sgRNA
  Gabbr2_13
gtacccatatttcttccgga

SEQ ID NO: 21400 - DNA, 20 bp, Artificial Sequence
  sgRNA
  Gabbr2_14
cgttgtctgagggcaccgtc

SEQ ID NO: 21401 - DNA, 20 bp, Artificial Sequence
  sgRNA
  Gabbr2_15
gttgaggatgattctgccca

SEQ ID NO: 21402 - DNA, 20 bp, Artificial Sequence
  sgRNA
  Gabbr2_16
aggcccatgatggagagcgg

SEQ ID NO: 21403 - DNA, 20 bp, Artificial Sequence
  sgRNA
  Gabbr2_17
gctggcgtccacgcctccaa

SEQ ID NO: 21404 - DNA, 20 bp, Artificial Sequence
  sgRNA
  Gabbr2_18
ctgtgatcttcattcgtagg

SEQ ID NO: 21405 - DNA, 20 bp, Artificial Sequence
  sgRNA
  Gabbr2_19
ctcgatggctagctccacgg

SEQ ID NO: 21406 - DNA, 20 bp, Artificial Sequence
  sgRNA
  Gabbr2_20
aactacacagaccacaccct

SEQ ID NO: 21407 - DNA, 20 bp, Artificial Sequence
  sgRNA
  Gabra1_1
cagagagccagcccgttcag

SEQ ID NO: 21408 - DNA, 20 bp, Artificial Sequence
  sgRNA
  Gabra1_2
cagtgtcacttaccatatcg

SEQ ID NO: 21409 - DNA, 20 bp, Artificial Sequence
  sgRNA
  Gabra1_3
agaataactgtcattatgca

SEQ ID NO: 21410 - DNA, 20 bp, Artificial Sequence
  sgRNA
  Gabra1_4
acgcaggagcttattaggca

SEQ ID NO: 21411 - DNA, 20 bp, Artificial Sequence
  sgRNA
  Gabra1_5
ctatacccctaacttagcca

SEQ ID NO: 21412 - DNA, 20 bp, Artificial Sequence
  sgRNA
  Gabra1_6
gctccggctaaacaacctta

SEQ ID NO: 21413 - DNA, 20 bp, Artificial Sequence
  sgRNA
  Gabra1_7
tagcaatagttgccaagccg

SEQ ID NO: 21414 - DNA, 20 bp, Artificial Sequence
  sgRNA
  Gabra1_8
tcaccaagagagggtatgcg

SEQ ID NO: 21415 - DNA, 20 bp, Artificial Sequence
  sgRNA
  Gabra1_9
tatacccctaacttagccag

SEQ ID NO: 21416 - DNA, 20 bp, Artificial Sequence
  sgRNA
  Gabra1_10
tcagaccgtgtgagtgagcg

SEQ ID NO: 21417 - DNA, 20 bp, Artificial Sequence
  sgRNA
  Gabra1_11
tgcgtgggatggcaaaagcg

SEQ ID NO: 21418 - DNA, 20 bp, Artificial Sequence
  sgRNA
  Gabra1_12
gaaactggtgacgaaaatgt

SEQ ID NO: 21419 - DNA, 20 bp, Artificial Sequence
  sgRNA
  Gabra1_13
gctatacccctaacttagcc

SEQ ID NO: 21420 - DNA, 20 bp, Artificial Sequence
  sgRNA
  Gabra1_14
gtgtgagtgagcgcggcgcg

SEQ ID NO: 21421 - DNA, 20 bp, Artificial Sequence
  sgRNA
  Gabra1_15
gaaaggctattcttgacagt

SEQ ID NO: 21422 - DNA, 20 bp, Artificial Sequence
  sgRNA
  Gabra1_16
ggtcacccctggctaagtta

SEQ ID NO: 21423 - DNA, 20 bp, Artificial Sequence
  sgRNA
  Gabra1_17
gctacaaccactgaacgggc

SEQ ID NO: 21424 - DNA, 20 bp, Artificial Sequence
  sgRNA
  Gabra1_18
gggtctctctgactatcttt

SEQ ID NO: 21425 - DNA, 20 bp, Artificial Sequence
  sgRNA
  Gabra1_19
ggtggcttatgcaacagcta

SEQ ID NO: 21426 - DNA, 20 bp, Artificial Sequence
  sgRNA
  Gabra1_20
taagctcctgcgtatcacag

SEQ ID NO: 21427 - DNA, 20 bp, Artificial Sequence
  sgRNA
  Gabra2_1
tatgataatcggcttagacc

SEQ ID NO: 21428 - DNA, 20 bp, Artificial Sequence
  sgRNA
  Gabra2_2
ggctaacatccaagaagatg

SEQ ID NO: 21429 - DNA, 20 bp, Artificial Sequence
  sgRNA
  Gabra2_3
ggtgcatgggacattcggct

SEQ ID NO: 21430 - DNA, 20 bp, Artificial Sequence
  sgRNA
  Gabra2_4
gtcattacagtatattcacc

SEQ ID NO: 21431 - DNA, 20 bp, Artificial Sequence
  sgRNA
  Gabra2_5
cgaatgtcccatgcacctgg

SEQ ID NO: 21432 - DNA, 20 bp, Artificial Sequence
  sgRNA
  Gabra2_6
acagtgtcagcaaaatcgac

SEQ ID NO: 21433 - DNA, 20 bp, Artificial Sequence
  sgRNA
  Gabra2_7
gtgaattacttcacaaaaag

SEQ ID NO: 21434 - DNA, 20 bp, Artificial Sequence
  sgRNA
  Gabra2_8
gatacagaacaacgcctatg

SEQ ID NO: 21435 - DNA, 20 bp, Artificial Sequence
  sgRNA
  Gabra2_9
ccatatctgtatctgagaca

SEQ ID NO: 21436 - DNA, 20 bp, Artificial Sequence
  sgRNA
  Gabra2_10
tataaaccagtccatggcag

SEQ ID NO: 21437 - DNA, 20 bp, Artificial Sequence
  sgRNA
  Gabra2_11
tggcataagccactttcggg

SEQ ID NO: 21438 - DNA, 20 bp, Artificial Sequence
  sgRNA
  Gabra2_12
ggcatgaatgagcatccatc

SEQ ID NO: 21439 - DNA, 20 bp, Artificial Sequence
  sgRNA
  Gabra2_13
attctggctgaacagagaat

SEQ ID NO: 21440 - DNA, 20 bp, Artificial Sequence
  sgRNA
  Gabra2_14
gttggcaacagctaccgcat

SEQ ID NO: 21441 - DNA, 20 bp, Artificial Sequence
  sgRNA
  Gabra2_15
ggcgttgttctgtatcatga

SEQ ID NO: 21442 - DNA, 20 bp, Artificial Sequence
  sgRNA
  Gabra2_16
tgttcagccagaatgacact

SEQ ID NO: 21443 - DNA, 20 bp, Artificial Sequence
  sgRNA
  Gabra2_17
ccaaatatatgtgacttctg

SEQ ID NO: 21444 - DNA, 20 bp, Artificial Sequence
  sgRNA
  Gabra2_18
gcagtggcataagccacttt

SEQ ID NO: 21445 - DNA, 20 bp, Artificial Sequence
  sgRNA
  Gabra2_19
gcacctggaggatttcccga

SEQ ID NO: 21446 - DNA, 20 bp, Artificial Sequence
  sgRNA
  Gabra2_20
cctgataccttctttcacaa

SEQ ID NO: 21447 - DNA, 20 bp, Artificial Sequence
  sgRNA
  Gabra3_1
tttgtgaaacaagatattgg

SEQ ID NO: 21448 - DNA, 20 bp, Artificial Sequence
  sgRNA
  Gabra3_2
ccatatcagtgtctgacaca

SEQ ID NO: 21449 - DNA, 20 bp, Artificial Sequence
  sgRNA
  Gabra3_3
ccacaatggtaaaaaatcag

SEQ ID NO: 21450 - DNA, 20 bp, Artificial Sequence
  sgRNA
  Gabra3_4
agtcatgatacatggcaagt

SEQ ID NO: 21451 - DNA, 20 bp, Artificial Sequence
  sgRNA
  Gabra3_5
ctgtcaactacttcaccaag

SEQ ID NO: 21452 - DNA, 20 bp, Artificial Sequence
  sgRNA
  Gabra3_6
ggaaggcaagaaggtaccag

SEQ ID NO: 21453 - DNA, 20 bp, Artificial Sequence
  sgRNA
  Gabra3_7
tcttgtttcacaaagtcccc

SEQ ID NO: 21454 - DNA, 20 bp, Artificial Sequence
  sgRNA
  Gabra3_8
tcttcactagaatcttggat

SEQ ID NO: 21455 - DNA, 20 bp, Artificial Sequence
  sgRNA
  Gabra3_9
gtatccttggccagattgat

SEQ ID NO: 21456 - DNA, 20 bp, Artificial Sequence
  sgRNA
  Gabra3_10
ttcccaagcccaactccgct

SEQ ID NO: 21457 - DNA, 20 bp, Artificial Sequence
  sgRNA
  Gabra3_11
cctgataccttcttccacaa

SEQ ID NO: 21458 - DNA, 20 bp, Artificial Sequence
  sgRNA
  Gabra3_12
acctaaagtggcatacgcga

SEQ ID NO: 21459 - DNA, 20 bp, Artificial Sequence
  sgRNA
  Gabra3_13
ggtggtacccactatgttga

SEQ ID NO: 21460 - DNA, 20 bp, Artificial Sequence
  sgRNA
  Gabra3_14
ctagccagaagattgttcag

SEQ ID NO: 21461 - DNA, 20 bp, Artificial Sequence
  sgRNA
  Gabra3_15
ccctggaaccactagccaag

SEQ ID NO: 21462 - DNA, 20 bp, Artificial Sequence
  sgRNA
  Gabra3_16
ggaatatctggggcatgctt

SEQ ID NO: 21463 - DNA, 20 bp, Artificial Sequence
  sgRNA
  Gabra3_17
ttatctctgtcccaacaaca

SEQ ID NO: 21464 - DNA, 20 bp, Artificial Sequence
  sgRNA
  Gabra3_18
gcatttggaagatttcccca

SEQ ID NO: 21465 - DNA, 20 bp, Artificial Sequence
  sgRNA
  Gabra3_19
tctggcactgatactcaagg

SEQ ID NO: 21466 - DNA, 20 bp, Artificial Sequence
  sgRNA
  Gabra3_20
cttgtcgtcttgattcccct

SEQ ID NO: 21467 - DNA, 20 bp, Artificial Sequence
  sgRNA
  Gabra4_1
ttgatacagtctgcccaatg

SEQ ID NO: 21468 - DNA, 20 bp, Artificial Sequence
  sgRNA
  Gabra4_2
tgcttagggtggtcatcgtg

SEQ ID NO: 21469 - DNA, 20 bp, Artificial Sequence
  sgRNA
  Gabra4_3
tgcagtttaaacgaatcccc

SEQ ID NO: 21470 - DNA, 20 bp, Artificial Sequence
  sgRNA
  Gabra4_4
acggcccaattgaaatcttg

SEQ ID NO: 21471 - DNA, 20 bp, Artificial Sequence
  sgRNA
  Gabra4_5
cagtccaaatccattcagca

SEQ ID NO: 21472 - DNA, 20 bp, Artificial Sequence
  sgRNA
  Gabra4_6
agctaagtgagccttaggcg

SEQ ID NO: 21473 - DNA, 20 bp, Artificial Sequence
  sgRNA
  Gabra4_7
agacaacagttaatacaaca

SEQ ID NO: 21474 - DNA, 20 bp, Artificial Sequence
  sgRNA
  Gabra4_8
gtgtgtttctccttcagcac

SEQ ID NO: 21475 - DNA, 20 bp, Artificial Sequence
  sgRNA
  Gabra4_9
attcctgaagaaagtatcag

SEQ ID NO: 21476 - DNA, 20 bp, Artificial Sequence
  sgRNA
  Gabra4_10
gctggccgcaatgtgccatg

SEQ ID NO: 21477 - DNA, 20 bp, Artificial Sequence
  sgRNA
  Gabra4_11
cggtttacttccacctcaga

SEQ ID NO: 21478 - DNA, 20 bp, Artificial Sequence
  sgRNA
  Gabra4_12
ggatgtcaaaagcagaactg

SEQ ID NO: 21479 - DNA, 20 bp, Artificial Sequence
  sgRNA
  Gabra4_13
cattgcggccagcttctttg

SEQ ID NO: 21480 - DNA, 20 bp, Artificial Sequence
  sgRNA
  Gabra4_14
gcagcatccccctctcctca

SEQ ID NO: 21481 - DNA, 20 bp, Artificial Sequence
  sgRNA
  Gabra4_15
gtgccagatccagaaggcgg

SEQ ID NO: 21482 - DNA, 20 bp, Artificial Sequence
  sgRNA
  Gabra4_16
cgcgattgcgctgtgctccg

SEQ ID NO: 21483 - DNA, 20 bp, Artificial Sequence
  sgRNA
  Gabra4_17
gctgcatttgccctgctgaa

SEQ ID NO: 21484 - DNA, 20 bp, Artificial Sequence
  sgRNA
  Gabra4_18
cttgaggctgaataatatga

SEQ ID NO: 21485 - DNA, 20 bp, Artificial Sequence
  sgRNA
  Gabra4_19
cttgtgccagatccagaagg

SEQ ID NO: 21486 - DNA, 20 bp, Artificial Sequence
  sgRNA
  Gabra4_20
caggcacaggaagtgcagga

SEQ ID NO: 21487 - DNA, 20 bp, Artificial Sequence
  sgRNA
  Gabra5_1
tgtttcagagcgaatcacgc

SEQ ID NO: 21488 - DNA, 20 bp, Artificial Sequence
  sgRNA
  Gabra5_2
ttgccggaaaaacacatcga

SEQ ID NO: 21489 - DNA, 20 bp, Artificial Sequence
  sgRNA
  Gabra5_3
gtacttaactgcttaccgca

SEQ ID NO: 21490 - DNA, 20 bp, Artificial Sequence
  sgRNA
  Gabra5_4
tcgtcttgtacagaactagt

SEQ ID NO: 21491 - DNA, 20 bp, Artificial Sequence
  sgRNA
  Gabra5_5
gcaagatcgacaaaatgtcc

SEQ ID NO: 21492 - DNA, 20 bp, Artificial Sequence
  sgRNA
  Gabra5_6
atggctatgacaacagactg

SEQ ID NO: 21493 - DNA, 20 bp, Artificial Sequence
  sgRNA
  Gabra5_7
ccagacacgttcttccacaa

SEQ ID NO: 21494 - DNA, 20 bp, Artificial Sequence
  sgRNA
  Gabra5_8
acaacatcacaatattcacc

SEQ ID NO: 21495 - DNA, 20 bp, Artificial Sequence
  sgRNA
  Gabra5_9
aatgaaccagtccatggctg

SEQ ID NO: 21496 - DNA, 20 bp, Artificial Sequence
  sgRNA
  Gabra5_10
atattcaccaggatcttgga

SEQ ID NO: 21497 - DNA, 20 bp, Artificial Sequence
  sgRNA
  Gabra5_11
gaagctttgatggagactgt

SEQ ID NO: 21498 - DNA, 20 bp, Artificial Sequence
  sgRNA
  Gabra5_12
aagatgacagtcatgatgca

SEQ ID NO: 21499 - DNA, 20 bp, Artificial Sequence
  sgRNA
  Gabra5_13
atttagccaaaaggacacct

SEQ ID NO: 21500 - DNA, 20 bp, Artificial Sequence
  sgRNA
  Gabra5_14
tcaaccagtaccacctcatg

SEQ ID NO: 21501 - DNA, 20 bp, Artificial Sequence
  sgRNA
  Gabra5_15
atgaccttatccagtcactt

SEQ ID NO: 21502 - DNA, 20 bp, Artificial Sequence
  sgRNA
  Gabra5_16
gctcaaccagtaccacctca

SEQ ID NO: 21503 - DNA, 20 bp, Artificial Sequence
  sgRNA
  Gabra5_17
gtcaactactttacaaagag

SEQ ID NO: 21504 - DNA, 20 bp, Artificial Sequence
  sgRNA
  Gabra5_18
ctggcaagaaggttgttgag

SEQ ID NO: 21505 - DNA, 20 bp, Artificial Sequence
  sgRNA
  Gabra5_19
gcagcttgaggactttccaa

SEQ ID NO: 21506 - DNA, 20 bp, Artificial Sequence
  sgRNA
  Gabra5_20
ggcaaagctggaaagatgaa

SEQ ID NO: 21507 - DNA, 20 bp, Artificial Sequence
  sgRNA
  Gabra6_1
ggaagttaaccaatctcatg

SEQ ID NO: 21508 - DNA, 20 bp, Artificial Sequence
  sgRNA
  Gabra6_2
gggacttctactgagtaaag

SEQ ID NO: 21509 - DNA, 20 bp, Artificial Sequence
  sgRNA
  Gabra6_3
tctactctgaaaatgtcagt

SEQ ID NO: 21510 - DNA, 20 bp, Artificial Sequence
  sgRNA
  Gabra6_4
ttaagctcagaatctcagca

SEQ ID NO: 21511 - DNA, 20 bp, Artificial Sequence
  sgRNA
  Gabra6_5
gacaagcgtgtccatccata

SEQ ID NO: 21512 - DNA, 20 bp, Artificial Sequence
  sgRNA
  Gabra6_6
agtgtcctatgcaaccgcca

SEQ ID NO: 21513 - DNA, 20 bp, Artificial Sequence
  sgRNA
  Gabra6_7
gcctcagaagatggaacgat

SEQ ID NO: 21514 - DNA, 20 bp, Artificial Sequence
  sgRNA
  Gabra6_8
tctcatcagtccaagtctgg

SEQ ID NO: 21515 - DNA, 20 bp, Artificial Sequence
  sgRNA
  Gabra6_9
ggtaaactatccagtacaca

SEQ ID NO: 21516 - DNA, 20 bp, Artificial Sequence
  sgRNA
  Gabra6_10
gcccaatcaaatcatactgg

SEQ ID NO: 21517 - DNA, 20 bp, Artificial Sequence
  sgRNA
  Gabra6_11
cattgctcttaccagccact

SEQ ID NO: 21518 - DNA, 20 bp, Artificial Sequence
  sgRNA
  Gabra6_12
ggacaagcgtgtccatccat

SEQ ID NO: 21519 - DNA, 20 bp, Artificial Sequence
  sgRNA
  Gabra6_13
ggtggtcatggttaaaacag

SEQ ID NO: 21520 - DNA, 20 bp, Artificial Sequence
  sgRNA
  Gabra6_14
gaacaatcctctataccatg

SEQ ID NO: 21521 - DNA, 20 bp, Artificial Sequence
  sgRNA
  Gabra6_15
ccccaaatcctggccgtaga

SEQ ID NO: 21522 - DNA, 20 bp, Artificial Sequence
  sgRNA
  Gabra6_16
gggaagttaaccaatctcat

SEQ ID NO: 21523 - DNA, 20 bp, Artificial Sequence
  sgRNA
  Gabra6_17
ccgagcactgatgcttaagg

SEQ ID NO: 21524 - DNA, 20 bp, Artificial Sequence
  sgRNA
  Gabra6_18
caccaatctccagtcacaga

SEQ ID NO: 21525 - DNA, 20 bp, Artificial Sequence
  sgRNA
  Gabra6_19
tgaatcctgcaaaagctact

SEQ ID NO: 21526 - DNA, 20 bp, Artificial Sequence
  sgRNA
  Gabra6_20
ttgttccattctgcattaat

SEQ ID NO: 21527 - DNA, 20 bp, Artificial Sequence
  sgRNA
  Gabrb1_1
tctgtccacaggaatcacta

SEQ ID NO: 21528 - DNA, 20 bp, Artificial Sequence
  sgRNA
  Gabrb1_2
cacttcagatggctatacca

SEQ ID NO: 21529 - DNA, 20 bp, Artificial Sequence
  sgRNA
  Gabrb1_3
atagtcgtggatatgcccct

SEQ ID NO: 21530 - DNA, 20 bp, Artificial Sequence
  sgRNA
  Gabrb1_4
caagaaatcatttgtgcatg

SEQ ID NO: 21531 - DNA, 20 bp, Artificial Sequence
  sgRNA
  Gabrb1_5
caagccactgagcagccgcg

SEQ ID NO: 21532 - DNA, 20 bp, Artificial Sequence
  sgRNA
  Gabrb1_6
gctgtcgtacgagtacatgg

SEQ ID NO: 21533 - DNA, 20 bp, Artificial Sequence
  sgRNA
  Gabrb1_7
atatgacattcgcttgcggc

SEQ ID NO: 21534 - DNA, 20 bp, Artificial Sequence
  sgRNA
  Gabrb1_8
gttgatccaaaacgacaccc

SEQ ID NO: 21535 - DNA, 20 bp, Artificial Sequence
  sgRNA
  Gabrb1_9
gatcttcactttgagctgcg

SEQ ID NO: 21536 - DNA, 20 bp, Artificial Sequence
  sgRNA
  Gabrb1_10
gtaaaattcgatgtcatccg

SEQ ID NO: 21537 - DNA, 20 bp, Artificial Sequence
  sgRNA
  Gabrb1_11
ggatgagcaaaactgcaccc

SEQ ID NO: 21538 - DNA, 20 bp, Artificial Sequence
  sgRNA
  Gabrb1_12
ttcacgtatgacatgttgct

SEQ ID NO: 21539 - DNA, 20 bp, Artificial Sequence
  sgRNA
  Gabrb1_13
tgctgaggagaatattgccg

SEQ ID NO: 21540 - DNA, 20 bp, Artificial Sequence
  sgRNA
  Gabrb1_14
gctgaggagaatattgccgt

SEQ ID NO: 21541 - DNA, 20 bp, Artificial Sequence
  sgRNA
  Gabrb1_15
ggcgctgtcgtacgagtaca

SEQ ID NO: 21542 - DNA, 20 bp, Artificial Sequence
  sgRNA
  Gabrb1_16
gcgattgacatctatctcat

SEQ ID NO: 21543 - DNA, 20 bp, Artificial Sequence
  sgRNA
  Gabrb1_17
ggatcttcgaagataccctc

SEQ ID NO: 21544 - DNA, 20 bp, Artificial Sequence
  sgRNA
  Gabrb1_18
tcttcggcaaagtctccctg

SEQ ID NO: 21545 - DNA, 20 bp, Artificial Sequence
  sgRNA
  Gabrb1_19
acgtgaactccatagacaag

SEQ ID NO: 21546 - DNA, 20 bp, Artificial Sequence
  sgRNA
  Gabrb1_20
tgtcaatcgctttgacgtaa

SEQ ID NO: 21547 - DNA, 20 bp, Artificial Sequence
  sgRNA
  Gabrb2_1
atgattcgattgcatcccga

SEQ ID NO: 21548 - DNA, 20 bp, Artificial Sequence
  sgRNA
  Gabrb2_2
taaccagcgacatattacta

SEQ ID NO: 21549 - DNA, 20 bp, Artificial Sequence
  sgRNA
  Gabrb2_3
cttgactttggacaaccgag

SEQ ID NO: 21550 - DNA, 20 bp, Artificial Sequence
  sgRNA
  Gabrb2_4
gatgagtttataatctacga

SEQ ID NO: 21551 - DNA, 20 bp, Artificial Sequence
  sgRNA
  Gabrb2_5
gagacctctccccaactaga

SEQ ID NO: 21552 - DNA, 20 bp, Artificial Sequence
  sgRNA
  Gabrb2_6
gcatccagtatcgaaaagct

SEQ ID NO: 21553 - DNA, 20 bp, Artificial Sequence
  sgRNA
  Gabrb2_7
tgttcattcctacggccaca

SEQ ID NO: 21554 - DNA, 20 bp, Artificial Sequence
  sgRNA
  Gabrb2_8
gccacatccgaagcagtaat

SEQ ID NO: 21555 - DNA, 20 bp, Artificial Sequence
  sgRNA
  Gabrb2_9
atgtgaatgccattgatcgg

SEQ ID NO: 21556 - DNA, 20 bp, Artificial Sequence
  sgRNA
  Gabrb2_10
ttgcggccaaaactatgcct

SEQ ID NO: 21557 - DNA, 20 bp, Artificial Sequence
  sgRNA
  Gabrb2_11
ttaaccagcgacatattact

SEQ ID NO: 21558 - DNA, 20 bp, Artificial Sequence
  sgRNA
  Gabrb2_12
attggtagtccgtctagttg

SEQ ID NO: 21559 - DNA, 20 bp, Artificial Sequence
  sgRNA
  Gabrb2_13
ctgatgtgaatgccattgat

SEQ ID NO: 21560 - DNA, 20 bp, Artificial Sequence
  sgRNA
  Gabrb2_14
atacagagagaaatcataat

SEQ ID NO: 21561 - DNA, 20 bp, Artificial Sequence
  sgRNA
  Gabrb2_15
gctgagtaagatgttctcat

SEQ ID NO: 21562 - DNA, 20 bp, Artificial Sequence
  sgRNA
  Gabrb2_16
aatgcgggaccaccgatcaa

SEQ ID NO: 21563 - DNA, 20 bp, Artificial Sequence
  sgRNA
  Gabrb2_17
gacccagtatcgatccttgt

SEQ ID NO: 21564 - DNA, 20 bp, Artificial Sequence
  sgRNA
  Gabrb2_18
gtcccacaaggatcgatact

SEQ ID NO: 21565 - DNA, 20 bp, Artificial Sequence
  sgRNA
  Gabrb2_19
cgggatgcaatcgaatcata

SEQ ID NO: 21566 - DNA, 20 bp, Artificial Sequence
  sgRNA
  Gabrb2_20
ccaggcttgctgaaaataca

SEQ ID NO: 21567 - DNA, 20 bp, Artificial Sequence
  sgRNA
  Gabrb3_1
cctcacgcttgacaatcgag

SEQ ID NO: 21568 - DNA, 20 bp, Artificial Sequence
  sgRNA
  Gabrb3_2
cctggtagatggctacacta

SEQ ID NO: 21569 - DNA, 20 bp, Artificial Sequence
  sgRNA
  Gabrb3_3
cgcctgagacccgacttcgg

SEQ ID NO: 21570 - DNA, 20 bp, Artificial Sequence
  sgRNA
  Gabrb3_4
cgaaaactcaatgaaagtcg

SEQ ID NO: 21571 - DNA, 20 bp, Artificial Sequence
  sgRNA
  Gabrb3_5
atttcattgtgaacatccat

SEQ ID NO: 21572 - DNA, 20 bp, Artificial Sequence
  sgRNA
  Gabrb3_6
ggatgagcaaaactgcactt

SEQ ID NO: 21573 - DNA, 20 bp, Artificial Sequence
  sgRNA
  Gabrb3_7
acaagaagacccacctacgg

SEQ ID NO: 21574 - DNA, 20 bp, Artificial Sequence
  sgRNA
  Gabrb3_8
ctcagatcctcgcgtcccca

SEQ ID NO: 21575 - DNA, 20 bp, Artificial Sequence
  sgRNA
  Gabrb3_9
tcacaaaggacatgttcccg

SEQ ID NO: 21576 - DNA, 20 bp, Artificial Sequence
  sgRNA
  Gabrb3_10
ggttgtcatggtgagcacgg

SEQ ID NO: 21577 - DNA, 20 bp, Artificial Sequence
  sgRNA
  Gabrb3_11
tctgtctatggcattcacat

SEQ ID NO: 21578 - DNA, 20 bp, Artificial Sequence
  sgRNA
  Gabrb3_12
atgtgaatgccatagacaga

SEQ ID NO: 21579 - DNA, 20 bp, Artificial Sequence
  sgRNA
  Gabrb3_13
cctgatcacaatcctctcgt

SEQ ID NO: 21580 - DNA, 20 bp, Artificial Sequence
  sgRNA
  Gabrb3_14
ggacctcagaagatacccac

SEQ ID NO: 21581 - DNA, 20 bp, Artificial Sequence
  sgRNA
  Gabrb3_15
tcctggaccctggggacgcg

SEQ ID NO: 21582 - DNA, 20 bp, Artificial Sequence
  sgRNA
  Gabrb3_16
gaacatccatcggtgctaat

SEQ ID NO: 21583 - DNA, 20 bp, Artificial Sequence
  sgRNA
  Gabrb3_17
ccactcgattgtcaagcgtg

SEQ ID NO: 21584 - DNA, 20 bp, Artificial Sequence
  sgRNA
  Gabrb3_18
agaacgatcattcttggcct

SEQ ID NO: 21585 - DNA, 20 bp, Artificial Sequence
  sgRNA
  Gabrb3_19
gtcgaccgtctccttcacaa

SEQ ID NO: 21586 - DNA, 20 bp, Artificial Sequence
  sgRNA
  Gabrb3_20
acaactcaggaatccagtat

SEQ ID NO: 21587 - DNA, 20 bp, Artificial Sequence
  sgRNA
  Gabrd_1
tgtggcgcttgccctagagg

SEQ ID NO: 21588 - DNA, 20 bp, Artificial Sequence
  sgRNA
  Gabrd_2
gtaactggtgatagtgaact

SEQ ID NO: 21589 - DNA, 20 bp, Artificial Sequence
  sgRNA
  Gabrd_3
aaccataccaacgagacctt

SEQ ID NO: 21590 - DNA, 20 bp, Artificial Sequence
  sgRNA
  Gabrd_4
tatccgcctacagcctgatg

SEQ ID NO: 21591 - DNA, 20 bp, Artificial Sequence
  sgRNA
  Gabrd_5
ggaacctcatgggttcctat

SEQ ID NO: 21592 - DNA, 20 bp, Artificial Sequence
  sgRNA
  Gabrd_6
gcgggcactgaccatgagcg

SEQ ID NO: 21593 - DNA, 20 bp, Artificial Sequence
  sgRNA
  Gabrd_7
ggagctgatgaacttcaaat

SEQ ID NO: 21594 - DNA, 20 bp, Artificial Sequence
  sgRNA
  Gabrd_8
tcgatggtgtctgcatcgat

SEQ ID NO: 21595 - DNA, 20 bp, Artificial Sequence
  sgRNA
  Gabrd_9
gcttacacttccagcttcgg

SEQ ID NO: 21596 - DNA, 20 bp, Artificial Sequence
  sgRNA
  Gabrd_10
tcgtgaatgccaaatctgcc

SEQ ID NO: 21597 - DNA, 20 bp, Artificial Sequence
  sgRNA
  Gabrd_11
cagcattgaccatatctcag

SEQ ID NO: 21598 - DNA, 20 bp, Artificial Sequence
  sgRNA
  Gabrd_12
gccgctttgtggacaagcta

SEQ ID NO: 21599 - DNA, 20 bp, Artificial Sequence
  sgRNA
  Gabrd_13
tgcactcctgctcatccagt

SEQ ID NO: 21600 - DNA, 20 bp, Artificial Sequence
  sgRNA
  Gabrd_14
tgaccgctgcaaaagctgcc

SEQ ID NO: 21601 - DNA, 20 bp, Artificial Sequence
  sgRNA
  Gabrd_15
ggtcaacatcatctactggg

SEQ ID NO: 21602 - DNA, 20 bp, Artificial Sequence
  sgRNA
  Gabrd_16
cttatccgcctacagcctga

SEQ ID NO: 21603 - DNA, 20 bp, Artificial Sequence
  sgRNA
  Gabrd_17
aatgacattggggactacgt

SEQ ID NO: 21604 - DNA, 20 bp, Artificial Sequence
  sgRNA
  Gabrd_18
catccagtgggtacttggcg

SEQ ID NO: 21605 - DNA, 20 bp, Artificial Sequence
  sgRNA
  Gabrd_19
gctttgatagctgaagcccg

SEQ ID NO: 21606 - DNA, 20 bp, Artificial Sequence
  sgRNA
  Gabrd_20
aacctggatggcttaatgga

SEQ ID NO: 21607 - DNA, 20 bp, Artificial Sequence
  sgRNA
  Gabre_1
ctggggtggaaataggcccg

SEQ ID NO: 21608 - DNA, 20 bp, Artificial Sequence
  sgRNA
  Gabre_2
tatcaccatacctaaccaga

SEQ ID NO: 21609 - DNA, 20 bp, Artificial Sequence
  sgRNA
  Gabre_3
cagctggagcctcaacctag

SEQ ID NO: 21610 - DNA, 20 bp, Artificial Sequence
  sgRNA
  Gabre_4
aactaaagactacatcatca

SEQ ID NO: 21611 - DNA, 20 bp, Artificial Sequence
  sgRNA
  Gabre_5
gcattagcacggctattggt

SEQ ID NO: 21612 - DNA, 20 bp, Artificial Sequence
  sgRNA
  Gabre_6
agttatccagacgataaaca

SEQ ID NO: 21613 - DNA, 20 bp, Artificial Sequence
  sgRNA
  Gabre_7
tcgtctggataactattcgc

SEQ ID NO: 21614 - DNA, 20 bp, Artificial Sequence
  sgRNA
  Gabre_8
aagactacagtatctccagc

SEQ ID NO: 21615 - DNA, 20 bp, Artificial Sequence
  sgRNA
  Gabre_9
ccgtgagataggagacacga

SEQ ID NO: 21616 - DNA, 20 bp, Artificial Sequence
  sgRNA
  Gabre_10
gccgtgagataggagacacg

SEQ ID NO: 21617 - DNA, 20 bp, Artificial Sequence
  sgRNA
  Gabre_11
tctccagcaggagattcagg

SEQ ID NO: 21618 - DNA, 20 bp, Artificial Sequence
  sgRNA
  Gabre_12
acttcaacagtgaccacagt

SEQ ID NO: 21619 - DNA, 20 bp, Artificial Sequence
  sgRNA
  Gabre_13
gcagccacaaccacagccgt

SEQ ID NO: 21620 - DNA, 20 bp, Artificial Sequence
  sgRNA
  Gabre_14
gcatgactgaacgcccaggt

SEQ ID NO: 21621 - DNA, 20 bp, Artificial Sequence
  sgRNA
  Gabre_15
gctgaggctgaggcatcggc

SEQ ID NO: 21622 - DNA, 20 bp, Artificial Sequence
  sgRNA
  Gabre_16
cagtgaaatgatctacaaat

SEQ ID NO: 21623 - DNA, 20 bp, Artificial Sequence
  sgRNA
  Gabre_17
tttgaaacccttattctgca

SEQ ID NO: 21624 - DNA, 20 bp, Artificial Sequence
  sgRNA
  Gabre_18
acaacacctttccatccttg

SEQ ID NO: 21625 - DNA, 20 bp, Artificial Sequence
  sgRNA
  Gabre_19
tatgaccataaactgcgccc

SEQ ID NO: 21626 - DNA, 20 bp, Artificial Sequence
  sgRNA
  Gabre_20
ggtcagttctgtgctcacca

SEQ ID NO: 21627 - DNA, 20 bp, Artificial Sequence
  sgRNA
  Gabrg1_1
acttatgctcaacagcaaca

SEQ ID NO: 21628 - DNA, 20 bp, Artificial Sequence
  sgRNA
  Gabrg1_2
cattccgtgtattctaacag

SEQ ID NO: 21629 - DNA, 20 bp, Artificial Sequence
  sgRNA
  Gabrg1_3
tttaactatgaacaaaacat

SEQ ID NO: 21630 - DNA, 20 bp, Artificial Sequence
  sgRNA
  Gabrg1_4
acatctgtttcaatcactgt

SEQ ID NO: 21631 - DNA, 20 bp, Artificial Sequence
  sgRNA
  Gabrg1_5
ggatcagctacttccacaga

SEQ ID NO: 21632 - DNA, 20 bp, Artificial Sequence
  sgRNA
  Gabrg1_6
attgatccaaaaagacaccc

SEQ ID NO: 21633 - DNA, 20 bp, Artificial Sequence
  sgRNA
  Gabrg1_7
gtacctgctagaacatccct

SEQ ID NO: 21634 - DNA, 20 bp, Artificial Sequence
  sgRNA
  Gabrg1_8
gctgtcacgtaagaaacctt

SEQ ID NO: 21635 - DNA, 20 bp, Artificial Sequence
  sgRNA
  Gabrg1_9
ggtttcttacgtgacagcaa

SEQ ID NO: 21636 - DNA, 20 bp, Artificial Sequence
  sgRNA
  Gabrg1_10
tgagttcctgaagaaagtgt

SEQ ID NO: 21637 - DNA, 20 bp, Artificial Sequence
  sgRNA
  Gabrg1_11
tttgacctgagcagacggat

SEQ ID NO: 21638 - DNA, 20 bp, Artificial Sequence
  sgRNA
  Gabrg1_12
tggtgctattgaactttaaa

SEQ ID NO: 21639 - DNA, 20 bp, Artificial Sequence
  sgRNA
  Gabrg1_13
ttatggctaccagtgtttgg

SEQ ID NO: 21640 - DNA, 20 bp, Artificial Sequence
  sgRNA
  Gabrg1_14
ggatgaacattcctgtccac

SEQ ID NO: 21641 - DNA, 20 bp, Artificial Sequence
  sgRNA
  Gabrg1_15
agaaccactgttagaataca

SEQ ID NO: 21642 - DNA, 20 bp, Artificial Sequence
  sgRNA
  Gabrg1_16
gcggatttggagtgatggaa

SEQ ID NO: 21643 - DNA, 20 bp, Artificial Sequence
  sgRNA
  Gabrg1_17
cagcatttctttgccacaag

SEQ ID NO: 21644 - DNA, 20 bp, Artificial Sequence
  sgRNA
  Gabrg1_18
gttgctagtaaaataatgca

SEQ ID NO: 21645 - DNA, 20 bp, Artificial Sequence
  sgRNA
  Gabrg1_19
ctgcagaactgggtcctgga

SEQ ID NO: 21646 - DNA, 20 bp, Artificial Sequence
  sgRNA
  Gabrg1_20
tatgctcaacagcaacatgg

SEQ ID NO: 21647 - DNA, 20 bp, Artificial Sequence
  sgRNA
  Gabrg2_1
aacaaacttcgacctgacat

SEQ ID NO: 21648 - DNA, 20 bp, Artificial Sequence
  sgRNA
  Gabrg2_2
ggttgaatagcaatatggtg

SEQ ID NO: 21649 - DNA, 20 bp, Artificial Sequence
  sgRNA
  Gabrg2_3
tcctgctatcgctctaccca

SEQ ID NO: 21650 - DNA, 20 bp, Artificial Sequence
  sgRNA
  Gabrg2_4
tacaactggagaactccagg

SEQ ID NO: 21651 - DNA, 20 bp, Artificial Sequence
  sgRNA
  Gabrg2_5
ttgactccaaaagttccaga

SEQ ID NO: 21652 - DNA, 20 bp, Artificial Sequence
  sgRNA
  Gabrg2_6
ggtctcctatgtcacagcaa

SEQ ID NO: 21653 - DNA, 20 bp, Artificial Sequence
  sgRNA
  Gabrg2_7
gggacgaatatcaatggtag

SEQ ID NO: 21654 - DNA, 20 bp, Artificial Sequence
  sgRNA
  Gabrg2_8
tgggtgacacaagatcatgg

SEQ ID NO: 21655 - DNA, 20 bp, Artificial Sequence
  sgRNA
  Gabrg2_9
gctgtgacataggagacctt

SEQ ID NO: 21656 - DNA, 20 bp, Artificial Sequence
  sgRNA
  Gabrg2_10
cattccctgcacactcatcg

SEQ ID NO: 21657 - DNA, 20 bp, Artificial Sequence
  sgRNA
  Gabrg2_11
tctccggttgaatagcaata

SEQ ID NO: 21658 - DNA, 20 bp, Artificial Sequence
  sgRNA
  Gabrg2_12
acagtaccattaaagttctc

SEQ ID NO: 21659 - DNA, 20 bp, Artificial Sequence
  sgRNA
  Gabrg2_13
ggatgaacactcctgccccc

SEQ ID NO: 21660 - DNA, 20 bp, Artificial Sequence
  sgRNA
  Gabrg2_14
ggttgctgacaaaataatgc

SEQ ID NO: 21661 - DNA, 20 bp, Artificial Sequence
  sgRNA
  Gabrg2_15
ccaccatattgctattcaac

SEQ ID NO: 21662 - DNA, 20 bp, Artificial Sequence
  sgRNA
  Gabrg2_16
ggcaggagtgttcatccatt

SEQ ID NO: 21663 - DNA, 20 bp, Artificial Sequence
  sgRNA
  Gabrg2_17
gcagggaatgtaagtctgga

SEQ ID NO: 21664 - DNA, 20 bp, Artificial Sequence
  sgRNA
  Gabrg2_18
gttgctgacaaaataatgca

SEQ ID NO: 21665 - DNA, 20 bp, Artificial Sequence
  sgRNA
  Gabrg2_19
agggaagaagatccgagcat

SEQ ID NO: 21666 - DNA, 20 bp, Artificial Sequence
  sgRNA
  Gabrg2_20
aggaccacgatgagtgtgca

SEQ ID NO: 21667 - DNA, 20 bp, Artificial Sequence
  sgRNA
  Gabrg3_1
aaaaccaactgtgatcgatg

SEQ ID NO: 21668 - DNA, 20 bp, Artificial Sequence
  sgRNA
  Gabrg3_2
gaaccacagtcagtatgcag

SEQ ID NO: 21669 - DNA, 20 bp, Artificial Sequence
  sgRNA
  Gabrg3_3
ttggaggaaaaattcagttg

SEQ ID NO: 21670 - DNA, 20 bp, Artificial Sequence
  sgRNA
  Gabrg3_4
tcgaaattctaaaacagcgg

SEQ ID NO: 21671 - DNA, 20 bp, Artificial Sequence
  sgRNA
  Gabrg3_5
gcagtgacataggacacccg

SEQ ID NO: 21672 - DNA, 20 bp, Artificial Sequence
  sgRNA
  Gabrg3_6
gttgagaatcagcgttacat

SEQ ID NO: 21673 - DNA, 20 bp, Artificial Sequence
  sgRNA
  Gabrg3_7
tttaacgtgatcatcacagg

SEQ ID NO: 21674 - DNA, 20 bp, Artificial Sequence
  sgRNA
  Gabrg3_8
gtcttgctccagcatcataa

SEQ ID NO: 21675 - DNA, 20 bp, Artificial Sequence
  sgRNA
  Gabrg3_9
gcaactgcataacttcccta

SEQ ID NO: 21676 - DNA, 20 bp, Artificial Sequence
  sgRNA
  Gabrg3_10
ggtgtcctatgtcactgcca

SEQ ID NO: 21677 - DNA, 20 bp, Artificial Sequence
  sgRNA
  Gabrg3_11
gctgtcgaaagccaaccatc

SEQ ID NO: 21678 - DNA, 20 bp, Artificial Sequence
  sgRNA
  Gabrg3_12
ggtatccaacccaatagacc

SEQ ID NO: 21679 - DNA, 20 bp, Artificial Sequence
  sgRNA
  Gabrg3_13
gcaagcccgagaacaggcag

SEQ ID NO: 21680 - DNA, 20 bp, Artificial Sequence
  sgRNA
  Gabrg3_14
actctgaacagcaacatggt

SEQ ID NO: 21681 - DNA, 20 bp, Artificial Sequence
  sgRNA
  Gabrg3_15
agaaccacagtcagtatgca

SEQ ID NO: 21682 - DNA, 20 bp, Artificial Sequence
  sgRNA
  Gabrg3_16
acaccagcaagaacaacatt

SEQ ID NO: 21683 - DNA, 20 bp, Artificial Sequence
  sgRNA
  Gabrg3_17
atatgacaaaaagctgagac

SEQ ID NO: 21684 - DNA, 20 bp, Artificial Sequence
  sgRNA
  Gabrg3_18
ttgccaggaagtctctgcct

SEQ ID NO: 21685 - DNA, 20 bp, Artificial Sequence
  sgRNA
  Gabrg3_19
tcgagattcaccaagtgcaa

SEQ ID NO: 21686 - DNA, 20 bp, Artificial Sequence
  sgRNA
  Gabrg3_20
ctttcgaaattctaaaacag

SEQ ID NO: 21687 - DNA, 20 bp, Artificial Sequence
  sgRNA
  Gabrp_1
ggcagcgttggacagaccca

SEQ ID NO: 21688 - DNA, 20 bp, Artificial Sequence
  sgRNA
  Gabrp_2
ccaggggaaccaggtcaatg

SEQ ID NO: 21689 - DNA, 20 bp, Artificial Sequence
  sgRNA
  Gabrp_3
ttctcgcaggaactgaatcg

SEQ ID NO: 21690 - DNA, 20 bp, Artificial Sequence
  sgRNA
  Gabrp_4
aacaacagttacatgtaaca

SEQ ID NO: 21691 - DNA, 20 bp, Artificial Sequence
  sgRNA
  Gabrp_5
acgctgccggaggtatatag

SEQ ID NO: 21692 - DNA, 20 bp, Artificial Sequence
  sgRNA
  Gabrp_6
ttgccttcgaacactagccg

SEQ ID NO: 21693 - DNA, 20 bp, Artificial Sequence
  sgRNA
  Gabrp_7
acacagccactatatacctc

SEQ ID NO: 21694 - DNA, 20 bp, Artificial Sequence
  sgRNA
  Gabrp_8
aatccaacagtatttcaccc

SEQ ID NO: 21695 - DNA, 20 bp, Artificial Sequence
  sgRNA
  Gabrp_9
gacacaggaaggccaaatag

SEQ ID NO: 21696 - DNA, 20 bp, Artificial Sequence
  sgRNA
  Gabrp_10
aaggccatcgatgtgtacct

SEQ ID NO: 21697 - DNA, 20 bp, Artificial Sequence
  sgRNA
  Gabrp_11
tgtcccttccaccttcctgg

SEQ ID NO: 21698 - DNA, 20 bp, Artificial Sequence
  sgRNA
  Gabrp_12
ttcccactgtgacttcatgg

SEQ ID NO: 21699 - DNA, 20 bp, Artificial Sequence
  sgRNA
  Gabrp_13
agtatcgatccacattgctg

SEQ ID NO: 21700 - DNA, 20 bp, Artificial Sequence
  sgRNA
  Gabrp_14
tgtaagtgtctggcacccag

SEQ ID NO: 21701 - DNA, 20 bp, Artificial Sequence
  sgRNA
  Gabrp_15
tgccttcgaacactagccgt

SEQ ID NO: 21702 - DNA, 20 bp, Artificial Sequence
  sgRNA
  Gabrp_16
ggatctgtctaaatacccca

SEQ ID NO: 21703 - DNA, 20 bp, Artificial Sequence
  sgRNA
  Gabrp_17
gttcctgcgagaacctgcat

SEQ ID NO: 21704 - DNA, 20 bp, Artificial Sequence
  sgRNA
  Gabrp_18
ttgtgtactgagcaaggcgc

SEQ ID NO: 21705 - DNA, 20 bp, Artificial Sequence
  sgRNA
  Gabrp_19
ctatatacctccggcagcgt

SEQ ID NO: 21706 - DNA, 20 bp, Artificial Sequence
  sgRNA
  Gabrp_20
ctacagctccttacagcaga

SEQ ID NO: 21707 - DNA, 20 bp, Artificial Sequence
  sgRNA
  Gabrq_1
tgggccaatagacctgcaca

SEQ ID NO: 21708 - DNA, 20 bp, Artificial Sequence
  sgRNA
  Gabrq_2
acatagatagatactgacac

SEQ ID NO: 21709 - DNA, 20 bp, Artificial Sequence
  sgRNA
  Gabrq_3
ctcatgcatccgataatcca

SEQ ID NO: 21710 - DNA, 20 bp, Artificial Sequence
  sgRNA
  Gabrq_4
ctaccatcgactcacatatg

SEQ ID NO: 21711 - DNA, 20 bp, Artificial Sequence
  sgRNA
  Gabrq_5
ggatctgcaaaaattcccta

SEQ ID NO: 21712 - DNA, 20 bp, Artificial Sequence
  sgRNA
  Gabrq_6
ctaccaccacttcttggtag

SEQ ID NO: 21713 - DNA, 20 bp, Artificial Sequence
  sgRNA
  Gabrq_7
gggtccccaaggttgataga

SEQ ID NO: 21714 - DNA, 20 bp, Artificial Sequence
  sgRNA
  Gabrq_8
catcatcacaggcatcagat

SEQ ID NO: 21715 - DNA, 20 bp, Artificial Sequence
  sgRNA
  Gabrq_9
ccttgatgaacaatgcaagg

SEQ ID NO: 21716 - DNA, 20 bp, Artificial Sequence
  sgRNA
  Gabrq_10
cagcggctcgcagcatacct

SEQ ID NO: 21717 - DNA, 20 bp, Artificial Sequence
  sgRNA
  Gabrq_11
atgccatccacattactgat

SEQ ID NO: 21718 - DNA, 20 bp, Artificial Sequence
  sgRNA
  Gabrq_12
ataccgctaccaagaagtgg

SEQ ID NO: 21719 - DNA, 20 bp, Artificial Sequence
  sgRNA
  Gabrq_13
tatcgggcaacaactctcct

SEQ ID NO: 21720 - DNA, 20 bp, Artificial Sequence
  sgRNA
  Gabrq_14
gctttgatacaggaaatatg

SEQ ID NO: 21721 - DNA, 20 bp, Artificial Sequence
  sgRNA
  Gabrq_15
cttcattgaaggagcaccca

SEQ ID NO: 21722 - DNA, 20 bp, Artificial Sequence
  sgRNA
  Gabrq_16
tgatatccaggagagaatgg

SEQ ID NO: 21723 - DNA, 20 bp, Artificial Sequence
  sgRNA
  Gabrq_17
aaccacattgaacagcccaa

SEQ ID NO: 21724 - DNA, 20 bp, Artificial Sequence
  sgRNA
  Gabrq_18
gtatttcaacttcacccaga

SEQ ID NO: 21725 - DNA, 20 bp, Artificial Sequence
  sgRNA
  Gabrq_19
tcaagctccagattagccag

SEQ ID NO: 21726 - DNA, 20 bp, Artificial Sequence
  sgRNA
  Gabrq_20
ggccttgatgaacaatgcaa

SEQ ID NO: 21727 - DNA, 20 bp, Artificial Sequence
  sgRNA
  Gabrr1_1
agtgaccgcgatgtgcaaca

SEQ ID NO: 21728 - DNA, 20 bp, Artificial Sequence
  sgRNA
  Gabrr1_2
tggtgtggaattcttgaatg

SEQ ID NO: 21729 - DNA, 20 bp, Artificial Sequence
  sgRNA
  Gabrr1_3
acgaccatgatttcagcatg

SEQ ID NO: 21730 - DNA, 20 bp, Artificial Sequence
  sgRNA
  Gabrr1_4
ggccatcaaaggtcatgctg

SEQ ID NO: 21731 - DNA, 20 bp, Artificial Sequence
  sgRNA
  Gabrr1_5
agaacggagagaaacccgac

SEQ ID NO: 21732 - DNA, 20 bp, Artificial Sequence
  sgRNA
  Gabrr1_6
gctttgatgtaggacactcg

SEQ ID NO: 21733 - DNA, 20 bp, Artificial Sequence
  sgRNA
  Gabrr1_7
ggtggacatggtcagcaccg

SEQ ID NO: 21734 - DNA, 20 bp, Artificial Sequence
  sgRNA
  Gabrr1_8
cagctgcaccatcatccggt

SEQ ID NO: 21735 - DNA, 20 bp, Artificial Sequence
  sgRNA
  Gabrr1_9
agacctcagagacagagacg

SEQ ID NO: 21736 - DNA, 20 bp, Artificial Sequence
  sgRNA
  Gabrr1_10
atatttgaggcactactgga

SEQ ID NO: 21737 - DNA, 20 bp, Artificial Sequence
  sgRNA
  Gabrr1_11
tgtgcaacatggacttcagc

SEQ ID NO: 21738 - DNA, 20 bp, Artificial Sequence
  sgRNA
  Gabrr1_12
gaccatgtccaccatcatca

SEQ ID NO: 21739 - DNA, 20 bp, Artificial Sequence
  sgRNA
  Gabrr1_13
agtgtcctacatcaaagctg

SEQ ID NO: 21740 - DNA, 20 bp, Artificial Sequence
  sgRNA
  Gabrr1_14
ggcggctacatgcctgagaa

SEQ ID NO: 21741 - DNA, 20 bp, Artificial Sequence
  sgRNA
  Gabrr1_15
ctagccttctacagcagtac

SEQ ID NO: 21742 - DNA, 20 bp, Artificial Sequence
  sgRNA
  Gabrr1_16
tcaccatgacgctatatttg

SEQ ID NO: 21743 - DNA, 20 bp, Artificial Sequence
  sgRNA
  Gabrr1_17
atgctgcgcgtccagccaga

SEQ ID NO: 21744 - DNA, 20 bp, Artificial Sequence
  sgRNA
  Gabrr1_18
gagcctggacagcatctcag

SEQ ID NO: 21745 - DNA, 20 bp, Artificial Sequence
  sgRNA
  Gabrr1_19
gtcgatccagaaagacaccc

SEQ ID NO: 21746 - DNA, 20 bp, Artificial Sequence
  sgRNA
  Gabrr1_20
acctgcacatccacgcccac

SEQ ID NO: 21747 - DNA, 20 bp, Artificial Sequence
  sgRNA
  Gabrr2_1
aggaccacgacttcaccatg

SEQ ID NO: 21748 - DNA, 20 bp, Artificial Sequence
  sgRNA
  Gabrr2_2
gatgctgtactggaagaacg

SEQ ID NO: 21749 - DNA, 20 bp, Artificial Sequence
  sgRNA
  Gabrr2_3
tgtatagcacatggccatcg

SEQ ID NO: 21750 - DNA, 20 bp, Artificial Sequence
  sgRNA
  Gabrr2_4
tatacctgaggcattactgg

SEQ ID NO: 21751 - DNA, 20 bp, Artificial Sequence
  sgRNA
  Gabrr2_5
gagtctggacagcatctccg

SEQ ID NO: 21752 - DNA, 20 bp, Artificial Sequence
  sgRNA
  Gabrr2_6
agtgtcctacatccgggccg

SEQ ID NO: 21753 - DNA, 20 bp, Artificial Sequence
  sgRNA
  Gabrr2_7
gcatgaccatgagggtggca

SEQ ID NO: 21754 - DNA, 20 bp, Artificial Sequence
  sgRNA
  Gabrr2_8
gcacatgtctatgatgcaac

SEQ ID NO: 21755 - DNA, 20 bp, Artificial Sequence
  sgRNA
  Gabrr2_9
ggattcccagacctgctctt

SEQ ID NO: 21756 - DNA, 20 bp, Artificial Sequence
  sgRNA
  Gabrr2_10
ttatttgatgagactcgctt

SEQ ID NO: 21757 - DNA, 20 bp, Artificial Sequence
  sgRNA
  Gabrr2_11
atacctgaggcattactgga

SEQ ID NO: 21758 - DNA, 20 bp, Artificial Sequence
  sgRNA
  Gabrr2_12
atgctgcgagtgttccccga

SEQ ID NO: 21759 - DNA, 20 bp, Artificial Sequence
  sgRNA
  Gabrr2_13
ggagtatttgtcaatggcat

SEQ ID NO: 21760 - DNA, 20 bp, Artificial Sequence
  sgRNA
  Gabrr2_14
tcaccatgaccctatacctg

SEQ ID NO: 21761 - DNA, 20 bp, Artificial Sequence
  sgRNA
  Gabrr2_15
gctgctgtagaaggccagtc

SEQ ID NO: 21762 - DNA, 20 bp, Artificial Sequence
  sgRNA
  Gabrr2_16
ggaggtcaattcactgttga

SEQ ID NO: 21763 - DNA, 20 bp, Artificial Sequence
  sgRNA
  Gabrr2_17
tctaccctgagcagaggccg

SEQ ID NO: 21764 - DNA, 20 bp, Artificial Sequence
  sgRNA
  Gabrr2_18
agaggtagatgtccacggcc

SEQ ID NO: 21765 - DNA, 20 bp, Artificial Sequence
  sgRNA
  Gabrr2_19
ggctctgtggtcgatccaga

SEQ ID NO: 21766 - DNA, 20 bp, Artificial Sequence
  sgRNA
  Gabrr2_20
gctctccagctccaaagagc

SEQ ID NO: 21767 - DNA, 20 bp, Artificial Sequence
  sgRNA
  Gabrr3_1
cttcatccacgacacaaccg

SEQ ID NO: 21768 - DNA, 20 bp, Artificial Sequence
  sgRNA
  Gabrr3_2
aggaccacgatttctccacg

SEQ ID NO: 21769 - DNA, 20 bp, Artificial Sequence
  sgRNA
  Gabrr3_3
tcatcaactttgtgctacgg

SEQ ID NO: 21770 - DNA, 20 bp, Artificial Sequence
  sgRNA
  Gabrr3_4
tctcttcaccgaaacaaacc

SEQ ID NO: 21771 - DNA, 20 bp, Artificial Sequence
  sgRNA
  Gabrr3_5
ggtgtcctatgtcaaggcgg

SEQ ID NO: 21772 - DNA, 20 bp, Artificial Sequence
  sgRNA
  Gabrr3_6
tattctccacggttgtgtcg

SEQ ID NO: 21773 - DNA, 20 bp, Artificial Sequence
  sgRNA
  Gabrr3_7
tgcttcgagtacatcccgat

SEQ ID NO: 21774 - DNA, 20 bp, Artificial Sequence
  sgRNA
  Gabrr3_8
ccaggtgtcctatgtcaagg

SEQ ID NO: 21775 - DNA, 20 bp, Artificial Sequence
  sgRNA
  Gabrr3_9
tgtgaattacctcaccacag

SEQ ID NO: 21776 - DNA, 20 bp, Artificial Sequence
  sgRNA
  Gabrr3_10
tctgagatgaatctgcacag

SEQ ID NO: 21777 - DNA, 20 bp, Artificial Sequence
  sgRNA
  Gabrr3_11
atgcttcgagtacatcccga

SEQ ID NO: 21778 - DNA, 20 bp, Artificial Sequence
  sgRNA
  Gabrr3_12
gtagcaaccatcgaaggcca

SEQ ID NO: 21779 - DNA, 20 bp, Artificial Sequence
  sgRNA
  Gabrr3_13
gttcaagccatggccttcga

SEQ ID NO: 21780 - DNA, 20 bp, Artificial Sequence
  sgRNA
  Gabrr3_14
tattgatgctgttcaagcca

SEQ ID NO: 21781 - DNA, 20 bp, Artificial Sequence
  sgRNA
  Gabrr3_15
gctgtagaaagccagtccac

SEQ ID NO: 21782 - DNA, 20 bp, Artificial Sequence
  sgRNA
  Gabrr3_16
gggcatggaggcactcacac

SEQ ID NO: 21783 - DNA, 20 bp, Artificial Sequence
  sgRNA
  Gabrr3_17
tgacggacagaaacacaaag

SEQ ID NO: 21784 - DNA, 20 bp, Artificial Sequence
  sgRNA
  Gabrr3_18
gccttgacataggacacctg

SEQ ID NO: 21785 - DNA, 20 bp, Artificial Sequence
  sgRNA
  Gabrr3_19
ggaaagcatcaccatcaaca

SEQ ID NO: 21786 - DNA, 20 bp, Artificial Sequence
  sgRNA
  Gabrr3_20
aagcatcgacagcatttcag

SEQ ID NO: 21787 - DNA, 20 bp, Artificial Sequence
  sgRNA
  Galr1_1
ggagcgccgcgagtgcacaa

SEQ ID NO: 21788 - DNA, 20 bp, Artificial Sequence
  sgRNA
  Galr1_2
tgtcccgatggaaaagacgc

SEQ ID NO: 21789 - DNA, 20 bp, Artificial Sequence
  sgRNA
  Galr1_3
ggtgggcagtgcatacacgg

SEQ ID NO: 21790 - DNA, 20 bp, Artificial Sequence
  sgRNA
  Galr1_4
cgtggagaacttcattacgc

SEQ ID NO: 21791 - DNA, 20 bp, Artificial Sequence
  sgRNA
  Galr1_5
tctctcagaaaacttccgga

SEQ ID NO: 21792 - DNA, 20 bp, Artificial Sequence
  sgRNA
  Galr1_6
gtagcgatccacagacatcg

SEQ ID NO: 21793 - DNA, 20 bp, Artificial Sequence
  sgRNA
  Galr1_7
caaatactacaacgaccacc

SEQ ID NO: 21794 - DNA, 20 bp, Artificial Sequence
  sgRNA
  Galr1_8
tccacgccaatgccgaagag

SEQ ID NO: 21795 - DNA, 20 bp, Artificial Sequence
  sgRNA
  Galr1_9
gctccacaagaaggcttacg

SEQ ID NO: 21796 - DNA, 20 bp, Artificial Sequence
  sgRNA
  Galr1_10
aacaggttggtggtgctgcg

SEQ ID NO: 21797 - DNA, 20 bp, Artificial Sequence
  sgRNA
  Galr1_11
acacttgcttgtacgccttc

SEQ ID NO: 21798 - DNA, 20 bp, Artificial Sequence
  sgRNA
  Galr1_12
gctggtgagcatcttcaccc

SEQ ID NO: 21799 - DNA, 20 bp, Artificial Sequence
  sgRNA
  Galr1_13
atatatgatggggttcactg

SEQ ID NO: 21800 - DNA, 20 bp, Artificial Sequence
  sgRNA
  Galr1_14
aggctccaaactcagcccag

SEQ ID NO: 21801 - DNA, 20 bp, Artificial Sequence
  sgRNA
  Galr1_15
tgcgttgcgggacaccctga

SEQ ID NO: 21802 - DNA, 20 bp, Artificial Sequence
  sgRNA
  Galr1_16
agaaggaagctggcgtcagt

SEQ ID NO: 21803 - DNA, 20 bp, Artificial Sequence
  sgRNA
  Galr1_17
aggtctggttgctgtcccga

SEQ ID NO: 21804 - DNA, 20 bp, Artificial Sequence
  sgRNA
  Galr1_18
gactgcacagaccgtcctgg

SEQ ID NO: 21805 - DNA, 20 bp, Artificial Sequence
  sgRNA
  Galr1_19
gctgtatgccaggcaatggg

SEQ ID NO: 21806 - DNA, 20 bp, Artificial Sequence
  sgRNA
  Galr1_20
gctgggcgtgggcttcatct

SEQ ID NO: 21807 - DNA, 20 bp, Artificial Sequence
  sgRNA
  Galr2_1
gacacggatgatcgtcatcg

SEQ ID NO: 21808 - DNA, 20 bp, Artificial Sequence
  sgRNA
  Galr2_2
gcgcgaaaaataggggtacg

SEQ ID NO: 21809 - DNA, 20 bp, Artificial Sequence
  sgRNA
  Galr2_3
gccaaacacccaatcgtcca

SEQ ID NO: 21810 - DNA, 20 bp, Artificial Sequence
  sgRNA
  Galr2_4
gtggtgcgctccacgctggg

SEQ ID NO: 21811 - DNA, 20 bp, Artificial Sequence
  sgRNA
  Galr2_5
acacgcagaggataagcgcg

SEQ ID NO: 21812 - DNA, 20 bp, Artificial Sequence
  sgRNA
  Galr2_6
aggtttccgcaaaatctgcg

SEQ ID NO: 21813 - DNA, 20 bp, Artificial Sequence
  sgRNA
  Galr2_7
tgtgcgccagaggtagtgca

SEQ ID NO: 21814 - DNA, 20 bp, Artificial Sequence
  sgRNA
  Galr2_8
tagcccccagatgagcccga

SEQ ID NO: 21815 - DNA, 20 bp, Artificial Sequence
  sgRNA
  Galr2_9
tagatgtgaaaggatgcgca

SEQ ID NO: 21816 - DNA, 20 bp, Artificial Sequence
  sgRNA
  Galr2_10
acggatgatcgtcatcgtgg

SEQ ID NO: 21817 - DNA, 20 bp, Artificial Sequence
  sgRNA
  Galr2_11
cgttgcccacagcgcccacg

SEQ ID NO: 21818 - DNA, 20 bp, Artificial Sequence
  sgRNA
  Galr2_12
ctagatgtgaaaggatgcgc

SEQ ID NO: 21819 - DNA, 20 bp, Artificial Sequence
  sgRNA
  Galr2_13
agaccagagcataaacgatg

SEQ ID NO: 21820 - DNA, 20 bp, Artificial Sequence
  sgRNA
  Galr2_14
ggtttccgcaaaatctgcgc

SEQ ID NO: 21821 - DNA, 20 bp, Artificial Sequence
  sgRNA
  Galr2_15
gcaactctcgggagtgcagc

SEQ ID NO: 21822 - DNA, 20 bp, Artificial Sequence
  sgRNA
  Galr2_16
ggagaccagagcataaacga

SEQ ID NO: 21823 - DNA, 20 bp, Artificial Sequence
  sgRNA
  Galr2_17
tcgagccaggaaggtggcgg

SEQ ID NO: 21824 - DNA, 20 bp, Artificial Sequence
  sgRNA
  Galr2_18
ggtcggccacacccaggttg

SEQ ID NO: 21825 - DNA, 20 bp, Artificial Sequence
  sgRNA
  Galr2_19
gcgcctggaaaccatagtgg

SEQ ID NO: 21826 - DNA, 20 bp, Artificial Sequence
  sgRNA
  Galr2_20
ggagtgcagcgggtagcgga

SEQ ID NO: 21827 - DNA, 20 bp, Artificial Sequence
  sgRNA
  Galr3_1
ggctccatactccaaccgcg

SEQ ID NO: 21828 - DNA, 20 bp, Artificial Sequence
  sgRNA
  Galr3_2
ccagcagagtgcgtagagcg

SEQ ID NO: 21829 - DNA, 20 bp, Artificial Sequence
  sgRNA
  Galr3_3
agaagcagaggatgagcgcg

SEQ ID NO: 21830 - DNA, 20 bp, Artificial Sequence
  sgRNA
  Galr3_4
aagagatccgtggtactgcc

SEQ ID NO: 21831 - DNA, 20 bp, Artificial Sequence
  sgRNA
  Galr3_5
gcgacgccagacctcgcggt

SEQ ID NO: 21832 - DNA, 20 bp, Artificial Sequence
  sgRNA
  Galr3_6
tatccactgagacggccgcc

SEQ ID NO: 21833 - DNA, 20 bp, Artificial Sequence
  sgRNA
  Galr3_7
gttgaggatgaagagatccg

SEQ ID NO: 21834 - DNA, 20 bp, Artificial Sequence
  sgRNA
  Galr3_8
gttgaggcaggagttggcgt

SEQ ID NO: 21835 - DNA, 20 bp, Artificial Sequence
  sgRNA
  Galr3_9
gtgccgtagtagcttaggta

SEQ ID NO: 21836 - DNA, 20 bp, Artificial Sequence
  sgRNA
  Galr3_10
cttcatcctcaacttggcgg

SEQ ID NO: 21837 - DNA, 20 bp, Artificial Sequence
  sgRNA
  Galr3_11
tactacggcacggtgcgcta

SEQ ID NO: 21838 - DNA, 20 bp, Artificial Sequence
  sgRNA
  Galr3_12
ggtcggccaccgccaagttg

SEQ ID NO: 21839 - DNA, 20 bp, Artificial Sequence
  sgRNA
  Galr3_13
gcgccctacctaagctacta

SEQ ID NO: 21840 - DNA, 20 bp, Artificial Sequence
  sgRNA
  Galr3_14
ctacctaagctactacggca

SEQ ID NO: 21841 - DNA, 20 bp, Artificial Sequence
  sgRNA
  Galr3_15
gtatgccagcagcttcaccc

SEQ ID NO: 21842 - DNA, 20 bp, Artificial Sequence
  sgRNA
  Galr3_16
ggcaggagttggcgtaggcg

SEQ ID NO: 21843 - DNA, 20 bp, Artificial Sequence
  sgRNA
  Galr3_17
acgcacgctgtgcttcctgt

SEQ ID NO: 21844 - DNA, 20 bp, Artificial Sequence
  sgRNA
  Galr3_18
gaggcaagggaatagacgag

SEQ ID NO: 21845 - DNA, 20 bp, Artificial Sequence
  sgRNA
  Galr3_19
gcaggaaccgggcagtacca

SEQ ID NO: 21846 - DNA, 20 bp, Artificial Sequence
  sgRNA
  Galr3_20
gtagtagcttaggtagggcg

SEQ ID NO: 21847 - DNA, 20 bp, Artificial Sequence
  sgRNA
  Gas1_1
cgagtgccgcgcggtcatcg

SEQ ID NO: 21848 - DNA, 20 bp, Artificial Sequence
  sgRNA
  Gas1_2
gcgcggcagacagggctcga

SEQ ID NO: 21849 - DNA, 20 bp, Artificial Sequence
  sgRNA
  Gas1_3
agctcaaccacacgcgccgc

SEQ ID NO: 21850 - DNA, 20 bp, Artificial Sequence
  sgRNA
  Gas1_4
gcgccggtgctagcgcagcg

SEQ ID NO: 21851 - DNA, 20 bp, Artificial Sequence
  sgRNA
  Gas1_5
gcatgtcctcgatgaccgcg

SEQ ID NO: 21852 - DNA, 20 bp, Artificial Sequence
  sgRNA
  Gas1_6
tctttgaccgattcgcagat

SEQ ID NO: 21853 - DNA, 20 bp, Artificial Sequence
  sgRNA
  Gas1_7
aggccgtcgtcgtcgtccag

SEQ ID NO: 21854 - DNA, 20 bp, Artificial Sequence
  sgRNA
  Gas1_8
aggcgcttcgattcgcccag

SEQ ID NO: 21855 - DNA, 20 bp, Artificial Sequence
  sgRNA
  Gas1_9
ctgcacagacgagtgccgcg

SEQ ID NO: 21856 - DNA, 20 bp, Artificial Sequence
  sgRNA
  Gas1_10
cgcctacagccagtacgccg

SEQ ID NO: 21857 - DNA, 20 bp, Artificial Sequence
  sgRNA
  Gas1_11
gctagcatcgcgggcagcag

SEQ ID NO: 21858 - DNA, 20 bp, Artificial Sequence
  sgRNA
  Gas1_12
cagctcaaccacacgcgccg

SEQ ID NO: 21859 - DNA, 20 bp, Artificial Sequence
  sgRNA
  Gas1_13
ggataagcgccgagatgcag

SEQ ID NO: 21860 - DNA, 20 bp, Artificial Sequence
  sgRNA
  Gas1_14
ttcggcccagatgcgagcaa

SEQ ID NO: 21861 - DNA, 20 bp, Artificial Sequence
  sgRNA
  Gas1_15
gtacgccgaggcttgtgcgc

SEQ ID NO: 21862 - DNA, 20 bp, Artificial Sequence
  sgRNA
  Gas1_16
gcagtcgcagtcctccagcg

SEQ ID NO: 21863 - DNA, 20 bp, Artificial Sequence
  sgRNA
  Gas1_17
gttccgcgcacttctggcat

SEQ ID NO: 21864 - DNA, 20 bp, Artificial Sequence
  sgRNA
  Gas1_18
acgcccatgccagaagtgcg

SEQ ID NO: 21865 - DNA, 20 bp, Artificial Sequence
  sgRNA
  Gas1_19
ggagcggcccatctgcgaat

SEQ ID NO: 21866 - DNA, 20 bp, Artificial Sequence
  sgRNA
  Gas1_20
ggctgagcgccaggttgcag

SEQ ID NO: 21867 - DNA, 20 bp, Artificial Sequence
  sgRNA
  Gcgr_1
tacctaccttggtaccacaa

SEQ ID NO: 21868 - DNA, 20 bp, Artificial Sequence
  sgRNA
  Gcgr_2
gccgtactgcatgatcactg

SEQ ID NO: 21869 - DNA, 20 bp, Artificial Sequence
  sgRNA
  Gcgr_3
gacacttgaccaccacccag

SEQ ID NO: 21870 - DNA, 20 bp, Artificial Sequence
  sgRNA
  Gcgr_4
ccagcaggtgatgtacaccg

SEQ ID NO: 21871 - DNA, 20 bp, Artificial Sequence
  sgRNA
  Gcgr_5
cctcgtggacccccagcaga

SEQ ID NO: 21872 - DNA, 20 bp, Artificial Sequence
  sgRNA
  Gcgr_6
gcacccgaaactacatccat

SEQ ID NO: 21873 - DNA, 20 bp, Artificial Sequence
  sgRNA
  Gcgr_7
cattgggaggcgttgcgcca

SEQ ID NO: 21874 - DNA, 20 bp, Artificial Sequence
  sgRNA
  Gcgr_8
tcaagaggtgtgggcccgat

SEQ ID NO: 21875 - DNA, 20 bp, Artificial Sequence
  sgRNA
  Gcgr_9
gtcagcatagtgcatctgat

SEQ ID NO: 21876 - DNA, 20 bp, Artificial Sequence
  sgRNA
  Gcgr_10
gcagccacatggccccagca

SEQ ID NO: 21877 - DNA, 20 bp, Artificial Sequence
  sgRNA
  Gcgr_11
gctctgtgttggtcatcgat

SEQ ID NO: 21878 - DNA, 20 bp, Artificial Sequence
  sgRNA
  Gcgr_12
gcatcatagccaactattgc

SEQ ID NO: 21879 - DNA, 20 bp, Artificial Sequence
  sgRNA
  Gcgr_13
ccacggtgtacatcacctgc

SEQ ID NO: 21880 - DNA, 20 bp, Artificial Sequence
  sgRNA
  Gcgr_14
cacacctcttgaacactagg

SEQ ID NO: 21881 - DNA, 20 bp, Artificial Sequence
  sgRNA
  Gcgr_15
ccagcaggagtacttgtcga

SEQ ID NO: 21882 - DNA, 20 bp, Artificial Sequence
  sgRNA
  Gcgr_16
caagatgtatagcagccagc

SEQ ID NO: 21883 - DNA, 20 bp, Artificial Sequence
  sgRNA
  Gcgr_17
caggggatgacaaacagcag

SEQ ID NO: 21884 - DNA, 20 bp, Artificial Sequence
  sgRNA
  Gcgr_18
ggtaccaaggtaggtaccag

SEQ ID NO: 21885 - DNA, 20 bp, Artificial Sequence
  sgRNA
  Gcgr_19
ggggcaggaaatgttggcag

SEQ ID NO: 21886 - DNA, 20 bp, Artificial Sequence
  sgRNA
  Gcgr_20
gagcgtctggctcagtgacg

SEQ ID NO: 21887 - DNA, 20 bp, Artificial Sequence
  sgRNA
  Gdpd2_1
cattgtacttctagtggccg

SEQ ID NO: 21888 - DNA, 20 bp, Artificial Sequence
  sgRNA
  Gdpd2_2
gattcgctctggaaacacag

SEQ ID NO: 21889 - DNA, 20 bp, Artificial Sequence
  sgRNA
  Gdpd2_3
cccgatgtacagccatccca

SEQ ID NO: 21890 - DNA, 20 bp, Artificial Sequence
  sgRNA
  Gdpd2_4
ttgagtatcttcctcctccg

SEQ ID NO: 21891 - DNA, 20 bp, Artificial Sequence
  sgRNA
  Gdpd2_5
acagccccattccttcacat

SEQ ID NO: 21892 - DNA, 20 bp, Artificial Sequence
  sgRNA
  Gdpd2_6
atatatctggcgcattctgg

SEQ ID NO: 21893 - DNA, 20 bp, Artificial Sequence
  sgRNA
  Gdpd2_7
ccatccagtgtccccaatgg

SEQ ID NO: 21894 - DNA, 20 bp, Artificial Sequence
  sgRNA
  Gdpd2_8
tctgagtttcatgatgcagg

SEQ ID NO: 21895 - DNA, 20 bp, Artificial Sequence
  sgRNA
  Gdpd2_9
ttctaccgcatccacccaag

SEQ ID NO: 21896 - DNA, 20 bp, Artificial Sequence
  sgRNA
  Gdpd2_10
gcaaggatgcatatgtgacc

SEQ ID NO: 21897 - DNA, 20 bp, Artificial Sequence
  sgRNA
  Gdpd2_11
gagatttaccccccaagcct

SEQ ID NO: 21898 - DNA, 20 bp, Artificial Sequence
  sgRNA
  Gdpd2_12
cggccactagaagtacaatg

SEQ ID NO: 21899 - DNA, 20 bp, Artificial Sequence
  sgRNA
  Gdpd2_13
tggagactgtgaagatgcag

SEQ ID NO: 21900 - DNA, 20 bp, Artificial Sequence
  sgRNA
  Gdpd2_14
agttgtgcagatcattgaga

SEQ ID NO: 21901 - DNA, 20 bp, Artificial Sequence
  sgRNA
  Gdpd2_15
ctgtgggctgagattcgctc

SEQ ID NO: 21902 - DNA, 20 bp, Artificial Sequence
  sgRNA
  Gdpd2_16
gctcctcattgtacttctag

SEQ ID NO: 21903 - DNA, 20 bp, Artificial Sequence
  sgRNA
  Gdpd2_17
agtccatccagtgtccccaa

SEQ ID NO: 21904 - DNA, 20 bp, Artificial Sequence
  sgRNA
  Gdpd2_18
agggcttgttcactacaaac

SEQ ID NO: 21905 - DNA, 20 bp, Artificial Sequence
  sgRNA
  Gdpd2_19
ggacatcagggtattctcag

SEQ ID NO: 21906 - DNA, 20 bp, Artificial Sequence
  sgRNA
  Gdpd2_20
tctctgagtttcatgatgca

SEQ ID NO: 21907 - DNA, 20 bp, Artificial Sequence
  sgRNA
  Gdpd5_1
agtcgctccagtagcccatg

SEQ ID NO: 21908 - DNA, 20 bp, Artificial Sequence
  sgRNA
  Gdpd5_2
ccccgtgatcacccctaccg

SEQ ID NO: 21909 - DNA, 20 bp, Artificial Sequence
  sgRNA
  Gdpd5_3
ctcgcacgatgacaccacgc

SEQ ID NO: 21910 - DNA, 20 bp, Artificial Sequence
  sgRNA
  Gdpd5_4
gaacctgcactggatacaca

SEQ ID NO: 21911 - DNA, 20 bp, Artificial Sequence
  sgRNA
  Gdpd5_5
tgtacactgtcaatgcaccg

SEQ ID NO: 21912 - DNA, 20 bp, Artificial Sequence
  sgRNA
  Gdpd5_6
gagttgtcggaagtgacgga

SEQ ID NO: 21913 - DNA, 20 bp, Artificial Sequence
  sgRNA
  Gdpd5_7
cctgtcaccctccgaccaca

SEQ ID NO: 21914 - DNA, 20 bp, Artificial Sequence
  sgRNA
  Gdpd5_8
tggggctcgtagtattgcag

SEQ ID NO: 21915 - DNA, 20 bp, Artificial Sequence
  sgRNA
  Gdpd5_9
cagcatttcgagggcccacg

SEQ ID NO: 21916 - DNA, 20 bp, Artificial Sequence
  sgRNA
  Gdpd5_10
catgatgctgacgtcccggc

SEQ ID NO: 21917 - DNA, 20 bp, Artificial Sequence
  sgRNA
  Gdpd5_11
agacgagtactgcctcatgt

SEQ ID NO: 21918 - DNA, 20 bp, Artificial Sequence
  sgRNA
  Gdpd5_12
gtcaccctccgaccacaggg

SEQ ID NO: 21919 - DNA, 20 bp, Artificial Sequence
  sgRNA
  Gdpd5_13
tgtaactccgtataccaccc

SEQ ID NO: 21920 - DNA, 20 bp, Artificial Sequence
  sgRNA
  Gdpd5_14
cacggctgccagcatttcga

SEQ ID NO: 21921 - DNA, 20 bp, Artificial Sequence
  sgRNA
  Gdpd5_15
gagtgcagtgatggccacca

SEQ ID NO: 21922 - DNA, 20 bp, Artificial Sequence
  sgRNA
  Gdpd5_16
ggagccatcttccgtaccaa

SEQ ID NO: 21923 - DNA, 20 bp, Artificial Sequence
  sgRNA
  Gdpd5_17
gtagtgtcatgcatgagaaa

SEQ ID NO: 21924 - DNA, 20 bp, Artificial Sequence
  sgRNA
  Gdpd5_18
gacagtttgcccgtgcagag

SEQ ID NO: 21925 - DNA, 20 bp, Artificial Sequence
  sgRNA
  Gdpd5_19
tgctgagcgccgctgtacgc

SEQ ID NO: 21926 - DNA, 20 bp, Artificial Sequence
  sgRNA
  Gdpd5_20
actggttctgaacctccctg

SEQ ID NO: 21927 - DNA, 20 bp, Artificial Sequence
  sgRNA
  Gfra1_1
gcaccaagtaccgcacactg

SEQ ID NO: 21928 - DNA, 20 bp, Artificial Sequence
  sgRNA
  Gfra1_2
cttaccaatcagtcccgagt

SEQ ID NO: 21929 - DNA, 20 bp, Artificial Sequence
  sgRNA
  Gfra1_3
catatggggaatcttccagt

SEQ ID NO: 21930 - DNA, 20 bp, Artificial Sequence
  sgRNA
  Gfra1_4
tcaaggcctccatagcgctg

SEQ ID NO: 21931 - DNA, 20 bp, Artificial Sequence
  sgRNA
  Gfra1_5
catatgagccggttaacagc

SEQ ID NO: 21932 - DNA, 20 bp, Artificial Sequence
  sgRNA
  Gfra1_6
tttgtcgaagaactgcctga

SEQ ID NO: 21933 - DNA, 20 bp, Artificial Sequence
  sgRNA
  Gfra1_7
ctgttgctgcaatcgcacca

SEQ ID NO: 21934 - DNA, 20 bp, Artificial Sequence
  sgRNA
  Gfra1_8
tctgacagcctgctgttaac

SEQ ID NO: 21935 - DNA, 20 bp, Artificial Sequence
  sgRNA
  Gfra1_9
gctgttaaccggctcatatg

SEQ ID NO: 21936 - DNA, 20 bp, Artificial Sequence
  sgRNA
  Gfra1_10
cagtggaacacatttccaaa

SEQ ID NO: 21937 - DNA, 20 bp, Artificial Sequence
  sgRNA
  Gfra1_11
agagcggtgaacaccatcac

SEQ ID NO: 21938 - DNA, 20 bp, Artificial Sequence
  sgRNA
  Gfra1_12
gggacgtcgcctgcaccgag

SEQ ID NO: 21939 - DNA, 20 bp, Artificial Sequence
  sgRNA
  Gfra1_13
gcggtccccaccactcacct

SEQ ID NO: 21940 - DNA, 20 bp, Artificial Sequence
  sgRNA
  Gfra1_14
ggatcaagaacaagcctcta

SEQ ID NO: 21941 - DNA, 20 bp, Artificial Sequence
  sgRNA
  Gfra1_15
tgccaatgatacagacaaca

SEQ ID NO: 21942 - DNA, 20 bp, Artificial Sequence
  sgRNA
  Gfra1_16
aggcttgttcttgatccgga

SEQ ID NO: 21943 - DNA, 20 bp, Artificial Sequence
  sgRNA
  Gfra1_17
gcaattcaagcctttggcaa

SEQ ID NO: 21944 - DNA, 20 bp, Artificial Sequence
  sgRNA
  Gfra1_18
ttgctgacagaccttgactc

SEQ ID NO: 21945 - DNA, 20 bp, Artificial Sequence
  sgRNA
  Gfra1_19
tctacaactgccgctgcaag

SEQ ID NO: 21946 - DNA, 20 bp, Artificial Sequence
  sgRNA
  Gfra1_20
gagcatgtaccagagcctgc

SEQ ID NO: 21947 - DNA, 20 bp, Artificial Sequence
  sgRNA
  Gfra2_1
atgcctggtagttgtccgca

SEQ ID NO: 21948 - DNA, 20 bp, Artificial Sequence
  sgRNA
  Gfra2_2
tctattggagcatccatctg

SEQ ID NO: 21949 - DNA, 20 bp, Artificial Sequence
  sgRNA
  Gfra2_3
ggccaataaggagtgccagg

SEQ ID NO: 21950 - DNA, 20 bp, Artificial Sequence
  sgRNA
  Gfra2_4
ccgggccaatgagctgtgtg

SEQ ID NO: 21951 - DNA, 20 bp, Artificial Sequence
  sgRNA
  Gfra2_5
gcctgccaggcactgccgaa

SEQ ID NO: 21952 - DNA, 20 bp, Artificial Sequence
  sgRNA
  Gfra2_6
gctccaggtaccgcaccctt

SEQ ID NO: 21953 - DNA, 20 bp, Artificial Sequence
  sgRNA
  Gfra2_7
gccagcccttcctctccgca

SEQ ID NO: 21954 - DNA, 20 bp, Artificial Sequence
  sgRNA
  Gfra2_8
gcagctggtgattgtccggt

SEQ ID NO: 21955 - DNA, 20 bp, Artificial Sequence
  sgRNA
  Gfra2_9
ccaactgtcgagcctcctac

SEQ ID NO: 21956 - DNA, 20 bp, Artificial Sequence
  sgRNA
  Gfra2_10
aggaggctcgacagttggcg

SEQ ID NO: 21957 - DNA, 20 bp, Artificial Sequence
  sgRNA
  Gfra2_11
ggagacaccacgatgcccgt

SEQ ID NO: 21958 - DNA, 20 bp, Artificial Sequence
  sgRNA
  Gfra2_12
ggagcagaagagcatgcggt

SEQ ID NO: 21959 - DNA, 20 bp, Artificial Sequence
  sgRNA
  Gfra2_13
gatggtttgccggcgacgct

SEQ ID NO: 21960 - DNA, 20 bp, Artificial Sequence
  sgRNA
  Gfra2_14
cgagcctgaagatgtccgag

SEQ ID NO: 21961 - DNA, 20 bp, Artificial Sequence
  sgRNA
  Gfra2_15
acggtcgaagaactggcgca

SEQ ID NO: 21962 - DNA, 20 bp, Artificial Sequence
  sgRNA
  Gfra2_16
gcaacgttccttccacagca

SEQ ID NO: 21963 - DNA, 20 bp, Artificial Sequence
  sgRNA
  Gfra2_17
atccatctggggctgacgga

SEQ ID NO: 21964 - DNA, 20 bp, Artificial Sequence
  sgRNA
  Gfra2_18
acaagtggtctgtacgacac

SEQ ID NO: 21965 - DNA, 20 bp, Artificial Sequence
  sgRNA
  Gfra2_19
gagacaccacgatgcccgtg

SEQ ID NO: 21966 - DNA, 20 bp, Artificial Sequence
  sgRNA
  Gfra2_20
agggctggccaaagagcgga

SEQ ID NO: 21967 - DNA, 20 bp, Artificial Sequence
  sgRNA
  Gfra3_1
ccgcagatccaggcaattgg

SEQ ID NO: 21968 - DNA, 20 bp, Artificial Sequence
  sgRNA
  Gfra3_2
ggtccaataaatgtccagac

SEQ ID NO: 21969 - DNA, 20 bp, Artificial Sequence
  sgRNA
  Gfra3_3
gacatggcagactcctctaa

SEQ ID NO: 21970 - DNA, 20 bp, Artificial Sequence
  sgRNA
  Gfra3_4
cctgcgcaaggcctacgggg

SEQ ID NO: 21971 - DNA, 20 bp, Artificial Sequence
  sgRNA
  Gfra3_5
gctgttcacactcgtcctgt

SEQ ID NO: 21972 - DNA, 20 bp, Artificial Sequence
  sgRNA
  Gfra3_6
gctcagttgcacaagtccca

SEQ ID NO: 21973 - DNA, 20 bp, Artificial Sequence
  sgRNA
  Gfra3_7
cctgcacctccagtttaagc

SEQ ID NO: 21974 - DNA, 20 bp, Artificial Sequence
  sgRNA
  Gfra3_8
gctgcgctccttctttgaga

SEQ ID NO: 21975 - DNA, 20 bp, Artificial Sequence
  sgRNA
  Gfra3_9
tctgcagcagaatcaaggga

SEQ ID NO: 21976 - DNA, 20 bp, Artificial Sequence
  sgRNA
  Gfra3_10
tctgcggagcttctgccgtg

SEQ ID NO: 21977 - DNA, 20 bp, Artificial Sequence
  sgRNA
  Gfra3_11
agatgtctgcgggcatacct

SEQ ID NO: 21978 - DNA, 20 bp, Artificial Sequence
  sgRNA
  Gfra3_12
agctgcacctgccgaggcag

SEQ ID NO: 21979 - DNA, 20 bp, Artificial Sequence
  sgRNA
  Gfra3_13
gccttaagctgcacctgccg

SEQ ID NO: 21980 - DNA, 20 bp, Artificial Sequence
  sgRNA
  Gfra3_14
gtcatcctatggacatcctt

SEQ ID NO: 21981 - DNA, 20 bp, Artificial Sequence
  sgRNA
  Gfra3_15
cagcagcagaccctgagcgt

SEQ ID NO: 21982 - DNA, 20 bp, Artificial Sequence
  sgRNA
  Gfra3_16
acagctctctgatagactgc

SEQ ID NO: 21983 - DNA, 20 bp, Artificial Sequence
  sgRNA
  Gfra3_17
gtttgtgaacagctgtaccc

SEQ ID NO: 21984 - DNA, 20 bp, Artificial Sequence
  sgRNA
  Gfra3_18
gatgtctgcgggcatacctg

SEQ ID NO: 21985 - DNA, 20 bp, Artificial Sequence
  sgRNA
  Gfra3_19
gcagactcctctaagggcag

SEQ ID NO: 21986 - DNA, 20 bp, Artificial Sequence
  sgRNA
  Gfra3_20
ctacctgtctggacatttat

SEQ ID NO: 21987 - DNA, 20 bp, Artificial Sequence
  sgRNA
  Gfra4_1
taccgacgggaatcgctgcg

SEQ ID NO: 21988 - DNA, 20 bp, Artificial Sequence
  sgRNA
  Gfra4_2
cgtagacgcgcagacaacgc

SEQ ID NO: 21989 - DNA, 20 bp, Artificial Sequence
  sgRNA
  Gfra4_3
cctgcgcgttctccggcccg

SEQ ID NO: 21990 - DNA, 20 bp, Artificial Sequence
  sgRNA
  Gfra4_4
gaggcccacgcgcgaagaag

SEQ ID NO: 21991 - DNA, 20 bp, Artificial Sequence
  sgRNA
  Gfra4_5
aggcgtgtacagcagacgag

SEQ ID NO: 21992 - DNA, 20 bp, Artificial Sequence
  sgRNA
  Gfra4_6
aggcttcgcattcttcgcgc

SEQ ID NO: 21993 - DNA, 20 bp, Artificial Sequence
  sgRNA
  Gfra4_7
gtccacgcagcgattcccgt

SEQ ID NO: 21994 - DNA, 20 bp, Artificial Sequence
  sgRNA
  Gfra4_8
gggtctgcgagctttaccga

SEQ ID NO: 21995 - DNA, 20 bp, Artificial Sequence
  sgRNA
  Gfra4_9
gcgtagacgcgcagacaacg

SEQ ID NO: 21996 - DNA, 20 bp, Artificial Sequence
  sgRNA
  Gfra4_10
ggttccttgtaaagagcttg

SEQ ID NO: 21997 - DNA, 20 bp, Artificial Sequence
  sgRNA
  Gfra4_11
gcagctgcgctctgagtacg

SEQ ID NO: 21998 - DNA, 20 bp, Artificial Sequence
  sgRNA
  Gfra4_12
ctgattaggaacatgaaccg

SEQ ID NO: 21999 - DNA, 20 bp, Artificial Sequence
  sgRNA
  Gfra4_13
acgcgcgaagaagcggcgca

SEQ ID NO: 22000 - DNA, 20 bp, Artificial Sequence
  sgRNA
  Gfra4_14
cgggaatcgctgcgtggacg

SEQ ID NO: 22001 - DNA, 20 bp, Artificial Sequence
  sgRNA
  Gfra4_15
ggtctgcgagctttaccgac

SEQ ID NO: 22002 - DNA, 20 bp, Artificial Sequence
  sgRNA
  Gfra4_16
ctcgtctgctgtacacgcct

SEQ ID NO: 22003 - DNA, 20 bp, Artificial Sequence
  sgRNA
  Gfra4_17
cacgttgtccaggtagttgg

SEQ ID NO: 22004 - DNA, 20 bp, Artificial Sequence
  sgRNA
  Gfra4_18
ccttgtaaagagcttgcgga

SEQ ID NO: 22005 - DNA, 20 bp, Artificial Sequence
  sgRNA
  Gfra4_19
tcatgttcctaatcagagca

SEQ ID NO: 22006 - DNA, 20 bp, Artificial Sequence
  sgRNA
  Gfra4_20
tgctgggtgctgtttcccgc

SEQ ID NO: 22007 - DNA, 20 bp, Artificial Sequence
  sgRNA
  Gfral_1
ggcaagtgtgaattacactg

SEQ ID NO: 22008 - DNA, 20 bp, Artificial Sequence
  sgRNA
  Gfral_2
tggcacttcccagttatgtg

SEQ ID NO: 22009 - DNA, 20 bp, Artificial Sequence
  sgRNA
  Gfral_3
gaagacacctgccttactcc

SEQ ID NO: 22010 - DNA, 20 bp, Artificial Sequence
  sgRNA
  Gfral_4
aaaaagtgcaccaataagac

SEQ ID NO: 22011 - DNA, 20 bp, Artificial Sequence
  sgRNA
  Gfral_5
gtaacgcccctgcaagcaca

SEQ ID NO: 22012 - DNA, 20 bp, Artificial Sequence
  sgRNA
  Gfral_6
aatgctggccccacataact

SEQ ID NO: 22013 - DNA, 20 bp, Artificial Sequence
  sgRNA
  Gfral_7
attacactgaggcaagtggg

SEQ ID NO: 22014 - DNA, 20 bp, Artificial Sequence
  sgRNA
  Gfral_8
aacactgccaagcagccata

SEQ ID NO: 22015 - DNA, 20 bp, Artificial Sequence
  sgRNA
  Gfral_9
tcatccatcgaaatagctgg

SEQ ID NO: 22016 - DNA, 20 bp, Artificial Sequence
  sgRNA
  Gfral_10
gacacctccagctatttcga

SEQ ID NO: 22017 - DNA, 20 bp, Artificial Sequence
  sgRNA
  Gfral_11
ggaactatattcagtgcaca

SEQ ID NO: 22018 - DNA, 20 bp, Artificial Sequence
  sgRNA
  Gfral_12
gctgccttcctaggaacctt

SEQ ID NO: 22019 - DNA, 20 bp, Artificial Sequence
  sgRNA
  Gfral_13
ttctgggagtgagagctgca

SEQ ID NO: 22020 - DNA, 20 bp, Artificial Sequence
  sgRNA
  Gfral_14
aattacactgaggcaagtgg

SEQ ID NO: 22021 - DNA, 20 bp, Artificial Sequence
  sgRNA
  Gfral_15
gtttgtttactgtacagtgg

SEQ ID NO: 22022 - DNA, 20 bp, Artificial Sequence
  sgRNA
  Gfral_16
ggactgtcccaaaggttcct

SEQ ID NO: 22023 - DNA, 20 bp, Artificial Sequence
  sgRNA
  Gfral_17
ccagctatttcgatggatga

SEQ ID NO: 22024 - DNA, 20 bp, Artificial Sequence
  sgRNA
  Gfral_18
gccgaaatgatgaattatgc

SEQ ID NO: 22025 - DNA, 20 bp, Artificial Sequence
  sgRNA
  Gfral_19
gtttctttggattgctgaca

SEQ ID NO: 22026 - DNA, 20 bp, Artificial Sequence
  sgRNA
  Gfral_20
gcaagtaccctgtgcttgca

SEQ ID NO: 22027 - DNA, 20 bp, Artificial Sequence
  sgRNA
  Gfy_1
tgcagaatttaggtgtctcg

SEQ ID NO: 22028 - DNA, 20 bp, Artificial Sequence
  sgRNA
  Gfy_2
catggtgtagagttggtgtg

SEQ ID NO: 22029 - DNA, 20 bp, Artificial Sequence
  sgRNA
  Gfy_3
acatcagtagcagaatctca

SEQ ID NO: 22030 - DNA, 20 bp, Artificial Sequence
  sgRNA
  Gfy_4
tcagacggggaaattccagt

SEQ ID NO: 22031 - DNA, 20 bp, Artificial Sequence
  sgRNA
  Gfy_5
ggtatcttagactcttcacc

SEQ ID NO: 22032 - DNA, 20 bp, Artificial Sequence
  sgRNA
  Gfy_6
agtaccagtgggcatcccag

SEQ ID NO: 22033 - DNA, 20 bp, Artificial Sequence
  sgRNA
  Gfy_7
tgtccacctcagattcccca

SEQ ID NO: 22034 - DNA, 20 bp, Artificial Sequence
  sgRNA
  Gfy_8
ctgactgtggactttctgta

SEQ ID NO: 22035 - DNA, 20 bp, Artificial Sequence
  sgRNA
  Gfy_9
gcgtagaagtagagatccag

SEQ ID NO: 22036 - DNA, 20 bp, Artificial Sequence
  sgRNA
  Gfy_10
ctctgtgcctgttcttcgcg

SEQ ID NO: 22037 - DNA, 20 bp, Artificial Sequence
  sgRNA
  Gfy_11
cgtagaagtagagatccagc

SEQ ID NO: 22038 - DNA, 20 bp, Artificial Sequence
  sgRNA
  Gfy_12
actctggtcagccgcccacg

SEQ ID NO: 22039 - DNA, 20 bp, Artificial Sequence
  sgRNA
  Gfy_13
agtccctccagagcaacact

SEQ ID NO: 22040 - DNA, 20 bp, Artificial Sequence
  sgRNA
  Gfy_14
gatacccccaaactctcacc

SEQ ID NO: 22041 - DNA, 20 bp, Artificial Sequence
  sgRNA
  Gfy_15
cgatgccccgaaggacccgc

SEQ ID NO: 22042 - DNA, 20 bp, Artificial Sequence
  sgRNA
  Gfy_16
agtcaacactatcatcgtgg

SEQ ID NO: 22043 - DNA, 20 bp, Artificial Sequence
  sgRNA
  Gfy_17
ccagccaacaaccttcaggg

SEQ ID NO: 22044 - DNA, 20 bp, Artificial Sequence
  sgRNA
  Gfy_18
acttctacgcccccgatgcg

SEQ ID NO: 22045 - DNA, 20 bp, Artificial Sequence
  sgRNA
  Gfy_19
cttctacgcccccgatgcgt

SEQ ID NO: 22046 - DNA, 20 bp, Artificial Sequence
  sgRNA
  Gfy_20
gcccctcagagacacagccg

SEQ ID NO: 22047 - DNA, 20 bp, Artificial Sequence
  sgRNA
  Ggt1_1
actgacgtatcaccgtatcg

SEQ ID NO: 22048 - DNA, 20 bp, Artificial Sequence
  sgRNA
  Ggt1_2
cgtacagggtcgcatcaccg

SEQ ID NO: 22049 - DNA, 20 bp, Artificial Sequence
  sgRNA
  Ggt1_3
gaattcaggctcatagtagg

SEQ ID NO: 22050 - DNA, 20 bp, Artificial Sequence
  sgRNA
  Ggt1_4
cgaccacgtgtactccaggg

SEQ ID NO: 22051 - DNA, 20 bp, Artificial Sequence
  sgRNA
  Ggt1_5
gatgctcaatcagctcagca

SEQ ID NO: 22052 - DNA, 20 bp, Artificial Sequence
  sgRNA
  Ggt1_6
gacgtatcaccgtatcgtgg

SEQ ID NO: 22053 - DNA, 20 bp, Artificial Sequence
  sgRNA
  Ggt1_7
gctgtcgttcgagcatcagg

SEQ ID NO: 22054 - DNA, 20 bp, Artificial Sequence
  sgRNA
  Ggt1_8
attgagcatccgatgagcat

SEQ ID NO: 22055 - DNA, 20 bp, Artificial Sequence
  sgRNA
  Ggt1_9
ccacgtgtactccagggcgg

SEQ ID NO: 22056 - DNA, 20 bp, Artificial Sequence
  sgRNA
  Ggt1_10
ttcggtttgcctatgccaag

SEQ ID NO: 22057 - DNA, 20 bp, Artificial Sequence
  sgRNA
  Ggt1_11
cataaccacggatttcacca

SEQ ID NO: 22058 - DNA, 20 bp, Artificial Sequence
  sgRNA
  Ggt1_12
aatagccctggacaaaaaac

SEQ ID NO: 22059 - DNA, 20 bp, Artificial Sequence
  sgRNA
  Ggt1_13
gctgtccctggtgaaatccg

SEQ ID NO: 22060 - DNA, 20 bp, Artificial Sequence
  sgRNA
  Ggt1_14
ggtgtgccagctcataacca

SEQ ID NO: 22061 - DNA, 20 bp, Artificial Sequence
  sgRNA
  Ggt1_15
catacacagcaggcttgcga

SEQ ID NO: 22062 - DNA, 20 bp, Artificial Sequence
  sgRNA
  Ggt1_16
tcaatcatcctggataagga

SEQ ID NO: 22063 - DNA, 20 bp, Artificial Sequence
  sgRNA
  Ggt1_17
gattgtgaaagacatccagg

SEQ ID NO: 22064 - DNA, 20 bp, Artificial Sequence
  sgRNA
  Ggt1_18
tgcgatggctgcatccacca

SEQ ID NO: 22065 - DNA, 20 bp, Artificial Sequence
  sgRNA
  Ggt1_19
tcaccgaggccgatgctcat

SEQ ID NO: 22066 - DNA, 20 bp, Artificial Sequence
  sgRNA
  Ggt1_20
tgaaaccgcagacaggtgag

SEQ ID NO: 22067 - DNA, 20 bp, Artificial Sequence
  sgRNA
  Ggt7_1
ggtcatgcaaatctacttcg

SEQ ID NO: 22068 - DNA, 20 bp, Artificial Sequence
  sgRNA
  Ggt7_2
cgcaggcggtgtcataaccg

SEQ ID NO: 22069 - DNA, 20 bp, Artificial Sequence
  sgRNA
  Ggt7_3
gcgacggcctgatctcgctg

SEQ ID NO: 22070 - DNA, 20 bp, Artificial Sequence
  sgRNA
  Ggt7_4
tgttggtacatgatatccgg

SEQ ID NO: 22071 - DNA, 20 bp, Artificial Sequence
  sgRNA
  Ggt7_5
gtaaccctttcaccattccg

SEQ ID NO: 22072 - DNA, 20 bp, Artificial Sequence
  sgRNA
  Ggt7_6
gctgttgagaaggatcccgg

SEQ ID NO: 22073 - DNA, 20 bp, Artificial Sequence
  sgRNA
  Ggt7_7
tgttggttctccgactgccg

SEQ ID NO: 22074 - DNA, 20 bp, Artificial Sequence
  sgRNA
  Ggt7_8
agcagagtgttcttgccgcc

SEQ ID NO: 22075 - DNA, 20 bp, Artificial Sequence
  sgRNA
  Ggt7_9
ctgttgagaaggatcccgga

SEQ ID NO: 22076 - DNA, 20 bp, Artificial Sequence
  sgRNA
  Ggt7_10
agaaccaacaccttcatcat

SEQ ID NO: 22077 - DNA, 20 bp, Artificial Sequence
  sgRNA
  Ggt7_11
gatttgcatgaccagcgcca

SEQ ID NO: 22078 - DNA, 20 bp, Artificial Sequence
  sgRNA
  Ggt7_12
ttaggtggctctcattccgc

SEQ ID NO: 22079 - DNA, 20 bp, Artificial Sequence
  sgRNA
  Ggt7_13
tcatcggtgtgaaggaccct

SEQ ID NO: 22080 - DNA, 20 bp, Artificial Sequence
  sgRNA
  Ggt7_14
cctgcagtccaacctcctgc

SEQ ID NO: 22081 - DNA, 20 bp, Artificial Sequence
  sgRNA
  Ggt7_15
tgagcatcaccagcttcccg

SEQ ID NO: 22082 - DNA, 20 bp, Artificial Sequence
  sgRNA
  Ggt7_16
tcaagtctgcccggcttcag

SEQ ID NO: 22083 - DNA, 20 bp, Artificial Sequence
  sgRNA
  Ggt7_17
agacatctaccttctccacg

SEQ ID NO: 22084 - DNA, 20 bp, Artificial Sequence
  sgRNA
  Ggt7_18
gcctgtctatgagctggacg

SEQ ID NO: 22085 - DNA, 20 bp, Artificial Sequence
  sgRNA
  Ggt7_19
actcactgtcaacctgcagg

SEQ ID NO: 22086 - DNA, 20 bp, Artificial Sequence
  sgRNA
  Ggt7_20
tctgctggtcggactacagt

SEQ ID NO: 22087 - DNA, 20 bp, Artificial Sequence
  sgRNA
  Ghr_1
attgattctttgcagaactg

SEQ ID NO: 22088 - DNA, 20 bp, Artificial Sequence
  sgRNA
  Ghr_2
gcttccaatatgttcgtctg

SEQ ID NO: 22089 - DNA, 20 bp, Artificial Sequence
  sgRNA
  Ghr_3
aattgctcatgaatggaccc

SEQ ID NO: 22090 - DNA, 20 bp, Artificial Sequence
  sgRNA
  Ghr_4
gtccagttgaggccaatggg

SEQ ID NO: 22091 - DNA, 20 bp, Artificial Sequence
  sgRNA
  Ghr_5
gctcacataaccacacgagg

SEQ ID NO: 22092 - DNA, 20 bp, Artificial Sequence
  sgRNA
  Ghr_6
tctgaggaaatattacacgg

SEQ ID NO: 22093 - DNA, 20 bp, Artificial Sequence
  sgRNA
  Ghr_7
agacgtggcttccatgcgag

SEQ ID NO: 22094 - DNA, 20 bp, Artificial Sequence
  sgRNA
  Ghr_8
tcagtttcgctgctcaaaag

SEQ ID NO: 22095 - DNA, 20 bp, Artificial Sequence
  sgRNA
  Ghr_9
tagctcaatgaactcgaccc

SEQ ID NO: 22096 - DNA, 20 bp, Artificial Sequence
  sgRNA
  Ghr_10
tctactgtctgggtaatgga

SEQ ID NO: 22097 - DNA, 20 bp, Artificial Sequence
  sgRNA
  Ghr_11
agactgcacggtgtgaaccg

SEQ ID NO: 22098 - DNA, 20 bp, Artificial Sequence
  sgRNA
  Ghr_12
tcgtctgaggaaatattaca

SEQ ID NO: 22099 - DNA, 20 bp, Artificial Sequence
  sgRNA
  Ghr_13
gtaagcgacattacaccagc

SEQ ID NO: 22100 - DNA, 20 bp, Artificial Sequence
  sgRNA
  Ghr_14
gatgcagtagggtatccaaa

SEQ ID NO: 22101 - DNA, 20 bp, Artificial Sequence
  sgRNA
  Ghr_15
aatgatcatgagaaatcagc

SEQ ID NO: 22102 - DNA, 20 bp, Artificial Sequence
  sgRNA
  Ghr_16
aagataataattaagaacca

SEQ ID NO: 22103 - DNA, 20 bp, Artificial Sequence
  sgRNA
  Ghr_17
tgtgctcacataaccacacg

SEQ ID NO: 22104 - DNA, 20 bp, Artificial Sequence
  sgRNA
  Ghr_18
agtgatgtgggattactcat

SEQ ID NO: 22105 - DNA, 20 bp, Artificial Sequence
  sgRNA
  Ghr_19
tgcgggtgagatccagacaa

SEQ ID NO: 22106 - DNA, 20 bp, Artificial Sequence
  sgRNA
  Ghr_20
agtacagctgaatagatcct

SEQ ID NO: 22107 - DNA, 20 bp, Artificial Sequence
  sgRNA
  Ghrhr_1
acgtaccagtgcatagcacg

SEQ ID NO: 22108 - DNA, 20 bp, Artificial Sequence
  sgRNA
  Ghrhr_2
aggtggcaaacagctgcgtg

SEQ ID NO: 22109 - DNA, 20 bp, Artificial Sequence
  sgRNA
  Ghrhr_3
gatggcaatagccacgcaga

SEQ ID NO: 22110 - DNA, 20 bp, Artificial Sequence
  sgRNA
  Ghrhr_4
catggtggccaaatgtgaga

SEQ ID NO: 22111 - DNA, 20 bp, Artificial Sequence
  sgRNA
  Ghrhr_5
ggtgtagatgatcttcaccg

SEQ ID NO: 22112 - DNA, 20 bp, Artificial Sequence
  sgRNA
  Ghrhr_6
tcagcaccttcaatctcgat

SEQ ID NO: 22113 - DNA, 20 bp, Artificial Sequence
  sgRNA
  Ghrhr_7
agtggtccgtgctatccccc

SEQ ID NO: 22114 - DNA, 20 bp, Artificial Sequence
  sgRNA
  Ghrhr_8
tttgatgatccaccagcagg

SEQ ID NO: 22115 - DNA, 20 bp, Artificial Sequence
  sgRNA
  Ghrhr_9
tgttggcctccacatccccc

SEQ ID NO: 22116 - DNA, 20 bp, Artificial Sequence
  sgRNA
  Ghrhr_10
ggtgaagatcatctacacca

SEQ ID NO: 22117 - DNA, 20 bp, Artificial Sequence
  sgRNA
  Ghrhr_11
ctgaacttctgccagctcga

SEQ ID NO: 22118 - DNA, 20 bp, Artificial Sequence
  sgRNA
  Ghrhr_12
atgtaatgaattccaaacag

SEQ ID NO: 22119 - DNA, 20 bp, Artificial Sequence
  sgRNA
  Ghrhr_13
accttcaatctcgatcgggg

SEQ ID NO: 22120 - DNA, 20 bp, Artificial Sequence
  sgRNA
  Ghrhr_14
cctttgatgatccaccagca

SEQ ID NO: 22121 - DNA, 20 bp, Artificial Sequence
  sgRNA
  Ghrhr_15
gcagcccatcccaggtccca

SEQ ID NO: 22122 - DNA, 20 bp, Artificial Sequence
  sgRNA
  Ghrhr_16
tgagcttgcatgtcttcagg

SEQ ID NO: 22123 - DNA, 20 bp, Artificial Sequence
  sgRNA
  Ghrhr_17
ggatgccgccatcttccagg

SEQ ID NO: 22124 - DNA, 20 bp, Artificial Sequence
  sgRNA
  Ghrhr_18
cactggccagagcctgtcgg

SEQ ID NO: 22125 - DNA, 20 bp, Artificial Sequence
  sgRNA
  Ghrhr_19
tgatgaagtcacattctagg

SEQ ID NO: 22126 - DNA, 20 bp, Artificial Sequence
  sgRNA
  Ghrhr_20
cacgtaccagtgcatagcac

SEQ ID NO: 22127 - DNA, 20 bp, Artificial Sequence
  sgRNA
  Ghsr_1
gctcgacacccataccatca

SEQ ID NO: 22128 - DNA, 20 bp, Artificial Sequence
  sgRNA
  Ghsr_2
caacctctacctatccagca

SEQ ID NO: 22129 - DNA, 20 bp, Artificial Sequence
  sgRNA
  Ghsr_3
cggcactcgttggtgtcccg

SEQ ID NO: 22130 - DNA, 20 bp, Artificial Sequence
  sgRNA
  Ghsr_4
caccacgaagagcgccacgc

SEQ ID NO: 22131 - DNA, 20 bp, Artificial Sequence
  sgRNA
  Ghsr_5
gtagcgctcgacgctcagcg

SEQ ID NO: 22132 - DNA, 20 bp, Artificial Sequence
  sgRNA
  Ghsr_6
catgtccaagaagtaccggg

SEQ ID NO: 22133 - DNA, 20 bp, Artificial Sequence
  sgRNA
  Ghsr_7
gcacagcgaactcggtggcg

SEQ ID NO: 22134 - DNA, 20 bp, Artificial Sequence
  sgRNA
  Ghsr_8
ggaactctcatccttcagag

SEQ ID NO: 22135 - DNA, 20 bp, Artificial Sequence
  sgRNA
  Ghsr_9
actgtgctctacagtctcat

SEQ ID NO: 22136 - DNA, 20 bp, Artificial Sequence
  sgRNA
  Ghsr_10
gaagtttgaacacggccacc

SEQ ID NO: 22137 - DNA, 20 bp, Artificial Sequence
  sgRNA
  Ghsr_11
tcagagagtgagtcgttgcc

SEQ ID NO: 22138 - DNA, 20 bp, Artificial Sequence
  sgRNA
  Ghsr_12
gggcccatcttcgtgctggt

SEQ ID NO: 22139 - DNA, 20 bp, Artificial Sequence
  sgRNA
  Ghsr_13
agcaggtcgccgaagttcca

SEQ ID NO: 22140 - DNA, 20 bp, Artificial Sequence
  sgRNA
  Ghsr_14
gatcagtcagtactgcaacc

SEQ ID NO: 22141 - DNA, 20 bp, Artificial Sequence
  sgRNA
  Ghsr_15
aaaacagatatcttcccacg

SEQ ID NO: 22142 - DNA, 20 bp, Artificial Sequence
  sgRNA
  Ghsr_16
catccttgtcatttgggccg

SEQ ID NO: 22143 - DNA, 20 bp, Artificial Sequence
  sgRNA
  Ghsr_17
gatggtgaggaccgtggcgt

SEQ ID NO: 22144 - DNA, 20 bp, Artificial Sequence
  sgRNA
  Ghsr_18
ggataggtagaggttggtgg

SEQ ID NO: 22145 - DNA, 20 bp, Artificial Sequence
  sgRNA
  Ghsr_19
acatcatgtccaagaagtac

SEQ ID NO: 22146 - DNA, 20 bp, Artificial Sequence
  sgRNA
  Ghsr_20
tgctctacagtctcatcggg

SEQ ID NO: 22147 - DNA, 20 bp, Artificial Sequence
  sgRNA
  Ginm1_1
cttaacataacctatgagcg

SEQ ID NO: 22148 - DNA, 20 bp, Artificial Sequence
  sgRNA
  Ginm1_2
tgaggatcttagttctcgag

SEQ ID NO: 22149 - DNA, 20 bp, Artificial Sequence
  sgRNA
  Ginm1_3
tggtttccacattccccatg

SEQ ID NO: 22150 - DNA, 20 bp, Artificial Sequence
  sgRNA
  Ginm1_4
ggctgaccaccaacgcgccc

SEQ ID NO: 22151 - DNA, 20 bp, Artificial Sequence
  sgRNA
  Ginm1_5
ccattccgtaggaatagcgg

SEQ ID NO: 22152 - DNA, 20 bp, Artificial Sequence
  sgRNA
  Ginm1_6
tatgaacagcaacaaccgga

SEQ ID NO: 22153 - DNA, 20 bp, Artificial Sequence
  sgRNA
  Ginm1_7
gggccattccgtaggaatag

SEQ ID NO: 22154 - DNA, 20 bp, Artificial Sequence
  sgRNA
  Ginm1_8
atatacctgtccacgctcat

SEQ ID NO: 22155 - DNA, 20 bp, Artificial Sequence
  sgRNA
  Ginm1_9
gttcatagcgctgccagccg

SEQ ID NO: 22156 - DNA, 20 bp, Artificial Sequence
  sgRNA
  Ginm1_10
cctccgctattcctacggaa

SEQ ID NO: 22157 - DNA, 20 bp, Artificial Sequence
  sgRNA
  Ginm1_11
atttcccgcggcctaatggc

SEQ ID NO: 22158 - DNA, 20 bp, Artificial Sequence
  sgRNA
  Ginm1_12
catcaaaatcgccaagcccg

SEQ ID NO: 22159 - DNA, 20 bp, Artificial Sequence
  sgRNA
  Ginm1_13
acgagccggccattaggccg

SEQ ID NO: 22160 - DNA, 20 bp, Artificial Sequence
  sgRNA
  Ginm1_14
gcgctatgaacagcaacaac

SEQ ID NO: 22161 - DNA, 20 bp, Artificial Sequence
  sgRNA
  Ginm1_15
gcaacctcttccaaaggcaa

SEQ ID NO: 22162 - DNA, 20 bp, Artificial Sequence
  sgRNA
  Ginm1_16
aactaccctgagcaagagtg

SEQ ID NO: 22163 - DNA, 20 bp, Artificial Sequence
  sgRNA
  Ginm1_17
ggatgcctccgctattccta

SEQ ID NO: 22164 - DNA, 20 bp, Artificial Sequence
  sgRNA
  Ginm1_18
gagagactatggaaacccca

SEQ ID NO: 22165 - DNA, 20 bp, Artificial Sequence
  sgRNA
  Ginm1_19
gagctgagaaacctccaagc

SEQ ID NO: 22166 - DNA, 20 bp, Artificial Sequence
  sgRNA
  Ginm1_20
cctatcatcttatacccaga

SEQ ID NO: 22167 - DNA, 20 bp, Artificial Sequence
  sgRNA
  Gipr_1
gggaatgacgaaaagcgcgg

SEQ ID NO: 22168 - DNA, 20 bp, Artificial Sequence
  sgRNA
  Gipr_2
cctgcagatcatgtataccg

SEQ ID NO: 22169 - DNA, 20 bp, Artificial Sequence
  sgRNA
  Gipr_3
ccagcaggcatacatatcga

SEQ ID NO: 22170 - DNA, 20 bp, Artificial Sequence
  sgRNA
  Gipr_4
ctgaggggcagaccaccacg

SEQ ID NO: 22171 - DNA, 20 bp, Artificial Sequence
  sgRNA
  Gipr_5
gcgctggtacagctcccccg

SEQ ID NO: 22172 - DNA, 20 bp, Artificial Sequence
  sgRNA
  Gipr_6
ccagggaatgacgaaaagcg

SEQ ID NO: 22173 - DNA, 20 bp, Artificial Sequence
  sgRNA
  Gipr_7
ggtgcagtcggagatccgcc

SEQ ID NO: 22174 - DNA, 20 bp, Artificial Sequence
  sgRNA
  Gipr_8
aggtacctgacgatcaccca

SEQ ID NO: 22175 - DNA, 20 bp, Artificial Sequence
  sgRNA
  Gipr_9
gggtcatgatctgggccgtg

SEQ ID NO: 22176 - DNA, 20 bp, Artificial Sequence
  sgRNA
  Gipr_10
ggcacatgcagcatcccaga

SEQ ID NO: 22177 - DNA, 20 bp, Artificial Sequence
  sgRNA
  Gipr_11
ctgcagatcatgtataccgt

SEQ ID NO: 22178 - DNA, 20 bp, Artificial Sequence
  sgRNA
  Gipr_12
agggaatgacgaaaagcgcg

SEQ ID NO: 22179 - DNA, 20 bp, Artificial Sequence
  sgRNA
  Gipr_13
gcaacgaagtcaaagccatt

SEQ ID NO: 22180 - DNA, 20 bp, Artificial Sequence
  sgRNA
  Gipr_14
gtatctgccctggttccgtc

SEQ ID NO: 22181 - DNA, 20 bp, Artificial Sequence
  sgRNA
  Gipr_15
agagggcaaggcgttgccaa

SEQ ID NO: 22182 - DNA, 20 bp, Artificial Sequence
  sgRNA
  Gipr_16
ggggcaagacacccgagcag

SEQ ID NO: 22183 - DNA, 20 bp, Artificial Sequence
  sgRNA
  Gipr_17
ctactgcttcatcaacaaag

SEQ ID NO: 22184 - DNA, 20 bp, Artificial Sequence
  sgRNA
  Gipr_18
tgaggggcagaccaccacgg

SEQ ID NO: 22185 - DNA, 20 bp, Artificial Sequence
  sgRNA
  Gipr_19
gcgtgccgagaagctgccgt

SEQ ID NO: 22186 - DNA, 20 bp, Artificial Sequence
  sgRNA
  Gipr_20
gctcaaaggcacagcccggg

SEQ ID NO: 22187 - DNA, 20 bp, Artificial Sequence
  sgRNA
  Gja1_1
tgaacccatagatgtaccac

SEQ ID NO: 22188 - DNA, 20 bp, Artificial Sequence
  sgRNA
  Gja1_2
gggcgttaaggatcgcgtga

SEQ ID NO: 22189 - DNA, 20 bp, Artificial Sequence
  sgRNA
  Gja1_3
gcagaccgacggggtcaacg

SEQ ID NO: 22190 - DNA, 20 bp, Artificial Sequence
  sgRNA
  Gja1_4
attcagagcgagagacacca

SEQ ID NO: 22191 - DNA, 20 bp, Artificial Sequence
  sgRNA
  Gja1_5
gtgaccagcttgtacccagg

SEQ ID NO: 22192 - DNA, 20 bp, Artificial Sequence
  sgRNA
  Gja1_6
aagcctactccacggccgga

SEQ ID NO: 22193 - DNA, 20 bp, Artificial Sequence
  sgRNA
  Gja1_7
gcgcagagcaaaatcgaatg

SEQ ID NO: 22194 - DNA, 20 bp, Artificial Sequence
  sgRNA
  Gja1_8
agaacacgtgagccaagtac

SEQ ID NO: 22195 - DNA, 20 bp, Artificial Sequence
  sgRNA
  Gja1_9
cgacagccacaccttccctc

SEQ ID NO: 22196 - DNA, 20 bp, Artificial Sequence
  sgRNA
  Gja1_10
ctgagcccatccaaagactg

SEQ ID NO: 22197 - DNA, 20 bp, Artificial Sequence
  sgRNA
  Gja1_11
cgtgttctatgtgatgagaa

SEQ ID NO: 22198 - DNA, 20 bp, Artificial Sequence
  sgRNA
  Gja1_12
ctgtcgtcagggaaatcaaa

SEQ ID NO: 22199 - DNA, 20 bp, Artificial Sequence
  sgRNA
  Gja1_13
cgctgtaacactcaacaacc

SEQ ID NO: 22200 - DNA, 20 bp, Artificial Sequence
  sgRNA
  Gja1_14
ggagatccgcagtctttgga

SEQ ID NO: 22201 - DNA, 20 bp, Artificial Sequence
  sgRNA
  Gja1_15
cttgtccagcagcttcccca

SEQ ID NO: 22202 - DNA, 20 bp, Artificial Sequence
  sgRNA
  Gja1_16
caaagtggcgcagaccgacg

SEQ ID NO: 22203 - DNA, 20 bp, Artificial Sequence
  sgRNA
  Gja1_17
gagatccgcagtctttggat

SEQ ID NO: 22204 - DNA, 20 bp, Artificial Sequence
  sgRNA
  Gja1_18
cgctgatccacgatagctaa

SEQ ID NO: 22205 - DNA, 20 bp, Artificial Sequence
  sgRNA
  Gja1_19
ggaagcagtccacctggtgg

SEQ ID NO: 22206 - DNA, 20 bp, Artificial Sequence
  sgRNA
  Gja1_20
cgtcagggaaatcaaacggc

SEQ ID NO: 22207 - DNA, 20 bp, Artificial Sequence
  sgRNA
  Gja3_1
cctccactacgcgatgaccg

SEQ ID NO: 22208 - DNA, 20 bp, Artificial Sequence
  sgRNA
  Gja3_2
tgcgcacgatgtgtagcacg

SEQ ID NO: 22209 - DNA, 20 bp, Artificial Sequence
  sgRNA
  Gja3_3
agaagcggatgtgcgaaatg

SEQ ID NO: 22210 - DNA, 20 bp, Artificial Sequence
  sgRNA
  Gja3_4
tcaagacactcttcgaagtg

SEQ ID NO: 22211 - DNA, 20 bp, Artificial Sequence
  sgRNA
  Gja3_5
gtaataaggtgggaacccga

SEQ ID NO: 22212 - DNA, 20 bp, Artificial Sequence
  sgRNA
  Gja3_6
ccgcccctaacaccagaatg

SEQ ID NO: 22213 - DNA, 20 bp, Artificial Sequence
  sgRNA
  Gja3_7
gacaaccctcagcacggccg

SEQ ID NO: 22214 - DNA, 20 bp, Artificial Sequence
  sgRNA
  Gja3_8
aatgcggaagatgaacagca

SEQ ID NO: 22215 - DNA, 20 bp, Artificial Sequence
  sgRNA
  Gja3_9
tgatttgcagcgcccagaag

SEQ ID NO: 22216 - DNA, 20 bp, Artificial Sequence
  sgRNA
  Gja3_10
ctacagtcatcggcaaagtg

SEQ ID NO: 22217 - DNA, 20 bp, Artificial Sequence
  sgRNA
  Gja3_11
agttctgctctgtcgtcagg

SEQ ID NO: 22218 - DNA, 20 bp, Artificial Sequence
  sgRNA
  Gja3_12
atcaccagcagacttcacag

SEQ ID NO: 22219 - DNA, 20 bp, Artificial Sequence
  sgRNA
  Gja3_13
tggcccagatagatgagggt

SEQ ID NO: 22220 - DNA, 20 bp, Artificial Sequence
  sgRNA
  Gja3_14
tgtgcgaaatggggaaagcg

SEQ ID NO: 22221 - DNA, 20 bp, Artificial Sequence
  sgRNA
  Gja3_15
tgagcttcttccagcccagg

SEQ ID NO: 22222 - DNA, 20 bp, Artificial Sequence
  sgRNA
  Gja3_16
ggctggaagaagctcaagca

SEQ ID NO: 22223 - DNA, 20 bp, Artificial Sequence
  sgRNA
  Gja3_17
gcagaactggaccaggcaag

SEQ ID NO: 22224 - DNA, 20 bp, Artificial Sequence
  sgRNA
  Gja3_18
actacgcgatgaccgtggca

SEQ ID NO: 22225 - DNA, 20 bp, Artificial Sequence
  sgRNA
  Gja3_19
ccgcattctggtgttagggg

SEQ ID NO: 22226 - DNA, 20 bp, Artificial Sequence
  sgRNA
  Gja3_20
cgcgggctccctgtacgcat

SEQ ID NO: 22227 - DNA, 20 bp, Artificial Sequence
  sgRNA
  Gja4_1
ggtccaggaacactcgaccg

SEQ ID NO: 22228 - DNA, 20 bp, Artificial Sequence
  sgRNA
  Gja4_2
acacagcacgctgaccacat

SEQ ID NO: 22229 - DNA, 20 bp, Artificial Sequence
  sgRNA
  Gja4_3
cagcacccagtatcggatgt

SEQ ID NO: 22230 - DNA, 20 bp, Artificial Sequence
  sgRNA
  Gja4_4
cttggccatctgatgttcga

SEQ ID NO: 22231 - DNA, 20 bp, Artificial Sequence
  sgRNA
  Gja4_5
tttgtaaacacagctcccca

SEQ ID NO: 22232 - DNA, 20 bp, Artificial Sequence
  sgRNA
  Gja4_6
catagcagtccacgatgtgg

SEQ ID NO: 22233 - DNA, 20 bp, Artificial Sequence
  sgRNA
  Gja4_7
ctatggctggaccatggagc

SEQ ID NO: 22234 - DNA, 20 bp, Artificial Sequence
  sgRNA
  Gja4_8
ccaccgtgtcccacctacaa

SEQ ID NO: 22235 - DNA, 20 bp, Artificial Sequence
  sgRNA
  Gja4_9
ccaaggacctacatgtagag

SEQ ID NO: 22236 - DNA, 20 bp, Artificial Sequence
  sgRNA
  Gja4_10
gcacacaaacaccggctcca

SEQ ID NO: 22237 - DNA, 20 bp, Artificial Sequence
  sgRNA
  Gja4_11
acacccaccctgatctacct

SEQ ID NO: 22238 - DNA, 20 bp, Artificial Sequence
  sgRNA
  Gja4_12
ttctacctccccatgggcga

SEQ ID NO: 22239 - DNA, 20 bp, Artificial Sequence
  sgRNA
  Gja4_13
ggctgccatcgaacatcaga

SEQ ID NO: 22240 - DNA, 20 bp, Artificial Sequence
  sgRNA
  Gja4_14
cgtcatctacctgtctcggc

SEQ ID NO: 22241 - DNA, 20 bp, Artificial Sequence
  sgRNA
  Gja4_15
ggaactgcagcacccagtat

SEQ ID NO: 22242 - DNA, 20 bp, Artificial Sequence
  sgRNA
  Gja4_16
cggtcgtcttcggattcgtg

SEQ ID NO: 22243 - DNA, 20 bp, Artificial Sequence
  sgRNA
  Gja4_17
cttctacctccccatgggcg

SEQ ID NO: 22244 - DNA, 20 bp, Artificial Sequence
  sgRNA
  Gja4_18
gccgagacaggtagatgacg

SEQ ID NO: 22245 - DNA, 20 bp, Artificial Sequence
  sgRNA
  Gja4_19
ggcctggtcatagcagacgt

SEQ ID NO: 22246 - DNA, 20 bp, Artificial Sequence
  sgRNA
  Gja4_20
gcaggtgaaccagctccagc

SEQ ID NO: 22247 - DNA, 20 bp, Artificial Sequence
  sgRNA
  Gjb1_1
cagggaccataggcgcacgt

SEQ ID NO: 22248 - DNA, 20 bp, Artificial Sequence
  sgRNA
  Gjb1_2
agatgacagacagccatact

SEQ ID NO: 22249 - DNA, 20 bp, Artificial Sequence
  sgRNA
  Gjb1_3
gagctacgtgcattgccacg

SEQ ID NO: 22250 - DNA, 20 bp, Artificial Sequence
  sgRNA
  Gjb1_4
agaaaatgctacggcttgag

SEQ ID NO: 22251 - DNA, 20 bp, Artificial Sequence
  sgRNA
  Gjb1_5
gccgcaccatggcatagccg

SEQ ID NO: 22252 - DNA, 20 bp, Artificial Sequence
  sgRNA
  Gjb1_6
gctctaccccggctatgcca

SEQ ID NO: 22253 - DNA, 20 bp, Artificial Sequence
  sgRNA
  Gjb1_7
catctgcattatcctcaacg

SEQ ID NO: 22254 - DNA, 20 bp, Artificial Sequence
  sgRNA
  Gjb1_8
ggtctatacaccttgctcag

SEQ ID NO: 22255 - DNA, 20 bp, Artificial Sequence
  sgRNA
  Gjb1_9
acacttgaccagccgcacca

SEQ ID NO: 22256 - DNA, 20 bp, Artificial Sequence
  sgRNA
  Gjb1_10
gcttgtattcaggtgagagg

SEQ ID NO: 22257 - DNA, 20 bp, Artificial Sequence
  sgRNA
  Gjb1_11
tccaatccgccctcccgcaa

SEQ ID NO: 22258 - DNA, 20 bp, Artificial Sequence
  sgRNA
  Gjb1_12
tagcagacgctgttgcagcc

SEQ ID NO: 22259 - DNA, 20 bp, Artificial Sequence
  sgRNA
  Gjb1_13
ggaaaccaagataagctgca

SEQ ID NO: 22260 - DNA, 20 bp, Artificial Sequence
  sgRNA
  Gjb1_14
gcagggaccataggcgcacg

SEQ ID NO: 22261 - DNA, 20 bp, Artificial Sequence
  sgRNA
  Gjb1_15
cattatcctcaacgtggcgg

SEQ ID NO: 22262 - DNA, 20 bp, Artificial Sequence
  sgRNA
  Gjb1_16
gagcataaagacagtgaaga

SEQ ID NO: 22263 - DNA, 20 bp, Artificial Sequence
  sgRNA
  Gjb1_17
acaccacctccgccacgttg

SEQ ID NO: 22264 - DNA, 20 bp, Artificial Sequence
  sgRNA
  Gjb1_18
cttcccctgccccaacacag

SEQ ID NO: 22265 - DNA, 20 bp, Artificial Sequence
  sgRNA
  Gjb1_19
ggctgctgagagcgtgtggg

SEQ ID NO: 22266 - DNA, 20 bp, Artificial Sequence
  sgRNA
  Gjb1_20
gctgttgcagcccggctgga

SEQ ID NO: 22267 - DNA, 20 bp, Artificial Sequence
  sgRNA
  Gjb2_1
ccgcatcatgatcctcgtgg

SEQ ID NO: 22268 - DNA, 20 bp, Artificial Sequence
  sgRNA
  Gjb2_2
ggtggtgtaggtccaccaca

SEQ ID NO: 22269 - DNA, 20 bp, Artificial Sequence
  sgRNA
  Gjb2_3
cattggaaagatctggctca

SEQ ID NO: 22270 - DNA, 20 bp, Artificial Sequence
  sgRNA
  Gjb2_4
acttccccatctctcacatc

SEQ ID NO: 22271 - DNA, 20 bp, Artificial Sequence
  sgRNA
  Gjb2_5
cctcctttgcagccaccacg

SEQ ID NO: 22272 - DNA, 20 bp, Artificial Sequence
  sgRNA
  Gjb2_6
ccaccacgaggatcatgatg

SEQ ID NO: 22273 - DNA, 20 bp, Artificial Sequence
  sgRNA
  Gjb2_7
agacacagaaatcataaaca

SEQ ID NO: 22274 - DNA, 20 bp, Artificial Sequence
  sgRNA
  Gjb2_8
ttggccctgccccaatacag

SEQ ID NO: 22275 - DNA, 20 bp, Artificial Sequence
  sgRNA
  Gjb2_9
tccgtatcgaagggtccctg

SEQ ID NO: 22276 - DNA, 20 bp, Artificial Sequence
  sgRNA
  Gjb2_10
agacggcttcaaagatgacc

SEQ ID NO: 22277 - DNA, 20 bp, Artificial Sequence
  sgRNA
  Gjb2_11
agtgtttgttgacacccccg

SEQ ID NO: 22278 - DNA, 20 bp, Artificial Sequence
  sgRNA
  Gjb2_12
gatgacccggaagaagatgc

SEQ ID NO: 22279 - DNA, 20 bp, Artificial Sequence
  sgRNA
  Gjb2_13
cccagaaggtccgtatcgaa

SEQ ID NO: 22280 - DNA, 20 bp, Artificial Sequence
  sgRNA
  Gjb2_14
ccacatgcatagctaccagg

SEQ ID NO: 22281 - DNA, 20 bp, Artificial Sequence
  sgRNA
  Gjb2_15
gtaaaagacgtacatgaaga

SEQ ID NO: 22282 - DNA, 20 bp, Artificial Sequence
  sgRNA
  Gjb2_16
tagctatgcatgtggcctac

SEQ ID NO: 22283 - DNA, 20 bp, Artificial Sequence
  sgRNA
  Gjb2_17
gagcgtgttgcagacaaaat

SEQ ID NO: 22284 - DNA, 20 bp, Artificial Sequence
  sgRNA
  Gjb2_18
tgaagcagtccactgtattg

SEQ ID NO: 22285 - DNA, 20 bp, Artificial Sequence
  sgRNA
  Gjb2_19
tagcatacattcttgcagcc

SEQ ID NO: 22286 - DNA, 20 bp, Artificial Sequence
  sgRNA
  Gjb2_20
cacatgcatagctaccagga

SEQ ID NO: 22287 - DNA, 20 bp, Artificial Sequence
  sgRNA
  Gjb3_1
cctcgcggtaggctacatgc

SEQ ID NO: 22288 - DNA, 20 bp, Artificial Sequence
  sgRNA
  Gjb3_2
taaacaagtaggtccaccac

SEQ ID NO: 22289 - DNA, 20 bp, Artificial Sequence
  sgRNA
  Gjb3_3
gaagttgtcatagcacacgt

SEQ ID NO: 22290 - DNA, 20 bp, Artificial Sequence
  sgRNA
  Gjb3_4
ccgagcgatgtagcaatcca

SEQ ID NO: 22291 - DNA, 20 bp, Artificial Sequence
  sgRNA
  Gjb3_5
tagcacacgttggtacagcc

SEQ ID NO: 22292 - DNA, 20 bp, Artificial Sequence
  sgRNA
  Gjb3_6
gtaaagaccttcttctccgt

SEQ ID NO: 22293 - DNA, 20 bp, Artificial Sequence
  sgRNA
  Gjb3_7
atcatgcgaggcataagcaa

SEQ ID NO: 22294 - DNA, 20 bp, Artificial Sequence
  sgRNA
  Gjb3_8
aagctccaagacctattgag

SEQ ID NO: 22295 - DNA, 20 bp, Artificial Sequence
  sgRNA
  Gjb3_9
cctgcatgtagcctaccgcg

SEQ ID NO: 22296 - DNA, 20 bp, Artificial Sequence
  sgRNA
  Gjb3_10
cgtgacgaagatgagctgca

SEQ ID NO: 22297 - DNA, 20 bp, Artificial Sequence
  sgRNA
  Gjb3_11
ctcgtcaccccacacacgct

SEQ ID NO: 22298 - DNA, 20 bp, Artificial Sequence
  sgRNA
  Gjb3_12
actggttcacgccactcaat

SEQ ID NO: 22299 - DNA, 20 bp, Artificial Sequence
  sgRNA
  Gjb3_13
ccagatgcgcccaaatgccg

SEQ ID NO: 22300 - DNA, 20 bp, Artificial Sequence
  sgRNA
  Gjb3_14
tgtacgttctccacacgctc

SEQ ID NO: 22301 - DNA, 20 bp, Artificial Sequence
  sgRNA
  Gjb3_15
tgcaggatgaccagcataga

SEQ ID NO: 22302 - DNA, 20 bp, Artificial Sequence
  sgRNA
  Gjb3_16
gaagcatcgccagaagcacg

SEQ ID NO: 22303 - DNA, 20 bp, Artificial Sequence
  sgRNA
  Gjb3_17
gctccccgaagtcctccagc

SEQ ID NO: 22304 - DNA, 20 bp, Artificial Sequence
  sgRNA
  Gjb3_18
agagcgtgtggagaacgtac

SEQ ID NO: 22305 - DNA, 20 bp, Artificial Sequence
  sgRNA
  Gjb3_19
atcttccacaggatcatgcg

SEQ ID NO: 22306 - DNA, 20 bp, Artificial Sequence
  sgRNA
  Gjb3_20
ttatgcctcgcatgatcctg

SEQ ID NO: 22307 - DNA, 20 bp, Artificial Sequence
  sgRNA
  Gjb4_1
acagagcaagctaccactcg

SEQ ID NO: 22308 - DNA, 20 bp, Artificial Sequence
  sgRNA
  Gjb4_2
actcatcatagcagacgttg

SEQ ID NO: 22309 - DNA, 20 bp, Artificial Sequence
  sgRNA
  Gjb4_3
cacatgcatgaccactaaca

SEQ ID NO: 22310 - DNA, 20 bp, Artificial Sequence
  sgRNA
  Gjb4_4
agaccacagacagccagatg

SEQ ID NO: 22311 - DNA, 20 bp, Artificial Sequence
  sgRNA
  Gjb4_5
ctttggagatcacatacggt

SEQ ID NO: 22312 - DNA, 20 bp, Artificial Sequence
  sgRNA
  Gjb4_6
ggatcacgctctcatcttga

SEQ ID NO: 22313 - DNA, 20 bp, Artificial Sequence
  sgRNA
  Gjb4_7
tattctactcaacctcagtg

SEQ ID NO: 22314 - DNA, 20 bp, Artificial Sequence
  sgRNA
  Gjb4_8
gcgtgatcctaacaaaggcc

SEQ ID NO: 22315 - DNA, 20 bp, Artificial Sequence
  sgRNA
  Gjb4_9
ggactatgacatgccccgag

SEQ ID NO: 22316 - DNA, 20 bp, Artificial Sequence
  sgRNA
  Gjb4_10
atacacacctgcatccaccg

SEQ ID NO: 22317 - DNA, 20 bp, Artificial Sequence
  sgRNA
  Gjb4_11
ctggaagctttccggcgccg

SEQ ID NO: 22318 - DNA, 20 bp, Artificial Sequence
  sgRNA
  Gjb4_12
tcacagagcaagctaccact

SEQ ID NO: 22319 - DNA, 20 bp, Artificial Sequence
  sgRNA
  Gjb4_13
tggtgtgaacaagtactcca

SEQ ID NO: 22320 - DNA, 20 bp, Artificial Sequence
  sgRNA
  Gjb4_14
ggcgccggaaagcttccagg

SEQ ID NO: 22321 - DNA, 20 bp, Artificial Sequence
  sgRNA
  Gjb4_15
ggtgaccaggatgagctgca

SEQ ID NO: 22322 - DNA, 20 bp, Artificial Sequence
  sgRNA
  Gjb4_16
ccgtatgtgatctccaaagg

SEQ ID NO: 22323 - DNA, 20 bp, Artificial Sequence
  sgRNA
  Gjb4_17
cctttggagatcacatacgg

SEQ ID NO: 22324 - DNA, 20 bp, Artificial Sequence
  sgRNA
  Gjb4_18
cctcctttggagatcacata

SEQ ID NO: 22325 - DNA, 20 bp, Artificial Sequence
  sgRNA
  Gjb4_19
ggtgtgggacgacgatcaaa

SEQ ID NO: 22326 - DNA, 20 bp, Artificial Sequence
  sgRNA
  Gjb4_20
ccaggtagacgacctcactg

SEQ ID NO: 22327 - DNA, 20 bp, Artificial Sequence
  sgRNA
  Gjb5_1
agaggcgcacgtgagacacg

SEQ ID NO: 22328 - DNA, 20 bp, Artificial Sequence
  sgRNA
  Gjb5_2
tatatctgggatagaatgcg

SEQ ID NO: 22329 - DNA, 20 bp, Artificial Sequence
  sgRNA
  Gjb5_3
gcatgaccacaagcaaagag

SEQ ID NO: 22330 - DNA, 20 bp, Artificial Sequence
  sgRNA
  Gjb5_4
ggagccgtgtcccaacacag

SEQ ID NO: 22331 - DNA, 20 bp, Artificial Sequence
  sgRNA
  Gjb5_5
ctaggtagatcagctccaca

SEQ ID NO: 22332 - DNA, 20 bp, Artificial Sequence
  sgRNA
  Gjb5_6
tgttgggacacggctccgca

SEQ ID NO: 22333 - DNA, 20 bp, Artificial Sequence
  sgRNA
  Gjb5_7
catgcatgtggcctatcgaa

SEQ ID NO: 22334 - DNA, 20 bp, Artificial Sequence
  sgRNA
  Gjb5_8
gcacttgaccatagaaggga

SEQ ID NO: 22335 - DNA, 20 bp, Artificial Sequence
  sgRNA
  Gjb5_9
tagcagacattggtacagcc

SEQ ID NO: 22336 - DNA, 20 bp, Artificial Sequence
  sgRNA
  Gjb5_10
agacagccagatgcgaccaa

SEQ ID NO: 22337 - DNA, 20 bp, Artificial Sequence
  sgRNA
  Gjb5_11
tgatctacctagtgattaag

SEQ ID NO: 22338 - DNA, 20 bp, Artificial Sequence
  sgRNA
  Gjb5_12
tcagctccacaaggttaagc

SEQ ID NO: 22339 - DNA, 20 bp, Artificial Sequence
  sgRNA
  Gjb5_13
ggtgacagctgagcgcgtgt

SEQ ID NO: 22340 - DNA, 20 bp, Artificial Sequence
  sgRNA
  Gjb5_14
cttctctcgagcctttcgat

SEQ ID NO: 22341 - DNA, 20 bp, Artificial Sequence
  sgRNA
  Gjb5_15
gggcggtctggtaacagagg

SEQ ID NO: 22342 - DNA, 20 bp, Artificial Sequence
  sgRNA
  Gjb5_16
catggcacttgaccatagaa

SEQ ID NO: 22343 - DNA, 20 bp, Artificial Sequence
  sgRNA
  Gjb5_17
ggctcgagagaagaagtacc

SEQ ID NO: 22344 - DNA, 20 bp, Artificial Sequence
  sgRNA
  Gjb5_18
gagtccaccccgcttcttgc

SEQ ID NO: 22345 - DNA, 20 bp, Artificial Sequence
  sgRNA
  Gjb5_19
gcatggcacttgaccataga

SEQ ID NO: 22346 - DNA, 20 bp, Artificial Sequence
  sgRNA
  Gjb5_20
tcttcacgtgggctcgaggg

SEQ ID NO: 22347 - DNA, 20 bp, Artificial Sequence
  sgRNA
  Gjb6_1
ctgcccgaaagtttatacgt

SEQ ID NO: 22348 - DNA, 20 bp, Artificial Sequence
  sgRNA
  Gjb6_2
ccaccactaggatcatgact

SEQ ID NO: 22349 - DNA, 20 bp, Artificial Sequence
  sgRNA
  Gjb6_3
gctggtgtacgtccaccaca

SEQ ID NO: 22350 - DNA, 20 bp, Artificial Sequence
  sgRNA
  Gjb6_4
acaagcactctaccagcata

SEQ ID NO: 22351 - DNA, 20 bp, Artificial Sequence
  sgRNA
  Gjb6_5
gtaggtggtacccattgtag

SEQ ID NO: 22352 - DNA, 20 bp, Artificial Sequence
  sgRNA
  Gjb6_6
tttccgagtcatgatcctag

SEQ ID NO: 22353 - DNA, 20 bp, Artificial Sequence
  sgRNA
  Gjb6_7
tctgcaacactctgcagcca

SEQ ID NO: 22354 - DNA, 20 bp, Artificial Sequence
  sgRNA
  Gjb6_8
tagcagacgttcttgcaccc

SEQ ID NO: 22355 - DNA, 20 bp, Artificial Sequence
  sgRNA
  Gjb6_9
tgttctacttcctctacaat

SEQ ID NO: 22356 - DNA, 20 bp, Artificial Sequence
  sgRNA
  Gjb6_10
actgcccgaaagtttatacg

SEQ ID NO: 22357 - DNA, 20 bp, Artificial Sequence
  sgRNA
  Gjb6_11
caatgggtaccacctaccct

SEQ ID NO: 22358 - DNA, 20 bp, Artificial Sequence
  sgRNA
  Gjb6_12
atgccacatttcagtaccca

SEQ ID NO: 22359 - DNA, 20 bp, Artificial Sequence
  sgRNA
  Gjb6_13
agacacaaagatcagctgca

SEQ ID NO: 22360 - DNA, 20 bp, Artificial Sequence
  sgRNA
  Gjb6_14
gatgcggaagaaaatgctgc

SEQ ID NO: 22361 - DNA, 20 bp, Artificial Sequence
  sgRNA
  Gjb6_15
agagccggatgtgagacacc

SEQ ID NO: 22362 - DNA, 20 bp, Artificial Sequence
  sgRNA
  Gjb6_16
ccgagtcatgatcctagtgg

SEQ ID NO: 22363 - DNA, 20 bp, Artificial Sequence
  sgRNA
  Gjb6_17
ctaccagcatagggaaggtg

SEQ ID NO: 22364 - DNA, 20 bp, Artificial Sequence
  sgRNA
  Gjb6_18
gggaccctgcacaccgtcat

SEQ ID NO: 22365 - DNA, 20 bp, Artificial Sequence
  sgRNA
  Gjb6_19
cctgttggtggccatgcacg

SEQ ID NO: 22366 - DNA, 20 bp, Artificial Sequence
  sgRNA
  Gjb6_20
atttcagtacccagggtagg

SEQ ID NO: 22367 - DNA, 20 bp, Artificial Sequence
  sgRNA
  Gjc2_1
gcacctcgaagccgtacagt

SEQ ID NO: 22368 - DNA, 20 bp, Artificial Sequence
  sgRNA
  Gjc2_2
cgacggctgtcagcacaatg

SEQ ID NO: 22369 - DNA, 20 bp, Artificial Sequence
  sgRNA
  Gjc2_3
gttccgaggcccgcgccaag

SEQ ID NO: 22370 - DNA, 20 bp, Artificial Sequence
  sgRNA
  Gjc2_4
tagtggattgcttcgtgtcg

SEQ ID NO: 22371 - DNA, 20 bp, Artificial Sequence
  sgRNA
  Gjc2_5
gctcaatgcaacctctcggg

SEQ ID NO: 22372 - DNA, 20 bp, Artificial Sequence
  sgRNA
  Gjc2_6
atagatggactcaccaccga

SEQ ID NO: 22373 - DNA, 20 bp, Artificial Sequence
  sgRNA
  Gjc2_7
tagcagacgttgtcacaacc

SEQ ID NO: 22374 - DNA, 20 bp, Artificial Sequence
  sgRNA
  Gjc2_8
cgaagcaatccactacgtgg

SEQ ID NO: 22375 - DNA, 20 bp, Artificial Sequence
  sgRNA
  Gjc2_9
gcattgagcccagcgcacgg

SEQ ID NO: 22376 - DNA, 20 bp, Artificial Sequence
  sgRNA
  Gjc2_10
gtacctactgtacggcttcg

SEQ ID NO: 22377 - DNA, 20 bp, Artificial Sequence
  sgRNA
  Gjc2_11
gttgcattgagcccagcgca

SEQ ID NO: 22378 - DNA, 20 bp, Artificial Sequence
  sgRNA
  Gjc2_12
gcgtctgcgctcctgttccg

SEQ ID NO: 22379 - DNA, 20 bp, Artificial Sequence
  sgRNA
  Gjc2_13
cctcctccgtgtcttctccg

SEQ ID NO: 22380 - DNA, 20 bp, Artificial Sequence
  sgRNA
  Gjc2_14
ccagccttgcccccacgtag

SEQ ID NO: 22381 - DNA, 20 bp, Artificial Sequence
  sgRNA
  Gjc2_15
gctcagctgcacgcaccacc

SEQ ID NO: 22382 - DNA, 20 bp, Artificial Sequence
  sgRNA
  Gjc2_16
agtgcgcaggatgctgtgcg

SEQ ID NO: 22383 - DNA, 20 bp, Artificial Sequence
  sgRNA
  Gjc2_17
ggctcaatgcaacctctcgg

SEQ ID NO: 22384 - DNA, 20 bp, Artificial Sequence
  sgRNA
  Gjc2_18
acaccttctgtcatgtacct

SEQ ID NO: 22385 - DNA, 20 bp, Artificial Sequence
  sgRNA
  Gjc2_19
gtcgcggccgaccgagaaga

SEQ ID NO: 22386 - DNA, 20 bp, Artificial Sequence
  sgRNA
  Gjc2_20
acaactggccactaagccca

SEQ ID NO: 22387 - DNA, 20 bp, Artificial Sequence
  sgRNA
  Gjc3_1
tagcaaaggggatcatagca

SEQ ID NO: 22388 - DNA, 20 bp, Artificial Sequence
  sgRNA
  Gjc3_2
aaagccacataaatggcact

SEQ ID NO: 22389 - DNA, 20 bp, Artificial Sequence
  sgRNA
  Gjc3_3
agacggaatcccatgagcat

SEQ ID NO: 22390 - DNA, 20 bp, Artificial Sequence
  sgRNA
  Gjc3_4
tcatgtgattggatactggg

SEQ ID NO: 22391 - DNA, 20 bp, Artificial Sequence
  sgRNA
  Gjc3_5
tcatcattgccgaaaacccc

SEQ ID NO: 22392 - DNA, 20 bp, Artificial Sequence
  sgRNA
  Gjc3_6
gtacagccatcagaatgact

SEQ ID NO: 22393 - DNA, 20 bp, Artificial Sequence
  sgRNA
  Gjc3_7
catcatgtttgggatcagcg

SEQ ID NO: 22394 - DNA, 20 bp, Artificial Sequence
  sgRNA
  Gjc3_8
ggtgttcagtacaatctgta

SEQ ID NO: 22395 - DNA, 20 bp, Artificial Sequence
  sgRNA
  Gjc3_9
ctccaccactgacaattcat

SEQ ID NO: 22396 - DNA, 20 bp, Artificial Sequence
  sgRNA
  Gjc3_10
aagagacccagattagcaaa

SEQ ID NO: 22397 - DNA, 20 bp, Artificial Sequence
  sgRNA
  Gjc3_11
ggaagatggtcttctcagag

SEQ ID NO: 22398 - DNA, 20 bp, Artificial Sequence
  sgRNA
  Gjc3_12
gtatcatgtgattggatact

SEQ ID NO: 22399 - DNA, 20 bp, Artificial Sequence
  sgRNA
  Gjc3_13
gcggaagacatcatagcaaa

SEQ ID NO: 22400 - DNA, 20 bp, Artificial Sequence
  sgRNA
  Gjc3_14
ggccttccaagtcattctga

SEQ ID NO: 22401 - DNA, 20 bp, Artificial Sequence
  sgRNA
  Gjc3_15
tggagttgccaatcaagtgc

SEQ ID NO: 22402 - DNA, 20 bp, Artificial Sequence
  sgRNA
  Gjc3_16
caggttcctgagacagctat

SEQ ID NO: 22403 - DNA, 20 bp, Artificial Sequence
  sgRNA
  Gjc3_17
gaagaaggaagcgccccaca

SEQ ID NO: 22404 - DNA, 20 bp, Artificial Sequence
  sgRNA
  Gjc3_18
atatgtcatttagggcagcc

SEQ ID NO: 22405 - DNA, 20 bp, Artificial Sequence
  sgRNA
  Gjc3_19
caggttgtgctgccaataca

SEQ ID NO: 22406 - DNA, 20 bp, Artificial Sequence
  sgRNA
  Gjc3_20
tgtcgtgaggatccttgtat

SEQ ID NO: 22407 - DNA, 20 bp, Artificial Sequence
  sgRNA
  Gjd2_1
agcactccactatgattggg

SEQ ID NO: 22408 - DNA, 20 bp, Artificial Sequence
  sgRNA
  Gjd2_2
gaccctgctgagtctatagg

SEQ ID NO: 22409 - DNA, 20 bp, Artificial Sequence
  sgRNA
  Gjd2_3
tagggtgttgcacacaaaca

SEQ ID NO: 22410 - DNA, 20 bp, Artificial Sequence
  sgRNA
  Gjd2_4
gagcatttcgaaacaccact

SEQ ID NO: 22411 - DNA, 20 bp, Artificial Sequence
  sgRNA
  Gjd2_5
ccgcttctacatcatccaag

SEQ ID NO: 22412 - DNA, 20 bp, Artificial Sequence
  sgRNA
  Gjd2_6
tcagtgttcccaatttcggc

SEQ ID NO: 22413 - DNA, 20 bp, Artificial Sequence
  sgRNA
  Gjd2_7
gtacaccgtctcccctacaa

SEQ ID NO: 22414 - DNA, 20 bp, Artificial Sequence
  sgRNA
  Gjd2_8
gggatggcggaagatcaaac

SEQ ID NO: 22415 - DNA, 20 bp, Artificial Sequence
  sgRNA
  Gjd2_9
agtggagtgctgctgcaccg

SEQ ID NO: 22416 - DNA, 20 bp, Artificial Sequence
  sgRNA
  Gjd2_10
ccgttacccctgcatcaagg

SEQ ID NO: 22417 - DNA, 20 bp, Artificial Sequence
  sgRNA
  Gjd2_11
tatatggcttcagtgttcca

SEQ ID NO: 22418 - DNA, 20 bp, Artificial Sequence
  sgRNA
  Gjd2_12
gtgtgcaacaccctacagcc

SEQ ID NO: 22419 - DNA, 20 bp, Artificial Sequence
  sgRNA
  Gjd2_13
agatcaccaccacagtcaac

SEQ ID NO: 22420 - DNA, 20 bp, Artificial Sequence
  sgRNA
  Gjd2_14
gtccccctatagactcagca

SEQ ID NO: 22421 - DNA, 20 bp, Artificial Sequence
  sgRNA
  Gjd2_15
ccgccaagcagcgagaacgc

SEQ ID NO: 22422 - DNA, 20 bp, Artificial Sequence
  sgRNA
  Gjd2_16
cattctacctccttgatgca

SEQ ID NO: 22423 - DNA, 20 bp, Artificial Sequence
  sgRNA
  Gjd2_17
tagcaggcctggttacagcc

SEQ ID NO: 22424 - DNA, 20 bp, Artificial Sequence
  sgRNA
  Gjd2_18
aaattgggaacactgactcg

SEQ ID NO: 22425 - DNA, 20 bp, Artificial Sequence
  sgRNA
  Gjd2_19
gactgagtcctgccgaaatt

SEQ ID NO: 22426 - DNA, 20 bp, Artificial Sequence
  sgRNA
  Gjd2_20
ggagaggctgctggaagccg

SEQ ID NO: 22427 - DNA, 20 bp, Artificial Sequence
  sgRNA
  Gldn_1
aatgttcagtcacccaaatg

SEQ ID NO: 22428 - DNA, 20 bp, Artificial Sequence
  sgRNA
  Gldn_2
gctgtccatctgatccattg

SEQ ID NO: 22429 - DNA, 20 bp, Artificial Sequence
  sgRNA
  Gldn_3
tggagccaccggaaatccag

SEQ ID NO: 22430 - DNA, 20 bp, Artificial Sequence
  sgRNA
  Gldn_4
catacccaatgatgatacct

SEQ ID NO: 22431 - DNA, 20 bp, Artificial Sequence
  sgRNA
  Gldn_5
attgtggcctggtaacccgc

SEQ ID NO: 22432 - DNA, 20 bp, Artificial Sequence
  sgRNA
  Gldn_6
tcatgtcctggctctccgca

SEQ ID NO: 22433 - DNA, 20 bp, Artificial Sequence
  sgRNA
  Gldn_7
ggtaacccgccggctcctgg

SEQ ID NO: 22434 - DNA, 20 bp, Artificial Sequence
  sgRNA
  Gldn_8
gatgatgatgacctactcca

SEQ ID NO: 22435 - DNA, 20 bp, Artificial Sequence
  sgRNA
  Gldn_9
tcacagacaccaaagatacg

SEQ ID NO: 22436 - DNA, 20 bp, Artificial Sequence
  sgRNA
  Gldn_10
ccactggcacagcacgaaca

SEQ ID NO: 22437 - DNA, 20 bp, Artificial Sequence
  sgRNA
  Gldn_11
ccagtggcgggggttaagcg

SEQ ID NO: 22438 - DNA, 20 bp, Artificial Sequence
  sgRNA
  Gldn_12
tgaacacgtttggtggccga

SEQ ID NO: 22439 - DNA, 20 bp, Artificial Sequence
  sgRNA
  Gldn_13
ggcaatgccttcatagcccg

SEQ ID NO: 22440 - DNA, 20 bp, Artificial Sequence
  sgRNA
  Gldn_14
cacagacaccaaagatacga

SEQ ID NO: 22441 - DNA, 20 bp, Artificial Sequence
  sgRNA
  Gldn_15
gctgtccgcactgaacgccg

SEQ ID NO: 22442 - DNA, 20 bp, Artificial Sequence
  sgRNA
  Gldn_16
gcctgcgtcacacatccgtg

SEQ ID NO: 22443 - DNA, 20 bp, Artificial Sequence
  sgRNA
  Gldn_17
agatcagcatttatactcgt

SEQ ID NO: 22444 - DNA, 20 bp, Artificial Sequence
  sgRNA
  Gldn_18
attcggccagaaaggcgcgt

SEQ ID NO: 22445 - DNA, 20 bp, Artificial Sequence
  sgRNA
  Gldn_19
gcccggcgcacgactcaatt

SEQ ID NO: 22446 - DNA, 20 bp, Artificial Sequence
  sgRNA
  Gldn_20
gcaatgccttcatagcccga

SEQ ID NO: 22447 - DNA, 20 bp, Artificial Sequence
  sgRNA
  Glipr1_1
tttgccagatataacaaacg

SEQ ID NO: 22448 - DNA, 20 bp, Artificial Sequence
  sgRNA
  Glipr1_2
atgtacagcatattccgggc

SEQ ID NO: 22449 - DNA, 20 bp, Artificial Sequence
  sgRNA
  Glipr1_3
ccagatattctctcccaggg

SEQ ID NO: 22450 - DNA, 20 bp, Artificial Sequence
  sgRNA
  Glipr1_4
tgtctgtggccattatactc

SEQ ID NO: 22451 - DNA, 20 bp, Artificial Sequence
  sgRNA
  Glipr1_5
gtatccgtgaatgcagctgt

SEQ ID NO: 22452 - DNA, 20 bp, Artificial Sequence
  sgRNA
  Glipr1_6
cgtgagacctggtctcgtcg

SEQ ID NO: 22453 - DNA, 20 bp, Artificial Sequence
  sgRNA
  Glipr1_7
ataccaggcagagatggctg

SEQ ID NO: 22454 - DNA, 20 bp, Artificial Sequence
  sgRNA
  Glipr1_8
aagccagatattctctccca

SEQ ID NO: 22455 - DNA, 20 bp, Artificial Sequence
  sgRNA
  Glipr1_9
tagcccaaattgcaaaagca

SEQ ID NO: 22456 - DNA, 20 bp, Artificial Sequence
  sgRNA
  Glipr1_10
atatttgtgctttacccaga

SEQ ID NO: 22457 - DNA, 20 bp, Artificial Sequence
  sgRNA
  Glipr1_11
ccttgctgtgatagtctgga

SEQ ID NO: 22458 - DNA, 20 bp, Artificial Sequence
  sgRNA
  Glipr1_12
gagatgtgtatctgttacgc

SEQ ID NO: 22459 - DNA, 20 bp, Artificial Sequence
  sgRNA
  Glipr1_13
tatcctcagccatctctgcc

SEQ ID NO: 22460 - DNA, 20 bp, Artificial Sequence
  sgRNA
  Glipr1_14
ccttgcttatatggccacgt

SEQ ID NO: 22461 - DNA, 20 bp, Artificial Sequence
  sgRNA
  Glipr1_15
gtgagacctggtctcgtcgt

SEQ ID NO: 22462 - DNA, 20 bp, Artificial Sequence
  sgRNA
  Glipr1_16
ccatccagactatcacagca

SEQ ID NO: 22463 - DNA, 20 bp, Artificial Sequence
  sgRNA
  Glipr1_17
gtgcttaatttcttcatacc

SEQ ID NO: 22464 - DNA, 20 bp, Artificial Sequence
  sgRNA
  Glipr1_18
atataaaatttgctccatta

SEQ ID NO: 22465 - DNA, 20 bp, Artificial Sequence
  sgRNA
  Glipr1_19
tgtctgttataattaccatc

SEQ ID NO: 22466 - DNA, 20 bp, Artificial Sequence
  sgRNA
  Glipr1_20
actctgtcgattatccagac

SEQ ID NO: 22467 - DNA, 20 bp, Artificial Sequence
  sgRNA
  Glp1r_1
agaaatggagagaataccgg

SEQ ID NO: 22468 - DNA, 20 bp, Artificial Sequence
  sgRNA
  Glp1r_2
cctgtacattatctacacag

SEQ ID NO: 22469 - DNA, 20 bp, Artificial Sequence
  sgRNA
  Glp1r_3
acattcacgaaggaacctgg

SEQ ID NO: 22470 - DNA, 20 bp, Artificial Sequence
  sgRNA
  Glp1r_4
cactccgacaggtccctcca

SEQ ID NO: 22471 - DNA, 20 bp, Artificial Sequence
  sgRNA
  Glp1r_5
catgggataacgaacagcag

SEQ ID NO: 22472 - DNA, 20 bp, Artificial Sequence
  sgRNA
  Glp1r_6
gcatgagcaggaacaccagt

SEQ ID NO: 22473 - DNA, 20 bp, Artificial Sequence
  sgRNA
  Glp1r_7
cgtgctatacatccacttga

SEQ ID NO: 22474 - DNA, 20 bp, Artificial Sequence
  sgRNA
  Glp1r_8
ggactctctaggctgccgac

SEQ ID NO: 22475 - DNA, 20 bp, Artificial Sequence
  sgRNA
  Glp1r_9
ggggcagctgacattcacga

SEQ ID NO: 22476 - DNA, 20 bp, Artificial Sequence
  sgRNA
  Glp1r_10
gcagtgccagcgtttcctca

SEQ ID NO: 22477 - DNA, 20 bp, Artificial Sequence
  sgRNA
  Glp1r_11
agtgtgaagagtctaagcga

SEQ ID NO: 22478 - DNA, 20 bp, Artificial Sequence
  sgRNA
  Glp1r_12
gtgatggacgaacacgcccg

SEQ ID NO: 22479 - DNA, 20 bp, Artificial Sequence
  sgRNA
  Glp1r_13
cctcaagtggatgtatagca

SEQ ID NO: 22480 - DNA, 20 bp, Artificial Sequence
  sgRNA
  Glp1r_14
gagtgtgaagagtctaagcg

SEQ ID NO: 22481 - DNA, 20 bp, Artificial Sequence
  sgRNA
  Glp1r_15
tgatgactatgcctgctggc

SEQ ID NO: 22482 - DNA, 20 bp, Artificial Sequence
  sgRNA
  Glp1r_16
gctgctgttcgttatcccat

SEQ ID NO: 22483 - DNA, 20 bp, Artificial Sequence
  sgRNA
  Glp1r_17
acgccgatagcaaagagaat

SEQ ID NO: 22484 - DNA, 20 bp, Artificial Sequence
  sgRNA
  Glp1r_18
ggcgtgttcgtccatcacaa

SEQ ID NO: 22485 - DNA, 20 bp, Artificial Sequence
  sgRNA
  Glp1r_19
tagactcttcacactccgac

SEQ ID NO: 22486 - DNA, 20 bp, Artificial Sequence
  sgRNA
  Glp1r_20
gtgtgaagagtctaagcgag

SEQ ID NO: 22487 - DNA, 20 bp, Artificial Sequence
  sgRNA
  Glp2r_1
tctacaactcttactccagg

SEQ ID NO: 22488 - DNA, 20 bp, Artificial Sequence
  sgRNA
  Glp2r_2
taaggtacgtacttaccaga

SEQ ID NO: 22489 - DNA, 20 bp, Artificial Sequence
  sgRNA
  Glp2r_3
cttgctcggacaaaaatcca

SEQ ID NO: 22490 - DNA, 20 bp, Artificial Sequence
  sgRNA
  Glp2r_4
gttgtggttgtactcaccga

SEQ ID NO: 22491 - DNA, 20 bp, Artificial Sequence
  sgRNA
  Glp2r_5
atgatcccgcaggttcccag

SEQ ID NO: 22492 - DNA, 20 bp, Artificial Sequence
  sgRNA
  Glp2r_6
tgttccaagaagctgtcgga

SEQ ID NO: 22493 - DNA, 20 bp, Artificial Sequence
  sgRNA
  Glp2r_7
gtacggctttgccagtagag

SEQ ID NO: 22494 - DNA, 20 bp, Artificial Sequence
  sgRNA
  Glp2r_8
ggtacccatccacatagtcg

SEQ ID NO: 22495 - DNA, 20 bp, Artificial Sequence
  sgRNA
  Glp2r_9
ctagccccgactatgtggat

SEQ ID NO: 22496 - DNA, 20 bp, Artificial Sequence
  sgRNA
  Glp2r_10
gacttgctcgagaaaccttc

SEQ ID NO: 22497 - DNA, 20 bp, Artificial Sequence
  sgRNA
  Glp2r_11
gcagatctcatcatgtcaca

SEQ ID NO: 22498 - DNA, 20 bp, Artificial Sequence
  sgRNA
  Glp2r_12
gctgtggcccaagtacctgg

SEQ ID NO: 22499 - DNA, 20 bp, Artificial Sequence
  sgRNA
  Glp2r_13
tctagccccgactatgtgga

SEQ ID NO: 22500 - DNA, 20 bp, Artificial Sequence
  sgRNA
  Glp2r_14
agtggcgagctaataagaag

SEQ ID NO: 22501 - DNA, 20 bp, Artificial Sequence
  sgRNA
  Glp2r_15
gatggaaaccagcagaagca

SEQ ID NO: 22502 - DNA, 20 bp, Artificial Sequence
  sgRNA
  Glp2r_16
gctgtgccccatgatcccgc

SEQ ID NO: 22503 - DNA, 20 bp, Artificial Sequence
  sgRNA
  Glp2r_17
tcagacaggctgcttgcccg

SEQ ID NO: 22504 - DNA, 20 bp, Artificial Sequence
  sgRNA
  Glp2r_18
acgaagcgaacaggttcatg

SEQ ID NO: 22505 - DNA, 20 bp, Artificial Sequence
  sgRNA
  Glp2r_19
gctgcagagcctgtgtccta

SEQ ID NO: 22506 - DNA, 20 bp, Artificial Sequence
  sgRNA
  Glp2r_20
caacagtgcttcctgaaagg

SEQ ID NO: 22507 - DNA, 20 bp, Artificial Sequence
  sgRNA
  Glra1_1
ccacttccacgaaatcacca

SEQ ID NO: 22508 - DNA, 20 bp, Artificial Sequence
  sgRNA
  Glra1_2
ttccatcgctgagacaacca

SEQ ID NO: 22509 - DNA, 20 bp, Artificial Sequence
  sgRNA
  Glra1_3
atgctgcaccagctcgtgtg

SEQ ID NO: 22510 - DNA, 20 bp, Artificial Sequence
  sgRNA
  Glra1_4
tcctggataagctcatgggg

SEQ ID NO: 22511 - DNA, 20 bp, Artificial Sequence
  sgRNA
  Glra1_5
ggacctgaagaatttcccga

SEQ ID NO: 22512 - DNA, 20 bp, Artificial Sequence
  sgRNA
  Glra1_6
agcttatccaggaagtccga

SEQ ID NO: 22513 - DNA, 20 bp, Artificial Sequence
  sgRNA
  Glra1_7
attcattgtaggccagacgg

SEQ ID NO: 22514 - DNA, 20 bp, Artificial Sequence
  sgRNA
  Glra1_8
ggaaattcttcaggtccatg

SEQ ID NO: 22515 - DNA, 20 bp, Artificial Sequence
  sgRNA
  Glra1_9
catcgaggcccgattccacc

SEQ ID NO: 22516 - DNA, 20 bp, Artificial Sequence
  sgRNA
  Glra1_10
atcgacaagatatctcgcat

SEQ ID NO: 22517 - DNA, 20 bp, Artificial Sequence
  sgRNA
  Glra1_11
gagcttatccaggaagtccg

SEQ ID NO: 22518 - DNA, 20 bp, Artificial Sequence
  sgRNA
  Glra1_12
ggatcatctataagatcgtc

SEQ ID NO: 22519 - DNA, 20 bp, Artificial Sequence
  sgRNA
  Glra1_13
tgcgccatccaagtccccgg

SEQ ID NO: 22520 - DNA, 20 bp, Artificial Sequence
  sgRNA
  Glra1_14
ccgagacacaaagttgacgg

SEQ ID NO: 22521 - DNA, 20 bp, Artificial Sequence
  sgRNA
  Glra1_15
atagggtcaacatcttcctg

SEQ ID NO: 22522 - DNA, 20 bp, Artificial Sequence
  sgRNA
  Glra1_16
atacacgtctgtacatccat

SEQ ID NO: 22523 - DNA, 20 bp, Artificial Sequence
  sgRNA
  Glra1_17
ctttgtgtctcggcaacaca

SEQ ID NO: 22524 - DNA, 20 bp, Artificial Sequence
  sgRNA
  Glra1_18
gcttcaacttctctgcctat

SEQ ID NO: 22525 - DNA, 20 bp, Artificial Sequence
  sgRNA
  Glra1_19
agatggaatccaacatagat

SEQ ID NO: 22526 - DNA, 20 bp, Artificial Sequence
  sgRNA
  Glra1_20
atactctgcgattctacctt

SEQ ID NO: 22527 - DNA, 20 bp, Artificial Sequence
  sgRNA
  Glra2_1
atatttgagtggttaagtga

SEQ ID NO: 22528 - DNA, 20 bp, Artificial Sequence
  sgRNA
  Glra2_2
gcagtggaatgattcacggc

SEQ ID NO: 22529 - DNA, 20 bp, Artificial Sequence
  sgRNA
  Glra2_3
tctgcaaagaccatgactcc

SEQ ID NO: 22530 - DNA, 20 bp, Artificial Sequence
  sgRNA
  Glra2_4
aaatgactatcaacaggctg

SEQ ID NO: 22531 - DNA, 20 bp, Artificial Sequence
  sgRNA
  Glra2_5
tgaaggagatagggtctgcg

SEQ ID NO: 22532 - DNA, 20 bp, Artificial Sequence
  sgRNA
  Glra2_6
gatgtcaattgctttcacat

SEQ ID NO: 22533 - DNA, 20 bp, Artificial Sequence
  sgRNA
  Glra2_7
tctgtcgtctccggagacga

SEQ ID NO: 22534 - DNA, 20 bp, Artificial Sequence
  sgRNA
  Glra2_8
tgaatgacctgatatttgag

SEQ ID NO: 22535 - DNA, 20 bp, Artificial Sequence
  sgRNA
  Glra2_9
ttgcaagtaacgtttactgg

SEQ ID NO: 22536 - DNA, 20 bp, Artificial Sequence
  sgRNA
  Glra2_10
gttggattcgatttggaaac

SEQ ID NO: 22537 - DNA, 20 bp, Artificial Sequence
  sgRNA
  Glra2_11
tcttctttcaaaataaactg

SEQ ID NO: 22538 - DNA, 20 bp, Artificial Sequence
  sgRNA
  Glra2_12
gtttcacctggagcgccaga

SEQ ID NO: 22539 - DNA, 20 bp, Artificial Sequence
  sgRNA
  Glra2_13
gaaggagatagggtctgcga

SEQ ID NO: 22540 - DNA, 20 bp, Artificial Sequence
  sgRNA
  Glra2_14
ggtccagtacaagttgctga

SEQ ID NO: 22541 - DNA, 20 bp, Artificial Sequence
  sgRNA
  Glra2_15
catggatgcagcccctgcca

SEQ ID NO: 22542 - DNA, 20 bp, Artificial Sequence
  sgRNA
  Glra2_16
ggatcacatacaagatcatt

SEQ ID NO: 22543 - DNA, 20 bp, Artificial Sequence
  sgRNA
  Glra2_17
ggacctgaagaactttccaa

SEQ ID NO: 22544 - DNA, 20 bp, Artificial Sequence
  sgRNA
  Glra2_18
tttcacctggagcgccagat

SEQ ID NO: 22545 - DNA, 20 bp, Artificial Sequence
  sgRNA
  Glra2_19
ggatttggatccctcaatgt

SEQ ID NO: 22546 - DNA, 20 bp, Artificial Sequence
  sgRNA
  Glra2_20
aggacaaaatgactatcaac

SEQ ID NO: 22547 - DNA, 20 bp, Artificial Sequence
  sgRNA
  Glra3_1
tattcactgtatgcaagacg

SEQ ID NO: 22548 - DNA, 20 bp, Artificial Sequence
  sgRNA
  Glra3_2
gacttacctcagtaacagtg

SEQ ID NO: 22549 - DNA, 20 bp, Artificial Sequence
  sgRNA
  Glra3_3
aggatagaataacgatcagg

SEQ ID NO: 22550 - DNA, 20 bp, Artificial Sequence
  sgRNA
  Glra3_4
ttgcatgtgacattaactgg

SEQ ID NO: 22551 - DNA, 20 bp, Artificial Sequence
  sgRNA
  Glra3_5
ttggcatgacctggacagcg

SEQ ID NO: 22552 - DNA, 20 bp, Artificial Sequence
  sgRNA
  Glra3_6
ggatctcaagaatttcccaa

SEQ ID NO: 22553 - DNA, 20 bp, Artificial Sequence
  sgRNA
  Glra3_7
gtgctgagaacacaaaaagg

SEQ ID NO: 22554 - DNA, 20 bp, Artificial Sequence
  sgRNA
  Glra3_8
agaccttcctcatttcatca

SEQ ID NO: 22555 - DNA, 20 bp, Artificial Sequence
  sgRNA
  Glra3_9
ttaaaaatcaggaatgctag

SEQ ID NO: 22556 - DNA, 20 bp, Artificial Sequence
  sgRNA
  Glra3_10
tgtccgaaagtgtctcacgt

SEQ ID NO: 22557 - DNA, 20 bp, Artificial Sequence
  sgRNA
  Glra3_11
agtttgtccagaaaatcaga

SEQ ID NO: 22558 - DNA, 20 bp, Artificial Sequence
  sgRNA
  Glra3_12
ggtctcattctggattaaca

SEQ ID NO: 22559 - DNA, 20 bp, Artificial Sequence
  sgRNA
  Glra3_13
ttccatcttgagcgtcagat

SEQ ID NO: 22560 - DNA, 20 bp, Artificial Sequence
  sgRNA
  Glra3_14
gttaatccagaatgagaccc

SEQ ID NO: 22561 - DNA, 20 bp, Artificial Sequence
  sgRNA
  Glra3_15
gggaaattcttgagatccat

SEQ ID NO: 22562 - DNA, 20 bp, Artificial Sequence
  sgRNA
  Glra3_16
gaggaaggtcttcatcgaca

SEQ ID NO: 22563 - DNA, 20 bp, Artificial Sequence
  sgRNA
  Glra3_17
gagccctgatgaaatgagga

SEQ ID NO: 22564 - DNA, 20 bp, Artificial Sequence
  sgRNA
  Glra3_18
cctgatcgttattctatcct

SEQ ID NO: 22565 - DNA, 20 bp, Artificial Sequence
  sgRNA
  Glra3_19
agcccatctgacgctcaaga

SEQ ID NO: 22566 - DNA, 20 bp, Artificial Sequence
  sgRNA
  Glra3_20
agatgaagccccagtacaag

SEQ ID NO: 22567 - DNA, 20 bp, Artificial Sequence
  sgRNA
  Glra4_1
attctcggtaggccagacgt

SEQ ID NO: 22568 - DNA, 20 bp, Artificial Sequence
  sgRNA
  Glra4_2
gcttgtccaagaaatcagag

SEQ ID NO: 22569 - DNA, 20 bp, Artificial Sequence
  sgRNA
  Glra4_3
gaaaggggccaacttccatg

SEQ ID NO: 22570 - DNA, 20 bp, Artificial Sequence
  sgRNA
  Glra4_4
tcatcccgcaaaataaattg

SEQ ID NO: 22571 - DNA, 20 bp, Artificial Sequence
  sgRNA
  Glra4_5
ggatgacgatgagtaggctg

SEQ ID NO: 22572 - DNA, 20 bp, Artificial Sequence
  sgRNA
  Glra4_6
aggacactgcttacaagcaa

SEQ ID NO: 22573 - DNA, 20 bp, Artificial Sequence
  sgRNA
  Glra4_7
ggaagttcttgaggtccatt

SEQ ID NO: 22574 - DNA, 20 bp, Artificial Sequence
  sgRNA
  Glra4_8
ggacctcaagaacttcccaa

SEQ ID NO: 22575 - DNA, 20 bp, Artificial Sequence
  sgRNA
  Glra4_9
gagaattgacaccatctcca

SEQ ID NO: 22576 - DNA, 20 bp, Artificial Sequence
  sgRNA
  Glra4_10
gatgtcaattgcctttacgt

SEQ ID NO: 22577 - DNA, 20 bp, Artificial Sequence
  sgRNA
  Glra4_11
ttcttctctggaccttgcca

SEQ ID NO: 22578 - DNA, 20 bp, Artificial Sequence
  sgRNA
  Glra4_12
gccaaggcctacacgagcag

SEQ ID NO: 22579 - DNA, 20 bp, Artificial Sequence
  sgRNA
  Glra4_13
ccaacccctcttctaaagga

SEQ ID NO: 22580 - DNA, 20 bp, Artificial Sequence
  sgRNA
  Glra4_14
aggtaaagtttcacctggag

SEQ ID NO: 22581 - DNA, 20 bp, Artificial Sequence
  sgRNA
  Glra4_15
gtacaggtctgtatgtccat

SEQ ID NO: 22582 - DNA, 20 bp, Artificial Sequence
  sgRNA
  Glra4_16
ttgcaggtcacattcacagg

SEQ ID NO: 22583 - DNA, 20 bp, Artificial Sequence
  sgRNA
  Glra4_17
gtccacatagagtttcctca

SEQ ID NO: 22584 - DNA, 20 bp, Artificial Sequence
  sgRNA
  Glra4_18
catagccacgaaaatagaag

SEQ ID NO: 22585 - DNA, 20 bp, Artificial Sequence
  sgRNA
  Glra4_19
tttcacctggagcggcagat

SEQ ID NO: 22586 - DNA, 20 bp, Artificial Sequence
  sgRNA
  Glra4_20
gactgcagcatactcaagca

SEQ ID NO: 22587 - DNA, 20 bp, Artificial Sequence
  sgRNA
  Glrb_1
aggttactacacttgtgtgg

SEQ ID NO: 22588 - DNA, 20 bp, Artificial Sequence
  sgRNA
  Glrb_2
ggaaacagagttaagtctag

SEQ ID NO: 22589 - DNA, 20 bp, Artificial Sequence
  sgRNA
  Glrb_3
cacagcgtactccacgaggg

SEQ ID NO: 22590 - DNA, 20 bp, Artificial Sequence
  sgRNA
  Glrb_4
ccaccatgtataagtgcttg

SEQ ID NO: 22591 - DNA, 20 bp, Artificial Sequence
  sgRNA
  Glrb_5
agaatactgtaaacggcacg

SEQ ID NO: 22592 - DNA, 20 bp, Artificial Sequence
  sgRNA
  Glrb_6
gatgctgaacaatcccaaaa

SEQ ID NO: 22593 - DNA, 20 bp, Artificial Sequence
  sgRNA
  Glrb_7
agtccattgttgacttcgat

SEQ ID NO: 22594 - DNA, 20 bp, Artificial Sequence
  sgRNA
  Glrb_8
ggaccacagcgtactccacg

SEQ ID NO: 22595 - DNA, 20 bp, Artificial Sequence
  sgRNA
  Glrb_9
gaccacagcgtactccacga

SEQ ID NO: 22596 - DNA, 20 bp, Artificial Sequence
  sgRNA
  Glrb_10
gctaagaagaatactgtaaa

SEQ ID NO: 22597 - DNA, 20 bp, Artificial Sequence
  sgRNA
  Glrb_11
gttgatccagaaagagagcc

SEQ ID NO: 22598 - DNA, 20 bp, Artificial Sequence
  sgRNA
  Glrb_12
aaacccatcgaagtcaacaa

SEQ ID NO: 22599 - DNA, 20 bp, Artificial Sequence
  sgRNA
  Glrb_13
gctaaggctgagcaagcaga

SEQ ID NO: 22600 - DNA, 20 bp, Artificial Sequence
  sgRNA
  Glrb_14
ttgcagcgttgtgtgtccat

SEQ ID NO: 22601 - DNA, 20 bp, Artificial Sequence
  sgRNA
  Glrb_15
ctttaggaagctcggctgcg

SEQ ID NO: 22602 - DNA, 20 bp, Artificial Sequence
  sgRNA
  Glrb_16
tcgaagtcaacaatggactt

SEQ ID NO: 22603 - DNA, 20 bp, Artificial Sequence
  sgRNA
  Glrb_17
atgacaggcttggcaggcgg

SEQ ID NO: 22604 - DNA, 20 bp, Artificial Sequence
  sgRNA
  Glrb_18
cgagaaggcccgaatagcta

SEQ ID NO: 22605 - DNA, 20 bp, Artificial Sequence
  sgRNA
  Glrb_19
agtgtcttatgtgaaggcgc

SEQ ID NO: 22606 - DNA, 20 bp, Artificial Sequence
  sgRNA
  Glrb_20
ctccctcgtggagtacgctg

SEQ ID NO: 22607 - DNA, 20 bp, Artificial Sequence
  sgRNA
  Gm11127_1
cacacaatccaggatatgca

SEQ ID NO: 22608 - DNA, 20 bp, Artificial Sequence
  sgRNA
  Gm11127_2
gggtcacatgtgtatttggg

SEQ ID NO: 22609 - DNA, 20 bp, Artificial Sequence
  sgRNA
  Gm11127_3
gtcgtccacgtaacccacgg

SEQ ID NO: 22610 - DNA, 20 bp, Artificial Sequence
  sgRNA
  Gm11127_4
cgccctggccccgacccaag

SEQ ID NO: 22611 - DNA, 20 bp, Artificial Sequence
  sgRNA
  Gm11127_5
ttagagtcggtggatggaag

SEQ ID NO: 22612 - DNA, 20 bp, Artificial Sequence
  sgRNA
  Gm11127_6
ccacctgtataaccagagtc

SEQ ID NO: 22613 - DNA, 20 bp, Artificial Sequence
  sgRNA
  Gm11127_7
tccatccaccgactctaaca

SEQ ID NO: 22614 - DNA, 20 bp, Artificial Sequence
  sgRNA
  Gm11127_8
accatgttagagtcggtgga

SEQ ID NO: 22615 - DNA, 20 bp, Artificial Sequence
  sgRNA
  Gm11127_9
ggagcctcggttcaccgccg

SEQ ID NO: 22616 - DNA, 20 bp, Artificial Sequence
  sgRNA
  Gm11127_10
gattaccatgttagagtcgg

SEQ ID NO: 22617 - DNA, 20 bp, Artificial Sequence
  sgRNA
  Gm11127_11
aatgattaccatgttagagt

SEQ ID NO: 22618 - DNA, 20 bp, Artificial Sequence
  sgRNA
  Gm11127_12
gcctggcctggatatggcag

SEQ ID NO: 22619 - DNA, 20 bp, Artificial Sequence
  sgRNA
  Gm11127_13
cctgactctggttatacagg

SEQ ID NO: 22620 - DNA, 20 bp, Artificial Sequence
  sgRNA
  Gm11127_14
tgcatatcctggattgtgtg

SEQ ID NO: 22621 - DNA, 20 bp, Artificial Sequence
  sgRNA
  Gm11127_15
cctgcttctggcgaccgccc

SEQ ID NO: 22622 - DNA, 20 bp, Artificial Sequence
  sgRNA
  Gm11127_16
gccatatccaggccaggctt

SEQ ID NO: 22623 - DNA, 20 bp, Artificial Sequence
  sgRNA
  Gm11127_17
ctgtataaccagagtcagga

SEQ ID NO: 22624 - DNA, 20 bp, Artificial Sequence
  sgRNA
  Gm11127_18
cccgaagcctggcctggata

SEQ ID NO: 22625 - DNA, 20 bp, Artificial Sequence
  sgRNA
  Gm11127_19
catatccaggccaggcttcg

SEQ ID NO: 22626 - DNA, 20 bp, Artificial Sequence
  sgRNA
  Gm11127_20
gccagaagcaggagaagtag

SEQ ID NO: 22627 - DNA, 20 bp, Artificial Sequence
  sgRNA
  Gm12169_1
aaatgcgtccttgacaatcg

SEQ ID NO: 22628 - DNA, 20 bp, Artificial Sequence
  sgRNA
  Gm12169_2
tatcagatgtgcattcacct

SEQ ID NO: 22629 - DNA, 20 bp, Artificial Sequence
  sgRNA
  Gm12169_3
taagccattagacaccggat

SEQ ID NO: 22630 - DNA, 20 bp, Artificial Sequence
  sgRNA
  Gm12169_4
caatgaagaggcctctaatg

SEQ ID NO: 22631 - DNA, 20 bp, Artificial Sequence
  sgRNA
  Gm12169_5
gatgctaagccattagacac

SEQ ID NO: 22632 - DNA, 20 bp, Artificial Sequence
  sgRNA
  Gm12169_6
cctctaatggggatcttcag

SEQ ID NO: 22633 - DNA, 20 bp, Artificial Sequence
  sgRNA
  Gm12169_7
tgtacctatccggtgtctaa

SEQ ID NO: 22634 - DNA, 20 bp, Artificial Sequence
  sgRNA
  Gm12169_8
gctcgcaaggatcagcagtg

SEQ ID NO: 22635 - DNA, 20 bp, Artificial Sequence
  sgRNA
  Gm12169_9
ccaatgaagaggcctctaat

SEQ ID NO: 22636 - DNA, 20 bp, Artificial Sequence
  sgRNA
  Gm12169_10
tgatacatgtggacaaacac

SEQ ID NO: 22637 - DNA, 20 bp, Artificial Sequence
  sgRNA
  Gm12169_11
aataacgtagattatatctt

SEQ ID NO: 22638 - DNA, 20 bp, Artificial Sequence
  sgRNA
  Gm12169_12
tgtcatctcaaagggcaact

SEQ ID NO: 22639 - DNA, 20 bp, Artificial Sequence
  sgRNA
  Gm12169_13
ttagacaccggataggtaca

SEQ ID NO: 22640 - DNA, 20 bp, Artificial Sequence
  sgRNA
  Gm12169_14
gcatccatgtgctggggccg

SEQ ID NO: 22641 - DNA, 20 bp, Artificial Sequence
  sgRNA
  Gm12169_15
gcctgaaatgaggacttgat

SEQ ID NO: 22642 - DNA, 20 bp, Artificial Sequence
  sgRNA
  Gm12169_16
tggtctctactgctgtcgag

SEQ ID NO: 22643 - DNA, 20 bp, Artificial Sequence
  sgRNA
  Gm12169_17
tgacaacattccaaagctgc

SEQ ID NO: 22644 - DNA, 20 bp, Artificial Sequence
  sgRNA
  Gm12169_18
agagaaaagaagagtccaga

SEQ ID NO: 22645 - DNA, 20 bp, Artificial Sequence
  sgRNA
  Gm12169_19
tggaatgttgtcatctcaaa

SEQ ID NO: 22646 - DNA, 20 bp, Artificial Sequence
  sgRNA
  Gm12169_20
tgacgtcttcaaaccaccct

SEQ ID NO: 22647 - DNA, 20 bp, Artificial Sequence
  sgRNA
  Gm13723_1
tgtaaaaaacagtcactccg

SEQ ID NO: 22648 - DNA, 20 bp, Artificial Sequence
  sgRNA
  Gm13723_2
gtacagttgtgcgaaacaat

SEQ ID NO: 22649 - DNA, 20 bp, Artificial Sequence
  sgRNA
  Gm13723_3
atattgtgataagggacccc

SEQ ID NO: 22650 - DNA, 20 bp, Artificial Sequence
  sgRNA
  Gm13723_4
ggttgcagatagctatgtag

SEQ ID NO: 22651 - DNA, 20 bp, Artificial Sequence
  sgRNA
  Gm13723_5
agtcactccgaggagatgag

SEQ ID NO: 22652 - DNA, 20 bp, Artificial Sequence
  sgRNA
  Gm13723_6
tgttccccagaacagtgact

SEQ ID NO: 22653 - DNA, 20 bp, Artificial Sequence
  sgRNA
  Gm13723_7
atccacagctccaattacat

SEQ ID NO: 22654 - DNA, 20 bp, Artificial Sequence
  sgRNA
  Gm13723_8
tggagtctgtcaatcccatg

SEQ ID NO: 22655 - DNA, 20 bp, Artificial Sequence
  sgRNA
  Gm13723_9
catcgtggagacataataac

SEQ ID NO: 22656 - DNA, 20 bp, Artificial Sequence
  sgRNA
  Gm13723_10
tgatggcagttgaataactg

SEQ ID NO: 22657 - DNA, 20 bp, Artificial Sequence
  sgRNA
  Gm13723_11
tcaggagaaacagtacagag

SEQ ID NO: 22658 - DNA, 20 bp, Artificial Sequence
  sgRNA
  Gm13723_12
ataaaaatgacggatgacat

SEQ ID NO: 22659 - DNA, 20 bp, Artificial Sequence
  sgRNA
  Gm13723_13
atcgtggagacataataact

SEQ ID NO: 22660 - DNA, 20 bp, Artificial Sequence
  sgRNA
  Gm13723_14
acttgtgcctctcatctcct

SEQ ID NO: 22661 - DNA, 20 bp, Artificial Sequence
  sgRNA
  Gm13723_15
ttgtgcgaaacaattggtgt

SEQ ID NO: 22662 - DNA, 20 bp, Artificial Sequence
  sgRNA
  Gm13723_16
ttatagtctcagaaacaaag

SEQ ID NO: 22663 - DNA, 20 bp, Artificial Sequence
  sgRNA
  Gm13723_17
tgaggtcaactactgacaga

SEQ ID NO: 22664 - DNA, 20 bp, Artificial Sequence
  sgRNA
  Gm13723_18
gctgccttgctctccttact

SEQ ID NO: 22665 - DNA, 20 bp, Artificial Sequence
  sgRNA
  Gm13723_19
ataaattagtgggttcagca

SEQ ID NO: 22666 - DNA, 20 bp, Artificial Sequence
  sgRNA
  Gm13723_20
catgctaaacacagttagag

SEQ ID NO: 22667 - DNA, 20 bp, Artificial Sequence
  sgRNA
  Gm13762_1
acagagcctcctgttcataa

SEQ ID NO: 22668 - DNA, 20 bp, Artificial Sequence
  sgRNA
  Gm13762_2
gggactttcacagaatccaa

SEQ ID NO: 22669 - DNA, 20 bp, Artificial Sequence
  sgRNA
  Gm13762_3
tgctgtgcacttctttactg

SEQ ID NO: 22670 - DNA, 20 bp, Artificial Sequence
  sgRNA
  Gm13762_4
catcacaccaaaggtaactg

SEQ ID NO: 22671 - DNA, 20 bp, Artificial Sequence
  sgRNA
  Gm13762_5
aggctctgtggaattctgat

SEQ ID NO: 22672 - DNA, 20 bp, Artificial Sequence
  sgRNA
  Gm13762_6
actcttccattatgaacagg

SEQ ID NO: 22673 - DNA, 20 bp, Artificial Sequence
  sgRNA
  Gm13762_7
tcatctacattgcaacagtt

SEQ ID NO: 22674 - DNA, 20 bp, Artificial Sequence
  sgRNA
  Gm13762_8
gcttacaaatggccacatag

SEQ ID NO: 22675 - DNA, 20 bp, Artificial Sequence
  sgRNA
  Gm13762_9
gtagtacaagggcttacaaa

SEQ ID NO: 22676 - DNA, 20 bp, Artificial Sequence
  sgRNA
  Gm13762_10
aagtgcacgactacatatga

SEQ ID NO: 22677 - DNA, 20 bp, Artificial Sequence
  sgRNA
  Gm13762_11
catgcaaccttcaaaagaaa

SEQ ID NO: 22678 - DNA, 20 bp, Artificial Sequence
  sgRNA
  Gm13762_12
ggctctgtggaattctgatg

SEQ ID NO: 22679 - DNA, 20 bp, Artificial Sequence
  sgRNA
  Gm13762_13
aagtaagaactcagtgacaa

SEQ ID NO: 22680 - DNA, 20 bp, Artificial Sequence
  sgRNA
  Gm13762_14
ataatggaagagtagtacaa

SEQ ID NO: 22681 - DNA, 20 bp, Artificial Sequence
  sgRNA
  Gm13762_15
ttgagaactcacagtacaga

SEQ ID NO: 22682 - DNA, 20 bp, Artificial Sequence
  sgRNA
  Gm13762_16
atcacattggggccacaaaa

SEQ ID NO: 22683 - DNA, 20 bp, Artificial Sequence
  sgRNA
  Gm13762_17
gcatgccaagaagaagtaca

SEQ ID NO: 22684 - DNA, 20 bp, Artificial Sequence
  sgRNA
  Gm13762_18
tgagaactcacagtacagaa

SEQ ID NO: 22685 - DNA, 20 bp, Artificial Sequence
  sgRNA
  Gm13762_19
caaaaaatgatcaatcacat

SEQ ID NO: 22686 - DNA, 20 bp, Artificial Sequence
  sgRNA
  Gm13762_20
ggaaatgcatgcatccagaa

SEQ ID NO: 22687 - DNA, 20 bp, Artificial Sequence
  sgRNA
  Gm13769_1
gcggaagatgagaagaactt

SEQ ID NO: 22688 - DNA, 20 bp, Artificial Sequence
  sgRNA
  Gm13769_2
caaggactgtacacacctgt

SEQ ID NO: 22689 - DNA, 20 bp, Artificial Sequence
  sgRNA
  Gm13769_3
caacaatcagcagaccaatg

SEQ ID NO: 22690 - DNA, 20 bp, Artificial Sequence
  sgRNA
  Gm13769_4
gacagccccaaaactcatcg

SEQ ID NO: 22691 - DNA, 20 bp, Artificial Sequence
  sgRNA
  Gm14085_1
tgcgcaaagaaacacactag

SEQ ID NO: 22692 - DNA, 20 bp, Artificial Sequence
  sgRNA
  Gm14085_2
caagatctggctaactacag

SEQ ID NO: 22693 - DNA, 20 bp, Artificial Sequence
  sgRNA
  Gm14085_3
ccctcaaactcaccgcactg

SEQ ID NO: 22694 - DNA, 20 bp, Artificial Sequence
  sgRNA
  Gm14085_4
agaaatgaagaacacaagac

SEQ ID NO: 22695 - DNA, 20 bp, Artificial Sequence
  sgRNA
  Gm14085_5
ccactatctcaatcaccaga

SEQ ID NO: 22696 - DNA, 20 bp, Artificial Sequence
  sgRNA
  Gm14085_6
gatgtttcctgccatggcca

SEQ ID NO: 22697 - DNA, 20 bp, Artificial Sequence
  sgRNA
  Gm14085_7
agttagccagatcttgtggc

SEQ ID NO: 22698 - DNA, 20 bp, Artificial Sequence
  sgRNA
  Gm14085_8
ctttcatgatggctgtacag

SEQ ID NO: 22699 - DNA, 20 bp, Artificial Sequence
  sgRNA
  Gm14085_9
ggagagggtagcattgacga

SEQ ID NO: 22700 - DNA, 20 bp, Artificial Sequence
  sgRNA
  Gm14085_10
aatgacccaagccatcctcc

SEQ ID NO: 22701 - DNA, 20 bp, Artificial Sequence
  sgRNA
  Gm14085_11
acactagaggaagtgacaca

SEQ ID NO: 22702 - DNA, 20 bp, Artificial Sequence
  sgRNA
  Gm14085_12
gtactgaatcagttgctggt

SEQ ID NO: 22703 - DNA, 20 bp, Artificial Sequence
  sgRNA
  Gm14085_13
tggttctcgacacagctcaa

SEQ ID NO: 22704 - DNA, 20 bp, Artificial Sequence
  sgRNA
  Gm14085_14
aaggcccatggctttcatga

SEQ ID NO: 22705 - DNA, 20 bp, Artificial Sequence
  sgRNA
  Gm14085_15
acagccatcatgaaagccat

SEQ ID NO: 22706 - DNA, 20 bp, Artificial Sequence
  sgRNA
  Gm14085_16
tcttgtactgaatcagttgc

SEQ ID NO: 22707 - DNA, 20 bp, Artificial Sequence
  sgRNA
  Gm14085_17
tgctccagaaaccctggcca

SEQ ID NO: 22708 - DNA, 20 bp, Artificial Sequence
  sgRNA
  Gm14085_18
cttctggtgattgagatagt

SEQ ID NO: 22709 - DNA, 20 bp, Artificial Sequence
  sgRNA
  Gm14085_19
atatgtctcataggtcctat

SEQ ID NO: 22710 - DNA, 20 bp, Artificial Sequence
  sgRNA
  Gm14085_20
ctggacacgttgtcttgcca

SEQ ID NO: 22711 - DNA, 20 bp, Artificial Sequence
  sgRNA
  Gm14226_1
tctcctttactgacgcagga

SEQ ID NO: 22712 - DNA, 20 bp, Artificial Sequence
  sgRNA
  Gm14226_2
gcttcaccttgctgtggaca

SEQ ID NO: 22713 - DNA, 20 bp, Artificial Sequence
  sgRNA
  Gm14226_3
gtaacagtctgtggaatact

SEQ ID NO: 22714 - DNA, 20 bp, Artificial Sequence
  sgRNA
  Gm14226_4
ctgttaccttaggcctaccc

SEQ ID NO: 22715 - DNA, 20 bp, Artificial Sequence
  sgRNA
  Gm14226_5
ctgccaaagcagagtccccc

SEQ ID NO: 22716 - DNA, 20 bp, Artificial Sequence
  sgRNA
  Gm14226_6
ccaaagcctgaggaaccagg

SEQ ID NO: 22717 - DNA, 20 bp, Artificial Sequence
  sgRNA
  Gm14226_7
ggaatatagtagtcccgggt

SEQ ID NO: 22718 - DNA, 20 bp, Artificial Sequence
  sgRNA
  Gm14226_8
tttccttcctgcgtcagtaa

SEQ ID NO: 22719 - DNA, 20 bp, Artificial Sequence
  sgRNA
  Gm14226_9
actgttaccttaggcctacc

SEQ ID NO: 22720 - DNA, 20 bp, Artificial Sequence
  sgRNA
  Gm14226_10
ggataaaattaattctgtgg

SEQ ID NO: 22721 - DNA, 20 bp, Artificial Sequence
  sgRNA
  Gm14226_11
aatagagccttcaatcttgg

SEQ ID NO: 22722 - DNA, 20 bp, Artificial Sequence
  sgRNA
  Gm14226_12
gtggaggagggagatccagc

SEQ ID NO: 22723 - DNA, 20 bp, Artificial Sequence
  sgRNA
  Gm14226_13
gaatatccctgtccacagca

SEQ ID NO: 22724 - DNA, 20 bp, Artificial Sequence
  sgRNA
  Gm14226_14
agttccaaccagacttccaa

SEQ ID NO: 22725 - DNA, 20 bp, Artificial Sequence
  sgRNA
  Gm14226_15
cgcaggaaggaaatttaatt

SEQ ID NO: 22726 - DNA, 20 bp, Artificial Sequence
  sgRNA
  Gm14226_16
agattgaaggctctattcca

SEQ ID NO: 22727 - DNA, 20 bp, Artificial Sequence
  sgRNA
  Gm14226_17
aggctggaatatagtagtcc

SEQ ID NO: 22728 - DNA, 20 bp, Artificial Sequence
  sgRNA
  Gm14226_18
tggggcatatacatttgtcc

SEQ ID NO: 22729 - DNA, 20 bp, Artificial Sequence
  sgRNA
  Gm14226_19
aggcctaaggtaacagtctg

SEQ ID NO: 22730 - DNA, 20 bp, Artificial Sequence
  sgRNA
  Gm14226_20
tccaaagcctgaggaaccag

SEQ ID NO: 22731 - DNA, 20 bp, Artificial Sequence
  sgRNA
  Gm14548_1
cagagtacagccacactctg

SEQ ID NO: 22732 - DNA, 20 bp, Artificial Sequence
  sgRNA
  Gm14548_2
gaatatccatcgctggttgg

SEQ ID NO: 22733 - DNA, 20 bp, Artificial Sequence
  sgRNA
  Gm14548_3
tcgatgttcctacaacaccc

SEQ ID NO: 22734 - DNA, 20 bp, Artificial Sequence
  sgRNA
  Gm14548_4
gaacctgtgattgttgtgcc

SEQ ID NO: 22735 - DNA, 20 bp, Artificial Sequence
  sgRNA
  Gm14548_5
agtcctggcacaacaatcac

SEQ ID NO: 22736 - DNA, 20 bp, Artificial Sequence
  sgRNA
  Gm14548_6
cacaatataacaactctaca

SEQ ID NO: 22737 - DNA, 20 bp, Artificial Sequence
  sgRNA
  Gm14548_7
cacactctgtggtctccaga

SEQ ID NO: 22738 - DNA, 20 bp, Artificial Sequence
  sgRNA
  Gm14548_8
ctgtgacccccaaccagcga

SEQ ID NO: 22739 - DNA, 20 bp, Artificial Sequence
  sgRNA
  Gm14548_9
atcgctggttgggggtcaca

SEQ ID NO: 22740 - DNA, 20 bp, Artificial Sequence
  sgRNA
  Gm14548_10
tgtggctgtactctgaggat

SEQ ID NO: 22741 - DNA, 20 bp, Artificial Sequence
  sgRNA
  Gm14548_11
tgttgtgccaggactcacac

SEQ ID NO: 22742 - DNA, 20 bp, Artificial Sequence
  sgRNA
  Gm14548_12
tgaatatccatcgctggttg

SEQ ID NO: 22743 - DNA, 20 bp, Artificial Sequence
  sgRNA
  Gm14548_13
tctgaatatccatcgctggt

SEQ ID NO: 22744 - DNA, 20 bp, Artificial Sequence
  sgRNA
  Gm14548_14
aacatctgaatatccatcgc

SEQ ID NO: 22745 - DNA, 20 bp, Artificial Sequence
  sgRNA
  Gm14548_15
cctgtcaccaccagctccag

SEQ ID NO: 22746 - DNA, 20 bp, Artificial Sequence
  sgRNA
  Gm14548_16
tgcatccatgagagcttctg

SEQ ID NO: 22747 - DNA, 20 bp, Artificial Sequence
  sgRNA
  Gm14548_17
cagagtgtggctgtactctg

SEQ ID NO: 22748 - DNA, 20 bp, Artificial Sequence
  sgRNA
  Gm14548_18
ctgaatatccatcgctggtt

SEQ ID NO: 22749 - DNA, 20 bp, Artificial Sequence
  sgRNA
  Gm14548_19
catcgctggttgggggtcac

SEQ ID NO: 22750 - DNA, 20 bp, Artificial Sequence
  sgRNA
  Gm14548_20
ctacagtgaccccctggagc

SEQ ID NO: 22751 - DNA, 20 bp, Artificial Sequence
  sgRNA
  Gm15448_1
tcaggatcaggacgtccacg

SEQ ID NO: 22752 - DNA, 20 bp, Artificial Sequence
  sgRNA
  Gm15448_2
acagaatgaaagtctccaca

SEQ ID NO: 22753 - DNA, 20 bp, Artificial Sequence
  sgRNA
  Gm15448_3
acaagaatgcaccacagctg

SEQ ID NO: 22754 - DNA, 20 bp, Artificial Sequence
  sgRNA
  Gm15448_4
gatcaggatcaggacgtcca

SEQ ID NO: 22755 - DNA, 20 bp, Artificial Sequence
  sgRNA
  Gm15448_5
gtcagcctctagtgaccccg

SEQ ID NO: 22756 - DNA, 20 bp, Artificial Sequence
  sgRNA
  Gm15448_6
ttaggcttcactaagaggga

SEQ ID NO: 22757 - DNA, 20 bp, Artificial Sequence
  sgRNA
  Gm15448_7
actagaggctgaccactcag

SEQ ID NO: 22758 - DNA, 20 bp, Artificial Sequence
  sgRNA
  Gm15448_8
tctatggccaacttcacact

SEQ ID NO: 22759 - DNA, 20 bp, Artificial Sequence
  sgRNA
  Gm15448_9
gtggttaggcttcactaaga

SEQ ID NO: 22760 - DNA, 20 bp, Artificial Sequence
  sgRNA
  Gm15448_10
gtcagcactgcccagcactg

SEQ ID NO: 22761 - DNA, 20 bp, Artificial Sequence
  sgRNA
  Gm15448_11
agcactgtggtgacagcagg

SEQ ID NO: 22762 - DNA, 20 bp, Artificial Sequence
  sgRNA
  Gm15448_12
cagagaatctgatcaggatg

SEQ ID NO: 22763 - DNA, 20 bp, Artificial Sequence
  sgRNA
  Gm15448_13
atcaggatcaggacgtccac

SEQ ID NO: 22764 - DNA, 20 bp, Artificial Sequence
  sgRNA
  Gm15448_14
tgtggttaggcttcactaag

SEQ ID NO: 22765 - DNA, 20 bp, Artificial Sequence
  sgRNA
  Gm15448_15
ctctatggccaacttcacac

SEQ ID NO: 22766 - DNA, 20 bp, Artificial Sequence
  sgRNA
  Gm15448_16
gacagaatgaaagtctccac

SEQ ID NO: 22767 - DNA, 20 bp, Artificial Sequence
  sgRNA
  Gm15448_17
acagagaatctgatcaggat

SEQ ID NO: 22768 - DNA, 20 bp, Artificial Sequence
  sgRNA
  Gm15448_18
ataaactgtgtccagtgagt

SEQ ID NO: 22769 - DNA, 20 bp, Artificial Sequence
  sgRNA
  Gm15448_19
ctaagagggaaggagtgata

SEQ ID NO: 22770 - DNA, 20 bp, Artificial Sequence
  sgRNA
  Gm15448_20
gactgacactggcttctcta

SEQ ID NO: 22771 - DNA, 20 bp, Artificial Sequence
  sgRNA
  Gm156_1
agaatgtactacttccattg

SEQ ID NO: 22772 - DNA, 20 bp, Artificial Sequence
  sgRNA
  Gm156_2
ggctgctatacatgtcaagg

SEQ ID NO: 22773 - DNA, 20 bp, Artificial Sequence
  sgRNA
  Gm156_3
atcacaacacttatgcgcca

SEQ ID NO: 22774 - DNA, 20 bp, Artificial Sequence
  sgRNA
  Gm156_4
cgctaagattgacagcagag

SEQ ID NO: 22775 - DNA, 20 bp, Artificial Sequence
  sgRNA
  Gm156_5
gctgctatacatgtcaagga

SEQ ID NO: 22776 - DNA, 20 bp, Artificial Sequence
  sgRNA
  Gm156_6
catccttatggtgtacccac

SEQ ID NO: 22777 - DNA, 20 bp, Artificial Sequence
  sgRNA
  Gm156_7
gctatacatgtcaaggaggg

SEQ ID NO: 22778 - DNA, 20 bp, Artificial Sequence
  sgRNA
  Gm156_8
catgtagcagatgcagaatg

SEQ ID NO: 22779 - DNA, 20 bp, Artificial Sequence
  sgRNA
  Gm156_9
tcttagcgagaagagaaccc

SEQ ID NO: 22780 - DNA, 20 bp, Artificial Sequence
  sgRNA
  Gm156_10
tgggttggattacataaaaa

SEQ ID NO: 22781 - DNA, 20 bp, Artificial Sequence
  sgRNA
  Gm156_11
aaaaggaagtcagttccagt

SEQ ID NO: 22782 - DNA, 20 bp, Artificial Sequence
  sgRNA
  Gm156_12
gaggcatcctgcaaagtcct

SEQ ID NO: 22783 - DNA, 20 bp, Artificial Sequence
  sgRNA
  Gm156_13
tgaaagtgctgtctcctcaa

SEQ ID NO: 22784 - DNA, 20 bp, Artificial Sequence
  sgRNA
  Gm156_14
acaagtgaattacagctatt

SEQ ID NO: 22785 - DNA, 20 bp, Artificial Sequence
  sgRNA
  Gm156_15
gttccagtgggtacaccata

SEQ ID NO: 22786 - DNA, 20 bp, Artificial Sequence
  sgRNA
  Gm156_16
ttcagaagaagaaaagacat

SEQ ID NO: 22787 - DNA, 20 bp, Artificial Sequence
  sgRNA
  Gm156_17
atggaagtagtacattcttc

SEQ ID NO: 22788 - DNA, 20 bp, Artificial Sequence
  sgRNA
  Gm156_18
aagagaacccaggactttgc

SEQ ID NO: 22789 - DNA, 20 bp, Artificial Sequence
  sgRNA
  Gm156_19
tttcagaagaagaaaagaca

SEQ ID NO: 22790 - DNA, 20 bp, Artificial Sequence
  sgRNA
  Gm156_20
cgcataagtgttgtgatcct

SEQ ID NO: 22791 - DNA, 20 bp, Artificial Sequence
  sgRNA
  Gm15922_1
gactcaccaaggccatacca

SEQ ID NO: 22792 - DNA, 20 bp, Artificial Sequence
  sgRNA
  Gm15922_2
atatgctctgcacaaggtgg

SEQ ID NO: 22793 - DNA, 20 bp, Artificial Sequence
  sgRNA
  Gm15922_3
tatgctctgcacaaggtggg

SEQ ID NO: 22794 - DNA, 20 bp, Artificial Sequence
  sgRNA
  Gm15922_4
aatgtagacctgagaaatgc

SEQ ID NO: 22795 - DNA, 20 bp, Artificial Sequence
  sgRNA
  Gm15922_5
tgtggttaggcttcactgag

SEQ ID NO: 22796 - DNA, 20 bp, Artificial Sequence
  sgRNA
  Gm15922_6
cagggtccatggtatggcct

SEQ ID NO: 22797 - DNA, 20 bp, Artificial Sequence
  sgRNA
  Gm15922_7
tcattccagggtccatggta

SEQ ID NO: 22798 - DNA, 20 bp, Artificial Sequence
  sgRNA
  Gm15922_8
gtggttaggcttcactgaga

SEQ ID NO: 22799 - DNA, 20 bp, Artificial Sequence
  sgRNA
  Gm15922_9
caaggccataccatggaccc

SEQ ID NO: 22800 - DNA, 20 bp, Artificial Sequence
  sgRNA
  Gm15922_10
atcacagcccagtgacaccc

SEQ ID NO: 22801 - DNA, 20 bp, Artificial Sequence
  sgRNA
  Gm15922_11
gaaagtcaccttagtcctcc

SEQ ID NO: 22802 - DNA, 20 bp, Artificial Sequence
  sgRNA
  Gm20489_1
ctacagtatgactcccccag

SEQ ID NO: 22803 - DNA, 20 bp, Artificial Sequence
  sgRNA
  Gm20489_2
cgattcatcacacaaatcaa

SEQ ID NO: 22804 - DNA, 20 bp, Artificial Sequence
  sgRNA
  Gm20489_3
cctggagtggtgtgtctaaa

SEQ ID NO: 22805 - DNA, 20 bp, Artificial Sequence
  sgRNA
  Gm20489_4
gcttgtgctagtagtctgct

SEQ ID NO: 22806 - DNA, 20 bp, Artificial Sequence
  sgRNA
  Gm20489_5
ggagctggacaacaaatgtc

SEQ ID NO: 22807 - DNA, 20 bp, Artificial Sequence
  sgRNA
  Gm20489_6
ttatccctgttggcaccatg

SEQ ID NO: 22808 - DNA, 20 bp, Artificial Sequence
  sgRNA
  Gm20489_7
tctgctctagtcttgtagaa

SEQ ID NO: 22809 - DNA, 20 bp, Artificial Sequence
  sgRNA
  Gm20489_8
ccttgctgggagatttacag

SEQ ID NO: 22810 - DNA, 20 bp, Artificial Sequence
  sgRNA
  Gm20489_9
gtatgactcccccagtggac

SEQ ID NO: 22811 - DNA, 20 bp, Artificial Sequence
  sgRNA
  Gm20489_10
agtcttgtagaatggtctgc

SEQ ID NO: 22812 - DNA, 20 bp, Artificial Sequence
  sgRNA
  Gm20489_11
ggttctggattcttcagcat

SEQ ID NO: 22813 - DNA, 20 bp, Artificial Sequence
  sgRNA
  Gm20489_12
aggacccccagaaaccccag

SEQ ID NO: 22814 - DNA, 20 bp, Artificial Sequence
  sgRNA
  Gm20489_13
tcctctagattcttgatggg

SEQ ID NO: 22815 - DNA, 20 bp, Artificial Sequence
  sgRNA
  Gm20489_14
cttgtagaatggtctgcggg

SEQ ID NO: 22816 - DNA, 20 bp, Artificial Sequence
  sgRNA
  Gm20489_15
ggagcaacagagatcgaagc

SEQ ID NO: 22817 - DNA, 20 bp, Artificial Sequence
  sgRNA
  Gm20489_16
ggtgggcgatcagatgaaga

SEQ ID NO: 22818 - DNA, 20 bp, Artificial Sequence
  sgRNA
  Gm20489_17
ctcccagcaaggtctcccaa

SEQ ID NO: 22819 - DNA, 20 bp, Artificial Sequence
  sgRNA
  Gm20489_18
atctggttactgaataccaa

SEQ ID NO: 22820 - DNA, 20 bp, Artificial Sequence
  sgRNA
  Gm20489_19
acagccagaagtaatctctt

SEQ ID NO: 22821 - DNA, 20 bp, Artificial Sequence
  sgRNA
  Gm20489_20
ctcttcctgtcaaagacacc

SEQ ID NO: 22822 - DNA, 20 bp, Artificial Sequence
  sgRNA
  Gm20518_1
gggttctacttcactcccaa

SEQ ID NO: 22823 - DNA, 20 bp, Artificial Sequence
  sgRNA
  Gm20518_2
gggttgatagacgcctcata

SEQ ID NO: 22824 - DNA, 20 bp, Artificial Sequence
  sgRNA
  Gm20518_3
ccgtcgtcagaaagatgtag

SEQ ID NO: 22825 - DNA, 20 bp, Artificial Sequence
  sgRNA
  Gm20518_4
tcactcttatcctcacacgt

SEQ ID NO: 22826 - DNA, 20 bp, Artificial Sequence
  sgRNA
  Gm20518_5
actacatctttctgacgacg

SEQ ID NO: 22827 - DNA, 20 bp, Artificial Sequence
  sgRNA
  Gm20518_6
tgagctgtacctgccatcga

SEQ ID NO: 22828 - DNA, 20 bp, Artificial Sequence
  sgRNA
  Gm20518_7
tggtccaccggctacgccag

SEQ ID NO: 22829 - DNA, 20 bp, Artificial Sequence
  sgRNA
  Gm20518_8
gctttgactatggtccagat

SEQ ID NO: 22830 - DNA, 20 bp, Artificial Sequence
  sgRNA
  Gm20518_9
gaaactgtggatctgcggca

SEQ ID NO: 22831 - DNA, 20 bp, Artificial Sequence
  sgRNA
  Gm20518_10
ggggtgtcagcagtaccgca

SEQ ID NO: 22832 - DNA, 20 bp, Artificial Sequence
  sgRNA
  Gm20518_11
gaccagccagagcggagctt

SEQ ID NO: 22833 - DNA, 20 bp, Artificial Sequence
  sgRNA
  Gm20518_12
cagccactgcagcatcatgt

SEQ ID NO: 22834 - DNA, 20 bp, Artificial Sequence
  sgRNA
  Gm20518_13
gtggaggtcatggtgcctca

SEQ ID NO: 22835 - DNA, 20 bp, Artificial Sequence
  sgRNA
  Gm20518_14
cggtgacagtgagaaccagc

SEQ ID NO: 22836 - DNA, 20 bp, Artificial Sequence
  sgRNA
  Gm20518_15
cgtgacatgcaaactgccca

SEQ ID NO: 22837 - DNA, 20 bp, Artificial Sequence
  sgRNA
  Gm20518_16
ccactacatctttctgacga

SEQ ID NO: 22838 - DNA, 20 bp, Artificial Sequence
  sgRNA
  Gm20518_17
atagacgcctcatagggtgg

SEQ ID NO: 22839 - DNA, 20 bp, Artificial Sequence
  sgRNA
  Gm20518_18
gacatggcagaggcgaagat

SEQ ID NO: 22840 - DNA, 20 bp, Artificial Sequence
  sgRNA
  Gm20518_19
ccagctacagaagcaccgcc

SEQ ID NO: 22841 - DNA, 20 bp, Artificial Sequence
  sgRNA
  Gm20518_20
cttcctccttatacaactgg

SEQ ID NO: 22842 - DNA, 20 bp, Artificial Sequence
  sgRNA
  Gm21970_1
ccaacgatctcaaattctgg

SEQ ID NO: 22843 - DNA, 20 bp, Artificial Sequence
  sgRNA
  Gm21970_2
cttactgcattcaagttcaa

SEQ ID NO: 22844 - DNA, 20 bp, Artificial Sequence
  sgRNA
  Gm21970_3
agagaagtcgcactgagtcg

SEQ ID NO: 22845 - DNA, 20 bp, Artificial Sequence
  sgRNA
  Gm21970_4
tgaatgcagtaagttgtcca

SEQ ID NO: 22846 - DNA, 20 bp, Artificial Sequence
  sgRNA
  Gm21970_5
gcaggtgtaaagactcagca

SEQ ID NO: 22847 - DNA, 20 bp, Artificial Sequence
  sgRNA
  Gm21970_6
caatgtcaccttctgccccg

SEQ ID NO: 22848 - DNA, 20 bp, Artificial Sequence
  sgRNA
  Gm21970_7
tgtgtctccgtacgactctg

SEQ ID NO: 22849 - DNA, 20 bp, Artificial Sequence
  sgRNA
  Gm21970_8
attcattctgaccttctcag

SEQ ID NO: 22850 - DNA, 20 bp, Artificial Sequence
  sgRNA
  Gm21970_9
ttgagaatgagcctgagacg

SEQ ID NO: 22851 - DNA, 20 bp, Artificial Sequence
  sgRNA
  Gm21970_10
tggcggatgaacattcggag

SEQ ID NO: 22852 - DNA, 20 bp, Artificial Sequence
  sgRNA
  Gm21970_11
caggtgtaaagactcagcaa

SEQ ID NO: 22853 - DNA, 20 bp, Artificial Sequence
  sgRNA
  Gm21970_12
agaccacataaacgtgacga

SEQ ID NO: 22854 - DNA, 20 bp, Artificial Sequence
  sgRNA
  Gm21970_13
gattctatctgcatctcagg

SEQ ID NO: 22855 - DNA, 20 bp, Artificial Sequence
  sgRNA
  Gm21970_14
tccacggctccaggttccgg

SEQ ID NO: 22856 - DNA, 20 bp, Artificial Sequence
  sgRNA
  Gm21970_15
atctgttctttgatgacaaa

SEQ ID NO: 22857 - DNA, 20 bp, Artificial Sequence
  sgRNA
  Gm21970_16
cggaggacctcagagtcgta

SEQ ID NO: 22858 - DNA, 20 bp, Artificial Sequence
  sgRNA
  Gm21970_17
ggcggatgaacattcggagt

SEQ ID NO: 22859 - DNA, 20 bp, Artificial Sequence
  sgRNA
  Gm21970_18
atttcaagaacattctacag

SEQ ID NO: 22860 - DNA, 20 bp, Artificial Sequence
  sgRNA
  Gm21970_19
attctgaccttctcaggggg

SEQ ID NO: 22861 - DNA, 20 bp, Artificial Sequence
  sgRNA
  Gm21970_20
aaatgcatcgtccttcagcc

SEQ ID NO: 22862 - DNA, 20 bp, Artificial Sequence
  sgRNA
  Gm21973_1
gcatctttccaccagttccg

SEQ ID NO: 22863 - DNA, 20 bp, Artificial Sequence
  sgRNA
  Gm21973_2
ccttgaaagacacaactgtg

SEQ ID NO: 22864 - DNA, 20 bp, Artificial Sequence
  sgRNA
  Gm21973_3
gttccggggccaaaaataaa

SEQ ID NO: 22865 - DNA, 20 bp, Artificial Sequence
  sgRNA
  Gm21973_4
gtctgggcagtggctttgaa

SEQ ID NO: 22866 - DNA, 20 bp, Artificial Sequence
  sgRNA
  Gm21973_5
acagatgacagcagagagaa

SEQ ID NO: 22867 - DNA, 20 bp, Artificial Sequence
  sgRNA
  Gm21973_6
ccacacagttgtgtctttca

SEQ ID NO: 22868 - DNA, 20 bp, Artificial Sequence
  sgRNA
  Gm21973_7
cacaactgtgtggatcattg

SEQ ID NO: 22869 - DNA, 20 bp, Artificial Sequence
  sgRNA
  Gm21973_8
cggaactggtggaaagatgc

SEQ ID NO: 22870 - DNA, 20 bp, Artificial Sequence
  sgRNA
  Gm21973_9
catctgtttgattatggtct

SEQ ID NO: 22871 - DNA, 20 bp, Artificial Sequence
  sgRNA
  Gm21973_10
tttgattatggtctgggcag

SEQ ID NO: 22872 - DNA, 20 bp, Artificial Sequence
  sgRNA
  Gm21973_11
tgctgtcatctgtttgatta

SEQ ID NO: 22873 - DNA, 20 bp, Artificial Sequence
  sgRNA
  Gm21973_12
ctgcatctttccaccagttc

SEQ ID NO: 22874 - DNA, 20 bp, Artificial Sequence
  sgRNA
  Gm21973_13
tcatctgtttgattatggtc

SEQ ID NO: 22875 - DNA, 20 bp, Artificial Sequence
  sgRNA
  Gm21973_14
tgcatctttccaccagttcc

SEQ ID NO: 22876 - DNA, 20 bp, Artificial Sequence
  sgRNA
  Gm21973_15
ggtctgggcagtggctttga

SEQ ID NO: 22877 - DNA, 20 bp, Artificial Sequence
  sgRNA
  Gm21985_1
tcatcaccttcagggttccg

SEQ ID NO: 22878 - DNA, 20 bp, Artificial Sequence
  sgRNA
  Gm21985_2
tgtcaccatgaaccgaactg

SEQ ID NO: 22879 - DNA, 20 bp, Artificial Sequence
  sgRNA
  Gm21985_3
gagccaataacgatcaccca

SEQ ID NO: 22880 - DNA, 20 bp, Artificial Sequence
  sgRNA
  Gm21985_4
tctcaatccaaggcattcca

SEQ ID NO: 22881 - DNA, 20 bp, Artificial Sequence
  sgRNA
  Gm21985_5
gcttggcagccaccaccaat

SEQ ID NO: 22882 - DNA, 20 bp, Artificial Sequence
  sgRNA
  Gm21985_6
ccttatcctggccatccccg

SEQ ID NO: 22883 - DNA, 20 bp, Artificial Sequence
  sgRNA
  Gm21985_7
gttcgctcataggctcacta

SEQ ID NO: 22884 - DNA, 20 bp, Artificial Sequence
  sgRNA
  Gm21985_8
ataaatacatggcatcccgg

SEQ ID NO: 22885 - DNA, 20 bp, Artificial Sequence
  sgRNA
  Gm21985_9
ggacctctgctccatcatca

SEQ ID NO: 22886 - DNA, 20 bp, Artificial Sequence
  sgRNA
  Gm21985_10
taatccccaggatgttacgg

SEQ ID NO: 22887 - DNA, 20 bp, Artificial Sequence
  sgRNA
  Gm21985_11
ttgtgggctctgtcatcgtg

SEQ ID NO: 22888 - DNA, 20 bp, Artificial Sequence
  sgRNA
  Gm21985_12
ggaatgtcatcaatcttagt

SEQ ID NO: 22889 - DNA, 20 bp, Artificial Sequence
  sgRNA
  Gm21985_13
gataaatacatggcatcccg

SEQ ID NO: 22890 - DNA, 20 bp, Artificial Sequence
  sgRNA
  Gm21985_14
aggattctgccaattggtgg

SEQ ID NO: 22891 - DNA, 20 bp, Artificial Sequence
  sgRNA
  Gm21985_15
cattgctgcgaacccccaac

SEQ ID NO: 22892 - DNA, 20 bp, Artificial Sequence
  sgRNA
  Gm21985_16
ggaccaccccggaaccctga

SEQ ID NO: 22893 - DNA, 20 bp, Artificial Sequence
  sgRNA
  Gm21985_17
acagtaccatcaaagttatg

SEQ ID NO: 22894 - DNA, 20 bp, Artificial Sequence
  sgRNA
  Gm21985_18
ggaaagggactcacgattgt

SEQ ID NO: 22895 - DNA, 20 bp, Artificial Sequence
  sgRNA
  Gm21985_19
ggatgccatgtatttatcct

SEQ ID NO: 22896 - DNA, 20 bp, Artificial Sequence
  sgRNA
  Gm21985_20
gctgctgcaggctatcgcca

SEQ ID NO: 22897 - DNA, 20 bp, Artificial Sequence
  sgRNA
  Gm26938_1
gacgaagcgctgctctcgcg

SEQ ID NO: 22898 - DNA, 20 bp, Artificial Sequence
  sgRNA
  Gm26938_2
gcgtggacaacggctcgcag

SEQ ID NO: 22899 - DNA, 20 bp, Artificial Sequence
  sgRNA
  Gm26938_3
gggtcaccacaactaggatg

SEQ ID NO: 22900 - DNA, 20 bp, Artificial Sequence
  sgRNA
  Gm26938_4
gctcttcctcaccagcgcat

SEQ ID NO: 22901 - DNA, 20 bp, Artificial Sequence
  sgRNA
  Gm26938_5
cagatggagcgcgtggacaa

SEQ ID NO: 22902 - DNA, 20 bp, Artificial Sequence
  sgRNA
  Gm26938_6
agatgggcacaatgaacagg

SEQ ID NO: 22903 - DNA, 20 bp, Artificial Sequence
  sgRNA
  Gm26938_7
ggcggtataggaacgtaggt

SEQ ID NO: 22904 - DNA, 20 bp, Artificial Sequence
  sgRNA
  Gm26938_8
aggactctcgtggtgagcac

SEQ ID NO: 22905 - DNA, 20 bp, Artificial Sequence
  sgRNA
  Gm26938_9
ccttgtgcttccaatatctg

SEQ ID NO: 22906 - DNA, 20 bp, Artificial Sequence
  sgRNA
  Gm26938_10
ccaggtcgctgacacgaggg

SEQ ID NO: 22907 - DNA, 20 bp, Artificial Sequence
  sgRNA
  Gm26938_11
tcaccacgagagtcctcctc

SEQ ID NO: 22908 - DNA, 20 bp, Artificial Sequence
  sgRNA
  Gm26938_12
ttgtgcttccaatatctggg

SEQ ID NO: 22909 - DNA, 20 bp, Artificial Sequence
  sgRNA
  Gm26938_13
gcaatgcccacagtggcagc

SEQ ID NO: 22910 - DNA, 20 bp, Artificial Sequence
  sgRNA
  Gm26938_14
caaacacgcctgaaacgcct

SEQ ID NO: 22911 - DNA, 20 bp, Artificial Sequence
  sgRNA
  Gm26938_15
gcccacccaggtggtctgca

SEQ ID NO: 22912 - DNA, 20 bp, Artificial Sequence
  sgRNA
  Gm26938_16
tgaaggccgtgcagaccacc

SEQ ID NO: 22913 - DNA, 20 bp, Artificial Sequence
  sgRNA
  Gm26938_17
gagtcgaagtagacgtagta

SEQ ID NO: 22914 - DNA, 20 bp, Artificial Sequence
  sgRNA
  Gm26938_18
ctcaccagcgcattggcccg

SEQ ID NO: 22915 - DNA, 20 bp, Artificial Sequence
  sgRNA
  Gm26938_19
tgggcacaatgaacaggagg

SEQ ID NO: 22916 - DNA, 20 bp, Artificial Sequence
  sgRNA
  Gm26938_20
tcagggtttctgaagacagc

SEQ ID NO: 22917 - DNA, 20 bp, Artificial Sequence
  sgRNA
  Gm36028_1
gcaaagctgtcagccccaat

SEQ ID NO: 22918 - DNA, 20 bp, Artificial Sequence
  sgRNA
  Gm36028_2
aatgtgacctggttggaccg

SEQ ID NO: 22919 - DNA, 20 bp, Artificial Sequence
  sgRNA
  Gm36028_3
ccaggatctccaccgtactg

SEQ ID NO: 22920 - DNA, 20 bp, Artificial Sequence
  sgRNA
  Gm36028_4
cctgagcaaccacagtacgg

SEQ ID NO: 22921 - DNA, 20 bp, Artificial Sequence
  sgRNA
  Gm36028_5
cagtacggtggagatcctgg

SEQ ID NO: 22922 - DNA, 20 bp, Artificial Sequence
  sgRNA
  Gm36028_6
cggagcagcaggccttcgaa

SEQ ID NO: 22923 - DNA, 20 bp, Artificial Sequence
  sgRNA
  Gm36028_7
ttacgtgcacatccaaaggc

SEQ ID NO: 22924 - DNA, 20 bp, Artificial Sequence
  sgRNA
  Gm36028_8
gacccttcaactgcaaaacg

SEQ ID NO: 22925 - DNA, 20 bp, Artificial Sequence
  sgRNA
  Gm36028_9
ggccaatcagatccatccgg

SEQ ID NO: 22926 - DNA, 20 bp, Artificial Sequence
  sgRNA
  Gm36028_10
gctggtttctctgatcagcc

SEQ ID NO: 22927 - DNA, 20 bp, Artificial Sequence
  sgRNA
  Gm36028_11
agaatgccttatatgaagga

SEQ ID NO: 22928 - DNA, 20 bp, Artificial Sequence
  sgRNA
  Gm36028_12
cagagatgaacgaaaacaac

SEQ ID NO: 22929 - DNA, 20 bp, Artificial Sequence
  sgRNA
  Gm36028_13
tgaaggagaactcacagtcg

SEQ ID NO: 22930 - DNA, 20 bp, Artificial Sequence
  sgRNA
  Gm36028_14
tcgaggctcacgtcagtgaa

SEQ ID NO: 22931 - DNA, 20 bp, Artificial Sequence
  sgRNA
  Gm36028_15
gagcacagtcaagctgatag

SEQ ID NO: 22932 - DNA, 20 bp, Artificial Sequence
  sgRNA
  Gm36028_16
accggccaatcagatccatc

SEQ ID NO: 22933 - DNA, 20 bp, Artificial Sequence
  sgRNA
  Gm36028_17
gatcttgtcaaacttcacct

SEQ ID NO: 22934 - DNA, 20 bp, Artificial Sequence
  sgRNA
  Gm36028_18
tgtgctctctcctctcccat

SEQ ID NO: 22935 - DNA, 20 bp, Artificial Sequence
  sgRNA
  Gm36028_19
gctgtcagccccaatgggag

SEQ ID NO: 22936 - DNA, 20 bp, Artificial Sequence
  sgRNA
  Gm36028_20
ccacacagctaacccttcga

SEQ ID NO: 22937 - DNA, 20 bp, Artificial Sequence
  sgRNA
  Gm37388_1
gagcctccagagtggatcag

SEQ ID NO: 22938 - DNA, 20 bp, Artificial Sequence
  sgRNA
  Gm37388_2
gtacacagcgctgcgctgtt

SEQ ID NO: 22939 - DNA, 20 bp, Artificial Sequence
  sgRNA
  Gm37388_3
cctgatcatcgccatctgcg

SEQ ID NO: 22940 - DNA, 20 bp, Artificial Sequence
  sgRNA
  Gm37388_4
agagaaacgccagtcagtgt

SEQ ID NO: 22941 - DNA, 20 bp, Artificial Sequence
  sgRNA
  Gm37388_5
acgccagtcagtgttgggcg

SEQ ID NO: 22942 - DNA, 20 bp, Artificial Sequence
  sgRNA
  Gm37388_6
tgttcggcgacgcccaccga

SEQ ID NO: 22943 - DNA, 20 bp, Artificial Sequence
  sgRNA
  Gm37388_7
gagaaacgccagtcagtgtt

SEQ ID NO: 22944 - DNA, 20 bp, Artificial Sequence
  sgRNA
  Gm37388_8
aagccccgcccaacactgac

SEQ ID NO: 22945 - DNA, 20 bp, Artificial Sequence
  sgRNA
  Gm37388_9
tgggaccctgaggtaggctg

SEQ ID NO: 22946 - DNA, 20 bp, Artificial Sequence
  sgRNA
  Gm37388_10
ccgatggagcctgtgctcca

SEQ ID NO: 22947 - DNA, 20 bp, Artificial Sequence
  sgRNA
  Gm37388_11
gcagtagcgtgagcaccaac

SEQ ID NO: 22948 - DNA, 20 bp, Artificial Sequence
  sgRNA
  Gm37388_12
gtctcatctaaggtgtcagc

SEQ ID NO: 22949 - DNA, 20 bp, Artificial Sequence
  sgRNA
  Gm37388_13
tctgtagagctgggaccctg

SEQ ID NO: 22950 - DNA, 20 bp, Artificial Sequence
  sgRNA
  Gm37388_14
aaacgccagtcagtgttggg

SEQ ID NO: 22951 - DNA, 20 bp, Artificial Sequence
  sgRNA
  Gm37388_15
ttcagccccagcctacctca

SEQ ID NO: 22952 - DNA, 20 bp, Artificial Sequence
  sgRNA
  Gm37388_16
cagcctctgatccactctgg

SEQ ID NO: 22953 - DNA, 20 bp, Artificial Sequence
  sgRNA
  Gm37388_17
gctgggaccctgaggtaggc

SEQ ID NO: 22954 - DNA, 20 bp, Artificial Sequence
  sgRNA
  Gm37388_18
ttctctcaagcccagagacc

SEQ ID NO: 22955 - DNA, 20 bp, Artificial Sequence
  sgRNA
  Gm37388_19
ggctggggctgaaggccatg

SEQ ID NO: 22956 - DNA, 20 bp, Artificial Sequence
  sgRNA
  Gm37388_20
ccctggagcacaggctccat

SEQ ID NO: 22957 - DNA, 20 bp, Artificial Sequence
  sgRNA
  Gm42416_1
ttccacatagaccctgttag

SEQ ID NO: 22958 - DNA, 20 bp, Artificial Sequence
  sgRNA
  Gm42416_2
acggaaatctttagaccggg

SEQ ID NO: 22959 - DNA, 20 bp, Artificial Sequence
  sgRNA
  Gm42416_3
acactcgtggatactcgcga

SEQ ID NO: 22960 - DNA, 20 bp, Artificial Sequence
  sgRNA
  Gm42416_4
gtagtcaggcacgtgctgca

SEQ ID NO: 22961 - DNA, 20 bp, Artificial Sequence
  sgRNA
  Gm42416_5
ttagtgcttactgtcacgga

SEQ ID NO: 22962 - DNA, 20 bp, Artificial Sequence
  sgRNA
  Gm42416_6
ttatctctggagtttcctcc

SEQ ID NO: 22963 - DNA, 20 bp, Artificial Sequence
  sgRNA
  Gm42416_7
atacgagagaattctccagt

SEQ ID NO: 22964 - DNA, 20 bp, Artificial Sequence
  sgRNA
  Gm42416_8
agtgcgatgacagtgcccac

SEQ ID NO: 22965 - DNA, 20 bp, Artificial Sequence
  sgRNA
  Gm42416_9
gtatcgagcgctcagaccca

SEQ ID NO: 22966 - DNA, 20 bp, Artificial Sequence
  sgRNA
  Gm42416_10
aatacgagagaattctccag

SEQ ID NO: 22967 - DNA, 20 bp, Artificial Sequence
  sgRNA
  Gm42416_11
cgcgcaccttagccaccaca

SEQ ID NO: 22968 - DNA, 20 bp, Artificial Sequence
  sgRNA
  Gm42416_12
atgcctcagatttagacgaa

SEQ ID NO: 22969 - DNA, 20 bp, Artificial Sequence
  sgRNA
  Gm42416_13
tttacccgttcgtcgttgga

SEQ ID NO: 22970 - DNA, 20 bp, Artificial Sequence
  sgRNA
  Gm42416_14
gatccactactccatccctg

SEQ ID NO: 22971 - DNA, 20 bp, Artificial Sequence
  sgRNA
  Gm42416_15
cgcccgtatacaaacctacg

SEQ ID NO: 22972 - DNA, 20 bp, Artificial Sequence
  sgRNA
  Gm42416_16
gcagcagcgtgagcactagc

SEQ ID NO: 22973 - DNA, 20 bp, Artificial Sequence
  sgRNA
  Gm42416_17
ggtccttcaccagcaccaga

SEQ ID NO: 22974 - DNA, 20 bp, Artificial Sequence
  sgRNA
  Gm42416_18
gtgcttactgtcacggacgg

SEQ ID NO: 22975 - DNA, 20 bp, Artificial Sequence
  sgRNA
  Gm42416_19
tctctggtggaatcgtgagc

SEQ ID NO: 22976 - DNA, 20 bp, Artificial Sequence
  sgRNA
  Gm42416_20
gcactggagcacaccattac

SEQ ID NO: 22977 - DNA, 20 bp, Artificial Sequence
  sgRNA
  Gm42957_1
gatgcttcattccggcccca

SEQ ID NO: 22978 - DNA, 20 bp, Artificial Sequence
  sgRNA
  Gm42957_2
gcaggcacgagaccaaagag

SEQ ID NO: 22979 - DNA, 20 bp, Artificial Sequence
  sgRNA
  Gm42957_3
gcccttccactggctcacgt

SEQ ID NO: 22980 - DNA, 20 bp, Artificial Sequence
  sgRNA
  Gm42957_4
aagggaacaggcatactggg

SEQ ID NO: 22981 - DNA, 20 bp, Artificial Sequence
  sgRNA
  Gm42957_5
gcccagactttccagcccat

SEQ ID NO: 22982 - DNA, 20 bp, Artificial Sequence
  sgRNA
  Gm42957_6
tgccctggagtcagccaaaa

SEQ ID NO: 22983 - DNA, 20 bp, Artificial Sequence
  sgRNA
  Gm42957_7
tctctagtagagacatccct

SEQ ID NO: 22984 - DNA, 20 bp, Artificial Sequence
  sgRNA
  Gm42957_8
gtttatcgttgctctatagg

SEQ ID NO: 22985 - DNA, 20 bp, Artificial Sequence
  sgRNA
  Gm42957_9
ccgagtggaccaggaaaagt

SEQ ID NO: 22986 - DNA, 20 bp, Artificial Sequence
  sgRNA
  Gm42957_10
tgcctgtgacaatgtcctat

SEQ ID NO: 22987 - DNA, 20 bp, Artificial Sequence
  sgRNA
  Gm42957_11
ggaagctcagttcccagata

SEQ ID NO: 22988 - DNA, 20 bp, Artificial Sequence
  sgRNA
  Gm42957_12
aaacagattcgacaactgga

SEQ ID NO: 22989 - DNA, 20 bp, Artificial Sequence
  sgRNA
  Gm42957_13
ccatgtaccaaaggccacct

SEQ ID NO: 22990 - DNA, 20 bp, Artificial Sequence
  sgRNA
  Gm42957_14
accacccacgactcttcaca

SEQ ID NO: 22991 - DNA, 20 bp, Artificial Sequence
  sgRNA
  Gm42957_15
cctgctgtgaatatgcacct

SEQ ID NO: 22992 - DNA, 20 bp, Artificial Sequence
  sgRNA
  Gm42957_16
ttatgagattcgcctattga

SEQ ID NO: 22993 - DNA, 20 bp, Artificial Sequence
  sgRNA
  Gm42957_17
gggcatctgttgagttcccc

SEQ ID NO: 22994 - DNA, 20 bp, Artificial Sequence
  sgRNA
  Gm42957_18
ggtggccctgtgaagagtcg

SEQ ID NO: 22995 - DNA, 20 bp, Artificial Sequence
  sgRNA
  Gm42957_19
agttgtggcagacttcctcc

SEQ ID NO: 22996 - DNA, 20 bp, Artificial Sequence
  sgRNA
  Gm42957_20
atctcagaacgacatctgac

SEQ ID NO: 22997 - DNA, 20 bp, Artificial Sequence
  sgRNA
  Gm43720_1
cggcggggtgagtctccgaa

SEQ ID NO: 22998 - DNA, 20 bp, Artificial Sequence
  sgRNA
  Gm43720_2
gatgctgaagtcacattccg

SEQ ID NO: 22999 - DNA, 20 bp, Artificial Sequence
  sgRNA
  Gm43720_3
ttaggtttaagctatatccc

SEQ ID NO: 23000 - DNA, 20 bp, Artificial Sequence
  sgRNA
  Gm43720_4
ctgtgcccagaaatccgcca

SEQ ID NO: 23001 - DNA, 20 bp, Artificial Sequence
  sgRNA
  Gm43720_5
gccgagtctctgcacaactc

SEQ ID NO: 23002 - DNA, 20 bp, Artificial Sequence
  sgRNA
  Gm43720_6
tgtattgtgggtgcagcaaa

SEQ ID NO: 23003 - DNA, 20 bp, Artificial Sequence
  sgRNA
  Gm43720_7
gcagccagttcaaaggaaaa

SEQ ID NO: 23004 - DNA, 20 bp, Artificial Sequence
  sgRNA
  Gm43720_8
gagttgtgcagagactcggc

SEQ ID NO: 23005 - DNA, 20 bp, Artificial Sequence
  sgRNA
  Gm43720_9
acttctcatagtagtcccgc

SEQ ID NO: 23006 - DNA, 20 bp, Artificial Sequence
  sgRNA
  Gm43720_10
ctactatgagaagtctggcg

SEQ ID NO: 23007 - DNA, 20 bp, Artificial Sequence
  sgRNA
  Gm43720_11
gatggctctctgcagccctt

SEQ ID NO: 23008 - DNA, 20 bp, Artificial Sequence
  sgRNA
  Gm43720_12
gacagagcagaagttgatca

SEQ ID NO: 23009 - DNA, 20 bp, Artificial Sequence
  sgRNA
  Gm43720_13
cactgtcctctaccaggcca

SEQ ID NO: 23010 - DNA, 20 bp, Artificial Sequence
  sgRNA
  Gm43720_14
actatgagaagtctggcgag

SEQ ID NO: 23011 - DNA, 20 bp, Artificial Sequence
  sgRNA
  Gm43720_15
gacagagcaggaagtcagga

SEQ ID NO: 23012 - DNA, 20 bp, Artificial Sequence
  sgRNA
  Gm43720_16
ggactcagcagccagttcaa

SEQ ID NO: 23013 - DNA, 20 bp, Artificial Sequence
  sgRNA
  Gm43720_17
cagctcttctcgcattccta

SEQ ID NO: 23014 - DNA, 20 bp, Artificial Sequence
  sgRNA
  Gm43720_18
ctgctggctgagaaactcca

SEQ ID NO: 23015 - DNA, 20 bp, Artificial Sequence
  sgRNA
  Gm43720_19
cggcttacttcaactgctga

SEQ ID NO: 23016 - DNA, 20 bp, Artificial Sequence
  sgRNA
  Gm43720_20
cacattccgtggcctggtag

SEQ ID NO: 23017 - DNA, 20 bp, Artificial Sequence
  sgRNA
  Gm44511_1
gagccaaccgatgccagcga

SEQ ID NO: 23018 - DNA, 20 bp, Artificial Sequence
  sgRNA
  Gm44511_2
atgccagcgagggcaccgac

SEQ ID NO: 23019 - DNA, 20 bp, Artificial Sequence
  sgRNA
  Gm44511_3
gagaacagaacacatacaac

SEQ ID NO: 23020 - DNA, 20 bp, Artificial Sequence
  sgRNA
  Gm44511_4
gtcggtgccctcgctggcat

SEQ ID NO: 23021 - DNA, 20 bp, Artificial Sequence
  sgRNA
  Gm44511_5
gtgccctcgctggcatcggt

SEQ ID NO: 23022 - DNA, 20 bp, Artificial Sequence
  sgRNA
  Gm44511_6
gatggaggtgaatcatgctt

SEQ ID NO: 23023 - DNA, 20 bp, Artificial Sequence
  sgRNA
  Gm44511_7
tcgacattccttccaagtgt

SEQ ID NO: 23024 - DNA, 20 bp, Artificial Sequence
  sgRNA
  Gm44511_8
atcagtacaaaaaatctgcg

SEQ ID NO: 23025 - DNA, 20 bp, Artificial Sequence
  sgRNA
  Gm44511_9
caatcacgaccagcacaaga

SEQ ID NO: 23026 - DNA, 20 bp, Artificial Sequence
  sgRNA
  Gm44511_10
gaggaaggtcaagctgactg

SEQ ID NO: 23027 - DNA, 20 bp, Artificial Sequence
  sgRNA
  Gm44511_11
gctgtgcttcagacaaccgt

SEQ ID NO: 23028 - DNA, 20 bp, Artificial Sequence
  sgRNA
  Gm44511_12
cttcttgtgctggtcgtgat

SEQ ID NO: 23029 - DNA, 20 bp, Artificial Sequence
  sgRNA
  Gm44511_13
cgaccagcacaagaaggatg

SEQ ID NO: 23030 - DNA, 20 bp, Artificial Sequence
  sgRNA
  Gm44511_14
tcaagtttccaacacttgga

SEQ ID NO: 23031 - DNA, 20 bp, Artificial Sequence
  sgRNA
  Gm44511_15
ttgaccttcctcccaagtgt

SEQ ID NO: 23032 - DNA, 20 bp, Artificial Sequence
  sgRNA
  Gm44511_16
catcggttggctctgaaatt

SEQ ID NO: 23033 - DNA, 20 bp, Artificial Sequence
  sgRNA
  Gm44511_17
atgcagatttaaacctagcc

SEQ ID NO: 23034 - DNA, 20 bp, Artificial Sequence
  sgRNA
  Gm44511_18
cactttatctcctaagatgg

SEQ ID NO: 23035 - DNA, 20 bp, Artificial Sequence
  sgRNA
  Gm44511_19
agagccaaccgatgccagcg

SEQ ID NO: 23036 - DNA, 20 bp, Artificial Sequence
  sgRNA
  Gm44511_20
ggtgtaaaagccagtcttgt

SEQ ID NO: 23037 - DNA, 20 bp, Artificial Sequence
  sgRNA
  Gm44579_1
gggcctcctcctcaagccat

SEQ ID NO: 23038 - DNA, 20 bp, Artificial Sequence
  sgRNA
  Gm44579_2
catgatgatggtatagagga

SEQ ID NO: 23039 - DNA, 20 bp, Artificial Sequence
  sgRNA
  Gm44579_3
catcatgcccatgtgcaacc

SEQ ID NO: 23040 - DNA, 20 bp, Artificial Sequence
  sgRNA
  Gm44579_4
aaaagatgaccacagtcagg

SEQ ID NO: 23041 - DNA, 20 bp, Artificial Sequence
  sgRNA
  Gm44579_5
gcatgatgatggtatagagg

SEQ ID NO: 23042 - DNA, 20 bp, Artificial Sequence
  sgRNA
  Gm44579_6
ggtcttcctatggcttgagg

SEQ ID NO: 23043 - DNA, 20 bp, Artificial Sequence
  sgRNA
  Gm44579_7
cctggcctccatcctccaca

SEQ ID NO: 23044 - DNA, 20 bp, Artificial Sequence
  sgRNA
  Gm44579_8
acagtgctgctgctgttctt

SEQ ID NO: 23045 - DNA, 20 bp, Artificial Sequence
  sgRNA
  Gm44579_9
gttgcacatgggcatgatga

SEQ ID NO: 23046 - DNA, 20 bp, Artificial Sequence
  sgRNA
  Gm44579_10
tgggcatgatgatggtatag

SEQ ID NO: 23047 - DNA, 20 bp, Artificial Sequence
  sgRNA
  Gm44579_11
aagtagaaaaggtcttccta

SEQ ID NO: 23048 - DNA, 20 bp, Artificial Sequence
  sgRNA
  Gm44579_12
gatgaccacagtcaggtggg

SEQ ID NO: 23049 - DNA, 20 bp, Artificial Sequence
  sgRNA
  Gm44579_13
acaaaaagatgaccacagtc

SEQ ID NO: 23050 - DNA, 20 bp, Artificial Sequence
  sgRNA
  Gm44579_14
aaagatgaccacagtcaggt

SEQ ID NO: 23051 - DNA, 20 bp, Artificial Sequence
  sgRNA
  Gm44579_15
tcctggcctccatcctccac

SEQ ID NO: 23052 - DNA, 20 bp, Artificial Sequence
  sgRNA
  Gm44579_16
ggaggccctgtggaggatgg

SEQ ID NO: 23053 - DNA, 20 bp, Artificial Sequence
  sgRNA
  Gm44579_17
gtgggaggcacaagtagaaa

SEQ ID NO: 23054 - DNA, 20 bp, Artificial Sequence
  sgRNA
  Gm44579_18
ggaggaggccctgtggagga

SEQ ID NO: 23055 - DNA, 20 bp, Artificial Sequence
  sgRNA
  Gm44579_19
gagaaagacttgtctttgtc

SEQ ID NO: 23056 - DNA, 20 bp, Artificial Sequence
  sgRNA
  Gm44579_20
ggcttgaggaggaggccctg

SEQ ID NO: 23057 - DNA, 20 bp, Artificial Sequence
  sgRNA
  Gm49339_1
ccagggaattgtctacgccc

SEQ ID NO: 23058 - DNA, 20 bp, Artificial Sequence
  sgRNA
  Gm49339_2
agaacaaaagtagcatagga

SEQ ID NO: 23059 - DNA, 20 bp, Artificial Sequence
  sgRNA
  Gm49339_3
ccacaaaatgaagaccccca

SEQ ID NO: 23060 - DNA, 20 bp, Artificial Sequence
  sgRNA
  Gm49339_4
tgggcgtagacaattccctg

SEQ ID NO: 23061 - DNA, 20 bp, Artificial Sequence
  sgRNA
  Gm49339_5
tcctcatcggataccagtat

SEQ ID NO: 23062 - DNA, 20 bp, Artificial Sequence
  sgRNA
  Gm49339_6
gggcgtagacaattccctgg

SEQ ID NO: 23063 - DNA, 20 bp, Artificial Sequence
  sgRNA
  Gm49339_7
ctgggcgtagacaattccct

SEQ ID NO: 23064 - DNA, 20 bp, Artificial Sequence
  sgRNA
  Gm49339_8
gcccatactggtatccgatg

SEQ ID NO: 23065 - DNA, 20 bp, Artificial Sequence
  sgRNA
  Gm49339_9
gctgttactcccaaccacaa

SEQ ID NO: 23066 - DNA, 20 bp, Artificial Sequence
  sgRNA
  Gm49339_10
gcatggcctctcttggaccc

SEQ ID NO: 23067 - DNA, 20 bp, Artificial Sequence
  sgRNA
  Gm49339_11
agagggacttgagtgtccca

SEQ ID NO: 23068 - DNA, 20 bp, Artificial Sequence
  sgRNA
  Gm49339_12
aaaaccctccaggcttcaga

SEQ ID NO: 23069 - DNA, 20 bp, Artificial Sequence
  sgRNA
  Gm49339_13
ccttattcctggtttccaga

SEQ ID NO: 23070 - DNA, 20 bp, Artificial Sequence
  sgRNA
  Gm49339_14
gccttattcctggtttccag

SEQ ID NO: 23071 - DNA, 20 bp, Artificial Sequence
  sgRNA
  Gm49339_15
tcctctacacccactgaaga

SEQ ID NO: 23072 - DNA, 20 bp, Artificial Sequence
  sgRNA
  Gm49339_16
tgcagctcatccatagtatt

SEQ ID NO: 23073 - DNA, 20 bp, Artificial Sequence
  sgRNA
  Gm49339_17
aatgaatctgccaaatacta

SEQ ID NO: 23074 - DNA, 20 bp, Artificial Sequence
  sgRNA
  Gm49339_18
gcatatgaggttgtcatgct

SEQ ID NO: 23075 - DNA, 20 bp, Artificial Sequence
  sgRNA
  Gm49339_19
agtagcataggatggctgat

SEQ ID NO: 23076 - DNA, 20 bp, Artificial Sequence
  sgRNA
  Gm49339_20
ttgggacactcaagtccctc

SEQ ID NO: 23077 - DNA, 20 bp, Artificial Sequence
  sgRNA
  Gm49368_1
gctgccccaaagcgacccca

SEQ ID NO: 23078 - DNA, 20 bp, Artificial Sequence
  sgRNA
  Gm49368_2
aagccaatatgctgataccg

SEQ ID NO: 23079 - DNA, 20 bp, Artificial Sequence
  sgRNA
  Gm49368_3
cattactatgagaagacccg

SEQ ID NO: 23080 - DNA, 20 bp, Artificial Sequence
  sgRNA
  Gm49368_4
cactcatgttaaagtcctgg

SEQ ID NO: 23081 - DNA, 20 bp, Artificial Sequence
  sgRNA
  Gm49368_5
cctgcgcctcaattatacac

SEQ ID NO: 23082 - DNA, 20 bp, Artificial Sequence
  sgRNA
  Gm49368_6
agtgtgactacagcacaagc

SEQ ID NO: 23083 - DNA, 20 bp, Artificial Sequence
  sgRNA
  Gm49368_7
atgacatccttataatccaa

SEQ ID NO: 23084 - DNA, 20 bp, Artificial Sequence
  sgRNA
  Gm49368_8
aactggtcggaggttcccaa

SEQ ID NO: 23085 - DNA, 20 bp, Artificial Sequence
  sgRNA
  Gm49368_9
tgggtagtagacggtaacct

SEQ ID NO: 23086 - DNA, 20 bp, Artificial Sequence
  sgRNA
  Gm49368_10
ccatagccagaactggtcgg

SEQ ID NO: 23087 - DNA, 20 bp, Artificial Sequence
  sgRNA
  Gm49368_11
tgatgtaccagtcaaatgat

SEQ ID NO: 23088 - DNA, 20 bp, Artificial Sequence
  sgRNA
  Gm49368_12
tcacattgttgatctgaaca

SEQ ID NO: 23089 - DNA, 20 bp, Artificial Sequence
  sgRNA
  Gm49368_13
ccgtgtccgcaagaacacca

SEQ ID NO: 23090 - DNA, 20 bp, Artificial Sequence
  sgRNA
  Gm49368_14
aatcctgtaccactcattgt

SEQ ID NO: 23091 - DNA, 20 bp, Artificial Sequence
  sgRNA
  Gm49368_15
actgcctgtcactttggcga

SEQ ID NO: 23092 - DNA, 20 bp, Artificial Sequence
  sgRNA
  Gm49368_16
agggatgaccctgatcaccg

SEQ ID NO: 23093 - DNA, 20 bp, Artificial Sequence
  sgRNA
  Gm49368_17
gaagccatgacacaaggcta

SEQ ID NO: 23094 - DNA, 20 bp, Artificial Sequence
  sgRNA
  Gm49368_18
catccatagccagaactggt

SEQ ID NO: 23095 - DNA, 20 bp, Artificial Sequence
  sgRNA
  Gm49368_19
gatcttcgcagcattctccc

SEQ ID NO: 23096 - DNA, 20 bp, Artificial Sequence
  sgRNA
  Gm49368_20
gagccccacactagcatcaa

SEQ ID NO: 23097 - DNA, 20 bp, Artificial Sequence
  sgRNA
  Gm49378_1
tggcgatccgtgctgagcgt

SEQ ID NO: 23098 - DNA, 20 bp, Artificial Sequence
  sgRNA
  Gm49378_2
gcacggatcgccaccaccag

SEQ ID NO: 23099 - DNA, 20 bp, Artificial Sequence
  sgRNA
  Gm49378_3
ggtggagccgacgctcagca

SEQ ID NO: 23100 - DNA, 20 bp, Artificial Sequence
  sgRNA
  Gm49378_4
cgagagcagtacactctgta

SEQ ID NO: 23101 - DNA, 20 bp, Artificial Sequence
  sgRNA
  Gm49378_5
ccggcgctctaacatgtcag

SEQ ID NO: 23102 - DNA, 20 bp, Artificial Sequence
  sgRNA
  Gm49378_6
ggatggcgaagacaaagaag

SEQ ID NO: 23103 - DNA, 20 bp, Artificial Sequence
  sgRNA
  Gm49378_7
ataacggatgaactttaaag

SEQ ID NO: 23104 - DNA, 20 bp, Artificial Sequence
  sgRNA
  Gm49378_8
gtacagacagtagagttctt

SEQ ID NO: 23105 - DNA, 20 bp, Artificial Sequence
  sgRNA
  Gm49378_9
aaagatgtagtacagctcca

SEQ ID NO: 23106 - DNA, 20 bp, Artificial Sequence
  sgRNA
  Gm49378_10
catagtagaaaactgagtag

SEQ ID NO: 23107 - DNA, 20 bp, Artificial Sequence
  sgRNA
  Gm49378_11
cccctgacatgttagagcgc

SEQ ID NO: 23108 - DNA, 20 bp, Artificial Sequence
  sgRNA
  Gm49378_12
gtagtacagctccacggaga

SEQ ID NO: 23109 - DNA, 20 bp, Artificial Sequence
  sgRNA
  Gm49378_13
tgaggttaacatagatataa

SEQ ID NO: 23110 - DNA, 20 bp, Artificial Sequence
  sgRNA
  Gm49378_14
gggaagactaccgctggtgg

SEQ ID NO: 23111 - DNA, 20 bp, Artificial Sequence
  sgRNA
  Gm49378_15
tttggctactctttactgac

SEQ ID NO: 23112 - DNA, 20 bp, Artificial Sequence
  sgRNA
  Gm49378_16
ggtagtcttccccagacagc

SEQ ID NO: 23113 - DNA, 20 bp, Artificial Sequence
  sgRNA
  Gm49378_17
gtgctgagcgtcggctccac

SEQ ID NO: 23114 - DNA, 20 bp, Artificial Sequence
  sgRNA
  Gm49378_18
ctgctctcgaccccagactg

SEQ ID NO: 23115 - DNA, 20 bp, Artificial Sequence
  sgRNA
  Gm49378_19
ctggaagtaggtgagcgcaa

SEQ ID NO: 23116 - DNA, 20 bp, Artificial Sequence
  sgRNA
  Gm49378_20
tatgtcttcttcctcatgct

SEQ ID NO: 23117 - DNA, 20 bp, Artificial Sequence
  sgRNA
  Gm5150_1
aacttgatatattcttacac

SEQ ID NO: 23118 - DNA, 20 bp, Artificial Sequence
  sgRNA
  Gm5150_2
ggtaccgaggtgtaggacac

SEQ ID NO: 23119 - DNA, 20 bp, Artificial Sequence
  sgRNA
  Gm5150_3
acctgatgggccccacaggg

SEQ ID NO: 23120 - DNA, 20 bp, Artificial Sequence
  sgRNA
  Gm5150_4
caccttcaactctttcccag

SEQ ID NO: 23121 - DNA, 20 bp, Artificial Sequence
  sgRNA
  Gm5150_5
agtgacatccctcatccctg

SEQ ID NO: 23122 - DNA, 20 bp, Artificial Sequence
  sgRNA
  Gm5150_6
gggcccatcaggtggtaccg

SEQ ID NO: 23123 - DNA, 20 bp, Artificial Sequence
  sgRNA
  Gm5150_7
ccttggatccaaactactgc

SEQ ID NO: 23124 - DNA, 20 bp, Artificial Sequence
  sgRNA
  Gm5150_8
gttacatccctcctccctgt

SEQ ID NO: 23125 - DNA, 20 bp, Artificial Sequence
  sgRNA
  Gm5150_9
agttacatccctcctccctg

SEQ ID NO: 23126 - DNA, 20 bp, Artificial Sequence
  sgRNA
  Gm5150_10
gggcccatgaggtggtaccg

SEQ ID NO: 23127 - DNA, 20 bp, Artificial Sequence
  sgRNA
  Gm5150_11
accacctgatgggccccaca

SEQ ID NO: 23128 - DNA, 20 bp, Artificial Sequence
  sgRNA
  Gm5150_12
catgggccccacagggatga

SEQ ID NO: 23129 - DNA, 20 bp, Artificial Sequence
  sgRNA
  Gm5150_13
accacctcatgggccccaca

SEQ ID NO: 23130 - DNA, 20 bp, Artificial Sequence
  sgRNA
  Gm5150_14
acacctcggtaccacctgat

SEQ ID NO: 23131 - DNA, 20 bp, Artificial Sequence
  sgRNA
  Gm5150_15
ctggaacttcacacaatagt

SEQ ID NO: 23132 - DNA, 20 bp, Artificial Sequence
  sgRNA
  Gm5150_16
gatgggccccacagggagga

SEQ ID NO: 23133 - DNA, 20 bp, Artificial Sequence
  sgRNA
  Gm5150_17
ccagcagcaggatcaacagc

SEQ ID NO: 23134 - DNA, 20 bp, Artificial Sequence
  sgRNA
  Gm5150_18
tgctacaaagagaagaaacc

SEQ ID NO: 23135 - DNA, 20 bp, Artificial Sequence
  sgRNA
  Gm5150_19
tcatccctgtggggcccatg

SEQ ID NO: 23136 - DNA, 20 bp, Artificial Sequence
  sgRNA
  Gm5150_20
ttacatccctcctccctgtg

SEQ ID NO: 23137 - DNA, 20 bp, Artificial Sequence
  sgRNA
  Gm5155_1
ccacttgcatggaagcacaa

SEQ ID NO: 23138 - DNA, 20 bp, Artificial Sequence
  sgRNA
  Gm5155_2
gtatgcactccccatgatgg

SEQ ID NO: 23139 - DNA, 20 bp, Artificial Sequence
  sgRNA
  Gm5155_3
tgtagaatacagcagagcca

SEQ ID NO: 23140 - DNA, 20 bp, Artificial Sequence
  sgRNA
  Gm5155_4
gccaacggatggagactcca

SEQ ID NO: 23141 - DNA, 20 bp, Artificial Sequence
  sgRNA
  Gm5155_5
atttacaaggagttgaacat

SEQ ID NO: 23142 - DNA, 20 bp, Artificial Sequence
  sgRNA
  Gm5155_6
agtggtgtactcacttgcaa

SEQ ID NO: 23143 - DNA, 20 bp, Artificial Sequence
  sgRNA
  Gm5155_7
agtgacattctggatcagca

SEQ ID NO: 23144 - DNA, 20 bp, Artificial Sequence
  sgRNA
  Gm5155_8
tattgcagtgaagaaatttg

SEQ ID NO: 23145 - DNA, 20 bp, Artificial Sequence
  sgRNA
  Gm5155_9
ggtgacattgtagatttgca

SEQ ID NO: 23146 - DNA, 20 bp, Artificial Sequence
  sgRNA
  Gm5155_10
gctgagttggcactttgaag

SEQ ID NO: 23147 - DNA, 20 bp, Artificial Sequence
  sgRNA
  Gm5155_11
ccatggaatccactatctgg

SEQ ID NO: 23148 - DNA, 20 bp, Artificial Sequence
  sgRNA
  Gm5155_12
ccatggacatcaccattatg

SEQ ID NO: 23149 - DNA, 20 bp, Artificial Sequence
  sgRNA
  Gm5155_13
gtgacagcaagtagaaaggg

SEQ ID NO: 23150 - DNA, 20 bp, Artificial Sequence
  sgRNA
  Gm5155_14
gcttgcacacagtggaagag

SEQ ID NO: 23151 - DNA, 20 bp, Artificial Sequence
  sgRNA
  Gm5155_15
tgtaccagaaaagggataga

SEQ ID NO: 23152 - DNA, 20 bp, Artificial Sequence
  sgRNA
  Gm5155_16
ctttccccttcaacaatgct

SEQ ID NO: 23153 - DNA, 20 bp, Artificial Sequence
  sgRNA
  Gm5155_17
tccccttcaacaatgctggg

SEQ ID NO: 23154 - DNA, 20 bp, Artificial Sequence
  sgRNA
  Gm5155_18
agtgacatcaattatcagca

SEQ ID NO: 23155 - DNA, 20 bp, Artificial Sequence
  sgRNA
  Gm5155_19
acaaccttagtctggttcag

SEQ ID NO: 23156 - DNA, 20 bp, Artificial Sequence
  sgRNA
  Gm5155_20
aatcatcgccatggatccat

SEQ ID NO: 23157 - DNA, 20 bp, Artificial Sequence
  sgRNA
  Gm5724_1
agacaaggattctaacccgt

SEQ ID NO: 23158 - DNA, 20 bp, Artificial Sequence
  sgRNA
  Gm5724_2
ggaaaaacatctgaccccac

SEQ ID NO: 23159 - DNA, 20 bp, Artificial Sequence
  sgRNA
  Gm5724_3
acgtcctcataagtcttagg

SEQ ID NO: 23160 - DNA, 20 bp, Artificial Sequence
  sgRNA
  Gm5724_4
tctccattactctcgaactt

SEQ ID NO: 23161 - DNA, 20 bp, Artificial Sequence
  sgRNA
  Gm5724_5
tctcattatcatctatacct

SEQ ID NO: 23162 - DNA, 20 bp, Artificial Sequence
  sgRNA
  Gm5724_6
tttgttccaaaataactcac

SEQ ID NO: 23163 - DNA, 20 bp, Artificial Sequence
  sgRNA
  Gm5724_7
gacaaggattctaacccgtg

SEQ ID NO: 23164 - DNA, 20 bp, Artificial Sequence
  sgRNA
  Gm5724_8
cctcatggtctacatgtaga

SEQ ID NO: 23165 - DNA, 20 bp, Artificial Sequence
  sgRNA
  Gm5724_9
ggcctttgttacacagcccg

SEQ ID NO: 23166 - DNA, 20 bp, Artificial Sequence
  sgRNA
  Gm5724_10
ctacagttgggcttatcact

SEQ ID NO: 23167 - DNA, 20 bp, Artificial Sequence
  sgRNA
  Gm5724_11
tgtgtatccaaatcactaac

SEQ ID NO: 23168 - DNA, 20 bp, Artificial Sequence
  sgRNA
  Gm5724_12
tatagttagacaaagacaga

SEQ ID NO: 23169 - DNA, 20 bp, Artificial Sequence
  sgRNA
  Gm5724_13
atcctgttagtgcagcaggc

SEQ ID NO: 23170 - DNA, 20 bp, Artificial Sequence
  sgRNA
  Gm5724_14
tctatgtaagaaatacccaa

SEQ ID NO: 23171 - DNA, 20 bp, Artificial Sequence
  sgRNA
  Gm5724_15
gttagcacagaaagatccca

SEQ ID NO: 23172 - DNA, 20 bp, Artificial Sequence
  sgRNA
  Gm5724_16
ttacaaatagagagacagtt

SEQ ID NO: 23173 - DNA, 20 bp, Artificial Sequence
  sgRNA
  Gm5724_17
gatccagtgtgtggaaacaa

SEQ ID NO: 23174 - DNA, 20 bp, Artificial Sequence
  sgRNA
  Gm5724_18
gtcttaggaggaagactgca

SEQ ID NO: 23175 - DNA, 20 bp, Artificial Sequence
  sgRNA
  Gm5724_19
ccctctacatgtagaccatg

SEQ ID NO: 23176 - DNA, 20 bp, Artificial Sequence
  sgRNA
  Gm5724_20
atatccaatccagtagctaa

SEQ ID NO: 23177 - DNA, 20 bp, Artificial Sequence
  sgRNA
  Gm5868_1
tcgctacaaatacaaccgcg

SEQ ID NO: 23178 - DNA, 20 bp, Artificial Sequence
  sgRNA
  Gm5868_2
cattcccacaactgtttacg

SEQ ID NO: 23179 - DNA, 20 bp, Artificial Sequence
  sgRNA
  Gm5868_3
tgaagacgcctagcccaata

SEQ ID NO: 23180 - DNA, 20 bp, Artificial Sequence
  sgRNA
  Gm5868_4
ggggagcaattgcaccagag

SEQ ID NO: 23181 - DNA, 20 bp, Artificial Sequence
  sgRNA
  Gm5868_5
gcgaccacgtaaacagttgt

SEQ ID NO: 23182 - DNA, 20 bp, Artificial Sequence
  sgRNA
  Gm5868_6
acagtcctcttgcagttggg

SEQ ID NO: 23183 - DNA, 20 bp, Artificial Sequence
  sgRNA
  Gm5868_7
gcagcactctcatccctatt

SEQ ID NO: 23184 - DNA, 20 bp, Artificial Sequence
  sgRNA
  Gm5868_8
aggcatggctgtagatccag

SEQ ID NO: 23185 - DNA, 20 bp, Artificial Sequence
  sgRNA
  Gm5868_9
cacacagtcctcttgcagtt

SEQ ID NO: 23186 - DNA, 20 bp, Artificial Sequence
  sgRNA
  Gm5868_10
tctggatctacagccatgcc

SEQ ID NO: 23187 - DNA, 20 bp, Artificial Sequence
  sgRNA
  Gm5868_11
acacacagtcctcttgcagt

SEQ ID NO: 23188 - DNA, 20 bp, Artificial Sequence
  sgRNA
  Gm5868_12
actctcatccctattgggct

SEQ ID NO: 23189 - DNA, 20 bp, Artificial Sequence
  sgRNA
  Gm5868_13
tcttgcagttgggcgggagg

SEQ ID NO: 23190 - DNA, 20 bp, Artificial Sequence
  sgRNA
  Gm5868_14
cagtcctcttgcagttgggc

SEQ ID NO: 23191 - DNA, 20 bp, Artificial Sequence
  sgRNA
  Gm5868_15
ctgcaagaggactgtgtgtc

SEQ ID NO: 23192 - DNA, 20 bp, Artificial Sequence
  sgRNA
  Gm5868_16
tcctcttgcagttgggcggg

SEQ ID NO: 23193 - DNA, 20 bp, Artificial Sequence
  sgRNA
  Gm5868_17
aggactgtgtgtctggaaac

SEQ ID NO: 23194 - DNA, 20 bp, Artificial Sequence
  sgRNA
  Gm5868_18
tgcagcactctcatccctat

SEQ ID NO: 23195 - DNA, 20 bp, Artificial Sequence
  sgRNA
  Gm6614_1
ctatagctggactcatcagt

SEQ ID NO: 23196 - DNA, 20 bp, Artificial Sequence
  sgRNA
  Gm6614_2
gctgttccaggtacttagac

SEQ ID NO: 23197 - DNA, 20 bp, Artificial Sequence
  sgRNA
  Gm6614_3
ttagtgctgcaggtagtcca

SEQ ID NO: 23198 - DNA, 20 bp, Artificial Sequence
  sgRNA
  Gm6614_4
tgagtccagctatagatgca

SEQ ID NO: 23199 - DNA, 20 bp, Artificial Sequence
  sgRNA
  Gm6614_5
tctatagctggactcatcag

SEQ ID NO: 23200 - DNA, 20 bp, Artificial Sequence
  sgRNA
  Gm6614_6
agacctatcatcattggtgt

SEQ ID NO: 23201 - DNA, 20 bp, Artificial Sequence
  sgRNA
  Gm6614_7
agatagttaagccagaaact

SEQ ID NO: 23202 - DNA, 20 bp, Artificial Sequence
  sgRNA
  Gm6614_8
gctccaatgtaaacaggtgc

SEQ ID NO: 23203 - DNA, 20 bp, Artificial Sequence
  sgRNA
  Gm6614_9
gtttctgatggcattaacat

SEQ ID NO: 23204 - DNA, 20 bp, Artificial Sequence
  sgRNA
  Gm6614_10
tctatgtaggaaacacccaa

SEQ ID NO: 23205 - DNA, 20 bp, Artificial Sequence
  sgRNA
  Gm6614_11
gtctgaagagaagtcacctg

SEQ ID NO: 23206 - DNA, 20 bp, Artificial Sequence
  sgRNA
  Gm6614_12
gtgaaattaagaaacacccc

SEQ ID NO: 23207 - DNA, 20 bp, Artificial Sequence
  sgRNA
  Gm6614_13
ggatgaatagcacgtaaatt

SEQ ID NO: 23208 - DNA, 20 bp, Artificial Sequence
  sgRNA
  Gm6614_14
atttggaaaatccactgcag

SEQ ID NO: 23209 - DNA, 20 bp, Artificial Sequence
  sgRNA
  Gm6614_15
ggactacctgcagcactaag

SEQ ID NO: 23210 - DNA, 20 bp, Artificial Sequence
  sgRNA
  Gm6614_16
agcaaagctccaatgtaaac

SEQ ID NO: 23211 - DNA, 20 bp, Artificial Sequence
  sgRNA
  Gm6614_17
acacacaaaaagctgtttga

SEQ ID NO: 23212 - DNA, 20 bp, Artificial Sequence
  sgRNA
  Gm6614_18
ctgaagagttgatttctcca

SEQ ID NO: 23213 - DNA, 20 bp, Artificial Sequence
  sgRNA
  Gm6614_19
agaaaaagattgcaacccat

SEQ ID NO: 23214 - DNA, 20 bp, Artificial Sequence
  sgRNA
  Gm6614_20
tttgatggtaagttgcttgc

SEQ ID NO: 23215 - DNA, 20 bp, Artificial Sequence
  sgRNA
  Gm7030_1
gagccccggttcaccgccgt

SEQ ID NO: 23216 - DNA, 20 bp, Artificial Sequence
  sgRNA
  Gm7030_2
cagcgactctgagaatccca

SEQ ID NO: 23217 - DNA, 20 bp, Artificial Sequence
  sgRNA
  Gm7030_3
cacactatccaggatatgca

SEQ ID NO: 23218 - DNA, 20 bp, Artificial Sequence
  sgRNA
  Gm7030_4
cgccctggccccgacccgag

SEQ ID NO: 23219 - DNA, 20 bp, Artificial Sequence
  sgRNA
  Gm7030_5
ccagcagcaggagaagtaga

SEQ ID NO: 23220 - DNA, 20 bp, Artificial Sequence
  sgRNA
  Gm7030_6
gcctggcctggacatggcag

SEQ ID NO: 23221 - DNA, 20 bp, Artificial Sequence
  sgRNA
  Gm7030_7
tgcatatcctggatagtgtg

SEQ ID NO: 23222 - DNA, 20 bp, Artificial Sequence
  sgRNA
  Gm7030_8
gtgcatatcctggatagtgt

SEQ ID NO: 23223 - DNA, 20 bp, Artificial Sequence
  sgRNA
  Gm7030_9
gcagctgtcgtggtgccttt

SEQ ID NO: 23224 - DNA, 20 bp, Artificial Sequence
  sgRNA
  Gm7030_10
ctgtacaaccagagtcagga

SEQ ID NO: 23225 - DNA, 20 bp, Artificial Sequence
  sgRNA
  Gm7030_11
ccatgtccaggccaggctta

SEQ ID NO: 23226 - DNA, 20 bp, Artificial Sequence
  sgRNA
  Gm7030_12
cctgactctggttgtacagg

SEQ ID NO: 23227 - DNA, 20 bp, Artificial Sequence
  sgRNA
  Gm7030_13
ccacctgtacaaccagagtc

SEQ ID NO: 23228 - DNA, 20 bp, Artificial Sequence
  sgRNA
  Gm7030_14
cgtaacccacggcggtgaac

SEQ ID NO: 23229 - DNA, 20 bp, Artificial Sequence
  sgRNA
  Gm7030_15
catgtccaggccaggcttag

SEQ ID NO: 23230 - DNA, 20 bp, Artificial Sequence
  sgRNA
  Gm7030_16
tctggttgtacaggtggagt

SEQ ID NO: 23231 - DNA, 20 bp, Artificial Sequence
  sgRNA
  Gm7030_17
ccctaagcctggcctggaca

SEQ ID NO: 23232 - DNA, 20 bp, Artificial Sequence
  sgRNA
  Gm7030_18
gccagcagcaggagaagtag

SEQ ID NO: 23233 - DNA, 20 bp, Artificial Sequence
  sgRNA
  Gm7030_19
gtaacccacggcggtgaacc

SEQ ID NO: 23234 - DNA, 20 bp, Artificial Sequence
  sgRNA
  Gm7030_20
aaccggggctcccctaagcc

SEQ ID NO: 23235 - DNA, 20 bp, Artificial Sequence
  sgRNA
  Gm884_1
ggttcaactatcattcccag

SEQ ID NO: 23236 - DNA, 20 bp, Artificial Sequence
  sgRNA
  Gm884_2
agtagtagaacgataaacct

SEQ ID NO: 23237 - DNA, 20 bp, Artificial Sequence
  sgRNA
  Gm884_3
atgtatggaaggtataccgt

SEQ ID NO: 23238 - DNA, 20 bp, Artificial Sequence
  sgRNA
  Gm884_4
taggatcttacctagccaca

SEQ ID NO: 23239 - DNA, 20 bp, Artificial Sequence
  sgRNA
  Gm884_5
gatcacggaatcacctacag

SEQ ID NO: 23240 - DNA, 20 bp, Artificial Sequence
  sgRNA
  Gm884_6
ggttcagccaccattcctat

SEQ ID NO: 23241 - DNA, 20 bp, Artificial Sequence
  sgRNA
  Gm884_7
gtaggttgtggagttatggt

SEQ ID NO: 23242 - DNA, 20 bp, Artificial Sequence
  sgRNA
  Gm884_8
ggatcttcaacaactgcgag

SEQ ID NO: 23243 - DNA, 20 bp, Artificial Sequence
  sgRNA
  Gm884_9
tcgaagtccagaacataagg

SEQ ID NO: 23244 - DNA, 20 bp, Artificial Sequence
  sgRNA
  Gm884_10
aaatccagagaacctccagc

SEQ ID NO: 23245 - DNA, 20 bp, Artificial Sequence
  sgRNA
  Gm884_11
gcttgatcctgactaggtgt

SEQ ID NO: 23246 - DNA, 20 bp, Artificial Sequence
  sgRNA
  Gm884_12
ttgagtatatttctaagccg

SEQ ID NO: 23247 - DNA, 20 bp, Artificial Sequence
  sgRNA
  Gm884_13
gggtgatgagtccaacccgg

SEQ ID NO: 23248 - DNA, 20 bp, Artificial Sequence
  sgRNA
  Gm884_14
cacactctagaatataagga

SEQ ID NO: 23249 - DNA, 20 bp, Artificial Sequence
  sgRNA
  Gm884_15
catcatgcagaacatcccat

SEQ ID NO: 23250 - DNA, 20 bp, Artificial Sequence
  sgRNA
  Gm884_16
ggagtctcagaaggttcacc

SEQ ID NO: 23251 - DNA, 20 bp, Artificial Sequence
  sgRNA
  Gm884_17
gataagttcccctgcacgag

SEQ ID NO: 23252 - DNA, 20 bp, Artificial Sequence
  sgRNA
  Gm884_18
agactaaaaaccatacacca

SEQ ID NO: 23253 - DNA, 20 bp, Artificial Sequence
  sgRNA
  Gm884_19
ctacagctcttactccgaag

SEQ ID NO: 23254 - DNA, 20 bp, Artificial Sequence
  sgRNA
  Gm884_20
agagctacaacctctataag

SEQ ID NO: 23255 - DNA, 20 bp, Artificial Sequence
  sgRNA
  Gm8909_1
cggcgcagatcactcgacgc

SEQ ID NO: 23256 - DNA, 20 bp, Artificial Sequence
  sgRNA
  Gm8909_2
gatactgacggagacacgcg

SEQ ID NO: 23257 - DNA, 20 bp, Artificial Sequence
  sgRNA
  Gm8909_3
caggctctcacacatttcag

SEQ ID NO: 23258 - DNA, 20 bp, Artificial Sequence
  sgRNA
  Gm8909_4
ctgaagatgatgtcaccctg

SEQ ID NO: 23259 - DNA, 20 bp, Artificial Sequence
  sgRNA
  Gm8909_5
tactggcagttcgcttacga

SEQ ID NO: 23260 - DNA, 20 bp, Artificial Sequence
  sgRNA
  Gm8909_6
gcagatcactcgacgcaggt

SEQ ID NO: 23261 - DNA, 20 bp, Artificial Sequence
  sgRNA
  Gm8909_7
aagcgaactgccagtacccg

SEQ ID NO: 23262 - DNA, 20 bp, Artificial Sequence
  sgRNA
  Gm8909_8
ggatgtacggctgtgacctg

SEQ ID NO: 23263 - DNA, 20 bp, Artificial Sequence
  sgRNA
  Gm8909_9
taattctgctcctttccaag

SEQ ID NO: 23264 - DNA, 20 bp, Artificial Sequence
  sgRNA
  Gm8909_10
cctcctcccgggaccttcgg

SEQ ID NO: 23265 - DNA, 20 bp, Artificial Sequence
  sgRNA
  Gm8909_11
atcgccaagggccatgagca

SEQ ID NO: 23266 - DNA, 20 bp, Artificial Sequence
  sgRNA
  Gm8909_12
tgaaccaagacctgaaaacg

SEQ ID NO: 23267 - DNA, 20 bp, Artificial Sequence
  sgRNA
  Gm8909_13
gtacggctgtgacctggggt

SEQ ID NO: 23268 - DNA, 20 bp, Artificial Sequence
  sgRNA
  Gm8909_14
ttggagtccctggatggacg

SEQ ID NO: 23269 - DNA, 20 bp, Artificial Sequence
  sgRNA
  Gm8909_15
gcgtgtctccgtcagtatca

SEQ ID NO: 23270 - DNA, 20 bp, Artificial Sequence
  sgRNA
  Gm8909_16
accatgttggagtccctgga

SEQ ID NO: 23271 - DNA, 20 bp, Artificial Sequence
  sgRNA
  Gm8909_17
ccaagacctgaaaacgtgga

SEQ ID NO: 23272 - DNA, 20 bp, Artificial Sequence
  sgRNA
  Gm8909_18
tccatccagggactccaaca

SEQ ID NO: 23273 - DNA, 20 bp, Artificial Sequence
  sgRNA
  Gm8909_19
cgaactgccagtacccgcgg

SEQ ID NO: 23274 - DNA, 20 bp, Artificial Sequence
  sgRNA
  Gm8909_20
ggagtggctccgcagatacc

SEQ ID NO: 23275 - DNA, 20 bp, Artificial Sequence
  sgRNA
  Gm9573_1
ccactgctagatgcagtggt

SEQ ID NO: 23276 - DNA, 20 bp, Artificial Sequence
  sgRNA
  Gm9573_2
ggcagtgctagatgcagtgg

SEQ ID NO: 23277 - DNA, 20 bp, Artificial Sequence
  sgRNA
  Gm9573_3
ccagtgctggatacagtggt

SEQ ID NO: 23278 - DNA, 20 bp, Artificial Sequence
  sgRNA
  Gm9573_4
accaccactgcatctagcag

SEQ ID NO: 23279 - DNA, 20 bp, Artificial Sequence
  sgRNA
  Gm9573_5
gtgatgagaaagatttccca

SEQ ID NO: 23280 - DNA, 20 bp, Artificial Sequence
  sgRNA
  Gm9573_6
gaggatctgctatgactcca

SEQ ID NO: 23281 - DNA, 20 bp, Artificial Sequence
  sgRNA
  Gm9573_7
tctagcctgacagtttccac

SEQ ID NO: 23282 - DNA, 20 bp, Artificial Sequence
  sgRNA
  Gm9573_8
gctgagcccagtggtagtcg

SEQ ID NO: 23283 - DNA, 20 bp, Artificial Sequence
  sgRNA
  Gm9573_9
gatgcagtggtggttagggt

SEQ ID NO: 23284 - DNA, 20 bp, Artificial Sequence
  sgRNA
  Gm9573_10
gctggatgaagcagtggtcg

SEQ ID NO: 23285 - DNA, 20 bp, Artificial Sequence
  sgRNA
  Gm9573_11
ggcactgctggatgaagcag

SEQ ID NO: 23286 - DNA, 20 bp, Artificial Sequence
  sgRNA
  Gm9573_12
ggcagtgctagatatagtgg

SEQ ID NO: 23287 - DNA, 20 bp, Artificial Sequence
  sgRNA
  Gm9573_13
ggagtcatagcagatcctcc

SEQ ID NO: 23288 - DNA, 20 bp, Artificial Sequence
  sgRNA
  Gm9573_14
tcccatgaccacgataacag

SEQ ID NO: 23289 - DNA, 20 bp, Artificial Sequence
  sgRNA
  Gm9573_15
gctaggtccagaggtggtcg

SEQ ID NO: 23290 - DNA, 20 bp, Artificial Sequence
  sgRNA
  Gm9573_16
cagatcctccaggatcagga

SEQ ID NO: 23291 - DNA, 20 bp, Artificial Sequence
  sgRNA
  Gm9573_17
ggttatgctggtcatagtgg

SEQ ID NO: 23292 - DNA, 20 bp, Artificial Sequence
  sgRNA
  Gm9573_18
acctccatcagaaccagcac

SEQ ID NO: 23293 - DNA, 20 bp, Artificial Sequence
  sgRNA
  Gm9573_19
tgaggcacttctggatgcag

SEQ ID NO: 23294 - DNA, 20 bp, Artificial Sequence
  sgRNA
  Gm9573_20
cattcaccccagcctccatt

SEQ ID NO: 23295 - DNA, 20 bp, Artificial Sequence
  sgRNA
  Gm9733_1
tgacctccctgcttcctgtg

SEQ ID NO: 23296 - DNA, 20 bp, Artificial Sequence
  sgRNA
  Gm9733_2
aatgttacacttgctgacta

SEQ ID NO: 23297 - DNA, 20 bp, Artificial Sequence
  sgRNA
  Gm9733_3
cagttaatatatagtttcac

SEQ ID NO: 23298 - DNA, 20 bp, Artificial Sequence
  sgRNA
  Gm9733_4
catgctcacctgtaagtccc

SEQ ID NO: 23299 - DNA, 20 bp, Artificial Sequence
  sgRNA
  Gm9733_5
caggagtagagtcatgagca

SEQ ID NO: 23300 - DNA, 20 bp, Artificial Sequence
  sgRNA
  Gm9733_6
ctgctcatgactctactcct

SEQ ID NO: 23301 - DNA, 20 bp, Artificial Sequence
  sgRNA
  Gm9733_7
tatgggccccacaggaagca

SEQ ID NO: 23302 - DNA, 20 bp, Artificial Sequence
  sgRNA
  Gm9733_8
gagaacatactctgaagagg

SEQ ID NO: 23303 - DNA, 20 bp, Artificial Sequence
  sgRNA
  Gm9733_9
ttatgggccccacaggaagc

SEQ ID NO: 23304 - DNA, 20 bp, Artificial Sequence
  sgRNA
  Gm9733_10
ttattgtctctgtcatgtac

SEQ ID NO: 23305 - DNA, 20 bp, Artificial Sequence
  sgRNA
  Gm9733_11
ttctgtggagagtatgtggc

SEQ ID NO: 23306 - DNA, 20 bp, Artificial Sequence
  sgRNA
  Gm9733_12
ggtcacagtgcagtttaaaa

SEQ ID NO: 23307 - DNA, 20 bp, Artificial Sequence
  sgRNA
  Gm9733_13
actctactcctgggacttac

SEQ ID NO: 23308 - DNA, 20 bp, Artificial Sequence
  sgRNA
  Gm9733_14
tcagaaaaatgggacaatgt

SEQ ID NO: 23309 - DNA, 20 bp, Artificial Sequence
  sgRNA
  Gm9733_15
gtgacctccctgcttcctgt

SEQ ID NO: 23310 - DNA, 20 bp, Artificial Sequence
  sgRNA
  Gm9733_16
gggccccacaggaagcaggg

SEQ ID NO: 23311 - DNA, 20 bp, Artificial Sequence
  sgRNA
  Gm9733_17
ctgaaacatttctaactctg

SEQ ID NO: 23312 - DNA, 20 bp, Artificial Sequence
  sgRNA
  Gm9733_18
ccaggagtagagtcatgagc

SEQ ID NO: 23313 - DNA, 20 bp, Artificial Sequence
  sgRNA
  Gm9733_19
ccttggacccaaacttcttc

SEQ ID NO: 23314 - DNA, 20 bp, Artificial Sequence
  sgRNA
  Gm9733_20
acaataaccagaagaagttt

SEQ ID NO: 23315 - DNA, 20 bp, Artificial Sequence
  sgRNA
  Gml_1
acatatccactattgtgaca

SEQ ID NO: 23316 - DNA, 20 bp, Artificial Sequence
  sgRNA
  Gml_2
tgtagacatagagcagccga

SEQ ID NO: 23317 - DNA, 20 bp, Artificial Sequence
  sgRNA
  Gml_3
aatagaaggtgttatgctcc

SEQ ID NO: 23318 - DNA, 20 bp, Artificial Sequence
  sgRNA
  Gml_4
gtattcgacaacactactgg

SEQ ID NO: 23319 - DNA, 20 bp, Artificial Sequence
  sgRNA
  Gml_5
agaggatcaaggcaagacaa

SEQ ID NO: 23320 - DNA, 20 bp, Artificial Sequence
  sgRNA
  Gml_6
tgtctacaagcactgcacca

SEQ ID NO: 23321 - DNA, 20 bp, Artificial Sequence
  sgRNA
  Gml_7
gttaggtgaaacttccatag

SEQ ID NO: 23322 - DNA, 20 bp, Artificial Sequence
  sgRNA
  Gml_8
gatgagatgccattcatgcc

SEQ ID NO: 23323 - DNA, 20 bp, Artificial Sequence
  sgRNA
  Gml_9
tagagctgtgagtctggggt

SEQ ID NO: 23324 - DNA, 20 bp, Artificial Sequence
  sgRNA
  Gml_10
tcaaggcaagacaaaggaga

SEQ ID NO: 23325 - DNA, 20 bp, Artificial Sequence
  sgRNA
  Gml_11
agtgtcgtttgcaatgaggg

SEQ ID NO: 23326 - DNA, 20 bp, Artificial Sequence
  sgRNA
  Gml_12
actgcacatttatttataga

SEQ ID NO: 23327 - DNA, 20 bp, Artificial Sequence
  sgRNA
  Gml_13
tgtgcctccagaactcccta

SEQ ID NO: 23328 - DNA, 20 bp, Artificial Sequence
  sgRNA
  Gml_14
gaggacccagaaatatggag

SEQ ID NO: 23329 - DNA, 20 bp, Artificial Sequence
  sgRNA
  Gml_15
gtggatatgtggacaataga

SEQ ID NO: 23330 - DNA, 20 bp, Artificial Sequence
  sgRNA
  Gml_16
aatatggagagggacttgtt

SEQ ID NO: 23331 - DNA, 20 bp, Artificial Sequence
  sgRNA
  Gml_17
tgatatccatgtcacaatag

SEQ ID NO: 23332 - DNA, 20 bp, Artificial Sequence
  sgRNA
  Gml_18
aggacccagaaatatggaga

SEQ ID NO: 23333 - DNA, 20 bp, Artificial Sequence
  sgRNA
  Gml_19
tgttatgctcctggcatgaa

SEQ ID NO: 23334 - DNA, 20 bp, Artificial Sequence
  sgRNA
  Gml_20
aagtccctctccatatttct

SEQ ID NO: 23335 - DNA, 20 bp, Artificial Sequence
  sgRNA
  Gml2_1
agtccctctctaaattagtg

SEQ ID NO: 23336 - DNA, 20 bp, Artificial Sequence
  sgRNA
  Gml2_2
tgttctcaaggactgcacca

SEQ ID NO: 23337 - DNA, 20 bp, Artificial Sequence
  sgRNA
  Gml2_3
atacagcgtctgagattcga

SEQ ID NO: 23338 - DNA, 20 bp, Artificial Sequence
  sgRNA
  Gml2_4
agaggattaaggcaaaacac

SEQ ID NO: 23339 - DNA, 20 bp, Artificial Sequence
  sgRNA
  Gml2_5
aggccccactaatttagaga

SEQ ID NO: 23340 - DNA, 20 bp, Artificial Sequence
  sgRNA
  Gml2_6
ggtgtccaagaagtctagaa

SEQ ID NO: 23341 - DNA, 20 bp, Artificial Sequence
  sgRNA
  Gml2_7
agtataacttgcaatgtggg

SEQ ID NO: 23342 - DNA, 20 bp, Artificial Sequence
  sgRNA
  Gml2_8
catacagcgtctgagattcg

SEQ ID NO: 23343 - DNA, 20 bp, Artificial Sequence
  sgRNA
  Gml2_9
ttaaggcaaaacacaggagg

SEQ ID NO: 23344 - DNA, 20 bp, Artificial Sequence
  sgRNA
  Gml2_10
cgtgcctccagaactcccta

SEQ ID NO: 23345 - DNA, 20 bp, Artificial Sequence
  sgRNA
  Gml2_11
gaggccccactaatttagag

SEQ ID NO: 23346 - DNA, 20 bp, Artificial Sequence
  sgRNA
  Gml2_12
ggattaaggcaaaacacagg

SEQ ID NO: 23347 - DNA, 20 bp, Artificial Sequence
  sgRNA
  Gml2_13
gtgtccaagaagtctagaag

SEQ ID NO: 23348 - DNA, 20 bp, Artificial Sequence
  sgRNA
  Gml2_14
aagtccctctctaaattagt

SEQ ID NO: 23349 - DNA, 20 bp, Artificial Sequence
  sgRNA
  Gml2_15
tagagctgagtgtctagggt

SEQ ID NO: 23350 - DNA, 20 bp, Artificial Sequence
  sgRNA
  Gml2_16
gttggatgaaacttccatag

SEQ ID NO: 23351 - DNA, 20 bp, Artificial Sequence
  sgRNA
  Gml2_17
ctagagctgagtgtctaggg

SEQ ID NO: 23352 - DNA, 20 bp, Artificial Sequence
  sgRNA
  Gml2_18
gagggacactcagagagctt

SEQ ID NO: 23353 - DNA, 20 bp, Artificial Sequence
  sgRNA
  Gml2_19
gggtgtccaagaagtctaga

SEQ ID NO: 23354 - DNA, 20 bp, Artificial Sequence
  sgRNA
  Gml2_20
tcaagtataacttgcaatgt

SEQ ID NO: 23355 - DNA, 20 bp, Artificial Sequence
  sgRNA
  Gnrhr_1
cacacattgcgagaagactg

SEQ ID NO: 23356 - DNA, 20 bp, Artificial Sequence
  sgRNA
  Gnrhr_2
ggagcttgccctgtatcaag

SEQ ID NO: 23357 - DNA, 20 bp, Artificial Sequence
  sgRNA
  Gnrhr_3
tgatcgtcatgccactggat

SEQ ID NO: 23358 - DNA, 20 bp, Artificial Sequence
  sgRNA
  Gnrhr_4
caccaccatcatgaaagctg

SEQ ID NO: 23359 - DNA, 20 bp, Artificial Sequence
  sgRNA
  Gnrhr_5
agtccagcagacgacaaagg

SEQ ID NO: 23360 - DNA, 20 bp, Artificial Sequence
  sgRNA
  Gnrhr_6
tgacgatcagagtctccagc

SEQ ID NO: 23361 - DNA, 20 bp, Artificial Sequence
  sgRNA
  Gnrhr_7
gatagctgagaactttgcag

SEQ ID NO: 23362 - DNA, 20 bp, Artificial Sequence
  sgRNA
  Gnrhr_8
gctgttgctttgtacagcaa

SEQ ID NO: 23363 - DNA, 20 bp, Artificial Sequence
  sgRNA
  Gnrhr_9
tcatcaagacccacgcagta

SEQ ID NO: 23364 - DNA, 20 bp, Artificial Sequence
  sgRNA
  Gnrhr_10
tgtggaatattactgttcag

SEQ ID NO: 23365 - DNA, 20 bp, Artificial Sequence
  sgRNA
  Gnrhr_11
ctaaggaataccgtactgcg

SEQ ID NO: 23366 - DNA, 20 bp, Artificial Sequence
  sgRNA
  Gnrhr_12
gtatgccccagctttcatga

SEQ ID NO: 23367 - DNA, 20 bp, Artificial Sequence
  sgRNA
  Gnrhr_13
atatgagtgggtcgaagcac

SEQ ID NO: 23368 - DNA, 20 bp, Artificial Sequence
  sgRNA
  Gnrhr_14
gcagattagcatgatgagga

SEQ ID NO: 23369 - DNA, 20 bp, Artificial Sequence
  sgRNA
  Gnrhr_15
ggaagaaagtcacggtcact

SEQ ID NO: 23370 - DNA, 20 bp, Artificial Sequence
  sgRNA
  Gnrhr_16
gcttcgacccactcatatat

SEQ ID NO: 23371 - DNA, 20 bp, Artificial Sequence
  sgRNA
  Gnrhr_17
gcaggacccaaatcactgct

SEQ ID NO: 23372 - DNA, 20 bp, Artificial Sequence
  sgRNA
  Gnrhr_18
aaggggctgagtgatggcca

SEQ ID NO: 23373 - DNA, 20 bp, Artificial Sequence
  sgRNA
  Gnrhr_19
aggatgatctacctagcaga

SEQ ID NO: 23374 - DNA, 20 bp, Artificial Sequence
  sgRNA
  Gnrhr_20
gctgagtgatggccagggag

SEQ ID NO: 23375 - DNA, 20 bp, Artificial Sequence
  sgRNA
  Gp1ba_1
caaggacacaactcctaacg

SEQ ID NO: 23376 - DNA, 20 bp, Artificial Sequence
  sgRNA
  Gp1ba_2
tggcttcgcacaataccaaa

SEQ ID NO: 23377 - DNA, 20 bp, Artificial Sequence
  sgRNA
  Gp1ba_3
cacctgggcgagaaccaact

SEQ ID NO: 23378 - DNA, 20 bp, Artificial Sequence
  sgRNA
  Gp1ba_4
tgcaggcaatgcccatccta

SEQ ID NO: 23379 - DNA, 20 bp, Artificial Sequence
  sgRNA
  Gp1ba_5
ctaaagttcatactacccac

SEQ ID NO: 23380 - DNA, 20 bp, Artificial Sequence
  sgRNA
  Gp1ba_6
tctcacagtttacttccagc

SEQ ID NO: 23381 - DNA, 20 bp, Artificial Sequence
  sgRNA
  Gp1ba_7
tcgttggcaacaagagcccg

SEQ ID NO: 23382 - DNA, 20 bp, Artificial Sequence
  sgRNA
  Gp1ba_8
cagctttctcaatctcccag

SEQ ID NO: 23383 - DNA, 20 bp, Artificial Sequence
  sgRNA
  Gp1ba_9
ggcaatgcccatcctaggga

SEQ ID NO: 23384 - DNA, 20 bp, Artificial Sequence
  sgRNA
  Gp1ba_10
gcagacctgccagcagacac

SEQ ID NO: 23385 - DNA, 20 bp, Artificial Sequence
  sgRNA
  Gp1ba_11
cgaccctgactcagagctga

SEQ ID NO: 23386 - DNA, 20 bp, Artificial Sequence
  sgRNA
  Gp1ba_12
cgcctgtctactcctaccca

SEQ ID NO: 23387 - DNA, 20 bp, Artificial Sequence
  sgRNA
  Gp1ba_13
ggagccagtgacggaagtag

SEQ ID NO: 23388 - DNA, 20 bp, Artificial Sequence
  sgRNA
  Gp1ba_14
ggtggaggtgggctctaggg

SEQ ID NO: 23389 - DNA, 20 bp, Artificial Sequence
  sgRNA
  Gp1ba_15
ggtagactctggagtggtca

SEQ ID NO: 23390 - DNA, 20 bp, Artificial Sequence
  sgRNA
  Gp1ba_16
cgttggcaacaagagcccgg

SEQ ID NO: 23391 - DNA, 20 bp, Artificial Sequence
  sgRNA
  Gp1ba_17
gtctactcctacccagggaa

SEQ ID NO: 23392 - DNA, 20 bp, Artificial Sequence
  sgRNA
  Gp1ba_18
gttggcaacaagagcccggg

SEQ ID NO: 23393 - DNA, 20 bp, Artificial Sequence
  sgRNA
  Gp1ba_19
aaaaggctagaccggaaagt

SEQ ID NO: 23394 - DNA, 20 bp, Artificial Sequence
  sgRNA
  Gp1ba_20
tgacctcagttcttgtggca

SEQ ID NO: 23395 - DNA, 20 bp, Artificial Sequence
  sgRNA
  Gp1bb_1
ccaattcggtggtgtcggga

SEQ ID NO: 23396 - DNA, 20 bp, Artificial Sequence
  sgRNA
  Gp1bb_2
ccgcttgctgccctacgtgg

SEQ ID NO: 23397 - DNA, 20 bp, Artificial Sequence
  sgRNA
  Gp1bb_3
aggcgcgcagcggcaatagg

SEQ ID NO: 23398 - DNA, 20 bp, Artificial Sequence
  sgRNA
  Gp1bb_4
gcagggacgctcgtggactg

SEQ ID NO: 23399 - DNA, 20 bp, Artificial Sequence
  sgRNA
  Gp1bb_5
gcagcgcgtgtagcagcccg

SEQ ID NO: 23400 - DNA, 20 bp, Artificial Sequence
  sgRNA
  Gp1bb_6
acacagcgcaggtcgcggta

SEQ ID NO: 23401 - DNA, 20 bp, Artificial Sequence
  sgRNA
  Gp1bb_7
gagtagaccgggtgcgcacg

SEQ ID NO: 23402 - DNA, 20 bp, Artificial Sequence
  sgRNA
  Gp1bb_8
gcttctctttcagggccccg

SEQ ID NO: 23403 - DNA, 20 bp, Artificial Sequence
  sgRNA
  Gp1bb_9
gcacccggtctactctgctg

SEQ ID NO: 23404 - DNA, 20 bp, Artificial Sequence
  sgRNA
  Gp1bb_10
accaattcggtggtgtcggg

SEQ ID NO: 23405 - DNA, 20 bp, Artificial Sequence
  sgRNA
  Gp1bb_11
gctctgcgcgcagcacacct

SEQ ID NO: 23406 - DNA, 20 bp, Artificial Sequence
  sgRNA
  Gp1bb_12
gctgaccggcaacaacctga

SEQ ID NO: 23407 - DNA, 20 bp, Artificial Sequence
  sgRNA
  Gp1bb_13
gccggtcagcaccaattcgg

SEQ ID NO: 23408 - DNA, 20 bp, Artificial Sequence
  sgRNA
  Gp1bb_14
cttgctgccctacgtggcgg

SEQ ID NO: 23409 - DNA, 20 bp, Artificial Sequence
  sgRNA
  Gp1bb_15
gcgctagcaacagaagcagc

SEQ ID NO: 23410 - DNA, 20 bp, Artificial Sequence
  sgRNA
  Gp1bb_16
ccgccacgtagggcagcaag

SEQ ID NO: 23411 - DNA, 20 bp, Artificial Sequence
  sgRNA
  Gp1bb_17
ctgctattggcacttctact

SEQ ID NO: 23412 - DNA, 20 bp, Artificial Sequence
  sgRNA
  Gp1bb_18
gctccccagcagagtagacc

SEQ ID NO: 23413 - DNA, 20 bp, Artificial Sequence
  sgRNA
  Gp1bb_19
aacgcgtccagaagcccggg

SEQ ID NO: 23414 - DNA, 20 bp, Artificial Sequence
  sgRNA
  Gp1bb_20
gctgctacacgcgctgctat

SEQ ID NO: 23415 - DNA, 20 bp, Artificial Sequence
  sgRNA
  Gp2_1
gcaccggaacacactcacac

SEQ ID NO: 23416 - DNA, 20 bp, Artificial Sequence
  sgRNA
  Gp2_2
cctgttgtggctaattactg

SEQ ID NO: 23417 - DNA, 20 bp, Artificial Sequence
  sgRNA
  Gp2_3
gtatctcagactgcattcag

SEQ ID NO: 23418 - DNA, 20 bp, Artificial Sequence
  sgRNA
  Gp2_4
tctccatctacaatacatca

SEQ ID NO: 23419 - DNA, 20 bp, Artificial Sequence
  sgRNA
  Gp2_5
tcattgcctacctcaatgac

SEQ ID NO: 23420 - DNA, 20 bp, Artificial Sequence
  sgRNA
  Gp2_6
ggctgacgctcatgtccagt

SEQ ID NO: 23421 - DNA, 20 bp, Artificial Sequence
  sgRNA
  Gp2_7
tgaacatctgcactgaaaat

SEQ ID NO: 23422 - DNA, 20 bp, Artificial Sequence
  sgRNA
  Gp2_8
gggtgtcctcttaaatagag

SEQ ID NO: 23423 - DNA, 20 bp, Artificial Sequence
  sgRNA
  Gp2_9
tgatccctgccagaatcaca

SEQ ID NO: 23424 - DNA, 20 bp, Artificial Sequence
  sgRNA
  Gp2_10
gattacttgtcgtcctgagg

SEQ ID NO: 23425 - DNA, 20 bp, Artificial Sequence
  sgRNA
  Gp2_11
gcagttccggtcattgaggt

SEQ ID NO: 23426 - DNA, 20 bp, Artificial Sequence
  sgRNA
  Gp2_12
ttatctccacagtccagaag

SEQ ID NO: 23427 - DNA, 20 bp, Artificial Sequence
  sgRNA
  Gp2_13
cacagtaattagccacaaca

SEQ ID NO: 23428 - DNA, 20 bp, Artificial Sequence
  sgRNA
  Gp2_14
tatcacgtgtacaagttaca

SEQ ID NO: 23429 - DNA, 20 bp, Artificial Sequence
  sgRNA
  Gp2_15
cagcaacagtttgaacctgg

SEQ ID NO: 23430 - DNA, 20 bp, Artificial Sequence
  sgRNA
  Gp2_16
aggtatcccctctatttaag

SEQ ID NO: 23431 - DNA, 20 bp, Artificial Sequence
  sgRNA
  Gp2_17
tgatgatgaagtacttcaca

SEQ ID NO: 23432 - DNA, 20 bp, Artificial Sequence
  sgRNA
  Gp2_18
gcaagatgagcccaacaact

SEQ ID NO: 23433 - DNA, 20 bp, Artificial Sequence
  sgRNA
  Gp2_19
ggtgtttctgtagatggcat

SEQ ID NO: 23434 - DNA, 20 bp, Artificial Sequence
  sgRNA
  Gp2_20
tgaaggggtggcatagcagt

SEQ ID NO: 23435 - DNA, 20 bp, Artificial Sequence
  sgRNA
  Gp5_1
tctgttcgagaaccccctgg

SEQ ID NO: 23436 - DNA, 20 bp, Artificial Sequence
  sgRNA
  Gp5_2
atcttatccaggatcgcacg

SEQ ID NO: 23437 - DNA, 20 bp, Artificial Sequence
  sgRNA
  Gp5_3
gaatggaccagggcatattg

SEQ ID NO: 23438 - DNA, 20 bp, Artificial Sequence
  sgRNA
  Gp5_4
gaggtttccggatagagtca

SEQ ID NO: 23439 - DNA, 20 bp, Artificial Sequence
  sgRNA
  Gp5_5
acgcaagagtgcgagcaccg

SEQ ID NO: 23440 - DNA, 20 bp, Artificial Sequence
  sgRNA
  Gp5_6
ccaggtcattgaaggtgccg

SEQ ID NO: 23441 - DNA, 20 bp, Artificial Sequence
  sgRNA
  Gp5_7
tttgttgcgcgtcaacctga

SEQ ID NO: 23442 - DNA, 20 bp, Artificial Sequence
  sgRNA
  Gp5_8
gctgcacaccaacgccctgg

SEQ ID NO: 23443 - DNA, 20 bp, Artificial Sequence
  sgRNA
  Gp5_9
cgggcggcagagactccagg

SEQ ID NO: 23444 - DNA, 20 bp, Artificial Sequence
  sgRNA
  Gp5_10
gcagctagagcacaaccagc

SEQ ID NO: 23445 - DNA, 20 bp, Artificial Sequence
  sgRNA
  Gp5_11
tgagcggcttgcagacgctg

SEQ ID NO: 23446 - DNA, 20 bp, Artificial Sequence
  sgRNA
  Gp5_12
gcagcagctcccagaacgac

SEQ ID NO: 23447 - DNA, 20 bp, Artificial Sequence
  sgRNA
  Gp5_13
cgagcacgcgcagctcccgt

SEQ ID NO: 23448 - DNA, 20 bp, Artificial Sequence
  sgRNA
  Gp5_14
acacatcctgctcttccgaa

SEQ ID NO: 23449 - DNA, 20 bp, Artificial Sequence
  sgRNA
  Gp5_15
gctcacgtgaaggaagagcg

SEQ ID NO: 23450 - DNA, 20 bp, Artificial Sequence
  sgRNA
  Gp5_16
tgggcgccctgactgagctg

SEQ ID NO: 23451 - DNA, 20 bp, Artificial Sequence
  sgRNA
  Gp5_17
gctctagctgcacgctctcg

SEQ ID NO: 23452 - DNA, 20 bp, Artificial Sequence
  sgRNA
  Gp5_18
tgattaatgttcgaaacagc

SEQ ID NO: 23453 - DNA, 20 bp, Artificial Sequence
  sgRNA
  Gp5_19
ggttcaaaccgagctcctga

SEQ ID NO: 23454 - DNA, 20 bp, Artificial Sequence
  sgRNA
  Gp5_20
aggatgtgtgtgaggttcgt

SEQ ID NO: 23455 - DNA, 20 bp, Artificial Sequence
  sgRNA
  Gp6_1
cgatataaatccacatctgg

SEQ ID NO: 23456 - DNA, 20 bp, Artificial Sequence
  sgRNA
  Gp6_2
tgatgatggggaaattggcc

SEQ ID NO: 23457 - DNA, 20 bp, Artificial Sequence
  sgRNA
  Gp6_3
ccagtaaccacaagcactag

SEQ ID NO: 23458 - DNA, 20 bp, Artificial Sequence
  sgRNA
  Gp6_4
ttagctcaagctggtcactt

SEQ ID NO: 23459 - DNA, 20 bp, Artificial Sequence
  sgRNA
  Gp6_5
agaataactgactgacccag

SEQ ID NO: 23460 - DNA, 20 bp, Artificial Sequence
  sgRNA
  Gp6_6
tcgcctggagaaactgaaac

SEQ ID NO: 23461 - DNA, 20 bp, Artificial Sequence
  sgRNA
  Gp6_7
ggagaggcagtgatattcat

SEQ ID NO: 23462 - DNA, 20 bp, Artificial Sequence
  sgRNA
  Gp6_8
cagaataactgactgaccca

SEQ ID NO: 23463 - DNA, 20 bp, Artificial Sequence
  sgRNA
  Gp6_9
agatgtggatttatatcgcc

SEQ ID NO: 23464 - DNA, 20 bp, Artificial Sequence
  sgRNA
  Gp6_10
atatcactgcctctccagag

SEQ ID NO: 23465 - DNA, 20 bp, Artificial Sequence
  sgRNA
  Gp6_11
cagtgactgctgctcacagt

SEQ ID NO: 23466 - DNA, 20 bp, Artificial Sequence
  sgRNA
  Gp6_12
tatccggaccagattcccct

SEQ ID NO: 23467 - DNA, 20 bp, Artificial Sequence
  sgRNA
  Gp6_13
aatatcactgcctctccaga

SEQ ID NO: 23468 - DNA, 20 bp, Artificial Sequence
  sgRNA
  Gp6_14
ctgctcacagtgggacgtac

SEQ ID NO: 23469 - DNA, 20 bp, Artificial Sequence
  sgRNA
  Gp6_15
attcgttctatacaaagaag

SEQ ID NO: 23470 - DNA, 20 bp, Artificial Sequence
  sgRNA
  Gp6_16
acaagcactagagggtcact

SEQ ID NO: 23471 - DNA, 20 bp, Artificial Sequence
  sgRNA
  Gp6_17
tgggtcagtcagttattctg

SEQ ID NO: 23472 - DNA, 20 bp, Artificial Sequence
  sgRNA
  Gp6_18
caagcactagagggtcactc

SEQ ID NO: 23473 - DNA, 20 bp, Artificial Sequence
  sgRNA
  Gp6_19
aatctggtccggatatgcct

SEQ ID NO: 23474 - DNA, 20 bp, Artificial Sequence
  sgRNA
  Gp6_20
tggaaagaagtaatgctgga

SEQ ID NO: 23475 - DNA, 20 bp, Artificial Sequence
  sgRNA
  Gpa33_1
tcttaccgtggaaactacac

SEQ ID NO: 23476 - DNA, 20 bp, Artificial Sequence
  sgRNA
  Gpa33_2
cacctatgtttcagaccgag

SEQ ID NO: 23477 - DNA, 20 bp, Artificial Sequence
  sgRNA
  Gpa33_3
cagtgacacggagcactcgt

SEQ ID NO: 23478 - DNA, 20 bp, Artificial Sequence
  sgRNA
  Gpa33_4
gtagtaacccgctgtctccg

SEQ ID NO: 23479 - DNA, 20 bp, Artificial Sequence
  sgRNA
  Gpa33_5
gcacctccagcaatgacgtg

SEQ ID NO: 23480 - DNA, 20 bp, Artificial Sequence
  sgRNA
  Gpa33_6
ctctcactcgattctcataa

SEQ ID NO: 23481 - DNA, 20 bp, Artificial Sequence
  sgRNA
  Gpa33_7
agagtcctgcaacatcaccg

SEQ ID NO: 23482 - DNA, 20 bp, Artificial Sequence
  sgRNA
  Gpa33_8
cgctgctgatgctcttaccg

SEQ ID NO: 23483 - DNA, 20 bp, Artificial Sequence
  sgRNA
  Gpa33_9
atacagcgcaatgttcatgg

SEQ ID NO: 23484 - DNA, 20 bp, Artificial Sequence
  sgRNA
  Gpa33_10
gttgctgaagaacatctcca

SEQ ID NO: 23485 - DNA, 20 bp, Artificial Sequence
  sgRNA
  Gpa33_11
gccagactgcagcatccaag

SEQ ID NO: 23486 - DNA, 20 bp, Artificial Sequence
  sgRNA
  Gpa33_12
gtaggtgccattgtcgtcca

SEQ ID NO: 23487 - DNA, 20 bp, Artificial Sequence
  sgRNA
  Gpa33_13
cctatgtttcagaccgagag

SEQ ID NO: 23488 - DNA, 20 bp, Artificial Sequence
  sgRNA
  Gpa33_14
tcccgatcaccatctcccct

SEQ ID NO: 23489 - DNA, 20 bp, Artificial Sequence
  sgRNA
  Gpa33_15
gctgacatgccactctgcag

SEQ ID NO: 23490 - DNA, 20 bp, Artificial Sequence
  sgRNA
  Gpa33_16
cgctgtatgcgggcattgcg

SEQ ID NO: 23491 - DNA, 20 bp, Artificial Sequence
  sgRNA
  Gpa33_17
agccagactgcagcatccaa

SEQ ID NO: 23492 - DNA, 20 bp, Artificial Sequence
  sgRNA
  Gpa33_18
atgaccacagacatgaggat

SEQ ID NO: 23493 - DNA, 20 bp, Artificial Sequence
  sgRNA
  Gpa33_19
taagcttctccgaagtcaga

SEQ ID NO: 23494 - DNA, 20 bp, Artificial Sequence
  sgRNA
  Gpa33_20
gagcagaaagaaatttccag

SEQ ID NO: 23495 - DNA, 20 bp, Artificial Sequence
  sgRNA
  Gpbar1_1
ccagggttgagggtacatcg

SEQ ID NO: 23496 - DNA, 20 bp, Artificial Sequence
  sgRNA
  Gpbar1_2
tccggccccatggaagtgtg

SEQ ID NO: 23497 - DNA, 20 bp, Artificial Sequence
  sgRNA
  Gpbar1_3
gctgcgcaagtggcggtcca

SEQ ID NO: 23498 - DNA, 20 bp, Artificial Sequence
  sgRNA
  Gpbar1_4
gatgacgatgaggcttgcca

SEQ ID NO: 23499 - DNA, 20 bp, Artificial Sequence
  sgRNA
  Gpbar1_5
gctgtgtgagatccgccgac

SEQ ID NO: 23500 - DNA, 20 bp, Artificial Sequence
  sgRNA
  Gpbar1_6
ccaggtgagagccctagcca

SEQ ID NO: 23501 - DNA, 20 bp, Artificial Sequence
  sgRNA
  Gpbar1_7
gctagccgcacacttccatg

SEQ ID NO: 23502 - DNA, 20 bp, Artificial Sequence
  sgRNA
  Gpbar1_8
gcccggctagtagtaggctt

SEQ ID NO: 23503 - DNA, 20 bp, Artificial Sequence
  sgRNA
  Gpbar1_9
cctggaggacagctgcccaa

SEQ ID NO: 23504 - DNA, 20 bp, Artificial Sequence
  sgRNA
  Gpbar1_10
atgagcgtcgcccaccacta

SEQ ID NO: 23505 - DNA, 20 bp, Artificial Sequence
  sgRNA
  Gpbar1_11
aagcactcgtagacaccttt

SEQ ID NO: 23506 - DNA, 20 bp, Artificial Sequence
  sgRNA
  Gpbar1_12
gagctgtcggccattcccat

SEQ ID NO: 23507 - DNA, 20 bp, Artificial Sequence
  sgRNA
  Gpbar1_13
ggtgggcagtggccaacacg

SEQ ID NO: 23508 - DNA, 20 bp, Artificial Sequence
  sgRNA
  Gpbar1_14
tgtaccctcaaccctggcta

SEQ ID NO: 23509 - DNA, 20 bp, Artificial Sequence
  sgRNA
  Gpbar1_15
gcgctgatcacccagcccca

SEQ ID NO: 23510 - DNA, 20 bp, Artificial Sequence
  sgRNA
  Gpbar1_16
gatctcacacagctggcggt

SEQ ID NO: 23511 - DNA, 20 bp, Artificial Sequence
  sgRNA
  Gpbar1_17
acactgcccgctccagtcgg

SEQ ID NO: 23512 - DNA, 20 bp, Artificial Sequence
  sgRNA
  Gpbar1_18
aggtgtctacgagtgcttcg

SEQ ID NO: 23513 - DNA, 20 bp, Artificial Sequence
  sgRNA
  Gpbar1_19
ggcacactgcccgctccagt

SEQ ID NO: 23514 - DNA, 20 bp, Artificial Sequence
  sgRNA
  Gpbar1_20
ggccataaacttccaggtag

SEQ ID NO: 23515 - DNA, 20 bp, Artificial Sequence
  sgRNA
  Gpc1_1
gctgcgcctctactaccgtg

SEQ ID NO: 23516 - DNA, 20 bp, Artificial Sequence
  sgRNA
  Gpc1_2
cccgaggagaagcgtcgccg

SEQ ID NO: 23517 - DNA, 20 bp, Artificial Sequence
  sgRNA
  Gpc1_3
gcacatttcggcaatagtcg

SEQ ID NO: 23518 - DNA, 20 bp, Artificial Sequence
  sgRNA
  Gpc1_4
ccgcaggcgcagttctcgag

SEQ ID NO: 23519 - DNA, 20 bp, Artificial Sequence
  sgRNA
  Gpc1_5
ataggcgccacgtaaacggt

SEQ ID NO: 23520 - DNA, 20 bp, Artificial Sequence
  sgRNA
  Gpc1_6
aggccgacctggatgccgag

SEQ ID NO: 23521 - DNA, 20 bp, Artificial Sequence
  sgRNA
  Gpc1_7
atgacactctccgcacccga

SEQ ID NO: 23522 - DNA, 20 bp, Artificial Sequence
  sgRNA
  Gpc1_8
cctgcagtgccaatttgcca

SEQ ID NO: 23523 - DNA, 20 bp, Artificial Sequence
  sgRNA
  Gpc1_9
gtgcgctctccagctccatt

SEQ ID NO: 23524 - DNA, 20 bp, Artificial Sequence
  sgRNA
  Gpc1_10
tgagctgcataatctgctgg

SEQ ID NO: 23525 - DNA, 20 bp, Artificial Sequence
  sgRNA
  Gpc1_11
ggccagtgatgtagtccgga

SEQ ID NO: 23526 - DNA, 20 bp, Artificial Sequence
  sgRNA
  Gpc1_12
acaggtccccaaaggcccca

SEQ ID NO: 23527 - DNA, 20 bp, Artificial Sequence
  sgRNA
  Gpc1_13
ctcagcatataggtcccgga

SEQ ID NO: 23528 - DNA, 20 bp, Artificial Sequence
  sgRNA
  Gpc1_14
ggtgcggagagtgtcattgg

SEQ ID NO: 23529 - DNA, 20 bp, Artificial Sequence
  sgRNA
  Gpc1_15
agatgacacctgtggccgga

SEQ ID NO: 23530 - DNA, 20 bp, Artificial Sequence
  sgRNA
  Gpc1_16
cgaagtccgccagatctacg

SEQ ID NO: 23531 - DNA, 20 bp, Artificial Sequence
  sgRNA
  Gpc1_17
ggttggccccacggtagtag

SEQ ID NO: 23532 - DNA, 20 bp, Artificial Sequence
  sgRNA
  Gpc1_18
gcacctgcggatctgccccc

SEQ ID NO: 23533 - DNA, 20 bp, Artificial Sequence
  sgRNA
  Gpc1_19
tgatgtccacttccacctca

SEQ ID NO: 23534 - DNA, 20 bp, Artificial Sequence
  sgRNA
  Gpc1_20
gctgcacgttcctttgtgca

SEQ ID NO: 23535 - DNA, 20 bp, Artificial Sequence
  sgRNA
  Gpc2_1
ctactatgagaagtctggcg

SEQ ID NO: 23536 - DNA, 20 bp, Artificial Sequence
  sgRNA
  Gpc2_2
actggctgctgagtccattg

SEQ ID NO: 23537 - DNA, 20 bp, Artificial Sequence
  sgRNA
  Gpc2_3
gcagccaatcagacgcatca

SEQ ID NO: 23538 - DNA, 20 bp, Artificial Sequence
  sgRNA
  Gpc2_4
agaggctagccggtcgtgga

SEQ ID NO: 23539 - DNA, 20 bp, Artificial Sequence
  sgRNA
  Gpc2_5
cggcggggtgagtctccgaa

SEQ ID NO: 23540 - DNA, 20 bp, Artificial Sequence
  sgRNA
  Gpc2_6
gatgctgaagtcacattccg

SEQ ID NO: 23541 - DNA, 20 bp, Artificial Sequence
  sgRNA
  Gpc2_7
agctactgctcgaatgaagg

SEQ ID NO: 23542 - DNA, 20 bp, Artificial Sequence
  sgRNA
  Gpc2_8
cgagtcccgatgtcccgacg

SEQ ID NO: 23543 - DNA, 20 bp, Artificial Sequence
  sgRNA
  Gpc2_9
ggaagaacggcccacaacag

SEQ ID NO: 23544 - DNA, 20 bp, Artificial Sequence
  sgRNA
  Gpc2_10
gccacctcgtcctcctcgaa

SEQ ID NO: 23545 - DNA, 20 bp, Artificial Sequence
  sgRNA
  Gpc2_11
gagagacttagccgagtacg

SEQ ID NO: 23546 - DNA, 20 bp, Artificial Sequence
  sgRNA
  Gpc2_12
ccaagaccgtcccttcgagg

SEQ ID NO: 23547 - DNA, 20 bp, Artificial Sequence
  sgRNA
  Gpc2_13
ttaggtttaagctatatccc

SEQ ID NO: 23548 - DNA, 20 bp, Artificial Sequence
  sgRNA
  Gpc2_14
ctgtgcccagaaatccgcca

SEQ ID NO: 23549 - DNA, 20 bp, Artificial Sequence
  sgRNA
  Gpc2_15
gtgagagatctgccgccatg

SEQ ID NO: 23550 - DNA, 20 bp, Artificial Sequence
  sgRNA
  Gpc2_16
gccgagtctctgcacaactc

SEQ ID NO: 23551 - DNA, 20 bp, Artificial Sequence
  sgRNA
  Gpc2_17
attggctgccctctttgtcg

SEQ ID NO: 23552 - DNA, 20 bp, Artificial Sequence
  sgRNA
  Gpc2_18
tcattcgagcagtagctgct

SEQ ID NO: 23553 - DNA, 20 bp, Artificial Sequence
  sgRNA
  Gpc2_19
tgtattgtgggtgcagcaaa

SEQ ID NO: 23554 - DNA, 20 bp, Artificial Sequence
  sgRNA
  Gpc2_20
acttctcatagtagtcccgc

SEQ ID NO: 23555 - DNA, 20 bp, Artificial Sequence
  sgRNA
  Gpc3_1
ttgcggtggttattgcaatg

SEQ ID NO: 23556 - DNA, 20 bp, Artificial Sequence
  sgRNA
  Gpc3_2
cttgggttctgatatcaacg

SEQ ID NO: 23557 - DNA, 20 bp, Artificial Sequence
  sgRNA
  Gpc3_3
ggtcacgtcttgctcctcgg

SEQ ID NO: 23558 - DNA, 20 bp, Artificial Sequence
  sgRNA
  Gpc3_4
cttactaaacttgaggtggt

SEQ ID NO: 23559 - DNA, 20 bp, Artificial Sequence
  sgRNA
  Gpc3_5
tgttcagccgtgctgttagt

SEQ ID NO: 23560 - DNA, 20 bp, Artificial Sequence
  sgRNA
  Gpc3_6
agaaccatgtctgtgcccaa

SEQ ID NO: 23561 - DNA, 20 bp, Artificial Sequence
  sgRNA
  Gpc3_7
gggtgtagatgactggaaag

SEQ ID NO: 23562 - DNA, 20 bp, Artificial Sequence
  sgRNA
  Gpc3_8
tcaccacctctcacagcgtg

SEQ ID NO: 23563 - DNA, 20 bp, Artificial Sequence
  sgRNA
  Gpc3_9
tcaatgatctggctaaccac

SEQ ID NO: 23564 - DNA, 20 bp, Artificial Sequence
  sgRNA
  Gpc3_10
actaacagcacggctgaaca

SEQ ID NO: 23565 - DNA, 20 bp, Artificial Sequence
  sgRNA
  Gpc3_11
gatcaccacctctcacagcg

SEQ ID NO: 23566 - DNA, 20 bp, Artificial Sequence
  sgRNA
  Gpc3_12
gcttaaccatcatcagtccc

SEQ ID NO: 23567 - DNA, 20 bp, Artificial Sequence
  sgRNA
  Gpc3_13
tttccatgctgcttgttccc

SEQ ID NO: 23568 - DNA, 20 bp, Artificial Sequence
  sgRNA
  Gpc3_14
cagtatgtgcagaagaacgg

SEQ ID NO: 23569 - DNA, 20 bp, Artificial Sequence
  sgRNA
  Gpc3_15
tggtattgctcttactgcca

SEQ ID NO: 23570 - DNA, 20 bp, Artificial Sequence
  sgRNA
  Gpc3_16
gtaagagcaataccacattc

SEQ ID NO: 23571 - DNA, 20 bp, Artificial Sequence
  sgRNA
  Gpc3_17
tgtcaataaacagatcttca

SEQ ID NO: 23572 - DNA, 20 bp, Artificial Sequence
  sgRNA
  Gpc3_18
catcgccaccagcaagcacg

SEQ ID NO: 23573 - DNA, 20 bp, Artificial Sequence
  sgRNA
  Gpc3_19
tttgcaagtatgtctcccca

SEQ ID NO: 23574 - DNA, 20 bp, Artificial Sequence
  sgRNA
  Gpc3_20
tgtctaagactgactcaggc

SEQ ID NO: 23575 - DNA, 20 bp, Artificial Sequence
  sgRNA
  Gpc4_1
ccctctatgagatcaacggt

SEQ ID NO: 23576 - DNA, 20 bp, Artificial Sequence
  sgRNA
  Gpc4_2
tattgctcaaacatcatgcg

SEQ ID NO: 23577 - DNA, 20 bp, Artificial Sequence
  sgRNA
  Gpc4_3
tgtagtaagcaaagtgtccg

SEQ ID NO: 23578 - DNA, 20 bp, Artificial Sequence
  sgRNA
  Gpc4_4
taaagatgatttcaaaaccg

SEQ ID NO: 23579 - DNA, 20 bp, Artificial Sequence
  sgRNA
  Gpc4_5
cgttgtactcgaactccgaa

SEQ ID NO: 23580 - DNA, 20 bp, Artificial Sequence
  sgRNA
  Gpc4_6
ggaaatggattggccaacca

SEQ ID NO: 23581 - DNA, 20 bp, Artificial Sequence
  sgRNA
  Gpc4_7
tttactggtcataacccgaa

SEQ ID NO: 23582 - DNA, 20 bp, Artificial Sequence
  sgRNA
  Gpc4_8
gttgaagcgctactatgtgg

SEQ ID NO: 23583 - DNA, 20 bp, Artificial Sequence
  sgRNA
  Gpc4_9
gcaccgtttgcaatgatgag

SEQ ID NO: 23584 - DNA, 20 bp, Artificial Sequence
  sgRNA
  Gpc4_10
tcagaaatcttcacatcgat

SEQ ID NO: 23585 - DNA, 20 bp, Artificial Sequence
  sgRNA
  Gpc4_11
tccagagcaacgcccaacca

SEQ ID NO: 23586 - DNA, 20 bp, Artificial Sequence
  sgRNA
  Gpc4_12
catcctctcatcattgcaaa

SEQ ID NO: 23587 - DNA, 20 bp, Artificial Sequence
  sgRNA
  Gpc4_13
ggcgaaacatgcgctccaga

SEQ ID NO: 23588 - DNA, 20 bp, Artificial Sequence
  sgRNA
  Gpc4_14
gttgcactgttcgctgacca

SEQ ID NO: 23589 - DNA, 20 bp, Artificial Sequence
  sgRNA
  Gpc4_15
gcccccctctatgagatcaa

SEQ ID NO: 23590 - DNA, 20 bp, Artificial Sequence
  sgRNA
  Gpc4_16
gctcaagtcgaaaagttgct

SEQ ID NO: 23591 - DNA, 20 bp, Artificial Sequence
  sgRNA
  Gpc4_17
cctggctgcaacaaatgcgc

SEQ ID NO: 23592 - DNA, 20 bp, Artificial Sequence
  sgRNA
  Gpc4_18
tctggagcgcatgtttcgcc

SEQ ID NO: 23593 - DNA, 20 bp, Artificial Sequence
  sgRNA
  Gpc4_19
tcctggctgcaacaaatgcg

SEQ ID NO: 23594 - DNA, 20 bp, Artificial Sequence
  sgRNA
  Gpc4_20
tgaatatcagcagtgccctt

SEQ ID NO: 23595 - DNA, 20 bp, Artificial Sequence
  sgRNA
  Gpc5_1
gagcacgtgttcaacgtcgt

SEQ ID NO: 23596 - DNA, 20 bp, Artificial Sequence
  sgRNA
  Gpc5_2
tgctcagtaagccctgtatg

SEQ ID NO: 23597 - DNA, 20 bp, Artificial Sequence
  sgRNA
  Gpc5_3
agaggtaccagattgcagct

SEQ ID NO: 23598 - DNA, 20 bp, Artificial Sequence
  sgRNA
  Gpc5_4
caaatggactaacatcctgg

SEQ ID NO: 23599 - DNA, 20 bp, Artificial Sequence
  sgRNA
  Gpc5_5
ccttggatctacccgaagcg

SEQ ID NO: 23600 - DNA, 20 bp, Artificial Sequence
  sgRNA
  Gpc5_6
agggcgcgacccgaacaccg

SEQ ID NO: 23601 - DNA, 20 bp, Artificial Sequence
  sgRNA
  Gpc5_7
cttggatctacccgaagcga

SEQ ID NO: 23602 - DNA, 20 bp, Artificial Sequence
  sgRNA
  Gpc5_8
tgcgtggcggaatctggcaa

SEQ ID NO: 23603 - DNA, 20 bp, Artificial Sequence
  sgRNA
  Gpc5_9
tggtgcggatgttaatcccg

SEQ ID NO: 23604 - DNA, 20 bp, Artificial Sequence
  sgRNA
  Gpc5_10
gagttgtcagatgcgatgca

SEQ ID NO: 23605 - DNA, 20 bp, Artificial Sequence
  sgRNA
  Gpc5_11
agctcttgcaggtgaagccg

SEQ ID NO: 23606 - DNA, 20 bp, Artificial Sequence
  sgRNA
  Gpc5_12
cctcgcttcgggtagatcca

SEQ ID NO: 23607 - DNA, 20 bp, Artificial Sequence
  sgRNA
  Gpc5_13
gatcacccaagcccaacaag

SEQ ID NO: 23608 - DNA, 20 bp, Artificial Sequence
  sgRNA
  Gpc5_14
acaatactgcatcttcagga

SEQ ID NO: 23609 - DNA, 20 bp, Artificial Sequence
  sgRNA
  Gpc5_15
ctccaaggccatgttccggt

SEQ ID NO: 23610 - DNA, 20 bp, Artificial Sequence
  sgRNA
  Gpc5_16
ttgaggcagtaccccataca

SEQ ID NO: 23611 - DNA, 20 bp, Artificial Sequence
  sgRNA
  Gpc5_17
ttgtctgatgagggtttcca

SEQ ID NO: 23612 - DNA, 20 bp, Artificial Sequence
  sgRNA
  Gpc5_18
gtcccttcgcggtcttcccg

SEQ ID NO: 23613 - DNA, 20 bp, Artificial Sequence
  sgRNA
  Gpc5_19
cattgaggtcatcaacacca

SEQ ID NO: 23614 - DNA, 20 bp, Artificial Sequence
  sgRNA
  Gpc5_20
atactcagaatgcattcgaa

SEQ ID NO: 23615 - DNA, 20 bp, Artificial Sequence
  sgRNA
  Gpc6_1
ccctcagtatcacttcagcg

SEQ ID NO: 23616 - DNA, 20 bp, Artificial Sequence
  sgRNA
  Gpc6_2
gctaaagcggtactacacag

SEQ ID NO: 23617 - DNA, 20 bp, Artificial Sequence
  sgRNA
  Gpc6_3
cttgtgcctcgacacaaacg

SEQ ID NO: 23618 - DNA, 20 bp, Artificial Sequence
  sgRNA
  Gpc6_4
ggtcacccgcgccttcatcg

SEQ ID NO: 23619 - DNA, 20 bp, Artificial Sequence
  sgRNA
  Gpc6_5
gaaggctcggagctgcagcg

SEQ ID NO: 23620 - DNA, 20 bp, Artificial Sequence
  sgRNA
  Gpc6_6
ctgtactgcccatactgccg

SEQ ID NO: 23621 - DNA, 20 bp, Artificial Sequence
  sgRNA
  Gpc6_7
agccatttggagacgtgcca

SEQ ID NO: 23622 - DNA, 20 bp, Artificial Sequence
  sgRNA
  Gpc6_8
ctgcatgtacagcatcccgt

SEQ ID NO: 23623 - DNA, 20 bp, Artificial Sequence
  sgRNA
  Gpc6_9
tgagcgagcagatctgagag

SEQ ID NO: 23624 - DNA, 20 bp, Artificial Sequence
  sgRNA
  Gpc6_10
ggtgacaaactcgaactccg

SEQ ID NO: 23625 - DNA, 20 bp, Artificial Sequence
  sgRNA
  Gpc6_11
gttcgagtttgtcaccaccg

SEQ ID NO: 23626 - DNA, 20 bp, Artificial Sequence
  sgRNA
  Gpc6_12
ttccgtggcacgtctccaaa

SEQ ID NO: 23627 - DNA, 20 bp, Artificial Sequence
  sgRNA
  Gpc6_13
tcagtttgttggtcatcaca

SEQ ID NO: 23628 - DNA, 20 bp, Artificial Sequence
  sgRNA
  Gpc6_14
cacacgttcgtccttgcaga

SEQ ID NO: 23629 - DNA, 20 bp, Artificial Sequence
  sgRNA
  Gpc6_15
gcacttacgcatctgccctc

SEQ ID NO: 23630 - DNA, 20 bp, Artificial Sequence
  sgRNA
  Gpc6_16
acctcttcactgagctaaag

SEQ ID NO: 23631 - DNA, 20 bp, Artificial Sequence
  sgRNA
  Gpc6_17
catcgttcatgatctcaggc

SEQ ID NO: 23632 - DNA, 20 bp, Artificial Sequence
  sgRNA
  Gpc6_18
agctaaagcggtactacaca

SEQ ID NO: 23633 - DNA, 20 bp, Artificial Sequence
  sgRNA
  Gpc6_19
ctaaagcggtactacacagg

SEQ ID NO: 23634 - DNA, 20 bp, Artificial Sequence
  sgRNA
  Gpc6_20
tgcctgagatcatgaacgat

SEQ ID NO: 23635 - DNA, 20 bp, Artificial Sequence
  sgRNA
  Gper1_1
gtccccagtgaggttccccg

SEQ ID NO: 23636 - DNA, 20 bp, Artificial Sequence
  sgRNA
  Gper1_2
ggatgagggctcgcacgatg

SEQ ID NO: 23637 - DNA, 20 bp, Artificial Sequence
  sgRNA
  Gper1_3
ggccacagctgagccgtgcg

SEQ ID NO: 23638 - DNA, 20 bp, Artificial Sequence
  sgRNA
  Gper1_4
caggttgaacacctcaatca

SEQ ID NO: 23639 - DNA, 20 bp, Artificial Sequence
  sgRNA
  Gper1_5
tgactatgtggcctgtcaag

SEQ ID NO: 23640 - DNA, 20 bp, Artificial Sequence
  sgRNA
  Gper1_6
gtacttcatcaacctggcgg

SEQ ID NO: 23641 - DNA, 20 bp, Artificial Sequence
  sgRNA
  Gper1_7
gttggggtggagatctacct

SEQ ID NO: 23642 - DNA, 20 bp, Artificial Sequence
  sgRNA
  Gper1_8
atgttgcccacaaagccaat

SEQ ID NO: 23643 - DNA, 20 bp, Artificial Sequence
  sgRNA
  Gper1_9
tcacctggatgagcttcgac

SEQ ID NO: 23644 - DNA, 20 bp, Artificial Sequence
  sgRNA
  Gper1_10
agatctacctaggtcccgtg

SEQ ID NO: 23645 - DNA, 20 bp, Artificial Sequence
  sgRNA
  Gper1_11
ggtgcacctgcggcacacgg

SEQ ID NO: 23646 - DNA, 20 bp, Artificial Sequence
  sgRNA
  Gper1_12
ggagcagaagacgagcctgc

SEQ ID NO: 23647 - DNA, 20 bp, Artificial Sequence
  sgRNA
  Gper1_13
actgcagtggacgcagccag

SEQ ID NO: 23648 - DNA, 20 bp, Artificial Sequence
  sgRNA
  Gper1_14
tccgcaccaagcaccacgca

SEQ ID NO: 23649 - DNA, 20 bp, Artificial Sequence
  sgRNA
  Gper1_15
agacctgtacttcatcaacc

SEQ ID NO: 23650 - DNA, 20 bp, Artificial Sequence
  sgRNA
  Gper1_16
gatgagggctcgcacgatga

SEQ ID NO: 23651 - DNA, 20 bp, Artificial Sequence
  sgRNA
  Gper1_17
gcatggccttggccagcgct

SEQ ID NO: 23652 - DNA, 20 bp, Artificial Sequence
  sgRNA
  Gper1_18
cactgcgaagatcatcctca

SEQ ID NO: 23653 - DNA, 20 bp, Artificial Sequence
  sgRNA
  Gper1_19
cagaggccaatgatggcgaa

SEQ ID NO: 23654 - DNA, 20 bp, Artificial Sequence
  sgRNA
  Gper1_20
gcacgatgagggagtagcag

SEQ ID NO: 23655 - DNA, 20 bp, Artificial Sequence
  sgRNA
  Gpihbp1_1
gcaggtatcagtacaccaca

SEQ ID NO: 23656 - DNA, 20 bp, Artificial Sequence
  sgRNA
  Gpihbp1_2
cactgtgcaatattccaccc

SEQ ID NO: 23657 - DNA, 20 bp, Artificial Sequence
  sgRNA
  Gpihbp1_3
ctgtcaagtgcttcacagcg

SEQ ID NO: 23658 - DNA, 20 bp, Artificial Sequence
  sgRNA
  Gpihbp1_4
cctgcttccagggatcatgt

SEQ ID NO: 23659 - DNA, 20 bp, Artificial Sequence
  sgRNA
  Gpihbp1_5
gagacgagcgtgatgcagaa

SEQ ID NO: 23660 - DNA, 20 bp, Artificial Sequence
  sgRNA
  Gpihbp1_6
atcacgctcgtctcccacag

SEQ ID NO: 23661 - DNA, 20 bp, Artificial Sequence
  sgRNA
  Gpihbp1_7
tggcaagtttagccaccccc

SEQ ID NO: 23662 - DNA, 20 bp, Artificial Sequence
  sgRNA
  Gpihbp1_8
cctcccactgtcttgatgat

SEQ ID NO: 23663 - DNA, 20 bp, Artificial Sequence
  sgRNA
  Gpihbp1_9
tggctaaacttgccaccctg

SEQ ID NO: 23664 - DNA, 20 bp, Artificial Sequence
  sgRNA
  Gpihbp1_10
tatcctgccccacttccctg

SEQ ID NO: 23665 - DNA, 20 bp, Artificial Sequence
  sgRNA
  Gpihbp1_11
gctgctcatcctcagagcga

SEQ ID NO: 23666 - DNA, 20 bp, Artificial Sequence
  sgRNA
  Gpihbp1_12
tgagcagccttgacaacctg

SEQ ID NO: 23667 - DNA, 20 bp, Artificial Sequence
  sgRNA
  Gpihbp1_13
agtgggactagacatcctca

SEQ ID NO: 23668 - DNA, 20 bp, Artificial Sequence
  sgRNA
  Gpihbp1_14
tgacagaagtagcattgtag

SEQ ID NO: 23669 - DNA, 20 bp, Artificial Sequence
  sgRNA
  Gpihbp1_15
atgtctagtcccactttcca

SEQ ID NO: 23670 - DNA, 20 bp, Artificial Sequence
  sgRNA
  Gpihbp1_16
agctggttgtcaggaaggag

SEQ ID NO: 23671 - DNA, 20 bp, Artificial Sequence
  sgRNA
  Gpihbp1_17
acctgactacctactccatg

SEQ ID NO: 23672 - DNA, 20 bp, Artificial Sequence
  sgRNA
  Gpihbp1_18
gcacagtgtggactggcaac

SEQ ID NO: 23673 - DNA, 20 bp, Artificial Sequence
  sgRNA
  Gpihbp1_19
ttctgtcaagtgcttcacag

SEQ ID NO: 23674 - DNA, 20 bp, Artificial Sequence
  sgRNA
  Gpihbp1_20
tcttgtgcccagccactccc

SEQ ID NO: 23675 - DNA, 20 bp, Artificial Sequence
  sgRNA
  Gpm6a_1
gaggatgtgtgaatctactg

SEQ ID NO: 23676 - DNA, 20 bp, Artificial Sequence
  sgRNA
  Gpm6a_2
ccggaacaccactctagtgg

SEQ ID NO: 23677 - DNA, 20 bp, Artificial Sequence
  sgRNA
  Gpm6a_3
tgtacatgtatttcaatgtg

SEQ ID NO: 23678 - DNA, 20 bp, Artificial Sequence
  sgRNA
  Gpm6a_4
tgcttggatctgcgtcagtt

SEQ ID NO: 23679 - DNA, 20 bp, Artificial Sequence
  sgRNA
  Gpm6a_5
catcctcaggaagttctcag

SEQ ID NO: 23680 - DNA, 20 bp, Artificial Sequence
  sgRNA
  Gpm6a_6
agttggcagacagaaccatc

SEQ ID NO: 23681 - DNA, 20 bp, Artificial Sequence
  sgRNA
  Gpm6a_7
gtacgaagacatcaagtcaa

SEQ ID NO: 23682 - DNA, 20 bp, Artificial Sequence
  sgRNA
  Gpm6a_8
agtccttgccaactcaaagt

SEQ ID NO: 23683 - DNA, 20 bp, Artificial Sequence
  sgRNA
  Gpm6a_9
gctgacatacctcttcatgt

SEQ ID NO: 23684 - DNA, 20 bp, Artificial Sequence
  sgRNA
  Gpm6a_10
ggggctatcaaagatctcta

SEQ ID NO: 23685 - DNA, 20 bp, Artificial Sequence
  sgRNA
  Gpm6a_11
gtacgcattgagccgctctt

SEQ ID NO: 23686 - DNA, 20 bp, Artificial Sequence
  sgRNA
  Gpm6a_12
tcaatgtgtggaccatctgc

SEQ ID NO: 23687 - DNA, 20 bp, Artificial Sequence
  sgRNA
  Gpm6a_13
cggaacaccactctagtgga

SEQ ID NO: 23688 - DNA, 20 bp, Artificial Sequence
  sgRNA
  Gpm6a_14
gcaaccatcctgctgtatgc

SEQ ID NO: 23689 - DNA, 20 bp, Artificial Sequence
  sgRNA
  Gpm6a_15
gttgcaatcagagaagcata

SEQ ID NO: 23690 - DNA, 20 bp, Artificial Sequence
  sgRNA
  Gpm6a_16
acattgaaatacatgtacac

SEQ ID NO: 23691 - DNA, 20 bp, Artificial Sequence
  sgRNA
  Gpm6a_17
aacgcctgcatacagcagga

SEQ ID NO: 23692 - DNA, 20 bp, Artificial Sequence
  sgRNA
  Gpm6a_18
attctactcgctccaaagag

SEQ ID NO: 23693 - DNA, 20 bp, Artificial Sequence
  sgRNA
  Gpm6a_19
gcggcaggcatctttcacat

SEQ ID NO: 23694 - DNA, 20 bp, Artificial Sequence
  sgRNA
  Gpm6a_20
atttgctccctccactagag

SEQ ID NO: 23695 - DNA, 20 bp, Artificial Sequence
  sgRNA
  Gpm6b_1
gtgttgctcaagaattgcca

SEQ ID NO: 23696 - DNA, 20 bp, Artificial Sequence
  sgRNA
  Gpm6b_2
ccactcccagcacataggtg

SEQ ID NO: 23697 - DNA, 20 bp, Artificial Sequence
  sgRNA
  Gpm6b_3
tactcacacttcactcagca

SEQ ID NO: 23698 - DNA, 20 bp, Artificial Sequence
  sgRNA
  Gpm6b_4
acagatctgctccacacccg

SEQ ID NO: 23699 - DNA, 20 bp, Artificial Sequence
  sgRNA
  Gpm6b_5
aggccactccagagaaacat

SEQ ID NO: 23700 - DNA, 20 bp, Artificial Sequence
  sgRNA
  Gpm6b_6
ttgcaatgcctgctttcgca

SEQ ID NO: 23701 - DNA, 20 bp, Artificial Sequence
  sgRNA
  Gpm6b_7
cgtgttgcagatgttctcca

SEQ ID NO: 23702 - DNA, 20 bp, Artificial Sequence
  sgRNA
  Gpm6b_8
cactccagagaaacatagga

SEQ ID NO: 23703 - DNA, 20 bp, Artificial Sequence
  sgRNA
  Gpm6b_9
gagctgaaatggaaattggc

SEQ ID NO: 23704 - DNA, 20 bp, Artificial Sequence
  sgRNA
  Gpm6b_10
agttccctatgcctccctgg

SEQ ID NO: 23705 - DNA, 20 bp, Artificial Sequence
  sgRNA
  Gpm6b_11
tcaagtccccacaaagcaac

SEQ ID NO: 23706 - DNA, 20 bp, Artificial Sequence
  sgRNA
  Gpm6b_12
accgtcctgtgccaaccctg

SEQ ID NO: 23707 - DNA, 20 bp, Artificial Sequence
  sgRNA
  Gpm6b_13
ttaccaggatatcaaagcaa

SEQ ID NO: 23708 - DNA, 20 bp, Artificial Sequence
  sgRNA
  Gpm6b_14
gctttcccaggcaaaatctg

SEQ ID NO: 23709 - DNA, 20 bp, Artificial Sequence
  sgRNA
  Gpm6b_15
gtaccgtcctgtgccaaccc

SEQ ID NO: 23710 - DNA, 20 bp, Artificial Sequence
  sgRNA
  Gpm6b_16
gccatacaggaagaaaaagg

SEQ ID NO: 23711 - DNA, 20 bp, Artificial Sequence
  sgRNA
  Gpm6b_17
gtgttcctcacctatgtgct

SEQ ID NO: 23712 - DNA, 20 bp, Artificial Sequence
  sgRNA
  Gpm6b_18
tgtggctcttgcaggcaccg

SEQ ID NO: 23713 - DNA, 20 bp, Artificial Sequence
  sgRNA
  Gpm6b_19
actgatggttctttgagcct

SEQ ID NO: 23714 - DNA, 20 bp, Artificial Sequence
  sgRNA
  Gpm6b_20
aggtaccactggatgtaccc

SEQ ID NO: 23715 - DNA, 20 bp, Artificial Sequence
  sgRNA
  Gpnmb_1
agagagcacaaccaattacg

SEQ ID NO: 23716 - DNA, 20 bp, Artificial Sequence
  sgRNA
  Gpnmb_2
tccatggatttgtaaccagt

SEQ ID NO: 23717 - DNA, 20 bp, Artificial Sequence
  sgRNA
  Gpnmb_3
ggcatacattcccatctcga

SEQ ID NO: 23718 - DNA, 20 bp, Artificial Sequence
  sgRNA
  Gpnmb_4
aggaaatggcagagtcgttg

SEQ ID NO: 23719 - DNA, 20 bp, Artificial Sequence
  sgRNA
  Gpnmb_5
ctgtctttcgaagatacggc

SEQ ID NO: 23720 - DNA, 20 bp, Artificial Sequence
  sgRNA
  Gpnmb_6
tgatcgtacaggcttccatg

SEQ ID NO: 23721 - DNA, 20 bp, Artificial Sequence
  sgRNA
  Gpnmb_7
ggtcacagtgaagtccatca

SEQ ID NO: 23722 - DNA, 20 bp, Artificial Sequence
  sgRNA
  Gpnmb_8
gtacagcaagatggtaacca

SEQ ID NO: 23723 - DNA, 20 bp, Artificial Sequence
  sgRNA
  Gpnmb_9
gcgaaagccccgttcttccg

SEQ ID NO: 23724 - DNA, 20 bp, Artificial Sequence
  sgRNA
  Gpnmb_10
atgaggacatcgaagacgat

SEQ ID NO: 23725 - DNA, 20 bp, Artificial Sequence
  sgRNA
  Gpnmb_11
tcttccatccatgggggcga

SEQ ID NO: 23726 - DNA, 20 bp, Artificial Sequence
  sgRNA
  Gpnmb_12
actctgccatttcctacaag

SEQ ID NO: 23727 - DNA, 20 bp, Artificial Sequence
  sgRNA
  Gpnmb_13
cacaaggcgtacaagccaat

SEQ ID NO: 23728 - DNA, 20 bp, Artificial Sequence
  sgRNA
  Gpnmb_14
gtaggtgccagacccattga

SEQ ID NO: 23729 - DNA, 20 bp, Artificial Sequence
  sgRNA
  Gpnmb_15
ggaacctgagatgctggctt

SEQ ID NO: 23730 - DNA, 20 bp, Artificial Sequence
  sgRNA
  Gpnmb_16
ggaaatgtcactcagctcca

SEQ ID NO: 23731 - DNA, 20 bp, Artificial Sequence
  sgRNA
  Gpnmb_17
aggaacacggtcaagggcaa

SEQ ID NO: 23732 - DNA, 20 bp, Artificial Sequence
  sgRNA
  Gpnmb_18
cattgctccaggacaagcca

SEQ ID NO: 23733 - DNA, 20 bp, Artificial Sequence
  sgRNA
  Gpnmb_19
ctccatttcttccatccatg

SEQ ID NO: 23734 - DNA, 20 bp, Artificial Sequence
  sgRNA
  Gpnmb_20
gttgtgctctctcatgtgat

SEQ ID NO: 23735 - DNA, 20 bp, Artificial Sequence
  sgRNA
  Gpr1_1
tgctagggcatataagaaca

SEQ ID NO: 23736 - DNA, 20 bp, Artificial Sequence
  sgRNA
  Gpr1_2
gagacaccatgttctgacct

SEQ ID NO: 23737 - DNA, 20 bp, Artificial Sequence
  sgRNA
  Gpr1_3
gccacgtaggaaatgtacag

SEQ ID NO: 23738 - DNA, 20 bp, Artificial Sequence
  sgRNA
  Gpr1_4
ccggactctaaagagctcac

SEQ ID NO: 23739 - DNA, 20 bp, Artificial Sequence
  sgRNA
  Gpr1_5
gcccctgtacatttcctacg

SEQ ID NO: 23740 - DNA, 20 bp, Artificial Sequence
  sgRNA
  Gpr1_6
gatgcccagaacaaatgcta

SEQ ID NO: 23741 - DNA, 20 bp, Artificial Sequence
  sgRNA
  Gpr1_7
ggccacgtaggaaatgtaca

SEQ ID NO: 23742 - DNA, 20 bp, Artificial Sequence
  sgRNA
  Gpr1_8
gatgctaaacaggtgataag

SEQ ID NO: 23743 - DNA, 20 bp, Artificial Sequence
  sgRNA
  Gpr1_9
cagattgaggaaccaaagag

SEQ ID NO: 23744 - DNA, 20 bp, Artificial Sequence
  sgRNA
  Gpr1_10
aggagctcatggttagcaaa

SEQ ID NO: 23745 - DNA, 20 bp, Artificial Sequence
  sgRNA
  Gpr1_11
tttggctcatgggattcaag

SEQ ID NO: 23746 - DNA, 20 bp, Artificial Sequence
  sgRNA
  Gpr1_12
catggtgtcccggaagtata

SEQ ID NO: 23747 - DNA, 20 bp, Artificial Sequence
  sgRNA
  Gpr1_13
gcttattaggacgtaaagga

SEQ ID NO: 23748 - DNA, 20 bp, Artificial Sequence
  sgRNA
  Gpr1_14
ggatgcccagaacaaatgct

SEQ ID NO: 23749 - DNA, 20 bp, Artificial Sequence
  sgRNA
  Gpr1_15
gatggagcaagtggatgtag

SEQ ID NO: 23750 - DNA, 20 bp, Artificial Sequence
  sgRNA
  Gpr1_16
agaaggcaatgaccacagac

SEQ ID NO: 23751 - DNA, 20 bp, Artificial Sequence
  sgRNA
  Gpr1_17
ggagtaataatctaaggcat

SEQ ID NO: 23752 - DNA, 20 bp, Artificial Sequence
  sgRNA
  Gpr1_18
tgccttagattattactccc

SEQ ID NO: 23753 - DNA, 20 bp, Artificial Sequence
  sgRNA
  Gpr1_19
ggtggaatccccctctcaac

SEQ ID NO: 23754 - DNA, 20 bp, Artificial Sequence
  sgRNA
  Gpr1_20
tcatggttagcaaagggaag

SEQ ID NO: 23755 - DNA, 20 bp, Artificial Sequence
  sgRNA
  Gpr101_1
agaggagaatataactacgt

SEQ ID NO: 23756 - DNA, 20 bp, Artificial Sequence
  sgRNA
  Gpr101_2
taacacccagtggaataacg

SEQ ID NO: 23757 - DNA, 20 bp, Artificial Sequence
  sgRNA
  Gpr101_3
tacggtcatcaaaagtagcg

SEQ ID NO: 23758 - DNA, 20 bp, Artificial Sequence
  sgRNA
  Gpr101_4
gagagtcccatggtagccga

SEQ ID NO: 23759 - DNA, 20 bp, Artificial Sequence
  sgRNA
  Gpr101_5
tggtgttcggtgcagcccgg

SEQ ID NO: 23760 - DNA, 20 bp, Artificial Sequence
  sgRNA
  Gpr101_6
caggcaatcataacacccag

SEQ ID NO: 23761 - DNA, 20 bp, Artificial Sequence
  sgRNA
  Gpr101_7
gctttgcactcatagcatgg

SEQ ID NO: 23762 - DNA, 20 bp, Artificial Sequence
  sgRNA
  Gpr101_8
cactgacaaccgtataggca

SEQ ID NO: 23763 - DNA, 20 bp, Artificial Sequence
  sgRNA
  Gpr101_9
catagcatggaggcaaaggt

SEQ ID NO: 23764 - DNA, 20 bp, Artificial Sequence
  sgRNA
  Gpr101_10
tcgataccagggtaccccag

SEQ ID NO: 23765 - DNA, 20 bp, Artificial Sequence
  sgRNA
  Gpr101_11
ggtggctatcttctacaggg

SEQ ID NO: 23766 - DNA, 20 bp, Artificial Sequence
  sgRNA
  Gpr101_12
gtgggtggatatcgatacca

SEQ ID NO: 23767 - DNA, 20 bp, Artificial Sequence
  sgRNA
  Gpr101_13
gcagctttgcactcatagca

SEQ ID NO: 23768 - DNA, 20 bp, Artificial Sequence
  sgRNA
  Gpr101_14
ggagggcaaggacagtgacg

SEQ ID NO: 23769 - DNA, 20 bp, Artificial Sequence
  sgRNA
  Gpr101_15
catcaagaaggaaatccagg

SEQ ID NO: 23770 - DNA, 20 bp, Artificial Sequence
  sgRNA
  Gpr101_16
cgactctcacctccaagcgg

SEQ ID NO: 23771 - DNA, 20 bp, Artificial Sequence
  sgRNA
  Gpr101_17
cctcgactctcacctccaag

SEQ ID NO: 23772 - DNA, 20 bp, Artificial Sequence
  sgRNA
  Gpr101_18
ctgattggcatctatgcggc

SEQ ID NO: 23773 - DNA, 20 bp, Artificial Sequence
  sgRNA
  Gpr101_19
ccgtttcatgaaggtcaggg

SEQ ID NO: 23774 - DNA, 20 bp, Artificial Sequence
  sgRNA
  Gpr101_20
tatgattgcctgctattctg

SEQ ID NO: 23775 - DNA, 20 bp, Artificial Sequence
  sgRNA
  Gpr107_1
ctggatcggactaagaacga

SEQ ID NO: 23776 - DNA, 20 bp, Artificial Sequence
  sgRNA
  Gpr107_2
aattcacaagaatgacgggg

SEQ ID NO: 23777 - DNA, 20 bp, Artificial Sequence
  sgRNA
  Gpr107_3
ttcaatcggaaagccctgcg

SEQ ID NO: 23778 - DNA, 20 bp, Artificial Sequence
  sgRNA
  Gpr107_4
cccatccttgaagaacccga

SEQ ID NO: 23779 - DNA, 20 bp, Artificial Sequence
  sgRNA
  Gpr107_5
acaacagcccagccttcaat

SEQ ID NO: 23780 - DNA, 20 bp, Artificial Sequence
  sgRNA
  Gpr107_6
aaggagccgaagcggccgag

SEQ ID NO: 23781 - DNA, 20 bp, Artificial Sequence
  sgRNA
  Gpr107_7
tgagcgccaggtgatggacg

SEQ ID NO: 23782 - DNA, 20 bp, Artificial Sequence
  sgRNA
  Gpr107_8
ctctctgtgaacgagcctga

SEQ ID NO: 23783 - DNA, 20 bp, Artificial Sequence
  sgRNA
  Gpr107_9
ccattaacttagcgaagctg

SEQ ID NO: 23784 - DNA, 20 bp, Artificial Sequence
  sgRNA
  Gpr107_10
gtagaggccttcctggtcat

SEQ ID NO: 23785 - DNA, 20 bp, Artificial Sequence
  sgRNA
  Gpr107_11
aagtccatctcaacaccttc

SEQ ID NO: 23786 - DNA, 20 bp, Artificial Sequence
  sgRNA
  Gpr107_12
tggtgttctttgtcctgacg

SEQ ID NO: 23787 - DNA, 20 bp, Artificial Sequence
  sgRNA
  Gpr107_13
gccagtgccgatgagggcga

SEQ ID NO: 23788 - DNA, 20 bp, Artificial Sequence
  sgRNA
  Gpr107_14
tctcaattcacaagaatgac

SEQ ID NO: 23789 - DNA, 20 bp, Artificial Sequence
  sgRNA
  Gpr107_15
tttcaccaagtctctctcgt

SEQ ID NO: 23790 - DNA, 20 bp, Artificial Sequence
  sgRNA
  Gpr107_16
gcacaactgagtatggccta

SEQ ID NO: 23791 - DNA, 20 bp, Artificial Sequence
  sgRNA
  Gpr107_17
agtttgctgttccattccag

SEQ ID NO: 23792 - DNA, 20 bp, Artificial Sequence
  sgRNA
  Gpr107_18
gatggacgcggcccaagacg

SEQ ID NO: 23793 - DNA, 20 bp, Artificial Sequence
  sgRNA
  Gpr107_19
gctggatgaaacagccacgc

SEQ ID NO: 23794 - DNA, 20 bp, Artificial Sequence
  sgRNA
  Gpr107_20
ctaccactacatctcctcgc

SEQ ID NO: 23795 - DNA, 20 bp, Artificial Sequence
  sgRNA
  Gpr108_1
aggggataaaactaccccag

SEQ ID NO: 23796 - DNA, 20 bp, Artificial Sequence
  sgRNA
  Gpr108_2
tgatatagtgcatgaccgcg

SEQ ID NO: 23797 - DNA, 20 bp, Artificial Sequence
  sgRNA
  Gpr108_3
ggtccaagtccgaaaatatg

SEQ ID NO: 23798 - DNA, 20 bp, Artificial Sequence
  sgRNA
  Gpr108_4
ccctggagctgatcacaatg

SEQ ID NO: 23799 - DNA, 20 bp, Artificial Sequence
  sgRNA
  Gpr108_5
gcagcgacaagtatccccat

SEQ ID NO: 23800 - DNA, 20 bp, Artificial Sequence
  sgRNA
  Gpr108_6
gcctgagccgatcaaggcga

SEQ ID NO: 23801 - DNA, 20 bp, Artificial Sequence
  sgRNA
  Gpr108_7
tgcatcctgcagatgccgaa

SEQ ID NO: 23802 - DNA, 20 bp, Artificial Sequence
  sgRNA
  Gpr108_8
gtagccagtgagcacgaaga

SEQ ID NO: 23803 - DNA, 20 bp, Artificial Sequence
  sgRNA
  Gpr108_9
ccacattgtgatcagctcca

SEQ ID NO: 23804 - DNA, 20 bp, Artificial Sequence
  sgRNA
  Gpr108_10
gacactcttggtgaacgcca

SEQ ID NO: 23805 - DNA, 20 bp, Artificial Sequence
  sgRNA
  Gpr108_11
ccaccccatcgaaggcctcg

SEQ ID NO: 23806 - DNA, 20 bp, Artificial Sequence
  sgRNA
  Gpr108_12
ggttcagcttgagcagagtt

SEQ ID NO: 23807 - DNA, 20 bp, Artificial Sequence
  sgRNA
  Gpr108_13
gctgctcaggccgtatccac

SEQ ID NO: 23808 - DNA, 20 bp, Artificial Sequence
  sgRNA
  Gpr108_14
cattgttattgagtcccgtg

SEQ ID NO: 23809 - DNA, 20 bp, Artificial Sequence
  sgRNA
  Gpr108_15
cagcgactatggactctgga

SEQ ID NO: 23810 - DNA, 20 bp, Artificial Sequence
  sgRNA
  Gpr108_16
ggacacccagaagatgtctg

SEQ ID NO: 23811 - DNA, 20 bp, Artificial Sequence
  sgRNA
  Gpr108_17
gtactggccttcctcagccc

SEQ ID NO: 23812 - DNA, 20 bp, Artificial Sequence
  sgRNA
  Gpr108_18
aagtagcagtgcccttccag

SEQ ID NO: 23813 - DNA, 20 bp, Artificial Sequence
  sgRNA
  Gpr108_19
ctgctggtgctgacgctgag

SEQ ID NO: 23814 - DNA, 20 bp, Artificial Sequence
  sgRNA
  Gpr108_20
atgaccgcgaggccttcgat

SEQ ID NO: 23815 - DNA, 20 bp, Artificial Sequence
  sgRNA
  Gpr119_1
tgccatccgaaggctacaca

SEQ ID NO: 23816 - DNA, 20 bp, Artificial Sequence
  sgRNA
  Gpr119_2
ggaatatggagactccgagt

SEQ ID NO: 23817 - DNA, 20 bp, Artificial Sequence
  sgRNA
  Gpr119_3
gaagtcattgacagaccgtg

SEQ ID NO: 23818 - DNA, 20 bp, Artificial Sequence
  sgRNA
  Gpr119_4
tcatgatctggaagtaacgg

SEQ ID NO: 23819 - DNA, 20 bp, Artificial Sequence
  sgRNA
  Gpr119_5
tggaatatggagactccgag

SEQ ID NO: 23820 - DNA, 20 bp, Artificial Sequence
  sgRNA
  Gpr119_6
aagtcattgacagaccgtgg

SEQ ID NO: 23821 - DNA, 20 bp, Artificial Sequence
  sgRNA
  Gpr119_7
atatggagactccgagtggg

SEQ ID NO: 23822 - DNA, 20 bp, Artificial Sequence
  sgRNA
  Gpr119_8
ctatcaatctacaagaatga

SEQ ID NO: 23823 - DNA, 20 bp, Artificial Sequence
  sgRNA
  Gpr119_9
ttgaagtcattgacagaccg

SEQ ID NO: 23824 - DNA, 20 bp, Artificial Sequence
  sgRNA
  Gpr119_10
ctatgcctattggcagaggg

SEQ ID NO: 23825 - DNA, 20 bp, Artificial Sequence
  sgRNA
  Gpr119_11
gctgatagtgacgatgtgat

SEQ ID NO: 23826 - DNA, 20 bp, Artificial Sequence
  sgRNA
  Gpr119_12
catcgtcactatcagccatc

SEQ ID NO: 23827 - DNA, 20 bp, Artificial Sequence
  sgRNA
  Gpr119_13
catgatctggaagtaacgga

SEQ ID NO: 23828 - DNA, 20 bp, Artificial Sequence
  sgRNA
  Gpr119_14
tcatctatgcctattggcag

SEQ ID NO: 23829 - DNA, 20 bp, Artificial Sequence
  sgRNA
  Gpr119_15
gcagctctaccacatggccc

SEQ ID NO: 23830 - DNA, 20 bp, Artificial Sequence
  sgRNA
  Gpr119_16
tgaagtcattgacagaccgt

SEQ ID NO: 23831 - DNA, 20 bp, Artificial Sequence
  sgRNA
  Gpr119_17
catcattgctgttaatgcac

SEQ ID NO: 23832 - DNA, 20 bp, Artificial Sequence
  sgRNA
  Gpr119_18
acccactcatctatgcctat

SEQ ID NO: 23833 - DNA, 20 bp, Artificial Sequence
  sgRNA
  Gpr119_19
agacaaagaggagcacagct

SEQ ID NO: 23834 - DNA, 20 bp, Artificial Sequence
  sgRNA
  Gpr119_20
ccgaacctccctctgccaat

SEQ ID NO: 23835 - DNA, 20 bp, Artificial Sequence
  sgRNA
  Gpr12_1
ccctgacgtaccactccgag

SEQ ID NO: 23836 - DNA, 20 bp, Artificial Sequence
  sgRNA
  Gpr12_2
gcctatcagtaggaacatgg

SEQ ID NO: 23837 - DNA, 20 bp, Artificial Sequence
  sgRNA
  Gpr12_3
ctgcacaagacaatgtccca

SEQ ID NO: 23838 - DNA, 20 bp, Artificial Sequence
  sgRNA
  Gpr12_4
agaggcgacaatgagtccga

SEQ ID NO: 23839 - DNA, 20 bp, Artificial Sequence
  sgRNA
  Gpr12_5
tcagggcgtaatatagcgag

SEQ ID NO: 23840 - DNA, 20 bp, Artificial Sequence
  sgRNA
  Gpr12_6
ccggcatctatacagtcccg

SEQ ID NO: 23841 - DNA, 20 bp, Artificial Sequence
  sgRNA
  Gpr12_7
ggacgagtccacctgcagcg

SEQ ID NO: 23842 - DNA, 20 bp, Artificial Sequence
  sgRNA
  Gpr12_8
gcagcgttgttcttagtgag

SEQ ID NO: 23843 - DNA, 20 bp, Artificial Sequence
  sgRNA
  Gpr12_9
ataggtatagatcgaagggt

SEQ ID NO: 23844 - DNA, 20 bp, Artificial Sequence
  sgRNA
  Gpr12_10
tgcacaagacaatgtcccag

SEQ ID NO: 23845 - DNA, 20 bp, Artificial Sequence
  sgRNA
  Gpr12_11
gcccccatgttcctactgat

SEQ ID NO: 23846 - DNA, 20 bp, Artificial Sequence
  sgRNA
  Gpr12_12
ggtaaaggtgacggtcctct

SEQ ID NO: 23847 - DNA, 20 bp, Artificial Sequence
  sgRNA
  Gpr12_13
gagcatcactagcatgacat

SEQ ID NO: 23848 - DNA, 20 bp, Artificial Sequence
  sgRNA
  Gpr12_14
cgagctcgttgtcaacccct

SEQ ID NO: 23849 - DNA, 20 bp, Artificial Sequence
  sgRNA
  Gpr12_15
ggtccctaggatgagagcca

SEQ ID NO: 23850 - DNA, 20 bp, Artificial Sequence
  sgRNA
  Gpr12_16
gtaggaacatgggggctcgc

SEQ ID NO: 23851 - DNA, 20 bp, Artificial Sequence
  sgRNA
  Gpr12_17
aatcggcgatcaaggaatag

SEQ ID NO: 23852 - DNA, 20 bp, Artificial Sequence
  sgRNA
  Gpr12_18
cctctcggagtggtacgtca

SEQ ID NO: 23853 - DNA, 20 bp, Artificial Sequence
  sgRNA
  Gpr12_19
gagggtgaaaggcatccagc

SEQ ID NO: 23854 - DNA, 20 bp, Artificial Sequence
  sgRNA
  Gpr12_20
tcagccgctgtcccctccca

SEQ ID NO: 23855 - DNA, 20 bp, Artificial Sequence
  sgRNA
  Gpr137_1
tagatgccttcgattacgac

SEQ ID NO: 23856 - DNA, 20 bp, Artificial Sequence
  sgRNA
  Gpr137_2
agcagctgcctgacacacgc

SEQ ID NO: 23857 - DNA, 20 bp, Artificial Sequence
  sgRNA
  Gpr137_3
gagcagtgaagcacccacga

SEQ ID NO: 23858 - DNA, 20 bp, Artificial Sequence
  sgRNA
  Gpr137_4
ggaatactgtctgatagctg

SEQ ID NO: 23859 - DNA, 20 bp, Artificial Sequence
  sgRNA
  Gpr137_5
gcaccagtcgaatcctcaat

SEQ ID NO: 23860 - DNA, 20 bp, Artificial Sequence
  sgRNA
  Gpr137_6
cgtaatcgaaggcatctagc

SEQ ID NO: 23861 - DNA, 20 bp, Artificial Sequence
  sgRNA
  Gpr137_7
ggagctcccgaaatggcgcg

SEQ ID NO: 23862 - DNA, 20 bp, Artificial Sequence
  sgRNA
  Gpr137_8
tcaaggccaaggcgaagcgt

SEQ ID NO: 23863 - DNA, 20 bp, Artificial Sequence
  sgRNA
  Gpr137_9
gctggcatagagaaggacca

SEQ ID NO: 23864 - DNA, 20 bp, Artificial Sequence
  sgRNA
  Gpr137_10
gctgtccgaggggccttcgt

SEQ ID NO: 23865 - DNA, 20 bp, Artificial Sequence
  sgRNA
  Gpr137_11
tcccggtcactcggtccagg

SEQ ID NO: 23866 - DNA, 20 bp, Artificial Sequence
  sgRNA
  Gpr137_12
gagtaggagggcaatctcaa

SEQ ID NO: 23867 - DNA, 20 bp, Artificial Sequence
  sgRNA
  Gpr137_13
ggagctcctttacggcagga

SEQ ID NO: 23868 - DNA, 20 bp, Artificial Sequence
  sgRNA
  Gpr137_14
atatagggcagtgtaggcag

SEQ ID NO: 23869 - DNA, 20 bp, Artificial Sequence
  sgRNA
  Gpr137_15
cttggccttgaacaccacct

SEQ ID NO: 23870 - DNA, 20 bp, Artificial Sequence
  sgRNA
  Gpr137_16
tttacggcaggatggccgcc

SEQ ID NO: 23871 - DNA, 20 bp, Artificial Sequence
  sgRNA
  Gpr137_17
tggtccttctctatgccagc

SEQ ID NO: 23872 - DNA, 20 bp, Artificial Sequence
  sgRNA
  Gpr137_18
gatggggtatctctgctccc

SEQ ID NO: 23873 - DNA, 20 bp, Artificial Sequence
  sgRNA
  Gpr137_19
ctacttccgagatactccca

SEQ ID NO: 23874 - DNA, 20 bp, Artificial Sequence
  sgRNA
  Gpr137_20
tctacttccgagatactccc

SEQ ID NO: 23875 - DNA, 20 bp, Artificial Sequence
  sgRNA
  Gpr137b_1
agacggtgtagaccgcggtg

SEQ ID NO: 23876 - DNA, 20 bp, Artificial Sequence
  sgRNA
  Gpr137b_2
catgaacttgtacttcacgc

SEQ ID NO: 23877 - DNA, 20 bp, Artificial Sequence
  sgRNA
  Gpr137b_3
tgctgcgctaccgtcacaag

SEQ ID NO: 23878 - DNA, 20 bp, Artificial Sequence
  sgRNA
  Gpr137b_4
ctccaagtagatgttggcca

SEQ ID NO: 23879 - DNA, 20 bp, Artificial Sequence
  sgRNA
  Gpr137b_5
gtagaagacggtgtagaccg

SEQ ID NO: 23880 - DNA, 20 bp, Artificial Sequence
  sgRNA
  Gpr137b_6
gctccagactactatgattg

SEQ ID NO: 23881 - DNA, 20 bp, Artificial Sequence
  sgRNA
  Gpr137b_7
gtccctggccaacatctact

SEQ ID NO: 23882 - DNA, 20 bp, Artificial Sequence
  sgRNA
  Gpr137b_8
ctttgactccaagtagatgt

SEQ ID NO: 23883 - DNA, 20 bp, Artificial Sequence
  sgRNA
  Gpr137b_9
agaggtgtagagcaagatga

SEQ ID NO: 23884 - DNA, 20 bp, Artificial Sequence
  sgRNA
  Gpr137b_10
gaagaaataaaccaccaagg

SEQ ID NO: 23885 - DNA, 20 bp, Artificial Sequence
  sgRNA
  Gpr137b_11
aagagccagctgggtgacgc

SEQ ID NO: 23886 - DNA, 20 bp, Artificial Sequence
  sgRNA
  Gpr137b_12
catcttgctctacacctctc

SEQ ID NO: 23887 - DNA, 20 bp, Artificial Sequence
  sgRNA
  Gpr137b_13
tcatcttgctctacacctct

SEQ ID NO: 23888 - DNA, 20 bp, Artificial Sequence
  sgRNA
  Gpr137b_14
ccgagtcagaaatcccacga

SEQ ID NO: 23889 - DNA, 20 bp, Artificial Sequence
  sgRNA
  Gpr137b_15
ccttcgtgggatttctgact

SEQ ID NO: 23890 - DNA, 20 bp, Artificial Sequence
  sgRNA
  Gpr137b_16
actccaagtagatgttggcc

SEQ ID NO: 23891 - DNA, 20 bp, Artificial Sequence
  sgRNA
  Gpr137b_17
gaggatccaagatgtctgcc

SEQ ID NO: 23892 - DNA, 20 bp, Artificial Sequence
  sgRNA
  Gpr137b_18
tgtccccaatcatagtagtc

SEQ ID NO: 23893 - DNA, 20 bp, Artificial Sequence
  sgRNA
  Gpr137b_19
ggacatccaggcagacatct

SEQ ID NO: 23894 - DNA, 20 bp, Artificial Sequence
  sgRNA
  Gpr137b_20
tcggaagaaataaaccacca

SEQ ID NO: 23895 - DNA, 20 bp, Artificial Sequence
  sgRNA
  Gpr137c_1
agttcactgctaagaagagg

SEQ ID NO: 23896 - DNA, 20 bp, Artificial Sequence
  sgRNA
  Gpr137c_2
tctgtgccagactgtcatcg

SEQ ID NO: 23897 - DNA, 20 bp, Artificial Sequence
  sgRNA
  Gpr137c_3
ggtagtgatcaccatatcac

SEQ ID NO: 23898 - DNA, 20 bp, Artificial Sequence
  sgRNA
  Gpr137c_4
cgaaccctcgacgtccggcg

SEQ ID NO: 23899 - DNA, 20 bp, Artificial Sequence
  sgRNA
  Gpr137c_5
acctgtgcaatgctagtcca

SEQ ID NO: 23900 - DNA, 20 bp, Artificial Sequence
  sgRNA
  Gpr137c_6
ctgcaccgaaccgggaaccg

SEQ ID NO: 23901 - DNA, 20 bp, Artificial Sequence
  sgRNA
  Gpr137c_7
tcggcaggagtggatcccgg

SEQ ID NO: 23902 - DNA, 20 bp, Artificial Sequence
  sgRNA
  Gpr137c_8
gtaggcaaaggcgaagagcg

SEQ ID NO: 23903 - DNA, 20 bp, Artificial Sequence
  sgRNA
  Gpr137c_9
tcaggcaccgagtccatcag

SEQ ID NO: 23904 - DNA, 20 bp, Artificial Sequence
  sgRNA
  Gpr137c_10
cctcttcctgtgtctcgcgt

SEQ ID NO: 23905 - DNA, 20 bp, Artificial Sequence
  sgRNA
  Gpr137c_11
ttatcccagccataattaaa

SEQ ID NO: 23906 - DNA, 20 bp, Artificial Sequence
  sgRNA
  Gpr137c_12
tgctcctgtaccgcgagcgg

SEQ ID NO: 23907 - DNA, 20 bp, Artificial Sequence
  sgRNA
  Gpr137c_13
gccttacctctgccaggtag

SEQ ID NO: 23908 - DNA, 20 bp, Artificial Sequence
  sgRNA
  Gpr137c_14
cagccacagctacagctcca

SEQ ID NO: 23909 - DNA, 20 bp, Artificial Sequence
  sgRNA
  Gpr137c_15
cccacgcgagacacaggaag

SEQ ID NO: 23910 - DNA, 20 bp, Artificial Sequence
  sgRNA
  Gpr137c_16
gcgctgcccacgcgagacac

SEQ ID NO: 23911 - DNA, 20 bp, Artificial Sequence
  sgRNA
  Gpr137c_17
gcatgtaccagcatggtcag

SEQ ID NO: 23912 - DNA, 20 bp, Artificial Sequence
  sgRNA
  Gpr137c_18
ccatcagcggcttaagttga

SEQ ID NO: 23913 - DNA, 20 bp, Artificial Sequence
  sgRNA
  Gpr137c_19
tcaagttcactgctaagaag

SEQ ID NO: 23914 - DNA, 20 bp, Artificial Sequence
  sgRNA
  Gpr137c_20
gcctcttcctgtgtctcgcg

SEQ ID NO: 23915 - DNA, 20 bp, Artificial Sequence
  sgRNA
  Gpr139_1
aagaagctgtagtagaccac

SEQ ID NO: 23916 - DNA, 20 bp, Artificial Sequence
  sgRNA
  Gpr139_2
gcctccgtggctattccaca

SEQ ID NO: 23917 - DNA, 20 bp, Artificial Sequence
  sgRNA
  Gpr139_3
tgttaggccaccagtagtag

SEQ ID NO: 23918 - DNA, 20 bp, Artificial Sequence
  sgRNA
  Gpr139_4
aaactgtgtggtatttgagt

SEQ ID NO: 23919 - DNA, 20 bp, Artificial Sequence
  sgRNA
  Gpr139_5
tagagaatcatgatgatgcg

SEQ ID NO: 23920 - DNA, 20 bp, Artificial Sequence
  sgRNA
  Gpr139_6
aagccgagctattcgcagcg

SEQ ID NO: 23921 - DNA, 20 bp, Artificial Sequence
  sgRNA
  Gpr139_7
ccacctcgctgcgaatagct

SEQ ID NO: 23922 - DNA, 20 bp, Artificial Sequence
  sgRNA
  Gpr139_8
ggatgggtgctccgtagagg

SEQ ID NO: 23923 - DNA, 20 bp, Artificial Sequence
  sgRNA
  Gpr139_9
tatacctgtcaaccgttaag

SEQ ID NO: 23924 - DNA, 20 bp, Artificial Sequence
  sgRNA
  Gpr139_10
gagaatcatgatgatgcggg

SEQ ID NO: 23925 - DNA, 20 bp, Artificial Sequence
  sgRNA
  Gpr139_11
tcttccctgtggaatagcca

SEQ ID NO: 23926 - DNA, 20 bp, Artificial Sequence
  sgRNA
  Gpr139_12
ccgtaatccaaatagaagtg

SEQ ID NO: 23927 - DNA, 20 bp, Artificial Sequence
  sgRNA
  Gpr139_13
atgattctctaccacctcta

SEQ ID NO: 23928 - DNA, 20 bp, Artificial Sequence
  sgRNA
  Gpr139_14
tgttatggaaaagttatggt

SEQ ID NO: 23929 - DNA, 20 bp, Artificial Sequence
  sgRNA
  Gpr139_15
gagtttgctggtgagatcca

SEQ ID NO: 23930 - DNA, 20 bp, Artificial Sequence
  sgRNA
  Gpr139_16
ttggctggtccacatcatgt

SEQ ID NO: 23931 - DNA, 20 bp, Artificial Sequence
  sgRNA
  Gpr139_17
gagcacccatccagaaccct

SEQ ID NO: 23932 - DNA, 20 bp, Artificial Sequence
  sgRNA
  Gpr139_18
tgaccagtatcccctactac

SEQ ID NO: 23933 - DNA, 20 bp, Artificial Sequence
  sgRNA
  Gpr139_19
tgatgatgcggggggcccag

SEQ ID NO: 23934 - DNA, 20 bp, Artificial Sequence
  sgRNA
  Gpr139_20
tggttggtatagaactgtac

SEQ ID NO: 23935 - DNA, 20 bp, Artificial Sequence
  sgRNA
  Gpr141_1
gtacatgtggatatgtaaca

SEQ ID NO: 23936 - DNA, 20 bp, Artificial Sequence
  sgRNA
  Gpr141_2
agaccccatgaaccaccacg

SEQ ID NO: 23937 - DNA, 20 bp, Artificial Sequence
  sgRNA
  Gpr141_3
gcttggcatacctcatcaaa

SEQ ID NO: 23938 - DNA, 20 bp, Artificial Sequence
  sgRNA
  Gpr141_4
tccatactgagaaaccacca

SEQ ID NO: 23939 - DNA, 20 bp, Artificial Sequence
  sgRNA
  Gpr141_5
ctttgatgaggtatgccaag

SEQ ID NO: 23940 - DNA, 20 bp, Artificial Sequence
  sgRNA
  Gpr141_6
gtcacaagaggaattctcag

SEQ ID NO: 23941 - DNA, 20 bp, Artificial Sequence
  sgRNA
  Gpr141_7
ctagtatcaccacgtagaag

SEQ ID NO: 23942 - DNA, 20 bp, Artificial Sequence
  sgRNA
  Gpr141_8
actgacggtgcctttccgct

SEQ ID NO: 23943 - DNA, 20 bp, Artificial Sequence
  sgRNA
  Gpr141_9
ccatactgagaaaccaccaa

SEQ ID NO: 23944 - DNA, 20 bp, Artificial Sequence
  sgRNA
  Gpr141_10
gcactcacaaatttgcagaa

SEQ ID NO: 23945 - DNA, 20 bp, Artificial Sequence
  sgRNA
  Gpr141_11
ccacgtagaagaggaacgtg

SEQ ID NO: 23946 - DNA, 20 bp, Artificial Sequence
  sgRNA
  Gpr141_12
tcatcacattgtccatggtg

SEQ ID NO: 23947 - DNA, 20 bp, Artificial Sequence
  sgRNA
  Gpr141_13
ttgtgcccagaactcctggt

SEQ ID NO: 23948 - DNA, 20 bp, Artificial Sequence
  sgRNA
  Gpr141_14
cctcacgttcctcttctacg

SEQ ID NO: 23949 - DNA, 20 bp, Artificial Sequence
  sgRNA
  Gpr141_15
ttaagtggtgtgccagtata

SEQ ID NO: 23950 - DNA, 20 bp, Artificial Sequence
  sgRNA
  Gpr141_16
ataaatcctgaagaactggt

SEQ ID NO: 23951 - DNA, 20 bp, Artificial Sequence
  sgRNA
  Gpr141_17
gttgtgcccagaactcctgg

SEQ ID NO: 23952 - DNA, 20 bp, Artificial Sequence
  sgRNA
  Gpr141_18
cagcaaatcacagcagctga

SEQ ID NO: 23953 - DNA, 20 bp, Artificial Sequence
  sgRNA
  Gpr141_19
ccactccttactatcccacc

SEQ ID NO: 23954 - DNA, 20 bp, Artificial Sequence
  sgRNA
  Gpr141_20
tacttcatagtgctcattgg

SEQ ID NO: 23955 - DNA, 20 bp, Artificial Sequence
  sgRNA
  Gpr142_1
tatggacaaactcctcaagt

SEQ ID NO: 23956 - DNA, 20 bp, Artificial Sequence
  sgRNA
  Gpr142_2
gattgcagtcttgttcacgg

SEQ ID NO: 23957 - DNA, 20 bp, Artificial Sequence
  sgRNA
  Gpr142_3
ggtatgataccagccacaca

SEQ ID NO: 23958 - DNA, 20 bp, Artificial Sequence
  sgRNA
  Gpr142_4
gaatgggatgccggtcagga

SEQ ID NO: 23959 - DNA, 20 bp, Artificial Sequence
  sgRNA
  Gpr142_5
ggtagtaacccaagatacga

SEQ ID NO: 23960 - DNA, 20 bp, Artificial Sequence
  sgRNA
  Gpr142_6
caataatacgtggtgcccag

SEQ ID NO: 23961 - DNA, 20 bp, Artificial Sequence
  sgRNA
  Gpr142_7
tacagcatgacaataatacg

SEQ ID NO: 23962 - DNA, 20 bp, Artificial Sequence
  sgRNA
  Gpr142_8
gctgtgctcttgctcaccaa

SEQ ID NO: 23963 - DNA, 20 bp, Artificial Sequence
  sgRNA
  Gpr142_9
catccagccaccagtagaat

SEQ ID NO: 23964 - DNA, 20 bp, Artificial Sequence
  sgRNA
  Gpr142_10
tggcccgatggcgtagaggg

SEQ ID NO: 23965 - DNA, 20 bp, Artificial Sequence
  sgRNA
  Gpr142_11
aactcatgctgaagtccgta

SEQ ID NO: 23966 - DNA, 20 bp, Artificial Sequence
  sgRNA
  Gpr142_12
ccaactctgccatcatcctt

SEQ ID NO: 23967 - DNA, 20 bp, Artificial Sequence
  sgRNA
  Gpr142_13
gtgaccaggaaaacattgca

SEQ ID NO: 23968 - DNA, 20 bp, Artificial Sequence
  sgRNA
  Gpr142_14
gagtgccaggagatagtgat

SEQ ID NO: 23969 - DNA, 20 bp, Artificial Sequence
  sgRNA
  Gpr142_15
ggcctctcttccgtagccga

SEQ ID NO: 23970 - DNA, 20 bp, Artificial Sequence
  sgRNA
  Gpr142_16
gtcacagccaaagcaaacgg

SEQ ID NO: 23971 - DNA, 20 bp, Artificial Sequence
  sgRNA
  Gpr142_17
tgttggctatgtccaaggcc

SEQ ID NO: 23972 - DNA, 20 bp, Artificial Sequence
  sgRNA
  Gpr142_18
gccaggagatagtgatagga

SEQ ID NO: 23973 - DNA, 20 bp, Artificial Sequence
  sgRNA
  Gpr142_19
tgacagcagcaatagcgcgg

SEQ ID NO: 23974 - DNA, 20 bp, Artificial Sequence
  sgRNA
  Gpr142_20
gtttgtccatagtgctagga

SEQ ID NO: 23975 - DNA, 20 bp, Artificial Sequence
  sgRNA
  Gpr143_1
tgggtaggctatccacactg

SEQ ID NO: 23976 - DNA, 20 bp, Artificial Sequence
  sgRNA
  Gpr143_2
cacagggcatggaacacccg

SEQ ID NO: 23977 - DNA, 20 bp, Artificial Sequence
  sgRNA
  Gpr143_3
tcaggagatcggcgggacgg

SEQ ID NO: 23978 - DNA, 20 bp, Artificial Sequence
  sgRNA
  Gpr143_4
agcacggaggatgtggactg

SEQ ID NO: 23979 - DNA, 20 bp, Artificial Sequence
  sgRNA
  Gpr143_5
gcagaaaattcccaggcgcg

SEQ ID NO: 23980 - DNA, 20 bp, Artificial Sequence
  sgRNA
  Gpr143_6
gcgtcgatctgttggtcaca

SEQ ID NO: 23981 - DNA, 20 bp, Artificial Sequence
  sgRNA
  Gpr143_7
tggtgctaagcttccaaccg

SEQ ID NO: 23982 - DNA, 20 bp, Artificial Sequence
  sgRNA
  Gpr143_8
cgacacatacaaccttcctg

SEQ ID NO: 23983 - DNA, 20 bp, Artificial Sequence
  sgRNA
  Gpr143_9
cactgaatcaccatcttggg

SEQ ID NO: 23984 - DNA, 20 bp, Artificial Sequence
  sgRNA
  Gpr143_10
ggatgtccatcctcccaaga

SEQ ID NO: 23985 - DNA, 20 bp, Artificial Sequence
  sgRNA
  Gpr143_11
catgatgtggtacagcagga

SEQ ID NO: 23986 - DNA, 20 bp, Artificial Sequence
  sgRNA
  Gpr143_12
cttggtgatcaggagatcgg

SEQ ID NO: 23987 - DNA, 20 bp, Artificial Sequence
  sgRNA
  Gpr143_13
tgatcaggagatcggcggga

SEQ ID NO: 23988 - DNA, 20 bp, Artificial Sequence
  sgRNA
  Gpr143_14
actccatttcccaagcccag

SEQ ID NO: 23989 - DNA, 20 bp, Artificial Sequence
  sgRNA
  Gpr143_15
gtgtggctgcgtcccacgta

SEQ ID NO: 23990 - DNA, 20 bp, Artificial Sequence
  sgRNA
  Gpr143_16
cacaggcagtggcagcacgg

SEQ ID NO: 23991 - DNA, 20 bp, Artificial Sequence
  sgRNA
  Gpr143_17
agaatgcagctaggaccaca

SEQ ID NO: 23992 - DNA, 20 bp, Artificial Sequence
  sgRNA
  Gpr143_18
gctgtaccacatcatggcct

SEQ ID NO: 23993 - DNA, 20 bp, Artificial Sequence
  sgRNA
  Gpr143_19
ggaatactgaatccagccca

SEQ ID NO: 23994 - DNA, 20 bp, Artificial Sequence
  sgRNA
  Gpr143_20
gaaggaggccaagcaccagg

SEQ ID NO: 23995 - DNA, 20 bp, Artificial Sequence
  sgRNA
  Gpr146_1
catgttcacgaagtacacgt

SEQ ID NO: 23996 - DNA, 20 bp, Artificial Sequence
  sgRNA
  Gpr146_2
tgcccggatgcagaacacgg

SEQ ID NO: 23997 - DNA, 20 bp, Artificial Sequence
  sgRNA
  Gpr146_3
gattctcgagatgagtgcca

SEQ ID NO: 23998 - DNA, 20 bp, Artificial Sequence
  sgRNA
  Gpr146_4
tggccagtgtgtacaacacc

SEQ ID NO: 23999 - DNA, 20 bp, Artificial Sequence
  sgRNA
  Gpr146_5
tcacctgctgtatccccgag

SEQ ID NO: 24000 - DNA, 20 bp, Artificial Sequence
  sgRNA
  Gpr146_6
gcattatctgggcatcctac

SEQ ID NO: 24001 - DNA, 20 bp, Artificial Sequence
  sgRNA
  Gpr146_7
tcgtgaacatggccgtggcg

SEQ ID NO: 24002 - DNA, 20 bp, Artificial Sequence
  sgRNA
  Gpr146_8
gcatcttcttcatcagccgc

SEQ ID NO: 24003 - DNA, 20 bp, Artificial Sequence
  sgRNA
  Gpr146_9
agatcagctgcattccacaa

SEQ ID NO: 24004 - DNA, 20 bp, Artificial Sequence
  sgRNA
  Gpr146_10
catcacctgctgtatccccg

SEQ ID NO: 24005 - DNA, 20 bp, Artificial Sequence
  sgRNA
  Gpr146_11
gcccagataatgcccctcca

SEQ ID NO: 24006 - DNA, 20 bp, Artificial Sequence
  sgRNA
  Gpr146_12
ctagaatcgctgagtgtgcc

SEQ ID NO: 24007 - DNA, 20 bp, Artificial Sequence
  sgRNA
  Gpr146_13
acactggccatgtaggtgcg

SEQ ID NO: 24008 - DNA, 20 bp, Artificial Sequence
  sgRNA
  Gpr146_14
actcatctcgagaatcggga

SEQ ID NO: 24009 - DNA, 20 bp, Artificial Sequence
  sgRNA
  Gpr146_15
acacagtgctgacgtcacgg

SEQ ID NO: 24010 - DNA, 20 bp, Artificial Sequence
  sgRNA
  Gpr146_16
atcacctgctgtatccccga

SEQ ID NO: 24011 - DNA, 20 bp, Artificial Sequence
  sgRNA
  Gpr146_17
gcagggcccaacaggtacgc

SEQ ID NO: 24012 - DNA, 20 bp, Artificial Sequence
  sgRNA
  Gpr146_18
ccttgtgctcatcggctacg

SEQ ID NO: 24013 - DNA, 20 bp, Artificial Sequence
  sgRNA
  Gpr146_19
gtgtgcccggatgcagaaca

SEQ ID NO: 24014 - DNA, 20 bp, Artificial Sequence
  sgRNA
  Gpr146_20
ttgatgtaacggtagagcag

SEQ ID NO: 24015 - DNA, 20 bp, Artificial Sequence
  sgRNA
  Gpr149_1
aactaccaggaaatttctcg

SEQ ID NO: 24016 - DNA, 20 bp, Artificial Sequence
  sgRNA
  Gpr149_2
tggtggtaaaacacgtggtg

SEQ ID NO: 24017 - DNA, 20 bp, Artificial Sequence
  sgRNA
  Gpr149_3
cagtggccaaaagaggcaca

SEQ ID NO: 24018 - DNA, 20 bp, Artificial Sequence
  sgRNA
  Gpr149_4
cccatcgaaggcaacggagt

SEQ ID NO: 24019 - DNA, 20 bp, Artificial Sequence
  sgRNA
  Gpr149_5
atgctccccgagctccgacg

SEQ ID NO: 24020 - DNA, 20 bp, Artificial Sequence
  sgRNA
  Gpr149_6
gcttctgtgccaagctcaag

SEQ ID NO: 24021 - DNA, 20 bp, Artificial Sequence
  sgRNA
  Gpr149_7
atacgtgctgctcctcttcg

SEQ ID NO: 24022 - DNA, 20 bp, Artificial Sequence
  sgRNA
  Gpr149_8
cctactccgttgccttcgat

SEQ ID NO: 24023 - DNA, 20 bp, Artificial Sequence
  sgRNA
  Gpr149_9
aagtacctgtcctaatcgcc

SEQ ID NO: 24024 - DNA, 20 bp, Artificial Sequence
  sgRNA
  Gpr149_10
cagttgatgatgcagccaca

SEQ ID NO: 24025 - DNA, 20 bp, Artificial Sequence
  sgRNA
  Gpr149_11
tcaccatcaggatcacttgt

SEQ ID NO: 24026 - DNA, 20 bp, Artificial Sequence
  sgRNA
  Gpr149_12
agaaagctgagcatatcgac

SEQ ID NO: 24027 - DNA, 20 bp, Artificial Sequence
  sgRNA
  Gpr149_13
tggccatgaaccgaactcag

SEQ ID NO: 24028 - DNA, 20 bp, Artificial Sequence
  sgRNA
  Gpr149_14
cagcaggctgactgcccaaa

SEQ ID NO: 24029 - DNA, 20 bp, Artificial Sequence
  sgRNA
  Gpr149_15
gcactcttcccgcagcagca

SEQ ID NO: 24030 - DNA, 20 bp, Artificial Sequence
  sgRNA
  Gpr149_16
catggtggtaaaacacgtgg

SEQ ID NO: 24031 - DNA, 20 bp, Artificial Sequence
  sgRNA
  Gpr149_17
ttacccacaagtgatcctga

SEQ ID NO: 24032 - DNA, 20 bp, Artificial Sequence
  sgRNA
  Gpr149_18
gagatgttaatatcaccatc

SEQ ID NO: 24033 - DNA, 20 bp, Artificial Sequence
  sgRNA
  Gpr149_19
ttatacgatgaacaggacgg

SEQ ID NO: 24034 - DNA, 20 bp, Artificial Sequence
  sgRNA
  Gpr149_20
tctcttgagcgtcttgtccg

SEQ ID NO: 24035 - DNA, 20 bp, Artificial Sequence
  sgRNA
  Gpr15_1
atagctctgcatttcaaacg

SEQ ID NO: 24036 - DNA, 20 bp, Artificial Sequence
  sgRNA
  Gpr15_2
gcttccttatccatccaaag

SEQ ID NO: 24037 - DNA, 20 bp, Artificial Sequence
  sgRNA
  Gpr15_3
ccttagccaagagattacga

SEQ ID NO: 24038 - DNA, 20 bp, Artificial Sequence
  sgRNA
  Gpr15_4
catgttcacggagatcacat

SEQ ID NO: 24039 - DNA, 20 bp, Artificial Sequence
  sgRNA
  Gpr15_5
ctttgacagctatatccgcc

SEQ ID NO: 24040 - DNA, 20 bp, Artificial Sequence
  sgRNA
  Gpr15_6
gacaacgtacaatggcccgg

SEQ ID NO: 24041 - DNA, 20 bp, Artificial Sequence
  sgRNA
  Gpr15_7
gcatgagatgatccagacga

SEQ ID NO: 24042 - DNA, 20 bp, Artificial Sequence
  sgRNA
  Gpr15_8
atagtaatccacaatcagca

SEQ ID NO: 24043 - DNA, 20 bp, Artificial Sequence
  sgRNA
  Gpr15_9
agtcctccatagtcctagag

SEQ ID NO: 24044 - DNA, 20 bp, Artificial Sequence
  sgRNA
  Gpr15_10
gctactgttgcatcacaagg

SEQ ID NO: 24045 - DNA, 20 bp, Artificial Sequence
  sgRNA
  Gpr15_11
cataggagctgcctttgcac

SEQ ID NO: 24046 - DNA, 20 bp, Artificial Sequence
  sgRNA
  Gpr15_12
agtgctgctcccaaagttgt

SEQ ID NO: 24047 - DNA, 20 bp, Artificial Sequence
  sgRNA
  Gpr15_13
agttggaaagagccttagtg

SEQ ID NO: 24048 - DNA, 20 bp, Artificial Sequence
  sgRNA
  Gpr15_14
ggatcatctcatgcgtcctg

SEQ ID NO: 24049 - DNA, 20 bp, Artificial Sequence
  sgRNA
  Gpr15_15
gtaatctcttggctaaggct

SEQ ID NO: 24050 - DNA, 20 bp, Artificial Sequence
  sgRNA
  Gpr15_16
gtgtgctcattaccagcagt

SEQ ID NO: 24051 - DNA, 20 bp, Artificial Sequence
  sgRNA
  Gpr15_17
ggtgcatgatagccaggtaa

SEQ ID NO: 24052 - DNA, 20 bp, Artificial Sequence
  sgRNA
  Gpr15_18
tgtcacagtgcctctttgga

SEQ ID NO: 24053 - DNA, 20 bp, Artificial Sequence
  sgRNA
  Gpr15_19
tctttgacagctatatccgc

SEQ ID NO: 24054 - DNA, 20 bp, Artificial Sequence
  sgRNA
  Gpr15_20
agtgaaaaaggccttctggc

SEQ ID NO: 24055 - DNA, 20 bp, Artificial Sequence
  sgRNA
  Gpr151_1
cacacggccatcaagagaga

SEQ ID NO: 24056 - DNA, 20 bp, Artificial Sequence
  sgRNA
  Gpr151_2
ttagattcagaatcagggag

SEQ ID NO: 24057 - DNA, 20 bp, Artificial Sequence
  sgRNA
  Gpr151_3
agcaccaccagacgtcacgc

SEQ ID NO: 24058 - DNA, 20 bp, Artificial Sequence
  sgRNA
  Gpr151_4
cgagcggcagcatactccaa

SEQ ID NO: 24059 - DNA, 20 bp, Artificial Sequence
  sgRNA
  Gpr151_5
ccttggagtatgctgccgct

SEQ ID NO: 24060 - DNA, 20 bp, Artificial Sequence
  sgRNA
  Gpr151_6
ggagggccgatgccaccaca

SEQ ID NO: 24061 - DNA, 20 bp, Artificial Sequence
  sgRNA
  Gpr151_7
ggtagcctcctgcaaagtgg

SEQ ID NO: 24062 - DNA, 20 bp, Artificial Sequence
  sgRNA
  Gpr151_8
ggtcattgtcttgtgctgaa

SEQ ID NO: 24063 - DNA, 20 bp, Artificial Sequence
  sgRNA
  Gpr151_9
cttctctgcacctgtccgag

SEQ ID NO: 24064 - DNA, 20 bp, Artificial Sequence
  sgRNA
  Gpr151_10
tcgtacatcgtgtcttacat

SEQ ID NO: 24065 - DNA, 20 bp, Artificial Sequence
  sgRNA
  Gpr151_11
aaaactgctccacgtcaggg

SEQ ID NO: 24066 - DNA, 20 bp, Artificial Sequence
  sgRNA
  Gpr151_12
cctgattctgaatctaagcc

SEQ ID NO: 24067 - DNA, 20 bp, Artificial Sequence
  sgRNA
  Gpr151_13
gagggccgatgccaccacag

SEQ ID NO: 24068 - DNA, 20 bp, Artificial Sequence
  sgRNA
  Gpr151_14
cacgtgggtgaaccagtcag

SEQ ID NO: 24069 - DNA, 20 bp, Artificial Sequence
  sgRNA
  Gpr151_15
aggtgtggaaatgtgcctcg

SEQ ID NO: 24070 - DNA, 20 bp, Artificial Sequence
  sgRNA
  Gpr151_16
cgccagccagaagtaaagga

SEQ ID NO: 24071 - DNA, 20 bp, Artificial Sequence
  sgRNA
  Gpr151_17
ggagaatgccaatcacacac

SEQ ID NO: 24072 - DNA, 20 bp, Artificial Sequence
  sgRNA
  Gpr151_18
acataactagaaaaatgaga

SEQ ID NO: 24073 - DNA, 20 bp, Artificial Sequence
  sgRNA
  Gpr151_19
acatgcatcctagacacaga

SEQ ID NO: 24074 - DNA, 20 bp, Artificial Sequence
  sgRNA
  Gpr151_20
ggcacctgctggaaacacag

SEQ ID NO: 24075 - DNA, 20 bp, Artificial Sequence
  sgRNA
  Gpr152_1
gatgaggactactaccctca

SEQ ID NO: 24076 - DNA, 20 bp, Artificial Sequence
  sgRNA
  Gpr152_2
caaaatggtcttggccacac

SEQ ID NO: 24077 - DNA, 20 bp, Artificial Sequence
  sgRNA
  Gpr152_3
cggatgcttgagatcttggg

SEQ ID NO: 24078 - DNA, 20 bp, Artificial Sequence
  sgRNA
  Gpr152_4
tgagcgctgtcaataggaag

SEQ ID NO: 24079 - DNA, 20 bp, Artificial Sequence
  sgRNA
  Gpr152_5
tgaactacagtatccaacgg

SEQ ID NO: 24080 - DNA, 20 bp, Artificial Sequence
  sgRNA
  Gpr152_6
tggccacacgggcaaagccg

SEQ ID NO: 24081 - DNA, 20 bp, Artificial Sequence
  sgRNA
  Gpr152_7
aagatctcaagcatccgcag

SEQ ID NO: 24082 - DNA, 20 bp, Artificial Sequence
  sgRNA
  Gpr152_8
agttgaactacagtatccaa

SEQ ID NO: 24083 - DNA, 20 bp, Artificial Sequence
  sgRNA
  Gpr152_9
tgggccacagaatctgactg

SEQ ID NO: 24084 - DNA, 20 bp, Artificial Sequence
  sgRNA
  Gpr152_10
caggtagtcagaatagacca

SEQ ID NO: 24085 - DNA, 20 bp, Artificial Sequence
  sgRNA
  Gpr152_11
ccgcttctactacttcctgt

SEQ ID NO: 24086 - DNA, 20 bp, Artificial Sequence
  sgRNA
  Gpr152_12
gcctcagggaagaccaacca

SEQ ID NO: 24087 - DNA, 20 bp, Artificial Sequence
  sgRNA
  Gpr152_13
ggtcctacaagcagtggctt

SEQ ID NO: 24088 - DNA, 20 bp, Artificial Sequence
  sgRNA
  Gpr152_14
gagccatgccatcagcccat

SEQ ID NO: 24089 - DNA, 20 bp, Artificial Sequence
  sgRNA
  Gpr152_15
ggcacagtgccagcaagcag

SEQ ID NO: 24090 - DNA, 20 bp, Artificial Sequence
  sgRNA
  Gpr152_16
tgtgccctcgatggtaccct

SEQ ID NO: 24091 - DNA, 20 bp, Artificial Sequence
  sgRNA
  Gpr152_17
tcatcactgagctctgtacg

SEQ ID NO: 24092 - DNA, 20 bp, Artificial Sequence
  sgRNA
  Gpr152_18
tggaccacagactttgattg

SEQ ID NO: 24093 - DNA, 20 bp, Artificial Sequence
  sgRNA
  Gpr152_19
tggtctgtctaggttctcag

SEQ ID NO: 24094 - DNA, 20 bp, Artificial Sequence
  sgRNA
  Gpr152_20
gcacggagctggcacaagat

SEQ ID NO: 24095 - DNA, 20 bp, Artificial Sequence
  sgRNA
  Gpr153_1
gacttgtgatcgttaccggg

SEQ ID NO: 24096 - DNA, 20 bp, Artificial Sequence
  sgRNA
  Gpr153_2
tcccgactacgagtggaacg

SEQ ID NO: 24097 - DNA, 20 bp, Artificial Sequence
  sgRNA
  Gpr153_3
agcgctccaataccatgtcg

SEQ ID NO: 24098 - DNA, 20 bp, Artificial Sequence
  sgRNA
  Gpr153_4
agcgagcgtttctacaccca

SEQ ID NO: 24099 - DNA, 20 bp, Artificial Sequence
  sgRNA
  Gpr153_5
gtgcagcgtgacgtagcccg

SEQ ID NO: 24100 - DNA, 20 bp, Artificial Sequence
  sgRNA
  Gpr153_6
gcacacttaatgctgcccgc

SEQ ID NO: 24101 - DNA, 20 bp, Artificial Sequence
  sgRNA
  Gpr153_7
tcctcgcccgagctccagcg

SEQ ID NO: 24102 - DNA, 20 bp, Artificial Sequence
  sgRNA
  Gpr153_8
gctgaggtcccaacgccccc

SEQ ID NO: 24103 - DNA, 20 bp, Artificial Sequence
  sgRNA
  Gpr153_9
gctcgccccaagatgcgctc

SEQ ID NO: 24104 - DNA, 20 bp, Artificial Sequence
  sgRNA
  Gpr153_10
tcgacacgaagaccttacag

SEQ ID NO: 24105 - DNA, 20 bp, Artificial Sequence
  sgRNA
  Gpr153_11
cagccctcgtccctagacgg

SEQ ID NO: 24106 - DNA, 20 bp, Artificial Sequence
  sgRNA
  Gpr153_12
atcgtgggagaaccgccggg

SEQ ID NO: 24107 - DNA, 20 bp, Artificial Sequence
  sgRNA
  Gpr153_13
gcgtcttccaccacgatggt

SEQ ID NO: 24108 - DNA, 20 bp, Artificial Sequence
  sgRNA
  Gpr153_14
acgtagcccgaggactcgga

SEQ ID NO: 24109 - DNA, 20 bp, Artificial Sequence
  sgRNA
  Gpr153_15
ggcaacgtcccgactacgag

SEQ ID NO: 24110 - DNA, 20 bp, Artificial Sequence
  sgRNA
  Gpr153_16
gatggtgtccttcatcctgt

SEQ ID NO: 24111 - DNA, 20 bp, Artificial Sequence
  sgRNA
  Gpr153_17
cccgactacgagtggaacga

SEQ ID NO: 24112 - DNA, 20 bp, Artificial Sequence
  sgRNA
  Gpr153_18
gcgctccaataccatgtcgg

SEQ ID NO: 24113 - DNA, 20 bp, Artificial Sequence
  sgRNA
  Gpr153_19
ccacgatgatgccgacgtgt

SEQ ID NO: 24114 - DNA, 20 bp, Artificial Sequence
  sgRNA
  Gpr153_20
ggccgtacgcaacgcagcca

SEQ ID NO: 24115 - DNA, 20 bp, Artificial Sequence
  sgRNA
  Gpr155_1
gagaaaagcccagtccacgt

SEQ ID NO: 24116 - DNA, 20 bp, Artificial Sequence
  sgRNA
  Gpr155_2
tatgccaaagcactccagta

SEQ ID NO: 24117 - DNA, 20 bp, Artificial Sequence
  sgRNA
  Gpr155_3
ggtcagaccaagataaaaca

SEQ ID NO: 24118 - DNA, 20 bp, Artificial Sequence
  sgRNA
  Gpr155_4
atgctgacagatgatcacca

SEQ ID NO: 24119 - DNA, 20 bp, Artificial Sequence
  sgRNA
  Gpr155_5
tgtttcggatgcacaggtcg

SEQ ID NO: 24120 - DNA, 20 bp, Artificial Sequence
  sgRNA
  Gpr155_6
cgtagatcacagcttcgccg

SEQ ID NO: 24121 - DNA, 20 bp, Artificial Sequence
  sgRNA
  Gpr155_7
gcagaacagggtgactgccg

SEQ ID NO: 24122 - DNA, 20 bp, Artificial Sequence
  sgRNA
  Gpr155_8
cgagagcgttcagctcccgg

SEQ ID NO: 24123 - DNA, 20 bp, Artificial Sequence
  sgRNA
  Gpr155_9
cgggttatcgacatcgaagg

SEQ ID NO: 24124 - DNA, 20 bp, Artificial Sequence
  sgRNA
  Gpr155_10
ctgataactggaaaacacaa

SEQ ID NO: 24125 - DNA, 20 bp, Artificial Sequence
  sgRNA
  Gpr155_11
tgttcaaccacgagacggga

SEQ ID NO: 24126 - DNA, 20 bp, Artificial Sequence
  sgRNA
  Gpr155_12
tactctaagagaccaccagg

SEQ ID NO: 24127 - DNA, 20 bp, Artificial Sequence
  sgRNA
  Gpr155_13
tgacgatgtttcggatgcac

SEQ ID NO: 24128 - DNA, 20 bp, Artificial Sequence
  sgRNA
  Gpr155_14
ggtaaaagagatactcgtcc

SEQ ID NO: 24129 - DNA, 20 bp, Artificial Sequence
  sgRNA
  Gpr155_15
cctggtggtctcttagagta

SEQ ID NO: 24130 - DNA, 20 bp, Artificial Sequence
  sgRNA
  Gpr155_16
gcaaagaactcaacgcttgc

SEQ ID NO: 24131 - DNA, 20 bp, Artificial Sequence
  sgRNA
  Gpr155_17
ttgtggctacatagcaggaa

SEQ ID NO: 24132 - DNA, 20 bp, Artificial Sequence
  sgRNA
  Gpr155_18
aatcaggcgactgaagaagt

SEQ ID NO: 24133 - DNA, 20 bp, Artificial Sequence
  sgRNA
  Gpr155_19
gagatgatgatgattcccac

SEQ ID NO: 24134 - DNA, 20 bp, Artificial Sequence
  sgRNA
  Gpr155_20
ttgtgcttgctgcttatcat

SEQ ID NO: 24135 - DNA, 20 bp, Artificial Sequence
  sgRNA
  Gpr156_1
aggtccacataatccccaag

SEQ ID NO: 24136 - DNA, 20 bp, Artificial Sequence
  sgRNA
  Gpr156_2
gtctttggactcacatccgg

SEQ ID NO: 24137 - DNA, 20 bp, Artificial Sequence
  sgRNA
  Gpr156_3
aaccttgcatcccaaaacca

SEQ ID NO: 24138 - DNA, 20 bp, Artificial Sequence
  sgRNA
  Gpr156_4
cttccacggccagttcgatg

SEQ ID NO: 24139 - DNA, 20 bp, Artificial Sequence
  sgRNA
  Gpr156_5
ctccatctgccattaaacgc

SEQ ID NO: 24140 - DNA, 20 bp, Artificial Sequence
  sgRNA
  Gpr156_6
ggtccacataatccccaaga

SEQ ID NO: 24141 - DNA, 20 bp, Artificial Sequence
  sgRNA
  Gpr156_7
gcaggccgctggaacgtgta

SEQ ID NO: 24142 - DNA, 20 bp, Artificial Sequence
  sgRNA
  Gpr156_8
tcggaacctcgccggaaaca

SEQ ID NO: 24143 - DNA, 20 bp, Artificial Sequence
  sgRNA
  Gpr156_9
actcccaaagaagctacctg

SEQ ID NO: 24144 - DNA, 20 bp, Artificial Sequence
  sgRNA
  Gpr156_10
ctgactactgaactgacccc

SEQ ID NO: 24145 - DNA, 20 bp, Artificial Sequence
  sgRNA
  Gpr156_11
tgtgcaaacgaagatacctc

SEQ ID NO: 24146 - DNA, 20 bp, Artificial Sequence
  sgRNA
  Gpr156_12
agggtaccctgtttccggcg

SEQ ID NO: 24147 - DNA, 20 bp, Artificial Sequence
  sgRNA
  Gpr156_13
ccaaaggctgaacaaagcga

SEQ ID NO: 24148 - DNA, 20 bp, Artificial Sequence
  sgRNA
  Gpr156_14
tagcacccagaagacaagga

SEQ ID NO: 24149 - DNA, 20 bp, Artificial Sequence
  sgRNA
  Gpr156_15
ggactccctacacgttccag

SEQ ID NO: 24150 - DNA, 20 bp, Artificial Sequence
  sgRNA
  Gpr156_16
acctcctgctcctcaccgct

SEQ ID NO: 24151 - DNA, 20 bp, Artificial Sequence
  sgRNA
  Gpr156_17
actgggtttcagcccgtacg

SEQ ID NO: 24152 - DNA, 20 bp, Artificial Sequence
  sgRNA
  Gpr156_18
ggctggaccacaacaatgca

SEQ ID NO: 24153 - DNA, 20 bp, Artificial Sequence
  sgRNA
  Gpr156_19
ggattcaagatgctcttgag

SEQ ID NO: 24154 - DNA, 20 bp, Artificial Sequence
  sgRNA
  Gpr156_20
cagatgcagcctctgcccgt

SEQ ID NO: 24155 - DNA, 20 bp, Artificial Sequence
  sgRNA
  Gpr157_1
gcatcgtccgaactacgcgc

SEQ ID NO: 24156 - DNA, 20 bp, Artificial Sequence
  sgRNA
  Gpr157_2
gctactcttcctgtcgctag

SEQ ID NO: 24157 - DNA, 20 bp, Artificial Sequence
  sgRNA
  Gpr157_3
agtaccggcccatctgcgag

SEQ ID NO: 24158 - DNA, 20 bp, Artificial Sequence
  sgRNA
  Gpr157_4
ccagcccacagacacatccg

SEQ ID NO: 24159 - DNA, 20 bp, Artificial Sequence
  sgRNA
  Gpr157_5
gagcgtcaggacaaagcgca

SEQ ID NO: 24160 - DNA, 20 bp, Artificial Sequence
  sgRNA
  Gpr157_6
agcatcgtccgaactacgcg

SEQ ID NO: 24161 - DNA, 20 bp, Artificial Sequence
  sgRNA
  Gpr157_7
gctacgcaggtcaggccaca

SEQ ID NO: 24162 - DNA, 20 bp, Artificial Sequence
  sgRNA
  Gpr157_8
gcgtagttcggacgatgctg

SEQ ID NO: 24163 - DNA, 20 bp, Artificial Sequence
  sgRNA
  Gpr157_9
cagcactccgtagaagtacg

SEQ ID NO: 24164 - DNA, 20 bp, Artificial Sequence
  sgRNA
  Gpr157_10
tcagtagcatccacaggaca

SEQ ID NO: 24165 - DNA, 20 bp, Artificial Sequence
  sgRNA
  Gpr157_11
agagcaggtccgctagcgac

SEQ ID NO: 24166 - DNA, 20 bp, Artificial Sequence
  sgRNA
  Gpr157_12
gcacggtgctccagacgcgg

SEQ ID NO: 24167 - DNA, 20 bp, Artificial Sequence
  sgRNA
  Gpr157_13
gatgcctcggatgtgtctgt

SEQ ID NO: 24168 - DNA, 20 bp, Artificial Sequence
  sgRNA
  Gpr157_14
gcgaggctcctccacttcca

SEQ ID NO: 24169 - DNA, 20 bp, Artificial Sequence
  sgRNA
  Gpr157_15
ggtgaaaagcccagattagg

SEQ ID NO: 24170 - DNA, 20 bp, Artificial Sequence
  sgRNA
  Gpr157_16
tgagattctcctatcttggg

SEQ ID NO: 24171 - DNA, 20 bp, Artificial Sequence
  sgRNA
  Gpr157_17
gcacgggtgtctgtacagcc

SEQ ID NO: 24172 - DNA, 20 bp, Artificial Sequence
  sgRNA
  Gpr157_18
ctgagattctcctatcttgg

SEQ ID NO: 24173 - DNA, 20 bp, Artificial Sequence
  sgRNA
  Gpr157_19
aagtagagagagcgccctga

SEQ ID NO: 24174 - DNA, 20 bp, Artificial Sequence
  sgRNA
  Gpr157_20
aactacgcgcgggccctcca

SEQ ID NO: 24175 - DNA, 20 bp, Artificial Sequence
  sgRNA
  Gpr158_1
ggcacaaaaactagccgagg

SEQ ID NO: 24176 - DNA, 20 bp, Artificial Sequence
  sgRNA
  Gpr158_2
ttgttcactgagaagacacg

SEQ ID NO: 24177 - DNA, 20 bp, Artificial Sequence
  sgRNA
  Gpr158_3
ctgctgtcatgtaatcccag

SEQ ID NO: 24178 - DNA, 20 bp, Artificial Sequence
  sgRNA
  Gpr158_4
gatgcgactctcctcgcggg

SEQ ID NO: 24179 - DNA, 20 bp, Artificial Sequence
  sgRNA
  Gpr158_5
gcaggccagccaactcgtag

SEQ ID NO: 24180 - DNA, 20 bp, Artificial Sequence
  sgRNA
  Gpr158_6
gcaggatgcgactctcctcg

SEQ ID NO: 24181 - DNA, 20 bp, Artificial Sequence
  sgRNA
  Gpr158_7
actgcgacagccatgtagcg

SEQ ID NO: 24182 - DNA, 20 bp, Artificial Sequence
  sgRNA
  Gpr158_8
tctaggggctcgaactccca

SEQ ID NO: 24183 - DNA, 20 bp, Artificial Sequence
  sgRNA
  Gpr158_9
agaaccctactgagtcctca

SEQ ID NO: 24184 - DNA, 20 bp, Artificial Sequence
  sgRNA
  Gpr158_10
cctcgagagaggactccgag

SEQ ID NO: 24185 - DNA, 20 bp, Artificial Sequence
  sgRNA
  Gpr158_11
atatgtgcctcattgaccgc

SEQ ID NO: 24186 - DNA, 20 bp, Artificial Sequence
  sgRNA
  Gpr158_12
gccaatcctgacgtgagctc

SEQ ID NO: 24187 - DNA, 20 bp, Artificial Sequence
  sgRNA
  Gpr158_13
acgccactctagagaccgag

SEQ ID NO: 24188 - DNA, 20 bp, Artificial Sequence
  sgRNA
  Gpr158_14
tctaagactccagttctccc

SEQ ID NO: 24189 - DNA, 20 bp, Artificial Sequence
  sgRNA
  Gpr158_15
actagccgaggaggtgcccg

SEQ ID NO: 24190 - DNA, 20 bp, Artificial Sequence
  sgRNA
  Gpr158_16
cttcctccaggccacccgcg

SEQ ID NO: 24191 - DNA, 20 bp, Artificial Sequence
  sgRNA
  Gpr158_17
ctagagtggcgttagccagg

SEQ ID NO: 24192 - DNA, 20 bp, Artificial Sequence
  sgRNA
  Gpr158_18
ggacgatcatcagcacagaa

SEQ ID NO: 24193 - DNA, 20 bp, Artificial Sequence
  sgRNA
  Gpr158_19
tccccgagatgacattgcta

SEQ ID NO: 24194 - DNA, 20 bp, Artificial Sequence
  sgRNA
  Gpr158_20
acttcggctcgtgatgttaa

SEQ ID NO: 24195 - DNA, 20 bp, Artificial Sequence
  sgRNA
  Gpr160_1
ggtcaaccaaaacgtaagca

SEQ ID NO: 24196 - DNA, 20 bp, Artificial Sequence
  sgRNA
  Gpr160_2
ccagcaagcagtcatctagg

SEQ ID NO: 24197 - DNA, 20 bp, Artificial Sequence
  sgRNA
  Gpr160_3
agtactccatcaaagtccag

SEQ ID NO: 24198 - DNA, 20 bp, Artificial Sequence
  sgRNA
  Gpr160_4
tgtttaataacactttcccc

SEQ ID NO: 24199 - DNA, 20 bp, Artificial Sequence
  sgRNA
  Gpr160_5
tctgagtgctgacataggcg

SEQ ID NO: 24200 - DNA, 20 bp, Artificial Sequence
  sgRNA
  Gpr160_6
agaaagcacacgatgagcct

SEQ ID NO: 24201 - DNA, 20 bp, Artificial Sequence
  sgRNA
  Gpr160_7
gtactccatcaaagtccagc

SEQ ID NO: 24202 - DNA, 20 bp, Artificial Sequence
  sgRNA
  Gpr160_8
gtcagcctaaaggcacacag

SEQ ID NO: 24203 - DNA, 20 bp, Artificial Sequence
  sgRNA
  Gpr160_9
aggacctgaagtgctacaaa

SEQ ID NO: 24204 - DNA, 20 bp, Artificial Sequence
  sgRNA
  Gpr160_10
tttcctttcccactccactg

SEQ ID NO: 24205 - DNA, 20 bp, Artificial Sequence
  sgRNA
  Gpr160_11
gcagagaagcactcttgccc

SEQ ID NO: 24206 - DNA, 20 bp, Artificial Sequence
  sgRNA
  Gpr160_12
ctgttgacaaagtacagcca

SEQ ID NO: 24207 - DNA, 20 bp, Artificial Sequence
  sgRNA
  Gpr160_13
cccttctcactcttagaagg

SEQ ID NO: 24208 - DNA, 20 bp, Artificial Sequence
  sgRNA
  Gpr160_14
ggccatctcagtcagcctaa

SEQ ID NO: 24209 - DNA, 20 bp, Artificial Sequence
  sgRNA
  Gpr160_15
tgttgacaaagtacagccag

SEQ ID NO: 24210 - DNA, 20 bp, Artificial Sequence
  sgRNA
  Gpr160_16
gcattacccagtctgctcac

SEQ ID NO: 24211 - DNA, 20 bp, Artificial Sequence
  sgRNA
  Gpr160_17
gatagcatcctataagagca

SEQ ID NO: 24212 - DNA, 20 bp, Artificial Sequence
  sgRNA
  Gpr160_18
acatagaaatgaacgtcccc

SEQ ID NO: 24213 - DNA, 20 bp, Artificial Sequence
  sgRNA
  Gpr160_19
agtcagcctaaaggcacaca

SEQ ID NO: 24214 - DNA, 20 bp, Artificial Sequence
  sgRNA
  Gpr160_20
tttaggctgactgagatggc

SEQ ID NO: 24215 - DNA, 20 bp, Artificial Sequence
  sgRNA
  Gpr161_1
gatgaccaaccaaatagggg

SEQ ID NO: 24216 - DNA, 20 bp, Artificial Sequence
  sgRNA
  Gpr161_2
atggagctagtcaccacgaa

SEQ ID NO: 24217 - DNA, 20 bp, Artificial Sequence
  sgRNA
  Gpr161_3
ggtgactagctccatccgga

SEQ ID NO: 24218 - DNA, 20 bp, Artificial Sequence
  sgRNA
  Gpr161_4
tgtaccccatgaagatcaca

SEQ ID NO: 24219 - DNA, 20 bp, Artificial Sequence
  sgRNA
  Gpr161_5
gctgatcagcaggtagagga

SEQ ID NO: 24220 - DNA, 20 bp, Artificial Sequence
  sgRNA
  Gpr161_6
ctctgctcaccgcatcccga

SEQ ID NO: 24221 - DNA, 20 bp, Artificial Sequence
  sgRNA
  Gpr161_7
gaaaatccattccctccgga

SEQ ID NO: 24222 - DNA, 20 bp, Artificial Sequence
  sgRNA
  Gpr161_8
tctgctcaccgcatcccgag

SEQ ID NO: 24223 - DNA, 20 bp, Artificial Sequence
  sgRNA
  Gpr161_9
ggtcctctgtcgctgcacaa

SEQ ID NO: 24224 - DNA, 20 bp, Artificial Sequence
  sgRNA
  Gpr161_10
gctctgctcaccgcatcccg

SEQ ID NO: 24225 - DNA, 20 bp, Artificial Sequence
  sgRNA
  Gpr161_11
cacagcacggaccgtcccag

SEQ ID NO: 24226 - DNA, 20 bp, Artificial Sequence
  sgRNA
  Gpr161_12
ggctcttcagcatttccaac

SEQ ID NO: 24227 - DNA, 20 bp, Artificial Sequence
  sgRNA
  Gpr161_13
acaaggtgactacaatgacc

SEQ ID NO: 24228 - DNA, 20 bp, Artificial Sequence
  sgRNA
  Gpr161_14
ttacctcagaggcactctgg

SEQ ID NO: 24229 - DNA, 20 bp, Artificial Sequence
  sgRNA
  Gpr161_15
aggactctcagaggagcggg

SEQ ID NO: 24230 - DNA, 20 bp, Artificial Sequence
  sgRNA
  Gpr161_16
tcgtggtgactagctccatc

SEQ ID NO: 24231 - DNA, 20 bp, Artificial Sequence
  sgRNA
  Gpr161_17
ctacggtttcatcttccggg

SEQ ID NO: 24232 - DNA, 20 bp, Artificial Sequence
  sgRNA
  Gpr161_18
gcagcaccagcaccgacaac

SEQ ID NO: 24233 - DNA, 20 bp, Artificial Sequence
  sgRNA
  Gpr161_19
agacgagagccatcacagct

SEQ ID NO: 24234 - DNA, 20 bp, Artificial Sequence
  sgRNA
  Gpr161_20
tggtgactagctccatccgg

SEQ ID NO: 24235 - DNA, 20 bp, Artificial Sequence
  sgRNA
  Gpr162_1
gtgtgtggcgatcatgtccg

SEQ ID NO: 24236 - DNA, 20 bp, Artificial Sequence
  sgRNA
  Gpr162_2
ttgtggtggaggatactcga

SEQ ID NO: 24237 - DNA, 20 bp, Artificial Sequence
  sgRNA
  Gpr162_3
tgtgtccacctactacacgc

SEQ ID NO: 24238 - DNA, 20 bp, Artificial Sequence
  sgRNA
  Gpr162_4
ttctctatgactcactcacg

SEQ ID NO: 24239 - DNA, 20 bp, Artificial Sequence
  sgRNA
  Gpr162_5
tctctatgactcactcacgg

SEQ ID NO: 24240 - DNA, 20 bp, Artificial Sequence
  sgRNA
  Gpr162_6
catcggctggcacaacaacg

SEQ ID NO: 24241 - DNA, 20 bp, Artificial Sequence
  sgRNA
  Gpr162_7
tcgagtatcctccaccacaa

SEQ ID NO: 24242 - DNA, 20 bp, Artificial Sequence
  sgRNA
  Gpr162_8
gctaaggatgatccaagcgt

SEQ ID NO: 24243 - DNA, 20 bp, Artificial Sequence
  sgRNA
  Gpr162_9
ttgatgctaacggggccaca

SEQ ID NO: 24244 - DNA, 20 bp, Artificial Sequence
  sgRNA
  Gpr162_10
gggataatcgtcgggacaaa

SEQ ID NO: 24245 - DNA, 20 bp, Artificial Sequence
  sgRNA
  Gpr162_11
catgcgatggtaggagagcg

SEQ ID NO: 24246 - DNA, 20 bp, Artificial Sequence
  sgRNA
  Gpr162_12
ctcgttccagtcatagtcag

SEQ ID NO: 24247 - DNA, 20 bp, Artificial Sequence
  sgRNA
  Gpr162_13
ggggagcgctactatgcccg

SEQ ID NO: 24248 - DNA, 20 bp, Artificial Sequence
  sgRNA
  Gpr162_14
cactttctagaaactgtcga

SEQ ID NO: 24249 - DNA, 20 bp, Artificial Sequence
  sgRNA
  Gpr162_15
agtcagactcagctccgcca

SEQ ID NO: 24250 - DNA, 20 bp, Artificial Sequence
  sgRNA
  Gpr162_16
aggatactcgagggaagcgg

SEQ ID NO: 24251 - DNA, 20 bp, Artificial Sequence
  sgRNA
  Gpr162_17
aggtgtctcatcgatgaagg

SEQ ID NO: 24252 - DNA, 20 bp, Artificial Sequence
  sgRNA
  Gpr162_18
agattcagagccatccagcg

SEQ ID NO: 24253 - DNA, 20 bp, Artificial Sequence
  sgRNA
  Gpr162_19
gatctcctcccggaaaaaac

SEQ ID NO: 24254 - DNA, 20 bp, Artificial Sequence
  sgRNA
  Gpr162_20
ttgttgtgccagccgatgga

SEQ ID NO: 24255 - DNA, 20 bp, Artificial Sequence
  sgRNA
  Gpr17_1
agagaagtgataaaccaacc

SEQ ID NO: 24256 - DNA, 20 bp, Artificial Sequence
  sgRNA
  Gpr17_2
atgcggacaagagacccccc

SEQ ID NO: 24257 - DNA, 20 bp, Artificial Sequence
  sgRNA
  Gpr17_3
ggacttgacagggtgcacaa

SEQ ID NO: 24258 - DNA, 20 bp, Artificial Sequence
  sgRNA
  Gpr17_4
gtcccatatgaaaagccaca

SEQ ID NO: 24259 - DNA, 20 bp, Artificial Sequence
  sgRNA
  Gpr17_5
gaagcacatagactgaacgg

SEQ ID NO: 24260 - DNA, 20 bp, Artificial Sequence
  sgRNA
  Gpr17_6
ccagaaccatagcaatcatg

SEQ ID NO: 24261 - DNA, 20 bp, Artificial Sequence
  sgRNA
  Gpr17_7
ttgaggtgcttctctatccg

SEQ ID NO: 24262 - DNA, 20 bp, Artificial Sequence
  sgRNA
  Gpr17_8
gagaggtcttcgaagcttga

SEQ ID NO: 24263 - DNA, 20 bp, Artificial Sequence
  sgRNA
  Gpr17_9
gtctatgtgcttcactaccg

SEQ ID NO: 24264 - DNA, 20 bp, Artificial Sequence
  sgRNA
  Gpr17_10
ggtaggcaggaccaacacgc

SEQ ID NO: 24265 - DNA, 20 bp, Artificial Sequence
  sgRNA
  Gpr17_11
gcaacttgctctgcagcaaa

SEQ ID NO: 24266 - DNA, 20 bp, Artificial Sequence
  sgRNA
  Gpr17_12
ctgcctcaccagcctcaacg

SEQ ID NO: 24267 - DNA, 20 bp, Artificial Sequence
  sgRNA
  Gpr17_13
cgcacgaagtcccaccacca

SEQ ID NO: 24268 - DNA, 20 bp, Artificial Sequence
  sgRNA
  Gpr17_14
gttggtcctgcctacccggt

SEQ ID NO: 24269 - DNA, 20 bp, Artificial Sequence
  sgRNA
  Gpr17_15
gaagtacatgacaggatcca

SEQ ID NO: 24270 - DNA, 20 bp, Artificial Sequence
  sgRNA
  Gpr17_16
ggttggtctgcactgtctgt

SEQ ID NO: 24271 - DNA, 20 bp, Artificial Sequence
  sgRNA
  Gpr17_17
ggtcccatatgaaaagccac

SEQ ID NO: 24272 - DNA, 20 bp, Artificial Sequence
  sgRNA
  Gpr17_18
gcaggctgcgaatgatcagc

SEQ ID NO: 24273 - DNA, 20 bp, Artificial Sequence
  sgRNA
  Gpr17_19
cgaagagcatgttctccagg

SEQ ID NO: 24274 - DNA, 20 bp, Artificial Sequence
  sgRNA
  Gpr17_20
ctgtgggctgactagcagtg

SEQ ID NO: 24275 - DNA, 20 bp, Artificial Sequence
  sgRNA
  Gpr171_1
tataccgaatacaagaacct

SEQ ID NO: 24276 - DNA, 20 bp, Artificial Sequence
  sgRNA
  Gpr171_2
agtacatattgatgtagatg

SEQ ID NO: 24277 - DNA, 20 bp, Artificial Sequence
  sgRNA
  Gpr171_3
gctaacaaacttcatctgtg

SEQ ID NO: 24278 - DNA, 20 bp, Artificial Sequence
  sgRNA
  Gpr171_4
gctgatcatggtgccgaaca

SEQ ID NO: 24279 - DNA, 20 bp, Artificial Sequence
  sgRNA
  Gpr171_5
acagcgatcgatgctgacaa

SEQ ID NO: 24280 - DNA, 20 bp, Artificial Sequence
  sgRNA
  Gpr171_6
tgtatgggatcctgacagcg

SEQ ID NO: 24281 - DNA, 20 bp, Artificial Sequence
  sgRNA
  Gpr171_7
atatgacctctgtctggctg

SEQ ID NO: 24282 - DNA, 20 bp, Artificial Sequence
  sgRNA
  Gpr171_8
gtaaaaatcattgttgactt

SEQ ID NO: 24283 - DNA, 20 bp, Artificial Sequence
  sgRNA
  Gpr171_9
tatgacctctgtctggctga

SEQ ID NO: 24284 - DNA, 20 bp, Artificial Sequence
  sgRNA
  Gpr171_10
ggcaggctgtcacttggcag

SEQ ID NO: 24285 - DNA, 20 bp, Artificial Sequence
  sgRNA
  Gpr171_11
aatcagatatgacctctgtc

SEQ ID NO: 24286 - DNA, 20 bp, Artificial Sequence
  sgRNA
  Gpr171_12
tttctgtataaaagcccacg

SEQ ID NO: 24287 - DNA, 20 bp, Artificial Sequence
  sgRNA
  Gpr171_13
ctcggtgacctttagtcgaa

SEQ ID NO: 24288 - DNA, 20 bp, Artificial Sequence
  sgRNA
  Gpr171_14
gggatcctgacagcgtggta

SEQ ID NO: 24289 - DNA, 20 bp, Artificial Sequence
  sgRNA
  Gpr171_15
aaatgatatcagctgtcgtg

SEQ ID NO: 24290 - DNA, 20 bp, Artificial Sequence
  sgRNA
  Gpr171_16
cttctcaatctttcttccag

SEQ ID NO: 24291 - DNA, 20 bp, Artificial Sequence
  sgRNA
  Gpr171_17
atacaccctcagccagacag

SEQ ID NO: 24292 - DNA, 20 bp, Artificial Sequence
  sgRNA
  Gpr171_18
ctgtctggctgagggtgtat

SEQ ID NO: 24293 - DNA, 20 bp, Artificial Sequence
  sgRNA
  Gpr171_19
gctgacacatctgtgatttg

SEQ ID NO: 24294 - DNA, 20 bp, Artificial Sequence
  sgRNA
  Gpr171_20
acctaaaaagagcaagcctc

SEQ ID NO: 24295 - DNA, 20 bp, Artificial Sequence
  sgRNA
  Gpr173_1
ctacaagtttatccgagagg

SEQ ID NO: 24296 - DNA, 20 bp, Artificial Sequence
  sgRNA
  Gpr173_2
gcacagaagccagtacaaag

SEQ ID NO: 24297 - DNA, 20 bp, Artificial Sequence
  sgRNA
  Gpr173_3
tcatgcgcttggcatagaag

SEQ ID NO: 24298 - DNA, 20 bp, Artificial Sequence
  sgRNA
  Gpr173_4
agcatcggcttatgtgaagc

SEQ ID NO: 24299 - DNA, 20 bp, Artificial Sequence
  sgRNA
  Gpr173_5
gccaaaaccagcgatccagt

SEQ ID NO: 24300 - DNA, 20 bp, Artificial Sequence
  sgRNA
  Gpr173_6
atgggcatgcagctagccgg

SEQ ID NO: 24301 - DNA, 20 bp, Artificial Sequence
  sgRNA
  Gpr173_7
gagtgcactgaaggtccatg

SEQ ID NO: 24302 - DNA, 20 bp, Artificial Sequence
  sgRNA
  Gpr173_8
gcggctactgggcatggacg

SEQ ID NO: 24303 - DNA, 20 bp, Artificial Sequence
  sgRNA
  Gpr173_9
gtatgccatcggctaggcac

SEQ ID NO: 24304 - DNA, 20 bp, Artificial Sequence
  sgRNA
  Gpr173_10
tgtttggatgagcttcgccc

SEQ ID NO: 24305 - DNA, 20 bp, Artificial Sequence
  sgRNA
  Gpr173_11
cgtccatgcccagtagccgc

SEQ ID NO: 24306 - DNA, 20 bp, Artificial Sequence
  sgRNA
  Gpr173_12
ggtgggcgatggccatgtag

SEQ ID NO: 24307 - DNA, 20 bp, Artificial Sequence
  sgRNA
  Gpr173_13
gcagtggccaagtagcggtg

SEQ ID NO: 24308 - DNA, 20 bp, Artificial Sequence
  sgRNA
  Gpr173_14
gtgcccacatcaaagacagg

SEQ ID NO: 24309 - DNA, 20 bp, Artificial Sequence
  sgRNA
  Gpr173_15
gatggcagagcgtatgccat

SEQ ID NO: 24310 - DNA, 20 bp, Artificial Sequence
  sgRNA
  Gpr173_16
cacctacaagtttatccgag

SEQ ID NO: 24311 - DNA, 20 bp, Artificial Sequence
  sgRNA
  Gpr173_17
cagagcgtatgccatcggct

SEQ ID NO: 24312 - DNA, 20 bp, Artificial Sequence
  sgRNA
  Gpr173_18
gtactggcttctgtgcgcca

SEQ ID NO: 24313 - DNA, 20 bp, Artificial Sequence
  sgRNA
  Gpr173_19
agaacagcatgaaggccgca

SEQ ID NO: 24314 - DNA, 20 bp, Artificial Sequence
  sgRNA
  Gpr173_20
ggagagcccgaagaggtgag

SEQ ID NO: 24315 - DNA, 20 bp, Artificial Sequence
  sgRNA
  Gpr174_1
tgcagtcattgaaacgaaag

SEQ ID NO: 24316 - DNA, 20 bp, Artificial Sequence
  sgRNA
  Gpr174_2
aatctgtaataagtcagcaa

SEQ ID NO: 24317 - DNA, 20 bp, Artificial Sequence
  sgRNA
  Gpr174_3
atagccgtaaaatacccata

SEQ ID NO: 24318 - DNA, 20 bp, Artificial Sequence
  sgRNA
  Gpr174_4
ataactatcggagaggtggt

SEQ ID NO: 24319 - DNA, 20 bp, Artificial Sequence
  sgRNA
  Gpr174_5
taaccatgccacttctaccg

SEQ ID NO: 24320 - DNA, 20 bp, Artificial Sequence
  sgRNA
  Gpr174_6
gccagattaacattcctgat

SEQ ID NO: 24321 - DNA, 20 bp, Artificial Sequence
  sgRNA
  Gpr174_7
agatgattctgacctgtgca

SEQ ID NO: 24322 - DNA, 20 bp, Artificial Sequence
  sgRNA
  Gpr174_8
gcgtcttctgaactcattag

SEQ ID NO: 24323 - DNA, 20 bp, Artificial Sequence
  sgRNA
  Gpr174_9
gatgattctgacctgtgcag

SEQ ID NO: 24324 - DNA, 20 bp, Artificial Sequence
  sgRNA
  Gpr174_10
tgtatatcagcattattggc

SEQ ID NO: 24325 - DNA, 20 bp, Artificial Sequence
  sgRNA
  Gpr174_11
tttgcagtcattgaaacgaa

SEQ ID NO: 24326 - DNA, 20 bp, Artificial Sequence
  sgRNA
  Gpr174_12
gttcaggcttgccagacaca

SEQ ID NO: 24327 - DNA, 20 bp, Artificial Sequence
  sgRNA
  Gpr174_13
gcatcagtgtgcgaagattt

SEQ ID NO: 24328 - DNA, 20 bp, Artificial Sequence
  sgRNA
  Gpr174_14
gcagaccaagaagtagatgc

SEQ ID NO: 24329 - DNA, 20 bp, Artificial Sequence
  sgRNA
  Gpr174_15
agttcaggcttgccagacac

SEQ ID NO: 24330 - DNA, 20 bp, Artificial Sequence
  sgRNA
  Gpr174_16
ttcttgtgccaggtcttata

SEQ ID NO: 24331 - DNA, 20 bp, Artificial Sequence
  sgRNA
  Gpr174_17
gtatggagttggatgttatc

SEQ ID NO: 24332 - DNA, 20 bp, Artificial Sequence
  sgRNA
  Gpr174_18
aagtagtaaaagatcctcag

SEQ ID NO: 24333 - DNA, 20 bp, Artificial Sequence
  sgRNA
  Gpr174_19
catgataactatcggagagg

SEQ ID NO: 24334 - DNA, 20 bp, Artificial Sequence
  sgRNA
  Gpr174_20
tttactacttgaaccatgac

SEQ ID NO: 24335 - DNA, 20 bp, Artificial Sequence
  sgRNA
  Gpr176_1
tgtagatcagaacatacacc

SEQ ID NO: 24336 - DNA, 20 bp, Artificial Sequence
  sgRNA
  Gpr176_2
ggtgctcaaattcctacaca

SEQ ID NO: 24337 - DNA, 20 bp, Artificial Sequence
  sgRNA
  Gpr176_3
ccggtggtgcaactgcacca

SEQ ID NO: 24338 - DNA, 20 bp, Artificial Sequence
  sgRNA
  Gpr176_4
agtctggtagacaaccaggg

SEQ ID NO: 24339 - DNA, 20 bp, Artificial Sequence
  sgRNA
  Gpr176_5
ctttctcatcctgatccgga

SEQ ID NO: 24340 - DNA, 20 bp, Artificial Sequence
  sgRNA
  Gpr176_6
ggagctactggggacacccg

SEQ ID NO: 24341 - DNA, 20 bp, Artificial Sequence
  sgRNA
  Gpr176_7
tcttgcttctcacggccatt

SEQ ID NO: 24342 - DNA, 20 bp, Artificial Sequence
  sgRNA
  Gpr176_8
ggaaatatcccagattccat

SEQ ID NO: 24343 - DNA, 20 bp, Artificial Sequence
  sgRNA
  Gpr176_9
ctttcttcctcatcctccga

SEQ ID NO: 24344 - DNA, 20 bp, Artificial Sequence
  sgRNA
  Gpr176_10
gaagatgacgacctgcacgg

SEQ ID NO: 24345 - DNA, 20 bp, Artificial Sequence
  sgRNA
  Gpr176_11
gccgcaatgtggttagtaca

SEQ ID NO: 24346 - DNA, 20 bp, Artificial Sequence
  sgRNA
  Gpr176_12
cattgcggcgactgtaccgg

SEQ ID NO: 24347 - DNA, 20 bp, Artificial Sequence
  sgRNA
  Gpr176_13
ctgctcaggatgatgtcgaa

SEQ ID NO: 24348 - DNA, 20 bp, Artificial Sequence
  sgRNA
  Gpr176_14
acagatctttaagccctcgg

SEQ ID NO: 24349 - DNA, 20 bp, Artificial Sequence
  sgRNA
  Gpr176_15
ggtctcagagagccactgag

SEQ ID NO: 24350 - DNA, 20 bp, Artificial Sequence
  sgRNA
  Gpr176_16
cattggtcacagcaaacaca

SEQ ID NO: 24351 - DNA, 20 bp, Artificial Sequence
  sgRNA
  Gpr176_17
tcagctccccgaacgcgctg

SEQ ID NO: 24352 - DNA, 20 bp, Artificial Sequence
  sgRNA
  Gpr176_18
agaagagctgatccagacaa

SEQ ID NO: 24353 - DNA, 20 bp, Artificial Sequence
  sgRNA
  Gpr176_19
gttgctccagacttccgtgc

SEQ ID NO: 24354 - DNA, 20 bp, Artificial Sequence
  sgRNA
  Gpr176_20
cagatttgaacactgttgtg

SEQ ID NO: 24355 - DNA, 20 bp, Artificial Sequence
  sgRNA
  Gpr179_1
cccacgtatccatccccccg

SEQ ID NO: 24356 - DNA, 20 bp, Artificial Sequence
  sgRNA
  Gpr179_2
ggaggggacatctactcaga

SEQ ID NO: 24357 - DNA, 20 bp, Artificial Sequence
  sgRNA
  Gpr179_3
agggcaatgctcatgtagcg

SEQ ID NO: 24358 - DNA, 20 bp, Artificial Sequence
  sgRNA
  Gpr179_4
cagaataggagccaatgtgg

SEQ ID NO: 24359 - DNA, 20 bp, Artificial Sequence
  sgRNA
  Gpr179_5
gcacctcttggtatcccgcg

SEQ ID NO: 24360 - DNA, 20 bp, Artificial Sequence
  sgRNA
  Gpr179_6
ggtctcatcccccatccgag

SEQ ID NO: 24361 - DNA, 20 bp, Artificial Sequence
  sgRNA
  Gpr179_7
tgacctttaaccctgcaccg

SEQ ID NO: 24362 - DNA, 20 bp, Artificial Sequence
  sgRNA
  Gpr179_8
catagaatccaggtcggcag

SEQ ID NO: 24363 - DNA, 20 bp, Artificial Sequence
  sgRNA
  Gpr179_9
gcaggacgattccagatgcc

SEQ ID NO: 24364 - DNA, 20 bp, Artificial Sequence
  sgRNA
  Gpr179_10
gggttactggtaaagccagg

SEQ ID NO: 24365 - DNA, 20 bp, Artificial Sequence
  sgRNA
  Gpr179_11
cagcacttatgaccaccaca

SEQ ID NO: 24366 - DNA, 20 bp, Artificial Sequence
  sgRNA
  Gpr179_12
tgagaaatatgaagtccgtg

SEQ ID NO: 24367 - DNA, 20 bp, Artificial Sequence
  sgRNA
  Gpr179_13
tctactctggagatgttcaa

SEQ ID NO: 24368 - DNA, 20 bp, Artificial Sequence
  sgRNA
  Gpr179_14
gcaacgcagcggaatacgct

SEQ ID NO: 24369 - DNA, 20 bp, Artificial Sequence
  sgRNA
  Gpr179_15
gggcacctcttggtatcccg

SEQ ID NO: 24370 - DNA, 20 bp, Artificial Sequence
  sgRNA
  Gpr179_16
gataatggtcccatagacga

SEQ ID NO: 24371 - DNA, 20 bp, Artificial Sequence
  sgRNA
  Gpr179_17
atccagaatctgtagacgcg

SEQ ID NO: 24372 - DNA, 20 bp, Artificial Sequence
  sgRNA
  Gpr179_18
tcatccaagatttcttcccg

SEQ ID NO: 24373 - DNA, 20 bp, Artificial Sequence
  sgRNA
  Gpr179_19
gggagacccgaaagcctaca

SEQ ID NO: 24374 - DNA, 20 bp, Artificial Sequence
  sgRNA
  Gpr179_20
acttgggtgtggcacccgct

SEQ ID NO: 24375 - DNA, 20 bp, Artificial Sequence
  sgRNA
  Gpr18_1
gcagactgagtataaatacg

SEQ ID NO: 24376 - DNA, 20 bp, Artificial Sequence
  sgRNA
  Gpr18_2
gcttgggtaaaacaccacca

SEQ ID NO: 24377 - DNA, 20 bp, Artificial Sequence
  sgRNA
  Gpr18_3
gcttagacgtctgccctcgg

SEQ ID NO: 24378 - DNA, 20 bp, Artificial Sequence
  sgRNA
  Gpr18_4
tcttcgtagagcagtagcag

SEQ ID NO: 24379 - DNA, 20 bp, Artificial Sequence
  sgRNA
  Gpr18_5
tcattcacagtctcctccga

SEQ ID NO: 24380 - DNA, 20 bp, Artificial Sequence
  sgRNA
  Gpr18_6
tgcatagtaaaacatccgaa

SEQ ID NO: 24381 - DNA, 20 bp, Artificial Sequence
  sgRNA
  Gpr18_7
gtgaccgtaaactgcccgat

SEQ ID NO: 24382 - DNA, 20 bp, Artificial Sequence
  sgRNA
  Gpr18_8
gatgtcggagatcttcaggc

SEQ ID NO: 24383 - DNA, 20 bp, Artificial Sequence
  sgRNA
  Gpr18_9
gcatagtaaaacatccgaaa

SEQ ID NO: 24384 - DNA, 20 bp, Artificial Sequence
  sgRNA
  Gpr18_10
tttgccgtcctgatgctaca

SEQ ID NO: 24385 - DNA, 20 bp, Artificial Sequence
  sgRNA
  Gpr18_11
gtacttctgccacattcttg

SEQ ID NO: 24386 - DNA, 20 bp, Artificial Sequence
  sgRNA
  Gpr18_12
gagggtcatgatgatccgta

SEQ ID NO: 24387 - DNA, 20 bp, Artificial Sequence
  sgRNA
  Gpr18_13
cgtacagccaaaatatgcca

SEQ ID NO: 24388 - DNA, 20 bp, Artificial Sequence
  sgRNA
  Gpr18_14
tggcagaagtactctccaaa

SEQ ID NO: 24389 - DNA, 20 bp, Artificial Sequence
  sgRNA
  Gpr18_15
ggagaacagctatagcccct

SEQ ID NO: 24390 - DNA, 20 bp, Artificial Sequence
  sgRNA
  Gpr18_16
aggtcaaggagaagtccata

SEQ ID NO: 24391 - DNA, 20 bp, Artificial Sequence
  sgRNA
  Gpr18_17
cttcgtagagcagtagcagg

SEQ ID NO: 24392 - DNA, 20 bp, Artificial Sequence
  sgRNA
  Gpr18_18
tcgcagaaaaagtgtccgat

SEQ ID NO: 24393 - DNA, 20 bp, Artificial Sequence
  sgRNA
  Gpr18_19
gtcttcgtagagcagtagca

SEQ ID NO: 24394 - DNA, 20 bp, Artificial Sequence
  sgRNA
  Gpr18_20
cattagtgctgacagataca

SEQ ID NO: 24395 - DNA, 20 bp, Artificial Sequence
  sgRNA
  Gpr180_1
tgaggagcaccatttcaaag

SEQ ID NO: 24396 - DNA, 20 bp, Artificial Sequence
  sgRNA
  Gpr180_2
cagaatcaacaacgtagcag

SEQ ID NO: 24397 - DNA, 20 bp, Artificial Sequence
  sgRNA
  Gpr180_3
tcacaaagtacactaggacg

SEQ ID NO: 24398 - DNA, 20 bp, Artificial Sequence
  sgRNA
  Gpr180_4
gcagagcagaccgctccagt

SEQ ID NO: 24399 - DNA, 20 bp, Artificial Sequence
  sgRNA
  Gpr180_5
ctattgtccagcccatacac

SEQ ID NO: 24400 - DNA, 20 bp, Artificial Sequence
  sgRNA
  Gpr180_6
atcggccatttcgagttcca

SEQ ID NO: 24401 - DNA, 20 bp, Artificial Sequence
  sgRNA
  Gpr180_7
tgtcatcctgtgtcaggccg

SEQ ID NO: 24402 - DNA, 20 bp, Artificial Sequence
  sgRNA
  Gpr180_8
tagcgttactgaggagagcg

SEQ ID NO: 24403 - DNA, 20 bp, Artificial Sequence
  sgRNA
  Gpr180_9
gctcctcaacccggacgccg

SEQ ID NO: 24404 - DNA, 20 bp, Artificial Sequence
  sgRNA
  Gpr180_10
gtacagaatgaccatggcca

SEQ ID NO: 24405 - DNA, 20 bp, Artificial Sequence
  sgRNA
  Gpr180_11
tgaaatggtgctcctcaacc

SEQ ID NO: 24406 - DNA, 20 bp, Artificial Sequence
  sgRNA
  Gpr180_12
gctcactgcagctgtagccg

SEQ ID NO: 24407 - DNA, 20 bp, Artificial Sequence
  sgRNA
  Gpr180_13
tgactcagagagcccccagg

SEQ ID NO: 24408 - DNA, 20 bp, Artificial Sequence
  sgRNA
  Gpr180_14
gcatctatgcgcagtctctg

SEQ ID NO: 24409 - DNA, 20 bp, Artificial Sequence
  sgRNA
  Gpr180_15
gtcccacagtctttactggg

SEQ ID NO: 24410 - DNA, 20 bp, Artificial Sequence
  sgRNA
  Gpr180_16
gatgactcagagagccccca

SEQ ID NO: 24411 - DNA, 20 bp, Artificial Sequence
  sgRNA
  Gpr180_17
gtatgggctggacaatagtg

SEQ ID NO: 24412 - DNA, 20 bp, Artificial Sequence
  sgRNA
  Gpr180_18
ttgaggagcaccatttcaaa

SEQ ID NO: 24413 - DNA, 20 bp, Artificial Sequence
  sgRNA
  Gpr180_19
accaggtcatcacagtggag

SEQ ID NO: 24414 - DNA, 20 bp, Artificial Sequence
  sgRNA
  Gpr180_20
tgtgcagacgagatggtcag

SEQ ID NO: 24415 - DNA, 20 bp, Artificial Sequence
  sgRNA
  Gpr182_1
ctccggcagtgggataatgg

SEQ ID NO: 24416 - DNA, 20 bp, Artificial Sequence
  sgRNA
  Gpr182_2
ggcagttgacacatatcacc

SEQ ID NO: 24417 - DNA, 20 bp, Artificial Sequence
  sgRNA
  Gpr182_3
tctgcctgtttggatgctgg

SEQ ID NO: 24418 - DNA, 20 bp, Artificial Sequence
  sgRNA
  Gpr182_4
tgctgctgtacatgttgaca

SEQ ID NO: 24419 - DNA, 20 bp, Artificial Sequence
  sgRNA
  Gpr182_5
ccaccagcaccgaatacgga

SEQ ID NO: 24420 - DNA, 20 bp, Artificial Sequence
  sgRNA
  Gpr182_6
tcgggctgagaaagttgtag

SEQ ID NO: 24421 - DNA, 20 bp, Artificial Sequence
  sgRNA
  Gpr182_7
tcaatatcctgacagcctgc

SEQ ID NO: 24422 - DNA, 20 bp, Artificial Sequence
  sgRNA
  Gpr182_8
gaacctgtacatcctcaaca

SEQ ID NO: 24423 - DNA, 20 bp, Artificial Sequence
  sgRNA
  Gpr182_9
gccaccagcaccgaatacgg

SEQ ID NO: 24424 - DNA, 20 bp, Artificial Sequence
  sgRNA
  Gpr182_10
ggtctgcgatggccatgttg

SEQ ID NO: 24425 - DNA, 20 bp, Artificial Sequence
  sgRNA
  Gpr182_11
cttctacctggccatcttcg

SEQ ID NO: 24426 - DNA, 20 bp, Artificial Sequence
  sgRNA
  Gpr182_12
gctacagaattgcagagtgt

SEQ ID NO: 24427 - DNA, 20 bp, Artificial Sequence
  sgRNA
  Gpr182_13
aagcccacatcaacaggcag

SEQ ID NO: 24428 - DNA, 20 bp, Artificial Sequence
  sgRNA
  Gpr182_14
cctttgcctccgaagccggc

SEQ ID NO: 24429 - DNA, 20 bp, Artificial Sequence
  sgRNA
  Gpr182_15
ggacgcctgaacgtttcgga

SEQ ID NO: 24430 - DNA, 20 bp, Artificial Sequence
  sgRNA
  Gpr182_16
acaggttcagcatccccacc

SEQ ID NO: 24431 - DNA, 20 bp, Artificial Sequence
  sgRNA
  Gpr182_17
gtaggtgaggtgtttggagg

SEQ ID NO: 24432 - DNA, 20 bp, Artificial Sequence
  sgRNA
  Gpr182_18
tgtggtccgttaccttccca

SEQ ID NO: 24433 - DNA, 20 bp, Artificial Sequence
  sgRNA
  Gpr182_19
gctcggagccatccaacagc

SEQ ID NO: 24434 - DNA, 20 bp, Artificial Sequence
  sgRNA
  Gpr182_20
agtgtaggtgaggtgtttgg

SEQ ID NO: 24435 - DNA, 20 bp, Artificial Sequence
  sgRNA
  Gpr183_1
ttctacatcaacacgtacgc

SEQ ID NO: 24436 - DNA, 20 bp, Artificial Sequence
  sgRNA
  Gpr183_2
tatccgagtgggtaaagctg

SEQ ID NO: 24437 - DNA, 20 bp, Artificial Sequence
  sgRNA
  Gpr183_3
tccgagcagaatccacggca

SEQ ID NO: 24438 - DNA, 20 bp, Artificial Sequence
  sgRNA
  Gpr183_4
aaaagaatcgaatacgcaaa

SEQ ID NO: 24439 - DNA, 20 bp, Artificial Sequence
  sgRNA
  Gpr183_5
agaacaccagagcagttacc

SEQ ID NO: 24440 - DNA, 20 bp, Artificial Sequence
  sgRNA
  Gpr183_6
gtgcttcacgccctaccacg

SEQ ID NO: 24441 - DNA, 20 bp, Artificial Sequence
  sgRNA
  Gpr183_7
cgcatagtaggctatccgag

SEQ ID NO: 24442 - DNA, 20 bp, Artificial Sequence
  sgRNA
  Gpr183_8
ttaccacagctttacccact

SEQ ID NO: 24443 - DNA, 20 bp, Artificial Sequence
  sgRNA
  Gpr183_9
ggtgcaccacagcgaagaag

SEQ ID NO: 24444 - DNA, 20 bp, Artificial Sequence
  sgRNA
  Gpr183_10
gtttggatactccatgcaag

SEQ ID NO: 24445 - DNA, 20 bp, Artificial Sequence
  sgRNA
  Gpr183_11
ttgccatgagacgttgccag

SEQ ID NO: 24446 - DNA, 20 bp, Artificial Sequence
  sgRNA
  Gpr183_12
catagaccgcttcttcgctg

SEQ ID NO: 24447 - DNA, 20 bp, Artificial Sequence
  sgRNA
  Gpr183_13
tgtgctgaatgatggccacg

SEQ ID NO: 24448 - DNA, 20 bp, Artificial Sequence
  sgRNA
  Gpr183_14
gatgaacttcaactgctgca

SEQ ID NO: 24449 - DNA, 20 bp, Artificial Sequence
  sgRNA
  Gpr183_15
ttaataccctggctgtgctg

SEQ ID NO: 24450 - DNA, 20 bp, Artificial Sequence
  sgRNA
  Gpr183_16
gggagacaagaccacttgca

SEQ ID NO: 24451 - DNA, 20 bp, Artificial Sequence
  sgRNA
  Gpr183_17
actatgcgctgggctttgat

SEQ ID NO: 24452 - DNA, 20 bp, Artificial Sequence
  sgRNA
  Gpr183_18
agcaaagaccagaatccaga

SEQ ID NO: 24453 - DNA, 20 bp, Artificial Sequence
  sgRNA
  Gpr183_19
cggatagcctactatgcgct

SEQ ID NO: 24454 - DNA, 20 bp, Artificial Sequence
  sgRNA
  Gpr183_20
agcagatctgagagtaacac

SEQ ID NO: 24455 - DNA, 20 bp, Artificial Sequence
  sgRNA
  Gpr19_1
gcacgtagatctgcacgccg

SEQ ID NO: 24456 - DNA, 20 bp, Artificial Sequence
  sgRNA
  Gpr19_2
ggagaataggcacggacggg

SEQ ID NO: 24457 - DNA, 20 bp, Artificial Sequence
  sgRNA
  Gpr19_3
tgctgaccttctcatcagcg

SEQ ID NO: 24458 - DNA, 20 bp, Artificial Sequence
  sgRNA
  Gpr19_4
tgcaatcccatcaggccatg

SEQ ID NO: 24459 - DNA, 20 bp, Artificial Sequence
  sgRNA
  Gpr19_5
ggtagacgatggtatagaag

SEQ ID NO: 24460 - DNA, 20 bp, Artificial Sequence
  sgRNA
  Gpr19_6
ctatgactcatttgaccggg

SEQ ID NO: 24461 - DNA, 20 bp, Artificial Sequence
  sgRNA
  Gpr19_7
tgtcttcacggcagtcacgt

SEQ ID NO: 24462 - DNA, 20 bp, Artificial Sequence
  sgRNA
  Gpr19_8
ataggcagttccctcccagg

SEQ ID NO: 24463 - DNA, 20 bp, Artificial Sequence
  sgRNA
  Gpr19_9
gtacgagctgaaccctggag

SEQ ID NO: 24464 - DNA, 20 bp, Artificial Sequence
  sgRNA
  Gpr19_10
tggtatgtctggtcatccac

SEQ ID NO: 24465 - DNA, 20 bp, Artificial Sequence
  sgRNA
  Gpr19_11
ccttcagaacagcagctgcg

SEQ ID NO: 24466 - DNA, 20 bp, Artificial Sequence
  sgRNA
  Gpr19_12
gtgaactgcagcacgacaaa

SEQ ID NO: 24467 - DNA, 20 bp, Artificial Sequence
  sgRNA
  Gpr19_13
gtgttccgaaggtttcccgg

SEQ ID NO: 24468 - DNA, 20 bp, Artificial Sequence
  sgRNA
  Gpr19_14
gctgcggtagcatttcatcg

SEQ ID NO: 24469 - DNA, 20 bp, Artificial Sequence
  sgRNA
  Gpr19_15
gtatatctggagaataggca

SEQ ID NO: 24470 - DNA, 20 bp, Artificial Sequence
  sgRNA
  Gpr19_16
gttatggtcctgctcacggg

SEQ ID NO: 24471 - DNA, 20 bp, Artificial Sequence
  sgRNA
  Gpr19_17
cttggtcaggaacagctcgc

SEQ ID NO: 24472 - DNA, 20 bp, Artificial Sequence
  sgRNA
  Gpr19_18
ggacaccacgaagtagttgg

SEQ ID NO: 24473 - DNA, 20 bp, Artificial Sequence
  sgRNA
  Gpr19_19
gtccaccaccaactacttcg

SEQ ID NO: 24474 - DNA, 20 bp, Artificial Sequence
  sgRNA
  Gpr19_20
tgctgcagttcaccaccggg

SEQ ID NO: 24475 - DNA, 20 bp, Artificial Sequence
  sgRNA
  Gpr20_1
tagaagacagcaaagcgtgt

SEQ ID NO: 24476 - DNA, 20 bp, Artificial Sequence
  sgRNA
  Gpr20_2
ggaaccctcgggttgcacaa

SEQ ID NO: 24477 - DNA, 20 bp, Artificial Sequence
  sgRNA
  Gpr20_3
caagcactaatggtcgtgca

SEQ ID NO: 24478 - DNA, 20 bp, Artificial Sequence
  sgRNA
  Gpr20_4
ggatggaacagtgcatgttg

SEQ ID NO: 24479 - DNA, 20 bp, Artificial Sequence
  sgRNA
  Gpr20_5
gctgtcttctacggtgcccg

SEQ ID NO: 24480 - DNA, 20 bp, Artificial Sequence
  sgRNA
  Gpr20_6
gtggtgactgacctgctagt

SEQ ID NO: 24481 - DNA, 20 bp, Artificial Sequence
  sgRNA
  Gpr20_7
ctggccattgtgcaacccga

SEQ ID NO: 24482 - DNA, 20 bp, Artificial Sequence
  sgRNA
  Gpr20_8
cgaccattagtgcttgccac

SEQ ID NO: 24483 - DNA, 20 bp, Artificial Sequence
  sgRNA
  Gpr20_9
gcatgttgaggaagtagccc

SEQ ID NO: 24484 - DNA, 20 bp, Artificial Sequence
  sgRNA
  Gpr20_10
cagccttgtggcttaccacg

SEQ ID NO: 24485 - DNA, 20 bp, Artificial Sequence
  sgRNA
  Gpr20_11
gaacggtcagagcaaagaca

SEQ ID NO: 24486 - DNA, 20 bp, Artificial Sequence
  sgRNA
  Gpr20_12
gcttgaattcttctccacgc

SEQ ID NO: 24487 - DNA, 20 bp, Artificial Sequence
  sgRNA
  Gpr20_13
ttacccagcctttgaccaac

SEQ ID NO: 24488 - DNA, 20 bp, Artificial Sequence
  sgRNA
  Gpr20_14
tcatcagcgtgttcacaggc

SEQ ID NO: 24489 - DNA, 20 bp, Artificial Sequence
  sgRNA
  Gpr20_15
cccattcacatcctcagcat

SEQ ID NO: 24490 - DNA, 20 bp, Artificial Sequence
  sgRNA
  Gpr20_16
gtagcccaggacatgaggga

SEQ ID NO: 24491 - DNA, 20 bp, Artificial Sequence
  sgRNA
  Gpr20_17
cttcctcacctgcatctgcg

SEQ ID NO: 24492 - DNA, 20 bp, Artificial Sequence
  sgRNA
  Gpr20_18
cttacccagcctttgaccaa

SEQ ID NO: 24493 - DNA, 20 bp, Artificial Sequence
  sgRNA
  Gpr20_19
gttgcacaatggccaggtag

SEQ ID NO: 24494 - DNA, 20 bp, Artificial Sequence
  sgRNA
  Gpr20_20
aggccgggtctgctacgcca

SEQ ID NO: 24495 - DNA, 20 bp, Artificial Sequence
  sgRNA
  Gpr21_1
gtagaatgatggttcaacag

SEQ ID NO: 24496 - DNA, 20 bp, Artificial Sequence
  sgRNA
  Gpr21_2
gatatccgggtttaccccag

SEQ ID NO: 24497 - DNA, 20 bp, Artificial Sequence
  sgRNA
  Gpr21_3
gcctttaacctataataccc

SEQ ID NO: 24498 - DNA, 20 bp, Artificial Sequence
  sgRNA
  Gpr21_4
gaacaatgtgaagtaggagt

SEQ ID NO: 24499 - DNA, 20 bp, Artificial Sequence
  sgRNA
  Gpr21_5
tagtctccagggagtaacca

SEQ ID NO: 24500 - DNA, 20 bp, Artificial Sequence
  sgRNA
  Gpr21_6
gcatatgctgacctcttggt

SEQ ID NO: 24501 - DNA, 20 bp, Artificial Sequence
  sgRNA
  Gpr21_7
ataataccctggttactccc

SEQ ID NO: 24502 - DNA, 20 bp, Artificial Sequence
  sgRNA
  Gpr21_8
ctaccctcttccgattgagg

SEQ ID NO: 24503 - DNA, 20 bp, Artificial Sequence
  sgRNA
  Gpr21_9
ggcagcttaccccaaccaag

SEQ ID NO: 24504 - DNA, 20 bp, Artificial Sequence
  sgRNA
  Gpr21_10
tagtcaggaaggatgcaagg

SEQ ID NO: 24505 - DNA, 20 bp, Artificial Sequence
  sgRNA
  Gpr21_11
tggcctcctcaatcggaaga

SEQ ID NO: 24506 - DNA, 20 bp, Artificial Sequence
  sgRNA
  Gpr21_12
ataggttaaaggcttagtga

SEQ ID NO: 24507 - DNA, 20 bp, Artificial Sequence
  sgRNA
  Gpr21_13
agtagaggagtgataaggaa

SEQ ID NO: 24508 - DNA, 20 bp, Artificial Sequence
  sgRNA
  Gpr21_14
gctctgattaccatcccagg

SEQ ID NO: 24509 - DNA, 20 bp, Artificial Sequence
  sgRNA
  Gpr21_15
acacaaaagaaatcagcgaa

SEQ ID NO: 24510 - DNA, 20 bp, Artificial Sequence
  sgRNA
  Gpr21_16
ggtgattctgaataggacca

SEQ ID NO: 24511 - DNA, 20 bp, Artificial Sequence
  sgRNA
  Gpr21_17
gtagtctccagggagtaacc

SEQ ID NO: 24512 - DNA, 20 bp, Artificial Sequence
  sgRNA
  Gpr21_18
ttaccccagtggaagaagga

SEQ ID NO: 24513 - DNA, 20 bp, Artificial Sequence
  sgRNA
  Gpr21_19
agatgatgtatggcaaccag

SEQ ID NO: 24514 - DNA, 20 bp, Artificial Sequence
  sgRNA
  Gpr21_20
gccaaatcagaaaaatacag

SEQ ID NO: 24515 - DNA, 20 bp, Artificial Sequence
  sgRNA
  Gpr22_1
gcgagccgtgaaacgccacc

SEQ ID NO: 24516 - DNA, 20 bp, Artificial Sequence
  sgRNA
  Gpr22_2
gccgttctcgtcgttcccgg

SEQ ID NO: 24517 - DNA, 20 bp, Artificial Sequence
  sgRNA
  Gpr22_3
gcgtttcacggctcgccgga

SEQ ID NO: 24518 - DNA, 20 bp, Artificial Sequence
  sgRNA
  Gpr22_4
catgcagtaaagtaccagga

SEQ ID NO: 24519 - DNA, 20 bp, Artificial Sequence
  sgRNA
  Gpr22_5
gcagtctgaatcaaacgtca

SEQ ID NO: 24520 - DNA, 20 bp, Artificial Sequence
  sgRNA
  Gpr22_6
aagcttagtgggtatgacag

SEQ ID NO: 24521 - DNA, 20 bp, Artificial Sequence
  sgRNA
  Gpr22_7
caatttgtggaaaactacca

SEQ ID NO: 24522 - DNA, 20 bp, Artificial Sequence
  sgRNA
  Gpr22_8
attacagcgttattaggcat

SEQ ID NO: 24523 - DNA, 20 bp, Artificial Sequence
  sgRNA
  Gpr22_9
gcaaacagaattctgacaat

SEQ ID NO: 24524 - DNA, 20 bp, Artificial Sequence
  sgRNA
  Gpr22_10
ataactgtgaagaagaagat

SEQ ID NO: 24525 - DNA, 20 bp, Artificial Sequence
  sgRNA
  Gpr22_11
agtaaagtaccaggacggta

SEQ ID NO: 24526 - DNA, 20 bp, Artificial Sequence
  sgRNA
  Gpr22_12
tcttcaaagtggaaatacat

SEQ ID NO: 24527 - DNA, 20 bp, Artificial Sequence
  sgRNA
  Gpr22_13
acagacatgtcacaaagcag

SEQ ID NO: 24528 - DNA, 20 bp, Artificial Sequence
  sgRNA
  Gpr22_14
ctatgcggatgttaagagcc

SEQ ID NO: 24529 - DNA, 20 bp, Artificial Sequence
  sgRNA
  Gpr22_15
actgctttgtgacatgtctg

SEQ ID NO: 24530 - DNA, 20 bp, Artificial Sequence
  sgRNA
  Gpr22_16
gagacacttgaaagcttagt

SEQ ID NO: 24531 - DNA, 20 bp, Artificial Sequence
  sgRNA
  Gpr22_17
tgggcctaaacatagaatgg

SEQ ID NO: 24532 - DNA, 20 bp, Artificial Sequence
  sgRNA
  Gpr22_18
catgggatcagcttcaacta

SEQ ID NO: 24533 - DNA, 20 bp, Artificial Sequence
  sgRNA
  Gpr22_19
cgggatgtactatcaccttt

SEQ ID NO: 24534 - DNA, 20 bp, Artificial Sequence
  sgRNA
  Gpr22_20
ttatgacatcaagtacatgg

SEQ ID NO: 24535 - DNA, 20 bp, Artificial Sequence
  sgRNA
  Gpr25_1
ctccgggccctaccgacgcg

SEQ ID NO: 24536 - DNA, 20 bp, Artificial Sequence
  sgRNA
  Gpr25_2
ttgcacaggccgtcgccgaa

SEQ ID NO: 24537 - DNA, 20 bp, Artificial Sequence
  sgRNA
  Gpr25_3
aagcagggcacaactccact

SEQ ID NO: 24538 - DNA, 20 bp, Artificial Sequence
  sgRNA
  Gpr25_4
ctgcagtccccggtagagca

SEQ ID NO: 24539 - DNA, 20 bp, Artificial Sequence
  sgRNA
  Gpr25_5
gacgacagttcggtgttccg

SEQ ID NO: 24540 - DNA, 20 bp, Artificial Sequence
  sgRNA
  Gpr25_6
cctgcgcatcatcttcaccg

SEQ ID NO: 24541 - DNA, 20 bp, Artificial Sequence
  sgRNA
  Gpr25_7
ggaatgagcggtccaacagg

SEQ ID NO: 24542 - DNA, 20 bp, Artificial Sequence
  sgRNA
  Gpr25_8
agggagcgcaggacgccgaa

SEQ ID NO: 24543 - DNA, 20 bp, Artificial Sequence
  sgRNA
  Gpr25_9
gcccacgaagacgctctcca

SEQ ID NO: 24544 - DNA, 20 bp, Artificial Sequence
  sgRNA
  Gpr25_10
gctccctcttccacctggcg

SEQ ID NO: 24545 - DNA, 20 bp, Artificial Sequence
  sgRNA
  Gpr25_11
ttgccggccttgctctaccg

SEQ ID NO: 24546 - DNA, 20 bp, Artificial Sequence
  sgRNA
  Gpr25_12
catcccagcgctctacctgg

SEQ ID NO: 24547 - DNA, 20 bp, Artificial Sequence
  sgRNA
  Gpr25_13
ctacctggcggccttcgccg

SEQ ID NO: 24548 - DNA, 20 bp, Artificial Sequence
  sgRNA
  Gpr25_14
gagcgtggaccgctacctgg

SEQ ID NO: 24549 - DNA, 20 bp, Artificial Sequence
  sgRNA
  Gpr25_15
gcaaggccggcaaacccgcc

SEQ ID NO: 24550 - DNA, 20 bp, Artificial Sequence
  sgRNA
  Gpr25_16
gcacaactccacttggtcca

SEQ ID NO: 24551 - DNA, 20 bp, Artificial Sequence
  sgRNA
  Gpr25_17
cgaagctgctgactttgcac

SEQ ID NO: 24552 - DNA, 20 bp, Artificial Sequence
  sgRNA
  Gpr25_18
gagccgcgccaggtggaaga

SEQ ID NO: 24553 - DNA, 20 bp, Artificial Sequence
  sgRNA
  Gpr25_19
ggccgccaagtgcagcacga

SEQ ID NO: 24554 - DNA, 20 bp, Artificial Sequence
  sgRNA
  Gpr25_20
gctgctggcgggcatgagcg

SEQ ID NO: 24555 - DNA, 20 bp, Artificial Sequence
  sgRNA
  Gpr26_1
tggccggcgtcgtggcacaa

SEQ ID NO: 24556 - DNA, 20 bp, Artificial Sequence
  sgRNA
  Gpr26_2
acagcaggttgccacacgtg

SEQ ID NO: 24557 - DNA, 20 bp, Artificial Sequence
  sgRNA
  Gpr26_3
tgcacgaggcatatagctgg

SEQ ID NO: 24558 - DNA, 20 bp, Artificial Sequence
  sgRNA
  Gpr26_4
gggccaccttgagcaccttg

SEQ ID NO: 24559 - DNA, 20 bp, Artificial Sequence
  sgRNA
  Gpr26_5
ccagcggtcgatgctgagcg

SEQ ID NO: 24560 - DNA, 20 bp, Artificial Sequence
  sgRNA
  Gpr26_6
gctcagcatcgaccgctggg

SEQ ID NO: 24561 - DNA, 20 bp, Artificial Sequence
  sgRNA
  Gpr26_7
gaaagaccacagccacccag

SEQ ID NO: 24562 - DNA, 20 bp, Artificial Sequence
  sgRNA
  Gpr26_8
gcgtgtcgctgctgtccaac

SEQ ID NO: 24563 - DNA, 20 bp, Artificial Sequence
  sgRNA
  Gpr26_9
tcacgtcgatgcgcttgcag

SEQ ID NO: 24564 - DNA, 20 bp, Artificial Sequence
  sgRNA
  Gpr26_10
ccttcatggtggcctacacg

SEQ ID NO: 24565 - DNA, 20 bp, Artificial Sequence
  sgRNA
  Gpr26_11
ggcgtgtcgctgctgtccaa

SEQ ID NO: 24566 - DNA, 20 bp, Artificial Sequence
  sgRNA
  Gpr26_12
tggtgaagacagcaaagcgc

SEQ ID NO: 24567 - DNA, 20 bp, Artificial Sequence
  sgRNA
  Gpr26_13
tgttgaccacggtacacagc

SEQ ID NO: 24568 - DNA, 20 bp, Artificial Sequence
  sgRNA
  Gpr26_14
cgcagcaaggaatacacgaa

SEQ ID NO: 24569 - DNA, 20 bp, Artificial Sequence
  sgRNA
  Gpr26_15
gcagagcagcaccagcccgt

SEQ ID NO: 24570 - DNA, 20 bp, Artificial Sequence
  sgRNA
  Gpr26_16
gcacccattggctctcactg

SEQ ID NO: 24571 - DNA, 20 bp, Artificial Sequence
  sgRNA
  Gpr26_17
tggcggccagaaaggtgtcg

SEQ ID NO: 24572 - DNA, 20 bp, Artificial Sequence
  sgRNA
  Gpr26_18
tgtgagggaacggtgtctgg

SEQ ID NO: 24573 - DNA, 20 bp, Artificial Sequence
  sgRNA
  Gpr26_19
actccccagtgagagccaat

SEQ ID NO: 24574 - DNA, 20 bp, Artificial Sequence
  sgRNA
  Gpr26_20
gtgtgcacgaggcatatagc

SEQ ID NO: 24575 - DNA, 20 bp, Artificial Sequence
  sgRNA
  Gpr27_1
ggccgtggaaggtccagtcg

SEQ ID NO: 24576 - DNA, 20 bp, Artificial Sequence
  sgRNA
  Gpr27_2
gcagcaggtagtacggcgcg

SEQ ID NO: 24577 - DNA, 20 bp, Artificial Sequence
  sgRNA
  Gpr27_3
ttcccgccggtgctggacgg

SEQ ID NO: 24578 - DNA, 20 bp, Artificial Sequence
  sgRNA
  Gpr27_4
ccaggcgctcggcgtagaag

SEQ ID NO: 24579 - DNA, 20 bp, Artificial Sequence
  sgRNA
  Gpr27_5
cgcgaatgtcagccacaccg

SEQ ID NO: 24580 - DNA, 20 bp, Artificial Sequence
  sgRNA
  Gpr27_6
ggtgtggctgacattcgcgc

SEQ ID NO: 24581 - DNA, 20 bp, Artificial Sequence
  sgRNA
  Gpr27_7
gtagaagcggtggtgcgcga

SEQ ID NO: 24582 - DNA, 20 bp, Artificial Sequence
  sgRNA
  Gpr27_8
tgttcgcgctgctcatcgtg

SEQ ID NO: 24583 - DNA, 20 bp, Artificial Sequence
  sgRNA
  Gpr27_9
ccagcagcaggaaggccgcg

SEQ ID NO: 24584 - DNA, 20 bp, Artificial Sequence
  sgRNA
  Gpr27_10
gcggaggtagacgaggtgcg

SEQ ID NO: 24585 - DNA, 20 bp, Artificial Sequence
  sgRNA
  Gpr27_11
ggtccagtcgtggctgacgg

SEQ ID NO: 24586 - DNA, 20 bp, Artificial Sequence
  sgRNA
  Gpr27_12
aggagttcaagacggagaag

SEQ ID NO: 24587 - DNA, 20 bp, Artificial Sequence
  sgRNA
  Gpr27_13
gccgaagcccgccgtccagt

SEQ ID NO: 24588 - DNA, 20 bp, Artificial Sequence
  sgRNA
  Gpr27_14
gttcgcgctgctcatcgtgc

SEQ ID NO: 24589 - DNA, 20 bp, Artificial Sequence
  sgRNA
  Gpr27_15
cgcactcttctgcttccacg

SEQ ID NO: 24590 - DNA, 20 bp, Artificial Sequence
  sgRNA
  Gpr27_16
gcaggcctacctgacagcct

SEQ ID NO: 24591 - DNA, 20 bp, Artificial Sequence
  sgRNA
  Gpr27_17
ccaatgcctttcaggtcgca

SEQ ID NO: 24592 - DNA, 20 bp, Artificial Sequence
  sgRNA
  Gpr27_18
ttctacgccgagcgcctggc

SEQ ID NO: 24593 - DNA, 20 bp, Artificial Sequence
  sgRNA
  Gpr27_19
gcaggccggcatcaaccccg

SEQ ID NO: 24594 - DNA, 20 bp, Artificial Sequence
  sgRNA
  Gpr27_20
caggaagcctagcgcacccg

SEQ ID NO: 24595 - DNA, 20 bp, Artificial Sequence
  sgRNA
  Gpr3_1
cgggatggcctgaccacgtg

SEQ ID NO: 24596 - DNA, 20 bp, Artificial Sequence
  sgRNA
  Gpr3_2
actcagagacaacggtaact

SEQ ID NO: 24597 - DNA, 20 bp, Artificial Sequence
  sgRNA
  Gpr3_3
gagcagcgtggacccagtag

SEQ ID NO: 24598 - DNA, 20 bp, Artificial Sequence
  sgRNA
  Gpr3_4
gtcctgcgagaacgcgctgg

SEQ ID NO: 24599 - DNA, 20 bp, Artificial Sequence
  sgRNA
  Gpr3_5
gctgcctgcctctcactacg

SEQ ID NO: 24600 - DNA, 20 bp, Artificial Sequence
  sgRNA
  Gpr3_6
gtaagataggtgtagagacg

SEQ ID NO: 24601 - DNA, 20 bp, Artificial Sequence
  sgRNA
  Gpr3_7
gcgggtggccacgtagtgag

SEQ ID NO: 24602 - DNA, 20 bp, Artificial Sequence
  sgRNA
  Gpr3_8
ctgcacatcttggttgcgaa

SEQ ID NO: 24603 - DNA, 20 bp, Artificial Sequence
  sgRNA
  Gpr3_9
ggtgtcctgcgagaacgcgc

SEQ ID NO: 24604 - DNA, 20 bp, Artificial Sequence
  sgRNA
  Gpr3_10
cgcgttctcgcaggacacca

SEQ ID NO: 24605 - DNA, 20 bp, Artificial Sequence
  sgRNA
  Gpr3_11
gccgtagcagacctgctggc

SEQ ID NO: 24606 - DNA, 20 bp, Artificial Sequence
  sgRNA
  Gpr3_12
tttgcggctgacttctgcat

SEQ ID NO: 24607 - DNA, 20 bp, Artificial Sequence
  sgRNA
  Gpr3_13
gtaagtgagagcattgtaca

SEQ ID NO: 24608 - DNA, 20 bp, Artificial Sequence
  sgRNA
  Gpr3_14
gacccagtagaggaacccac

SEQ ID NO: 24609 - DNA, 20 bp, Artificial Sequence
  sgRNA
  Gpr3_15
cgatggccagaaccaccaga

SEQ ID NO: 24610 - DNA, 20 bp, Artificial Sequence
  sgRNA
  Gpr3_16
aaacaccatgaagaaggcga

SEQ ID NO: 24611 - DNA, 20 bp, Artificial Sequence
  sgRNA
  Gpr3_17
gagatgagcttgatgctggt

SEQ ID NO: 24612 - DNA, 20 bp, Artificial Sequence
  sgRNA
  Gpr3_18
cacttactactcagagacaa

SEQ ID NO: 24613 - DNA, 20 bp, Artificial Sequence
  sgRNA
  Gpr3_19
cattgtacagggaaaggtag

SEQ ID NO: 24614 - DNA, 20 bp, Artificial Sequence
  sgRNA
  Gpr3_20
aggcagcaggtgtcgttgga

SEQ ID NO: 24615 - DNA, 20 bp, Artificial Sequence
  sgRNA
  Gpr31b_1
ggaaggctactcccacacca

SEQ ID NO: 24616 - DNA, 20 bp, Artificial Sequence
  sgRNA
  Gpr31b_2
gacggtaaaagaaggtccag

SEQ ID NO: 24617 - DNA, 20 bp, Artificial Sequence
  sgRNA
  Gpr31b_3
gatgaggccactgttgcaga

SEQ ID NO: 24618 - DNA, 20 bp, Artificial Sequence
  sgRNA
  Gpr31b_4
tgtctacctgttcaacctgg

SEQ ID NO: 24619 - DNA, 20 bp, Artificial Sequence
  sgRNA
  Gpr31b_5
ctctcggagtctcttctgga

SEQ ID NO: 24620 - DNA, 20 bp, Artificial Sequence
  sgRNA
  Gpr31b_6
tctgcaacagtggcctcatc

SEQ ID NO: 24621 - DNA, 20 bp, Artificial Sequence
  sgRNA
  Gpr31b_7
actctcggagtctcttctgg

SEQ ID NO: 24622 - DNA, 20 bp, Artificial Sequence
  sgRNA
  Gpr31b_8
tcttctggagggtcctgatg

SEQ ID NO: 24623 - DNA, 20 bp, Artificial Sequence
  sgRNA
  Gpr31b_9
cagactctcggagtctcttc

SEQ ID NO: 24624 - DNA, 20 bp, Artificial Sequence
  sgRNA
  Gpr33_1
aaactaaatagggtatgctg

SEQ ID NO: 24625 - DNA, 20 bp, Artificial Sequence
  sgRNA
  Gpr33_2
ataacgagcaacactgatgg

SEQ ID NO: 24626 - DNA, 20 bp, Artificial Sequence
  sgRNA
  Gpr33_3
attgcagcatccatagatag

SEQ ID NO: 24627 - DNA, 20 bp, Artificial Sequence
  sgRNA
  Gpr33_4
attcatgcagcctgtttcgt

SEQ ID NO: 24628 - DNA, 20 bp, Artificial Sequence
  sgRNA
  Gpr33_5
gtaatggctgactcttagtg

SEQ ID NO: 24629 - DNA, 20 bp, Artificial Sequence
  sgRNA
  Gpr33_6
ttacctttacacttgacact

SEQ ID NO: 24630 - DNA, 20 bp, Artificial Sequence
  sgRNA
  Gpr33_7
tgttctctatctattcactg

SEQ ID NO: 24631 - DNA, 20 bp, Artificial Sequence
  sgRNA
  Gpr33_8
acaacacatgatgaccacaa

SEQ ID NO: 24632 - DNA, 20 bp, Artificial Sequence
  sgRNA
  Gpr33_9
ataattggtgtcatcagcaa

SEQ ID NO: 24633 - DNA, 20 bp, Artificial Sequence
  sgRNA
  Gpr33_10
gcagcaccgaaccccacact

SEQ ID NO: 24634 - DNA, 20 bp, Artificial Sequence
  sgRNA
  Gpr33_11
accagtgctgtttgttaacg

SEQ ID NO: 24635 - DNA, 20 bp, Artificial Sequence
  sgRNA
  Gpr33_12
gtgattgtcctgaaggaagg

SEQ ID NO: 24636 - DNA, 20 bp, Artificial Sequence
  sgRNA
  Gpr33_13
gttgtcctgaaaactaaata

SEQ ID NO: 24637 - DNA, 20 bp, Artificial Sequence
  sgRNA
  Gpr33_14
tgttgtcctgaaaactaaat

SEQ ID NO: 24638 - DNA, 20 bp, Artificial Sequence
  sgRNA
  Gpr33_15
gcaaagagcatcaaacacta

SEQ ID NO: 24639 - DNA, 20 bp, Artificial Sequence
  sgRNA
  Gpr33_16
ggaccaagccactgtgtaca

SEQ ID NO: 24640 - DNA, 20 bp, Artificial Sequence
  sgRNA
  Gpr33_17
cttccttcaggacaatcact

SEQ ID NO: 24641 - DNA, 20 bp, Artificial Sequence
  sgRNA
  Gpr33_18
cttgacactgggacttgcag

SEQ ID NO: 24642 - DNA, 20 bp, Artificial Sequence
  sgRNA
  Gpr33_19
ctaccatgtacacagtggct

SEQ ID NO: 24643 - DNA, 20 bp, Artificial Sequence
  sgRNA
  Gpr33_20
gtaataacgagcaacactga

SEQ ID NO: 24644 - DNA, 20 bp, Artificial Sequence
  sgRNA
  Gpr34_1
tctgtaatggaaacacattg

SEQ ID NO: 24645 - DNA, 20 bp, Artificial Sequence
  sgRNA
  Gpr34_2
ggttgatgtgatacattatg

SEQ ID NO: 24646 - DNA, 20 bp, Artificial Sequence
  sgRNA
  Gpr34_3
ctactctgttatattcctcg

SEQ ID NO: 24647 - DNA, 20 bp, Artificial Sequence
  sgRNA
  Gpr34_4
agattggcaagaatctactg

SEQ ID NO: 24648 - DNA, 20 bp, Artificial Sequence
  sgRNA
  Gpr34_5
gcaaatatgctacaacagcc

SEQ ID NO: 24649 - DNA, 20 bp, Artificial Sequence
  sgRNA
  Gpr34_6
tgtttgctgtatagtatgga

SEQ ID NO: 24650 - DNA, 20 bp, Artificial Sequence
  sgRNA
  Gpr34_7
agaaatgtaaatgaaccgaa

SEQ ID NO: 24651 - DNA, 20 bp, Artificial Sequence
  sgRNA
  Gpr34_8
atcgctatataaaaatcaat

SEQ ID NO: 24652 - DNA, 20 bp, Artificial Sequence
  sgRNA
  Gpr34_9
gatacattatgcggaaaggg

SEQ ID NO: 24653 - DNA, 20 bp, Artificial Sequence
  sgRNA
  Gpr34_10
gatttccttccaataacaag

SEQ ID NO: 24654 - DNA, 20 bp, Artificial Sequence
  sgRNA
  Gpr34_11
tgccaatcttaatatatgag

SEQ ID NO: 24655 - DNA, 20 bp, Artificial Sequence
  sgRNA
  Gpr34_12
tgtttccaaccagtcccacg

SEQ ID NO: 24656 - DNA, 20 bp, Artificial Sequence
  sgRNA
  Gpr34_13
tactgaggatttctaaacgg

SEQ ID NO: 24657 - DNA, 20 bp, Artificial Sequence
  sgRNA
  Gpr34_14
gaatgcccagaaatacatag

SEQ ID NO: 24658 - DNA, 20 bp, Artificial Sequence
  sgRNA
  Gpr34_15
atattcctcgtgggactggt

SEQ ID NO: 24659 - DNA, 20 bp, Artificial Sequence
  sgRNA
  Gpr34_16
tgtgtcctcttgttattgga

SEQ ID NO: 24660 - DNA, 20 bp, Artificial Sequence
  sgRNA
  Gpr34_17
tgtcacggacagatcatgca

SEQ ID NO: 24661 - DNA, 20 bp, Artificial Sequence
  sgRNA
  Gpr34_18
gtatggacggttgctcttgc

SEQ ID NO: 24662 - DNA, 20 bp, Artificial Sequence
  sgRNA
  Gpr34_19
atctactgaggatttctaaa

SEQ ID NO: 24663 - DNA, 20 bp, Artificial Sequence
  sgRNA
  Gpr34_20
tcggtctatacaacaaagaa

SEQ ID NO: 24664 - DNA, 20 bp, Artificial Sequence
  sgRNA
  Gpr35_1
aggtgaccactatcacccaa

SEQ ID NO: 24665 - DNA, 20 bp, Artificial Sequence
  sgRNA
  Gpr35_2
ccgcatctatatgaccaacc

SEQ ID NO: 24666 - DNA, 20 bp, Artificial Sequence
  sgRNA
  Gpr35_3
tagtgactgtgctatcgaga

SEQ ID NO: 24667 - DNA, 20 bp, Artificial Sequence
  sgRNA
  Gpr35_4
cgcagctcacgcgcacgcag

SEQ ID NO: 24668 - DNA, 20 bp, Artificial Sequence
  sgRNA
  Gpr35_5
agtggtgctgaaattgcgcc

SEQ ID NO: 24669 - DNA, 20 bp, Artificial Sequence
  sgRNA
  Gpr35_6
ggtgaccactatcacccaaa

SEQ ID NO: 24670 - DNA, 20 bp, Artificial Sequence
  sgRNA
  Gpr35_7
ggccatgtagtagtaacaga

SEQ ID NO: 24671 - DNA, 20 bp, Artificial Sequence
  sgRNA
  Gpr35_8
ctatatgaccaacctggctg

SEQ ID NO: 24672 - DNA, 20 bp, Artificial Sequence
  sgRNA
  Gpr35_9
cagtggtgctgaaattgcgc

SEQ ID NO: 24673 - DNA, 20 bp, Artificial Sequence
  sgRNA
  Gpr35_10
gcgccagcgcactaccaggg

SEQ ID NO: 24674 - DNA, 20 bp, Artificial Sequence
  sgRNA
  Gpr35_11
caaagagcagaagaccacga

SEQ ID NO: 24675 - DNA, 20 bp, Artificial Sequence
  sgRNA
  Gpr35_12
ctctgcctgccccacatcag

SEQ ID NO: 24676 - DNA, 20 bp, Artificial Sequence
  sgRNA
  Gpr35_13
gggcctgctgctcaacagcg

SEQ ID NO: 24677 - DNA, 20 bp, Artificial Sequence
  sgRNA
  Gpr35_14
tcacctccctggtagtgcgc

SEQ ID NO: 24678 - DNA, 20 bp, Artificial Sequence
  sgRNA
  Gpr35_15
gccctgtgagagctggcaga

SEQ ID NO: 24679 - DNA, 20 bp, Artificial Sequence
  sgRNA
  Gpr35_16
gttggcccagaccatgtggg

SEQ ID NO: 24680 - DNA, 20 bp, Artificial Sequence
  sgRNA
  Gpr35_17
gcaggcagaggccacccaaa

SEQ ID NO: 24681 - DNA, 20 bp, Artificial Sequence
  sgRNA
  Gpr35_18
acggtcaggaccacatgcaa

SEQ ID NO: 24682 - DNA, 20 bp, Artificial Sequence
  sgRNA
  Gpr35_19
agaccacgatggccagcggc

SEQ ID NO: 24683 - DNA, 20 bp, Artificial Sequence
  sgRNA
  Gpr35_20
caggcgccagcgcactacca

SEQ ID NO: 24684 - DNA, 20 bp, Artificial Sequence
  sgRNA
  Gpr37_1
cacgccgtggaaacaccacg

SEQ ID NO: 24685 - DNA, 20 bp, Artificial Sequence
  sgRNA
  Gpr37_2
gctgcggcgttggatcagtg

SEQ ID NO: 24686 - DNA, 20 bp, Artificial Sequence
  sgRNA
  Gpr37_3
caagatcgtgccctatatcg

SEQ ID NO: 24687 - DNA, 20 bp, Artificial Sequence
  sgRNA
  Gpr37_4
tcttctttccgacatcggag

SEQ ID NO: 24688 - DNA, 20 bp, Artificial Sequence
  sgRNA
  Gpr37_5
gcccttcagtactatccgca

SEQ ID NO: 24689 - DNA, 20 bp, Artificial Sequence
  sgRNA
  Gpr37_6
cttcaatctcacgcgccgcg

SEQ ID NO: 24690 - DNA, 20 bp, Artificial Sequence
  sgRNA
  Gpr37_7
actgatccaacgccgcagca

SEQ ID NO: 24691 - DNA, 20 bp, Artificial Sequence
  sgRNA
  Gpr37_8
agaatcctacggagcctatg

SEQ ID NO: 24692 - DNA, 20 bp, Artificial Sequence
  sgRNA
  Gpr37_9
cctctgcagacccttcagca

SEQ ID NO: 24693 - DNA, 20 bp, Artificial Sequence
  sgRNA
  Gpr37_10
acacctgtgtcaccgcccct

SEQ ID NO: 24694 - DNA, 20 bp, Artificial Sequence
  sgRNA
  Gpr37_11
ggtctgctgagagacgcccg

SEQ ID NO: 24695 - DNA, 20 bp, Artificial Sequence
  sgRNA
  Gpr37_12
aggccttcagcagtacacga

SEQ ID NO: 24696 - DNA, 20 bp, Artificial Sequence
  sgRNA
  Gpr37_13
ccaggaatggaacttgtctg

SEQ ID NO: 24697 - DNA, 20 bp, Artificial Sequence
  sgRNA
  Gpr37_14
gcacagtgcacataaggtga

SEQ ID NO: 24698 - DNA, 20 bp, Artificial Sequence
  sgRNA
  Gpr37_15
tgtcactgcctacatggcca

SEQ ID NO: 24699 - DNA, 20 bp, Artificial Sequence
  sgRNA
  Gpr37_16
ggcggaggacaacttccgga

SEQ ID NO: 24700 - DNA, 20 bp, Artificial Sequence
  sgRNA
  Gpr37_17
aggtgtgattgaagaagcgg

SEQ ID NO: 24701 - DNA, 20 bp, Artificial Sequence
  sgRNA
  Gpr37_18
tgctcggaagatccgcaaag

SEQ ID NO: 24702 - DNA, 20 bp, Artificial Sequence
  sgRNA
  Gpr37_19
ccattgacccaagaatccta

SEQ ID NO: 24703 - DNA, 20 bp, Artificial Sequence
  sgRNA
  Gpr37_20
gataacggcaagtttggcag

SEQ ID NO: 24704 - DNA, 20 bp, Artificial Sequence
  sgRNA
  Gpr37l1_1
cctaccagaatgcccgcatg

SEQ ID NO: 24705 - DNA, 20 bp, Artificial Sequence
  sgRNA
  Gpr37l1_2
gggcatagaccgattccatg

SEQ ID NO: 24706 - DNA, 20 bp, Artificial Sequence
  sgRNA
  Gpr37l1_3
tctcggtcaccggatacagg

SEQ ID NO: 24707 - DNA, 20 bp, Artificial Sequence
  sgRNA
  Gpr37l1_4
tcgaccccgaagaggcacca

SEQ ID NO: 24708 - DNA, 20 bp, Artificial Sequence
  sgRNA
  Gpr37l1_5
gaacgtctgcaatatcgtgg

SEQ ID NO: 24709 - DNA, 20 bp, Artificial Sequence
  sgRNA
  Gpr37l1_6
gctctcggtcaccggataca

SEQ ID NO: 24710 - DNA, 20 bp, Artificial Sequence
  sgRNA
  Gpr37l1_7
gcccgaatctgtctattcgc

SEQ ID NO: 24711 - DNA, 20 bp, Artificial Sequence
  sgRNA
  Gpr37l1_8
tgaccgggacgccaagtcag

SEQ ID NO: 24712 - DNA, 20 bp, Artificial Sequence
  sgRNA
  Gpr37l1_9
ggtacagcactatgtacccg

SEQ ID NO: 24713 - DNA, 20 bp, Artificial Sequence
  sgRNA
  Gpr37l1_10
gaagaggcaccaaggacgag

SEQ ID NO: 24714 - DNA, 20 bp, Artificial Sequence
  sgRNA
  Gpr37l1_11
gaccacagtcaggccgacca

SEQ ID NO: 24715 - DNA, 20 bp, Artificial Sequence
  sgRNA
  Gpr37l1_12
acaacaagagacacagccag

SEQ ID NO: 24716 - DNA, 20 bp, Artificial Sequence
  sgRNA
  Gpr37l1_13
ctcctcagccacagtcagcg

SEQ ID NO: 24717 - DNA, 20 bp, Artificial Sequence
  sgRNA
  Gpr37l1_14
ccacatgcgggcattctggt

SEQ ID NO: 24718 - DNA, 20 bp, Artificial Sequence
  sgRNA
  Gpr37l1_15
ctatctacttccacaagccc

SEQ ID NO: 24719 - DNA, 20 bp, Artificial Sequence
  sgRNA
  Gpr37l1_16
cagctcttgtccattacctg

SEQ ID NO: 24720 - DNA, 20 bp, Artificial Sequence
  sgRNA
  Gpr37l1_17
tgagaacgtctgcaatatcg

SEQ ID NO: 24721 - DNA, 20 bp, Artificial Sequence
  sgRNA
  Gpr37l1_18
gctgccacctcatctttagg

SEQ ID NO: 24722 - DNA, 20 bp, Artificial Sequence
  sgRNA
  Gpr37l1_19
gcgaatagacagattcgggc

SEQ ID NO: 24723 - DNA, 20 bp, Artificial Sequence
  sgRNA
  Gpr37l1_20
tcaatgagattaccaagcaa

SEQ ID NO: 24724 - DNA, 20 bp, Artificial Sequence
  sgRNA
  Gpr39_1
gtaaacgtacccactcacaa

SEQ ID NO: 24725 - DNA, 20 bp, Artificial Sequence
  sgRNA
  Gpr39_2
ttacaggacagagcatagct

SEQ ID NO: 24726 - DNA, 20 bp, Artificial Sequence
  sgRNA
  Gpr39_3
cgtcaccatcagggttacgc

SEQ ID NO: 24727 - DNA, 20 bp, Artificial Sequence
  sgRNA
  Gpr39_4
agacctcccaacggttggag

SEQ ID NO: 24728 - DNA, 20 bp, Artificial Sequence
  sgRNA
  Gpr39_5
cgtagctgcacgtctcaaag

SEQ ID NO: 24729 - DNA, 20 bp, Artificial Sequence
  sgRNA
  Gpr39_6
gtcctctcagcagttccgga

SEQ ID NO: 24730 - DNA, 20 bp, Artificial Sequence
  sgRNA
  Gpr39_7
gcacctgccagaacaccttc

SEQ ID NO: 24731 - DNA, 20 bp, Artificial Sequence
  sgRNA
  Gpr39_8
ggatgcccaatcagatccga

SEQ ID NO: 24732 - DNA, 20 bp, Artificial Sequence
  sgRNA
  Gpr39_9
tgagtgggtacgtttaccag

SEQ ID NO: 24733 - DNA, 20 bp, Artificial Sequence
  sgRNA
  Gpr39_10
ggtgtacctgatcatctttg

SEQ ID NO: 24734 - DNA, 20 bp, Artificial Sequence
  sgRNA
  Gpr39_11
ggaagagttactgcgccggg

SEQ ID NO: 24735 - DNA, 20 bp, Artificial Sequence
  sgRNA
  Gpr39_12
gaacctctccaaccgttggg

SEQ ID NO: 24736 - DNA, 20 bp, Artificial Sequence
  sgRNA
  Gpr39_13
tggagtttccaggttcatcg

SEQ ID NO: 24737 - DNA, 20 bp, Artificial Sequence
  sgRNA
  Gpr39_14
gcacgaacctctccaaccgt

SEQ ID NO: 24738 - DNA, 20 bp, Artificial Sequence
  sgRNA
  Gpr39_15
gagtgggtacgtttaccaga

SEQ ID NO: 24739 - DNA, 20 bp, Artificial Sequence
  sgRNA
  Gpr39_16
acgcaggtattgcagaagaa

SEQ ID NO: 24740 - DNA, 20 bp, Artificial Sequence
  sgRNA
  Gpr39_17
gatcaggtacaccaagatga

SEQ ID NO: 24741 - DNA, 20 bp, Artificial Sequence
  sgRNA
  Gpr39_18
atacccatggcaaagagcaa

SEQ ID NO: 24742 - DNA, 20 bp, Artificial Sequence
  sgRNA
  Gpr39_19
cacgaacctctccaaccgtt

SEQ ID NO: 24743 - DNA, 20 bp, Artificial Sequence
  sgRNA
  Gpr39_20
gtgctaatgaagagcaagca

SEQ ID NO: 24744 - DNA, 20 bp, Artificial Sequence
  sgRNA
  Gpr4_1
aggaagtagtcgacccacag

SEQ ID NO: 24745 - DNA, 20 bp, Artificial Sequence
  sgRNA
  Gpr4_2
acagcaacatgagtgcccag

SEQ ID NO: 24746 - DNA, 20 bp, Artificial Sequence
  sgRNA
  Gpr4_3
aggccacccaacgctccatg

SEQ ID NO: 24747 - DNA, 20 bp, Artificial Sequence
  sgRNA
  Gpr4_4
aacagctcatcatggaagag

SEQ ID NO: 24748 - DNA, 20 bp, Artificial Sequence
  sgRNA
  Gpr4_5
gtgttggcgcacctgccggt

SEQ ID NO: 24749 - DNA, 20 bp, Artificial Sequence
  sgRNA
  Gpr4_6
gtgctaccgtggcatcctga

SEQ ID NO: 24750 - DNA, 20 bp, Artificial Sequence
  sgRNA
  Gpr4_7
gcgccgggtcaagacagcag

SEQ ID NO: 24751 - DNA, 20 bp, Artificial Sequence
  sgRNA
  Gpr4_8
tcctcgaagccacagtccca

SEQ ID NO: 24752 - DNA, 20 bp, Artificial Sequence
  sgRNA
  Gpr4_9
tgaattggcgcccagctccg

SEQ ID NO: 24753 - DNA, 20 bp, Artificial Sequence
  sgRNA
  Gpr4_10
gcagaggatgagccacagcc

SEQ ID NO: 24754 - DNA, 20 bp, Artificial Sequence
  sgRNA
  Gpr4_11
acttcctccaccatgacaac

SEQ ID NO: 24755 - DNA, 20 bp, Artificial Sequence
  sgRNA
  Gpr4_12
gatgagccacagccaggtag

SEQ ID NO: 24756 - DNA, 20 bp, Artificial Sequence
  sgRNA
  Gpr4_13
agtgcctccgactgcccagg

SEQ ID NO: 24757 - DNA, 20 bp, Artificial Sequence
  sgRNA
  Gpr4_14
tctctacatcttcgtcatcg

SEQ ID NO: 24758 - DNA, 20 bp, Artificial Sequence
  sgRNA
  Gpr4_15
ggatccagttgtcatggtgg

SEQ ID NO: 24759 - DNA, 20 bp, Artificial Sequence
  sgRNA
  Gpr4_16
ctacatcttcgtcatcgggg

SEQ ID NO: 24760 - DNA, 20 bp, Artificial Sequence
  sgRNA
  Gpr4_17
gcagtgcctccgactgccca

SEQ ID NO: 24761 - DNA, 20 bp, Artificial Sequence
  sgRNA
  Gpr4_18
tggtccccctgggcagtcgg

SEQ ID NO: 24762 - DNA, 20 bp, Artificial Sequence
  sgRNA
  Gpr4_19
cttcctgtgctgcatctccg

SEQ ID NO: 24763 - DNA, 20 bp, Artificial Sequence
  sgRNA
  Gpr4_20
cctgtgggcagcctaccggc

SEQ ID NO: 24764 - DNA, 20 bp, Artificial Sequence
  sgRNA
  Gpr45_1
acgcgcctatgtagtgacac

SEQ ID NO: 24765 - DNA, 20 bp, Artificial Sequence
  sgRNA
  Gpr45_2
aggattccttggcaacacgg

SEQ ID NO: 24766 - DNA, 20 bp, Artificial Sequence
  sgRNA
  Gpr45_3
tgtgcatcctcaatacggtg

SEQ ID NO: 24767 - DNA, 20 bp, Artificial Sequence
  sgRNA
  Gpr45_4
ggacaagctgaacccacgca

SEQ ID NO: 24768 - DNA, 20 bp, Artificial Sequence
  sgRNA
  Gpr45_5
gaggatcaagaaattccgcg

SEQ ID NO: 24769 - DNA, 20 bp, Artificial Sequence
  sgRNA
  Gpr45_6
gagcacaacatgacgccgaa

SEQ ID NO: 24770 - DNA, 20 bp, Artificial Sequence
  sgRNA
  Gpr45_7
tgtccgtgtgcacaaccagt

SEQ ID NO: 24771 - DNA, 20 bp, Artificial Sequence
  sgRNA
  Gpr45_8
catcctgctcatcattagcg

SEQ ID NO: 24772 - DNA, 20 bp, Artificial Sequence
  sgRNA
  Gpr45_9
cagggctaagatgatcatcg

SEQ ID NO: 24773 - DNA, 20 bp, Artificial Sequence
  sgRNA
  Gpr45_10
cagatgttcgtaagtcccca

SEQ ID NO: 24774 - DNA, 20 bp, Artificial Sequence
  sgRNA
  Gpr45_11
atgatcatcttagccctgcg

SEQ ID NO: 24775 - DNA, 20 bp, Artificial Sequence
  sgRNA
  Gpr45_12
ctatgtagtgacactggtgg

SEQ ID NO: 24776 - DNA, 20 bp, Artificial Sequence
  sgRNA
  Gpr45_13
attgccagcgagatcctgag

SEQ ID NO: 24777 - DNA, 20 bp, Artificial Sequence
  sgRNA
  Gpr45_14
ctatctgtgcatcctcaata

SEQ ID NO: 24778 - DNA, 20 bp, Artificial Sequence
  sgRNA
  Gpr45_15
tgatcatcttagccctgcgt

SEQ ID NO: 24779 - DNA, 20 bp, Artificial Sequence
  sgRNA
  Gpr45_16
ggatccgctcaggcacttta

SEQ ID NO: 24780 - DNA, 20 bp, Artificial Sequence
  sgRNA
  Gpr45_17
agatgttcgtaagtccccat

SEQ ID NO: 24781 - DNA, 20 bp, Artificial Sequence
  sgRNA
  Gpr45_18
gcataaagacagcatgatgt

SEQ ID NO: 24782 - DNA, 20 bp, Artificial Sequence
  sgRNA
  Gpr45_19
tctgcatcatcgtgtaccag

SEQ ID NO: 24783 - DNA, 20 bp, Artificial Sequence
  sgRNA
  Gpr45_20
aggcgctgtaatagaaccgc

SEQ ID NO: 24784 - DNA, 20 bp, Artificial Sequence
  sgRNA
  Gpr50_1
ggaccatcttccatgctatg

SEQ ID NO: 24785 - DNA, 20 bp, Artificial Sequence
  sgRNA
  Gpr50_2
gtcctgcctaacatgtacat

SEQ ID NO: 24786 - DNA, 20 bp, Artificial Sequence
  sgRNA
  Gpr50_3
ctgtatgccatgtcagttgg

SEQ ID NO: 24787 - DNA, 20 bp, Artificial Sequence
  sgRNA
  Gpr50_4
aacattccggacgttccttg

SEQ ID NO: 24788 - DNA, 20 bp, Artificial Sequence
  sgRNA
  Gpr50_5
gccacagcctccaatacaag

SEQ ID NO: 24789 - DNA, 20 bp, Artificial Sequence
  sgRNA
  Gpr50_6
ttacagccaatgcagccgaa

SEQ ID NO: 24790 - DNA, 20 bp, Artificial Sequence
  sgRNA
  Gpr50_7
gagtcagctccagtgccaga

SEQ ID NO: 24791 - DNA, 20 bp, Artificial Sequence
  sgRNA
  Gpr50_8
acagtcgtcgtagacctgat

SEQ ID NO: 24792 - DNA, 20 bp, Artificial Sequence
  sgRNA
  Gpr50_9
ggattgcagtggtatcagga

SEQ ID NO: 24793 - DNA, 20 bp, Artificial Sequence
  sgRNA
  Gpr50_10
ggtcatctcaaggcaatggg

SEQ ID NO: 24794 - DNA, 20 bp, Artificial Sequence
  sgRNA
  Gpr50_11
gttgaagtaggctatgcagt

SEQ ID NO: 24795 - DNA, 20 bp, Artificial Sequence
  sgRNA
  Gpr50_12
gtaggtcccatgttgctctt

SEQ ID NO: 24796 - DNA, 20 bp, Artificial Sequence
  sgRNA
  Gpr50_13
acacagtgagcacattgaca

SEQ ID NO: 24797 - DNA, 20 bp, Artificial Sequence
  sgRNA
  Gpr50_14
gggattgcagtggtatcagg

SEQ ID NO: 24798 - DNA, 20 bp, Artificial Sequence
  sgRNA
  Gpr50_15
gcaagctcgaagggtacaga

SEQ ID NO: 24799 - DNA, 20 bp, Artificial Sequence
  sgRNA
  Gpr50_16
gaccttgcggtaatcaccag

SEQ ID NO: 24800 - DNA, 20 bp, Artificial Sequence
  sgRNA
  Gpr50_17
gggtaaacagaggcagactt

SEQ ID NO: 24801 - DNA, 20 bp, Artificial Sequence
  sgRNA
  Gpr50_18
ttgctctcggacttgatcac

SEQ ID NO: 24802 - DNA, 20 bp, Artificial Sequence
  sgRNA
  Gpr50_19
ggctggcttagggtaaacag

SEQ ID NO: 24803 - DNA, 20 bp, Artificial Sequence
  sgRNA
  Gpr50_20
gcatacagcatcaaagggta

SEQ ID NO: 24804 - DNA, 20 bp, Artificial Sequence
  sgRNA
  Gpr55_1
caagtgctttcacaacatgt

SEQ ID NO: 24805 - DNA, 20 bp, Artificial Sequence
  sgRNA
  Gpr55_2
tcagtgccttcctaaagaag

SEQ ID NO: 24806 - DNA, 20 bp, Artificial Sequence
  sgRNA
  Gpr55_3
caggaccatcttgaatggga

SEQ ID NO: 24807 - DNA, 20 bp, Artificial Sequence
  sgRNA
  Gpr55_4
cagaagcccatgatgcccat

SEQ ID NO: 24808 - DNA, 20 bp, Artificial Sequence
  sgRNA
  Gpr55_5
gcatgcgcatcaaggcccac

SEQ ID NO: 24809 - DNA, 20 bp, Artificial Sequence
  sgRNA
  Gpr55_6
ttgaccagcttgattgtgga

SEQ ID NO: 24810 - DNA, 20 bp, Artificial Sequence
  sgRNA
  Gpr55_7
gctggtcaaccaggatacca

SEQ ID NO: 24811 - DNA, 20 bp, Artificial Sequence
  sgRNA
  Gpr55_8
gcgccgtccagacagcactg

SEQ ID NO: 24812 - DNA, 20 bp, Artificial Sequence
  sgRNA
  Gpr55_9
ggaagccaaagatctccagg

SEQ ID NO: 24813 - DNA, 20 bp, Artificial Sequence
  sgRNA
  Gpr55_10
ctagccatctccggtcgccc

SEQ ID NO: 24814 - DNA, 20 bp, Artificial Sequence
  sgRNA
  Gpr55_11
ggttctggtaagcttatcca

SEQ ID NO: 24815 - DNA, 20 bp, Artificial Sequence
  sgRNA
  Gpr55_12
ggttcctcaccagatactgc

SEQ ID NO: 24816 - DNA, 20 bp, Artificial Sequence
  sgRNA
  Gpr55_13
tgaagcctcggatggccagt

SEQ ID NO: 24817 - DNA, 20 bp, Artificial Sequence
  sgRNA
  Gpr55_14
caactgctcattcgattccg

SEQ ID NO: 24818 - DNA, 20 bp, Artificial Sequence
  sgRNA
  Gpr55_15
ggtcgcccaggaagaccttt

SEQ ID NO: 24819 - DNA, 20 bp, Artificial Sequence
  sgRNA
  Gpr55_16
gaggaagccaaagatctcca

SEQ ID NO: 24820 - DNA, 20 bp, Artificial Sequence
  sgRNA
  Gpr55_17
ctcaacctactggccatccg

SEQ ID NO: 24821 - DNA, 20 bp, Artificial Sequence
  sgRNA
  Gpr55_18
gtccaacagagagacactaa

SEQ ID NO: 24822 - DNA, 20 bp, Artificial Sequence
  sgRNA
  Gpr55_19
catacatgctgatgaagtag

SEQ ID NO: 24823 - DNA, 20 bp, Artificial Sequence
  sgRNA
  Gpr55_20
tgtatctctccacttccctg

SEQ ID NO: 24824 - DNA, 20 bp, Artificial Sequence
  sgRNA
  Gpr6_1
ggaacacgaagtgtaagatg

SEQ ID NO: 24825 - DNA, 20 bp, Artificial Sequence
  sgRNA
  Gpr6_2
ctacccacgagcacaaacat

SEQ ID NO: 24826 - DNA, 20 bp, Artificial Sequence
  sgRNA
  Gpr6_3
caagaggtgcacgcccaaca

SEQ ID NO: 24827 - DNA, 20 bp, Artificial Sequence
  sgRNA
  Gpr6_4
aagtagagagcaacgccaca

SEQ ID NO: 24828 - DNA, 20 bp, Artificial Sequence
  sgRNA
  Gpr6_5
gccgaaagcagtagtcccga

SEQ ID NO: 24829 - DNA, 20 bp, Artificial Sequence
  sgRNA
  Gpr6_6
gctcaacgagtcccaagtgg

SEQ ID NO: 24830 - DNA, 20 bp, Artificial Sequence
  sgRNA
  Gpr6_7
gtacgtgcgcatctgccagg

SEQ ID NO: 24831 - DNA, 20 bp, Artificial Sequence
  sgRNA
  Gpr6_8
cacttgggactcgttgagcg

SEQ ID NO: 24832 - DNA, 20 bp, Artificial Sequence
  sgRNA
  Gpr6_9
aggcagcaaccccaacccga

SEQ ID NO: 24833 - DNA, 20 bp, Artificial Sequence
  sgRNA
  Gpr6_10
gctttcggcagtgaatccct

SEQ ID NO: 24834 - DNA, 20 bp, Artificial Sequence
  sgRNA
  Gpr6_11
acgcccatgtttgtgctcgt

SEQ ID NO: 24835 - DNA, 20 bp, Artificial Sequence
  sgRNA
  Gpr6_12
accacacaatagatggcgaa

SEQ ID NO: 24836 - DNA, 20 bp, Artificial Sequence
  sgRNA
  Gpr6_13
gttataggtggcaggcaaca

SEQ ID NO: 24837 - DNA, 20 bp, Artificial Sequence
  sgRNA
  Gpr6_14
cgaccgcacgtcctgcagcg

SEQ ID NO: 24838 - DNA, 20 bp, Artificial Sequence
  sgRNA
  Gpr6_15
gctacccaccacacaataga

SEQ ID NO: 24839 - DNA, 20 bp, Artificial Sequence
  sgRNA
  Gpr6_16
cgctcacctactactcgcgc

SEQ ID NO: 24840 - DNA, 20 bp, Artificial Sequence
  sgRNA
  Gpr6_17
gatgccaaagaccacgaaga

SEQ ID NO: 24841 - DNA, 20 bp, Artificial Sequence
  sgRNA
  Gpr6_18
actacccacgagcacaaaca

SEQ ID NO: 24842 - DNA, 20 bp, Artificial Sequence
  sgRNA
  Gpr6_19
ttgtgtggtgggtagccaag

SEQ ID NO: 24843 - DNA, 20 bp, Artificial Sequence
  sgRNA
  Gpr6_20
gccactgctgacctgttggc

SEQ ID NO: 24844 - DNA, 20 bp, Artificial Sequence
  sgRNA
  Gpr61_1
agagactcagagcgttgccg

SEQ ID NO: 24845 - DNA, 20 bp, Artificial Sequence
  sgRNA
  Gpr61_2
ggtccacccaatgcgctacg

SEQ ID NO: 24846 - DNA, 20 bp, Artificial Sequence
  sgRNA
  Gpr61_3
tgtctcaaccgtcagatccg

SEQ ID NO: 24847 - DNA, 20 bp, Artificial Sequence
  sgRNA
  Gpr61_4
tactatggttaccagctccg

SEQ ID NO: 24848 - DNA, 20 bp, Artificial Sequence
  sgRNA
  Gpr61_5
gcaggtccaccagacaaaga

SEQ ID NO: 24849 - DNA, 20 bp, Artificial Sequence
  sgRNA
  Gpr61_6
gcacctcgtagcgcattggg

SEQ ID NO: 24850 - DNA, 20 bp, Artificial Sequence
  sgRNA
  Gpr61_7
ctactgcagcatgtttcgag

SEQ ID NO: 24851 - DNA, 20 bp, Artificial Sequence
  sgRNA
  Gpr61_8
gattcgaaagtcaacaacag

SEQ ID NO: 24852 - DNA, 20 bp, Artificial Sequence
  sgRNA
  Gpr61_9
cattaatggcagacaccgaa

SEQ ID NO: 24853 - DNA, 20 bp, Artificial Sequence
  sgRNA
  Gpr61_10
ggagctcccagtgttaaccc

SEQ ID NO: 24854 - DNA, 20 bp, Artificial Sequence
  sgRNA
  Gpr61_11
catgtttcgagtggctcgcg

SEQ ID NO: 24855 - DNA, 20 bp, Artificial Sequence
  sgRNA
  Gpr61_12
acgagtttcctgatgactgg

SEQ ID NO: 24856 - DNA, 20 bp, Artificial Sequence
  sgRNA
  Gpr61_13
gggaccccgctggcagtaga

SEQ ID NO: 24857 - DNA, 20 bp, Artificial Sequence
  sgRNA
  Gpr61_14
acatccgtagaaaaaggggt

SEQ ID NO: 24858 - DNA, 20 bp, Artificial Sequence
  sgRNA
  Gpr61_15
attcgaaagtcaacaacagg

SEQ ID NO: 24859 - DNA, 20 bp, Artificial Sequence
  sgRNA
  Gpr61_16
tgtggagcgctactattatg

SEQ ID NO: 24860 - DNA, 20 bp, Artificial Sequence
  sgRNA
  Gpr61_17
ccgagaaacccagttctcag

SEQ ID NO: 24861 - DNA, 20 bp, Artificial Sequence
  sgRNA
  Gpr61_18
aaagagggcgtggtcaaaga

SEQ ID NO: 24862 - DNA, 20 bp, Artificial Sequence
  sgRNA
  Gpr61_19
gttgggaagggtctactggg

SEQ ID NO: 24863 - DNA, 20 bp, Artificial Sequence
  sgRNA
  Gpr61_20
gagcatggcaagcggcatga

SEQ ID NO: 24864 - DNA, 20 bp, Artificial Sequence
  sgRNA
  Gpr62_1
caccaggaagatgctaccgt

SEQ ID NO: 24865 - DNA, 20 bp, Artificial Sequence
  sgRNA
  Gpr62_2
gcctcatagtgcatccgctg

SEQ ID NO: 24866 - DNA, 20 bp, Artificial Sequence
  sgRNA
  Gpr62_3
ggacccctcgtcgtgccgag

SEQ ID NO: 24867 - DNA, 20 bp, Artificial Sequence
  sgRNA
  Gpr62_4
ctgtctagagagtcggagcg

SEQ ID NO: 24868 - DNA, 20 bp, Artificial Sequence
  sgRNA
  Gpr62_5
gcgcctccaggaactccgca

SEQ ID NO: 24869 - DNA, 20 bp, Artificial Sequence
  sgRNA
  Gpr62_6
ccacctctacgagaaccgcc

SEQ ID NO: 24870 - DNA, 20 bp, Artificial Sequence
  sgRNA
  Gpr62_7
ctagcatcgcccagagcggc

SEQ ID NO: 24871 - DNA, 20 bp, Artificial Sequence
  sgRNA
  Gpr62_8
gactgtctagagagtcggag

SEQ ID NO: 24872 - DNA, 20 bp, Artificial Sequence
  sgRNA
  Gpr62_9
gcacaagtgcgctaagtaga

SEQ ID NO: 24873 - DNA, 20 bp, Artificial Sequence
  sgRNA
  Gpr62_10
cttagcgcacttgtgcgtcg

SEQ ID NO: 24874 - DNA, 20 bp, Artificial Sequence
  sgRNA
  Gpr62_11
gtgcgtcgtggacctgctgg

SEQ ID NO: 24875 - DNA, 20 bp, Artificial Sequence
  sgRNA
  Gpr62_12
ctatggcctgctgcagcgcc

SEQ ID NO: 24876 - DNA, 20 bp, Artificial Sequence
  sgRNA
  Gpr62_13
gctcagcgtcaccgaactcg

SEQ ID NO: 24877 - DNA, 20 bp, Artificial Sequence
  sgRNA
  Gpr62_14
ggtagcctactccgccttcg

SEQ ID NO: 24878 - DNA, 20 bp, Artificial Sequence
  sgRNA
  Gpr62_15
gcagcggatgcactatgagg

SEQ ID NO: 24879 - DNA, 20 bp, Artificial Sequence
  sgRNA
  Gpr62_16
ttacccgccgagcgctgcct

SEQ ID NO: 24880 - DNA, 20 bp, Artificial Sequence
  sgRNA
  Gpr62_17
gtagcatcttcctggtggcg

SEQ ID NO: 24881 - DNA, 20 bp, Artificial Sequence
  sgRNA
  Gpr62_18
ggtccttgcggagttcctgg

SEQ ID NO: 24882 - DNA, 20 bp, Artificial Sequence
  sgRNA
  Gpr62_19
gccgcagcggatgcactatg

SEQ ID NO: 24883 - DNA, 20 bp, Artificial Sequence
  sgRNA
  Gpr62_20
gtaggcggccaacagcagga

SEQ ID NO: 24884 - DNA, 20 bp, Artificial Sequence
  sgRNA
  Gpr63_1
gcggagccgtaatattcacg

SEQ ID NO: 24885 - DNA, 20 bp, Artificial Sequence
  sgRNA
  Gpr63_2
taaatgaatataatatgacc

SEQ ID NO: 24886 - DNA, 20 bp, Artificial Sequence
  sgRNA
  Gpr63_3
gtatccaaacacgcactgtg

SEQ ID NO: 24887 - DNA, 20 bp, Artificial Sequence
  sgRNA
  Gpr63_4
tgctcattattagtatcgat

SEQ ID NO: 24888 - DNA, 20 bp, Artificial Sequence
  sgRNA
  Gpr63_5
cctcaaggcattatgccgaa

SEQ ID NO: 24889 - DNA, 20 bp, Artificial Sequence
  sgRNA
  Gpr63_6
ggattcatagctaccccgaa

SEQ ID NO: 24890 - DNA, 20 bp, Artificial Sequence
  sgRNA
  Gpr63_7
gcagcatgtctgcaaacgcc

SEQ ID NO: 24891 - DNA, 20 bp, Artificial Sequence
  sgRNA
  Gpr63_8
cggagccgtaatattcacgt

SEQ ID NO: 24892 - DNA, 20 bp, Artificial Sequence
  sgRNA
  Gpr63_9
tctacgtgtgtggggaacat

SEQ ID NO: 24893 - DNA, 20 bp, Artificial Sequence
  sgRNA
  Gpr63_10
cgtgtgtggggaacatcgga

SEQ ID NO: 24894 - DNA, 20 bp, Artificial Sequence
  sgRNA
  Gpr63_11
tgggcatcctcaataccctt

SEQ ID NO: 24895 - DNA, 20 bp, Artificial Sequence
  sgRNA
  Gpr63_12
ggcccagcagacaatgaaaa

SEQ ID NO: 24896 - DNA, 20 bp, Artificial Sequence
  sgRNA
  Gpr63_13
cattatgccgaagggtattg

SEQ ID NO: 24897 - DNA, 20 bp, Artificial Sequence
  sgRNA
  Gpr63_14
atgtcgatgctcatttggaa

SEQ ID NO: 24898 - DNA, 20 bp, Artificial Sequence
  sgRNA
  Gpr63_15
atgttccccacacacgtaga

SEQ ID NO: 24899 - DNA, 20 bp, Artificial Sequence
  sgRNA
  Gpr63_16
cacacacgtagacggcacta

SEQ ID NO: 24900 - DNA, 20 bp, Artificial Sequence
  sgRNA
  Gpr63_17
ctgcagatcagggtttccca

SEQ ID NO: 24901 - DNA, 20 bp, Artificial Sequence
  sgRNA
  Gpr63_18
ctgccaaggagctaaatcca

SEQ ID NO: 24902 - DNA, 20 bp, Artificial Sequence
  sgRNA
  Gpr63_19
taactattcttactaccaga

SEQ ID NO: 24903 - DNA, 20 bp, Artificial Sequence
  sgRNA
  Gpr63_20
ggtttctgattatagttcag

SEQ ID NO: 24904 - DNA, 20 bp, Artificial Sequence
  sgRNA
  Gpr65_1
gctgctgtaaaagttcatgt

SEQ ID NO: 24905 - DNA, 20 bp, Artificial Sequence
  sgRNA
  Gpr65_2
gagtgttgaatattgtgact

SEQ ID NO: 24906 - DNA, 20 bp, Artificial Sequence
  sgRNA
  Gpr65_3
ggtagacgactgctaaatag

SEQ ID NO: 24907 - DNA, 20 bp, Artificial Sequence
  sgRNA
  Gpr65_4
cgaacactatttgttcccgg

SEQ ID NO: 24908 - DNA, 20 bp, Artificial Sequence
  sgRNA
  Gpr65_5
tgtcgcgctctaaaacgcag

SEQ ID NO: 24909 - DNA, 20 bp, Artificial Sequence
  sgRNA
  Gpr65_6
tgtgcggcacaaccaagcca

SEQ ID NO: 24910 - DNA, 20 bp, Artificial Sequence
  sgRNA
  Gpr65_7
tgcacgtccgaaacaggttg

SEQ ID NO: 24911 - DNA, 20 bp, Artificial Sequence
  sgRNA
  Gpr65_8
gtcagcgtcccagccaacat

SEQ ID NO: 24912 - DNA, 20 bp, Artificial Sequence
  sgRNA
  Gpr65_9
gaaggactctaatatccaga

SEQ ID NO: 24913 - DNA, 20 bp, Artificial Sequence
  sgRNA
  Gpr65_10
actgctttgtgactgagacg

SEQ ID NO: 24914 - DNA, 20 bp, Artificial Sequence
  sgRNA
  Gpr65_11
ttatctgccatttctccaga

SEQ ID NO: 24915 - DNA, 20 bp, Artificial Sequence
  sgRNA
  Gpr65_12
acgtcaatgacaagtctgga

SEQ ID NO: 24916 - DNA, 20 bp, Artificial Sequence
  sgRNA
  Gpr65_13
ccaagtgtaattgatccaga

SEQ ID NO: 24917 - DNA, 20 bp, Artificial Sequence
  sgRNA
  Gpr65_14
ctttacccccttccacgtga

SEQ ID NO: 24918 - DNA, 20 bp, Artificial Sequence
  sgRNA
  Gpr65_15
ataaagtctaccgagctgtg

SEQ ID NO: 24919 - DNA, 20 bp, Artificial Sequence
  sgRNA
  Gpr65_16
acacaattatgtagaccacc

SEQ ID NO: 24920 - DNA, 20 bp, Artificial Sequence
  sgRNA
  Gpr65_17
ggaaacacaatagacaccaa

SEQ ID NO: 24921 - DNA, 20 bp, Artificial Sequence
  sgRNA
  Gpr65_18
acgcttcctttgcacaaggt

SEQ ID NO: 24922 - DNA, 20 bp, Artificial Sequence
  sgRNA
  Gpr65_19
ttctctcccaccttgtgcaa

SEQ ID NO: 24923 - DNA, 20 bp, Artificial Sequence
  sgRNA
  Gpr65_20
ttaggaaggaaaacttcaga

SEQ ID NO: 24924 - DNA, 20 bp, Artificial Sequence
  sgRNA
  Gpr68_1
cacggtcacatagaccactg

SEQ ID NO: 24925 - DNA, 20 bp, Artificial Sequence
  sgRNA
  Gpr68_2
ctggcaggataggtcaccat

SEQ ID NO: 24926 - DNA, 20 bp, Artificial Sequence
  sgRNA
  Gpr68_3
tctgcaagtacccgaagtag

SEQ ID NO: 24927 - DNA, 20 bp, Artificial Sequence
  sgRNA
  Gpr68_4
ggtaatgctcaaagcagact

SEQ ID NO: 24928 - DNA, 20 bp, Artificial Sequence
  sgRNA
  Gpr68_5
gatgagcacactgacaccca

SEQ ID NO: 24929 - DNA, 20 bp, Artificial Sequence
  sgRNA
  Gpr68_6
tgtcagtgagaccactcaca

SEQ ID NO: 24930 - DNA, 20 bp, Artificial Sequence
  sgRNA
  Gpr68_7
actcacagtttctctcccag

SEQ ID NO: 24931 - DNA, 20 bp, Artificial Sequence
  sgRNA
  Gpr68_8
gcaagccaggaagatgacca

SEQ ID NO: 24932 - DNA, 20 bp, Artificial Sequence
  sgRNA
  Gpr68_9
ctgcaagtacccgaagtaga

SEQ ID NO: 24933 - DNA, 20 bp, Artificial Sequence
  sgRNA
  Gpr68_10
tgagaacatttacatcagcg

SEQ ID NO: 24934 - DNA, 20 bp, Artificial Sequence
  sgRNA
  Gpr68_11
acgtgcttcagcacgacgac

SEQ ID NO: 24935 - DNA, 20 bp, Artificial Sequence
  sgRNA
  Gpr68_12
gccgctgaatctggtccttg

SEQ ID NO: 24936 - DNA, 20 bp, Artificial Sequence
  sgRNA
  Gpr68_13
gccgcaaggaccagattcag

SEQ ID NO: 24937 - DNA, 20 bp, Artificial Sequence
  sgRNA
  Gpr68_14
ggtacactcccagctcattc

SEQ ID NO: 24938 - DNA, 20 bp, Artificial Sequence
  sgRNA
  Gpr68_15
ctacttcctcaatcacaagg

SEQ ID NO: 24939 - DNA, 20 bp, Artificial Sequence
  sgRNA
  Gpr68_16
tggggaagagaaagcccacc

SEQ ID NO: 24940 - DNA, 20 bp, Artificial Sequence
  sgRNA
  Gpr68_17
gcggctggtgctcagcaccg

SEQ ID NO: 24941 - DNA, 20 bp, Artificial Sequence
  sgRNA
  Gpr68_18
caaggaccagattcagcggc

SEQ ID NO: 24942 - DNA, 20 bp, Artificial Sequence
  sgRNA
  Gpr68_19
tcttctgtgtgccgtggctg

SEQ ID NO: 24943 - DNA, 20 bp, Artificial Sequence
  sgRNA
  Gpr68_20
accagcagcagcacgtggta

SEQ ID NO: 24944 - DNA, 20 bp, Artificial Sequence
  sgRNA
  Gpr75_1
agcatcaactgtgatcaccg

SEQ ID NO: 24945 - DNA, 20 bp, Artificial Sequence
  sgRNA
  Gpr75_2
ccatccataagactggacat

SEQ ID NO: 24946 - DNA, 20 bp, Artificial Sequence
  sgRNA
  Gpr75_3
aacagcacgaaggtgaacat

SEQ ID NO: 24947 - DNA, 20 bp, Artificial Sequence
  sgRNA
  Gpr75_4
caaatggttctgtctgacaa

SEQ ID NO: 24948 - DNA, 20 bp, Artificial Sequence
  sgRNA
  Gpr75_5
ttatgattgctcaaaccctt

SEQ ID NO: 24949 - DNA, 20 bp, Artificial Sequence
  sgRNA
  Gpr75_6
catcaactgtgatcaccggg

SEQ ID NO: 24950 - DNA, 20 bp, Artificial Sequence
  sgRNA
  Gpr75_7
gttggttctgaacttcctga

SEQ ID NO: 24951 - DNA, 20 bp, Artificial Sequence
  sgRNA
  Gpr75_8
gcatcaactgtgatcaccgg

SEQ ID NO: 24952 - DNA, 20 bp, Artificial Sequence
  sgRNA
  Gpr75_9
gcaccatgccagctctgtat

SEQ ID NO: 24953 - DNA, 20 bp, Artificial Sequence
  sgRNA
  Gpr75_10
aatcacagccaccatcttga

SEQ ID NO: 24954 - DNA, 20 bp, Artificial Sequence
  sgRNA
  Gpr75_11
ggttcaatcctagtgttgat

SEQ ID NO: 24955 - DNA, 20 bp, Artificial Sequence
  sgRNA
  Gpr75_12
gctgcttccccatcaccatc

SEQ ID NO: 24956 - DNA, 20 bp, Artificial Sequence
  sgRNA
  Gpr75_13
tgagctgaagaacagcacga

SEQ ID NO: 24957 - DNA, 20 bp, Artificial Sequence
  sgRNA
  Gpr75_14
gatgaccacacaggtgacca

SEQ ID NO: 24958 - DNA, 20 bp, Artificial Sequence
  sgRNA
  Gpr75_15
tgccaaggattccaaagccg

SEQ ID NO: 24959 - DNA, 20 bp, Artificial Sequence
  sgRNA
  Gpr75_16
cgtcatcatgtccctcaaga

SEQ ID NO: 24960 - DNA, 20 bp, Artificial Sequence
  sgRNA
  Gpr75_17
tgattgctctgcaccggctc

SEQ ID NO: 24961 - DNA, 20 bp, Artificial Sequence
  sgRNA
  Gpr75_18
ccagtcttatggatggggaa

SEQ ID NO: 24962 - DNA, 20 bp, Artificial Sequence
  sgRNA
  Gpr75_19
tgacaacacgatgaccacac

SEQ ID NO: 24963 - DNA, 20 bp, Artificial Sequence
  sgRNA
  Gpr75_20
aaacatgcctcccctgcacg

SEQ ID NO: 24964 - DNA, 20 bp, Artificial Sequence
  sgRNA
  Gpr82_1
cctatactactcagtagtcg

SEQ ID NO: 24965 - DNA, 20 bp, Artificial Sequence
  sgRNA
  Gpr82_2
aaaggagaatccaataaatg

SEQ ID NO: 24966 - DNA, 20 bp, Artificial Sequence
  sgRNA
  Gpr82_3
cattctctcgtagcatgagg

SEQ ID NO: 24967 - DNA, 20 bp, Artificial Sequence
  sgRNA
  Gpr82_4
aacatcaacacatatctact

SEQ ID NO: 24968 - DNA, 20 bp, Artificial Sequence
  sgRNA
  Gpr82_5
gtaagtgaccggtaaagctg

SEQ ID NO: 24969 - DNA, 20 bp, Artificial Sequence
  sgRNA
  Gpr82_6
gctgtggtagaaatcacgga

SEQ ID NO: 24970 - DNA, 20 bp, Artificial Sequence
  sgRNA
  Gpr82_7
tggctgatgcaagacaagtg

SEQ ID NO: 24971 - DNA, 20 bp, Artificial Sequence
  sgRNA
  Gpr82_8
caatccagcttaaaattaag

SEQ ID NO: 24972 - DNA, 20 bp, Artificial Sequence
  sgRNA
  Gpr82_9
ggaggacctggatgatcaaa

SEQ ID NO: 24973 - DNA, 20 bp, Artificial Sequence
  sgRNA
  Gpr82_10
aggtccttactcttcgcaga

SEQ ID NO: 24974 - DNA, 20 bp, Artificial Sequence
  sgRNA
  Gpr82_11
tctcagattgcgggtctcat

SEQ ID NO: 24975 - DNA, 20 bp, Artificial Sequence
  sgRNA
  Gpr82_12
gacagagccagtgctacaat

SEQ ID NO: 24976 - DNA, 20 bp, Artificial Sequence
  sgRNA
  Gpr82_13
tggtgcagaacataaaaaat

SEQ ID NO: 24977 - DNA, 20 bp, Artificial Sequence
  sgRNA
  Gpr82_14
ctcgactactgagtagtata

SEQ ID NO: 24978 - DNA, 20 bp, Artificial Sequence
  sgRNA
  Gpr82_15
gaagaaagcaaactactagg

SEQ ID NO: 24979 - DNA, 20 bp, Artificial Sequence
  sgRNA
  Gpr82_16
gctgacagtctccttctctc

SEQ ID NO: 24980 - DNA, 20 bp, Artificial Sequence
  sgRNA
  Gpr82_17
cctcgactactgagtagtat

SEQ ID NO: 24981 - DNA, 20 bp, Artificial Sequence
  sgRNA
  Gpr82_18
tgcactgctatgcctttcat

SEQ ID NO: 24982 - DNA, 20 bp, Artificial Sequence
  sgRNA
  Gpr82_19
tcagccatctgcgaagagta

SEQ ID NO: 24983 - DNA, 20 bp, Artificial Sequence
  sgRNA
  Gpr82_20
ccagtgctacaatcggcaga

SEQ ID NO: 24984 - DNA, 20 bp, Artificial Sequence
  sgRNA
  Gpr83_1
cctcggatctccatcaccaa

SEQ ID NO: 24985 - DNA, 20 bp, Artificial Sequence
  sgRNA
  Gpr83_2
cccatgtgctgttcacaaag

SEQ ID NO: 24986 - DNA, 20 bp, Artificial Sequence
  sgRNA
  Gpr83_3
tgagcagtgctttcaccgtg

SEQ ID NO: 24987 - DNA, 20 bp, Artificial Sequence
  sgRNA
  Gpr83_4
cttcttggccacacgagcat

SEQ ID NO: 24988 - DNA, 20 bp, Artificial Sequence
  sgRNA
  Gpr83_5
ggatgctcagtgacgacctg

SEQ ID NO: 24989 - DNA, 20 bp, Artificial Sequence
  sgRNA
  Gpr83_6
tcttcttgcgtcgcagggcg

SEQ ID NO: 24990 - DNA, 20 bp, Artificial Sequence
  sgRNA
  Gpr83_7
gtagttggcccagaagtgcg

SEQ ID NO: 24991 - DNA, 20 bp, Artificial Sequence
  sgRNA
  Gpr83_8
ggccgagtcccagaacccca

SEQ ID NO: 24992 - DNA, 20 bp, Artificial Sequence
  sgRNA
  Gpr83_9
ggtcttcttcttgcgtcgca

SEQ ID NO: 24993 - DNA, 20 bp, Artificial Sequence
  sgRNA
  Gpr83_10
gatgagcagtgctttcaccg

SEQ ID NO: 24994 - DNA, 20 bp, Artificial Sequence
  sgRNA
  Gpr83_11
tatcgcagtggaccgccacc

SEQ ID NO: 24995 - DNA, 20 bp, Artificial Sequence
  sgRNA
  Gpr83_12
tactgctcatggcaaaccag

SEQ ID NO: 24996 - DNA, 20 bp, Artificial Sequence
  sgRNA
  Gpr83_13
cccttggtgatggagatccg

SEQ ID NO: 24997 - DNA, 20 bp, Artificial Sequence
  sgRNA
  Gpr83_14
aagcaccagcatcttcacgg

SEQ ID NO: 24998 - DNA, 20 bp, Artificial Sequence
  sgRNA
  Gpr83_15
cgtgggcaggagacgttatg

SEQ ID NO: 24999 - DNA, 20 bp, Artificial Sequence
  sgRNA
  Gpr83_16
ccagtcagagaaagtgtagt

SEQ ID NO: 25000 - DNA, 20 bp, Artificial Sequence
  sgRNA
  Gpr83_17
gttggcccagaagtgcgagg

SEQ ID NO: 25001 - DNA, 20 bp, Artificial Sequence
  sgRNA
  Gpr83_18
gctcaacacgcccttcactt

SEQ ID NO: 25002 - DNA, 20 bp, Artificial Sequence
  sgRNA
  Gpr83_19
gcgagctactgagcaaccgc

SEQ ID NO: 25003 - DNA, 20 bp, Artificial Sequence
  sgRNA
  Gpr83_20
gtagtggagccctccgacca

SEQ ID NO: 25004 - DNA, 20 bp, Artificial Sequence
  sgRNA
  Gpr85_1
atcaccgcttctatacaaag

SEQ ID NO: 25005 - DNA, 20 bp, Artificial Sequence
  sgRNA
  Gpr85_2
tgcctacatctaaaactggg

SEQ ID NO: 25006 - DNA, 20 bp, Artificial Sequence
  sgRNA
  Gpr85_3
ggaaacaggacaaaaccccc

SEQ ID NO: 25007 - DNA, 20 bp, Artificial Sequence
  sgRNA
  Gpr85_4
gtagtaaggagctctatgca

SEQ ID NO: 25008 - DNA, 20 bp, Artificial Sequence
  sgRNA
  Gpr85_5
ggcgaaactcatccagacag

SEQ ID NO: 25009 - DNA, 20 bp, Artificial Sequence
  sgRNA
  Gpr85_6
catggtgtggactctgtccg

SEQ ID NO: 25010 - DNA, 20 bp, Artificial Sequence
  sgRNA
  Gpr85_7
gactcctattatgaaaccca

SEQ ID NO: 25011 - DNA, 20 bp, Artificial Sequence
  sgRNA
  Gpr85_8
tccaaatcctgctagccaat

SEQ ID NO: 25012 - DNA, 20 bp, Artificial Sequence
  sgRNA
  Gpr85_9
gcggctgttagaaatccccc

SEQ ID NO: 25013 - DNA, 20 bp, Artificial Sequence
  sgRNA
  Gpr85_10
agctccttactacttcctgc

SEQ ID NO: 25014 - DNA, 20 bp, Artificial Sequence
  sgRNA
  Gpr85_11
gctgatgcagaagagcatga

SEQ ID NO: 25015 - DNA, 20 bp, Artificial Sequence
  sgRNA
  Gpr85_12
ctttgtatagaagcggtgat

SEQ ID NO: 25016 - DNA, 20 bp, Artificial Sequence
  sgRNA
  Gpr85_13
gcaaaatgttgtcggctgca

SEQ ID NO: 25017 - DNA, 20 bp, Artificial Sequence
  sgRNA
  Gpr85_14
cgagggcctgtagtaccagg

SEQ ID NO: 25018 - DNA, 20 bp, Artificial Sequence
  sgRNA
  Gpr85_15
cagaaaatccaggttaccaa

SEQ ID NO: 25019 - DNA, 20 bp, Artificial Sequence
  sgRNA
  Gpr85_16
cacgagggcctgtagtacca

SEQ ID NO: 25020 - DNA, 20 bp, Artificial Sequence
  sgRNA
  Gpr85_17
aatcgttagccctgaaggag

SEQ ID NO: 25021 - DNA, 20 bp, Artificial Sequence
  sgRNA
  Gpr85_18
gtgtttggctgtgatctgca

SEQ ID NO: 25022 - DNA, 20 bp, Artificial Sequence
  sgRNA
  Gpr85_19
cgaataccacaggcagaagg

SEQ ID NO: 25023 - DNA, 20 bp, Artificial Sequence
  sgRNA
  Gpr85_20
cagggaagtcagtttcagaa

SEQ ID NO: 25024 - DNA, 20 bp, Artificial Sequence
  sgRNA
  Gpr87_1
tgttgatcggtatctaaagg

SEQ ID NO: 25025 - DNA, 20 bp, Artificial Sequence
  sgRNA
  Gpr87_2
gtttgcatagaacaaaactg

SEQ ID NO: 25026 - DNA, 20 bp, Artificial Sequence
  sgRNA
  Gpr87_3
acagcacaagtgagggacat

SEQ ID NO: 25027 - DNA, 20 bp, Artificial Sequence
  sgRNA
  Gpr87_4
aagataactaggtaaagcac

SEQ ID NO: 25028 - DNA, 20 bp, Artificial Sequence
  sgRNA
  Gpr87_5
aaaacacagccacgaccacg

SEQ ID NO: 25029 - DNA, 20 bp, Artificial Sequence
  sgRNA
  Gpr87_6
atgaaactcaaaagtccgct

SEQ ID NO: 25030 - DNA, 20 bp, Artificial Sequence
  sgRNA
  Gpr87_7
acacggccagaccgttcagc

SEQ ID NO: 25031 - DNA, 20 bp, Artificial Sequence
  sgRNA
  Gpr87_8
ttaccttcagtaacttagac

SEQ ID NO: 25032 - DNA, 20 bp, Artificial Sequence
  sgRNA
  Gpr87_9
gatacatccacaaatccagc

SEQ ID NO: 25033 - DNA, 20 bp, Artificial Sequence
  sgRNA
  Gpr87_10
gtggcaagcatcctgctgaa

SEQ ID NO: 25034 - DNA, 20 bp, Artificial Sequence
  sgRNA
  Gpr87_11
atagtccgtgatgcaggatt

SEQ ID NO: 25035 - DNA, 20 bp, Artificial Sequence
  sgRNA
  Gpr87_12
ttgggctgatcagtgttgat

SEQ ID NO: 25036 - DNA, 20 bp, Artificial Sequence
  sgRNA
  Gpr87_13
aatgtggaagaagatccaca

SEQ ID NO: 25037 - DNA, 20 bp, Artificial Sequence
  sgRNA
  Gpr87_14
ttggcttatgaattgcctgc

SEQ ID NO: 25038 - DNA, 20 bp, Artificial Sequence
  sgRNA
  Gpr87_15
ggtgtcaaatttgttgtgca

SEQ ID NO: 25039 - DNA, 20 bp, Artificial Sequence
  sgRNA
  Gpr87_16
aagcctgtctaagttactga

SEQ ID NO: 25040 - DNA, 20 bp, Artificial Sequence
  sgRNA
  Gpr87_17
catgaaactcaaaagtccgc

SEQ ID NO: 25041 - DNA, 20 bp, Artificial Sequence
  sgRNA
  Gpr87_18
gctttcgcttccggctcgat

SEQ ID NO: 25042 - DNA, 20 bp, Artificial Sequence
  sgRNA
  Gpr87_19
aggataaactcgaagtacca

SEQ ID NO: 25043 - DNA, 20 bp, Artificial Sequence
  sgRNA
  Gpr87_20
tccaatcaggatcaccagca

SEQ ID NO: 25044 - DNA, 20 bp, Artificial Sequence
  sgRNA
  Gpr88_1
catcgtgaatggctgcgccg

SEQ ID NO: 25045 - DNA, 20 bp, Artificial Sequence
  sgRNA
  Gpr88_2
ggtagcggttcagcgccacg

SEQ ID NO: 25046 - DNA, 20 bp, Artificial Sequence
  sgRNA
  Gpr88_3
gagatagatgaccataccgt

SEQ ID NO: 25047 - DNA, 20 bp, Artificial Sequence
  sgRNA
  Gpr88_4
cctaccaggtgctctaccaa

SEQ ID NO: 25048 - DNA, 20 bp, Artificial Sequence
  sgRNA
  Gpr88_5
gcttgacgctgacgcgcacg

SEQ ID NO: 25049 - DNA, 20 bp, Artificial Sequence
  sgRNA
  Gpr88_6
tcaacccgctgctctacacg

SEQ ID NO: 25050 - DNA, 20 bp, Artificial Sequence
  sgRNA
  Gpr88_7
ggtggtctgcagctttcgga

SEQ ID NO: 25051 - DNA, 20 bp, Artificial Sequence
  sgRNA
  Gpr88_8
tcgacctccaccactaccgg

SEQ ID NO: 25052 - DNA, 20 bp, Artificial Sequence
  sgRNA
  Gpr88_9
ttgaggctgcgcgggatgcg

SEQ ID NO: 25053 - DNA, 20 bp, Artificial Sequence
  sgRNA
  Gpr88_10
gctctaccaacggcgccaca

SEQ ID NO: 25054 - DNA, 20 bp, Artificial Sequence
  sgRNA
  Gpr88_11
gcgtgcgcgtcagcgtcaag

SEQ ID NO: 25055 - DNA, 20 bp, Artificial Sequence
  sgRNA
  Gpr88_12
gcccggcaggacagatcgca

SEQ ID NO: 25056 - DNA, 20 bp, Artificial Sequence
  sgRNA
  Gpr88_13
gctccgggcttaggagccca

SEQ ID NO: 25057 - DNA, 20 bp, Artificial Sequence
  sgRNA
  Gpr88_14
ggacagatcgcacggatctg

SEQ ID NO: 25058 - DNA, 20 bp, Artificial Sequence
  sgRNA
  Gpr88_15
gtgccagcatgcccaccgtg

SEQ ID NO: 25059 - DNA, 20 bp, Artificial Sequence
  sgRNA
  Gpr88_16
cgcctcctgtggcatccaga

SEQ ID NO: 25060 - DNA, 20 bp, Artificial Sequence
  sgRNA
  Gpr88_17
ctaccaacggcgccacacgg

SEQ ID NO: 25061 - DNA, 20 bp, Artificial Sequence
  sgRNA
  Gpr88_18
gagcagcagcagcgatcccc

SEQ ID NO: 25062 - DNA, 20 bp, Artificial Sequence
  sgRNA
  Gpr88_19
gccaggctcacccacaccag

SEQ ID NO: 25063 - DNA, 20 bp, Artificial Sequence
  sgRNA
  Gpr88_20
cgtgcgcgtcagcgtcaagc

SEQ ID NO: 25064 - DNA, 20 bp, Artificial Sequence
  sgRNA
  Gprc5a_1
acgaaatcctcattgcgccg

SEQ ID NO: 25065 - DNA, 20 bp, Artificial Sequence
  sgRNA
  Gprc5a_2
ccgccaggtcacaaagtctg

SEQ ID NO: 25066 - DNA, 20 bp, Artificial Sequence
  sgRNA
  Gprc5a_3
gaggatcacaagccacgaca

SEQ ID NO: 25067 - DNA, 20 bp, Artificial Sequence
  sgRNA
  Gprc5a_4
gagtgcaaacatgcaagcca

SEQ ID NO: 25068 - DNA, 20 bp, Artificial Sequence
  sgRNA
  Gprc5a_5
gtccgtacaatgactacgaa

SEQ ID NO: 25069 - DNA, 20 bp, Artificial Sequence
  sgRNA
  Gprc5a_6
actcctagagctgcccctag

SEQ ID NO: 25070 - DNA, 20 bp, Artificial Sequence
  sgRNA
  Gprc5a_7
gaacagagcctactcccaag

SEQ ID NO: 25071 - DNA, 20 bp, Artificial Sequence
  sgRNA
  Gprc5a_8
cgatgccccagccttccgcc

SEQ ID NO: 25072 - DNA, 20 bp, Artificial Sequence
  sgRNA
  Gprc5a_9
tagctctgcttcatgagctg

SEQ ID NO: 25073 - DNA, 20 bp, Artificial Sequence
  sgRNA
  Gprc5a_10
aggatcacaagccacgacag

SEQ ID NO: 25074 - DNA, 20 bp, Artificial Sequence
  sgRNA
  Gprc5a_11
tcctgattcccgacattgac

SEQ ID NO: 25075 - DNA, 20 bp, Artificial Sequence
  sgRNA
  Gprc5a_12
acttgatcaagctggtccga

SEQ ID NO: 25076 - DNA, 20 bp, Artificial Sequence
  sgRNA
  Gprc5a_13
aaaggatttctctatcccga

SEQ ID NO: 25077 - DNA, 20 bp, Artificial Sequence
  sgRNA
  Gprc5a_14
agactttgtgacctggcgga

SEQ ID NO: 25078 - DNA, 20 bp, Artificial Sequence
  sgRNA
  Gprc5a_15
agacccctagcactcccagg

SEQ ID NO: 25079 - DNA, 20 bp, Artificial Sequence
  sgRNA
  Gprc5a_16
aacttgatcaagctggtccg

SEQ ID NO: 25080 - DNA, 20 bp, Artificial Sequence
  sgRNA
  Gprc5a_17
ggtctgagcggcaaccgcta

SEQ ID NO: 25081 - DNA, 20 bp, Artificial Sequence
  sgRNA
  Gprc5a_18
ttcgacagctcccaaggcaa

SEQ ID NO: 25082 - DNA, 20 bp, Artificial Sequence
  sgRNA
  Gprc5a_19
tgatcaagctggtccgaggg

SEQ ID NO: 25083 - DNA, 20 bp, Artificial Sequence
  sgRNA
  Gprc5a_20
tccgaagaggaagaagcgcg

SEQ ID NO: 25084 - DNA, 20 bp, Artificial Sequence
  sgRNA
  Gprc5b_1
tcgcacagggacacgtactg

SEQ ID NO: 25085 - DNA, 20 bp, Artificial Sequence
  sgRNA
  Gprc5b_2
tgtgtggcaagttcaaacgg

SEQ ID NO: 25086 - DNA, 20 bp, Artificial Sequence
  sgRNA
  Gprc5b_3
tccatccgacgcttcctctg

SEQ ID NO: 25087 - DNA, 20 bp, Artificial Sequence
  sgRNA
  Gprc5b_4
agcgccatcacaaaatccat

SEQ ID NO: 25088 - DNA, 20 bp, Artificial Sequence
  sgRNA
  Gprc5b_5
gcgcgaagaggacaccccag

SEQ ID NO: 25089 - DNA, 20 bp, Artificial Sequence
  sgRNA
  Gprc5b_6
gagaacgccagcacgtcccg

SEQ ID NO: 25090 - DNA, 20 bp, Artificial Sequence
  sgRNA
  Gprc5b_7
actgctccgccatctcacac

SEQ ID NO: 25091 - DNA, 20 bp, Artificial Sequence
  sgRNA
  Gprc5b_8
ggacaccccagaggaagcgt

SEQ ID NO: 25092 - DNA, 20 bp, Artificial Sequence
  sgRNA
  Gprc5b_9
gatggcgctcatctacgaca

SEQ ID NO: 25093 - DNA, 20 bp, Artificial Sequence
  sgRNA
  Gprc5b_10
gatggcgtccaggtcgcaca

SEQ ID NO: 25094 - DNA, 20 bp, Artificial Sequence
  sgRNA
  Gprc5b_11
agtccctccattgagcacga

SEQ ID NO: 25095 - DNA, 20 bp, Artificial Sequence
  sgRNA
  Gprc5b_12
gtacgtgtccctgtgcgacc

SEQ ID NO: 25096 - DNA, 20 bp, Artificial Sequence
  sgRNA
  Gprc5b_13
aggtcatcattgccactgag

SEQ ID NO: 25097 - DNA, 20 bp, Artificial Sequence
  sgRNA
  Gprc5b_14
ggcaactcattaattaagca

SEQ ID NO: 25098 - DNA, 20 bp, Artificial Sequence
  sgRNA
  Gprc5b_15
ggatgatgaaggcaaacgtc

SEQ ID NO: 25099 - DNA, 20 bp, Artificial Sequence
  sgRNA
  Gprc5b_16
gatgacaaagacccatccgc

SEQ ID NO: 25100 - DNA, 20 bp, Artificial Sequence
  sgRNA
  Gprc5b_17
ggagaacaaggccttctcaa

SEQ ID NO: 25101 - DNA, 20 bp, Artificial Sequence
  sgRNA
  Gprc5b_18
gccattacactggcagccag

SEQ ID NO: 25102 - DNA, 20 bp, Artificial Sequence
  sgRNA
  Gprc5b_19
tctttgctccaagcttccat

SEQ ID NO: 25103 - DNA, 20 bp, Artificial Sequence
  sgRNA
  Gprc5b_20
tggccgtcgtgctcaatgga

SEQ ID NO: 25104 - DNA, 20 bp, Artificial Sequence
  sgRNA
  Gprc5c_1
cacctgggatgaccccacgt

SEQ ID NO: 25105 - DNA, 20 bp, Artificial Sequence
  sgRNA
  Gprc5c_2
aggcccccgagcggtcacag

SEQ ID NO: 25106 - DNA, 20 bp, Artificial Sequence
  sgRNA
  Gprc5c_3
caaatggaaggctagccaca

SEQ ID NO: 25107 - DNA, 20 bp, Artificial Sequence
  sgRNA
  Gprc5c_4
gtggccgcttcaagcgctgg

SEQ ID NO: 25108 - DNA, 20 bp, Artificial Sequence
  sgRNA
  Gprc5c_5
ggacatgtacccgacccgag

SEQ ID NO: 25109 - DNA, 20 bp, Artificial Sequence
  sgRNA
  Gprc5c_6
gggacatgtacccgacccga

SEQ ID NO: 25110 - DNA, 20 bp, Artificial Sequence
  sgRNA
  Gprc5c_7
aggctgggtgatcttcaccg

SEQ ID NO: 25111 - DNA, 20 bp, Artificial Sequence
  sgRNA
  Gprc5c_8
gttaatgatgacctccacaa

SEQ ID NO: 25112 - DNA, 20 bp, Artificial Sequence
  sgRNA
  Gprc5c_9
gtacatgtcttcggcccgca

SEQ ID NO: 25113 - DNA, 20 bp, Artificial Sequence
  sgRNA
  Gprc5c_10
gcagcaccatagccccacct

SEQ ID NO: 25114 - DNA, 20 bp, Artificial Sequence
  sgRNA
  Gprc5c_11
agaccagtgtcaccttacag

SEQ ID NO: 25115 - DNA, 20 bp, Artificial Sequence
  sgRNA
  Gprc5c_12
aggtcatcattaacaccgag

SEQ ID NO: 25116 - DNA, 20 bp, Artificial Sequence
  sgRNA
  Gprc5c_13
atacgacgtcatcctcccac

SEQ ID NO: 25117 - DNA, 20 bp, Artificial Sequence
  sgRNA
  Gprc5c_14
gtcggcactgacattgccca

SEQ ID NO: 25118 - DNA, 20 bp, Artificial Sequence
  sgRNA
  Gprc5c_15
gcgggccgaagacatgtaca

SEQ ID NO: 25119 - DNA, 20 bp, Artificial Sequence
  sgRNA
  Gprc5c_16
gtacatggtccagagccacc

SEQ ID NO: 25120 - DNA, 20 bp, Artificial Sequence
  sgRNA
  Gprc5c_17
tgttaatgatgacctccaca

SEQ ID NO: 25121 - DNA, 20 bp, Artificial Sequence
  sgRNA
  Gprc5c_18
gcccagcaggaagaacacct

SEQ ID NO: 25122 - DNA, 20 bp, Artificial Sequence
  sgRNA
  Gprc5c_19
tcctaacccggaagaaccat

SEQ ID NO: 25123 - DNA, 20 bp, Artificial Sequence
  sgRNA
  Gprc5c_20
gtttccgccagcgcttgaag

SEQ ID NO: 25124 - DNA, 20 bp, Artificial Sequence
  sgRNA
  Gprc5d_1
gacaccgtatcagctcaatg

SEQ ID NO: 25125 - DNA, 20 bp, Artificial Sequence
  sgRNA
  Gprc5d_2
tgccaaggactccagaacaa

SEQ ID NO: 25126 - DNA, 20 bp, Artificial Sequence
  sgRNA
  Gprc5d_3
aaagaggaagtagcgaacag

SEQ ID NO: 25127 - DNA, 20 bp, Artificial Sequence
  sgRNA
  Gprc5d_4
agtcctgaaccttccgcatg

SEQ ID NO: 25128 - DNA, 20 bp, Artificial Sequence
  sgRNA
  Gprc5d_5
gctccagcgacagccccact

SEQ ID NO: 25129 - DNA, 20 bp, Artificial Sequence
  sgRNA
  Gprc5d_6
gtgggcttagtgtagctgat

SEQ ID NO: 25130 - DNA, 20 bp, Artificial Sequence
  sgRNA
  Gprc5d_7
acctcttctgtgacaacgag

SEQ ID NO: 25131 - DNA, 20 bp, Artificial Sequence
  sgRNA
  Gprc5d_8
gtgaccctcatcatgaccag

SEQ ID NO: 25132 - DNA, 20 bp, Artificial Sequence
  sgRNA
  Gprc5d_9
tgttcgctacttcctctttg

SEQ ID NO: 25133 - DNA, 20 bp, Artificial Sequence
  sgRNA
  Gprc5d_10
tggcctggtcaccaacgctt

SEQ ID NO: 25134 - DNA, 20 bp, Artificial Sequence
  sgRNA
  Gprc5d_11
gcatgaggaacagaaatgcc

SEQ ID NO: 25135 - DNA, 20 bp, Artificial Sequence
  sgRNA
  Gprc5d_12
agacagtgatggagctcagg

SEQ ID NO: 25136 - DNA, 20 bp, Artificial Sequence
  sgRNA
  Gprc5d_13
gatctatgtcctcttcctga

SEQ ID NO: 25137 - DNA, 20 bp, Artificial Sequence
  sgRNA
  Gprc5d_14
tatccatcctgaagctgcgt

SEQ ID NO: 25138 - DNA, 20 bp, Artificial Sequence
  sgRNA
  Gprc5d_15
tcgcaatgatggtctgcaac

SEQ ID NO: 25139 - DNA, 20 bp, Artificial Sequence
  sgRNA
  Gprc5d_16
gatgactgcatcgtcccagt

SEQ ID NO: 25140 - DNA, 20 bp, Artificial Sequence
  sgRNA
  Gprc5d_17
ctaccaacgcagcttcagga

SEQ ID NO: 25141 - DNA, 20 bp, Artificial Sequence
  sgRNA
  Gprc5d_18
agagcccgagcacagccagc

SEQ ID NO: 25142 - DNA, 20 bp, Artificial Sequence
  sgRNA
  Gprc5d_19
gctgtttccagttctcacat

SEQ ID NO: 25143 - DNA, 20 bp, Artificial Sequence
  sgRNA
  Gprc5d_20
gcatactctacaggtcatgt

SEQ ID NO: 25144 - DNA, 20 bp, Artificial Sequence
  sgRNA
  Gprc6a_1
ctactctgaaacatccatcg

SEQ ID NO: 25145 - DNA, 20 bp, Artificial Sequence
  sgRNA
  Gprc6a_2
tcccgattgtcggatcaggt

SEQ ID NO: 25146 - DNA, 20 bp, Artificial Sequence
  sgRNA
  Gprc6a_3
accagtatttaaatccccgt

SEQ ID NO: 25147 - DNA, 20 bp, Artificial Sequence
  sgRNA
  Gprc6a_4
atgcaacaatgaaacccact

SEQ ID NO: 25148 - DNA, 20 bp, Artificial Sequence
  sgRNA
  Gprc6a_5
gatagccacgaagtcatctg

SEQ ID NO: 25149 - DNA, 20 bp, Artificial Sequence
  sgRNA
  Gprc6a_6
gctttgtatttgcattcaag

SEQ ID NO: 25150 - DNA, 20 bp, Artificial Sequence
  sgRNA
  Gprc6a_7
cctgtcgtgaaatcatctgg

SEQ ID NO: 25151 - DNA, 20 bp, Artificial Sequence
  sgRNA
  Gprc6a_8
agcttggcacagatcccgga

SEQ ID NO: 25152 - DNA, 20 bp, Artificial Sequence
  sgRNA
  Gprc6a_9
acctgatccgacaatcggga

SEQ ID NO: 25153 - DNA, 20 bp, Artificial Sequence
  sgRNA
  Gprc6a_10
tggctttcttcatttgacca

SEQ ID NO: 25154 - DNA, 20 bp, Artificial Sequence
  sgRNA
  Gprc6a_11
agtagttgtaaaccatctgg

SEQ ID NO: 25155 - DNA, 20 bp, Artificial Sequence
  sgRNA
  Gprc6a_12
gatggtgataatcttggtag

SEQ ID NO: 25156 - DNA, 20 bp, Artificial Sequence
  sgRNA
  Gprc6a_13
ttatgacgtggtgctctgga

SEQ ID NO: 25157 - DNA, 20 bp, Artificial Sequence
  sgRNA
  Gprc6a_14
gcctgtgctggcaaagttaa

SEQ ID NO: 25158 - DNA, 20 bp, Artificial Sequence
  sgRNA
  Gprc6a_15
atttcactttgatgcccacg

SEQ ID NO: 25159 - DNA, 20 bp, Artificial Sequence
  sgRNA
  Gprc6a_16
gatcccggatggcatgacca

SEQ ID NO: 25160 - DNA, 20 bp, Artificial Sequence
  sgRNA
  Gprc6a_17
cctccagatgatttcacgac

SEQ ID NO: 25161 - DNA, 20 bp, Artificial Sequence
  sgRNA
  Gprc6a_18
atgactataatctccacggc

SEQ ID NO: 25162 - DNA, 20 bp, Artificial Sequence
  sgRNA
  Gprc6a_19
gcccgtgcaggtaagaacaa

SEQ ID NO: 25163 - DNA, 20 bp, Artificial Sequence
  sgRNA
  Gprc6a_20
tggggtatgacaagactggg

SEQ ID NO: 25164 - DNA, 20 bp, Artificial Sequence
  sgRNA
  Gramd1b_1
taccacccataccgaaacag

SEQ ID NO: 25165 - DNA, 20 bp, Artificial Sequence
  sgRNA
  Gramd1b_2
gattacgccctccagcgacg

SEQ ID NO: 25166 - DNA, 20 bp, Artificial Sequence
  sgRNA
  Gramd1b_3
acctgctcgaatcatcgtcg

SEQ ID NO: 25167 - DNA, 20 bp, Artificial Sequence
  sgRNA
  Gramd1b_4
ttactagctcaccaacaatg

SEQ ID NO: 25168 - DNA, 20 bp, Artificial Sequence
  sgRNA
  Gramd1b_5
gcagacacggcacatcccgg

SEQ ID NO: 25169 - DNA, 20 bp, Artificial Sequence
  sgRNA
  Gramd1b_6
gaacctcagggcgcacccga

SEQ ID NO: 25170 - DNA, 20 bp, Artificial Sequence
  sgRNA
  Gramd1b_7
gggccacaggatcaagcacg

SEQ ID NO: 25171 - DNA, 20 bp, Artificial Sequence
  sgRNA
  Gramd1b_8
gctatcgaaaacagccctgg

SEQ ID NO: 25172 - DNA, 20 bp, Artificial Sequence
  sgRNA
  Gramd1b_9
cttccaggtgaggcacccgc

SEQ ID NO: 25173 - DNA, 20 bp, Artificial Sequence
  sgRNA
  Gramd1b_10
gctgctccatgaaatcccgc

SEQ ID NO: 25174 - DNA, 20 bp, Artificial Sequence
  sgRNA
  Gramd1b_11
ccagcgacgaggacaccccg

SEQ ID NO: 25175 - DNA, 20 bp, Artificial Sequence
  sgRNA
  Gramd1b_12
catgcagcacagctgtcaag

SEQ ID NO: 25176 - DNA, 20 bp, Artificial Sequence
  sgRNA
  Gramd1b_13
gttgcaggaactccttgccg

SEQ ID NO: 25177 - DNA, 20 bp, Artificial Sequence
  sgRNA
  Gramd1b_14
gccggcgctttaagatgcgc

SEQ ID NO: 25178 - DNA, 20 bp, Artificial Sequence
  sgRNA
  Gramd1b_15
ggcgcatcttaaagcgccgg

SEQ ID NO: 25179 - DNA, 20 bp, Artificial Sequence
  sgRNA
  Gramd1b_16
tcttcctcagacaggagaca

SEQ ID NO: 25180 - DNA, 20 bp, Artificial Sequence
  sgRNA
  Gramd1b_17
gcgttgcacaccctgctccg

SEQ ID NO: 25181 - DNA, 20 bp, Artificial Sequence
  sgRNA
  Gramd1b_18
gccacgacgatgattcgagc

SEQ ID NO: 25182 - DNA, 20 bp, Artificial Sequence
  sgRNA
  Gramd1b_19
caccgagctccagaagtgga

SEQ ID NO: 25183 - DNA, 20 bp, Artificial Sequence
  sgRNA
  Gramd1b_20
gagggcgtaatctcaatgga

SEQ ID NO: 25184 - DNA, 20 bp, Artificial Sequence
  sgRNA
  Gria1_1
atgttcacaatatcgatctg

SEQ ID NO: 25185 - DNA, 20 bp, Artificial Sequence
  sgRNA
  Gria1_2
cgtcgctgacaatctcaagt

SEQ ID NO: 25186 - DNA, 20 bp, Artificial Sequence
  sgRNA
  Gria1_3
tgtcaacattctaacaacca

SEQ ID NO: 25187 - DNA, 20 bp, Artificial Sequence
  sgRNA
  Gria1_4
agtttaacgagaaagggcgc

SEQ ID NO: 25188 - DNA, 20 bp, Artificial Sequence
  sgRNA
  Gria1_5
aatcccgtagcgagtcgaag

SEQ ID NO: 25189 - DNA, 20 bp, Artificial Sequence
  sgRNA
  Gria1_6
gcattatcgaccattacaag

SEQ ID NO: 25190 - DNA, 20 bp, Artificial Sequence
  sgRNA
  Gria1_7
catccggtatccttcctccg

SEQ ID NO: 25191 - DNA, 20 bp, Artificial Sequence
  sgRNA
  Gria1_8
ggattgacatatcccggcga

SEQ ID NO: 25192 - DNA, 20 bp, Artificial Sequence
  sgRNA
  Gria1_9
tcatccgcttcgactcgcta

SEQ ID NO: 25193 - DNA, 20 bp, Artificial Sequence
  sgRNA
  Gria1_10
gaccataaccttggtccggg

SEQ ID NO: 25194 - DNA, 20 bp, Artificial Sequence
  sgRNA
  Gria1_11
tgttaaaactgaacgagcag

SEQ ID NO: 25195 - DNA, 20 bp, Artificial Sequence
  sgRNA
  Gria1_12
atggcattgcaacacccaag

SEQ ID NO: 25196 - DNA, 20 bp, Artificial Sequence
  sgRNA
  Gria1_13
ctgtctggacgcatcgtcgg

SEQ ID NO: 25197 - DNA, 20 bp, Artificial Sequence
  sgRNA
  Gria1_14
tgacgctcgggaccacacca

SEQ ID NO: 25198 - DNA, 20 bp, Artificial Sequence
  sgRNA
  Gria1_15
gtggtccgaacaaacacaga

SEQ ID NO: 25199 - DNA, 20 bp, Artificial Sequence
  sgRNA
  Gria1_16
ccgctatgagggctactgcg

SEQ ID NO: 25200 - DNA, 20 bp, Artificial Sequence
  sgRNA
  Gria1_17
cactgagtttcaaaaccgct

SEQ ID NO: 25201 - DNA, 20 bp, Artificial Sequence
  sgRNA
  Gria1_18
gctgacaatctcaagtcggt

SEQ ID NO: 25202 - DNA, 20 bp, Artificial Sequence
  sgRNA
  Gria1_19
gccgtttcagtccttatgaa

SEQ ID NO: 25203 - DNA, 20 bp, Artificial Sequence
  sgRNA
  Gria1_20
aaggatgtgacatttccccc

SEQ ID NO: 25204 - DNA, 20 bp, Artificial Sequence
  sgRNA
  Gria2_1
tgtcagtctgaactccgaag

SEQ ID NO: 25205 - DNA, 20 bp, Artificial Sequence
  sgRNA
  Gria2_2
ttggacagcatcataagtca

SEQ ID NO: 25206 - DNA, 20 bp, Artificial Sequence
  sgRNA
  Gria2_3
agctcaaaacaaatggaccc

SEQ ID NO: 25207 - DNA, 20 bp, Artificial Sequence
  sgRNA
  Gria2_4
caggtgactgctatcaatgt

SEQ ID NO: 25208 - DNA, 20 bp, Artificial Sequence
  sgRNA
  Gria2_5
ggtatgcgaacttatcccat

SEQ ID NO: 25209 - DNA, 20 bp, Artificial Sequence
  sgRNA
  Gria2_6
tattcttgatcagcgcccct

SEQ ID NO: 25210 - DNA, 20 bp, Artificial Sequence
  sgRNA
  Gria2_7
ggtcgcatctggatgacaaa

SEQ ID NO: 25211 - DNA, 20 bp, Artificial Sequence
  sgRNA
  Gria2_8
ttgtcgctgtgtgtgctcca

SEQ ID NO: 25212 - DNA, 20 bp, Artificial Sequence
  sgRNA
  Gria2_9
tgagttctgttacaagtcaa

SEQ ID NO: 25213 - DNA, 20 bp, Artificial Sequence
  sgRNA
  Gria2_10
tgtaatccttgactgcgaaa

SEQ ID NO: 25214 - DNA, 20 bp, Artificial Sequence
  sgRNA
  Gria2_11
tccgcaatcttcggaagcag

SEQ ID NO: 25215 - DNA, 20 bp, Artificial Sequence
  sgRNA
  Gria2_12
cttgattgagtactaccaat

SEQ ID NO: 25216 - DNA, 20 bp, Artificial Sequence
  sgRNA
  Gria2_13
tgaatgagtacatcgagcag

SEQ ID NO: 25217 - DNA, 20 bp, Artificial Sequence
  sgRNA
  Gria2_14
cgtagtcctcacaaacacag

SEQ ID NO: 25218 - DNA, 20 bp, Artificial Sequence
  sgRNA
  Gria2_15
gtattctacatccttgtcgg

SEQ ID NO: 25219 - DNA, 20 bp, Artificial Sequence
  sgRNA
  Gria2_16
aaaattctgggaattctgcg

SEQ ID NO: 25220 - DNA, 20 bp, Artificial Sequence
  sgRNA
  Gria2_17
caccttcattcgtttcgcct

SEQ ID NO: 25221 - DNA, 20 bp, Artificial Sequence
  sgRNA
  Gria2_18
tgtagactacgacgactccc

SEQ ID NO: 25222 - DNA, 20 bp, Artificial Sequence
  sgRNA
  Gria2_19
ccattggaaagcatgttaaa

SEQ ID NO: 25223 - DNA, 20 bp, Artificial Sequence
  sgRNA
  Gria2_20
tcgaagccattcatgagcct

SEQ ID NO: 25224 - DNA, 20 bp, Artificial Sequence
  sgRNA
  Gria3_1
tgtgacgaaagatgtatgca

SEQ ID NO: 25225 - DNA, 20 bp, Artificial Sequence
  sgRNA
  Gria3_2
gtacaatgtcagtaaaaccc

SEQ ID NO: 25226 - DNA, 20 bp, Artificial Sequence
  sgRNA
  Gria3_3
tacctctatgacacagaacg

SEQ ID NO: 25227 - DNA, 20 bp, Artificial Sequence
  sgRNA
  Gria3_4
aggaatccaagtggtctacg

SEQ ID NO: 25228 - DNA, 20 bp, Artificial Sequence
  sgRNA
  Gria3_5
ttatcatgatggagatcccc

SEQ ID NO: 25229 - DNA, 20 bp, Artificial Sequence
  sgRNA
  Gria3_6
tgattgactgtgaagtcgaa

SEQ ID NO: 25230 - DNA, 20 bp, Artificial Sequence
  sgRNA
  Gria3_7
cgagtggatgtatcccgcag

SEQ ID NO: 25231 - DNA, 20 bp, Artificial Sequence
  sgRNA
  Gria3_8
cttccaagtgccactcataa

SEQ ID NO: 25232 - DNA, 20 bp, Artificial Sequence
  sgRNA
  Gria3_9
tacgatggtcctgttctcgg

SEQ ID NO: 25233 - DNA, 20 bp, Artificial Sequence
  sgRNA
  Gria3_10
ctggatgacaaactgcacat

SEQ ID NO: 25234 - DNA, 20 bp, Artificial Sequence
  sgRNA
  Gria3_11
ggagggctttgtgggtcacg

SEQ ID NO: 25235 - DNA, 20 bp, Artificial Sequence
  sgRNA
  Gria3_12
ggtctacgtggtagttcaaa

SEQ ID NO: 25236 - DNA, 20 bp, Artificial Sequence
  sgRNA
  Gria3_13
agtcacagaaaaactattgg

SEQ ID NO: 25237 - DNA, 20 bp, Artificial Sequence
  sgRNA
  Gria3_14
tgtataactgcacagcaaag

SEQ ID NO: 25238 - DNA, 20 bp, Artificial Sequence
  sgRNA
  Gria3_15
ctgcctcctcaggtatcgga

SEQ ID NO: 25239 - DNA, 20 bp, Artificial Sequence
  sgRNA
  Gria3_16
tgctccactcactataacat

SEQ ID NO: 25240 - DNA, 20 bp, Artificial Sequence
  sgRNA
  Gria3_17
gtaacccagaagactcagaa

SEQ ID NO: 25241 - DNA, 20 bp, Artificial Sequence
  sgRNA
  Gria3_18
agaattctgttacaaatcac

SEQ ID NO: 25242 - DNA, 20 bp, Artificial Sequence
  sgRNA
  Gria3_19
cagatgcgcccagccttaaa

SEQ ID NO: 25243 - DNA, 20 bp, Artificial Sequence
  sgRNA
  Gria3_20
atatacttgtcggaggtctg

SEQ ID NO: 25244 - DNA, 20 bp, Artificial Sequence
  sgRNA
  Gria4_1
tgcatacattggtgtcagcg

SEQ ID NO: 25245 - DNA, 20 bp, Artificial Sequence
  sgRNA
  Gria4_2
gcatgtcagtgcgatatgtg

SEQ ID NO: 25246 - DNA, 20 bp, Artificial Sequence
  sgRNA
  Gria4_3
acgtagagttaattacacaa

SEQ ID NO: 25247 - DNA, 20 bp, Artificial Sequence
  sgRNA
  Gria4_4
tgcacctctgacaatcacgt

SEQ ID NO: 25248 - DNA, 20 bp, Artificial Sequence
  sgRNA
  Gria4_5
tacgcctccaacaatccgac

SEQ ID NO: 25249 - DNA, 20 bp, Artificial Sequence
  sgRNA
  Gria4_6
gatgtggacctacatgcgat

SEQ ID NO: 25250 - DNA, 20 bp, Artificial Sequence
  sgRNA
  Gria4_7
gtaggtttagcccatatgag

SEQ ID NO: 25251 - DNA, 20 bp, Artificial Sequence
  sgRNA
  Gria4_8
agagttctgttacaagtcca

SEQ ID NO: 25252 - DNA, 20 bp, Artificial Sequence
  sgRNA
  Gria4_9
gctgacccccgactgcccca

SEQ ID NO: 25253 - DNA, 20 bp, Artificial Sequence
  sgRNA
  Gria4_10
gtagttctagtgaacacaga

SEQ ID NO: 25254 - DNA, 20 bp, Artificial Sequence
  sgRNA
  Gria4_11
gcccatggtgacgaaactaa

SEQ ID NO: 25255 - DNA, 20 bp, Artificial Sequence
  sgRNA
  Gria4_12
ggcgtcttctacattctggt

SEQ ID NO: 25256 - DNA, 20 bp, Artificial Sequence
  sgRNA
  Gria4_13
agctatcgagaacagaacag

SEQ ID NO: 25257 - DNA, 20 bp, Artificial Sequence
  sgRNA
  Gria4_14
tggtcttgttcctagtcagt

SEQ ID NO: 25258 - DNA, 20 bp, Artificial Sequence
  sgRNA
  Gria4_15
aagatgccaaactcattggg

SEQ ID NO: 25259 - DNA, 20 bp, Artificial Sequence
  sgRNA
  Gria4_16
tctgttcccagtattctaga

SEQ ID NO: 25260 - DNA, 20 bp, Artificial Sequence
  sgRNA
  Gria4_17
tgcctcactgagtttcaaaa

SEQ ID NO: 25261 - DNA, 20 bp, Artificial Sequence
  sgRNA
  Gria4_18
agggtttgccagacaatccc

SEQ ID NO: 25262 - DNA, 20 bp, Artificial Sequence
  sgRNA
  Gria4_19
cgcaccaacgtgattgtcag

SEQ ID NO: 25263 - DNA, 20 bp, Artificial Sequence
  sgRNA
  Gria4_20
gcccgtgtccgcaagtccaa

SEQ ID NO: 25264 - DNA, 20 bp, Artificial Sequence
  sgRNA
  Grid1_1
ggccaataatccgttccagg

SEQ ID NO: 25265 - DNA, 20 bp, Artificial Sequence
  sgRNA
  Grid1_2
gaaactccataacccctgtg

SEQ ID NO: 25266 - DNA, 20 bp, Artificial Sequence
  sgRNA
  Grid1_3
attcaaatatgagatatacc

SEQ ID NO: 25267 - DNA, 20 bp, Artificial Sequence
  sgRNA
  Grid1_4
ggaccagatccaggatctcg

SEQ ID NO: 25268 - DNA, 20 bp, Artificial Sequence
  sgRNA
  Grid1_5
gtaacgcactggcatatcca

SEQ ID NO: 25269 - DNA, 20 bp, Artificial Sequence
  sgRNA
  Grid1_6
gagaaccctttgtaacgctt

SEQ ID NO: 25270 - DNA, 20 bp, Artificial Sequence
  sgRNA
  Grid1_7
gacaacccaagcgttacaaa

SEQ ID NO: 25271 - DNA, 20 bp, Artificial Sequence
  sgRNA
  Grid1_8
ggcgcactccttcatcaatg

SEQ ID NO: 25272 - DNA, 20 bp, Artificial Sequence
  sgRNA
  Grid1_9
acatcattgagacggacagg

SEQ ID NO: 25273 - DNA, 20 bp, Artificial Sequence
  sgRNA
  Grid1_10
gcacgggctggaaggacata

SEQ ID NO: 25274 - DNA, 20 bp, Artificial Sequence
  sgRNA
  Grid1_11
attggcggatgcacagcccg

SEQ ID NO: 25275 - DNA, 20 bp, Artificial Sequence
  sgRNA
  Grid1_12
tttgtccagcgcaaccccgg

SEQ ID NO: 25276 - DNA, 20 bp, Artificial Sequence
  sgRNA
  Grid1_13
agcgaagctgtgcagcttaa

SEQ ID NO: 25277 - DNA, 20 bp, Artificial Sequence
  sgRNA
  Grid1_14
ggcgtctgtgagggactgca

SEQ ID NO: 25278 - DNA, 20 bp, Artificial Sequence
  sgRNA
  Grid1_15
cttcgaggagaacgcagcca

SEQ ID NO: 25279 - DNA, 20 bp, Artificial Sequence
  sgRNA
  Grid1_16
cccacaccgcaaagtcaaag

SEQ ID NO: 25280 - DNA, 20 bp, Artificial Sequence
  sgRNA
  Grid1_17
tgacggcgaggcctacacac

SEQ ID NO: 25281 - DNA, 20 bp, Artificial Sequence
  sgRNA
  Grid1_18
agtctacaggagaggcccat

SEQ ID NO: 25282 - DNA, 20 bp, Artificial Sequence
  sgRNA
  Grid1_19
ccacaccgcaaagtcaaagg

SEQ ID NO: 25283 - DNA, 20 bp, Artificial Sequence
  sgRNA
  Grid1_20
ttaagctgcacagcttcgct

SEQ ID NO: 25284 - DNA, 20 bp, Artificial Sequence
  sgRNA
  Grid2_1
gatcccatttgcaatcgtgg

SEQ ID NO: 25285 - DNA, 20 bp, Artificial Sequence
  sgRNA
  Grid2_2
aaactggagaacaacatgcg

SEQ ID NO: 25286 - DNA, 20 bp, Artificial Sequence
  sgRNA
  Grid2_3
gtaataatcctagatatccg

SEQ ID NO: 25287 - DNA, 20 bp, Artificial Sequence
  sgRNA
  Grid2_4
caaatatggaagcccacaag

SEQ ID NO: 25288 - DNA, 20 bp, Artificial Sequence
  sgRNA
  Grid2_5
gcaggagagcacaattcccg

SEQ ID NO: 25289 - DNA, 20 bp, Artificial Sequence
  sgRNA
  Grid2_6
ttaccgccaagcttcaaaca

SEQ ID NO: 25290 - DNA, 20 bp, Artificial Sequence
  sgRNA
  Grid2_7
ggaaaaccgaagaaatacca

SEQ ID NO: 25291 - DNA, 20 bp, Artificial Sequence
  sgRNA
  Grid2_8
gatgccctatctaactacct

SEQ ID NO: 25292 - DNA, 20 bp, Artificial Sequence
  sgRNA
  Grid2_9
gcagtgcaatgccatacccc

SEQ ID NO: 25293 - DNA, 20 bp, Artificial Sequence
  sgRNA
  Grid2_10
agtgggagtccttcttcgaa

SEQ ID NO: 25294 - DNA, 20 bp, Artificial Sequence
  sgRNA
  Grid2_11
gctgattctatcatccacat

SEQ ID NO: 25295 - DNA, 20 bp, Artificial Sequence
  sgRNA
  Grid2_12
ggaacactgttgctgaccgg

SEQ ID NO: 25296 - DNA, 20 bp, Artificial Sequence
  sgRNA
  Grid2_13
tcatagctgtcctcgagacg

SEQ ID NO: 25297 - DNA, 20 bp, Artificial Sequence
  sgRNA
  Grid2_14
ccacactctttgacaccatg

SEQ ID NO: 25298 - DNA, 20 bp, Artificial Sequence
  sgRNA
  Grid2_15
acgtctcgaggacagctatg

SEQ ID NO: 25299 - DNA, 20 bp, Artificial Sequence
  sgRNA
  Grid2_16
gttgcaccggaccacaaata

SEQ ID NO: 25300 - DNA, 20 bp, Artificial Sequence
  sgRNA
  Grid2_17
tagctgtcctcgagacgtgg

SEQ ID NO: 25301 - DNA, 20 bp, Artificial Sequence
  sgRNA
  Grid2_18
catactctgtgactactctt

SEQ ID NO: 25302 - DNA, 20 bp, Artificial Sequence
  sgRNA
  Grid2_19
aggccgtgtttgaagcttgg

SEQ ID NO: 25303 - DNA, 20 bp, Artificial Sequence
  sgRNA
  Grid2_20
cagtgtagaaggaacagtcg

SEQ ID NO: 25304 - DNA, 20 bp, Artificial Sequence
  sgRNA
  Grik1_1
gatttcctgtacatcacgta

SEQ ID NO: 25305 - DNA, 20 bp, Artificial Sequence
  sgRNA
  Grik1_2
gcacagtccttatccaaccc

SEQ ID NO: 25306 - DNA, 20 bp, Artificial Sequence
  sgRNA
  Grik1_3
ttggcatccttattgccaga

SEQ ID NO: 25307 - DNA, 20 bp, Artificial Sequence
  sgRNA
  Grik1_4
agattatgcagctatcagca

SEQ ID NO: 25308 - DNA, 20 bp, Artificial Sequence
  sgRNA
  Grik1_5
ggatttcctgtacatcacgt

SEQ ID NO: 25309 - DNA, 20 bp, Artificial Sequence
  sgRNA
  Grik1_6
cttatgtcgatggcactgca

SEQ ID NO: 25310 - DNA, 20 bp, Artificial Sequence
  sgRNA
  Grik1_7
agtgggctgaacatgacgga

SEQ ID NO: 25311 - DNA, 20 bp, Artificial Sequence
  sgRNA
  Grik1_8
gtgtggcaaattattacgag

SEQ ID NO: 25312 - DNA, 20 bp, Artificial Sequence
  sgRNA
  Grik1_9
ggacattatcagtctcaaag

SEQ ID NO: 25313 - DNA, 20 bp, Artificial Sequence
  sgRNA
  Grik1_10
ggatttggaactccaacagt

SEQ ID NO: 25314 - DNA, 20 bp, Artificial Sequence
  sgRNA
  Grik1_11
ctaggagtggaaaatatcgg

SEQ ID NO: 25315 - DNA, 20 bp, Artificial Sequence
  sgRNA
  Grik1_12
ctatcgaccagaatagttgg

SEQ ID NO: 25316 - DNA, 20 bp, Artificial Sequence
  sgRNA
  Grik1_13
atttgattgttcgcacgaga

SEQ ID NO: 25317 - DNA, 20 bp, Artificial Sequence
  sgRNA
  Grik1_14
gtgcttagacacttcaccag

SEQ ID NO: 25318 - DNA, 20 bp, Artificial Sequence
  sgRNA
  Grik1_15
cggccaccccaagagccagt

SEQ ID NO: 25319 - DNA, 20 bp, Artificial Sequence
  sgRNA
  Grik1_16
gcattgagtatgtgacacag

SEQ ID NO: 25320 - DNA, 20 bp, Artificial Sequence
  sgRNA
  Grik1_17
aatagtttctggtttggcgt

SEQ ID NO: 25321 - DNA, 20 bp, Artificial Sequence
  sgRNA
  Grik1_18
acaaaccaagatagaatacg

SEQ ID NO: 25322 - DNA, 20 bp, Artificial Sequence
  sgRNA
  Grik1_19
agtgccatcgacataagcca

SEQ ID NO: 25323 - DNA, 20 bp, Artificial Sequence
  sgRNA
  Grik1_20
tttctcccgtacatacgtga

SEQ ID NO: 25324 - DNA, 20 bp, Artificial Sequence
  sgRNA
  Grik2_1
aagcgagtcccaaagcgcca

SEQ ID NO: 25325 - DNA, 20 bp, Artificial Sequence
  sgRNA
  Grik2_2
acagtggcgtaaatatgaca

SEQ ID NO: 25326 - DNA, 20 bp, Artificial Sequence
  sgRNA
  Grik2_3
cgaacataggtaatagccag

SEQ ID NO: 25327 - DNA, 20 bp, Artificial Sequence
  sgRNA
  Grik2_4
ctgtgtatcatatgttaacg

SEQ ID NO: 25328 - DNA, 20 bp, Artificial Sequence
  sgRNA
  Grik2_5
cgtgaggttacagttccgct

SEQ ID NO: 25329 - DNA, 20 bp, Artificial Sequence
  sgRNA
  Grik2_6
aatcgatcattcccatagag

SEQ ID NO: 25330 - DNA, 20 bp, Artificial Sequence
  sgRNA
  Grik2_7
aatgcaatcgacacaaaccc

SEQ ID NO: 25331 - DNA, 20 bp, Artificial Sequence
  sgRNA
  Grik2_8
gctccacatcaagagcgaag

SEQ ID NO: 25332 - DNA, 20 bp, Artificial Sequence
  sgRNA
  Grik2_9
ccatcgagtttgttacccag

SEQ ID NO: 25333 - DNA, 20 bp, Artificial Sequence
  sgRNA
  Grik2_10
ccagagtcgtaaatatatag

SEQ ID NO: 25334 - DNA, 20 bp, Artificial Sequence
  sgRNA
  Grik2_11
ggctgcagtcgaagatcacg

SEQ ID NO: 25335 - DNA, 20 bp, Artificial Sequence
  sgRNA
  Grik2_12
aggcgactccatgcgttcca

SEQ ID NO: 25336 - DNA, 20 bp, Artificial Sequence
  sgRNA
  Grik2_13
aatgcctcccactatcctgg

SEQ ID NO: 25337 - DNA, 20 bp, Artificial Sequence
  sgRNA
  Grik2_14
catcatcgagaagtggtcga

SEQ ID NO: 25338 - DNA, 20 bp, Artificial Sequence
  sgRNA
  Grik2_15
gttgtgtatgacgacagcac

SEQ ID NO: 25339 - DNA, 20 bp, Artificial Sequence
  sgRNA
  Grik2_16
gcgttccacggtcagaaagg

SEQ ID NO: 25340 - DNA, 20 bp, Artificial Sequence
  sgRNA
  Grik2_17
ttgtggatcggatattcgca

SEQ ID NO: 25341 - DNA, 20 bp, Artificial Sequence
  sgRNA
  Grik2_18
cattaagaaagcataatcgg

SEQ ID NO: 25342 - DNA, 20 bp, Artificial Sequence
  sgRNA
  Grik2_19
tttgctggatggatttatga

SEQ ID NO: 25343 - DNA, 20 bp, Artificial Sequence
  sgRNA
  Grik2_20
tgtggattataccactcata

SEQ ID NO: 25344 - DNA, 20 bp, Artificial Sequence
  sgRNA
  Grik3_1
tgggttccgcatactcaacg

SEQ ID NO: 25345 - DNA, 20 bp, Artificial Sequence
  sgRNA
  Grik3_2
tgacggtctcaatatcactg

SEQ ID NO: 25346 - DNA, 20 bp, Artificial Sequence
  sgRNA
  Grik3_3
tgagggactggaccaagtcg

SEQ ID NO: 25347 - DNA, 20 bp, Artificial Sequence
  sgRNA
  Grik3_4
cctctgaatgtcgtaagtca

SEQ ID NO: 25348 - DNA, 20 bp, Artificial Sequence
  sgRNA
  Grik3_5
gcctcctatgatggtcaaga

SEQ ID NO: 25349 - DNA, 20 bp, Artificial Sequence
  sgRNA
  Grik3_6
ttgctcaaagagatgaagcg

SEQ ID NO: 25350 - DNA, 20 bp, Artificial Sequence
  sgRNA
  Grik3_7
tcaggttcactcccgagtag

SEQ ID NO: 25351 - DNA, 20 bp, Artificial Sequence
  sgRNA
  Grik3_8
actgtcatcatagaccacgg

SEQ ID NO: 25352 - DNA, 20 bp, Artificial Sequence
  sgRNA
  Grik3_9
ttgttcttcaccagagccga

SEQ ID NO: 25353 - DNA, 20 bp, Artificial Sequence
  sgRNA
  Grik3_10
ttcactcccgagtagcggta

SEQ ID NO: 25354 - DNA, 20 bp, Artificial Sequence
  sgRNA
  Grik3_11
tctggatcccagactcgcgc

SEQ ID NO: 25355 - DNA, 20 bp, Artificial Sequence
  sgRNA
  Grik3_12
gtggaccgcgtcatagagca

SEQ ID NO: 25356 - DNA, 20 bp, Artificial Sequence
  sgRNA
  Grik3_13
tgcacacctttaatgaccga

SEQ ID NO: 25357 - DNA, 20 bp, Artificial Sequence
  sgRNA
  Grik3_14
gcttctccctcacctgccaa

SEQ ID NO: 25358 - DNA, 20 bp, Artificial Sequence
  sgRNA
  Grik3_15
gatgttggcagaaaatcgaa

SEQ ID NO: 25359 - DNA, 20 bp, Artificial Sequence
  sgRNA
  Grik3_16
ctgggcatccagaagatcgg

SEQ ID NO: 25360 - DNA, 20 bp, Artificial Sequence
  sgRNA
  Grik3_17
ctgtagctgcagaatggcga

SEQ ID NO: 25361 - DNA, 20 bp, Artificial Sequence
  sgRNA
  Grik3_18
ctacaacacccagtgccaac

SEQ ID NO: 25362 - DNA, 20 bp, Artificial Sequence
  sgRNA
  Grik3_19
tgtgatgtactctatggtag

SEQ ID NO: 25363 - DNA, 20 bp, Artificial Sequence
  sgRNA
  Grik3_20
gtataagatgctcactccaa

SEQ ID NO: 25364 - DNA, 20 bp, Artificial Sequence
  sgRNA
  Grik4_1
gtatcaaccgcgcaccagag

SEQ ID NO: 25365 - DNA, 20 bp, Artificial Sequence
  sgRNA
  Grik4_2
cagcgggtagacaaagctcg

SEQ ID NO: 25366 - DNA, 20 bp, Artificial Sequence
  sgRNA
  Grik4_3
agatgttggaggcgtagagg

SEQ ID NO: 25367 - DNA, 20 bp, Artificial Sequence
  sgRNA
  Grik4_4
gaacctgacaaattcctctg

SEQ ID NO: 25368 - DNA, 20 bp, Artificial Sequence
  sgRNA
  Grik4_5
ggttgaccaggagattacac

SEQ ID NO: 25369 - DNA, 20 bp, Artificial Sequence
  sgRNA
  Grik4_6
gttgatacggttcttggcca

SEQ ID NO: 25370 - DNA, 20 bp, Artificial Sequence
  sgRNA
  Grik4_7
tgttgactctatcatccaca

SEQ ID NO: 25371 - DNA, 20 bp, Artificial Sequence
  sgRNA
  Grik4_8
gctgcaggagaacaaccgcc

SEQ ID NO: 25372 - DNA, 20 bp, Artificial Sequence
  sgRNA
  Grik4_9
acaatatccatcccaggcgg

SEQ ID NO: 25373 - DNA, 20 bp, Artificial Sequence
  sgRNA
  Grik4_10
cctcatgaactaccttcgca

SEQ ID NO: 25374 - DNA, 20 bp, Artificial Sequence
  sgRNA
  Grik4_11
tgctgcatgaagcctccaac

SEQ ID NO: 25375 - DNA, 20 bp, Artificial Sequence
  sgRNA
  Grik4_12
aggacaatatccatcccagg

SEQ ID NO: 25376 - DNA, 20 bp, Artificial Sequence
  sgRNA
  Grik4_13
tccgcttcagaatttccagg

SEQ ID NO: 25377 - DNA, 20 bp, Artificial Sequence
  sgRNA
  Grik4_14
gtagttccacatgcgttggt

SEQ ID NO: 25378 - DNA, 20 bp, Artificial Sequence
  sgRNA
  Grik4_15
gtttgacgctgtctatgctg

SEQ ID NO: 25379 - DNA, 20 bp, Artificial Sequence
  sgRNA
  Grik4_16
ggcgggcctcaccatcacag

SEQ ID NO: 25380 - DNA, 20 bp, Artificial Sequence
  sgRNA
  Grik4_17
ccacacagaatccctcatat

SEQ ID NO: 25381 - DNA, 20 bp, Artificial Sequence
  sgRNA
  Grik4_18
ggaacggctctccatcaccc

SEQ ID NO: 25382 - DNA, 20 bp, Artificial Sequence
  sgRNA
  Grik4_19
gcgggtagacaaagctcgag

SEQ ID NO: 25383 - DNA, 20 bp, Artificial Sequence
  sgRNA
  Grik4_20
tgtgttcgtgaagagcacgg

SEQ ID NO: 25384 - DNA, 20 bp, Artificial Sequence
  sgRNA
  Grik5_1
ggaggagacccaccttacgg

SEQ ID NO: 25385 - DNA, 20 bp, Artificial Sequence
  sgRNA
  Grik5_2
agtatgacgggctgaccggg

SEQ ID NO: 25386 - DNA, 20 bp, Artificial Sequence
  sgRNA
  Grik5_3
tgggccggcgcataacatac

SEQ ID NO: 25387 - DNA, 20 bp, Artificial Sequence
  sgRNA
  Grik5_4
gctgcatgaagccacccacg

SEQ ID NO: 25388 - DNA, 20 bp, Artificial Sequence
  sgRNA
  Grik5_5
gctgtcatcaagcatcctca

SEQ ID NO: 25389 - DNA, 20 bp, Artificial Sequence
  sgRNA
  Grik5_6
tctttcggcaagacacggcg

SEQ ID NO: 25390 - DNA, 20 bp, Artificial Sequence
  sgRNA
  Grik5_7
ggacagccagtacgagacca

SEQ ID NO: 25391 - DNA, 20 bp, Artificial Sequence
  sgRNA
  Grik5_8
tggagttcatctggtccacg

SEQ ID NO: 25392 - DNA, 20 bp, Artificial Sequence
  sgRNA
  Grik5_9
gctgttgaactcaacccgcc

SEQ ID NO: 25393 - DNA, 20 bp, Artificial Sequence
  sgRNA
  Grik5_10
atgcctgtccaggaaccgtt

SEQ ID NO: 25394 - DNA, 20 bp, Artificial Sequence
  sgRNA
  Grik5_11
agaacccgtatgttatgcgc

SEQ ID NO: 25395 - DNA, 20 bp, Artificial Sequence
  sgRNA
  Grik5_12
ccttcaccatcaccgccgag

SEQ ID NO: 25396 - DNA, 20 bp, Artificial Sequence
  sgRNA
  Grik5_13
tcagggaatgagcgcttcga

SEQ ID NO: 25397 - DNA, 20 bp, Artificial Sequence
  sgRNA
  Grik5_14
ggactccgctgacctccgcg

SEQ ID NO: 25398 - DNA, 20 bp, Artificial Sequence
  sgRNA
  Grik5_15
gcgcttcgagggcttctgcg

SEQ ID NO: 25399 - DNA, 20 bp, Artificial Sequence
  sgRNA
  Grik5_16
gaaagacctcgcgttcccgc

SEQ ID NO: 25400 - DNA, 20 bp, Artificial Sequence
  sgRNA
  Grik5_17
catcctggagaagtcccgcc

SEQ ID NO: 25401 - DNA, 20 bp, Artificial Sequence
  sgRNA
  Grik5_18
gtgctcttgacaaacacgct

SEQ ID NO: 25402 - DNA, 20 bp, Artificial Sequence
  sgRNA
  Grik5_19
tacggcatcggcatgccgct

SEQ ID NO: 25403 - DNA, 20 bp, Artificial Sequence
  sgRNA
  Grik5_20
caacagcctctggttccccg

SEQ ID NO: 25404 - DNA, 20 bp, Artificial Sequence
  sgRNA
  Grin1_1
aacatcactgatccaccgcg

SEQ ID NO: 25405 - DNA, 20 bp, Artificial Sequence
  sgRNA
  Grin1_2
gtggacatctggtatcctcg

SEQ ID NO: 25406 - DNA, 20 bp, Artificial Sequence
  sgRNA
  Grin1_3
ctgtcctatgacaacaagcg

SEQ ID NO: 25407 - DNA, 20 bp, Artificial Sequence
  sgRNA
  Grin1_4
aaccaggccaataagcgaca

SEQ ID NO: 25408 - DNA, 20 bp, Artificial Sequence
  sgRNA
  Grin1_5
gcacgagcagatgttccgcg

SEQ ID NO: 25409 - DNA, 20 bp, Artificial Sequence
  sgRNA
  Grin1_6
agaacatcactgatccaccg

SEQ ID NO: 25410 - DNA, 20 bp, Artificial Sequence
  sgRNA
  Grin1_7
gtgttgcccacgcaaccccg

SEQ ID NO: 25411 - DNA, 20 bp, Artificial Sequence
  sgRNA
  Grin1_8
caagattgtcaacatcggcg

SEQ ID NO: 25412 - DNA, 20 bp, Artificial Sequence
  sgRNA
  Grin1_9
gtgggcttgacatacacgaa

SEQ ID NO: 25413 - DNA, 20 bp, Artificial Sequence
  sgRNA
  Grin1_10
ttcaccttaaatcggccaaa

SEQ ID NO: 25414 - DNA, 20 bp, Artificial Sequence
  sgRNA
  Grin1_11
acgagcagagaaactccggg

SEQ ID NO: 25415 - DNA, 20 bp, Artificial Sequence
  sgRNA
  Grin1_12
agcgacacaaggatgcccgt

SEQ ID NO: 25416 - DNA, 20 bp, Artificial Sequence
  sgRNA
  Grin1_13
gatcgcctacaagcgacaca

SEQ ID NO: 25417 - DNA, 20 bp, Artificial Sequence
  sgRNA
  Grin1_14
tccaagcccttcaagtacca

SEQ ID NO: 25418 - DNA, 20 bp, Artificial Sequence
  sgRNA
  Grin1_15
tggcctggtttactgcctcg

SEQ ID NO: 25419 - DNA, 20 bp, Artificial Sequence
  sgRNA
  Grin1_16
ccgatttaaggtgaacagcg

SEQ ID NO: 25420 - DNA, 20 bp, Artificial Sequence
  sgRNA
  Grin1_17
tccctctcaatagcgcgtcg

SEQ ID NO: 25421 - DNA, 20 bp, Artificial Sequence
  sgRNA
  Grin1_18
gccctgcgctacgctcctga

SEQ ID NO: 25422 - DNA, 20 bp, Artificial Sequence
  sgRNA
  Grin1_19
ctgtggatatctacttccgg

SEQ ID NO: 25423 - DNA, 20 bp, Artificial Sequence
  sgRNA
  Grin1_20
tgtgggcttgacatacacga

SEQ ID NO: 25424 - DNA, 20 bp, Artificial Sequence
  sgRNA
  Grin2a_1
atggtaaaagaaggcccatg

SEQ ID NO: 25425 - DNA, 20 bp, Artificial Sequence
  sgRNA
  Grin2a_2
agaagaaatcgtagccggtg

SEQ ID NO: 25426 - DNA, 20 bp, Artificial Sequence
  sgRNA
  Grin2a_3
atcttgacaaacttccgaca

SEQ ID NO: 25427 - DNA, 20 bp, Artificial Sequence
  sgRNA
  Grin2a_4
tgtgtgcgacctcatgtccg

SEQ ID NO: 25428 - DNA, 20 bp, Artificial Sequence
  sgRNA
  Grin2a_5
atgtcttctacgatgacgaa

SEQ ID NO: 25429 - DNA, 20 bp, Artificial Sequence
  sgRNA
  Grin2a_6
gcacgatcaccacaagcctg

SEQ ID NO: 25430 - DNA, 20 bp, Artificial Sequence
  sgRNA
  Grin2a_7
gtgcccgtccagaatcctaa

SEQ ID NO: 25431 - DNA, 20 bp, Artificial Sequence
  sgRNA
  Grin2a_8
ggtactgtcccaaatcggaa

SEQ ID NO: 25432 - DNA, 20 bp, Artificial Sequence
  sgRNA
  Grin2a_9
cattgggtactgtcccaaat

SEQ ID NO: 25433 - DNA, 20 bp, Artificial Sequence
  sgRNA
  Grin2a_10
ttaccattggaaaagctata

SEQ ID NO: 25434 - DNA, 20 bp, Artificial Sequence
  sgRNA
  Grin2a_11
gatcgtgctgaataaggacc

SEQ ID NO: 25435 - DNA, 20 bp, Artificial Sequence
  sgRNA
  Grin2a_12
gtaacttgcaaggaagatga

SEQ ID NO: 25436 - DNA, 20 bp, Artificial Sequence
  sgRNA
  Grin2a_13
gccaccacgttcacatccag

SEQ ID NO: 25437 - DNA, 20 bp, Artificial Sequence
  sgRNA
  Grin2a_14
gagactgaaatgagacccga

SEQ ID NO: 25438 - DNA, 20 bp, Artificial Sequence
  sgRNA
  Grin2a_15
ggctgtcctcatcctgagcg

SEQ ID NO: 25439 - DNA, 20 bp, Artificial Sequence
  sgRNA
  Grin2a_16
gttcacctatgacctctacc

SEQ ID NO: 25440 - DNA, 20 bp, Artificial Sequence
  sgRNA
  Grin2a_17
acccagacagaggcgctgaa

SEQ ID NO: 25441 - DNA, 20 bp, Artificial Sequence
  sgRNA
  Grin2a_18
tgaggctcttagggtcagtg

SEQ ID NO: 25442 - DNA, 20 bp, Artificial Sequence
  sgRNA
  Grin2a_19
tggagatgatacggaccaag

SEQ ID NO: 25443 - DNA, 20 bp, Artificial Sequence
  sgRNA
  Grin2a_20
catctccaaacaccaagcca

SEQ ID NO: 25444 - DNA, 20 bp, Artificial Sequence
  sgRNA
  Grin2b_1
tatcctacgcttgctccgaa

SEQ ID NO: 25445 - DNA, 20 bp, Artificial Sequence
  sgRNA
  Grin2b_2
ggcaccggttgtaacccaca

SEQ ID NO: 25446 - DNA, 20 bp, Artificial Sequence
  sgRNA
  Grin2b_3
acatcatggaagaatacgac

SEQ ID NO: 25447 - DNA, 20 bp, Artificial Sequence
  sgRNA
  Grin2b_4
tgactggctacggctacaca

SEQ ID NO: 25448 - DNA, 20 bp, Artificial Sequence
  sgRNA
  Grin2b_5
catagacagaggactcacgg

SEQ ID NO: 25449 - DNA, 20 bp, Artificial Sequence
  sgRNA
  Grin2b_6
gctcctctatagctactccg

SEQ ID NO: 25450 - DNA, 20 bp, Artificial Sequence
  sgRNA
  Grin2b_7
cctatcctcccaatccacat

SEQ ID NO: 25451 - DNA, 20 bp, Artificial Sequence
  sgRNA
  Grin2b_8
gtacctgtgcagaacccaaa

SEQ ID NO: 25452 - DNA, 20 bp, Artificial Sequence
  sgRNA
  Grin2b_9
tggccgttcggagcaagcgt

SEQ ID NO: 25453 - DNA, 20 bp, Artificial Sequence
  sgRNA
  Grin2b_10
agaatcggaacaaactgcgc

SEQ ID NO: 25454 - DNA, 20 bp, Artificial Sequence
  sgRNA
  Grin2b_11
cactaactatcaatgaagaa

SEQ ID NO: 25455 - DNA, 20 bp, Artificial Sequence
  sgRNA
  Grin2b_12
gcctaacaacaaaaacccca

SEQ ID NO: 25456 - DNA, 20 bp, Artificial Sequence
  sgRNA
  Grin2b_13
gcagcaccagctccattgat

SEQ ID NO: 25457 - DNA, 20 bp, Artificial Sequence
  sgRNA
  Grin2b_14
gtcacctatggcaacatcga

SEQ ID NO: 25458 - DNA, 20 bp, Artificial Sequence
  sgRNA
  Grin2b_15
ctccctcctagatttggccg

SEQ ID NO: 25459 - DNA, 20 bp, Artificial Sequence
  sgRNA
  Grin2b_16
acacagagatgagccccgtg

SEQ ID NO: 25460 - DNA, 20 bp, Artificial Sequence
  sgRNA
  Grin2b_17
ttcaagagtgaccgctacag

SEQ ID NO: 25461 - DNA, 20 bp, Artificial Sequence
  sgRNA
  Grin2b_18
gatcgtgccgagtctggtgg

SEQ ID NO: 25462 - DNA, 20 bp, Artificial Sequence
  sgRNA
  Grin2b_19
gagcatcgttaccttggagg

SEQ ID NO: 25463 - DNA, 20 bp, Artificial Sequence
  sgRNA
  Grin2b_20
tcgagggcaacgcagccaag

SEQ ID NO: 25464 - DNA, 20 bp, Artificial Sequence
  sgRNA
  Grin2c_1
gtggaatggtatgatcggtg

SEQ ID NO: 25465 - DNA, 20 bp, Artificial Sequence
  sgRNA
  Grin2c_2
cgccatgtagttgaggacgg

SEQ ID NO: 25466 - DNA, 20 bp, Artificial Sequence
  sgRNA
  Grin2c_3
gtttgtaatgtgcctcacgg

SEQ ID NO: 25467 - DNA, 20 bp, Artificial Sequence
  sgRNA
  Grin2c_4
ccagaatggctacaccgtcg

SEQ ID NO: 25468 - DNA, 20 bp, Artificial Sequence
  sgRNA
  Grin2c_5
ctacgccagaaagtccgcga

SEQ ID NO: 25469 - DNA, 20 bp, Artificial Sequence
  sgRNA
  Grin2c_6
catctacagctgcttcaacg

SEQ ID NO: 25470 - DNA, 20 bp, Artificial Sequence
  sgRNA
  Grin2c_7
gattggccgtgtagctagcg

SEQ ID NO: 25471 - DNA, 20 bp, Artificial Sequence
  sgRNA
  Grin2c_8
gcaggcacgcttgggatgcg

SEQ ID NO: 25472 - DNA, 20 bp, Artificial Sequence
  sgRNA
  Grin2c_9
gctggaccaggtacccacca

SEQ ID NO: 25473 - DNA, 20 bp, Artificial Sequence
  sgRNA
  Grin2c_10
gcttcggcagtctccagccg

SEQ ID NO: 25474 - DNA, 20 bp, Artificial Sequence
  sgRNA
  Grin2c_11
tgtttgagccacgtgccggc

SEQ ID NO: 25475 - DNA, 20 bp, Artificial Sequence
  sgRNA
  Grin2c_12
gttcccatcgagaacccccg

SEQ ID NO: 25476 - DNA, 20 bp, Artificial Sequence
  sgRNA
  Grin2c_13
agagccttccgagccctgcg

SEQ ID NO: 25477 - DNA, 20 bp, Artificial Sequence
  sgRNA
  Grin2c_14
cattaggtaccgtgccaaaa

SEQ ID NO: 25478 - DNA, 20 bp, Artificial Sequence
  sgRNA
  Grin2c_15
gcatcctcacccaaatctgt

SEQ ID NO: 25479 - DNA, 20 bp, Artificial Sequence
  sgRNA
  Grin2c_16
gctgcaagctggtcaccatt

SEQ ID NO: 25480 - DNA, 20 bp, Artificial Sequence
  sgRNA
  Grin2c_17
ggcggaggtgctcttcgcgg

SEQ ID NO: 25481 - DNA, 20 bp, Artificial Sequence
  sgRNA
  Grin2c_18
tctcgatggtacgagtggcg

SEQ ID NO: 25482 - DNA, 20 bp, Artificial Sequence
  sgRNA
  Grin2c_19
gtacctggtccagcccacaa

SEQ ID NO: 25483 - DNA, 20 bp, Artificial Sequence
  sgRNA
  Grin2c_20
tgtcctcaaagacgatgccg

SEQ ID NO: 25484 - DNA, 20 bp, Artificial Sequence
  sgRNA
  Grin2d_1
agccttcttgtcatacatcg

SEQ ID NO: 25485 - DNA, 20 bp, Artificial Sequence
  sgRNA
  Grin2d_2
ccagaatcgcacccaccgcg

SEQ ID NO: 25486 - DNA, 20 bp, Artificial Sequence
  sgRNA
  Grin2d_3
ccaggtgttctatcagcgtg

SEQ ID NO: 25487 - DNA, 20 bp, Artificial Sequence
  sgRNA
  Grin2d_4
ggcaccgttccaaacttcag

SEQ ID NO: 25488 - DNA, 20 bp, Artificial Sequence
  sgRNA
  Grin2d_5
gtgccagtggagaatcctcg

SEQ ID NO: 25489 - DNA, 20 bp, Artificial Sequence
  sgRNA
  Grin2d_6
gctcaactacatggcccgaa

SEQ ID NO: 25490 - DNA, 20 bp, Artificial Sequence
  sgRNA
  Grin2d_7
gttcgtcatgtgcctcaccg

SEQ ID NO: 25491 - DNA, 20 bp, Artificial Sequence
  sgRNA
  Grin2d_8
caggtcctccagcgaacgcg

SEQ ID NO: 25492 - DNA, 20 bp, Artificial Sequence
  sgRNA
  Grin2d_9
tcagaacgcggccagcgcga

SEQ ID NO: 25493 - DNA, 20 bp, Artificial Sequence
  sgRNA
  Grin2d_10
gtagtatcggtggaagccgt

SEQ ID NO: 25494 - DNA, 20 bp, Artificial Sequence
  sgRNA
  Grin2d_11
gctcttctgcgcccgcgagg

SEQ ID NO: 25495 - DNA, 20 bp, Artificial Sequence
  sgRNA
  Grin2d_12
acatcatcacccacacagcg

SEQ ID NO: 25496 - DNA, 20 bp, Artificial Sequence
  sgRNA
  Grin2d_13
catctcagctgctcgcacga

SEQ ID NO: 25497 - DNA, 20 bp, Artificial Sequence
  sgRNA
  Grin2d_14
tgacgacttggcacgtcgag

SEQ ID NO: 25498 - DNA, 20 bp, Artificial Sequence
  sgRNA
  Grin2d_15
ggatacgccggactgggcag

SEQ ID NO: 25499 - DNA, 20 bp, Artificial Sequence
  sgRNA
  Grin2d_16
tcgcacgacggcctagacgg

SEQ ID NO: 25500 - DNA, 20 bp, Artificial Sequence
  sgRNA
  Grin2d_17
gcatcttagcggggccccga

SEQ ID NO: 25501 - DNA, 20 bp, Artificial Sequence
  sgRNA
  Grin2d_18
gcagcaacagcatcttagcg

SEQ ID NO: 25502 - DNA, 20 bp, Artificial Sequence
  sgRNA
  Grin2d_19
tatggcatcgccctacacaa

SEQ ID NO: 25503 - DNA, 20 bp, Artificial Sequence
  sgRNA
  Grin2d_20
gacggcttccaccgatacta

SEQ ID NO: 25504 - DNA, 20 bp, Artificial Sequence
  sgRNA
  Grin3a_1
ccccttgtaccactacggtg

SEQ ID NO: 25505 - DNA, 20 bp, Artificial Sequence
  sgRNA
  Grin3a_2
tgatgttgatgatagactcg

SEQ ID NO: 25506 - DNA, 20 bp, Artificial Sequence
  sgRNA
  Grin3a_3
ctttaggagtcataccaaag

SEQ ID NO: 25507 - DNA, 20 bp, Artificial Sequence
  sgRNA
  Grin3a_4
aaacaagttacacttgagag

SEQ ID NO: 25508 - DNA, 20 bp, Artificial Sequence
  sgRNA
  Grin3a_5
ccatgagcaatgagccctaa

SEQ ID NO: 25509 - DNA, 20 bp, Artificial Sequence
  sgRNA
  Grin3a_6
cctttaggagtcataccaaa

SEQ ID NO: 25510 - DNA, 20 bp, Artificial Sequence
  sgRNA
  Grin3a_7
tagtgcgccacgagtttccg

SEQ ID NO: 25511 - DNA, 20 bp, Artificial Sequence
  sgRNA
  Grin3a_8
gcaaagcttctctttccgca

SEQ ID NO: 25512 - DNA, 20 bp, Artificial Sequence
  sgRNA
  Grin3a_9
cctcaagcgcatcggacacg

SEQ ID NO: 25513 - DNA, 20 bp, Artificial Sequence
  sgRNA
  Grin3a_10
gcagtgctgaggactatgta

SEQ ID NO: 25514 - DNA, 20 bp, Artificial Sequence
  sgRNA
  Grin3a_11
gcacttgcaaccctggacca

SEQ ID NO: 25515 - DNA, 20 bp, Artificial Sequence
  sgRNA
  Grin3a_12
gcgaacagtagggcatcccg

SEQ ID NO: 25516 - DNA, 20 bp, Artificial Sequence
  sgRNA
  Grin3a_13
ggaccttctaagtttcctgc

SEQ ID NO: 25517 - DNA, 20 bp, Artificial Sequence
  sgRNA
  Grin3a_14
gatgagctcagatatgttag

SEQ ID NO: 25518 - DNA, 20 bp, Artificial Sequence
  sgRNA
  Grin3a_15
ccagctccatcatttcgccc

SEQ ID NO: 25519 - DNA, 20 bp, Artificial Sequence
  sgRNA
  Grin3a_16
cctttggtatgactcctaaa

SEQ ID NO: 25520 - DNA, 20 bp, Artificial Sequence
  sgRNA
  Grin3a_17
ccatcactacttccaaagac

SEQ ID NO: 25521 - DNA, 20 bp, Artificial Sequence
  sgRNA
  Grin3a_18
atgcgcttgaggatctggca

SEQ ID NO: 25522 - DNA, 20 bp, Artificial Sequence
  sgRNA
  Grin3a_19
tgttgatgatagactcgagg

SEQ ID NO: 25523 - DNA, 20 bp, Artificial Sequence
  sgRNA
  Grin3a_20
gcagatccaagtgatccgcc

SEQ ID NO: 25524 - DNA, 20 bp, Artificial Sequence
  sgRNA
  Grin3b_1
ttcatgaggaagcgtccggt

SEQ ID NO: 25525 - DNA, 20 bp, Artificial Sequence
  sgRNA
  Grin3b_2
caaggtatggagcttacgca

SEQ ID NO: 25526 - DNA, 20 bp, Artificial Sequence
  sgRNA
  Grin3b_3
acacccatttgtgttcacca

SEQ ID NO: 25527 - DNA, 20 bp, Artificial Sequence
  sgRNA
  Grin3b_4
ctataacctttcccgaggcg

SEQ ID NO: 25528 - DNA, 20 bp, Artificial Sequence
  sgRNA
  Grin3b_5
ttattgcccctgcggatgcg

SEQ ID NO: 25529 - DNA, 20 bp, Artificial Sequence
  sgRNA
  Grin3b_6
gtaccacggttgcggccgcg

SEQ ID NO: 25530 - DNA, 20 bp, Artificial Sequence
  sgRNA
  Grin3b_7
tgtccagcgtccatcacgca

SEQ ID NO: 25531 - DNA, 20 bp, Artificial Sequence
  sgRNA
  Grin3b_8
atagaggccaccacgccggg

SEQ ID NO: 25532 - DNA, 20 bp, Artificial Sequence
  sgRNA
  Grin3b_9
gcgaacacccgcttcccgca

SEQ ID NO: 25533 - DNA, 20 bp, Artificial Sequence
  sgRNA
  Grin3b_10
gagattcatgaggaagcgtc

SEQ ID NO: 25534 - DNA, 20 bp, Artificial Sequence
  sgRNA
  Grin3b_11
tgtgaggacctgaaaacggg

SEQ ID NO: 25535 - DNA, 20 bp, Artificial Sequence
  sgRNA
  Grin3b_12
ggccacatgaaagccccaat

SEQ ID NO: 25536 - DNA, 20 bp, Artificial Sequence
  sgRNA
  Grin3b_13
gcgccgttcccgttccacca

SEQ ID NO: 25537 - DNA, 20 bp, Artificial Sequence
  sgRNA
  Grin3b_14
gatcgcaaagggtttgccca

SEQ ID NO: 25538 - DNA, 20 bp, Artificial Sequence
  sgRNA
  Grin3b_15
gcagggccagtgtagcccga

SEQ ID NO: 25539 - DNA, 20 bp, Artificial Sequence
  sgRNA
  Grin3b_16
ccgtaggacgctcagcaccg

SEQ ID NO: 25540 - DNA, 20 bp, Artificial Sequence
  sgRNA
  Grin3b_17
ggtgctgagcgtcctacgga

SEQ ID NO: 25541 - DNA, 20 bp, Artificial Sequence
  sgRNA
  Grin3b_18
tgtgtgcccgaccggccagc

SEQ ID NO: 25542 - DNA, 20 bp, Artificial Sequence
  sgRNA
  Grin3b_19
tgagcacgtcttctaccgcc

SEQ ID NO: 25543 - DNA, 20 bp, Artificial Sequence
  sgRNA
  Grin3b_20
gcttccgctttggcaccgtg

SEQ ID NO: 25544 - DNA, 20 bp, Artificial Sequence
  sgRNA
  Grm1_1
gggtgacaaatagcgtcacg

SEQ ID NO: 25545 - DNA, 20 bp, Artificial Sequence
  sgRNA
  Grm1_2
tagtgtacagctgacactag

SEQ ID NO: 25546 - DNA, 20 bp, Artificial Sequence
  sgRNA
  Grm1_3
actctcccacgacgccaagg

SEQ ID NO: 25547 - DNA, 20 bp, Artificial Sequence
  sgRNA
  Grm1_4
agataagattaatgcggacc

SEQ ID NO: 25548 - DNA, 20 bp, Artificial Sequence
  sgRNA
  Grm1_5
tgaaagggcatacgtagccg

SEQ ID NO: 25549 - DNA, 20 bp, Artificial Sequence
  sgRNA
  Grm1_6
gcgagggcatgacagtgcgg

SEQ ID NO: 25550 - DNA, 20 bp, Artificial Sequence
  sgRNA
  Grm1_7
agaagtccgttgtaacccac

SEQ ID NO: 25551 - DNA, 20 bp, Artificial Sequence
  sgRNA
  Grm1_8
gatgccatgaagcccattga

SEQ ID NO: 25552 - DNA, 20 bp, Artificial Sequence
  sgRNA
  Grm1_9
ggttgtggtctgcttctgcg

SEQ ID NO: 25553 - DNA, 20 bp, Artificial Sequence
  sgRNA
  Grm1_10
ttactatccgttacctcgag

SEQ ID NO: 25554 - DNA, 20 bp, Artificial Sequence
  sgRNA
  Grm1_11
gcagctgagcaccttccgag

SEQ ID NO: 25555 - DNA, 20 bp, Artificial Sequence
  sgRNA
  Grm1_12
ggtggaagacaggcgcccaa

SEQ ID NO: 25556 - DNA, 20 bp, Artificial Sequence
  sgRNA
  Grm1_13
gtcggtgcaccaccatggaa

SEQ ID NO: 25557 - DNA, 20 bp, Artificial Sequence
  sgRNA
  Grm1_14
gatgtagtgcgcatgcacgt

SEQ ID NO: 25558 - DNA, 20 bp, Artificial Sequence
  sgRNA
  Grm1_15
gatggccagaccctaccccc

SEQ ID NO: 25559 - DNA, 20 bp, Artificial Sequence
  sgRNA
  Grm1_16
gcagaagcagaccacaaccc

SEQ ID NO: 25560 - DNA, 20 bp, Artificial Sequence
  sgRNA
  Grm1_17
gttgtggtctgcttctgcga

SEQ ID NO: 25561 - DNA, 20 bp, Artificial Sequence
  sgRNA
  Grm1_18
catcaacgccatctatgcca

SEQ ID NO: 25562 - DNA, 20 bp, Artificial Sequence
  sgRNA
  Grm1_19
gctcatacacgaactcctgc

SEQ ID NO: 25563 - DNA, 20 bp, Artificial Sequence
  sgRNA
  Grm1_20
cgtgccggccaatttcaatg

SEQ ID NO: 25564 - DNA, 20 bp, Artificial Sequence
  sgRNA
  Grm2_1
cccagcagataccgacgacg

SEQ ID NO: 25565 - DNA, 20 bp, Artificial Sequence
  sgRNA
  Grm2_2
ctggacgtatgtgtctacgg

SEQ ID NO: 25566 - DNA, 20 bp, Artificial Sequence
  sgRNA
  Grm2_3
ccgtggcatacagcgcctag

SEQ ID NO: 25567 - DNA, 20 bp, Artificial Sequence
  sgRNA
  Grm2_4
ccccaggagtacatccgctg

SEQ ID NO: 25568 - DNA, 20 bp, Artificial Sequence
  sgRNA
  Grm2_5
gtagcaaagctcccgccccg

SEQ ID NO: 25569 - DNA, 20 bp, Artificial Sequence
  sgRNA
  Grm2_6
gaggcgggactgatgaagcg

SEQ ID NO: 25570 - DNA, 20 bp, Artificial Sequence
  sgRNA
  Grm2_7
catcgctcgcatctttggcg

SEQ ID NO: 25571 - DNA, 20 bp, Artificial Sequence
  sgRNA
  Grm2_8
tcagccctatgagtacaggc

SEQ ID NO: 25572 - DNA, 20 bp, Artificial Sequence
  sgRNA
  Grm2_9
ggacctgttaatgagcaccg

SEQ ID NO: 25573 - DNA, 20 bp, Artificial Sequence
  sgRNA
  Grm2_10
tcgggcacgcaacatctgcg

SEQ ID NO: 25574 - DNA, 20 bp, Artificial Sequence
  sgRNA
  Grm2_11
gatgctcccacagctatcac

SEQ ID NO: 25575 - DNA, 20 bp, Artificial Sequence
  sgRNA
  Grm2_12
tgggcgctatcgctaccaga

SEQ ID NO: 25576 - DNA, 20 bp, Artificial Sequence
  sgRNA
  Grm2_13
gaggcgccttaaggtgcaga

SEQ ID NO: 25577 - DNA, 20 bp, Artificial Sequence
  sgRNA
  Grm2_14
gtaggagccgccaatgacac

SEQ ID NO: 25578 - DNA, 20 bp, Artificial Sequence
  sgRNA
  Grm2_15
caagcatgcttgcgtcacgg

SEQ ID NO: 25579 - DNA, 20 bp, Artificial Sequence
  sgRNA
  Grm2_16
gcagggctcgctacagcgag

SEQ ID NO: 25580 - DNA, 20 bp, Artificial Sequence
  sgRNA
  Grm2_17
gtgcccggagaacttcaacg

SEQ ID NO: 25581 - DNA, 20 bp, Artificial Sequence
  sgRNA
  Grm2_18
gtcaaagcggacctcgtcgt

SEQ ID NO: 25582 - DNA, 20 bp, Artificial Sequence
  sgRNA
  Grm2_19
gtgtctacggtggcatctga

SEQ ID NO: 25583 - DNA, 20 bp, Artificial Sequence
  sgRNA
  Grm2_20
acgtcacctccagtgattat

SEQ ID NO: 25584 - DNA, 20 bp, Artificial Sequence
  sgRNA
  Grm3_1
ctcacggatcacgctgtcgt

SEQ ID NO: 25585 - DNA, 20 bp, Artificial Sequence
  sgRNA
  Grm3_2
ggtattcatagggctcacat

SEQ ID NO: 25586 - DNA, 20 bp, Artificial Sequence
  sgRNA
  Grm3_3
cagaggtatccaacgcctgg

SEQ ID NO: 25587 - DNA, 20 bp, Artificial Sequence
  sgRNA
  Grm3_4
tgactcctgcaatgagtagt

SEQ ID NO: 25588 - DNA, 20 bp, Artificial Sequence
  sgRNA
  Grm3_5
acaacaatcatcgtaacccc

SEQ ID NO: 25589 - DNA, 20 bp, Artificial Sequence
  sgRNA
  Grm3_6
tatgtcccgacagtgtgcaa

SEQ ID NO: 25590 - DNA, 20 bp, Artificial Sequence
  sgRNA
  Grm3_7
tttgcaccagtatcaaaccc

SEQ ID NO: 25591 - DNA, 20 bp, Artificial Sequence
  sgRNA
  Grm3_8
aggtgaaggaagcattcacg

SEQ ID NO: 25592 - DNA, 20 bp, Artificial Sequence
  sgRNA
  Grm3_9
gcatcgctcgcatctttgat

SEQ ID NO: 25593 - DNA, 20 bp, Artificial Sequence
  sgRNA
  Grm3_10
cgtgaatgcttccttcacct

SEQ ID NO: 25594 - DNA, 20 bp, Artificial Sequence
  sgRNA
  Grm3_11
gatctctctgacctatgacg

SEQ ID NO: 25595 - DNA, 20 bp, Artificial Sequence
  sgRNA
  Grm3_12
tttgtcgctgagtttggcac

SEQ ID NO: 25596 - DNA, 20 bp, Artificial Sequence
  sgRNA
  Grm3_13
aatgcacagatgacaggcga

SEQ ID NO: 25597 - DNA, 20 bp, Artificial Sequence
  sgRNA
  Grm3_14
ggtgaatgcagtgtatgcca

SEQ ID NO: 25598 - DNA, 20 bp, Artificial Sequence
  sgRNA
  Grm3_15
gggtcaagaatggcgctcag

SEQ ID NO: 25599 - DNA, 20 bp, Artificial Sequence
  sgRNA
  Grm3_16
tgaataacagatggcaaagg

SEQ ID NO: 25600 - DNA, 20 bp, Artificial Sequence
  sgRNA
  Grm3_17
gctccattcaacccaaataa

SEQ ID NO: 25601 - DNA, 20 bp, Artificial Sequence
  sgRNA
  Grm3_18
gatgcaatgaagatcctgga

SEQ ID NO: 25602 - DNA, 20 bp, Artificial Sequence
  sgRNA
  Grm3_19
tgcaggtgaactcatcaacc

SEQ ID NO: 25603 - DNA, 20 bp, Artificial Sequence
  sgRNA
  Grm3_20
tggatgctacaaccttccag

SEQ ID NO: 25604 - DNA, 20 bp, Artificial Sequence
  sgRNA
  Grm4_1
tgggtgtcatcggagcttcg

SEQ ID NO: 25605 - DNA, 20 bp, Artificial Sequence
  sgRNA
  Grm4_2
gtggaactatgtgtccacgc

SEQ ID NO: 25606 - DNA, 20 bp, Artificial Sequence
  sgRNA
  Grm4_3
ttcgagggcagagtcctacg

SEQ ID NO: 25607 - DNA, 20 bp, Artificial Sequence
  sgRNA
  Grm4_4
cctactgcccaacatcacgt

SEQ ID NO: 25608 - DNA, 20 bp, Artificial Sequence
  sgRNA
  Grm4_5
acgagaacggagacgcgcca

SEQ ID NO: 25609 - DNA, 20 bp, Artificial Sequence
  sgRNA
  Grm4_6
gtaccaacgtcgcaacggct

SEQ ID NO: 25610 - DNA, 20 bp, Artificial Sequence
  sgRNA
  Grm4_7
actcggcctacgaacaggag

SEQ ID NO: 25611 - DNA, 20 bp, Artificial Sequence
  sgRNA
  Grm4_8
atacggatagagttcatgtg

SEQ ID NO: 25612 - DNA, 20 bp, Artificial Sequence
  sgRNA
  Grm4_9
taccagtaccaacgtcgcaa

SEQ ID NO: 25613 - DNA, 20 bp, Artificial Sequence
  sgRNA
  Grm4_10
tccacgggaacccaagaccg

SEQ ID NO: 25614 - DNA, 20 bp, Artificial Sequence
  sgRNA
  Grm4_11
catccacagggtccattcga

SEQ ID NO: 25615 - DNA, 20 bp, Artificial Sequence
  sgRNA
  Grm4_12
cgttcaggcttggtgatgat

SEQ ID NO: 25616 - DNA, 20 bp, Artificial Sequence
  sgRNA
  Grm4_13
catcgagaaggacggcacgg

SEQ ID NO: 25617 - DNA, 20 bp, Artificial Sequence
  sgRNA
  Grm4_14
gcctgttgttgtcaagcgtg

SEQ ID NO: 25618 - DNA, 20 bp, Artificial Sequence
  sgRNA
  Grm4_15
gcagctcgtgcggttctccg

SEQ ID NO: 25619 - DNA, 20 bp, Artificial Sequence
  sgRNA
  Grm4_16
gggcatgtagagcatcccca

SEQ ID NO: 25620 - DNA, 20 bp, Artificial Sequence
  sgRNA
  Grm4_17
ggaggcctgtttcccgtcca

SEQ ID NO: 25621 - DNA, 20 bp, Artificial Sequence
  sgRNA
  Grm4_18
ctttgagcagggcaagcggt

SEQ ID NO: 25622 - DNA, 20 bp, Artificial Sequence
  sgRNA
  Grm4_19
gcaggactcggcctacgaac

SEQ ID NO: 25623 - DNA, 20 bp, Artificial Sequence
  sgRNA
  Grm4_20
gctcatcgagaaggacggca

SEQ ID NO: 25624 - DNA, 20 bp, Artificial Sequence
  sgRNA
  Grm5_1
tagtcatgcattatatccgg

SEQ ID NO: 25625 - DNA, 20 bp, Artificial Sequence
  sgRNA
  Grm5_2
gtacctgtcaagtcgtcagt

SEQ ID NO: 25626 - DNA, 20 bp, Artificial Sequence
  sgRNA
  Grm5_3
gaccgatgccaattctctga

SEQ ID NO: 25627 - DNA, 20 bp, Artificial Sequence
  sgRNA
  Grm5_4
aaatggatgatgatgaagtg

SEQ ID NO: 25628 - DNA, 20 bp, Artificial Sequence
  sgRNA
  Grm5_5
aataatccattgtatccaag

SEQ ID NO: 25629 - DNA, 20 bp, Artificial Sequence
  sgRNA
  Grm5_6
tcatttacctaaagcccggg

SEQ ID NO: 25630 - DNA, 20 bp, Artificial Sequence
  sgRNA
  Grm5_7
ttgtaacaccaccaacctag

SEQ ID NO: 25631 - DNA, 20 bp, Artificial Sequence
  sgRNA
  Grm5_8
ccggccatcgaggtgaccgg

SEQ ID NO: 25632 - DNA, 20 bp, Artificial Sequence
  sgRNA
  Grm5_9
gcgaaggtcgtcatggtcgt

SEQ ID NO: 25633 - DNA, 20 bp, Artificial Sequence
  sgRNA
  Grm5_10
gctgctggatctgctggcag

SEQ ID NO: 25634 - DNA, 20 bp, Artificial Sequence
  sgRNA
  Grm5_11
ggcgctttatgatgtcgcag

SEQ ID NO: 25635 - DNA, 20 bp, Artificial Sequence
  sgRNA
  Grm5_12
tgttccagccaactttaacg

SEQ ID NO: 25636 - DNA, 20 bp, Artificial Sequence
  sgRNA
  Grm5_13
cctccggtcacctcgatggc

SEQ ID NO: 25637 - DNA, 20 bp, Artificial Sequence
  sgRNA
  Grm5_14
tctattcaagtacttcatga

SEQ ID NO: 25638 - DNA, 20 bp, Artificial Sequence
  sgRNA
  Grm5_15
gcaggatgcacagcgacagg

SEQ ID NO: 25639 - DNA, 20 bp, Artificial Sequence
  sgRNA
  Grm5_16
tggcccactgacgacttgac

SEQ ID NO: 25640 - DNA, 20 bp, Artificial Sequence
  sgRNA
  Grm5_17
cctgcccaagagacgcccgc

SEQ ID NO: 25641 - DNA, 20 bp, Artificial Sequence
  sgRNA
  Grm5_18
gcgctgcgcacatttctctc

SEQ ID NO: 25642 - DNA, 20 bp, Artificial Sequence
  sgRNA
  Grm5_19
tccagtctcctgatgtcaag

SEQ ID NO: 25643 - DNA, 20 bp, Artificial Sequence
  sgRNA
  Grm5_20
gcacgcagcagctcatccca

SEQ ID NO: 25644 - DNA, 20 bp, Artificial Sequence
  sgRNA
  Grm6_1
attctcattgaacatcactg

SEQ ID NO: 25645 - DNA, 20 bp, Artificial Sequence
  sgRNA
  Grm6_2
ggagtcaggaggcaccactc

SEQ ID NO: 25646 - DNA, 20 bp, Artificial Sequence
  sgRNA
  Grm6_3
ccggtgtgcgactaggcgcg

SEQ ID NO: 25647 - DNA, 20 bp, Artificial Sequence
  sgRNA
  Grm6_4
gtggtcaggcgacccccatg

SEQ ID NO: 25648 - DNA, 20 bp, Artificial Sequence
  sgRNA
  Grm6_5
gggcacatagagcatgccga

SEQ ID NO: 25649 - DNA, 20 bp, Artificial Sequence
  sgRNA
  Grm6_6
tagtcaatcacgctgtgtgg

SEQ ID NO: 25650 - DNA, 20 bp, Artificial Sequence
  sgRNA
  Grm6_7
ctatgacttcttctcccgag

SEQ ID NO: 25651 - DNA, 20 bp, Artificial Sequence
  sgRNA
  Grm6_8
gaagatgtcatagcgcccgg

SEQ ID NO: 25652 - DNA, 20 bp, Artificial Sequence
  sgRNA
  Grm6_9
gcctcctgaacgcgtcgtgg

SEQ ID NO: 25653 - DNA, 20 bp, Artificial Sequence
  sgRNA
  Grm6_10
tgattgactatgaggaacag

SEQ ID NO: 25654 - DNA, 20 bp, Artificial Sequence
  sgRNA
  Grm6_11
cgtagagcatcgcctccagc

SEQ ID NO: 25655 - DNA, 20 bp, Artificial Sequence
  sgRNA
  Grm6_12
actccacctatgaacaggag

SEQ ID NO: 25656 - DNA, 20 bp, Artificial Sequence
  sgRNA
  Grm6_13
gggcaactatggtgaaagcg

SEQ ID NO: 25657 - DNA, 20 bp, Artificial Sequence
  sgRNA
  Grm6_14
ctacgccatcaccttcctca

SEQ ID NO: 25658 - DNA, 20 bp, Artificial Sequence
  sgRNA
  Grm6_15
ggtggaccctgagcaagcca

SEQ ID NO: 25659 - DNA, 20 bp, Artificial Sequence
  sgRNA
  Grm6_16
tctgagttctcgctcttggg

SEQ ID NO: 25660 - DNA, 20 bp, Artificial Sequence
  sgRNA
  Grm6_17
tcgcagctagtcatcacctt

SEQ ID NO: 25661 - DNA, 20 bp, Artificial Sequence
  sgRNA
  Grm6_18
gccagtcagatgattccacc

SEQ ID NO: 25662 - DNA, 20 bp, Artificial Sequence
  sgRNA
  Grm6_19
taagctcacggccagaggcg

SEQ ID NO: 25663 - DNA, 20 bp, Artificial Sequence
  sgRNA
  Grm6_20
gctgtgcagagcatgagcga

SEQ ID NO: 25664 - DNA, 20 bp, Artificial Sequence
  sgRNA
  Grm7_1
tccgttggtgcaacgcacgt

SEQ ID NO: 25665 - DNA, 20 bp, Artificial Sequence
  sgRNA
  Grm7_2
tgatactggtatccatcaca

SEQ ID NO: 25666 - DNA, 20 bp, Artificial Sequence
  sgRNA
  Grm7_3
ccaacctaagagagcgactg

SEQ ID NO: 25667 - DNA, 20 bp, Artificial Sequence
  sgRNA
  Grm7_4
gccctgcggcgacatcaaga

SEQ ID NO: 25668 - DNA, 20 bp, Artificial Sequence
  sgRNA
  Grm7_5
gcactcgatccggatcgagg

SEQ ID NO: 25669 - DNA, 20 bp, Artificial Sequence
  sgRNA
  Grm7_6
gaatatgcgataaatccgat

SEQ ID NO: 25670 - DNA, 20 bp, Artificial Sequence
  sgRNA
  Grm7_7
ccaacgtaacgttaggcgcg

SEQ ID NO: 25671 - DNA, 20 bp, Artificial Sequence
  sgRNA
  Grm7_8
ctctggcttgacgaaaaccg

SEQ ID NO: 25672 - DNA, 20 bp, Artificial Sequence
  sgRNA
  Grm7_9
gtgcacgccaagggtcccag

SEQ ID NO: 25673 - DNA, 20 bp, Artificial Sequence
  sgRNA
  Grm7_10
cttggacacccccaactcca

SEQ ID NO: 25674 - DNA, 20 bp, Artificial Sequence
  sgRNA
  Grm7_11
gttggtgcaacgcacgtcgg

SEQ ID NO: 25675 - DNA, 20 bp, Artificial Sequence
  sgRNA
  Grm7_12
ctatgacttcttctctcgcg

SEQ ID NO: 25676 - DNA, 20 bp, Artificial Sequence
  sgRNA
  Grm7_13
tgtacactctttcttactgg

SEQ ID NO: 25677 - DNA, 20 bp, Artificial Sequence
  sgRNA
  Grm7_14
ccatcgtcagggcatctggg

SEQ ID NO: 25678 - DNA, 20 bp, Artificial Sequence
  sgRNA
  Grm7_15
gatctgtgtgctgactaccg

SEQ ID NO: 25679 - DNA, 20 bp, Artificial Sequence
  sgRNA
  Grm7_16
ctcgatccggatcgagtgcg

SEQ ID NO: 25680 - DNA, 20 bp, Artificial Sequence
  sgRNA
  Grm7_17
cgatgggtgtatcattgtag

SEQ ID NO: 25681 - DNA, 20 bp, Artificial Sequence
  sgRNA
  Grm7_18
acttcatcaaagtcaggacg

SEQ ID NO: 25682 - DNA, 20 bp, Artificial Sequence
  sgRNA
  Grm7_19
gatcctggacacttgttcca

SEQ ID NO: 25683 - DNA, 20 bp, Artificial Sequence
  sgRNA
  Grm7_20
tccctcttgatgtcgccgca

SEQ ID NO: 25684 - DNA, 20 bp, Artificial Sequence
  sgRNA
  Grm8_1
atggaattatgtgtcaacac

SEQ ID NO: 25685 - DNA, 20 bp, Artificial Sequence
  sgRNA
  Grm8_2
ggcaaaggcctatgtaacca

SEQ ID NO: 25686 - DNA, 20 bp, Artificial Sequence
  sgRNA
  Grm8_3
gatgcaaattaggatcacat

SEQ ID NO: 25687 - DNA, 20 bp, Artificial Sequence
  sgRNA
  Grm8_4
ctggtcgattgcataaagca

SEQ ID NO: 25688 - DNA, 20 bp, Artificial Sequence
  sgRNA
  Grm8_5
cgagggttataactaccagg

SEQ ID NO: 25689 - DNA, 20 bp, Artificial Sequence
  sgRNA
  Grm8_6
gtatgcgcattccatccgcc

SEQ ID NO: 25690 - DNA, 20 bp, Artificial Sequence
  sgRNA
  Grm8_7
tgacacataattccatccca

SEQ ID NO: 25691 - DNA, 20 bp, Artificial Sequence
  sgRNA
  Grm8_8
tggcactgtgaacgctgcga

SEQ ID NO: 25692 - DNA, 20 bp, Artificial Sequence
  sgRNA
  Grm8_9
ggccttcactcagatctcaa

SEQ ID NO: 25693 - DNA, 20 bp, Artificial Sequence
  sgRNA
  Grm8_10
gctcgaatattcggtggata

SEQ ID NO: 25694 - DNA, 20 bp, Artificial Sequence
  sgRNA
  Grm8_11
tagtgactgctccaaagcat

SEQ ID NO: 25695 - DNA, 20 bp, Artificial Sequence
  sgRNA
  Grm8_12
ctccaggtcttggttcacgt

SEQ ID NO: 25696 - DNA, 20 bp, Artificial Sequence
  sgRNA
  Grm8_13
caatcgtgagagcttctggg

SEQ ID NO: 25697 - DNA, 20 bp, Artificial Sequence
  sgRNA
  Grm8_14
gggatacagtatcctcctga

SEQ ID NO: 25698 - DNA, 20 bp, Artificial Sequence
  sgRNA
  Grm8_15
ttagttatgtgctcctaacg

SEQ ID NO: 25699 - DNA, 20 bp, Artificial Sequence
  sgRNA
  Grm8_16
tcccttgctcgaatattcgg

SEQ ID NO: 25700 - DNA, 20 bp, Artificial Sequence
  sgRNA
  Grm8_17
gatccttgacacatgttcca

SEQ ID NO: 25701 - DNA, 20 bp, Artificial Sequence
  sgRNA
  Grm8_18
cgattggtgtgtcattatag

SEQ ID NO: 25702 - DNA, 20 bp, Artificial Sequence
  sgRNA
  Grm8_19
gattcatcttacgaacaaga

SEQ ID NO: 25703 - DNA, 20 bp, Artificial Sequence
  sgRNA
  Grm8_20
tttatgccattaaaaccaga

SEQ ID NO: 25704 - DNA, 20 bp, Artificial Sequence
  sgRNA
  Grpr_1
ttatacaacttacttcagtg

SEQ ID NO: 25705 - DNA, 20 bp, Artificial Sequence
  sgRNA
  Grpr_2
atggacaactggtttcaccc

SEQ ID NO: 25706 - DNA, 20 bp, Artificial Sequence
  sgRNA
  Grpr_3
tttggttggtatctttcaca

SEQ ID NO: 25707 - DNA, 20 bp, Artificial Sequence
  sgRNA
  Grpr_4
acaccctaaaatccattcca

SEQ ID NO: 25708 - DNA, 20 bp, Artificial Sequence
  sgRNA
  Grpr_5
gagtgcctacaatcttcccg

SEQ ID NO: 25709 - DNA, 20 bp, Artificial Sequence
  sgRNA
  Grpr_6
gctcatcaagatcttctgca

SEQ ID NO: 25710 - DNA, 20 bp, Artificial Sequence
  sgRNA
  Grpr_7
cttcaagagcactaacccct

SEQ ID NO: 25711 - DNA, 20 bp, Artificial Sequence
  sgRNA
  Grpr_8
gtagggggcacaactaatga

SEQ ID NO: 25712 - DNA, 20 bp, Artificial Sequence
  sgRNA
  Grpr_9
gcaagtacctggctgacagg

SEQ ID NO: 25713 - DNA, 20 bp, Artificial Sequence
  sgRNA
  Grpr_10
acagaaatatctgtcatgag

SEQ ID NO: 25714 - DNA, 20 bp, Artificial Sequence
  sgRNA
  Grpr_11
gatatccattggccgtacaa

SEQ ID NO: 25715 - DNA, 20 bp, Artificial Sequence
  sgRNA
  Grpr_12
tatgttgttggccatcccag

SEQ ID NO: 25716 - DNA, 20 bp, Artificial Sequence
  sgRNA
  Grpr_13
atgaggctaaaggtagccga

SEQ ID NO: 25717 - DNA, 20 bp, Artificial Sequence
  sgRNA
  Grpr_14
tgaggctaaaggtagccgag

SEQ ID NO: 25718 - DNA, 20 bp, Artificial Sequence
  sgRNA
  Grpr_15
acatgtatattgccttccac

SEQ ID NO: 25719 - DNA, 20 bp, Artificial Sequence
  sgRNA
  Grpr_16
gataacgtagaaaaccagaa

SEQ ID NO: 25720 - DNA, 20 bp, Artificial Sequence
  sgRNA
  Grpr_17
gatgaggctaaaggtagccg

SEQ ID NO: 25721 - DNA, 20 bp, Artificial Sequence
  sgRNA
  Grpr_18
gggatgacatagatgaagcc

SEQ ID NO: 25722 - DNA, 20 bp, Artificial Sequence
  sgRNA
  Grpr_19
agacagagatgatcgccagt

SEQ ID NO: 25723 - DNA, 20 bp, Artificial Sequence
  sgRNA
  Grpr_20
ttacggcactgtcagctgac

SEQ ID NO: 25724 - DNA, 20 bp, Artificial Sequence
  sgRNA
  Gsg1_1
gtgacatgagccttgcaacg

SEQ ID NO: 25725 - DNA, 20 bp, Artificial Sequence
  sgRNA
  Gsg1_2
ggaggtggtacaatacacct

SEQ ID NO: 25726 - DNA, 20 bp, Artificial Sequence
  sgRNA
  Gsg1_3
ggccgagtgataacatgttg

SEQ ID NO: 25727 - DNA, 20 bp, Artificial Sequence
  sgRNA
  Gsg1_4
tcactcacctgacaggacca

SEQ ID NO: 25728 - DNA, 20 bp, Artificial Sequence
  sgRNA
  Gsg1_5
acagatccgtcagtagcagg

SEQ ID NO: 25729 - DNA, 20 bp, Artificial Sequence
  sgRNA
  Gsg1_6
ccaccttcaacatgtacacg

SEQ ID NO: 25730 - DNA, 20 bp, Artificial Sequence
  sgRNA
  Gsg1_7
tgacgtgcacaacccacgca

SEQ ID NO: 25731 - DNA, 20 bp, Artificial Sequence
  sgRNA
  Gsg1_8
ggtgtattgtaccacctcct

SEQ ID NO: 25732 - DNA, 20 bp, Artificial Sequence
  sgRNA
  Gsg1_9
gacgtgcacaacccacgcag

SEQ ID NO: 25733 - DNA, 20 bp, Artificial Sequence
  sgRNA
  Gsg1_10
atttcaacaagggatcagcc

SEQ ID NO: 25734 - DNA, 20 bp, Artificial Sequence
  sgRNA
  Gsg1_11
catccttgctcagcagcgag

SEQ ID NO: 25735 - DNA, 20 bp, Artificial Sequence
  sgRNA
  Gsg1_12
gccagactttgcccgcacag

SEQ ID NO: 25736 - DNA, 20 bp, Artificial Sequence
  sgRNA
  Gsg1_13
accccactctccgatttgga

SEQ ID NO: 25737 - DNA, 20 bp, Artificial Sequence
  sgRNA
  Gsg1_14
ttaaccactcccctccaaat

SEQ ID NO: 25738 - DNA, 20 bp, Artificial Sequence
  sgRNA
  Gsg1_15
tgtcctgtagcgccgagtag

SEQ ID NO: 25739 - DNA, 20 bp, Artificial Sequence
  sgRNA
  Gsg1_16
ttagcttgagcccacagcca

SEQ ID NO: 25740 - DNA, 20 bp, Artificial Sequence
  sgRNA
  Gsg1_17
gcttcagagacagagcggat

SEQ ID NO: 25741 - DNA, 20 bp, Artificial Sequence
  sgRNA
  Gsg1_18
cctcgtgtacatgttgaagg

SEQ ID NO: 25742 - DNA, 20 bp, Artificial Sequence
  sgRNA
  Gsg1_19
gctatcctgtgaggaaacca

SEQ ID NO: 25743 - DNA, 20 bp, Artificial Sequence
  sgRNA
  Gsg1_20
tgaagctattgacctctact

SEQ ID NO: 25744 - DNA, 20 bp, Artificial Sequence
  sgRNA
  Gsg1l_1
cgcacacatgatgtacacac

SEQ ID NO: 25745 - DNA, 20 bp, Artificial Sequence
  sgRNA
  Gsg1l_2
tggcatctggtactcgtgtg

SEQ ID NO: 25746 - DNA, 20 bp, Artificial Sequence
  sgRNA
  Gsg1l_3
gaaggaccacccatagtccc

SEQ ID NO: 25747 - DNA, 20 bp, Artificial Sequence
  sgRNA
  Gsg1l_4
actggtgccagggcacgcaa

SEQ ID NO: 25748 - DNA, 20 bp, Artificial Sequence
  sgRNA
  Gsg1l_5
gggtcgggtatctctcgtgg

SEQ ID NO: 25749 - DNA, 20 bp, Artificial Sequence
  sgRNA
  Gsg1l_6
cgtgccctggcaccagtacg

SEQ ID NO: 25750 - DNA, 20 bp, Artificial Sequence
  sgRNA
  Gsg1l_7
cctctcccggaagtatttga

SEQ ID NO: 25751 - DNA, 20 bp, Artificial Sequence
  sgRNA
  Gsg1l_8
actccagcagcgtcatagac

SEQ ID NO: 25752 - DNA, 20 bp, Artificial Sequence
  sgRNA
  Gsg1l_9
gtacgtggtgaggaaggcgg

SEQ ID NO: 25753 - DNA, 20 bp, Artificial Sequence
  sgRNA
  Gsg1l_10
gcctcgtgagctgagctccg

SEQ ID NO: 25754 - DNA, 20 bp, Artificial Sequence
  sgRNA
  Gsg1l_11
tgagttccggcataagcgca

SEQ ID NO: 25755 - DNA, 20 bp, Artificial Sequence
  sgRNA
  Gsg1l_12
acatgggagactcctggcca

SEQ ID NO: 25756 - DNA, 20 bp, Artificial Sequence
  sgRNA
  Gsg1l_13
tactcgtgtgaggaagagct

SEQ ID NO: 25757 - DNA, 20 bp, Artificial Sequence
  sgRNA
  Gsg1l_14
ggtgctctacatccttctgc

SEQ ID NO: 25758 - DNA, 20 bp, Artificial Sequence
  sgRNA
  Gsg1l_15
gaagctcaatgcctttgctg

SEQ ID NO: 25759 - DNA, 20 bp, Artificial Sequence
  sgRNA
  Gsg1l_16
tcatgtgtgcgaccattccc

SEQ ID NO: 25760 - DNA, 20 bp, Artificial Sequence
  sgRNA
  Gsg1l_17
tctcgtggcggcaggcaagg

SEQ ID NO: 25761 - DNA, 20 bp, Artificial Sequence
  sgRNA
  Gsg1l_18
ggcggctgtgctgttggccg

SEQ ID NO: 25762 - DNA, 20 bp, Artificial Sequence
  sgRNA
  Gsg1l_19
caactcgggcgccaacgcca

SEQ ID NO: 25763 - DNA, 20 bp, Artificial Sequence
  sgRNA
  Gsg1l_20
gcctcaggatctatgaacgt

SEQ ID NO: 25764 - DNA, 20 bp, Artificial Sequence
  sgRNA
  Gsg1l2_1
gaatgcagttcaagcccccg

SEQ ID NO: 25765 - DNA, 20 bp, Artificial Sequence
  sgRNA
  Gsg1l2_2
tttcaaatcaccgtgaacct

SEQ ID NO: 25766 - DNA, 20 bp, Artificial Sequence
  sgRNA
  Gsg1l2_3
ggagcgactccccatcctgt

SEQ ID NO: 25767 - DNA, 20 bp, Artificial Sequence
  sgRNA
  Gsg1l2_4
gcagcagccactggtgcgag

SEQ ID NO: 25768 - DNA, 20 bp, Artificial Sequence
  sgRNA
  Gsg1l2_5
tctatgccaggatctcctcg

SEQ ID NO: 25769 - DNA, 20 bp, Artificial Sequence
  sgRNA
  Gsg1l2_6
gctcaacgtggacgcctcag

SEQ ID NO: 25770 - DNA, 20 bp, Artificial Sequence
  sgRNA
  Gsg1l2_7
tatccaacgcaggttccatg

SEQ ID NO: 25771 - DNA, 20 bp, Artificial Sequence
  sgRNA
  Gsg1l2_8
acgacaagtttatccaacgc

SEQ ID NO: 25772 - DNA, 20 bp, Artificial Sequence
  sgRNA
  Gsg1l2_9
ctggggatagtacccgccga

SEQ ID NO: 25773 - DNA, 20 bp, Artificial Sequence
  sgRNA
  Gsg1l2_10
aggactgccaaagccccgca

SEQ ID NO: 25774 - DNA, 20 bp, Artificial Sequence
  sgRNA
  Gsg1l2_11
atacaccacagcccaagcag

SEQ ID NO: 25775 - DNA, 20 bp, Artificial Sequence
  sgRNA
  Gsg1l2_12
agattggcggcctcagacat

SEQ ID NO: 25776 - DNA, 20 bp, Artificial Sequence
  sgRNA
  Gsg1l2_13
tgaactgcattcacttcagc

SEQ ID NO: 25777 - DNA, 20 bp, Artificial Sequence
  sgRNA
  Gsg1l2_14
ctatgccaggatctcctcgg

SEQ ID NO: 25778 - DNA, 20 bp, Artificial Sequence
  sgRNA
  Gsg1l2_15
cggatgcagctggctcaacg

SEQ ID NO: 25779 - DNA, 20 bp, Artificial Sequence
  sgRNA
  Gsg1l2_16
ttcgtgaagatgtgtcccac

SEQ ID NO: 25780 - DNA, 20 bp, Artificial Sequence
  sgRNA
  Gsg1l2_17
acctaggaccagaagattgg

SEQ ID NO: 25781 - DNA, 20 bp, Artificial Sequence
  sgRNA
  Gsg1l2_18
acagagagcaaaagatcccc

SEQ ID NO: 25782 - DNA, 20 bp, Artificial Sequence
  sgRNA
  Gsg1l2_19
acactttgcctcctgtacct

SEQ ID NO: 25783 - DNA, 20 bp, Artificial Sequence
  sgRNA
  Gsg1l2_20
aactcatgctgaagcccagg

SEQ ID NO: 25784 - DNA, 20 bp, Artificial Sequence
  sgRNA
  Gucy2c_1
gaaggtggaatacgtgcacg

SEQ ID NO: 25785 - DNA, 20 bp, Artificial Sequence
  sgRNA
  Gucy2c_2
tgaaaacctctcggcgacag

SEQ ID NO: 25786 - DNA, 20 bp, Artificial Sequence
  sgRNA
  Gucy2c_3
ttgccgtcttcacgctcacg

SEQ ID NO: 25787 - DNA, 20 bp, Artificial Sequence
  sgRNA
  Gucy2c_4
tagtcttaccggcttcacgc

SEQ ID NO: 25788 - DNA, 20 bp, Artificial Sequence
  sgRNA
  Gucy2c_5
ggaccaccatgacgtctaca

SEQ ID NO: 25789 - DNA, 20 bp, Artificial Sequence
  sgRNA
  Gucy2c_6
gatccccgtgagcgtgaaga

SEQ ID NO: 25790 - DNA, 20 bp, Artificial Sequence
  sgRNA
  Gucy2c_7
tgacttatgaatcagaccgt

SEQ ID NO: 25791 - DNA, 20 bp, Artificial Sequence
  sgRNA
  Gucy2c_8
aaggtggaatacgtgcacga

SEQ ID NO: 25792 - DNA, 20 bp, Artificial Sequence
  sgRNA
  Gucy2c_9
ggacaatccataacttccag

SEQ ID NO: 25793 - DNA, 20 bp, Artificial Sequence
  sgRNA
  Gucy2c_10
cggtgatcttcaccaccatg

SEQ ID NO: 25794 - DNA, 20 bp, Artificial Sequence
  sgRNA
  Gucy2c_11
caaacacctctgtcgccgag

SEQ ID NO: 25795 - DNA, 20 bp, Artificial Sequence
  sgRNA
  Gucy2c_12
gcgtgtaaaaagtctcctta

SEQ ID NO: 25796 - DNA, 20 bp, Artificial Sequence
  sgRNA
  Gucy2c_13
tctccaaacaggcaatagcg

SEQ ID NO: 25797 - DNA, 20 bp, Artificial Sequence
  sgRNA
  Gucy2c_14
tttgagttggagcatctccc

SEQ ID NO: 25798 - DNA, 20 bp, Artificial Sequence
  sgRNA
  Gucy2c_15
gcgactttcatctactccga

SEQ ID NO: 25799 - DNA, 20 bp, Artificial Sequence
  sgRNA
  Gucy2c_16
ggcccagaacaccatcagcg

SEQ ID NO: 25800 - DNA, 20 bp, Artificial Sequence
  sgRNA
  Gucy2c_17
gatagttcaactctgtgtcg

SEQ ID NO: 25801 - DNA, 20 bp, Artificial Sequence
  sgRNA
  Gucy2c_18
tgtcggttgccgtttctcat

SEQ ID NO: 25802 - DNA, 20 bp, Artificial Sequence
  sgRNA
  Gucy2c_19
ggatccacacggggaggcca

SEQ ID NO: 25803 - DNA, 20 bp, Artificial Sequence
  sgRNA
  Gucy2c_20
cctccggctcttcttgcccg

SEQ ID NO: 25804 - DNA, 20 bp, Artificial Sequence
  sgRNA
  Gypa_1
tcttcaaataaccactcctg

SEQ ID NO: 25805 - DNA, 20 bp, Artificial Sequence
  sgRNA
  Gypa_2
tcagcaacaatgtcaacacc

SEQ ID NO: 25806 - DNA, 20 bp, Artificial Sequence
  sgRNA
  Gypa_3
catatcaacatacctagtgc

SEQ ID NO: 25807 - DNA, 20 bp, Artificial Sequence
  sgRNA
  Gypa_4
acgcagcagacacttcagta

SEQ ID NO: 25808 - DNA, 20 bp, Artificial Sequence
  sgRNA
  Gypa_5
cctgtctcaccacacattgg

SEQ ID NO: 25809 - DNA, 20 bp, Artificial Sequence
  sgRNA
  Gypa_6
aaatcgtgttgaattggtga

SEQ ID NO: 25810 - DNA, 20 bp, Artificial Sequence
  sgRNA
  Gypa_7
acactgttgtcaccaccctc

SEQ ID NO: 25811 - DNA, 20 bp, Artificial Sequence
  sgRNA
  Gypa_8
aacgcagcagacacttcagt

SEQ ID NO: 25812 - DNA, 20 bp, Artificial Sequence
  sgRNA
  Gypa_9
gttgacatccaatctcctga

SEQ ID NO: 25813 - DNA, 20 bp, Artificial Sequence
  sgRNA
  Gypa_10
tcatgtctcaacttatcaca

SEQ ID NO: 25814 - DNA, 20 bp, Artificial Sequence
  sgRNA
  Gypa_11
cagcctgtctcaccacacat

SEQ ID NO: 25815 - DNA, 20 bp, Artificial Sequence
  sgRNA
  Gypa_12
agttgacatccaatctcctg

SEQ ID NO: 25816 - DNA, 20 bp, Artificial Sequence
  sgRNA
  Gypa_13
cgcagcagacacttcagtag

SEQ ID NO: 25817 - DNA, 20 bp, Artificial Sequence
  sgRNA
  Gypa_14
ttgacttgaaggtatatgga

SEQ ID NO: 25818 - DNA, 20 bp, Artificial Sequence
  sgRNA
  Gypa_15
acagctgctgtgacaacatc

SEQ ID NO: 25819 - DNA, 20 bp, Artificial Sequence
  sgRNA
  Gypa_16
agttgaagccaccacaggag

SEQ ID NO: 25820 - DNA, 20 bp, Artificial Sequence
  sgRNA
  Gypa_17
cctgtggtggcttcaactgt

SEQ ID NO: 25821 - DNA, 20 bp, Artificial Sequence
  sgRNA
  Gypa_18
cctacagttgaagccaccac

SEQ ID NO: 25822 - DNA, 20 bp, Artificial Sequence
  sgRNA
  Gypa_19
ggcgtgatggcagggattat

SEQ ID NO: 25823 - DNA, 20 bp, Artificial Sequence
  sgRNA
  Gypa_20
tcaaataaccactcctgtgg

SEQ ID NO: 25824 - DNA, 20 bp, Artificial Sequence
  sgRNA
  Gypc_1
ggcaatctccataatgccgt

SEQ ID NO: 25825 - DNA, 20 bp, Artificial Sequence
  sgRNA
  Gypc_2
tatccacagagcctaaccca

SEQ ID NO: 25826 - DNA, 20 bp, Artificial Sequence
  sgRNA
  Gypc_3
tcgctacctgtacaggcaca

SEQ ID NO: 25827 - DNA, 20 bp, Artificial Sequence
  sgRNA
  Gypc_4
gggtacctaccacaccaatg

SEQ ID NO: 25828 - DNA, 20 bp, Artificial Sequence
  sgRNA
  Gypc_5
taatgccgtaggacttccct

SEQ ID NO: 25829 - DNA, 20 bp, Artificial Sequence
  sgRNA
  Gypc_6
tggtgtccccagcatcctgg

SEQ ID NO: 25830 - DNA, 20 bp, Artificial Sequence
  sgRNA
  Gypc_7
ataatgccgtaggacttccc

SEQ ID NO: 25831 - DNA, 20 bp, Artificial Sequence
  sgRNA
  Gypc_8
cctaacccagggaagtccta

SEQ ID NO: 25832 - DNA, 20 bp, Artificial Sequence
  sgRNA
  Gypc_9
cgctacctgtacaggcacaa

SEQ ID NO: 25833 - DNA, 20 bp, Artificial Sequence
  sgRNA
  Gypc_10
ggtgtccccagcatcctgga

SEQ ID NO: 25834 - DNA, 20 bp, Artificial Sequence
  sgRNA
  Gypc_11
agcgaagcatgagaaagagg

SEQ ID NO: 25835 - DNA, 20 bp, Artificial Sequence
  sgRNA
  Gypc_12
agggaagtcctacggcatta

SEQ ID NO: 25836 - DNA, 20 bp, Artificial Sequence
  sgRNA
  Gypc_13
tgctggggacaccagcaaga

SEQ ID NO: 25837 - DNA, 20 bp, Artificial Sequence
  sgRNA
  Gypc_14
tcgggaggcggcttgctgac

SEQ ID NO: 25838 - DNA, 20 bp, Artificial Sequence
  sgRNA
  Gypc_15
tcatgcttcgctacctgtac

SEQ ID NO: 25839 - DNA, 20 bp, Artificial Sequence
  sgRNA
  Gypc_16
ggtagcgaagcatgagaaag

SEQ ID NO: 25840 - DNA, 20 bp, Artificial Sequence
  sgRNA
  Gypc_17
tttggcctcattggtgtggt

SEQ ID NO: 25841 - DNA, 20 bp, Artificial Sequence
  sgRNA
  Gypc_18
gagggcagggtcactttgca

SEQ ID NO: 25842 - DNA, 20 bp, Artificial Sequence
  sgRNA
  Gypc_19
gcaaagtgaccctgccctcc

SEQ ID NO: 25843 - DNA, 20 bp, Artificial Sequence
  sgRNA
  Gypc_20
aggtacccttgtgcctgtac

SEQ ID NO: 25844 - DNA, 20 bp, Artificial Sequence
  sgRNA
  H13_1
ggtattcggcaccaacgtga

SEQ ID NO: 25845 - DNA, 20 bp, Artificial Sequence
  sgRNA
  H13_2
ccccagccaacggcacgacg

SEQ ID NO: 25846 - DNA, 20 bp, Artificial Sequence
  sgRNA
  H13_3
gaaaaaacttattcatgaag

SEQ ID NO: 25847 - DNA, 20 bp, Artificial Sequence
  sgRNA
  H13_4
tgagtttgacactaaggacc

SEQ ID NO: 25848 - DNA, 20 bp, Artificial Sequence
  sgRNA
  H13_5
gcttggtcaccacctagcaa

SEQ ID NO: 25849 - DNA, 20 bp, Artificial Sequence
  sgRNA
  H13_6
tctcggctgctggatcttta

SEQ ID NO: 25850 - DNA, 20 bp, Artificial Sequence
  sgRNA
  H13_7
tccgcacaacggcagcgccg

SEQ ID NO: 25851 - DNA, 20 bp, Artificial Sequence
  sgRNA
  H13_8
atgaggcaggattacggccg

SEQ ID NO: 25852 - DNA, 20 bp, Artificial Sequence
  sgRNA
  H13_9
gctgtcagcgatccgcacaa

SEQ ID NO: 25853 - DNA, 20 bp, Artificial Sequence
  sgRNA
  H13_10
tatcagctgctcttcacaca

SEQ ID NO: 25854 - DNA, 20 bp, Artificial Sequence
  sgRNA
  H13_11
agaaatacatggacagcaag

SEQ ID NO: 25855 - DNA, 20 bp, Artificial Sequence
  sgRNA
  H13_12
ggcggcatctcgactggtga

SEQ ID NO: 25856 - DNA, 20 bp, Artificial Sequence
  sgRNA
  H13_13
cttggtcaccacctagcaat

SEQ ID NO: 25857 - DNA, 20 bp, Artificial Sequence
  sgRNA
  H13_14
tgtcctggtggcactagcca

SEQ ID NO: 25858 - DNA, 20 bp, Artificial Sequence
  sgRNA
  H13_15
agaggggaagacacacccca

SEQ ID NO: 25859 - DNA, 20 bp, Artificial Sequence
  sgRNA
  H13_16
cagaggcgtcggcatcgaag

SEQ ID NO: 25860 - DNA, 20 bp, Artificial Sequence
  sgRNA
  H13_17
gtcctggtggcactagccaa

SEQ ID NO: 25861 - DNA, 20 bp, Artificial Sequence
  sgRNA
  H13_18
caccaacgtgatggtgacag

SEQ ID NO: 25862 - DNA, 20 bp, Artificial Sequence
  sgRNA
  H13_19
agcccgtgctcagaaacaac

SEQ ID NO: 25863 - DNA, 20 bp, Artificial Sequence
  sgRNA
  H13_20
ccccagcacgaagaaataca

SEQ ID NO: 25864 - DNA, 20 bp, Artificial Sequence
  sgRNA
  H2-Ab1_1
ggtgtgcagacacaactacg

SEQ ID NO: 25865 - DNA, 20 bp, Artificial Sequence
  sgRNA
  H2-Ab1_2
cagatacatctacaaccggg

SEQ ID NO: 25866 - DNA, 20 bp, Artificial Sequence
  sgRNA
  H2-Ab1_3
tcgtatgcgctgcgtcccgt

SEQ ID NO: 25867 - DNA, 20 bp, Artificial Sequence
  sgRNA
  H2-Ab1_4
agcagaccagagtgttgtgg

SEQ ID NO: 25868 - DNA, 20 bp, Artificial Sequence
  sgRNA
  H2-Ab1_5
tgtgcagacacaactacgag

SEQ ID NO: 25869 - DNA, 20 bp, Artificial Sequence
  sgRNA
  H2-Ab1_6
gtgtgcagacacaactacga

SEQ ID NO: 25870 - DNA, 20 bp, Artificial Sequence
  sgRNA
  H2-Ab1_7
gcgagtgctacttcaccaac

SEQ ID NO: 25871 - DNA, 20 bp, Artificial Sequence
  sgRNA
  H2-Ab1_8
cgagtactggaacagccagc

SEQ ID NO: 25872 - DNA, 20 bp, Artificial Sequence
  sgRNA
  H2-Ab1_9
ggagatcctggagcgaacgc

SEQ ID NO: 25873 - DNA, 20 bp, Artificial Sequence
  sgRNA
  H2-Ab1_10
agacccacacctccctgcgg

SEQ ID NO: 25874 - DNA, 20 bp, Artificial Sequence
  sgRNA
  H2-Ab1_11
ctggagatgacccctcggcg

SEQ ID NO: 25875 - DNA, 20 bp, Artificial Sequence
  sgRNA
  H2-Ab1_12
ttcgctccaggatctccggc

SEQ ID NO: 25876 - DNA, 20 bp, Artificial Sequence
  sgRNA
  H2-Ab1_13
ggatgaaaaggccaagcccg

SEQ ID NO: 25877 - DNA, 20 bp, Artificial Sequence
  sgRNA
  H2-Ab1_14
gcctggagcaagatgttgag

SEQ ID NO: 25878 - DNA, 20 bp, Artificial Sequence
  sgRNA
  H2-Ab1_15
aatggccaggaggagacggt

SEQ ID NO: 25879 - DNA, 20 bp, Artificial Sequence
  sgRNA
  H2-Ab1_16
gtagacctctccccgccgag

SEQ ID NO: 25880 - DNA, 20 bp, Artificial Sequence
  sgRNA
  H2-Ab1_17
cgtagcgcacgtactcctcc

SEQ ID NO: 25881 - DNA, 20 bp, Artificial Sequence
  sgRNA
  H2-Ab1_18
cagccaagatcaaagtgcgc

SEQ ID NO: 25882 - DNA, 20 bp, Artificial Sequence
  sgRNA
  H2-Ab1_19
agaggtctacacctgtcacg

SEQ ID NO: 25883 - DNA, 20 bp, Artificial Sequence
  sgRNA
  H2-Ab1_20
ggacagggagatgacgacat

SEQ ID NO: 25884 - DNA, 20 bp, Artificial Sequence
  sgRNA
  H2-Bl_1
actatgatcgagactcgcgc

SEQ ID NO: 25885 - DNA, 20 bp, Artificial Sequence
  sgRNA
  H2-Bl_2
gactatgatcgagactcgcg

SEQ ID NO: 25886 - DNA, 20 bp, Artificial Sequence
  sgRNA
  H2-Bl_3
gctatacaagttctacctgg

SEQ ID NO: 25887 - DNA, 20 bp, Artificial Sequence
  sgRNA
  H2-Bl_4
cctgaaaacgtggatggcgg

SEQ ID NO: 25888 - DNA, 20 bp, Artificial Sequence
  sgRNA
  H2-Bl_5
agaatccgagatctgagccg

SEQ ID NO: 25889 - DNA, 20 bp, Artificial Sequence
  sgRNA
  H2-Bl_6
gcgagtctcgatcatagtca

SEQ ID NO: 25890 - DNA, 20 bp, Artificial Sequence
  sgRNA
  H2-Bl_7
acaatgagcagagtttcgga

SEQ ID NO: 25891 - DNA, 20 bp, Artificial Sequence
  sgRNA
  H2-Bl_8
agtctcgatcatagtcaggg

SEQ ID NO: 25892 - DNA, 20 bp, Artificial Sequence
  sgRNA
  H2-Bl_9
agagctatacaagttctacc

SEQ ID NO: 25893 - DNA, 20 bp, Artificial Sequence
  sgRNA
  H2-Bl_10
tgtcacagccagacaaccgc

SEQ ID NO: 25894 - DNA, 20 bp, Artificial Sequence
  sgRNA
  H2-Bl_11
gatgatcccttagtgcctgc

SEQ ID NO: 25895 - DNA, 20 bp, Artificial Sequence
  sgRNA
  H2-Bl_12
gtttaccatgttggagccgg

SEQ ID NO: 25896 - DNA, 20 bp, Artificial Sequence
  sgRNA
  H2-Bl_13
ggttgtctggctgtgacatg

SEQ ID NO: 25897 - DNA, 20 bp, Artificial Sequence
  sgRNA
  H2-Bl_14
agacctgaaaacgtggatgg

SEQ ID NO: 25898 - DNA, 20 bp, Artificial Sequence
  sgRNA
  H2-Bl_15
aaggacaatgagcagagttt

SEQ ID NO: 25899 - DNA, 20 bp, Artificial Sequence
  sgRNA
  H2-Bl_16
tgttccatccacggcgcccg

SEQ ID NO: 25900 - DNA, 20 bp, Artificial Sequence
  sgRNA
  H2-Bl_17
gagaccgcagtgttccggcc

SEQ ID NO: 25901 - DNA, 20 bp, Artificial Sequence
  sgRNA
  H2-Bl_18
ggtccctcctgttccatcca

SEQ ID NO: 25902 - DNA, 20 bp, Artificial Sequence
  sgRNA
  H2-Bl_19
agatgaaccggggctccccg

SEQ ID NO: 25903 - DNA, 20 bp, Artificial Sequence
  sgRNA
  H2-Bl_20
ggcgccgtggatggaacagg

SEQ ID NO: 25904 - DNA, 20 bp, Artificial Sequence
  sgRNA
  H2-D1_1
ggccccgactcagacccgcg

SEQ ID NO: 25905 - DNA, 20 bp, Artificial Sequence
  sgRNA
  H2-D1_2
cgacgcaagtgggagcagag

SEQ ID NO: 25906 - DNA, 20 bp, Artificial Sequence
  sgRNA
  H2-D1_3
tagccgacagagatgtaccg

SEQ ID NO: 25907 - DNA, 20 bp, Artificial Sequence
  sgRNA
  H2-D1_4
gtgagcctgaggaacctgct

SEQ ID NO: 25908 - DNA, 20 bp, Artificial Sequence
  sgRNA
  H2-D1_5
gtacatctctgtcggctatg

SEQ ID NO: 25909 - DNA, 20 bp, Artificial Sequence
  sgRNA
  H2-D1_6
actctgctcccacttgcgtc

SEQ ID NO: 25910 - DNA, 20 bp, Artificial Sequence
  sgRNA
  H2-D1_7
tgtcggctatgtggacaaca

SEQ ID NO: 25911 - DNA, 20 bp, Artificial Sequence
  sgRNA
  H2-D1_8
agatgtaccggggctcctcg

SEQ ID NO: 25912 - DNA, 20 bp, Artificial Sequence
  sgRNA
  H2-D1_9
gcattacaaggcctacctgg

SEQ ID NO: 25913 - DNA, 20 bp, Artificial Sequence
  sgRNA
  H2-D1_10
gcaggttcctcaggctcact

SEQ ID NO: 25914 - DNA, 20 bp, Artificial Sequence
  sgRNA
  H2-D1_11
ctaaaggtgaagtcaccctg

SEQ ID NO: 25915 - DNA, 20 bp, Artificial Sequence
  sgRNA
  H2-D1_12
catagccgacagagatgtac

SEQ ID NO: 25916 - DNA, 20 bp, Artificial Sequence
  sgRNA
  H2-D1_13
atgtaagagtcagtggacgg

SEQ ID NO: 25917 - DNA, 20 bp, Artificial Sequence
  sgRNA
  H2-D1_14
gcagatgtctggctgtgact

SEQ ID NO: 25918 - DNA, 20 bp, Artificial Sequence
  sgRNA
  H2-D1_15
cggctactacaaccagagcg

SEQ ID NO: 25919 - DNA, 20 bp, Artificial Sequence
  sgRNA
  H2-D1_16
agtggttccgagtgagcctg

SEQ ID NO: 25920 - DNA, 20 bp, Artificial Sequence
  sgRNA
  H2-D1_17
agtcacagccagacatctgc

SEQ ID NO: 25921 - DNA, 20 bp, Artificial Sequence
  sgRNA
  H2-D1_18
cactctgctcccacttgcgt

SEQ ID NO: 25922 - DNA, 20 bp, Artificial Sequence
  sgRNA
  H2-D1_19
ctccacagatacctgaagaa

SEQ ID NO: 25923 - DNA, 20 bp, Artificial Sequence
  sgRNA
  H2-D1_20
gtctggctgtgacttggggt

SEQ ID NO: 25924 - DNA, 20 bp, Artificial Sequence
  sgRNA
  H2-DMa_1
gtttggcaagcccaacacgt

SEQ ID NO: 25925 - DNA, 20 bp, Artificial Sequence
  sgRNA
  H2-DMa_2
atagagtgtgccggaatgtg

SEQ ID NO: 25926 - DNA, 20 bp, Artificial Sequence
  sgRNA
  H2-DMa_3
aggacgggattcccaacata

SEQ ID NO: 25927 - DNA, 20 bp, Artificial Sequence
  sgRNA
  H2-DMa_4
tctgcaaagtcaggcagtcg

SEQ ID NO: 25928 - DNA, 20 bp, Artificial Sequence
  sgRNA
  H2-DMa_5
gctctcggagacctatgacg

SEQ ID NO: 25929 - DNA, 20 bp, Artificial Sequence
  sgRNA
  H2-DMa_6
gcattctctaggagatccga

SEQ ID NO: 25930 - DNA, 20 bp, Artificial Sequence
  sgRNA
  H2-DMa_7
catccatctcagctgtcgat

SEQ ID NO: 25931 - DNA, 20 bp, Artificial Sequence
  sgRNA
  H2-DMa_8
aataggcaattgccgtgtag

SEQ ID NO: 25932 - DNA, 20 bp, Artificial Sequence
  sgRNA
  H2-DMa_9
cctggcagaatagagtgtgc

SEQ ID NO: 25933 - DNA, 20 bp, Artificial Sequence
  sgRNA
  H2-DMa_10
ggtgtgctaggcaccatcat

SEQ ID NO: 25934 - DNA, 20 bp, Artificial Sequence
  sgRNA
  H2-DMa_11
gccaaaggccacaccacaca

SEQ ID NO: 25935 - DNA, 20 bp, Artificial Sequence
  sgRNA
  H2-DMa_12
tgatggtgcctagcacaccg

SEQ ID NO: 25936 - DNA, 20 bp, Artificial Sequence
  sgRNA
  H2-DMa_13
tgtgggtcatcccagaacac

SEQ ID NO: 25937 - DNA, 20 bp, Artificial Sequence
  sgRNA
  H2-DMa_14
gtgcaggagtaaaggtcaaa

SEQ ID NO: 25938 - DNA, 20 bp, Artificial Sequence
  sgRNA
  H2-DMa_15
acatccatctcagctgtcga

SEQ ID NO: 25939 - DNA, 20 bp, Artificial Sequence
  sgRNA
  H2-DMa_16
gcttcactcggcccctgtgg

SEQ ID NO: 25940 - DNA, 20 bp, Artificial Sequence
  sgRNA
  H2-DMa_17
agagtgggctcagggacagg

SEQ ID NO: 25941 - DNA, 20 bp, Artificial Sequence
  sgRNA
  H2-DMa_18
ttgggcttgccaaactccag

SEQ ID NO: 25942 - DNA, 20 bp, Artificial Sequence
  sgRNA
  H2-DMa_19
gttgggcttgccaaactcca

SEQ ID NO: 25943 - DNA, 20 bp, Artificial Sequence
  sgRNA
  H2-DMa_20
ctcttatttaaacttcacac

SEQ ID NO: 25944 - DNA, 20 bp, Artificial Sequence
  sgRNA
  H2-DMb1_1
atttggggtgctgtatccat

SEQ ID NO: 25945 - DNA, 20 bp, Artificial Sequence
  sgRNA
  H2-DMb1_2
cgtgcgtgctggatgatgct

SEQ ID NO: 25946 - DNA, 20 bp, Artificial Sequence
  sgRNA
  H2-DMb1_3
tgggtcagcgcattccagaa

SEQ ID NO: 25947 - DNA, 20 bp, Artificial Sequence
  sgRNA
  H2-DMb1_4
cctcagtctggactgtatgg

SEQ ID NO: 25948 - DNA, 20 bp, Artificial Sequence
  sgRNA
  H2-DMb1_5
tctggatccacctacccgga

SEQ ID NO: 25949 - DNA, 20 bp, Artificial Sequence
  sgRNA
  H2-DMb1_6
gacctctgagcccatccgag

SEQ ID NO: 25950 - DNA, 20 bp, Artificial Sequence
  sgRNA
  H2-DMb1_7
gggtaggtggatccagagag

SEQ ID NO: 25951 - DNA, 20 bp, Artificial Sequence
  sgRNA
  H2-DMb1_8
gtcccctcggatgggctcag

SEQ ID NO: 25952 - DNA, 20 bp, Artificial Sequence
  sgRNA
  H2-DMb1_9
ggacctctgagcccatccga

SEQ ID NO: 25953 - DNA, 20 bp, Artificial Sequence
  sgRNA
  H2-DMb1_10
accggctcccttgtgttaaa

SEQ ID NO: 25954 - DNA, 20 bp, Artificial Sequence
  sgRNA
  H2-DMb1_11
gctgctgctggtcctcagtc

SEQ ID NO: 25955 - DNA, 20 bp, Artificial Sequence
  sgRNA
  H2-DMb1_12
gtgggtcagcgcattccaga

SEQ ID NO: 25956 - DNA, 20 bp, Artificial Sequence
  sgRNA
  H2-DMb1_13
cttctccagcgtttgcaaaa

SEQ ID NO: 25957 - DNA, 20 bp, Artificial Sequence
  sgRNA
  H2-DMb1_14
tacagcaccccaaattcaca

SEQ ID NO: 25958 - DNA, 20 bp, Artificial Sequence
  sgRNA
  H2-DMb1_15
ggatgatgctgggaccccac

SEQ ID NO: 25959 - DNA, 20 bp, Artificial Sequence
  sgRNA
  H2-DMb1_16
tcctcagtctggactgtatg

SEQ ID NO: 25960 - DNA, 20 bp, Artificial Sequence
  sgRNA
  H2-DMb1_17
tctctctggatccacctacc

SEQ ID NO: 25961 - DNA, 20 bp, Artificial Sequence
  sgRNA
  H2-DMb1_18
tgtggaaagcacgtgcgtgc

SEQ ID NO: 25962 - DNA, 20 bp, Artificial Sequence
  sgRNA
  H2-DMb1_19
gaaggctctcttctttgttg

SEQ ID NO: 25963 - DNA, 20 bp, Artificial Sequence
  sgRNA
  H2-DMb1_20
tcagcgcattccagaagggc

SEQ ID NO: 25964 - DNA, 20 bp, Artificial Sequence
  sgRNA
  H2-DMb2_1
taaggctctcctgttcgttg

SEQ ID NO: 25965 - DNA, 20 bp, Artificial Sequence
  sgRNA
  H2-DMb2_2
cgtgcgtgctgaatgatgct

SEQ ID NO: 25966 - DNA, 20 bp, Artificial Sequence
  sgRNA
  H2-DMb2_3
tgggtcagcacatcccagaa

SEQ ID NO: 25967 - DNA, 20 bp, Artificial Sequence
  sgRNA
  H2-DMb2_4
cctcagtctgcactgtatgg

SEQ ID NO: 25968 - DNA, 20 bp, Artificial Sequence
  sgRNA
  H2-DMb2_5
gacctctgagcccatccgcg

SEQ ID NO: 25969 - DNA, 20 bp, Artificial Sequence
  sgRNA
  H2-DMb2_6
gtccccgcggatgggctcag

SEQ ID NO: 25970 - DNA, 20 bp, Artificial Sequence
  sgRNA
  H2-DMb2_7
atttggggtgctgtctagat

SEQ ID NO: 25971 - DNA, 20 bp, Artificial Sequence
  sgRNA
  H2-DMb2_8
cagcacatcccagaaaggtt

SEQ ID NO: 25972 - DNA, 20 bp, Artificial Sequence
  sgRNA
  H2-DMb2_9
acgggctcccttgtgttaaa

SEQ ID NO: 25973 - DNA, 20 bp, Artificial Sequence
  sgRNA
  H2-DMb2_10
cttattcatcgcttgcaaaa

SEQ ID NO: 25974 - DNA, 20 bp, Artificial Sequence
  sgRNA
  H2-DMb2_11
gacagcaccccaaattcaca

SEQ ID NO: 25975 - DNA, 20 bp, Artificial Sequence
  sgRNA
  H2-DMb2_12
agacagcaccccaaattcac

SEQ ID NO: 25976 - DNA, 20 bp, Artificial Sequence
  sgRNA
  H2-DMb2_13
ggacctctgagcccatccgc

SEQ ID NO: 25977 - DNA, 20 bp, Artificial Sequence
  sgRNA
  H2-DMb2_14
gacgtagcaggccagcatca

SEQ ID NO: 25978 - DNA, 20 bp, Artificial Sequence
  sgRNA
  H2-DMb2_15
tcagcacatcccagaaaggt

SEQ ID NO: 25979 - DNA, 20 bp, Artificial Sequence
  sgRNA
  H2-DMb2_16
cccggatccacctacccaga

SEQ ID NO: 25980 - DNA, 20 bp, Artificial Sequence
  sgRNA
  H2-DMb2_17
ttattcatcgcttgcaaaac

SEQ ID NO: 25981 - DNA, 20 bp, Artificial Sequence
  sgRNA
  H2-DMb2_18
cttctgggtaggtggatccg

SEQ ID NO: 25982 - DNA, 20 bp, Artificial Sequence
  sgRNA
  H2-DMb2_19
gaatgatgctgggaccccac

SEQ ID NO: 25983 - DNA, 20 bp, Artificial Sequence
  sgRNA
  H2-DMb2_20
ggtcctcagtctgcactgta

SEQ ID NO: 25984 - DNA, 20 bp, Artificial Sequence
  sgRNA
  H2-Eb2_1
cctgactaaaatcaccggag

SEQ ID NO: 25985 - DNA, 20 bp, Artificial Sequence
  sgRNA
  H2-Eb2_2
cagatggttccggaatggcg

SEQ ID NO: 25986 - DNA, 20 bp, Artificial Sequence
  sgRNA
  H2-Eb2_3
tcaacatgaagatatccaca

SEQ ID NO: 25987 - DNA, 20 bp, Artificial Sequence
  sgRNA
  H2-Eb2_4
agactggacctaccagaccc

SEQ ID NO: 25988 - DNA, 20 bp, Artificial Sequence
  sgRNA
  H2-Eb2_5
aaccatctccagcatcacca

SEQ ID NO: 25989 - DNA, 20 bp, Artificial Sequence
  sgRNA
  H2-Eb2_6
ggatcacagctgccacacag

SEQ ID NO: 25990 - DNA, 20 bp, Artificial Sequence
  sgRNA
  H2-Eb2_7
gtgtaaacctctccaccccg

SEQ ID NO: 25991 - DNA, 20 bp, Artificial Sequence
  sgRNA
  H2-Eb2_8
gggtccctgactaaaatcac

SEQ ID NO: 25992 - DNA, 20 bp, Artificial Sequence
  sgRNA
  H2-Eb2_9
ccctgactaaaatcaccgga

SEQ ID NO: 25993 - DNA, 20 bp, Artificial Sequence
  sgRNA
  H2-Eb2_10
attatcgtgcctcagtagac

SEQ ID NO: 25994 - DNA, 20 bp, Artificial Sequence
  sgRNA
  H2-Eb2_11
gcagggtacacagtcacctt

SEQ ID NO: 25995 - DNA, 20 bp, Artificial Sequence
  sgRNA
  H2-Eb2_12
agaagaacagccccactgcg

SEQ ID NO: 25996 - DNA, 20 bp, Artificial Sequence
  sgRNA
  H2-Eb2_13
ctgagtgtcactacttcaat

SEQ ID NO: 25997 - DNA, 20 bp, Artificial Sequence
  sgRNA
  H2-Eb2_14
gcacagaacaagttgttgag

SEQ ID NO: 25998 - DNA, 20 bp, Artificial Sequence
  sgRNA
  H2-Eb2_15
gctgagtgtcactacttcaa

SEQ ID NO: 25999 - DNA, 20 bp, Artificial Sequence
  sgRNA
  H2-Eb2_16
ccagaggctgtgtctttgca

SEQ ID NO: 26000 - DNA, 20 bp, Artificial Sequence
  sgRNA
  H2-Eb2_17
atgctggagatggttcctcg

SEQ ID NO: 26001 - DNA, 20 bp, Artificial Sequence
  sgRNA
  H2-Eb2_18
aggtctgttcatcctcgcag

SEQ ID NO: 26002 - DNA, 20 bp, Artificial Sequence
  sgRNA
  H2-Eb2_19
tgagtacttgaacacccaga

SEQ ID NO: 26003 - DNA, 20 bp, Artificial Sequence
  sgRNA
  H2-Eb2_20
ggtctgttcatcctcgcagt

SEQ ID NO: 26004 - DNA, 20 bp, Artificial Sequence
  sgRNA
  H2-K1_1
tagccgacttccatgtaccg

SEQ ID NO: 26005 - DNA, 20 bp, Artificial Sequence
  sgRNA
  H2-K1_2
caatgagcagagtttccgag

SEQ ID NO: 26006 - DNA, 20 bp, Artificial Sequence
  sgRNA
  H2-K1_3
gtacatggaagtcggctacg

SEQ ID NO: 26007 - DNA, 20 bp, Artificial Sequence
  sgRNA
  H2-K1_4
gcagggtcctcaggtccact

SEQ ID NO: 26008 - DNA, 20 bp, Artificial Sequence
  sgRNA
  H2-K1_5
ccatgtaccggggctccccg

SEQ ID NO: 26009 - DNA, 20 bp, Artificial Sequence
  sgRNA
  H2-K1_6
gatatgagccgcgggcgcgg

SEQ ID NO: 26010 - DNA, 20 bp, Artificial Sequence
  sgRNA
  H2-K1_7
catgccatgtgtaccatcag

SEQ ID NO: 26011 - DNA, 20 bp, Artificial Sequence
  sgRNA
  H2-K1_8
taccagcagtacgcctacga

SEQ ID NO: 26012 - DNA, 20 bp, Artificial Sequence
  sgRNA
  H2-K1_9
cagtgactattgcagctcca

SEQ ID NO: 26013 - DNA, 20 bp, Artificial Sequence
  sgRNA
  H2-K1_10
gctgatcaccaaacacaagt

SEQ ID NO: 26014 - DNA, 20 bp, Artificial Sequence
  sgRNA
  H2-K1_11
ctgaagataaagtcaccctg

SEQ ID NO: 26015 - DNA, 20 bp, Artificial Sequence
  sgRNA
  H2-K1_12
cgagatatgagccgcgggcg

SEQ ID NO: 26016 - DNA, 20 bp, Artificial Sequence
  sgRNA
  H2-K1_13
cgaaatacctcagcgagtgt

SEQ ID NO: 26017 - DNA, 20 bp, Artificial Sequence
  sgRNA
  H2-K1_14
gcgggtctgagtcggagcca

SEQ ID NO: 26018 - DNA, 20 bp, Artificial Sequence
  sgRNA
  H2-K1_15
ggtctgagtcggagccaggg

SEQ ID NO: 26019 - DNA, 20 bp, Artificial Sequence
  sgRNA
  H2-K1_16
cggaccacctcaccagaccc

SEQ ID NO: 26020 - DNA, 20 bp, Artificial Sequence
  sgRNA
  H2-K1_17
tctgctgtgatgggtcacat

SEQ ID NO: 26021 - DNA, 20 bp, Artificial Sequence
  sgRNA
  H2-K1_18
atctgggagagacagatcag

SEQ ID NO: 26022 - DNA, 20 bp, Artificial Sequence
  sgRNA
  H2-K1_19
ggaccacctcaccagacccc

SEQ ID NO: 26023 - DNA, 20 bp, Artificial Sequence
  sgRNA
  H2-K1_20
tggtgaagcagagagactca

SEQ ID NO: 26024 - DNA, 20 bp, Artificial Sequence
  sgRNA
  H2-M1_1
tagccgagaaagattaactg

SEQ ID NO: 26025 - DNA, 20 bp, Artificial Sequence
  sgRNA
  H2-M1_2
cagtatatcagagaatctgg

SEQ ID NO: 26026 - DNA, 20 bp, Artificial Sequence
  sgRNA
  H2-M1_3
gaaaataaaatatgcaaacc

SEQ ID NO: 26027 - DNA, 20 bp, Artificial Sequence
  sgRNA
  H2-M1_4
cacagacgctacttcagtca

SEQ ID NO: 26028 - DNA, 20 bp, Artificial Sequence
  sgRNA
  H2-M1_5
tcttcagtctcatacatcca

SEQ ID NO: 26029 - DNA, 20 bp, Artificial Sequence
  sgRNA
  H2-M1_6
gccatcacgaagcatccaaa

SEQ ID NO: 26030 - DNA, 20 bp, Artificial Sequence
  sgRNA
  H2-M1_7
atagccaagaagggaatggt

SEQ ID NO: 26031 - DNA, 20 bp, Artificial Sequence
  sgRNA
  H2-M1_8
gcaataacaatagccaagaa

SEQ ID NO: 26032 - DNA, 20 bp, Artificial Sequence
  sgRNA
  H2-M1_9
tctgcaggaaagacttcacc

SEQ ID NO: 26033 - DNA, 20 bp, Artificial Sequence
  sgRNA
  H2-M1_10
cagcaaactcttcttcccaa

SEQ ID NO: 26034 - DNA, 20 bp, Artificial Sequence
  sgRNA
  H2-M1_11
ataccctcctgtcatggcct

SEQ ID NO: 26035 - DNA, 20 bp, Artificial Sequence
  sgRNA
  H2-M1_12
aattaccctaacctggcaga

SEQ ID NO: 26036 - DNA, 20 bp, Artificial Sequence
  sgRNA
  H2-M1_13
gtacttggagcactccttat

SEQ ID NO: 26037 - DNA, 20 bp, Artificial Sequence
  sgRNA
  H2-M1_14
tatatcagagaatctggggg

SEQ ID NO: 26038 - DNA, 20 bp, Artificial Sequence
  sgRNA
  H2-M1_15
aggtgatcatgagcagcagg

SEQ ID NO: 26039 - DNA, 20 bp, Artificial Sequence
  sgRNA
  H2-M1_16
cagataggaaaaccaccttg

SEQ ID NO: 26040 - DNA, 20 bp, Artificial Sequence
  sgRNA
  H2-M1_17
gaaggcccagcacctcaagg

SEQ ID NO: 26041 - DNA, 20 bp, Artificial Sequence
  sgRNA
  H2-M1_18
tgagatgcttaaggaaatgt

SEQ ID NO: 26042 - DNA, 20 bp, Artificial Sequence
  sgRNA
  H2-M1_19
aactcttcttcccaaaggcc

SEQ ID NO: 26043 - DNA, 20 bp, Artificial Sequence
  sgRNA
  H2-M1_20
agtagcgtctgtgcatgact

SEQ ID NO: 26044 - DNA, 20 bp, Artificial Sequence
  sgRNA
  H2-M10.1_1
atgcaggtgaagcaaaacgg

SEQ ID NO: 26045 - DNA, 20 bp, Artificial Sequence
  sgRNA
  H2-M10.1_2
tgagtcggtagtgaccgccg

SEQ ID NO: 26046 - DNA, 20 bp, Artificial Sequence
  sgRNA
  H2-M10.1_3
acagcaaagacccatctgca

SEQ ID NO: 26047 - DNA, 20 bp, Artificial Sequence
  sgRNA
  H2-M10.1_4
tgaaccactattgtgcaggt

SEQ ID NO: 26048 - DNA, 20 bp, Artificial Sequence
  sgRNA
  H2-M10.1_5
acacgcgaagagcaggtggg

SEQ ID NO: 26049 - DNA, 20 bp, Artificial Sequence
  sgRNA
  H2-M10.1_6
tcaacacgcgaagagcaggt

SEQ ID NO: 26050 - DNA, 20 bp, Artificial Sequence
  sgRNA
  H2-M10.1_7
ggaggaagacttacctgcaa

SEQ ID NO: 26051 - DNA, 20 bp, Artificial Sequence
  sgRNA
  H2-M10.1_8
gaggttgcatccctgcagat

SEQ ID NO: 26052 - DNA, 20 bp, Artificial Sequence
  sgRNA
  H2-M10.1_9
tcttggactgcagagggcaa

SEQ ID NO: 26053 - DNA, 20 bp, Artificial Sequence
  sgRNA
  H2-M10.1_10
ggtccaaggccaccatcagg

SEQ ID NO: 26054 - DNA, 20 bp, Artificial Sequence
  sgRNA
  H2-M10.1_11
ggatgcaacctcgagctgca

SEQ ID NO: 26055 - DNA, 20 bp, Artificial Sequence
  sgRNA
  H2-M10.1_12
agctctatccatgcagctcg

SEQ ID NO: 26056 - DNA, 20 bp, Artificial Sequence
  sgRNA
  H2-M10.1_13
gttcttggaaccttggtggt

SEQ ID NO: 26057 - DNA, 20 bp, Artificial Sequence
  sgRNA
  H2-M10.1_14
gtatcttagctcttctccag

SEQ ID NO: 26058 - DNA, 20 bp, Artificial Sequence
  sgRNA
  H2-M10.1_15
gaggaagacttacctgcaag

SEQ ID NO: 26059 - DNA, 20 bp, Artificial Sequence
  sgRNA
  H2-M10.1_16
tatcttagctcttctccaga

SEQ ID NO: 26060 - DNA, 20 bp, Artificial Sequence
  sgRNA
  H2-M10.1_17
aggaggagcaggagtgtgca

SEQ ID NO: 26061 - DNA, 20 bp, Artificial Sequence
  sgRNA
  H2-M10.1_18
gctcctcctgatggtggcct

SEQ ID NO: 26062 - DNA, 20 bp, Artificial Sequence
  sgRNA
  H2-M10.1_19
tcgagctgcatggatagagc

SEQ ID NO: 26063 - DNA, 20 bp, Artificial Sequence
  sgRNA
  H2-M10.1_20
gacctgaaccactattgtgc

SEQ ID NO: 26064 - DNA, 20 bp, Artificial Sequence
  sgRNA
  H2-M10.2_1
ctacaatgaacagagcaatg

SEQ ID NO: 26065 - DNA, 20 bp, Artificial Sequence
  sgRNA
  H2-M10.2_2
tgagccggtagagaccgccg

SEQ ID NO: 26066 - DNA, 20 bp, Artificial Sequence
  sgRNA
  H2-M10.2_3
gtgaatgtaggcgcagcgga

SEQ ID NO: 26067 - DNA, 20 bp, Artificial Sequence
  sgRNA
  H2-M10.2_4
tagccgacctggatgatccg

SEQ ID NO: 26068 - DNA, 20 bp, Artificial Sequence
  sgRNA
  H2-M10.2_5
cttggtgaatgtaggcgcag

SEQ ID NO: 26069 - DNA, 20 bp, Artificial Sequence
  sgRNA
  H2-M10.2_6
tgtgcactcccctagcaggt

SEQ ID NO: 26070 - DNA, 20 bp, Artificial Sequence
  sgRNA
  H2-M10.2_7
gctgcaatgtggataatgat

SEQ ID NO: 26071 - DNA, 20 bp, Artificial Sequence
  sgRNA
  H2-M10.2_8
cgtttgtcagtgacaagcgc

SEQ ID NO: 26072 - DNA, 20 bp, Artificial Sequence
  sgRNA
  H2-M10.2_9
agatgggaaaaactacaccc

SEQ ID NO: 26073 - DNA, 20 bp, Artificial Sequence
  sgRNA
  H2-M10.2_10
ccaggaaagttccaagaacc

SEQ ID NO: 26074 - DNA, 20 bp, Artificial Sequence
  sgRNA
  H2-M10.2_11
gttcttggaactttcctggt

SEQ ID NO: 26075 - DNA, 20 bp, Artificial Sequence
  sgRNA
  H2-M10.2_12
gatgaactcatagccgtagt

SEQ ID NO: 26076 - DNA, 20 bp, Artificial Sequence
  sgRNA
  H2-M10.2_13
cgaggttgcatccttgcagt

SEQ ID NO: 26077 - DNA, 20 bp, Artificial Sequence
  sgRNA
  H2-M10.2_14
tagatgcctggacctcggaa

SEQ ID NO: 26078 - DNA, 20 bp, Artificial Sequence
  sgRNA
  H2-M10.2_15
gtatctcagctcttctccag

SEQ ID NO: 26079 - DNA, 20 bp, Artificial Sequence
  sgRNA
  H2-M10.2_16
tttcctggtaggaactgtgg

SEQ ID NO: 26080 - DNA, 20 bp, Artificial Sequence
  sgRNA
  H2-M10.2_17
tcaggtccaaggccaccaag

SEQ ID NO: 26081 - DNA, 20 bp, Artificial Sequence
  sgRNA
  H2-M10.2_18
aagaggaggaggaagttgca

SEQ ID NO: 26082 - DNA, 20 bp, Artificial Sequence
  sgRNA
  H2-M10.2_19
acagcaaagaaccgactgca

SEQ ID NO: 26083 - DNA, 20 bp, Artificial Sequence
  sgRNA
  H2-M10.2_20
tgggttcctgaagacagact

SEQ ID NO: 26084 - DNA, 20 bp, Artificial Sequence
  sgRNA
  H2-M10.3_1
actacctaagtattggaacg

SEQ ID NO: 26085 - DNA, 20 bp, Artificial Sequence
  sgRNA
  H2-M10.3_2
gtggaagacttaccttcgag

SEQ ID NO: 26086 - DNA, 20 bp, Artificial Sequence
  sgRNA
  H2-M10.3_3
atttgacagcaaagaaccaa

SEQ ID NO: 26087 - DNA, 20 bp, Artificial Sequence
  sgRNA
  H2-M10.3_4
aaatatgaacatagaatgaa

SEQ ID NO: 26088 - DNA, 20 bp, Artificial Sequence
  sgRNA
  H2-M10.3_5
ggtggaagacttaccttcga

SEQ ID NO: 26089 - DNA, 20 bp, Artificial Sequence
  sgRNA
  H2-M10.3_6
cccatcatagcaatcctcat

SEQ ID NO: 26090 - DNA, 20 bp, Artificial Sequence
  sgRNA
  H2-M10.3_7
tgaatacatgaagaacaggt

SEQ ID NO: 26091 - DNA, 20 bp, Artificial Sequence
  sgRNA
  H2-M10.3_8
catcaccctgacctggaaga

SEQ ID NO: 26092 - DNA, 20 bp, Artificial Sequence
  sgRNA
  H2-M10.3_9
aggtctcctttccaaggtcg

SEQ ID NO: 26093 - DNA, 20 bp, Artificial Sequence
  sgRNA
  H2-M10.3_10
atatgagtgaggcagaaagg

SEQ ID NO: 26094 - DNA, 20 bp, Artificial Sequence
  sgRNA
  H2-M10.3_11
gtctccacgttccaatactt

SEQ ID NO: 26095 - DNA, 20 bp, Artificial Sequence
  sgRNA
  H2-M10.3_12
gccagataccaggcctgcag

SEQ ID NO: 26096 - DNA, 20 bp, Artificial Sequence
  sgRNA
  H2-M10.3_13
atagccaatgtggatgaacc

SEQ ID NO: 26097 - DNA, 20 bp, Artificial Sequence
  sgRNA
  H2-M10.3_14
acatggagctgccagatacc

SEQ ID NO: 26098 - DNA, 20 bp, Artificial Sequence
  sgRNA
  H2-M10.3_15
cgaggtttcaaaatagccat

SEQ ID NO: 26099 - DNA, 20 bp, Artificial Sequence
  sgRNA
  H2-M10.3_16
gcctagggcccagcacctca

SEQ ID NO: 26100 - DNA, 20 bp, Artificial Sequence
  sgRNA
  H2-M10.3_17
tagatacctcgaccttggaa

SEQ ID NO: 26101 - DNA, 20 bp, Artificial Sequence
  sgRNA
  H2-M10.3_18
tgagccggaagtgaccgtga

SEQ ID NO: 26102 - DNA, 20 bp, Artificial Sequence
  sgRNA
  H2-M10.3_19
caggtgggagaatatgagtg

SEQ ID NO: 26103 - DNA, 20 bp, Artificial Sequence
  sgRNA
  H2-M10.3_20
cttcttagatacctcgacct

SEQ ID NO: 26104 - DNA, 20 bp, Artificial Sequence
  sgRNA
  H2-M10.4_1
tgagcccgtagtgaccacca

SEQ ID NO: 26105 - DNA, 20 bp, Artificial Sequence
  sgRNA
  H2-M10.4_2
cacccaccttcacaatactg

SEQ ID NO: 26106 - DNA, 20 bp, Artificial Sequence
  sgRNA
  H2-M10.4_3
cctgaactcttggactacag

SEQ ID NO: 26107 - DNA, 20 bp, Artificial Sequence
  sgRNA
  H2-M10.4_4
aagacgaactcttatataca

SEQ ID NO: 26108 - DNA, 20 bp, Artificial Sequence
  sgRNA
  H2-M10.4_5
tttaatccagaccggacgca

SEQ ID NO: 26109 - DNA, 20 bp, Artificial Sequence
  sgRNA
  H2-M10.4_6
gccggtctatggtcaccaat

SEQ ID NO: 26110 - DNA, 20 bp, Artificial Sequence
  sgRNA
  H2-M10.4_7
acgcaaggaagcgtgacaga

SEQ ID NO: 26111 - DNA, 20 bp, Artificial Sequence
  sgRNA
  H2-M10.4_8
gctgcaatgtggcacatgat

SEQ ID NO: 26112 - DNA, 20 bp, Artificial Sequence
  sgRNA
  H2-M10.4_9
tggactacagagggaaaagt

SEQ ID NO: 26113 - DNA, 20 bp, Artificial Sequence
  sgRNA
  H2-M10.4_10
cccacaaagtaacacctgaa

SEQ ID NO: 26114 - DNA, 20 bp, Artificial Sequence
  sgRNA
  H2-M10.4_11
acagcagatcagagactgcg

SEQ ID NO: 26115 - DNA, 20 bp, Artificial Sequence
  sgRNA
  H2-M10.4_12
ctgaactcttggactacaga

SEQ ID NO: 26116 - DNA, 20 bp, Artificial Sequence
  sgRNA
  H2-M10.4_13
tggtcaccaataggaggcaa

SEQ ID NO: 26117 - DNA, 20 bp, Artificial Sequence
  sgRNA
  H2-M10.4_14
actacagagggaaaagtagg

SEQ ID NO: 26118 - DNA, 20 bp, Artificial Sequence
  sgRNA
  H2-M10.4_15
tcattcttccaatattcagg

SEQ ID NO: 26119 - DNA, 20 bp, Artificial Sequence
  sgRNA
  H2-M10.4_16
gcagctgtggtggttccttt

SEQ ID NO: 26120 - DNA, 20 bp, Artificial Sequence
  sgRNA
  H2-M10.4_17
tgccatcctttgcctcctat

SEQ ID NO: 26121 - DNA, 20 bp, Artificial Sequence
  sgRNA
  H2-M10.4_18
gaccggccccagtattgtga

SEQ ID NO: 26122 - DNA, 20 bp, Artificial Sequence
  sgRNA
  H2-M10.4_19
aatgagacagaacatgccat

SEQ ID NO: 26123 - DNA, 20 bp, Artificial Sequence
  sgRNA
  H2-M10.4_20
ggttcttgtagctttggtgg

SEQ ID NO: 26124 - DNA, 20 bp, Artificial Sequence
  sgRNA
  H2-M10.5_1
cagtgagacagcaagcgttg

SEQ ID NO: 26125 - DNA, 20 bp, Artificial Sequence
  sgRNA
  H2-M10.5_2
tgagccggaagtgaccgccg

SEQ ID NO: 26126 - DNA, 20 bp, Artificial Sequence
  sgRNA
  H2-M10.5_3
aaaaatgaacaaagaatgga

SEQ ID NO: 26127 - DNA, 20 bp, Artificial Sequence
  sgRNA
  H2-M10.5_4
tgaatatgtgaagagcaggt

SEQ ID NO: 26128 - DNA, 20 bp, Artificial Sequence
  sgRNA
  H2-M10.5_5
tgctccatccatgcaacccg

SEQ ID NO: 26129 - DNA, 20 bp, Artificial Sequence
  sgRNA
  H2-M10.5_6
ggaaaggcttcttagataca

SEQ ID NO: 26130 - DNA, 20 bp, Artificial Sequence
  sgRNA
  H2-M10.5_7
acataaccatgacttggaag

SEQ ID NO: 26131 - DNA, 20 bp, Artificial Sequence
  sgRNA
  H2-M10.5_8
cataaccatgacttggaaga

SEQ ID NO: 26132 - DNA, 20 bp, Artificial Sequence
  sgRNA
  H2-M10.5_9
cgaggtagcaaaactgcaat

SEQ ID NO: 26133 - DNA, 20 bp, Artificial Sequence
  sgRNA
  H2-M10.5_10
catgtcatgtgcaccataaa

SEQ ID NO: 26134 - DNA, 20 bp, Artificial Sequence
  sgRNA
  H2-M10.5_11
tcactggtccaatatgtcat

SEQ ID NO: 26135 - DNA, 20 bp, Artificial Sequence
  sgRNA
  H2-M10.5_12
atagccaatgtggacgaacc

SEQ ID NO: 26136 - DNA, 20 bp, Artificial Sequence
  sgRNA
  H2-M10.5_13
tttccacgcacactccttgc

SEQ ID NO: 26137 - DNA, 20 bp, Artificial Sequence
  sgRNA
  H2-M10.5_14
gcagcaatgcttcctttcca

SEQ ID NO: 26138 - DNA, 20 bp, Artificial Sequence
  sgRNA
  H2-M10.5_15
ctgagctcctggattgcaca

SEQ ID NO: 26139 - DNA, 20 bp, Artificial Sequence
  sgRNA
  H2-M10.5_16
gtgaaggtgatgcagaaagg

SEQ ID NO: 26140 - DNA, 20 bp, Artificial Sequence
  sgRNA
  H2-M10.5_17
tgagcctctcaagctgaaat

SEQ ID NO: 26141 - DNA, 20 bp, Artificial Sequence
  sgRNA
  H2-M10.5_18
acaatactggatcaggtcca

SEQ ID NO: 26142 - DNA, 20 bp, Artificial Sequence
  sgRNA
  H2-M10.5_19
ttacctgcaaggagtgtgcg

SEQ ID NO: 26143 - DNA, 20 bp, Artificial Sequence
  sgRNA
  H2-M10.5_20
ggaagtgtatggctgcaatg

SEQ ID NO: 26144 - DNA, 20 bp, Artificial Sequence
  sgRNA
  H2-M10.6_1
gcttcctcgaaggtcactac

SEQ ID NO: 26145 - DNA, 20 bp, Artificial Sequence
  sgRNA
  H2-M10.6_2
aagacataccaggagcaagg

SEQ ID NO: 26146 - DNA, 20 bp, Artificial Sequence
  sgRNA
  H2-M10.6_3
acagcaaagaaccaaatgca

SEQ ID NO: 26147 - DNA, 20 bp, Artificial Sequence
  sgRNA
  H2-M10.6_4
tggagtctacgtatccgacc

SEQ ID NO: 26148 - DNA, 20 bp, Artificial Sequence
  sgRNA
  H2-M10.6_5
ggtctattgccatcaacagg

SEQ ID NO: 26149 - DNA, 20 bp, Artificial Sequence
  sgRNA
  H2-M10.6_6
ggaagtgtatggctgcaacg

SEQ ID NO: 26150 - DNA, 20 bp, Artificial Sequence
  sgRNA
  H2-M10.6_7
catgtcatgtcaaccatgaa

SEQ ID NO: 26151 - DNA, 20 bp, Artificial Sequence
  sgRNA
  H2-M10.6_8
gctgcaacgtggcaaatgat

SEQ ID NO: 26152 - DNA, 20 bp, Artificial Sequence
  sgRNA
  H2-M10.6_9
tcaaccatgaagggttacct

SEQ ID NO: 26153 - DNA, 20 bp, Artificial Sequence
  sgRNA
  H2-M10.6_10
tcaggtctattgccatcaac

SEQ ID NO: 26154 - DNA, 20 bp, Artificial Sequence
  sgRNA
  H2-M10.6_11
ggatggaaaaaaccacaccc

SEQ ID NO: 26155 - DNA, 20 bp, Artificial Sequence
  sgRNA
  H2-M10.6_12
tggactgcagagggtgaagt

SEQ ID NO: 26156 - DNA, 20 bp, Artificial Sequence
  sgRNA
  H2-M10.6_13
gcaaataaagacaagaataa

SEQ ID NO: 26157 - DNA, 20 bp, Artificial Sequence
  sgRNA
  H2-M10.6_14
gaggcatgacagaaagttgg

SEQ ID NO: 26158 - DNA, 20 bp, Artificial Sequence
  sgRNA
  H2-M10.6_15
ctattgccatcaacaggagg

SEQ ID NO: 26159 - DNA, 20 bp, Artificial Sequence
  sgRNA
  H2-M10.6_16
gtatccgacctggatgaacc

SEQ ID NO: 26160 - DNA, 20 bp, Artificial Sequence
  sgRNA
  H2-M10.6_17
ttacctgctaggggaatgcg

SEQ ID NO: 26161 - DNA, 20 bp, Artificial Sequence
  sgRNA
  H2-M10.6_18
tctttctcccaatattcagg

SEQ ID NO: 26162 - DNA, 20 bp, Artificial Sequence
  sgRNA
  H2-M10.6_19
ttgccatcaacaggaggagg

SEQ ID NO: 26163 - DNA, 20 bp, Artificial Sequence
  sgRNA
  H2-M10.6_20
tatctcagctcttctccagg

SEQ ID NO: 26164 - DNA, 20 bp, Artificial Sequence
  sgRNA
  H2-M11_1
ccgtttctgaaataccctcg

SEQ ID NO: 26165 - DNA, 20 bp, Artificial Sequence
  sgRNA
  H2-M11_2
cctgaaaatagctcagaacg

SEQ ID NO: 26166 - DNA, 20 bp, Artificial Sequence
  sgRNA
  H2-M11_3
gccatgaccagtcatccaga

SEQ ID NO: 26167 - DNA, 20 bp, Artificial Sequence
  sgRNA
  H2-M11_4
aattggggcttaggcatcca

SEQ ID NO: 26168 - DNA, 20 bp, Artificial Sequence
  sgRNA
  H2-M11_5
aaatgtgaagaatttcctgg

SEQ ID NO: 26169 - DNA, 20 bp, Artificial Sequence
  sgRNA
  H2-M11_6
gctgctatatcctgcctcga

SEQ ID NO: 26170 - DNA, 20 bp, Artificial Sequence
  sgRNA
  H2-M11_7
atatgcataaaggaaatggt

SEQ ID NO: 26171 - DNA, 20 bp, Artificial Sequence
  sgRNA
  H2-M11_8
ggacaaaagcaatcaaaccc

SEQ ID NO: 26172 - DNA, 20 bp, Artificial Sequence
  sgRNA
  H2-M11_9
tcaatgaccatgattccatc

SEQ ID NO: 26173 - DNA, 20 bp, Artificial Sequence
  sgRNA
  H2-M11_10
aggttagggtgatttcagca

SEQ ID NO: 26174 - DNA, 20 bp, Artificial Sequence
  sgRNA
  H2-M11_11
gaagagagcctcggtaacaa

SEQ ID NO: 26175 - DNA, 20 bp, Artificial Sequence
  sgRNA
  H2-M11_12
ggacagagcactgtgcacca

SEQ ID NO: 26176 - DNA, 20 bp, Artificial Sequence
  sgRNA
  H2-M11_13
caaaatacatgtgatccgta

SEQ ID NO: 26177 - DNA, 20 bp, Artificial Sequence
  sgRNA
  H2-M11_14
ctccgtgacctccatgtcca

SEQ ID NO: 26178 - DNA, 20 bp, Artificial Sequence
  sgRNA
  H2-M11_15
gtgttatccttccaatactc

SEQ ID NO: 26179 - DNA, 20 bp, Artificial Sequence
  sgRNA
  H2-M11_16
tcacggagaccatgcctaca

SEQ ID NO: 26180 - DNA, 20 bp, Artificial Sequence
  sgRNA
  H2-M11_17
acagcagaagagatgttcag

SEQ ID NO: 26181 - DNA, 20 bp, Artificial Sequence
  sgRNA
  H2-M11_18
tttgtccctttcccaggtta

SEQ ID NO: 26182 - DNA, 20 bp, Artificial Sequence
  sgRNA
  H2-M11_19
cagcagcaggaagagagcct

SEQ ID NO: 26183 - DNA, 20 bp, Artificial Sequence
  sgRNA
  H2-M11_20
aaagaagccagagtattgga

SEQ ID NO: 26184 - DNA, 20 bp, Artificial Sequence
  sgRNA
  H2-M2_1
atagccaacagtcatgtagt

SEQ ID NO: 26185 - DNA, 20 bp, Artificial Sequence
  sgRNA
  H2-M2_2
agagtgggaggcaactaatg

SEQ ID NO: 26186 - DNA, 20 bp, Artificial Sequence
  sgRNA
  H2-M2_3
caggttctcacaccatccaa

SEQ ID NO: 26187 - DNA, 20 bp, Artificial Sequence
  sgRNA
  H2-M2_4
tgcgatgtcgaagtaccgca

SEQ ID NO: 26188 - DNA, 20 bp, Artificial Sequence
  sgRNA
  H2-M2_5
tgtcatgtggaagaagagct

SEQ ID NO: 26189 - DNA, 20 bp, Artificial Sequence
  sgRNA
  H2-M2_6
gctgctacattggaccagac

SEQ ID NO: 26190 - DNA, 20 bp, Artificial Sequence
  sgRNA
  H2-M2_7
agatcatgatgatgtcagaa

SEQ ID NO: 26191 - DNA, 20 bp, Artificial Sequence
  sgRNA
  H2-M2_8
tgttccatccaaggcactcg

SEQ ID NO: 26192 - DNA, 20 bp, Artificial Sequence
  sgRNA
  H2-M2_9
gatcacccgtagagagtggg

SEQ ID NO: 26193 - DNA, 20 bp, Artificial Sequence
  sgRNA
  H2-M2_10
cagtggctactcttgtcatg

SEQ ID NO: 26194 - DNA, 20 bp, Artificial Sequence
  sgRNA
  H2-M2_11
agttgcctcccactctctac

SEQ ID NO: 26195 - DNA, 20 bp, Artificial Sequence
  sgRNA
  H2-M2_12
ggaggaccagacccaggaca

SEQ ID NO: 26196 - DNA, 20 bp, Artificial Sequence
  sgRNA
  H2-M2_13
gtcgaagtaccgcaaggagt

SEQ ID NO: 26197 - DNA, 20 bp, Artificial Sequence
  sgRNA
  H2-M2_14
ggtttgagccccgagtgcct

SEQ ID NO: 26198 - DNA, 20 bp, Artificial Sequence
  sgRNA
  H2-M2_15
tcatgatctggcaaagagat

SEQ ID NO: 26199 - DNA, 20 bp, Artificial Sequence
  sgRNA
  H2-M2_16
actgacggtatgcgtgaagt

SEQ ID NO: 26200 - DNA, 20 bp, Artificial Sequence
  sgRNA
  H2-M2_17
acaatgaggctgagaatccg

SEQ ID NO: 26201 - DNA, 20 bp, Artificial Sequence
  sgRNA
  H2-M2_18
gcccatcataaccaaactga

SEQ ID NO: 26202 - DNA, 20 bp, Artificial Sequence
  sgRNA
  H2-M2_19
ggctgctacattggaccaga

SEQ ID NO: 26203 - DNA, 20 bp, Artificial Sequence
  sgRNA
  H2-M2_20
acatgccatgtggctcatga

SEQ ID NO: 26204 - DNA, 20 bp, Artificial Sequence
  sgRNA
  H2-M3_1
actgcgctatttccacactg

SEQ ID NO: 26205 - DNA, 20 bp, Artificial Sequence
  sgRNA
  H2-M3_2
atagcattgaggaaattccg

SEQ ID NO: 26206 - DNA, 20 bp, Artificial Sequence
  sgRNA
  H2-M3_3
aaagtgccagagcaaacctt

SEQ ID NO: 26207 - DNA, 20 bp, Artificial Sequence
  sgRNA
  H2-M3_4
ggaaagaccagagtactgga

SEQ ID NO: 26208 - DNA, 20 bp, Artificial Sequence
  sgRNA
  H2-M3_5
agatatactggggctcccca

SEQ ID NO: 26209 - DNA, 20 bp, Artificial Sequence
  sgRNA
  H2-M3_6
acatggagcttgtggaaacg

SEQ ID NO: 26210 - DNA, 20 bp, Artificial Sequence
  sgRNA
  H2-M3_7
gttgctagtctggttctcct

SEQ ID NO: 26211 - DNA, 20 bp, Artificial Sequence
  sgRNA
  H2-M3_8
agctgctccacagattcctg

SEQ ID NO: 26212 - DNA, 20 bp, Artificial Sequence
  sgRNA
  H2-M3_9
ccaaaggtgatgttaccttg

SEQ ID NO: 26213 - DNA, 20 bp, Artificial Sequence
  sgRNA
  H2-M3_10
ggtctttccttctccatcca

SEQ ID NO: 26214 - DNA, 20 bp, Artificial Sequence
  sgRNA
  H2-M3_11
ggagccccagtatatctctg

SEQ ID NO: 26215 - DNA, 20 bp, Artificial Sequence
  sgRNA
  H2-M3_12
tagcccacagagatatactg

SEQ ID NO: 26216 - DNA, 20 bp, Artificial Sequence
  sgRNA
  H2-M3_13
aagagccgtttagagtcagc

SEQ ID NO: 26217 - DNA, 20 bp, Artificial Sequence
  sgRNA
  H2-M3_14
atttccacactgcggtgtca

SEQ ID NO: 26218 - DNA, 20 bp, Artificial Sequence
  sgRNA
  H2-M3_15
gtacttcagggcctatgtgg

SEQ ID NO: 26219 - DNA, 20 bp, Artificial Sequence
  sgRNA
  H2-M3_16
caggcactctccctccacat

SEQ ID NO: 26220 - DNA, 20 bp, Artificial Sequence
  sgRNA
  H2-M3_17
tggcacagcagagtacttca

SEQ ID NO: 26221 - DNA, 20 bp, Artificial Sequence
  sgRNA
  H2-M3_18
ggatggaacctcgtgcacct

SEQ ID NO: 26222 - DNA, 20 bp, Artificial Sequence
  sgRNA
  H2-M3_19
tgtggaaacgaggccttcag

SEQ ID NO: 26223 - DNA, 20 bp, Artificial Sequence
  sgRNA
  H2-M3_20
ccaccatgtgcaggagagcg

SEQ ID NO: 26224 - DNA, 20 bp, Artificial Sequence
  sgRNA
  H2-M5_1
tgccctagtgaatttgcagg

SEQ ID NO: 26225 - DNA, 20 bp, Artificial Sequence
  sgRNA
  H2-M5_2
gcactcacctgcgcgaacca

SEQ ID NO: 26226 - DNA, 20 bp, Artificial Sequence
  sgRNA
  H2-M5_3
atgcgtgcttctcatgccca

SEQ ID NO: 26227 - DNA, 20 bp, Artificial Sequence
  sgRNA
  H2-M5_4
caaaggcaatccttcttgaa

SEQ ID NO: 26228 - DNA, 20 bp, Artificial Sequence
  sgRNA
  H2-M5_5
catgagaagcacgcatacga

SEQ ID NO: 26229 - DNA, 20 bp, Artificial Sequence
  sgRNA
  H2-M5_6
ggcctcctgcaaattcacta

SEQ ID NO: 26230 - DNA, 20 bp, Artificial Sequence
  sgRNA
  H2-M5_7
ataggagggtagagagcgca

SEQ ID NO: 26231 - DNA, 20 bp, Artificial Sequence
  sgRNA
  H2-M5_8
catgtcatgtgcaacatgag

SEQ ID NO: 26232 - DNA, 20 bp, Artificial Sequence
  sgRNA
  H2-M5_9
ggtgagcagcaaggatagga

SEQ ID NO: 26233 - DNA, 20 bp, Artificial Sequence
  sgRNA
  H2-M5_10
gcaaaggcaatccttcttga

SEQ ID NO: 26234 - DNA, 20 bp, Artificial Sequence
  sgRNA
  H2-M5_11
gccttgaccctggttcgcgc

SEQ ID NO: 26235 - DNA, 20 bp, Artificial Sequence
  sgRNA
  H2-M5_12
cgtgcttctcatgcccacgg

SEQ ID NO: 26236 - DNA, 20 bp, Artificial Sequence
  sgRNA
  H2-M5_13
ccagatggactcttcctccg

SEQ ID NO: 26237 - DNA, 20 bp, Artificial Sequence
  sgRNA
  H2-M5_14
tcctgtgctacaacaataag

SEQ ID NO: 26238 - DNA, 20 bp, Artificial Sequence
  sgRNA
  H2-M5_15
tgcttcacccacagagcgcg

SEQ ID NO: 26239 - DNA, 20 bp, Artificial Sequence
  sgRNA
  H2-M5_16
catcatcctgacctggcagt

SEQ ID NO: 26240 - DNA, 20 bp, Artificial Sequence
  sgRNA
  H2-M5_17
ggacatctacaaccacagca

SEQ ID NO: 26241 - DNA, 20 bp, Artificial Sequence
  sgRNA
  H2-M5_18
ccaacagtgattcccatgat

SEQ ID NO: 26242 - DNA, 20 bp, Artificial Sequence
  sgRNA
  H2-M5_19
gctgtggttgtagatgtcca

SEQ ID NO: 26243 - DNA, 20 bp, Artificial Sequence
  sgRNA
  H2-M5_20
ctcctatccttgctgctcac

SEQ ID NO: 26244 - DNA, 20 bp, Artificial Sequence
  sgRNA
  H2-M9_1
gcatttagctcattcaacca

SEQ ID NO: 26245 - DNA, 20 bp, Artificial Sequence
  sgRNA
  H2-M9_2
tcatgctatcattatagatg

SEQ ID NO: 26246 - DNA, 20 bp, Artificial Sequence
  sgRNA
  H2-M9_3
atcgaataataattccatga

SEQ ID NO: 26247 - DNA, 20 bp, Artificial Sequence
  sgRNA
  H2-M9_4
gtggatgaaacacagatcat

SEQ ID NO: 26248 - DNA, 20 bp, Artificial Sequence
  sgRNA
  H2-M9_5
gtcatcgcaaagcatccaaa

SEQ ID NO: 26249 - DNA, 20 bp, Artificial Sequence
  sgRNA
  H2-M9_6
gcaataatcataggcaggaa

SEQ ID NO: 26250 - DNA, 20 bp, Artificial Sequence
  sgRNA
  H2-M9_7
ggatctgcaaacatggagag

SEQ ID NO: 26251 - DNA, 20 bp, Artificial Sequence
  sgRNA
  H2-M9_8
tcgaggccatgataagaagg

SEQ ID NO: 26252 - DNA, 20 bp, Artificial Sequence
  sgRNA
  H2-M9_9
ggatggagagtcgggtacca

SEQ ID NO: 26253 - DNA, 20 bp, Artificial Sequence
  sgRNA
  H2-M9_10
agaaccagagcaataatcat

SEQ ID NO: 26254 - DNA, 20 bp, Artificial Sequence
  sgRNA
  H2-M9_11
tggatgctttgcgatgacca

SEQ ID NO: 26255 - DNA, 20 bp, Artificial Sequence
  sgRNA
  H2-M9_12
cctataagatcagaccagat

SEQ ID NO: 26256 - DNA, 20 bp, Artificial Sequence
  sgRNA
  H2-M9_13
aaatcaccctaacctggcag

SEQ ID NO: 26257 - DNA, 20 bp, Artificial Sequence
  sgRNA
  H2-M9_14
cacataatccaggaaacata

SEQ ID NO: 26258 - DNA, 20 bp, Artificial Sequence
  sgRNA
  H2-M9_15
aatcaccctaacctggcaga

SEQ ID NO: 26259 - DNA, 20 bp, Artificial Sequence
  sgRNA
  H2-M9_16
tgaaaagttccatcaccaga

SEQ ID NO: 26260 - DNA, 20 bp, Artificial Sequence
  sgRNA
  H2-M9_17
tgctgggtgcatgtgtggag

SEQ ID NO: 26261 - DNA, 20 bp, Artificial Sequence
  sgRNA
  H2-M9_18
tatatcagagagtcagagga

SEQ ID NO: 26262 - DNA, 20 bp, Artificial Sequence
  sgRNA
  H2-M9_19
aggtgaccatgaacagcagg

SEQ ID NO: 26263 - DNA, 20 bp, Artificial Sequence
  sgRNA
  H2-M9_20
tgagcctgtcaccctgagat

SEQ ID NO: 26264 - DNA, 20 bp, Artificial Sequence
  sgRNA
  H2-Oa_1
gggactcaggaagctcattg

SEQ ID NO: 26265 - DNA, 20 bp, Artificial Sequence
  sgRNA
  H2-Oa_2
aaccgaaccagagctgtcag

SEQ ID NO: 26266 - DNA, 20 bp, Artificial Sequence
  sgRNA
  H2-Oa_3
cgttctccccaagactcgtg

SEQ ID NO: 26267 - DNA, 20 bp, Artificial Sequence
  sgRNA
  H2-Oa_4
cccactctgaaagtccgagt

SEQ ID NO: 26268 - DNA, 20 bp, Artificial Sequence
  sgRNA
  H2-Oa_5
gcccactctgaaagtccgag

SEQ ID NO: 26269 - DNA, 20 bp, Artificial Sequence
  sgRNA
  H2-Oa_6
gcccactcggactttcagag

SEQ ID NO: 26270 - DNA, 20 bp, Artificial Sequence
  sgRNA
  H2-Oa_7
gtttggagacttcgcccact

SEQ ID NO: 26271 - DNA, 20 bp, Artificial Sequence
  sgRNA
  H2-Oa_8
tcgtacacatcctccgcaga

SEQ ID NO: 26272 - DNA, 20 bp, Artificial Sequence
  sgRNA
  H2-Oa_9
cctgagtccccgaggagtaa

SEQ ID NO: 26273 - DNA, 20 bp, Artificial Sequence
  sgRNA
  H2-Oa_10
ggaggatgtgtacgactgca

SEQ ID NO: 26274 - DNA, 20 bp, Artificial Sequence
  sgRNA
  H2-Oa_11
caggtgacattgatcacagg

SEQ ID NO: 26275 - DNA, 20 bp, Artificial Sequence
  sgRNA
  H2-Oa_12
gctgacagctctggttcggt

SEQ ID NO: 26276 - DNA, 20 bp, Artificial Sequence
  sgRNA
  H2-Oa_13
aggtgacattgatcacaggc

SEQ ID NO: 26277 - DNA, 20 bp, Artificial Sequence
  sgRNA
  H2-Oa_14
agcgtcgtaagattggtaga

SEQ ID NO: 26278 - DNA, 20 bp, Artificial Sequence
  sgRNA
  H2-Oa_15
tgtgcctgtgatcatgagca

SEQ ID NO: 26279 - DNA, 20 bp, Artificial Sequence
  sgRNA
  H2-Oa_16
tcgtaagattggtagaaggc

SEQ ID NO: 26280 - DNA, 20 bp, Artificial Sequence
  sgRNA
  H2-Oa_17
gtccagaagcgtcgtaagat

SEQ ID NO: 26281 - DNA, 20 bp, Artificial Sequence
  sgRNA
  H2-Oa_18
agctcatctggacatcttgg

SEQ ID NO: 26282 - DNA, 20 bp, Artificial Sequence
  sgRNA
  H2-Oa_19
ggcaccgtgctcatgatcac

SEQ ID NO: 26283 - DNA, 20 bp, Artificial Sequence
  sgRNA
  H2-Oa_20
agccaggtgacattgatcac

SEQ ID NO: 26284 - DNA, 20 bp, Artificial Sequence
  sgRNA
  H2-Ob_1
ccggggacataagtgtcaag

SEQ ID NO: 26285 - DNA, 20 bp, Artificial Sequence
  sgRNA
  H2-Ob_2
ggatacactgtcacctctgg

SEQ ID NO: 26286 - DNA, 20 bp, Artificial Sequence
  sgRNA
  H2-Ob_3
gggaacctgatgctgaccag

SEQ ID NO: 26287 - DNA, 20 bp, Artificial Sequence
  sgRNA
  H2-Ob_4
tgaaggaatccagcctcatg

SEQ ID NO: 26288 - DNA, 20 bp, Artificial Sequence
  sgRNA
  H2-Ob_5
acttgacacttatgtccccg

SEQ ID NO: 26289 - DNA, 20 bp, Artificial Sequence
  sgRNA
  H2-Ob_6
tgtgacaggcttctaccccg

SEQ ID NO: 26290 - DNA, 20 bp, Artificial Sequence
  sgRNA
  H2-Ob_7
tgaccagtggaacaaacgcc

SEQ ID NO: 26291 - DNA, 20 bp, Artificial Sequence
  sgRNA
  H2-Ob_8
gctgggggcccccttcactg

SEQ ID NO: 26292 - DNA, 20 bp, Artificial Sequence
  sgRNA
  H2-Ob_9
gatggataacaacccccacc

SEQ ID NO: 26293 - DNA, 20 bp, Artificial Sequence
  sgRNA
  H2-Ob_10
tacacttcgacagtgacctg

SEQ ID NO: 26294 - DNA, 20 bp, Artificial Sequence
  sgRNA
  H2-Ob_11
ccaacagagccaccacccag

SEQ ID NO: 26295 - DNA, 20 bp, Artificial Sequence
  sgRNA
  H2-Ob_12
tgacatctacagctgcctcg

SEQ ID NO: 26296 - DNA, 20 bp, Artificial Sequence
  sgRNA
  H2-Ob_13
gcggactgttacttcaccaa

SEQ ID NO: 26297 - DNA, 20 bp, Artificial Sequence
  sgRNA
  H2-Ob_14
ttacacttcgacagtgacct

SEQ ID NO: 26298 - DNA, 20 bp, Artificial Sequence
  sgRNA
  H2-Ob_15
cgaagtgtaaatactcctcc

SEQ ID NO: 26299 - DNA, 20 bp, Artificial Sequence
  sgRNA
  H2-Ob_16
tttccagcattactgttgtc

SEQ ID NO: 26300 - DNA, 20 bp, Artificial Sequence
  sgRNA
  H2-Ob_17
gttgtgctgctgcagcaacg

SEQ ID NO: 26301 - DNA, 20 bp, Artificial Sequence
  sgRNA
  H2-Ob_18
ttgtggctctgacggagctg

SEQ ID NO: 26302 - DNA, 20 bp, Artificial Sequence
  sgRNA
  H2-Ob_19
tccccagtcaagatcaaatg

SEQ ID NO: 26303 - DNA, 20 bp, Artificial Sequence
  sgRNA
  H2-Ob_20
gctgattgtcttcctggtgg

SEQ ID NO: 26304 - DNA, 20 bp, Artificial Sequence
  sgRNA
  H2-Q1_1
gctgcggtatttcgagacct

SEQ ID NO: 26305 - DNA, 20 bp, Artificial Sequence
  sgRNA
  H2-Q1_2
tcagatgggcgccttcaaag

SEQ ID NO: 26306 - DNA, 20 bp, Artificial Sequence
  sgRNA
  H2-Q1_3
agtattgggaacggaacaca

SEQ ID NO: 26307 - DNA, 20 bp, Artificial Sequence
  sgRNA
  H2-Q1_4
gaaacacaggacctacctgg

SEQ ID NO: 26308 - DNA, 20 bp, Artificial Sequence
  sgRNA
  H2-Q1_5
tcaggaaacccgacgcaagt

SEQ ID NO: 26309 - DNA, 20 bp, Artificial Sequence
  sgRNA
  H2-Q1_6
gccctgaccctgaccaaaac

SEQ ID NO: 26310 - DNA, 20 bp, Artificial Sequence
  sgRNA
  H2-Q1_7
gctgtgatctggggtcagat

SEQ ID NO: 26311 - DNA, 20 bp, Artificial Sequence
  sgRNA
  H2-Q1_8
gatgtggctccacagatacc

SEQ ID NO: 26312 - DNA, 20 bp, Artificial Sequence
  sgRNA
  H2-Q1_9
tgacatcaccttgagatctg

SEQ ID NO: 26313 - DNA, 20 bp, Artificial Sequence
  sgRNA
  H2-Q1_10
agttgtctggctgtgatctg

SEQ ID NO: 26314 - DNA, 20 bp, Artificial Sequence
  sgRNA
  H2-Q1_11
catcgccctgaatgaagacc

SEQ ID NO: 26315 - DNA, 20 bp, Artificial Sequence
  sgRNA
  H2-Q1_12
cttggagctgtgatagtcat

SEQ ID NO: 26316 - DNA, 20 bp, Artificial Sequence
  sgRNA
  H2-Q1_13
ctggtgctgctgagaaacac

SEQ ID NO: 26317 - DNA, 20 bp, Artificial Sequence
  sgRNA
  H2-Q1_14
ggtttccaggtcttcattca

SEQ ID NO: 26318 - DNA, 20 bp, Artificial Sequence
  sgRNA
  H2-Q1_15
ggtatctgtggagccacatc

SEQ ID NO: 26319 - DNA, 20 bp, Artificial Sequence
  sgRNA
  H2-Q1_16
gaccctgaccaaaaccggag

SEQ ID NO: 26320 - DNA, 20 bp, Artificial Sequence
  sgRNA
  H2-Q1_17
atgttggaaacagtgtatgg

SEQ ID NO: 26321 - DNA, 20 bp, Artificial Sequence
  sgRNA
  H2-Q1_18
cggaacacacggagagtcaa

SEQ ID NO: 26322 - DNA, 20 bp, Artificial Sequence
  sgRNA
  H2-Q1_19
gagtcacatgtgcctttggg

SEQ ID NO: 26323 - DNA, 20 bp, Artificial Sequence
  sgRNA
  H2-Q1_20
cagatgggcgccttcaaagc

SEQ ID NO: 26324 - DNA, 20 bp, Artificial Sequence
  sgRNA
  H2-Q10_1
tacctgcaatacgcatacga

SEQ ID NO: 26325 - DNA, 20 bp, Artificial Sequence
  sgRNA
  H2-Q10_2
ccccaggctcacactccatg

SEQ ID NO: 26326 - DNA, 20 bp, Artificial Sequence
  sgRNA
  H2-Q10_3
tggtgctgcagagtattaca

SEQ ID NO: 26327 - DNA, 20 bp, Artificial Sequence
  sgRNA
  H2-Q10_4
taaccgacaataatgaaccg

SEQ ID NO: 26328 - DNA, 20 bp, Artificial Sequence
  sgRNA
  H2-Q10_5
ggaggtttcgaaatacctca

SEQ ID NO: 26329 - DNA, 20 bp, Artificial Sequence
  sgRNA
  H2-Q10_6
gtattacagggcctacctgg

SEQ ID NO: 26330 - DNA, 20 bp, Artificial Sequence
  sgRNA
  H2-Q10_7
cctgaaaacgtggacggcag

SEQ ID NO: 26331 - DNA, 20 bp, Artificial Sequence
  sgRNA
  H2-Q10_8
gattatcacccgacgcaagt

SEQ ID NO: 26332 - DNA, 20 bp, Artificial Sequence
  sgRNA
  H2-Q10_9
ggatgtatggctgtaaagtg

SEQ ID NO: 26333 - DNA, 20 bp, Artificial Sequence
  sgRNA
  H2-Q10_10
gcagggtcctcaggctcaca

SEQ ID NO: 26334 - DNA, 20 bp, Artificial Sequence
  sgRNA
  H2-Q10_11
gctgtaaagtggggtccgac

SEQ ID NO: 26335 - DNA, 20 bp, Artificial Sequence
  sgRNA
  H2-Q10_12
gttcattattgtcggttacg

SEQ ID NO: 26336 - DNA, 20 bp, Artificial Sequence
  sgRNA
  H2-Q10_13
tgctccatccaaggcgcccg

SEQ ID NO: 26337 - DNA, 20 bp, Artificial Sequence
  sgRNA
  H2-Q10_14
cgattatcacccgacgcaag

SEQ ID NO: 26338 - DNA, 20 bp, Artificial Sequence
  sgRNA
  H2-Q10_15
ctttacagccatacatccac

SEQ ID NO: 26339 - DNA, 20 bp, Artificial Sequence
  sgRNA
  H2-Q10_16
atagagtcagtggaaggagg

SEQ ID NO: 26340 - DNA, 20 bp, Artificial Sequence
  sgRNA
  H2-Q10_17
cgtaaccgacaataatgaac

SEQ ID NO: 26341 - DNA, 20 bp, Artificial Sequence
  sgRNA
  H2-Q10_18
gtggatgtatggctgtaaag

SEQ ID NO: 26342 - DNA, 20 bp, Artificial Sequence
  sgRNA
  H2-Q10_19
agactccgaggatggagccg

SEQ ID NO: 26343 - DNA, 20 bp, Artificial Sequence
  sgRNA
  H2-Q10_20
cgtattgcaggtacccgcgg

SEQ ID NO: 26344 - DNA, 20 bp, Artificial Sequence
  sgRNA
  H2-Q2_1
tgacatcaccttgagaactg

SEQ ID NO: 26345 - DNA, 20 bp, Artificial Sequence
  sgRNA
  H2-Q2_2
gtattgggagcggaacacac

SEQ ID NO: 26346 - DNA, 20 bp, Artificial Sequence
  sgRNA
  H2-Q2_3
tggaggtcgattgcttgacg

SEQ ID NO: 26347 - DNA, 20 bp, Artificial Sequence
  sgRNA
  H2-Q2_4
gaaactgactgagacacgcg

SEQ ID NO: 26348 - DNA, 20 bp, Artificial Sequence
  sgRNA
  H2-Q2_5
tcagatcctcattcagggcg

SEQ ID NO: 26349 - DNA, 20 bp, Artificial Sequence
  sgRNA
  H2-Q2_6
ggatctgataacgtggacag

SEQ ID NO: 26350 - DNA, 20 bp, Artificial Sequence
  sgRNA
  H2-Q2_7
ggtcacagccaaccaaccac

SEQ ID NO: 26351 - DNA, 20 bp, Artificial Sequence
  sgRNA
  H2-Q2_8
aaactgactgagacacgcgc

SEQ ID NO: 26352 - DNA, 20 bp, Artificial Sequence
  sgRNA
  H2-Q2_9
gcctagatacacatgccatg

SEQ ID NO: 26353 - DNA, 20 bp, Artificial Sequence
  sgRNA
  H2-Q2_10
tctgataacgtggacagcgg

SEQ ID NO: 26354 - DNA, 20 bp, Artificial Sequence
  sgRNA
  H2-Q2_11
tggtcttgcagagaagcgca

SEQ ID NO: 26355 - DNA, 20 bp, Artificial Sequence
  sgRNA
  H2-Q2_12
ccagacggaagcctactccg

SEQ ID NO: 26356 - DNA, 20 bp, Artificial Sequence
  sgRNA
  H2-Q2_13
tatgagcagtctgcctacga

SEQ ID NO: 26357 - DNA, 20 bp, Artificial Sequence
  sgRNA
  H2-Q2_14
tgtctcagtcagtttcaggg

SEQ ID NO: 26358 - DNA, 20 bp, Artificial Sequence
  sgRNA
  H2-Q2_15
aggcagactgctcataccct

SEQ ID NO: 26359 - DNA, 20 bp, Artificial Sequence
  sgRNA
  H2-Q2_16
caagcaatcgacctccaggt

SEQ ID NO: 26360 - DNA, 20 bp, Artificial Sequence
  sgRNA
  H2-Q2_17
cagagtttccgagtgagcct

SEQ ID NO: 26361 - DNA, 20 bp, Artificial Sequence
  sgRNA
  H2-Q2_18
cagacggaagcctactccga

SEQ ID NO: 26362 - DNA, 20 bp, Artificial Sequence
  sgRNA
  H2-Q2_19
taatgaaccggggctccccg

SEQ ID NO: 26363 - DNA, 20 bp, Artificial Sequence
  sgRNA
  H2-Q2_20
agtagctcagtgcggtcccc

SEQ ID NO: 26364 - DNA, 20 bp, Artificial Sequence
  sgRNA
  H2-Q4_1
tggtgctacagagaaaagca

SEQ ID NO: 26365 - DNA, 20 bp, Artificial Sequence
  sgRNA
  H2-Q4_2
gatatgagccgcgggcaccg

SEQ ID NO: 26366 - DNA, 20 bp, Artificial Sequence
  sgRNA
  H2-Q4_3
gaccctgatcgagatccgcg

SEQ ID NO: 26367 - DNA, 20 bp, Artificial Sequence
  sgRNA
  H2-Q4_4
tgtcggttacgtggacaaca

SEQ ID NO: 26368 - DNA, 20 bp, Artificial Sequence
  sgRNA
  H2-Q4_5
tgctccatccacggtgcccg

SEQ ID NO: 26369 - DNA, 20 bp, Artificial Sequence
  sgRNA
  H2-Q4_6
taaccgacagagatgaaccg

SEQ ID NO: 26370 - DNA, 20 bp, Artificial Sequence
  sgRNA
  H2-Q4_7
ctacacctccgtgtcccggc

SEQ ID NO: 26371 - DNA, 20 bp, Artificial Sequence
  sgRNA
  H2-Q4_8
gagctccaggtatctgcgga

SEQ ID NO: 26372 - DNA, 20 bp, Artificial Sequence
  sgRNA
  H2-Q4_9
gcaatgatggccaagctcca

SEQ ID NO: 26373 - DNA, 20 bp, Artificial Sequence
  sgRNA
  H2-Q4_10
gttcatctctgtcggttacg

SEQ ID NO: 26374 - DNA, 20 bp, Artificial Sequence
  sgRNA
  H2-Q4_11
ctgacggtgatgtcaccctg

SEQ ID NO: 26375 - DNA, 20 bp, Artificial Sequence
  sgRNA
  H2-Q4_12
tgacatcaccgtcagatctg

SEQ ID NO: 26376 - DNA, 20 bp, Artificial Sequence
  sgRNA
  H2-Q4_13
gtgagaccccgaactccttc

SEQ ID NO: 26377 - DNA, 20 bp, Artificial Sequence
  sgRNA
  H2-Q4_14
ggggtcccggaaggagttcg

SEQ ID NO: 26378 - DNA, 20 bp, Artificial Sequence
  sgRNA
  H2-Q4_15
cgagctccaggtatctgcgg

SEQ ID NO: 26379 - DNA, 20 bp, Artificial Sequence
  sgRNA
  H2-Q4_16
gcagtccctccgcagatacc

SEQ ID NO: 26380 - DNA, 20 bp, Artificial Sequence
  sgRNA
  H2-Q4_17
agaaataactcagcaagtgt

SEQ ID NO: 26381 - DNA, 20 bp, Artificial Sequence
  sgRNA
  H2-Q4_18
gcagggtcctcaggttcact

SEQ ID NO: 26382 - DNA, 20 bp, Artificial Sequence
  sgRNA
  H2-Q4_19
aggcgaactgctggtacccg

SEQ ID NO: 26383 - DNA, 20 bp, Artificial Sequence
  sgRNA
  H2-Q4_20
cagctactacaaccagagcg

SEQ ID NO: 26384 - DNA, 20 bp, Artificial Sequence
  sgRNA
  H2-Q5_1
gcctcatgcgacctccaggt

SEQ ID NO: 26385 - DNA, 20 bp, Artificial Sequence
  sgRNA
  H2-Q5_2
aagtcagggtgatgtcaaca

SEQ ID NO: 26386 - DNA, 20 bp, Artificial Sequence
  sgRNA
  H2-Q5_3
gtgacagcatcataagatat

SEQ ID NO: 26387 - DNA, 20 bp, Artificial Sequence
  sgRNA
  H2-Q5_4
cttatgatgctgtcaccctg

SEQ ID NO: 26388 - DNA, 20 bp, Artificial Sequence
  sgRNA
  H2-Q5_5
gcagctgtgatggtgccttt

SEQ ID NO: 26389 - DNA, 20 bp, Artificial Sequence
  sgRNA
  H2-Q5_6
gcctacctggaggtcgcatg

SEQ ID NO: 26390 - DNA, 20 bp, Artificial Sequence
  sgRNA
  H2-Q5_7
gccatgagcagagtttccaa

SEQ ID NO: 26391 - DNA, 20 bp, Artificial Sequence
  sgRNA
  H2-Q5_8
atgcgacctccaggtaggcc

SEQ ID NO: 26392 - DNA, 20 bp, Artificial Sequence
  sgRNA
  H2-Q5_9
tctcccccatctcagggtga

SEQ ID NO: 26393 - DNA, 20 bp, Artificial Sequence
  sgRNA
  H2-Q5_10
tagccgacgatgatgaaccg

SEQ ID NO: 26394 - DNA, 20 bp, Artificial Sequence
  sgRNA
  H2-Q5_11
agtagctctgtgcagtcctc

SEQ ID NO: 26395 - DNA, 20 bp, Artificial Sequence
  sgRNA
  H2-Q5_12
tgacagcatcataagatatg

SEQ ID NO: 26396 - DNA, 20 bp, Artificial Sequence
  sgRNA
  H2-Q5_13
caaatacctgcagctcggga

SEQ ID NO: 26397 - DNA, 20 bp, Artificial Sequence
  sgRNA
  H2-Q5_14
gttcatcatcgtcggctacg

SEQ ID NO: 26398 - DNA, 20 bp, Artificial Sequence
  sgRNA
  H2-Q5_15
gagccccggttcatcatcgt

SEQ ID NO: 26399 - DNA, 20 bp, Artificial Sequence
  sgRNA
  H2-Q5_16
gtagccgacgatgatgaacc

SEQ ID NO: 26400 - DNA, 20 bp, Artificial Sequence
  sgRNA
  H2-Q5_17
tcccgagctgcaggtatttg

SEQ ID NO: 26401 - DNA, 20 bp, Artificial Sequence
  sgRNA
  H2-Q5_18
agagtttccaagggagcctg

SEQ ID NO: 26402 - DNA, 20 bp, Artificial Sequence
  sgRNA
  H2-Q5_19
ctccgcaaatacctgcagct

SEQ ID NO: 26403 - DNA, 20 bp, Artificial Sequence
  sgRNA
  H2-Q5_20
gtcaacagggtagaagccca

SEQ ID NO: 26404 - DNA, 20 bp, Artificial Sequence
  sgRNA
  H2-Q6_1
agacctgaaaacctggacgg

SEQ ID NO: 26405 - DNA, 20 bp, Artificial Sequence
  sgRNA
  H2-Q6_2
cgggccaggacacagcagtg

SEQ ID NO: 26406 - DNA, 20 bp, Artificial Sequence
  sgRNA
  H2-Q6_3
ggatgtatggctgtgacgtg

SEQ ID NO: 26407 - DNA, 20 bp, Artificial Sequence
  sgRNA
  H2-Q6_4
acagaaagccaagggccatg

SEQ ID NO: 26408 - DNA, 20 bp, Artificial Sequence
  sgRNA
  H2-Q6_5
taatgaaccggggctccacg

SEQ ID NO: 26409 - DNA, 20 bp, Artificial Sequence
  sgRNA
  H2-Q6_6
ctggttgtagtatctctgtg

SEQ ID NO: 26410 - DNA, 20 bp, Artificial Sequence
  sgRNA
  H2-Q6_7
agatactacaaccagagcaa

SEQ ID NO: 26411 - DNA, 20 bp, Artificial Sequence
  sgRNA
  H2-Q6_8
agcctgctcccacttgtgta

SEQ ID NO: 26412 - DNA, 20 bp, Artificial Sequence
  sgRNA
  H2-Q6_9
gagatactacaaccagagca

SEQ ID NO: 26413 - DNA, 20 bp, Artificial Sequence
  sgRNA
  H2-Q6_10
acagatcaccctacacaagt

SEQ ID NO: 26414 - DNA, 20 bp, Artificial Sequence
  sgRNA
  H2-Q6_11
cgaagacctgaaaacctgga

SEQ ID NO: 26415 - DNA, 20 bp, Artificial Sequence
  sgRNA
  H2-Q6_12
ccttgtagcttggccatcat

SEQ ID NO: 26416 - DNA, 20 bp, Artificial Sequence
  sgRNA
  H2-Q6_13
cagatacctgcagctccgga

SEQ ID NO: 26417 - DNA, 20 bp, Artificial Sequence
  sgRNA
  H2-Q6_14
cacagatcaccctacacaag

SEQ ID NO: 26418 - DNA, 20 bp, Artificial Sequence
  sgRNA
  H2-Q6_15
gtgcggtcctcaggctcact

SEQ ID NO: 26419 - DNA, 20 bp, Artificial Sequence
  sgRNA
  H2-Q6_16
tccggagctgcaggtatctg

SEQ ID NO: 26420 - DNA, 20 bp, Artificial Sequence
  sgRNA
  H2-Q6_17
gtggatgtatggctgtgacg

SEQ ID NO: 26421 - DNA, 20 bp, Artificial Sequence
  sgRNA
  H2-Q6_18
tcactcggaaactctcctca

SEQ ID NO: 26422 - DNA, 20 bp, Artificial Sequence
  sgRNA
  H2-Q6_19
cctgaaaacctggacggcgg

SEQ ID NO: 26423 - DNA, 20 bp, Artificial Sequence
  sgRNA
  H2-Q6_20
actgcacgcaagcgccctcc

SEQ ID NO: 26424 - DNA, 20 bp, Artificial Sequence
  sgRNA
  H2-Q7_1
ctggttgtagtagctctgtg

SEQ ID NO: 26425 - DNA, 20 bp, Artificial Sequence
  sgRNA
  H2-Q7_2
tggtattgcagagaaagacc

SEQ ID NO: 26426 - DNA, 20 bp, Artificial Sequence
  sgRNA
  H2-Q7_3
gtggacggcggtggacatgg

SEQ ID NO: 26427 - DNA, 20 bp, Artificial Sequence
  sgRNA
  H2-Q7_4
cgtgcgcttcgacagcgatg

SEQ ID NO: 26428 - DNA, 20 bp, Artificial Sequence
  sgRNA
  H2-Q7_5
tctcccccatctcagggtaa

SEQ ID NO: 26429 - DNA, 20 bp, Artificial Sequence
  sgRNA
  H2-Q7_6
gaaagaccaggcctacctgg

SEQ ID NO: 26430 - DNA, 20 bp, Artificial Sequence
  sgRNA
  H2-Q7_7
tgagccccttaccctgagat

SEQ ID NO: 26431 - DNA, 20 bp, Artificial Sequence
  sgRNA
  H2-Q7_8
gccatgagcagagtttccga

SEQ ID NO: 26432 - DNA, 20 bp, Artificial Sequence
  sgRNA
  H2-Q7_9
cgatgcggaaaatccgagga

SEQ ID NO: 26433 - DNA, 20 bp, Artificial Sequence
  sgRNA
  H2-Q7_10
acagcgatgcggaaaatccg

SEQ ID NO: 26434 - DNA, 20 bp, Artificial Sequence
  sgRNA
  H2-Q7_11
gtgcggtcctcaggctccct

SEQ ID NO: 26435 - DNA, 20 bp, Artificial Sequence
  sgRNA
  H2-Q7_12
ggccatgagcagagtttccg

SEQ ID NO: 26436 - DNA, 20 bp, Artificial Sequence
  sgRNA
  H2-Q7_13
ttaccctgagatgggggaga

SEQ ID NO: 26437 - DNA, 20 bp, Artificial Sequence
  sgRNA
  H2-Q7_14
aaagaccaggcctacctgga

SEQ ID NO: 26438 - DNA, 20 bp, Artificial Sequence
  sgRNA
  H2-Q7_15
acgtgccctccaggtaggcc

SEQ ID NO: 26439 - DNA, 20 bp, Artificial Sequence
  sgRNA
  H2-Q7_16
gagccccttaccctgagatg

SEQ ID NO: 26440 - DNA, 20 bp, Artificial Sequence
  sgRNA
  H2-Q7_17
actgcatgcacgtgccctcc

SEQ ID NO: 26441 - DNA, 20 bp, Artificial Sequence
  sgRNA
  H2-Q7_18
agtagctctgtgcggtcctc

SEQ ID NO: 26442 - DNA, 20 bp, Artificial Sequence
  sgRNA
  H2-Q7_19
agagaaagaccaggcctacc

SEQ ID NO: 26443 - DNA, 20 bp, Artificial Sequence
  sgRNA
  H2-Q7_20
ctcccccatctcagggtaag

SEQ ID NO: 26444 - DNA, 20 bp, Artificial Sequence
  sgRNA
  H2-T10_1
gagcaaaatggaaaaaaccg

SEQ ID NO: 26445 - DNA, 20 bp, Artificial Sequence
  sgRNA
  H2-T10_2
tagccgacaattatgaacca

SEQ ID NO: 26446 - DNA, 20 bp, Artificial Sequence
  sgRNA
  H2-T10_3
ctgtacagtgggaaaacagt

SEQ ID NO: 26447 - DNA, 20 bp, Artificial Sequence
  sgRNA
  H2-T10_4
tcagatctctcagcacctgg

SEQ ID NO: 26448 - DNA, 20 bp, Artificial Sequence
  sgRNA
  H2-T10_5
gacctggcagaaggatgggg

SEQ ID NO: 26449 - DNA, 20 bp, Artificial Sequence
  sgRNA
  H2-T10_6
agacccatgaagaagaatgc

SEQ ID NO: 26450 - DNA, 20 bp, Artificial Sequence
  sgRNA
  H2-T10_7
cctgtacagtgggaaaacag

SEQ ID NO: 26451 - DNA, 20 bp, Artificial Sequence
  sgRNA
  H2-T10_8
cgtgccatgtggaccatgag

SEQ ID NO: 26452 - DNA, 20 bp, Artificial Sequence
  sgRNA
  H2-T10_9
gcagagttacacgtgccatg

SEQ ID NO: 26453 - DNA, 20 bp, Artificial Sequence
  sgRNA
  H2-T10_10
tccaggtgctgagagatctg

SEQ ID NO: 26454 - DNA, 20 bp, Artificial Sequence
  sgRNA
  H2-T10_11
gagccctggttcataattgt

SEQ ID NO: 26455 - DNA, 20 bp, Artificial Sequence
  sgRNA
  H2-T10_12
taactctgcacctttccaag

SEQ ID NO: 26456 - DNA, 20 bp, Artificial Sequence
  sgRNA
  H2-T10_13
accctgacctggcagaagga

SEQ ID NO: 26457 - DNA, 20 bp, Artificial Sequence
  sgRNA
  H2-T10_14
ggaggagctgacccaagaag

SEQ ID NO: 26458 - DNA, 20 bp, Artificial Sequence
  sgRNA
  H2-T10_15
gttcataattgtcggctatg

SEQ ID NO: 26459 - DNA, 20 bp, Artificial Sequence
  sgRNA
  H2-T10_16
cagatctctcagcacctgga

SEQ ID NO: 26460 - DNA, 20 bp, Artificial Sequence
  sgRNA
  H2-T10_17
gcagcccctcatggtccaca

SEQ ID NO: 26461 - DNA, 20 bp, Artificial Sequence
  sgRNA
  H2-T10_18
acagagacaaatgagcaaaa

SEQ ID NO: 26462 - DNA, 20 bp, Artificial Sequence
  sgRNA
  H2-T10_19
gtggcaacaatccaaatcca

SEQ ID NO: 26463 - DNA, 20 bp, Artificial Sequence
  sgRNA
  H2-T10_20
cgcagaccacagcagccctg

SEQ ID NO: 26464 - DNA, 20 bp, Artificial Sequence
  sgRNA
  H2-T22_1
ttcaggtcctgagagatgtg

SEQ ID NO: 26465 - DNA, 20 bp, Artificial Sequence
  sgRNA
  H2-T22_2
tagccgacgattatgaacca

SEQ ID NO: 26466 - DNA, 20 bp, Artificial Sequence
  sgRNA
  H2-T22_3
gcaggaggaagcagataact

SEQ ID NO: 26467 - DNA, 20 bp, Artificial Sequence
  sgRNA
  H2-T22_4
tagactctcacacactacag

SEQ ID NO: 26468 - DNA, 20 bp, Artificial Sequence
  sgRNA
  H2-T22_5
gcatgaagaagaatgcaggt

SEQ ID NO: 26469 - DNA, 20 bp, Artificial Sequence
  sgRNA
  H2-T22_6
gagcccctcatcctgagatg

SEQ ID NO: 26470 - DNA, 20 bp, Artificial Sequence
  sgRNA
  H2-T22_7
gatgaacaaaatgaaaacca

SEQ ID NO: 26471 - DNA, 20 bp, Artificial Sequence
  sgRNA
  H2-T22_8
atatgcatgaagaagaatgc

SEQ ID NO: 26472 - DNA, 20 bp, Artificial Sequence
  sgRNA
  H2-T22_9
gagaagggcgcagaccacag

SEQ ID NO: 26473 - DNA, 20 bp, Artificial Sequence
  sgRNA
  H2-T22_10
gagccctggttcataatcgt

SEQ ID NO: 26474 - DNA, 20 bp, Artificial Sequence
  sgRNA
  H2-T22_11
gttcatcatttgtctctgtg

SEQ ID NO: 26475 - DNA, 20 bp, Artificial Sequence
  sgRNA
  H2-T22_12
cactgtacctcacatctctc

SEQ ID NO: 26476 - DNA, 20 bp, Artificial Sequence
  sgRNA
  H2-T22_13
agtgctgtttcccactgtac

SEQ ID NO: 26477 - DNA, 20 bp, Artificial Sequence
  sgRNA
  H2-T22_14
agcaggaggaagcagataac

SEQ ID NO: 26478 - DNA, 20 bp, Artificial Sequence
  sgRNA
  H2-T22_15
tgagcccctcatcctgagat

SEQ ID NO: 26479 - DNA, 20 bp, Artificial Sequence
  sgRNA
  H2-T22_16
aagtcctgtaaaacttgtct

SEQ ID NO: 26480 - DNA, 20 bp, Artificial Sequence
  sgRNA
  H2-T22_17
cgcagaccacagcggccctg

SEQ ID NO: 26481 - DNA, 20 bp, Artificial Sequence
  sgRNA
  H2-T22_18
atagccgacgattatgaacc

SEQ ID NO: 26482 - DNA, 20 bp, Artificial Sequence
  sgRNA
  H2-T22_19
taactctgctctttcccaag

SEQ ID NO: 26483 - DNA, 20 bp, Artificial Sequence
  sgRNA
  H2-T22_20
atggcaacaatccaaatcca

SEQ ID NO: 26484 - DNA, 20 bp, Artificial Sequence
  sgRNA
  H2-T23_1
tactacaatcagagtaacga

SEQ ID NO: 26485 - DNA, 20 bp, Artificial Sequence
  sgRNA
  H2-T23_2
ctgaagatgaagtcaccctg

SEQ ID NO: 26486 - DNA, 20 bp, Artificial Sequence
  sgRNA
  H2-T23_3
gtgtctcatttcccagccgt

SEQ ID NO: 26487 - DNA, 20 bp, Artificial Sequence
  sgRNA
  H2-T23_4
cttgtgcttagagatctgtg

SEQ ID NO: 26488 - DNA, 20 bp, Artificial Sequence
  sgRNA
  H2-T23_5
agtggctccatagataccta

SEQ ID NO: 26489 - DNA, 20 bp, Artificial Sequence
  sgRNA
  H2-T23_6
ggattacatctccctgaacg

SEQ ID NO: 26490 - DNA, 20 bp, Artificial Sequence
  sgRNA
  H2-T23_7
gcgggagacttggaaagcca

SEQ ID NO: 26491 - DNA, 20 bp, Artificial Sequence
  sgRNA
  H2-T23_8
tattgtcaggaggcctacga

SEQ ID NO: 26492 - DNA, 20 bp, Artificial Sequence
  sgRNA
  H2-T23_9
caaaagccaccacagctcca

SEQ ID NO: 26493 - DNA, 20 bp, Artificial Sequence
  sgRNA
  H2-T23_10
gatctctaagcacaagtcag

SEQ ID NO: 26494 - DNA, 20 bp, Artificial Sequence
  sgRNA
  H2-T23_11
gaccagcagctgaagcaagt

SEQ ID NO: 26495 - DNA, 20 bp, Artificial Sequence
  sgRNA
  H2-T23_12
ctgtgaggctatgtcattcg

SEQ ID NO: 26496 - DNA, 20 bp, Artificial Sequence
  sgRNA
  H2-T23_13
gatcatccttggagctgtgg

SEQ ID NO: 26497 - DNA, 20 bp, Artificial Sequence
  sgRNA
  H2-T23_14
tgatgaaccggggctccccg

SEQ ID NO: 26498 - DNA, 20 bp, Artificial Sequence
  sgRNA
  H2-T23_15
gctccatagatacctacggc

SEQ ID NO: 26499 - DNA, 20 bp, Artificial Sequence
  sgRNA
  H2-T23_16
caaggatgatcacagctcca

SEQ ID NO: 26500 - DNA, 20 bp, Artificial Sequence
  sgRNA
  H2-T23_17
cttggagctgtgatcatcct

SEQ ID NO: 26501 - DNA, 20 bp, Artificial Sequence
  sgRNA
  H2-T23_18
gcagctgtcgtggtgcctct

SEQ ID NO: 26502 - DNA, 20 bp, Artificial Sequence
  sgRNA
  H2-T23_19
tgaaataccgcagcgagtgt

SEQ ID NO: 26503 - DNA, 20 bp, Artificial Sequence
  sgRNA
  H2-T23_20
cttggaaagccagggacatg

SEQ ID NO: 26504 - DNA, 20 bp, Artificial Sequence
  sgRNA
  H2-T3_1
cgtgcgcttcaacagctcag

SEQ ID NO: 26505 - DNA, 20 bp, Artificial Sequence
  sgRNA
  H2-T3_2
cattgagggcaatgtaatcg

SEQ ID NO: 26506 - DNA, 20 bp, Artificial Sequence
  sgRNA
  H2-T3_3
ctggttatacagagctccgt

SEQ ID NO: 26507 - DNA, 20 bp, Artificial Sequence
  sgRNA
  H2-T3_4
gtcagcagggtagaagcgca

SEQ ID NO: 26508 - DNA, 20 bp, Artificial Sequence
  sgRNA
  H2-T3_5
gacctgcaatcagcgaaccg

SEQ ID NO: 26509 - DNA, 20 bp, Artificial Sequence
  sgRNA
  H2-T3_6
gtgcctcagattcagcccga

SEQ ID NO: 26510 - DNA, 20 bp, Artificial Sequence
  sgRNA
  H2-T3_7
tagcccacagctatgtacca

SEQ ID NO: 26511 - DNA, 20 bp, Artificial Sequence
  sgRNA
  H2-T3_8
gttctccaggtatctgagca

SEQ ID NO: 26512 - DNA, 20 bp, Artificial Sequence
  sgRNA
  H2-T3_9
catataagctaagtgcgcca

SEQ ID NO: 26513 - DNA, 20 bp, Artificial Sequence
  sgRNA
  H2-T3_10
agccatgctgctcataagcg

SEQ ID NO: 26514 - DNA, 20 bp, Artificial Sequence
  sgRNA
  H2-T3_11
tgaatctgaggcactcgggg

SEQ ID NO: 26515 - DNA, 20 bp, Artificial Sequence
  sgRNA
  H2-T3_12
ctaagatgatcatagctcca

SEQ ID NO: 26516 - DNA, 20 bp, Artificial Sequence
  sgRNA
  H2-T3_13
gctccgtaggacctacttgg

SEQ ID NO: 26517 - DNA, 20 bp, Artificial Sequence
  sgRNA
  H2-T3_14
acggttcgctgattgcaggt

SEQ ID NO: 26518 - DNA, 20 bp, Artificial Sequence
  sgRNA
  H2-T3_15
cacaccatccaggtgatgta

SEQ ID NO: 26519 - DNA, 20 bp, Artificial Sequence
  sgRNA
  H2-T3_16
tgctgcatatcagaatgaga

SEQ ID NO: 26520 - DNA, 20 bp, Artificial Sequence
  sgRNA
  H2-T3_17
agagatcaccagaagcaagt

SEQ ID NO: 26521 - DNA, 20 bp, Artificial Sequence
  sgRNA
  H2-T3_18
tccaaggagagcacgaacag

SEQ ID NO: 26522 - DNA, 20 bp, Artificial Sequence
  sgRNA
  H2-T3_19
ggctgaatctgaggcactcg

SEQ ID NO: 26523 - DNA, 20 bp, Artificial Sequence
  sgRNA
  H2-T3_20
gcacgaactgagtgtcatcc

SEQ ID NO: 26524 - DNA, 20 bp, Artificial Sequence
  sgRNA
  Havcr1_1
ggaatcacaacgacatgttg

SEQ ID NO: 26525 - DNA, 20 bp, Artificial Sequence
  sgRNA
  Havcr1_2
tggtctgtattgttgtcgag

SEQ ID NO: 26526 - DNA, 20 bp, Artificial Sequence
  sgRNA
  Havcr1_3
tccccatgagacaacagctg

SEQ ID NO: 26527 - DNA, 20 bp, Artificial Sequence
  sgRNA
  Havcr1_4
gcagtcggtacaacttaaag

SEQ ID NO: 26528 - DNA, 20 bp, Artificial Sequence
  sgRNA
  Havcr1_5
actgctccttgtgagcaccg

SEQ ID NO: 26529 - DNA, 20 bp, Artificial Sequence
  sgRNA
  Havcr1_6
ataggtgacacgatgtccat

SEQ ID NO: 26530 - DNA, 20 bp, Artificial Sequence
  sgRNA
  Havcr1_7
tgtacttactcaacatatcg

SEQ ID NO: 26531 - DNA, 20 bp, Artificial Sequence
  sgRNA
  Havcr1_8
tgacatcctcaggagatacc

SEQ ID NO: 26532 - DNA, 20 bp, Artificial Sequence
  sgRNA
  Havcr1_9
ccgcagaaaaaccctactaa

SEQ ID NO: 26533 - DNA, 20 bp, Artificial Sequence
  sgRNA
  Havcr1_10
aagtacatggaagtgtgaca

SEQ ID NO: 26534 - DNA, 20 bp, Artificial Sequence
  sgRNA
  Havcr1_11
tgaagctttgcagaacgcag

SEQ ID NO: 26535 - DNA, 20 bp, Artificial Sequence
  sgRNA
  Havcr1_12
attcttatgtggaagtaaag

SEQ ID NO: 26536 - DNA, 20 bp, Artificial Sequence
  sgRNA
  Havcr1_13
aagcttcaatcttagagaca

SEQ ID NO: 26537 - DNA, 20 bp, Artificial Sequence
  sgRNA
  Havcr1_14
gtagttgtgggtcttcttgg

SEQ ID NO: 26538 - DNA, 20 bp, Artificial Sequence
  sgRNA
  Havcr1_15
aggcgctgtggattcttatg

SEQ ID NO: 26539 - DNA, 20 bp, Artificial Sequence
  sgRNA
  Havcr1_16
ttatgtggaagtaaaggggg

SEQ ID NO: 26540 - DNA, 20 bp, Artificial Sequence
  sgRNA
  Havcr1_17
gtagatgttgtcttcagctc

SEQ ID NO: 26541 - DNA, 20 bp, Artificial Sequence
  sgRNA
  Havcr1_18
tcacctatcagaagagcagt

SEQ ID NO: 26542 - DNA, 20 bp, Artificial Sequence
  sgRNA
  Havcr1_19
caacatagaagcccttagta

SEQ ID NO: 26543 - DNA, 20 bp, Artificial Sequence
  sgRNA
  Havcr1_20
attactccaggtatctcctg

SEQ ID NO: 26544 - DNA, 20 bp, Artificial Sequence
  sgRNA
  Havcr2_1
gttacactctatctacacct

SEQ ID NO: 26545 - DNA, 20 bp, Artificial Sequence
  sgRNA
  Havcr2_2
ttctccaagaaccctaacca

SEQ ID NO: 26546 - DNA, 20 bp, Artificial Sequence
  sgRNA
  Havcr2_3
ctaaagggcgatctcaacaa

SEQ ID NO: 26547 - DNA, 20 bp, Artificial Sequence
  sgRNA
  Havcr2_4
atcagttctgagcaactcgt

SEQ ID NO: 26548 - DNA, 20 bp, Artificial Sequence
  sgRNA
  Havcr2_5
gtgaccctccataataacaa

SEQ ID NO: 26549 - DNA, 20 bp, Artificial Sequence
  sgRNA
  Havcr2_6
agctgtagtagagtccccat

SEQ ID NO: 26550 - DNA, 20 bp, Artificial Sequence
  sgRNA
  Havcr2_7
tccagcagataccagctaaa

SEQ ID NO: 26551 - DNA, 20 bp, Artificial Sequence
  sgRNA
  Havcr2_8
atgtgactctggatgaccat

SEQ ID NO: 26552 - DNA, 20 bp, Artificial Sequence
  sgRNA
  Havcr2_9
aatcccttgccccagcacat

SEQ ID NO: 26553 - DNA, 20 bp, Artificial Sequence
  sgRNA
  Havcr2_10
ggaaaatatctacaccatcg

SEQ ID NO: 26554 - DNA, 20 bp, Artificial Sequence
  sgRNA
  Havcr2_11
ctccagctcagactgcccat

SEQ ID NO: 26555 - DNA, 20 bp, Artificial Sequence
  sgRNA
  Havcr2_12
gtagatagagtgtaactgca

SEQ ID NO: 26556 - DNA, 20 bp, Artificial Sequence
  sgRNA
  Havcr2_13
gcacttgtgcctatgtgctg

SEQ ID NO: 26557 - DNA, 20 bp, Artificial Sequence
  sgRNA
  Havcr2_14
accctaaccacggagagaaa

SEQ ID NO: 26558 - DNA, 20 bp, Artificial Sequence
  sgRNA
  Havcr2_15
gcagcagcaggacacagttg

SEQ ID NO: 26559 - DNA, 20 bp, Artificial Sequence
  sgRNA
  Havcr2_16
ctggccaacttgcctccagg

SEQ ID NO: 26560 - DNA, 20 bp, Artificial Sequence
  sgRNA
  Havcr2_17
tgttgagatcgccctttagc

SEQ ID NO: 26561 - DNA, 20 bp, Artificial Sequence
  sgRNA
  Havcr2_18
ttgaccctggcacttatcat

SEQ ID NO: 26562 - DNA, 20 bp, Artificial Sequence
  sgRNA
  Havcr2_19
gacaccaatgataagtgcca

SEQ ID NO: 26563 - DNA, 20 bp, Artificial Sequence
  sgRNA
  Havcr2_20
gcatttgccaaccctcctgg

SEQ ID NO: 26564 - DNA, 20 bp, Artificial Sequence
  sgRNA
  Hbegf_1
actctcaccggtcaccaacg

SEQ ID NO: 26565 - DNA, 20 bp, Artificial Sequence
  sgRNA
  Hbegf_2
caaggactactgcatccacg

SEQ ID NO: 26566 - DNA, 20 bp, Artificial Sequence
  sgRNA
  Hbegf_3
acaaaccagctgctacccac

SEQ ID NO: 26567 - DNA, 20 bp, Artificial Sequence
  sgRNA
  Hbegf_4
gtggagcacttacttgcaag

SEQ ID NO: 26568 - DNA, 20 bp, Artificial Sequence
  sgRNA
  Hbegf_5
tgagcacgatcacctcccgt

SEQ ID NO: 26569 - DNA, 20 bp, Artificial Sequence
  sgRNA
  Hbegf_6
gcggcttcggagaggtctgg

SEQ ID NO: 26570 - DNA, 20 bp, Artificial Sequence
  sgRNA
  Hbegf_7
aagagcttcagcatcaccga

SEQ ID NO: 26571 - DNA, 20 bp, Artificial Sequence
  sgRNA
  Hbegf_8
gcaggtatctgcactccccg

SEQ ID NO: 26572 - DNA, 20 bp, Artificial Sequence
  sgRNA
  Hbegf_9
tcatgggctgactctaccag

SEQ ID NO: 26573 - DNA, 20 bp, Artificial Sequence
  sgRNA
  Hbegf_10
ccacagccaagactgtagtg

SEQ ID NO: 26574 - DNA, 20 bp, Artificial Sequence
  sgRNA
  Hbegf_11
aaccagctgctacccacggg

SEQ ID NO: 26575 - DNA, 20 bp, Artificial Sequence
  sgRNA
  Hbegf_12
agcaaccctgaccctcccac

SEQ ID NO: 26576 - DNA, 20 bp, Artificial Sequence
  sgRNA
  Hbegf_13
tgtgtccgtggtaaccaggg

SEQ ID NO: 26577 - DNA, 20 bp, Artificial Sequence
  sgRNA
  Hbegf_14
ctgagcacgatcacctcccg

SEQ ID NO: 26578 - DNA, 20 bp, Artificial Sequence
  sgRNA
  Hbegf_15
cacgatgacaagaagacaga

SEQ ID NO: 26579 - DNA, 20 bp, Artificial Sequence
  sgRNA
  Hbegf_16
aagccgctccagactctcac

SEQ ID NO: 26580 - DNA, 20 bp, Artificial Sequence
  sgRNA
  Hbegf_17
tggtttgtggatccagtggg

SEQ ID NO: 26581 - DNA, 20 bp, Artificial Sequence
  sgRNA
  Hbegf_18
agtcataacctcctctcctg

SEQ ID NO: 26582 - DNA, 20 bp, Artificial Sequence
  sgRNA
  Hbegf_19
agagaaagtgaagttgggcg

SEQ ID NO: 26583 - DNA, 20 bp, Artificial Sequence
  sgRNA
  Hbegf_20
cgggaggtgatcgtgctcag

SEQ ID NO: 26584 - DNA, 20 bp, Artificial Sequence
  sgRNA
  Hcar1_1
aggtagtagtctgtccgaag

SEQ ID NO: 26585 - DNA, 20 bp, Artificial Sequence
  sgRNA
  Hcar1_2
gagtagaggaggcatcactt

SEQ ID NO: 26586 - DNA, 20 bp, Artificial Sequence
  sgRNA
  Hcar1_3
atggcattcaccatatggtg

SEQ ID NO: 26587 - DNA, 20 bp, Artificial Sequence
  sgRNA
  Hcar1_4
catgacatcgtgccacccgt

SEQ ID NO: 26588 - DNA, 20 bp, Artificial Sequence
  sgRNA
  Hcar1_5
tggtgaatgccatctccaac

SEQ ID NO: 26589 - DNA, 20 bp, Artificial Sequence
  sgRNA
  Hcar1_6
ggtcgtgctgtctcatcgag

SEQ ID NO: 26590 - DNA, 20 bp, Artificial Sequence
  sgRNA
  Hcar1_7
atggggcaaatcgttcccag

SEQ ID NO: 26591 - DNA, 20 bp, Artificial Sequence
  sgRNA
  Hcar1_8
gaggtagtagtctgtccgaa

SEQ ID NO: 26592 - DNA, 20 bp, Artificial Sequence
  sgRNA
  Hcar1_9
gtcgtgctgtctcatcgagg

SEQ ID NO: 26593 - DNA, 20 bp, Artificial Sequence
  sgRNA
  Hcar1_10
gttcccagaggccatctgac

SEQ ID NO: 26594 - DNA, 20 bp, Artificial Sequence
  sgRNA
  Hcar1_11
tcatggagtcagccaacggg

SEQ ID NO: 26595 - DNA, 20 bp, Artificial Sequence
  sgRNA
  Hcar1_12
gcacgatgtcatgttccagc

SEQ ID NO: 26596 - DNA, 20 bp, Artificial Sequence
  sgRNA
  Hcar1_13
taggctctacttcctctgga

SEQ ID NO: 26597 - DNA, 20 bp, Artificial Sequence
  sgRNA
  Hcar1_14
actacctcagacgcagacac

SEQ ID NO: 26598 - DNA, 20 bp, Artificial Sequence
  sgRNA
  Hcar1_15
gtgtagaatttggggagcga

SEQ ID NO: 26599 - DNA, 20 bp, Artificial Sequence
  sgRNA
  Hcar1_16
gttcaggtaggtgaagctca

SEQ ID NO: 26600 - DNA, 20 bp, Artificial Sequence
  sgRNA
  Hcar1_17
gcttgagaagtaatatacaa

SEQ ID NO: 26601 - DNA, 20 bp, Artificial Sequence
  sgRNA
  Hcar1_18
acgaagaccaggatgagtag

SEQ ID NO: 26602 - DNA, 20 bp, Artificial Sequence
  sgRNA
  Hcar1_19
tatccacagccaccacagtg

SEQ ID NO: 26603 - DNA, 20 bp, Artificial Sequence
  sgRNA
  Hcar1_20
tggcattcaccatatggtgg

SEQ ID NO: 26604 - DNA, 20 bp, Artificial Sequence
  sgRNA
  Hcar2_1
catgatgaccaaaaatggcg

SEQ ID NO: 26605 - DNA, 20 bp, Artificial Sequence
  sgRNA
  Hcar2_2
ggacaactatgtccataact

SEQ ID NO: 26606 - DNA, 20 bp, Artificial Sequence
  sgRNA
  Hcar2_3
gttgaacaagaaaatccggc

SEQ ID NO: 26607 - DNA, 20 bp, Artificial Sequence
  sgRNA
  Hcar2_4
gaacaagatctccaaccgga

SEQ ID NO: 26608 - DNA, 20 bp, Artificial Sequence
  sgRNA
  Hcar2_5
tgtggaccgctacttccggg

SEQ ID NO: 26609 - DNA, 20 bp, Artificial Sequence
  sgRNA
  Hcar2_6
ggggcaagaagaattccaag

SEQ ID NO: 26610 - DNA, 20 bp, Artificial Sequence
  sgRNA
  Hcar2_7
tcttgaacaagatctccaac

SEQ ID NO: 26611 - DNA, 20 bp, Artificial Sequence
  sgRNA
  Hcar2_8
gcacaaccagaagtattcca

SEQ ID NO: 26612 - DNA, 20 bp, Artificial Sequence
  sgRNA
  Hcar2_9
aagaaatgatggccgccgtc

SEQ ID NO: 26613 - DNA, 20 bp, Artificial Sequence
  sgRNA
  Hcar2_10
aatgatggccgccgtccggt

SEQ ID NO: 26614 - DNA, 20 bp, Artificial Sequence
  sgRNA
  Hcar2_11
agtggtgtggatggaccacc

SEQ ID NO: 26615 - DNA, 20 bp, Artificial Sequence
  sgRNA
  Hcar2_12
acatagttgtccgtcaggaa

SEQ ID NO: 26616 - DNA, 20 bp, Artificial Sequence
  sgRNA
  Hcar2_13
tgccgtttatcactagaaaa

SEQ ID NO: 26617 - DNA, 20 bp, Artificial Sequence
  sgRNA
  Hcar2_14
gatcaggagaaagtcagcca

SEQ ID NO: 26618 - DNA, 20 bp, Artificial Sequence
  sgRNA
  Hcar2_15
cagacatgccaagatcaaga

SEQ ID NO: 26619 - DNA, 20 bp, Artificial Sequence
  sgRNA
  Hcar2_16
gcctgagcagaacaagatga

SEQ ID NO: 26620 - DNA, 20 bp, Artificial Sequence
  sgRNA
  Hcar2_17
aattccagccccaacaccgg

SEQ ID NO: 26621 - DNA, 20 bp, Artificial Sequence
  sgRNA
  Hcar2_18
gaatacttctggttgtgctg

SEQ ID NO: 26622 - DNA, 20 bp, Artificial Sequence
  sgRNA
  Hcar2_19
ccaacatgaagagcatcaca

SEQ ID NO: 26623 - DNA, 20 bp, Artificial Sequence
  sgRNA
  Hcar2_20
agttgtccgtcaggaacggc

SEQ ID NO: 26624 - DNA, 20 bp, Artificial Sequence
  sgRNA
  Hcrtr1_1
ctacccgaagcagtacgagt

SEQ ID NO: 26625 - DNA, 20 bp, Artificial Sequence
  sgRNA
  Hcrtr1_2
agaaaacagacacctaccca

SEQ ID NO: 26626 - DNA, 20 bp, Artificial Sequence
  sgRNA
  Hcrtr1_3
tagtggacatcaccgagtcg

SEQ ID NO: 26627 - DNA, 20 bp, Artificial Sequence
  sgRNA
  Hcrtr1_4
gctgtgctcttgaacaacag

SEQ ID NO: 26628 - DNA, 20 bp, Artificial Sequence
  sgRNA
  Hcrtr1_5
gatggcataccagcggtcca

SEQ ID NO: 26629 - DNA, 20 bp, Artificial Sequence
  sgRNA
  Hcrtr1_6
aactcgtcctcatagtctgg

SEQ ID NO: 26630 - DNA, 20 bp, Artificial Sequence
  sgRNA
  Hcrtr1_7
tgaagcagatgcgagctcgg

SEQ ID NO: 26631 - DNA, 20 bp, Artificial Sequence
  sgRNA
  Hcrtr1_8
tgctcttgaacaacagtggg

SEQ ID NO: 26632 - DNA, 20 bp, Artificial Sequence
  sgRNA
  Hcrtr1_9
ggaaataggccatagccatg

SEQ ID NO: 26633 - DNA, 20 bp, Artificial Sequence
  sgRNA
  Hcrtr1_10
gataatcgcgccacaggtat

SEQ ID NO: 26634 - DNA, 20 bp, Artificial Sequence
  sgRNA
  Hcrtr1_11
ggtgatgtccactaacaggc

SEQ ID NO: 26635 - DNA, 20 bp, Artificial Sequence
  sgRNA
  Hcrtr1_12
tctacccgaagcagtacgag

SEQ ID NO: 26636 - DNA, 20 bp, Artificial Sequence
  sgRNA
  Hcrtr1_13
ggtggcagatggcataccag

SEQ ID NO: 26637 - DNA, 20 bp, Artificial Sequence
  sgRNA
  Hcrtr1_14
aatcgcgccacaggtatcgg

SEQ ID NO: 26638 - DNA, 20 bp, Artificial Sequence
  sgRNA
  Hcrtr1_15
tatgaggaacacagccacgt

SEQ ID NO: 26639 - DNA, 20 bp, Artificial Sequence
  sgRNA
  Hcrtr1_16
tgagcctccagttgttccga

SEQ ID NO: 26640 - DNA, 20 bp, Artificial Sequence
  sgRNA
  Hcrtr1_17
ggttctcattgcagcctacg

SEQ ID NO: 26641 - DNA, 20 bp, Artificial Sequence
  sgRNA
  Hcrtr1_18
actcggtgatgtccactaac

SEQ ID NO: 26642 - DNA, 20 bp, Artificial Sequence
  sgRNA
  Hcrtr1_19
tattgcccaccaaggctatg

SEQ ID NO: 26643 - DNA, 20 bp, Artificial Sequence
  sgRNA
  Hcrtr1_20
ccaaggctgatgtggtacca

SEQ ID NO: 26644 - DNA, 20 bp, Artificial Sequence
  sgRNA
  Hcrtr2_1
ccaaggagaccgcctcgcca

SEQ ID NO: 26645 - DNA, 20 bp, Artificial Sequence
  sgRNA
  Hcrtr2_2
atgacgacgaggaattcctg

SEQ ID NO: 26646 - DNA, 20 bp, Artificial Sequence
  sgRNA
  Hcrtr2_3
tggtcttattggctaggcca

SEQ ID NO: 26647 - DNA, 20 bp, Artificial Sequence
  sgRNA
  Hcrtr2_4
ggtgacaaatggcgtaccat

SEQ ID NO: 26648 - DNA, 20 bp, Artificial Sequence
  sgRNA
  Hcrtr2_5
tcctcgtcgtcatagtccgt

SEQ ID NO: 26649 - DNA, 20 bp, Artificial Sequence
  sgRNA
  Hcrtr2_6
taaagcagatccgagcacga

SEQ ID NO: 26650 - DNA, 20 bp, Artificial Sequence
  sgRNA
  Hcrtr2_7
tctcagtgatgtcaacaacg

SEQ ID NO: 26651 - DNA, 20 bp, Artificial Sequence
  sgRNA
  Hcrtr2_8
attcctgcggtacctgtgga

SEQ ID NO: 26652 - DNA, 20 bp, Artificial Sequence
  sgRNA
  Hcrtr2_9
ctcagtgatgtcaacaacga

SEQ ID NO: 26653 - DNA, 20 bp, Artificial Sequence
  sgRNA
  Hcrtr2_10
tgaccagttgcgacgagaga

SEQ ID NO: 26654 - DNA, 20 bp, Artificial Sequence
  sgRNA
  Hcrtr2_11
ggtcacaagcacatctgcta

SEQ ID NO: 26655 - DNA, 20 bp, Artificial Sequence
  sgRNA
  Hcrtr2_12
tgttcaagagcacagccaaa

SEQ ID NO: 26656 - DNA, 20 bp, Artificial Sequence
  sgRNA
  Hcrtr2_13
ctgtgctcttgaacatcaaa

SEQ ID NO: 26657 - DNA, 20 bp, Artificial Sequence
  sgRNA
  Hcrtr2_14
acacccgaaagaatatgagt

SEQ ID NO: 26658 - DNA, 20 bp, Artificial Sequence
  sgRNA
  Hcrtr2_15
gccaatatcataagacacag

SEQ ID NO: 26659 - DNA, 20 bp, Artificial Sequence
  sgRNA
  Hcrtr2_16
gtatgtgatgaacactgggg

SEQ ID NO: 26660 - DNA, 20 bp, Artificial Sequence
  sgRNA
  Hcrtr2_17
ttgttgacatcactgagact

SEQ ID NO: 26661 - DNA, 20 bp, Artificial Sequence
  sgRNA
  Hcrtr2_18
tagtccgtgggatttaaaaa

SEQ ID NO: 26662 - DNA, 20 bp, Artificial Sequence
  sgRNA
  Hcrtr2_19
gctgctgcactccatgacaa

SEQ ID NO: 26663 - DNA, 20 bp, Artificial Sequence
  sgRNA
  Hcrtr2_20
cttggggttcatcatcgcca

SEQ ID NO: 26664 - DNA, 20 bp, Artificial Sequence
  sgRNA
  Heg1_1
aagtagacggaacatagccg

SEQ ID NO: 26665 - DNA, 20 bp, Artificial Sequence
  sgRNA
  Heg1_2
atttggactgaagtcacacg

SEQ ID NO: 26666 - DNA, 20 bp, Artificial Sequence
  sgRNA
  Heg1_3
gacttcagtccaaatgtcga

SEQ ID NO: 26667 - DNA, 20 bp, Artificial Sequence
  sgRNA
  Heg1_4
aaagcggtcccgcgaccggg

SEQ ID NO: 26668 - DNA, 20 bp, Artificial Sequence
  sgRNA
  Heg1_5
ttccacagttgagtccaccg

SEQ ID NO: 26669 - DNA, 20 bp, Artificial Sequence
  sgRNA
  Heg1_6
gagtcttcgccgccacctcg

SEQ ID NO: 26670 - DNA, 20 bp, Artificial Sequence
  sgRNA
  Heg1_7
agggggccatcaccacagaa

SEQ ID NO: 26671 - DNA, 20 bp, Artificial Sequence
  sgRNA
  Heg1_8
tgtccccagaggcgtgagcg

SEQ ID NO: 26672 - DNA, 20 bp, Artificial Sequence
  sgRNA
  Heg1_9
cttggtccccagccttaaca

SEQ ID NO: 26673 - DNA, 20 bp, Artificial Sequence
  sgRNA
  Heg1_10
aatcctcgctcgcaagagtg

SEQ ID NO: 26674 - DNA, 20 bp, Artificial Sequence
  sgRNA
  Heg1_11
tcatcagcgacgagagcagg

SEQ ID NO: 26675 - DNA, 20 bp, Artificial Sequence
  sgRNA
  Heg1_12
gctgtgggcagttggcgccg

SEQ ID NO: 26676 - DNA, 20 bp, Artificial Sequence
  sgRNA
  Heg1_13
tccctgagtattgttgcacg

SEQ ID NO: 26677 - DNA, 20 bp, Artificial Sequence
  sgRNA
  Heg1_14
gaggagtgttcgatgggccg

SEQ ID NO: 26678 - DNA, 20 bp, Artificial Sequence
  sgRNA
  Heg1_15
gtattgttgcacgtggctag

SEQ ID NO: 26679 - DNA, 20 bp, Artificial Sequence
  sgRNA
  Heg1_16
agataacacctcctactcag

SEQ ID NO: 26680 - DNA, 20 bp, Artificial Sequence
  sgRNA
  Heg1_17
aaggcacccgtgaatcagat

SEQ ID NO: 26681 - DNA, 20 bp, Artificial Sequence
  sgRNA
  Heg1_18
acacgtctgcaatgtccacc

SEQ ID NO: 26682 - DNA, 20 bp, Artificial Sequence
  sgRNA
  Heg1_19
gaccctgcagatgagacaga

SEQ ID NO: 26683 - DNA, 20 bp, Artificial Sequence
  sgRNA
  Heg1_20
gtccttgagtccttcacaga

SEQ ID NO: 26684 - DNA, 20 bp, Artificial Sequence
  sgRNA
  Hepacam_1
cactgacgacaccttcaccg

SEQ ID NO: 26685 - DNA, 20 bp, Artificial Sequence
  sgRNA
  Hepacam_2
gcaccaagcctagctacacg

SEQ ID NO: 26686 - DNA, 20 bp, Artificial Sequence
  sgRNA
  Hepacam_3
ggtgcagtctataggcacag

SEQ ID NO: 26687 - DNA, 20 bp, Artificial Sequence
  sgRNA
  Hepacam_4
ctcactgagctccagcacag

SEQ ID NO: 26688 - DNA, 20 bp, Artificial Sequence
  sgRNA
  Hepacam_5
tgtgcctatagactgcacca

SEQ ID NO: 26689 - DNA, 20 bp, Artificial Sequence
  sgRNA
  Hepacam_6
cttcagctgccacttcacca

SEQ ID NO: 26690 - DNA, 20 bp, Artificial Sequence
  sgRNA
  Hepacam_7
acaggagcggaagaacccaa

SEQ ID NO: 26691 - DNA, 20 bp, Artificial Sequence
  sgRNA
  Hepacam_8
aaaaccctgctacagagcca

SEQ ID NO: 26692 - DNA, 20 bp, Artificial Sequence
  sgRNA
  Hepacam_9
gcggcgacacggagtagcca

SEQ ID NO: 26693 - DNA, 20 bp, Artificial Sequence
  sgRNA
  Hepacam_10
tatatcatcttgtctacagg

SEQ ID NO: 26694 - DNA, 20 bp, Artificial Sequence
  sgRNA
  Hepacam_11
ctatacacagtgatcttgac

SEQ ID NO: 26695 - DNA, 20 bp, Artificial Sequence
  sgRNA
  Hepacam_12
tgatgttcaccccctccagg

SEQ ID NO: 26696 - DNA, 20 bp, Artificial Sequence
  sgRNA
  Hepacam_13
gctggtgctactgtactgca

SEQ ID NO: 26697 - DNA, 20 bp, Artificial Sequence
  sgRNA
  Hepacam_14
tcaggatatagagtgccatt

SEQ ID NO: 26698 - DNA, 20 bp, Artificial Sequence
  sgRNA
  Hepacam_15
tcactgacgacaccttcacc

SEQ ID NO: 26699 - DNA, 20 bp, Artificial Sequence
  sgRNA
  Hepacam_16
gaagaccatcaacctcaccg

SEQ ID NO: 26700 - DNA, 20 bp, Artificial Sequence
  sgRNA
  Hepacam_17
gcagctcttcgcgctcactg

SEQ ID NO: 26701 - DNA, 20 bp, Artificial Sequence
  sgRNA
  Hepacam_18
agcccagtacgtctgatcca

SEQ ID NO: 26702 - DNA, 20 bp, Artificial Sequence
  sgRNA
  Hepacam_19
ggagcattcgggagtcattg

SEQ ID NO: 26703 - DNA, 20 bp, Artificial Sequence
  sgRNA
  Hepacam_20
ggtgaaggtgtcgtcagtga

SEQ ID NO: 26704 - DNA, 20 bp, Artificial Sequence
  sgRNA
  Hepacam2_1
gtggacagtgtatgacggca

SEQ ID NO: 26705 - DNA, 20 bp, Artificial Sequence
  sgRNA
  Hepacam2_2
tgagggcaattacatcgtga

SEQ ID NO: 26706 - DNA, 20 bp, Artificial Sequence
  sgRNA
  Hepacam2_3
aggctccgttaataagtctg

SEQ ID NO: 26707 - DNA, 20 bp, Artificial Sequence
  sgRNA
  Hepacam2_4
agttacttacaatatatggt

SEQ ID NO: 26708 - DNA, 20 bp, Artificial Sequence
  sgRNA
  Hepacam2_5
gtgccgtcatacactgtcca

SEQ ID NO: 26709 - DNA, 20 bp, Artificial Sequence
  sgRNA
  Hepacam2_6
acagtcatcataacttccgt

SEQ ID NO: 26710 - DNA, 20 bp, Artificial Sequence
  sgRNA
  Hepacam2_7
tcgtgaaggtcaacatccag

SEQ ID NO: 26711 - DNA, 20 bp, Artificial Sequence
  sgRNA
  Hepacam2_8
ttgtcactggaacaatccaa

SEQ ID NO: 26712 - DNA, 20 bp, Artificial Sequence
  sgRNA
  Hepacam2_9
gctataagacagaagctaga

SEQ ID NO: 26713 - DNA, 20 bp, Artificial Sequence
  sgRNA
  Hepacam2_10
tgtcactggaacaatccaaa

SEQ ID NO: 26714 - DNA, 20 bp, Artificial Sequence
  sgRNA
  Hepacam2_11
tctggggctgttgagtatgt

SEQ ID NO: 26715 - DNA, 20 bp, Artificial Sequence
  sgRNA
  Hepacam2_12
cacgatgtaattgccctcat

SEQ ID NO: 26716 - DNA, 20 bp, Artificial Sequence
  sgRNA
  Hepacam2_13
ctgcctctgatggtgtaaca

SEQ ID NO: 26717 - DNA, 20 bp, Artificial Sequence
  sgRNA
  Hepacam2_14
gcctggtacctccttctacc

SEQ ID NO: 26718 - DNA, 20 bp, Artificial Sequence
  sgRNA
  Hepacam2_15
tgttacaccatcagaggcag

SEQ ID NO: 26719 - DNA, 20 bp, Artificial Sequence
  sgRNA
  Hepacam2_16
gtttaccagtggcgaaaaag

SEQ ID NO: 26720 - DNA, 20 bp, Artificial Sequence
  sgRNA
  Hepacam2_17
tatggagcttctcagaagca

SEQ ID NO: 26721 - DNA, 20 bp, Artificial Sequence
  sgRNA
  Hepacam2_18
gaattaacctgaagtccata

SEQ ID NO: 26722 - DNA, 20 bp, Artificial Sequence
  sgRNA
  Hepacam2_19
ctacacatgtcattaagcat

SEQ ID NO: 26723 - DNA, 20 bp, Artificial Sequence
  sgRNA
  Hepacam2_20
gactggagaagcttgcacaa

SEQ ID NO: 26724 - DNA, 20 bp, Artificial Sequence
  sgRNA
  Heph_1
catgtgcaagggtgatactg

SEQ ID NO: 26725 - DNA, 20 bp, Artificial Sequence
  sgRNA
  Heph_2
ttggagcatctacatgcgag

SEQ ID NO: 26726 - DNA, 20 bp, Artificial Sequence
  sgRNA
  Heph_3
gtttataaggaatacagtga

SEQ ID NO: 26727 - DNA, 20 bp, Artificial Sequence
  sgRNA
  Heph_4
aaaagtcacatactactgga

SEQ ID NO: 26728 - DNA, 20 bp, Artificial Sequence
  sgRNA
  Heph_5
gtacatggggtaatgttcga

SEQ ID NO: 26729 - DNA, 20 bp, Artificial Sequence
  sgRNA
  Heph_6
tggcatggagaccatcttta

SEQ ID NO: 26730 - DNA, 20 bp, Artificial Sequence
  sgRNA
  Heph_7
atatcattccggcctccatt

SEQ ID NO: 26731 - DNA, 20 bp, Artificial Sequence
  sgRNA
  Heph_8
ccattcagcatacagcccca

SEQ ID NO: 26732 - DNA, 20 bp, Artificial Sequence
  sgRNA
  Heph_9
tctggtccagaccttggccg

SEQ ID NO: 26733 - DNA, 20 bp, Artificial Sequence
  sgRNA
  Heph_10
ctgctctcagaggatgtcga

SEQ ID NO: 26734 - DNA, 20 bp, Artificial Sequence
  sgRNA
  Heph_11
tgtggtctataccaactgat

SEQ ID NO: 26735 - DNA, 20 bp, Artificial Sequence
  sgRNA
  Heph_12
aagcttggtagtgttggcgt

SEQ ID NO: 26736 - DNA, 20 bp, Artificial Sequence
  sgRNA
  Heph_13
ccaagcaggcagccaccgag

SEQ ID NO: 26737 - DNA, 20 bp, Artificial Sequence
  sgRNA
  Heph_14
gcctcggtggacaaagaaga

SEQ ID NO: 26738 - DNA, 20 bp, Artificial Sequence
  sgRNA
  Heph_15
tcaggcccatgagattcaat

SEQ ID NO: 26739 - DNA, 20 bp, Artificial Sequence
  sgRNA
  Heph_16
cccaggctggacatgtgcaa

SEQ ID NO: 26740 - DNA, 20 bp, Artificial Sequence
  sgRNA
  Heph_17
cagccttgcacaccagtaga

SEQ ID NO: 26741 - DNA, 20 bp, Artificial Sequence
  sgRNA
  Heph_18
gaaagcttcggcgcaacagg

SEQ ID NO: 26742 - DNA, 20 bp, Artificial Sequence
  sgRNA
  Heph_19
tctcataaaaaacaccgtga

SEQ ID NO: 26743 - DNA, 20 bp, Artificial Sequence
  sgRNA
  Heph_20
gatgattctgtcccccctgg

SEQ ID NO: 26744 - DNA, 20 bp, Artificial Sequence
  sgRNA
  Hephl1_1
acagcggcgctacttcatag

SEQ ID NO: 26745 - DNA, 20 bp, Artificial Sequence
  sgRNA
  Hephl1_2
gtttccccatatggccacaa

SEQ ID NO: 26746 - DNA, 20 bp, Artificial Sequence
  sgRNA
  Hephl1_3
gtgaaaccttcacctacagg

SEQ ID NO: 26747 - DNA, 20 bp, Artificial Sequence
  sgRNA
  Hephl1_4
cccagagcagatatccttag

SEQ ID NO: 26748 - DNA, 20 bp, Artificial Sequence
  sgRNA
  Hephl1_5
gcaacaccatccacctacga

SEQ ID NO: 26749 - DNA, 20 bp, Artificial Sequence
  sgRNA
  Hephl1_6
ccttgaagatcggagtctga

SEQ ID NO: 26750 - DNA, 20 bp, Artificial Sequence
  sgRNA
  Hephl1_7
gaccgctgagaagtaaagat

SEQ ID NO: 26751 - DNA, 20 bp, Artificial Sequence
  sgRNA
  Hephl1_8
ttatgcccctaacaaaaact

SEQ ID NO: 26752 - DNA, 20 bp, Artificial Sequence
  sgRNA
  Hephl1_9
ggcaagaatctgcgtccaag

SEQ ID NO: 26753 - DNA, 20 bp, Artificial Sequence
  sgRNA
  Hephl1_10
gcgaccttatttctggagcg

SEQ ID NO: 26754 - DNA, 20 bp, Artificial Sequence
  sgRNA
  Hephl1_11
tcagactccgatcttcaagg

SEQ ID NO: 26755 - DNA, 20 bp, Artificial Sequence
  sgRNA
  Hephl1_12
gctcctcacccaaaggtgca

SEQ ID NO: 26756 - DNA, 20 bp, Artificial Sequence
  sgRNA
  Hephl1_13
agggcacgctcaatgccgat

SEQ ID NO: 26757 - DNA, 20 bp, Artificial Sequence
  sgRNA
  Hephl1_14
gtctacagcatcttacccca

SEQ ID NO: 26758 - DNA, 20 bp, Artificial Sequence
  sgRNA
  Hephl1_15
ggtgtggaggactcaaacaa

SEQ ID NO: 26759 - DNA, 20 bp, Artificial Sequence
  sgRNA
  Hephl1_16
cagtcattatgagaccaggg

SEQ ID NO: 26760 - DNA, 20 bp, Artificial Sequence
  sgRNA
  Hephl1_17
accttaccccacttcacgag

SEQ ID NO: 26761 - DNA, 20 bp, Artificial Sequence
  sgRNA
  Hephl1_18
gtaataacatccttcccttg

SEQ ID NO: 26762 - DNA, 20 bp, Artificial Sequence
  sgRNA
  Hephl1_19
aggagtttgtgaaatccaat

SEQ ID NO: 26763 - DNA, 20 bp, Artificial Sequence
  sgRNA
  Hephl1_20
gtttctgggtcccatcctga

SEQ ID NO: 26764 - DNA, 20 bp, Artificial Sequence
  sgRNA
  Hfe_1
tgctccacgtacccttactg

SEQ ID NO: 26765 - DNA, 20 bp, Artificial Sequence
  sgRNA
  Hfe_2
ttcctcccgcactcacgcgg

SEQ ID NO: 26766 - DNA, 20 bp, Artificial Sequence
  sgRNA
  Hfe_3
gatccgtgccaaacagaaca

SEQ ID NO: 26767 - DNA, 20 bp, Artificial Sequence
  sgRNA
  Hfe_4
catgaagacaacagtaccag

SEQ ID NO: 26768 - DNA, 20 bp, Artificial Sequence
  sgRNA
  Hfe_5
ggtttgctccaagatccacg

SEQ ID NO: 26769 - DNA, 20 bp, Artificial Sequence
  sgRNA
  Hfe_6
tgataggtctcatccccgtt

SEQ ID NO: 26770 - DNA, 20 bp, Artificial Sequence
  sgRNA
  Hfe_7
ggtgaaagtgactcgccact

SEQ ID NO: 26771 - DNA, 20 bp, Artificial Sequence
  sgRNA
  Hfe_8
aggctggctgacattggccg

SEQ ID NO: 26772 - DNA, 20 bp, Artificial Sequence
  sgRNA
  Hfe_9
tgaaccttgtctcgtcccca

SEQ ID NO: 26773 - DNA, 20 bp, Artificial Sequence
  sgRNA
  Hfe_10
cgttaggtagcaccttctcg

SEQ ID NO: 26774 - DNA, 20 bp, Artificial Sequence
  sgRNA
  Hfe_11
ctcgccactgggcctctacg

SEQ ID NO: 26775 - DNA, 20 bp, Artificial Sequence
  sgRNA
  Hfe_12
tagcccctagcctcaaacaa

SEQ ID NO: 26776 - DNA, 20 bp, Artificial Sequence
  sgRNA
  Hfe_13
ttgacatctttggcatccag

SEQ ID NO: 26777 - DNA, 20 bp, Artificial Sequence
  sgRNA
  Hfe_14
atcatggcctgagattgcaa

SEQ ID NO: 26778 - DNA, 20 bp, Artificial Sequence
  sgRNA
  Hfe_15
gttgaaggacaaccaaccac

SEQ ID NO: 26779 - DNA, 20 bp, Artificial Sequence
  sgRNA
  Hfe_16
cgagaaggtgctacctaacg

SEQ ID NO: 26780 - DNA, 20 bp, Artificial Sequence
  sgRNA
  Hfe_17
ggtgcctcagagccagacct

SEQ ID NO: 26781 - DNA, 20 bp, Artificial Sequence
  sgRNA
  Hfe_18
tctctaagatacctcttcat

SEQ ID NO: 26782 - DNA, 20 bp, Artificial Sequence
  sgRNA
  Hfe_19
cccagaacatcactatgagg

SEQ ID NO: 26783 - DNA, 20 bp, Artificial Sequence
  sgRNA
  Hfe_20
gaggtttgctccaagatcca

SEQ ID NO: 26784 - DNA, 20 bp, Artificial Sequence
  sgRNA
  Hrh1_1
ttggctgaagacagtcggag

SEQ ID NO: 26785 - DNA, 20 bp, Artificial Sequence
  sgRNA
  Hrh1_2
tgagcgcaagctacacaccg

SEQ ID NO: 26786 - DNA, 20 bp, Artificial Sequence
  sgRNA
  Hrh1_3
agcggtagcgatcaatacac

SEQ ID NO: 26787 - DNA, 20 bp, Artificial Sequence
  sgRNA
  Hrh1_4
actacttagaaccaccacca

SEQ ID NO: 26788 - DNA, 20 bp, Artificial Sequence
  sgRNA
  Hrh1_5
ggttgcacttgaaccgagag

SEQ ID NO: 26789 - DNA, 20 bp, Artificial Sequence
  sgRNA
  Hrh1_6
tcgatacctcaggtaccgga

SEQ ID NO: 26790 - DNA, 20 bp, Artificial Sequence
  sgRNA
  Hrh1_7
tctgatccagacctccagta

SEQ ID NO: 26791 - DNA, 20 bp, Artificial Sequence
  sgRNA
  Hrh1_8
tgacgtcaagacggaaacag

SEQ ID NO: 26792 - DNA, 20 bp, Artificial Sequence
  sgRNA
  Hrh1_9
gttgatgtagcccagccaaa

SEQ ID NO: 26793 - DNA, 20 bp, Artificial Sequence
  sgRNA
  Hrh1_10
gacaatgtacaggttgccca

SEQ ID NO: 26794 - DNA, 20 bp, Artificial Sequence
  sgRNA
  Hrh1_11
tgcttcagctaccatcctgg

SEQ ID NO: 26795 - DNA, 20 bp, Artificial Sequence
  sgRNA
  Hrh1_12
caatcaggtctgctaccgac

SEQ ID NO: 26796 - DNA, 20 bp, Artificial Sequence
  sgRNA
  Hrh1_13
cagacaccagcatagagcca

SEQ ID NO: 26797 - DNA, 20 bp, Artificial Sequence
  sgRNA
  Hrh1_14
ccgtcaagagaccctactgg

SEQ ID NO: 26798 - DNA, 20 bp, Artificial Sequence
  sgRNA
  Hrh1_15
gtgtctgcatgacgtcaaga

SEQ ID NO: 26799 - DNA, 20 bp, Artificial Sequence
  sgRNA
  Hrh1_16
cctccagtagggtctcttga

SEQ ID NO: 26800 - DNA, 20 bp, Artificial Sequence
  sgRNA
  Hrh1_17
gctctgtccagcaacccctc

SEQ ID NO: 26801 - DNA, 20 bp, Artificial Sequence
  sgRNA
  Hrh1_18
tactacttagaaccaccacc

SEQ ID NO: 26802 - DNA, 20 bp, Artificial Sequence
  sgRNA
  Hrh1_19
gcactgcatacagcaccagc

SEQ ID NO: 26803 - DNA, 20 bp, Artificial Sequence
  sgRNA
  Hrh1_20
atgacgtcaagacggaaaca

SEQ ID NO: 26804 - DNA, 20 bp, Artificial Sequence
  sgRNA
  Hrh2_1
cagaatctttaagatcgcca

SEQ ID NO: 26805 - DNA, 20 bp, Artificial Sequence
  sgRNA
  Hrh2_2
tctcagtccacggtaaacga

SEQ ID NO: 26806 - DNA, 20 bp, Artificial Sequence
  sgRNA
  Hrh2_3
agagatggcaacgcgaacag

SEQ ID NO: 26807 - DNA, 20 bp, Artificial Sequence
  sgRNA
  Hrh2_4
tccatcctaggtgaatagag

SEQ ID NO: 26808 - DNA, 20 bp, Artificial Sequence
  sgRNA
  Hrh2_5
cctcaacagagacttccgca

SEQ ID NO: 26809 - DNA, 20 bp, Artificial Sequence
  sgRNA
  Hrh2_6
gctgtgaacgaggtggtcga

SEQ ID NO: 26810 - DNA, 20 bp, Artificial Sequence
  sgRNA
  Hrh2_7
ttcactgccttcgtttaccg

SEQ ID NO: 26811 - DNA, 20 bp, Artificial Sequence
  sgRNA
  Hrh2_8
ggtccaagctgatcatgaag

SEQ ID NO: 26812 - DNA, 20 bp, Artificial Sequence
  sgRNA
  Hrh2_9
gcgctgtcacggacccactg

SEQ ID NO: 26813 - DNA, 20 bp, Artificial Sequence
  sgRNA
  Hrh2_10
cgtttaccgtggactgagag

SEQ ID NO: 26814 - DNA, 20 bp, Artificial Sequence
  sgRNA
  Hrh2_11
tgtggcttgcaagcttgcag

SEQ ID NO: 26815 - DNA, 20 bp, Artificial Sequence
  sgRNA
  Hrh2_12
actctcacaaaacttccctg

SEQ ID NO: 26816 - DNA, 20 bp, Artificial Sequence
  sgRNA
  Hrh2_13
agagctgttggtacgccatg

SEQ ID NO: 26817 - DNA, 20 bp, Artificial Sequence
  sgRNA
  Hrh2_14
tgaagcaattggtcagactg

SEQ ID NO: 26818 - DNA, 20 bp, Artificial Sequence
  sgRNA
  Hrh2_15
tccttcctctctattcacct

SEQ ID NO: 26819 - DNA, 20 bp, Artificial Sequence
  sgRNA
  Hrh2_16
gaacaggggtgaccaacacg

SEQ ID NO: 26820 - DNA, 20 bp, Artificial Sequence
  sgRNA
  Hrh2_17
ggtccgtgacagcgcagtag

SEQ ID NO: 26821 - DNA, 20 bp, Artificial Sequence
  sgRNA
  Hrh2_18
gacgatgaatgctcccatga

SEQ ID NO: 26822 - DNA, 20 bp, Artificial Sequence
  sgRNA
  Hrh2_19
gatcatgaagaggttgagga

SEQ ID NO: 26823 - DNA, 20 bp, Artificial Sequence
  sgRNA
  Hrh2_20
tcgccagggagcaagccaag

SEQ ID NO: 26824 - DNA, 20 bp, Artificial Sequence
  sgRNA
  Hrh3_1
cctccccagtctcaacacca

SEQ ID NO: 26825 - DNA, 20 bp, Artificial Sequence
  sgRNA
  Hrh3_2
gaggctcgaatccgccacga

SEQ ID NO: 26826 - DNA, 20 bp, Artificial Sequence
  sgRNA
  Hrh3_3
cggacaggtactcccaactc

SEQ ID NO: 26827 - DNA, 20 bp, Artificial Sequence
  sgRNA
  Hrh3_4
gtctgggggctttacccacg

SEQ ID NO: 26828 - DNA, 20 bp, Artificial Sequence
  sgRNA
  Hrh3_5
gcgttcatcagcccgtcggg

SEQ ID NO: 26829 - DNA, 20 bp, Artificial Sequence
  sgRNA
  Hrh3_6
cgacgggctgatgaacgcgt

SEQ ID NO: 26830 - DNA, 20 bp, Artificial Sequence
  sgRNA
  Hrh3_7
agttgggagtacctgtccgg

SEQ ID NO: 26831 - DNA, 20 bp, Artificial Sequence
  sgRNA
  Hrh3_8
tctgcgcagtcagaatttgg

SEQ ID NO: 26832 - DNA, 20 bp, Artificial Sequence
  sgRNA
  Hrh3_9
ggacgtctcgtaccagtagt

SEQ ID NO: 26833 - DNA, 20 bp, Artificial Sequence
  sgRNA
  Hrh3_10
ggttgaagaaggtaacgctg

SEQ ID NO: 26834 - DNA, 20 bp, Artificial Sequence
  sgRNA
  Hrh3_11
acgtctcgtaccagtagtcg

SEQ ID NO: 26835 - DNA, 20 bp, Artificial Sequence
  sgRNA
  Hrh3_12
cgacgcgttcatcagcccgt

SEQ ID NO: 26836 - DNA, 20 bp, Artificial Sequence
  sgRNA
  Hrh3_13
ggtggcagctccatccccga

SEQ ID NO: 26837 - DNA, 20 bp, Artificial Sequence
  sgRNA
  Hrh3_14
gatcatgaggagtgtgtacg

SEQ ID NO: 26838 - DNA, 20 bp, Artificial Sequence
  sgRNA
  Hrh3_15
gcgcagtcagaatttggggg

SEQ ID NO: 26839 - DNA, 20 bp, Artificial Sequence
  sgRNA
  Hrh3_16
tcggctggatgggggccgag

SEQ ID NO: 26840 - DNA, 20 bp, Artificial Sequence
  sgRNA
  Hrh3_17
caggtactcccaactcagga

SEQ ID NO: 26841 - DNA, 20 bp, Artificial Sequence
  sgRNA
  Hrh3_18
gccatctccgacttcctcgt

SEQ ID NO: 26842 - DNA, 20 bp, Artificial Sequence
  sgRNA
  Hrh3_19
ggctatcgtcccgagcctgg

SEQ ID NO: 26843 - DNA, 20 bp, Artificial Sequence
  sgRNA
  Hrh3_20
ggtcatgctcgccttcgtgg

SEQ ID NO: 26844 - DNA, 20 bp, Artificial Sequence
  sgRNA
  Hrh4_1
agatacataacttacccacg

SEQ ID NO: 26845 - DNA, 20 bp, Artificial Sequence
  sgRNA
  Hrh4_2
gaagaacagcacgaacacaa

SEQ ID NO: 26846 - DNA, 20 bp, Artificial Sequence
  sgRNA
  Hrh4_3
gacaatattgtagacagatg

SEQ ID NO: 26847 - DNA, 20 bp, Artificial Sequence
  sgRNA
  Hrh4_4
gaagattgttgctcaaatgg

SEQ ID NO: 26848 - DNA, 20 bp, Artificial Sequence
  sgRNA
  Hrh4_5
gctatttctgacttcctcgt

SEQ ID NO: 26849 - DNA, 20 bp, Artificial Sequence
  sgRNA
  Hrh4_6
attgaaccattgcagccaga

SEQ ID NO: 26850 - DNA, 20 bp, Artificial Sequence
  sgRNA
  Hrh4_7
tgcactttccgatcgccaga

SEQ ID NO: 26851 - DNA, 20 bp, Artificial Sequence
  sgRNA
  Hrh4_8
ggctatttctgacttcctcg

SEQ ID NO: 26852 - DNA, 20 bp, Artificial Sequence
  sgRNA
  Hrh4_9
cagaacggaacgccccaaat

SEQ ID NO: 26853 - DNA, 20 bp, Artificial Sequence
  sgRNA
  Hrh4_10
aggatgctgctctttcttcg

SEQ ID NO: 26854 - DNA, 20 bp, Artificial Sequence
  sgRNA
  Hrh4_11
gtgtcacaggcgtttccaga

SEQ ID NO: 26855 - DNA, 20 bp, Artificial Sequence
  sgRNA
  Hrh4_12
aagacattaaaaatgccaag

SEQ ID NO: 26856 - DNA, 20 bp, Artificial Sequence
  sgRNA
  Hrh4_13
aagtgcagcgcttcgccaaa

SEQ ID NO: 26857 - DNA, 20 bp, Artificial Sequence
  sgRNA
  Hrh4_14
tggagaatccagcatggcta

SEQ ID NO: 26858 - DNA, 20 bp, Artificial Sequence
  sgRNA
  Hrh4_15
atttggggcgttccgttctg

SEQ ID NO: 26859 - DNA, 20 bp, Artificial Sequence
  sgRNA
  Hrh4_16
gagtacgcagagcttctcag

SEQ ID NO: 26860 - DNA, 20 bp, Artificial Sequence
  sgRNA
  Hrh4_17
tgtgagtccttaaggacacc

SEQ ID NO: 26861 - DNA, 20 bp, Artificial Sequence
  sgRNA
  Hrh4_18
gtatcttccagaaagccttc

SEQ ID NO: 26862 - DNA, 20 bp, Artificial Sequence
  sgRNA
  Hrh4_19
ctggagcctgtggaagcgta

SEQ ID NO: 26863 - DNA, 20 bp, Artificial Sequence
  sgRNA
  Hrh4_20
ggaaacgcctgtgacacaaa

SEQ ID NO: 26864 - DNA, 20 bp, Artificial Sequence
  sgRNA
  Htr1a_1
gttcacgtagtctatagggt

SEQ ID NO: 26865 - DNA, 20 bp, Artificial Sequence
  sgRNA
  Htr1a_2
tggagtagatggtgtacccg

SEQ ID NO: 26866 - DNA, 20 bp, Artificial Sequence
  sgRNA
  Htr1a_3
aatccgcaagacggtcaaga

SEQ ID NO: 26867 - DNA, 20 bp, Artificial Sequence
  sgRNA
  Htr1a_4
cagggcgataaacaggtcac

SEQ ID NO: 26868 - DNA, 20 bp, Artificial Sequence
  sgRNA
  Htr1a_5
cttgcggattcggaagcgcg

SEQ ID NO: 26869 - DNA, 20 bp, Artificial Sequence
  sgRNA
  Htr1a_6
ccagtacctgtctagcgcga

SEQ ID NO: 26870 - DNA, 20 bp, Artificial Sequence
  sgRNA
  Htr1a_7
gcgcttccgaatccgcaaga

SEQ ID NO: 26871 - DNA, 20 bp, Artificial Sequence
  sgRNA
  Htr1a_8
gcacatccagggcgataaac

SEQ ID NO: 26872 - DNA, 20 bp, Artificial Sequence
  sgRNA
  Htr1a_9
gcctgtcccgaagggctcca

SEQ ID NO: 26873 - DNA, 20 bp, Artificial Sequence
  sgRNA
  Htr1a_10
agtgagcgagatcagcgcag

SEQ ID NO: 26874 - DNA, 20 bp, Artificial Sequence
  sgRNA
  Htr1a_11
atagttggcaacattctgaa

SEQ ID NO: 26875 - DNA, 20 bp, Artificial Sequence
  sgRNA
  Htr1a_12
atgcacctcgatcacctcca

SEQ ID NO: 26876 - DNA, 20 bp, Artificial Sequence
  sgRNA
  Htr1a_13
ctatagactacgtgaacaag

SEQ ID NO: 26877 - DNA, 20 bp, Artificial Sequence
  sgRNA
  Htr1a_14
tgcactcgttggggttcgag

SEQ ID NO: 26878 - DNA, 20 bp, Artificial Sequence
  sgRNA
  Htr1a_15
gagcgtccccagcaaaagag

SEQ ID NO: 26879 - DNA, 20 bp, Artificial Sequence
  sgRNA
  Htr1a_16
acgtgaacaagaggacgccc

SEQ ID NO: 26880 - DNA, 20 bp, Artificial Sequence
  sgRNA
  Htr1a_17
acaacgtccctggagccctt

SEQ ID NO: 26881 - DNA, 20 bp, Artificial Sequence
  sgRNA
  Htr1a_18
tcgttgccgcctgtcccgaa

SEQ ID NO: 26882 - DNA, 20 bp, Artificial Sequence
  sgRNA
  Htr1a_19
aatgttgccaactatctcat

SEQ ID NO: 26883 - DNA, 20 bp, Artificial Sequence
  sgRNA
  Htr1a_20
atcgagtgggcaactccaaa

SEQ ID NO: 26884 - DNA, 20 bp, Artificial Sequence
  sgRNA
  Htr1b_1
tctgtttcaaaatccgagag

SEQ ID NO: 26885 - DNA, 20 bp, Artificial Sequence
  sgRNA
  Htr1b_2
atacaccgtagcgattacaa

SEQ ID NO: 26886 - DNA, 20 bp, Artificial Sequence
  sgRNA
  Htr1b_3
ctacacggtctactccacgg

SEQ ID NO: 26887 - DNA, 20 bp, Artificial Sequence
  sgRNA
  Htr1b_4
taaaaggactcccaaaaggg

SEQ ID NO: 26888 - DNA, 20 bp, Artificial Sequence
  sgRNA
  Htr1b_5
gcttgacgccagaagaaggg

SEQ ID NO: 26889 - DNA, 20 bp, Artificial Sequence
  sgRNA
  Htr1b_6
gcgccaacaaagcaaccagc

SEQ ID NO: 26890 - DNA, 20 bp, Artificial Sequence
  sgRNA
  Htr1b_7
gtcctggtaaatgtagccgt

SEQ ID NO: 26891 - DNA, 20 bp, Artificial Sequence
  sgRNA
  Htr1b_8
agtagaccgtgtagaggacg

SEQ ID NO: 26892 - DNA, 20 bp, Artificial Sequence
  sgRNA
  Htr1b_9
agcagaatactccaccgcat

SEQ ID NO: 26893 - DNA, 20 bp, Artificial Sequence
  sgRNA
  Htr1b_10
ccgtggagtagaccgtgtag

SEQ ID NO: 26894 - DNA, 20 bp, Artificial Sequence
  sgRNA
  Htr1b_11
ctactgggccatcaccgatg

SEQ ID NO: 26895 - DNA, 20 bp, Artificial Sequence
  sgRNA
  Htr1b_12
gcgtccagtgaccgtgtaca

SEQ ID NO: 26896 - DNA, 20 bp, Artificial Sequence
  sgRNA
  Htr1b_13
gcaaccagcaggactttcca

SEQ ID NO: 26897 - DNA, 20 bp, Artificial Sequence
  sgRNA
  Htr1b_14
gcaaagccaccaagacccta

SEQ ID NO: 26898 - DNA, 20 bp, Artificial Sequence
  sgRNA
  Htr1b_15
catcggtgatggcccagtag

SEQ ID NO: 26899 - DNA, 20 bp, Artificial Sequence
  sgRNA
  Htr1b_16
ggcgatcaggtagttagccg

SEQ ID NO: 26900 - DNA, 20 bp, Artificial Sequence
  sgRNA
  Htr1b_17
cttacagataggcatcacca

SEQ ID NO: 26901 - DNA, 20 bp, Artificial Sequence
  sgRNA
  Htr1b_18
taaatagaaagcgcccaccg

SEQ ID NO: 26902 - DNA, 20 bp, Artificial Sequence
  sgRNA
  Htr1b_19
gaccgtgtagaggacgtggt

SEQ ID NO: 26903 - DNA, 20 bp, Artificial Sequence
  sgRNA
  Htr1b_20
ggagttaatggaggtgaccg

SEQ ID NO: 26904 - DNA, 20 bp, Artificial Sequence
  sgRNA
  Htr1f_1
catcatgatcacgatcgtgt

SEQ ID NO: 26905 - DNA, 20 bp, Artificial Sequence
  sgRNA
  Htr1f_2
gatgtagaaagctccaaacg

SEQ ID NO: 26906 - DNA, 20 bp, Artificial Sequence
  sgRNA
  Htr1f_3
accacaagagacaagcgagt

SEQ ID NO: 26907 - DNA, 20 bp, Artificial Sequence
  sgRNA
  Htr1f_4
tcgctgcgatcattgtgact

SEQ ID NO: 26908 - DNA, 20 bp, Artificial Sequence
  sgRNA
  Htr1f_5
agcgagtcggatgataaagg

SEQ ID NO: 26909 - DNA, 20 bp, Artificial Sequence
  sgRNA
  Htr1f_6
caatgatcgcagcgatcacg

SEQ ID NO: 26910 - DNA, 20 bp, Artificial Sequence
  sgRNA
  Htr1f_7
gcatcatgatcacgatcgtg

SEQ ID NO: 26911 - DNA, 20 bp, Artificial Sequence
  sgRNA
  Htr1f_8
ttaaagatggtataaatcag

SEQ ID NO: 26912 - DNA, 20 bp, Artificial Sequence
  sgRNA
  Htr1f_9
ggatcaatatcaatacaagc

SEQ ID NO: 26913 - DNA, 20 bp, Artificial Sequence
  sgRNA
  Htr1f_10
cagatgcagttgaatacgcc

SEQ ID NO: 26914 - DNA, 20 bp, Artificial Sequence
  sgRNA
  Htr1f_11
tgccagcccagacagagtga

SEQ ID NO: 26915 - DNA, 20 bp, Artificial Sequence
  sgRNA
  Htr1f_12
gcatctgtcggctatagcct

SEQ ID NO: 26916 - DNA, 20 bp, Artificial Sequence
  sgRNA
  Htr1f_13
gatggcgcggtacctatcca

SEQ ID NO: 26917 - DNA, 20 bp, Artificial Sequence
  sgRNA
  Htr1f_14
tatagccgacagatgcaaga

SEQ ID NO: 26918 - DNA, 20 bp, Artificial Sequence
  sgRNA
  Htr1f_15
tgtcggctatagccttggat

SEQ ID NO: 26919 - DNA, 20 bp, Artificial Sequence
  sgRNA
  Htr1f_16
cacgatcgtgatcatgatgc

SEQ ID NO: 26920 - DNA, 20 bp, Artificial Sequence
  sgRNA
  Htr1f_17
acaatgtacacaatactgaa

SEQ ID NO: 26921 - DNA, 20 bp, Artificial Sequence
  sgRNA
  Htr1f_18
ggtcaagtcttcttggagag

SEQ ID NO: 26922 - DNA, 20 bp, Artificial Sequence
  sgRNA
  Htr1f_19
tgcacccaagatcaatccca

SEQ ID NO: 26923 - DNA, 20 bp, Artificial Sequence
  sgRNA
  Htr1f_20
catcatcacggctagttcct

SEQ ID NO: 26924 - DNA, 20 bp, Artificial Sequence
  sgRNA
  Htr2a_1
gcggtgtggaccatatccgt

SEQ ID NO: 26925 - DNA, 20 bp, Artificial Sequence
  sgRNA
  Htr2a_2
acaccactcaccatacagga

SEQ ID NO: 26926 - DNA, 20 bp, Artificial Sequence
  sgRNA
  Htr2a_3
gctgaggtcactcacacaca

SEQ ID NO: 26927 - DNA, 20 bp, Artificial Sequence
  sgRNA
  Htr2a_4
ggttctggatagccacgtag

SEQ ID NO: 26928 - DNA, 20 bp, Artificial Sequence
  sgRNA
  Htr2a_5
actgctccatggttacacta

SEQ ID NO: 26929 - DNA, 20 bp, Artificial Sequence
  sgRNA
  Htr2a_6
catctccctggaccgctacg

SEQ ID NO: 26930 - DNA, 20 bp, Artificial Sequence
  sgRNA
  Htr2a_7
tgatcaccatgatggttagg

SEQ ID NO: 26931 - DNA, 20 bp, Artificial Sequence
  sgRNA
  Htr2a_8
gaggtgcatgatggacgccg

SEQ ID NO: 26932 - DNA, 20 bp, Artificial Sequence
  sgRNA
  Htr2a_9
gtacattcagtgccagtaca

SEQ ID NO: 26933 - DNA, 20 bp, Artificial Sequence
  sgRNA
  Htr2a_10
tgaacaacgtatataccagt

SEQ ID NO: 26934 - DNA, 20 bp, Artificial Sequence
  sgRNA
  Htr2a_11
cctggatgtgctcttctcca

SEQ ID NO: 26935 - DNA, 20 bp, Artificial Sequence
  sgRNA
  Htr2a_12
gaaccaacctctcctgcgaa

SEQ ID NO: 26936 - DNA, 20 bp, Artificial Sequence
  sgRNA
  Htr2a_13
tgacatcaggaaatagttgg

SEQ ID NO: 26937 - DNA, 20 bp, Artificial Sequence
  sgRNA
  Htr2a_14
catcagaaaagctcttccag

SEQ ID NO: 26938 - DNA, 20 bp, Artificial Sequence
  sgRNA
  Htr2a_15
ctgatgacagagaactctga

SEQ ID NO: 26939 - DNA, 20 bp, Artificial Sequence
  sgRNA
  Htr2a_16
ccctaatgacttcaactcca

SEQ ID NO: 26940 - DNA, 20 bp, Artificial Sequence
  sgRNA
  Htr2a_17
tgatggactgcatcgtcctt

SEQ ID NO: 26941 - DNA, 20 bp, Artificial Sequence
  sgRNA
  Htr2a_18
gacagctaatgactgctcca

SEQ ID NO: 26942 - DNA, 20 bp, Artificial Sequence
  sgRNA
  Htr2a_19
gaatggagaggcatgtcggt

SEQ ID NO: 26943 - DNA, 20 bp, Artificial Sequence
  sgRNA
  Htr2a_20
cttataggtccgccttctca

SEQ ID NO: 26944 - DNA, 20 bp, Artificial Sequence
  sgRNA
  Htr2b_1
ggataggctacgtttcctcg

SEQ ID NO: 26945 - DNA, 20 bp, Artificial Sequence
  sgRNA
  Htr2b_2
gcgatagcagatttgctggt

SEQ ID NO: 26946 - DNA, 20 bp, Artificial Sequence
  sgRNA
  Htr2b_3
aggatgttcccaccaatggt

SEQ ID NO: 26947 - DNA, 20 bp, Artificial Sequence
  sgRNA
  Htr2b_4
gatcagaggattcacccccg

SEQ ID NO: 26948 - DNA, 20 bp, Artificial Sequence
  sgRNA
  Htr2b_5
cagcaaatctgctatcgcca

SEQ ID NO: 26949 - DNA, 20 bp, Artificial Sequence
  sgRNA
  Htr2b_6
ggaatgcctctatttccata

SEQ ID NO: 26950 - DNA, 20 bp, Artificial Sequence
  sgRNA
  Htr2b_7
tgataatacccaccattggt

SEQ ID NO: 26951 - DNA, 20 bp, Artificial Sequence
  sgRNA
  Htr2b_8
tcttgatgaatgcagtagcc

SEQ ID NO: 26952 - DNA, 20 bp, Artificial Sequence
  sgRNA
  Htr2b_9
gtgcaacagccagaatcaca

SEQ ID NO: 26953 - DNA, 20 bp, Artificial Sequence
  sgRNA
  Htr2b_10
agccacctcaacgcctaaca

SEQ ID NO: 26954 - DNA, 20 bp, Artificial Sequence
  sgRNA
  Htr2b_11
gagaacatcgaggaataacc

SEQ ID NO: 26955 - DNA, 20 bp, Artificial Sequence
  sgRNA
  Htr2b_12
ctttgtggctcggtaattgc

SEQ ID NO: 26956 - DNA, 20 bp, Artificial Sequence
  sgRNA
  Htr2b_13
gataggctacgtttcctcgg

SEQ ID NO: 26957 - DNA, 20 bp, Artificial Sequence
  sgRNA
  Htr2b_14
agtctgtctctaatccagaa

SEQ ID NO: 26958 - DNA, 20 bp, Artificial Sequence
  sgRNA
  Htr2b_15
acccttctcactgaaaacga

SEQ ID NO: 26959 - DNA, 20 bp, Artificial Sequence
  sgRNA
  Htr2b_16
gtgactaccatgatggtgag

SEQ ID NO: 26960 - DNA, 20 bp, Artificial Sequence
  sgRNA
  Htr2b_17
ttagatttgtaataaaaaag

SEQ ID NO: 26961 - DNA, 20 bp, Artificial Sequence
  sgRNA
  Htr2b_18
gcggtgataatacccaccat

SEQ ID NO: 26962 - DNA, 20 bp, Artificial Sequence
  sgRNA
  Htr2b_19
agagacagactcagtagcag

SEQ ID NO: 26963 - DNA, 20 bp, Artificial Sequence
  sgRNA
  Htr2b_20
ggctctctgctcattagaaa

SEQ ID NO: 26964 - DNA, 20 bp, Artificial Sequence
  sgRNA
  Htr2c_1
tattgatattgcccaaacga

SEQ ID NO: 26965 - DNA, 20 bp, Artificial Sequence
  sgRNA
  Htr2c_2
acatcagggtttgacggcgt

SEQ ID NO: 26966 - DNA, 20 bp, Artificial Sequence
  sgRNA
  Htr2c_3
aaacaagcgtccaccatcgg

SEQ ID NO: 26967 - DNA, 20 bp, Artificial Sequence
  sgRNA
  Htr2c_4
aagaaagaaaagcggcctag

SEQ ID NO: 26968 - DNA, 20 bp, Artificial Sequence
  sgRNA
  Htr2c_5
gttacttcgaggtcacaccg

SEQ ID NO: 26969 - DNA, 20 bp, Artificial Sequence
  sgRNA
  Htr2c_6
gtaatcctattgagcatagc

SEQ ID NO: 26970 - DNA, 20 bp, Artificial Sequence
  sgRNA
  Htr2c_7
gattacgtattgctacatac

SEQ ID NO: 26971 - DNA, 20 bp, Artificial Sequence
  sgRNA
  Htr2c_8
ctaggaatctgtcgaacagg

SEQ ID NO: 26972 - DNA, 20 bp, Artificial Sequence
  sgRNA
  Htr2c_9
cttgtttcaattcccggacg

SEQ ID NO: 26973 - DNA, 20 bp, Artificial Sequence
  sgRNA
  Htr2c_10
cttcaacaaaatttaccgaa

SEQ ID NO: 26974 - DNA, 20 bp, Artificial Sequence
  sgRNA
  Htr2c_11
gccattgctgatatgctggt

SEQ ID NO: 26975 - DNA, 20 bp, Artificial Sequence
  sgRNA
  Htr2c_12
ggtccagcgatatggcgcag

SEQ ID NO: 26976 - DNA, 20 bp, Artificial Sequence
  sgRNA
  Htr2c_13
tcctgttcgacagattccta

SEQ ID NO: 26977 - DNA, 20 bp, Artificial Sequence
  sgRNA
  Htr2c_14
accacattagagggattgac

SEQ ID NO: 26978 - DNA, 20 bp, Artificial Sequence
  sgRNA
  Htr2c_15
ccttcccacaaagcaccgac

SEQ ID NO: 26979 - DNA, 20 bp, Artificial Sequence
  sgRNA
  Htr2c_16
ctctcgctgaccacattaga

SEQ ID NO: 26980 - DNA, 20 bp, Artificial Sequence
  sgRNA
  Htr2c_17
gttcgggtcattgagcacgc

SEQ ID NO: 26981 - DNA, 20 bp, Artificial Sequence
  sgRNA
  Htr2c_18
gatattacgcagttcctcct

SEQ ID NO: 26982 - DNA, 20 bp, Artificial Sequence
  sgRNA
  Htr2c_19
catctagtgaaatccagacg

SEQ ID NO: 26983 - DNA, 20 bp, Artificial Sequence
  sgRNA
  Htr2c_20
tgatcaccataattgtcaac

SEQ ID NO: 26984 - DNA, 20 bp, Artificial Sequence
  sgRNA
  Htr3a_1
cctggctaactacaagaagg

SEQ ID NO: 26985 - DNA, 20 bp, Artificial Sequence
  sgRNA
  Htr3a_2
ctgccggtaccatatgtagg

SEQ ID NO: 26986 - DNA, 20 bp, Artificial Sequence
  sgRNA
  Htr3a_3
ggactcacaactcattgatg

SEQ ID NO: 26987 - DNA, 20 bp, Artificial Sequence
  sgRNA
  Htr3a_4
aggacatcaacattaccctg

SEQ ID NO: 26988 - DNA, 20 bp, Artificial Sequence
  sgRNA
  Htr3a_5
ccacaatgtccacgaccatg

SEQ ID NO: 26989 - DNA, 20 bp, Artificial Sequence
  sgRNA
  Htr3a_6
cgtagaataaaggcctccgg

SEQ ID NO: 26990 - DNA, 20 bp, Artificial Sequence
  sgRNA
  Htr3a_7
gctcgcttacagcatcaccc

SEQ ID NO: 26991 - DNA, 20 bp, Artificial Sequence
  sgRNA
  Htr3a_8
actctctcaccgctgtccgg

SEQ ID NO: 26992 - DNA, 20 bp, Artificial Sequence
  sgRNA
  Htr3a_9
caggcggtcaccaattgcaa

SEQ ID NO: 26993 - DNA, 20 bp, Artificial Sequence
  sgRNA
  Htr3a_10
tatgtgtacgtgcatcatcg

SEQ ID NO: 26994 - DNA, 20 bp, Artificial Sequence
  sgRNA
  Htr3a_11
aatggaccagagagtgacca

SEQ ID NO: 26995 - DNA, 20 bp, Artificial Sequence
  sgRNA
  Htr3a_12
tgaccacctacatatggtac

SEQ ID NO: 26996 - DNA, 20 bp, Artificial Sequence
  sgRNA
  Htr3a_13
catgtatgccatcctcaacg

SEQ ID NO: 26997 - DNA, 20 bp, Artificial Sequence
  sgRNA
  Htr3a_14
tgcataagcaggacctacag

SEQ ID NO: 26998 - DNA, 20 bp, Artificial Sequence
  sgRNA
  Htr3a_15
gtagatgtcaaggctacagg

SEQ ID NO: 26999 - DNA, 20 bp, Artificial Sequence
  sgRNA
  Htr3a_16
gactctctcaccgctgtccg

SEQ ID NO: 27000 - DNA, 20 bp, Artificial Sequence
  sgRNA
  Htr3a_17
acatcaatggagacagtagt

SEQ ID NO: 27001 - DNA, 20 bp, Artificial Sequence
  sgRNA
  Htr3a_18
gctgcgggtgggatacgtgc

SEQ ID NO: 27002 - DNA, 20 bp, Artificial Sequence
  sgRNA
  Htr3a_19
cctcctggctaactacaaga

SEQ ID NO: 27003 - DNA, 20 bp, Artificial Sequence
  sgRNA
  Htr3a_20
acaaggccaacagcacctgc

SEQ ID NO: 27004 - DNA, 20 bp, Artificial Sequence
  sgRNA
  Htr3b_1
tatcaagaggctcacaacgt

SEQ ID NO: 27005 - DNA, 20 bp, Artificial Sequence
  sgRNA
  Htr3b_2
gcagaatgctattaaaggtg

SEQ ID NO: 27006 - DNA, 20 bp, Artificial Sequence
  sgRNA
  Htr3b_3
ttaccacatccaatacagca

SEQ ID NO: 27007 - DNA, 20 bp, Artificial Sequence
  sgRNA
  Htr3b_4
cttacaacagtaccacaagg

SEQ ID NO: 27008 - DNA, 20 bp, Artificial Sequence
  sgRNA
  Htr3b_5
cgtcagcacgtggagccccg

SEQ ID NO: 27009 - DNA, 20 bp, Artificial Sequence
  sgRNA
  Htr3b_6
gacaagcgtgtggtaccgag

SEQ ID NO: 27010 - DNA, 20 bp, Artificial Sequence
  sgRNA
  Htr3b_7
ccgatgctcctgatggaccg

SEQ ID NO: 27011 - DNA, 20 bp, Artificial Sequence
  sgRNA
  Htr3b_8
gctgaggtgtcgctgtacct

SEQ ID NO: 27012 - DNA, 20 bp, Artificial Sequence
  sgRNA
  Htr3b_9
aatccttcagagtatctgat

SEQ ID NO: 27013 - DNA, 20 bp, Artificial Sequence
  sgRNA
  Htr3b_10
tcaaggcgactctgatgccg

SEQ ID NO: 27014 - DNA, 20 bp, Artificial Sequence
  sgRNA
  Htr3b_11
tcttgaacacaattcttgca

SEQ ID NO: 27015 - DNA, 20 bp, Artificial Sequence
  sgRNA
  Htr3b_12
gtacagcgacacctcagcct

SEQ ID NO: 27016 - DNA, 20 bp, Artificial Sequence
  sgRNA
  Htr3b_13
tgcagttctggatatcaaag

SEQ ID NO: 27017 - DNA, 20 bp, Artificial Sequence
  sgRNA
  Htr3b_14
atatgtctgcaaactgcatg

SEQ ID NO: 27018 - DNA, 20 bp, Artificial Sequence
  sgRNA
  Htr3b_15
ggaagatgctaggtatcaag

SEQ ID NO: 27019 - DNA, 20 bp, Artificial Sequence
  sgRNA
  Htr3b_16
ggtgggctatacggtcttca

SEQ ID NO: 27020 - DNA, 20 bp, Artificial Sequence
  sgRNA
  Htr3b_17
gcagggtgcacacctctgat

SEQ ID NO: 27021 - DNA, 20 bp, Artificial Sequence
  sgRNA
  Htr3b_18
gcaaaggtccaggtagacag

SEQ ID NO: 27022 - DNA, 20 bp, Artificial Sequence
  sgRNA
  Htr3b_19
agtgatccgcagatgtccat

SEQ ID NO: 27023 - DNA, 20 bp, Artificial Sequence
  sgRNA
  Htr3b_20
attcttgcacggcagttggg

SEQ ID NO: 27024 - DNA, 20 bp, Artificial Sequence
  sgRNA
  Htr4_1
gccacaactctaactccacg

SEQ ID NO: 27025 - DNA, 20 bp, Artificial Sequence
  sgRNA
  Htr4_2
cattaatgcgatgcgtagag

SEQ ID NO: 27026 - DNA, 20 bp, Artificial Sequence
  sgRNA
  Htr4_3
agcacagcacacatcgcatg

SEQ ID NO: 27027 - DNA, 20 bp, Artificial Sequence
  sgRNA
  Htr4_4
caggtgaaagatcgatgctg

SEQ ID NO: 27028 - DNA, 20 bp, Artificial Sequence
  sgRNA
  Htr4_5
cgcatcgcattaatgttggg

SEQ ID NO: 27029 - DNA, 20 bp, Artificial Sequence
  sgRNA
  Htr4_6
tcaccagcaccgaaaccagc

SEQ ID NO: 27030 - DNA, 20 bp, Artificial Sequence
  sgRNA
  Htr4_7
ggcttggctatatcaattcg

SEQ ID NO: 27031 - DNA, 20 bp, Artificial Sequence
  sgRNA
  Htr4_8
gaccatgaagacacaccacg

SEQ ID NO: 27032 - DNA, 20 bp, Artificial Sequence
  sgRNA
  Htr4_9
acacagccaccatcaccagc

SEQ ID NO: 27033 - DNA, 20 bp, Artificial Sequence
  sgRNA
  Htr4_10
gcagatacagatgttacaac

SEQ ID NO: 27034 - DNA, 20 bp, Artificial Sequence
  sgRNA
  Htr4_11
accagctcaatggcaccaaa

SEQ ID NO: 27035 - DNA, 20 bp, Artificial Sequence
  sgRNA
  Htr4_12
ctacgcatcgcattaatgtt

SEQ ID NO: 27036 - DNA, 20 bp, Artificial Sequence
  sgRNA
  Htr4_13
ggtaagtaggacatccagag

SEQ ID NO: 27037 - DNA, 20 bp, Artificial Sequence
  sgRNA
  Htr4_14
atgcaaggctggaacaacat

SEQ ID NO: 27038 - DNA, 20 bp, Artificial Sequence
  sgRNA
  Htr4_15
ggtgacaccgactctcccac

SEQ ID NO: 27039 - DNA, 20 bp, Artificial Sequence
  sgRNA
  Htr4_16
gatgtcttggaccagctcaa

SEQ ID NO: 27040 - DNA, 20 bp, Artificial Sequence
  sgRNA
  Htr4_17
gagcagcacgaccttctcca

SEQ ID NO: 27041 - DNA, 20 bp, Artificial Sequence
  sgRNA
  Htr4_18
ggtggatccattaatggttg

SEQ ID NO: 27042 - DNA, 20 bp, Artificial Sequence
  sgRNA
  Htr4_19
atacagatgttacaacgggc

SEQ ID NO: 27043 - DNA, 20 bp, Artificial Sequence
  sgRNA
  Htr4_20
ccatcaggataaccactgca

SEQ ID NO: 27044 - DNA, 20 bp, Artificial Sequence
  sgRNA
  Htr5a_1
agggcggcgaaattccgcat

SEQ ID NO: 27045 - DNA, 20 bp, Artificial Sequence
  sgRNA
  Htr5a_2
tctccccagccaaatagcag

SEQ ID NO: 27046 - DNA, 20 bp, Artificial Sequence
  sgRNA
  Htr5a_3
ccaggttgtgtggtactcgg

SEQ ID NO: 27047 - DNA, 20 bp, Artificial Sequence
  sgRNA
  Htr5a_4
ggacttccgtgtccaagctg

SEQ ID NO: 27048 - DNA, 20 bp, Artificial Sequence
  sgRNA
  Htr5a_5
cagggcggcgaaattccgca

SEQ ID NO: 27049 - DNA, 20 bp, Artificial Sequence
  sgRNA
  Htr5a_6
ctacaccgtgttctccaccg

SEQ ID NO: 27050 - DNA, 20 bp, Artificial Sequence
  sgRNA
  Htr5a_7
ggtgagcaggatcatcacat

SEQ ID NO: 27051 - DNA, 20 bp, Artificial Sequence
  sgRNA
  Htr5a_8
ggcgcgtgattgaccagtag

SEQ ID NO: 27052 - DNA, 20 bp, Artificial Sequence
  sgRNA
  Htr5a_9
cggcaggtagaaggcaccca

SEQ ID NO: 27053 - DNA, 20 bp, Artificial Sequence
  sgRNA
  Htr5a_10
ggatggtagccagcaccagc

SEQ ID NO: 27054 - DNA, 20 bp, Artificial Sequence
  sgRNA
  Htr5a_11
tccacagctggcatagacgc

SEQ ID NO: 27055 - DNA, 20 bp, Artificial Sequence
  sgRNA
  Htr5a_12
gctgcggttaggttccaaag

SEQ ID NO: 27056 - DNA, 20 bp, Artificial Sequence
  sgRNA
  Htr5a_13
ttctgtctggaaggtgacgg

SEQ ID NO: 27057 - DNA, 20 bp, Artificial Sequence
  sgRNA
  Htr5a_14
ccgtcaccttccagacagaa

SEQ ID NO: 27058 - DNA, 20 bp, Artificial Sequence
  sgRNA
  Htr5a_15
cacggtggagaacacggtgt

SEQ ID NO: 27059 - DNA, 20 bp, Artificial Sequence
  sgRNA
  Htr5a_16
cggttaggttccaaagagga

SEQ ID NO: 27060 - DNA, 20 bp, Artificial Sequence
  sgRNA
  Htr5a_17
acaaagagcaccacgcacag

SEQ ID NO: 27061 - DNA, 20 bp, Artificial Sequence
  sgRNA
  Htr5a_18
tgctacacaacatccccaga

SEQ ID NO: 27062 - DNA, 20 bp, Artificial Sequence
  sgRNA
  Htr5a_19
gctccactgctatttggctg

SEQ ID NO: 27063 - DNA, 20 bp, Artificial Sequence
  sgRNA
  Htr5a_20
acctaaccgcagcttggaca

SEQ ID NO: 27064 - DNA, 20 bp, Artificial Sequence
  sgRNA
  Htr6_1
aggtgacgccggacgccacg

SEQ ID NO: 27065 - DNA, 20 bp, Artificial Sequence
  sgRNA
  Htr6_2
gttagacgtgttgcgcagcg

SEQ ID NO: 27066 - DNA, 20 bp, Artificial Sequence
  sgRNA
  Htr6_3
gcagcacatcacgtcgaagg

SEQ ID NO: 27067 - DNA, 20 bp, Artificial Sequence
  sgRNA
  Htr6_4
gaccaccaagcatagcagga

SEQ ID NO: 27068 - DNA, 20 bp, Artificial Sequence
  sgRNA
  Htr6_5
gctatgctggccacaaagaa

SEQ ID NO: 27069 - DNA, 20 bp, Artificial Sequence
  sgRNA
  Htr6_6
gccgtgtgtccactgtcccc

SEQ ID NO: 27070 - DNA, 20 bp, Artificial Sequence
  sgRNA
  Htr6_7
acacggcacgaacctgccca

SEQ ID NO: 27071 - DNA, 20 bp, Artificial Sequence
  sgRNA
  Htr6_8
gctcaccacgggcacggcta

SEQ ID NO: 27072 - DNA, 20 bp, Artificial Sequence
  sgRNA
  Htr6_9
cttcatgcgggacttcaaga

SEQ ID NO: 27073 - DNA, 20 bp, Artificial Sequence
  sgRNA
  Htr6_10
acgccacgaggacataaggc

SEQ ID NO: 27074 - DNA, 20 bp, Artificial Sequence
  sgRNA
  Htr6_11
ttagacgtgttgcgcagcgc

SEQ ID NO: 27075 - DNA, 20 bp, Artificial Sequence
  sgRNA
  Htr6_12
gcttgtagcgcagcggcgag

SEQ ID NO: 27076 - DNA, 20 bp, Artificial Sequence
  sgRNA
  Htr6_13
gtgaagcagatggcacccga

SEQ ID NO: 27077 - DNA, 20 bp, Artificial Sequence
  sgRNA
  Htr6_14
atgcgcagcttgtagcgcag

SEQ ID NO: 27078 - DNA, 20 bp, Artificial Sequence
  sgRNA
  Htr6_15
catgctcagcaggatgccga

SEQ ID NO: 27079 - DNA, 20 bp, Artificial Sequence
  sgRNA
  Htr6_16
ttcacgtcggacctgatggt

SEQ ID NO: 27080 - DNA, 20 bp, Artificial Sequence
  sgRNA
  Htr6_17
tgcccaggacaccacgccca

SEQ ID NO: 27081 - DNA, 20 bp, Artificial Sequence
  sgRNA
  Htr6_18
gatgaggcagaggttgagaa

SEQ ID NO: 27082 - DNA, 20 bp, Artificial Sequence
  sgRNA
  Htr6_19
gcagactccatccctgggcg

SEQ ID NO: 27083 - DNA, 20 bp, Artificial Sequence
  sgRNA
  Htr6_20
gcaagtggcctcgctcacca

SEQ ID NO: 27084 - DNA, 20 bp, Artificial Sequence
  sgRNA
  Htr7_1
ggggatataaaacgccactg

SEQ ID NO: 27085 - DNA, 20 bp, Artificial Sequence
  sgRNA
  Htr7_2
aggtccgtgacactaacgaa

SEQ ID NO: 27086 - DNA, 20 bp, Artificial Sequence
  sgRNA
  Htr7_3
cacgcacagggtcatgatcg

SEQ ID NO: 27087 - DNA, 20 bp, Artificial Sequence
  sgRNA
  Htr7_4
caggacctgagccccgacgg

SEQ ID NO: 27088 - DNA, 20 bp, Artificial Sequence
  sgRNA
  Htr7_5
gcagccggagacattgtccg

SEQ ID NO: 27089 - DNA, 20 bp, Artificial Sequence
  sgRNA
  Htr7_6
gccagtaccggaatatcaac

SEQ ID NO: 27090 - DNA, 20 bp, Artificial Sequence
  sgRNA
  Htr7_7
tgaccgccacggccaccgag

SEQ ID NO: 27091 - DNA, 20 bp, Artificial Sequence
  sgRNA
  Htr7_8
gtattcactccgttacccca

SEQ ID NO: 27092 - DNA, 20 bp, Artificial Sequence
  sgRNA
  Htr7_9
gcactggagtaggctacgat

SEQ ID NO: 27093 - DNA, 20 bp, Artificial Sequence
  sgRNA
  Htr7_10
ggacaatgtctccggctgcg

SEQ ID NO: 27094 - DNA, 20 bp, Artificial Sequence
  sgRNA
  Htr7_11
tgtgcgtgatcagcatcgac

SEQ ID NO: 27095 - DNA, 20 bp, Artificial Sequence
  sgRNA
  Htr7_12
tctccgctctctcatcctgc

SEQ ID NO: 27096 - DNA, 20 bp, Artificial Sequence
  sgRNA
  Htr7_13
gatggccgtagaggtcgggg

SEQ ID NO: 27097 - DNA, 20 bp, Artificial Sequence
  sgRNA
  Htr7_14
cgagactgctcaaacacgaa

SEQ ID NO: 27098 - DNA, 20 bp, Artificial Sequence
  sgRNA
  Htr7_15
tccaggagctcaccaccgag

SEQ ID NO: 27099 - DNA, 20 bp, Artificial Sequence
  sgRNA
  Htr7_16
tggcgtggtgaaactccaga

SEQ ID NO: 27100 - DNA, 20 bp, Artificial Sequence
  sgRNA
  Htr7_17
agcacaccgagatcaccacc

SEQ ID NO: 27101 - DNA, 20 bp, Artificial Sequence
  sgRNA
  Htr7_18
tgtcgatgctgatcacgcac

SEQ ID NO: 27102 - DNA, 20 bp, Artificial Sequence
  sgRNA
  Htr7_19
agtgtcacggacctcatcgg

SEQ ID NO: 27103 - DNA, 20 bp, Artificial Sequence
  sgRNA
  Htr7_20
gatataaaacgccactgcgg

SEQ ID NO: 27104 - DNA, 20 bp, Artificial Sequence
  sgRNA
  Hyal2_1
aaagttgcggctgtgtacgg

SEQ ID NO: 27105 - DNA, 20 bp, Artificial Sequence
  sgRNA
  Hyal2_2
gaacactctccgttacgtca

SEQ ID NO: 27106 - DNA, 20 bp, Artificial Sequence
  sgRNA
  Hyal2_3
gggacgcgtgaagacgtaca

SEQ ID NO: 27107 - DNA, 20 bp, Artificial Sequence
  sgRNA
  Hyal2_4
accttctactacgaccgtct

SEQ ID NO: 27108 - DNA, 20 bp, Artificial Sequence
  sgRNA
  Hyal2_5
ggtccaactgcaatactggg

SEQ ID NO: 27109 - DNA, 20 bp, Artificial Sequence
  sgRNA
  Hyal2_6
acgagtttgagttcgccgct

SEQ ID NO: 27110 - DNA, 20 bp, Artificial Sequence
  sgRNA
  Hyal2_7
gacgcgtgaagacgtacacg

SEQ ID NO: 27111 - DNA, 20 bp, Artificial Sequence
  sgRNA
  Hyal2_8
gttcaacatgaactgccgag

SEQ ID NO: 27112 - DNA, 20 bp, Artificial Sequence
  sgRNA
  Hyal2_9
tgttcgggaggcccttcgag

SEQ ID NO: 27113 - DNA, 20 bp, Artificial Sequence
  sgRNA
  Hyal2_10
ccgataacacaagcatgcag

SEQ ID NO: 27114 - DNA, 20 bp, Artificial Sequence
  sgRNA
  Hyal2_11
tagacggtcgtagtagaagg

SEQ ID NO: 27115 - DNA, 20 bp, Artificial Sequence
  sgRNA
  Hyal2_12
gtctcgtccaggtacacaga

SEQ ID NO: 27116 - DNA, 20 bp, Artificial Sequence
  sgRNA
  Hyal2_13
tgtctcgtccaggtacacag

SEQ ID NO: 27117 - DNA, 20 bp, Artificial Sequence
  sgRNA
  Hyal2_14
acgcgtcccacatacacccg

SEQ ID NO: 27118 - DNA, 20 bp, Artificial Sequence
  sgRNA
  Hyal2_15
ggaacgctacatccagaccc

SEQ ID NO: 27119 - DNA, 20 bp, Artificial Sequence
  sgRNA
  Hyal2_16
cgtgaagacgtacacgggga

SEQ ID NO: 27120 - DNA, 20 bp, Artificial Sequence
  sgRNA
  Hyal2_17
ccagctggcgtgaagactgt

SEQ ID NO: 27121 - DNA, 20 bp, Artificial Sequence
  sgRNA
  Hyal2_18
gggtatggccaggcactagg

SEQ ID NO: 27122 - DNA, 20 bp, Artificial Sequence
  sgRNA
  Hyal2_19
ggtggcacggaacgaccagc

SEQ ID NO: 27123 - DNA, 20 bp, Artificial Sequence
  sgRNA
  Hyal2_20
ccgacagtcttcacgccagc

SEQ ID NO: 27124 - DNA, 20 bp, Artificial Sequence
  sgRNA
  Hyal5_1
tacatgccaatagacaatgt

SEQ ID NO: 27125 - DNA, 20 bp, Artificial Sequence
  sgRNA
  Hyal5_2
tgtgaaacaagactcagttg

SEQ ID NO: 27126 - DNA, 20 bp, Artificial Sequence
  sgRNA
  Hyal5_3
cttcggccaaatcacttatg

SEQ ID NO: 27127 - DNA, 20 bp, Artificial Sequence
  sgRNA
  Hyal5_4
tttgactttagacactcgaa

SEQ ID NO: 27128 - DNA, 20 bp, Artificial Sequence
  sgRNA
  Hyal5_5
tctctcctgacagttcaggt

SEQ ID NO: 27129 - DNA, 20 bp, Artificial Sequence
  sgRNA
  Hyal5_6
ggcacatcagggataagtgg

SEQ ID NO: 27130 - DNA, 20 bp, Artificial Sequence
  sgRNA
  Hyal5_7
gattccgtgctacttgactg

SEQ ID NO: 27131 - DNA, 20 bp, Artificial Sequence
  sgRNA
  Hyal5_8
tccccacattaccattccag

SEQ ID NO: 27132 - DNA, 20 bp, Artificial Sequence
  sgRNA
  Hyal5_9
gagaacagaccaagatctag

SEQ ID NO: 27133 - DNA, 20 bp, Artificial Sequence
  sgRNA
  Hyal5_10
gattgctattaacaaagtaa

SEQ ID NO: 27134 - DNA, 20 bp, Artificial Sequence
  sgRNA
  Hyal5_11
gggtttccaatttcttgccc

SEQ ID NO: 27135 - DNA, 20 bp, Artificial Sequence
  sgRNA
  Hyal5_12
ttattcctataaatatcctt

SEQ ID NO: 27136 - DNA, 20 bp, Artificial Sequence
  sgRNA
  Hyal5_13
tctcaagggtgggattgcca

SEQ ID NO: 27137 - DNA, 20 bp, Artificial Sequence
  sgRNA
  Hyal5_14
catggaaagtatgaaatccg

SEQ ID NO: 27138 - DNA, 20 bp, Artificial Sequence
  sgRNA
  Hyal5_15
ggtgggcaaaacagctgcaa

SEQ ID NO: 27139 - DNA, 20 bp, Artificial Sequence
  sgRNA
  Hyal5_16
tggcacacatggactcactg

SEQ ID NO: 27140 - DNA, 20 bp, Artificial Sequence
  sgRNA
  Hyal5_17
gccaggcccacattgtctat

SEQ ID NO: 27141 - DNA, 20 bp, Artificial Sequence
  sgRNA
  Hyal5_18
aatgaatctgaaagttctga

SEQ ID NO: 27142 - DNA, 20 bp, Artificial Sequence
  sgRNA
  Hyal5_19
tcaagtagcacggaatcaga

SEQ ID NO: 27143 - DNA, 20 bp, Artificial Sequence
  sgRNA
  Hyal5_20
ggaaacccaaggatatttat

SEQ ID NO: 27144 - DNA, 20 bp, Artificial Sequence
  sgRNA
  Icam1_1
gtgaagtgtgaagcccacag

SEQ ID NO: 27145 - DNA, 20 bp, Artificial Sequence
  sgRNA
  Icam1_2
gccctgccactcacaataca

SEQ ID NO: 27146 - DNA, 20 bp, Artificial Sequence
  sgRNA
  Icam1_3
gagaacaatgccagcccttg

SEQ ID NO: 27147 - DNA, 20 bp, Artificial Sequence
  sgRNA
  Icam1_4
gcggtgctccaccatccacg

SEQ ID NO: 27148 - DNA, 20 bp, Artificial Sequence
  sgRNA
  Icam1_5
gatggtgccctgctgcccat

SEQ ID NO: 27149 - DNA, 20 bp, Artificial Sequence
  sgRNA
  Icam1_6
ggaagaacagttcacctgca

SEQ ID NO: 27150 - DNA, 20 bp, Artificial Sequence
  sgRNA
  Icam1_7
agagaagccttcctgcccca

SEQ ID NO: 27151 - DNA, 20 bp, Artificial Sequence
  sgRNA
  Icam1_8
agctccaaaacgcagcgcag

SEQ ID NO: 27152 - DNA, 20 bp, Artificial Sequence
  sgRNA
  Icam1_9
gctgaggtcctccttgcatg

SEQ ID NO: 27153 - DNA, 20 bp, Artificial Sequence
  sgRNA
  Icam1_10
gaggaggccataaaactcaa

SEQ ID NO: 27154 - DNA, 20 bp, Artificial Sequence
  sgRNA
  Icam1_11
gctgggtgcccacctccagg

SEQ ID NO: 27155 - DNA, 20 bp, Artificial Sequence
  sgRNA
  Icam1_12
attgttctctaatgtctccg

SEQ ID NO: 27156 - DNA, 20 bp, Artificial Sequence
  sgRNA
  Icam1_13
gtttgagctgagcgagatcg

SEQ ID NO: 27157 - DNA, 20 bp, Artificial Sequence
  sgRNA
  Icam1_14
cagtgtgaattggacctgcg

SEQ ID NO: 27158 - DNA, 20 bp, Artificial Sequence
  sgRNA
  Icam1_15
gctcccatgggaatgtcacc

SEQ ID NO: 27159 - DNA, 20 bp, Artificial Sequence
  sgRNA
  Icam1_16
gccaggagcagaggtagcgt

SEQ ID NO: 27160 - DNA, 20 bp, Artificial Sequence
  sgRNA
  Icam1_17
agtcacctctaccaaggcag

SEQ ID NO: 27161 - DNA, 20 bp, Artificial Sequence
  sgRNA
  Icam1_18
cgacacccctgacctcctgg

SEQ ID NO: 27162 - DNA, 20 bp, Artificial Sequence
  sgRNA
  Icam1_19
cctcaccctgcgctgccacg

SEQ ID NO: 27163 - DNA, 20 bp, Artificial Sequence
  sgRNA
  Icam1_20
ggtctcagctccacactctc

SEQ ID NO: 27164 - DNA, 20 bp, Artificial Sequence
  sgRNA
  Icam2_1
tcttcacccacaaacacccg

SEQ ID NO: 27165 - DNA, 20 bp, Artificial Sequence
  sgRNA
  Icam2_2
ggaccatatgtagacctcaa

SEQ ID NO: 27166 - DNA, 20 bp, Artificial Sequence
  sgRNA
  Icam2_3
aactgcgcagccccagacat

SEQ ID NO: 27167 - DNA, 20 bp, Artificial Sequence
  sgRNA
  Icam2_4
atgttggaagagcatcctca

SEQ ID NO: 27168 - DNA, 20 bp, Artificial Sequence
  sgRNA
  Icam2_5
gccgatgcaggacaaccaaa

SEQ ID NO: 27169 - DNA, 20 bp, Artificial Sequence
  sgRNA
  Icam2_6
cggatgatatacccaccatg

SEQ ID NO: 27170 - DNA, 20 bp, Artificial Sequence
  sgRNA
  Icam2_7
ccaggcagctagcaccccgt

SEQ ID NO: 27171 - DNA, 20 bp, Artificial Sequence
  sgRNA
  Icam2_8
tcatgaacgcatgctcccga

SEQ ID NO: 27172 - DNA, 20 bp, Artificial Sequence
  sgRNA
  Icam2_9
ggacgtgcccgaaaggctcg

SEQ ID NO: 27173 - DNA, 20 bp, Artificial Sequence
  sgRNA
  Icam2_10
tgttggaagagcatcctcaa

SEQ ID NO: 27174 - DNA, 20 bp, Artificial Sequence
  sgRNA
  Icam2_11
tctggtactccgagatgctg

SEQ ID NO: 27175 - DNA, 20 bp, Artificial Sequence
  sgRNA
  Icam2_12
gctttcccgaacacgtgaaa

SEQ ID NO: 27176 - DNA, 20 bp, Artificial Sequence
  sgRNA
  Icam2_13
tagcacttcttggcaacgtg

SEQ ID NO: 27177 - DNA, 20 bp, Artificial Sequence
  sgRNA
  Icam2_14
gagagggtgagcctctcaag

SEQ ID NO: 27178 - DNA, 20 bp, Artificial Sequence
  sgRNA
  Icam2_15
ctattggctgagagggttag

SEQ ID NO: 27179 - DNA, 20 bp, Artificial Sequence
  sgRNA
  Icam2_16
tctaaccctctcagccaata

SEQ ID NO: 27180 - DNA, 20 bp, Artificial Sequence
  sgRNA
  Icam2_17
tctgccacggagcagagaga

SEQ ID NO: 27181 - DNA, 20 bp, Artificial Sequence
  sgRNA
  Icam2_18
ctatggtaaggagaccctat

SEQ ID NO: 27182 - DNA, 20 bp, Artificial Sequence
  sgRNA
  Icam2_19
agcacagctctgaaaaagga

SEQ ID NO: 27183 - DNA, 20 bp, Artificial Sequence
  sgRNA
  Icam2_20
ctcaccctctctctgctccg

SEQ ID NO: 27184 - DNA, 20 bp, Artificial Sequence
  sgRNA
  Icam4_1
gatagttaatggatccggct

SEQ ID NO: 27185 - DNA, 20 bp, Artificial Sequence
  sgRNA
  Icam4_2
ttgcgcaggagaaacccgag

SEQ ID NO: 27186 - DNA, 20 bp, Artificial Sequence
  sgRNA
  Icam4_3
agcatcgcagagtgtacttg

SEQ ID NO: 27187 - DNA, 20 bp, Artificial Sequence
  sgRNA
  Icam4_4
ggctttcatgataaatcact

SEQ ID NO: 27188 - DNA, 20 bp, Artificial Sequence
  sgRNA
  Icam4_5
gattacaggatgcctcaccg

SEQ ID NO: 27189 - DNA, 20 bp, Artificial Sequence
  sgRNA
  Icam4_6
tgtgacacacgtgttcccag

SEQ ID NO: 27190 - DNA, 20 bp, Artificial Sequence
  sgRNA
  Icam4_7
catgcgcgcctcaatctcga

SEQ ID NO: 27191 - DNA, 20 bp, Artificial Sequence
  sgRNA
  Icam4_8
agatagttaatggatccggc

SEQ ID NO: 27192 - DNA, 20 bp, Artificial Sequence
  sgRNA
  Icam4_9
gctagtggtgcgcagcagct

SEQ ID NO: 27193 - DNA, 20 bp, Artificial Sequence
  sgRNA
  Icam4_10
gctggtggctgcctatccga

SEQ ID NO: 27194 - DNA, 20 bp, Artificial Sequence
  sgRNA
  Icam4_11
gtaagcagtgatcctggcgg

SEQ ID NO: 27195 - DNA, 20 bp, Artificial Sequence
  sgRNA
  Icam4_12
gcgtcttaatccagagctag

SEQ ID NO: 27196 - DNA, 20 bp, Artificial Sequence
  sgRNA
  Icam4_13
tagctggtaagatacccagc

SEQ ID NO: 27197 - DNA, 20 bp, Artificial Sequence
  sgRNA
  Icam4_14
gcagccaccagcaaaagcga

SEQ ID NO: 27198 - DNA, 20 bp, Artificial Sequence
  sgRNA
  Icam4_15
cctgttatgttgacagtcct

SEQ ID NO: 27199 - DNA, 20 bp, Artificial Sequence
  sgRNA
  Icam4_16
ggattaagacgcacccagaa

SEQ ID NO: 27200 - DNA, 20 bp, Artificial Sequence
  sgRNA
  Icam4_17
ttgacctacgtgatgcgggc

SEQ ID NO: 27201 - DNA, 20 bp, Artificial Sequence
  sgRNA
  Icam4_18
gttcccagtgggattcttgg

SEQ ID NO: 27202 - DNA, 20 bp, Artificial Sequence
  sgRNA
  Icam4_19
gtgacacacgtgttcccagt

SEQ ID NO: 27203 - DNA, 20 bp, Artificial Sequence
  sgRNA
  Icam4_20
gctgaggtcacggaaggcgc

SEQ ID NO: 27204 - DNA, 20 bp, Artificial Sequence
  sgRNA
  Icam5_1
gtggctcgcctacgaaactg

SEQ ID NO: 27205 - DNA, 20 bp, Artificial Sequence
  sgRNA
  Icam5_2
ggtcccgtttcggcgtagcg

SEQ ID NO: 27206 - DNA, 20 bp, Artificial Sequence
  sgRNA
  Icam5_3
aaaggtacggagctgtctgg

SEQ ID NO: 27207 - DNA, 20 bp, Artificial Sequence
  sgRNA
  Icam5_4
cccttgcagagcgaccggat

SEQ ID NO: 27208 - DNA, 20 bp, Artificial Sequence
  sgRNA
  Icam5_5
gcatcggtaagtgcctgcga

SEQ ID NO: 27209 - DNA, 20 bp, Artificial Sequence
  sgRNA
  Icam5_6
agtgagccagaagcccccga

SEQ ID NO: 27210 - DNA, 20 bp, Artificial Sequence
  sgRNA
  Icam5_7
gggcgagtacaacgtccagg

SEQ ID NO: 27211 - DNA, 20 bp, Artificial Sequence
  sgRNA
  Icam5_8
gagcctacgcactccacacg

SEQ ID NO: 27212 - DNA, 20 bp, Artificial Sequence
  sgRNA
  Icam5_9
gcatggcacggattcacgga

SEQ ID NO: 27213 - DNA, 20 bp, Artificial Sequence
  sgRNA
  Icam5_10
ctggaggccaagcctctgcg

SEQ ID NO: 27214 - DNA, 20 bp, Artificial Sequence
  sgRNA
  Icam5_11
ttccccgtccacatcgaggg

SEQ ID NO: 27215 - DNA, 20 bp, Artificial Sequence
  sgRNA
  Icam5_12
gtcagagtgaagttaccgcc

SEQ ID NO: 27216 - DNA, 20 bp, Artificial Sequence
  sgRNA
  Icam5_13
aaggccggtgacttgcacgt

SEQ ID NO: 27217 - DNA, 20 bp, Artificial Sequence
  sgRNA
  Icam5_14
caaaacagtcgtcgtgagcg

SEQ ID NO: 27218 - DNA, 20 bp, Artificial Sequence
  sgRNA
  Icam5_15
tggcgttgatggcttcgcat

SEQ ID NO: 27219 - DNA, 20 bp, Artificial Sequence
  sgRNA
  Icam5_16
gtgcagcgaccaatgcgcat

SEQ ID NO: 27220 - DNA, 20 bp, Artificial Sequence
  sgRNA
  Icam5_17
ggccgtgtgtctcaatggcg

SEQ ID NO: 27221 - DNA, 20 bp, Artificial Sequence
  sgRNA
  Icam5_18
gaattccagctgcggtcccg

SEQ ID NO: 27222 - DNA, 20 bp, Artificial Sequence
  sgRNA
  Icam5_19
agtttccccgtccacatcga

SEQ ID NO: 27223 - DNA, 20 bp, Artificial Sequence
  sgRNA
  Icam5_20
gcttagctgtgtggcacacg

SEQ ID NO: 27224 - DNA, 20 bp, Artificial Sequence
  sgRNA
  Icos_1
tggtcttggtgagttcgcag

SEQ ID NO: 27225 - DNA, 20 bp, Artificial Sequence
  sgRNA
  Icos_2
tatgcaaatatcctccacta

SEQ ID NO: 27226 - DNA, 20 bp, Artificial Sequence
  sgRNA
  Icos_3
gcagaagtaatagcttccct

SEQ ID NO: 27227 - DNA, 20 bp, Artificial Sequence
  sgRNA
  Icos_4
aaatgaaaacatcctatgat

SEQ ID NO: 27228 - DNA, 20 bp, Artificial Sequence
  sgRNA
  Icos_5
tgaagctctggctacccgta

SEQ ID NO: 27229 - DNA, 20 bp, Artificial Sequence
  sgRNA
  Icos_6
tcaatggctcggccgatcat

SEQ ID NO: 27230 - DNA, 20 bp, Artificial Sequence
  sgRNA
  Icos_7
acgaaagctgcacaccctac

SEQ ID NO: 27231 - DNA, 20 bp, Artificial Sequence
  sgRNA
  Icos_8
tgcgaactcaccaagaccaa

SEQ ID NO: 27232 - DNA, 20 bp, Artificial Sequence
  sgRNA
  Icos_9
acaaagacacggcagaagta

SEQ ID NO: 27233 - DNA, 20 bp, Artificial Sequence
  sgRNA
  Icos_10
tgataagtatgcatccaaaa

SEQ ID NO: 27234 - DNA, 20 bp, Artificial Sequence
  sgRNA
  Icos_11
gaggtgggtcaaaaatggac

SEQ ID NO: 27235 - DNA, 20 bp, Artificial Sequence
  sgRNA
  Icos_12
aacaacccagacagctccca

SEQ ID NO: 27236 - DNA, 20 bp, Artificial Sequence
  sgRNA
  Icos_13
tccccttacggctttgggga

SEQ ID NO: 27237 - DNA, 20 bp, Artificial Sequence
  sgRNA
  Icos_14
tgcaggtacagctcccctta

SEQ ID NO: 27238 - DNA, 20 bp, Artificial Sequence
  sgRNA
  Icos_15
ggaagcagaagacaaagaca

SEQ ID NO: 27239 - DNA, 20 bp, Artificial Sequence
  sgRNA
  Icos_16
tccctccccaaagccgtaag

SEQ ID NO: 27240 - DNA, 20 bp, Artificial Sequence
  sgRNA
  Icos_17
ttccctccccaaagccgtaa

SEQ ID NO: 27241 - DNA, 20 bp, Artificial Sequence
  sgRNA
  Icos_18
ttaactgctggacagtctca

SEQ ID NO: 27242 - DNA, 20 bp, Artificial Sequence
  sgRNA
  Icos_19
tagtgaatacatgttcatgg

SEQ ID NO: 27243 - DNA, 20 bp, Artificial Sequence
  sgRNA
  Icos_20
ggagggaagaacacacttca

SEQ ID NO: 27244 - DNA, 20 bp, Artificial Sequence
  sgRNA
  Icosl_1
ggacaatagcctaatagaca

SEQ ID NO: 27245 - DNA, 20 bp, Artificial Sequence
  sgRNA
  Icosl_2
agagactgaagtcggtgcaa

SEQ ID NO: 27246 - DNA, 20 bp, Artificial Sequence
  sgRNA
  Icosl_3
tggctgtattcataaatacc

SEQ ID NO: 27247 - DNA, 20 bp, Artificial Sequence
  sgRNA
  Icosl_4
tccctggactccatgaagca

SEQ ID NO: 27248 - DNA, 20 bp, Artificial Sequence
  sgRNA
  Icosl_5
gctcccttggacatctcgtg

SEQ ID NO: 27249 - DNA, 20 bp, Artificial Sequence
  sgRNA
  Icosl_6
gttcccaaggacacaaaaca

SEQ ID NO: 27250 - DNA, 20 bp, Artificial Sequence
  sgRNA
  Icosl_7
ccgccagtacagcaaggacg

SEQ ID NO: 27251 - DNA, 20 bp, Artificial Sequence
  sgRNA
  Icosl_8
catccccacgagatgtccaa

SEQ ID NO: 27252 - DNA, 20 bp, Artificial Sequence
  sgRNA
  Icosl_9
ggacagttcctacaagaaca

SEQ ID NO: 27253 - DNA, 20 bp, Artificial Sequence
  sgRNA
  Icosl_10
ccgctgccgccagtacagca

SEQ ID NO: 27254 - DNA, 20 bp, Artificial Sequence
  sgRNA
  Icosl_11
gcctctgcagagactgaagt

SEQ ID NO: 27255 - DNA, 20 bp, Artificial Sequence
  sgRNA
  Icosl_12
gcccgggttggagctatcag

SEQ ID NO: 27256 - DNA, 20 bp, Artificial Sequence
  sgRNA
  Icosl_13
agttgaaatggcgtctgtgg

SEQ ID NO: 27257 - DNA, 20 bp, Artificial Sequence
  sgRNA
  Icosl_14
gaactcctgggtatcctgag

SEQ ID NO: 27258 - DNA, 20 bp, Artificial Sequence
  sgRNA
  Icosl_15
tgaactcctgggtatcctga

SEQ ID NO: 27259 - DNA, 20 bp, Artificial Sequence
  sgRNA
  Icosl_16
aagaagctccatgtttctag

SEQ ID NO: 27260 - DNA, 20 bp, Artificial Sequence
  sgRNA
  Icosl_17
acctgccttacaagtctcca

SEQ ID NO: 27261 - DNA, 20 bp, Artificial Sequence
  sgRNA
  Icosl_18
actgaagtcggtgcaatggt

SEQ ID NO: 27262 - DNA, 20 bp, Artificial Sequence
  sgRNA
  Icosl_19
ctatcagaggtgctgatgac

SEQ ID NO: 27263 - DNA, 20 bp, Artificial Sequence
  sgRNA
  Icosl_20
gacagttcctacaagaacag

SEQ ID NO: 27264 - DNA, 20 bp, Artificial Sequence
  sgRNA
  Ifnar1_1
acagttgacataaacaagca

SEQ ID NO: 27265 - DNA, 20 bp, Artificial Sequence
  sgRNA
  Ifnar1_2
cttctaaacgtacttctggg

SEQ ID NO: 27266 - DNA, 20 bp, Artificial Sequence
  sgRNA
  Ifnar1_3
tctccatgtacaagcctcag

SEQ ID NO: 27267 - DNA, 20 bp, Artificial Sequence
  sgRNA
  Ifnar1_4
gtgcagtgtataagcaccac

SEQ ID NO: 27268 - DNA, 20 bp, Artificial Sequence
  sgRNA
  Ifnar1_5
cactgcccattgactctccg

SEQ ID NO: 27269 - DNA, 20 bp, Artificial Sequence
  sgRNA
  Ifnar1_6
cagcggctgcaggttcttga

SEQ ID NO: 27270 - DNA, 20 bp, Artificial Sequence
  sgRNA
  Ifnar1_7
acagtttcgtgtcagagcag

SEQ ID NO: 27271 - DNA, 20 bp, Artificial Sequence
  sgRNA
  Ifnar1_8
cgtagtctggacatttgcac

SEQ ID NO: 27272 - DNA, 20 bp, Artificial Sequence
  sgRNA
  Ifnar1_9
tggacacagtacacagtcag

SEQ ID NO: 27273 - DNA, 20 bp, Artificial Sequence
  sgRNA
  Ifnar1_10
gggcaactattccaacgaag

SEQ ID NO: 27274 - DNA, 20 bp, Artificial Sequence
  sgRNA
  Ifnar1_11
atgttcccgtcttgtccggg

SEQ ID NO: 27275 - DNA, 20 bp, Artificial Sequence
  sgRNA
  Ifnar1_12
ttgctgtgtttcttaagtga

SEQ ID NO: 27276 - DNA, 20 bp, Artificial Sequence
  sgRNA
  Ifnar1_13
gttgctggtcttattcagca

SEQ ID NO: 27277 - DNA, 20 bp, Artificial Sequence
  sgRNA
  Ifnar1_14
gcggtgacagtaatgaccgg

SEQ ID NO: 27278 - DNA, 20 bp, Artificial Sequence
  sgRNA
  Ifnar1_15
tctccaaagctccctgcggg

SEQ ID NO: 27279 - DNA, 20 bp, Artificial Sequence
  sgRNA
  Ifnar1_16
acgtgctcttcagggcacag

SEQ ID NO: 27280 - DNA, 20 bp, Artificial Sequence
  sgRNA
  Ifnar1_17
gcttgtttatgtcaactgtc

SEQ ID NO: 27281 - DNA, 20 bp, Artificial Sequence
  sgRNA
  Ifnar1_18
tctgacggctgaggagcaca

SEQ ID NO: 27282 - DNA, 20 bp, Artificial Sequence
  sgRNA
  Ifnar1_19
acttggagatttcctggcac

SEQ ID NO: 27283 - DNA, 20 bp, Artificial Sequence
  sgRNA
  Ifnar1_20
tagacgtctatattctcagg

SEQ ID NO: 27284 - DNA, 20 bp, Artificial Sequence
  sgRNA
  Ifnar2_1
caaagacgaaaatctgacga

SEQ ID NO: 27285 - DNA, 20 bp, Artificial Sequence
  sgRNA
  Ifnar2_2
gccatcgtcatagtgcacag

SEQ ID NO: 27286 - DNA, 20 bp, Artificial Sequence
  sgRNA
  Ifnar2_3
taacctggataatccctgaa

SEQ ID NO: 27287 - DNA, 20 bp, Artificial Sequence
  sgRNA
  Ifnar2_4
actgtggaattacgattatg

SEQ ID NO: 27288 - DNA, 20 bp, Artificial Sequence
  sgRNA
  Ifnar2_5
ccaacgatctcaaattctgg

SEQ ID NO: 27289 - DNA, 20 bp, Artificial Sequence
  sgRNA
  Ifnar2_6
gatgatttccagccgatcga

SEQ ID NO: 27290 - DNA, 20 bp, Artificial Sequence
  sgRNA
  Ifnar2_7
acacaagctgaggagaccga

SEQ ID NO: 27291 - DNA, 20 bp, Artificial Sequence
  sgRNA
  Ifnar2_8
tcctagacgaaggtccccag

SEQ ID NO: 27292 - DNA, 20 bp, Artificial Sequence
  sgRNA
  Ifnar2_9
ttatccaggttaaaaagtgg

SEQ ID NO: 27293 - DNA, 20 bp, Artificial Sequence
  sgRNA
  Ifnar2_10
gcacgatgtagtctgagcag

SEQ ID NO: 27294 - DNA, 20 bp, Artificial Sequence
  sgRNA
  Ifnar2_11
tgtccccaccagctatccga

SEQ ID NO: 27295 - DNA, 20 bp, Artificial Sequence
  sgRNA
  Ifnar2_12
gctcgaggactcattcccca

SEQ ID NO: 27296 - DNA, 20 bp, Artificial Sequence
  sgRNA
  Ifnar2_13
cagaactccccacagaggcg

SEQ ID NO: 27297 - DNA, 20 bp, Artificial Sequence
  sgRNA
  Ifnar2_14
caccttcagaagccatcgat

SEQ ID NO: 27298 - DNA, 20 bp, Artificial Sequence
  sgRNA
  Ifnar2_15
ttgaagataatgttgtcccc

SEQ ID NO: 27299 - DNA, 20 bp, Artificial Sequence
  sgRNA
  Ifnar2_16
gtagtctgagcagcggcaca

SEQ ID NO: 27300 - DNA, 20 bp, Artificial Sequence
  sgRNA
  Ifnar2_17
cctgaatcttcttcatgcag

SEQ ID NO: 27301 - DNA, 20 bp, Artificial Sequence
  sgRNA
  Ifnar2_18
gccgtcccccacatcagcat

SEQ ID NO: 27302 - DNA, 20 bp, Artificial Sequence
  sgRNA
  Ifnar2_19
cagaccttcggatagctggt

SEQ ID NO: 27303 - DNA, 20 bp, Artificial Sequence
  sgRNA
  Ifnar2_20
catgtgacgtgacagataag

SEQ ID NO: 27304 - DNA, 20 bp, Artificial Sequence
  sgRNA
  Ifngr1_1
tatgtggagcataaccggag

SEQ ID NO: 27305 - DNA, 20 bp, Artificial Sequence
  sgRNA
  Ifngr1_2
ggtattcccagcatacgaca

SEQ ID NO: 27306 - DNA, 20 bp, Artificial Sequence
  sgRNA
  Ifngr1_3
ttcagggtgaaatacgagga

SEQ ID NO: 27307 - DNA, 20 bp, Artificial Sequence
  sgRNA
  Ifngr1_4
tataccaatacgcaaatacc

SEQ ID NO: 27308 - DNA, 20 bp, Artificial Sequence
  sgRNA
  Ifngr1_5
gatcctacatacgaaacata

SEQ ID NO: 27309 - DNA, 20 bp, Artificial Sequence
  sgRNA
  Ifngr1_6
gccgtttcgggagtgatagg

SEQ ID NO: 27310 - DNA, 20 bp, Artificial Sequence
  sgRNA
  Ifngr1_7
tggagctgcccgatcccacg

SEQ ID NO: 27311 - DNA, 20 bp, Artificial Sequence
  sgRNA
  Ifngr1_8
gtgcggtttgtcataaccgg

SEQ ID NO: 27312 - DNA, 20 bp, Artificial Sequence
  sgRNA
  Ifngr1_9
gggcctttctcacgggtgga

SEQ ID NO: 27313 - DNA, 20 bp, Artificial Sequence
  sgRNA
  Ifngr1_10
ggtgctcccgtcaccaaaca

SEQ ID NO: 27314 - DNA, 20 bp, Artificial Sequence
  sgRNA
  Ifngr1_11
agcacgtccaccaacatgtg

SEQ ID NO: 27315 - DNA, 20 bp, Artificial Sequence
  sgRNA
  Ifngr1_12
gtctttgtgtcggagttgga

SEQ ID NO: 27316 - DNA, 20 bp, Artificial Sequence
  sgRNA
  Ifngr1_13
tggtattcccagcatacgac

SEQ ID NO: 27317 - DNA, 20 bp, Artificial Sequence
  sgRNA
  Ifngr1_14
cgacttcagggtgaaatacg

SEQ ID NO: 27318 - DNA, 20 bp, Artificial Sequence
  sgRNA
  Ifngr1_15
gtatcctgatgtatctgcct

SEQ ID NO: 27319 - DNA, 20 bp, Artificial Sequence
  sgRNA
  Ifngr1_16
gacttaattagaacattcgt

SEQ ID NO: 27320 - DNA, 20 bp, Artificial Sequence
  sgRNA
  Ifngr1_17
gataggcggtgaggctacaa

SEQ ID NO: 27321 - DNA, 20 bp, Artificial Sequence
  sgRNA
  Ifngr1_18
tgacaaaccgcacatgttgg

SEQ ID NO: 27322 - DNA, 20 bp, Artificial Sequence
  sgRNA
  Ifngr1_19
agatattgtatttcagtaga

SEQ ID NO: 27323 - DNA, 20 bp, Artificial Sequence
  sgRNA
  Ifngr1_20
tttacctgtacagtaaaaat

SEQ ID NO: 27324 - DNA, 20 bp, Artificial Sequence
  sgRNA
  Ifngr2_1
agggaacctcacttccaagt

SEQ ID NO: 27325 - DNA, 20 bp, Artificial Sequence
  sgRNA
  Ifngr2_2
tggacctccgaaaaacatct

SEQ ID NO: 27326 - DNA, 20 bp, Artificial Sequence
  sgRNA
  Ifngr2_3
tccctttgatgtgttccacg

SEQ ID NO: 27327 - DNA, 20 bp, Artificial Sequence
  sgRNA
  Ifngr2_4
tgatgagcagattctaactt

SEQ ID NO: 27328 - DNA, 20 bp, Artificial Sequence
  sgRNA
  Ifngr2_5
gatactgaaaagttgccccg

SEQ ID NO: 27329 - DNA, 20 bp, Artificial Sequence
  sgRNA
  Ifngr2_6
aggggagaagtgtatgacga

SEQ ID NO: 27330 - DNA, 20 bp, Artificial Sequence
  sgRNA
  Ifngr2_7
tattccacctggtagaccac

SEQ ID NO: 27331 - DNA, 20 bp, Artificial Sequence
  sgRNA
  Ifngr2_8
tgcgggtgcgagccaagcga

SEQ ID NO: 27332 - DNA, 20 bp, Artificial Sequence
  sgRNA
  Ifngr2_9
ggtgaagccttgggttcaga

SEQ ID NO: 27333 - DNA, 20 bp, Artificial Sequence
  sgRNA
  Ifngr2_10
agcaatgcgaagatgcccaa

SEQ ID NO: 27334 - DNA, 20 bp, Artificial Sequence
  sgRNA
  Ifngr2_11
acaaagtgtgacttaacagg

SEQ ID NO: 27335 - DNA, 20 bp, Artificial Sequence
  sgRNA
  Ifngr2_12
atttgttccgggatgtttgg

SEQ ID NO: 27336 - DNA, 20 bp, Artificial Sequence
  sgRNA
  Ifngr2_13
ttagaggtcttggacaagga

SEQ ID NO: 27337 - DNA, 20 bp, Artificial Sequence
  sgRNA
  Ifngr2_14
gttgctggagccgaactgta

SEQ ID NO: 27338 - DNA, 20 bp, Artificial Sequence
  sgRNA
  Ifngr2_15
gcatcgatggctcttggcat

SEQ ID NO: 27339 - DNA, 20 bp, Artificial Sequence
  sgRNA
  Ifngr2_16
ggcatcttcgcattgctgct

SEQ ID NO: 27340 - DNA, 20 bp, Artificial Sequence
  sgRNA
  Ifngr2_17
cctccctttgatgtgttcca

SEQ ID NO: 27341 - DNA, 20 bp, Artificial Sequence
  sgRNA
  Ifngr2_18
gctttggtatttgaggaaca

SEQ ID NO: 27342 - DNA, 20 bp, Artificial Sequence
  sgRNA
  Ifngr2_19
cttcagattgcccagcacaa

SEQ ID NO: 27343 - DNA, 20 bp, Artificial Sequence
  sgRNA
  Ifngr2_20
gggtcattgctggaaggtga

SEQ ID NO: 27344 - DNA, 20 bp, Artificial Sequence
  sgRNA
  Ifnlr1_1
ttctgaatacagatacccag

SEQ ID NO: 27345 - DNA, 20 bp, Artificial Sequence
  sgRNA
  Ifnlr1_2
tccagcgacggcatgcaagg

SEQ ID NO: 27346 - DNA, 20 bp, Artificial Sequence
  sgRNA
  Ifnlr1_3
ctagctatatcaaaaccggt

SEQ ID NO: 27347 - DNA, 20 bp, Artificial Sequence
  sgRNA
  Ifnlr1_4
ggtaccgggactccacccgt

SEQ ID NO: 27348 - DNA, 20 bp, Artificial Sequence
  sgRNA
  Ifnlr1_5
gctgggtcaacaatcctgag

SEQ ID NO: 27349 - DNA, 20 bp, Artificial Sequence
  sgRNA
  Ifnlr1_6
ttctggtcctgcctgtagcg

SEQ ID NO: 27350 - DNA, 20 bp, Artificial Sequence
  sgRNA
  Ifnlr1_7
tggtacttcagttccagcga

SEQ ID NO: 27351 - DNA, 20 bp, Artificial Sequence
  sgRNA
  Ifnlr1_8
tccgagtgttccataacccg

SEQ ID NO: 27352 - DNA, 20 bp, Artificial Sequence
  sgRNA
  Ifnlr1_9
gacacagactacgatgacga

SEQ ID NO: 27353 - DNA, 20 bp, Artificial Sequence
  sgRNA
  Ifnlr1_10
tgctgggtcaacaatcctga

SEQ ID NO: 27354 - DNA, 20 bp, Artificial Sequence
  sgRNA
  Ifnlr1_11
gtaccgggactccacccgtg

SEQ ID NO: 27355 - DNA, 20 bp, Artificial Sequence
  sgRNA
  Ifnlr1_12
tttacctgacatggcttccg

SEQ ID NO: 27356 - DNA, 20 bp, Artificial Sequence
  sgRNA
  Ifnlr1_13
aagagtgtcacgtttctggg

SEQ ID NO: 27357 - DNA, 20 bp, Artificial Sequence
  sgRNA
  Ifnlr1_14
gcgcctggtccggctccttt

SEQ ID NO: 27358 - DNA, 20 bp, Artificial Sequence
  sgRNA
  Ifnlr1_15
tctccgagtgttccataacc

SEQ ID NO: 27359 - DNA, 20 bp, Artificial Sequence
  sgRNA
  Ifnlr1_16
gcccagctgcatcttcctag

SEQ ID NO: 27360 - DNA, 20 bp, Artificial Sequence
  sgRNA
  Ifnlr1_17
gtacaggcagcttccgcaca

SEQ ID NO: 27361 - DNA, 20 bp, Artificial Sequence
  sgRNA
  Ifnlr1_18
tcagacactgactttctgct

SEQ ID NO: 27362 - DNA, 20 bp, Artificial Sequence
  sgRNA
  Ifnlr1_19
ggcttctcgctgatgaagag

SEQ ID NO: 27363 - DNA, 20 bp, Artificial Sequence
  sgRNA
  Ifnlr1_20
ggaaccagaaatcctccacc

SEQ ID NO: 27364 - DNA, 20 bp, Artificial Sequence
  sgRNA
  Igdcc3_1
acagctcggacattgcgtgg

SEQ ID NO: 27365 - DNA, 20 bp, Artificial Sequence
  sgRNA
  Igdcc3_2
cctgacagtgcaccagactg

SEQ ID NO: 27366 - DNA, 20 bp, Artificial Sequence
  sgRNA
  Igdcc3_3
caaagcctacacaccacgag

SEQ ID NO: 27367 - DNA, 20 bp, Artificial Sequence
  sgRNA
  Igdcc3_4
aggtacacactactgcccaa

SEQ ID NO: 27368 - DNA, 20 bp, Artificial Sequence
  sgRNA
  Igdcc3_5
gttatctgcaggactccctt

SEQ ID NO: 27369 - DNA, 20 bp, Artificial Sequence
  sgRNA
  Igdcc3_6
tcaaagcctacacaccacga

SEQ ID NO: 27370 - DNA, 20 bp, Artificial Sequence
  sgRNA
  Igdcc3_7
gccctgaatggactgagccg

SEQ ID NO: 27371 - DNA, 20 bp, Artificial Sequence
  sgRNA
  Igdcc3_8
ccattgacacggacgatgag

SEQ ID NO: 27372 - DNA, 20 bp, Artificial Sequence
  sgRNA
  Igdcc3_9
gctgatccaccacttcaggc

SEQ ID NO: 27373 - DNA, 20 bp, Artificial Sequence
  sgRNA
  Igdcc3_10
gagccgagatgaaaagccgg

SEQ ID NO: 27374 - DNA, 20 bp, Artificial Sequence
  sgRNA
  Igdcc3_11
ggttggtgacatcttccttc

SEQ ID NO: 27375 - DNA, 20 bp, Artificial Sequence
  sgRNA
  Igdcc3_12
atcaaagcctacacaccacg

SEQ ID NO: 27376 - DNA, 20 bp, Artificial Sequence
  sgRNA
  Igdcc3_13
gctgagccgagatgaaaagc

SEQ ID NO: 27377 - DNA, 20 bp, Artificial Sequence
  sgRNA
  Igdcc3_14
tgacggcctgggggtgtacg

SEQ ID NO: 27378 - DNA, 20 bp, Artificial Sequence
  sgRNA
  Igdcc3_15
gagacagctcggacattgcg

SEQ ID NO: 27379 - DNA, 20 bp, Artificial Sequence
  sgRNA
  Igdcc3_16
tcccccatgtgactgccgga

SEQ ID NO: 27380 - DNA, 20 bp, Artificial Sequence
  sgRNA
  Igdcc3_17
cattgtgtcctggagccgct

SEQ ID NO: 27381 - DNA, 20 bp, Artificial Sequence
  sgRNA
  Igdcc3_18
tagtgtgcgggtcagccacg

SEQ ID NO: 27382 - DNA, 20 bp, Artificial Sequence
  sgRNA
  Igdcc3_19
atgttcacctgccaagcgca

SEQ ID NO: 27383 - DNA, 20 bp, Artificial Sequence
  sgRNA
  Igdcc3_20
atgatgatattgccaaccct

SEQ ID NO: 27384 - DNA, 20 bp, Artificial Sequence
  sgRNA
  Igdcc4_1
ctgtacgcttcggcccctgg

SEQ ID NO: 27385 - DNA, 20 bp, Artificial Sequence
  sgRNA
  Igdcc4_2
cacgcgtgatttcgccactg

SEQ ID NO: 27386 - DNA, 20 bp, Artificial Sequence
  sgRNA
  Igdcc4_3
acaagatagagtacggtttg

SEQ ID NO: 27387 - DNA, 20 bp, Artificial Sequence
  sgRNA
  Igdcc4_4
actctgtccagacactaccg

SEQ ID NO: 27388 - DNA, 20 bp, Artificial Sequence
  sgRNA
  Igdcc4_5
ctacaccctctccaactacg

SEQ ID NO: 27389 - DNA, 20 bp, Artificial Sequence
  sgRNA
  Igdcc4_6
cgtagctttcaacaaacacg

SEQ ID NO: 27390 - DNA, 20 bp, Artificial Sequence
  sgRNA
  Igdcc4_7
gggacaccagtgtaaccgaa

SEQ ID NO: 27391 - DNA, 20 bp, Artificial Sequence
  sgRNA
  Igdcc4_8
ggtgccaaccaacaaccagt

SEQ ID NO: 27392 - DNA, 20 bp, Artificial Sequence
  sgRNA
  Igdcc4_9
ggatcccgttgcgacccaat

SEQ ID NO: 27393 - DNA, 20 bp, Artificial Sequence
  sgRNA
  Igdcc4_10
gcgctgcactggctgcacga

SEQ ID NO: 27394 - DNA, 20 bp, Artificial Sequence
  sgRNA
  Igdcc4_11
gagtgtagtgatggagtgcg

SEQ ID NO: 27395 - DNA, 20 bp, Artificial Sequence
  sgRNA
  Igdcc4_12
acaccagtgtaaccgaacgg

SEQ ID NO: 27396 - DNA, 20 bp, Artificial Sequence
  sgRNA
  Igdcc4_13
gttacactggtgtcccccca

SEQ ID NO: 27397 - DNA, 20 bp, Artificial Sequence
  sgRNA
  Igdcc4_14
ccctcaccttcaattctgca

SEQ ID NO: 27398 - DNA, 20 bp, Artificial Sequence
  sgRNA
  Igdcc4_15
atgccaccctgatgtccgag

SEQ ID NO: 27399 - DNA, 20 bp, Artificial Sequence
  sgRNA
  Igdcc4_16
acgcgcccattgggtcgcaa

SEQ ID NO: 27400 - DNA, 20 bp, Artificial Sequence
  sgRNA
  Igdcc4_17
tggctggccaccactcctag

SEQ ID NO: 27401 - DNA, 20 bp, Artificial Sequence
  sgRNA
  Igdcc4_18
tctgagggccacagtgagcg

SEQ ID NO: 27402 - DNA, 20 bp, Artificial Sequence
  sgRNA
  Igdcc4_19
catgccaccctgatgtccga

SEQ ID NO: 27403 - DNA, 20 bp, Artificial Sequence
  sgRNA
  Igdcc4_20
cgttctacgacggagccaaa

SEQ ID NO: 27404 - DNA, 20 bp, Artificial Sequence
  sgRNA
  Igf1r_1
agaaccgaatcatcataacg

SEQ ID NO: 27405 - DNA, 20 bp, Artificial Sequence
  sgRNA
  Igf1r_2
ggaaaacgaccatatccgtg

SEQ ID NO: 27406 - DNA, 20 bp, Artificial Sequence
  sgRNA
  Igf1r_3
ctatggtggagaggtaacag

SEQ ID NO: 27407 - DNA, 20 bp, Artificial Sequence
  sgRNA
  Igf1r_4
ctgcttattaacatccggag

SEQ ID NO: 27408 - DNA, 20 bp, Artificial Sequence
  sgRNA
  Igf1r_5
ccttacgctcacatgaacgg

SEQ ID NO: 27409 - DNA, 20 bp, Artificial Sequence
  sgRNA
  Igf1r_6
tatccacagctgcaaccacg

SEQ ID NO: 27410 - DNA, 20 bp, Artificial Sequence
  sgRNA
  Igf1r_7
ggccatcaagacggtaaacg

SEQ ID NO: 27411 - DNA, 20 bp, Artificial Sequence
  sgRNA
  Igf1r_8
gccttacgctcacatgaacg

SEQ ID NO: 27412 - DNA, 20 bp, Artificial Sequence
  sgRNA
  Igf1r_9
cgtcggccagagagagagcg

SEQ ID NO: 27413 - DNA, 20 bp, Artificial Sequence
  sgRNA
  Igf1r_10
gtacgtgcctgatgaatggg

SEQ ID NO: 27414 - DNA, 20 bp, Artificial Sequence
  sgRNA
  Igf1r_11
ggtctccttctactacagcg

SEQ ID NO: 27415 - DNA, 20 bp, Artificial Sequence
  sgRNA
  Igf1r_12
ggacgacaacacaacctgcg

SEQ ID NO: 27416 - DNA, 20 bp, Artificial Sequence
  sgRNA
  Igf1r_13
atgagatcccggtagtccgg

SEQ ID NO: 27417 - DNA, 20 bp, Artificial Sequence
  sgRNA
  Igf1r_14
gcgccagccctcgaacctgt

SEQ ID NO: 27418 - DNA, 20 bp, Artificial Sequence
  sgRNA
  Igf1r_15
cctgcatgcactcatcgtcg

SEQ ID NO: 27419 - DNA, 20 bp, Artificial Sequence
  sgRNA
  Igf1r_16
agcgatttgtggtccagcag

SEQ ID NO: 27420 - DNA, 20 bp, Artificial Sequence
  sgRNA
  Igf1r_17
tctacgagacggactactac

SEQ ID NO: 27421 - DNA, 20 bp, Artificial Sequence
  sgRNA
  Igf1r_18
agctgcccaggcactccggg

SEQ ID NO: 27422 - DNA, 20 bp, Artificial Sequence
  sgRNA
  Igf1r_19
ccttgctgctaggaactgca

SEQ ID NO: 27423 - DNA, 20 bp, Artificial Sequence
  sgRNA
  Igf1r_20
ccgatgatctccaggaagga

SEQ ID NO: 27424 - DNA, 20 bp, Artificial Sequence
  sgRNA
  Igf2r_1
aggacattgactccacacga

SEQ ID NO: 27425 - DNA, 20 bp, Artificial Sequence
  sgRNA
  Igf2r_2
tgaaaatgaactatactggg

SEQ ID NO: 27426 - DNA, 20 bp, Artificial Sequence
  sgRNA
  Igf2r_3
gtcacaccgtctgtccactg

SEQ ID NO: 27427 - DNA, 20 bp, Artificial Sequence
  sgRNA
  Igf2r_4
ggacagacgaggatcagtgt

SEQ ID NO: 27428 - DNA, 20 bp, Artificial Sequence
  sgRNA
  Igf2r_5
ctgcctgtggaacggttgcg

SEQ ID NO: 27429 - DNA, 20 bp, Artificial Sequence
  sgRNA
  Igf2r_6
gcacagggcgtccaagtcga

SEQ ID NO: 27430 - DNA, 20 bp, Artificial Sequence
  sgRNA
  Igf2r_7
actaagctcacctactacga

SEQ ID NO: 27431 - DNA, 20 bp, Artificial Sequence
  sgRNA
  Igf2r_8
acgttggccgacccaaggag

SEQ ID NO: 27432 - DNA, 20 bp, Artificial Sequence
  sgRNA
  Igf2r_9
gcgctgatacaccttatggc

SEQ ID NO: 27433 - DNA, 20 bp, Artificial Sequence
  sgRNA
  Igf2r_10
actctacctacaacttccgg

SEQ ID NO: 27434 - DNA, 20 bp, Artificial Sequence
  sgRNA
  Igf2r_11
ccttgagcagaatcgttgag

SEQ ID NO: 27435 - DNA, 20 bp, Artificial Sequence
  sgRNA
  Igf2r_12
ccttcaccagagggtcacag

SEQ ID NO: 27436 - DNA, 20 bp, Artificial Sequence
  sgRNA
  Igf2r_13
tgaagctcttgccggtcaca

SEQ ID NO: 27437 - DNA, 20 bp, Artificial Sequence
  sgRNA
  Igf2r_14
aggctcctctccatcccgac

SEQ ID NO: 27438 - DNA, 20 bp, Artificial Sequence
  sgRNA
  Igf2r_15
cccgggaacatgttacacgg

SEQ ID NO: 27439 - DNA, 20 bp, Artificial Sequence
  sgRNA
  Igf2r_16
cttgtacctcaggtctgaca

SEQ ID NO: 27440 - DNA, 20 bp, Artificial Sequence
  sgRNA
  Igf2r_17
gtactcgccaacactgacga

SEQ ID NO: 27441 - DNA, 20 bp, Artificial Sequence
  sgRNA
  Igf2r_18
tccttgtcagtcaaactcgg

SEQ ID NO: 27442 - DNA, 20 bp, Artificial Sequence
  sgRNA
  Igf2r_19
acactcgaacacgatcctgg

SEQ ID NO: 27443 - DNA, 20 bp, Artificial Sequence
  sgRNA
  Igf2r_20
gttcgagtgtgcccagacgt

SEQ ID NO: 27444 - DNA, 20 bp, Artificial Sequence
  sgRNA
  Igflr1_1
gcagggccagtaatgtagag

SEQ ID NO: 27445 - DNA, 20 bp, Artificial Sequence
  sgRNA
  Igflr1_2
aaggtggccacagaagctag

SEQ ID NO: 27446 - DNA, 20 bp, Artificial Sequence
  sgRNA
  Igflr1_3
gaggacagacatccttggga

SEQ ID NO: 27447 - DNA, 20 bp, Artificial Sequence
  sgRNA
  Igflr1_4
attggggttgcaatacccag

SEQ ID NO: 27448 - DNA, 20 bp, Artificial Sequence
  sgRNA
  Igflr1_5
tctactttccaatacctcca

SEQ ID NO: 27449 - DNA, 20 bp, Artificial Sequence
  sgRNA
  Igflr1_6
ctaccttcgcctactcactt

SEQ ID NO: 27450 - DNA, 20 bp, Artificial Sequence
  sgRNA
  Igflr1_7
gggccgaagtgagtaggcga

SEQ ID NO: 27451 - DNA, 20 bp, Artificial Sequence
  sgRNA
  Igflr1_8
gctgcttctgatattggcag

SEQ ID NO: 27452 - DNA, 20 bp, Artificial Sequence
  sgRNA
  Igflr1_9
agtactggaactctgacaag

SEQ ID NO: 27453 - DNA, 20 bp, Artificial Sequence
  sgRNA
  Igflr1_10
actgaggctgagacaaaacc

SEQ ID NO: 27454 - DNA, 20 bp, Artificial Sequence
  sgRNA
  Igflr1_11
ggaggagctgattatgctat

SEQ ID NO: 27455 - DNA, 20 bp, Artificial Sequence
  sgRNA
  Igflr1_12
actgcttgtgggttctacca

SEQ ID NO: 27456 - DNA, 20 bp, Artificial Sequence
  sgRNA
  Igflr1_13
gcagcccgtatcttgcagcc

SEQ ID NO: 27457 - DNA, 20 bp, Artificial Sequence
  sgRNA
  Igflr1_14
ttatggtaccacacgacacc

SEQ ID NO: 27458 - DNA, 20 bp, Artificial Sequence
  sgRNA
  Igflr1_15
ccataagccgtgctcccgct

SEQ ID NO: 27459 - DNA, 20 bp, Artificial Sequence
  sgRNA
  Igflr1_16
ccaatacctccagggtacct

SEQ ID NO: 27460 - DNA, 20 bp, Artificial Sequence
  sgRNA
  Igflr1_17
gatacgggctgcctgccacc

SEQ ID NO: 27461 - DNA, 20 bp, Artificial Sequence
  sgRNA
  Igflr1_18
gcttctctggacagtggcgg

SEQ ID NO: 27462 - DNA, 20 bp, Artificial Sequence
  sgRNA
  Igflr1_19
cctcttaaacctgaagacgc

SEQ ID NO: 27463 - DNA, 20 bp, Artificial Sequence
  sgRNA
  Igflr1_20
tctgctactctgggtcaatt

SEQ ID NO: 27464 - DNA, 20 bp, Artificial Sequence
  sgRNA
  Igsf1_1
ttcctggccccggattggaa

SEQ ID NO: 27465 - DNA, 20 bp, Artificial Sequence
  sgRNA
  Igsf1_2
ggaacaattgaaagtcactc

SEQ ID NO: 27466 - DNA, 20 bp, Artificial Sequence
  sgRNA
  Igsf1_3
acttggaatgtcttgtaagg

SEQ ID NO: 27467 - DNA, 20 bp, Artificial Sequence
  sgRNA
  Igsf1_4
tagattaccaagtcccaact

SEQ ID NO: 27468 - DNA, 20 bp, Artificial Sequence
  sgRNA
  Igsf1_5
ggtactttggaactgtaaag

SEQ ID NO: 27469 - DNA, 20 bp, Artificial Sequence
  sgRNA
  Igsf1_6
ctgtcacaacgagctccaca

SEQ ID NO: 27470 - DNA, 20 bp, Artificial Sequence
  sgRNA
  Igsf1_7
cttccagccatcctttacag

SEQ ID NO: 27471 - DNA, 20 bp, Artificial Sequence
  sgRNA
  Igsf1_8
ttccactgagacttcttgcg

SEQ ID NO: 27472 - DNA, 20 bp, Artificial Sequence
  sgRNA
  Igsf1_9
gcatccagtgacctagcctg

SEQ ID NO: 27473 - DNA, 20 bp, Artificial Sequence
  sgRNA
  Igsf1_10
tctcctcccatgaatggcaa

SEQ ID NO: 27474 - DNA, 20 bp, Artificial Sequence
  sgRNA
  Igsf1_11
ggagcatctggatatgagtg

SEQ ID NO: 27475 - DNA, 20 bp, Artificial Sequence
  sgRNA
  Igsf1_12
tcggcttcccttccaatccg

SEQ ID NO: 27476 - DNA, 20 bp, Artificial Sequence
  sgRNA
  Igsf1_13
gagacaaccatgtcgaacag

SEQ ID NO: 27477 - DNA, 20 bp, Artificial Sequence
  sgRNA
  Igsf1_14
ggtctttcctactttgaaca

SEQ ID NO: 27478 - DNA, 20 bp, Artificial Sequence
  sgRNA
  Igsf1_15
gacagcccttagaacaacag

SEQ ID NO: 27479 - DNA, 20 bp, Artificial Sequence
  sgRNA
  Igsf1_16
gtatttatgctgtttaaaga

SEQ ID NO: 27480 - DNA, 20 bp, Artificial Sequence
  sgRNA
  Igsf1_17
cctaaagaatgtgacctaca

SEQ ID NO: 27481 - DNA, 20 bp, Artificial Sequence
  sgRNA
  Igsf1_18
gatagagtccaactaccccc

SEQ ID NO: 27482 - DNA, 20 bp, Artificial Sequence
  sgRNA
  Igsf1_19
agagtgtgatgttctcccaa

SEQ ID NO: 27483 - DNA, 20 bp, Artificial Sequence
  sgRNA
  Igsf1_20
cagtcacccagatcataaga

SEQ ID NO: 27484 - DNA, 20 bp, Artificial Sequence
  sgRNA
  Igsf11_1
gctattactccaacgctccg

SEQ ID NO: 27485 - DNA, 20 bp, Artificial Sequence
  sgRNA
  Igsf11_2
cggtaaatcctaccctcccg

SEQ ID NO: 27486 - DNA, 20 bp, Artificial Sequence
  sgRNA
  Igsf11_3
gctccacaatgccaaatcca

SEQ ID NO: 27487 - DNA, 20 bp, Artificial Sequence
  sgRNA
  Igsf11_4
gagggcactgatattccgga

SEQ ID NO: 27488 - DNA, 20 bp, Artificial Sequence
  sgRNA
  Igsf11_5
gcactggtggagaaggcgca

SEQ ID NO: 27489 - DNA, 20 bp, Artificial Sequence
  sgRNA
  Igsf11_6
tggtagttacagccaacaga

SEQ ID NO: 27490 - DNA, 20 bp, Artificial Sequence
  sgRNA
  Igsf11_7
acgcccctgaaattagtgca

SEQ ID NO: 27491 - DNA, 20 bp, Artificial Sequence
  sgRNA
  Igsf11_8
gtatcgactgttgtaggtat

SEQ ID NO: 27492 - DNA, 20 bp, Artificial Sequence
  sgRNA
  Igsf11_9
tattatctaacttctcccaa

SEQ ID NO: 27493 - DNA, 20 bp, Artificial Sequence
  sgRNA
  Igsf11_10
gaaggatgacgtcactgccg

SEQ ID NO: 27494 - DNA, 20 bp, Artificial Sequence
  sgRNA
  Igsf11_11
ttctgccaaagccttccaca

SEQ ID NO: 27495 - DNA, 20 bp, Artificial Sequence
  sgRNA
  Igsf11_12
tgcctgcccagagtcgagca

SEQ ID NO: 27496 - DNA, 20 bp, Artificial Sequence
  sgRNA
  Igsf11_13
ttggcagaagagcatttagg

SEQ ID NO: 27497 - DNA, 20 bp, Artificial Sequence
  sgRNA
  Igsf11_14
ctaccctcccgtggaaccgg

SEQ ID NO: 27498 - DNA, 20 bp, Artificial Sequence
  sgRNA
  Igsf11_15
aacttctcccaaaggtacgt

SEQ ID NO: 27499 - DNA, 20 bp, Artificial Sequence
  sgRNA
  Igsf11_16
agccacacactggtacagac

SEQ ID NO: 27500 - DNA, 20 bp, Artificial Sequence
  sgRNA
  Igsf11_17
actggtacagaccggaagag

SEQ ID NO: 27501 - DNA, 20 bp, Artificial Sequence
  sgRNA
  Igsf11_18
aatgacattgaggttcagga

SEQ ID NO: 27502 - DNA, 20 bp, Artificial Sequence
  sgRNA
  Igsf11_19
taccctcccgtggaaccgga

SEQ ID NO: 27503 - DNA, 20 bp, Artificial Sequence
  sgRNA
  Igsf11_20
tatgtggacccaaaaccaga

SEQ ID NO: 27504 - DNA, 20 bp, Artificial Sequence
  sgRNA
  Igsf3_1
cgagtacgggacctacgccg

SEQ ID NO: 27505 - DNA, 20 bp, Artificial Sequence
  sgRNA
  Igsf3_2
agtacagatcgttagcacgg

SEQ ID NO: 27506 - DNA, 20 bp, Artificial Sequence
  sgRNA
  Igsf3_3
ccagcagcgaatatgcccag

SEQ ID NO: 27507 - DNA, 20 bp, Artificial Sequence
  sgRNA
  Igsf3_4
agtgccaagatgaacctagt

SEQ ID NO: 27508 - DNA, 20 bp, Artificial Sequence
  sgRNA
  Igsf3_5
ccagggcgagttctactgcg

SEQ ID NO: 27509 - DNA, 20 bp, Artificial Sequence
  sgRNA
  Igsf3_6
ggagttcagatgtatcctag

SEQ ID NO: 27510 - DNA, 20 bp, Artificial Sequence
  sgRNA
  Igsf3_7
gagctctctgtgcggtacaa

SEQ ID NO: 27511 - DNA, 20 bp, Artificial Sequence
  sgRNA
  Igsf3_8
ggtgtgacattcatactcgc

SEQ ID NO: 27512 - DNA, 20 bp, Artificial Sequence
  sgRNA
  Igsf3_9
gctcactcattgccaccatg

SEQ ID NO: 27513 - DNA, 20 bp, Artificial Sequence
  sgRNA
  Igsf3_10
acacccagcgagtccgcggt

SEQ ID NO: 27514 - DNA, 20 bp, Artificial Sequence
  sgRNA
  Igsf3_11
gatgaagagcctgtacacgc

SEQ ID NO: 27515 - DNA, 20 bp, Artificial Sequence
  sgRNA
  Igsf3_12
ggagcagatgagcgactgca

SEQ ID NO: 27516 - DNA, 20 bp, Artificial Sequence
  sgRNA
  Igsf3_13
cggtagctactactgccacg

SEQ ID NO: 27517 - DNA, 20 bp, Artificial Sequence
  sgRNA
  Igsf3_14
gtagcgctcatcggtgttgg

SEQ ID NO: 27518 - DNA, 20 bp, Artificial Sequence
  sgRNA
  Igsf3_15
gaagatataccacctccgcc

SEQ ID NO: 27519 - DNA, 20 bp, Artificial Sequence
  sgRNA
  Igsf3_16
gccgcagccaggataccgag

SEQ ID NO: 27520 - DNA, 20 bp, Artificial Sequence
  sgRNA
  Igsf3_17
aggctcagaacattcccgac

SEQ ID NO: 27521 - DNA, 20 bp, Artificial Sequence
  sgRNA
  Igsf3_18
agtgggctggacgttgacca

SEQ ID NO: 27522 - DNA, 20 bp, Artificial Sequence
  sgRNA
  Igsf3_19
tgcctggtacaagctggccg

SEQ ID NO: 27523 - DNA, 20 bp, Artificial Sequence
  sgRNA
  Igsf3_20
tagagaccagggtactggcg

SEQ ID NO: 27524 - DNA, 20 bp, Artificial Sequence
  sgRNA
  Igsf6_1
tggaaaggggactacactgg

SEQ ID NO: 27525 - DNA, 20 bp, Artificial Sequence
  sgRNA
  Igsf6_2
cttggatggatgcagaaatg

SEQ ID NO: 27526 - DNA, 20 bp, Artificial Sequence
  sgRNA
  Igsf6_3
ggttacctagaagtggacta

SEQ ID NO: 27527 - DNA, 20 bp, Artificial Sequence
  sgRNA
  Igsf6_4
gagacagcctgttaacagtg

SEQ ID NO: 27528 - DNA, 20 bp, Artificial Sequence
  sgRNA
  Igsf6_5
gcagagctaagagcactatc

SEQ ID NO: 27529 - DNA, 20 bp, Artificial Sequence
  sgRNA
  Igsf6_6
ccaagcacagagcttcaggc

SEQ ID NO: 27530 - DNA, 20 bp, Artificial Sequence
  sgRNA
  Igsf6_7
tttccaacgtgtttagcgct

SEQ ID NO: 27531 - DNA, 20 bp, Artificial Sequence
  sgRNA
  Igsf6_8
aagtcttcctcactgttaac

SEQ ID NO: 27532 - DNA, 20 bp, Artificial Sequence
  sgRNA
  Igsf6_9
aagagcttgtggtttcgctg

SEQ ID NO: 27533 - DNA, 20 bp, Artificial Sequence
  sgRNA
  Igsf6_10
tcaccaagcgctaaacacgt

SEQ ID NO: 27534 - DNA, 20 bp, Artificial Sequence
  sgRNA
  Igsf6_11
agctctttggtggcactgga

SEQ ID NO: 27535 - DNA, 20 bp, Artificial Sequence
  sgRNA
  Igsf6_12
gcaaccaggttacctagaag

SEQ ID NO: 27536 - DNA, 20 bp, Artificial Sequence
  sgRNA
  Igsf6_13
tagtccacttctaggtaacc

SEQ ID NO: 27537 - DNA, 20 bp, Artificial Sequence
  sgRNA
  Igsf6_14
gcgcttggtgacagttcatt

SEQ ID NO: 27538 - DNA, 20 bp, Artificial Sequence
  sgRNA
  Igsf6_15
gttcacagtgaaagaaaccc

SEQ ID NO: 27539 - DNA, 20 bp, Artificial Sequence
  sgRNA
  Igsf6_16
attataccataagagatatg

SEQ ID NO: 27540 - DNA, 20 bp, Artificial Sequence
  sgRNA
  Igsf6_17
agaaaagcactccccaaccc

SEQ ID NO: 27541 - DNA, 20 bp, Artificial Sequence
  sgRNA
  Igsf6_18
ggatcaggctgatctctggc

SEQ ID NO: 27542 - DNA, 20 bp, Artificial Sequence
  sgRNA
  Igsf6_19
tatgaaggtcacacacacac

SEQ ID NO: 27543 - DNA, 20 bp, Artificial Sequence
  sgRNA
  Igsf6_20
ctgctctctgtctacatcac

SEQ ID NO: 27544 - DNA, 20 bp, Artificial Sequence
  sgRNA
  Igsf8_1
tcacgcctcacagtgcacga

SEQ ID NO: 27545 - DNA, 20 bp, Artificial Sequence
  sgRNA
  Igsf8_2
gcagttctaagggttcgcct

SEQ ID NO: 27546 - DNA, 20 bp, Artificial Sequence
  sgRNA
  Igsf8_3
ccattccggaggcgccagtg

SEQ ID NO: 27547 - DNA, 20 bp, Artificial Sequence
  sgRNA
  Igsf8_4
tccacagatacgcagtacct

SEQ ID NO: 27548 - DNA, 20 bp, Artificial Sequence
  sgRNA
  Igsf8_5
ctatgcaacatatctgtgcg

SEQ ID NO: 27549 - DNA, 20 bp, Artificial Sequence
  sgRNA
  Igsf8_6
caggggacctctttaccggg

SEQ ID NO: 27550 - DNA, 20 bp, Artificial Sequence
  sgRNA
  Igsf8_7
ggtcccagaccctcgaacat

SEQ ID NO: 27551 - DNA, 20 bp, Artificial Sequence
  sgRNA
  Igsf8_8
gtagtccgcatgctgcaccc

SEQ ID NO: 27552 - DNA, 20 bp, Artificial Sequence
  sgRNA
  Igsf8_9
gcagggggcactgtgtaccg

SEQ ID NO: 27553 - DNA, 20 bp, Artificial Sequence
  sgRNA
  Igsf8_10
tcgccaaagcctatgttcga

SEQ ID NO: 27554 - DNA, 20 bp, Artificial Sequence
  sgRNA
  Igsf8_11
gccactctacaggaagtagt

SEQ ID NO: 27555 - DNA, 20 bp, Artificial Sequence
  sgRNA
  Igsf8_12
gccattccggaggcgccagt

SEQ ID NO: 27556 - DNA, 20 bp, Artificial Sequence
  sgRNA
  Igsf8_13
ggtgaacgtcggattggccc

SEQ ID NO: 27557 - DNA, 20 bp, Artificial Sequence
  sgRNA
  Igsf8_14
gggactgcactccgacatgg

SEQ ID NO: 27558 - DNA, 20 bp, Artificial Sequence
  sgRNA
  Igsf8_15
ggtactgcgtatctgtggag

SEQ ID NO: 27559 - DNA, 20 bp, Artificial Sequence
  sgRNA
  Igsf8_16
ccgacgttcaccaggtccca

SEQ ID NO: 27560 - DNA, 20 bp, Artificial Sequence
  sgRNA
  Igsf8_17
gcagcgcctgaagggagatt

SEQ ID NO: 27561 - DNA, 20 bp, Artificial Sequence
  sgRNA
  Igsf8_18
gggcacccccaaccaccatt

SEQ ID NO: 27562 - DNA, 20 bp, Artificial Sequence
  sgRNA
  Igsf8_19
actgcactccgacatggcgg

SEQ ID NO: 27563 - DNA, 20 bp, Artificial Sequence
  sgRNA
  Igsf8_20
agggactgatcggtaccgaa

SEQ ID NO: 27564 - DNA, 20 bp, Artificial Sequence
  sgRNA
  Igsf9_1
caatgcagaagtaccccccg

SEQ ID NO: 27565 - DNA, 20 bp, Artificial Sequence
  sgRNA
  Igsf9_2
actgacgtagctatcagcga

SEQ ID NO: 27566 - DNA, 20 bp, Artificial Sequence
  sgRNA
  Igsf9_3
acgtaatcggggtcaattcg

SEQ ID NO: 27567 - DNA, 20 bp, Artificial Sequence
  sgRNA
  Igsf9_4
gggctggtctataaaagccg

SEQ ID NO: 27568 - DNA, 20 bp, Artificial Sequence
  sgRNA
  Igsf9_5
ggtcaattcggggagagtag

SEQ ID NO: 27569 - DNA, 20 bp, Artificial Sequence
  sgRNA
  Igsf9_6
agctatcagcgaaggccacg

SEQ ID NO: 27570 - DNA, 20 bp, Artificial Sequence
  sgRNA
  Igsf9_7
cctagctttccgcagacgca

SEQ ID NO: 27571 - DNA, 20 bp, Artificial Sequence
  sgRNA
  Igsf9_8
agctaggaattcctcccgaa

SEQ ID NO: 27572 - DNA, 20 bp, Artificial Sequence
  sgRNA
  Igsf9_9
ggctggtctataaaagccgg

SEQ ID NO: 27573 - DNA, 20 bp, Artificial Sequence
  sgRNA
  Igsf9_10
ctgcctgatgaatcggcgca

SEQ ID NO: 27574 - DNA, 20 bp, Artificial Sequence
  sgRNA
  Igsf9_11
cgaattgaccccgattacgt

SEQ ID NO: 27575 - DNA, 20 bp, Artificial Sequence
  sgRNA
  Igsf9_12
ccggattctccacttggccg

SEQ ID NO: 27576 - DNA, 20 bp, Artificial Sequence
  sgRNA
  Igsf9_13
actgccctgagatttgcagg

SEQ ID NO: 27577 - DNA, 20 bp, Artificial Sequence
  sgRNA
  Igsf9_14
ccagattgaggggctccggg

SEQ ID NO: 27578 - DNA, 20 bp, Artificial Sequence
  sgRNA
  Igsf9_15
gacaggacaatctcactgaa

SEQ ID NO: 27579 - DNA, 20 bp, Artificial Sequence
  sgRNA
  Igsf9_16
actgccaccaaacctctagg

SEQ ID NO: 27580 - DNA, 20 bp, Artificial Sequence
  sgRNA
  Igsf9_17
gattagcacgaaccggacac

SEQ ID NO: 27581 - DNA, 20 bp, Artificial Sequence
  sgRNA
  Igsf9_18
cgaggacaagaccttggcaa

SEQ ID NO: 27582 - DNA, 20 bp, Artificial Sequence
  sgRNA
  Igsf9_19
ccactcgatgacatgcagag

SEQ ID NO: 27583 - DNA, 20 bp, Artificial Sequence
  sgRNA
  Igsf9_20
ttggcccaagagacaatagg

SEQ ID NO: 27584 - DNA, 20 bp, Artificial Sequence
  sgRNA
  Igsf9b_1
gatactttgcactagcaccg

SEQ ID NO: 27585 - DNA, 20 bp, Artificial Sequence
  sgRNA
  Igsf9b_2
cagtatgacacattccacaa

SEQ ID NO: 27586 - DNA, 20 bp, Artificial Sequence
  sgRNA
  Igsf9b_3
gtagcaccgtgaagtacggg

SEQ ID NO: 27587 - DNA, 20 bp, Artificial Sequence
  sgRNA
  Igsf9b_4
ggaggggaaacaatgaaggg

SEQ ID NO: 27588 - DNA, 20 bp, Artificial Sequence
  sgRNA
  Igsf9b_5
ggtagcaccgtgaagtacgg

SEQ ID NO: 27589 - DNA, 20 bp, Artificial Sequence
  sgRNA
  Igsf9b_6
cagagggctccatctccgat

SEQ ID NO: 27590 - DNA, 20 bp, Artificial Sequence
  sgRNA
  Igsf9b_7
tgactcagacacctacagga

SEQ ID NO: 27591 - DNA, 20 bp, Artificial Sequence
  sgRNA
  Igsf9b_8
gctctgcgaaggagatcccg

SEQ ID NO: 27592 - DNA, 20 bp, Artificial Sequence
  sgRNA
  Igsf9b_9
gattcgccgacccttcacag

SEQ ID NO: 27593 - DNA, 20 bp, Artificial Sequence
  sgRNA
  Igsf9b_10
gtcgtcagaggattcagacg

SEQ ID NO: 27594 - DNA, 20 bp, Artificial Sequence
  sgRNA
  Igsf9b_11
attcgccgacccttcacaga

SEQ ID NO: 27595 - DNA, 20 bp, Artificial Sequence
  sgRNA
  Igsf9b_12
gtgaagggtcggcgaatcga

SEQ ID NO: 27596 - DNA, 20 bp, Artificial Sequence
  sgRNA
  Igsf9b_13
ggaaattctggccggcccca

SEQ ID NO: 27597 - DNA, 20 bp, Artificial Sequence
  sgRNA
  Igsf9b_14
agcgcaagcgcaaactcaag

SEQ ID NO: 27598 - DNA, 20 bp, Artificial Sequence
  sgRNA
  Igsf9b_15
tgtcgagcatatagcatcca

SEQ ID NO: 27599 - DNA, 20 bp, Artificial Sequence
  sgRNA
  Igsf9b_16
gcccacttctggcatataga

SEQ ID NO: 27600 - DNA, 20 bp, Artificial Sequence
  sgRNA
  Igsf9b_17
ggtcttccggaagctgacgg

SEQ ID NO: 27601 - DNA, 20 bp, Artificial Sequence
  sgRNA
  Igsf9b_18
aggtgtcccctggtgccgga

SEQ ID NO: 27602 - DNA, 20 bp, Artificial Sequence
  sgRNA
  Igsf9b_19
gctcgagcagtcacaaactc

SEQ ID NO: 27603 - DNA, 20 bp, Artificial Sequence
  sgRNA
  Igsf9b_20
ccttccctgtcatcacctgg

SEQ ID NO: 27604 - DNA, 20 bp, Artificial Sequence
  sgRNA
  Il10ra_1
gcagtgtttacttatcacga

SEQ ID NO: 27605 - DNA, 20 bp, Artificial Sequence
  sgRNA
  Il10ra_2
gtggggacaacacggacagt

SEQ ID NO: 27606 - DNA, 20 bp, Artificial Sequence
  sgRNA
  Il10ra_3
ggtgaacgttgtgagatcac

SEQ ID NO: 27607 - DNA, 20 bp, Artificial Sequence
  sgRNA
  Il10ra_4
tctggcttcaaaccacacat

SEQ ID NO: 27608 - DNA, 20 bp, Artificial Sequence
  sgRNA
  Il10ra_5
gcttcggtgatacagatcca

SEQ ID NO: 27609 - DNA, 20 bp, Artificial Sequence
  sgRNA
  Il10ra_6
tagttctgagaacttccgga

SEQ ID NO: 27610 - DNA, 20 bp, Artificial Sequence
  sgRNA
  Il10ra_7
agtggtacatccggcacccg

SEQ ID NO: 27611 - DNA, 20 bp, Artificial Sequence
  sgRNA
  Il10ra_8
gctaccagaaacagaccaga

SEQ ID NO: 27612 - DNA, 20 bp, Artificial Sequence
  sgRNA
  Il10ra_9
ttaattcgggattccaagcg

SEQ ID NO: 27613 - DNA, 20 bp, Artificial Sequence
  sgRNA
  Il10ra_10
gggctgccccacagtccaga

SEQ ID NO: 27614 - DNA, 20 bp, Artificial Sequence
  sgRNA
  Il10ra_11
gagtttacaagatttccatc

SEQ ID NO: 27615 - DNA, 20 bp, Artificial Sequence
  sgRNA
  Il10ra_12
ttcgtactcatcccctgcag

SEQ ID NO: 27616 - DNA, 20 bp, Artificial Sequence
  sgRNA
  Il10ra_13
ggaatcaactgaccgaagag

SEQ ID NO: 27617 - DNA, 20 bp, Artificial Sequence
  sgRNA
  Il10ra_14
gtgactctgaaagcaatgga

SEQ ID NO: 27618 - DNA, 20 bp, Artificial Sequence
  sgRNA
  Il10ra_15
ggatcaaaggcatctgtcaa

SEQ ID NO: 27619 - DNA, 20 bp, Artificial Sequence
  sgRNA
  Il10ra_16
cctagaacctaaagcccctg

SEQ ID NO: 27620 - DNA, 20 bp, Artificial Sequence
  sgRNA
  Il10ra_17
cttggaatcccgaattaaca

SEQ ID NO: 27621 - DNA, 20 bp, Artificial Sequence
  sgRNA
  Il10ra_18
acctagtccagaactctcca

SEQ ID NO: 27622 - DNA, 20 bp, Artificial Sequence
  sgRNA
  Il10ra_19
tcacccctatggggaccgtg

SEQ ID NO: 27623 - DNA, 20 bp, Artificial Sequence
  sgRNA
  Il10ra_20
gccaagccaaatcatcctgc

SEQ ID NO: 27624 - DNA, 20 bp, Artificial Sequence
  sgRNA
  Il10rb_1
tggcggatgaacattcggag

SEQ ID NO: 27625 - DNA, 20 bp, Artificial Sequence
  sgRNA
  Il10rb_2
atttcaagaacattctacag

SEQ ID NO: 27626 - DNA, 20 bp, Artificial Sequence
  sgRNA
  Il10rb_3
cggaggacctcagagtcgta

SEQ ID NO: 27627 - DNA, 20 bp, Artificial Sequence
  sgRNA
  Il10rb_4
agagaagtcgcactgagtcg

SEQ ID NO: 27628 - DNA, 20 bp, Artificial Sequence
  sgRNA
  Il10rb_5
cttactgcattcaagttcaa

SEQ ID NO: 27629 - DNA, 20 bp, Artificial Sequence
  sgRNA
  Il10rb_6
tgaatgcagtaagttgtcca

SEQ ID NO: 27630 - DNA, 20 bp, Artificial Sequence
  sgRNA
  Il10rb_7
gcaggtgtaaagactcagca

SEQ ID NO: 27631 - DNA, 20 bp, Artificial Sequence
  sgRNA
  Il10rb_8
caatgtcaccttctgccccg

SEQ ID NO: 27632 - DNA, 20 bp, Artificial Sequence
  sgRNA
  Il10rb_9
gcacgacaaagcagcccagg

SEQ ID NO: 27633 - DNA, 20 bp, Artificial Sequence
  sgRNA
  Il10rb_10
cgaacacctcggcctcctcg

SEQ ID NO: 27634 - DNA, 20 bp, Artificial Sequence
  sgRNA
  Il10rb_11
tgtgtctccgtacgactctg

SEQ ID NO: 27635 - DNA, 20 bp, Artificial Sequence
  sgRNA
  Il10rb_12
gcttagtttgtcgaacacct

SEQ ID NO: 27636 - DNA, 20 bp, Artificial Sequence
  sgRNA
  Il10rb_13
ttgagaatgagcctgagacg

SEQ ID NO: 27637 - DNA, 20 bp, Artificial Sequence
  sgRNA
  Il10rb_14
ggagtgaacccatctgtgaa

SEQ ID NO: 27638 - DNA, 20 bp, Artificial Sequence
  sgRNA
  Il10rb_15
tgatggccacaatccaggaa

SEQ ID NO: 27639 - DNA, 20 bp, Artificial Sequence
  sgRNA
  Il10rb_16
attcattctgaccttctcag

SEQ ID NO: 27640 - DNA, 20 bp, Artificial Sequence
  sgRNA
  Il10rb_17
ttgcctgtccgttcacagat

SEQ ID NO: 27641 - DNA, 20 bp, Artificial Sequence
  sgRNA
  Il10rb_18
aagagacgtcccagaacgga

SEQ ID NO: 27642 - DNA, 20 bp, Artificial Sequence
  sgRNA
  Il10rb_19
cgaggccctggatcagacgg

SEQ ID NO: 27643 - DNA, 20 bp, Artificial Sequence
  sgRNA
  Il10rb_20
caggtgtaaagactcagcaa

SEQ ID NO: 27644 - DNA, 20 bp, Artificial Sequence
  sgRNA
  Il11ra1_1
gtgcgtcctgatccacccca

SEQ ID NO: 27645 - DNA, 20 bp, Artificial Sequence
  sgRNA
  Il11ra1_2
tcctgaagtctcctgccaag

SEQ ID NO: 27646 - DNA, 20 bp, Artificial Sequence
  sgRNA
  Il11ra1_3
taggaagtaaggtagcgggt

SEQ ID NO: 27647 - DNA, 20 bp, Artificial Sequence
  sgRNA
  Il11ra1_4
agacataagtgccttcatca

SEQ ID NO: 27648 - DNA, 20 bp, Artificial Sequence
  sgRNA
  Il11ra1_5
acacagctacttgctccaag

SEQ ID NO: 27649 - DNA, 20 bp, Artificial Sequence
  sgRNA
  Il11ra1_6
aggatggaccgcaaaaacct

SEQ ID NO: 27650 - DNA, 20 bp, Artificial Sequence
  sgRNA
  Il11ra1_7
tcaggtatctcatcctgcag

SEQ ID NO: 27651 - DNA, 20 bp, Artificial Sequence
  sgRNA
  Il11ra1_8
atcaggtatctcatcctgca

SEQ ID NO: 27652 - DNA, 20 bp, Artificial Sequence
  sgRNA
  Il11ra1_9
tgcaaggccttccttgcagc

SEQ ID NO: 27653 - DNA, 20 bp, Artificial Sequence
  sgRNA
  Il11ra1_10
gagctccaacagccaggcca

SEQ ID NO: 27654 - DNA, 20 bp, Artificial Sequence
  sgRNA
  Il11ra1_11
gtgccagagctccaacagcc

SEQ ID NO: 27655 - DNA, 20 bp, Artificial Sequence
  sgRNA
  Il11ra1_12
cgagacgcctgcatgccagc

SEQ ID NO: 27656 - DNA, 20 bp, Artificial Sequence
  sgRNA
  Il11ra1_13
tgtggctgggctgccacacg

SEQ ID NO: 27657 - DNA, 20 bp, Artificial Sequence
  sgRNA
  Il11ra1_14
ggagacttcaggacgtgctg

SEQ ID NO: 27658 - DNA, 20 bp, Artificial Sequence
  sgRNA
  Il11ra1_15
ctagctgctgtccgtgtccc

SEQ ID NO: 27659 - DNA, 20 bp, Artificial Sequence
  sgRNA
  Il11ra1_16
tgcaggcgtctcgggtaacc

SEQ ID NO: 27660 - DNA, 20 bp, Artificial Sequence
  sgRNA
  Il11ra1_17
ctgttggagctctggcactg

SEQ ID NO: 27661 - DNA, 20 bp, Artificial Sequence
  sgRNA
  Il11ra1_18
ggaagtgataacagatgctg

SEQ ID NO: 27662 - DNA, 20 bp, Artificial Sequence
  sgRNA
  Il11ra1_19
tgatccaccccaaggactgc

SEQ ID NO: 27663 - DNA, 20 bp, Artificial Sequence
  sgRNA
  Il11ra1_20
gggacacggacagcagctag

SEQ ID NO: 27664 - DNA, 20 bp, Artificial Sequence
  sgRNA
  Il12rb1_1
gtcggtgaggaaccaaaccg

SEQ ID NO: 27665 - DNA, 20 bp, Artificial Sequence
  sgRNA
  Il12rb1_2
cctccgaaccatacccacac

SEQ ID NO: 27666 - DNA, 20 bp, Artificial Sequence
  sgRNA
  Il12rb1_3
tgagaagacatcgttcccag

SEQ ID NO: 27667 - DNA, 20 bp, Artificial Sequence
  sgRNA
  Il12rb1_4
tcaaggtgtcacaatcacac

SEQ ID NO: 27668 - DNA, 20 bp, Artificial Sequence
  sgRNA
  Il12rb1_5
gcaatacgtcgtgcgctgcg

SEQ ID NO: 27669 - DNA, 20 bp, Artificial Sequence
  sgRNA
  Il12rb1_6
gctagggaggactgtccccg

SEQ ID NO: 27670 - DNA, 20 bp, Artificial Sequence
  sgRNA
  Il12rb1_7
tgtatccgagactgcccacg

SEQ ID NO: 27671 - DNA, 20 bp, Artificial Sequence
  sgRNA
  Il12rb1_8
ggagcagcgggagtgtcacg

SEQ ID NO: 27672 - DNA, 20 bp, Artificial Sequence
  sgRNA
  Il12rb1_9
gctgcgaccgaaacgagttt

SEQ ID NO: 27673 - DNA, 20 bp, Artificial Sequence
  sgRNA
  Il12rb1_10
gtgctcgccaaaactcgttt

SEQ ID NO: 27674 - DNA, 20 bp, Artificial Sequence
  sgRNA
  Il12rb1_11
aggtgcgagccgacactgcg

SEQ ID NO: 27675 - DNA, 20 bp, Artificial Sequence
  sgRNA
  Il12rb1_12
cggtactccacgacacgtgt

SEQ ID NO: 27676 - DNA, 20 bp, Artificial Sequence
  sgRNA
  Il12rb1_13
cctgagccagagttaacctg

SEQ ID NO: 27677 - DNA, 20 bp, Artificial Sequence
  sgRNA
  Il12rb1_14
gcgcagccgagtaatgtaca

SEQ ID NO: 27678 - DNA, 20 bp, Artificial Sequence
  sgRNA
  Il12rb1_15
gcaccacctactgccttgag

SEQ ID NO: 27679 - DNA, 20 bp, Artificial Sequence
  sgRNA
  Il12rb1_16
tggaggcgaacactgtgatg

SEQ ID NO: 27680 - DNA, 20 bp, Artificial Sequence
  sgRNA
  Il12rb1_17
gcgaggctgaagacggcgcg

SEQ ID NO: 27681 - DNA, 20 bp, Artificial Sequence
  sgRNA
  Il12rb1_18
gcagtgctgccacagggtgt

SEQ ID NO: 27682 - DNA, 20 bp, Artificial Sequence
  sgRNA
  Il12rb1_19
aggaaggtgccacttctgga

SEQ ID NO: 27683 - DNA, 20 bp, Artificial Sequence
  sgRNA
  Il12rb1_20
agagccctgaatgtcagcgt

SEQ ID NO: 27684 - DNA, 20 bp, Artificial Sequence
  sgRNA
  Il12rb2_1
actgagaacacgaacaccag

SEQ ID NO: 27685 - DNA, 20 bp, Artificial Sequence
  sgRNA
  Il12rb2_2
attaacatagtggacctatg

SEQ ID NO: 27686 - DNA, 20 bp, Artificial Sequence
  sgRNA
  Il12rb2_3
agagcagacatgttgtccgg

SEQ ID NO: 27687 - DNA, 20 bp, Artificial Sequence
  sgRNA
  Il12rb2_4
ctatcaggtgacgttacaag

SEQ ID NO: 27688 - DNA, 20 bp, Artificial Sequence
  sgRNA
  Il12rb2_5
gagcagacatgttgtccggg

SEQ ID NO: 27689 - DNA, 20 bp, Artificial Sequence
  sgRNA
  Il12rb2_6
aataagcagcctacagccca

SEQ ID NO: 27690 - DNA, 20 bp, Artificial Sequence
  sgRNA
  Il12rb2_7
gctaggaaggtagttcactg

SEQ ID NO: 27691 - DNA, 20 bp, Artificial Sequence
  sgRNA
  Il12rb2_8
acactggctgcggatccccc

SEQ ID NO: 27692 - DNA, 20 bp, Artificial Sequence
  sgRNA
  Il12rb2_9
acaactagtgaacctataca

SEQ ID NO: 27693 - DNA, 20 bp, Artificial Sequence
  sgRNA
  Il12rb2_10
taaacggtctcagatctcgc

SEQ ID NO: 27694 - DNA, 20 bp, Artificial Sequence
  sgRNA
  Il12rb2_11
aatggagagctctccaacca

SEQ ID NO: 27695 - DNA, 20 bp, Artificial Sequence
  sgRNA
  Il12rb2_12
agatccagcaaacagcactt

SEQ ID NO: 27696 - DNA, 20 bp, Artificial Sequence
  sgRNA
  Il12rb2_13
tatcacgaatgctttccagt

SEQ ID NO: 27697 - DNA, 20 bp, Artificial Sequence
  sgRNA
  Il12rb2_14
ccgtccaagccccagttcgg

SEQ ID NO: 27698 - DNA, 20 bp, Artificial Sequence
  sgRNA
  Il12rb2_15
acctacggataatctcctga

SEQ ID NO: 27699 - DNA, 20 bp, Artificial Sequence
  sgRNA
  Il12rb2_16
tgtctactctcaaacctcaa

SEQ ID NO: 27700 - DNA, 20 bp, Artificial Sequence
  sgRNA
  Il12rb2_17
tgacccaagaggaatcacag

SEQ ID NO: 27701 - DNA, 20 bp, Artificial Sequence
  sgRNA
  Il12rb2_18
gacaaacaaggtcataccaa

SEQ ID NO: 27702 - DNA, 20 bp, Artificial Sequence
  sgRNA
  Il12rb2_19
gccatcaggagattatccgt

SEQ ID NO: 27703 - DNA, 20 bp, Artificial Sequence
  sgRNA
  Il12rb2_20
atactacaagacacacctcc

SEQ ID NO: 27704 - DNA, 20 bp, Artificial Sequence
  sgRNA
  Il13ra1_1
tctgcacgataatatggacg

SEQ ID NO: 27705 - DNA, 20 bp, Artificial Sequence
  sgRNA
  Il13ra1_2
ttgtatctgttaccttcagg

SEQ ID NO: 27706 - DNA, 20 bp, Artificial Sequence
  sgRNA
  Il13ra1_3
gagaaaatctgtctgcaggt

SEQ ID NO: 27707 - DNA, 20 bp, Artificial Sequence
  sgRNA
  Il13ra1_4
acagagtatagtgtgtgtca

SEQ ID NO: 27708 - DNA, 20 bp, Artificial Sequence
  sgRNA
  Il13ra1_5
gctactgtggaccgccaccg

SEQ ID NO: 27709 - DNA, 20 bp, Artificial Sequence
  sgRNA
  Il13ra1_6
tctgactgtgtagacagcgt

SEQ ID NO: 27710 - DNA, 20 bp, Artificial Sequence
  sgRNA
  Il13ra1_7
tcgtaaagaggaattacccc

SEQ ID NO: 27711 - DNA, 20 bp, Artificial Sequence
  sgRNA
  Il13ra1_8
cagcgtcggcaagaacacca

SEQ ID NO: 27712 - DNA, 20 bp, Artificial Sequence
  sgRNA
  Il13ra1_9
gcacttgagctcagtcacag

SEQ ID NO: 27713 - DNA, 20 bp, Artificial Sequence
  sgRNA
  Il13ra1_10
gctttgatgacaacaaactg

SEQ ID NO: 27714 - DNA, 20 bp, Artificial Sequence
  sgRNA
  Il13ra1_11
gagacgctcaaattcgtcac

SEQ ID NO: 27715 - DNA, 20 bp, Artificial Sequence
  sgRNA
  Il13ra1_12
acgctcaaattcgtcacagg

SEQ ID NO: 27716 - DNA, 20 bp, Artificial Sequence
  sgRNA
  Il13ra1_13
tggaatggtgagtaacatgg

SEQ ID NO: 27717 - DNA, 20 bp, Artificial Sequence
  sgRNA
  Il13ra1_14
aggaacacttcatatagctc

SEQ ID NO: 27718 - DNA, 20 bp, Artificial Sequence
  sgRNA
  Il13ra1_15
caccgtgggccaagttgccg

SEQ ID NO: 27719 - DNA, 20 bp, Artificial Sequence
  sgRNA
  Il13ra1_16
agaagatgtttaatatgtgg

SEQ ID NO: 27720 - DNA, 20 bp, Artificial Sequence
  sgRNA
  Il13ra1_17
aagtgcatctcaccccctga

SEQ ID NO: 27721 - DNA, 20 bp, Artificial Sequence
  sgRNA
  Il13ra1_18
actgccactgcgacaaagac

SEQ ID NO: 27722 - DNA, 20 bp, Artificial Sequence
  sgRNA
  Il13ra1_19
tccagaaactcatcgtaaag

SEQ ID NO: 27723 - DNA, 20 bp, Artificial Sequence
  sgRNA
  Il13ra1_20
ttgccaggatcaggaattgg

SEQ ID NO: 27724 - DNA, 20 bp, Artificial Sequence
  sgRNA
  Il13ra2_1
atagtctgatgagtccaagt

SEQ ID NO: 27725 - DNA, 20 bp, Artificial Sequence
  sgRNA
  Il13ra2_2
tcttatgggatatcagatga

SEQ ID NO: 27726 - DNA, 20 bp, Artificial Sequence
  sgRNA
  Il13ra2_3
ctaatatgaaggaattctgg

SEQ ID NO: 27727 - DNA, 20 bp, Artificial Sequence
  sgRNA
  Il13ra2_4
tactaggaatctaatttaca

SEQ ID NO: 27728 - DNA, 20 bp, Artificial Sequence
  sgRNA
  Il13ra2_5
gatcagaagtacaaagtcca

SEQ ID NO: 27729 - DNA, 20 bp, Artificial Sequence
  sgRNA
  Il13ra2_6
gaaatgttgatagcgacagc

SEQ ID NO: 27730 - DNA, 20 bp, Artificial Sequence
  sgRNA
  Il13ra2_7
tgaagtgtatatattataac

SEQ ID NO: 27731 - DNA, 20 bp, Artificial Sequence
  sgRNA
  Il13ra2_8
atttcataagtgtaacacct

SEQ ID NO: 27732 - DNA, 20 bp, Artificial Sequence
  sgRNA
  Il13ra2_9
tcataagtgtaacaccttgg

SEQ ID NO: 27733 - DNA, 20 bp, Artificial Sequence
  sgRNA
  Il13ra2_10
gtggttatagaaaaatttaa

SEQ ID NO: 27734 - DNA, 20 bp, Artificial Sequence
  sgRNA
  Il13ra2_11
tttgcaatggaaacctcctg

SEQ ID NO: 27735 - DNA, 20 bp, Artificial Sequence
  sgRNA
  Il13ra2_12
atgaaatggagcacacctgg

SEQ ID NO: 27736 - DNA, 20 bp, Artificial Sequence
  sgRNA
  Il13ra2_13
aattctccacactaatatga

SEQ ID NO: 27737 - DNA, 20 bp, Artificial Sequence
  sgRNA
  Il13ra2_14
ctttgttcagatccacatgg

SEQ ID NO: 27738 - DNA, 20 bp, Artificial Sequence
  sgRNA
  Il13ra2_15
agctgtcgctatcaacattt

SEQ ID NO: 27739 - DNA, 20 bp, Artificial Sequence
  sgRNA
  Il13ra2_16
tgaaggaattctggtggcaa

SEQ ID NO: 27740 - DNA, 20 bp, Artificial Sequence
  sgRNA
  Il13ra2_17
tacatcttacaaaaaagcat

SEQ ID NO: 27741 - DNA, 20 bp, Artificial Sequence
  sgRNA
  Il13ra2_18
agaattccttcatattagtg

SEQ ID NO: 27742 - DNA, 20 bp, Artificial Sequence
  sgRNA
  Il13ra2_19
aatatttcaaaatcctgagg

SEQ ID NO: 27743 - DNA, 20 bp, Artificial Sequence
  sgRNA
  Il13ra2_20
cttctttgttcagatccaca

SEQ ID NO: 27744 - DNA, 20 bp, Artificial Sequence
  sgRNA
  Il15ra_1
agatacgggaggtggacacg

SEQ ID NO: 27745 - DNA, 20 bp, Artificial Sequence
  sgRNA
  Il15ra_2
gttgatcacacactcaatca

SEQ ID NO: 27746 - DNA, 20 bp, Artificial Sequence
  sgRNA
  Il15ra_3
acagagacagctattatgcc

SEQ ID NO: 27747 - DNA, 20 bp, Artificial Sequence
  sgRNA
  Il15ra_4
tcacactgtaattcttgacc

SEQ ID NO: 27748 - DNA, 20 bp, Artificial Sequence
  sgRNA
  Il15ra_5
gcatgctcaatagatacggg

SEQ ID NO: 27749 - DNA, 20 bp, Artificial Sequence
  sgRNA
  Il15ra_6
gctgtgtgtaaccgatgaca

SEQ ID NO: 27750 - DNA, 20 bp, Artificial Sequence
  sgRNA
  Il15ra_7
gatcacacactcaatcaggg

SEQ ID NO: 27751 - DNA, 20 bp, Artificial Sequence
  sgRNA
  Il15ra_8
gttacagacatacctctccc

SEQ ID NO: 27752 - DNA, 20 bp, Artificial Sequence
  sgRNA
  Il15ra_9
cactggactgtagtgagcta

SEQ ID NO: 27753 - DNA, 20 bp, Artificial Sequence
  sgRNA
  Il15ra_10
ccatggtttccacctcaaca

SEQ ID NO: 27754 - DNA, 20 bp, Artificial Sequence
  sgRNA
  Il15ra_11
tggcctggactccatagccc

SEQ ID NO: 27755 - DNA, 20 bp, Artificial Sequence
  sgRNA
  Il15ra_12
tgttatcctgagggaggtgg

SEQ ID NO: 27756 - DNA, 20 bp, Artificial Sequence
  sgRNA
  Il15ra_13
actccatagccccggagctg

SEQ ID NO: 27757 - DNA, 20 bp, Artificial Sequence
  sgRNA
  Il15ra_14
gccaacagtagtgacaccaa

SEQ ID NO: 27758 - DNA, 20 bp, Artificial Sequence
  sgRNA
  Il15ra_15
tctacatcggtcctcttggt

SEQ ID NO: 27759 - DNA, 20 bp, Artificial Sequence
  sgRNA
  Il15ra_16
gtttccacctcaacacggca

SEQ ID NO: 27760 - DNA, 20 bp, Artificial Sequence
  sgRNA
  Il15ra_17
caacccctgcaccaaccaag

SEQ ID NO: 27761 - DNA, 20 bp, Artificial Sequence
  sgRNA
  Il15ra_18
tctggctgtgaggtcacctt

SEQ ID NO: 27762 - DNA, 20 bp, Artificial Sequence
  sgRNA
  Il15ra_19
tcattgttgctgcaagagat

SEQ ID NO: 27763 - DNA, 20 bp, Artificial Sequence
  sgRNA
  Il15ra_20
ctacagcctccacctccctc

SEQ ID NO: 27764 - DNA, 20 bp, Artificial Sequence
  sgRNA
  Il17ra_1
actgaagtagcaaacaacgt

SEQ ID NO: 27765 - DNA, 20 bp, Artificial Sequence
  sgRNA
  Il17ra_2
atgaggccatacacccacag

SEQ ID NO: 27766 - DNA, 20 bp, Artificial Sequence
  sgRNA
  Il17ra_3
gaaggtctggatcgtctact

SEQ ID NO: 27767 - DNA, 20 bp, Artificial Sequence
  sgRNA
  Il17ra_4
gacctggagatgtttgaacc

SEQ ID NO: 27768 - DNA, 20 bp, Artificial Sequence
  sgRNA
  Il17ra_5
gttctcacgctcgaaccagt

SEQ ID NO: 27769 - DNA, 20 bp, Artificial Sequence
  sgRNA
  Il17ra_6
ggaccacctccacatagagg

SEQ ID NO: 27770 - DNA, 20 bp, Artificial Sequence
  sgRNA
  Il17ra_7
tctgacatggtgcatccggc

SEQ ID NO: 27771 - DNA, 20 bp, Artificial Sequence
  sgRNA
  Il17ra_8
gggggtggattcattccaca

SEQ ID NO: 27772 - DNA, 20 bp, Artificial Sequence
  sgRNA
  Il17ra_9
gccagcatcctgtacctcga

SEQ ID NO: 27773 - DNA, 20 bp, Artificial Sequence
  sgRNA
  Il17ra_10
tggagatgtttgaacccggc

SEQ ID NO: 27774 - DNA, 20 bp, Artificial Sequence
  sgRNA
  Il17ra_11
tgggagctcgagaagaaccc

SEQ ID NO: 27775 - DNA, 20 bp, Artificial Sequence
  sgRNA
  Il17ra_12
tctcacgctcgaaccagtcg

SEQ ID NO: 27776 - DNA, 20 bp, Artificial Sequence
  sgRNA
  Il17ra_13
tgtttgacaattcctccccc

SEQ ID NO: 27777 - DNA, 20 bp, Artificial Sequence
  sgRNA
  Il17ra_14
tttaggcagctgctgaagaa

SEQ ID NO: 27778 - DNA, 20 bp, Artificial Sequence
  sgRNA
  Il17ra_15
tgatcatctgtatgacctgg

SEQ ID NO: 27779 - DNA, 20 bp, Artificial Sequence
  sgRNA
  Il17ra_16
gctccaagctgttccagcca

SEQ ID NO: 27780 - DNA, 20 bp, Artificial Sequence
  sgRNA
  Il17ra_17
aggaccacctccacatagag

SEQ ID NO: 27781 - DNA, 20 bp, Artificial Sequence
  sgRNA
  Il17ra_18
cagtcggtgcagtcggacca

SEQ ID NO: 27782 - DNA, 20 bp, Artificial Sequence
  sgRNA
  Il17ra_19
agtgtttcctctacccagca

SEQ ID NO: 27783 - DNA, 20 bp, Artificial Sequence
  sgRNA
  Il17ra_20
agataacctgctcttccagg

SEQ ID NO: 27784 - DNA, 20 bp, Artificial Sequence
  sgRNA
  Il17rb_1
ggaactcgtcaagacaagtg

SEQ ID NO: 27785 - DNA, 20 bp, Artificial Sequence
  sgRNA
  Il17rb_2
ttcaacgggacacgacattg

SEQ ID NO: 27786 - DNA, 20 bp, Artificial Sequence
  sgRNA
  Il17rb_3
gcacaactgtcccttcgcgt

SEQ ID NO: 27787 - DNA, 20 bp, Artificial Sequence
  sgRNA
  Il17rb_4
ctccacagggaagcctacat

SEQ ID NO: 27788 - DNA, 20 bp, Artificial Sequence
  sgRNA
  Il17rb_5
gaaaacacagaagtaacgtc

SEQ ID NO: 27789 - DNA, 20 bp, Artificial Sequence
  sgRNA
  Il17rb_6
tgtgaggtgcaactacacag

SEQ ID NO: 27790 - DNA, 20 bp, Artificial Sequence
  sgRNA
  Il17rb_7
gatacacgattctcattcaa

SEQ ID NO: 27791 - DNA, 20 bp, Artificial Sequence
  sgRNA
  Il17rb_8
atgactgcatccgacgcgaa

SEQ ID NO: 27792 - DNA, 20 bp, Artificial Sequence
  sgRNA
  Il17rb_9
tcttgacgagttccacttgg

SEQ ID NO: 27793 - DNA, 20 bp, Artificial Sequence
  sgRNA
  Il17rb_10
tcttggtggccttcaacaag

SEQ ID NO: 27794 - DNA, 20 bp, Artificial Sequence
  sgRNA
  Il17rb_11
cccccaatatcatctcatga

SEQ ID NO: 27795 - DNA, 20 bp, Artificial Sequence
  sgRNA
  Il17rb_12
agagagtgctcagctccaca

SEQ ID NO: 27796 - DNA, 20 bp, Artificial Sequence
  sgRNA
  Il17rb_13
aatttcacaaccaatcccct

SEQ ID NO: 27797 - DNA, 20 bp, Artificial Sequence
  sgRNA
  Il17rb_14
tagccttgagaagttctgtg

SEQ ID NO: 27798 - DNA, 20 bp, Artificial Sequence
  sgRNA
  Il17rb_15
accccatatttacatacctg

SEQ ID NO: 27799 - DNA, 20 bp, Artificial Sequence
  sgRNA
  Il17rb_16
ctcctatgtaggcttccctg

SEQ ID NO: 27800 - DNA, 20 bp, Artificial Sequence
  sgRNA
  Il17rb_17
ccacaatgagggcagcgcca

SEQ ID NO: 27801 - DNA, 20 bp, Artificial Sequence
  sgRNA
  Il17rb_18
tctgtgaacttcacctcgcc

SEQ ID NO: 27802 - DNA, 20 bp, Artificial Sequence
  sgRNA
  Il17rb_19
tcaaaactactgcagaagtg

SEQ ID NO: 27803 - DNA, 20 bp, Artificial Sequence
  sgRNA
  Il17rb_20
ccttcatgagatgatattgg

SEQ ID NO: 27804 - DNA, 20 bp, Artificial Sequence
  sgRNA
  Il17rc_1
ctgtggaacgatgacaacat

SEQ ID NO: 27805 - DNA, 20 bp, Artificial Sequence
  sgRNA
  Il17rc_2
agcaatacttaccccagagg

SEQ ID NO: 27806 - DNA, 20 bp, Artificial Sequence
  sgRNA
  Il17rc_3
ggagccacaagatttccagt

SEQ ID NO: 27807 - DNA, 20 bp, Artificial Sequence
  sgRNA
  Il17rc_4
atctagctgccatacccctg

SEQ ID NO: 27808 - DNA, 20 bp, Artificial Sequence
  sgRNA
  Il17rc_5
gaggctgctccacttccgcg

SEQ ID NO: 27809 - DNA, 20 bp, Artificial Sequence
  sgRNA
  Il17rc_6
gtagaccccgacgtagcggc

SEQ ID NO: 27810 - DNA, 20 bp, Artificial Sequence
  sgRNA
  Il17rc_7
cgaagtagaccccgacgtag

SEQ ID NO: 27811 - DNA, 20 bp, Artificial Sequence
  sgRNA
  Il17rc_8
tctgtagacacattgagcca

SEQ ID NO: 27812 - DNA, 20 bp, Artificial Sequence
  sgRNA
  Il17rc_9
ccactgctgacactgcgcca

SEQ ID NO: 27813 - DNA, 20 bp, Artificial Sequence
  sgRNA
  Il17rc_10
cctgggtcactcgttccacc

SEQ ID NO: 27814 - DNA, 20 bp, Artificial Sequence
  sgRNA
  Il17rc_11
cagtggcatctggctcaacg

SEQ ID NO: 27815 - DNA, 20 bp, Artificial Sequence
  sgRNA
  Il17rc_12
cggatgctctcaaatccttg

SEQ ID NO: 27816 - DNA, 20 bp, Artificial Sequence
  sgRNA
  Il17rc_13
gctttcctggatgcactgca

SEQ ID NO: 27817 - DNA, 20 bp, Artificial Sequence
  sgRNA
  Il17rc_14
ttaccacgccaccctcctgc

SEQ ID NO: 27818 - DNA, 20 bp, Artificial Sequence
  sgRNA
  Il17rc_15
gatgccactgcgcgtggccg

SEQ ID NO: 27819 - DNA, 20 bp, Artificial Sequence
  sgRNA
  Il17rc_16
gtgctacccgatttcctgca

SEQ ID NO: 27820 - DNA, 20 bp, Artificial Sequence
  sgRNA
  Il17rc_17
ggacagctgtacttctagct

SEQ ID NO: 27821 - DNA, 20 bp, Artificial Sequence
  sgRNA
  Il17rc_18
gctagagccagactctgaga

SEQ ID NO: 27822 - DNA, 20 bp, Artificial Sequence
  sgRNA
  Il17rc_19
ttgctcctccactccgccga

SEQ ID NO: 27823 - DNA, 20 bp, Artificial Sequence
  sgRNA
  Il17rc_20
ggtgcagcctggtcagtccg

SEQ ID NO: 27824 - DNA, 20 bp, Artificial Sequence
  sgRNA
  Il17rd_1
tggccagaatcacatgaacg

SEQ ID NO: 27825 - DNA, 20 bp, Artificial Sequence
  sgRNA
  Il17rd_2
cttcccgccgggattcaagt

SEQ ID NO: 27826 - DNA, 20 bp, Artificial Sequence
  sgRNA
  Il17rd_3
actcgccttgcgcctcgccg

SEQ ID NO: 27827 - DNA, 20 bp, Artificial Sequence
  sgRNA
  Il17rd_4
cctccaaaacgtttctccag

SEQ ID NO: 27828 - DNA, 20 bp, Artificial Sequence
  sgRNA
  Il17rd_5
gtacgcttgccacgaccagg

SEQ ID NO: 27829 - DNA, 20 bp, Artificial Sequence
  sgRNA
  Il17rd_6
accacctacttgaatcccgg

SEQ ID NO: 27830 - DNA, 20 bp, Artificial Sequence
  sgRNA
  Il17rd_7
gctttcactgcgtgtaacag

SEQ ID NO: 27831 - DNA, 20 bp, Artificial Sequence
  sgRNA
  Il17rd_8
acggaagccgaagttctgcg

SEQ ID NO: 27832 - DNA, 20 bp, Artificial Sequence
  sgRNA
  Il17rd_9
gcaatcgcatgcttcccgcc

SEQ ID NO: 27833 - DNA, 20 bp, Artificial Sequence
  sgRNA
  Il17rd_10
ggagtcgtccacatacgctg

SEQ ID NO: 27834 - DNA, 20 bp, Artificial Sequence
  sgRNA
  Il17rd_11
atgatgtcataagcaaacca

SEQ ID NO: 27835 - DNA, 20 bp, Artificial Sequence
  sgRNA
  Il17rd_12
tgacttctgtcggaaagtcg

SEQ ID NO: 27836 - DNA, 20 bp, Artificial Sequence
  sgRNA
  Il17rd_13
aggattccgagtcatcctgg

SEQ ID NO: 27837 - DNA, 20 bp, Artificial Sequence
  sgRNA
  Il17rd_14
gcaaggcgagttcttcctgg

SEQ ID NO: 27838 - DNA, 20 bp, Artificial Sequence
  sgRNA
  Il17rd_15
ccacctacttgaatcccggc

SEQ ID NO: 27839 - DNA, 20 bp, Artificial Sequence
  sgRNA
  Il17rd_16
ctggaggagctgaagtcgga

SEQ ID NO: 27840 - DNA, 20 bp, Artificial Sequence
  sgRNA
  Il17rd_17
tctgcacatcacagtgaaca

SEQ ID NO: 27841 - DNA, 20 bp, Artificial Sequence
  sgRNA
  Il17rd_18
gagtcccgtggcatctctga

SEQ ID NO: 27842 - DNA, 20 bp, Artificial Sequence
  sgRNA
  Il17rd_19
ataagagtcggctggcccag

SEQ ID NO: 27843 - DNA, 20 bp, Artificial Sequence
  sgRNA
  Il17rd_20
gaccatgccccgcagaactt

SEQ ID NO: 27844 - DNA, 20 bp, Artificial Sequence
  sgRNA
  Il17re_1
ccagtgcccactgataacaa

SEQ ID NO: 27845 - DNA, 20 bp, Artificial Sequence
  sgRNA
  Il17re_2
ccagcacaatcagatggtca

SEQ ID NO: 27846 - DNA, 20 bp, Artificial Sequence
  sgRNA
  Il17re_3
tctgccctgcatgtgcatag

SEQ ID NO: 27847 - DNA, 20 bp, Artificial Sequence
  sgRNA
  Il17re_4
gcaggaccttaccacacggt

SEQ ID NO: 27848 - DNA, 20 bp, Artificial Sequence
  sgRNA
  Il17re_5
tcacgaagcaggcggtagcg

SEQ ID NO: 27849 - DNA, 20 bp, Artificial Sequence
  sgRNA
  Il17re_6
tctctcccgctactgctcat

SEQ ID NO: 27850 - DNA, 20 bp, Artificial Sequence
  sgRNA
  Il17re_7
tcaagcaccgcttagcccca

SEQ ID NO: 27851 - DNA, 20 bp, Artificial Sequence
  sgRNA
  Il17re_8
gcgttgggaagggtttcgca

SEQ ID NO: 27852 - DNA, 20 bp, Artificial Sequence
  sgRNA
  Il17re_9
tagcgtggcagagcgcgcag

SEQ ID NO: 27853 - DNA, 20 bp, Artificial Sequence
  sgRNA
  Il17re_10
gcggtgcttgaaaaaccgtc

SEQ ID NO: 27854 - DNA, 20 bp, Artificial Sequence
  sgRNA
  Il17re_11
gcgccaaaggtgacatcccc

SEQ ID NO: 27855 - DNA, 20 bp, Artificial Sequence
  sgRNA
  Il17re_12
gctgaaaccacagggactat

SEQ ID NO: 27856 - DNA, 20 bp, Artificial Sequence
  sgRNA
  Il17re_13
ctacagccagcacaatcaga

SEQ ID NO: 27857 - DNA, 20 bp, Artificial Sequence
  sgRNA
  Il17re_14
tttggccgaactgctgcgga

SEQ ID NO: 27858 - DNA, 20 bp, Artificial Sequence
  sgRNA
  Il17re_15
gcgaggccgatgagcagtag

SEQ ID NO: 27859 - DNA, 20 bp, Artificial Sequence
  sgRNA
  Il17re_16
cctacatgcagcggactcag

SEQ ID NO: 27860 - DNA, 20 bp, Artificial Sequence
  sgRNA
  Il17re_17
gttcggccaaagctcccacc

SEQ ID NO: 27861 - DNA, 20 bp, Artificial Sequence
  sgRNA
  Il17re_18
ctgtctcctggcctaccgtg

SEQ ID NO: 27862 - DNA, 20 bp, Artificial Sequence
  sgRNA
  Il17re_19
cagaggccaacgcaccaaaa

SEQ ID NO: 27863 - DNA, 20 bp, Artificial Sequence
  sgRNA
  Il17re_20
tgtgcgcctttgttatcagt

SEQ ID NO: 27864 - DNA, 20 bp, Artificial Sequence
  sgRNA
  Il18r1_1
tcaccgatcacaaattcatg

SEQ ID NO: 27865 - DNA, 20 bp, Artificial Sequence
  sgRNA
  Il18r1_2
ctgtccaccataatgggaca

SEQ ID NO: 27866 - DNA, 20 bp, Artificial Sequence
  sgRNA
  Il18r1_3
attctggccagttgagatgg

SEQ ID NO: 27867 - DNA, 20 bp, Artificial Sequence
  sgRNA
  Il18r1_4
tgtcaacttctatctaggaa

SEQ ID NO: 27868 - DNA, 20 bp, Artificial Sequence
  sgRNA
  Il18r1_5
tctgttctataggcgcatag

SEQ ID NO: 27869 - DNA, 20 bp, Artificial Sequence
  sgRNA
  Il18r1_6
ctaccacatgaatttgtgat

SEQ ID NO: 27870 - DNA, 20 bp, Artificial Sequence
  sgRNA
  Il18r1_7
tcaggagtttcagcgacggg

SEQ ID NO: 27871 - DNA, 20 bp, Artificial Sequence
  sgRNA
  Il18r1_8
tcctctctaccagtgcttcg

SEQ ID NO: 27872 - DNA, 20 bp, Artificial Sequence
  sgRNA
  Il18r1_9
tgctgtggagacgttaccca

SEQ ID NO: 27873 - DNA, 20 bp, Artificial Sequence
  sgRNA
  Il18r1_10
gtagccctcatctccaaact

SEQ ID NO: 27874 - DNA, 20 bp, Artificial Sequence
  sgRNA
  Il18r1_11
gagtggactccacgaagcac

SEQ ID NO: 27875 - DNA, 20 bp, Artificial Sequence
  sgRNA
  Il18r1_12
agtcctacagagttctaaaa

SEQ ID NO: 27876 - DNA, 20 bp, Artificial Sequence
  sgRNA
  Il18r1_13
tatggcttcttcgttggcca

SEQ ID NO: 27877 - DNA, 20 bp, Artificial Sequence
  sgRNA
  Il18r1_14
gcctttgaaccatctcatgg

SEQ ID NO: 27878 - DNA, 20 bp, Artificial Sequence
  sgRNA
  Il18r1_15
cactgatagagaaaagccgg

SEQ ID NO: 27879 - DNA, 20 bp, Artificial Sequence
  sgRNA
  Il18r1_16
ccaggccatgtctttacagg

SEQ ID NO: 27880 - DNA, 20 bp, Artificial Sequence
  sgRNA
  Il18r1_17
cagaaccttgagttcatgga

SEQ ID NO: 27881 - DNA, 20 bp, Artificial Sequence
  sgRNA
  Il18r1_18
ggaacgtacatttctcaagt

SEQ ID NO: 27882 - DNA, 20 bp, Artificial Sequence
  sgRNA
  Il18r1_19
ccgcaaaagccgtcaagcca

SEQ ID NO: 27883 - DNA, 20 bp, Artificial Sequence
  sgRNA
  Il18r1_20
ggaccaaagtgtgagaaggt

SEQ ID NO: 27884 - DNA, 20 bp, Artificial Sequence
  sgRNA
  Il18rap_1
tggtacatgcaacctcggag

SEQ ID NO: 27885 - DNA, 20 bp, Artificial Sequence
  sgRNA
  Il18rap_2
ctgtggacatattctgcaag

SEQ ID NO: 27886 - DNA, 20 bp, Artificial Sequence
  sgRNA
  Il18rap_3
caacacggaccatacggctg

SEQ ID NO: 27887 - DNA, 20 bp, Artificial Sequence
  sgRNA
  Il18rap_4
ttcctggacagtccgagctg

SEQ ID NO: 27888 - DNA, 20 bp, Artificial Sequence
  sgRNA
  Il18rap_5
tctagtggacttccactccg

SEQ ID NO: 27889 - DNA, 20 bp, Artificial Sequence
  sgRNA
  Il18rap_6
ggaacacaacacggaccata

SEQ ID NO: 27890 - DNA, 20 bp, Artificial Sequence
  sgRNA
  Il18rap_7
gctttgcccagaactccatt

SEQ ID NO: 27891 - DNA, 20 bp, Artificial Sequence
  sgRNA
  Il18rap_8
ggtccgtgttgtgttcccaa

SEQ ID NO: 27892 - DNA, 20 bp, Artificial Sequence
  sgRNA
  Il18rap_9
aggagagctccaattcgagt

SEQ ID NO: 27893 - DNA, 20 bp, Artificial Sequence
  sgRNA
  Il18rap_10
cctgctcacaaaccttgcag

SEQ ID NO: 27894 - DNA, 20 bp, Artificial Sequence
  sgRNA
  Il18rap_11
gcttgtagctcaaagacacg

SEQ ID NO: 27895 - DNA, 20 bp, Artificial Sequence
  sgRNA
  Il18rap_12
actccattgggaacacaaca

SEQ ID NO: 27896 - DNA, 20 bp, Artificial Sequence
  sgRNA
  Il18rap_13
gatacactggacgtagagct

SEQ ID NO: 27897 - DNA, 20 bp, Artificial Sequence
  sgRNA
  Il18rap_14
gttgcaggagagaagaccac

SEQ ID NO: 27898 - DNA, 20 bp, Artificial Sequence
  sgRNA
  Il18rap_15
ggatcccattacagatacac

SEQ ID NO: 27899 - DNA, 20 bp, Artificial Sequence
  sgRNA
  Il18rap_16
agcagcagtgaatcttgcct

SEQ ID NO: 27900 - DNA, 20 bp, Artificial Sequence
  sgRNA
  Il18rap_17
ggcacggccttgatgctggt

SEQ ID NO: 27901 - DNA, 20 bp, Artificial Sequence
  sgRNA
  Il18rap_18
ggtaacttctctcaagaaga

SEQ ID NO: 27902 - DNA, 20 bp, Artificial Sequence
  sgRNA
  Il18rap_19
cttgaccgagatgtgacccc

SEQ ID NO: 27903 - DNA, 20 bp, Artificial Sequence
  sgRNA
  Il18rap_20
aggacctatctgatgtccag

SEQ ID NO: 27904 - DNA, 20 bp, Artificial Sequence
  sgRNA
  Il1r1_1
agcatacaattgtagccgtg

SEQ ID NO: 27905 - DNA, 20 bp, Artificial Sequence
  sgRNA
  Il1r1_2
cagcaagacccccatatcag

SEQ ID NO: 27906 - DNA, 20 bp, Artificial Sequence
  sgRNA
  Il1r1_3
cgtatgtcctatacgttccg

SEQ ID NO: 27907 - DNA, 20 bp, Artificial Sequence
  sgRNA
  Il1r1_4
actgtgttagagaatgaccc

SEQ ID NO: 27908 - DNA, 20 bp, Artificial Sequence
  sgRNA
  Il1r1_5
gtatgtcctatacgttccgg

SEQ ID NO: 27909 - DNA, 20 bp, Artificial Sequence
  sgRNA
  Il1r1_6
cttcgatcgtctcattccga

SEQ ID NO: 27910 - DNA, 20 bp, Artificial Sequence
  sgRNA
  Il1r1_7
acagcggctccacattgccg

SEQ ID NO: 27911 - DNA, 20 bp, Artificial Sequence
  sgRNA
  Il1r1_8
tgaaaataatgagttacccg

SEQ ID NO: 27912 - DNA, 20 bp, Artificial Sequence
  sgRNA
  Il1r1_9
gcttcgatcgtctcattccg

SEQ ID NO: 27913 - DNA, 20 bp, Artificial Sequence
  sgRNA
  Il1r1_10
gagacgatcgaagctgaccc

SEQ ID NO: 27914 - DNA, 20 bp, Artificial Sequence
  sgRNA
  Il1r1_11
cttactccaaataaaatgca

SEQ ID NO: 27915 - DNA, 20 bp, Artificial Sequence
  sgRNA
  Il1r1_12
agacaatggtgatctccgtt

SEQ ID NO: 27916 - DNA, 20 bp, Artificial Sequence
  sgRNA
  Il1r1_13
ggacactaaggagaaactgc

SEQ ID NO: 27917 - DNA, 20 bp, Artificial Sequence
  sgRNA
  Il1r1_14
gtgtgctgtaacacaagcca

SEQ ID NO: 27918 - DNA, 20 bp, Artificial Sequence
  sgRNA
  Il1r1_15
agtcccggtccgctgatatg

SEQ ID NO: 27919 - DNA, 20 bp, Artificial Sequence
  sgRNA
  Il1r1_16
agtgtcccgcacaggatcca

SEQ ID NO: 27920 - DNA, 20 bp, Artificial Sequence
  sgRNA
  Il1r1_17
agtggtaagtgtgttgctgc

SEQ ID NO: 27921 - DNA, 20 bp, Artificial Sequence
  sgRNA
  Il1r1_18
ttatcccaagaccctgggag

SEQ ID NO: 27922 - DNA, 20 bp, Artificial Sequence
  sgRNA
  Il1r1_19
gtttgtacctgccaaggtgg

SEQ ID NO: 27923 - DNA, 20 bp, Artificial Sequence
  sgRNA
  Il1r1_20
agaaacacggagtcatttgc

SEQ ID NO: 27924 - DNA, 20 bp, Artificial Sequence
  sgRNA
  Il1r2_1
tgtcggagtgaggtgccaag

SEQ ID NO: 27925 - DNA, 20 bp, Artificial Sequence
  sgRNA
  Il1r2_2
agggcacactagtaacccgg

SEQ ID NO: 27926 - DNA, 20 bp, Artificial Sequence
  sgRNA
  Il1r2_3
gactatcagtcttgaccctg

SEQ ID NO: 27927 - DNA, 20 bp, Artificial Sequence
  sgRNA
  Il1r2_4
gggcttctccgatgtaatgg

SEQ ID NO: 27928 - DNA, 20 bp, Artificial Sequence
  sgRNA
  Il1r2_5
gcgcagacggtgtaaacgca

SEQ ID NO: 27929 - DNA, 20 bp, Artificial Sequence
  sgRNA
  Il1r2_6
gtaatagcctgcatcgtcca

SEQ ID NO: 27930 - DNA, 20 bp, Artificial Sequence
  sgRNA
  Il1r2_7
aatgtgttgcctcgaatcca

SEQ ID NO: 27931 - DNA, 20 bp, Artificial Sequence
  sgRNA
  Il1r2_8
gttagccaaccaccacacaa

SEQ ID NO: 27932 - DNA, 20 bp, Artificial Sequence
  sgRNA
  Il1r2_9
acgctgatggaaagatacag

SEQ ID NO: 27933 - DNA, 20 bp, Artificial Sequence
  sgRNA
  Il1r2_10
attgatatccaacacgtcca

SEQ ID NO: 27934 - DNA, 20 bp, Artificial Sequence
  sgRNA
  Il1r2_11
gttcccagaaacactttgca

SEQ ID NO: 27935 - DNA, 20 bp, Artificial Sequence
  sgRNA
  Il1r2_12
catatggactgaccaagcta

SEQ ID NO: 27936 - DNA, 20 bp, Artificial Sequence
  sgRNA
  Il1r2_13
gtcagggcacactagtaacc

SEQ ID NO: 27937 - DNA, 20 bp, Artificial Sequence
  sgRNA
  Il1r2_14
tgatcccaagagatgagcca

SEQ ID NO: 27938 - DNA, 20 bp, Artificial Sequence
  sgRNA
  Il1r2_15
gcacactagtaacccggtgg

SEQ ID NO: 27939 - DNA, 20 bp, Artificial Sequence
  sgRNA
  Il1r2_16
ttctgaatcccccattacat

SEQ ID NO: 27940 - DNA, 20 bp, Artificial Sequence
  sgRNA
  Il1r2_17
cttccaacaccattgtgtgg

SEQ ID NO: 27941 - DNA, 20 bp, Artificial Sequence
  sgRNA
  Il1r2_18
atctcggctgcttacccaag

SEQ ID NO: 27942 - DNA, 20 bp, Artificial Sequence
  sgRNA
  Il1r2_19
ccaagaggccgtgtgaccga

SEQ ID NO: 27943 - DNA, 20 bp, Artificial Sequence
  sgRNA
  Il1r2_20
ggtgtagcccctcggtcaca

SEQ ID NO: 27944 - DNA, 20 bp, Artificial Sequence
  sgRNA
  Il1rap_1
tacacagtagaactcgcctg

SEQ ID NO: 27945 - DNA, 20 bp, Artificial Sequence
  sgRNA
  Il1rap_2
tttcataatgtactacccga

SEQ ID NO: 27946 - DNA, 20 bp, Artificial Sequence
  sgRNA
  Il1rap_3
tggtccaccagacctcattg

SEQ ID NO: 27947 - DNA, 20 bp, Artificial Sequence
  sgRNA
  Il1rap_4
catcaagaaagtcaccccgg

SEQ ID NO: 27948 - DNA, 20 bp, Artificial Sequence
  sgRNA
  Il1rap_5
gttgcgcctgagatcctccg

SEQ ID NO: 27949 - DNA, 20 bp, Artificial Sequence
  sgRNA
  Il1rap_6
gcacgatgtccaagcaccga

SEQ ID NO: 27950 - DNA, 20 bp, Artificial Sequence
  sgRNA
  Il1rap_7
gtgcttggacatcgtgcccg

SEQ ID NO: 27951 - DNA, 20 bp, Artificial Sequence
  sgRNA
  Il1rap_8
gagcatcaagaaagtcaccc

SEQ ID NO: 27952 - DNA, 20 bp, Artificial Sequence
  sgRNA
  Il1rap_9
cttggagaggaggcttacag

SEQ ID NO: 27953 - DNA, 20 bp, Artificial Sequence
  sgRNA
  Il1rap_10
tcatgctcgaaataccaaag

SEQ ID NO: 27954 - DNA, 20 bp, Artificial Sequence
  sgRNA
  Il1rap_11
agtgaccgatggtttgacac

SEQ ID NO: 27955 - DNA, 20 bp, Artificial Sequence
  sgRNA
  Il1rap_12
gtaggtgacacagcagcgac

SEQ ID NO: 27956 - DNA, 20 bp, Artificial Sequence
  sgRNA
  Il1rap_13
gagaaatccaagtatcctca

SEQ ID NO: 27957 - DNA, 20 bp, Artificial Sequence
  sgRNA
  Il1rap_14
ggcacgatgtccaagcaccg

SEQ ID NO: 27958 - DNA, 20 bp, Artificial Sequence
  sgRNA
  Il1rap_15
agaacagctctcattccagc

SEQ ID NO: 27959 - DNA, 20 bp, Artificial Sequence
  sgRNA
  Il1rap_16
ggtccaccagacctcattgt

SEQ ID NO: 27960 - DNA, 20 bp, Artificial Sequence
  sgRNA
  Il1rap_17
aaacacttggatttgtcgca

SEQ ID NO: 27961 - DNA, 20 bp, Artificial Sequence
  sgRNA
  Il1rap_18
catctgttccaaagtgagct

SEQ ID NO: 27962 - DNA, 20 bp, Artificial Sequence
  sgRNA
  Il1rap_19
tccttccagtgtcaaaccat

SEQ ID NO: 27963 - DNA, 20 bp, Artificial Sequence
  sgRNA
  Il1rap_20
gctgccaaggtgaaacagaa

SEQ ID NO: 27964 - DNA, 20 bp, Artificial Sequence
  sgRNA
  Il1rapl1_1
ttgaaaatggaaacggacgt

SEQ ID NO: 27965 - DNA, 20 bp, Artificial Sequence
  sgRNA
  Il1rapl1_2
aatttcatgccgagacatag

SEQ ID NO: 27966 - DNA, 20 bp, Artificial Sequence
  sgRNA
  Il1rapl1_3
ccagtggaatcaagagactg

SEQ ID NO: 27967 - DNA, 20 bp, Artificial Sequence
  sgRNA
  Il1rapl1_4
caacattactacaggacagt

SEQ ID NO: 27968 - DNA, 20 bp, Artificial Sequence
  sgRNA
  Il1rapl1_5
attgaatgcagcgaactccg

SEQ ID NO: 27969 - DNA, 20 bp, Artificial Sequence
  sgRNA
  Il1rapl1_6
aggaattatgaactaccagg

SEQ ID NO: 27970 - DNA, 20 bp, Artificial Sequence
  sgRNA
  Il1rapl1_7
acaccgttgaacttgctgga

SEQ ID NO: 27971 - DNA, 20 bp, Artificial Sequence
  sgRNA
  Il1rapl1_8
gtaagtggcagggtgcccgt

SEQ ID NO: 27972 - DNA, 20 bp, Artificial Sequence
  sgRNA
  Il1rapl1_9
gatgcgtagatcaaagtaag

SEQ ID NO: 27973 - DNA, 20 bp, Artificial Sequence
  sgRNA
  Il1rapl1_10
ctttagatgtcagtgagcag

SEQ ID NO: 27974 - DNA, 20 bp, Artificial Sequence
  sgRNA
  Il1rapl1_11
catcctgccgttgttgccaa

SEQ ID NO: 27975 - DNA, 20 bp, Artificial Sequence
  sgRNA
  Il1rapl1_12
actgtcagtttactttccat

SEQ ID NO: 27976 - DNA, 20 bp, Artificial Sequence
  sgRNA
  Il1rapl1_13
acctgtgaattaaaatacgg

SEQ ID NO: 27977 - DNA, 20 bp, Artificial Sequence
  sgRNA
  Il1rapl1_14
ttaggtggcttatcagttag

SEQ ID NO: 27978 - DNA, 20 bp, Artificial Sequence
  sgRNA
  Il1rapl1_15
gcataccatcaagcttctga

SEQ ID NO: 27979 - DNA, 20 bp, Artificial Sequence
  sgRNA
  Il1rapl1_16
ctacttccatcaaaggcgat

SEQ ID NO: 27980 - DNA, 20 bp, Artificial Sequence
  sgRNA
  Il1rapl1_17
aagccctccagcaagttcaa

SEQ ID NO: 27981 - DNA, 20 bp, Artificial Sequence
  sgRNA
  Il1rapl1_18
ggtagaacggagatctggat

SEQ ID NO: 27982 - DNA, 20 bp, Artificial Sequence
  sgRNA
  Il1rapl1_19
acagttcaggagactcaact

SEQ ID NO: 27983 - DNA, 20 bp, Artificial Sequence
  sgRNA
  Il1rapl1_20
gtctccatctcactgacagt

SEQ ID NO: 27984 - DNA, 20 bp, Artificial Sequence
  sgRNA
  Il1rapl2_1
tttggactgtgacaatactg

SEQ ID NO: 27985 - DNA, 20 bp, Artificial Sequence
  sgRNA
  Il1rapl2_2
gaaagggatctcattccaag

SEQ ID NO: 27986 - DNA, 20 bp, Artificial Sequence
  sgRNA
  Il1rapl2_3
gtactcgtcatggcaattga

SEQ ID NO: 27987 - DNA, 20 bp, Artificial Sequence
  sgRNA
  Il1rapl2_4
gctcggcagagtctagaaca

SEQ ID NO: 27988 - DNA, 20 bp, Artificial Sequence
  sgRNA
  Il1rapl2_5
gcggatataactgtagaaaa

SEQ ID NO: 27989 - DNA, 20 bp, Artificial Sequence
  sgRNA
  Il1rapl2_6
tcccaagccattgttcccca

SEQ ID NO: 27990 - DNA, 20 bp, Artificial Sequence
  sgRNA
  Il1rapl2_7
ggctaattatacctgccatg

SEQ ID NO: 27991 - DNA, 20 bp, Artificial Sequence
  sgRNA
  Il1rapl2_8
ccagtagcagtataagtagt

SEQ ID NO: 27992 - DNA, 20 bp, Artificial Sequence
  sgRNA
  Il1rapl2_9
gtatctctcttacacaaaag

SEQ ID NO: 27993 - DNA, 20 bp, Artificial Sequence
  sgRNA
  Il1rapl2_10
ttgccactgacactactcaa

SEQ ID NO: 27994 - DNA, 20 bp, Artificial Sequence
  sgRNA
  Il1rapl2_11
agtgttatagatgtccagct

SEQ ID NO: 27995 - DNA, 20 bp, Artificial Sequence
  sgRNA
  Il1rapl2_12
gatgtcttagaaaaacacta

SEQ ID NO: 27996 - DNA, 20 bp, Artificial Sequence
  sgRNA
  Il1rapl2_13
ctgacctctgaaaagatgat

SEQ ID NO: 27997 - DNA, 20 bp, Artificial Sequence
  sgRNA
  Il1rapl2_14
gctttgcaagggatgttcag

SEQ ID NO: 27998 - DNA, 20 bp, Artificial Sequence
  sgRNA
  Il1rapl2_15
gtgtggtggttgcctaagga

SEQ ID NO: 27999 - DNA, 20 bp, Artificial Sequence
  sgRNA
  Il1rapl2_16
atccaaagaaagctttgcaa

SEQ ID NO: 28000 - DNA, 20 bp, Artificial Sequence
  sgRNA
  Il1rapl2_17
ttgagtgtacagaattaaaa

SEQ ID NO: 28001 - DNA, 20 bp, Artificial Sequence
  sgRNA
  Il1rapl2_18
cctttcatccagtagatcat

SEQ ID NO: 28002 - DNA, 20 bp, Artificial Sequence
  sgRNA
  Il1rapl2_19
agaagcataataatacagaa

SEQ ID NO: 28003 - DNA, 20 bp, Artificial Sequence
  sgRNA
  Il1rapl2_20
tgtccattgagtagtgtcag

SEQ ID NO: 28004 - DNA, 20 bp, Artificial Sequence
  sgRNA
  Il1rl1_1
cacttgtcaattcacacacg

SEQ ID NO: 28005 - DNA, 20 bp, Artificial Sequence
  sgRNA
  Il1rl1_2
accagttatccttaacactg

SEQ ID NO: 28006 - DNA, 20 bp, Artificial Sequence
  sgRNA
  Il1rl1_3
ttgatgtactcgacagtacg

SEQ ID NO: 28007 - DNA, 20 bp, Artificial Sequence
  sgRNA
  Il1rl1_4
aggacgctcgacttatcctg

SEQ ID NO: 28008 - DNA, 20 bp, Artificial Sequence
  sgRNA
  Il1rl1_5
gatactgctttccaccacgg

SEQ ID NO: 28009 - DNA, 20 bp, Artificial Sequence
  sgRNA
  Il1rl1_6
atgtatttgacagttacgga

SEQ ID NO: 28010 - DNA, 20 bp, Artificial Sequence
  sgRNA
  Il1rl1_7
gatgctggagagaatcttgc

SEQ ID NO: 28011 - DNA, 20 bp, Artificial Sequence
  sgRNA
  Il1rl1_8
tcagggatattgcagcttgg

SEQ ID NO: 28012 - DNA, 20 bp, Artificial Sequence
  sgRNA
  Il1rl1_9
aagcatgccttgccactcaa

SEQ ID NO: 28013 - DNA, 20 bp, Artificial Sequence
  sgRNA
  Il1rl1_10
ggccagacagtcatattcca

SEQ ID NO: 28014 - DNA, 20 bp, Artificial Sequence
  sgRNA
  Il1rl1_11
tggaaccaactacatcgtga

SEQ ID NO: 28015 - DNA, 20 bp, Artificial Sequence
  sgRNA
  Il1rl1_12
atttaccctcgggtcttccg

SEQ ID NO: 28016 - DNA, 20 bp, Artificial Sequence
  sgRNA
  Il1rl1_13
gcaggtccccaacctgtagt

SEQ ID NO: 28017 - DNA, 20 bp, Artificial Sequence
  sgRNA
  Il1rl1_14
ggtggccgtcacgatgtagt

SEQ ID NO: 28018 - DNA, 20 bp, Artificial Sequence
  sgRNA
  Il1rl1_15
atgcgtacatcatttaccct

SEQ ID NO: 28019 - DNA, 20 bp, Artificial Sequence
  sgRNA
  Il1rl1_16
ggaacttagagactgcttgt

SEQ ID NO: 28020 - DNA, 20 bp, Artificial Sequence
  sgRNA
  Il1rl1_17
tcctccatacaaccacacaa

SEQ ID NO: 28021 - DNA, 20 bp, Artificial Sequence
  sgRNA
  Il1rl1_18
gtatccagtcttattcaagt

SEQ ID NO: 28022 - DNA, 20 bp, Artificial Sequence
  sgRNA
  Il1rl1_19
tccgtaactgtcaaatacat

SEQ ID NO: 28023 - DNA, 20 bp, Artificial Sequence
  sgRNA
  Il1rl1_20
tcaggggaccatcaagtgga

SEQ ID NO: 28024 - DNA, 20 bp, Artificial Sequence
  sgRNA
  Il1rl2_1
tacatcattctgatataccc

SEQ ID NO: 28025 - DNA, 20 bp, Artificial Sequence
  sgRNA
  Il1rl2_2
gtaccgaatttgatccctca

SEQ ID NO: 28026 - DNA, 20 bp, Artificial Sequence
  sgRNA
  Il1rl2_3
ctgcaatataacagacacga

SEQ ID NO: 28027 - DNA, 20 bp, Artificial Sequence
  sgRNA
  Il1rl2_4
gttgtgaagagattaaagcg

SEQ ID NO: 28028 - DNA, 20 bp, Artificial Sequence
  sgRNA
  Il1rl2_5
gtatatccgacagaagcacg

SEQ ID NO: 28029 - DNA, 20 bp, Artificial Sequence
  sgRNA
  Il1rl2_6
ggtactgaagatcttgcccg

SEQ ID NO: 28030 - DNA, 20 bp, Artificial Sequence
  sgRNA
  Il1rl2_7
gagagtcaacaacaccctgg

SEQ ID NO: 28031 - DNA, 20 bp, Artificial Sequence
  sgRNA
  Il1rl2_8
ttataccccaagtacccgag

SEQ ID NO: 28032 - DNA, 20 bp, Artificial Sequence
  sgRNA
  Il1rl2_9
cagtatatccgacagaagca

SEQ ID NO: 28033 - DNA, 20 bp, Artificial Sequence
  sgRNA
  Il1rl2_10
gcaaatgcaatgctgccaca

SEQ ID NO: 28034 - DNA, 20 bp, Artificial Sequence
  sgRNA
  Il1rl2_11
acatacccgccagaaacaaa

SEQ ID NO: 28035 - DNA, 20 bp, Artificial Sequence
  sgRNA
  Il1rl2_12
tgtccttgagggatcaaatt

SEQ ID NO: 28036 - DNA, 20 bp, Artificial Sequence
  sgRNA
  Il1rl2_13
ttgcctgccttgcaattgca

SEQ ID NO: 28037 - DNA, 20 bp, Artificial Sequence
  sgRNA
  Il1rl2_14
ttaagatcgacatcatgctt

SEQ ID NO: 28038 - DNA, 20 bp, Artificial Sequence
  sgRNA
  Il1rl2_15
cacaatgtgataatttcaga

SEQ ID NO: 28039 - DNA, 20 bp, Artificial Sequence
  sgRNA
  Il1rl2_16
actgccccgtttgtttctgg

SEQ ID NO: 28040 - DNA, 20 bp, Artificial Sequence
  sgRNA
  Il1rl2_17
gcaccagagtcgtctagctt

SEQ ID NO: 28041 - DNA, 20 bp, Artificial Sequence
  sgRNA
  Il1rl2_18
gtaccagtgtgtctacatca

SEQ ID NO: 28042 - DNA, 20 bp, Artificial Sequence
  sgRNA
  Il1rl2_19
atacccgccagaaacaaacg

SEQ ID NO: 28043 - DNA, 20 bp, Artificial Sequence
  sgRNA
  Il1rl2_20
agtatatccgacagaagcac

SEQ ID NO: 28044 - DNA, 20 bp, Artificial Sequence
  sgRNA
  Il20ra_1
gaaacacgataacagatgtg

SEQ ID NO: 28045 - DNA, 20 bp, Artificial Sequence
  sgRNA
  Il20ra_2
taacactaagtcgagaagaa

SEQ ID NO: 28046 - DNA, 20 bp, Artificial Sequence
  sgRNA
  Il20ra_3
tggctgaatgcctctaaatg

SEQ ID NO: 28047 - DNA, 20 bp, Artificial Sequence
  sgRNA
  Il20ra_4
gcttctgagaaggcatcggg

SEQ ID NO: 28048 - DNA, 20 bp, Artificial Sequence
  sgRNA
  Il20ra_5
agtcctaagtgacttctacg

SEQ ID NO: 28049 - DNA, 20 bp, Artificial Sequence
  sgRNA
  Il20ra_6
acgtggagtcccttgtccca

SEQ ID NO: 28050 - DNA, 20 bp, Artificial Sequence
  sgRNA
  Il20ra_7
ctaaatgcgggagtatcaac

SEQ ID NO: 28051 - DNA, 20 bp, Artificial Sequence
  sgRNA
  Il20ra_8
cactctgtattgtgtccacg

SEQ ID NO: 28052 - DNA, 20 bp, Artificial Sequence
  sgRNA
  Il20ra_9
tcaggagcatactgtctccg

SEQ ID NO: 28053 - DNA, 20 bp, Artificial Sequence
  sgRNA
  Il20ra_10
ggagcacctggcttcccaaa

SEQ ID NO: 28054 - DNA, 20 bp, Artificial Sequence
  sgRNA
  Il20ra_11
gttgatactcccgcatttag

SEQ ID NO: 28055 - DNA, 20 bp, Artificial Sequence
  sgRNA
  Il20ra_12
gagagagaccagctcttaga

SEQ ID NO: 28056 - DNA, 20 bp, Artificial Sequence
  sgRNA
  Il20ra_13
agtatcatccaacatactga

SEQ ID NO: 28057 - DNA, 20 bp, Artificial Sequence
  sgRNA
  Il20ra_14
cttgaagacctacatcacct

SEQ ID NO: 28058 - DNA, 20 bp, Artificial Sequence
  sgRNA
  Il20ra_15
gtaaaccaagtagccaattg

SEQ ID NO: 28059 - DNA, 20 bp, Artificial Sequence
  sgRNA
  Il20ra_16
attgggaccctcaaactggc

SEQ ID NO: 28060 - DNA, 20 bp, Artificial Sequence
  sgRNA
  Il20ra_17
ggccaaagataggtaaggaa

SEQ ID NO: 28061 - DNA, 20 bp, Artificial Sequence
  sgRNA
  Il20ra_18
cctaagtgacttctacgggg

SEQ ID NO: 28062 - DNA, 20 bp, Artificial Sequence
  sgRNA
  Il20ra_19
tgagagagaccagctcttag

SEQ ID NO: 28063 - DNA, 20 bp, Artificial Sequence
  sgRNA
  Il20ra_20
aagtttgctgaagtcaccag

SEQ ID NO: 28064 - DNA, 20 bp, Artificial Sequence
  sgRNA
  Il20rb_1
tgttggttgactgtacagag

SEQ ID NO: 28065 - DNA, 20 bp, Artificial Sequence
  sgRNA
  Il20rb_2
cctgaagttatatggcactg

SEQ ID NO: 28066 - DNA, 20 bp, Artificial Sequence
  sgRNA
  Il20rb_3
tctattgtgtggagtatcag

SEQ ID NO: 28067 - DNA, 20 bp, Artificial Sequence
  sgRNA
  Il20rb_4
ttcacacagtacatggcccc

SEQ ID NO: 28068 - DNA, 20 bp, Artificial Sequence
  sgRNA
  Il20rb_5
ccttgcatctccacacacgt

SEQ ID NO: 28069 - DNA, 20 bp, Artificial Sequence
  sgRNA
  Il20rb_6
ggaacccagtgacccagccg

SEQ ID NO: 28070 - DNA, 20 bp, Artificial Sequence
  sgRNA
  Il20rb_7
gaccccaaagagatgctccg

SEQ ID NO: 28071 - DNA, 20 bp, Artificial Sequence
  sgRNA
  Il20rb_8
gcaaacagagctagtgccag

SEQ ID NO: 28072 - DNA, 20 bp, Artificial Sequence
  sgRNA
  Il20rb_9
ctgtacagagaggttctgag

SEQ ID NO: 28073 - DNA, 20 bp, Artificial Sequence
  sgRNA
  Il20rb_10
cactggtgaaagccatcggg

SEQ ID NO: 28074 - DNA, 20 bp, Artificial Sequence
  sgRNA
  Il20rb_11
gctgcatctggttattgagc

SEQ ID NO: 28075 - DNA, 20 bp, Artificial Sequence
  sgRNA
  Il20rb_12
agttccttgtggtctactgg

SEQ ID NO: 28076 - DNA, 20 bp, Artificial Sequence
  sgRNA
  Il20rb_13
cctagaaaccatggaaccgg

SEQ ID NO: 28077 - DNA, 20 bp, Artificial Sequence
  sgRNA
  Il20rb_14
ggtgtctgggaggacaacgg

SEQ ID NO: 28078 - DNA, 20 bp, Artificial Sequence
  sgRNA
  Il20rb_15
gtacatggcccccggttcca

SEQ ID NO: 28079 - DNA, 20 bp, Artificial Sequence
  sgRNA
  Il20rb_16
gaaggcactgtgcctcccga

SEQ ID NO: 28080 - DNA, 20 bp, Artificial Sequence
  sgRNA
  Il20rb_17
gccttgaccctgaagttata

SEQ ID NO: 28081 - DNA, 20 bp, Artificial Sequence
  sgRNA
  Il20rb_18
tgtctgggaggacaacggcg

SEQ ID NO: 28082 - DNA, 20 bp, Artificial Sequence
  sgRNA
  Il20rb_19
gccccagtttgagttccttg

SEQ ID NO: 28083 - DNA, 20 bp, Artificial Sequence
  sgRNA
  Il20rb_20
gaacccagtgacccagccgg

SEQ ID NO: 28084 - DNA, 20 bp, Artificial Sequence
  sgRNA
  Il21r_1
gcacgtgtaccatatatgtg

SEQ ID NO: 28085 - DNA, 20 bp, Artificial Sequence
  sgRNA
  Il21r_2
aggacgctatgatatctcct

SEQ ID NO: 28086 - DNA, 20 bp, Artificial Sequence
  sgRNA
  Il21r_3
gccacctcaccacagcatag

SEQ ID NO: 28087 - DNA, 20 bp, Artificial Sequence
  sgRNA
  Il21r_4
gggctggaagaaactctcag

SEQ ID NO: 28088 - DNA, 20 bp, Artificial Sequence
  sgRNA
  Il21r_5
tcgaagctatctccgccagt

SEQ ID NO: 28089 - DNA, 20 bp, Artificial Sequence
  sgRNA
  Il21r_6
tggacaccagaccatatggc

SEQ ID NO: 28090 - DNA, 20 bp, Artificial Sequence
  sgRNA
  Il21r_7
cccctcagcacgtagttgga

SEQ ID NO: 28091 - DNA, 20 bp, Artificial Sequence
  sgRNA
  Il21r_8
gggtccttcatcagtctcca

SEQ ID NO: 28092 - DNA, 20 bp, Artificial Sequence
  sgRNA
  Il21r_9
agccgcaagacagaaaagca

SEQ ID NO: 28093 - DNA, 20 bp, Artificial Sequence
  sgRNA
  Il21r_10
gccacagtcacgttcaaggg

SEQ ID NO: 28094 - DNA, 20 bp, Artificial Sequence
  sgRNA
  Il21r_11
tcactggtgcataatcccct

SEQ ID NO: 28095 - DNA, 20 bp, Artificial Sequence
  sgRNA
  Il21r_12
tatgctggaggccgtgaaag

SEQ ID NO: 28096 - DNA, 20 bp, Artificial Sequence
  sgRNA
  Il21r_13
ccgcttggccagctgccaag

SEQ ID NO: 28097 - DNA, 20 bp, Artificial Sequence
  sgRNA
  Il21r_14
ccgctgtgctccctgtacag

SEQ ID NO: 28098 - DNA, 20 bp, Artificial Sequence
  sgRNA
  Il21r_15
aagctatctccgccagtggg

SEQ ID NO: 28099 - DNA, 20 bp, Artificial Sequence
  sgRNA
  Il21r_16
gtccttcatcagtctccacg

SEQ ID NO: 28100 - DNA, 20 bp, Artificial Sequence
  sgRNA
  Il21r_17
gaggagagagaccggccata

SEQ ID NO: 28101 - DNA, 20 bp, Artificial Sequence
  sgRNA
  Il21r_18
ggacaatgatcaagacagcc

SEQ ID NO: 28102 - DNA, 20 bp, Artificial Sequence
  sgRNA
  Il21r_19
ttactcctgctgattctcca

SEQ ID NO: 28103 - DNA, 20 bp, Artificial Sequence
  sgRNA
  Il21r_20
gctccactgtccacaggtgg

SEQ ID NO: 28104 - DNA, 20 bp, Artificial Sequence
  sgRNA
  Il22ra1_1
gacatctgactgccctacgt

SEQ ID NO: 28105 - DNA, 20 bp, Artificial Sequence
  sgRNA
  Il22ra1_2
tggcgtagtaaaactcagtg

SEQ ID NO: 28106 - DNA, 20 bp, Artificial Sequence
  sgRNA
  Il22ra1_3
tcttcactcggcacacgtag

SEQ ID NO: 28107 - DNA, 20 bp, Artificial Sequence
  sgRNA
  Il22ra1_4
tgacctgtatccccaaagtg

SEQ ID NO: 28108 - DNA, 20 bp, Artificial Sequence
  sgRNA
  Il22ra1_5
tgtctgacctcacctacgta

SEQ ID NO: 28109 - DNA, 20 bp, Artificial Sequence
  sgRNA
  Il22ra1_6
ttactacgccaaggtcacgg

SEQ ID NO: 28110 - DNA, 20 bp, Artificial Sequence
  sgRNA
  Il22ra1_7
ctactgaccatcctgacggt

SEQ ID NO: 28111 - DNA, 20 bp, Artificial Sequence
  sgRNA
  Il22ra1_8
gggatacaggtcacatcagg

SEQ ID NO: 28112 - DNA, 20 bp, Artificial Sequence
  sgRNA
  Il22ra1_9
ctgtcctctgtgcagatcga

SEQ ID NO: 28113 - DNA, 20 bp, Artificial Sequence
  sgRNA
  Il22ra1_10
tgttctactcaccacaacag

SEQ ID NO: 28114 - DNA, 20 bp, Artificial Sequence
  sgRNA
  Il22ra1_11
tcatgttccccctcagacga

SEQ ID NO: 28115 - DNA, 20 bp, Artificial Sequence
  sgRNA
  Il22ra1_12
ggtcacatcaggcggtttga

SEQ ID NO: 28116 - DNA, 20 bp, Artificial Sequence
  sgRNA
  Il22ra1_13
gagacaccacggtacctgaa

SEQ ID NO: 28117 - DNA, 20 bp, Artificial Sequence
  sgRNA
  Il22ra1_14
gcccatccagtactcccaag

SEQ ID NO: 28118 - DNA, 20 bp, Artificial Sequence
  sgRNA
  Il22ra1_15
gtggccctcgatctgcacag

SEQ ID NO: 28119 - DNA, 20 bp, Artificial Sequence
  sgRNA
  Il22ra1_16
catccagtactcccaagtgg

SEQ ID NO: 28120 - DNA, 20 bp, Artificial Sequence
  sgRNA
  Il22ra1_17
tctgtagagaaaggtcccct

SEQ ID NO: 28121 - DNA, 20 bp, Artificial Sequence
  sgRNA
  Il22ra1_18
tgttagaagctgtctcccag

SEQ ID NO: 28122 - DNA, 20 bp, Artificial Sequence
  sgRNA
  Il22ra1_19
ggtccaccccacactcacac

SEQ ID NO: 28123 - DNA, 20 bp, Artificial Sequence
  sgRNA
  Il22ra1_20
gctggtggccatcttccgag

SEQ ID NO: 28124 - DNA, 20 bp, Artificial Sequence
  sgRNA
  Il23r_1
tctatagtacttacgtccag

SEQ ID NO: 28125 - DNA, 20 bp, Artificial Sequence
  sgRNA
  Il23r_2
aaactgctctggtgacatgt

SEQ ID NO: 28126 - DNA, 20 bp, Artificial Sequence
  sgRNA
  Il23r_3
ggagatcttaacatagcttg

SEQ ID NO: 28127 - DNA, 20 bp, Artificial Sequence
  sgRNA
  Il23r_4
caccaaacttcccagacagg

SEQ ID NO: 28128 - DNA, 20 bp, Artificial Sequence
  sgRNA
  Il23r_5
ccatctgaagagcacataaa

SEQ ID NO: 28129 - DNA, 20 bp, Artificial Sequence
  sgRNA
  Il23r_6
ggattaatagaacaacagct

SEQ ID NO: 28130 - DNA, 20 bp, Artificial Sequence
  sgRNA
  Il23r_7
acaacaactacacgtccatc

SEQ ID NO: 28131 - DNA, 20 bp, Artificial Sequence
  sgRNA
  Il23r_8
cagacaacagagtctgcgct

SEQ ID NO: 28132 - DNA, 20 bp, Artificial Sequence
  sgRNA
  Il23r_9
gacacatgtcagattgctgg

SEQ ID NO: 28133 - DNA, 20 bp, Artificial Sequence
  sgRNA
  Il23r_10
tgacatgcacctggaacact

SEQ ID NO: 28134 - DNA, 20 bp, Artificial Sequence
  sgRNA
  Il23r_11
atctccactgactcactgca

SEQ ID NO: 28135 - DNA, 20 bp, Artificial Sequence
  sgRNA
  Il23r_12
ctcagtgctacaatcttcag

SEQ ID NO: 28136 - DNA, 20 bp, Artificial Sequence
  sgRNA
  Il23r_13
cttcacatgcacaatatact

SEQ ID NO: 28137 - DNA, 20 bp, Artificial Sequence
  sgRNA
  Il23r_14
gtttcaaatgttcctcctgg

SEQ ID NO: 28138 - DNA, 20 bp, Artificial Sequence
  sgRNA
  Il23r_15
ggtgacatgtgggttgagcc

SEQ ID NO: 28139 - DNA, 20 bp, Artificial Sequence
  sgRNA
  Il23r_16
ccttggtcggcagtgcttaa

SEQ ID NO: 28140 - DNA, 20 bp, Artificial Sequence
  sgRNA
  Il23r_17
ttataaaagtaaagattcct

SEQ ID NO: 28141 - DNA, 20 bp, Artificial Sequence
  sgRNA
  Il23r_18
gtggtcatctgtggtctcaa

SEQ ID NO: 28142 - DNA, 20 bp, Artificial Sequence
  sgRNA
  Il23r_19
tatattcctgacctcaacac

SEQ ID NO: 28143 - DNA, 20 bp, Artificial Sequence
  sgRNA
  Il23r_20
gctgccttgcagtgagtcag

SEQ ID NO: 28144 - DNA, 20 bp, Artificial Sequence
  sgRNA
  Il27ra_1
cagtcactgtaattcgatag

SEQ ID NO: 28145 - DNA, 20 bp, Artificial Sequence
  sgRNA
  Il27ra_2
tgctcactcccacgtcacag

SEQ ID NO: 28146 - DNA, 20 bp, Artificial Sequence
  sgRNA
  Il27ra_3
tccccgggaacagttcacca

SEQ ID NO: 28147 - DNA, 20 bp, Artificial Sequence
  sgRNA
  Il27ra_4
ccagacgccattcttaggtg

SEQ ID NO: 28148 - DNA, 20 bp, Artificial Sequence
  sgRNA
  Il27ra_5
gcagtcactgtaattcgata

SEQ ID NO: 28149 - DNA, 20 bp, Artificial Sequence
  sgRNA
  Il27ra_6
gggaatcctgaactgctcct

SEQ ID NO: 28150 - DNA, 20 bp, Artificial Sequence
  sgRNA
  Il27ra_7
ggagtctccaggtcgcccaa

SEQ ID NO: 28151 - DNA, 20 bp, Artificial Sequence
  sgRNA
  Il27ra_8
ctgtggggtttgcttctgat

SEQ ID NO: 28152 - DNA, 20 bp, Artificial Sequence
  sgRNA
  Il27ra_9
gagttgggtgaccattcccc

SEQ ID NO: 28153 - DNA, 20 bp, Artificial Sequence
  sgRNA
  Il27ra_10
gccatggtgaactgttcccg

SEQ ID NO: 28154 - DNA, 20 bp, Artificial Sequence
  sgRNA
  Il27ra_11
ggcgaactccactcgcccca

SEQ ID NO: 28155 - DNA, 20 bp, Artificial Sequence
  sgRNA
  Il27ra_12
cagtccaccacatactccaa

SEQ ID NO: 28156 - DNA, 20 bp, Artificial Sequence
  sgRNA
  Il27ra_13
gctcactcccacgtcacagg

SEQ ID NO: 28157 - DNA, 20 bp, Artificial Sequence
  sgRNA
  Il27ra_14
gacttccagatgacccccca

SEQ ID NO: 28158 - DNA, 20 bp, Artificial Sequence
  sgRNA
  Il27ra_15
gcagaagctccaacggcgtg

SEQ ID NO: 28159 - DNA, 20 bp, Artificial Sequence
  sgRNA
  Il27ra_16
gtgtccaccgttgcaggaca

SEQ ID NO: 28160 - DNA, 20 bp, Artificial Sequence
  sgRNA
  Il27ra_17
gcagtgctgatgggagccca

SEQ ID NO: 28161 - DNA, 20 bp, Artificial Sequence
  sgRNA
  Il27ra_18
tccacttgagagaagatctg

SEQ ID NO: 28162 - DNA, 20 bp, Artificial Sequence
  sgRNA
  Il27ra_19
ccaaactgctggcccagcaa

SEQ ID NO: 28163 - DNA, 20 bp, Artificial Sequence
  sgRNA
  Il27ra_20
tctgggggacacaaaaggga

SEQ ID NO: 28164 - DNA, 20 bp, Artificial Sequence
  sgRNA
  Il2ra_1
gtgtctgtatgacccacccg

SEQ ID NO: 28165 - DNA, 20 bp, Artificial Sequence
  sgRNA
  Il2ra_2
atcttgcagatgctaatagc

SEQ ID NO: 28166 - DNA, 20 bp, Artificial Sequence
  sgRNA
  Il2ra_3
gagaggtttccgaagactaa

SEQ ID NO: 28167 - DNA, 20 bp, Artificial Sequence
  sgRNA
  Il2ra_4
gaatcttcatgtttccaagg

SEQ ID NO: 28168 - DNA, 20 bp, Artificial Sequence
  sgRNA
  Il2ra_5
tcatctacacatgtgagctg

SEQ ID NO: 28169 - DNA, 20 bp, Artificial Sequence
  sgRNA
  Il2ra_6
ggatacaaggctctacagag

SEQ ID NO: 28170 - DNA, 20 bp, Artificial Sequence
  sgRNA
  Il2ra_7
gcatctgcaagatgaagtgt

SEQ ID NO: 28171 - DNA, 20 bp, Artificial Sequence
  sgRNA
  Il2ra_8
aaccccaacatcagcaagcg

SEQ ID NO: 28172 - DNA, 20 bp, Artificial Sequence
  sgRNA
  Il2ra_9
ggtgccgttcttgtaggaga

SEQ ID NO: 28173 - DNA, 20 bp, Artificial Sequence
  sgRNA
  Il2ra_10
ctaaactgtgaatgcaagag

SEQ ID NO: 28174 - DNA, 20 bp, Artificial Sequence
  sgRNA
  Il2ra_11
ctataatcctaatgcatgaa

SEQ ID NO: 28175 - DNA, 20 bp, Artificial Sequence
  sgRNA
  Il2ra_12
gtaggagagggctttgaatg

SEQ ID NO: 28176 - DNA, 20 bp, Artificial Sequence
  sgRNA
  Il2ra_13
cttgcattcacagtttagga

SEQ ID NO: 28177 - DNA, 20 bp, Artificial Sequence
  sgRNA
  Il2ra_14
atgcaccaagagaaccttac

SEQ ID NO: 28178 - DNA, 20 bp, Artificial Sequence
  sgRNA
  Il2ra_15
aaagccctctcctacaagaa

SEQ ID NO: 28179 - DNA, 20 bp, Artificial Sequence
  sgRNA
  Il2ra_16
ttcatgcattaggattatag

SEQ ID NO: 28180 - DNA, 20 bp, Artificial Sequence
  sgRNA
  Il2ra_17
agatgaagtgtgggaaaacg

SEQ ID NO: 28181 - DNA, 20 bp, Artificial Sequence
  sgRNA
  Il2ra_18
ggatgctgatgagcaggaag

SEQ ID NO: 28182 - DNA, 20 bp, Artificial Sequence
  sgRNA
  Il2ra_19
atgcattaggattatagagg

SEQ ID NO: 28183 - DNA, 20 bp, Artificial Sequence
  sgRNA
  Il2ra_20
aggtgagcccgctcaggagg

SEQ ID NO: 28184 - DNA, 20 bp, Artificial Sequence
  sgRNA
  Il2rb_1
ggacctccttgacataaatg

SEQ ID NO: 28185 - DNA, 20 bp, Artificial Sequence
  sgRNA
  Il2rb_2
tctccgtcgagcacttccag

SEQ ID NO: 28186 - DNA, 20 bp, Artificial Sequence
  sgRNA
  Il2rb_3
aagctcaacgaaacaatacc

SEQ ID NO: 28187 - DNA, 20 bp, Artificial Sequence
  sgRNA
  Il2rb_4
aggtatctgagccatgacat

SEQ ID NO: 28188 - DNA, 20 bp, Artificial Sequence
  sgRNA
  Il2rb_5
gatgggtcaaggctgcccga

SEQ ID NO: 28189 - DNA, 20 bp, Artificial Sequence
  sgRNA
  Il2rb_6
ggttcgacttggcatggacg

SEQ ID NO: 28190 - DNA, 20 bp, Artificial Sequence
  sgRNA
  Il2rb_7
gcacccccaacactgcctat

SEQ ID NO: 28191 - DNA, 20 bp, Artificial Sequence
  sgRNA
  Il2rb_8
ggacctcatatgaggtacta

SEQ ID NO: 28192 - DNA, 20 bp, Artificial Sequence
  sgRNA
  Il2rb_9
cctctggagcggatgccgga

SEQ ID NO: 28193 - DNA, 20 bp, Artificial Sequence
  sgRNA
  Il2rb_10
gatggaagaagaagtagccc

SEQ ID NO: 28194 - DNA, 20 bp, Artificial Sequence
  sgRNA
  Il2rb_11
gcttacagcgccctctggag

SEQ ID NO: 28195 - DNA, 20 bp, Artificial Sequence
  sgRNA
  Il2rb_12
gccagctgcttcaccaacca

SEQ ID NO: 28196 - DNA, 20 bp, Artificial Sequence
  sgRNA
  Il2rb_13
gcccctttaccctcgcccag

SEQ ID NO: 28197 - DNA, 20 bp, Artificial Sequence
  sgRNA
  Il2rb_14
ggaagagaagggttggcgta

SEQ ID NO: 28198 - DNA, 20 bp, Artificial Sequence
  sgRNA
  Il2rb_15
ggccttgtccgaaaggtcag

SEQ ID NO: 28199 - DNA, 20 bp, Artificial Sequence
  sgRNA
  Il2rb_16
agtgctcgacggagattcca

SEQ ID NO: 28200 - DNA, 20 bp, Artificial Sequence
  sgRNA
  Il2rb_17
ctagcatcccgtgacctgat

SEQ ID NO: 28201 - DNA, 20 bp, Artificial Sequence
  sgRNA
  Il2rb_18
cttccggcatccgctccaga

SEQ ID NO: 28202 - DNA, 20 bp, Artificial Sequence
  sgRNA
  Il2rb_19
tctccgctggaagtgctcga

SEQ ID NO: 28203 - DNA, 20 bp, Artificial Sequence
  sgRNA
  Il2rb_20
ggatgggtcaaggctgcccg

SEQ ID NO: 28204 - DNA, 20 bp, Artificial Sequence
  sgRNA
  Il2rg_1
ttccacagattgggttatag

SEQ ID NO: 28205 - DNA, 20 bp, Artificial Sequence
  sgRNA
  Il2rg_2
ggagcaacagagatcgaagc

SEQ ID NO: 28206 - DNA, 20 bp, Artificial Sequence
  sgRNA
  Il2rg_3
cccgattaccaagattctgt

SEQ ID NO: 28207 - DNA, 20 bp, Artificial Sequence
  sgRNA
  Il2rg_4
catacctatagtgcagcgtg

SEQ ID NO: 28208 - DNA, 20 bp, Artificial Sequence
  sgRNA
  Il2rg_5
ctacagtatgactcccccag

SEQ ID NO: 28209 - DNA, 20 bp, Artificial Sequence
  sgRNA
  Il2rg_6
cctggagtggtgtgtctaaa

SEQ ID NO: 28210 - DNA, 20 bp, Artificial Sequence
  sgRNA
  Il2rg_7
ggagctggacaacaaatgtc

SEQ ID NO: 28211 - DNA, 20 bp, Artificial Sequence
  sgRNA
  Il2rg_8
gcgagattccccccaaagga

SEQ ID NO: 28212 - DNA, 20 bp, Artificial Sequence
  sgRNA
  Il2rg_9
ttatccctgttggcaccatg

SEQ ID NO: 28213 - DNA, 20 bp, Artificial Sequence
  sgRNA
  Il2rg_10
gtatgactcccccagtggac

SEQ ID NO: 28214 - DNA, 20 bp, Artificial Sequence
  sgRNA
  Il2rg_11
tcctctagattcttgatggg

SEQ ID NO: 28215 - DNA, 20 bp, Artificial Sequence
  sgRNA
  Il2rg_12
tttgatgtcttcattcgcac

SEQ ID NO: 28216 - DNA, 20 bp, Artificial Sequence
  sgRNA
  Il2rg_13
aggacccccagaaaccccag

SEQ ID NO: 28217 - DNA, 20 bp, Artificial Sequence
  sgRNA
  Il2rg_14
cggcttcagagaataacatg

SEQ ID NO: 28218 - DNA, 20 bp, Artificial Sequence
  sgRNA
  Il2rg_15
atctggttactgaataccaa

SEQ ID NO: 28219 - DNA, 20 bp, Artificial Sequence
  sgRNA
  Il2rg_16
ccggcttcagagaataacat

SEQ ID NO: 28220 - DNA, 20 bp, Artificial Sequence
  sgRNA
  Il2rg_17
aagcactgaacctctggaag

SEQ ID NO: 28221 - DNA, 20 bp, Artificial Sequence
  sgRNA
  Il2rg_18
gatcctctagattcttgatg

SEQ ID NO: 28222 - DNA, 20 bp, Artificial Sequence
  sgRNA
  Il2rg_19
acagccagaagtaatctctt

SEQ ID NO: 28223 - DNA, 20 bp, Artificial Sequence
  sgRNA
  Il2rg_20
cagctcatccacactaggca

SEQ ID NO: 28224 - DNA, 20 bp, Artificial Sequence
  sgRNA
  Il31ra_1
gaaggtgcgattgttgtgga

SEQ ID NO: 28225 - DNA, 20 bp, Artificial Sequence
  sgRNA
  Il31ra_2
acgaactggaccatcgagca

SEQ ID NO: 28226 - DNA, 20 bp, Artificial Sequence
  sgRNA
  Il31ra_3
aaccgcgtgaaaagactcgt

SEQ ID NO: 28227 - DNA, 20 bp, Artificial Sequence
  sgRNA
  Il31ra_4
tgccagttcaccaccaacag

SEQ ID NO: 28228 - DNA, 20 bp, Artificial Sequence
  sgRNA
  Il31ra_5
gcttgtcaatgagatccgcg

SEQ ID NO: 28229 - DNA, 20 bp, Artificial Sequence
  sgRNA
  Il31ra_6
aaaaccatgtcccgtccccg

SEQ ID NO: 28230 - DNA, 20 bp, Artificial Sequence
  sgRNA
  Il31ra_7
gcaacctcagttaaaacgga

SEQ ID NO: 28231 - DNA, 20 bp, Artificial Sequence
  sgRNA
  Il31ra_8
attccagcgttcacacccag

SEQ ID NO: 28232 - DNA, 20 bp, Artificial Sequence
  sgRNA
  Il31ra_9
gggaacatcaggacaacaca

SEQ ID NO: 28233 - DNA, 20 bp, Artificial Sequence
  sgRNA
  Il31ra_10
tggctaaactactttcagca

SEQ ID NO: 28234 - DNA, 20 bp, Artificial Sequence
  sgRNA
  Il31ra_11
tcaacactgcagatgtctgg

SEQ ID NO: 28235 - DNA, 20 bp, Artificial Sequence
  sgRNA
  Il31ra_12
ctaacatctctagttggagg

SEQ ID NO: 28236 - DNA, 20 bp, Artificial Sequence
  sgRNA
  Il31ra_13
ggaacatcaggacaacacag

SEQ ID NO: 28237 - DNA, 20 bp, Artificial Sequence
  sgRNA
  Il31ra_14
tctgtcgaagtaaaagacgc

SEQ ID NO: 28238 - DNA, 20 bp, Artificial Sequence
  sgRNA
  Il31ra_15
cagcttgtcaatgagatccg

SEQ ID NO: 28239 - DNA, 20 bp, Artificial Sequence
  sgRNA
  Il31ra_16
tttgccagttcaccaccaac

SEQ ID NO: 28240 - DNA, 20 bp, Artificial Sequence
  sgRNA
  Il31ra_17
aaaccgcgtgaaaagactcg

SEQ ID NO: 28241 - DNA, 20 bp, Artificial Sequence
  sgRNA
  Il31ra_18
tctaggcccgacggtccccc

SEQ ID NO: 28242 - DNA, 20 bp, Artificial Sequence
  sgRNA
  Il31ra_19
ccagagctggaggtaccaac

SEQ ID NO: 28243 - DNA, 20 bp, Artificial Sequence
  sgRNA
  Il31ra_20
cgtcttcctgtcagagtcca

SEQ ID NO: 28244 - DNA, 20 bp, Artificial Sequence
  sgRNA
  Il4ra_1
acagataccagatggaactg

SEQ ID NO: 28245 - DNA, 20 bp, Artificial Sequence
  sgRNA
  Il4ra_2
cactaacattctctggccag

SEQ ID NO: 28246 - DNA, 20 bp, Artificial Sequence
  sgRNA
  Il4ra_3
atccaggaaccactcacacg

SEQ ID NO: 28247 - DNA, 20 bp, Artificial Sequence
  sgRNA
  Il4ra_4
caggattaagaagatatggt

SEQ ID NO: 28248 - DNA, 20 bp, Artificial Sequence
  sgRNA
  Il4ra_5
cagcagcaatggcatccgcg

SEQ ID NO: 28249 - DNA, 20 bp, Artificial Sequence
  sgRNA
  Il4ra_6
tgttcccagccagacgaccg

SEQ ID NO: 28250 - DNA, 20 bp, Artificial Sequence
  sgRNA
  Il4ra_7
acaccaatgtgtccgacgaa

SEQ ID NO: 28251 - DNA, 20 bp, Artificial Sequence
  sgRNA
  Il4ra_8
atgtcacctgagaacagcgg

SEQ ID NO: 28252 - DNA, 20 bp, Artificial Sequence
  sgRNA
  Il4ra_9
cagacgaccgaggtgcctgt

SEQ ID NO: 28253 - DNA, 20 bp, Artificial Sequence
  sgRNA
  Il4ra_10
gcaatgcccagggcgcccac

SEQ ID NO: 28254 - DNA, 20 bp, Artificial Sequence
  sgRNA
  Il4ra_11
ggataagcagacccgaagcc

SEQ ID NO: 28255 - DNA, 20 bp, Artificial Sequence
  sgRNA
  Il4ra_12
gcagtcactaaaactccggt

SEQ ID NO: 28256 - DNA, 20 bp, Artificial Sequence
  sgRNA
  Il4ra_13
atgacagatcaccatccctg

SEQ ID NO: 28257 - DNA, 20 bp, Artificial Sequence
  sgRNA
  Il4ra_14
gtaagttgttcgatgggtac

SEQ ID NO: 28258 - DNA, 20 bp, Artificial Sequence
  sgRNA
  Il4ra_15
gcttctggtggtattccctc

SEQ ID NO: 28259 - DNA, 20 bp, Artificial Sequence
  sgRNA
  Il4ra_16
tctagtccgaaagtaaataa

SEQ ID NO: 28260 - DNA, 20 bp, Artificial Sequence
  sgRNA
  Il4ra_17
attctcagcctccaacaagt

SEQ ID NO: 28261 - DNA, 20 bp, Artificial Sequence
  sgRNA
  Il4ra_18
ccctcccctgacaagtttga

SEQ ID NO: 28262 - DNA, 20 bp, Artificial Sequence
  sgRNA
  Il4ra_19
gtacaaagacctcatctcca

SEQ ID NO: 28263 - DNA, 20 bp, Artificial Sequence
  sgRNA
  Il4ra_20
agtacacaataccaaagccc

SEQ ID NO: 28264 - DNA, 20 bp, Artificial Sequence
  sgRNA
  Il5ra_1
acaagttaaattcgtaaccg

SEQ ID NO: 28265 - DNA, 20 bp, Artificial Sequence
  sgRNA
  Il5ra_2
caacaagccaggtgcaacga

SEQ ID NO: 28266 - DNA, 20 bp, Artificial Sequence
  sgRNA
  Il5ra_3
gcaattctctctatatacag

SEQ ID NO: 28267 - DNA, 20 bp, Artificial Sequence
  sgRNA
  Il5ra_4
ttaatggtaaaattgacagg

SEQ ID NO: 28268 - DNA, 20 bp, Artificial Sequence
  sgRNA
  Il5ra_5
ggcaaaatgccatcaaaacg

SEQ ID NO: 28269 - DNA, 20 bp, Artificial Sequence
  sgRNA
  Il5ra_6
tgtatggctgctcttcagaa

SEQ ID NO: 28270 - DNA, 20 bp, Artificial Sequence
  sgRNA
  Il5ra_7
cacttggtatggccttaagt

SEQ ID NO: 28271 - DNA, 20 bp, Artificial Sequence
  sgRNA
  Il5ra_8
aacaagccaggtgcaacgaa

SEQ ID NO: 28272 - DNA, 20 bp, Artificial Sequence
  sgRNA
  Il5ra_9
tgcaaagccttcatgaaggg

SEQ ID NO: 28273 - DNA, 20 bp, Artificial Sequence
  sgRNA
  Il5ra_10
aagaacttgagctaatccag

SEQ ID NO: 28274 - DNA, 20 bp, Artificial Sequence
  sgRNA
  Il5ra_11
gctgaactcaaagctccacc

SEQ ID NO: 28275 - DNA, 20 bp, Artificial Sequence
  sgRNA
  Il5ra_12
ggacatttatcaacagcaaa

SEQ ID NO: 28276 - DNA, 20 bp, Artificial Sequence
  sgRNA
  Il5ra_13
atacaactctggccagcagt

SEQ ID NO: 28277 - DNA, 20 bp, Artificial Sequence
  sgRNA
  Il5ra_14
aaggctttgcagctagcgtg

SEQ ID NO: 28278 - DNA, 20 bp, Artificial Sequence
  sgRNA
  Il5ra_15
aatgagatgccattctacca

SEQ ID NO: 28279 - DNA, 20 bp, Artificial Sequence
  sgRNA
  Il5ra_16
ttgatgttactctttggggc

SEQ ID NO: 28280 - DNA, 20 bp, Artificial Sequence
  sgRNA
  Il5ra_17
cctgtgttactaattcttgt

SEQ ID NO: 28281 - DNA, 20 bp, Artificial Sequence
  sgRNA
  Il5ra_18
cattccttggaggattcact

SEQ ID NO: 28282 - DNA, 20 bp, Artificial Sequence
  sgRNA
  Il5ra_19
gattaacaagacgaagcagg

SEQ ID NO: 28283 - DNA, 20 bp, Artificial Sequence
  sgRNA
  Il5ra_20
atggaccaggttgtttccac

SEQ ID NO: 28284 - DNA, 20 bp, Artificial Sequence
  sgRNA
  Il6ra_1
ctgtgcgttgcaaacagtgt

SEQ ID NO: 28285 - DNA, 20 bp, Artificial Sequence
  sgRNA
  Il6ra_2
ggggcaaatcagggtaacgg

SEQ ID NO: 28286 - DNA, 20 bp, Artificial Sequence
  sgRNA
  Il6ra_3
caggtatggctgataccaca

SEQ ID NO: 28287 - DNA, 20 bp, Artificial Sequence
  sgRNA
  Il6ra_4
caccccctctccaaccacga

SEQ ID NO: 28288 - DNA, 20 bp, Artificial Sequence
  sgRNA
  Il6ra_5
gccagagtacacccagtgaa

SEQ ID NO: 28289 - DNA, 20 bp, Artificial Sequence
  sgRNA
  Il6ra_6
ggatccacctgccaaccttg

SEQ ID NO: 28290 - DNA, 20 bp, Artificial Sequence
  sgRNA
  Il6ra_7
aatcctctggaaccccacac

SEQ ID NO: 28291 - DNA, 20 bp, Artificial Sequence
  sgRNA
  Il6ra_8
gctcggacgccactcacaga

SEQ ID NO: 28292 - DNA, 20 bp, Artificial Sequence
  sgRNA
  Il6ra_9
ggacgaggattcttgcactg

SEQ ID NO: 28293 - DNA, 20 bp, Artificial Sequence
  sgRNA
  Il6ra_10
ttgtcaacgccatctgtgag

SEQ ID NO: 28294 - DNA, 20 bp, Artificial Sequence
  sgRNA
  Il6ra_11
ccgttaccctgatttgcccc

SEQ ID NO: 28295 - DNA, 20 bp, Artificial Sequence
  sgRNA
  Il6ra_12
aactttcgtactgatcctcg

SEQ ID NO: 28296 - DNA, 20 bp, Artificial Sequence
  sgRNA
  Il6ra_13
actcctttgaccatacaggt

SEQ ID NO: 28297 - DNA, 20 bp, Artificial Sequence
  sgRNA
  Il6ra_14
tgaagactctgccaaccacg

SEQ ID NO: 28298 - DNA, 20 bp, Artificial Sequence
  sgRNA
  Il6ra_15
gttccagaggattcctgccg

SEQ ID NO: 28299 - DNA, 20 bp, Artificial Sequence
  sgRNA
  Il6ra_16
tgccaggtggagatcctgga

SEQ ID NO: 28300 - DNA, 20 bp, Artificial Sequence
  sgRNA
  Il6ra_17
cccacattcctggtagctgg

SEQ ID NO: 28301 - DNA, 20 bp, Artificial Sequence
  sgRNA
  Il6ra_18
gtgggcccaaggaatacggt

SEQ ID NO: 28302 - DNA, 20 bp, Artificial Sequence
  sgRNA
  Il6ra_19
actgaagccgaccttccttc

SEQ ID NO: 28303 - DNA, 20 bp, Artificial Sequence
  sgRNA
  Il6ra_20
ataccgacctgtatggtcaa

SEQ ID NO: 28304 - DNA, 20 bp, Artificial Sequence
  sgRNA
  Il6st_1
taactcccgtattcgccacg

SEQ ID NO: 28305 - DNA, 20 bp, Artificial Sequence
  sgRNA
  Il6st_2
tctaagtacctttatccacg

SEQ ID NO: 28306 - DNA, 20 bp, Artificial Sequence
  sgRNA
  Il6st_3
atccggtccattaaggacag

SEQ ID NO: 28307 - DNA, 20 bp, Artificial Sequence
  sgRNA
  Il6st_4
gagtagtgatacgttgtaca

SEQ ID NO: 28308 - DNA, 20 bp, Artificial Sequence
  sgRNA
  Il6st_5
agccctatggatccgagcaa

SEQ ID NO: 28309 - DNA, 20 bp, Artificial Sequence
  sgRNA
  Il6st_6
tcagggtagatgtaaccaca

SEQ ID NO: 28310 - DNA, 20 bp, Artificial Sequence
  sgRNA
  Il6st_7
gtagccgctgtgcaccacag

SEQ ID NO: 28311 - DNA, 20 bp, Artificial Sequence
  sgRNA
  Il6st_8
gaatttccagttgtccagcg

SEQ ID NO: 28312 - DNA, 20 bp, Artificial Sequence
  sgRNA
  Il6st_9
tacgttgtacatggtccgaa

SEQ ID NO: 28313 - DNA, 20 bp, Artificial Sequence
  sgRNA
  Il6st_10
atatcttacagaaccagcgt

SEQ ID NO: 28314 - DNA, 20 bp, Artificial Sequence
  sgRNA
  Il6st_11
cgctcctccgagtctagcag

SEQ ID NO: 28315 - DNA, 20 bp, Artificial Sequence
  sgRNA
  Il6st_12
ggtcacctcacaccccccca

SEQ ID NO: 28316 - DNA, 20 bp, Artificial Sequence
  sgRNA
  Il6st_13
ctagcagcaagaaacaaggt

SEQ ID NO: 28317 - DNA, 20 bp, Artificial Sequence
  sgRNA
  Il6st_14
attcctgtggacgaccagaa

SEQ ID NO: 28318 - DNA, 20 bp, Artificial Sequence
  sgRNA
  Il6st_15
agtaactcccgtattcgcca

SEQ ID NO: 28319 - DNA, 20 bp, Artificial Sequence
  sgRNA
  Il6st_16
agatctatattcctgcccat

SEQ ID NO: 28320 - DNA, 20 bp, Artificial Sequence
  sgRNA
  Il6st_17
catctgtgtacgcggccatt

SEQ ID NO: 28321 - DNA, 20 bp, Artificial Sequence
  sgRNA
  Il6st_18
cctatggatccgagcaacgg

SEQ ID NO: 28322 - DNA, 20 bp, Artificial Sequence
  sgRNA
  Il6st_19
ggagtactgcaccgtgctgg

SEQ ID NO: 28323 - DNA, 20 bp, Artificial Sequence
  sgRNA
  Il6st_20
gctcgatctgcccaaaggac

SEQ ID NO: 28324 - DNA, 20 bp, Artificial Sequence
  sgRNA
  Il7r_1
gggagactaggccatacgac

SEQ ID NO: 28325 - DNA, 20 bp, Artificial Sequence
  sgRNA
  Il7r_2
agacctagaagatgcagacg

SEQ ID NO: 28326 - DNA, 20 bp, Artificial Sequence
  sgRNA
  Il7r_3
cagaacccaagaatcaaggt

SEQ ID NO: 28327 - DNA, 20 bp, Artificial Sequence
  sgRNA
  Il7r_4
cctttgaagtaatcgttatg

SEQ ID NO: 28328 - DNA, 20 bp, Artificial Sequence
  sgRNA
  Il7r_5
cttgggttctggagtttcga

SEQ ID NO: 28329 - DNA, 20 bp, Artificial Sequence
  sgRNA
  Il7r_6
tttctagccaggcatcttaa

SEQ ID NO: 28330 - DNA, 20 bp, Artificial Sequence
  sgRNA
  Il7r_7
tgactgaagtctcaggcgag

SEQ ID NO: 28331 - DNA, 20 bp, Artificial Sequence
  sgRNA
  Il7r_8
gacttccatccacttccaac

SEQ ID NO: 28332 - DNA, 20 bp, Artificial Sequence
  sgRNA
  Il7r_9
gtgccacagccagttggaag

SEQ ID NO: 28333 - DNA, 20 bp, Artificial Sequence
  sgRNA
  Il7r_10
tcaaaggcttctggagcgag

SEQ ID NO: 28334 - DNA, 20 bp, Artificial Sequence
  sgRNA
  Il7r_11
tgatcttcctgcacagccag

SEQ ID NO: 28335 - DNA, 20 bp, Artificial Sequence
  sgRNA
  Il7r_12
tctgtagtcaggggacctag

SEQ ID NO: 28336 - DNA, 20 bp, Artificial Sequence
  sgRNA
  Il7r_13
gcggtttgcactgtgtacag

SEQ ID NO: 28337 - DNA, 20 bp, Artificial Sequence
  sgRNA
  Il7r_14
aatcgttatggggaatggat

SEQ ID NO: 28338 - DNA, 20 bp, Artificial Sequence
  sgRNA
  Il7r_15
cctggactgccagattcatg

SEQ ID NO: 28339 - DNA, 20 bp, Artificial Sequence
  sgRNA
  Il7r_16
tggagaaagtggaaatgccc

SEQ ID NO: 28340 - DNA, 20 bp, Artificial Sequence
  sgRNA
  Il7r_17
gtcaccatctctgtagtcag

SEQ ID NO: 28341 - DNA, 20 bp, Artificial Sequence
  sgRNA
  Il7r_18
aggtcccctgactacagaga

SEQ ID NO: 28342 - DNA, 20 bp, Artificial Sequence
  sgRNA
  Il7r_19
tgtggcctaccgcccagcaa

SEQ ID NO: 28343 - DNA, 20 bp, Artificial Sequence
  sgRNA
  Il7r_20
ggggacctagaggaaaggag

SEQ ID NO: 28344 - DNA, 20 bp, Artificial Sequence
  sgRNA
  Il9r_1
gaatcctggttccatctacg

SEQ ID NO: 28345 - DNA, 20 bp, Artificial Sequence
  sgRNA
  Il9r_2
cagggcaagattgatacccc

SEQ ID NO: 28346 - DNA, 20 bp, Artificial Sequence
  sgRNA
  Il9r_3
caggatcgactgccactggt

SEQ ID NO: 28347 - DNA, 20 bp, Artificial Sequence
  sgRNA
  Il9r_4
gatgcagcggtgaagtgtga

SEQ ID NO: 28348 - DNA, 20 bp, Artificial Sequence
  sgRNA
  Il9r_5
gctacgagctggccttcaag

SEQ ID NO: 28349 - DNA, 20 bp, Artificial Sequence
  sgRNA
  Il9r_6
gcaggtactgtgagtccacc

SEQ ID NO: 28350 - DNA, 20 bp, Artificial Sequence
  sgRNA
  Il9r_7
ccagaacattccatctcccg

SEQ ID NO: 28351 - DNA, 20 bp, Artificial Sequence
  sgRNA
  Il9r_8
gttcctgtcccatgatgcag

SEQ ID NO: 28352 - DNA, 20 bp, Artificial Sequence
  sgRNA
  Il9r_9
gctctgggaccgagactccc

SEQ ID NO: 28353 - DNA, 20 bp, Artificial Sequence
  sgRNA
  Il9r_10
gtctgctctggagtctgccg

SEQ ID NO: 28354 - DNA, 20 bp, Artificial Sequence
  sgRNA
  Il9r_11
gccaggtcactccaacgata

SEQ ID NO: 28355 - DNA, 20 bp, Artificial Sequence
  sgRNA
  Il9r_12
ggtacacatactgtcccaga

SEQ ID NO: 28356 - DNA, 20 bp, Artificial Sequence
  sgRNA
  Il9r_13
ccatggtacacactgtagag

SEQ ID NO: 28357 - DNA, 20 bp, Artificial Sequence
  sgRNA
  Il9r_14
cctcctccagactcagacag

SEQ ID NO: 28358 - DNA, 20 bp, Artificial Sequence
  sgRNA
  Il9r_15
acattgctctgcagatcaga

SEQ ID NO: 28359 - DNA, 20 bp, Artificial Sequence
  sgRNA
  Il9r_16
gtaaatactgttgctgagac

SEQ ID NO: 28360 - DNA, 20 bp, Artificial Sequence
  sgRNA
  Il9r_17
ctggttcctgatctacagct

SEQ ID NO: 28361 - DNA, 20 bp, Artificial Sequence
  sgRNA
  Il9r_18
tgtggcctcccacttcaggc

SEQ ID NO: 28362 - DNA, 20 bp, Artificial Sequence
  sgRNA
  Il9r_19
gacattgctctgcagatcag

SEQ ID NO: 28363 - DNA, 20 bp, Artificial Sequence
  sgRNA
  Il9r_20
gtgacagcttgaacagaagg

SEQ ID NO: 28364 - DNA, 20 bp, Artificial Sequence
  sgRNA
  Ildr1_1
agtatactattgtaccatcg

SEQ ID NO: 28365 - DNA, 20 bp, Artificial Sequence
  sgRNA
  Ildr1_2
gtcacacttgagggtaacgg

SEQ ID NO: 28366 - DNA, 20 bp, Artificial Sequence
  sgRNA
  Ildr1_3
tcagagggaagttcgcatcg

SEQ ID NO: 28367 - DNA, 20 bp, Artificial Sequence
  sgRNA
  Ildr1_4
tggaaaaacccctgtactgg

SEQ ID NO: 28368 - DNA, 20 bp, Artificial Sequence
  sgRNA
  Ildr1_5
ggacaccattagccaccgga

SEQ ID NO: 28369 - DNA, 20 bp, Artificial Sequence
  sgRNA
  Ildr1_6
ggtggtgtagtcacacttga

SEQ ID NO: 28370 - DNA, 20 bp, Artificial Sequence
  sgRNA
  Ildr1_7
gcgatctgagtgagcgcccg

SEQ ID NO: 28371 - DNA, 20 bp, Artificial Sequence
  sgRNA
  Ildr1_8
tgactgtagtgacaatcaga

SEQ ID NO: 28372 - DNA, 20 bp, Artificial Sequence
  sgRNA
  Ildr1_9
agtttggagactgtgagcgg

SEQ ID NO: 28373 - DNA, 20 bp, Artificial Sequence
  sgRNA
  Ildr1_10
gatggctgctcaccctccgg

SEQ ID NO: 28374 - DNA, 20 bp, Artificial Sequence
  sgRNA
  Ildr1_11
ggtgggtctctgattagtgg

SEQ ID NO: 28375 - DNA, 20 bp, Artificial Sequence
  sgRNA
  Ildr1_12
gatttggctctgagatccgc

SEQ ID NO: 28376 - DNA, 20 bp, Artificial Sequence
  sgRNA
  Ildr1_13
ttgtcactacagtcattgga

SEQ ID NO: 28377 - DNA, 20 bp, Artificial Sequence
  sgRNA
  Ildr1_14
gcagagaagtagtcaaagat

SEQ ID NO: 28378 - DNA, 20 bp, Artificial Sequence
  sgRNA
  Ildr1_15
gtcccagtctgaccaaggca

SEQ ID NO: 28379 - DNA, 20 bp, Artificial Sequence
  sgRNA
  Ildr1_16
aggacaccattagccaccgg

SEQ ID NO: 28380 - DNA, 20 bp, Artificial Sequence
  sgRNA
  Ildr1_17
atgactcgctgggcctagag

SEQ ID NO: 28381 - DNA, 20 bp, Artificial Sequence
  sgRNA
  Ildr1_18
tccgagagctccaggaccag

SEQ ID NO: 28382 - DNA, 20 bp, Artificial Sequence
  sgRNA
  Ildr1_19
catgtagcggtggcgggcca

SEQ ID NO: 28383 - DNA, 20 bp, Artificial Sequence
  sgRNA
  Ildr1_20
gattaatgaagtgatgtggt

SEQ ID NO: 28384 - DNA, 20 bp, Artificial Sequence
  sgRNA
  Impg2_1
tctggcaacatggtccacac

SEQ ID NO: 28385 - DNA, 20 bp, Artificial Sequence
  sgRNA
  Impg2_2
gggtatagtagatctaacat

SEQ ID NO: 28386 - DNA, 20 bp, Artificial Sequence
  sgRNA
  Impg2_3
aggttgaaaaagcattcaca

SEQ ID NO: 28387 - DNA, 20 bp, Artificial Sequence
  sgRNA
  Impg2_4
cagaggtgtctggaaaccat

SEQ ID NO: 28388 - DNA, 20 bp, Artificial Sequence
  sgRNA
  Impg2_5
gatgcactattaccaactga

SEQ ID NO: 28389 - DNA, 20 bp, Artificial Sequence
  sgRNA
  Impg2_6
tacaggcctgaaacttgcaa

SEQ ID NO: 28390 - DNA, 20 bp, Artificial Sequence
  sgRNA
  Impg2_7
acaacatgtttgtcacgcgg

SEQ ID NO: 28391 - DNA, 20 bp, Artificial Sequence
  sgRNA
  Impg2_8
tctccagtgcttcctatcca

SEQ ID NO: 28392 - DNA, 20 bp, Artificial Sequence
  sgRNA
  Impg2_9
ctgaaataaactcttccacg

SEQ ID NO: 28393 - DNA, 20 bp, Artificial Sequence
  sgRNA
  Impg2_10
cctgacttctgcttgaacga

SEQ ID NO: 28394 - DNA, 20 bp, Artificial Sequence
  sgRNA
  Impg2_11
ggatatcgataagtactccc

SEQ ID NO: 28395 - DNA, 20 bp, Artificial Sequence
  sgRNA
  Impg2_12
acagggttacctggctacaa

SEQ ID NO: 28396 - DNA, 20 bp, Artificial Sequence
  sgRNA
  Impg2_13
gccgtgtcagagtcttccat

SEQ ID NO: 28397 - DNA, 20 bp, Artificial Sequence
  sgRNA
  Impg2_14
tgacgatattcatcacgccc

SEQ ID NO: 28398 - DNA, 20 bp, Artificial Sequence
  sgRNA
  Impg2_15
cgataagtactccctggacg

SEQ ID NO: 28399 - DNA, 20 bp, Artificial Sequence
  sgRNA
  Impg2_16
gctatagttaccggtaagaa

SEQ ID NO: 28400 - DNA, 20 bp, Artificial Sequence
  sgRNA
  Impg2_17
acagttcacatccagccaag

SEQ ID NO: 28401 - DNA, 20 bp, Artificial Sequence
  sgRNA
  Impg2_18
tcgatcccaaaacgtcctga

SEQ ID NO: 28402 - DNA, 20 bp, Artificial Sequence
  sgRNA
  Impg2_19
gagctaactgaagaacaaca

SEQ ID NO: 28403 - DNA, 20 bp, Artificial Sequence
  sgRNA
  Impg2_20
gttgcggactctacaaagat

SEQ ID NO: 28404 - DNA, 20 bp, Artificial Sequence
  sgRNA
  Insr_1
cgaggattacctgcacaacg

SEQ ID NO: 28405 - DNA, 20 bp, Artificial Sequence
  sgRNA
  Insr_2
gtgataccagagcataggag

SEQ ID NO: 28406 - DNA, 20 bp, Artificial Sequence
  sgRNA
  Insr_3
cacactgcacctctcatctg

SEQ ID NO: 28407 - DNA, 20 bp, Artificial Sequence
  sgRNA
  Insr_4
tatagccagacgggcactcg

SEQ ID NO: 28408 - DNA, 20 bp, Artificial Sequence
  sgRNA
  Insr_5
cctgatcatcaacatccgag

SEQ ID NO: 28409 - DNA, 20 bp, Artificial Sequence
  sgRNA
  Insr_6
tctacgagacagattactat

SEQ ID NO: 28410 - DNA, 20 bp, Artificial Sequence
  sgRNA
  Insr_7
cctggcagctcgaaactgca

SEQ ID NO: 28411 - DNA, 20 bp, Artificial Sequence
  sgRNA
  Insr_8
ataccagagcataggagcgg

SEQ ID NO: 28412 - DNA, 20 bp, Artificial Sequence
  sgRNA
  Insr_9
gcctgatcatcaacatccga

SEQ ID NO: 28413 - DNA, 20 bp, Artificial Sequence
  sgRNA
  Insr_10
aggagatctcggaagtcggg

SEQ ID NO: 28414 - DNA, 20 bp, Artificial Sequence
  sgRNA
  Insr_11
tgacagtcttaaccgcaaca

SEQ ID NO: 28415 - DNA, 20 bp, Artificial Sequence
  sgRNA
  Insr_12
tcacccttcttcgagagctg

SEQ ID NO: 28416 - DNA, 20 bp, Artificial Sequence
  sgRNA
  Insr_13
gaagaagtctccggaactaa

SEQ ID NO: 28417 - DNA, 20 bp, Artificial Sequence
  sgRNA
  Insr_14
gcagccatgtgacttacaga

SEQ ID NO: 28418 - DNA, 20 bp, Artificial Sequence
  sgRNA
  Insr_15
gactttccagaccatagaca

SEQ ID NO: 28419 - DNA, 20 bp, Artificial Sequence
  sgRNA
  Insr_16
caatgtcgttcctctcctga

SEQ ID NO: 28420 - DNA, 20 bp, Artificial Sequence
  sgRNA
  Insr_17
ggtgtatgaaggcaatgcca

SEQ ID NO: 28421 - DNA, 20 bp, Artificial Sequence
  sgRNA
  Insr_18
aatgaggcatcagtcatgaa

SEQ ID NO: 28422 - DNA, 20 bp, Artificial Sequence
  sgRNA
  Insr_19
atccagatagaagttgcgac

SEQ ID NO: 28423 - DNA, 20 bp, Artificial Sequence
  sgRNA
  Insr_20
aatgccaaggatatcatcaa

SEQ ID NO: 28424 - DNA, 20 bp, Artificial Sequence
  sgRNA
  Insrr_1
cagaatgccacagaacacgt

SEQ ID NO: 28425 - DNA, 20 bp, Artificial Sequence
  sgRNA
  Insrr_2
acggcagcccgacgtcccgt

SEQ ID NO: 28426 - DNA, 20 bp, Artificial Sequence
  sgRNA
  Insrr_3
cgggagcgagcgatattgag

SEQ ID NO: 28427 - DNA, 20 bp, Artificial Sequence
  sgRNA
  Insrr_4
aagaacctcaaactaatccg

SEQ ID NO: 28428 - DNA, 20 bp, Artificial Sequence
  sgRNA
  Insrr_5
ggattcggagaggcaccgca

SEQ ID NO: 28429 - DNA, 20 bp, Artificial Sequence
  sgRNA
  Insrr_6
accaccttcggcatctacga

SEQ ID NO: 28430 - DNA, 20 bp, Artificial Sequence
  sgRNA
  Insrr_7
gccactggagaggatttccg

SEQ ID NO: 28431 - DNA, 20 bp, Artificial Sequence
  sgRNA
  Insrr_8
gcaaggctgaaatcaacccc

SEQ ID NO: 28432 - DNA, 20 bp, Artificial Sequence
  sgRNA
  Insrr_9
gcgccaggactcatattggt

SEQ ID NO: 28433 - DNA, 20 bp, Artificial Sequence
  sgRNA
  Insrr_10
catattggtaggtgcccgga

SEQ ID NO: 28434 - DNA, 20 bp, Artificial Sequence
  sgRNA
  Insrr_11
ggaacgcgttgaattcctca

SEQ ID NO: 28435 - DNA, 20 bp, Artificial Sequence
  sgRNA
  Insrr_12
tctgctgtagaagaaaccga

SEQ ID NO: 28436 - DNA, 20 bp, Artificial Sequence
  sgRNA
  Insrr_13
gcggggctcaccattcccgt

SEQ ID NO: 28437 - DNA, 20 bp, Artificial Sequence
  sgRNA
  Insrr_14
catagactcggaacaacagc

SEQ ID NO: 28438 - DNA, 20 bp, Artificial Sequence
  sgRNA
  Insrr_15
tgagacagactattaccgca

SEQ ID NO: 28439 - DNA, 20 bp, Artificial Sequence
  sgRNA
  Insrr_16
catggtgcgtgcaaagacga

SEQ ID NO: 28440 - DNA, 20 bp, Artificial Sequence
  sgRNA
  Insrr_17
ggagctcggtcacctccgag

SEQ ID NO: 28441 - DNA, 20 bp, Artificial Sequence
  sgRNA
  Insrr_18
cgagcagcatgaaccccaca

SEQ ID NO: 28442 - DNA, 20 bp, Artificial Sequence
  sgRNA
  Insrr_19
tgttcgagaaccaccttcag

SEQ ID NO: 28443 - DNA, 20 bp, Artificial Sequence
  sgRNA
  Insrr_20
cccaacctcactgtgatccg

SEQ ID NO: 28444 - DNA, 20 bp, Artificial Sequence
  sgRNA
  Islr2_1
aagattacggtactaaggcg

SEQ ID NO: 28445 - DNA, 20 bp, Artificial Sequence
  sgRNA
  Islr2_2
gcagcgcgctcaagttacga

SEQ ID NO: 28446 - DNA, 20 bp, Artificial Sequence
  sgRNA
  Islr2_3
atggttagacacatagcgag

SEQ ID NO: 28447 - DNA, 20 bp, Artificial Sequence
  sgRNA
  Islr2_4
cacccgtaaggacgttgagt

SEQ ID NO: 28448 - DNA, 20 bp, Artificial Sequence
  sgRNA
  Islr2_5
acgcccaactcaaaaacgtg

SEQ ID NO: 28449 - DNA, 20 bp, Artificial Sequence
  sgRNA
  Islr2_6
gcaccaactcaacgtcctta

SEQ ID NO: 28450 - DNA, 20 bp, Artificial Sequence
  sgRNA
  Islr2_7
ccgcgatgcgtttctccata

SEQ ID NO: 28451 - DNA, 20 bp, Artificial Sequence
  sgRNA
  Islr2_8
tgcgagggccaagaagcgcg

SEQ ID NO: 28452 - DNA, 20 bp, Artificial Sequence
  sgRNA
  Islr2_9
cagatccctgcagatccgat

SEQ ID NO: 28453 - DNA, 20 bp, Artificial Sequence
  sgRNA
  Islr2_10
tctctcccatcggatctgca

SEQ ID NO: 28454 - DNA, 20 bp, Artificial Sequence
  sgRNA
  Islr2_11
agttacgaaggtcgctccaa

SEQ ID NO: 28455 - DNA, 20 bp, Artificial Sequence
  sgRNA
  Islr2_12
ggaagcagtcaacatcgccc

SEQ ID NO: 28456 - DNA, 20 bp, Artificial Sequence
  sgRNA
  Islr2_13
gattacggtactaaggcggg

SEQ ID NO: 28457 - DNA, 20 bp, Artificial Sequence
  sgRNA
  Islr2_14
gcttagtgcgtcgaacgtgc

SEQ ID NO: 28458 - DNA, 20 bp, Artificial Sequence
  sgRNA
  Islr2_15
gtcacgataaccagcaggga

SEQ ID NO: 28459 - DNA, 20 bp, Artificial Sequence
  sgRNA
  Islr2_16
ccgcaggccgcgaaaccagt

SEQ ID NO: 28460 - DNA, 20 bp, Artificial Sequence
  sgRNA
  Islr2_17
gttggcagacagactaagcg

SEQ ID NO: 28461 - DNA, 20 bp, Artificial Sequence
  sgRNA
  Islr2_18
ccaacagagagccatttgcg

SEQ ID NO: 28462 - DNA, 20 bp, Artificial Sequence
  sgRNA
  Islr2_19
cacggtcacgataaccagca

SEQ ID NO: 28463 - DNA, 20 bp, Artificial Sequence
  sgRNA
  Islr2_20
gcgtttctccatagggtccg

SEQ ID NO: 28464 - DNA, 20 bp, Artificial Sequence
  sgRNA
  Itfg1_1
caaccgcagatactgctagg

SEQ ID NO: 28465 - DNA, 20 bp, Artificial Sequence
  sgRNA
  Itfg1_2
gagtgcgttggtaacaagtg

SEQ ID NO: 28466 - DNA, 20 bp, Artificial Sequence
  sgRNA
  Itfg1_3
aaaacctaaaaatctggtgg

SEQ ID NO: 28467 - DNA, 20 bp, Artificial Sequence
  sgRNA
  Itfg1_4
cctcaactccgacaaacaga

SEQ ID NO: 28468 - DNA, 20 bp, Artificial Sequence
  sgRNA
  Itfg1_5
cgagctgcgaagaagtgcat

SEQ ID NO: 28469 - DNA, 20 bp, Artificial Sequence
  sgRNA
  Itfg1_6
cgcgagccccaagaacagcg

SEQ ID NO: 28470 - DNA, 20 bp, Artificial Sequence
  sgRNA
  Itfg1_7
cgatgacagagaaaaacgac

SEQ ID NO: 28471 - DNA, 20 bp, Artificial Sequence
  sgRNA
  Itfg1_8
ccaggctgatttactccaaa

SEQ ID NO: 28472 - DNA, 20 bp, Artificial Sequence
  sgRNA
  Itfg1_9
gcaaatggatatctgaaaaa

SEQ ID NO: 28473 - DNA, 20 bp, Artificial Sequence
  sgRNA
  Itfg1_10
cgcagctcgcattattgcat

SEQ ID NO: 28474 - DNA, 20 bp, Artificial Sequence
  sgRNA
  Itfg1_11
aggccggcttcctagcgcca

SEQ ID NO: 28475 - DNA, 20 bp, Artificial Sequence
  sgRNA
  Itfg1_12
tagaggcagtcaatgtcgtg

SEQ ID NO: 28476 - DNA, 20 bp, Artificial Sequence
  sgRNA
  Itfg1_13
ggcctcagccccaaagagct

SEQ ID NO: 28477 - DNA, 20 bp, Artificial Sequence
  sgRNA
  Itfg1_14
ttactcttagtggtcaaggc

SEQ ID NO: 28478 - DNA, 20 bp, Artificial Sequence
  sgRNA
  Itfg1_15
cgtcacggccgagctctttg

SEQ ID NO: 28479 - DNA, 20 bp, Artificial Sequence
  sgRNA
  Itfg1_16
aatccccatcataatcacca

SEQ ID NO: 28480 - DNA, 20 bp, Artificial Sequence
  sgRNA
  Itfg1_17
agccaaccgcagatactgct

SEQ ID NO: 28481 - DNA, 20 bp, Artificial Sequence
  sgRNA
  Itfg1_18
ctccaatgtgaagtgtgagt

SEQ ID NO: 28482 - DNA, 20 bp, Artificial Sequence
  sgRNA
  Itfg1_19
ttagcaataagggtacactc

SEQ ID NO: 28483 - DNA, 20 bp, Artificial Sequence
  sgRNA
  Itfg1_20
tcgcagctcgcattattgca

SEQ ID NO: 28484 - DNA, 20 bp, Artificial Sequence
  sgRNA
  Itga1_1
attcggattctcgaacggtg

SEQ ID NO: 28485 - DNA, 20 bp, Artificial Sequence
  sgRNA
  Itga1_2
actttagtcaccaatccgaa

SEQ ID NO: 28486 - DNA, 20 bp, Artificial Sequence
  sgRNA
  Itga1_3
gcaaacaaaataggccgcag

SEQ ID NO: 28487 - DNA, 20 bp, Artificial Sequence
  sgRNA
  Itga1_4
tggccggtgtgattgtaccg

SEQ ID NO: 28488 - DNA, 20 bp, Artificial Sequence
  sgRNA
  Itga1_5
gatgcattcggattctcgaa

SEQ ID NO: 28489 - DNA, 20 bp, Artificial Sequence
  sgRNA
  Itga1_6
tatctgcctcagcgaatcaa

SEQ ID NO: 28490 - DNA, 20 bp, Artificial Sequence
  sgRNA
  Itga1_7
tgctgtaaaagacctcaacg

SEQ ID NO: 28491 - DNA, 20 bp, Artificial Sequence
  sgRNA
  Itga1_8
gagatgtgctctatatcgct

SEQ ID NO: 28492 - DNA, 20 bp, Artificial Sequence
  sgRNA
  Itga1_9
catttaaatccatctctccg

SEQ ID NO: 28493 - DNA, 20 bp, Artificial Sequence
  sgRNA
  Itga1_10
atagccatctgacgtcagat

SEQ ID NO: 28494 - DNA, 20 bp, Artificial Sequence
  sgRNA
  Itga1_11
ctatgactggaacggaactg

SEQ ID NO: 28495 - DNA, 20 bp, Artificial Sequence
  sgRNA
  Itga1_12
gttccaaaacgggccccaca

SEQ ID NO: 28496 - DNA, 20 bp, Artificial Sequence
  sgRNA
  Itga1_13
ttagtcaccaatccgaaggg

SEQ ID NO: 28497 - DNA, 20 bp, Artificial Sequence
  sgRNA
  Itga1_14
tcgtctggagaccacccctg

SEQ ID NO: 28498 - DNA, 20 bp, Artificial Sequence
  sgRNA
  Itga1_15
atgcgtttcagacctcaccc

SEQ ID NO: 28499 - DNA, 20 bp, Artificial Sequence
  sgRNA
  Itga1_16
cgatatagagcacatctccc

SEQ ID NO: 28500 - DNA, 20 bp, Artificial Sequence
  sgRNA
  Itga1_17
gggaaggagatgacacgtga

SEQ ID NO: 28501 - DNA, 20 bp, Artificial Sequence
  sgRNA
  Itga1_18
ttatcgtaaagagattccag

SEQ ID NO: 28502 - DNA, 20 bp, Artificial Sequence
  sgRNA
  Itga1_19
ggtgggctcagtttgaaagg

SEQ ID NO: 28503 - DNA, 20 bp, Artificial Sequence
  sgRNA
  Itga1_20
atatccaaagacgggctccc

SEQ ID NO: 28504 - DNA, 20 bp, Artificial Sequence
  sgRNA
  Itga10_1
acttcggccgaagtatcgga

SEQ ID NO: 28505 - DNA, 20 bp, Artificial Sequence
  sgRNA
  Itga10_2
atacccggctctgcaccgtg

SEQ ID NO: 28506 - DNA, 20 bp, Artificial Sequence
  sgRNA
  Itga10_3
actgccaacgaggatccaca

SEQ ID NO: 28507 - DNA, 20 bp, Artificial Sequence
  sgRNA
  Itga10_4
gatgcttcattccggcccca

SEQ ID NO: 28508 - DNA, 20 bp, Artificial Sequence
  sgRNA
  Itga10_5
tggacaacaccacgaagcca

SEQ ID NO: 28509 - DNA, 20 bp, Artificial Sequence
  sgRNA
  Itga10_6
tttcctcgatgtctaaacct

SEQ ID NO: 28510 - DNA, 20 bp, Artificial Sequence
  sgRNA
  Itga10_7
cgtccttatctgtatccaac

SEQ ID NO: 28511 - DNA, 20 bp, Artificial Sequence
  sgRNA
  Itga10_8
ctttgttcggaagtctccca

SEQ ID NO: 28512 - DNA, 20 bp, Artificial Sequence
  sgRNA
  Itga10_9
actaagctggagctgccgag

SEQ ID NO: 28513 - DNA, 20 bp, Artificial Sequence
  sgRNA
  Itga10_10
agcaaggaacctaagtcgga

SEQ ID NO: 28514 - DNA, 20 bp, Artificial Sequence
  sgRNA
  Itga10_11
ggtaggactggtacagtacg

SEQ ID NO: 28515 - DNA, 20 bp, Artificial Sequence
  sgRNA
  Itga10_12
gagtaacagtcgatgtcagg

SEQ ID NO: 28516 - DNA, 20 bp, Artificial Sequence
  sgRNA
  Itga10_13
tgaacagaacggctgccccg

SEQ ID NO: 28517 - DNA, 20 bp, Artificial Sequence
  sgRNA
  Itga10_14
gatcttgtagatgttgccgt

SEQ ID NO: 28518 - DNA, 20 bp, Artificial Sequence
  sgRNA
  Itga10_15
ccgtccttatctgtatccaa

SEQ ID NO: 28519 - DNA, 20 bp, Artificial Sequence
  sgRNA
  Itga10_16
ttcgtaccggatgtaggcag

SEQ ID NO: 28520 - DNA, 20 bp, Artificial Sequence
  sgRNA
  Itga10_17
ccacacttcggccgaagtat

SEQ ID NO: 28521 - DNA, 20 bp, Artificial Sequence
  sgRNA
  Itga10_18
ccacaggccctccgatactt

SEQ ID NO: 28522 - DNA, 20 bp, Artificial Sequence
  sgRNA
  Itga10_19
gcatggttctgcaacgcagg

SEQ ID NO: 28523 - DNA, 20 bp, Artificial Sequence
  sgRNA
  Itga10_20
gcaggcacgagaccaaagag

SEQ ID NO: 28524 - DNA, 20 bp, Artificial Sequence
  sgRNA
  Itga11_1
caacgtgaccagatacgctg

SEQ ID NO: 28525 - DNA, 20 bp, Artificial Sequence
  sgRNA
  Itga11_2
ccaaagtaggagcctatctg

SEQ ID NO: 28526 - DNA, 20 bp, Artificial Sequence
  sgRNA
  Itga11_3
ttaaggtaggactctcggtg

SEQ ID NO: 28527 - DNA, 20 bp, Artificial Sequence
  sgRNA
  Itga11_4
tggcgttgatttgaactaca

SEQ ID NO: 28528 - DNA, 20 bp, Artificial Sequence
  sgRNA
  Itga11_5
tttgggctactacaaccgca

SEQ ID NO: 28529 - DNA, 20 bp, Artificial Sequence
  sgRNA
  Itga11_6
gctgcccacgatgatccaga

SEQ ID NO: 28530 - DNA, 20 bp, Artificial Sequence
  sgRNA
  Itga11_7
gatgattgtcatcacggacg

SEQ ID NO: 28531 - DNA, 20 bp, Artificial Sequence
  sgRNA
  Itga11_8
gcacccatgtacttcagcga

SEQ ID NO: 28532 - DNA, 20 bp, Artificial Sequence
  sgRNA
  Itga11_9
gtacagcagcatgatatcag

SEQ ID NO: 28533 - DNA, 20 bp, Artificial Sequence
  sgRNA
  Itga11_10
cagccccttcatcttccgag

SEQ ID NO: 28534 - DNA, 20 bp, Artificial Sequence
  sgRNA
  Itga11_11
ttgaaaacacagttgaacgg

SEQ ID NO: 28535 - DNA, 20 bp, Artificial Sequence
  sgRNA
  Itga11_12
cagcaccgcagacgataaca

SEQ ID NO: 28536 - DNA, 20 bp, Artificial Sequence
  sgRNA
  Itga11_13
gcagatgatggagaccacgt

SEQ ID NO: 28537 - DNA, 20 bp, Artificial Sequence
  sgRNA
  Itga11_14
tctctggattgatccccctg

SEQ ID NO: 28538 - DNA, 20 bp, Artificial Sequence
  sgRNA
  Itga11_15
attaaggtggaactcatgga

SEQ ID NO: 28539 - DNA, 20 bp, Artificial Sequence
  sgRNA
  Itga11_16
cgttgatttgaactacaggg

SEQ ID NO: 28540 - DNA, 20 bp, Artificial Sequence
  sgRNA
  Itga11_17
agaggaagaccctagccgcc

SEQ ID NO: 28541 - DNA, 20 bp, Artificial Sequence
  sgRNA
  Itga11_18
cattgaggtccagttgtccg

SEQ ID NO: 28542 - DNA, 20 bp, Artificial Sequence
  sgRNA
  Itga11_19
ctgggaccagcaatgacccg

SEQ ID NO: 28543 - DNA, 20 bp, Artificial Sequence
  sgRNA
  Itga11_20
tcattacagccattccagaa

SEQ ID NO: 28544 - DNA, 20 bp, Artificial Sequence
  sgRNA
  Itga2_1
tggccagtataatttgctcg

SEQ ID NO: 28545 - DNA, 20 bp, Artificial Sequence
  sgRNA
  Itga2_2
tacaactacaacatccacga

SEQ ID NO: 28546 - DNA, 20 bp, Artificial Sequence
  sgRNA
  Itga2_3
tcagagctatcgaattcgca

SEQ ID NO: 28547 - DNA, 20 bp, Artificial Sequence
  sgRNA
  Itga2_4
tttcaatgtggccgacgaag

SEQ ID NO: 28548 - DNA, 20 bp, Artificial Sequence
  sgRNA
  Itga2_5
gagaaagcagaagtaccgac

SEQ ID NO: 28549 - DNA, 20 bp, Artificial Sequence
  sgRNA
  Itga2_6
gtaccgacaggggttatcat

SEQ ID NO: 28550 - DNA, 20 bp, Artificial Sequence
  sgRNA
  Itga2_7
gcaatgatgacgagatactg

SEQ ID NO: 28551 - DNA, 20 bp, Artificial Sequence
  sgRNA
  Itga2_8
gcttattcacagacttctgg

SEQ ID NO: 28552 - DNA, 20 bp, Artificial Sequence
  sgRNA
  Itga2_9
ggctactggttggttcaccg

SEQ ID NO: 28553 - DNA, 20 bp, Artificial Sequence
  sgRNA
  Itga2_10
agttcggcatcatacaggag

SEQ ID NO: 28554 - DNA, 20 bp, Artificial Sequence
  sgRNA
  Itga2_11
ctgcctatgataacccctgt

SEQ ID NO: 28555 - DNA, 20 bp, Artificial Sequence
  sgRNA
  Itga2_12
cctgcagtaacatcacctgc

SEQ ID NO: 28556 - DNA, 20 bp, Artificial Sequence
  sgRNA
  Itga2_13
cggtacttctgctttctccg

SEQ ID NO: 28557 - DNA, 20 bp, Artificial Sequence
  sgRNA
  Itga2_14
ataaagaccaacatgagcct

SEQ ID NO: 28558 - DNA, 20 bp, Artificial Sequence
  sgRNA
  Itga2_15
tcgacactcttgatgacaga

SEQ ID NO: 28559 - DNA, 20 bp, Artificial Sequence
  sgRNA
  Itga2_16
catccagggtaacctccagg

SEQ ID NO: 28560 - DNA, 20 bp, Artificial Sequence
  sgRNA
  Itga2_17
ctacaacatccacgagggaa

SEQ ID NO: 28561 - DNA, 20 bp, Artificial Sequence
  sgRNA
  Itga2_18
tgtccacacgcagatccaaa

SEQ ID NO: 28562 - DNA, 20 bp, Artificial Sequence
  sgRNA
  Itga2_19
ggaaagtgcatacaacactg

SEQ ID NO: 28563 - DNA, 20 bp, Artificial Sequence
  sgRNA
  Itga2_20
acttggtgcgaatggtaccc

SEQ ID NO: 28564 - DNA, 20 bp, Artificial Sequence
  sgRNA
  Itga2b_1
gcctatctgccacaccacgg

SEQ ID NO: 28565 - DNA, 20 bp, Artificial Sequence
  sgRNA
  Itga2b_2
gccacaaaagggtacccggg

SEQ ID NO: 28566 - DNA, 20 bp, Artificial Sequence
  sgRNA
  Itga2b_3
cctacacagcgtgtccatcg

SEQ ID NO: 28567 - DNA, 20 bp, Artificial Sequence
  sgRNA
  Itga2b_4
cgatgtctacagcaccacga

SEQ ID NO: 28568 - DNA, 20 bp, Artificial Sequence
  sgRNA
  Itga2b_5
gatgtctacagcaccacgaa

SEQ ID NO: 28569 - DNA, 20 bp, Artificial Sequence
  sgRNA
  Itga2b_6
gctgcagaaacaaataaacg

SEQ ID NO: 28570 - DNA, 20 bp, Artificial Sequence
  sgRNA
  Itga2b_7
gcactaggacccaagaacag

SEQ ID NO: 28571 - DNA, 20 bp, Artificial Sequence
  sgRNA
  Itga2b_8
caggatgtagagcagatccg

SEQ ID NO: 28572 - DNA, 20 bp, Artificial Sequence
  sgRNA
  Itga2b_9
aggatgtagagcagatccga

SEQ ID NO: 28573 - DNA, 20 bp, Artificial Sequence
  sgRNA
  Itga2b_10
gcgctcacgctggtgatgga

SEQ ID NO: 28574 - DNA, 20 bp, Artificial Sequence
  sgRNA
  Itga2b_11
ccacatggccaaaactagca

SEQ ID NO: 28575 - DNA, 20 bp, Artificial Sequence
  sgRNA
  Itga2b_12
ttggctcagctccaaagcgg

SEQ ID NO: 28576 - DNA, 20 bp, Artificial Sequence
  sgRNA
  Itga2b_13
gctcacgctggtgatggacg

SEQ ID NO: 28577 - DNA, 20 bp, Artificial Sequence
  sgRNA
  Itga2b_14
tcttcatcttcctccagagg

SEQ ID NO: 28578 - DNA, 20 bp, Artificial Sequence
  sgRNA
  Itga2b_15
cggctcagcgtcctgtacgg

SEQ ID NO: 28579 - DNA, 20 bp, Artificial Sequence
  sgRNA
  Itga2b_16
gacagggcgagtactctgcg

SEQ ID NO: 28580 - DNA, 20 bp, Artificial Sequence
  sgRNA
  Itga2b_17
atgccagcaggagcacccgg

SEQ ID NO: 28581 - DNA, 20 bp, Artificial Sequence
  sgRNA
  Itga2b_18
catcatctccagctaccgcc

SEQ ID NO: 28582 - DNA, 20 bp, Artificial Sequence
  sgRNA
  Itga2b_19
accccatgaaaaaggacacc

SEQ ID NO: 28583 - DNA, 20 bp, Artificial Sequence
  sgRNA
  Itga2b_20
tctccatgaagccggtgcag

SEQ ID NO: 28584 - DNA, 20 bp, Artificial Sequence
  sgRNA
  Itga3_1
ggctatggagaatcacactg

SEQ ID NO: 28585 - DNA, 20 bp, Artificial Sequence
  sgRNA
  Itga3_2
gtgggcaagtgctatgtgcg

SEQ ID NO: 28586 - DNA, 20 bp, Artificial Sequence
  sgRNA
  Itga3_3
gtacacagcaccagtccggt

SEQ ID NO: 28587 - DNA, 20 bp, Artificial Sequence
  sgRNA
  Itga3_4
aggtagctgtacaaagcgca

SEQ ID NO: 28588 - DNA, 20 bp, Artificial Sequence
  sgRNA
  Itga3_5
tctttccgttcgaagtagta

SEQ ID NO: 28589 - DNA, 20 bp, Artificial Sequence
  sgRNA
  Itga3_6
ttaagccgacccgctactac

SEQ ID NO: 28590 - DNA, 20 bp, Artificial Sequence
  sgRNA
  Itga3_7
tctaccacagcagctccggg

SEQ ID NO: 28591 - DNA, 20 bp, Artificial Sequence
  sgRNA
  Itga3_8
tcgctcagtctgccgatgga

SEQ ID NO: 28592 - DNA, 20 bp, Artificial Sequence
  sgRNA
  Itga3_9
tcatggcaatgacgatagga

SEQ ID NO: 28593 - DNA, 20 bp, Artificial Sequence
  sgRNA
  Itga3_10
gtgccctgtatgaagctaag

SEQ ID NO: 28594 - DNA, 20 bp, Artificial Sequence
  sgRNA
  Itga3_11
gtgctccctactacttcgaa

SEQ ID NO: 28595 - DNA, 20 bp, Artificial Sequence
  sgRNA
  Itga3_12
ggtctgggctagaagaccag

SEQ ID NO: 28596 - DNA, 20 bp, Artificial Sequence
  sgRNA
  Itga3_13
tcacccacagcgaggtcccg

SEQ ID NO: 28597 - DNA, 20 bp, Artificial Sequence
  sgRNA
  Itga3_14
ccatgcagtgcgtatccggg

SEQ ID NO: 28598 - DNA, 20 bp, Artificial Sequence
  sgRNA
  Itga3_15
gcagcacgatgtggtccgac

SEQ ID NO: 28599 - DNA, 20 bp, Artificial Sequence
  sgRNA
  Itga3_16
aatgacctacagctcgaccc

SEQ ID NO: 28600 - DNA, 20 bp, Artificial Sequence
  sgRNA
  Itga3_17
atgtctgccagtcatcgccg

SEQ ID NO: 28601 - DNA, 20 bp, Artificial Sequence
  sgRNA
  Itga3_18
caattcaccgagcagccaac

SEQ ID NO: 28602 - DNA, 20 bp, Artificial Sequence
  sgRNA
  Itga3_19
ggctgccatgaaaactgcgg

SEQ ID NO: 28603 - DNA, 20 bp, Artificial Sequence
  sgRNA
  Itga3_20
gcccatatgttggtgccgtg

SEQ ID NO: 28604 - DNA, 20 bp, Artificial Sequence
  sgRNA
  Itga4_1
agtccagtacgatgatcccg

SEQ ID NO: 28605 - DNA, 20 bp, Artificial Sequence
  sgRNA
  Itga4_2
gcactcctacaacctggacc

SEQ ID NO: 28606 - DNA, 20 bp, Artificial Sequence
  sgRNA
  Itga4_3
tcttctgctgaaggatcggc

SEQ ID NO: 28607 - DNA, 20 bp, Artificial Sequence
  sgRNA
  Itga4_4
atgacgtagcaaatgccagt

SEQ ID NO: 28608 - DNA, 20 bp, Artificial Sequence
  sgRNA
  Itga4_5
ttgtacttcggggtgccaac

SEQ ID NO: 28609 - DNA, 20 bp, Artificial Sequence
  sgRNA
  Itga4_6
tgaacaacttatcatcttga

SEQ ID NO: 28610 - DNA, 20 bp, Artificial Sequence
  sgRNA
  Itga4_7
tagccaaacagcgtgccgga

SEQ ID NO: 28611 - DNA, 20 bp, Artificial Sequence
  sgRNA
  Itga4_8
acagcatcaccgcttcccgg

SEQ ID NO: 28612 - DNA, 20 bp, Artificial Sequence
  sgRNA
  Itga4_9
ggtgctgtctacatttacaa

SEQ ID NO: 28613 - DNA, 20 bp, Artificial Sequence
  sgRNA
  Itga4_10
gggacttctgacgtgattac

SEQ ID NO: 28614 - DNA, 20 bp, Artificial Sequence
  sgRNA
  Itga4_11
tcctatctgttcgtgttgag

SEQ ID NO: 28615 - DNA, 20 bp, Artificial Sequence
  sgRNA
  Itga4_12
ccacatactaccgaagtcgt

SEQ ID NO: 28616 - DNA, 20 bp, Artificial Sequence
  sgRNA
  Itga4_13
gggcgaattggaccaagtga

SEQ ID NO: 28617 - DNA, 20 bp, Artificial Sequence
  sgRNA
  Itga4_14
aggttatgctgactgttcat

SEQ ID NO: 28618 - DNA, 20 bp, Artificial Sequence
  sgRNA
  Itga4_15
ggggagttggacattcagag

SEQ ID NO: 28619 - DNA, 20 bp, Artificial Sequence
  sgRNA
  Itga4_16
gtagccaaacagcgtgccgg

SEQ ID NO: 28620 - DNA, 20 bp, Artificial Sequence
  sgRNA
  Itga4_17
ggatgtgagctcactcagca

SEQ ID NO: 28621 - DNA, 20 bp, Artificial Sequence
  sgRNA
  Itga4_18
catgacgtagcaaatgccag

SEQ ID NO: 28622 - DNA, 20 bp, Artificial Sequence
  sgRNA
  Itga4_19
tggaggagattccatcgact

SEQ ID NO: 28623 - DNA, 20 bp, Artificial Sequence
  sgRNA
  Itga4_20
gagaatgcactgctgtacca

SEQ ID NO: 28624 - DNA, 20 bp, Artificial Sequence
  sgRNA
  Itga5_1
tttgctgtcaaattgaatgg

SEQ ID NO: 28625 - DNA, 20 bp, Artificial Sequence
  sgRNA
  Itga5_2
gtcttacatagccataggtg

SEQ ID NO: 28626 - DNA, 20 bp, Artificial Sequence
  sgRNA
  Itga5_3
gacccacagaatgacccagt

SEQ ID NO: 28627 - DNA, 20 bp, Artificial Sequence
  sgRNA
  Itga5_4
gtcgtatttatattcccggg

SEQ ID NO: 28628 - DNA, 20 bp, Artificial Sequence
  sgRNA
  Itga5_5
gctaggatgatgatccacaa

SEQ ID NO: 28629 - DNA, 20 bp, Artificial Sequence
  sgRNA
  Itga5_6
tctgtgcgccagctatacag

SEQ ID NO: 28630 - DNA, 20 bp, Artificial Sequence
  sgRNA
  Itga5_7
gggcccagctccatcagcca

SEQ ID NO: 28631 - DNA, 20 bp, Artificial Sequence
  sgRNA
  Itga5_8
tgagtactcggcctctagag

SEQ ID NO: 28632 - DNA, 20 bp, Artificial Sequence
  sgRNA
  Itga5_9
gcagactacggctctcttgg

SEQ ID NO: 28633 - DNA, 20 bp, Artificial Sequence
  sgRNA
  Itga5_10
aagtcaggaacagtgcccgc

SEQ ID NO: 28634 - DNA, 20 bp, Artificial Sequence
  sgRNA
  Itga5_11
cagatctcgtcctcctcgaa

SEQ ID NO: 28635 - DNA, 20 bp, Artificial Sequence
  sgRNA
  Itga5_12
ggtagtgtagaactggccgg

SEQ ID NO: 28636 - DNA, 20 bp, Artificial Sequence
  sgRNA
  Itga5_13
tgttgctccgaaccactgca

SEQ ID NO: 28637 - DNA, 20 bp, Artificial Sequence
  sgRNA
  Itga5_14
tcccggccggtaaaactcca

SEQ ID NO: 28638 - DNA, 20 bp, Artificial Sequence
  sgRNA
  Itga5_15
gatgcgctggcagatatgat

SEQ ID NO: 28639 - DNA, 20 bp, Artificial Sequence
  sgRNA
  Itga5_16
gcagctccttgacacccttg

SEQ ID NO: 28640 - DNA, 20 bp, Artificial Sequence
  sgRNA
  Itga5_17
tttgttgctggcgtgcccaa

SEQ ID NO: 28641 - DNA, 20 bp, Artificial Sequence
  sgRNA
  Itga5_18
tctccacagaaaacttcacc

SEQ ID NO: 28642 - DNA, 20 bp, Artificial Sequence
  sgRNA
  Itga5_19
gcgctcctctgggttgaaca

SEQ ID NO: 28643 - DNA, 20 bp, Artificial Sequence
  sgRNA
  Itga5_20
gcctcgatctcctctccacg

SEQ ID NO: 28644 - DNA, 20 bp, Artificial Sequence
  sgRNA
  Itga6_1
gaggggacatcgccttactt

SEQ ID NO: 28645 - DNA, 20 bp, Artificial Sequence
  sgRNA
  Itga6_2
gcagagggcgaacagaacag

SEQ ID NO: 28646 - DNA, 20 bp, Artificial Sequence
  sgRNA
  Itga6_3
gagtatatatttgacggaga

SEQ ID NO: 28647 - DNA, 20 bp, Artificial Sequence
  sgRNA
  Itga6_4
ggagactggagtttctgcga

SEQ ID NO: 28648 - DNA, 20 bp, Artificial Sequence
  sgRNA
  Itga6_5
ggggattccttggatccgaa

SEQ ID NO: 28649 - DNA, 20 bp, Artificial Sequence
  sgRNA
  Itga6_6
cttcaacctggacacccgcg

SEQ ID NO: 28650 - DNA, 20 bp, Artificial Sequence
  sgRNA
  Itga6_7
ctttccggatccgcaccgca

SEQ ID NO: 28651 - DNA, 20 bp, Artificial Sequence
  sgRNA
  Itga6_8
gcctgctctacctgtccgcg

SEQ ID NO: 28652 - DNA, 20 bp, Artificial Sequence
  sgRNA
  Itga6_9
gcatcgtcgccatctttccg

SEQ ID NO: 28653 - DNA, 20 bp, Artificial Sequence
  sgRNA
  Itga6_10
tgccacatcatagccaaacg

SEQ ID NO: 28654 - DNA, 20 bp, Artificial Sequence
  sgRNA
  Itga6_11
gctccaagagccaatcacag

SEQ ID NO: 28655 - DNA, 20 bp, Artificial Sequence
  sgRNA
  Itga6_12
cagcattccccgataccatg

SEQ ID NO: 28656 - DNA, 20 bp, Artificial Sequence
  sgRNA
  Itga6_13
ttacgatgccacctatcaca

SEQ ID NO: 28657 - DNA, 20 bp, Artificial Sequence
  sgRNA
  Itga6_14
gagctccctatgatgatctg

SEQ ID NO: 28658 - DNA, 20 bp, Artificial Sequence
  sgRNA
  Itga6_15
ataacctcgaaaaaaaacag

SEQ ID NO: 28659 - DNA, 20 bp, Artificial Sequence
  sgRNA
  Itga6_16
gcttctcgctcgccatgcac

SEQ ID NO: 28660 - DNA, 20 bp, Artificial Sequence
  sgRNA
  Itga6_17
ccatccctatcaaaatactg

SEQ ID NO: 28661 - DNA, 20 bp, Artificial Sequence
  sgRNA
  Itga6_18
aatatcaagctccctcacgc

SEQ ID NO: 28662 - DNA, 20 bp, Artificial Sequence
  sgRNA
  Itga6_19
gtctctccaccaacttcata

SEQ ID NO: 28663 - DNA, 20 bp, Artificial Sequence
  sgRNA
  Itga6_20
tggtggacctcaatgcagat

SEQ ID NO: 28664 - DNA, 20 bp, Artificial Sequence
  sgRNA
  Itga7_1
ggttcggagaccatatgaca

SEQ ID NO: 28665 - DNA, 20 bp, Artificial Sequence
  sgRNA
  Itga7_2
gtgtatgtgtacatgaacca

SEQ ID NO: 28666 - DNA, 20 bp, Artificial Sequence
  sgRNA
  Itga7_3
cccactcaatgcgaacaggg

SEQ ID NO: 28667 - DNA, 20 bp, Artificial Sequence
  sgRNA
  Itga7_4
cttagattatatgttagatg

SEQ ID NO: 28668 - DNA, 20 bp, Artificial Sequence
  sgRNA
  Itga7_5
ataagatagtagattccggg

SEQ ID NO: 28669 - DNA, 20 bp, Artificial Sequence
  sgRNA
  Itga7_6
gactcctgagtaccgtagag

SEQ ID NO: 28670 - DNA, 20 bp, Artificial Sequence
  sgRNA
  Itga7_7
gcggccccagacgtgaagca

SEQ ID NO: 28671 - DNA, 20 bp, Artificial Sequence
  sgRNA
  Itga7_8
cgtgtgacgtttctgagccg

SEQ ID NO: 28672 - DNA, 20 bp, Artificial Sequence
  sgRNA
  Itga7_9
ggggactccttccacaacca

SEQ ID NO: 28673 - DNA, 20 bp, Artificial Sequence
  sgRNA
  Itga7_10
ggaaggtctttatctaccat

SEQ ID NO: 28674 - DNA, 20 bp, Artificial Sequence
  sgRNA
  Itga7_11
tcacacgtggaacctggccc

SEQ ID NO: 28675 - DNA, 20 bp, Artificial Sequence
  sgRNA
  Itga7_12
actgctgtcggtcttcccga

SEQ ID NO: 28676 - DNA, 20 bp, Artificial Sequence
  sgRNA
  Itga7_13
ggccggagaaaatcgcacct

SEQ ID NO: 28677 - DNA, 20 bp, Artificial Sequence
  sgRNA
  Itga7_14
aatgaagacatgagcccgaa

SEQ ID NO: 28678 - DNA, 20 bp, Artificial Sequence
  sgRNA
  Itga7_15
ttcctggagccccaaagacg

SEQ ID NO: 28679 - DNA, 20 bp, Artificial Sequence
  sgRNA
  Itga7_16
gtacatggccgtgaaatccc

SEQ ID NO: 28680 - DNA, 20 bp, Artificial Sequence
  sgRNA
  Itga7_17
gtacttggaccccatggccg

SEQ ID NO: 28681 - DNA, 20 bp, Artificial Sequence
  sgRNA
  Itga7_18
ggggagccacagattcggag

SEQ ID NO: 28682 - DNA, 20 bp, Artificial Sequence
  sgRNA
  Itga7_19
ggggtcaatgaagatctctt

SEQ ID NO: 28683 - DNA, 20 bp, Artificial Sequence
  sgRNA
  Itga7_20
gcacaacctcaggtatcaag

SEQ ID NO: 28684 - DNA, 20 bp, Artificial Sequence
  sgRNA
  Itga8_1
cagccggatatcgtagaagg

SEQ ID NO: 28685 - DNA, 20 bp, Artificial Sequence
  sgRNA
  Itga8_2
tttgcaggcaaggatcaacg

SEQ ID NO: 28686 - DNA, 20 bp, Artificial Sequence
  sgRNA
  Itga8_3
atatacttactgtttcgaca

SEQ ID NO: 28687 - DNA, 20 bp, Artificial Sequence
  sgRNA
  Itga8_4
aattctcgctccataaagag

SEQ ID NO: 28688 - DNA, 20 bp, Artificial Sequence
  sgRNA
  Itga8_5
agttgaacgccagacacgca

SEQ ID NO: 28689 - DNA, 20 bp, Artificial Sequence
  sgRNA
  Itga8_6
ccccttctacgatatccggc

SEQ ID NO: 28690 - DNA, 20 bp, Artificial Sequence
  sgRNA
  Itga8_7
gaacccactgtggtcccccg

SEQ ID NO: 28691 - DNA, 20 bp, Artificial Sequence
  sgRNA
  Itga8_8
agtgacagcattcttgacgt

SEQ ID NO: 28692 - DNA, 20 bp, Artificial Sequence
  sgRNA
  Itga8_9
agacctgtcccacttctcta

SEQ ID NO: 28693 - DNA, 20 bp, Artificial Sequence
  sgRNA
  Itga8_10
gctcccccttctacgatatc

SEQ ID NO: 28694 - DNA, 20 bp, Artificial Sequence
  sgRNA
  Itga8_11
cgttgatccttgcctgcaaa

SEQ ID NO: 28695 - DNA, 20 bp, Artificial Sequence
  sgRNA
  Itga8_12
ggaccacagcatccccagcg

SEQ ID NO: 28696 - DNA, 20 bp, Artificial Sequence
  sgRNA
  Itga8_13
cgaaggccaaggttactgcc

SEQ ID NO: 28697 - DNA, 20 bp, Artificial Sequence
  sgRNA
  Itga8_14
gccacagtgagagctcacaa

SEQ ID NO: 28698 - DNA, 20 bp, Artificial Sequence
  sgRNA
  Itga8_15
catcagcctgaactacagtt

SEQ ID NO: 28699 - DNA, 20 bp, Artificial Sequence
  sgRNA
  Itga8_16
tggatgggcagaacaatctg

SEQ ID NO: 28700 - DNA, 20 bp, Artificial Sequence
  sgRNA
  Itga8_17
gtgtgaccttgggaacccga

SEQ ID NO: 28701 - DNA, 20 bp, Artificial Sequence
  sgRNA
  Itga8_18
aaatcctgagatcaacccac

SEQ ID NO: 28702 - DNA, 20 bp, Artificial Sequence
  sgRNA
  Itga8_19
attgctcaggtcgaaatcag

SEQ ID NO: 28703 - DNA, 20 bp, Artificial Sequence
  sgRNA
  Itga8_20
tctgatttcgacctgagcaa

SEQ ID NO: 28704 - DNA, 20 bp, Artificial Sequence
  sgRNA
  Itga9_1
acagcacctcagtgtcacga

SEQ ID NO: 28705 - DNA, 20 bp, Artificial Sequence
  sgRNA
  Itga9_2
cgaagtgtgtcatcactacg

SEQ ID NO: 28706 - DNA, 20 bp, Artificial Sequence
  sgRNA
  Itga9_3
ggagacattaaaggacacgt

SEQ ID NO: 28707 - DNA, 20 bp, Artificial Sequence
  sgRNA
  Itga9_4
tttgggcagtccatatcagg

SEQ ID NO: 28708 - DNA, 20 bp, Artificial Sequence
  sgRNA
  Itga9_5
attactctccaggtaccgac

SEQ ID NO: 28709 - DNA, 20 bp, Artificial Sequence
  sgRNA
  Itga9_6
ttgcacaatctggaaccccg

SEQ ID NO: 28710 - DNA, 20 bp, Artificial Sequence
  sgRNA
  Itga9_7
caccccacaacgtagccacg

SEQ ID NO: 28711 - DNA, 20 bp, Artificial Sequence
  sgRNA
  Itga9_8
ggactgcccaaacatccgca

SEQ ID NO: 28712 - DNA, 20 bp, Artificial Sequence
  sgRNA
  Itga9_9
ggggagaccgggatgacgag

SEQ ID NO: 28713 - DNA, 20 bp, Artificial Sequence
  sgRNA
  Itga9_10
tgttcttgagggatgatgca

SEQ ID NO: 28714 - DNA, 20 bp, Artificial Sequence
  sgRNA
  Itga9_11
ggggtgtgaccgctcacgcg

SEQ ID NO: 28715 - DNA, 20 bp, Artificial Sequence
  sgRNA
  Itga9_12
tgttgtttggagagacggca

SEQ ID NO: 28716 - DNA, 20 bp, Artificial Sequence
  sgRNA
  Itga9_13
cctaccacatcagtgatgga

SEQ ID NO: 28717 - DNA, 20 bp, Artificial Sequence
  sgRNA
  Itga9_14
agagtggtggagatagctaa

SEQ ID NO: 28718 - DNA, 20 bp, Artificial Sequence
  sgRNA
  Itga9_15
gagacatccaccgtgatgac

SEQ ID NO: 28719 - DNA, 20 bp, Artificial Sequence
  sgRNA
  Itga9_16
ggaggctaaacccgaccctg

SEQ ID NO: 28720 - DNA, 20 bp, Artificial Sequence
  sgRNA
  Itga9_17
ctgccttcggtgcacccacg

SEQ ID NO: 28721 - DNA, 20 bp, Artificial Sequence
  sgRNA
  Itga9_18
agccttcctgtccgacagcg

SEQ ID NO: 28722 - DNA, 20 bp, Artificial Sequence
  sgRNA
  Itga9_19
gtttgggcagtccatatcag

SEQ ID NO: 28723 - DNA, 20 bp, Artificial Sequence
  sgRNA
  Itga9_20
gtgacattcaggcagttcac

SEQ ID NO: 28724 - DNA, 20 bp, Artificial Sequence
  sgRNA
  Itgad_1
agcagagctatcttaccgac

SEQ ID NO: 28725 - DNA, 20 bp, Artificial Sequence
  sgRNA
  Itgad_2
gctggacgatggcatccacc

SEQ ID NO: 28726 - DNA, 20 bp, Artificial Sequence
  sgRNA
  Itgad_3
acttcaccggaagctccagc

SEQ ID NO: 28727 - DNA, 20 bp, Artificial Sequence
  sgRNA
  Itgad_4
gcatcctctttgaacacgac

SEQ ID NO: 28728 - DNA, 20 bp, Artificial Sequence
  sgRNA
  Itgad_5
gctgctcttgaattccgtga

SEQ ID NO: 28729 - DNA, 20 bp, Artificial Sequence
  sgRNA
  Itgad_6
gtatagaccgtgtacttcac

SEQ ID NO: 28730 - DNA, 20 bp, Artificial Sequence
  sgRNA
  Itgad_7
ccactgagctgaacaccatg

SEQ ID NO: 28731 - DNA, 20 bp, Artificial Sequence
  sgRNA
  Itgad_8
tgactgccaccgcctccaga

SEQ ID NO: 28732 - DNA, 20 bp, Artificial Sequence
  sgRNA
  Itgad_9
tcatccgtacccactacgcc

SEQ ID NO: 28733 - DNA, 20 bp, Artificial Sequence
  sgRNA
  Itgad_10
aatgaagtcaagctcatcca

SEQ ID NO: 28734 - DNA, 20 bp, Artificial Sequence
  sgRNA
  Itgad_11
ttgaacacgtggtcctgcga

SEQ ID NO: 28735 - DNA, 20 bp, Artificial Sequence
  sgRNA
  Itgad_12
ccagggataagttaaggcgc

SEQ ID NO: 28736 - DNA, 20 bp, Artificial Sequence
  sgRNA
  Itgad_13
ggagcttccggtgaagtaca

SEQ ID NO: 28737 - DNA, 20 bp, Artificial Sequence
  sgRNA
  Itgad_14
gttactggctctcatcactg

SEQ ID NO: 28738 - DNA, 20 bp, Artificial Sequence
  sgRNA
  Itgad_15
aattgcccaccttgaacacg

SEQ ID NO: 28739 - DNA, 20 bp, Artificial Sequence
  sgRNA
  Itgad_16
tgacatgtctatactccagg

SEQ ID NO: 28740 - DNA, 20 bp, Artificial Sequence
  sgRNA
  Itgad_17
gaagcccgtcgtgttcaaag

SEQ ID NO: 28741 - DNA, 20 bp, Artificial Sequence
  sgRNA
  Itgad_18
gttaaggcgcaggatgatag

SEQ ID NO: 28742 - DNA, 20 bp, Artificial Sequence
  sgRNA
  Itgad_19
tgcatcctctttgaacacga

SEQ ID NO: 28743 - DNA, 20 bp, Artificial Sequence
  sgRNA
  Itgad_20
cctgcgccttaacttatccc

SEQ ID NO: 28744 - DNA, 20 bp, Artificial Sequence
  sgRNA
  Itgae_1
tactcaccaaaacaccattg

SEQ ID NO: 28745 - DNA, 20 bp, Artificial Sequence
  sgRNA
  Itgae_2
tccttctatccgtcgcacaa

SEQ ID NO: 28746 - DNA, 20 bp, Artificial Sequence
  sgRNA
  Itgae_3
atacggtcaggtcaaccaca

SEQ ID NO: 28747 - DNA, 20 bp, Artificial Sequence
  sgRNA
  Itgae_4
ctgtgcgagttgatattgaa

SEQ ID NO: 28748 - DNA, 20 bp, Artificial Sequence
  sgRNA
  Itgae_5
gatgttcctcaactttacgg

SEQ ID NO: 28749 - DNA, 20 bp, Artificial Sequence
  sgRNA
  Itgae_6
agttggctctcgggactcgg

SEQ ID NO: 28750 - DNA, 20 bp, Artificial Sequence
  sgRNA
  Itgae_7
gcggtgctacacaaggccca

SEQ ID NO: 28751 - DNA, 20 bp, Artificial Sequence
  sgRNA
  Itgae_8
ctgcagtgtgaggactcgag

SEQ ID NO: 28752 - DNA, 20 bp, Artificial Sequence
  sgRNA
  Itgae_9
tctggccaaagacttctcat

SEQ ID NO: 28753 - DNA, 20 bp, Artificial Sequence
  sgRNA
  Itgae_10
tgacagtcgtaagattgaga

SEQ ID NO: 28754 - DNA, 20 bp, Artificial Sequence
  sgRNA
  Itgae_11
gtgttcatgtacatcactga

SEQ ID NO: 28755 - DNA, 20 bp, Artificial Sequence
  sgRNA
  Itgae_12
gccgaagtagtggagtcccg

SEQ ID NO: 28756 - DNA, 20 bp, Artificial Sequence
  sgRNA
  Itgae_13
ggagctcaaacacagcccca

SEQ ID NO: 28757 - DNA, 20 bp, Artificial Sequence
  sgRNA
  Itgae_14
acaggatcgcttccacacgc

SEQ ID NO: 28758 - DNA, 20 bp, Artificial Sequence
  sgRNA
  Itgae_15
ggatatagcgcatcgataca

SEQ ID NO: 28759 - DNA, 20 bp, Artificial Sequence
  sgRNA
  Itgae_16
gccattgaaatctaacccac

SEQ ID NO: 28760 - DNA, 20 bp, Artificial Sequence
  sgRNA
  Itgae_17
aatatcttcattccaagccg

SEQ ID NO: 28761 - DNA, 20 bp, Artificial Sequence
  sgRNA
  Itgae_18
tgaaattgcttgccagccag

SEQ ID NO: 28762 - DNA, 20 bp, Artificial Sequence
  sgRNA
  Itgae_19
acattggtcgggaaccacaa

SEQ ID NO: 28763 - DNA, 20 bp, Artificial Sequence
  sgRNA
  Itgae_20
tatagcgcatcgatacaggg

SEQ ID NO: 28764 - DNA, 20 bp, Artificial Sequence
  sgRNA
  Itgal_1
cataacccgctacatcatcg

SEQ ID NO: 28765 - DNA, 20 bp, Artificial Sequence
  sgRNA
  Itgal_2
cgctgcctagcagaacatcg

SEQ ID NO: 28766 - DNA, 20 bp, Artificial Sequence
  sgRNA
  Itgal_3
gaaacacggagtcaagctca

SEQ ID NO: 28767 - DNA, 20 bp, Artificial Sequence
  sgRNA
  Itgal_4
aacaccaagggaccaaaagg

SEQ ID NO: 28768 - DNA, 20 bp, Artificial Sequence
  sgRNA
  Itgal_5
ggatcaggtcaaccttcacg

SEQ ID NO: 28769 - DNA, 20 bp, Artificial Sequence
  sgRNA
  Itgal_6
gcggctccaaaccgaccaag

SEQ ID NO: 28770 - DNA, 20 bp, Artificial Sequence
  sgRNA
  Itgal_7
aagcatctccactttccgga

SEQ ID NO: 28771 - DNA, 20 bp, Artificial Sequence
  sgRNA
  Itgal_8
gctgtccaattgtcttcagg

SEQ ID NO: 28772 - DNA, 20 bp, Artificial Sequence
  sgRNA
  Itgal_9
ttagacctggacttccctcg

SEQ ID NO: 28773 - DNA, 20 bp, Artificial Sequence
  sgRNA
  Itgal_10
catccaagtgacggggaccg

SEQ ID NO: 28774 - DNA, 20 bp, Artificial Sequence
  sgRNA
  Itgal_11
gcgtgttaaacatcacctgg

SEQ ID NO: 28775 - DNA, 20 bp, Artificial Sequence
  sgRNA
  Itgal_12
gtatggcagcaaagcctccg

SEQ ID NO: 28776 - DNA, 20 bp, Artificial Sequence
  sgRNA
  Itgal_13
agatcctcatccaagtgacg

SEQ ID NO: 28777 - DNA, 20 bp, Artificial Sequence
  sgRNA
  Itgal_14
ggatggagcggccaaaccac

SEQ ID NO: 28778 - DNA, 20 bp, Artificial Sequence
  sgRNA
  Itgal_15
cttcacgtgtacgtactcag

SEQ ID NO: 28779 - DNA, 20 bp, Artificial Sequence
  sgRNA
  Itgal_16
acaaggtacgagctttcaga

SEQ ID NO: 28780 - DNA, 20 bp, Artificial Sequence
  sgRNA
  Itgal_17
cttccccaggtactgccaga

SEQ ID NO: 28781 - DNA, 20 bp, Artificial Sequence
  sgRNA
  Itgal_18
cacgctgcctagcagaacat

SEQ ID NO: 28782 - DNA, 20 bp, Artificial Sequence
  sgRNA
  Itgal_19
gtttggccgctccatccatg

SEQ ID NO: 28783 - DNA, 20 bp, Artificial Sequence
  sgRNA
  Itgal_20
ggcagaggacatcagacgca

SEQ ID NO: 28784 - DNA, 20 bp, Artificial Sequence
  sgRNA
  Itgam_1
agggatgaccctgatcaccg

SEQ ID NO: 28785 - DNA, 20 bp, Artificial Sequence
  sgRNA
  Itgam_2
tgggcgcctatgatccgctg

SEQ ID NO: 28786 - DNA, 20 bp, Artificial Sequence
  sgRNA
  Itgam_3
cctgcgcctcaattatacac

SEQ ID NO: 28787 - DNA, 20 bp, Artificial Sequence
  sgRNA
  Itgam_4
ggtcattcgctacgtaattg

SEQ ID NO: 28788 - DNA, 20 bp, Artificial Sequence
  sgRNA
  Itgam_5
gctgccccaaagcgacccca

SEQ ID NO: 28789 - DNA, 20 bp, Artificial Sequence
  sgRNA
  Itgam_6
aagccaatatgctgataccg

SEQ ID NO: 28790 - DNA, 20 bp, Artificial Sequence
  sgRNA
  Itgam_7
cattactatgagaagacccg

SEQ ID NO: 28791 - DNA, 20 bp, Artificial Sequence
  sgRNA
  Itgam_8
cactcatgttaaagtcctgg

SEQ ID NO: 28792 - DNA, 20 bp, Artificial Sequence
  sgRNA
  Itgam_9
aactggtcggaggttcccaa

SEQ ID NO: 28793 - DNA, 20 bp, Artificial Sequence
  sgRNA
  Itgam_10
agtgtgactacagcacaagc

SEQ ID NO: 28794 - DNA, 20 bp, Artificial Sequence
  sgRNA
  Itgam_11
atgacatccttataatccaa

SEQ ID NO: 28795 - DNA, 20 bp, Artificial Sequence
  sgRNA
  Itgam_12
tgggtagtagacggtaacct

SEQ ID NO: 28796 - DNA, 20 bp, Artificial Sequence
  sgRNA
  Itgam_13
ccatagccagaactggtcgg

SEQ ID NO: 28797 - DNA, 20 bp, Artificial Sequence
  sgRNA
  Itgam_14
tgatgtaccagtcaaatgat

SEQ ID NO: 28798 - DNA, 20 bp, Artificial Sequence
  sgRNA
  Itgam_15
tcacattgttgatctgaaca

SEQ ID NO: 28799 - DNA, 20 bp, Artificial Sequence
  sgRNA
  Itgam_16
ccgtgtccgcaagaacacca

SEQ ID NO: 28800 - DNA, 20 bp, Artificial Sequence
  sgRNA
  Itgam_17
aatcctgtaccactcattgt

SEQ ID NO: 28801 - DNA, 20 bp, Artificial Sequence
  sgRNA
  Itgam_18
catccatagccagaactggt

SEQ ID NO: 28802 - DNA, 20 bp, Artificial Sequence
  sgRNA
  Itgam_19
gatcttcgcagcattctccc

SEQ ID NO: 28803 - DNA, 20 bp, Artificial Sequence
  sgRNA
  Itgam_20
gagccccacactagcatcaa

SEQ ID NO: 28804 - DNA, 20 bp, Artificial Sequence
  sgRNA
  Itgav_1
ggtgccatctcaaatcctcg

SEQ ID NO: 28805 - DNA, 20 bp, Artificial Sequence
  sgRNA
  Itgav_2
tcatggaccgaggttccgat

SEQ ID NO: 28806 - DNA, 20 bp, Artificial Sequence
  sgRNA
  Itgav_3
cctgcatggagcatactcaa

SEQ ID NO: 28807 - DNA, 20 bp, Artificial Sequence
  sgRNA
  Itgav_4
ataataaccaattagcaaca

SEQ ID NO: 28808 - DNA, 20 bp, Artificial Sequence
  sgRNA
  Itgav_5
gccgagtatgcgggtcccga

SEQ ID NO: 28809 - DNA, 20 bp, Artificial Sequence
  sgRNA
  Itgav_6
accgcaggctgacttcatcg

SEQ ID NO: 28810 - DNA, 20 bp, Artificial Sequence
  sgRNA
  Itgav_7
gtatcggttggaccagagaa

SEQ ID NO: 28811 - DNA, 20 bp, Artificial Sequence
  sgRNA
  Itgav_8
ccttcacagtcagtgtcaga

SEQ ID NO: 28812 - DNA, 20 bp, Artificial Sequence
  sgRNA
  Itgav_9
tatggagaaacagtgctcgt

SEQ ID NO: 28813 - DNA, 20 bp, Artificial Sequence
  sgRNA
  Itgav_10
tgacgggccaatgaactgca

SEQ ID NO: 28814 - DNA, 20 bp, Artificial Sequence
  sgRNA
  Itgav_11
gcccccctgttcatggaccg

SEQ ID NO: 28815 - DNA, 20 bp, Artificial Sequence
  sgRNA
  Itgav_12
ggtgggacttaaactccagt

SEQ ID NO: 28816 - DNA, 20 bp, Artificial Sequence
  sgRNA
  Itgav_13
gtgaacatctccctctctga

SEQ ID NO: 28817 - DNA, 20 bp, Artificial Sequence
  sgRNA
  Itgav_14
gtgccatctcaaatcctcga

SEQ ID NO: 28818 - DNA, 20 bp, Artificial Sequence
  sgRNA
  Itgav_15
gtttctccataacaggtccc

SEQ ID NO: 28819 - DNA, 20 bp, Artificial Sequence
  sgRNA
  Itgav_16
tgccatctcaaatcctcgag

SEQ ID NO: 28820 - DNA, 20 bp, Artificial Sequence
  sgRNA
  Itgav_17
gctgacagagtacttctcgg

SEQ ID NO: 28821 - DNA, 20 bp, Artificial Sequence
  sgRNA
  Itgav_18
aagttacttcggattcgccg

SEQ ID NO: 28822 - DNA, 20 bp, Artificial Sequence
  sgRNA
  Itgav_19
ggaagtgccatagctccatt

SEQ ID NO: 28823 - DNA, 20 bp, Artificial Sequence
  sgRNA
  Itgav_20
gtgcagtccgtgttgctaat

SEQ ID NO: 28824 - DNA, 20 bp, Artificial Sequence
  sgRNA
  Itgax_1
ccatgaatacgtattcagcg

SEQ ID NO: 28825 - DNA, 20 bp, Artificial Sequence
  sgRNA
  Itgax_2
tcttcaaggagacaaagacc

SEQ ID NO: 28826 - DNA, 20 bp, Artificial Sequence
  sgRNA
  Itgax_3
catgacatgcttgatagccg

SEQ ID NO: 28827 - DNA, 20 bp, Artificial Sequence
  sgRNA
  Itgax_4
tacaaatgtggctatcacac

SEQ ID NO: 28828 - DNA, 20 bp, Artificial Sequence
  sgRNA
  Itgax_5
gtaatcagagaactgcatca

SEQ ID NO: 28829 - DNA, 20 bp, Artificial Sequence
  sgRNA
  Itgax_6
ttatgatagtgtcatcccca

SEQ ID NO: 28830 - DNA, 20 bp, Artificial Sequence
  sgRNA
  Itgax_7
agtcactctgttctaccccg

SEQ ID NO: 28831 - DNA, 20 bp, Artificial Sequence
  sgRNA
  Itgax_8
ctgagctgcccacgataaga

SEQ ID NO: 28832 - DNA, 20 bp, Artificial Sequence
  sgRNA
  Itgax_9
gatatgttcacagcctctgg

SEQ ID NO: 28833 - DNA, 20 bp, Artificial Sequence
  sgRNA
  Itgax_10
cccaaaatattgaatcctgg

SEQ ID NO: 28834 - DNA, 20 bp, Artificial Sequence
  sgRNA
  Itgax_11
tgtctccttgaagatggccc

SEQ ID NO: 28835 - DNA, 20 bp, Artificial Sequence
  sgRNA
  Itgax_12
gtcactctgttctaccccgt

SEQ ID NO: 28836 - DNA, 20 bp, Artificial Sequence
  sgRNA
  Itgax_13
tctcccccaaagctgagctg

SEQ ID NO: 28837 - DNA, 20 bp, Artificial Sequence
  sgRNA
  Itgax_14
actgagctgcccacgataag

SEQ ID NO: 28838 - DNA, 20 bp, Artificial Sequence
  sgRNA
  Itgax_15
tcactgatgggagaaaacaa

SEQ ID NO: 28839 - DNA, 20 bp, Artificial Sequence
  sgRNA
  Itgax_16
tcttatcgtgggcagctcag

SEQ ID NO: 28840 - DNA, 20 bp, Artificial Sequence
  sgRNA
  Itgax_17
cagaacccaacagacttaaa

SEQ ID NO: 28841 - DNA, 20 bp, Artificial Sequence
  sgRNA
  Itgax_18
agcttcagagacctagcaca

SEQ ID NO: 28842 - DNA, 20 bp, Artificial Sequence
  sgRNA
  Itgax_19
tttaactcgagtcagagccc

SEQ ID NO: 28843 - DNA, 20 bp, Artificial Sequence
  sgRNA
  Itgax_20
gagagaatatatacttgaca

SEQ ID NO: 28844 - DNA, 20 bp, Artificial Sequence
  sgRNA
  Itgb1_1
gaggaatgtaacacgactgc

SEQ ID NO: 28845 - DNA, 20 bp, Artificial Sequence
  sgRNA
  Itgb1_2
tcccaacattcctaccaatg

SEQ ID NO: 28846 - DNA, 20 bp, Artificial Sequence
  sgRNA
  Itgb1_3
ggaaatgggacatttgagtg

SEQ ID NO: 28847 - DNA, 20 bp, Artificial Sequence
  sgRNA
  Itgb1_4
gcaattgaaggataatccta

SEQ ID NO: 28848 - DNA, 20 bp, Artificial Sequence
  sgRNA
  Itgb1_5
ggtccatgtctagcgtcaaa

SEQ ID NO: 28849 - DNA, 20 bp, Artificial Sequence
  sgRNA
  Itgb1_6
gtggtcaatccgaagtatga

SEQ ID NO: 28850 - DNA, 20 bp, Artificial Sequence
  sgRNA
  Itgb1_7
atgtcaccaatcgcagcaaa

SEQ ID NO: 28851 - DNA, 20 bp, Artificial Sequence
  sgRNA
  Itgb1_8
gctggggttgtgctaatata

SEQ ID NO: 28852 - DNA, 20 bp, Artificial Sequence
  sgRNA
  Itgb1_9
gcggagaatgtatacaagca

SEQ ID NO: 28853 - DNA, 20 bp, Artificial Sequence
  sgRNA
  Itgb1_10
cgatcctgtgacccattgca

SEQ ID NO: 28854 - DNA, 20 bp, Artificial Sequence
  sgRNA
  Itgb1_11
tcggaaatctgcagtaacaa

SEQ ID NO: 28855 - DNA, 20 bp, Artificial Sequence
  sgRNA
  Itgb1_12
gggatgatgtcgggaccagt

SEQ ID NO: 28856 - DNA, 20 bp, Artificial Sequence
  sgRNA
  Itgb1_13
catgcactgccagtgtaatt

SEQ ID NO: 28857 - DNA, 20 bp, Artificial Sequence
  sgRNA
  Itgb1_14
caccaatcgcagcaaaggga

SEQ ID NO: 28858 - DNA, 20 bp, Artificial Sequence
  sgRNA
  Itgb1_15
attacttcagacttccgcat

SEQ ID NO: 28859 - DNA, 20 bp, Artificial Sequence
  sgRNA
  Itgb1_16
tcaaatggtcagatctgcaa

SEQ ID NO: 28860 - DNA, 20 bp, Artificial Sequence
  sgRNA
  Itgb1_17
atacaagcagggccaaattg

SEQ ID NO: 28861 - DNA, 20 bp, Artificial Sequence
  sgRNA
  Itgb1_18
agtgacatagagaatcccag

SEQ ID NO: 28862 - DNA, 20 bp, Artificial Sequence
  sgRNA
  Itgb1_19
ggtcagatctgcaatggccg

SEQ ID NO: 28863 - DNA, 20 bp, Artificial Sequence
  sgRNA
  Itgb1_20
gcacagatcccaagtttcaa

SEQ ID NO: 28864 - DNA, 20 bp, Artificial Sequence
  sgRNA
  Itgb2_1
gagtataggcaaatcccgtg

SEQ ID NO: 28865 - DNA, 20 bp, Artificial Sequence
  sgRNA
  Itgb2_2
ttggctggcgcaatgtcacg

SEQ ID NO: 28866 - DNA, 20 bp, Artificial Sequence
  sgRNA
  Itgb2_3
atcctgagttcgaccaacgg

SEQ ID NO: 28867 - DNA, 20 bp, Artificial Sequence
  sgRNA
  Itgb2_4
tggagtaggagagatccatg

SEQ ID NO: 28868 - DNA, 20 bp, Artificial Sequence
  sgRNA
  Itgb2_5
tcgagtataggcaaatcccg

SEQ ID NO: 28869 - DNA, 20 bp, Artificial Sequence
  sgRNA
  Itgb2_6
attcaatgtgactttccggc

SEQ ID NO: 28870 - DNA, 20 bp, Artificial Sequence
  sgRNA
  Itgb2_7
ggacaatcctcacacatcgg

SEQ ID NO: 28871 - DNA, 20 bp, Artificial Sequence
  sgRNA
  Itgb2_8
agttgcaagcccggttacga

SEQ ID NO: 28872 - DNA, 20 bp, Artificial Sequence
  sgRNA
  Itgb2_9
cattcaatgtgactttccgg

SEQ ID NO: 28873 - DNA, 20 bp, Artificial Sequence
  sgRNA
  Itgb2_10
gtgccagctgacccacggat

SEQ ID NO: 28874 - DNA, 20 bp, Artificial Sequence
  sgRNA
  Itgb2_11
gtctgacgactccagcaacg

SEQ ID NO: 28875 - DNA, 20 bp, Artificial Sequence
  sgRNA
  Itgb2_12
agactcggtgatctcgttga

SEQ ID NO: 28876 - DNA, 20 bp, Artificial Sequence
  sgRNA
  Itgb2_13
tgtacatgttatcctccagg

SEQ ID NO: 28877 - DNA, 20 bp, Artificial Sequence
  sgRNA
  Itgb2_14
tacactttgcagcagaagga

SEQ ID NO: 28878 - DNA, 20 bp, Artificial Sequence
  sgRNA
  Itgb2_15
ctaatcctgagttcgaccaa

SEQ ID NO: 28879 - DNA, 20 bp, Artificial Sequence
  sgRNA
  Itgb2_16
tgaggtagtacagatcaatg

SEQ ID NO: 28880 - DNA, 20 bp, Artificial Sequence
  sgRNA
  Itgb2_17
tgactttcagggtgtccggg

SEQ ID NO: 28881 - DNA, 20 bp, Artificial Sequence
  sgRNA
  Itgb2_18
gttcccccactgctgacttg

SEQ ID NO: 28882 - DNA, 20 bp, Artificial Sequence
  sgRNA
  Itgb2_19
cctggggtccatgatatcat

SEQ ID NO: 28883 - DNA, 20 bp, Artificial Sequence
  sgRNA
  Itgb2_20
aatcctgagttcgaccaacg

SEQ ID NO: 28884 - DNA, 20 bp, Artificial Sequence
  sgRNA
  Itgb2l_1
aaatccaggcaaacccagcg

SEQ ID NO: 28885 - DNA, 20 bp, Artificial Sequence
  sgRNA
  Itgb2l_2
tcatggattcagtgaccgtg

SEQ ID NO: 28886 - DNA, 20 bp, Artificial Sequence
  sgRNA
  Itgb2l_3
atagttccatcatgtgctcg

SEQ ID NO: 28887 - DNA, 20 bp, Artificial Sequence
  sgRNA
  Itgb2l_4
catccccaagctgaccattg

SEQ ID NO: 28888 - DNA, 20 bp, Artificial Sequence
  sgRNA
  Itgb2l_5
gtcagatgactccagcaacg

SEQ ID NO: 28889 - DNA, 20 bp, Artificial Sequence
  sgRNA
  Itgb2l_6
ggactccagccaatttcaga

SEQ ID NO: 28890 - DNA, 20 bp, Artificial Sequence
  sgRNA
  Itgb2l_7
tttccaagaaccccaccatg

SEQ ID NO: 28891 - DNA, 20 bp, Artificial Sequence
  sgRNA
  Itgb2l_8
cgcccactataacgcccagt

SEQ ID NO: 28892 - DNA, 20 bp, Artificial Sequence
  sgRNA
  Itgb2l_9
ggtcgctgtcacctggacga

SEQ ID NO: 28893 - DNA, 20 bp, Artificial Sequence
  sgRNA
  Itgb2l_10
ctgcacatctgagtacctcg

SEQ ID NO: 28894 - DNA, 20 bp, Artificial Sequence
  sgRNA
  Itgb2l_11
acacaggggaaggacccgca

SEQ ID NO: 28895 - DNA, 20 bp, Artificial Sequence
  sgRNA
  Itgb2l_12
gctggtagcccgggtcacag

SEQ ID NO: 28896 - DNA, 20 bp, Artificial Sequence
  sgRNA
  Itgb2l_13
gattccacactggctccaca

SEQ ID NO: 28897 - DNA, 20 bp, Artificial Sequence
  sgRNA
  Itgb2l_14
ggtgcaactctggctacgct

SEQ ID NO: 28898 - DNA, 20 bp, Artificial Sequence
  sgRNA
  Itgb2l_15
tggaaggtattagatattaa

SEQ ID NO: 28899 - DNA, 20 bp, Artificial Sequence
  sgRNA
  Itgb2l_16
cttgagggcaccacgaagat

SEQ ID NO: 28900 - DNA, 20 bp, Artificial Sequence
  sgRNA
  Itgb2l_17
cattcaaagtggacttccag

SEQ ID NO: 28901 - DNA, 20 bp, Artificial Sequence
  sgRNA
  Itgb2l_18
tgttacagtagcatcgacca

SEQ ID NO: 28902 - DNA, 20 bp, Artificial Sequence
  sgRNA
  Itgb2l_19
gagcagcgatggaaatagcc

SEQ ID NO: 28903 - DNA, 20 bp, Artificial Sequence
  sgRNA
  Itgb2l_20
acagtgtgagaagtcacaaa

SEQ ID NO: 28904 - DNA, 20 bp, Artificial Sequence
  sgRNA
  Itgb3_1
gcaggtggaggattaccccg

SEQ ID NO: 28905 - DNA, 20 bp, Artificial Sequence
  sgRNA
  Itgb3_2
aatatgggtcttggcatccg

SEQ ID NO: 28906 - DNA, 20 bp, Artificial Sequence
  sgRNA
  Itgb3_3
ttctccttcaggttacatcg

SEQ ID NO: 28907 - DNA, 20 bp, Artificial Sequence
  sgRNA
  Itgb3_4
cgatacaggcttgtccacga

SEQ ID NO: 28908 - DNA, 20 bp, Artificial Sequence
  sgRNA
  Itgb3_5
acagtgacagttcttccggc

SEQ ID NO: 28909 - DNA, 20 bp, Artificial Sequence
  sgRNA
  Itgb3_6
gaattgtacctacaagaacg

SEQ ID NO: 28910 - DNA, 20 bp, Artificial Sequence
  sgRNA
  Itgb3_7
cgtaatcgagatgccccaga

SEQ ID NO: 28911 - DNA, 20 bp, Artificial Sequence
  sgRNA
  Itgb3_8
tctcctgcgtccgctacaaa

SEQ ID NO: 28912 - DNA, 20 bp, Artificial Sequence
  sgRNA
  Itgb3_9
gcattgtcctgcccaatgat

SEQ ID NO: 28913 - DNA, 20 bp, Artificial Sequence
  sgRNA
  Itgb3_10
ggagtgtaagaagttcaacc

SEQ ID NO: 28914 - DNA, 20 bp, Artificial Sequence
  sgRNA
  Itgb3_11
gcaagcttactagcaacctt

SEQ ID NO: 28915 - DNA, 20 bp, Artificial Sequence
  sgRNA
  Itgb3_12
acacctgcatgtccaccaat

SEQ ID NO: 28916 - DNA, 20 bp, Artificial Sequence
  sgRNA
  Itgb3_13
agatcttctcacttcaagtg

SEQ ID NO: 28917 - DNA, 20 bp, Artificial Sequence
  sgRNA
  Itgb3_14
agaggattgcccttcgacta

SEQ ID NO: 28918 - DNA, 20 bp, Artificial Sequence
  sgRNA
  Itgb3_15
ctcctgcgtccgctacaaag

SEQ ID NO: 28919 - DNA, 20 bp, Artificial Sequence
  sgRNA
  Itgb3_16
ccttcaccaatatcacctac

SEQ ID NO: 28920 - DNA, 20 bp, Artificial Sequence
  sgRNA
  Itgb3_17
gctaggccactcagcagcaa

SEQ ID NO: 28921 - DNA, 20 bp, Artificial Sequence
  sgRNA
  Itgb3_18
tccaacatctgtaccacacg

SEQ ID NO: 28922 - DNA, 20 bp, Artificial Sequence
  sgRNA
  Itgb3_19
ggttctccttcaggttacat

SEQ ID NO: 28923 - DNA, 20 bp, Artificial Sequence
  sgRNA
  Itgb3_20
gcaggaagagtgcagcccca

SEQ ID NO: 28924 - DNA, 20 bp, Artificial Sequence
  sgRNA
  Itgb4_1
ggtcctttcacatcaagcgg

SEQ ID NO: 28925 - DNA, 20 bp, Artificial Sequence
  sgRNA
  Itgb4_2
gtattgggtgtaggcgcccg

SEQ ID NO: 28926 - DNA, 20 bp, Artificial Sequence
  sgRNA
  Itgb4_3
gaataccagctactaaacgg

SEQ ID NO: 28927 - DNA, 20 bp, Artificial Sequence
  sgRNA
  Itgb4_4
cgtcttctggagagtatcgg

SEQ ID NO: 28928 - DNA, 20 bp, Artificial Sequence
  sgRNA
  Itgb4_5
acgttcttgaaggagaacgg

SEQ ID NO: 28929 - DNA, 20 bp, Artificial Sequence
  sgRNA
  Itgb4_6
tgtacagtgatgacgtcctg

SEQ ID NO: 28930 - DNA, 20 bp, Artificial Sequence
  sgRNA
  Itgb4_7
cgagtctgccttccactacg

SEQ ID NO: 28931 - DNA, 20 bp, Artificial Sequence
  sgRNA
  Itgb4_8
acttacagctacaacgtgga

SEQ ID NO: 28932 - DNA, 20 bp, Artificial Sequence
  sgRNA
  Itgb4_9
agagcagcagaagcaacgcc

SEQ ID NO: 28933 - DNA, 20 bp, Artificial Sequence
  sgRNA
  Itgb4_10
gcacctggtgaatggccgga

SEQ ID NO: 28934 - DNA, 20 bp, Artificial Sequence
  sgRNA
  Itgb4_11
gtttgtcctcaccctcacgc

SEQ ID NO: 28935 - DNA, 20 bp, Artificial Sequence
  sgRNA
  Itgb4_12
ctgcacttacagctacaacg

SEQ ID NO: 28936 - DNA, 20 bp, Artificial Sequence
  sgRNA
  Itgb4_13
tatggtgaaggccgctacga

SEQ ID NO: 28937 - DNA, 20 bp, Artificial Sequence
  sgRNA
  Itgb4_14
cttagggcagtgaacaccag

SEQ ID NO: 28938 - DNA, 20 bp, Artificial Sequence
  sgRNA
  Itgb4_15
agtgaacaccagcggtcccg

SEQ ID NO: 28939 - DNA, 20 bp, Artificial Sequence
  sgRNA
  Itgb4_16
ctgtaccgagtgcatccggg

SEQ ID NO: 28940 - DNA, 20 bp, Artificial Sequence
  sgRNA
  Itgb4_17
ctatggtgaaggccgctacg

SEQ ID NO: 28941 - DNA, 20 bp, Artificial Sequence
  sgRNA
  Itgb4_18
gttgtctccgtccacccgga

SEQ ID NO: 28942 - DNA, 20 bp, Artificial Sequence
  sgRNA
  Itgb4_19
gtgtgaccagctacgccagg

SEQ ID NO: 28943 - DNA, 20 bp, Artificial Sequence
  sgRNA
  Itgb4_20
ggtgagtcgtggagaccagg

SEQ ID NO: 28944 - DNA, 20 bp, Artificial Sequence
  sgRNA
  Itgb5_1
caaaagacccgaaacctaag

SEQ ID NO: 28945 - DNA, 20 bp, Artificial Sequence
  sgRNA
  Itgb5_2
ccgcatcaaaccccccctcg

SEQ ID NO: 28946 - DNA, 20 bp, Artificial Sequence
  sgRNA
  Itgb5_3
gaaccactatatgctctaca

SEQ ID NO: 28947 - DNA, 20 bp, Artificial Sequence
  sgRNA
  Itgb5_4
tgctgagaggtaggttccgg

SEQ ID NO: 28948 - DNA, 20 bp, Artificial Sequence
  sgRNA
  Itgb5_5
ggagtgccatcccaatcagg

SEQ ID NO: 28949 - DNA, 20 bp, Artificial Sequence
  sgRNA
  Itgb5_6
tgtagacctgtactacctga

SEQ ID NO: 28950 - DNA, 20 bp, Artificial Sequence
  sgRNA
  Itgb5_7
gcttcgagagtgagttcggg

SEQ ID NO: 28951 - DNA, 20 bp, Artificial Sequence
  sgRNA
  Itgb5_8
gtaccagaacctgtgccggg

SEQ ID NO: 28952 - DNA, 20 bp, Artificial Sequence
  sgRNA
  Itgb5_9
tctccacgcccgctgcacag

SEQ ID NO: 28953 - DNA, 20 bp, Artificial Sequence
  sgRNA
  Itgb5_10
gcacatgcggctgtagcacg

SEQ ID NO: 28954 - DNA, 20 bp, Artificial Sequence
  sgRNA
  Itgb5_11
cgatgtgccccacatcgcac

SEQ ID NO: 28955 - DNA, 20 bp, Artificial Sequence
  sgRNA
  Itgb5_12
cggaaccgagatgcccccga

SEQ ID NO: 28956 - DNA, 20 bp, Artificial Sequence
  sgRNA
  Itgb5_13
gttccaaagtgagcgctcca

SEQ ID NO: 28957 - DNA, 20 bp, Artificial Sequence
  sgRNA
  Itgb5_14
gatgccggaacccgaaggag

SEQ ID NO: 28958 - DNA, 20 bp, Artificial Sequence
  sgRNA
  Itgb5_15
tgtccccaatgtaacctgcg

SEQ ID NO: 28959 - DNA, 20 bp, Artificial Sequence
  sgRNA
  Itgb5_16
ctgacagctccactttagcc

SEQ ID NO: 28960 - DNA, 20 bp, Artificial Sequence
  sgRNA
  Itgb5_17
ccaacagtgccagatgcagt

SEQ ID NO: 28961 - DNA, 20 bp, Artificial Sequence
  sgRNA
  Itgb5_18
ggaacttggcaaactctcgg

SEQ ID NO: 28962 - DNA, 20 bp, Artificial Sequence
  sgRNA
  Itgb5_19
tctttcaccttgaggcccgt

SEQ ID NO: 28963 - DNA, 20 bp, Artificial Sequence
  sgRNA
  Itgb5_20
agatgggctttctgtacagg

SEQ ID NO: 28964 - DNA, 20 bp, Artificial Sequence
  sgRNA
  Itgb6_1
tgtctacactaaaggaactg

SEQ ID NO: 28965 - DNA, 20 bp, Artificial Sequence
  sgRNA
  Itgb6_2
tgaggtaatacagatctact

SEQ ID NO: 28966 - DNA, 20 bp, Artificial Sequence
  sgRNA
  Itgb6_3
atgggtcctcactgcgagtg

SEQ ID NO: 28967 - DNA, 20 bp, Artificial Sequence
  sgRNA
  Itgb6_4
tttggctaaaagattcgctg

SEQ ID NO: 28968 - DNA, 20 bp, Artificial Sequence
  sgRNA
  Itgb6_5
ggtccgtagatgcttccgta

SEQ ID NO: 28969 - DNA, 20 bp, Artificial Sequence
  sgRNA
  Itgb6_6
actgcatgaagggtgacccg

SEQ ID NO: 28970 - DNA, 20 bp, Artificial Sequence
  sgRNA
  Itgb6_7
atctgccacttatcgccgta

SEQ ID NO: 28971 - DNA, 20 bp, Artificial Sequence
  sgRNA
  Itgb6_8
ggacttctatgcgggagaca

SEQ ID NO: 28972 - DNA, 20 bp, Artificial Sequence
  sgRNA
  Itgb6_9
agtgaggacccatgtggccg

SEQ ID NO: 28973 - DNA, 20 bp, Artificial Sequence
  sgRNA
  Itgb6_10
ggaaccaatcctctgtaccg

SEQ ID NO: 28974 - DNA, 20 bp, Artificial Sequence
  sgRNA
  Itgb6_11
gcgacccctgtaactctaaa

SEQ ID NO: 28975 - DNA, 20 bp, Artificial Sequence
  sgRNA
  Itgb6_12
ctttggctaaaagattcgct

SEQ ID NO: 28976 - DNA, 20 bp, Artificial Sequence
  sgRNA
  Itgb6_13
cattggtgccaccatcagtg

SEQ ID NO: 28977 - DNA, 20 bp, Artificial Sequence
  sgRNA
  Itgb6_14
gctaatattgacacacctga

SEQ ID NO: 28978 - DNA, 20 bp, Artificial Sequence
  sgRNA
  Itgb6_15
actcattcctggagcaaccg

SEQ ID NO: 28979 - DNA, 20 bp, Artificial Sequence
  sgRNA
  Itgb6_16
gacacccccaacatgatcat

SEQ ID NO: 28980 - DNA, 20 bp, Artificial Sequence
  sgRNA
  Itgb6_17
ggtatcatttcatgaccgga

SEQ ID NO: 28981 - DNA, 20 bp, Artificial Sequence
  sgRNA
  Itgb6_18
tcactggcgatcctgctcat

SEQ ID NO: 28982 - DNA, 20 bp, Artificial Sequence
  sgRNA
  Itgb6_19
cattcccatgatcatgttgg

SEQ ID NO: 28983 - DNA, 20 bp, Artificial Sequence
  sgRNA
  Itgb6_20
tgcttccgtacggcgataag

SEQ ID NO: 28984 - DNA, 20 bp, Artificial Sequence
  sgRNA
  Itgb7_1
acagtgtgcgactgtaactg

SEQ ID NO: 28985 - DNA, 20 bp, Artificial Sequence
  sgRNA
  Itgb7_2
cgtgacgcggatccgctgcg

SEQ ID NO: 28986 - DNA, 20 bp, Artificial Sequence
  sgRNA
  Itgb7_3
gtggctgacaacgctccagt

SEQ ID NO: 28987 - DNA, 20 bp, Artificial Sequence
  sgRNA
  Itgb7_4
tgatgtccgagtcaaccaga

SEQ ID NO: 28988 - DNA, 20 bp, Artificial Sequence
  sgRNA
  Itgb7_5
gtgcctggatggctactacg

SEQ ID NO: 28989 - DNA, 20 bp, Artificial Sequence
  sgRNA
  Itgb7_6
taaggtaatataggtccacg

SEQ ID NO: 28990 - DNA, 20 bp, Artificial Sequence
  sgRNA
  Itgb7_7
gctcctctagctcctgcgcg

SEQ ID NO: 28991 - DNA, 20 bp, Artificial Sequence
  sgRNA
  Itgb7_8
gcaccggtgacagcaaagat

SEQ ID NO: 28992 - DNA, 20 bp, Artificial Sequence
  sgRNA
  Itgb7_9
gcttccaagggacaaacggt

SEQ ID NO: 28993 - DNA, 20 bp, Artificial Sequence
  sgRNA
  Itgb7_10
tgtggaaatctacgaccgac

SEQ ID NO: 28994 - DNA, 20 bp, Artificial Sequence
  sgRNA
  Itgb7_11
ccacgtgctgtccctcaccg

SEQ ID NO: 28995 - DNA, 20 bp, Artificial Sequence
  sgRNA
  Itgb7_12
caaagcgcctgtactcccgt

SEQ ID NO: 28996 - DNA, 20 bp, Artificial Sequence
  sgRNA
  Itgb7_13
gctgtgtcagtcctgaagga

SEQ ID NO: 28997 - DNA, 20 bp, Artificial Sequence
  sgRNA
  Itgb7_14
cgacccttcccgctgcatag

SEQ ID NO: 28998 - DNA, 20 bp, Artificial Sequence
  sgRNA
  Itgb7_15
cgtttgtcccttggaagcgg

SEQ ID NO: 28999 - DNA, 20 bp, Artificial Sequence
  sgRNA
  Itgb7_16
tcagctgtgtgaatgctctg

SEQ ID NO: 29000 - DNA, 20 bp, Artificial Sequence
  sgRNA
  Itgb7_17
ctgtggaaatctacgaccga

SEQ ID NO: 29001 - DNA, 20 bp, Artificial Sequence
  sgRNA
  Itgb7_18
acactacagttggctgccag

SEQ ID NO: 29002 - DNA, 20 bp, Artificial Sequence
  sgRNA
  Itgb7_19
agagtgctcaagagtcacag

SEQ ID NO: 29003 - DNA, 20 bp, Artificial Sequence
  sgRNA
  Itgb7_20
aagggtcctgagaagacgga

SEQ ID NO: 29004 - DNA, 20 bp, Artificial Sequence
  sgRNA
  Itgb8_1
ccagataataaagatccacg

SEQ ID NO: 29005 - DNA, 20 bp, Artificial Sequence
  sgRNA
  Itgb8_2
acatgaatgtatccatgggg

SEQ ID NO: 29006 - DNA, 20 bp, Artificial Sequence
  sgRNA
  Itgb8_3
atttcagaacacaatagatg

SEQ ID NO: 29007 - DNA, 20 bp, Artificial Sequence
  sgRNA
  Itgb8_4
atgaaaacatgtgatatcat

SEQ ID NO: 29008 - DNA, 20 bp, Artificial Sequence
  sgRNA
  Itgb8_5
tcagaaagttggcctaatga

SEQ ID NO: 29009 - DNA, 20 bp, Artificial Sequence
  sgRNA
  Itgb8_6
ggaggatttacactgatcaa

SEQ ID NO: 29010 - DNA, 20 bp, Artificial Sequence
  sgRNA
  Itgb8_7
gtttccagtttgataagcaa

SEQ ID NO: 29011 - DNA, 20 bp, Artificial Sequence
  sgRNA
  Itgb8_8
tcccacagatgcaaacacct

SEQ ID NO: 29012 - DNA, 20 bp, Artificial Sequence
  sgRNA
  Itgb8_9
gccatacattagtatccacc

SEQ ID NO: 29013 - DNA, 20 bp, Artificial Sequence
  sgRNA
  Itgb8_10
ttagactgtatgcctcccca

SEQ ID NO: 29014 - DNA, 20 bp, Artificial Sequence
  sgRNA
  Itgb8_11
ctaccgacgagaaaagcctg

SEQ ID NO: 29015 - DNA, 20 bp, Artificial Sequence
  sgRNA
  Itgb8_12
gattgtggatcctttccggg

SEQ ID NO: 29016 - DNA, 20 bp, Artificial Sequence
  sgRNA
  Itgb8_13
gagaacaagtgaaaataccc

SEQ ID NO: 29017 - DNA, 20 bp, Artificial Sequence
  sgRNA
  Itgb8_14
ctacgtcaaatcgacaacca

SEQ ID NO: 29018 - DNA, 20 bp, Artificial Sequence
  sgRNA
  Itgb8_15
tcttgctcttgacagcaaat

SEQ ID NO: 29019 - DNA, 20 bp, Artificial Sequence
  sgRNA
  Itgb8_16
gcaatggcaccaggcaaaag

SEQ ID NO: 29020 - DNA, 20 bp, Artificial Sequence
  sgRNA
  Itgb8_17
tgaaacttgcaagccacagg

SEQ ID NO: 29021 - DNA, 20 bp, Artificial Sequence
  sgRNA
  Itgb8_18
ttagacaagtgatactacaa

SEQ ID NO: 29022 - DNA, 20 bp, Artificial Sequence
  sgRNA
  Itgb8_19
tttccacacccacttatgcc

SEQ ID NO: 29023 - DNA, 20 bp, Artificial Sequence
  sgRNA
  Itgb8_20
ttagtggctgggaaggagat

SEQ ID NO: 29024 - DNA, 20 bp, Artificial Sequence
  sgRNA
  Itln1_1
atgcgtgggaagtgcactgt

SEQ ID NO: 29025 - DNA, 20 bp, Artificial Sequence
  sgRNA
  Itln1_2
acaagtgatgactacaaggt

SEQ ID NO: 29026 - DNA, 20 bp, Artificial Sequence
  sgRNA
  Itln1_3
aatcaagcaggagcacacaa

SEQ ID NO: 29027 - DNA, 20 bp, Artificial Sequence
  sgRNA
  Itln1_4
ggaaagtgttggactgacaa

SEQ ID NO: 29028 - DNA, 20 bp, Artificial Sequence
  sgRNA
  Itln1_5
gggccaactacaacaccttt

SEQ ID NO: 29029 - DNA, 20 bp, Artificial Sequence
  sgRNA
  Itln1_6
aagagaacctggacaccaac

SEQ ID NO: 29030 - DNA, 20 bp, Artificial Sequence
  sgRNA
  Itln1_7
tttatcatggttgctaccag

SEQ ID NO: 29031 - DNA, 20 bp, Artificial Sequence
  sgRNA
  Itln1_8
tatttcctgcgcacgaagaa

SEQ ID NO: 29032 - DNA, 20 bp, Artificial Sequence
  sgRNA
  Itln1_9
gtgcatgagaacaacatgcg

SEQ ID NO: 29033 - DNA, 20 bp, Artificial Sequence
  sgRNA
  Itln1_10
actggcttcctgcagcactt

SEQ ID NO: 29034 - DNA, 20 bp, Artificial Sequence
  sgRNA
  Itln1_11
cgcaaagtctccacactgca

SEQ ID NO: 29035 - DNA, 20 bp, Artificial Sequence
  sgRNA
  Itln1_12
ggaggaggattcttcccaga

SEQ ID NO: 29036 - DNA, 20 bp, Artificial Sequence
  sgRNA
  Itln1_13
gctcttcctccagttgtgca

SEQ ID NO: 29037 - DNA, 20 bp, Artificial Sequence
  sgRNA
  Itln1_14
atggatatggaactcacaat

SEQ ID NO: 29038 - DNA, 20 bp, Artificial Sequence
  sgRNA
  Itln1_15
gccagagggggagtaataag

SEQ ID NO: 29039 - DNA, 20 bp, Artificial Sequence
  sgRNA
  Itln1_16
tctatgactttggtgatgct

SEQ ID NO: 29040 - DNA, 20 bp, Artificial Sequence
  sgRNA
  Itln1_17
gattatgtcccaagtgctgc

SEQ ID NO: 29041 - DNA, 20 bp, Artificial Sequence
  sgRNA
  Itln1_18
cctggatgtcaaagtagcca

SEQ ID NO: 29042 - DNA, 20 bp, Artificial Sequence
  sgRNA
  Itln1_19
caaagtctccacactgcacg

SEQ ID NO: 29043 - DNA, 20 bp, Artificial Sequence
  sgRNA
  Itln1_20
cagagctgactacccagagg

SEQ ID NO: 29044 - DNA, 20 bp, Artificial Sequence
  sgRNA
  Itm2b_1
tgtacaggtacgcccctccg

SEQ ID NO: 29045 - DNA, 20 bp, Artificial Sequence
  sgRNA
  Itm2b_2
gttgaagtcgtgcacaatgt

SEQ ID NO: 29046 - DNA, 20 bp, Artificial Sequence
  sgRNA
  Itm2b_3
ccagatgatgtgtactactg

SEQ ID NO: 29047 - DNA, 20 bp, Artificial Sequence
  sgRNA
  Itm2b_4
caaccggaaccacgtcaccc

SEQ ID NO: 29048 - DNA, 20 bp, Artificial Sequence
  sgRNA
  Itm2b_5
ggttgtccacgttctcgatg

SEQ ID NO: 29049 - DNA, 20 bp, Artificial Sequence
  sgRNA
  Itm2b_6
ttgctggcgtcatcctcgga

SEQ ID NO: 29050 - DNA, 20 bp, Artificial Sequence
  sgRNA
  Itm2b_7
ggaggcgctcatcgtccctc

SEQ ID NO: 29051 - DNA, 20 bp, Artificial Sequence
  sgRNA
  Itm2b_8
ggacgagcccaagagcagcg

SEQ ID NO: 29052 - DNA, 20 bp, Artificial Sequence
  sgRNA
  Itm2b_9
catcgtccctccggatgccg

SEQ ID NO: 29053 - DNA, 20 bp, Artificial Sequence
  sgRNA
  Itm2b_10
tttgttctcaaaatgccgaa

SEQ ID NO: 29054 - DNA, 20 bp, Artificial Sequence
  sgRNA
  Itm2b_11
tatgccgcccaaaaacctgc

SEQ ID NO: 29055 - DNA, 20 bp, Artificial Sequence
  sgRNA
  Itm2b_12
catgtgctcatggataaggt

SEQ ID NO: 29056 - DNA, 20 bp, Artificial Sequence
  sgRNA
  Itm2b_13
tgttaataaggagctccagc

SEQ ID NO: 29057 - DNA, 20 bp, Artificial Sequence
  sgRNA
  Itm2b_14
aagtcgtgcacaatgttggc

SEQ ID NO: 29058 - DNA, 20 bp, Artificial Sequence
  sgRNA
  Itm2b_15
tcatggataaggtaggactg

SEQ ID NO: 29059 - DNA, 20 bp, Artificial Sequence
  sgRNA
  Itm2b_16
cagcgccgggaaacaattag

SEQ ID NO: 29060 - DNA, 20 bp, Artificial Sequence
  sgRNA
  Itm2b_17
ataacgatggaagtgttcag

SEQ ID NO: 29061 - DNA, 20 bp, Artificial Sequence
  sgRNA
  Itm2b_18
ggatcgctgtccgcaaactc

SEQ ID NO: 29062 - DNA, 20 bp, Artificial Sequence
  sgRNA
  Itm2b_19
ccaaccggaaccacgtcacc

SEQ ID NO: 29063 - DNA, 20 bp, Artificial Sequence
  sgRNA
  Itm2b_20
tctccttgtcgtgacacagt

SEQ ID NO: 29064 - DNA, 20 bp, Artificial Sequence
  sgRNA
  Itm2c_1
gtacctgtagatgtagaccg

SEQ ID NO: 29065 - DNA, 20 bp, Artificial Sequence
  sgRNA
  Itm2c_2
cttcgtagagcacaccacag

SEQ ID NO: 29066 - DNA, 20 bp, Artificial Sequence
  sgRNA
  Itm2c_3
gtctagggagatgtcgtggt

SEQ ID NO: 29067 - DNA, 20 bp, Artificial Sequence
  sgRNA
  Itm2c_4
gtttcgtgggggtagcacga

SEQ ID NO: 29068 - DNA, 20 bp, Artificial Sequence
  sgRNA
  Itm2c_5
gcaacgggaaggacacctac

SEQ ID NO: 29069 - DNA, 20 bp, Artificial Sequence
  sgRNA
  Itm2c_6
tgtattctcgaagtggcgga

SEQ ID NO: 29070 - DNA, 20 bp, Artificial Sequence
  sgRNA
  Itm2c_7
gggtccccaccaccaaactg

SEQ ID NO: 29071 - DNA, 20 bp, Artificial Sequence
  sgRNA
  Itm2c_8
ggaaggacacctaccggctg

SEQ ID NO: 29072 - DNA, 20 bp, Artificial Sequence
  sgRNA
  Itm2c_9
ggatgatgtacgtctgtggg

SEQ ID NO: 29073 - DNA, 20 bp, Artificial Sequence
  sgRNA
  Itm2c_10
caaatgtattctcgaagtgg

SEQ ID NO: 29074 - DNA, 20 bp, Artificial Sequence
  sgRNA
  Itm2c_11
gccttgatgcccgctaccgc

SEQ ID NO: 29075 - DNA, 20 bp, Artificial Sequence
  sgRNA
  Itm2c_12
agtcatggatgatgtctgca

SEQ ID NO: 29076 - DNA, 20 bp, Artificial Sequence
  sgRNA
  Itm2c_13
cggcgtcagcaggatctccg

SEQ ID NO: 29077 - DNA, 20 bp, Artificial Sequence
  sgRNA
  Itm2c_14
agagcatgtccgcgacaagg

SEQ ID NO: 29078 - DNA, 20 bp, Artificial Sequence
  sgRNA
  Itm2c_15
acttgtctagggagatgtcg

SEQ ID NO: 29079 - DNA, 20 bp, Artificial Sequence
  sgRNA
  Itm2c_16
ccacaaatgtattctcgaag

SEQ ID NO: 29080 - DNA, 20 bp, Artificial Sequence
  sgRNA
  Itm2c_17
tgtagaccgaggcaaacaca

SEQ ID NO: 29081 - DNA, 20 bp, Artificial Sequence
  sgRNA
  Itm2c_18
catcatccatgacttccagc

SEQ ID NO: 29082 - DNA, 20 bp, Artificial Sequence
  sgRNA
  Itm2c_19
tgataaagcggacaaagcag

SEQ ID NO: 29083 - DNA, 20 bp, Artificial Sequence
  sgRNA
  Itm2c_20
atacaaccatgcccatggac

SEQ ID NO: 29084 - DNA, 20 bp, Artificial Sequence
  sgRNA
  Izumo1_1
atatctgaccaagtcgatgg

SEQ ID NO: 29085 - DNA, 20 bp, Artificial Sequence
  sgRNA
  Izumo1_2
cggaaatccctagattgtgg

SEQ ID NO: 29086 - DNA, 20 bp, Artificial Sequence
  sgRNA
  Izumo1_3
gttctttgtcccaacaaatg

SEQ ID NO: 29087 - DNA, 20 bp, Artificial Sequence
  sgRNA
  Izumo1_4
actgacctgtgacatcgtag

SEQ ID NO: 29088 - DNA, 20 bp, Artificial Sequence
  sgRNA
  Izumo1_5
tctgagaccttgattgccaa

SEQ ID NO: 29089 - DNA, 20 bp, Artificial Sequence
  sgRNA
  Izumo1_6
tatctgaccaagtcgatggt

SEQ ID NO: 29090 - DNA, 20 bp, Artificial Sequence
  sgRNA
  Izumo1_7
tcttgggttatgatgttcgg

SEQ ID NO: 29091 - DNA, 20 bp, Artificial Sequence
  sgRNA
  Izumo1_8
ctactctggagataagagcg

SEQ ID NO: 29092 - DNA, 20 bp, Artificial Sequence
  sgRNA
  Izumo1_9
tcttgctagacagttccaaa

SEQ ID NO: 29093 - DNA, 20 bp, Artificial Sequence
  sgRNA
  Izumo1_10
gacatcgtagcggatgacgg

SEQ ID NO: 29094 - DNA, 20 bp, Artificial Sequence
  sgRNA
  Izumo1_11
tgactccacagacaccaccg

SEQ ID NO: 29095 - DNA, 20 bp, Artificial Sequence
  sgRNA
  Izumo1_12
ttagcgcatctgtcacaaac

SEQ ID NO: 29096 - DNA, 20 bp, Artificial Sequence
  sgRNA
  Izumo1_13
ccacatagaggtacatcgct

SEQ ID NO: 29097 - DNA, 20 bp, Artificial Sequence
  sgRNA
  Izumo1_14
tgatggtatctagcacacag

SEQ ID NO: 29098 - DNA, 20 bp, Artificial Sequence
  sgRNA
  Izumo1_15
attgcccccaaagcattcag

SEQ ID NO: 29099 - DNA, 20 bp, Artificial Sequence
  sgRNA
  Izumo1_16
gctgcacccagagttgtacc

SEQ ID NO: 29100 - DNA, 20 bp, Artificial Sequence
  sgRNA
  Izumo1_17
gccagcaagagtgtaaaatg

SEQ ID NO: 29101 - DNA, 20 bp, Artificial Sequence
  sgRNA
  Izumo1_18
accatatctgaccaagtcga

SEQ ID NO: 29102 - DNA, 20 bp, Artificial Sequence
  sgRNA
  Izumo1_19
gtgactccacagacaccacc

SEQ ID NO: 29103 - DNA, 20 bp, Artificial Sequence
  sgRNA
  Izumo1_20
gtgctagataccatcaacca

SEQ ID NO: 29104 - DNA, 20 bp, Artificial Sequence
  sgRNA
  Izumo1r_1
agaagacgaactctaccagg

SEQ ID NO: 29105 - DNA, 20 bp, Artificial Sequence
  sgRNA
  Izumo1r_2
atttacaagtcaaagatgag

SEQ ID NO: 29106 - DNA, 20 bp, Artificial Sequence
  sgRNA
  Izumo1r_3
taaagagcaagggctcctca

SEQ ID NO: 29107 - DNA, 20 bp, Artificial Sequence
  sgRNA
  Izumo1r_4
agtttgtcccctgccaaggt

SEQ ID NO: 29108 - DNA, 20 bp, Artificial Sequence
  sgRNA
  Izumo1r_5
cttctcacacaggtcatccg

SEQ ID NO: 29109 - DNA, 20 bp, Artificial Sequence
  sgRNA
  Izumo1r_6
tcacaatcctcctggcacag

SEQ ID NO: 29110 - DNA, 20 bp, Artificial Sequence
  sgRNA
  Izumo1r_7
cacccttagcaaccccaacg

SEQ ID NO: 29111 - DNA, 20 bp, Artificial Sequence
  sgRNA
  Izumo1r_8
tggggaagtgatacgaaaaa

SEQ ID NO: 29112 - DNA, 20 bp, Artificial Sequence
  sgRNA
  Izumo1r_9
ccgagcgcaggaacagtggg

SEQ ID NO: 29113 - DNA, 20 bp, Artificial Sequence
  sgRNA
  Izumo1r_10
tcaagactgcagaagaggat

SEQ ID NO: 29114 - DNA, 20 bp, Artificial Sequence
  sgRNA
  Izumo1r_11
cctggggccttggatccagc

SEQ ID NO: 29115 - DNA, 20 bp, Artificial Sequence
  sgRNA
  Izumo1r_12
ttcgtatcacttccccaccc

SEQ ID NO: 29116 - DNA, 20 bp, Artificial Sequence
  sgRNA
  Izumo1r_13
ggactgcccacaaccccaag

SEQ ID NO: 29117 - DNA, 20 bp, Artificial Sequence
  sgRNA
  Izumo1r_14
ggagggccacttccacgttg

SEQ ID NO: 29118 - DNA, 20 bp, Artificial Sequence
  sgRNA
  Izumo1r_15
atgctgaagttaaagagcaa

SEQ ID NO: 29119 - DNA, 20 bp, Artificial Sequence
  sgRNA
  Izumo1r_16
cccagaagacgaactctacc

SEQ ID NO: 29120 - DNA, 20 bp, Artificial Sequence
  sgRNA
  Izumo1r_17
ggaagtgatacgaaaaaggg

SEQ ID NO: 29121 - DNA, 20 bp, Artificial Sequence
  sgRNA
  Izumo1r_18
tagcaaccccaacgtggaag

SEQ ID NO: 29122 - DNA, 20 bp, Artificial Sequence
  sgRNA
  Izumo1r_19
tgatacgaaaaagggaggca

SEQ ID NO: 29123 - DNA, 20 bp, Artificial Sequence
  sgRNA
  Izumo1r_20
gcacagagagaaggctggga

SEQ ID NO: 29124 - DNA, 20 bp, Artificial Sequence
  sgRNA
  Izumo3_1
gaagacagttccaacaatcg

SEQ ID NO: 29125 - DNA, 20 bp, Artificial Sequence
  sgRNA
  Izumo3_2
ctgggcaacgaaacatggaa

SEQ ID NO: 29126 - DNA, 20 bp, Artificial Sequence
  sgRNA
  Izumo3_3
gataacccatataagctcca

SEQ ID NO: 29127 - DNA, 20 bp, Artificial Sequence
  sgRNA
  Izumo3_4
aggtaccaggtttcccaaca

SEQ ID NO: 29128 - DNA, 20 bp, Artificial Sequence
  sgRNA
  Izumo3_5
gtctcctttgaaacaccgag

SEQ ID NO: 29129 - DNA, 20 bp, Artificial Sequence
  sgRNA
  Izumo3_6
atccctagcagcctttcatg

SEQ ID NO: 29130 - DNA, 20 bp, Artificial Sequence
  sgRNA
  Izumo3_7
gtgtgaccccaaatttacag

SEQ ID NO: 29131 - DNA, 20 bp, Artificial Sequence
  sgRNA
  Izumo3_8
atgaaaacagaagtacccat

SEQ ID NO: 29132 - DNA, 20 bp, Artificial Sequence
  sgRNA
  Izumo3_9
tctggagatccgccaaaact

SEQ ID NO: 29133 - DNA, 20 bp, Artificial Sequence
  sgRNA
  Izumo3_10
tcaaattcaaactctctgac

SEQ ID NO: 29134 - DNA, 20 bp, Artificial Sequence
  sgRNA
  Izumo3_11
atgtttgcatctcacatcgg

SEQ ID NO: 29135 - DNA, 20 bp, Artificial Sequence
  sgRNA
  Izumo3_12
tttctatcaggaacttctag

SEQ ID NO: 29136 - DNA, 20 bp, Artificial Sequence
  sgRNA
  Izumo3_13
actactggacaggcaacata

SEQ ID NO: 29137 - DNA, 20 bp, Artificial Sequence
  sgRNA
  Izumo3_14
tccatgtttgcatctcacat

SEQ ID NO: 29138 - DNA, 20 bp, Artificial Sequence
  sgRNA
  Izumo3_15
gctgagtcagaaatgcaaac

SEQ ID NO: 29139 - DNA, 20 bp, Artificial Sequence
  sgRNA
  Izumo3_16
tcgattgttggaactgtctt

SEQ ID NO: 29140 - DNA, 20 bp, Artificial Sequence
  sgRNA
  Izumo3_17
ataggctgggcaacgaaaca

SEQ ID NO: 29141 - DNA, 20 bp, Artificial Sequence
  sgRNA
  Izumo3_18
acagcctctgaccccatgaa

SEQ ID NO: 29142 - DNA, 20 bp, Artificial Sequence
  sgRNA
  Izumo3_19
atagaaatcaactactggac

SEQ ID NO: 29143 - DNA, 20 bp, Artificial Sequence
  sgRNA
  Izumo3_20
gaccccatgaaaggctgcta

SEQ ID NO: 29144 - DNA, 20 bp, Artificial Sequence
  sgRNA
  Jag1_1
tctgacccctgccataaccg

SEQ ID NO: 29145 - DNA, 20 bp, Artificial Sequence
  sgRNA
  Jag1_2
gaagccacgtgtaataatgg

SEQ ID NO: 29146 - DNA, 20 bp, Artificial Sequence
  sgRNA
  Jag1_3
tgacttacgtacccgacagg

SEQ ID NO: 29147 - DNA, 20 bp, Artificial Sequence
  sgRNA
  Jag1_4
actggcacgattgtagcact

SEQ ID NO: 29148 - DNA, 20 bp, Artificial Sequence
  sgRNA
  Jag1_5
catcagccctgtctcaaccg

SEQ ID NO: 29149 - DNA, 20 bp, Artificial Sequence
  sgRNA
  Jag1_6
ggtaccaccattattacacg

SEQ ID NO: 29150 - DNA, 20 bp, Artificial Sequence
  sgRNA
  Jag1_7
gtatcggtgcgaatgtgccc

SEQ ID NO: 29151 - DNA, 20 bp, Artificial Sequence
  sgRNA
  Jag1_8
gcactggtgttggcgagtgt

SEQ ID NO: 29152 - DNA, 20 bp, Artificial Sequence
  sgRNA
  Jag1_9
gtacgtatcacactcgtcgc

SEQ ID NO: 29153 - DNA, 20 bp, Artificial Sequence
  sgRNA
  Jag1_10
ctccagctcaaactgacccg

SEQ ID NO: 29154 - DNA, 20 bp, Artificial Sequence
  sgRNA
  Jag1_11
agtacgtatcacactcgtcg

SEQ ID NO: 29155 - DNA, 20 bp, Artificial Sequence
  sgRNA
  Jag1_12
tttaagtgcatgtgtcccgg

SEQ ID NO: 29156 - DNA, 20 bp, Artificial Sequence
  sgRNA
  Jag1_13
gttggctccgtgtttctcga

SEQ ID NO: 29157 - DNA, 20 bp, Artificial Sequence
  sgRNA
  Jag1_14
gggtctacgcctgtcatcgg

SEQ ID NO: 29158 - DNA, 20 bp, Artificial Sequence
  sgRNA
  Jag1_15
tcttgccctcatagtcctcg

SEQ ID NO: 29159 - DNA, 20 bp, Artificial Sequence
  sgRNA
  Jag1_16
gtaaacttccaggtgactgc

SEQ ID NO: 29160 - DNA, 20 bp, Artificial Sequence
  sgRNA
  Jag1_17
actggtgtgtaaggaagcgg

SEQ ID NO: 29161 - DNA, 20 bp, Artificial Sequence
  sgRNA
  Jag1_18
gttacagtcatcatcccact

SEQ ID NO: 29162 - DNA, 20 bp, Artificial Sequence
  sgRNA
  Jag1_19
cagtgttgctacatgttccc

SEQ ID NO: 29163 - DNA, 20 bp, Artificial Sequence
  sgRNA
  Jag1_20
gtcagaatgacgcctcctgt

SEQ ID NO: 29164 - DNA, 20 bp, Artificial Sequence
  sgRNA
  Jag2_1
ggatgtaatttgctccacgg

SEQ ID NO: 29165 - DNA, 20 bp, Artificial Sequence
  sgRNA
  Jag2_2
tgagggccacatataccaga

SEQ ID NO: 29166 - DNA, 20 bp, Artificial Sequence
  sgRNA
  Jag2_3
cgctggcatgatcaaccccg

SEQ ID NO: 29167 - DNA, 20 bp, Artificial Sequence
  sgRNA
  Jag2_4
tgtcgtactctagttcgcaa

SEQ ID NO: 29168 - DNA, 20 bp, Artificial Sequence
  sgRNA
  Jag2_5
cctcacagatgccaccccgg

SEQ ID NO: 29169 - DNA, 20 bp, Artificial Sequence
  sgRNA
  Jag2_6
aggatgtaatttgctccacg

SEQ ID NO: 29170 - DNA, 20 bp, Artificial Sequence
  sgRNA
  Jag2_7
gatagcagccacgatggcgt

SEQ ID NO: 29171 - DNA, 20 bp, Artificial Sequence
  sgRNA
  Jag2_8
tggcgacctccaaagccccg

SEQ ID NO: 29172 - DNA, 20 bp, Artificial Sequence
  sgRNA
  Jag2_9
gtgggtccgttccatcctga

SEQ ID NO: 29173 - DNA, 20 bp, Artificial Sequence
  sgRNA
  Jag2_10
gtgagggccacatataccag

SEQ ID NO: 29174 - DNA, 20 bp, Artificial Sequence
  sgRNA
  Jag2_11
ccttggtacttctgacggcg

SEQ ID NO: 29175 - DNA, 20 bp, Artificial Sequence
  sgRNA
  Jag2_12
aggtaccacccgctgcacat

SEQ ID NO: 29176 - DNA, 20 bp, Artificial Sequence
  sgRNA
  Jag2_13
ggtggcacatgctatgacag

SEQ ID NO: 29177 - DNA, 20 bp, Artificial Sequence
  sgRNA
  Jag2_14
tggccaaagaagtcgttgcg

SEQ ID NO: 29178 - DNA, 20 bp, Artificial Sequence
  sgRNA
  Jag2_15
gtctcacagtcacagtgcca

SEQ ID NO: 29179 - DNA, 20 bp, Artificial Sequence
  sgRNA
  Jag2_16
cattgaccaggtcatagcag

SEQ ID NO: 29180 - DNA, 20 bp, Artificial Sequence
  sgRNA
  Jag2_17
aaccccattgagcggccagg

SEQ ID NO: 29181 - DNA, 20 bp, Artificial Sequence
  sgRNA
  Jag2_18
tatggtggacacgaaagcgc

SEQ ID NO: 29182 - DNA, 20 bp, Artificial Sequence
  sgRNA
  Jag2_19
tcttgcaaaaacctgattgg

SEQ ID NO: 29183 - DNA, 20 bp, Artificial Sequence
  sgRNA
  Jag2_20
tgagagcgccaacaaccagt

SEQ ID NO: 29184 - DNA, 20 bp, Artificial Sequence
  sgRNA
  Jam2_1
tgaaatctatcatctcagca

SEQ ID NO: 29185 - DNA, 20 bp, Artificial Sequence
  sgRNA
  Jam2_2
tctttaaaccagatgtactc

SEQ ID NO: 29186 - DNA, 20 bp, Artificial Sequence
  sgRNA
  Jam2_3
gtcacagtaatagagttcca

SEQ ID NO: 29187 - DNA, 20 bp, Artificial Sequence
  sgRNA
  Jam2_4
cttccagtcataacagaagt

SEQ ID NO: 29188 - DNA, 20 bp, Artificial Sequence
  sgRNA
  Jam2_5
aaagccaaaatctttccgcg

SEQ ID NO: 29189 - DNA, 20 bp, Artificial Sequence
  sgRNA
  Jam2_6
ttactgtgacttcttgacgg

SEQ ID NO: 29190 - DNA, 20 bp, Artificial Sequence
  sgRNA
  Jam2_7
agtttgctagggaatccaaa

SEQ ID NO: 29191 - DNA, 20 bp, Artificial Sequence
  sgRNA
  Jam2_8
ctattactgtgacttcttga

SEQ ID NO: 29192 - DNA, 20 bp, Artificial Sequence
  sgRNA
  Jam2_9
gcatgactttatcttcctgc

SEQ ID NO: 29193 - DNA, 20 bp, Artificial Sequence
  sgRNA
  Jam2_10
aagatggcacaagtttgcta

SEQ ID NO: 29194 - DNA, 20 bp, Artificial Sequence
  sgRNA
  Jam2_11
ctccttggtctactaccaac

SEQ ID NO: 29195 - DNA, 20 bp, Artificial Sequence
  sgRNA
  Jam2_12
acaaagccaaaatctttccg

SEQ ID NO: 29196 - DNA, 20 bp, Artificial Sequence
  sgRNA
  Jam2_13
acactacttgatcgtcgccc

SEQ ID NO: 29197 - DNA, 20 bp, Artificial Sequence
  sgRNA
  Jam2_14
gagtacatctggtttaaaga

SEQ ID NO: 29198 - DNA, 20 bp, Artificial Sequence
  sgRNA
  Jam2_15
agactggagtggaagaaggt

SEQ ID NO: 29199 - DNA, 20 bp, Artificial Sequence
  sgRNA
  Jam2_16
cctgctcagaccttattggt

SEQ ID NO: 29200 - DNA, 20 bp, Artificial Sequence
  sgRNA
  Jam2_17
ggaactctgtcggacaccgc

SEQ ID NO: 29201 - DNA, 20 bp, Artificial Sequence
  sgRNA
  Jam2_18
tcctgctcagaccttattgg

SEQ ID NO: 29202 - DNA, 20 bp, Artificial Sequence
  sgRNA
  Jam2_19
acagccaatgtgttgtggag

SEQ ID NO: 29203 - DNA, 20 bp, Artificial Sequence
  sgRNA
  Jam2_20
cagaccttattggtgggagt

SEQ ID NO: 29204 - DNA, 20 bp, Artificial Sequence
  sgRNA
  Jam3_1
ttcagccatctatcgctgtg

SEQ ID NO: 29205 - DNA, 20 bp, Artificial Sequence
  sgRNA
  Jam3_2
ttgcggtaccagctgtagtg

SEQ ID NO: 29206 - DNA, 20 bp, Artificial Sequence
  sgRNA
  Jam3_3
tttcaaattcatgtaccact

SEQ ID NO: 29207 - DNA, 20 bp, Artificial Sequence
  sgRNA
  Jam3_4
gaatggaagaaaatccaaga

SEQ ID NO: 29208 - DNA, 20 bp, Artificial Sequence
  sgRNA
  Jam3_5
tgcgacttcgactgtacgcg

SEQ ID NO: 29209 - DNA, 20 bp, Artificial Sequence
  sgRNA
  Jam3_6
gttcttgctgtgattacgat

SEQ ID NO: 29210 - DNA, 20 bp, Artificial Sequence
  sgRNA
  Jam3_7
cgtcttgcctacaggtacag

SEQ ID NO: 29211 - DNA, 20 bp, Artificial Sequence
  sgRNA
  Jam3_8
tgtcacattccagatcctca

SEQ ID NO: 29212 - DNA, 20 bp, Artificial Sequence
  sgRNA
  Jam3_9
ctgcagtgccaagagagcga

SEQ ID NO: 29213 - DNA, 20 bp, Artificial Sequence
  sgRNA
  Jam3_10
cagattccagagccaatccc

SEQ ID NO: 29214 - DNA, 20 bp, Artificial Sequence
  sgRNA
  Jam3_11
taccagctgtagtgaggccg

SEQ ID NO: 29215 - DNA, 20 bp, Artificial Sequence
  sgRNA
  Jam3_12
aacgacctcacagcgataga

SEQ ID NO: 29216 - DNA, 20 bp, Artificial Sequence
  sgRNA
  Jam3_13
ggaattgtcttgcatcatta

SEQ ID NO: 29217 - DNA, 20 bp, Artificial Sequence
  sgRNA
  Jam3_14
tgtttggaaaaacttccctg

SEQ ID NO: 29218 - DNA, 20 bp, Artificial Sequence
  sgRNA
  Jam3_15
actcacagacaagtgaccct

SEQ ID NO: 29219 - DNA, 20 bp, Artificial Sequence
  sgRNA
  Jam3_16
gatctggaatgtgacacgat

SEQ ID NO: 29220 - DNA, 20 bp, Artificial Sequence
  sgRNA
  Jam3_17
gctctggaatctgtaggcag

SEQ ID NO: 29221 - DNA, 20 bp, Artificial Sequence
  sgRNA
  Jam3_18
taggcagtggcacatcattg

SEQ ID NO: 29222 - DNA, 20 bp, Artificial Sequence
  sgRNA
  Jam3_19
ggaattctggaacctgggat

SEQ ID NO: 29223 - DNA, 20 bp, Artificial Sequence
  sgRNA
  Jam3_20
ccaatgacgcaggtgcagcc

SEQ ID NO: 29224 - DNA, 20 bp, Artificial Sequence
  sgRNA
  Kcna3_1
tggcgctggaagtcacggcg

SEQ ID NO: 29225 - DNA, 20 bp, Artificial Sequence
  sgRNA
  Kcna3_2
ggctgccaacaacagcacgt

SEQ ID NO: 29226 - DNA, 20 bp, Artificial Sequence
  sgRNA
  Kcna3_3
gagagtcatccgcctagtaa

SEQ ID NO: 29227 - DNA, 20 bp, Artificial Sequence
  sgRNA
  Kcna3_4
tggagaaggtggctttactg

SEQ ID NO: 29228 - DNA, 20 bp, Artificial Sequence
  sgRNA
  Kcna3_5
gcagcaatcttgctcgcccg

SEQ ID NO: 29229 - DNA, 20 bp, Artificial Sequence
  sgRNA
  Kcna3_6
gcccatcgacatcttctccg

SEQ ID NO: 29230 - DNA, 20 bp, Artificial Sequence
  sgRNA
  Kcna3_7
gcaatcttgctcgcccgcgg

SEQ ID NO: 29231 - DNA, 20 bp, Artificial Sequence
  sgRNA
  Kcna3_8
tatatggtgatcgaagaggg

SEQ ID NO: 29232 - DNA, 20 bp, Artificial Sequence
  sgRNA
  Kcna3_9
gtatatggtgatcgaagagg

SEQ ID NO: 29233 - DNA, 20 bp, Artificial Sequence
  sgRNA
  Kcna3_10
gcacctctcctcttcagccg

SEQ ID NO: 29234 - DNA, 20 bp, Artificial Sequence
  sgRNA
  Kcna3_11
tcctcggagaagatgtcgat

SEQ ID NO: 29235 - DNA, 20 bp, Artificial Sequence
  sgRNA
  Kcna3_12
gcaagcccagtacatgcacg

SEQ ID NO: 29236 - DNA, 20 bp, Artificial Sequence
  sgRNA
  Kcna3_13
tgcggaaaacccttactagg

SEQ ID NO: 29237 - DNA, 20 bp, Artificial Sequence
  sgRNA
  Kcna3_14
ggttactactgcccaccaga

SEQ ID NO: 29238 - DNA, 20 bp, Artificial Sequence
  sgRNA
  Kcna3_15
aatggtcaagacacctgcga

SEQ ID NO: 29239 - DNA, 20 bp, Artificial Sequence
  sgRNA
  Kcna3_16
ggtcgaagaagtactcattg

SEQ ID NO: 29240 - DNA, 20 bp, Artificial Sequence
  sgRNA
  Kcna3_17
cctggcgctggaagtcacgg

SEQ ID NO: 29241 - DNA, 20 bp, Artificial Sequence
  sgRNA
  Kcna3_18
cgatgggcacgttgaccggc

SEQ ID NO: 29242 - DNA, 20 bp, Artificial Sequence
  sgRNA
  Kcna3_19
cgggtggcagtggctcgtag

SEQ ID NO: 29243 - DNA, 20 bp, Artificial Sequence
  sgRNA
  Kcna3_20
ttgaagttggaaacaatcac

SEQ ID NO: 29244 - DNA, 20 bp, Artificial Sequence
  sgRNA
  Kcng4_1
agtgtctgacgaatccccgg

SEQ ID NO: 29245 - DNA, 20 bp, Artificial Sequence
  sgRNA
  Kcng4_2
gaagaactgacatttgttcg

SEQ ID NO: 29246 - DNA, 20 bp, Artificial Sequence
  sgRNA
  Kcng4_3
ccttgactgacttaggctcg

SEQ ID NO: 29247 - DNA, 20 bp, Artificial Sequence
  sgRNA
  Kcng4_4
aaggagatcctagtgaatgt

SEQ ID NO: 29248 - DNA, 20 bp, Artificial Sequence
  sgRNA
  Kcng4_5
ggtaggagtgagagaacgtg

SEQ ID NO: 29249 - DNA, 20 bp, Artificial Sequence
  sgRNA
  Kcng4_6
gcgtcttcagaacaccaatt

SEQ ID NO: 29250 - DNA, 20 bp, Artificial Sequence
  sgRNA
  Kcng4_7
gagccaggcgcattacgtag

SEQ ID NO: 29251 - DNA, 20 bp, Artificial Sequence
  sgRNA
  Kcng4_8
acaccaattcggccagcgaa

SEQ ID NO: 29252 - DNA, 20 bp, Artificial Sequence
  sgRNA
  Kcng4_9
ctagcatccccgcatcctat

SEQ ID NO: 29253 - DNA, 20 bp, Artificial Sequence
  sgRNA
  Kcng4_10
cgtggttgccacgaagagca

SEQ ID NO: 29254 - DNA, 20 bp, Artificial Sequence
  sgRNA
  Kcng4_11
ggagatgatggcccaccaat

SEQ ID NO: 29255 - DNA, 20 bp, Artificial Sequence
  sgRNA
  Kcng4_12
gctggccacccacattcact

SEQ ID NO: 29256 - DNA, 20 bp, Artificial Sequence
  sgRNA
  Kcng4_13
ccatcgtgaagcctgcacct

SEQ ID NO: 29257 - DNA, 20 bp, Artificial Sequence
  sgRNA
  Kcng4_14
gcatcaggagaccaaactct

SEQ ID NO: 29258 - DNA, 20 bp, Artificial Sequence
  sgRNA
  Kcng4_15
gtagctcagctcctcccgga

SEQ ID NO: 29259 - DNA, 20 bp, Artificial Sequence
  sgRNA
  Kcng4_16
catcctctacgtaatgcgcc

SEQ ID NO: 29260 - DNA, 20 bp, Artificial Sequence
  sgRNA
  Kcng4_17
catcatctccatgacgaccg

SEQ ID NO: 29261 - DNA, 20 bp, Artificial Sequence
  sgRNA
  Kcng4_18
agaatgtcgatgacattcag

SEQ ID NO: 29262 - DNA, 20 bp, Artificial Sequence
  sgRNA
  Kcng4_19
tctgtcccgggacgctgcga

SEQ ID NO: 29263 - DNA, 20 bp, Artificial Sequence
  sgRNA
  Kcng4_20
agagctgcgtgatctcctca

SEQ ID NO: 29264 - DNA, 20 bp, Artificial Sequence
  sgRNA
  Kcnj12_1
cctgcgtaagagtcacatcg

SEQ ID NO: 29265 - DNA, 20 bp, Artificial Sequence
  sgRNA
  Kcnj12_2
gatgatgccaaacaacaacc

SEQ ID NO: 29266 - DNA, 20 bp, Artificial Sequence
  sgRNA
  Kcnj12_3
gaccagattgacatcgatgt

SEQ ID NO: 29267 - DNA, 20 bp, Artificial Sequence
  sgRNA
  Kcnj12_4
gcgtagcccgtagccaatgg

SEQ ID NO: 29268 - DNA, 20 bp, Artificial Sequence
  sgRNA
  Kcnj12_5
gcgtaagagtcacatcgtgg

SEQ ID NO: 29269 - DNA, 20 bp, Artificial Sequence
  sgRNA
  Kcnj12_6
ccacgatgtgactcttacgc

SEQ ID NO: 29270 - DNA, 20 bp, Artificial Sequence
  sgRNA
  Kcnj12_7
gcaaggtgcatacacggcgc

SEQ ID NO: 29271 - DNA, 20 bp, Artificial Sequence
  sgRNA
  Kcnj12_8
gatgccaaacaacaaccagg

SEQ ID NO: 29272 - DNA, 20 bp, Artificial Sequence
  sgRNA
  Kcnj12_9
acacttccacaagacctacg

SEQ ID NO: 29273 - DNA, 20 bp, Artificial Sequence
  sgRNA
  Kcnj12_10
gttaccatgtcaggcgccaa

SEQ ID NO: 29274 - DNA, 20 bp, Artificial Sequence
  sgRNA
  Kcnj12_11
tgagcagcatgtagcgccag

SEQ ID NO: 29275 - DNA, 20 bp, Artificial Sequence
  sgRNA
  Kcnj12_12
tggggtactcagacgccggg

SEQ ID NO: 29276 - DNA, 20 bp, Artificial Sequence
  sgRNA
  Kcnj12_13
gccgtcacgcagagccacca

SEQ ID NO: 29277 - DNA, 20 bp, Artificial Sequence
  sgRNA
  Kcnj12_14
ccgtctgtagggccgttcaa

SEQ ID NO: 29278 - DNA, 20 bp, Artificial Sequence
  sgRNA
  Kcnj12_15
ggtcattgctgtcgcccacg

SEQ ID NO: 29279 - DNA, 20 bp, Artificial Sequence
  sgRNA
  Kcnj12_16
gatgagctgggcccgcacat

SEQ ID NO: 29280 - DNA, 20 bp, Artificial Sequence
  sgRNA
  Kcnj12_17
ccagcggatgtccacacacg

SEQ ID NO: 29281 - DNA, 20 bp, Artificial Sequence
  sgRNA
  Kcnj12_18
tgtgactgaagagtgcccgg

SEQ ID NO: 29282 - DNA, 20 bp, Artificial Sequence
  sgRNA
  Kcnj12_19
cgatgtcaatctggtccagt

SEQ ID NO: 29283 - DNA, 20 bp, Artificial Sequence
  sgRNA
  Kcnj12_20
gaaaggctgccatgaagccg

SEQ ID NO: 29284 - DNA, 20 bp, Artificial Sequence
  sgRNA
  Kcnj3_1
gtagtgaccacttcgtcgag

SEQ ID NO: 29285 - DNA, 20 bp, Artificial Sequence
  sgRNA
  Kcnj3_2
ataagcgatcacccaccaca

SEQ ID NO: 29286 - DNA, 20 bp, Artificial Sequence
  sgRNA
  Kcnj3_3
tgggtgatcgcttatacccg

SEQ ID NO: 29287 - DNA, 20 bp, Artificial Sequence
  sgRNA
  Kcnj3_4
catcacagataagtgccccg

SEQ ID NO: 29288 - DNA, 20 bp, Artificial Sequence
  sgRNA
  Kcnj3_5
gggtagtgaagaggtccgaa

SEQ ID NO: 29289 - DNA, 20 bp, Artificial Sequence
  sgRNA
  Kcnj3_6
cagcttgcagcggatctgcg

SEQ ID NO: 29290 - DNA, 20 bp, Artificial Sequence
  sgRNA
  Kcnj3_7
cctcttcttcatcgagaccg

SEQ ID NO: 29291 - DNA, 20 bp, Artificial Sequence
  sgRNA
  Kcnj3_8
gcatgcggttatctccatga

SEQ ID NO: 29292 - DNA, 20 bp, Artificial Sequence
  sgRNA
  Kcnj3_9
ggtgggtgatcgcttatacc

SEQ ID NO: 29293 - DNA, 20 bp, Artificial Sequence
  sgRNA
  Kcnj3_10
cttcatcctcacctacaccg

SEQ ID NO: 29294 - DNA, 20 bp, Artificial Sequence
  sgRNA
  Kcnj3_11
agctcgaacatcatacacag

SEQ ID NO: 29295 - DNA, 20 bp, Artificial Sequence
  sgRNA
  Kcnj3_12
gggagtgtagttgccgacat

SEQ ID NO: 29296 - DNA, 20 bp, Artificial Sequence
  sgRNA
  Kcnj3_13
gatgaggaaagcgtccacga

SEQ ID NO: 29297 - DNA, 20 bp, Artificial Sequence
  sgRNA
  Kcnj3_14
ttacagcgtgaaagagcagg

SEQ ID NO: 29298 - DNA, 20 bp, Artificial Sequence
  sgRNA
  Kcnj3_15
cagcggttcgtggacaagaa

SEQ ID NO: 29299 - DNA, 20 bp, Artificial Sequence
  sgRNA
  Kcnj3_16
cgaagctgcagaaaattacg

SEQ ID NO: 29300 - DNA, 20 bp, Artificial Sequence
  sgRNA
  Kcnj3_17
gggcaaatcacccaaactat

SEQ ID NO: 29301 - DNA, 20 bp, Artificial Sequence
  sgRNA
  Kcnj3_18
tgctctttcacgctgtaagg

SEQ ID NO: 29302 - DNA, 20 bp, Artificial Sequence
  sgRNA
  Kcnj3_19
ttatggctggtgctattaaa

SEQ ID NO: 29303 - DNA, 20 bp, Artificial Sequence
  sgRNA
  Kcnj3_20
gggatcagataacatcttgg

SEQ ID NO: 29304 - DNA, 20 bp, Artificial Sequence
  sgRNA
  Kcnj4_1
ggacaatatttcctatcgca

SEQ ID NO: 29305 - DNA, 20 bp, Artificial Sequence
  sgRNA
  Kcnj4_2
catagtgcatgaaatcgacg

SEQ ID NO: 29306 - DNA, 20 bp, Artificial Sequence
  sgRNA
  Kcnj4_3
gctgtcatctccgttcgaga

SEQ ID NO: 29307 - DNA, 20 bp, Artificial Sequence
  sgRNA
  Kcnj4_4
ggaccagcgggacctcaacg

SEQ ID NO: 29308 - DNA, 20 bp, Artificial Sequence
  sgRNA
  Kcnj4_5
ccgtttacgtgcatgataca

SEQ ID NO: 29309 - DNA, 20 bp, Artificial Sequence
  sgRNA
  Kcnj4_6
ggcctgagtggtcatagccg

SEQ ID NO: 29310 - DNA, 20 bp, Artificial Sequence
  sgRNA
  Kcnj4_7
gctctcctgcagctcacggg

SEQ ID NO: 29311 - DNA, 20 bp, Artificial Sequence
  sgRNA
  Kcnj4_8
gcagagcttgccgtctcgaa

SEQ ID NO: 29312 - DNA, 20 bp, Artificial Sequence
  sgRNA
  Kcnj4_9
tatgctcatgatcttctccg

SEQ ID NO: 29313 - DNA, 20 bp, Artificial Sequence
  sgRNA
  Kcnj4_10
attccacaagacctatgagg

SEQ ID NO: 29314 - DNA, 20 bp, Artificial Sequence
  sgRNA
  Kcnj4_11
gctgcaggagagcaagatca

SEQ ID NO: 29315 - DNA, 20 bp, Artificial Sequence
  sgRNA
  Kcnj4_12
gctctgcctgatgtggcgcg

SEQ ID NO: 29316 - DNA, 20 bp, Artificial Sequence
  sgRNA
  Kcnj4_13
gcgcaagagtcacattgtgg

SEQ ID NO: 29317 - DNA, 20 bp, Artificial Sequence
  sgRNA
  Kcnj4_14
atttcatgcactatgatgat

SEQ ID NO: 29318 - DNA, 20 bp, Artificial Sequence
  sgRNA
  Kcnj4_15
aaaccctacatgacacagga

SEQ ID NO: 29319 - DNA, 20 bp, Artificial Sequence
  sgRNA
  Kcnj4_16
gactggcctccaggtcacca

SEQ ID NO: 29320 - DNA, 20 bp, Artificial Sequence
  sgRNA
  Kcnj4_17
ggaaaagagtcactacaagg

SEQ ID NO: 29321 - DNA, 20 bp, Artificial Sequence
  sgRNA
  Kcnj4_18
ggcactcctctgtcacacac

SEQ ID NO: 29322 - DNA, 20 bp, Artificial Sequence
  sgRNA
  Kcnj4_19
gcgtttccgcctgggcacgt

SEQ ID NO: 29323 - DNA, 20 bp, Artificial Sequence
  sgRNA
  Kcnj4_20
tggcgaagtagacgttacac

SEQ ID NO: 29324 - DNA, 20 bp, Artificial Sequence
  sgRNA
  Kcnk18_1
gccatttgaagatatcgtgg

SEQ ID NO: 29325 - DNA, 20 bp, Artificial Sequence
  sgRNA
  Kcnk18_2
ggatatctcctatgtctgtg

SEQ ID NO: 29326 - DNA, 20 bp, Artificial Sequence
  sgRNA
  Kcnk18_3
gtcagggcggccctcgacag

SEQ ID NO: 29327 - DNA, 20 bp, Artificial Sequence
  sgRNA
  Kcnk18_4
cctaaacccgcagcccagca

SEQ ID NO: 29328 - DNA, 20 bp, Artificial Sequence
  sgRNA
  Kcnk18_5
tcttatccagggcttacagt

SEQ ID NO: 29329 - DNA, 20 bp, Artificial Sequence
  sgRNA
  Kcnk18_6
gctctcttctccgctgtcga

SEQ ID NO: 29330 - DNA, 20 bp, Artificial Sequence
  sgRNA
  Kcnk18_7
gcagcctgacagcaaaccgg

SEQ ID NO: 29331 - DNA, 20 bp, Artificial Sequence
  sgRNA
  Kcnk18_8
gatgtatgcaaagacgacca

SEQ ID NO: 29332 - DNA, 20 bp, Artificial Sequence
  sgRNA
  Kcnk18_9
tgaggaccaggaacattaga

SEQ ID NO: 29333 - DNA, 20 bp, Artificial Sequence
  sgRNA
  Kcnk18_10
ctttgcatacatctcctgcg

SEQ ID NO: 29334 - DNA, 20 bp, Artificial Sequence
  sgRNA
  Kcnk18_11
acaaccacccacgcgtcccg

SEQ ID NO: 29335 - DNA, 20 bp, Artificial Sequence
  sgRNA
  Kcnk18_12
cacgatgtccccaaacccga

SEQ ID NO: 29336 - DNA, 20 bp, Artificial Sequence
  sgRNA
  Kcnk18_13
gctcctctccacgggacgcg

SEQ ID NO: 29337 - DNA, 20 bp, Artificial Sequence
  sgRNA
  Kcnk18_14
gcgccatttgaagatatcgt

SEQ ID NO: 29338 - DNA, 20 bp, Artificial Sequence
  sgRNA
  Kcnk18_15
gcatcccctggccttcccca

SEQ ID NO: 29339 - DNA, 20 bp, Artificial Sequence
  sgRNA
  Kcnk18_16
gatgctgtcccgaggccctg

SEQ ID NO: 29340 - DNA, 20 bp, Artificial Sequence
  sgRNA
  Kcnk18_17
ggatgttgcacagatcgtcc

SEQ ID NO: 29341 - DNA, 20 bp, Artificial Sequence
  sgRNA
  Kcnk18_18
ttggcaaacaaacagcatga

SEQ ID NO: 29342 - DNA, 20 bp, Artificial Sequence
  sgRNA
  Kcnk18_19
agacgaccagggcgatgacg

SEQ ID NO: 29343 - DNA, 20 bp, Artificial Sequence
  sgRNA
  Kcnk18_20
cataggtcaccaggcagcaa

SEQ ID NO: 29344 - DNA, 20 bp, Artificial Sequence
  sgRNA
  Kcnk5_1
ggcacagcggcaccccgaag

SEQ ID NO: 29345 - DNA, 20 bp, Artificial Sequence
  sgRNA
  Kcnk5_2
ggagtgtggagagctctcaa

SEQ ID NO: 29346 - DNA, 20 bp, Artificial Sequence
  sgRNA
  Kcnk5_3
acagccatcttcatcgtgtg

SEQ ID NO: 29347 - DNA, 20 bp, Artificial Sequence
  sgRNA
  Kcnk5_4
gaaggcaatgaaaacaagtg

SEQ ID NO: 29348 - DNA, 20 bp, Artificial Sequence
  sgRNA
  Kcnk5_5
aattcacccgtgctgctcaa

SEQ ID NO: 29349 - DNA, 20 bp, Artificial Sequence
  sgRNA
  Kcnk5_6
tccaaagctccacaaagtat

SEQ ID NO: 29350 - DNA, 20 bp, Artificial Sequence
  sgRNA
  Kcnk5_7
aggtggactcatcggatgaa

SEQ ID NO: 29351 - DNA, 20 bp, Artificial Sequence
  sgRNA
  Kcnk5_8
cctcactgatacggtccagt

SEQ ID NO: 29352 - DNA, 20 bp, Artificial Sequence
  sgRNA
  Kcnk5_9
tcttcgggggacgtgcaaag

SEQ ID NO: 29353 - DNA, 20 bp, Artificial Sequence
  sgRNA
  Kcnk5_10
tgtacttccagccatctgta

SEQ ID NO: 29354 - DNA, 20 bp, Artificial Sequence
  sgRNA
  Kcnk5_11
atagaccaccaaaggtgcca

SEQ ID NO: 29355 - DNA, 20 bp, Artificial Sequence
  sgRNA
  Kcnk5_12
tagaggtctcctcgtctgag

SEQ ID NO: 29356 - DNA, 20 bp, Artificial Sequence
  sgRNA
  Kcnk5_13
gtacagccatcttcatcgtg

SEQ ID NO: 29357 - DNA, 20 bp, Artificial Sequence
  sgRNA
  Kcnk5_14
caaagtatcggtatagggcg

SEQ ID NO: 29358 - DNA, 20 bp, Artificial Sequence
  sgRNA
  Kcnk5_15
tctgtcaccatgaacacaaa

SEQ ID NO: 29359 - DNA, 20 bp, Artificial Sequence
  sgRNA
  Kcnk5_16
ccaaaggtgccagggatgca

SEQ ID NO: 29360 - DNA, 20 bp, Artificial Sequence
  sgRNA
  Kcnk5_17
ggtggtctattccaagaatc

SEQ ID NO: 29361 - DNA, 20 bp, Artificial Sequence
  sgRNA
  Kcnk5_18
catcagctgctcgtaaggca

SEQ ID NO: 29362 - DNA, 20 bp, Artificial Sequence
  sgRNA
  Kcnk5_19
tcaccatgaacacaaagggc

SEQ ID NO: 29363 - DNA, 20 bp, Artificial Sequence
  sgRNA
  Kcnk5_20
gggactggacaagatcctac

SEQ ID NO: 29364 - DNA, 20 bp, Artificial Sequence
  sgRNA
  Kcnmb1_1
cagctgatacattgacccaa

SEQ ID NO: 29365 - DNA, 20 bp, Artificial Sequence
  sgRNA
  Kcnmb1_2
tgaaactaatatcaaggacc

SEQ ID NO: 29366 - DNA, 20 bp, Artificial Sequence
  sgRNA
  Kcnmb1_3
ggacaactaccagacagcct

SEQ ID NO: 29367 - DNA, 20 bp, Artificial Sequence
  sgRNA
  Kcnmb1_4
agttgtacccaggacgtagt

SEQ ID NO: 29368 - DNA, 20 bp, Artificial Sequence
  sgRNA
  Kcnmb1_5
gtatcacacggaagacactc

SEQ ID NO: 29369 - DNA, 20 bp, Artificial Sequence
  sgRNA
  Kcnmb1_6
cccaccttcctgctgaccgg

SEQ ID NO: 29370 - DNA, 20 bp, Artificial Sequence
  sgRNA
  Kcnmb1_7
acgctggtctcgttgacttg

SEQ ID NO: 29371 - DNA, 20 bp, Artificial Sequence
  sgRNA
  Kcnmb1_8
cgttgacttgaggtgcagaa

SEQ ID NO: 29372 - DNA, 20 bp, Artificial Sequence
  sgRNA
  Kcnmb1_9
gccccagtacccatgccttt

SEQ ID NO: 29373 - DNA, 20 bp, Artificial Sequence
  sgRNA
  Kcnmb1_10
atacattgacccaaaggcat

SEQ ID NO: 29374 - DNA, 20 bp, Artificial Sequence
  sgRNA
  Kcnmb1_11
ggacctgttgagcttcacca

SEQ ID NO: 29375 - DNA, 20 bp, Artificial Sequence
  sgRNA
  Kcnmb1_12
atgggccatgctgtatcaca

SEQ ID NO: 29376 - DNA, 20 bp, Artificial Sequence
  sgRNA
  Kcnmb1_13
ggggcagcacagttgtaccc

SEQ ID NO: 29377 - DNA, 20 bp, Artificial Sequence
  sgRNA
  Kcnmb1_14
ggcaataagaataagacccc

SEQ ID NO: 29378 - DNA, 20 bp, Artificial Sequence
  sgRNA
  Kcnmb1_15
gatacattgacccaaaggca

SEQ ID NO: 29379 - DNA, 20 bp, Artificial Sequence
  sgRNA
  Kcnmb1_16
ctggtgatggcccagaagcg

SEQ ID NO: 29380 - DNA, 20 bp, Artificial Sequence
  sgRNA
  Kcnmb1_17
caggtccctatccatcttgg

SEQ ID NO: 29381 - DNA, 20 bp, Artificial Sequence
  sgRNA
  Kcnmb1_18
ggtagttgtccaggttcctg

SEQ ID NO: 29382 - DNA, 20 bp, Artificial Sequence
  sgRNA
  Kcnmb1_19
gcccaccttcctgctgaccg

SEQ ID NO: 29383 - DNA, 20 bp, Artificial Sequence
  sgRNA
  Kcnmb1_20
ctgagccgccaagatggata

SEQ ID NO: 29384 - DNA, 20 bp, Artificial Sequence
  sgRNA
  Kcnmb2_1
tcttcatggtctcttccgtg

SEQ ID NO: 29385 - DNA, 20 bp, Artificial Sequence
  sgRNA
  Kcnmb2_2
tgctcctatattcctaagtg

SEQ ID NO: 29386 - DNA, 20 bp, Artificial Sequence
  sgRNA
  Kcnmb2_3
catgatggagcacaccatca

SEQ ID NO: 29387 - DNA, 20 bp, Artificial Sequence
  sgRNA
  Kcnmb2_4
tgtgattgacacattcagca

SEQ ID NO: 29388 - DNA, 20 bp, Artificial Sequence
  sgRNA
  Kcnmb2_5
gaggctcctcctctaccaca

SEQ ID NO: 29389 - DNA, 20 bp, Artificial Sequence
  sgRNA
  Kcnmb2_6
gcagcagtgtgattcccagc

SEQ ID NO: 29390 - DNA, 20 bp, Artificial Sequence
  sgRNA
  Kcnmb2_7
ttgtctcccacacagtagca

SEQ ID NO: 29391 - DNA, 20 bp, Artificial Sequence
  sgRNA
  Kcnmb2_8
cgtgaacctgacatcttccg

SEQ ID NO: 29392 - DNA, 20 bp, Artificial Sequence
  sgRNA
  Kcnmb2_9
gtagaggaggagcctctccc

SEQ ID NO: 29393 - DNA, 20 bp, Artificial Sequence
  sgRNA
  Kcnmb2_10
ttggatcctctcacaaagca

SEQ ID NO: 29394 - DNA, 20 bp, Artificial Sequence
  sgRNA
  Kcnmb2_11
tctatgaccctgctactgtg

SEQ ID NO: 29395 - DNA, 20 bp, Artificial Sequence
  sgRNA
  Kcnmb2_12
ctatgaccctgctactgtgt

SEQ ID NO: 29396 - DNA, 20 bp, Artificial Sequence
  sgRNA
  Kcnmb2_13
gagagaatggaacagcacat

SEQ ID NO: 29397 - DNA, 20 bp, Artificial Sequence
  sgRNA
  Kcnmb2_14
cttctggccaacttgtatga

SEQ ID NO: 29398 - DNA, 20 bp, Artificial Sequence
  sgRNA
  Kcnmb2_15
cccccagccatcatacaagt

SEQ ID NO: 29399 - DNA, 20 bp, Artificial Sequence
  sgRNA
  Kcnmb2_16
gccaacttgtatgatggctg

SEQ ID NO: 29400 - DNA, 20 bp, Artificial Sequence
  sgRNA
  Kcnmb2_17
tcacgtacacctgcaggcaa

SEQ ID NO: 29401 - DNA, 20 bp, Artificial Sequence
  sgRNA
  Kcnmb2_18
tgctttgtgagaggatccaa

SEQ ID NO: 29402 - DNA, 20 bp, Artificial Sequence
  sgRNA
  Kcnmb2_19
tctcttccgtgtggtagagg

SEQ ID NO: 29403 - DNA, 20 bp, Artificial Sequence
  sgRNA
  Kcnmb2_20
acctctccctgctttgtgag

SEQ ID NO: 29404 - DNA, 20 bp, Artificial Sequence
  sgRNA
  Kcnmb3_1
gtccaaatcacgctacaggg

SEQ ID NO: 29405 - DNA, 20 bp, Artificial Sequence
  sgRNA
  Kcnmb3_2
aagtcacattaccttggggt

SEQ ID NO: 29406 - DNA, 20 bp, Artificial Sequence
  sgRNA
  Kcnmb3_3
ccaaagcttccatcaagcgc

SEQ ID NO: 29407 - DNA, 20 bp, Artificial Sequence
  sgRNA
  Kcnmb3_4
gttcgtaaacctgagccact

SEQ ID NO: 29408 - DNA, 20 bp, Artificial Sequence
  sgRNA
  Kcnmb3_5
gcttctccactacgacgacg

SEQ ID NO: 29409 - DNA, 20 bp, Artificial Sequence
  sgRNA
  Kcnmb3_6
tgatggcctcgtcgtcgtag

SEQ ID NO: 29410 - DNA, 20 bp, Artificial Sequence
  sgRNA
  Kcnmb3_7
gctgtactgttcacactgaa

SEQ ID NO: 29411 - DNA, 20 bp, Artificial Sequence
  sgRNA
  Kcnmb3_8
tcctcagaacaactcccaag

SEQ ID NO: 29412 - DNA, 20 bp, Artificial Sequence
  sgRNA
  Kcnmb3_9
tcaggtttacgaacacctgc

SEQ ID NO: 29413 - DNA, 20 bp, Artificial Sequence
  sgRNA
  Kcnmb3_10
cctgtccaaatcacgctaca

SEQ ID NO: 29414 - DNA, 20 bp, Artificial Sequence
  sgRNA
  Kcnmb3_11
gtgtgaacagtacagcacag

SEQ ID NO: 29415 - DNA, 20 bp, Artificial Sequence
  sgRNA
  Kcnmb3_12
cctgtagcgtgatttggaca

SEQ ID NO: 29416 - DNA, 20 bp, Artificial Sequence
  sgRNA
  Kcnmb3_13
ccctgtttctacagtcccga

SEQ ID NO: 29417 - DNA, 20 bp, Artificial Sequence
  sgRNA
  Kcnmb3_14
ccatcgggactgtagaaaca

SEQ ID NO: 29418 - DNA, 20 bp, Artificial Sequence
  sgRNA
  Kcnmb3_15
tggcctttattgactttgct

SEQ ID NO: 29419 - DNA, 20 bp, Artificial Sequence
  sgRNA
  Kcnmb3_16
actacgacgacgaggccatc

SEQ ID NO: 29420 - DNA, 20 bp, Artificial Sequence
  sgRNA
  Kcnmb3_17
catcgggactgtagaaacag

SEQ ID NO: 29421 - DNA, 20 bp, Artificial Sequence
  sgRNA
  Kcnmb3_18
gcaggcatggggatctcccg

SEQ ID NO: 29422 - DNA, 20 bp, Artificial Sequence
  sgRNA
  Kcnmb3_19
gaattcttcgatcacaacaa

SEQ ID NO: 29423 - DNA, 20 bp, Artificial Sequence
  sgRNA
  Kcnmb3_20
acaactcccaaggggccatc

SEQ ID NO: 29424 - DNA, 20 bp, Artificial Sequence
  sgRNA
  Kcnmb4_1
agggcgggatataggagcac

SEQ ID NO: 29425 - DNA, 20 bp, Artificial Sequence
  sgRNA
  Kcnmb4_2
ctggacgcagggatactgcg

SEQ ID NO: 29426 - DNA, 20 bp, Artificial Sequence
  sgRNA
  Kcnmb4_3
gtcggtgcagcagatcggcg

SEQ ID NO: 29427 - DNA, 20 bp, Artificial Sequence
  sgRNA
  Kcnmb4_4
gaagacaagagcatccggct

SEQ ID NO: 29428 - DNA, 20 bp, Artificial Sequence
  sgRNA
  Kcnmb4_5
gcaggatctgcaagccacgg

SEQ ID NO: 29429 - DNA, 20 bp, Artificial Sequence
  sgRNA
  Kcnmb4_6
cagggtgtcttacgagtaca

SEQ ID NO: 29430 - DNA, 20 bp, Artificial Sequence
  sgRNA
  Kcnmb4_7
cctgcactgcttcctctggc

SEQ ID NO: 29431 - DNA, 20 bp, Artificial Sequence
  sgRNA
  Kcnmb4_8
cttgcaggatctgcaagcca

SEQ ID NO: 29432 - DNA, 20 bp, Artificial Sequence
  sgRNA
  Kcnmb4_9
gatctgctgcaccgacagca

SEQ ID NO: 29433 - DNA, 20 bp, Artificial Sequence
  sgRNA
  Kcnmb4_10
caaacgccaccaccggccag

SEQ ID NO: 29434 - DNA, 20 bp, Artificial Sequence
  sgRNA
  Kcnmb4_11
cgtggcttgcagatcctgca

SEQ ID NO: 29435 - DNA, 20 bp, Artificial Sequence
  sgRNA
  Kcnmb4_12
agccgaagatgaagagcgac

SEQ ID NO: 29436 - DNA, 20 bp, Artificial Sequence
  sgRNA
  Kcnmb4_13
cgatgaggaacaagccgagc

SEQ ID NO: 29437 - DNA, 20 bp, Artificial Sequence
  sgRNA
  Kcnmb4_14
ggcttgcagatcctgcaagg

SEQ ID NO: 29438 - DNA, 20 bp, Artificial Sequence
  sgRNA
  Kcnmb4_15
caagagcctggcggtcaagg

SEQ ID NO: 29439 - DNA, 20 bp, Artificial Sequence
  sgRNA
  Kcnmb4_16
ttcacgtacacctggacgca

SEQ ID NO: 29440 - DNA, 20 bp, Artificial Sequence
  sgRNA
  Kcnmb4_17
catctgtgccaagagcctgg

SEQ ID NO: 29441 - DNA, 20 bp, Artificial Sequence
  sgRNA
  Kcnmb4_18
gtgctgtcggtgcagcagat

SEQ ID NO: 29442 - DNA, 20 bp, Artificial Sequence
  sgRNA
  Kcnmb4_19
tcttcatcttcggcttctgc

SEQ ID NO: 29443 - DNA, 20 bp, Artificial Sequence
  sgRNA
  Kcnmb4_20
ctgcgaggtgcccctgcagt

SEQ ID NO: 29444 - DNA, 20 bp, Artificial Sequence
  sgRNA
  Kcns1_1
cagctgcgtatccatcggcg

SEQ ID NO: 29445 - DNA, 20 bp, Artificial Sequence
  sgRNA
  Kcns1_2
gccgctccagataccgcgcg

SEQ ID NO: 29446 - DNA, 20 bp, Artificial Sequence
  sgRNA
  Kcns1_3
gcaccgacacgatgtcaatg

SEQ ID NO: 29447 - DNA, 20 bp, Artificial Sequence
  sgRNA
  Kcns1_4
gtgcgacgactacgacgcag

SEQ ID NO: 29448 - DNA, 20 bp, Artificial Sequence
  sgRNA
  Kcns1_5
gcagcgcttggtgaccagcg

SEQ ID NO: 29449 - DNA, 20 bp, Artificial Sequence
  sgRNA
  Kcns1_6
cgaccaccaggatgcccccg

SEQ ID NO: 29450 - DNA, 20 bp, Artificial Sequence
  sgRNA
  Kcns1_7
ttactgctgtacctggccgt

SEQ ID NO: 29451 - DNA, 20 bp, Artificial Sequence
  sgRNA
  Kcns1_8
acgagatctcggacgtgcag

SEQ ID NO: 29452 - DNA, 20 bp, Artificial Sequence
  sgRNA
  Kcns1_9
ccacttctaccggcgccaga

SEQ ID NO: 29453 - DNA, 20 bp, Artificial Sequence
  sgRNA
  Kcns1_10
ctgtcctcgtcccaggcgcg

SEQ ID NO: 29454 - DNA, 20 bp, Artificial Sequence
  sgRNA
  Kcns1_11
cttgctgagtagcgttgacg

SEQ ID NO: 29455 - DNA, 20 bp, Artificial Sequence
  sgRNA
  Kcns1_12
cgatgcagaagtactccagg

SEQ ID NO: 29456 - DNA, 20 bp, Artificial Sequence
  sgRNA
  Kcns1_13
ccatggtgagccagagacga

SEQ ID NO: 29457 - DNA, 20 bp, Artificial Sequence
  sgRNA
  Kcns1_14
gtaccaagctcgggaggcgg

SEQ ID NO: 29458 - DNA, 20 bp, Artificial Sequence
  sgRNA
  Kcns1_15
ggagaacactgacacaccca

SEQ ID NO: 29459 - DNA, 20 bp, Artificial Sequence
  sgRNA
  Kcns1_16
ctgcacgtccgagatctcgt

SEQ ID NO: 29460 - DNA, 20 bp, Artificial Sequence
  sgRNA
  Kcns1_17
gcagtaagatgcccacctca

SEQ ID NO: 29461 - DNA, 20 bp, Artificial Sequence
  sgRNA
  Kcns1_18
cctccagtgccttctggcgc

SEQ ID NO: 29462 - DNA, 20 bp, Artificial Sequence
  sgRNA
  Kcns1_19
cgagtagcctggattctcca

SEQ ID NO: 29463 - DNA, 20 bp, Artificial Sequence
  sgRNA
  Kcns1_20
gagtagcgttgacggggtat

SEQ ID NO: 29464 - DNA, 20 bp, Artificial Sequence
  sgRNA
  Kcnv2_1
tagttgccctcggtccattg

SEQ ID NO: 29465 - DNA, 20 bp, Artificial Sequence
  sgRNA
  Kcnv2_2
gcctacgttcactttcagcg

SEQ ID NO: 29466 - DNA, 20 bp, Artificial Sequence
  sgRNA
  Kcnv2_3
ctacaacttctacacatccg

SEQ ID NO: 29467 - DNA, 20 bp, Artificial Sequence
  sgRNA
  Kcnv2_4
aaagcgctgcaggttagggg

SEQ ID NO: 29468 - DNA, 20 bp, Artificial Sequence
  sgRNA
  Kcnv2_5
cgagtacaccgccatccgga

SEQ ID NO: 29469 - DNA, 20 bp, Artificial Sequence
  sgRNA
  Kcnv2_6
gctcgagtgcttcacgagcg

SEQ ID NO: 29470 - DNA, 20 bp, Artificial Sequence
  sgRNA
  Kcnv2_7
tttgggctggagtatcgttg

SEQ ID NO: 29471 - DNA, 20 bp, Artificial Sequence
  sgRNA
  Kcnv2_8
gcacgtggagatgctgtgcg

SEQ ID NO: 29472 - DNA, 20 bp, Artificial Sequence
  sgRNA
  Kcnv2_9
acgctgaaagtgaacgtagg

SEQ ID NO: 29473 - DNA, 20 bp, Artificial Sequence
  sgRNA
  Kcnv2_10
aactaccccaaaacgcgcct

SEQ ID NO: 29474 - DNA, 20 bp, Artificial Sequence
  sgRNA
  Kcnv2_11
ggtggccctggcgctcaaca

SEQ ID NO: 29475 - DNA, 20 bp, Artificial Sequence
  sgRNA
  Kcnv2_12
gtctcgcaccagcaacaccc

SEQ ID NO: 29476 - DNA, 20 bp, Artificial Sequence
  sgRNA
  Kcnv2_13
acgcagcgccctcaacctag

SEQ ID NO: 29477 - DNA, 20 bp, Artificial Sequence
  sgRNA
  Kcnv2_14
gtgcctcgtagtcatcacac

SEQ ID NO: 29478 - DNA, 20 bp, Artificial Sequence
  sgRNA
  Kcnv2_15
gcttcacgagcgaggaccag

SEQ ID NO: 29479 - DNA, 20 bp, Artificial Sequence
  sgRNA
  Kcnv2_16
ccacggagatgagcacgaag

SEQ ID NO: 29480 - DNA, 20 bp, Artificial Sequence
  sgRNA
  Kcnv2_17
tatcgttgtggccatccagg

SEQ ID NO: 29481 - DNA, 20 bp, Artificial Sequence
  sgRNA
  Kcnv2_18
catctgcttcgaggagcgga

SEQ ID NO: 29482 - DNA, 20 bp, Artificial Sequence
  sgRNA
  Kcnv2_19
gttgagcgccagggccacca

SEQ ID NO: 29483 - DNA, 20 bp, Artificial Sequence
  sgRNA
  Kcnv2_20
gcatcaggcagcccacctgc

SEQ ID NO: 29484 - DNA, 20 bp, Artificial Sequence
  sgRNA
  Kdr_1
ttacccgcttaacggtccgt

SEQ ID NO: 29485 - DNA, 20 bp, Artificial Sequence
  sgRNA
  Kdr_2
atacgtttgagaacctcacg

SEQ ID NO: 29486 - DNA, 20 bp, Artificial Sequence
  sgRNA
  Kdr_3
ttgtaaagaatggagacacg

SEQ ID NO: 29487 - DNA, 20 bp, Artificial Sequence
  sgRNA
  Kdr_4
catagctgatcatgtaactg

SEQ ID NO: 29488 - DNA, 20 bp, Artificial Sequence
  sgRNA
  Kdr_5
ccggaacctgactatccgca

SEQ ID NO: 29489 - DNA, 20 bp, Artificial Sequence
  sgRNA
  Kdr_6
ctaggaaaacctcttggccg

SEQ ID NO: 29490 - DNA, 20 bp, Artificial Sequence
  sgRNA
  Kdr_7
atagctcaatttcatgcggg

SEQ ID NO: 29491 - DNA, 20 bp, Artificial Sequence
  sgRNA
  Kdr_8
tcacttggccgaaggcaccg

SEQ ID NO: 29492 - DNA, 20 bp, Artificial Sequence
  sgRNA
  Kdr_9
gttcaaagacaacgagaccc

SEQ ID NO: 29493 - DNA, 20 bp, Artificial Sequence
  sgRNA
  Kdr_10
tgaggtttgaaatcgaccct

SEQ ID NO: 29494 - DNA, 20 bp, Artificial Sequence
  sgRNA
  Kdr_11
gagacgctcttcataataga

SEQ ID NO: 29495 - DNA, 20 bp, Artificial Sequence
  sgRNA
  Kdr_12
cgtggatctgaaaagacgct

SEQ ID NO: 29496 - DNA, 20 bp, Artificial Sequence
  sgRNA
  Kdr_13
agatagctcaatttcatgcg

SEQ ID NO: 29497 - DNA, 20 bp, Artificial Sequence
  sgRNA
  Kdr_14
ttacttctggttcctccaat

SEQ ID NO: 29498 - DNA, 20 bp, Artificial Sequence
  sgRNA
  Kdr_15
catgaaattgagctatctgc

SEQ ID NO: 29499 - DNA, 20 bp, Artificial Sequence
  sgRNA
  Kdr_16
ttgtcctacggaccgttaag

SEQ ID NO: 29500 - DNA, 20 bp, Artificial Sequence
  sgRNA
  Kdr_17
gcgagaacagagctcaatgt

SEQ ID NO: 29501 - DNA, 20 bp, Artificial Sequence
  sgRNA
  Kdr_18
cgttcacagcgctcatccaa

SEQ ID NO: 29502 - DNA, 20 bp, Artificial Sequence
  sgRNA
  Kdr_19
ggtctggttggagccttccg

SEQ ID NO: 29503 - DNA, 20 bp, Artificial Sequence
  sgRNA
  Kdr_20
gcagatagctcaatttcatg

SEQ ID NO: 29504 - DNA, 20 bp, Artificial Sequence
  sgRNA
  Kel_1
gtctaggtcatggaccacga

SEQ ID NO: 29505 - DNA, 20 bp, Artificial Sequence
  sgRNA
  Kel_2
ccacacacttcatccatcga

SEQ ID NO: 29506 - DNA, 20 bp, Artificial Sequence
  sgRNA
  Kel_3
attactggggagtaacccac

SEQ ID NO: 29507 - DNA, 20 bp, Artificial Sequence
  sgRNA
  Kel_4
ctggcacctaggatctggag

SEQ ID NO: 29508 - DNA, 20 bp, Artificial Sequence
  sgRNA
  Kel_5
gatgaggtcgtagataggct

SEQ ID NO: 29509 - DNA, 20 bp, Artificial Sequence
  sgRNA
  Kel_6
tgtgtgagaaccattgaacg

SEQ ID NO: 29510 - DNA, 20 bp, Artificial Sequence
  sgRNA
  Kel_7
ggtatgtcacatattcccgt

SEQ ID NO: 29511 - DNA, 20 bp, Artificial Sequence
  sgRNA
  Kel_8
gaagaatgtcaaactccggc

SEQ ID NO: 29512 - DNA, 20 bp, Artificial Sequence
  sgRNA
  Kel_9
tttcttccgaagctatgccc

SEQ ID NO: 29513 - DNA, 20 bp, Artificial Sequence
  sgRNA
  Kel_10
agtctaggtcatggaccacg

SEQ ID NO: 29514 - DNA, 20 bp, Artificial Sequence
  sgRNA
  Kel_11
gctaagatccaggttgggca

SEQ ID NO: 29515 - DNA, 20 bp, Artificial Sequence
  sgRNA
  Kel_12
gcgggcagagggattcagaa

SEQ ID NO: 29516 - DNA, 20 bp, Artificial Sequence
  sgRNA
  Kel_13
tgagctgtgtacgatccctc

SEQ ID NO: 29517 - DNA, 20 bp, Artificial Sequence
  sgRNA
  Kel_14
gatgaagtgtgtggaacaga

SEQ ID NO: 29518 - DNA, 20 bp, Artificial Sequence
  sgRNA
  Kel_15
gaattcctcccagaccctcg

SEQ ID NO: 29519 - DNA, 20 bp, Artificial Sequence
  sgRNA
  Kel_16
tggacttcaaccaaaatctg

SEQ ID NO: 29520 - DNA, 20 bp, Artificial Sequence
  sgRNA
  Kel_17
ggattcagaagggtcccacg

SEQ ID NO: 29521 - DNA, 20 bp, Artificial Sequence
  sgRNA
  Kel_18
aaatctggagtattgctcag

SEQ ID NO: 29522 - DNA, 20 bp, Artificial Sequence
  sgRNA
  Kel_19
tagtaagcattgacctccca

SEQ ID NO: 29523 - DNA, 20 bp, Artificial Sequence
  sgRNA
  Kel_20
gcttcggaagaaaagttgat

SEQ ID NO: 29524 - DNA, 20 bp, Artificial Sequence
  sgRNA
  Kir3dl1_1
tggagtctgaccattcatag

SEQ ID NO: 29525 - DNA, 20 bp, Artificial Sequence
  sgRNA
  Kir3dl1_2
gtcccctggtggatacagga

SEQ ID NO: 29526 - DNA, 20 bp, Artificial Sequence
  sgRNA
  Kir3dl1_3
tatggaacgtgtcaaactga

SEQ ID NO: 29527 - DNA, 20 bp, Artificial Sequence
  sgRNA
  Kir3dl1_4
cctgtgacaacagaacatgc

SEQ ID NO: 29528 - DNA, 20 bp, Artificial Sequence
  sgRNA
  Kir3dl1_5
cattccctcctgtatccacc

SEQ ID NO: 29529 - DNA, 20 bp, Artificial Sequence
  sgRNA
  Kir3dl1_6
ctcctgacatcatcagcaca

SEQ ID NO: 29530 - DNA, 20 bp, Artificial Sequence
  sgRNA
  Kir3dl1_7
gcaggcatcccctgtccccg

SEQ ID NO: 29531 - DNA, 20 bp, Artificial Sequence
  sgRNA
  Kir3dl1_8
gattctacaaagtcccctgg

SEQ ID NO: 29532 - DNA, 20 bp, Artificial Sequence
  sgRNA
  Kir3dl1_9
gagccacagtggtaaattcg

SEQ ID NO: 29533 - DNA, 20 bp, Artificial Sequence
  sgRNA
  Kir3dl1_10
ttccctcctgtatccaccag

SEQ ID NO: 29534 - DNA, 20 bp, Artificial Sequence
  sgRNA
  Kir3dl1_11
ttagtccaatgatccaaaaa

SEQ ID NO: 29535 - DNA, 20 bp, Artificial Sequence
  sgRNA
  Kir3dl1_12
agaacctgcacattctaact

SEQ ID NO: 29536 - DNA, 20 bp, Artificial Sequence
  sgRNA
  Kir3dl1_13
attccctcctgtatccacca

SEQ ID NO: 29537 - DNA, 20 bp, Artificial Sequence
  sgRNA
  Kir3dl1_14
tcaagctgtacaaagaagaa

SEQ ID NO: 29538 - DNA, 20 bp, Artificial Sequence
  sgRNA
  Kir3dl1_15
tcacatgtcagctactcaat

SEQ ID NO: 29539 - DNA, 20 bp, Artificial Sequence
  sgRNA
  Kir3dl1_16
aactgggctcttagtaacca

SEQ ID NO: 29540 - DNA, 20 bp, Artificial Sequence
  sgRNA
  Kir3dl1_17
agtcccctggtggatacagg

SEQ ID NO: 29541 - DNA, 20 bp, Artificial Sequence
  sgRNA
  Kir3dl1_18
gatgatgacgacaaggacca

SEQ ID NO: 29542 - DNA, 20 bp, Artificial Sequence
  sgRNA
  Kir3dl1_19
agagcccagttagaatgtgc

SEQ ID NO: 29543 - DNA, 20 bp, Artificial Sequence
  sgRNA
  Kir3dl1_20
ctggagtctgaccattcata

SEQ ID NO: 29544 - DNA, 20 bp, Artificial Sequence
  sgRNA
  Kir3dl2_1
cagaggatgtcagcacacgt

SEQ ID NO: 29545 - DNA, 20 bp, Artificial Sequence
  sgRNA
  Kir3dl2_2
tggggtctgaccattcatag

SEQ ID NO: 29546 - DNA, 20 bp, Artificial Sequence
  sgRNA
  Kir3dl2_3
aatgtagtctcatgtaactg

SEQ ID NO: 29547 - DNA, 20 bp, Artificial Sequence
  sgRNA
  Kir3dl2_4
ttccctcctgaattcaccag

SEQ ID NO: 29548 - DNA, 20 bp, Artificial Sequence
  sgRNA
  Kir3dl2_5
attccctcctgaattcacca

SEQ ID NO: 29549 - DNA, 20 bp, Artificial Sequence
  sgRNA
  Kir3dl2_6
cctggagtgcagatccacag

SEQ ID NO: 29550 - DNA, 20 bp, Artificial Sequence
  sgRNA
  Kir3dl2_7
gtaggttcctgcatgttctg

SEQ ID NO: 29551 - DNA, 20 bp, Artificial Sequence
  sgRNA
  Kir3dl2_8
gtcccctggtgaattcagga

SEQ ID NO: 29552 - DNA, 20 bp, Artificial Sequence
  sgRNA
  Kir3dl2_9
aactgggctcttaatgacca

SEQ ID NO: 29553 - DNA, 20 bp, Artificial Sequence
  sgRNA
  Kir3dl2_10
gatccacagtggtaaattcg

SEQ ID NO: 29554 - DNA, 20 bp, Artificial Sequence
  sgRNA
  Kir3dl2_11
tcacatgtcacctactcaat

SEQ ID NO: 29555 - DNA, 20 bp, Artificial Sequence
  sgRNA
  Kir3dl2_12
agagcccagttagaatgcgc

SEQ ID NO: 29556 - DNA, 20 bp, Artificial Sequence
  sgRNA
  Kir3dl2_13
tcaaactgtacaaagaagaa

SEQ ID NO: 29557 - DNA, 20 bp, Artificial Sequence
  sgRNA
  Kir3dl2_14
tgatgtcaatggggtcactg

SEQ ID NO: 29558 - DNA, 20 bp, Artificial Sequence
  sgRNA
  Kir3dl2_15
agtcccctggtgaattcagg

SEQ ID NO: 29559 - DNA, 20 bp, Artificial Sequence
  sgRNA
  Kir3dl2_16
tgttccatatgtccagggaa

SEQ ID NO: 29560 - DNA, 20 bp, Artificial Sequence
  sgRNA
  Kir3dl2_17
ttagttcaatgatccaaaag

SEQ ID NO: 29561 - DNA, 20 bp, Artificial Sequence
  sgRNA
  Kir3dl2_18
ggatcttcttctgtgcatgc

SEQ ID NO: 29562 - DNA, 20 bp, Artificial Sequence
  sgRNA
  Kir3dl2_19
tatggaacatgtcaaactga

SEQ ID NO: 29563 - DNA, 20 bp, Artificial Sequence
  sgRNA
  Kir3dl2_20
cttagttcaatgatccaaaa

SEQ ID NO: 29564 - DNA, 20 bp, Artificial Sequence
  sgRNA
  Kirrel2_1
tctgacctgtcggagtcgtg

SEQ ID NO: 29565 - DNA, 20 bp, Artificial Sequence
  sgRNA
  Kirrel2_2
aaaacctaagtccgtgtccg

SEQ ID NO: 29566 - DNA, 20 bp, Artificial Sequence
  sgRNA
  Kirrel2_3
ggtcccggtactggatatcg

SEQ ID NO: 29567 - DNA, 20 bp, Artificial Sequence
  sgRNA
  Kirrel2_4
tgcgggcgactatgtatgca

SEQ ID NO: 29568 - DNA, 20 bp, Artificial Sequence
  sgRNA
  Kirrel2_5
tcgaaccctgtagtaaccgt

SEQ ID NO: 29569 - DNA, 20 bp, Artificial Sequence
  sgRNA
  Kirrel2_6
tgaatccccacgactccgac

SEQ ID NO: 29570 - DNA, 20 bp, Artificial Sequence
  sgRNA
  Kirrel2_7
ttgccaccgccctctccgat

SEQ ID NO: 29571 - DNA, 20 bp, Artificial Sequence
  sgRNA
  Kirrel2_8
atgtatgcagggctgagccg

SEQ ID NO: 29572 - DNA, 20 bp, Artificial Sequence
  sgRNA
  Kirrel2_9
ggaagctgctcccatccagc

SEQ ID NO: 29573 - DNA, 20 bp, Artificial Sequence
  sgRNA
  Kirrel2_10
tgcgaggtcagcaacgcggt

SEQ ID NO: 29574 - DNA, 20 bp, Artificial Sequence
  sgRNA
  Kirrel2_11
gttccgagatgggatccggc

SEQ ID NO: 29575 - DNA, 20 bp, Artificial Sequence
  sgRNA
  Kirrel2_12
caggagtccgactttaccac

SEQ ID NO: 29576 - DNA, 20 bp, Artificial Sequence
  sgRNA
  Kirrel2_13
tcggaaccacagtagttcag

SEQ ID NO: 29577 - DNA, 20 bp, Artificial Sequence
  sgRNA
  Kirrel2_14
cggttactacagggttcgag

SEQ ID NO: 29578 - DNA, 20 bp, Artificial Sequence
  sgRNA
  Kirrel2_15
tccaaccaacggttactaca

SEQ ID NO: 29579 - DNA, 20 bp, Artificial Sequence
  sgRNA
  Kirrel2_16
ggactcgtccctctcctagc

SEQ ID NO: 29580 - DNA, 20 bp, Artificial Sequence
  sgRNA
  Kirrel2_17
gctacacatttccggaaccc

SEQ ID NO: 29581 - DNA, 20 bp, Artificial Sequence
  sgRNA
  Kirrel2_18
gaagctccccaggtactagg

SEQ ID NO: 29582 - DNA, 20 bp, Artificial Sequence
  sgRNA
  Kirrel2_19
ggagtccctgggagaccgat

SEQ ID NO: 29583 - DNA, 20 bp, Artificial Sequence
  sgRNA
  Kirrel2_20
ggacgagtccagatccactt

SEQ ID NO: 29584 - DNA, 20 bp, Artificial Sequence
  sgRNA
  Kirrel3_1
acctcgtttcatccacacga

SEQ ID NO: 29585 - DNA, 20 bp, Artificial Sequence
  sgRNA
  Kirrel3_2
ggagctgtataggaccacgg

SEQ ID NO: 29586 - DNA, 20 bp, Artificial Sequence
  sgRNA
  Kirrel3_3
gacatcagggcgctacacag

SEQ ID NO: 29587 - DNA, 20 bp, Artificial Sequence
  sgRNA
  Kirrel3_4
accgcttgtcaacttgtccg

SEQ ID NO: 29588 - DNA, 20 bp, Artificial Sequence
  sgRNA
  Kirrel3_5
gaagtatgtgtagtccaccg

SEQ ID NO: 29589 - DNA, 20 bp, Artificial Sequence
  sgRNA
  Kirrel3_6
gcatcacctgaagatcctga

SEQ ID NO: 29590 - DNA, 20 bp, Artificial Sequence
  sgRNA
  Kirrel3_7
agtcttgttggaattcaccc

SEQ ID NO: 29591 - DNA, 20 bp, Artificial Sequence
  sgRNA
  Kirrel3_8
caatggttgccattaggacg

SEQ ID NO: 29592 - DNA, 20 bp, Artificial Sequence
  sgRNA
  Kirrel3_9
tgatctggcccttctctccg

SEQ ID NO: 29593 - DNA, 20 bp, Artificial Sequence
  sgRNA
  Kirrel3_10
gctgtcctgacaccaccact

SEQ ID NO: 29594 - DNA, 20 bp, Artificial Sequence
  sgRNA
  Kirrel3_11
gttcccagagaagtacggga

SEQ ID NO: 29595 - DNA, 20 bp, Artificial Sequence
  sgRNA
  Kirrel3_12
ggagccatcttctggccggg

SEQ ID NO: 29596 - DNA, 20 bp, Artificial Sequence
  sgRNA
  Kirrel3_13
gatggcctggcactcataca

SEQ ID NO: 29597 - DNA, 20 bp, Artificial Sequence
  sgRNA
  Kirrel3_14
gcaaccccaggaccaagtgg

SEQ ID NO: 29598 - DNA, 20 bp, Artificial Sequence
  sgRNA
  Kirrel3_15
catctggctacgtaaaggag

SEQ ID NO: 29599 - DNA, 20 bp, Artificial Sequence
  sgRNA
  Kirrel3_16
gtaccaatggccgtcatcat

SEQ ID NO: 29600 - DNA, 20 bp, Artificial Sequence
  sgRNA
  Kirrel3_17
atgctgtcttcagctgtgcg

SEQ ID NO: 29601 - DNA, 20 bp, Artificial Sequence
  sgRNA
  Kirrel3_18
gcctctacgactatggacag

SEQ ID NO: 29602 - DNA, 20 bp, Artificial Sequence
  sgRNA
  Kirrel3_19
gggtgaattccaacaagact

SEQ ID NO: 29603 - DNA, 20 bp, Artificial Sequence
  sgRNA
  Kirrel3_20
tgagggggtcccctgcccga

SEQ ID NO: 29604 - DNA, 20 bp, Artificial Sequence
  sgRNA
  Kiss1r_1
gtcaacgcctcggatgaccc

SEQ ID NO: 29605 - DNA, 20 bp, Artificial Sequence
  sgRNA
  Kiss1r_2
cggcggtgaagtgcacgcag

SEQ ID NO: 29606 - DNA, 20 bp, Artificial Sequence
  sgRNA
  Kiss1r_3
acagttaccaacttctacat

SEQ ID NO: 29607 - DNA, 20 bp, Artificial Sequence
  sgRNA
  Kiss1r_4
gtgcggggcgtacagccgca

SEQ ID NO: 29608 - DNA, 20 bp, Artificial Sequence
  sgRNA
  Kiss1r_5
ggaacacagtcacataccag

SEQ ID NO: 29609 - DNA, 20 bp, Artificial Sequence
  sgRNA
  Kiss1r_6
gcacagtgtgagttgcagct

SEQ ID NO: 29610 - DNA, 20 bp, Artificial Sequence
  sgRNA
  Kiss1r_7
gtacagccgcacggcccagg

SEQ ID NO: 29611 - DNA, 20 bp, Artificial Sequence
  sgRNA
  Kiss1r_8
tcgaagctatgccgcctacg

SEQ ID NO: 29612 - DNA, 20 bp, Artificial Sequence
  sgRNA
  Kiss1r_9
cagctgctagcacagcgcgc

SEQ ID NO: 29613 - DNA, 20 bp, Artificial Sequence
  sgRNA
  Kiss1r_10
ccagatcttgaccgcgtagg

SEQ ID NO: 29614 - DNA, 20 bp, Artificial Sequence
  sgRNA
  Kiss1r_11
ggaaccagccaggcatccag

SEQ ID NO: 29615 - DNA, 20 bp, Artificial Sequence
  sgRNA
  Kiss1r_12
attcgtcaactacatccagc

SEQ ID NO: 29616 - DNA, 20 bp, Artificial Sequence
  sgRNA
  Kiss1r_13
gtgcgttcactctgagcgca

SEQ ID NO: 29617 - DNA, 20 bp, Artificial Sequence
  sgRNA
  Kiss1r_14
gcctcgctgcagtaggtgcg

SEQ ID NO: 29618 - DNA, 20 bp, Artificial Sequence
  sgRNA
  Kiss1r_15
gcgtaggcggcatagcttcg

SEQ ID NO: 29619 - DNA, 20 bp, Artificial Sequence
  sgRNA
  Kiss1r_16
gggcatcctgaagcgttgga

SEQ ID NO: 29620 - DNA, 20 bp, Artificial Sequence
  sgRNA
  Kiss1r_17
catgagtgtagcgaaaaaca

SEQ ID NO: 29621 - DNA, 20 bp, Artificial Sequence
  sgRNA
  Kiss1r_18
cattggctcccaatgtgacc

SEQ ID NO: 29622 - DNA, 20 bp, Artificial Sequence
  sgRNA
  Kiss1r_19
gtacgccccgcacccactga

SEQ ID NO: 29623 - DNA, 20 bp, Artificial Sequence
  sgRNA
  Kiss1r_20
cttcgcgctctacaacctgc

SEQ ID NO: 29624 - DNA, 20 bp, Artificial Sequence
  sgRNA
  Kit_1
aagcacaatagctggcaccg

SEQ ID NO: 29625 - DNA, 20 bp, Artificial Sequence
  sgRNA
  Kit_2
acacgtaaatagaactcgtg

SEQ ID NO: 29626 - DNA, 20 bp, Artificial Sequence
  sgRNA
  Kit_3
agatttggttgttgaatacg

SEQ ID NO: 29627 - DNA, 20 bp, Artificial Sequence
  sgRNA
  Kit_4
tggttgcagctggcgcgatg

SEQ ID NO: 29628 - DNA, 20 bp, Artificial Sequence
  sgRNA
  Kit_5
cggaatggtccaccaccacg

SEQ ID NO: 29629 - DNA, 20 bp, Artificial Sequence
  sgRNA
  Kit_6
ggacaaacgtcaggtccgtg

SEQ ID NO: 29630 - DNA, 20 bp, Artificial Sequence
  sgRNA
  Kit_7
ggagacgctgactatcagct

SEQ ID NO: 29631 - DNA, 20 bp, Artificial Sequence
  sgRNA
  Kit_8
ctacatccgtgaactccatg

SEQ ID NO: 29632 - DNA, 20 bp, Artificial Sequence
  sgRNA
  Kit_9
ctcccagaggaaaatcccat

SEQ ID NO: 29633 - DNA, 20 bp, Artificial Sequence
  sgRNA
  Kit_10
agtacaatggaaggttgtcg

SEQ ID NO: 29634 - DNA, 20 bp, Artificial Sequence
  sgRNA
  Kit_11
atatcctcctcactcacggg

SEQ ID NO: 29635 - DNA, 20 bp, Artificial Sequence
  sgRNA
  Kit_12
ccattccgtgagggtcaact

SEQ ID NO: 29636 - DNA, 20 bp, Artificial Sequence
  sgRNA
  Kit_13
tttcccatcacactcgatga

SEQ ID NO: 29637 - DNA, 20 bp, Artificial Sequence
  sgRNA
  Kit_14
acaggacctcggctaacaaa

SEQ ID NO: 29638 - DNA, 20 bp, Artificial Sequence
  sgRNA
  Kit_15
ccaaacccgagcaccagcag

SEQ ID NO: 29639 - DNA, 20 bp, Artificial Sequence
  sgRNA
  Kit_16
gggaataattggacacctgt

SEQ ID NO: 29640 - DNA, 20 bp, Artificial Sequence
  sgRNA
  Kit_17
gatcaatgcacgtcaggctg

SEQ ID NO: 29641 - DNA, 20 bp, Artificial Sequence
  sgRNA
  Kit_18
accacaaagccaatgagcag

SEQ ID NO: 29642 - DNA, 20 bp, Artificial Sequence
  sgRNA
  Kit_19
tgccaaccaagacagacaag

SEQ ID NO: 29643 - DNA, 20 bp, Artificial Sequence
  sgRNA
  Kit_20
ttaactctgattgtgctgga

SEQ ID NO: 29644 - DNA, 20 bp, Artificial Sequence
  sgRNA
  Kitl_1
ggatgacctcgtgttatgca

SEQ ID NO: 29645 - DNA, 20 bp, Artificial Sequence
  sgRNA
  Kitl_2
tctcgtagccaacaatgact

SEQ ID NO: 29646 - DNA, 20 bp, Artificial Sequence
  sgRNA
  Kitl_3
taatcctcttgtcaaaacca

SEQ ID NO: 29647 - DNA, 20 bp, Artificial Sequence
  sgRNA
  Kitl_4
tcaacattaggtcccgagaa

SEQ ID NO: 29648 - DNA, 20 bp, Artificial Sequence
  sgRNA
  Kitl_5
gctactgctgtcattcctaa

SEQ ID NO: 29649 - DNA, 20 bp, Artificial Sequence
  sgRNA
  Kitl_6
catcccggcgacatagttga

SEQ ID NO: 29650 - DNA, 20 bp, Artificial Sequence
  sgRNA
  Kitl_7
gctttccaagaaaatcgctc

SEQ ID NO: 29651 - DNA, 20 bp, Artificial Sequence
  sgRNA
  Kitl_8
taaccctcaactatgtcgcc

SEQ ID NO: 29652 - DNA, 20 bp, Artificial Sequence
  sgRNA
  Kitl_9
gctctcatttcgcttgtaat

SEQ ID NO: 29653 - DNA, 20 bp, Artificial Sequence
  sgRNA
  Kitl_10
ataaccctcaactatgtcgc

SEQ ID NO: 29654 - DNA, 20 bp, Artificial Sequence
  sgRNA
  Kitl_11
aaatcgctccgggagccccg

SEQ ID NO: 29655 - DNA, 20 bp, Artificial Sequence
  sgRNA
  Kitl_12
attacaagcgaaatgagagc

SEQ ID NO: 29656 - DNA, 20 bp, Artificial Sequence
  sgRNA
  Kitl_13
ctgttgcagccagctccctt

SEQ ID NO: 29657 - DNA, 20 bp, Artificial Sequence
  sgRNA
  Kitl_14
actccatcatagacaaactt

SEQ ID NO: 29658 - DNA, 20 bp, Artificial Sequence
  sgRNA
  Kitl_15
tttcttccatgcataacacg

SEQ ID NO: 29659 - DNA, 20 bp, Artificial Sequence
  sgRNA
  Kitl_16
cctcaactatgtcgccggga

SEQ ID NO: 29660 - DNA, 20 bp, Artificial Sequence
  sgRNA
  Kitl_17
aatgagagccggcaatgcca

SEQ ID NO: 29661 - DNA, 20 bp, Artificial Sequence
  sgRNA
  Kitl_18
taagggagctggctgcaaca

SEQ ID NO: 29662 - DNA, 20 bp, Artificial Sequence
  sgRNA
  Kitl_19
ctgaagactcgggcctacaa

SEQ ID NO: 29663 - DNA, 20 bp, Artificial Sequence
  sgRNA
  Kitl_20
ttgtaggcccgagtcttcag

SEQ ID NO: 29664 - DNA, 20 bp, Artificial Sequence
  sgRNA
  Kl_1
acgtcattgggtacaccgcg

SEQ ID NO: 29665 - DNA, 20 bp, Artificial Sequence
  sgRNA
  Kl_2
acgtctaccgcgacacagag

SEQ ID NO: 29666 - DNA, 20 bp, Artificial Sequence
  sgRNA
  Kl_3
cagcgccgcctatcagaccg

SEQ ID NO: 29667 - DNA, 20 bp, Artificial Sequence
  sgRNA
  Kl_4
tctcgaagtaaggttatctg

SEQ ID NO: 29668 - DNA, 20 bp, Artificial Sequence
  sgRNA
  Kl_5
gcttctccatatcgtgggcg

SEQ ID NO: 29669 - DNA, 20 bp, Artificial Sequence
  sgRNA
  Kl_6
tggtgtaatgactcaccgcc

SEQ ID NO: 29670 - DNA, 20 bp, Artificial Sequence
  sgRNA
  Kl_7
gccgccctcggtctgatagg

SEQ ID NO: 29671 - DNA, 20 bp, Artificial Sequence
  sgRNA
  Kl_8
accgtccatgagcgaccacg

SEQ ID NO: 29672 - DNA, 20 bp, Artificial Sequence
  sgRNA
  Kl_9
gtacgatgacaagtttaggg

SEQ ID NO: 29673 - DNA, 20 bp, Artificial Sequence
  sgRNA
  Kl_10
gttgatgtcgtccaacacgt

SEQ ID NO: 29674 - DNA, 20 bp, Artificial Sequence
  sgRNA
  Kl_11
acgacgatcggggagtcgga

SEQ ID NO: 29675 - DNA, 20 bp, Artificial Sequence
  sgRNA
  Kl_12
ccatgaacgagccaaacaca

SEQ ID NO: 29676 - DNA, 20 bp, Artificial Sequence
  sgRNA
  Kl_13
ggttgggagactccaattgg

SEQ ID NO: 29677 - DNA, 20 bp, Artificial Sequence
  sgRNA
  Kl_14
ctaccgcttctccatatcgt

SEQ ID NO: 29678 - DNA, 20 bp, Artificial Sequence
  sgRNA
  Kl_15
tgacctgaccaccgaagtgg

SEQ ID NO: 29679 - DNA, 20 bp, Artificial Sequence
  sgRNA
  Kl_16
ggtagtagcgcagcccctcg

SEQ ID NO: 29680 - DNA, 20 bp, Artificial Sequence
  sgRNA
  Kl_17
gcgcccacgatatggagaag

SEQ ID NO: 29681 - DNA, 20 bp, Artificial Sequence
  sgRNA
  Kl_18
gaggcttattaaagtagacg

SEQ ID NO: 29682 - DNA, 20 bp, Artificial Sequence
  sgRNA
  Kl_19
gatgaaaaaaagctagtccg

SEQ ID NO: 29683 - DNA, 20 bp, Artificial Sequence
  sgRNA
  Kl_20
ctatcgccttaagctcccat

SEQ ID NO: 29684 - DNA, 20 bp, Artificial Sequence
  sgRNA
  Klrb1_1
tcaaccagaccgtcagccca

SEQ ID NO: 29685 - DNA, 20 bp, Artificial Sequence
  sgRNA
  Klrb1_2
aataagcatttatcacagtg

SEQ ID NO: 29686 - DNA, 20 bp, Artificial Sequence
  sgRNA
  Klrb1_3
tcagctccatctctccccca

SEQ ID NO: 29687 - DNA, 20 bp, Artificial Sequence
  sgRNA
  Klrb1_4
ttaaatttagccgagaccag

SEQ ID NO: 29688 - DNA, 20 bp, Artificial Sequence
  sgRNA
  Klrb1_5
ttattgcagaacttctcaaa

SEQ ID NO: 29689 - DNA, 20 bp, Artificial Sequence
  sgRNA
  Klrb1_6
taaatttagccgagaccaga

SEQ ID NO: 29690 - DNA, 20 bp, Artificial Sequence
  sgRNA
  Klrb1_7
catcgggtggctctgaaact

SEQ ID NO: 29691 - DNA, 20 bp, Artificial Sequence
  sgRNA
  Klrb1_8
attattgcagaacttctcaa

SEQ ID NO: 29692 - DNA, 20 bp, Artificial Sequence
  sgRNA
  Klrb1_9
cctgttcttcagacaaccat

SEQ ID NO: 29693 - DNA, 20 bp, Artificial Sequence
  sgRNA
  Klrb1_10
tgatgtacacctgagccctc

SEQ ID NO: 29694 - DNA, 20 bp, Artificial Sequence
  sgRNA
  Klrb1_11
gggaccaggctggcatcggg

SEQ ID NO: 29695 - DNA, 20 bp, Artificial Sequence
  sgRNA
  Klrb1_12
tttaattcagcatagagcac

SEQ ID NO: 29696 - DNA, 20 bp, Artificial Sequence
  sgRNA
  Klrb1_13
gtcagggaccaggctggcat

SEQ ID NO: 29697 - DNA, 20 bp, Artificial Sequence
  sgRNA
  Klrb1_14
gtgtggctgttcaagaaaac

SEQ ID NO: 29698 - DNA, 20 bp, Artificial Sequence
  sgRNA
  Klrb1_15
tctaatagaaaaatgcagtg

SEQ ID NO: 29699 - DNA, 20 bp, Artificial Sequence
  sgRNA
  Klrb1_16
atcttgaatgagcagcaaag

SEQ ID NO: 29700 - DNA, 20 bp, Artificial Sequence
  sgRNA
  Klrb1_17
tgggctgatctttcttctga

SEQ ID NO: 29701 - DNA, 20 bp, Artificial Sequence
  sgRNA
  Klrb1_18
aagtggacaaggtttggaag

SEQ ID NO: 29702 - DNA, 20 bp, Artificial Sequence
  sgRNA
  Klrb1_19
acacctgagccctctggtct

SEQ ID NO: 29703 - DNA, 20 bp, Artificial Sequence
  sgRNA
  Klrb1_20
atgcctgtcagggaccaggc

SEQ ID NO: 29704 - DNA, 20 bp, Artificial Sequence
  sgRNA
  Klrb1a_1
caatcagggtcacgacaagg

SEQ ID NO: 29705 - DNA, 20 bp, Artificial Sequence
  sgRNA
  Klrb1a_2
gtcttgaatgagcatcaaag

SEQ ID NO: 29706 - DNA, 20 bp, Artificial Sequence
  sgRNA
  Klrb1a_3
aaagccacccaggactccag

SEQ ID NO: 29707 - DNA, 20 bp, Artificial Sequence
  sgRNA
  Klrb1a_4
aaaataaagtgactgacctg

SEQ ID NO: 29708 - DNA, 20 bp, Artificial Sequence
  sgRNA
  Klrb1a_5
ataacccacatagttgctca

SEQ ID NO: 29709 - DNA, 20 bp, Artificial Sequence
  sgRNA
  Klrb1a_6
ttgctgtgtccattgtgcat

SEQ ID NO: 29710 - DNA, 20 bp, Artificial Sequence
  sgRNA
  Klrb1a_7
gctgtaattcagacaaccgt

SEQ ID NO: 29711 - DNA, 20 bp, Artificial Sequence
  sgRNA
  Klrb1a_8
gacacagcaagggtctactt

SEQ ID NO: 29712 - DNA, 20 bp, Artificial Sequence
  sgRNA
  Klrb1a_9
actttggtttaaagccaccc

SEQ ID NO: 29713 - DNA, 20 bp, Artificial Sequence
  sgRNA
  Klrb1a_10
atgcacaatggacacagcaa

SEQ ID NO: 29714 - DNA, 20 bp, Artificial Sequence
  sgRNA
  Klrb1a_11
tagaccttcctcccaagtgt

SEQ ID NO: 29715 - DNA, 20 bp, Artificial Sequence
  sgRNA
  Klrb1a_12
tgaaaccctgagcaactatg

SEQ ID NO: 29716 - DNA, 20 bp, Artificial Sequence
  sgRNA
  Klrb1a_13
ggtgactcatgccaagcccc

SEQ ID NO: 29717 - DNA, 20 bp, Artificial Sequence
  sgRNA
  Klrb1a_14
tatgcacaatggacacagca

SEQ ID NO: 29718 - DNA, 20 bp, Artificial Sequence
  sgRNA
  Klrb1a_15
gaaaccctgagcaactatgt

SEQ ID NO: 29719 - DNA, 20 bp, Artificial Sequence
  sgRNA
  Klrb1a_16
tttcatggtatagttccttt

SEQ ID NO: 29720 - DNA, 20 bp, Artificial Sequence
  sgRNA
  Klrb1a_17
tcccaatcagggtcacgaca

SEQ ID NO: 29721 - DNA, 20 bp, Artificial Sequence
  sgRNA
  Klrb1a_18
ctccttgtcgtgaccctgat

SEQ ID NO: 29722 - DNA, 20 bp, Artificial Sequence
  sgRNA
  Klrb1a_19
catagttgctcagggtttca

SEQ ID NO: 29723 - DNA, 20 bp, Artificial Sequence
  sgRNA
  Klrb1a_20
tccttgtcgtgaccctgatt

SEQ ID NO: 29724 - DNA, 20 bp, Artificial Sequence
  sgRNA
  Klrb1b_1
atcagtacaaaaaatctgcg

SEQ ID NO: 29725 - DNA, 20 bp, Artificial Sequence
  sgRNA
  Klrb1b_2
caatcacgaccagcacaaga

SEQ ID NO: 29726 - DNA, 20 bp, Artificial Sequence
  sgRNA
  Klrb1b_3
agagccaaccgatgccagcg

SEQ ID NO: 29727 - DNA, 20 bp, Artificial Sequence
  sgRNA
  Klrb1b_4
atgcagatttaaacctagcc

SEQ ID NO: 29728 - DNA, 20 bp, Artificial Sequence
  sgRNA
  Klrb1b_5
gagccaaccgatgccagcga

SEQ ID NO: 29729 - DNA, 20 bp, Artificial Sequence
  sgRNA
  Klrb1b_6
atgccagcgagggcaccgac

SEQ ID NO: 29730 - DNA, 20 bp, Artificial Sequence
  sgRNA
  Klrb1b_7
gagaacagaacacatacaac

SEQ ID NO: 29731 - DNA, 20 bp, Artificial Sequence
  sgRNA
  Klrb1b_8
gtgccctcgctggcatcggt

SEQ ID NO: 29732 - DNA, 20 bp, Artificial Sequence
  sgRNA
  Klrb1b_9
ggagaaaaagtgacttctga

SEQ ID NO: 29733 - DNA, 20 bp, Artificial Sequence
  sgRNA
  Klrb1b_10
gatggaggtgaatcatgctt

SEQ ID NO: 29734 - DNA, 20 bp, Artificial Sequence
  sgRNA
  Klrb1b_11
gtcggtgccctcgctggcat

SEQ ID NO: 29735 - DNA, 20 bp, Artificial Sequence
  sgRNA
  Klrb1b_12
tcgacattccttccaagtgt

SEQ ID NO: 29736 - DNA, 20 bp, Artificial Sequence
  sgRNA
  Klrb1b_13
gctgttcttcagacaaccgt

SEQ ID NO: 29737 - DNA, 20 bp, Artificial Sequence
  sgRNA
  Klrb1b_14
cttcttgtgctggtcgtgat

SEQ ID NO: 29738 - DNA, 20 bp, Artificial Sequence
  sgRNA
  Klrb1b_15
cgaccagcacaagaaggatg

SEQ ID NO: 29739 - DNA, 20 bp, Artificial Sequence
  sgRNA
  Klrb1b_16
tcaagtttccaacacttgga

SEQ ID NO: 29740 - DNA, 20 bp, Artificial Sequence
  sgRNA
  Klrb1b_17
catcggttggctctgaaatt

SEQ ID NO: 29741 - DNA, 20 bp, Artificial Sequence
  sgRNA
  Klrb1b_18
acacctgtcggtgccctcgc

SEQ ID NO: 29742 - DNA, 20 bp, Artificial Sequence
  sgRNA
  Klrb1b_19
tggcctcatccttcttgtgc

SEQ ID NO: 29743 - DNA, 20 bp, Artificial Sequence
  sgRNA
  Klrb1b_20
taacagacatgaactggaag

SEQ ID NO: 29744 - DNA, 20 bp, Artificial Sequence
  sgRNA
  Klrb1c_1
gagatgcaacacttaactgg

SEQ ID NO: 29745 - DNA, 20 bp, Artificial Sequence
  sgRNA
  Klrb1c_2
tcctgggtggctttaaaccg

SEQ ID NO: 29746 - DNA, 20 bp, Artificial Sequence
  sgRNA
  Klrb1c_3
taagacactcatcccaatca

SEQ ID NO: 29747 - DNA, 20 bp, Artificial Sequence
  sgRNA
  Klrb1c_4
gaggaaggtcaagctgactg

SEQ ID NO: 29748 - DNA, 20 bp, Artificial Sequence
  sgRNA
  Klrb1c_5
gacacagcaagtatctacct

SEQ ID NO: 29749 - DNA, 20 bp, Artificial Sequence
  sgRNA
  Klrb1c_6
tgcactgtcttatccaaccc

SEQ ID NO: 29750 - DNA, 20 bp, Artificial Sequence
  sgRNA
  Klrb1c_7
cctcagagacaggaatcagt

SEQ ID NO: 29751 - DNA, 20 bp, Artificial Sequence
  sgRNA
  Klrb1c_8
gttggataagacagtgcagc

SEQ ID NO: 29752 - DNA, 20 bp, Artificial Sequence
  sgRNA
  Klrb1c_9
gctgtgcttcagacaaccgt

SEQ ID NO: 29753 - DNA, 20 bp, Artificial Sequence
  sgRNA
  Klrb1c_10
acttgctgtgtccatttcac

SEQ ID NO: 29754 - DNA, 20 bp, Artificial Sequence
  sgRNA
  Klrb1c_11
ttatttcacctcaaaggcct

SEQ ID NO: 29755 - DNA, 20 bp, Artificial Sequence
  sgRNA
  Klrb1c_12
ttgaccttcctcccaagtgt

SEQ ID NO: 29756 - DNA, 20 bp, Artificial Sequence
  sgRNA
  Klrb1c_13
aaagccacccaggacactgg

SEQ ID NO: 29757 - DNA, 20 bp, Artificial Sequence
  sgRNA
  Klrb1c_14
ttaaagccacccaggacact

SEQ ID NO: 29758 - DNA, 20 bp, Artificial Sequence
  sgRNA
  Klrb1c_15
cactttatctcctaagatgg

SEQ ID NO: 29759 - DNA, 20 bp, Artificial Sequence
  sgRNA
  Klrb1c_16
ccctcagagacaggaatcag

SEQ ID NO: 29760 - DNA, 20 bp, Artificial Sequence
  sgRNA
  Klrb1c_17
ggtgtaaaagccagtcttgt

SEQ ID NO: 29761 - DNA, 20 bp, Artificial Sequence
  sgRNA
  Klrb1c_18
cacttaactggtggtgagaa

SEQ ID NO: 29762 - DNA, 20 bp, Artificial Sequence
  sgRNA
  Klrb1c_19
caggagatgcaacacttaac

SEQ ID NO: 29763 - DNA, 20 bp, Artificial Sequence
  sgRNA
  Klrb1c_20
gacaaactccaaggcctttg

SEQ ID NO: 29764 - DNA, 20 bp, Artificial Sequence
  sgRNA
  Klrb1f_1
aataaacatttgttccagtg

SEQ ID NO: 29765 - DNA, 20 bp, Artificial Sequence
  sgRNA
  Klrb1f_2
gaagatgcttgcttataccc

SEQ ID NO: 29766 - DNA, 20 bp, Artificial Sequence
  sgRNA
  Klrb1f_3
ctaagacactgagtccaatc

SEQ ID NO: 29767 - DNA, 20 bp, Artificial Sequence
  sgRNA
  Klrb1f_4
agagccaaatgatgccagtg

SEQ ID NO: 29768 - DNA, 20 bp, Artificial Sequence
  sgRNA
  Klrb1f_5
ttataccctggacacctaaa

SEQ ID NO: 29769 - DNA, 20 bp, Artificial Sequence
  sgRNA
  Klrb1f_6
aggtcgagatgcctgctcta

SEQ ID NO: 29770 - DNA, 20 bp, Artificial Sequence
  sgRNA
  Klrb1f_7
tttgtgcagaacttgataaa

SEQ ID NO: 29771 - DNA, 20 bp, Artificial Sequence
  sgRNA
  Klrb1f_8
ctgtgccatcatctcacaca

SEQ ID NO: 29772 - DNA, 20 bp, Artificial Sequence
  sgRNA
  Klrb1f_9
gcatctcgaccttctgccca

SEQ ID NO: 29773 - DNA, 20 bp, Artificial Sequence
  sgRNA
  Klrb1f_10
gagccaaatgatgccagtgt

SEQ ID NO: 29774 - DNA, 20 bp, Artificial Sequence
  sgRNA
  Klrb1f_11
taaagccatttaggtgtcca

SEQ ID NO: 29775 - DNA, 20 bp, Artificial Sequence
  sgRNA
  Klrb1f_12
aatggcgtcttccatagagc

SEQ ID NO: 29776 - DNA, 20 bp, Artificial Sequence
  sgRNA
  Klrb1f_13
accaatagaaaaatgcagtg

SEQ ID NO: 29777 - DNA, 20 bp, Artificial Sequence
  sgRNA
  Klrb1f_14
atatctcgggcactctagta

SEQ ID NO: 29778 - DNA, 20 bp, Artificial Sequence
  sgRNA
  Klrb1f_15
agtgtggatgccaatatctc

SEQ ID NO: 29779 - DNA, 20 bp, Artificial Sequence
  sgRNA
  Klrb1f_16
taaatggctttacattgcca

SEQ ID NO: 29780 - DNA, 20 bp, Artificial Sequence
  sgRNA
  Klrb1f_17
atttgtgcagaacttgataa

SEQ ID NO: 29781 - DNA, 20 bp, Artificial Sequence
  sgRNA
  Klrb1f_18
cgagatattggcatccacac

SEQ ID NO: 29782 - DNA, 20 bp, Artificial Sequence
  sgRNA
  Klrb1f_19
tcgaccttctgcccaaggtc

SEQ ID NO: 29783 - DNA, 20 bp, Artificial Sequence
  sgRNA
  Klrb1f_20
gtgcccacactggcatcatt

SEQ ID NO: 29784 - DNA, 20 bp, Artificial Sequence
  sgRNA
  Klre1_1
agccatcaggagaaggcaca

SEQ ID NO: 29785 - DNA, 20 bp, Artificial Sequence
  sgRNA
  Klre1_2
cagacccagttctctggaca

SEQ ID NO: 29786 - DNA, 20 bp, Artificial Sequence
  sgRNA
  Klre1_3
aattgtcatccattgagcag

SEQ ID NO: 29787 - DNA, 20 bp, Artificial Sequence
  sgRNA
  Klre1_4
ctcacactttgtggtaaaag

SEQ ID NO: 29788 - DNA, 20 bp, Artificial Sequence
  sgRNA
  Klre1_5
aacacagcagaagacatcag

SEQ ID NO: 29789 - DNA, 20 bp, Artificial Sequence
  sgRNA
  Klre1_6
aggcttctctcgagtgtgct

SEQ ID NO: 29790 - DNA, 20 bp, Artificial Sequence
  sgRNA
  Klre1_7
tttagggtagaacgggttac

SEQ ID NO: 29791 - DNA, 20 bp, Artificial Sequence
  sgRNA
  Klre1_8
gcccagagggtagaaccgaa

SEQ ID NO: 29792 - DNA, 20 bp, Artificial Sequence
  sgRNA
  Klre1_9
ggtaaaagtggtcatcacca

SEQ ID NO: 29793 - DNA, 20 bp, Artificial Sequence
  sgRNA
  Klre1_10
tcatccctgtccagagaact

SEQ ID NO: 29794 - DNA, 20 bp, Artificial Sequence
  sgRNA
  Klre1_11
ataatgaaactcgcagacag

SEQ ID NO: 29795 - DNA, 20 bp, Artificial Sequence
  sgRNA
  Klre1_12
ggaattgctcacctccatgg

SEQ ID NO: 29796 - DNA, 20 bp, Artificial Sequence
  sgRNA
  Klre1_13
tgccatgtgccttctcctga

SEQ ID NO: 29797 - DNA, 20 bp, Artificial Sequence
  sgRNA
  Klre1_14
cagctgttatttcttctcca

SEQ ID NO: 29798 - DNA, 20 bp, Artificial Sequence
  sgRNA
  Klre1_15
tctcataaggatgaacaaag

SEQ ID NO: 29799 - DNA, 20 bp, Artificial Sequence
  sgRNA
  Klre1_16
gtggctgtgggaagaccatt

SEQ ID NO: 29800 - DNA, 20 bp, Artificial Sequence
  sgRNA
  Klre1_17
tctcctgatggctgtagcca

SEQ ID NO: 29801 - DNA, 20 bp, Artificial Sequence
  sgRNA
  Klre1_18
ctcgagagaagcctccatgg

SEQ ID NO: 29802 - DNA, 20 bp, Artificial Sequence
  sgRNA
  Klre1_19
acactcgagagaagcctcca

SEQ ID NO: 29803 - DNA, 20 bp, Artificial Sequence
  sgRNA
  Klre1_20
gcagaagacatcagtggtaa

SEQ ID NO: 29804 - DNA, 20 bp, Artificial Sequence
  sgRNA
  Klrg1_1
tatcaacggatcctgtgctg

SEQ ID NO: 29805 - DNA, 20 bp, Artificial Sequence
  sgRNA
  Klrg1_2
ttcaacactagagctgccgg

SEQ ID NO: 29806 - DNA, 20 bp, Artificial Sequence
  sgRNA
  Klrg1_3
cttacatttccggacaacca

SEQ ID NO: 29807 - DNA, 20 bp, Artificial Sequence
  sgRNA
  Klrg1_4
ggctaccattcctcgtccag

SEQ ID NO: 29808 - DNA, 20 bp, Artificial Sequence
  sgRNA
  Klrg1_5
gctgccccatcctctggacg

SEQ ID NO: 29809 - DNA, 20 bp, Artificial Sequence
  sgRNA
  Klrg1_6
gcttgaggaacattgatggc

SEQ ID NO: 29810 - DNA, 20 bp, Artificial Sequence
  sgRNA
  Klrg1_7
ttaccaacagcttgatacag

SEQ ID NO: 29811 - DNA, 20 bp, Artificial Sequence
  sgRNA
  Klrg1_8
gttgtgaagttgctttgcag

SEQ ID NO: 29812 - DNA, 20 bp, Artificial Sequence
  sgRNA
  Klrg1_9
tttgcagtggatctgtaaga

SEQ ID NO: 29813 - DNA, 20 bp, Artificial Sequence
  sgRNA
  Klrg1_10
gcacctctgtatcaagctgt

SEQ ID NO: 29814 - DNA, 20 bp, Artificial Sequence
  sgRNA
  Klrg1_11
aagtccaagatgagtccaga

SEQ ID NO: 29815 - DNA, 20 bp, Artificial Sequence
  sgRNA
  Klrg1_12
tgagtctactgatgtatcaa

SEQ ID NO: 29816 - DNA, 20 bp, Artificial Sequence
  sgRNA
  Klrg1_13
cctggttgtccggaaatgta

SEQ ID NO: 29817 - DNA, 20 bp, Artificial Sequence
  sgRNA
  Klrg1_14
tcttggacttgaggtgcctc

SEQ ID NO: 29818 - DNA, 20 bp, Artificial Sequence
  sgRNA
  Klrg1_15
ccattgaaaaatagtaacag

SEQ ID NO: 29819 - DNA, 20 bp, Artificial Sequence
  sgRNA
  Klrg1_16
ccatctttcccgctttgcaa

SEQ ID NO: 29820 - DNA, 20 bp, Artificial Sequence
  sgRNA
  Klrg1_17
ccaaagccaccattgcaaag

SEQ ID NO: 29821 - DNA, 20 bp, Artificial Sequence
  sgRNA
  Klrg1_18
aacagcttgatacagaggtg

SEQ ID NO: 29822 - DNA, 20 bp, Artificial Sequence
  sgRNA
  Klrg1_19
attgcaaagcgggaaagatg

SEQ ID NO: 29823 - DNA, 20 bp, Artificial Sequence
  sgRNA
  Klrg1_20
ccattcctcgtccagaggat

SEQ ID NO: 29824 - DNA, 20 bp, Artificial Sequence
  sgRNA
  Klri1_1
actggaacaaagatcacagg

SEQ ID NO: 29825 - DNA, 20 bp, Artificial Sequence
  sgRNA
  Klri1_2
gtggtgctgatgacaaccac

SEQ ID NO: 29826 - DNA, 20 bp, Artificial Sequence
  sgRNA
  Klri1_3
ctctccatactgttgatttg

SEQ ID NO: 29827 - DNA, 20 bp, Artificial Sequence
  sgRNA
  Klri1_4
gctcttcacatagcactaca

SEQ ID NO: 29828 - DNA, 20 bp, Artificial Sequence
  sgRNA
  Klri1_5
tggtgctgatgacaaccaca

SEQ ID NO: 29829 - DNA, 20 bp, Artificial Sequence
  sgRNA
  Klri1_6
cagcccagaaaacaagctat

SEQ ID NO: 29830 - DNA, 20 bp, Artificial Sequence
  sgRNA
  Klri1_7
tcatcctcttcggtgtccaa

SEQ ID NO: 29831 - DNA, 20 bp, Artificial Sequence
  sgRNA
  Klri1_8
tgaagacatgtaagtctcca

SEQ ID NO: 29832 - DNA, 20 bp, Artificial Sequence
  sgRNA
  Klri1_9
ataggtttccacgcagataa

SEQ ID NO: 29833 - DNA, 20 bp, Artificial Sequence
  sgRNA
  Klri1_10
acagggctctgcttgactgt

SEQ ID NO: 29834 - DNA, 20 bp, Artificial Sequence
  sgRNA
  Klri1_11
gctggggctgaggtgttctg

SEQ ID NO: 29835 - DNA, 20 bp, Artificial Sequence
  sgRNA
  Klri1_12
ggaatatacagcaaacaatc

SEQ ID NO: 29836 - DNA, 20 bp, Artificial Sequence
  sgRNA
  Klri1_13
tctccacaaccaggaactgt

SEQ ID NO: 29837 - DNA, 20 bp, Artificial Sequence
  sgRNA
  Klri1_14
tgtgaagagcagctaaaata

SEQ ID NO: 29838 - DNA, 20 bp, Artificial Sequence
  sgRNA
  Klri1_15
gctatgggaagaaaaagaca

SEQ ID NO: 29839 - DNA, 20 bp, Artificial Sequence
  sgRNA
  Klri1_16
taaagaaaacacaaaaacct

SEQ ID NO: 29840 - DNA, 20 bp, Artificial Sequence
  sgRNA
  Klri1_17
gattgtttgctgtatattcc

SEQ ID NO: 29841 - DNA, 20 bp, Artificial Sequence
  sgRNA
  Klri1_18
ccagcccagaaaacaagcta

SEQ ID NO: 29842 - DNA, 20 bp, Artificial Sequence
  sgRNA
  Klri1_19
tggattcttcacaaaatgga

SEQ ID NO: 29843 - DNA, 20 bp, Artificial Sequence
  sgRNA
  Klri1_20
tgtcatcagcaccacacaca

SEQ ID NO: 29844 - DNA, 20 bp, Artificial Sequence
  sgRNA
  Klri2_1
cgcagactgactctctaccc

SEQ ID NO: 29845 - DNA, 20 bp, Artificial Sequence
  sgRNA
  Klri2_2
cccaggacaggattcgatgt

SEQ ID NO: 29846 - DNA, 20 bp, Artificial Sequence
  sgRNA
  Klri2_3
actggaacaaaaatcacagg

SEQ ID NO: 29847 - DNA, 20 bp, Artificial Sequence
  sgRNA
  Klri2_4
aagcaggagattattaacat

SEQ ID NO: 29848 - DNA, 20 bp, Artificial Sequence
  sgRNA
  Klri2_5
atttgccatgttgtcagcca

SEQ ID NO: 29849 - DNA, 20 bp, Artificial Sequence
  sgRNA
  Klri2_6
gtcacatagaggatcaagaa

SEQ ID NO: 29850 - DNA, 20 bp, Artificial Sequence
  sgRNA
  Klri2_7
cagaccagagatctactgtg

SEQ ID NO: 29851 - DNA, 20 bp, Artificial Sequence
  sgRNA
  Klri2_8
tgtcacatagaggatcaaga

SEQ ID NO: 29852 - DNA, 20 bp, Artificial Sequence
  sgRNA
  Klri2_9
atatgtttccacgcagataa

SEQ ID NO: 29853 - DNA, 20 bp, Artificial Sequence
  sgRNA
  Klri2_10
acaggattcgatgtgggcaa

SEQ ID NO: 29854 - DNA, 20 bp, Artificial Sequence
  sgRNA
  Klri2_11
tcgagaaaactcaaaaacct

SEQ ID NO: 29855 - DNA, 20 bp, Artificial Sequence
  sgRNA
  Klri2_12
ggggaaatgacattaaaata

SEQ ID NO: 29856 - DNA, 20 bp, Artificial Sequence
  sgRNA
  Klri2_13
tcgaatcctgtcctgggctg

SEQ ID NO: 29857 - DNA, 20 bp, Artificial Sequence
  sgRNA
  Klri2_14
cccacatcgaatcctgtcct

SEQ ID NO: 29858 - DNA, 20 bp, Artificial Sequence
  sgRNA
  Klri2_15
gatctctggtctgtcttcga

SEQ ID NO: 29859 - DNA, 20 bp, Artificial Sequence
  sgRNA
  Klri2_16
ttcttgatcctctatgtgac

SEQ ID NO: 29860 - DNA, 20 bp, Artificial Sequence
  sgRNA
  Klri2_17
gaatattccacccccagccc

SEQ ID NO: 29861 - DNA, 20 bp, Artificial Sequence
  sgRNA
  Klri2_18
accaacagttccaggttgtg

SEQ ID NO: 29862 - DNA, 20 bp, Artificial Sequence
  sgRNA
  Klri2_19
gtcactggaacaaaaatcac

SEQ ID NO: 29863 - DNA, 20 bp, Artificial Sequence
  sgRNA
  Klri2_20
gcccaggacaggattcgatg

SEQ ID NO: 29864 - DNA, 20 bp, Artificial Sequence
  sgRNA
  Klrk1_1
aagggtgaatcgaattgcca

SEQ ID NO: 29865 - DNA, 20 bp, Artificial Sequence
  sgRNA
  Klrk1_2
atatccagttgttagggcat

SEQ ID NO: 29866 - DNA, 20 bp, Artificial Sequence
  sgRNA
  Klrk1_3
gcactaactaccagtcaacc

SEQ ID NO: 29867 - DNA, 20 bp, Artificial Sequence
  sgRNA
  Klrk1_4
cgacctcaagccagcaaagt

SEQ ID NO: 29868 - DNA, 20 bp, Artificial Sequence
  sgRNA
  Klrk1_5
aggactcgaacaacgaacat

SEQ ID NO: 29869 - DNA, 20 bp, Artificial Sequence
  sgRNA
  Klrk1_6
gcttgagccatagacagcac

SEQ ID NO: 29870 - DNA, 20 bp, Artificial Sequence
  sgRNA
  Klrk1_7
tagacagcacaggatccttt

SEQ ID NO: 29871 - DNA, 20 bp, Artificial Sequence
  sgRNA
  Klrk1_8
tcgagtccttgctatagcct

SEQ ID NO: 29872 - DNA, 20 bp, Artificial Sequence
  sgRNA
  Klrk1_9
acgacctcaagccagcaaag

SEQ ID NO: 29873 - DNA, 20 bp, Artificial Sequence
  sgRNA
  Klrk1_10
actctggtggaaataccaaa

SEQ ID NO: 29874 - DNA, 20 bp, Artificial Sequence
  sgRNA
  Klrk1_11
ggttaagtcctatcactgga

SEQ ID NO: 29875 - DNA, 20 bp, Artificial Sequence
  sgRNA
  Klrk1_12
gaattgccaaggctatagca

SEQ ID NO: 29876 - DNA, 20 bp, Artificial Sequence
  sgRNA
  Klrk1_13
tgtgacatatccagttgtta

SEQ ID NO: 29877 - DNA, 20 bp, Artificial Sequence
  sgRNA
  Klrk1_14
gaccagtcccatccagtgat

SEQ ID NO: 29878 - DNA, 20 bp, Artificial Sequence
  sgRNA
  Klrk1_15
ggagccatcttcccactgcc

SEQ ID NO: 29879 - DNA, 20 bp, Artificial Sequence
  sgRNA
  Klrk1_16
tgagaagtatcccactttgc

SEQ ID NO: 29880 - DNA, 20 bp, Artificial Sequence
  sgRNA
  Klrk1_17
tatcccactttgctggcttg

SEQ ID NO: 29881 - DNA, 20 bp, Artificial Sequence
  sgRNA
  Klrk1_18
gtggcccatgccctaacaac

SEQ ID NO: 29882 - DNA, 20 bp, Artificial Sequence
  sgRNA
  Klrk1_19
ctttactgtatatcttcaga

SEQ ID NO: 29883 - DNA, 20 bp, Artificial Sequence
  sgRNA
  Klrk1_20
cttgacagtattgtgcaaca

SEQ ID NO: 29884 - DNA, 20 bp, Artificial Sequence
  sgRNA
  Kremen1_1
gccaacggtgcagattacag

SEQ ID NO: 29885 - DNA, 20 bp, Artificial Sequence
  sgRNA
  Kremen1_2
cacgctgaagtaccccaacg

SEQ ID NO: 29886 - DNA, 20 bp, Artificial Sequence
  sgRNA
  Kremen1_3
gagccggaccaggacgcggt

SEQ ID NO: 29887 - DNA, 20 bp, Artificial Sequence
  sgRNA
  Kremen1_4
gaagtcaggggagtacacca

SEQ ID NO: 29888 - DNA, 20 bp, Artificial Sequence
  sgRNA
  Kremen1_5
gatcgcatcaatcaggccca

SEQ ID NO: 29889 - DNA, 20 bp, Artificial Sequence
  sgRNA
  Kremen1_6
cgtgagcccttggtgctacg

SEQ ID NO: 29890 - DNA, 20 bp, Artificial Sequence
  sgRNA
  Kremen1_7
tgtcaaccagaccctggcag

SEQ ID NO: 29891 - DNA, 20 bp, Artificial Sequence
  sgRNA
  Kremen1_8
cggtgggaactactcagcca

SEQ ID NO: 29892 - DNA, 20 bp, Artificial Sequence
  sgRNA
  Kremen1_9
gctcggtgatcacctctgcc

SEQ ID NO: 29893 - DNA, 20 bp, Artificial Sequence
  sgRNA
  Kremen1_10
tgactactggaagcacgggg

SEQ ID NO: 29894 - DNA, 20 bp, Artificial Sequence
  sgRNA
  Kremen1_11
actccgacagaagctgatac

SEQ ID NO: 29895 - DNA, 20 bp, Artificial Sequence
  sgRNA
  Kremen1_12
ttagggactgtcgtcagcct

SEQ ID NO: 29896 - DNA, 20 bp, Artificial Sequence
  sgRNA
  Kremen1_13
cagagtccctgatatcaaac

SEQ ID NO: 29897 - DNA, 20 bp, Artificial Sequence
  sgRNA
  Kremen1_14
tacgtggccgagcatgagga

SEQ ID NO: 29898 - DNA, 20 bp, Artificial Sequence
  sgRNA
  Kremen1_15
ccagtagcagactctgccag

SEQ ID NO: 29899 - DNA, 20 bp, Artificial Sequence
  sgRNA
  Kremen1_16
tcctgactactggaagcacg

SEQ ID NO: 29900 - DNA, 20 bp, Artificial Sequence
  sgRNA
  Kremen1_17
aacacgctgaagtaccccaa

SEQ ID NO: 29901 - DNA, 20 bp, Artificial Sequence
  sgRNA
  Kremen1_18
ctcggtgatcacctctgcca

SEQ ID NO: 29902 - DNA, 20 bp, Artificial Sequence
  sgRNA
  Kremen1_19
acacgctgaagtaccccaac

SEQ ID NO: 29903 - DNA, 20 bp, Artificial Sequence
  sgRNA
  Kremen1_20
gaagttgaaatggatgcgag

SEQ ID NO: 29904 - DNA, 20 bp, Artificial Sequence
  sgRNA
  Kremen2_1
gtgaacggcgctgactaccg

SEQ ID NO: 29905 - DNA, 20 bp, Artificial Sequence
  sgRNA
  Kremen2_2
tttactcactgtgacatgtg

SEQ ID NO: 29906 - DNA, 20 bp, Artificial Sequence
  sgRNA
  Kremen2_3
cggatgagtatggaccagac

SEQ ID NO: 29907 - DNA, 20 bp, Artificial Sequence
  sgRNA
  Kremen2_4
tgggtgcgcataacttctgt

SEQ ID NO: 29908 - DNA, 20 bp, Artificial Sequence
  sgRNA
  Kremen2_5
tctgaaagtgacctggcccg

SEQ ID NO: 29909 - DNA, 20 bp, Artificial Sequence
  sgRNA
  Kremen2_6
catggcctcttgcgtcgctg

SEQ ID NO: 29910 - DNA, 20 bp, Artificial Sequence
  sgRNA
  Kremen2_7
ggagctgcacaggcttcgat

SEQ ID NO: 29911 - DNA, 20 bp, Artificial Sequence
  sgRNA
  Kremen2_8
ttcaactgagagtctcgcag

SEQ ID NO: 29912 - DNA, 20 bp, Artificial Sequence
  sgRNA
  Kremen2_9
tctggtcccagaaaagacaa

SEQ ID NO: 29913 - DNA, 20 bp, Artificial Sequence
  sgRNA
  Kremen2_10
tatgcgcacccaacccccag

SEQ ID NO: 29914 - DNA, 20 bp, Artificial Sequence
  sgRNA
  Kremen2_11
caagggcgtccagctccgcg

SEQ ID NO: 29915 - DNA, 20 bp, Artificial Sequence
  sgRNA
  Kremen2_12
cttcgattctgccgcatgaa

SEQ ID NO: 29916 - DNA, 20 bp, Artificial Sequence
  sgRNA
  Kremen2_13
gcagctcgcgttagccccat

SEQ ID NO: 29917 - DNA, 20 bp, Artificial Sequence
  sgRNA
  Kremen2_14
attcaactgagagtctcgca

SEQ ID NO: 29918 - DNA, 20 bp, Artificial Sequence
  sgRNA
  Kremen2_15
cagaactacaccggcccacg

SEQ ID NO: 29919 - DNA, 20 bp, Artificial Sequence
  sgRNA
  Kremen2_16
ggcttcgcgctcacctaccg

SEQ ID NO: 29920 - DNA, 20 bp, Artificial Sequence
  sgRNA
  Kremen2_17
tcgacgcagcaaacgcagta

SEQ ID NO: 29921 - DNA, 20 bp, Artificial Sequence
  sgRNA
  Kremen2_18
gagctacgcgacgtctcgtc

SEQ ID NO: 29922 - DNA, 20 bp, Artificial Sequence
  sgRNA
  Kremen2_19
acagatctggtcacagtcgg

SEQ ID NO: 29923 - DNA, 20 bp, Artificial Sequence
  sgRNA
  Kremen2_20
gattcaactgagagtctcgc

SEQ ID NO: 29924 - DNA, 20 bp, Artificial Sequence
  sgRNA
  L1cam_1
catccagtagatcctaagtg

SEQ ID NO: 29925 - DNA, 20 bp, Artificial Sequence
  sgRNA
  L1cam_2
gtccaggcagtgaacaacca

SEQ ID NO: 29926 - DNA, 20 bp, Artificial Sequence
  sgRNA
  L1cam_3
tcagcgttccattggcatag

SEQ ID NO: 29927 - DNA, 20 bp, Artificial Sequence
  sgRNA
  L1cam_4
accctgcaactactcaatgt

SEQ ID NO: 29928 - DNA, 20 bp, Artificial Sequence
  sgRNA
  L1cam_5
aattgcactggcccttccga

SEQ ID NO: 29929 - DNA, 20 bp, Artificial Sequence
  sgRNA
  L1cam_6
gttaatggcagtgacccgaa

SEQ ID NO: 29930 - DNA, 20 bp, Artificial Sequence
  sgRNA
  L1cam_7
ggtactgtagatcagggttg

SEQ ID NO: 29931 - DNA, 20 bp, Artificial Sequence
  sgRNA
  L1cam_8
tgcttcatcaaacgcagcaa

SEQ ID NO: 29932 - DNA, 20 bp, Artificial Sequence
  sgRNA
  L1cam_9
aggctgtcatcactgcctag

SEQ ID NO: 29933 - DNA, 20 bp, Artificial Sequence
  sgRNA
  L1cam_10
gtacaggcctttaatgggcg

SEQ ID NO: 29934 - DNA, 20 bp, Artificial Sequence
  sgRNA
  L1cam_11
ttcttctcaattgcgctccg

SEQ ID NO: 29935 - DNA, 20 bp, Artificial Sequence
  sgRNA
  L1cam_12
ccgaaggtctcgtctttcat

SEQ ID NO: 29936 - DNA, 20 bp, Artificial Sequence
  sgRNA
  L1cam_13
gggcttctgcagccaatatg

SEQ ID NO: 29937 - DNA, 20 bp, Artificial Sequence
  sgRNA
  L1cam_14
ggtcaccattggctattcag

SEQ ID NO: 29938 - DNA, 20 bp, Artificial Sequence
  sgRNA
  L1cam_15
acaggtagctttgcctccga

SEQ ID NO: 29939 - DNA, 20 bp, Artificial Sequence
  sgRNA
  L1cam_16
gcatgcctactatgttactg

SEQ ID NO: 29940 - DNA, 20 bp, Artificial Sequence
  sgRNA
  L1cam_17
tggcatccacttcaaaccca

SEQ ID NO: 29941 - DNA, 20 bp, Artificial Sequence
  sgRNA
  L1cam_18
cttcccctctcacatccaca

SEQ ID NO: 29942 - DNA, 20 bp, Artificial Sequence
  sgRNA
  L1cam_19
attacacctggagtgtcagt

SEQ ID NO: 29943 - DNA, 20 bp, Artificial Sequence
  sgRNA
  L1cam_20
gaatctgtatgagcaggcag

SEQ ID NO: 29944 - DNA, 20 bp, Artificial Sequence
  sgRNA
  Lag3_1
gatcctaactttctacgaag

SEQ ID NO: 29945 - DNA, 20 bp, Artificial Sequence
  sgRNA
  Lag3_2
gagagaagtccccgcgctgg

SEQ ID NO: 29946 - DNA, 20 bp, Artificial Sequence
  sgRNA
  Lag3_3
tcagcagcgtacactgtcag

SEQ ID NO: 29947 - DNA, 20 bp, Artificial Sequence
  sgRNA
  Lag3_4
gtttcagctaaaaaatgacg

SEQ ID NO: 29948 - DNA, 20 bp, Artificial Sequence
  sgRNA
  Lag3_5
ggtgcgggttgtctaggcga

SEQ ID NO: 29949 - DNA, 20 bp, Artificial Sequence
  sgRNA
  Lag3_6
gatgaccgccaacgtgacag

SEQ ID NO: 29950 - DNA, 20 bp, Artificial Sequence
  sgRNA
  Lag3_7
gcgctcctccagctgcacgt

SEQ ID NO: 29951 - DNA, 20 bp, Artificial Sequence
  sgRNA
  Lag3_8
tcgggttacctggctcccgg

SEQ ID NO: 29952 - DNA, 20 bp, Artificial Sequence
  sgRNA
  Lag3_9
gcctgggaaagagctccccg

SEQ ID NO: 29953 - DNA, 20 bp, Artificial Sequence
  sgRNA
  Lag3_10
ccaggctccttgctgagcga

SEQ ID NO: 29954 - DNA, 20 bp, Artificial Sequence
  sgRNA
  Lag3_11
acccgcacccggtcgctaca

SEQ ID NO: 29955 - DNA, 20 bp, Artificial Sequence
  sgRNA
  Lag3_12
cagcagcgtacactgtcaga

SEQ ID NO: 29956 - DNA, 20 bp, Artificial Sequence
  sgRNA
  Lag3_13
tctttcctttccagatgccg

SEQ ID NO: 29957 - DNA, 20 bp, Artificial Sequence
  sgRNA
  Lag3_14
ggcgtggtactcgcccgcat

SEQ ID NO: 29958 - DNA, 20 bp, Artificial Sequence
  sgRNA
  Lag3_15
gtgctgagcgtggctccagg

SEQ ID NO: 29959 - DNA, 20 bp, Artificial Sequence
  sgRNA
  Lag3_16
ccggcccttgaccttcacca

SEQ ID NO: 29960 - DNA, 20 bp, Artificial Sequence
  sgRNA
  Lag3_17
atctcaggtgaccttaaagg

SEQ ID NO: 29961 - DNA, 20 bp, Artificial Sequence
  sgRNA
  Lag3_18
cagtgactcccaaatccttc

SEQ ID NO: 29962 - DNA, 20 bp, Artificial Sequence
  sgRNA
  Lag3_19
gtacgctgctgaaggttcta

SEQ ID NO: 29963 - DNA, 20 bp, Artificial Sequence
  sgRNA
  Lag3_20
tggcagtgtcagctgtacga

SEQ ID NO: 29964 - DNA, 20 bp, Artificial Sequence
  sgRNA
  Lair1_1
caagtcttatgatctcccaa

SEQ ID NO: 29965 - DNA, 20 bp, Artificial Sequence
  sgRNA
  Lair1_2
taaacacgacttgtataaca

SEQ ID NO: 29966 - DNA, 20 bp, Artificial Sequence
  sgRNA
  Lair1_3
gtccgaacgtagtaagacgc

SEQ ID NO: 29967 - DNA, 20 bp, Artificial Sequence
  sgRNA
  Lair1_4
acagctataatgtccagtaa

SEQ ID NO: 29968 - DNA, 20 bp, Artificial Sequence
  sgRNA
  Lair1_5
atagctgtatctattcgaag

SEQ ID NO: 29969 - DNA, 20 bp, Artificial Sequence
  sgRNA
  Lair1_6
tatagctgtatctattcgaa

SEQ ID NO: 29970 - DNA, 20 bp, Artificial Sequence
  sgRNA
  Lair1_7
ggatatacgtcacctcttga

SEQ ID NO: 29971 - DNA, 20 bp, Artificial Sequence
  sgRNA
  Lair1_8
ggagctgatcatgtgcacct

SEQ ID NO: 29972 - DNA, 20 bp, Artificial Sequence
  sgRNA
  Lair1_9
ccatcactccctcacacaga

SEQ ID NO: 29973 - DNA, 20 bp, Artificial Sequence
  sgRNA
  Lair1_10
agttgcaggagaccttcaag

SEQ ID NO: 29974 - DNA, 20 bp, Artificial Sequence
  sgRNA
  Lair1_11
atcagctccaaagttgccca

SEQ ID NO: 29975 - DNA, 20 bp, Artificial Sequence
  sgRNA
  Lair1_12
tcagctccaaagttgcccag

SEQ ID NO: 29976 - DNA, 20 bp, Artificial Sequence
  sgRNA
  Lair1_13
ttatagctgtatctattcga

SEQ ID NO: 29977 - DNA, 20 bp, Artificial Sequence
  sgRNA
  Lair1_14
cactgagccttataaaacag

SEQ ID NO: 29978 - DNA, 20 bp, Artificial Sequence
  sgRNA
  Lair1_15
agatcataagacttgaatta

SEQ ID NO: 29979 - DNA, 20 bp, Artificial Sequence
  sgRNA
  Lair1_16
cttgtataacatggtccgcc

SEQ ID NO: 29980 - DNA, 20 bp, Artificial Sequence
  sgRNA
  Lair1_17
gaggaagcagaacagaaggg

SEQ ID NO: 29981 - DNA, 20 bp, Artificial Sequence
  sgRNA
  Lair1_18
aggcaccgtcagaaaaagca

SEQ ID NO: 29982 - DNA, 20 bp, Artificial Sequence
  sgRNA
  Lair1_19
gggatggaaaattaacacac

SEQ ID NO: 29983 - DNA, 20 bp, Artificial Sequence
  sgRNA
  Lair1_20
agaggtgacgtatatccagc

SEQ ID NO: 29984 - DNA, 20 bp, Artificial Sequence
  sgRNA
  Lamp1_1
accattcgcagtctcgtagg

SEQ ID NO: 29985 - DNA, 20 bp, Artificial Sequence
  sgRNA
  Lamp1_2
gcccaaatgacacatctagt

SEQ ID NO: 29986 - DNA, 20 bp, Artificial Sequence
  sgRNA
  Lamp1_3
cattgtacttggatacagtg

SEQ ID NO: 29987 - DNA, 20 bp, Artificial Sequence
  sgRNA
  Lamp1_4
ctcttccaaaagtaattgtg

SEQ ID NO: 29988 - DNA, 20 bp, Artificial Sequence
  sgRNA
  Lamp1_5
accacctacgagactgcgaa

SEQ ID NO: 29989 - DNA, 20 bp, Artificial Sequence
  sgRNA
  Lamp1_6
ttgatccccattgctgtggg

SEQ ID NO: 29990 - DNA, 20 bp, Artificial Sequence
  sgRNA
  Lamp1_7
ggagaacaagaacagagccc

SEQ ID NO: 29991 - DNA, 20 bp, Artificial Sequence
  sgRNA
  Lamp1_8
atccaggcctacctgtcgag

SEQ ID NO: 29992 - DNA, 20 bp, Artificial Sequence
  sgRNA
  Lamp1_9
tggcgcctcagcactctttg

SEQ ID NO: 29993 - DNA, 20 bp, Artificial Sequence
  sgRNA
  Lamp1_10
tgctgaagttgccactcgac

SEQ ID NO: 29994 - DNA, 20 bp, Artificial Sequence
  sgRNA
  Lamp1_11
cagacatcaacaaagcatac

SEQ ID NO: 29995 - DNA, 20 bp, Artificial Sequence
  sgRNA
  Lamp1_12
agaaccattcgcagtctcgt

SEQ ID NO: 29996 - DNA, 20 bp, Artificial Sequence
  sgRNA
  Lamp1_13
gatgaggaccagccctgcca

SEQ ID NO: 29997 - DNA, 20 bp, Artificial Sequence
  sgRNA
  Lamp1_14
ggcaggaagaggagtcacgc

SEQ ID NO: 29998 - DNA, 20 bp, Artificial Sequence
  sgRNA
  Lamp1_15
atggaccttccccaaccact

SEQ ID NO: 29999 - DNA, 20 bp, Artificial Sequence
  sgRNA
  Lamp1_16
gcaggtccaggctttcaagg

SEQ ID NO: 30000 - DNA, 20 bp, Artificial Sequence
  sgRNA
  Lamp1_17
ctgcacactgaagacattga

SEQ ID NO: 30001 - DNA, 20 bp, Artificial Sequence
  sgRNA
  Lamp1_18
tcattgcctacctcattggc

SEQ ID NO: 30002 - DNA, 20 bp, Artificial Sequence
  sgRNA
  Lamp1_19
ctcgtaggtggtcagaaagg

SEQ ID NO: 30003 - DNA, 20 bp, Artificial Sequence
  sgRNA
  Lamp1_20
gatgtcagttgtggaatcca

SEQ ID NO: 30004 - DNA, 20 bp, Artificial Sequence
  sgRNA
  Lamp2_1
gagtgtagttgtagtcgacg

SEQ ID NO: 30005 - DNA, 20 bp, Artificial Sequence
  sgRNA
  Lamp2_2
cctgacaaggcgacacacga

SEQ ID NO: 30006 - DNA, 20 bp, Artificial Sequence
  sgRNA
  Lamp2_3
cacttaaagatgacatccaa

SEQ ID NO: 30007 - DNA, 20 bp, Artificial Sequence
  sgRNA
  Lamp2_4
gctgcagctgaacatcactg

SEQ ID NO: 30008 - DNA, 20 bp, Artificial Sequence
  sgRNA
  Lamp2_5
gctgccggtgaagttggttg

SEQ ID NO: 30009 - DNA, 20 bp, Artificial Sequence
  sgRNA
  Lamp2_6
cacatataagaacttcccag

SEQ ID NO: 30010 - DNA, 20 bp, Artificial Sequence
  sgRNA
  Lamp2_7
ccaactccaactccaaccgt

SEQ ID NO: 30011 - DNA, 20 bp, Artificial Sequence
  sgRNA
  Lamp2_8
agttgtagtcgacggggcag

SEQ ID NO: 30012 - DNA, 20 bp, Artificial Sequence
  sgRNA
  Lamp2_9
gggttgatgttaaaaatgaa

SEQ ID NO: 30013 - DNA, 20 bp, Artificial Sequence
  sgRNA
  Lamp2_10
gttaatttgacagattcaaa

SEQ ID NO: 30014 - DNA, 20 bp, Artificial Sequence
  sgRNA
  Lamp2_11
cggtgaagttggttgtggca

SEQ ID NO: 30015 - DNA, 20 bp, Artificial Sequence
  sgRNA
  Lamp2_12
ttatatgtgcaacaaagagc

SEQ ID NO: 30016 - DNA, 20 bp, Artificial Sequence
  sgRNA
  Lamp2_13
attctaataccaattatagt

SEQ ID NO: 30017 - DNA, 20 bp, Artificial Sequence
  sgRNA
  Lamp2_14
agaccaaactcccaccactg

SEQ ID NO: 30018 - DNA, 20 bp, Artificial Sequence
  sgRNA
  Lamp2_15
ttccttgtgcccatagcggt

SEQ ID NO: 30019 - DNA, 20 bp, Artificial Sequence
  sgRNA
  Lamp2_16
gtgagtgtagttgtagtcga

SEQ ID NO: 30020 - DNA, 20 bp, Artificial Sequence
  sgRNA
  Lamp2_17
cctgccacaaccaacttcac

SEQ ID NO: 30021 - DNA, 20 bp, Artificial Sequence
  sgRNA
  Lamp2_18
ggtctcaagcgccatcatac

SEQ ID NO: 30022 - DNA, 20 bp, Artificial Sequence
  sgRNA
  Lamp2_19
atgctgtagtttccaacggt

SEQ ID NO: 30023 - DNA, 20 bp, Artificial Sequence
  sgRNA
  Lamp2_20
acatataagaacttcccaga

SEQ ID NO: 30024 - DNA, 20 bp, Artificial Sequence
  sgRNA
  Lamp5_1
agatgtaatggtccaaaccg

SEQ ID NO: 30025 - DNA, 20 bp, Artificial Sequence
  sgRNA
  Lamp5_2
ccactgtggccacaacgagt

SEQ ID NO: 30026 - DNA, 20 bp, Artificial Sequence
  sgRNA
  Lamp5_3
ggcgatgtacttattaactg

SEQ ID NO: 30027 - DNA, 20 bp, Artificial Sequence
  sgRNA
  Lamp5_4
agaaagacatatttgtggtg

SEQ ID NO: 30028 - DNA, 20 bp, Artificial Sequence
  sgRNA
  Lamp5_5
aagtctgtctccaccaagaa

SEQ ID NO: 30029 - DNA, 20 bp, Artificial Sequence
  sgRNA
  Lamp5_6
gctgagatctccttgacccg

SEQ ID NO: 30030 - DNA, 20 bp, Artificial Sequence
  sgRNA
  Lamp5_7
tttaaagtgagtcttctccg

SEQ ID NO: 30031 - DNA, 20 bp, Artificial Sequence
  sgRNA
  Lamp5_8
aagtcagagatgatatcaaa

SEQ ID NO: 30032 - DNA, 20 bp, Artificial Sequence
  sgRNA
  Lamp5_9
tcatggtgacagtcttctga

SEQ ID NO: 30033 - DNA, 20 bp, Artificial Sequence
  sgRNA
  Lamp5_10
cgagtaagaacccttcttgg

SEQ ID NO: 30034 - DNA, 20 bp, Artificial Sequence
  sgRNA
  Lamp5_11
caatcaagtgcagatcccca

SEQ ID NO: 30035 - DNA, 20 bp, Artificial Sequence
  sgRNA
  Lamp5_12
ttccacttcttgttctgcca

SEQ ID NO: 30036 - DNA, 20 bp, Artificial Sequence
  sgRNA
  Lamp5_13
ggctcagcagaccatttctc

SEQ ID NO: 30037 - DNA, 20 bp, Artificial Sequence
  sgRNA
  Lamp5_14
ccacaacgagtcggagctgg

SEQ ID NO: 30038 - DNA, 20 bp, Artificial Sequence
  sgRNA
  Lamp5_15
tgtgtgggccagcaattatg

SEQ ID NO: 30039 - DNA, 20 bp, Artificial Sequence
  sgRNA
  Lamp5_16
ttgctggcccacacatcata

SEQ ID NO: 30040 - DNA, 20 bp, Artificial Sequence
  sgRNA
  Lamp5_17
agtggatgagcaagagcagt

SEQ ID NO: 30041 - DNA, 20 bp, Artificial Sequence
  sgRNA
  Lamp5_18
ggcgacttggaatctgaaca

SEQ ID NO: 30042 - DNA, 20 bp, Artificial Sequence
  sgRNA
  Lamp5_19
cctccagctccgactcgttg

SEQ ID NO: 30043 - DNA, 20 bp, Artificial Sequence
  sgRNA
  Lamp5_20
ctgctgagcctgacactcat

SEQ ID NO: 30044 - DNA, 20 bp, Artificial Sequence
  sgRNA
  Layn_1
gccaaaccgagggattcgaa

SEQ ID NO: 30045 - DNA, 20 bp, Artificial Sequence
  sgRNA
  Layn_2
aaataaatgactttatagca

SEQ ID NO: 30046 - DNA, 20 bp, Artificial Sequence
  sgRNA
  Layn_3
agccaaagaaacctgcatgg

SEQ ID NO: 30047 - DNA, 20 bp, Artificial Sequence
  sgRNA
  Layn_4
agtcaccatcagatgccagg

SEQ ID NO: 30048 - DNA, 20 bp, Artificial Sequence
  sgRNA
  Layn_5
tcacaaacccactttccgaa

SEQ ID NO: 30049 - DNA, 20 bp, Artificial Sequence
  sgRNA
  Layn_6
tacgagcccccgatgccggg

SEQ ID NO: 30050 - DNA, 20 bp, Artificial Sequence
  sgRNA
  Layn_7
tgttccagtggaatgatgac

SEQ ID NO: 30051 - DNA, 20 bp, Artificial Sequence
  sgRNA
  Layn_8
tgaattctccccggaccgaa

SEQ ID NO: 30052 - DNA, 20 bp, Artificial Sequence
  sgRNA
  Layn_9
aggcgacccttcgaatccct

SEQ ID NO: 30053 - DNA, 20 bp, Artificial Sequence
  sgRNA
  Layn_10
gctcgtcagcattgagacag

SEQ ID NO: 30054 - DNA, 20 bp, Artificial Sequence
  sgRNA
  Layn_11
ggtgctgctggccaaaccga

SEQ ID NO: 30055 - DNA, 20 bp, Artificial Sequence
  sgRNA
  Layn_12
tgacatctatgaattctccc

SEQ ID NO: 30056 - DNA, 20 bp, Artificial Sequence
  sgRNA
  Layn_13
tctgccgaggaggaacacgg

SEQ ID NO: 30057 - DNA, 20 bp, Artificial Sequence
  sgRNA
  Layn_14
tcagcaccacccggcatcgg

SEQ ID NO: 30058 - DNA, 20 bp, Artificial Sequence
  sgRNA
  Layn_15
tggtctgccgaggaggaaca

SEQ ID NO: 30059 - DNA, 20 bp, Artificial Sequence
  sgRNA
  Layn_16
ttccccagaacacacccgga

SEQ ID NO: 30060 - DNA, 20 bp, Artificial Sequence
  sgRNA
  Layn_17
aaacattgctgtgaaccctt

SEQ ID NO: 30061 - DNA, 20 bp, Artificial Sequence
  sgRNA
  Layn_18
gctgcaggctatgttgctgg

SEQ ID NO: 30062 - DNA, 20 bp, Artificial Sequence
  sgRNA
  Layn_19
gctcctccccattcggtccg

SEQ ID NO: 30063 - DNA, 20 bp, Artificial Sequence
  sgRNA
  Layn_20
gcctcggacttggaccccag

SEQ ID NO: 30064 - DNA, 20 bp, Artificial Sequence
  sgRNA
  Lct_1
tgagttgttcgatagctatg

SEQ ID NO: 30065 - DNA, 20 bp, Artificial Sequence
  sgRNA
  Lct_2
tcagcctatcaaatcgaagg

SEQ ID NO: 30066 - DNA, 20 bp, Artificial Sequence
  sgRNA
  Lct_3
ctcccgtggatacgccccag

SEQ ID NO: 30067 - DNA, 20 bp, Artificial Sequence
  sgRNA
  Lct_4
cttaaacttgtacatcaacg

SEQ ID NO: 30068 - DNA, 20 bp, Artificial Sequence
  sgRNA
  Lct_5
gcttccctggaatacacgaa

SEQ ID NO: 30069 - DNA, 20 bp, Artificial Sequence
  sgRNA
  Lct_6
gattgggaatgacgacaacg

SEQ ID NO: 30070 - DNA, 20 bp, Artificial Sequence
  sgRNA
  Lct_7
ggtcgaacccaaggacccgg

SEQ ID NO: 30071 - DNA, 20 bp, Artificial Sequence
  sgRNA
  Lct_8
agaacgagacagttgtacag

SEQ ID NO: 30072 - DNA, 20 bp, Artificial Sequence
  sgRNA
  Lct_9
gcacaatctgaaccatccgc

SEQ ID NO: 30073 - DNA, 20 bp, Artificial Sequence
  sgRNA
  Lct_10
caacctccggaagagcacat

SEQ ID NO: 30074 - DNA, 20 bp, Artificial Sequence
  sgRNA
  Lct_11
gacatgctgtgcaaatacag

SEQ ID NO: 30075 - DNA, 20 bp, Artificial Sequence
  sgRNA
  Lct_12
tggcctagaatcctccccga

SEQ ID NO: 30076 - DNA, 20 bp, Artificial Sequence
  sgRNA
  Lct_13
gagaatggagtgtcccgacg

SEQ ID NO: 30077 - DNA, 20 bp, Artificial Sequence
  sgRNA
  Lct_14
ggtcaggaaagccattgcag

SEQ ID NO: 30078 - DNA, 20 bp, Artificial Sequence
  sgRNA
  Lct_15
atgccgatgtgctcttccgg

SEQ ID NO: 30079 - DNA, 20 bp, Artificial Sequence
  sgRNA
  Lct_16
acttgaccttcagagttcga

SEQ ID NO: 30080 - DNA, 20 bp, Artificial Sequence
  sgRNA
  Lct_17
acttgttgaggcctgccgcc

SEQ ID NO: 30081 - DNA, 20 bp, Artificial Sequence
  sgRNA
  Lct_18
gcattgtgctcaattcagac

SEQ ID NO: 30082 - DNA, 20 bp, Artificial Sequence
  sgRNA
  Lct_19
atttgtacacgtcagccctg

SEQ ID NO: 30083 - DNA, 20 bp, Artificial Sequence
  sgRNA
  Lct_20
ggatgacctttaatgagcct

SEQ ID NO: 30084 - DNA, 20 bp, Artificial Sequence
  sgRNA
  Ldlr_1
aaaatgcatcgctagcaagt

SEQ ID NO: 30085 - DNA, 20 bp, Artificial Sequence
  sgRNA
  Ldlr_2
ggtgtcgtaggacaagttag

SEQ ID NO: 30086 - DNA, 20 bp, Artificial Sequence
  sgRNA
  Ldlr_3
gcagactggtgtactcgctg

SEQ ID NO: 30087 - DNA, 20 bp, Artificial Sequence
  sgRNA
  Ldlr_4
tgaccgtgaacatgactgca

SEQ ID NO: 30088 - DNA, 20 bp, Artificial Sequence
  sgRNA
  Ldlr_5
ccagcgacgcatcagatccg

SEQ ID NO: 30089 - DNA, 20 bp, Artificial Sequence
  sgRNA
  Ldlr_6
gctcttcaccaaccgccacg

SEQ ID NO: 30090 - DNA, 20 bp, Artificial Sequence
  sgRNA
  Ldlr_7
gctaccacagtggaactcca

SEQ ID NO: 30091 - DNA, 20 bp, Artificial Sequence
  sgRNA
  Ldlr_8
gtgtcccagcggcttccggt

SEQ ID NO: 30092 - DNA, 20 bp, Artificial Sequence
  sgRNA
  Ldlr_9
tccatcacacacaaactgcg

SEQ ID NO: 30093 - DNA, 20 bp, Artificial Sequence
  sgRNA
  Ldlr_10
gctagcaagtgggtgtgcga

SEQ ID NO: 30094 - DNA, 20 bp, Artificial Sequence
  sgRNA
  Ldlr_11
tgtggtggctctcgacacgg

SEQ ID NO: 30095 - DNA, 20 bp, Artificial Sequence
  sgRNA
  Ldlr_12
tctccagcatcgatgtcaat

SEQ ID NO: 30096 - DNA, 20 bp, Artificial Sequence
  sgRNA
  Ldlr_13
acactgtactgaccacccag

SEQ ID NO: 30097 - DNA, 20 bp, Artificial Sequence
  sgRNA
  Ldlr_14
gtatctgtggctgacaccaa

SEQ ID NO: 30098 - DNA, 20 bp, Artificial Sequence
  sgRNA
  Ldlr_15
tggtgaccgaaaacatccag

SEQ ID NO: 30099 - DNA, 20 bp, Artificial Sequence
  sgRNA
  Ldlr_16
tgaaaacctcttgtccccgg

SEQ ID NO: 30100 - DNA, 20 bp, Artificial Sequence
  sgRNA
  Ldlr_17
acctgtggaggtccaccaac

SEQ ID NO: 30101 - DNA, 20 bp, Artificial Sequence
  sgRNA
  Ldlr_18
gacaggaacctcataccatg

SEQ ID NO: 30102 - DNA, 20 bp, Artificial Sequence
  sgRNA
  Ldlr_19
tcatcttccggacctcgtgg

SEQ ID NO: 30103 - DNA, 20 bp, Artificial Sequence
  sgRNA
  Ldlr_20
cgaggtccggaagatgaccc

SEQ ID NO: 30104 - DNA, 20 bp, Artificial Sequence
  sgRNA
  Ldlrad3_1
ggaagcggccgatgatacag

SEQ ID NO: 30105 - DNA, 20 bp, Artificial Sequence
  sgRNA
  Ldlrad3_2
accaacgagtgcaacatccc

SEQ ID NO: 30106 - DNA, 20 bp, Artificial Sequence
  sgRNA
  Ldlrad3_3
tgatggcgtacgtgatgctg

SEQ ID NO: 30107 - DNA, 20 bp, Artificial Sequence
  sgRNA
  Ldlrad3_4
ggtgcacagggagggtcatg

SEQ ID NO: 30108 - DNA, 20 bp, Artificial Sequence
  sgRNA
  Ldlrad3_5
tcatgaccctccctgtgcac

SEQ ID NO: 30109 - DNA, 20 bp, Artificial Sequence
  sgRNA
  Ldlrad3_6
acttcatgtgcagcaacggg

SEQ ID NO: 30110 - DNA, 20 bp, Artificial Sequence
  sgRNA
  Ldlrad3_7
ggtaacttcatgtgcagcaa

SEQ ID NO: 30111 - DNA, 20 bp, Artificial Sequence
  sgRNA
  Ldlrad3_8
gtacacaagctggttctccg

SEQ ID NO: 30112 - DNA, 20 bp, Artificial Sequence
  sgRNA
  Ldlrad3_9
ctgtcccgacggcagcgacg

SEQ ID NO: 30113 - DNA, 20 bp, Artificial Sequence
  sgRNA
  Ldlrad3_10
ggatttgaggactgtcccga

SEQ ID NO: 30114 - DNA, 20 bp, Artificial Sequence
  sgRNA
  Ldlrad3_11
agcatcacgtacgccatcat

SEQ ID NO: 30115 - DNA, 20 bp, Artificial Sequence
  sgRNA
  Ldlrad3_12
agtcctcaaatccattgcag

SEQ ID NO: 30116 - DNA, 20 bp, Artificial Sequence
  sgRNA
  Ldlrad3_13
gagcagcctggctctccaga

SEQ ID NO: 30117 - DNA, 20 bp, Artificial Sequence
  sgRNA
  Ldlrad3_14
cctgcagtggtagcgagccg

SEQ ID NO: 30118 - DNA, 20 bp, Artificial Sequence
  sgRNA
  Ldlrad3_15
gcagcacaggatgctgcagc

SEQ ID NO: 30119 - DNA, 20 bp, Artificial Sequence
  sgRNA
  Ldlrad3_16
tgttcagtatgtggctaccc

SEQ ID NO: 30120 - DNA, 20 bp, Artificial Sequence
  sgRNA
  Ldlrad3_17
gggtggagagcctacttccg

SEQ ID NO: 30121 - DNA, 20 bp, Artificial Sequence
  sgRNA
  Ldlrad3_18
tgctgcacatgaagttacct

SEQ ID NO: 30122 - DNA, 20 bp, Artificial Sequence
  sgRNA
  Ldlrad3_19
cgagccgtggagcaaagcag

SEQ ID NO: 30123 - DNA, 20 bp, Artificial Sequence
  sgRNA
  Ldlrad3_20
gttctcctcgtcgctgccgt

SEQ ID NO: 30124 - DNA, 20 bp, Artificial Sequence
  sgRNA
  Ldlrad4_1
gatctgcgcgaattccagct

SEQ ID NO: 30125 - DNA, 20 bp, Artificial Sequence
  sgRNA
  Ldlrad4_2
tgtaaccaacagaacgactg

SEQ ID NO: 30126 - DNA, 20 bp, Artificial Sequence
  sgRNA
  Ldlrad4_3
caatctcgtgctgcacatag

SEQ ID NO: 30127 - DNA, 20 bp, Artificial Sequence
  sgRNA
  Ldlrad4_4
ggagctatcagaaggccaca

SEQ ID NO: 30128 - DNA, 20 bp, Artificial Sequence
  sgRNA
  Ldlrad4_5
gtttcagccgaacaactcag

SEQ ID NO: 30129 - DNA, 20 bp, Artificial Sequence
  sgRNA
  Ldlrad4_6
actcaaccgagagtccgtga

SEQ ID NO: 30130 - DNA, 20 bp, Artificial Sequence
  sgRNA
  Ldlrad4_7
gccacccccgacctacagcg

SEQ ID NO: 30131 - DNA, 20 bp, Artificial Sequence
  sgRNA
  Ldlrad4_8
gacatttctatgtacaacgg

SEQ ID NO: 30132 - DNA, 20 bp, Artificial Sequence
  sgRNA
  Ldlrad4_9
ggcacaatagtacccatcaa

SEQ ID NO: 30133 - DNA, 20 bp, Artificial Sequence
  sgRNA
  Ldlrad4_10
gcagctacctgtagcagtaa

SEQ ID NO: 30134 - DNA, 20 bp, Artificial Sequence
  sgRNA
  Ldlrad4_11
taccccatctttcatccaga

SEQ ID NO: 30135 - DNA, 20 bp, Artificial Sequence
  sgRNA
  Ldlrad4_12
aactcaaccgagagtccgtg

SEQ ID NO: 30136 - DNA, 20 bp, Artificial Sequence
  sgRNA
  Ldlrad4_13
gcagtaacggaagaatggag

SEQ ID NO: 30137 - DNA, 20 bp, Artificial Sequence
  sgRNA
  Ldlrad4_14
tgaagcccctgggcgctgca

SEQ ID NO: 30138 - DNA, 20 bp, Artificial Sequence
  sgRNA
  Ldlrad4_15
tttcagccgaacaactcaga

SEQ ID NO: 30139 - DNA, 20 bp, Artificial Sequence
  sgRNA
  Ldlrad4_16
gtgctggtgatggaagaacg

SEQ ID NO: 30140 - DNA, 20 bp, Artificial Sequence
  sgRNA
  Ldlrad4_17
tagctgcgctgatgcccgag

SEQ ID NO: 30141 - DNA, 20 bp, Artificial Sequence
  sgRNA
  Ldlrad4_18
tcaaaaacggttcgattggg

SEQ ID NO: 30142 - DNA, 20 bp, Artificial Sequence
  sgRNA
  Ldlrad4_19
gatggaagaacgaggtgcct

SEQ ID NO: 30143 - DNA, 20 bp, Artificial Sequence
  sgRNA
  Ldlrad4_20
gatagctccgtgcagcgccc

SEQ ID NO: 30144 - DNA, 20 bp, Artificial Sequence
  sgRNA
  Lepr_1
gtgtagtgtgaggaggtacg

SEQ ID NO: 30145 - DNA, 20 bp, Artificial Sequence
  sgRNA
  Lepr_2
gagtcaggaaggacacacgt

SEQ ID NO: 30146 - DNA, 20 bp, Artificial Sequence
  sgRNA
  Lepr_3
tgaaagccaccagacctcga

SEQ ID NO: 30147 - DNA, 20 bp, Artificial Sequence
  sgRNA
  Lepr_4
aggtgactgaaaactcacac

SEQ ID NO: 30148 - DNA, 20 bp, Artificial Sequence
  sgRNA
  Lepr_5
tcataggtaaacttccctcg

SEQ ID NO: 30149 - DNA, 20 bp, Artificial Sequence
  sgRNA
  Lepr_6
tcacgtataattcagcatag

SEQ ID NO: 30150 - DNA, 20 bp, Artificial Sequence
  sgRNA
  Lepr_7
ggtcagcaacgataaactag

SEQ ID NO: 30151 - DNA, 20 bp, Artificial Sequence
  sgRNA
  Lepr_8
agcacaatccaatcactagt

SEQ ID NO: 30152 - DNA, 20 bp, Artificial Sequence
  sgRNA
  Lepr_9
agaagcccccttcaaagccg

SEQ ID NO: 30153 - DNA, 20 bp, Artificial Sequence
  sgRNA
  Lepr_10
actctctcttctgttgacgg

SEQ ID NO: 30154 - DNA, 20 bp, Artificial Sequence
  sgRNA
  Lepr_11
gcactcacagacaacactga

SEQ ID NO: 30155 - DNA, 20 bp, Artificial Sequence
  sgRNA
  Lepr_12
atcctagtccatccaaccgc

SEQ ID NO: 30156 - DNA, 20 bp, Artificial Sequence
  sgRNA
  Lepr_13
acttccatatgcaaacctaa

SEQ ID NO: 30157 - DNA, 20 bp, Artificial Sequence
  sgRNA
  Lepr_14
tccatatgcaaacctaaggg

SEQ ID NO: 30158 - DNA, 20 bp, Artificial Sequence
  sgRNA
  Lepr_15
gggatgtgaatgtcatgtgc

SEQ ID NO: 30159 - DNA, 20 bp, Artificial Sequence
  sgRNA
  Lepr_16
ggaccaatctcactttcctg

SEQ ID NO: 30160 - DNA, 20 bp, Artificial Sequence
  sgRNA
  Lepr_17
gctcattcccaaagcaacag

SEQ ID NO: 30161 - DNA, 20 bp, Artificial Sequence
  sgRNA
  Lepr_18
agttgtggtgaaatcatggt

SEQ ID NO: 30162 - DNA, 20 bp, Artificial Sequence
  sgRNA
  Lepr_19
gcattgtttggggctccagc

SEQ ID NO: 30163 - DNA, 20 bp, Artificial Sequence
  sgRNA
  Lepr_20
ctaaactgatatttctcgat

SEQ ID NO: 30164 - DNA, 20 bp, Artificial Sequence
  sgRNA
  Lgr4_1
ctgattcgtgaaattcacag

SEQ ID NO: 30165 - DNA, 20 bp, Artificial Sequence
  sgRNA
  Lgr4_2
acagcactaccaagcttgaa

SEQ ID NO: 30166 - DNA, 20 bp, Artificial Sequence
  sgRNA
  Lgr4_3
ccatattacctcagtcccgg

SEQ ID NO: 30167 - DNA, 20 bp, Artificial Sequence
  sgRNA
  Lgr4_4
aagccctgtgaatatttact

SEQ ID NO: 30168 - DNA, 20 bp, Artificial Sequence
  sgRNA
  Lgr4_5
tcacctccgacagttccagg

SEQ ID NO: 30169 - DNA, 20 bp, Artificial Sequence
  sgRNA
  Lgr4_6
atattgccctccgtgaaaaa

SEQ ID NO: 30170 - DNA, 20 bp, Artificial Sequence
  sgRNA
  Lgr4_7
agcacccagcaaagctacga

SEQ ID NO: 30171 - DNA, 20 bp, Artificial Sequence
  sgRNA
  Lgr4_8
gagttccccacaaaagacag

SEQ ID NO: 30172 - DNA, 20 bp, Artificial Sequence
  sgRNA
  Lgr4_9
gcatgattaagcacgttgct

SEQ ID NO: 30173 - DNA, 20 bp, Artificial Sequence
  sgRNA
  Lgr4_10
gggttgacggcggtaccgga

SEQ ID NO: 30174 - DNA, 20 bp, Artificial Sequence
  sgRNA
  Lgr4_11
ggaagggctttaatagcctg

SEQ ID NO: 30175 - DNA, 20 bp, Artificial Sequence
  sgRNA
  Lgr4_12
taacagacttcattatctcg

SEQ ID NO: 30176 - DNA, 20 bp, Artificial Sequence
  sgRNA
  Lgr4_13
acccaaagtttaaagacgac

SEQ ID NO: 30177 - DNA, 20 bp, Artificial Sequence
  sgRNA
  Lgr4_14
tttcaactgattgttctgga

SEQ ID NO: 30178 - DNA, 20 bp, Artificial Sequence
  sgRNA
  Lgr4_15
ggcatgtattcccacttgca

SEQ ID NO: 30179 - DNA, 20 bp, Artificial Sequence
  sgRNA
  Lgr4_16
cgaatgagaaaaatgcaaca

SEQ ID NO: 30180 - DNA, 20 bp, Artificial Sequence
  sgRNA
  Lgr4_17
gtacccagtgaagccattcg

SEQ ID NO: 30181 - DNA, 20 bp, Artificial Sequence
  sgRNA
  Lgr4_18
aatgatggtgtctctcctgt

SEQ ID NO: 30182 - DNA, 20 bp, Artificial Sequence
  sgRNA
  Lgr4_19
ttaacctcatttcctacgga

SEQ ID NO: 30183 - DNA, 20 bp, Artificial Sequence
  sgRNA
  Lgr4_20
attgccctccgtgaaaaagg

SEQ ID NO: 30184 - DNA, 20 bp, Artificial Sequence
  sgRNA
  Lgr5_1
caaaggcgtagtctgctatg

SEQ ID NO: 30185 - DNA, 20 bp, Artificial Sequence
  sgRNA
  Lgr5_2
aaccaatggaataaagacga

SEQ ID NO: 30186 - DNA, 20 bp, Artificial Sequence
  sgRNA
  Lgr5_3
aggaaattcagtaatgtgcg

SEQ ID NO: 30187 - DNA, 20 bp, Artificial Sequence
  sgRNA
  Lgr5_4
taactcacttaaaattaaca

SEQ ID NO: 30188 - DNA, 20 bp, Artificial Sequence
  sgRNA
  Lgr5_5
ggaccagatgcgataccgcg

SEQ ID NO: 30189 - DNA, 20 bp, Artificial Sequence
  sgRNA
  Lgr5_6
atcgctctcaggctaaaaag

SEQ ID NO: 30190 - DNA, 20 bp, Artificial Sequence
  sgRNA
  Lgr5_7
gctttgacacacattcccaa

SEQ ID NO: 30191 - DNA, 20 bp, Artificial Sequence
  sgRNA
  Lgr5_8
ggaaagcgccagtactgccg

SEQ ID NO: 30192 - DNA, 20 bp, Artificial Sequence
  sgRNA
  Lgr5_9
ataccggagcgagcgttcgt

SEQ ID NO: 30193 - DNA, 20 bp, Artificial Sequence
  sgRNA
  Lgr5_10
gagtctgctgtccattaact

SEQ ID NO: 30194 - DNA, 20 bp, Artificial Sequence
  sgRNA
  Lgr5_11
actcggacgatgttgagaaa

SEQ ID NO: 30195 - DNA, 20 bp, Artificial Sequence
  sgRNA
  Lgr5_12
cagtgtgatgggcagccccg

SEQ ID NO: 30196 - DNA, 20 bp, Artificial Sequence
  sgRNA
  Lgr5_13
gtatcaggctctgtaaggct

SEQ ID NO: 30197 - DNA, 20 bp, Artificial Sequence
  sgRNA
  Lgr5_14
gccaaaagtgaatgcatcca

SEQ ID NO: 30198 - DNA, 20 bp, Artificial Sequence
  sgRNA
  Lgr5_15
gcggtagtggacattctcat

SEQ ID NO: 30199 - DNA, 20 bp, Artificial Sequence
  sgRNA
  Lgr5_16
gatcgctctcaggctaaaaa

SEQ ID NO: 30200 - DNA, 20 bp, Artificial Sequence
  sgRNA
  Lgr5_17
aaccatgtaacccagtcaca

SEQ ID NO: 30201 - DNA, 20 bp, Artificial Sequence
  sgRNA
  Lgr5_18
ggtagtggacattctcatgg

SEQ ID NO: 30202 - DNA, 20 bp, Artificial Sequence
  sgRNA
  Lgr5_19
gctgctaattggggtaatcg

SEQ ID NO: 30203 - DNA, 20 bp, Artificial Sequence
  sgRNA
  Lgr5_20
actctggcagcgctggaacg

SEQ ID NO: 30204 - DNA, 20 bp, Artificial Sequence
  sgRNA
  Lgr6_1
ataggtcaaggcgtccaccg

SEQ ID NO: 30205 - DNA, 20 bp, Artificial Sequence
  sgRNA
  Lgr6_2
gagtacggagagtaacacga

SEQ ID NO: 30206 - DNA, 20 bp, Artificial Sequence
  sgRNA
  Lgr6_3
gggtacttacagcttaacca

SEQ ID NO: 30207 - DNA, 20 bp, Artificial Sequence
  sgRNA
  Lgr6_4
ctcacaggtaagccgtcagg

SEQ ID NO: 30208 - DNA, 20 bp, Artificial Sequence
  sgRNA
  Lgr6_5
cctcagtatgaacaacctca

SEQ ID NO: 30209 - DNA, 20 bp, Artificial Sequence
  sgRNA
  Lgr6_6
catctcccgacatcagccgg

SEQ ID NO: 30210 - DNA, 20 bp, Artificial Sequence
  sgRNA
  Lgr6_7
acggcctcaaagtcaccccg

SEQ ID NO: 30211 - DNA, 20 bp, Artificial Sequence
  sgRNA
  Lgr6_8
ggactgacttgacagcctcg

SEQ ID NO: 30212 - DNA, 20 bp, Artificial Sequence
  sgRNA
  Lgr6_9
ggcgccatactctcccaccg

SEQ ID NO: 30213 - DNA, 20 bp, Artificial Sequence
  sgRNA
  Lgr6_10
gggttgagaaagcctcaggg

SEQ ID NO: 30214 - DNA, 20 bp, Artificial Sequence
  sgRNA
  Lgr6_11
tggggacccacagcttcgag

SEQ ID NO: 30215 - DNA, 20 bp, Artificial Sequence
  sgRNA
  Lgr6_12
tgacctgcgtccgagcctac

SEQ ID NO: 30216 - DNA, 20 bp, Artificial Sequence
  sgRNA
  Lgr6_13
ccagggtccggatagccaag

SEQ ID NO: 30217 - DNA, 20 bp, Artificial Sequence
  sgRNA
  Lgr6_14
ggatgccccagctctcaaag

SEQ ID NO: 30218 - DNA, 20 bp, Artificial Sequence
  sgRNA
  Lgr6_15
gctgttggcacactcccggt

SEQ ID NO: 30219 - DNA, 20 bp, Artificial Sequence
  sgRNA
  Lgr6_16
ccttgatccggttatgtcgg

SEQ ID NO: 30220 - DNA, 20 bp, Artificial Sequence
  sgRNA
  Lgr6_17
tggcctcctctactgccccg

SEQ ID NO: 30221 - DNA, 20 bp, Artificial Sequence
  sgRNA
  Lgr6_18
gtagagcttgatgtaggcgc

SEQ ID NO: 30222 - DNA, 20 bp, Artificial Sequence
  sgRNA
  Lgr6_19
cagcttaaccaaggatcgaa

SEQ ID NO: 30223 - DNA, 20 bp, Artificial Sequence
  sgRNA
  Lgr6_20
gtaggctcggacgcaggtca

SEQ ID NO: 30224 - DNA, 20 bp, Artificial Sequence
  sgRNA
  Lhcgr_1
tatacataaccaccatacca

SEQ ID NO: 30225 - DNA, 20 bp, Artificial Sequence
  sgRNA
  Lhcgr_2
aacctgctatacattgaacc

SEQ ID NO: 30226 - DNA, 20 bp, Artificial Sequence
  sgRNA
  Lhcgr_3
gtggctagggtaggtcagcg

SEQ ID NO: 30227 - DNA, 20 bp, Artificial Sequence
  sgRNA
  Lhcgr_4
gaccagtcgttataaactga

SEQ ID NO: 30228 - DNA, 20 bp, Artificial Sequence
  sgRNA
  Lhcgr_5
aggtcagcgtggcaaccagt

SEQ ID NO: 30229 - DNA, 20 bp, Artificial Sequence
  sgRNA
  Lhcgr_6
catgccatcccaattatgct

SEQ ID NO: 30230 - DNA, 20 bp, Artificial Sequence
  sgRNA
  Lhcgr_7
gccatcccaattatgctcgg

SEQ ID NO: 30231 - DNA, 20 bp, Artificial Sequence
  sgRNA
  Lhcgr_8
gtgatgggattactttgaca

SEQ ID NO: 30232 - DNA, 20 bp, Artificial Sequence
  sgRNA
  Lhcgr_9
gagttggtgacagtgataag

SEQ ID NO: 30233 - DNA, 20 bp, Artificial Sequence
  sgRNA
  Lhcgr_10
agatcttcgaaacatctggg

SEQ ID NO: 30234 - DNA, 20 bp, Artificial Sequence
  sgRNA
  Lhcgr_11
tatgggctatgccttcctta

SEQ ID NO: 30235 - DNA, 20 bp, Artificial Sequence
  sgRNA
  Lhcgr_12
agattacacatgaggaagcg

SEQ ID NO: 30236 - DNA, 20 bp, Artificial Sequence
  sgRNA
  Lhcgr_13
tgaacactgcgtacagaaat

SEQ ID NO: 30237 - DNA, 20 bp, Artificial Sequence
  sgRNA
  Lhcgr_14
agtcagcatctgcctcccca

SEQ ID NO: 30238 - DNA, 20 bp, Artificial Sequence
  sgRNA
  Lhcgr_15
cgtggcgatgagcgtctgaa

SEQ ID NO: 30239 - DNA, 20 bp, Artificial Sequence
  sgRNA
  Lhcgr_16
aggttgttgacagtgcacta

SEQ ID NO: 30240 - DNA, 20 bp, Artificial Sequence
  sgRNA
  Lhcgr_17
tgtaccttcaactccaaaaa

SEQ ID NO: 30241 - DNA, 20 bp, Artificial Sequence
  sgRNA
  Lhcgr_18
taactgctgacacccacaag

SEQ ID NO: 30242 - DNA, 20 bp, Artificial Sequence
  sgRNA
  Lhcgr_19
gatcttcgaaacatctggga

SEQ ID NO: 30243 - DNA, 20 bp, Artificial Sequence
  sgRNA
  Lhcgr_20
ttagccaaatcaacacccta

SEQ ID NO: 30244 - DNA, 20 bp, Artificial Sequence
  sgRNA
  Lhfpl1_1
cctgtccctagttaccgctg

SEQ ID NO: 30245 - DNA, 20 bp, Artificial Sequence
  sgRNA
  Lhfpl1_2
tcctttaggatggaacagcc

SEQ ID NO: 30246 - DNA, 20 bp, Artificial Sequence
  sgRNA
  Lhfpl1_3
ccagggctgctgataagcgc

SEQ ID NO: 30247 - DNA, 20 bp, Artificial Sequence
  sgRNA
  Lhfpl1_4
ggagatgcaactaccctgtg

SEQ ID NO: 30248 - DNA, 20 bp, Artificial Sequence
  sgRNA
  Lhfpl1_5
gagccaggtgcagatcaaca

SEQ ID NO: 30249 - DNA, 20 bp, Artificial Sequence
  sgRNA
  Lhfpl1_6
tccgggctgttccatcctaa

SEQ ID NO: 30250 - DNA, 20 bp, Artificial Sequence
  sgRNA
  Lhfpl1_7
tttaggatggaacagcccgg

SEQ ID NO: 30251 - DNA, 20 bp, Artificial Sequence
  sgRNA
  Lhfpl1_8
actggccacagcggtaacta

SEQ ID NO: 30252 - DNA, 20 bp, Artificial Sequence
  sgRNA
  Lhfpl1_9
ctgggcctattactgtgctg

SEQ ID NO: 30253 - DNA, 20 bp, Artificial Sequence
  sgRNA
  Lhfpl1_10
agaaggtgcctaccatagta

SEQ ID NO: 30254 - DNA, 20 bp, Artificial Sequence
  sgRNA
  Lhfpl1_11
ccggaggtaatgcaaacatg

SEQ ID NO: 30255 - DNA, 20 bp, Artificial Sequence
  sgRNA
  Lhfpl1_12
gctgggcctattactgtgct

SEQ ID NO: 30256 - DNA, 20 bp, Artificial Sequence
  sgRNA
  Lhfpl1_13
gtgcattatatcctttagga

SEQ ID NO: 30257 - DNA, 20 bp, Artificial Sequence
  sgRNA
  Lhfpl1_14
ggctgtgcattatatccttt

SEQ ID NO: 30258 - DNA, 20 bp, Artificial Sequence
  sgRNA
  Lhfpl1_15
gaggcagtgatcaagctcca

SEQ ID NO: 30259 - DNA, 20 bp, Artificial Sequence
  sgRNA
  Lhfpl1_16
cagccatgttgatctgcacc

SEQ ID NO: 30260 - DNA, 20 bp, Artificial Sequence
  sgRNA
  Lhfpl1_17
actggtagaactggccacag

SEQ ID NO: 30261 - DNA, 20 bp, Artificial Sequence
  sgRNA
  Lhfpl1_18
ataggcccagccgagtctac

SEQ ID NO: 30262 - DNA, 20 bp, Artificial Sequence
  sgRNA
  Lhfpl1_19
ccaccaacataactggcttg

SEQ ID NO: 30263 - DNA, 20 bp, Artificial Sequence
  sgRNA
  Lhfpl1_20
gtctccaatcaatttcagtt

SEQ ID NO: 30264 - DNA, 20 bp, Artificial Sequence
  sgRNA
  Lhfpl4_1
tctaccatgagcactacatg

SEQ ID NO: 30265 - DNA, 20 bp, Artificial Sequence
  sgRNA
  Lhfpl4_2
ctgcttcgccatcatcaacg

SEQ ID NO: 30266 - DNA, 20 bp, Artificial Sequence
  sgRNA
  Lhfpl4_3
acagcccaagacgaggcaca

SEQ ID NO: 30267 - DNA, 20 bp, Artificial Sequence
  sgRNA
  Lhfpl4_4
gaccatccgggacatgtgcg

SEQ ID NO: 30268 - DNA, 20 bp, Artificial Sequence
  sgRNA
  Lhfpl4_5
gcgcactgaacagtccccca

SEQ ID NO: 30269 - DNA, 20 bp, Artificial Sequence
  sgRNA
  Lhfpl4_6
gcaaccgcagatgcaataaa

SEQ ID NO: 30270 - DNA, 20 bp, Artificial Sequence
  sgRNA
  Lhfpl4_7
tgaagtcggtgaaagagccc

SEQ ID NO: 30271 - DNA, 20 bp, Artificial Sequence
  sgRNA
  Lhfpl4_8
gctgcaggaggagctcaaac

SEQ ID NO: 30272 - DNA, 20 bp, Artificial Sequence
  sgRNA
  Lhfpl4_9
ggctgtatgatctttcctga

SEQ ID NO: 30273 - DNA, 20 bp, Artificial Sequence
  sgRNA
  Lhfpl4_10
ggcctcttccactactgcgt

SEQ ID NO: 30274 - DNA, 20 bp, Artificial Sequence
  sgRNA
  Lhfpl4_11
ggccccgcacatgtcccgga

SEQ ID NO: 30275 - DNA, 20 bp, Artificial Sequence
  sgRNA
  Lhfpl4_12
gcgtacattctggccatcat

SEQ ID NO: 30276 - DNA, 20 bp, Artificial Sequence
  sgRNA
  Lhfpl4_13
cggcctcttccactactgcg

SEQ ID NO: 30277 - DNA, 20 bp, Artificial Sequence
  sgRNA
  Lhfpl4_14
agatcatacagcccaagacg

SEQ ID NO: 30278 - DNA, 20 bp, Artificial Sequence
  sgRNA
  Lhfpl4_15
gctgggatgctgagaccatc

SEQ ID NO: 30279 - DNA, 20 bp, Artificial Sequence
  sgRNA
  Lhfpl4_16
agttccgtgctgcggccagg

SEQ ID NO: 30280 - DNA, 20 bp, Artificial Sequence
  sgRNA
  Lhfpl4_17
gcactacatgcggaactcgc

SEQ ID NO: 30281 - DNA, 20 bp, Artificial Sequence
  sgRNA
  Lhfpl4_18
gccgccttgaaggcgctgga

SEQ ID NO: 30282 - DNA, 20 bp, Artificial Sequence
  sgRNA
  Lhfpl4_19
ggaaagcaacacgaagaagg

SEQ ID NO: 30283 - DNA, 20 bp, Artificial Sequence
  sgRNA
  Lhfpl4_20
gagctggcgattcagagcac

SEQ ID NO: 30284 - DNA, 20 bp, Artificial Sequence
  sgRNA
  Lhfpl5_1
acatccgatcattaggcccg

SEQ ID NO: 30285 - DNA, 20 bp, Artificial Sequence
  sgRNA
  Lhfpl5_2
ggcgcaaatcttgtagaccg

SEQ ID NO: 30286 - DNA, 20 bp, Artificial Sequence
  sgRNA
  Lhfpl5_3
aacactgtcgcctatccagt

SEQ ID NO: 30287 - DNA, 20 bp, Artificial Sequence
  sgRNA
  Lhfpl5_4
cagcacgttgcccacgcagt

SEQ ID NO: 30288 - DNA, 20 bp, Artificial Sequence
  sgRNA
  Lhfpl5_5
gatagcccaacacaaaagcc

SEQ ID NO: 30289 - DNA, 20 bp, Artificial Sequence
  sgRNA
  Lhfpl5_6
gggccactgcaccatccgct

SEQ ID NO: 30290 - DNA, 20 bp, Artificial Sequence
  sgRNA
  Lhfpl5_7
acactgtcgcctatccagta

SEQ ID NO: 30291 - DNA, 20 bp, Artificial Sequence
  sgRNA
  Lhfpl5_8
ggatgtctagtctacccaga

SEQ ID NO: 30292 - DNA, 20 bp, Artificial Sequence
  sgRNA
  Lhfpl5_9
cttcgtctgtaatacagcca

SEQ ID NO: 30293 - DNA, 20 bp, Artificial Sequence
  sgRNA
  Lhfpl5_10
ggcttgttctcctactgcgt

SEQ ID NO: 30294 - DNA, 20 bp, Artificial Sequence
  sgRNA
  Lhfpl5_11
ctgccttgtagtcatccggg

SEQ ID NO: 30295 - DNA, 20 bp, Artificial Sequence
  sgRNA
  Lhfpl5_12
gatgataaggaacatggcca

SEQ ID NO: 30296 - DNA, 20 bp, Artificial Sequence
  sgRNA
  Lhfpl5_13
tcgtcggaactcatctgcaa

SEQ ID NO: 30297 - DNA, 20 bp, Artificial Sequence
  sgRNA
  Lhfpl5_14
gttggtgtggtagatcttgg

SEQ ID NO: 30298 - DNA, 20 bp, Artificial Sequence
  sgRNA
  Lhfpl5_15
cgtatgtgtggcgagcagac

SEQ ID NO: 30299 - DNA, 20 bp, Artificial Sequence
  sgRNA
  Lhfpl5_16
tggccagcatgaaggcccag

SEQ ID NO: 30300 - DNA, 20 bp, Artificial Sequence
  sgRNA
  Lhfpl5_17
cgtcggaactcatctgcaag

SEQ ID NO: 30301 - DNA, 20 bp, Artificial Sequence
  sgRNA
  Lhfpl5_18
ttggccatgttccttatcat

SEQ ID NO: 30302 - DNA, 20 bp, Artificial Sequence
  sgRNA
  Lhfpl5_19
ggccaaggccacaaagaaca

SEQ ID NO: 30303 - DNA, 20 bp, Artificial Sequence
  sgRNA
  Lhfpl5_20
cggtctacaagatttgcgcc

SEQ ID NO: 30304 - DNA, 20 bp, Artificial Sequence
  sgRNA
  Lifr_1
cgacgatgtgtacggaacgg

SEQ ID NO: 30305 - DNA, 20 bp, Artificial Sequence
  sgRNA
  Lifr_2
catttgcacgcctaaccggt

SEQ ID NO: 30306 - DNA, 20 bp, Artificial Sequence
  sgRNA
  Lifr_3
tcacagtagagcaagcggtg

SEQ ID NO: 30307 - DNA, 20 bp, Artificial Sequence
  sgRNA
  Lifr_4
tgtttcgtgttcattgaacg

SEQ ID NO: 30308 - DNA, 20 bp, Artificial Sequence
  sgRNA
  Lifr_5
gtttcagaagagcgtctgcg

SEQ ID NO: 30309 - DNA, 20 bp, Artificial Sequence
  sgRNA
  Lifr_6
tgtcgcgccaaatttcaccg

SEQ ID NO: 30310 - DNA, 20 bp, Artificial Sequence
  sgRNA
  Lifr_7
ggttctacagaatccaagga

SEQ ID NO: 30311 - DNA, 20 bp, Artificial Sequence
  sgRNA
  Lifr_8
tgactggtcgcaatccactg

SEQ ID NO: 30312 - DNA, 20 bp, Artificial Sequence
  sgRNA
  Lifr_9
ctcccacttcatcggccgcg

SEQ ID NO: 30313 - DNA, 20 bp, Artificial Sequence
  sgRNA
  Lifr_10
agcttctgaggaacatcggg

SEQ ID NO: 30314 - DNA, 20 bp, Artificial Sequence
  sgRNA
  Lifr_11
tggtctctccagattccccg

SEQ ID NO: 30315 - DNA, 20 bp, Artificial Sequence
  sgRNA
  Lifr_12
ttattgtctaccatccacga

SEQ ID NO: 30316 - DNA, 20 bp, Artificial Sequence
  sgRNA
  Lifr_13
ttaaggttctacagaatcca

SEQ ID NO: 30317 - DNA, 20 bp, Artificial Sequence
  sgRNA
  Lifr_14
ggtccagttccagtgctgaa

SEQ ID NO: 30318 - DNA, 20 bp, Artificial Sequence
  sgRNA
  Lifr_15
ggatgactccaaacctgcca

SEQ ID NO: 30319 - DNA, 20 bp, Artificial Sequence
  sgRNA
  Lifr_16
gagtgagtggcacattgcaa

SEQ ID NO: 30320 - DNA, 20 bp, Artificial Sequence
  sgRNA
  Lifr_17
tttggcttgcggctgataca

SEQ ID NO: 30321 - DNA, 20 bp, Artificial Sequence
  sgRNA
  Lifr_18
atcacagtagagcaagcggt

SEQ ID NO: 30322 - DNA, 20 bp, Artificial Sequence
  sgRNA
  Lifr_19
ctactgaagtggaacgacag

SEQ ID NO: 30323 - DNA, 20 bp, Artificial Sequence
  sgRNA
  Lifr_20
gaacctttctccagtccagg

SEQ ID NO: 30324 - DNA, 20 bp, Artificial Sequence
  sgRNA
  Lilr4b_1
gtgagtccagggtccacgag

SEQ ID NO: 30325 - DNA, 20 bp, Artificial Sequence
  sgRNA
  Lilr4b_2
acaaaatgaagaccccccca

SEQ ID NO: 30326 - DNA, 20 bp, Artificial Sequence
  sgRNA
  Lilr4b_3
gcgtacacaattccctgggg

SEQ ID NO: 30327 - DNA, 20 bp, Artificial Sequence
  sgRNA
  Lilr4b_4
ggaggcccagtattattatc

SEQ ID NO: 30328 - DNA, 20 bp, Artificial Sequence
  sgRNA
  Lilr4b_5
ccagtgtcgtcacaaaaata

SEQ ID NO: 30329 - DNA, 20 bp, Artificial Sequence
  sgRNA
  Lilr4b_6
ataataatactgggcctccc

SEQ ID NO: 30330 - DNA, 20 bp, Artificial Sequence
  sgRNA
  Lilr4b_7
gggtgtacaggactgttcct

SEQ ID NO: 30331 - DNA, 20 bp, Artificial Sequence
  sgRNA
  Lilr4b_8
gacgacactggtatccgatg

SEQ ID NO: 30332 - DNA, 20 bp, Artificial Sequence
  sgRNA
  Lilr4b_9
gggcgtacacaattccctgg

SEQ ID NO: 30333 - DNA, 20 bp, Artificial Sequence
  sgRNA
  Lilr4b_10
agaacaaaagtagcatgggt

SEQ ID NO: 30334 - DNA, 20 bp, Artificial Sequence
  sgRNA
  Lilr4b_11
ctgatacaggaaggaaagca

SEQ ID NO: 30335 - DNA, 20 bp, Artificial Sequence
  sgRNA
  Lilr4b_12
gctgttgctcccaaccacaa

SEQ ID NO: 30336 - DNA, 20 bp, Artificial Sequence
  sgRNA
  Lilr4b_13
agagggacttcagtgtccca

SEQ ID NO: 30337 - DNA, 20 bp, Artificial Sequence
  sgRNA
  Lilr4b_14
tttatgacagcctcatatgc

SEQ ID NO: 30338 - DNA, 20 bp, Artificial Sequence
  sgRNA
  Lilr4b_15
agattcattctgatacagga

SEQ ID NO: 30339 - DNA, 20 bp, Artificial Sequence
  sgRNA
  Lilr4b_16
ttgggacactgaagtccctc

SEQ ID NO: 30340 - DNA, 20 bp, Artificial Sequence
  sgRNA
  Lilr4b_17
cacaaaatgaagaccccccc

SEQ ID NO: 30341 - DNA, 20 bp, Artificial Sequence
  sgRNA
  Lilr4b_18
aatgaatctgccaaatagtg

SEQ ID NO: 30342 - DNA, 20 bp, Artificial Sequence
  sgRNA
  Lilr4b_19
tgcagctcatccacactatt

SEQ ID NO: 30343 - DNA, 20 bp, Artificial Sequence
  sgRNA
  Lilr4b_20
ggcgtacacaattccctggg

SEQ ID NO: 30344 - DNA, 20 bp, Artificial Sequence
  sgRNA
  Lilra5_1
caattgaacaacgatctggg

SEQ ID NO: 30345 - DNA, 20 bp, Artificial Sequence
  sgRNA
  Lilra5_2
taccgtctttataaagaggg

SEQ ID NO: 30346 - DNA, 20 bp, Artificial Sequence
  sgRNA
  Lilra5_3
gggccaagagacctccatgt

SEQ ID NO: 30347 - DNA, 20 bp, Artificial Sequence
  sgRNA
  Lilra5_4
cagagtttataaactctacg

SEQ ID NO: 30348 - DNA, 20 bp, Artificial Sequence
  sgRNA
  Lilra5_5
cagtgttgagacacactgaa

SEQ ID NO: 30349 - DNA, 20 bp, Artificial Sequence
  sgRNA
  Lilra5_6
ctatcatgtcaacagccccc

SEQ ID NO: 30350 - DNA, 20 bp, Artificial Sequence
  sgRNA
  Lilra5_7
tgtatttccaagagatcgct

SEQ ID NO: 30351 - DNA, 20 bp, Artificial Sequence
  sgRNA
  Lilra5_8
ctgtgctctgaccacccagt

SEQ ID NO: 30352 - DNA, 20 bp, Artificial Sequence
  sgRNA
  Lilra5_9
tcgaagctcagcacagccaa

SEQ ID NO: 30353 - DNA, 20 bp, Artificial Sequence
  sgRNA
  Lilra5_10
acagccccagaattacacaa

SEQ ID NO: 30354 - DNA, 20 bp, Artificial Sequence
  sgRNA
  Lilra5_11
gttactataagacccccact

SEQ ID NO: 30355 - DNA, 20 bp, Artificial Sequence
  sgRNA
  Lilra5_12
cctgaattcacaacattgct

SEQ ID NO: 30356 - DNA, 20 bp, Artificial Sequence
  sgRNA
  Lilra5_13
gatggtcacctgcttccctt

SEQ ID NO: 30357 - DNA, 20 bp, Artificial Sequence
  sgRNA
  Lilra5_14
tcaattgaacaacgatctgg

SEQ ID NO: 30358 - DNA, 20 bp, Artificial Sequence
  sgRNA
  Lilra5_15
cagcaatgttgtgaattcag

SEQ ID NO: 30359 - DNA, 20 bp, Artificial Sequence
  sgRNA
  Lilra5_16
ggaataccgtctttataaag

SEQ ID NO: 30360 - DNA, 20 bp, Artificial Sequence
  sgRNA
  Lilra5_17
ataccgtctttataaagagg

SEQ ID NO: 30361 - DNA, 20 bp, Artificial Sequence
  sgRNA
  Lilra5_18
aactctacggggcaattcca

SEQ ID NO: 30362 - DNA, 20 bp, Artificial Sequence
  sgRNA
  Lilra5_19
ggcccacagtaaataggccc

SEQ ID NO: 30363 - DNA, 20 bp, Artificial Sequence
  sgRNA
  Lilra5_20
ccgtgacccccagtcaaagg

SEQ ID NO: 30364 - DNA, 20 bp, Artificial Sequence
  sgRNA
  Lilra6_1
ctgtcactactagcaccagg

SEQ ID NO: 30365 - DNA, 20 bp, Artificial Sequence
  sgRNA
  Lilra6_2
acaagaataccccattactg

SEQ ID NO: 30366 - DNA, 20 bp, Artificial Sequence
  sgRNA
  Lilra6_3
agtgaccatgtgaggcacag

SEQ ID NO: 30367 - DNA, 20 bp, Artificial Sequence
  sgRNA
  Lilra6_4
cagactctgtggtccaagtg

SEQ ID NO: 30368 - DNA, 20 bp, Artificial Sequence
  sgRNA
  Lilra6_5
cctgagatcaggatgtccag

SEQ ID NO: 30369 - DNA, 20 bp, Artificial Sequence
  sgRNA
  Lilra6_6
aggtactgaccacagtaatg

SEQ ID NO: 30370 - DNA, 20 bp, Artificial Sequence
  sgRNA
  Lilra6_7
catgttgtcgtctcacagaa

SEQ ID NO: 30371 - DNA, 20 bp, Artificial Sequence
  sgRNA
  Lilra6_8
ctgtgagacgacaacatgca

SEQ ID NO: 30372 - DNA, 20 bp, Artificial Sequence
  sgRNA
  Lilra6_9
gatggtcattgctctcttgg

SEQ ID NO: 30373 - DNA, 20 bp, Artificial Sequence
  sgRNA
  Lilra6_10
cacagtataacatctctaca

SEQ ID NO: 30374 - DNA, 20 bp, Artificial Sequence
  sgRNA
  Lilra6_11
ctaggtactgaccacagtaa

SEQ ID NO: 30375 - DNA, 20 bp, Artificial Sequence
  sgRNA
  Lilra6_12
ttgagcaccatagcacctgt

SEQ ID NO: 30376 - DNA, 20 bp, Artificial Sequence
  sgRNA
  Lilra6_13
ctgagatcaggatgtccagg

SEQ ID NO: 30377 - DNA, 20 bp, Artificial Sequence
  sgRNA
  Lilra6_14
cctgtcactactagcaccag

SEQ ID NO: 30378 - DNA, 20 bp, Artificial Sequence
  sgRNA
  Lilra6_15
gcctggttcagctttgatgg

SEQ ID NO: 30379 - DNA, 20 bp, Artificial Sequence
  sgRNA
  Lilra6_16
accaccatcaaagctgaacc

SEQ ID NO: 30380 - DNA, 20 bp, Artificial Sequence
  sgRNA
  Lilra6_17
aggtcaccttagtccacact

SEQ ID NO: 30381 - DNA, 20 bp, Artificial Sequence
  sgRNA
  Lilra6_18
tatgtgagtagctacactgg

SEQ ID NO: 30382 - DNA, 20 bp, Artificial Sequence
  sgRNA
  Lilra6_19
cggagaatctgatcaggatg

SEQ ID NO: 30383 - DNA, 20 bp, Artificial Sequence
  sgRNA
  Lilra6_20
gcatgttgtcgtctcacaga

SEQ ID NO: 30384 - DNA, 20 bp, Artificial Sequence
  sgRNA
  Lilrb4a_1
ccagggaattgtctacgccc

SEQ ID NO: 30385 - DNA, 20 bp, Artificial Sequence
  sgRNA
  Lilrb4a_2
agaacaaaagtagcatagga

SEQ ID NO: 30386 - DNA, 20 bp, Artificial Sequence
  sgRNA
  Lilrb4a_3
ccacaaaatgaagaccccca

SEQ ID NO: 30387 - DNA, 20 bp, Artificial Sequence
  sgRNA
  Lilrb4a_4
tgggcgtagacaattccctg

SEQ ID NO: 30388 - DNA, 20 bp, Artificial Sequence
  sgRNA
  Lilrb4a_5
gggcgtagacaattccctgg

SEQ ID NO: 30389 - DNA, 20 bp, Artificial Sequence
  sgRNA
  Lilrb4a_6
tcctcatcggataccagtat

SEQ ID NO: 30390 - DNA, 20 bp, Artificial Sequence
  sgRNA
  Lilrb4a_7
ctgggcgtagacaattccct

SEQ ID NO: 30391 - DNA, 20 bp, Artificial Sequence
  sgRNA
  Lilrb4a_8
gcccatactggtatccgatg

SEQ ID NO: 30392 - DNA, 20 bp, Artificial Sequence
  sgRNA
  Lilrb4a_9
gctgttactcccaaccacaa

SEQ ID NO: 30393 - DNA, 20 bp, Artificial Sequence
  sgRNA
  Lilrb4a_10
gcatggcctctcttggaccc

SEQ ID NO: 30394 - DNA, 20 bp, Artificial Sequence
  sgRNA
  Lilrb4a_11
agagggacttgagtgtccca

SEQ ID NO: 30395 - DNA, 20 bp, Artificial Sequence
  sgRNA
  Lilrb4a_12
aaaaccctccaggcttcaga

SEQ ID NO: 30396 - DNA, 20 bp, Artificial Sequence
  sgRNA
  Lilrb4a_13
ccttattcctggtttccaga

SEQ ID NO: 30397 - DNA, 20 bp, Artificial Sequence
  sgRNA
  Lilrb4a_14
gccttattcctggtttccag

SEQ ID NO: 30398 - DNA, 20 bp, Artificial Sequence
  sgRNA
  Lilrb4a_15
tgcagctcatccatagtatt

SEQ ID NO: 30399 - DNA, 20 bp, Artificial Sequence
  sgRNA
  Lilrb4a_16
tcctctacacccactgaaga

SEQ ID NO: 30400 - DNA, 20 bp, Artificial Sequence
  sgRNA
  Lilrb4a_17
aatgaatctgccaaatacta

SEQ ID NO: 30401 - DNA, 20 bp, Artificial Sequence
  sgRNA
  Lilrb4a_18
agtagcataggatggctgat

SEQ ID NO: 30402 - DNA, 20 bp, Artificial Sequence
  sgRNA
  Lilrb4a_19
gcatatgaggttgtcatgct

SEQ ID NO: 30403 - DNA, 20 bp, Artificial Sequence
  sgRNA
  Lilrb4a_20
ttgggacactcaagtccctc

SEQ ID NO: 30404 - DNA, 20 bp, Artificial Sequence
  sgRNA
  Lim2_1
tgatgcccgaggtggcacac

SEQ ID NO: 30405 - DNA, 20 bp, Artificial Sequence
  sgRNA
  Lim2_2
ggaggcaaaaaacatgatgc

SEQ ID NO: 30406 - DNA, 20 bp, Artificial Sequence
  sgRNA
  Lim2_3
tcggggtccttcgcacacca

SEQ ID NO: 30407 - DNA, 20 bp, Artificial Sequence
  sgRNA
  Lim2_4
ggtggcattccaatatgctg

SEQ ID NO: 30408 - DNA, 20 bp, Artificial Sequence
  sgRNA
  Lim2_5
gcggcggccgaggaaactga

SEQ ID NO: 30409 - DNA, 20 bp, Artificial Sequence
  sgRNA
  Lim2_6
ccggcactcatgcatccggt

SEQ ID NO: 30410 - DNA, 20 bp, Artificial Sequence
  sgRNA
  Lim2_7
gacacccatgatgatgcccg

SEQ ID NO: 30411 - DNA, 20 bp, Artificial Sequence
  sgRNA
  Lim2_8
agcgccagtctccaaagcgg

SEQ ID NO: 30412 - DNA, 20 bp, Artificial Sequence
  sgRNA
  Lim2_9
gccacctcgggcatcatcat

SEQ ID NO: 30413 - DNA, 20 bp, Artificial Sequence
  sgRNA
  Lim2_10
tagccacagcaactgaccac

SEQ ID NO: 30414 - DNA, 20 bp, Artificial Sequence
  sgRNA
  Lim2_11
gactccagtgtaaatagcca

SEQ ID NO: 30415 - DNA, 20 bp, Artificial Sequence
  sgRNA
  Lim2_12
gaaggtggattgctgcgcaa

SEQ ID NO: 30416 - DNA, 20 bp, Artificial Sequence
  sgRNA
  Lim2_13
tgtggctaccaccaacagga

SEQ ID NO: 30417 - DNA, 20 bp, Artificial Sequence
  sgRNA
  Lim2_14
gatgcccgaggtggcacaca

SEQ ID NO: 30418 - DNA, 20 bp, Artificial Sequence
  sgRNA
  Lim2_15
acagccggtactgcatccag

SEQ ID NO: 30419 - DNA, 20 bp, Artificial Sequence
  sgRNA
  Lim2_16
ggatgcagtaccggctgtcg

SEQ ID NO: 30420 - DNA, 20 bp, Artificial Sequence
  sgRNA
  Lim2_17
agtctccaaagcggcggccg

SEQ ID NO: 30421 - DNA, 20 bp, Artificial Sequence
  sgRNA
  Lim2_18
cctaccggatgcatgagtgc

SEQ ID NO: 30422 - DNA, 20 bp, Artificial Sequence
  sgRNA
  Lim2_19
tgcaaagaaggtcatgagca

SEQ ID NO: 30423 - DNA, 20 bp, Artificial Sequence
  sgRNA
  Lim2_20
aacatgatgccggcagagaa

SEQ ID NO: 30424 - DNA, 20 bp, Artificial Sequence
  sgRNA
  Lingo1_1
atgcctgcgtccgatttccg

SEQ ID NO: 30425 - DNA, 20 bp, Artificial Sequence
  sgRNA
  Lingo1_2
agatctctaagaccttaagt

SEQ ID NO: 30426 - DNA, 20 bp, Artificial Sequence
  sgRNA
  Lingo1_3
ccaccgcaaacgctttgtgg

SEQ ID NO: 30427 - DNA, 20 bp, Artificial Sequence
  sgRNA
  Lingo1_4
gtagctgcgcacatgcaagt

SEQ ID NO: 30428 - DNA, 20 bp, Artificial Sequence
  sgRNA
  Lingo1_5
gccacacctgagttcgtcca

SEQ ID NO: 30429 - DNA, 20 bp, Artificial Sequence
  sgRNA
  Lingo1_6
aacccaatcggtacaatcga

SEQ ID NO: 30430 - DNA, 20 bp, Artificial Sequence
  sgRNA
  Lingo1_7
gtttgtagatgagggccaca

SEQ ID NO: 30431 - DNA, 20 bp, Artificial Sequence
  sgRNA
  Lingo1_8
tctccaggttgcccaccgaa

SEQ ID NO: 30432 - DNA, 20 bp, Artificial Sequence
  sgRNA
  Lingo1_9
tgaaaacatcgtgagcgccg

SEQ ID NO: 30433 - DNA, 20 bp, Artificial Sequence
  sgRNA
  Lingo1_10
ggcagaataggacaacgccc

SEQ ID NO: 30434 - DNA, 20 bp, Artificial Sequence
  sgRNA
  Lingo1_11
gagtcagccttccattcggt

SEQ ID NO: 30435 - DNA, 20 bp, Artificial Sequence
  sgRNA
  Lingo1_12
gaggcgctctcccacctgca

SEQ ID NO: 30436 - DNA, 20 bp, Artificial Sequence
  sgRNA
  Lingo1_13
aggccggtgaagacgcccag

SEQ ID NO: 30437 - DNA, 20 bp, Artificial Sequence
  sgRNA
  Lingo1_14
ggaggagtcagccttccatt

SEQ ID NO: 30438 - DNA, 20 bp, Artificial Sequence
  sgRNA
  Lingo1_15
tgttgaagttgagccgccag

SEQ ID NO: 30439 - DNA, 20 bp, Artificial Sequence
  sgRNA
  Lingo1_16
cctgcgctgagcactcgcag

SEQ ID NO: 30440 - DNA, 20 bp, Artificial Sequence
  sgRNA
  Lingo1_17
gctttgtgttgcctttgccc

SEQ ID NO: 30441 - DNA, 20 bp, Artificial Sequence
  sgRNA
  Lingo1_18
gccaaaggatagctggtgga

SEQ ID NO: 30442 - DNA, 20 bp, Artificial Sequence
  sgRNA
  Lingo1_19
gagccctcgattgtaccgat

SEQ ID NO: 30443 - DNA, 20 bp, Artificial Sequence
  sgRNA
  Lingo1_20
tcaacaacctcttcaacctg

SEQ ID NO: 30444 - DNA, 20 bp, Artificial Sequence
  sgRNA
  Lingo2_1
acaggagcttcatatagtgg

SEQ ID NO: 30445 - DNA, 20 bp, Artificial Sequence
  sgRNA
  Lingo2_2
atttagtgtatatctcacac

SEQ ID NO: 30446 - DNA, 20 bp, Artificial Sequence
  sgRNA
  Lingo2_3
tggtgattgaaagggacgtg

SEQ ID NO: 30447 - DNA, 20 bp, Artificial Sequence
  sgRNA
  Lingo2_4
cttaaatgatctctcacgga

SEQ ID NO: 30448 - DNA, 20 bp, Artificial Sequence
  sgRNA
  Lingo2_5
tatgtgccccgaaaaaacaa

SEQ ID NO: 30449 - DNA, 20 bp, Artificial Sequence
  sgRNA
  Lingo2_6
gtgtctggcccagcacacat

SEQ ID NO: 30450 - DNA, 20 bp, Artificial Sequence
  sgRNA
  Lingo2_7
gctgctggcccccaaactgc

SEQ ID NO: 30451 - DNA, 20 bp, Artificial Sequence
  sgRNA
  Lingo2_8
ggtgccatcacccaacacag

SEQ ID NO: 30452 - DNA, 20 bp, Artificial Sequence
  sgRNA
  Lingo2_9
atacaaggtgtttaaaggcg

SEQ ID NO: 30453 - DNA, 20 bp, Artificial Sequence
  sgRNA
  Lingo2_10
gtggtgataaaacgccttcg

SEQ ID NO: 30454 - DNA, 20 bp, Artificial Sequence
  sgRNA
  Lingo2_11
cgattgctcgcgatcccaga

SEQ ID NO: 30455 - DNA, 20 bp, Artificial Sequence
  sgRNA
  Lingo2_12
gcatcgcgagcaacgctgct

SEQ ID NO: 30456 - DNA, 20 bp, Artificial Sequence
  sgRNA
  Lingo2_13
ccactatatgaagctcctgt

SEQ ID NO: 30457 - DNA, 20 bp, Artificial Sequence
  sgRNA
  Lingo2_14
ggtgtcacccaggaaatcac

SEQ ID NO: 30458 - DNA, 20 bp, Artificial Sequence
  sgRNA
  Lingo2_15
gctgtggtgttactcttaat

SEQ ID NO: 30459 - DNA, 20 bp, Artificial Sequence
  sgRNA
  Lingo2_16
ctatatgaagctcctgtagg

SEQ ID NO: 30460 - DNA, 20 bp, Artificial Sequence
  sgRNA
  Lingo2_17
tttagtgtatatctcacaca

SEQ ID NO: 30461 - DNA, 20 bp, Artificial Sequence
  sgRNA
  Lingo2_18
gtaacaccacagccagaccc

SEQ ID NO: 30462 - DNA, 20 bp, Artificial Sequence
  sgRNA
  Lingo2_19
atactggtatctacagccat

SEQ ID NO: 30463 - DNA, 20 bp, Artificial Sequence
  sgRNA
  Lingo2_20
gtccctttaggagtattcac

SEQ ID NO: 30464 - DNA, 20 bp, Artificial Sequence
  sgRNA
  Lingo3_1
caggtgacccagcgactccg

SEQ ID NO: 30465 - DNA, 20 bp, Artificial Sequence
  sgRNA
  Lingo3_2
gtgtgatggacaacgacgtg

SEQ ID NO: 30466 - DNA, 20 bp, Artificial Sequence
  sgRNA
  Lingo3_3
gattgcccacgtggaacctg

SEQ ID NO: 30467 - DNA, 20 bp, Artificial Sequence
  sgRNA
  Lingo3_4
cccatcagcatggtgccacg

SEQ ID NO: 30468 - DNA, 20 bp, Artificial Sequence
  sgRNA
  Lingo3_5
ggaggagaacacattccact

SEQ ID NO: 30469 - DNA, 20 bp, Artificial Sequence
  sgRNA
  Lingo3_6
tctcgagcgtgttcaccgag

SEQ ID NO: 30470 - DNA, 20 bp, Artificial Sequence
  sgRNA
  Lingo3_7
gcagcatgtgaccgccaccg

SEQ ID NO: 30471 - DNA, 20 bp, Artificial Sequence
  sgRNA
  Lingo3_8
tgtggaatattccttccgta

SEQ ID NO: 30472 - DNA, 20 bp, Artificial Sequence
  sgRNA
  Lingo3_9
agttattcttgtgctgtccg

SEQ ID NO: 30473 - DNA, 20 bp, Artificial Sequence
  sgRNA
  Lingo3_10
agatgcgtgaacacgcctgg

SEQ ID NO: 30474 - DNA, 20 bp, Artificial Sequence
  sgRNA
  Lingo3_11
ccgtaaggtggacggtccgg

SEQ ID NO: 30475 - DNA, 20 bp, Artificial Sequence
  sgRNA
  Lingo3_12
aggtctctgaaggagccgcg

SEQ ID NO: 30476 - DNA, 20 bp, Artificial Sequence
  sgRNA
  Lingo3_13
ggctggcagccgtaaccgag

SEQ ID NO: 30477 - DNA, 20 bp, Artificial Sequence
  sgRNA
  Lingo3_14
gcgatggtcagggtgccccc

SEQ ID NO: 30478 - DNA, 20 bp, Artificial Sequence
  sgRNA
  Lingo3_15
ttcttgtgtccaccgccatg

SEQ ID NO: 30479 - DNA, 20 bp, Artificial Sequence
  sgRNA
  Lingo3_16
cggaccgtccaccttacgga

SEQ ID NO: 30480 - DNA, 20 bp, Artificial Sequence
  sgRNA
  Lingo3_17
ccagcatgcgagtttcggcc

SEQ ID NO: 30481 - DNA, 20 bp, Artificial Sequence
  sgRNA
  Lingo3_18
gtactcgaagagcacagagt

SEQ ID NO: 30482 - DNA, 20 bp, Artificial Sequence
  sgRNA
  Lingo3_19
gatctgtcgcagccccacga

SEQ ID NO: 30483 - DNA, 20 bp, Artificial Sequence
  sgRNA
  Lingo3_20
gcaacgaggccaggtcccca

SEQ ID NO: 30484 - DNA, 20 bp, Artificial Sequence
  sgRNA
  Lingo4_1
catgagcagcgattgaggtg

SEQ ID NO: 30485 - DNA, 20 bp, Artificial Sequence
  sgRNA
  Lingo4_2
caagttaagtaccatcactc

SEQ ID NO: 30486 - DNA, 20 bp, Artificial Sequence
  sgRNA
  Lingo4_3
gaatactgcccgggtctggg

SEQ ID NO: 30487 - DNA, 20 bp, Artificial Sequence
  sgRNA
  Lingo4_4
tacaaagtctactcaccctg

SEQ ID NO: 30488 - DNA, 20 bp, Artificial Sequence
  sgRNA
  Lingo4_5
tgtcccgcagctgtaccgag

SEQ ID NO: 30489 - DNA, 20 bp, Artificial Sequence
  sgRNA
  Lingo4_6
tggtacactggagatccgct

SEQ ID NO: 30490 - DNA, 20 bp, Artificial Sequence
  sgRNA
  Lingo4_7
aatagtgtccagtcgcctgt

SEQ ID NO: 30491 - DNA, 20 bp, Artificial Sequence
  sgRNA
  Lingo4_8
gctcctggagccgtaccagg

SEQ ID NO: 30492 - DNA, 20 bp, Artificial Sequence
  sgRNA
  Lingo4_9
cgactggacactattcccgg

SEQ ID NO: 30493 - DNA, 20 bp, Artificial Sequence
  sgRNA
  Lingo4_10
ggacaatctgattgaggcgg

SEQ ID NO: 30494 - DNA, 20 bp, Artificial Sequence
  sgRNA
  Lingo4_11
gagatagatccaagatccgg

SEQ ID NO: 30495 - DNA, 20 bp, Artificial Sequence
  sgRNA
  Lingo4_12
tcgattgccctgcagcctca

SEQ ID NO: 30496 - DNA, 20 bp, Artificial Sequence
  sgRNA
  Lingo4_13
atgtgccgaagtccaggcgg

SEQ ID NO: 30497 - DNA, 20 bp, Artificial Sequence
  sgRNA
  Lingo4_14
gagctcctggagccgtacca

SEQ ID NO: 30498 - DNA, 20 bp, Artificial Sequence
  sgRNA
  Lingo4_15
accccaacatcactatgcca

SEQ ID NO: 30499 - DNA, 20 bp, Artificial Sequence
  sgRNA
  Lingo4_16
gatattgagaggctaccagc

SEQ ID NO: 30500 - DNA, 20 bp, Artificial Sequence
  sgRNA
  Lingo4_17
gtgggcacagaatactgccc

SEQ ID NO: 30501 - DNA, 20 bp, Artificial Sequence
  sgRNA
  Lingo4_18
aggtgcagtcacacacagtg

SEQ ID NO: 30502 - DNA, 20 bp, Artificial Sequence
  sgRNA
  Lingo4_19
gttgcaacgttccagagtga

SEQ ID NO: 30503 - DNA, 20 bp, Artificial Sequence
  sgRNA
  Lingo4_20
cttcctagccaagctccctg

SEQ ID NO: 30504 - DNA, 20 bp, Artificial Sequence
  sgRNA
  Lman2_1
gcaaatgtagaaatgtcgtg

SEQ ID NO: 30505 - DNA, 20 bp, Artificial Sequence
  sgRNA
  Lman2_2
atctcggtgatggtgaacaa

SEQ ID NO: 30506 - DNA, 20 bp, Artificial Sequence
  sgRNA
  Lman2_3
cccgggaatagcgtacagct

SEQ ID NO: 30507 - DNA, 20 bp, Artificial Sequence
  sgRNA
  Lman2_4
acttcaaagtccatggcaca

SEQ ID NO: 30508 - DNA, 20 bp, Artificial Sequence
  sgRNA
  Lman2_5
gcaacagcgaacacctcaag

SEQ ID NO: 30509 - DNA, 20 bp, Artificial Sequence
  sgRNA
  Lman2_6
gtggctgcggatatcaccga

SEQ ID NO: 30510 - DNA, 20 bp, Artificial Sequence
  sgRNA
  Lman2_7
ccaggaagatggccaaacca

SEQ ID NO: 30511 - DNA, 20 bp, Artificial Sequence
  sgRNA
  Lman2_8
tgttccagctcacggtggag

SEQ ID NO: 30512 - DNA, 20 bp, Artificial Sequence
  sgRNA
  Lman2_9
gttcccgtacatctcggtga

SEQ ID NO: 30513 - DNA, 20 bp, Artificial Sequence
  sgRNA
  Lman2_10
tgggcccctgacaggatgga

SEQ ID NO: 30514 - DNA, 20 bp, Artificial Sequence
  sgRNA
  Lman2_11
ctattcccggggccgcctca

SEQ ID NO: 30515 - DNA, 20 bp, Artificial Sequence
  sgRNA
  Lman2_12
ggaagcaaagacaacttcca

SEQ ID NO: 30516 - DNA, 20 bp, Artificial Sequence
  sgRNA
  Lman2_13
ctagctgtacgctattcccg

SEQ ID NO: 30517 - DNA, 20 bp, Artificial Sequence
  sgRNA
  Lman2_14
atgccgctctgggacttcca

SEQ ID NO: 30518 - DNA, 20 bp, Artificial Sequence
  sgRNA
  Lman2_15
agaactgcattgacatcaca

SEQ ID NO: 30519 - DNA, 20 bp, Artificial Sequence
  sgRNA
  Lman2_16
acctggaagacaagaacgag

SEQ ID NO: 30520 - DNA, 20 bp, Artificial Sequence
  sgRNA
  Lman2_17
ggaatagcgtacagctagga

SEQ ID NO: 30521 - DNA, 20 bp, Artificial Sequence
  sgRNA
  Lman2_18
tcaccatcaccgagatgtac

SEQ ID NO: 30522 - DNA, 20 bp, Artificial Sequence
  sgRNA
  Lman2_19
tcggtgatatccgcagccac

SEQ ID NO: 30523 - DNA, 20 bp, Artificial Sequence
  sgRNA
  Lman2_20
gctccaaagtagtagccagt

SEQ ID NO: 30524 - DNA, 20 bp, Artificial Sequence
  sgRNA
  Lman2l_1
tcttgacatagcgaatcacg

SEQ ID NO: 30525 - DNA, 20 bp, Artificial Sequence
  sgRNA
  Lman2l_2
tcttaccacccggttccaca

SEQ ID NO: 30526 - DNA, 20 bp, Artificial Sequence
  sgRNA
  Lman2l_3
tcgctgtcgaagccctacca

SEQ ID NO: 30527 - DNA, 20 bp, Artificial Sequence
  sgRNA
  Lman2l_4
cttggcaatctggtacacaa

SEQ ID NO: 30528 - DNA, 20 bp, Artificial Sequence
  sgRNA
  Lman2l_5
gtgccgaagtaatagccccg

SEQ ID NO: 30529 - DNA, 20 bp, Artificial Sequence
  sgRNA
  Lman2l_6
gcaacctcctctctaagcac

SEQ ID NO: 30530 - DNA, 20 bp, Artificial Sequence
  sgRNA
  Lman2l_7
cggcttcgagaccctcctgg

SEQ ID NO: 30531 - DNA, 20 bp, Artificial Sequence
  sgRNA
  Lman2l_8
acttcaagattcacggccaa

SEQ ID NO: 30532 - DNA, 20 bp, Artificial Sequence
  sgRNA
  Lman2l_9
agagagatccccagtaatgg

SEQ ID NO: 30533 - DNA, 20 bp, Artificial Sequence
  sgRNA
  Lman2l_10
tgtcagggcgggtcaagcgg

SEQ ID NO: 30534 - DNA, 20 bp, Artificial Sequence
  sgRNA
  Lman2l_11
ggactgcattgagatgcccg

SEQ ID NO: 30535 - DNA, 20 bp, Artificial Sequence
  sgRNA
  Lman2l_12
tcttcgctatggaacctgat

SEQ ID NO: 30536 - DNA, 20 bp, Artificial Sequence
  sgRNA
  Lman2l_13
ccagatatgcaaagtaaaca

SEQ ID NO: 30537 - DNA, 20 bp, Artificial Sequence
  sgRNA
  Lman2l_14
ccctcagctatgatcacgag

SEQ ID NO: 30538 - DNA, 20 bp, Artificial Sequence
  sgRNA
  Lman2l_15
gagggagccgttgttcacca

SEQ ID NO: 30539 - DNA, 20 bp, Artificial Sequence
  sgRNA
  Lman2l_16
cggcacttcctccattactg

SEQ ID NO: 30540 - DNA, 20 bp, Artificial Sequence
  sgRNA
  Lman2l_17
gatgtactgtgtcatcacca

SEQ ID NO: 30541 - DNA, 20 bp, Artificial Sequence
  sgRNA
  Lman2l_18
cctcagctatgatcacgagc

SEQ ID NO: 30542 - DNA, 20 bp, Artificial Sequence
  sgRNA
  Lman2l_19
gctatgatcacgagcgggat

SEQ ID NO: 30543 - DNA, 20 bp, Artificial Sequence
  sgRNA
  Lman2l_20
tgacccgccctgacatgccg

SEQ ID NO: 30544 - DNA, 20 bp, Artificial Sequence
  sgRNA
  Lmbr1_1
aatagggctatcttcatcgg

SEQ ID NO: 30545 - DNA, 20 bp, Artificial Sequence
  sgRNA
  Lmbr1_2
tgtatactaaccgtggatga

SEQ ID NO: 30546 - DNA, 20 bp, Artificial Sequence
  sgRNA
  Lmbr1_3
gaatattgcacgccaccagg

SEQ ID NO: 30547 - DNA, 20 bp, Artificial Sequence
  sgRNA
  Lmbr1_4
gtaggaaacgatgtagagaa

SEQ ID NO: 30548 - DNA, 20 bp, Artificial Sequence
  sgRNA
  Lmbr1_5
gagaggcacttcctatgccg

SEQ ID NO: 30549 - DNA, 20 bp, Artificial Sequence
  sgRNA
  Lmbr1_6
agcatcactgtcaatcaggg

SEQ ID NO: 30550 - DNA, 20 bp, Artificial Sequence
  sgRNA
  Lmbr1_7
gagactttggaagatttaat

SEQ ID NO: 30551 - DNA, 20 bp, Artificial Sequence
  sgRNA
  Lmbr1_8
tggactctcgcacttggctg

SEQ ID NO: 30552 - DNA, 20 bp, Artificial Sequence
  sgRNA
  Lmbr1_9
tgtagtttctgaatcccttg

SEQ ID NO: 30553 - DNA, 20 bp, Artificial Sequence
  sgRNA
  Lmbr1_10
cctgtgatgtccagaacact

SEQ ID NO: 30554 - DNA, 20 bp, Artificial Sequence
  sgRNA
  Lmbr1_11
agaaggagaaccataacagc

SEQ ID NO: 30555 - DNA, 20 bp, Artificial Sequence
  sgRNA
  Lmbr1_12
tcacttgtcagatacctcaa

SEQ ID NO: 30556 - DNA, 20 bp, Artificial Sequence
  sgRNA
  Lmbr1_13
tcattgctgatgattgagaa

SEQ ID NO: 30557 - DNA, 20 bp, Artificial Sequence
  sgRNA
  Lmbr1_14
gatgagactgcaatgccaaa

SEQ ID NO: 30558 - DNA, 20 bp, Artificial Sequence
  sgRNA
  Lmbr1_15
gctgattcttgggatggtgt

SEQ ID NO: 30559 - DNA, 20 bp, Artificial Sequence
  sgRNA
  Lmbr1_16
tgcgttgctgattcttggga

SEQ ID NO: 30560 - DNA, 20 bp, Artificial Sequence
  sgRNA
  Lmbr1_17
gatggcgaagagtaaattgt

SEQ ID NO: 30561 - DNA, 20 bp, Artificial Sequence
  sgRNA
  Lmbr1_18
ttgcagtctcatcaaccagc

SEQ ID NO: 30562 - DNA, 20 bp, Artificial Sequence
  sgRNA
  Lmbr1_19
gtccatttcagtcctcctgg

SEQ ID NO: 30563 - DNA, 20 bp, Artificial Sequence
  sgRNA
  Lmbr1_20
ctcacaactactatattcag

SEQ ID NO: 30564 - DNA, 20 bp, Artificial Sequence
  sgRNA
  Lmbr1l_1
tcacgcaatcttgttaactg

SEQ ID NO: 30565 - DNA, 20 bp, Artificial Sequence
  sgRNA
  Lmbr1l_2
taccaggccacatacccaag

SEQ ID NO: 30566 - DNA, 20 bp, Artificial Sequence
  sgRNA
  Lmbr1l_3
cagggagtcgctctacggtg

SEQ ID NO: 30567 - DNA, 20 bp, Artificial Sequence
  sgRNA
  Lmbr1l_4
tactacatactacatacccg

SEQ ID NO: 30568 - DNA, 20 bp, Artificial Sequence
  sgRNA
  Lmbr1l_5
gacgaggctgccatgccacg

SEQ ID NO: 30569 - DNA, 20 bp, Artificial Sequence
  sgRNA
  Lmbr1l_6
cactggatgtagtagttgcg

SEQ ID NO: 30570 - DNA, 20 bp, Artificial Sequence
  sgRNA
  Lmbr1l_7
gggccgggtctacgagacag

SEQ ID NO: 30571 - DNA, 20 bp, Artificial Sequence
  sgRNA
  Lmbr1l_8
gcatggccagagggtagccc

SEQ ID NO: 30572 - DNA, 20 bp, Artificial Sequence
  sgRNA
  Lmbr1l_9
cttctccatcatcagcaacg

SEQ ID NO: 30573 - DNA, 20 bp, Artificial Sequence
  sgRNA
  Lmbr1l_10
gcaagcacagcatggccaga

SEQ ID NO: 30574 - DNA, 20 bp, Artificial Sequence
  sgRNA
  Lmbr1l_11
gattggagaagaggaaaacg

SEQ ID NO: 30575 - DNA, 20 bp, Artificial Sequence
  sgRNA
  Lmbr1l_12
agaacagctgttccacgaca

SEQ ID NO: 30576 - DNA, 20 bp, Artificial Sequence
  sgRNA
  Lmbr1l_13
agtcagagctgcctcctcaa

SEQ ID NO: 30577 - DNA, 20 bp, Artificial Sequence
  sgRNA
  Lmbr1l_14
gctgtagaaacccaccactg

SEQ ID NO: 30578 - DNA, 20 bp, Artificial Sequence
  sgRNA
  Lmbr1l_15
ggagctgtgcacctttaccc

SEQ ID NO: 30579 - DNA, 20 bp, Artificial Sequence
  sgRNA
  Lmbr1l_16
ctgtctggtgaagaccttca

SEQ ID NO: 30580 - DNA, 20 bp, Artificial Sequence
  sgRNA
  Lmbr1l_17
gtgctgagctgaggaccagg

SEQ ID NO: 30581 - DNA, 20 bp, Artificial Sequence
  sgRNA
  Lmbr1l_18
gagtgtggtgaggccagcaa

SEQ ID NO: 30582 - DNA, 20 bp, Artificial Sequence
  sgRNA
  Lmbr1l_19
gggcctgtctgtcctcatcg

SEQ ID NO: 30583 - DNA, 20 bp, Artificial Sequence
  sgRNA
  Lmbr1l_20
cctggagctgcttattgacg

SEQ ID NO: 30584 - DNA, 20 bp, Artificial Sequence
  sgRNA
  Lmbrd1_1
ttacaaacagcaacgcaacg

SEQ ID NO: 30585 - DNA, 20 bp, Artificial Sequence
  sgRNA
  Lmbrd1_2
aaggcacgtctatccctcgc

SEQ ID NO: 30586 - DNA, 20 bp, Artificial Sequence
  sgRNA
  Lmbrd1_3
catcatctgtttcaggcgta

SEQ ID NO: 30587 - DNA, 20 bp, Artificial Sequence
  sgRNA
  Lmbrd1_4
aacggtattctcaatctgta

SEQ ID NO: 30588 - DNA, 20 bp, Artificial Sequence
  sgRNA
  Lmbrd1_5
gcgcctcagtacgtgatgta

SEQ ID NO: 30589 - DNA, 20 bp, Artificial Sequence
  sgRNA
  Lmbrd1_6
gagactgtagatcatgtagc

SEQ ID NO: 30590 - DNA, 20 bp, Artificial Sequence
  sgRNA
  Lmbrd1_7
ttacctttaaacctaatcaa

SEQ ID NO: 30591 - DNA, 20 bp, Artificial Sequence
  sgRNA
  Lmbrd1_8
gtacttctactacgaagaga

SEQ ID NO: 30592 - DNA, 20 bp, Artificial Sequence
  sgRNA
  Lmbrd1_9
tggtcgacctttgccagcga

SEQ ID NO: 30593 - DNA, 20 bp, Artificial Sequence
  sgRNA
  Lmbrd1_10
cgagcgcctggagaacacgg

SEQ ID NO: 30594 - DNA, 20 bp, Artificial Sequence
  sgRNA
  Lmbrd1_11
ctacgagcgcctggagaaca

SEQ ID NO: 30595 - DNA, 20 bp, Artificial Sequence
  sgRNA
  Lmbrd1_12
cttccgtacatcacgtactg

SEQ ID NO: 30596 - DNA, 20 bp, Artificial Sequence
  sgRNA
  Lmbrd1_13
gatcacatcagcactgctgc

SEQ ID NO: 30597 - DNA, 20 bp, Artificial Sequence
  sgRNA
  Lmbrd1_14
tcgtagtagaagtacacaaa

SEQ ID NO: 30598 - DNA, 20 bp, Artificial Sequence
  sgRNA
  Lmbrd1_15
ttgttgttgggcagatgcag

SEQ ID NO: 30599 - DNA, 20 bp, Artificial Sequence
  sgRNA
  Lmbrd1_16
gattcgggtttcatcatctt

SEQ ID NO: 30600 - DNA, 20 bp, Artificial Sequence
  sgRNA
  Lmbrd1_17
tggtaactgggcctttctcg

SEQ ID NO: 30601 - DNA, 20 bp, Artificial Sequence
  sgRNA
  Lmbrd1_18
ttcggaagtaccagagtcag

SEQ ID NO: 30602 - DNA, 20 bp, Artificial Sequence
  sgRNA
  Lmbrd1_19
gataaagctcttcattcagc

SEQ ID NO: 30603 - DNA, 20 bp, Artificial Sequence
  sgRNA
  Lmbrd1_20
gaacgcttaggaaaagagag

SEQ ID NO: 30604 - DNA, 20 bp, Artificial Sequence
  sgRNA
  Lmbrd2_1
gctccattccagtatgaccg

SEQ ID NO: 30605 - DNA, 20 bp, Artificial Sequence
  sgRNA
  Lmbrd2_2
tcaagtacaaccacccactg

SEQ ID NO: 30606 - DNA, 20 bp, Artificial Sequence
  sgRNA
  Lmbrd2_3
taccattctaaatgcaaacg

SEQ ID NO: 30607 - DNA, 20 bp, Artificial Sequence
  sgRNA
  Lmbrd2_4
gatagacaaaaccacagcaa

SEQ ID NO: 30608 - DNA, 20 bp, Artificial Sequence
  sgRNA
  Lmbrd2_5
ggtagtagtagttaaacacg

SEQ ID NO: 30609 - DNA, 20 bp, Artificial Sequence
  sgRNA
  Lmbrd2_6
gccattgcacttgagtccga

SEQ ID NO: 30610 - DNA, 20 bp, Artificial Sequence
  sgRNA
  Lmbrd2_7
catcctggagaagttctatt

SEQ ID NO: 30611 - DNA, 20 bp, Artificial Sequence
  sgRNA
  Lmbrd2_8
gcaagggtcctgtgaaacca

SEQ ID NO: 30612 - DNA, 20 bp, Artificial Sequence
  sgRNA
  Lmbrd2_9
ccatctggaatgtaactcca

SEQ ID NO: 30613 - DNA, 20 bp, Artificial Sequence
  sgRNA
  Lmbrd2_10
cataccccaataataacaca

SEQ ID NO: 30614 - DNA, 20 bp, Artificial Sequence
  sgRNA
  Lmbrd2_11
attcagttcaaaggcaccgt

SEQ ID NO: 30615 - DNA, 20 bp, Artificial Sequence
  sgRNA
  Lmbrd2_12
ctacacacttcctcagtggg

SEQ ID NO: 30616 - DNA, 20 bp, Artificial Sequence
  sgRNA
  Lmbrd2_13
ttgttcctcctgcatcgcta

SEQ ID NO: 30617 - DNA, 20 bp, Artificial Sequence
  sgRNA
  Lmbrd2_14
tctcagacacgactaccaac

SEQ ID NO: 30618 - DNA, 20 bp, Artificial Sequence
  sgRNA
  Lmbrd2_15
ctatatatattatcctatgt

SEQ ID NO: 30619 - DNA, 20 bp, Artificial Sequence
  sgRNA
  Lmbrd2_16
gtgtctacacacttcctcag

SEQ ID NO: 30620 - DNA, 20 bp, Artificial Sequence
  sgRNA
  Lmbrd2_17
ttcagtcctgttattagccc

SEQ ID NO: 30621 - DNA, 20 bp, Artificial Sequence
  sgRNA
  Lmbrd2_18
ctatcccaatcgtctgaagt

SEQ ID NO: 30622 - DNA, 20 bp, Artificial Sequence
  sgRNA
  Lmbrd2_19
cagcacagactggtaatcat

SEQ ID NO: 30623 - DNA, 20 bp, Artificial Sequence
  sgRNA
  Lmbrd2_20
gtttctgcattaaaatccag

SEQ ID NO: 30624 - DNA, 20 bp, Artificial Sequence
  sgRNA
  Lnpep_1
atattggaatatgccaaagg

SEQ ID NO: 30625 - DNA, 20 bp, Artificial Sequence
  sgRNA
  Lnpep_2
tcctgttagaagaggttccg

SEQ ID NO: 30626 - DNA, 20 bp, Artificial Sequence
  sgRNA
  Lnpep_3
tgtgaaaatgagcacatacc

SEQ ID NO: 30627 - DNA, 20 bp, Artificial Sequence
  sgRNA
  Lnpep_4
tgcagtggtggaatgacctg

SEQ ID NO: 30628 - DNA, 20 bp, Artificial Sequence
  sgRNA
  Lnpep_5
tggtgagcatgagatggacg

SEQ ID NO: 30629 - DNA, 20 bp, Artificial Sequence
  sgRNA
  Lnpep_6
gccgaaatacatcttcacta

SEQ ID NO: 30630 - DNA, 20 bp, Artificial Sequence
  sgRNA
  Lnpep_7
gggctcatattccacttcat

SEQ ID NO: 30631 - DNA, 20 bp, Artificial Sequence
  sgRNA
  Lnpep_8
gctacaggcagagtccagat

SEQ ID NO: 30632 - DNA, 20 bp, Artificial Sequence
  sgRNA
  Lnpep_9
tgtcccagagatcatcactt

SEQ ID NO: 30633 - DNA, 20 bp, Artificial Sequence
  sgRNA
  Lnpep_10
gaagtggaatatgagccccg

SEQ ID NO: 30634 - DNA, 20 bp, Artificial Sequence
  sgRNA
  Lnpep_11
atctgaaaacgctctcccag

SEQ ID NO: 30635 - DNA, 20 bp, Artificial Sequence
  sgRNA
  Lnpep_12
tcaggctcttcaagacacac

SEQ ID NO: 30636 - DNA, 20 bp, Artificial Sequence
  sgRNA
  Lnpep_13
tcccgttagtgacagtccag

SEQ ID NO: 30637 - DNA, 20 bp, Artificial Sequence
  sgRNA
  Lnpep_14
tcagattcctgaccatccac

SEQ ID NO: 30638 - DNA, 20 bp, Artificial Sequence
  sgRNA
  Lnpep_15
atatatctaactcttattat

SEQ ID NO: 30639 - DNA, 20 bp, Artificial Sequence
  sgRNA
  Lnpep_16
tgattcagctgaatatccag

SEQ ID NO: 30640 - DNA, 20 bp, Artificial Sequence
  sgRNA
  Lnpep_17
gtatggtataggagcccaga

SEQ ID NO: 30641 - DNA, 20 bp, Artificial Sequence
  sgRNA
  Lnpep_18
aggctaagttcatagcatag

SEQ ID NO: 30642 - DNA, 20 bp, Artificial Sequence
  sgRNA
  Lnpep_19
ggctgaccgaagctctcgca

SEQ ID NO: 30643 - DNA, 20 bp, Artificial Sequence
  sgRNA
  Lnpep_20
gcaggagcaatggaaaactg

SEQ ID NO: 30644 - DNA, 20 bp, Artificial Sequence
  sgRNA
  Lpar1_1
tctttggctatgttcgccag

SEQ ID NO: 30645 - DNA, 20 bp, Artificial Sequence
  sgRNA
  Lpar1_2
ggagactgactgttagcacg

SEQ ID NO: 30646 - DNA, 20 bp, Artificial Sequence
  sgRNA
  Lpar1_3
aagtaggagtcactgtagag

SEQ ID NO: 30647 - DNA, 20 bp, Artificial Sequence
  sgRNA
  Lpar1_4
acgaatgagcaaccggcgcg

SEQ ID NO: 30648 - DNA, 20 bp, Artificial Sequence
  sgRNA
  Lpar1_5
tgctggctattgctatcgag

SEQ ID NO: 30649 - DNA, 20 bp, Artificial Sequence
  sgRNA
  Lpar1_6
tcaatacaggacctaatacc

SEQ ID NO: 30650 - DNA, 20 bp, Artificial Sequence
  sgRNA
  Lpar1_7
gctcatctctttgtcgcggt

SEQ ID NO: 30651 - DNA, 20 bp, Artificial Sequence
  sgRNA
  Lpar1_8
gggtatagcacccatcacaa

SEQ ID NO: 30652 - DNA, 20 bp, Artificial Sequence
  sgRNA
  Lpar1_9
tggcgctcatctctttgtcg

SEQ ID NO: 30653 - DNA, 20 bp, Artificial Sequence
  sgRNA
  Lpar1_10
tctcgatagcaatagccagc

SEQ ID NO: 30654 - DNA, 20 bp, Artificial Sequence
  sgRNA
  Lpar1_11
tgtcaatgaggccctgccgg

SEQ ID NO: 30655 - DNA, 20 bp, Artificial Sequence
  sgRNA
  Lpar1_12
gcaacacaggatctgcctga

SEQ ID NO: 30656 - DNA, 20 bp, Artificial Sequence
  sgRNA
  Lpar1_13
gctgctgcagacttcttcgc

SEQ ID NO: 30657 - DNA, 20 bp, Artificial Sequence
  sgRNA
  Lpar1_14
ccatgaccacaaaggtcacc

SEQ ID NO: 30658 - DNA, 20 bp, Artificial Sequence
  sgRNA
  Lpar1_15
gagcggtcagagccttccgt

SEQ ID NO: 30659 - DNA, 20 bp, Artificial Sequence
  sgRNA
  Lpar1_16
caatcaccaccaccacgcgc

SEQ ID NO: 30660 - DNA, 20 bp, Artificial Sequence
  sgRNA
  Lpar1_17
aatggcccagaagactaagt

SEQ ID NO: 30661 - DNA, 20 bp, Artificial Sequence
  sgRNA
  Lpar1_18
agcggtcagagccttccgtg

SEQ ID NO: 30662 - DNA, 20 bp, Artificial Sequence
  sgRNA
  Lpar1_19
tcgcggtaggagtagatgat

SEQ ID NO: 30663 - DNA, 20 bp, Artificial Sequence
  sgRNA
  Lpar1_20
aatgagcaaccggcgcgtgg

SEQ ID NO: 30664 - DNA, 20 bp, Artificial Sequence
  sgRNA
  Lpar2_1
tttctataataacagcggca

SEQ ID NO: 30665 - DNA, 20 bp, Artificial Sequence
  sgRNA
  Lpar2_2
gtgggccagtatggaacatg

SEQ ID NO: 30666 - DNA, 20 bp, Artificial Sequence
  sgRNA
  Lpar2_3
agtgtgaccacacggccccg

SEQ ID NO: 30667 - DNA, 20 bp, Artificial Sequence
  sgRNA
  Lpar2_4
gtgtggccactgacgccgtg

SEQ ID NO: 30668 - DNA, 20 bp, Artificial Sequence
  sgRNA
  Lpar2_5
gctgtaccgccatcacactg

SEQ ID NO: 30669 - DNA, 20 bp, Artificial Sequence
  sgRNA
  Lpar2_6
gcgcatctcagcatctcggc

SEQ ID NO: 30670 - DNA, 20 bp, Artificial Sequence
  sgRNA
  Lpar2_7
gttattatagaaaaagccga

SEQ ID NO: 30671 - DNA, 20 bp, Artificial Sequence
  sgRNA
  Lpar2_8
gctgcggctgacctcttcgc

SEQ ID NO: 30672 - DNA, 20 bp, Artificial Sequence
  sgRNA
  Lpar2_9
cttctatgtgcgtagacggg

SEQ ID NO: 30673 - DNA, 20 bp, Artificial Sequence
  sgRNA
  Lpar2_10
ggtaggccatgccagcgaag

SEQ ID NO: 30674 - DNA, 20 bp, Artificial Sequence
  sgRNA
  Lpar2_11
cttggacagttgctcacgca

SEQ ID NO: 30675 - DNA, 20 bp, Artificial Sequence
  sgRNA
  Lpar2_12
acatgcagcagagaaggcgg

SEQ ID NO: 30676 - DNA, 20 bp, Artificial Sequence
  sgRNA
  Lpar2_13
tagacgggtggaacgcatgg

SEQ ID NO: 30677 - DNA, 20 bp, Artificial Sequence
  sgRNA
  Lpar2_14
gcggtgccgttccacagcga

SEQ ID NO: 30678 - DNA, 20 bp, Artificial Sequence
  sgRNA
  Lpar2_15
tctgggcagaagctgagtaa

SEQ ID NO: 30679 - DNA, 20 bp, Artificial Sequence
  sgRNA
  Lpar2_16
tcactggcgccccaaagatg

SEQ ID NO: 30680 - DNA, 20 bp, Artificial Sequence
  sgRNA
  Lpar2_17
cctgcttggcaacttggctg

SEQ ID NO: 30681 - DNA, 20 bp, Artificial Sequence
  sgRNA
  Lpar2_18
atactggcccacgcactgcc

SEQ ID NO: 30682 - DNA, 20 bp, Artificial Sequence
  sgRNA
  Lpar2_19
tggagagcctggcagtgcgt

SEQ ID NO: 30683 - DNA, 20 bp, Artificial Sequence
  sgRNA
  Lpar2_20
tgctggccatcgctgtggaa

SEQ ID NO: 30684 - DNA, 20 bp, Artificial Sequence
  sgRNA
  Lpar3_1
acagcaacttgaccaaaaag

SEQ ID NO: 30685 - DNA, 20 bp, Artificial Sequence
  sgRNA
  Lpar3_2
gaggcaattccatcccagcg

SEQ ID NO: 30686 - DNA, 20 bp, Artificial Sequence
  sgRNA
  Lpar3_3
ttgtgatcgtcctgtgcgtg

SEQ ID NO: 30687 - DNA, 20 bp, Artificial Sequence
  sgRNA
  Lpar3_4
ggtgtgtggagataagacgt

SEQ ID NO: 30688 - DNA, 20 bp, Artificial Sequence
  sgRNA
  Lpar3_5
tgcaggacagcaataccgag

SEQ ID NO: 30689 - DNA, 20 bp, Artificial Sequence
  sgRNA
  Lpar3_6
catctactcgtacaaggacg

SEQ ID NO: 30690 - DNA, 20 bp, Artificial Sequence
  sgRNA
  Lpar3_7
aataaccagcaaattggcca

SEQ ID NO: 30691 - DNA, 20 bp, Artificial Sequence
  sgRNA
  Lpar3_8
ggcccggtgtgcaataaaaa

SEQ ID NO: 30692 - DNA, 20 bp, Artificial Sequence
  sgRNA
  Lpar3_9
gcttcatgggagccctccgg

SEQ ID NO: 30693 - DNA, 20 bp, Artificial Sequence
  sgRNA
  Lpar3_10
acagcagatcatcttccgca

SEQ ID NO: 30694 - DNA, 20 bp, Artificial Sequence
  sgRNA
  Lpar3_11
gtgtcactatgacaagcgca

SEQ ID NO: 30695 - DNA, 20 bp, Artificial Sequence
  sgRNA
  Lpar3_12
acacagacacagcggacgag

SEQ ID NO: 30696 - DNA, 20 bp, Artificial Sequence
  sgRNA
  Lpar3_13
tggctccatcagccgccgga

SEQ ID NO: 30697 - DNA, 20 bp, Artificial Sequence
  sgRNA
  Lpar3_14
aggacatgtacaacaccatg

SEQ ID NO: 30698 - DNA, 20 bp, Artificial Sequence
  sgRNA
  Lpar3_15
ccatgatgaagaaggccagg

SEQ ID NO: 30699 - DNA, 20 bp, Artificial Sequence
  sgRNA
  Lpar3_16
agaagaacgtccccacgcac

SEQ ID NO: 30700 - DNA, 20 bp, Artificial Sequence
  sgRNA
  Lpar3_17
cagcagaaccaccagacccg

SEQ ID NO: 30701 - DNA, 20 bp, Artificial Sequence
  sgRNA
  Lpar3_18
ctctggctcccatttacagt

SEQ ID NO: 30702 - DNA, 20 bp, Artificial Sequence
  sgRNA
  Lpar3_19
caggagcaacacagacacag

SEQ ID NO: 30703 - DNA, 20 bp, Artificial Sequence
  sgRNA
  Lpar3_20
gatcaccgcagcaatgacca

SEQ ID NO: 30704 - DNA, 20 bp, Artificial Sequence
  sgRNA
  Lpar4_1
ctgatggtacgcgatcggaa

SEQ ID NO: 30705 - DNA, 20 bp, Artificial Sequence
  sgRNA
  Lpar4_2
gcagttgcatttcccaacct

SEQ ID NO: 30706 - DNA, 20 bp, Artificial Sequence
  sgRNA
  Lpar4_3
gcggaagcagaagacaaaca

SEQ ID NO: 30707 - DNA, 20 bp, Artificial Sequence
  sgRNA
  Lpar4_4
gaagccttcaaagcaagtgg

SEQ ID NO: 30708 - DNA, 20 bp, Artificial Sequence
  sgRNA
  Lpar4_5
agtccctgagatcttacaga

SEQ ID NO: 30709 - DNA, 20 bp, Artificial Sequence
  sgRNA
  Lpar4_6
tggtcctgatggtacgcgat

SEQ ID NO: 30710 - DNA, 20 bp, Artificial Sequence
  sgRNA
  Lpar4_7
caatgttgcaggcttgcgga

SEQ ID NO: 30711 - DNA, 20 bp, Artificial Sequence
  sgRNA
  Lpar4_8
ttcccttccagctatccaag

SEQ ID NO: 30712 - DNA, 20 bp, Artificial Sequence
  sgRNA
  Lpar4_9
gactccagcgcacacaatgg

SEQ ID NO: 30713 - DNA, 20 bp, Artificial Sequence
  sgRNA
  Lpar4_10
gcgttcctcaccaacatcta

SEQ ID NO: 30714 - DNA, 20 bp, Artificial Sequence
  sgRNA
  Lpar4_11
gatcaaacaacaaataatgg

SEQ ID NO: 30715 - DNA, 20 bp, Artificial Sequence
  sgRNA
  Lpar4_12
cagtccctgagatcttacag

SEQ ID NO: 30716 - DNA, 20 bp, Artificial Sequence
  sgRNA
  Lpar4_13
cgcgtaccatcaggaccagg

SEQ ID NO: 30717 - DNA, 20 bp, Artificial Sequence
  sgRNA
  Lpar4_14
cgatcggaagggatagacaa

SEQ ID NO: 30718 - DNA, 20 bp, Artificial Sequence
  sgRNA
  Lpar4_15
gatcgcgtaccatcaggacc

SEQ ID NO: 30719 - DNA, 20 bp, Artificial Sequence
  sgRNA
  Lpar4_16
acaatgttgcaggcttgcgg

SEQ ID NO: 30720 - DNA, 20 bp, Artificial Sequence
  sgRNA
  Lpar4_17
tggatcctagtcctcagtgg

SEQ ID NO: 30721 - DNA, 20 bp, Artificial Sequence
  sgRNA
  Lpar4_18
aatggcttgggagcgtacca

SEQ ID NO: 30722 - DNA, 20 bp, Artificial Sequence
  sgRNA
  Lpar4_19
aattccgccattgtgtgcgc

SEQ ID NO: 30723 - DNA, 20 bp, Artificial Sequence
  sgRNA
  Lpar4_20
gagacaatgttgcaggcttg

SEQ ID NO: 30724 - DNA, 20 bp, Artificial Sequence
  sgRNA
  Lpar5_1
agtgtacgcgcagtacacgc

SEQ ID NO: 30725 - DNA, 20 bp, Artificial Sequence
  sgRNA
  Lpar5_2
tgagactgcgccacctacgg

SEQ ID NO: 30726 - DNA, 20 bp, Artificial Sequence
  sgRNA
  Lpar5_3
gctgttggtagaagtcgtgt

SEQ ID NO: 30727 - DNA, 20 bp, Artificial Sequence
  sgRNA
  Lpar5_4
gatgttcttgtacgtgcagt

SEQ ID NO: 30728 - DNA, 20 bp, Artificial Sequence
  sgRNA
  Lpar5_5
gcactgaagtagtaaaccag

SEQ ID NO: 30729 - DNA, 20 bp, Artificial Sequence
  sgRNA
  Lpar5_6
cgtgccctataactccacgc

SEQ ID NO: 30730 - DNA, 20 bp, Artificial Sequence
  sgRNA
  Lpar5_7
actccacgctggctgtatat

SEQ ID NO: 30731 - DNA, 20 bp, Artificial Sequence
  sgRNA
  Lpar5_8
caaaggcctggtattcagcg

SEQ ID NO: 30732 - DNA, 20 bp, Artificial Sequence
  sgRNA
  Lpar5_9
gcagccccattggtagccaa

SEQ ID NO: 30733 - DNA, 20 bp, Artificial Sequence
  sgRNA
  Lpar5_10
tgtactgcgcgtacactcag

SEQ ID NO: 30734 - DNA, 20 bp, Artificial Sequence
  sgRNA
  Lpar5_11
gtttactacttcagtgccga

SEQ ID NO: 30735 - DNA, 20 bp, Artificial Sequence
  sgRNA
  Lpar5_12
ccactcagagccaacggcga

SEQ ID NO: 30736 - DNA, 20 bp, Artificial Sequence
  sgRNA
  Lpar5_13
ggtgctttctgagggtagtt

SEQ ID NO: 30737 - DNA, 20 bp, Artificial Sequence
  sgRNA
  Lpar5_14
caggaccgcgatcaggtgcg

SEQ ID NO: 30738 - DNA, 20 bp, Artificial Sequence
  sgRNA
  Lpar5_15
gcatatggtggtctacagcc

SEQ ID NO: 30739 - DNA, 20 bp, Artificial Sequence
  sgRNA
  Lpar5_16
gcatagtaggagaggcgcag

SEQ ID NO: 30740 - DNA, 20 bp, Artificial Sequence
  sgRNA
  Lpar5_17
acagccagcgtggagttata

SEQ ID NO: 30741 - DNA, 20 bp, Artificial Sequence
  sgRNA
  Lpar5_18
catcaacgtggaccgctatg

SEQ ID NO: 30742 - DNA, 20 bp, Artificial Sequence
  sgRNA
  Lpar5_19
ggatgagagcccacacgccc

SEQ ID NO: 30743 - DNA, 20 bp, Artificial Sequence
  sgRNA
  Lpar5_20
agagagccagagcgttgaga

SEQ ID NO: 30744 - DNA, 20 bp, Artificial Sequence
  sgRNA
  Lpar6_1
ttcagtcgacccactctcag

SEQ ID NO: 30745 - DNA, 20 bp, Artificial Sequence
  sgRNA
  Lpar6_2
tacaacgtacatgattaacc

SEQ ID NO: 30746 - DNA, 20 bp, Artificial Sequence
  sgRNA
  Lpar6_3
caagttacgttcaaaatgag

SEQ ID NO: 30747 - DNA, 20 bp, Artificial Sequence
  sgRNA
  Lpar6_4
agatcgtttgcattgctgtg

SEQ ID NO: 30748 - DNA, 20 bp, Artificial Sequence
  sgRNA
  Lpar6_5
gtacgggtgcatgttcagca

SEQ ID NO: 30749 - DNA, 20 bp, Artificial Sequence
  sgRNA
  Lpar6_6
tgttaactgctctgtggtgg

SEQ ID NO: 30750 - DNA, 20 bp, Artificial Sequence
  sgRNA
  Lpar6_7
tcatgagcgagtacaaaatg

SEQ ID NO: 30751 - DNA, 20 bp, Artificial Sequence
  sgRNA
  Lpar6_8
caccacagagcagttaacaa

SEQ ID NO: 30752 - DNA, 20 bp, Artificial Sequence
  sgRNA
  Lpar6_9
agaactttccagcggccaca

SEQ ID NO: 30753 - DNA, 20 bp, Artificial Sequence
  sgRNA
  Lpar6_10
ctgctttgagaactttccag

SEQ ID NO: 30754 - DNA, 20 bp, Artificial Sequence
  sgRNA
  Lpar6_11
gcagagagtgatcgggtaca

SEQ ID NO: 30755 - DNA, 20 bp, Artificial Sequence
  sgRNA
  Lpar6_12
cctttaagtacactctgtac

SEQ ID NO: 30756 - DNA, 20 bp, Artificial Sequence
  sgRNA
  Lpar6_13
ggagtcgtcataagggcact

SEQ ID NO: 30757 - DNA, 20 bp, Artificial Sequence
  sgRNA
  Lpar6_14
acagcgatgcagagagtgat

SEQ ID NO: 30758 - DNA, 20 bp, Artificial Sequence
  sgRNA
  Lpar6_15
aatagggtcaaagcagcagt

SEQ ID NO: 30759 - DNA, 20 bp, Artificial Sequence
  sgRNA
  Lpar6_16
ctttcagtcgacccactctc

SEQ ID NO: 30760 - DNA, 20 bp, Artificial Sequence
  sgRNA
  Lpar6_17
aataaaaatgaaaaactggt

SEQ ID NO: 30761 - DNA, 20 bp, Artificial Sequence
  sgRNA
  Lpar6_18
aagttacgttcaaaatgaga

SEQ ID NO: 30762 - DNA, 20 bp, Artificial Sequence
  sgRNA
  Lpar6_19
gtcgactgaaagaaaactgc

SEQ ID NO: 30763 - DNA, 20 bp, Artificial Sequence
  sgRNA
  Lpar6_20
ggtattgttcccctgagagt

SEQ ID NO: 30764 - DNA, 20 bp, Artificial Sequence
  sgRNA
  Lpl_1
gaaaaacgtaccgtctgctg

SEQ ID NO: 30765 - DNA, 20 bp, Artificial Sequence
  sgRNA
  Lpl_2
ccatccatggatcaccacga

SEQ ID NO: 30766 - DNA, 20 bp, Artificial Sequence
  sgRNA
  Lpl_3
tggattccaatacttcgacc

SEQ ID NO: 30767 - DNA, 20 bp, Artificial Sequence
  sgRNA
  Lpl_4
tgacactggataatgttgct

SEQ ID NO: 30768 - DNA, 20 bp, Artificial Sequence
  sgRNA
  Lpl_5
gccccagcttcgtcatcgag

SEQ ID NO: 30769 - DNA, 20 bp, Artificial Sequence
  sgRNA
  Lpl_6
tgtcttacacacatttacca

SEQ ID NO: 30770 - DNA, 20 bp, Artificial Sequence
  sgRNA
  Lpl_7
atttacacggaggtggacat

SEQ ID NO: 30771 - DNA, 20 bp, Artificial Sequence
  sgRNA
  Lpl_8
gatttctctgtacggcacag

SEQ ID NO: 30772 - DNA, 20 bp, Artificial Sequence
  sgRNA
  Lpl_9
gtttgaccgccttccgagga

SEQ ID NO: 30773 - DNA, 20 bp, Artificial Sequence
  sgRNA
  Lpl_10
cagagtttgaccgccttccg

SEQ ID NO: 30774 - DNA, 20 bp, Artificial Sequence
  sgRNA
  Lpl_11
tctctctgcaatcacacgga

SEQ ID NO: 30775 - DNA, 20 bp, Artificial Sequence
  sgRNA
  Lpl_12
acttcagctggcctgactgg

SEQ ID NO: 30776 - DNA, 20 bp, Artificial Sequence
  sgRNA
  Lpl_13
gagaggatccgagtgaaagc

SEQ ID NO: 30777 - DNA, 20 bp, Artificial Sequence
  sgRNA
  Lpl_14
gctggctacaccaagctggt

SEQ ID NO: 30778 - DNA, 20 bp, Artificial Sequence
  sgRNA
  Lpl_15
ctccttcttgatttacacgg

SEQ ID NO: 30779 - DNA, 20 bp, Artificial Sequence
  sgRNA
  Lpl_16
tctgggctatgagatcaaca

SEQ ID NO: 30780 - DNA, 20 bp, Artificial Sequence
  sgRNA
  Lpl_17
gagtctctccggctttcact

SEQ ID NO: 30781 - DNA, 20 bp, Artificial Sequence
  sgRNA
  Lpl_18
gtcctctctctgcaatcaca

SEQ ID NO: 30782 - DNA, 20 bp, Artificial Sequence
  sgRNA
  Lpl_19
gccgtacagagaaatctcga

SEQ ID NO: 30783 - DNA, 20 bp, Artificial Sequence
  sgRNA
  Lpl_20
tgtgtcttcaggggtcctta

SEQ ID NO: 30784 - DNA, 20 bp, Artificial Sequence
  sgRNA
  Lrfn1_1
acacacacaaatcataggcg

SEQ ID NO: 30785 - DNA, 20 bp, Artificial Sequence
  sgRNA
  Lrfn1_2
ccgggatggaccagaaatag

SEQ ID NO: 30786 - DNA, 20 bp, Artificial Sequence
  sgRNA
  Lrfn1_3
tgttgccgaggatcaagtgg

SEQ ID NO: 30787 - DNA, 20 bp, Artificial Sequence
  sgRNA
  Lrfn1_4
ctacataaattgccccccga

SEQ ID NO: 30788 - DNA, 20 bp, Artificial Sequence
  sgRNA
  Lrfn1_5
acaacgctattccttcgacg

SEQ ID NO: 30789 - DNA, 20 bp, Artificial Sequence
  sgRNA
  Lrfn1_6
gcatggtgcaggatctcccg

SEQ ID NO: 30790 - DNA, 20 bp, Artificial Sequence
  sgRNA
  Lrfn1_7
accagctccagaccgctacg

SEQ ID NO: 30791 - DNA, 20 bp, Artificial Sequence
  sgRNA
  Lrfn1_8
ggtactctccagcatccatt

SEQ ID NO: 30792 - DNA, 20 bp, Artificial Sequence
  sgRNA
  Lrfn1_9
gtgttggcagtctatgacga

SEQ ID NO: 30793 - DNA, 20 bp, Artificial Sequence
  sgRNA
  Lrfn1_10
ttccttcgacggggactacg

SEQ ID NO: 30794 - DNA, 20 bp, Artificial Sequence
  sgRNA
  Lrfn1_11
gagcacacgtggctgacccg

SEQ ID NO: 30795 - DNA, 20 bp, Artificial Sequence
  sgRNA
  Lrfn1_12
tcgctgcatctgtcagaacg

SEQ ID NO: 30796 - DNA, 20 bp, Artificial Sequence
  sgRNA
  Lrfn1_13
tctgctcatgattcgctaca

SEQ ID NO: 30797 - DNA, 20 bp, Artificial Sequence
  sgRNA
  Lrfn1_14
gcaccttgacagcaaccgcc

SEQ ID NO: 30798 - DNA, 20 bp, Artificial Sequence
  sgRNA
  Lrfn1_15
gtccacgccacacctggacg

SEQ ID NO: 30799 - DNA, 20 bp, Artificial Sequence
  sgRNA
  Lrfn1_16
ctgtgtgcaattcaccaccg

SEQ ID NO: 30800 - DNA, 20 bp, Artificial Sequence
  sgRNA
  Lrfn1_17
tacggatctgattgttgccg

SEQ ID NO: 30801 - DNA, 20 bp, Artificial Sequence
  sgRNA
  Lrfn1_18
tgtgactatcaccaccctga

SEQ ID NO: 30802 - DNA, 20 bp, Artificial Sequence
  sgRNA
  Lrfn1_19
tggacgtccccttgatgcgg

SEQ ID NO: 30803 - DNA, 20 bp, Artificial Sequence
  sgRNA
  Lrfn1_20
gcttcggcgcctgaccaggg

SEQ ID NO: 30804 - DNA, 20 bp, Artificial Sequence
  sgRNA
  Lrfn2_1
tggaacctgtgatgtccgaa

SEQ ID NO: 30805 - DNA, 20 bp, Artificial Sequence
  sgRNA
  Lrfn2_2
gcgacccttgagacttccgg

SEQ ID NO: 30806 - DNA, 20 bp, Artificial Sequence
  sgRNA
  Lrfn2_3
gtcctccggtcaatgtcagg

SEQ ID NO: 30807 - DNA, 20 bp, Artificial Sequence
  sgRNA
  Lrfn2_4
caaccggctacctagccttg

SEQ ID NO: 30808 - DNA, 20 bp, Artificial Sequence
  sgRNA
  Lrfn2_5
gcctggacctcacatccaat

SEQ ID NO: 30809 - DNA, 20 bp, Artificial Sequence
  sgRNA
  Lrfn2_6
gacttccctgggattccgta

SEQ ID NO: 30810 - DNA, 20 bp, Artificial Sequence
  sgRNA
  Lrfn2_7
tgccccctgacattgaccgg

SEQ ID NO: 30811 - DNA, 20 bp, Artificial Sequence
  sgRNA
  Lrfn2_8
agaccttgtaccgcaccatg

SEQ ID NO: 30812 - DNA, 20 bp, Artificial Sequence
  sgRNA
  Lrfn2_9
cttggggaggacacactccg

SEQ ID NO: 30813 - DNA, 20 bp, Artificial Sequence
  sgRNA
  Lrfn2_10
ggaccctgtgtccctccaag

SEQ ID NO: 30814 - DNA, 20 bp, Artificial Sequence
  sgRNA
  Lrfn2_11
tagtaacagcactagccgga

SEQ ID NO: 30815 - DNA, 20 bp, Artificial Sequence
  sgRNA
  Lrfn2_12
ggttccagcaagaccagccg

SEQ ID NO: 30816 - DNA, 20 bp, Artificial Sequence
  sgRNA
  Lrfn2_13
tttcgcaccacaactttggg

SEQ ID NO: 30817 - DNA, 20 bp, Artificial Sequence
  sgRNA
  Lrfn2_14
ccaacgggtatcccacccag

SEQ ID NO: 30818 - DNA, 20 bp, Artificial Sequence
  sgRNA
  Lrfn2_15
tcaggcaccacccaaagttg

SEQ ID NO: 30819 - DNA, 20 bp, Artificial Sequence
  sgRNA
  Lrfn2_16
ctagactccaggactccagc

SEQ ID NO: 30820 - DNA, 20 bp, Artificial Sequence
  sgRNA
  Lrfn2_17
atgcgccgtacggaatccca

SEQ ID NO: 30821 - DNA, 20 bp, Artificial Sequence
  sgRNA
  Lrfn2_18
gatgtttgagacccgcctag

SEQ ID NO: 30822 - DNA, 20 bp, Artificial Sequence
  sgRNA
  Lrfn2_19
gaggttgaccatgcgccgta

SEQ ID NO: 30823 - DNA, 20 bp, Artificial Sequence
  sgRNA
  Lrfn2_20
cacaagctgctggttctgga

SEQ ID NO: 30824 - DNA, 20 bp, Artificial Sequence
  sgRNA
  Lrfn3_1
cctaggcaacgtcaacacgt

SEQ ID NO: 30825 - DNA, 20 bp, Artificial Sequence
  sgRNA
  Lrfn3_2
cctaagcgtgttgtgcccag

SEQ ID NO: 30826 - DNA, 20 bp, Artificial Sequence
  sgRNA
  Lrfn3_3
ggtgatacccaacgcactcg

SEQ ID NO: 30827 - DNA, 20 bp, Artificial Sequence
  sgRNA
  Lrfn3_4
gcaccagctgtgaccccccg

SEQ ID NO: 30828 - DNA, 20 bp, Artificial Sequence
  sgRNA
  Lrfn3_5
agtcacttggacgccacggt

SEQ ID NO: 30829 - DNA, 20 bp, Artificial Sequence
  sgRNA
  Lrfn3_6
agtgtccgccactttggcgg

SEQ ID NO: 30830 - DNA, 20 bp, Artificial Sequence
  sgRNA
  Lrfn3_7
gctgctgttgagctgaccgt

SEQ ID NO: 30831 - DNA, 20 bp, Artificial Sequence
  sgRNA
  Lrfn3_8
ggttcgtgactgggccccca

SEQ ID NO: 30832 - DNA, 20 bp, Artificial Sequence
  sgRNA
  Lrfn3_9
gcgcggcgatccagtgatgg

SEQ ID NO: 30833 - DNA, 20 bp, Artificial Sequence
  sgRNA
  Lrfn3_10
gggctgcgctcggttctcca

SEQ ID NO: 30834 - DNA, 20 bp, Artificial Sequence
  sgRNA
  Lrfn3_11
ggctcgggaggacgacctcg

SEQ ID NO: 30835 - DNA, 20 bp, Artificial Sequence
  sgRNA
  Lrfn3_12
gtagctccagggtcccatta

SEQ ID NO: 30836 - DNA, 20 bp, Artificial Sequence
  sgRNA
  Lrfn3_13
gtccaattggaccacagtat

SEQ ID NO: 30837 - DNA, 20 bp, Artificial Sequence
  sgRNA
  Lrfn3_14
gtagccttggccttgccggg

SEQ ID NO: 30838 - DNA, 20 bp, Artificial Sequence
  sgRNA
  Lrfn3_15
ccaggcgcagttctgcagcg

SEQ ID NO: 30839 - DNA, 20 bp, Artificial Sequence
  sgRNA
  Lrfn3_16
atctaggtgcagggcacgca

SEQ ID NO: 30840 - DNA, 20 bp, Artificial Sequence
  sgRNA
  Lrfn3_17
cttctacgttacaaggtgca

SEQ ID NO: 30841 - DNA, 20 bp, Artificial Sequence
  sgRNA
  Lrfn3_18
ggtctcggcacagtcgtcta

SEQ ID NO: 30842 - DNA, 20 bp, Artificial Sequence
  sgRNA
  Lrfn3_19
ggaaggagcgactgtccgct

SEQ ID NO: 30843 - DNA, 20 bp, Artificial Sequence
  sgRNA
  Lrfn3_20
aattggactgtgagccctgg

SEQ ID NO: 30844 - DNA, 20 bp, Artificial Sequence
  sgRNA
  Lrfn4_1
caaaggagcgagccccaatg

SEQ ID NO: 30845 - DNA, 20 bp, Artificial Sequence
  sgRNA
  Lrfn4_2
gctgtttgtgccacccaacg

SEQ ID NO: 30846 - DNA, 20 bp, Artificial Sequence
  sgRNA
  Lrfn4_3
tgtgtgtgccgggcaatcag

SEQ ID NO: 30847 - DNA, 20 bp, Artificial Sequence
  sgRNA
  Lrfn4_4
ctcatcgatgcactaccccc

SEQ ID NO: 30848 - DNA, 20 bp, Artificial Sequence
  sgRNA
  Lrfn4_5
gtcctataacaacctccggc

SEQ ID NO: 30849 - DNA, 20 bp, Artificial Sequence
  sgRNA
  Lrfn4_6
ctagtggccgtgaggtcgga

SEQ ID NO: 30850 - DNA, 20 bp, Artificial Sequence
  sgRNA
  Lrfn4_7
ccagcagtctagtggccgtg

SEQ ID NO: 30851 - DNA, 20 bp, Artificial Sequence
  sgRNA
  Lrfn4_8
gcagaagcagcaatgtccga

SEQ ID NO: 30852 - DNA, 20 bp, Artificial Sequence
  sgRNA
  Lrfn4_9
agctgagcaaagacacctgg

SEQ ID NO: 30853 - DNA, 20 bp, Artificial Sequence
  sgRNA
  Lrfn4_10
atgtacagagtggctccgcc

SEQ ID NO: 30854 - DNA, 20 bp, Artificial Sequence
  sgRNA
  Lrfn4_11
agaactgctgccgaaggcga

SEQ ID NO: 30855 - DNA, 20 bp, Artificial Sequence
  sgRNA
  Lrfn4_12
gctcacagttgcagtgcagt

SEQ ID NO: 30856 - DNA, 20 bp, Artificial Sequence
  sgRNA
  Lrfn4_13
gaagtcgtcgaaggccccgg

SEQ ID NO: 30857 - DNA, 20 bp, Artificial Sequence
  sgRNA
  Lrfn4_14
gggtgctgagtgactccgac

SEQ ID NO: 30858 - DNA, 20 bp, Artificial Sequence
  sgRNA
  Lrfn4_15
tccggtgtctcctaggtcca

SEQ ID NO: 30859 - DNA, 20 bp, Artificial Sequence
  sgRNA
  Lrfn4_16
gtgcgcctgtccacgttggg

SEQ ID NO: 30860 - DNA, 20 bp, Artificial Sequence
  sgRNA
  Lrfn4_17
gctggccctctagcacccac

SEQ ID NO: 30861 - DNA, 20 bp, Artificial Sequence
  sgRNA
  Lrfn4_18
tgacctcacctccaaccgcc

SEQ ID NO: 30862 - DNA, 20 bp, Artificial Sequence
  sgRNA
  Lrfn4_19
cgacttccttgacagtctcg

SEQ ID NO: 30863 - DNA, 20 bp, Artificial Sequence
  sgRNA
  Lrfn4_20
gcagcaatgtccgaaggccc

SEQ ID NO: 30864 - DNA, 20 bp, Artificial Sequence
  sgRNA
  Lrfn5_1
tgtattgcttccaatccggc

SEQ ID NO: 30865 - DNA, 20 bp, Artificial Sequence
  sgRNA
  Lrfn5_2
gtatgacgagtgatgagcgg

SEQ ID NO: 30866 - DNA, 20 bp, Artificial Sequence
  sgRNA
  Lrfn5_3
gggttgcatccagtttacta

SEQ ID NO: 30867 - DNA, 20 bp, Artificial Sequence
  sgRNA
  Lrfn5_4
cctctgtaacagaatcagga

SEQ ID NO: 30868 - DNA, 20 bp, Artificial Sequence
  sgRNA
  Lrfn5_5
tcgtagatcagcaaaagcat

SEQ ID NO: 30869 - DNA, 20 bp, Artificial Sequence
  sgRNA
  Lrfn5_6
gtattgcttccaatccggca

SEQ ID NO: 30870 - DNA, 20 bp, Artificial Sequence
  sgRNA
  Lrfn5_7
aggggaagcaacacaaaccg

SEQ ID NO: 30871 - DNA, 20 bp, Artificial Sequence
  sgRNA
  Lrfn5_8
gggactgcataaagtggcaa

SEQ ID NO: 30872 - DNA, 20 bp, Artificial Sequence
  sgRNA
  Lrfn5_9
catgagatgagagtcttgga

SEQ ID NO: 30873 - DNA, 20 bp, Artificial Sequence
  sgRNA
  Lrfn5_10
tgggcaacacaaggtcacga

SEQ ID NO: 30874 - DNA, 20 bp, Artificial Sequence
  sgRNA
  Lrfn5_11
aactcaatgcaaaagtcgat

SEQ ID NO: 30875 - DNA, 20 bp, Artificial Sequence
  sgRNA
  Lrfn5_12
gcttgtttggacatggactg

SEQ ID NO: 30876 - DNA, 20 bp, Artificial Sequence
  sgRNA
  Lrfn5_13
ctcactgccacaagagtcgt

SEQ ID NO: 30877 - DNA, 20 bp, Artificial Sequence
  sgRNA
  Lrfn5_14
cgtagatcagcaaaagcatg

SEQ ID NO: 30878 - DNA, 20 bp, Artificial Sequence
  sgRNA
  Lrfn5_15
atgattgacaacattcctaa

SEQ ID NO: 30879 - DNA, 20 bp, Artificial Sequence
  sgRNA
  Lrfn5_16
tccatgtccaaacaagccat

SEQ ID NO: 30880 - DNA, 20 bp, Artificial Sequence
  sgRNA
  Lrfn5_17
tggtgctgtttagtaggtga

SEQ ID NO: 30881 - DNA, 20 bp, Artificial Sequence
  sgRNA
  Lrfn5_18
tttaattatgtgaagatcca

SEQ ID NO: 30882 - DNA, 20 bp, Artificial Sequence
  sgRNA
  Lrfn5_19
gcacttgaagtccaggtagg

SEQ ID NO: 30883 - DNA, 20 bp, Artificial Sequence
  sgRNA
  Lrfn5_20
gcatgtctatgaatgcaatg

SEQ ID NO: 30884 - DNA, 20 bp, Artificial Sequence
  sgRNA
  Lrig1_1
gtagcgaacctaagactgtg

SEQ ID NO: 30885 - DNA, 20 bp, Artificial Sequence
  sgRNA
  Lrig1_2
tgtccttcaacaacctcacg

SEQ ID NO: 30886 - DNA, 20 bp, Artificial Sequence
  sgRNA
  Lrig1_3
ggtacaatcgaggataccag

SEQ ID NO: 30887 - DNA, 20 bp, Artificial Sequence
  sgRNA
  Lrig1_4
gagcatttgatggtctgtcg

SEQ ID NO: 30888 - DNA, 20 bp, Artificial Sequence
  sgRNA
  Lrig1_5
gcccatccagagtcgctgaa

SEQ ID NO: 30889 - DNA, 20 bp, Artificial Sequence
  sgRNA
  Lrig1_6
ataccagtggtgcctttacg

SEQ ID NO: 30890 - DNA, 20 bp, Artificial Sequence
  sgRNA
  Lrig1_7
agaaggcgaggcgcaaggcg

SEQ ID NO: 30891 - DNA, 20 bp, Artificial Sequence
  sgRNA
  Lrig1_8
atgtgatgatagacgatgca

SEQ ID NO: 30892 - DNA, 20 bp, Artificial Sequence
  sgRNA
  Lrig1_9
gggctgcctgaagctaacgt

SEQ ID NO: 30893 - DNA, 20 bp, Artificial Sequence
  sgRNA
  Lrig1_10
ttgaaggcctcacgttccag

SEQ ID NO: 30894 - DNA, 20 bp, Artificial Sequence
  sgRNA
  Lrig1_11
acctacccctggctgccgga

SEQ ID NO: 30895 - DNA, 20 bp, Artificial Sequence
  sgRNA
  Lrig1_12
gctcaccaatgaccttcgcc

SEQ ID NO: 30896 - DNA, 20 bp, Artificial Sequence
  sgRNA
  Lrig1_13
attgaaggcctcacgttcca

SEQ ID NO: 30897 - DNA, 20 bp, Artificial Sequence
  sgRNA
  Lrig1_14
gcacaacaagatccttagtg

SEQ ID NO: 30898 - DNA, 20 bp, Artificial Sequence
  sgRNA
  Lrig1_15
tcacttcgccgtcctgtgca

SEQ ID NO: 30899 - DNA, 20 bp, Artificial Sequence
  sgRNA
  Lrig1_16
cacgtcacctttgggcacga

SEQ ID NO: 30900 - DNA, 20 bp, Artificial Sequence
  sgRNA
  Lrig1_17
actgcagtccagcgagtccc

SEQ ID NO: 30901 - DNA, 20 bp, Artificial Sequence
  sgRNA
  Lrig1_18
gcatcctacccattagccat

SEQ ID NO: 30902 - DNA, 20 bp, Artificial Sequence
  sgRNA
  Lrig1_19
gtgtatccaacacacagctt

SEQ ID NO: 30903 - DNA, 20 bp, Artificial Sequence
  sgRNA
  Lrig1_20
cccttaagccaggtgatgcg

SEQ ID NO: 30904 - DNA, 20 bp, Artificial Sequence
  sgRNA
  Lrig2_1
ttgcgccatatggtggacat

SEQ ID NO: 30905 - DNA, 20 bp, Artificial Sequence
  sgRNA
  Lrig2_2
actggagagattgaatttag

SEQ ID NO: 30906 - DNA, 20 bp, Artificial Sequence
  sgRNA
  Lrig2_3
acagatactcaagggactca

SEQ ID NO: 30907 - DNA, 20 bp, Artificial Sequence
  sgRNA
  Lrig2_4
agcacattctaatcttgcca

SEQ ID NO: 30908 - DNA, 20 bp, Artificial Sequence
  sgRNA
  Lrig2_5
tccagaggcctaataaacga

SEQ ID NO: 30909 - DNA, 20 bp, Artificial Sequence
  sgRNA
  Lrig2_6
tccttggtccaattgaggcg

SEQ ID NO: 30910 - DNA, 20 bp, Artificial Sequence
  sgRNA
  Lrig2_7
gcaataccgctgtctcacct

SEQ ID NO: 30911 - DNA, 20 bp, Artificial Sequence
  sgRNA
  Lrig2_8
gtgacggtcttgtcctccag

SEQ ID NO: 30912 - DNA, 20 bp, Artificial Sequence
  sgRNA
  Lrig2_9
cctttcccaccaaccatgag

SEQ ID NO: 30913 - DNA, 20 bp, Artificial Sequence
  sgRNA
  Lrig2_10
gttcgttatcggcagcagga

SEQ ID NO: 30914 - DNA, 20 bp, Artificial Sequence
  sgRNA
  Lrig2_11
tagaaggccttaccttccaa

SEQ ID NO: 30915 - DNA, 20 bp, Artificial Sequence
  sgRNA
  Lrig2_12
gaggacaagaccgtcacccg

SEQ ID NO: 30916 - DNA, 20 bp, Artificial Sequence
  sgRNA
  Lrig2_13
agaaccttcccttctcacag

SEQ ID NO: 30917 - DNA, 20 bp, Artificial Sequence
  sgRNA
  Lrig2_14
aacttatgcctcctgccaac

SEQ ID NO: 30918 - DNA, 20 bp, Artificial Sequence
  sgRNA
  Lrig2_15
ggcagaactcccatgcatcg

SEQ ID NO: 30919 - DNA, 20 bp, Artificial Sequence
  sgRNA
  Lrig2_16
tctggtcctcgagtagatgt

SEQ ID NO: 30920 - DNA, 20 bp, Artificial Sequence
  sgRNA
  Lrig2_17
atggatctaactattcgcac

SEQ ID NO: 30921 - DNA, 20 bp, Artificial Sequence
  sgRNA
  Lrig2_18
gagttgctgtagccttcctg

SEQ ID NO: 30922 - DNA, 20 bp, Artificial Sequence
  sgRNA
  Lrig2_19
ctgcgactgcagtccagcag

SEQ ID NO: 30923 - DNA, 20 bp, Artificial Sequence
  sgRNA
  Lrig2_20
ggaaggctacagcaactctg

SEQ ID NO: 30924 - DNA, 20 bp, Artificial Sequence
  sgRNA
  Lrig3_1
cgtccagccagaaacgcagt

SEQ ID NO: 30925 - DNA, 20 bp, Artificial Sequence
  sgRNA
  Lrig3_2
aacctaaccgagattaccaa

SEQ ID NO: 30926 - DNA, 20 bp, Artificial Sequence
  sgRNA
  Lrig3_3
gtgacggttctgtctaacag

SEQ ID NO: 30927 - DNA, 20 bp, Artificial Sequence
  sgRNA
  Lrig3_4
cggagtatgacgaaccgaag

SEQ ID NO: 30928 - DNA, 20 bp, Artificial Sequence
  sgRNA
  Lrig3_5
tttcgtccagttcagccgag

SEQ ID NO: 30929 - DNA, 20 bp, Artificial Sequence
  sgRNA
  Lrig3_6
tatgatgaccacccacacga

SEQ ID NO: 30930 - DNA, 20 bp, Artificial Sequence
  sgRNA
  Lrig3_7
gtgtctaaacaagtcctccg

SEQ ID NO: 30931 - DNA, 20 bp, Artificial Sequence
  sgRNA
  Lrig3_8
atgtggaattcaccagcgaa

SEQ ID NO: 30932 - DNA, 20 bp, Artificial Sequence
  sgRNA
  Lrig3_9
atatgatgaccacccacacg

SEQ ID NO: 30933 - DNA, 20 bp, Artificial Sequence
  sgRNA
  Lrig3_10
tcatataccacacaaggcgg

SEQ ID NO: 30934 - DNA, 20 bp, Artificial Sequence
  sgRNA
  Lrig3_11
gcctctcggtcaccaccaaa

SEQ ID NO: 30935 - DNA, 20 bp, Artificial Sequence
  sgRNA
  Lrig3_12
gtgcatgcgtctctctcggg

SEQ ID NO: 30936 - DNA, 20 bp, Artificial Sequence
  sgRNA
  Lrig3_13
gtatgacgaaccgaagtggt

SEQ ID NO: 30937 - DNA, 20 bp, Artificial Sequence
  sgRNA
  Lrig3_14
tggaccatcgaagacatgag

SEQ ID NO: 30938 - DNA, 20 bp, Artificial Sequence
  sgRNA
  Lrig3_15
gattcccctgtagatacaca

SEQ ID NO: 30939 - DNA, 20 bp, Artificial Sequence
  sgRNA
  Lrig3_16
gagtgtcgtccatggaacca

SEQ ID NO: 30940 - DNA, 20 bp, Artificial Sequence
  sgRNA
  Lrig3_17
gttagacagaaccgtcacca

SEQ ID NO: 30941 - DNA, 20 bp, Artificial Sequence
  sgRNA
  Lrig3_18
ttagacagaaccgtcaccaa

SEQ ID NO: 30942 - DNA, 20 bp, Artificial Sequence
  sgRNA
  Lrig3_19
ccctgtactgaaatccacgg

SEQ ID NO: 30943 - DNA, 20 bp, Artificial Sequence
  sgRNA
  Lrig3_20
gggcgtggtgatcatagctg

SEQ ID NO: 30944 - DNA, 20 bp, Artificial Sequence
  sgRNA
  Lrit1_1
ttcaaacctgatcttcatcg

SEQ ID NO: 30945 - DNA, 20 bp, Artificial Sequence
  sgRNA
  Lrit1_2
agacttctaccggatacagt

SEQ ID NO: 30946 - DNA, 20 bp, Artificial Sequence
  sgRNA
  Lrit1_3
ctggaggcagagtcaagtca

SEQ ID NO: 30947 - DNA, 20 bp, Artificial Sequence
  sgRNA
  Lrit1_4
agcacagtattgctacgttg

SEQ ID NO: 30948 - DNA, 20 bp, Artificial Sequence
  sgRNA
  Lrit1_5
gccaatggacgaccactcaa

SEQ ID NO: 30949 - DNA, 20 bp, Artificial Sequence
  sgRNA
  Lrit1_6
gcaatactgtgctacccaaa

SEQ ID NO: 30950 - DNA, 20 bp, Artificial Sequence
  sgRNA
  Lrit1_7
gccgacagtcacacacccag

SEQ ID NO: 30951 - DNA, 20 bp, Artificial Sequence
  sgRNA
  Lrit1_8
agagagaaccgccattcgca

SEQ ID NO: 30952 - DNA, 20 bp, Artificial Sequence
  sgRNA
  Lrit1_9
aagactagtgtcactatcga

SEQ ID NO: 30953 - DNA, 20 bp, Artificial Sequence
  sgRNA
  Lrit1_10
atagtgacactagtcttccc

SEQ ID NO: 30954 - DNA, 20 bp, Artificial Sequence
  sgRNA
  Lrit1_11
tgagacgcctacgagagctg

SEQ ID NO: 30955 - DNA, 20 bp, Artificial Sequence
  sgRNA
  Lrit1_12
ggctctccagaactttcaga

SEQ ID NO: 30956 - DNA, 20 bp, Artificial Sequence
  sgRNA
  Lrit1_13
cagtctttccaaattaacat

SEQ ID NO: 30957 - DNA, 20 bp, Artificial Sequence
  sgRNA
  Lrit1_14
tgtccctcagcgcagcccag

SEQ ID NO: 30958 - DNA, 20 bp, Artificial Sequence
  sgRNA
  Lrit1_15
ccgcctggtcacgttcccct

SEQ ID NO: 30959 - DNA, 20 bp, Artificial Sequence
  sgRNA
  Lrit1_16
gacactttcttagctccagc

SEQ ID NO: 30960 - DNA, 20 bp, Artificial Sequence
  sgRNA
  Lrit1_17
gctacatgctcgggcatatg

SEQ ID NO: 30961 - DNA, 20 bp, Artificial Sequence
  sgRNA
  Lrit1_18
gagccgacagtcacacaccc

SEQ ID NO: 30962 - DNA, 20 bp, Artificial Sequence
  sgRNA
  Lrit1_19
gagcccagagctccgtccag

SEQ ID NO: 30963 - DNA, 20 bp, Artificial Sequence
  sgRNA
  Lrit1_20
gtagccacagctgctccagg

SEQ ID NO: 30964 - DNA, 20 bp, Artificial Sequence
  sgRNA
  Lrit2_1
gataccttctgcaattggcg

SEQ ID NO: 30965 - DNA, 20 bp, Artificial Sequence
  sgRNA
  Lrit2_2
gatagtgacattgacactag

SEQ ID NO: 30966 - DNA, 20 bp, Artificial Sequence
  sgRNA
  Lrit2_3
gaattcaccagtatgaaagg

SEQ ID NO: 30967 - DNA, 20 bp, Artificial Sequence
  sgRNA
  Lrit2_4
ccttatttgaactttcccag

SEQ ID NO: 30968 - DNA, 20 bp, Artificial Sequence
  sgRNA
  Lrit2_5
catgttggtgaaaaacccct

SEQ ID NO: 30969 - DNA, 20 bp, Artificial Sequence
  sgRNA
  Lrit2_6
tggaatcaacacatacgccg

SEQ ID NO: 30970 - DNA, 20 bp, Artificial Sequence
  sgRNA
  Lrit2_7
gttgtgcgactgccgattaa

SEQ ID NO: 30971 - DNA, 20 bp, Artificial Sequence
  sgRNA
  Lrit2_8
gctcagtttgtcaagtccgt

SEQ ID NO: 30972 - DNA, 20 bp, Artificial Sequence
  sgRNA
  Lrit2_9
aattcgtacctggtatgcca

SEQ ID NO: 30973 - DNA, 20 bp, Artificial Sequence
  sgRNA
  Lrit2_10
gaccactcgtaggtcaacat

SEQ ID NO: 30974 - DNA, 20 bp, Artificial Sequence
  sgRNA
  Lrit2_11
tgtcgctgcacaataatcct

SEQ ID NO: 30975 - DNA, 20 bp, Artificial Sequence
  sgRNA
  Lrit2_12
tgacaggcaaagacagtggt

SEQ ID NO: 30976 - DNA, 20 bp, Artificial Sequence
  sgRNA
  Lrit2_13
aagctgttgccgtttctgat

SEQ ID NO: 30977 - DNA, 20 bp, Artificial Sequence
  sgRNA
  Lrit2_14
acaaactccgttcagtacca

SEQ ID NO: 30978 - DNA, 20 bp, Artificial Sequence
  sgRNA
  Lrit2_15
gtttgagatccaaaacccgc

SEQ ID NO: 30979 - DNA, 20 bp, Artificial Sequence
  sgRNA
  Lrit2_16
ctgtctgcttgaccactcgt

SEQ ID NO: 30980 - DNA, 20 bp, Artificial Sequence
  sgRNA
  Lrit2_17
gcagctcaactggtagatgg

SEQ ID NO: 30981 - DNA, 20 bp, Artificial Sequence
  sgRNA
  Lrit2_18
ggaagtatcccctgagcacg

SEQ ID NO: 30982 - DNA, 20 bp, Artificial Sequence
  sgRNA
  Lrit2_19
tgcctatgttgacctacgag

SEQ ID NO: 30983 - DNA, 20 bp, Artificial Sequence
  sgRNA
  Lrit2_20
agggtcctgtctctaaggca

SEQ ID NO: 30984 - DNA, 20 bp, Artificial Sequence
  sgRNA
  Lrit3_1
cagctctctatacatctacg

SEQ ID NO: 30985 - DNA, 20 bp, Artificial Sequence
  sgRNA
  Lrit3_2
ctgacgtggaccagatccga

SEQ ID NO: 30986 - DNA, 20 bp, Artificial Sequence
  sgRNA
  Lrit3_3
tgtgacagtcacagaaccag

SEQ ID NO: 30987 - DNA, 20 bp, Artificial Sequence
  sgRNA
  Lrit3_4
gtagctgacatcatcacgga

SEQ ID NO: 30988 - DNA, 20 bp, Artificial Sequence
  sgRNA
  Lrit3_5
ggtagtagaaggcctcggcg

SEQ ID NO: 30989 - DNA, 20 bp, Artificial Sequence
  sgRNA
  Lrit3_6
catcagagtcacactcacgc

SEQ ID NO: 30990 - DNA, 20 bp, Artificial Sequence
  sgRNA
  Lrit3_7
gcatctcaggacgcaccgcc

SEQ ID NO: 30991 - DNA, 20 bp, Artificial Sequence
  sgRNA
  Lrit3_8
agtcccagcaaacttccccg

SEQ ID NO: 30992 - DNA, 20 bp, Artificial Sequence
  sgRNA
  Lrit3_9
gctatgctcccagtcaagtg

SEQ ID NO: 30993 - DNA, 20 bp, Artificial Sequence
  sgRNA
  Lrit3_10
gatgctggtttgtacactgg

SEQ ID NO: 30994 - DNA, 20 bp, Artificial Sequence
  sgRNA
  Lrit3_11
ctaaatcctggttatcaccc

SEQ ID NO: 30995 - DNA, 20 bp, Artificial Sequence
  sgRNA
  Lrit3_12
taggggcacgactataacac

SEQ ID NO: 30996 - DNA, 20 bp, Artificial Sequence
  sgRNA
  Lrit3_13
tttctaccaacagagttgag

SEQ ID NO: 30997 - DNA, 20 bp, Artificial Sequence
  sgRNA
  Lrit3_14
acagtggtcattgctcctcg

SEQ ID NO: 30998 - DNA, 20 bp, Artificial Sequence
  sgRNA
  Lrit3_15
ggaaagtccgggcttctaga

SEQ ID NO: 30999 - DNA, 20 bp, Artificial Sequence
  sgRNA
  Lrit3_16
gttgctcgacaagtccaagc

SEQ ID NO: 31000 - DNA, 20 bp, Artificial Sequence
  sgRNA
  Lrit3_17
atgtgacagtcacagaacca

SEQ ID NO: 31001 - DNA, 20 bp, Artificial Sequence
  sgRNA
  Lrit3_18
agacgactatggcaagaacc

SEQ ID NO: 31002 - DNA, 20 bp, Artificial Sequence
  sgRNA
  Lrit3_19
gtgatacacagatcctcccg

SEQ ID NO: 31003 - DNA, 20 bp, Artificial Sequence
  sgRNA
  Lrit3_20
gcatctctcacaaggatgct

SEQ ID NO: 31004 - DNA, 20 bp, Artificial Sequence
  sgRNA
  Lrp1_1
gctgcggaacagtaccacgt

SEQ ID NO: 31005 - DNA, 20 bp, Artificial Sequence
  sgRNA
  Lrp1_2
aaatgccgggtaaataacgg

SEQ ID NO: 31006 - DNA, 20 bp, Artificial Sequence
  sgRNA
  Lrp1_3
actgcgtcttacccagactg

SEQ ID NO: 31007 - DNA, 20 bp, Artificial Sequence
  sgRNA
  Lrp1_4
tgacggtagcgatgattgcg

SEQ ID NO: 31008 - DNA, 20 bp, Artificial Sequence
  sgRNA
  Lrp1_5
tgaggtgtccaagcttaacg

SEQ ID NO: 31009 - DNA, 20 bp, Artificial Sequence
  sgRNA
  Lrp1_6
ctgccacgccccgttccaag

SEQ ID NO: 31010 - DNA, 20 bp, Artificial Sequence
  sgRNA
  Lrp1_7
gcacgtcagatggagatccg

SEQ ID NO: 31011 - DNA, 20 bp, Artificial Sequence
  sgRNA
  Lrp1_8
agatgaagccggtctcggcg

SEQ ID NO: 31012 - DNA, 20 bp, Artificial Sequence
  sgRNA
  Lrp1_9
cacttatcgcctgtgtaacg

SEQ ID NO: 31013 - DNA, 20 bp, Artificial Sequence
  sgRNA
  Lrp1_10
gcgttccgtgacgtagtcca

SEQ ID NO: 31014 - DNA, 20 bp, Artificial Sequence
  sgRNA
  Lrp1_11
ctacctagactacatcgagg

SEQ ID NO: 31015 - DNA, 20 bp, Artificial Sequence
  sgRNA
  Lrp1_12
gccacggcgatgatgcccat

SEQ ID NO: 31016 - DNA, 20 bp, Artificial Sequence
  sgRNA
  Lrp1_13
ataactgaagtccatggccg

SEQ ID NO: 31017 - DNA, 20 bp, Artificial Sequence
  sgRNA
  Lrp1_14
gcgtgaccagacatggcgag

SEQ ID NO: 31018 - DNA, 20 bp, Artificial Sequence
  sgRNA
  Lrp1_15
gccaatggctccatcaagcg

SEQ ID NO: 31019 - DNA, 20 bp, Artificial Sequence
  sgRNA
  Lrp1_16
ctttgtctgtaaccgaaacg

SEQ ID NO: 31020 - DNA, 20 bp, Artificial Sequence
  sgRNA
  Lrp1_17
gggcaagatgacacacccca

SEQ ID NO: 31021 - DNA, 20 bp, Artificial Sequence
  sgRNA
  Lrp1_18
gactggccacaacgtcaccg

SEQ ID NO: 31022 - DNA, 20 bp, Artificial Sequence
  sgRNA
  Lrp1_19
acaacctgctcctcgcaccg

SEQ ID NO: 31023 - DNA, 20 bp, Artificial Sequence
  sgRNA
  Lrp1_20
cttgcacgagagtctcccga

SEQ ID NO: 31024 - DNA, 20 bp, Artificial Sequence
  sgRNA
  Lrp10_1
aagtacaaggcactttacag

SEQ ID NO: 31025 - DNA, 20 bp, Artificial Sequence
  sgRNA
  Lrp10_2
gaggctacgtagcagtcgag

SEQ ID NO: 31026 - DNA, 20 bp, Artificial Sequence
  sgRNA
  Lrp10_3
ggccaggtgtgaatatccag

SEQ ID NO: 31027 - DNA, 20 bp, Artificial Sequence
  sgRNA
  Lrp10_4
aggtgagcgttgctatagcg

SEQ ID NO: 31028 - DNA, 20 bp, Artificial Sequence
  sgRNA
  Lrp10_5
ggagttgtccaggtcctacg

SEQ ID NO: 31029 - DNA, 20 bp, Artificial Sequence
  sgRNA
  Lrp10_6
gtaatggtgacattgccccc

SEQ ID NO: 31030 - DNA, 20 bp, Artificial Sequence
  sgRNA
  Lrp10_7
aggccaggtgtgaatatcca

SEQ ID NO: 31031 - DNA, 20 bp, Artificial Sequence
  sgRNA
  Lrp10_8
tatgggcagctcattgccca

SEQ ID NO: 31032 - DNA, 20 bp, Artificial Sequence
  sgRNA
  Lrp10_9
agaacgtctggtagttgcag

SEQ ID NO: 31033 - DNA, 20 bp, Artificial Sequence
  sgRNA
  Lrp10_10
tctgcttcagatcttacgcc

SEQ ID NO: 31034 - DNA, 20 bp, Artificial Sequence
  sgRNA
  Lrp10_11
gcgccgatggagcggatgag

SEQ ID NO: 31035 - DNA, 20 bp, Artificial Sequence
  sgRNA
  Lrp10_12
gggctcagagacagtagcaa

SEQ ID NO: 31036 - DNA, 20 bp, Artificial Sequence
  sgRNA
  Lrp10_13
gaccccataaaagtcctcca

SEQ ID NO: 31037 - DNA, 20 bp, Artificial Sequence
  sgRNA
  Lrp10_14
aggccagagcccaagccaca

SEQ ID NO: 31038 - DNA, 20 bp, Artificial Sequence
  sgRNA
  Lrp10_15
gatgattctacaggcactga

SEQ ID NO: 31039 - DNA, 20 bp, Artificial Sequence
  sgRNA
  Lrp10_16
ctgggcaatgagctgcccat

SEQ ID NO: 31040 - DNA, 20 bp, Artificial Sequence
  sgRNA
  Lrp10_17
gaggaagcaggccccaacga

SEQ ID NO: 31041 - DNA, 20 bp, Artificial Sequence
  sgRNA
  Lrp10_18
gacgttctgcgccgatggag

SEQ ID NO: 31042 - DNA, 20 bp, Artificial Sequence
  sgRNA
  Lrp10_19
tgatgggattgatgcctgcg

SEQ ID NO: 31043 - DNA, 20 bp, Artificial Sequence
  sgRNA
  Lrp10_20
gccgatggcacagatgagga

SEQ ID NO: 31044 - DNA, 20 bp, Artificial Sequence
  sgRNA
  Lrp11_1
cggtacggcggtctaccggg

SEQ ID NO: 31045 - DNA, 20 bp, Artificial Sequence
  sgRNA
  Lrp11_2
cagttgaacaggtagcagcg

SEQ ID NO: 31046 - DNA, 20 bp, Artificial Sequence
  sgRNA
  Lrp11_3
ttacaccctcagtcgcgccg

SEQ ID NO: 31047 - DNA, 20 bp, Artificial Sequence
  sgRNA
  Lrp11_4
ctgaagcagcctatccactc

SEQ ID NO: 31048 - DNA, 20 bp, Artificial Sequence
  sgRNA
  Lrp11_5
ccttcatgtccactgacgat

SEQ ID NO: 31049 - DNA, 20 bp, Artificial Sequence
  sgRNA
  Lrp11_6
ggtgacatgccgactccgac

SEQ ID NO: 31050 - DNA, 20 bp, Artificial Sequence
  sgRNA
  Lrp11_7
gaagtcttcatcagacccgt

SEQ ID NO: 31051 - DNA, 20 bp, Artificial Sequence
  sgRNA
  Lrp11_8
cacccaggattccatcgcgg

SEQ ID NO: 31052 - DNA, 20 bp, Artificial Sequence
  sgRNA
  Lrp11_9
aatcggactacctcatcaat

SEQ ID NO: 31053 - DNA, 20 bp, Artificial Sequence
  sgRNA
  Lrp11_10
gctgactgtgactgactccg

SEQ ID NO: 31054 - DNA, 20 bp, Artificial Sequence
  sgRNA
  Lrp11_11
tgatggtatcgggcaccgcc

SEQ ID NO: 31055 - DNA, 20 bp, Artificial Sequence
  sgRNA
  Lrp11_12
acgccattgtcctttatgag

SEQ ID NO: 31056 - DNA, 20 bp, Artificial Sequence
  sgRNA
  Lrp11_13
ctagagccggagctactggg

SEQ ID NO: 31057 - DNA, 20 bp, Artificial Sequence
  sgRNA
  Lrp11_14
gcaagttcgcgccactccgc

SEQ ID NO: 31058 - DNA, 20 bp, Artificial Sequence
  sgRNA
  Lrp11_15
gcgcgaacttgcagacgctg

SEQ ID NO: 31059 - DNA, 20 bp, Artificial Sequence
  sgRNA
  Lrp11_16
agtggctcttgaccgcaagt

SEQ ID NO: 31060 - DNA, 20 bp, Artificial Sequence
  sgRNA
  Lrp11_17
ctgtgtgtgtcaccaacttg

SEQ ID NO: 31061 - DNA, 20 bp, Artificial Sequence
  sgRNA
  Lrp11_18
ctgttcaactgcacggcgcg

SEQ ID NO: 31062 - DNA, 20 bp, Artificial Sequence
  sgRNA
  Lrp11_19
tctagaactaccccgtctgt

SEQ ID NO: 31063 - DNA, 20 bp, Artificial Sequence
  sgRNA
  Lrp11_20
gtaagctccttccttcaggc

SEQ ID NO: 31064 - DNA, 20 bp, Artificial Sequence
  sgRNA
  Lrp12_1
atgtactcttatctgtccgg

SEQ ID NO: 31065 - DNA, 20 bp, Artificial Sequence
  sgRNA
  Lrp12_2
agtggaaccggatccaaacg

SEQ ID NO: 31066 - DNA, 20 bp, Artificial Sequence
  sgRNA
  Lrp12_3
caggtgcagttacttccagg

SEQ ID NO: 31067 - DNA, 20 bp, Artificial Sequence
  sgRNA
  Lrp12_4
ctggcattgcccaaacggaa

SEQ ID NO: 31068 - DNA, 20 bp, Artificial Sequence
  sgRNA
  Lrp12_5
agttgcagcgatcagaacga

SEQ ID NO: 31069 - DNA, 20 bp, Artificial Sequence
  sgRNA
  Lrp12_6
tgagacccagttgtcacgcg

SEQ ID NO: 31070 - DNA, 20 bp, Artificial Sequence
  sgRNA
  Lrp12_7
ggttacttgttctcactcca

SEQ ID NO: 31071 - DNA, 20 bp, Artificial Sequence
  sgRNA
  Lrp12_8
ttatagtaatgatctcccct

SEQ ID NO: 31072 - DNA, 20 bp, Artificial Sequence
  sgRNA
  Lrp12_9
tcccactgtggcctccacgg

SEQ ID NO: 31073 - DNA, 20 bp, Artificial Sequence
  sgRNA
  Lrp12_10
gcacaaaagagtctcagcgg

SEQ ID NO: 31074 - DNA, 20 bp, Artificial Sequence
  sgRNA
  Lrp12_11
gctcataagggcaaacccag

SEQ ID NO: 31075 - DNA, 20 bp, Artificial Sequence
  sgRNA
  Lrp12_12
tccacagcggaactgatcac

SEQ ID NO: 31076 - DNA, 20 bp, Artificial Sequence
  sgRNA
  Lrp12_13
gatacggcgggagcatcggg

SEQ ID NO: 31077 - DNA, 20 bp, Artificial Sequence
  sgRNA
  Lrp12_14
tcacagaagcttattctccg

SEQ ID NO: 31078 - DNA, 20 bp, Artificial Sequence
  sgRNA
  Lrp12_15
gctttaagtcggatgactca

SEQ ID NO: 31079 - DNA, 20 bp, Artificial Sequence
  sgRNA
  Lrp12_16
gcgatcaactgtccatatga

SEQ ID NO: 31080 - DNA, 20 bp, Artificial Sequence
  sgRNA
  Lrp12_17
gctgctgttatgactctggt

SEQ ID NO: 31081 - DNA, 20 bp, Artificial Sequence
  sgRNA
  Lrp12_18
acaatgccacagcgctcgca

SEQ ID NO: 31082 - DNA, 20 bp, Artificial Sequence
  sgRNA
  Lrp12_19
tggacacgctgtcatctgag

SEQ ID NO: 31083 - DNA, 20 bp, Artificial Sequence
  sgRNA
  Lrp12_20
gatgactcagggcctgcgct

SEQ ID NO: 31084 - DNA, 20 bp, Artificial Sequence
  sgRNA
  Lrp1b_1
aagacgttctgagatccgag

SEQ ID NO: 31085 - DNA, 20 bp, Artificial Sequence
  sgRNA
  Lrp1b_2
gtgggagtagtagactacca

SEQ ID NO: 31086 - DNA, 20 bp, Artificial Sequence
  sgRNA
  Lrp1b_3
acacagcgacgattgtagca

SEQ ID NO: 31087 - DNA, 20 bp, Artificial Sequence
  sgRNA
  Lrp1b_4
tatgatccacgaaaacaaca

SEQ ID NO: 31088 - DNA, 20 bp, Artificial Sequence
  sgRNA
  Lrp1b_5
ggatagctcatcactcccgt

SEQ ID NO: 31089 - DNA, 20 bp, Artificial Sequence
  sgRNA
  Lrp1b_6
attgtggtagatccagtcaa

SEQ ID NO: 31090 - DNA, 20 bp, Artificial Sequence
  sgRNA
  Lrp1b_7
cagatgtgtgaacatccccc

SEQ ID NO: 31091 - DNA, 20 bp, Artificial Sequence
  sgRNA
  Lrp1b_8
agtactcagtttaatccagg

SEQ ID NO: 31092 - DNA, 20 bp, Artificial Sequence
  sgRNA
  Lrp1b_9
ccaagtccaaatgttcccgg

SEQ ID NO: 31093 - DNA, 20 bp, Artificial Sequence
  sgRNA
  Lrp1b_10
atcactgtaaaagatccgat

SEQ ID NO: 31094 - DNA, 20 bp, Artificial Sequence
  sgRNA
  Lrp1b_11
gtatatccattcaactacag

SEQ ID NO: 31095 - DNA, 20 bp, Artificial Sequence
  sgRNA
  Lrp1b_12
tggtcggcgagaattaagaa

SEQ ID NO: 31096 - DNA, 20 bp, Artificial Sequence
  sgRNA
  Lrp1b_13
ggatcactcccatatagagg

SEQ ID NO: 31097 - DNA, 20 bp, Artificial Sequence
  sgRNA
  Lrp1b_14
catactgtataccaatccga

SEQ ID NO: 31098 - DNA, 20 bp, Artificial Sequence
  sgRNA
  Lrp1b_15
gattgtcaatgtccacccct

SEQ ID NO: 31099 - DNA, 20 bp, Artificial Sequence
  sgRNA
  Lrp1b_16
gcgtgaaaatctaaagcacg

SEQ ID NO: 31100 - DNA, 20 bp, Artificial Sequence
  sgRNA
  Lrp1b_17
tgctacaagatgttattgcg

SEQ ID NO: 31101 - DNA, 20 bp, Artificial Sequence
  sgRNA
  Lrp1b_18
gcaagacgttctgagatccg

SEQ ID NO: 31102 - DNA, 20 bp, Artificial Sequence
  sgRNA
  Lrp1b_19
gttctcgtagggccgtactg

SEQ ID NO: 31103 - DNA, 20 bp, Artificial Sequence
  sgRNA
  Lrp1b_20
gataaaatagatgacagcgt

SEQ ID NO: 31104 - DNA, 20 bp, Artificial Sequence
  sgRNA
  Lrp2_1
gatatgaccgttgttcgacg

SEQ ID NO: 31105 - DNA, 20 bp, Artificial Sequence
  sgRNA
  Lrp2_2
tggatggcaattattccgag

SEQ ID NO: 31106 - DNA, 20 bp, Artificial Sequence
  sgRNA
  Lrp2_3
gtatcctattggacacacgc

SEQ ID NO: 31107 - DNA, 20 bp, Artificial Sequence
  sgRNA
  Lrp2_4
tgataggcgcaacgactgtg

SEQ ID NO: 31108 - DNA, 20 bp, Artificial Sequence
  sgRNA
  Lrp2_5
gctgatgccacgtcgaacaa

SEQ ID NO: 31109 - DNA, 20 bp, Artificial Sequence
  sgRNA
  Lrp2_6
cttccggtaccttccgtcaa

SEQ ID NO: 31110 - DNA, 20 bp, Artificial Sequence
  sgRNA
  Lrp2_7
gtatggcacacatcgcccat

SEQ ID NO: 31111 - DNA, 20 bp, Artificial Sequence
  sgRNA
  Lrp2_8
ttatctctaccaagatcgaa

SEQ ID NO: 31112 - DNA, 20 bp, Artificial Sequence
  sgRNA
  Lrp2_9
accgtgctaacaagtacgat

SEQ ID NO: 31113 - DNA, 20 bp, Artificial Sequence
  sgRNA
  Lrp2_10
agttccactgtgataacggc

SEQ ID NO: 31114 - DNA, 20 bp, Artificial Sequence
  sgRNA
  Lrp2_11
gggattctcctccgtcacga

SEQ ID NO: 31115 - DNA, 20 bp, Artificial Sequence
  sgRNA
  Lrp2_12
aggtagctacccttgacgga

SEQ ID NO: 31116 - DNA, 20 bp, Artificial Sequence
  sgRNA
  Lrp2_13
gatacaacgcccattaaggc

SEQ ID NO: 31117 - DNA, 20 bp, Artificial Sequence
  sgRNA
  Lrp2_14
gaccgaccttctctactggg

SEQ ID NO: 31118 - DNA, 20 bp, Artificial Sequence
  sgRNA
  Lrp2_15
gcaatgcatcccctctcgat

SEQ ID NO: 31119 - DNA, 20 bp, Artificial Sequence
  sgRNA
  Lrp2_16
gatgcaccacaatggatcga

SEQ ID NO: 31120 - DNA, 20 bp, Artificial Sequence
  sgRNA
  Lrp2_17
tgatggacagaaccgaaggc

SEQ ID NO: 31121 - DNA, 20 bp, Artificial Sequence
  sgRNA
  Lrp2_18
tggtaaactgtcactccgaa

SEQ ID NO: 31122 - DNA, 20 bp, Artificial Sequence
  sgRNA
  Lrp2_19
tgtgcctcatcaaagcagga

SEQ ID NO: 31123 - DNA, 20 bp, Artificial Sequence
  sgRNA
  Lrp2_20
ccactcccataactattcca

SEQ ID NO: 31124 - DNA, 20 bp, Artificial Sequence
  sgRNA
  Lrp3_1
gcaaccatgtgggagcagcg

SEQ ID NO: 31125 - DNA, 20 bp, Artificial Sequence
  sgRNA
  Lrp3_2
cctgtactcctgcgtgcgca

SEQ ID NO: 31126 - DNA, 20 bp, Artificial Sequence
  sgRNA
  Lrp3_3
gacccaaatgacacgcttag

SEQ ID NO: 31127 - DNA, 20 bp, Artificial Sequence
  sgRNA
  Lrp3_4
gcccaacaggagccagtcga

SEQ ID NO: 31128 - DNA, 20 bp, Artificial Sequence
  sgRNA
  Lrp3_5
caggaaaatcctcaaccggt

SEQ ID NO: 31129 - DNA, 20 bp, Artificial Sequence
  sgRNA
  Lrp3_6
cttcggaccttcactgcacg

SEQ ID NO: 31130 - DNA, 20 bp, Artificial Sequence
  sgRNA
  Lrp3_7
gaagggctactgcctcccgt

SEQ ID NO: 31131 - DNA, 20 bp, Artificial Sequence
  sgRNA
  Lrp3_8
ttccgcctctcctatatccg

SEQ ID NO: 31132 - DNA, 20 bp, Artificial Sequence
  sgRNA
  Lrp3_9
agtggaagaagatccagacg

SEQ ID NO: 31133 - DNA, 20 bp, Artificial Sequence
  sgRNA
  Lrp3_10
tttctggttgttgcaacgat

SEQ ID NO: 31134 - DNA, 20 bp, Artificial Sequence
  sgRNA
  Lrp3_11
ccatgcgacgacagatgcgt

SEQ ID NO: 31135 - DNA, 20 bp, Artificial Sequence
  sgRNA
  Lrp3_12
gccacgtctcaaagatgcac

SEQ ID NO: 31136 - DNA, 20 bp, Artificial Sequence
  sgRNA
  Lrp3_13
ctgtgcgatgagctgaccgt

SEQ ID NO: 31137 - DNA, 20 bp, Artificial Sequence
  sgRNA
  Lrp3_14
cacagggatactggtccgga

SEQ ID NO: 31138 - DNA, 20 bp, Artificial Sequence
  sgRNA
  Lrp3_15
gcaagcggccgagatgagca

SEQ ID NO: 31139 - DNA, 20 bp, Artificial Sequence
  sgRNA
  Lrp3_16
gccggccacatgctaggtcg

SEQ ID NO: 31140 - DNA, 20 bp, Artificial Sequence
  sgRNA
  Lrp3_17
tgcacaggttcgtaccacag

SEQ ID NO: 31141 - DNA, 20 bp, Artificial Sequence
  sgRNA
  Lrp3_18
ggtctcgcagatttaagggt

SEQ ID NO: 31142 - DNA, 20 bp, Artificial Sequence
  sgRNA
  Lrp3_19
ccgacgcatctgtcgtcgca

SEQ ID NO: 31143 - DNA, 20 bp, Artificial Sequence
  sgRNA
  Lrp3_20
gtaccacagtggaaggtgcc

SEQ ID NO: 31144 - DNA, 20 bp, Artificial Sequence
  sgRNA
  Lrp4_1
atagtgccaacaagtttacg

SEQ ID NO: 31145 - DNA, 20 bp, Artificial Sequence
  sgRNA
  Lrp4_2
tgacatctgtccaatacacg

SEQ ID NO: 31146 - DNA, 20 bp, Artificial Sequence
  sgRNA
  Lrp4_3
gacaacagtgacgagcaatg

SEQ ID NO: 31147 - DNA, 20 bp, Artificial Sequence
  sgRNA
  Lrp4_4
tggtataatacaatggcccg

SEQ ID NO: 31148 - DNA, 20 bp, Artificial Sequence
  sgRNA
  Lrp4_5
ccttggactatgatacccgc

SEQ ID NO: 31149 - DNA, 20 bp, Artificial Sequence
  sgRNA
  Lrp4_6
gtttcctcatcttcgccagg

SEQ ID NO: 31150 - DNA, 20 bp, Artificial Sequence
  sgRNA
  Lrp4_7
gtacctgtatccccgcccag

SEQ ID NO: 31151 - DNA, 20 bp, Artificial Sequence
  sgRNA
  Lrp4_8
ggtatgagctacggcccgat

SEQ ID NO: 31152 - DNA, 20 bp, Artificial Sequence
  sgRNA
  Lrp4_9
ctaccactatgtcccgagga

SEQ ID NO: 31153 - DNA, 20 bp, Artificial Sequence
  sgRNA
  Lrp4_10
ggacaggtggatctactgga

SEQ ID NO: 31154 - DNA, 20 bp, Artificial Sequence
  sgRNA
  Lrp4_11
gtagcagcgtgtactcggag

SEQ ID NO: 31155 - DNA, 20 bp, Artificial Sequence
  sgRNA
  Lrp4_12
ccatagcagcaccttccggt

SEQ ID NO: 31156 - DNA, 20 bp, Artificial Sequence
  sgRNA
  Lrp4_13
gctggaggcctcaatgcggg

SEQ ID NO: 31157 - DNA, 20 bp, Artificial Sequence
  sgRNA
  Lrp4_14
gaagtgtcagatggtgcgag

SEQ ID NO: 31158 - DNA, 20 bp, Artificial Sequence
  sgRNA
  Lrp4_15
cctcgactttcatcaccggc

SEQ ID NO: 31159 - DNA, 20 bp, Artificial Sequence
  sgRNA
  Lrp4_16
caatcgtatcgacatccggc

SEQ ID NO: 31160 - DNA, 20 bp, Artificial Sequence
  sgRNA
  Lrp4_17
cagcactgataccatcagca

SEQ ID NO: 31161 - DNA, 20 bp, Artificial Sequence
  sgRNA
  Lrp4_18
gattggccctctcgatgacg

SEQ ID NO: 31162 - DNA, 20 bp, Artificial Sequence
  sgRNA
  Lrp4_19
gctgagcattggtactgcga

SEQ ID NO: 31163 - DNA, 20 bp, Artificial Sequence
  sgRNA
  Lrp4_20
tgaccgacagcgaaactgtt

SEQ ID NO: 31164 - DNA, 20 bp, Artificial Sequence
  sgRNA
  Lrp5_1
cgtgtactggaccgacgatg

SEQ ID NO: 31165 - DNA, 20 bp, Artificial Sequence
  sgRNA
  Lrp5_2
tgggaccaattgtatgacac

SEQ ID NO: 31166 - DNA, 20 bp, Artificial Sequence
  sgRNA
  Lrp5_3
ggagactaacaacaacgatg

SEQ ID NO: 31167 - DNA, 20 bp, Artificial Sequence
  sgRNA
  Lrp5_4
tgggtgagtacagagcacta

SEQ ID NO: 31168 - DNA, 20 bp, Artificial Sequence
  sgRNA
  Lrp5_5
tgaggtgcgggctatccgca

SEQ ID NO: 31169 - DNA, 20 bp, Artificial Sequence
  sgRNA
  Lrp5_6
agacccctctctctacaacg

SEQ ID NO: 31170 - DNA, 20 bp, Artificial Sequence
  sgRNA
  Lrp5_7
ccactagccgcacatcccgg

SEQ ID NO: 31171 - DNA, 20 bp, Artificial Sequence
  sgRNA
  Lrp5_8
gccatacctcgaatgacgta

SEQ ID NO: 31172 - DNA, 20 bp, Artificial Sequence
  sgRNA
  Lrp5_9
aatactgcgtctctgccagt

SEQ ID NO: 31173 - DNA, 20 bp, Artificial Sequence
  sgRNA
  Lrp5_10
agataccaggatctttcggg

SEQ ID NO: 31174 - DNA, 20 bp, Artificial Sequence
  sgRNA
  Lrp5_11
tcgctggtcggcataatcaa

SEQ ID NO: 31175 - DNA, 20 bp, Artificial Sequence
  sgRNA
  Lrp5_12
gatgtgccagcgctacacag

SEQ ID NO: 31176 - DNA, 20 bp, Artificial Sequence
  sgRNA
  Lrp5_13
gctttcgattcgctttaggt

SEQ ID NO: 31177 - DNA, 20 bp, Artificial Sequence
  sgRNA
  Lrp5_14
acgttcctcagcccatgaag

SEQ ID NO: 31178 - DNA, 20 bp, Artificial Sequence
  sgRNA
  Lrp5_15
gatagcccgcacctcatcgt

SEQ ID NO: 31179 - DNA, 20 bp, Artificial Sequence
  sgRNA
  Lrp5_16
cgggcgccagaacatcaaga

SEQ ID NO: 31180 - DNA, 20 bp, Artificial Sequence
  sgRNA
  Lrp5_17
atccctgcccgctcgatccg

SEQ ID NO: 31181 - DNA, 20 bp, Artificial Sequence
  sgRNA
  Lrp5_18
gctcgatcatctgctgctgg

SEQ ID NO: 31182 - DNA, 20 bp, Artificial Sequence
  sgRNA
  Lrp5_19
ccatgcgaggaggacaacgg

SEQ ID NO: 31183 - DNA, 20 bp, Artificial Sequence
  sgRNA
  Lrp5_20
ggaggaacagaagctgtact

SEQ ID NO: 31184 - DNA, 20 bp, Artificial Sequence
  sgRNA
  Lrp6_1
ggatctaacacgatagcccg

SEQ ID NO: 31185 - DNA, 20 bp, Artificial Sequence
  sgRNA
  Lrp6_2
ttgccttagatccatcaagt

SEQ ID NO: 31186 - DNA, 20 bp, Artificial Sequence
  sgRNA
  Lrp6_3
tgtgtcctcaaataacgtca

SEQ ID NO: 31187 - DNA, 20 bp, Artificial Sequence
  sgRNA
  Lrp6_4
gttgttcatcaatcaccatg

SEQ ID NO: 31188 - DNA, 20 bp, Artificial Sequence
  sgRNA
  Lrp6_5
tgaataccgatggcaccggg

SEQ ID NO: 31189 - DNA, 20 bp, Artificial Sequence
  sgRNA
  Lrp6_6
gggtgaggaacataaccaag

SEQ ID NO: 31190 - DNA, 20 bp, Artificial Sequence
  sgRNA
  Lrp6_7
gaagagcgccatcaaccgca

SEQ ID NO: 31191 - DNA, 20 bp, Artificial Sequence
  sgRNA
  Lrp6_8
gtgactatgctcctagccgg

SEQ ID NO: 31192 - DNA, 20 bp, Artificial Sequence
  sgRNA
  Lrp6_9
ccgaagccagtacttgtcag

SEQ ID NO: 31193 - DNA, 20 bp, Artificial Sequence
  sgRNA
  Lrp6_10
aactattgctgttagcccga

SEQ ID NO: 31194 - DNA, 20 bp, Artificial Sequence
  sgRNA
  Lrp6_11
gatcactgctttcaattcgc

SEQ ID NO: 31195 - DNA, 20 bp, Artificial Sequence
  sgRNA
  Lrp6_12
tcaggagcggaagctttact

SEQ ID NO: 31196 - DNA, 20 bp, Artificial Sequence
  sgRNA
  Lrp6_13
ccacacacaaaacctccgac

SEQ ID NO: 31197 - DNA, 20 bp, Artificial Sequence
  sgRNA
  Lrp6_14
ccatcgactatgctaaaagg

SEQ ID NO: 31198 - DNA, 20 bp, Artificial Sequence
  sgRNA
  Lrp6_15
ccaccattatcaattccaca

SEQ ID NO: 31199 - DNA, 20 bp, Artificial Sequence
  sgRNA
  Lrp6_16
ctatgatcgagcgcacgtca

SEQ ID NO: 31200 - DNA, 20 bp, Artificial Sequence
  sgRNA
  Lrp6_17
ggtcttccactcttcccggc

SEQ ID NO: 31201 - DNA, 20 bp, Artificial Sequence
  sgRNA
  Lrp6_18
tgacgtgcgctcgatcatag

SEQ ID NO: 31202 - DNA, 20 bp, Artificial Sequence
  sgRNA
  Lrp6_19
atccatctatgaaggagcga

SEQ ID NO: 31203 - DNA, 20 bp, Artificial Sequence
  sgRNA
  Lrp6_20
gcttctttgacaccagtgag

SEQ ID NO: 31204 - DNA, 20 bp, Artificial Sequence
  sgRNA
  Lrp8_1
gagtgtctgcacaataacgg

SEQ ID NO: 31205 - DNA, 20 bp, Artificial Sequence
  sgRNA
  Lrp8_2
gttcgactgcgaggaccgct

SEQ ID NO: 31206 - DNA, 20 bp, Artificial Sequence
  sgRNA
  Lrp8_3
tcactcggttaacgtcccta

SEQ ID NO: 31207 - DNA, 20 bp, Artificial Sequence
  sgRNA
  Lrp8_4
ggtcctcgcagtcgaactgg

SEQ ID NO: 31208 - DNA, 20 bp, Artificial Sequence
  sgRNA
  Lrp8_5
ctatcctccgcacctcgtgt

SEQ ID NO: 31209 - DNA, 20 bp, Artificial Sequence
  sgRNA
  Lrp8_6
tcatcgcatctccacaccaa

SEQ ID NO: 31210 - DNA, 20 bp, Artificial Sequence
  sgRNA
  Lrp8_7
cctgccgagaagttaagctg

SEQ ID NO: 31211 - DNA, 20 bp, Artificial Sequence
  sgRNA
  Lrp8_8
cctccacagcggaactcgcg

SEQ ID NO: 31212 - DNA, 20 bp, Artificial Sequence
  sgRNA
  Lrp8_9
tcacgaaccgacacgaggtg

SEQ ID NO: 31213 - DNA, 20 bp, Artificial Sequence
  sgRNA
  Lrp8_10
aggtgccgcctcctccacag

SEQ ID NO: 31214 - DNA, 20 bp, Artificial Sequence
  sgRNA
  Lrp8_11
gatcttcacgaaccgacacg

SEQ ID NO: 31215 - DNA, 20 bp, Artificial Sequence
  sgRNA
  Lrp8_12
ggctgaagagagtacagcgg

SEQ ID NO: 31216 - DNA, 20 bp, Artificial Sequence
  sgRNA
  Lrp8_13
gtgtaagagtggcgagtgcg

SEQ ID NO: 31217 - DNA, 20 bp, Artificial Sequence
  sgRNA
  Lrp8_14
cgaccgccagttcgactgcg

SEQ ID NO: 31218 - DNA, 20 bp, Artificial Sequence
  sgRNA
  Lrp8_15
gctgcactggaactcgtgcg

SEQ ID NO: 31219 - DNA, 20 bp, Artificial Sequence
  sgRNA
  Lrp8_16
gccacgacattcttgagcat

SEQ ID NO: 31220 - DNA, 20 bp, Artificial Sequence
  sgRNA
  Lrp8_17
gagcagctgcactccccgga

SEQ ID NO: 31221 - DNA, 20 bp, Artificial Sequence
  sgRNA
  Lrp8_18
gtgtatccatctcatagcca

SEQ ID NO: 31222 - DNA, 20 bp, Artificial Sequence
  sgRNA
  Lrp8_19
tatggacccagtccaccgcc

SEQ ID NO: 31223 - DNA, 20 bp, Artificial Sequence
  sgRNA
  Lrp8_20
ttgccgttgaccccctgcga

SEQ ID NO: 31224 - DNA, 20 bp, Artificial Sequence
  sgRNA
  Lrrc15_1
caggctttcagacatcccca

SEQ ID NO: 31225 - DNA, 20 bp, Artificial Sequence
  sgRNA
  Lrrc15_2
catgggcccaaagacccccg

SEQ ID NO: 31226 - DNA, 20 bp, Artificial Sequence
  sgRNA
  Lrrc15_3
ggtctcaccaaactcaacct

SEQ ID NO: 31227 - DNA, 20 bp, Artificial Sequence
  sgRNA
  Lrrc15_4
tgttgaggaacttgtcctcg

SEQ ID NO: 31228 - DNA, 20 bp, Artificial Sequence
  sgRNA
  Lrrc15_5
cctgctgtccaataaccagc

SEQ ID NO: 31229 - DNA, 20 bp, Artificial Sequence
  sgRNA
  Lrrc15_6
acacatcaccgaactccccg

SEQ ID NO: 31230 - DNA, 20 bp, Artificial Sequence
  sgRNA
  Lrrc15_7
tgcaggctcatagcattcca

SEQ ID NO: 31231 - DNA, 20 bp, Artificial Sequence
  sgRNA
  Lrrc15_8
gcttcacccacctatcccct

SEQ ID NO: 31232 - DNA, 20 bp, Artificial Sequence
  sgRNA
  Lrrc15_9
ggtcctgtagagcattggtg

SEQ ID NO: 31233 - DNA, 20 bp, Artificial Sequence
  sgRNA
  Lrrc15_10
ggctcattctcaacagagcc

SEQ ID NO: 31234 - DNA, 20 bp, Artificial Sequence
  sgRNA
  Lrrc15_11
gtttgttgttggcaaggctg

SEQ ID NO: 31235 - DNA, 20 bp, Artificial Sequence
  sgRNA
  Lrrc15_12
tgtagagccaaagctccctc

SEQ ID NO: 31236 - DNA, 20 bp, Artificial Sequence
  sgRNA
  Lrrc15_13
aagtgatcaaagatgcccag

SEQ ID NO: 31237 - DNA, 20 bp, Artificial Sequence
  sgRNA
  Lrrc15_14
gtttggtgagacctaccagg

SEQ ID NO: 31238 - DNA, 20 bp, Artificial Sequence
  sgRNA
  Lrrc15_15
cctgaaggagctttccccgg

SEQ ID NO: 31239 - DNA, 20 bp, Artificial Sequence
  sgRNA
  Lrrc15_16
gctgctgctgctgcaaaaag

SEQ ID NO: 31240 - DNA, 20 bp, Artificial Sequence
  sgRNA
  Lrrc15_17
aatgctctacaggacctgga

SEQ ID NO: 31241 - DNA, 20 bp, Artificial Sequence
  sgRNA
  Lrrc15_18
tctccccaggagccttcaat

SEQ ID NO: 31242 - DNA, 20 bp, Artificial Sequence
  sgRNA
  Lrrc15_19
gtagtcatcatcggtagacc

SEQ ID NO: 31243 - DNA, 20 bp, Artificial Sequence
  sgRNA
  Lrrc15_20
ggtagacctggtgatctctg

SEQ ID NO: 31244 - DNA, 20 bp, Artificial Sequence
  sgRNA
  Lrrc19_1
gtgcaactcaagtagaccac

SEQ ID NO: 31245 - DNA, 20 bp, Artificial Sequence
  sgRNA
  Lrrc19_2
gtagctgtggtgcatcgaag

SEQ ID NO: 31246 - DNA, 20 bp, Artificial Sequence
  sgRNA
  Lrrc19_3
tcaatcagtgtaattcaaca

SEQ ID NO: 31247 - DNA, 20 bp, Artificial Sequence
  sgRNA
  Lrrc19_4
gagatcaagaatggtaacat

SEQ ID NO: 31248 - DNA, 20 bp, Artificial Sequence
  sgRNA
  Lrrc19_5
aattacactttgattccaga

SEQ ID NO: 31249 - DNA, 20 bp, Artificial Sequence
  sgRNA
  Lrrc19_6
gttataactgagatcaagaa

SEQ ID NO: 31250 - DNA, 20 bp, Artificial Sequence
  sgRNA
  Lrrc19_7
ccatcgcctggaagagcatg

SEQ ID NO: 31251 - DNA, 20 bp, Artificial Sequence
  sgRNA
  Lrrc19_8
agaccacaggtacagttcca

SEQ ID NO: 31252 - DNA, 20 bp, Artificial Sequence
  sgRNA
  Lrrc19_9
acattggtactgataccctc

SEQ ID NO: 31253 - DNA, 20 bp, Artificial Sequence
  sgRNA
  Lrrc19_10
gagtggcattcagttgtgaa

SEQ ID NO: 31254 - DNA, 20 bp, Artificial Sequence
  sgRNA
  Lrrc19_11
caactgttcaaatatcactg

SEQ ID NO: 31255 - DNA, 20 bp, Artificial Sequence
  sgRNA
  Lrrc19_12
attgaaagatgaattcctag

SEQ ID NO: 31256 - DNA, 20 bp, Artificial Sequence
  sgRNA
  Lrrc19_13
tcatctggagatactaactc

SEQ ID NO: 31257 - DNA, 20 bp, Artificial Sequence
  sgRNA
  Lrrc19_14
ctggagatactaactctgga

SEQ ID NO: 31258 - DNA, 20 bp, Artificial Sequence
  sgRNA
  Lrrc19_15
tccttctgctgaaattacat

SEQ ID NO: 31259 - DNA, 20 bp, Artificial Sequence
  sgRNA
  Lrrc19_16
tgtcgtgctttagctcatct

SEQ ID NO: 31260 - DNA, 20 bp, Artificial Sequence
  sgRNA
  Lrrc19_17
gctcttcacacaacttaaca

SEQ ID NO: 31261 - DNA, 20 bp, Artificial Sequence
  sgRNA
  Lrrc19_18
gagttacaaccaccatcgcc

SEQ ID NO: 31262 - DNA, 20 bp, Artificial Sequence
  sgRNA
  Lrrc19_19
tctgaatgctgcagatagca

SEQ ID NO: 31263 - DNA, 20 bp, Artificial Sequence
  sgRNA
  Lrrc19_20
tgagcctcttgggaaaagct

SEQ ID NO: 31264 - DNA, 20 bp, Artificial Sequence
  sgRNA
  Lrrc24_1
tcccaccgggaatccctccg

SEQ ID NO: 31265 - DNA, 20 bp, Artificial Sequence
  sgRNA
  Lrrc24_2
agtctactagaagtatctgg

SEQ ID NO: 31266 - DNA, 20 bp, Artificial Sequence
  sgRNA
  Lrrc24_3
gcttgaggcttaccatcgcg

SEQ ID NO: 31267 - DNA, 20 bp, Artificial Sequence
  sgRNA
  Lrrc24_4
gaggtccagtagggctaagg

SEQ ID NO: 31268 - DNA, 20 bp, Artificial Sequence
  sgRNA
  Lrrc24_5
aatagggtgccttctcccga

SEQ ID NO: 31269 - DNA, 20 bp, Artificial Sequence
  sgRNA
  Lrrc24_6
gctgggctcttggatcaaag

SEQ ID NO: 31270 - DNA, 20 bp, Artificial Sequence
  sgRNA
  Lrrc24_7
catagctgccaacaacagcg

SEQ ID NO: 31271 - DNA, 20 bp, Artificial Sequence
  sgRNA
  Lrrc24_8
ccagacttgagcccatcggg

SEQ ID NO: 31272 - DNA, 20 bp, Artificial Sequence
  sgRNA
  Lrrc24_9
cgcaggcaagtacgaatgcg

SEQ ID NO: 31273 - DNA, 20 bp, Artificial Sequence
  sgRNA
  Lrrc24_10
cagaacacaatcctcccgat

SEQ ID NO: 31274 - DNA, 20 bp, Artificial Sequence
  sgRNA
  Lrrc24_11
tgatctgccgacgccgacgc

SEQ ID NO: 31275 - DNA, 20 bp, Artificial Sequence
  sgRNA
  Lrrc24_12
ggcacccgagatactggcag

SEQ ID NO: 31276 - DNA, 20 bp, Artificial Sequence
  sgRNA
  Lrrc24_13
aaggtgccccagcctcgcga

SEQ ID NO: 31277 - DNA, 20 bp, Artificial Sequence
  sgRNA
  Lrrc24_14
ccgctgctacagcgccacag

SEQ ID NO: 31278 - DNA, 20 bp, Artificial Sequence
  sgRNA
  Lrrc24_15
agattagctgtaaactccgg

SEQ ID NO: 31279 - DNA, 20 bp, Artificial Sequence
  sgRNA
  Lrrc24_16
accggactccagcgcacgca

SEQ ID NO: 31280 - DNA, 20 bp, Artificial Sequence
  sgRNA
  Lrrc24_17
cttcctcaccaacatcacac

SEQ ID NO: 31281 - DNA, 20 bp, Artificial Sequence
  sgRNA
  Lrrc24_18
gctacgcctccctacacgtg

SEQ ID NO: 31282 - DNA, 20 bp, Artificial Sequence
  sgRNA
  Lrrc24_19
tttgtcaacgattattcgga

SEQ ID NO: 31283 - DNA, 20 bp, Artificial Sequence
  sgRNA
  Lrrc24_20
tggcgctctacggttgcgcg

SEQ ID NO: 31284 - DNA, 20 bp, Artificial Sequence
  sgRNA
  Lrrc25_1
ctgcatggttcacccgagca

SEQ ID NO: 31285 - DNA, 20 bp, Artificial Sequence
  sgRNA
  Lrrc25_2
cctgcaggccattcttagac

SEQ ID NO: 31286 - DNA, 20 bp, Artificial Sequence
  sgRNA
  Lrrc25_3
ctggttgtgggtgacaatca

SEQ ID NO: 31287 - DNA, 20 bp, Artificial Sequence
  sgRNA
  Lrrc25_4
ggcacctgcctcaatttcag

SEQ ID NO: 31288 - DNA, 20 bp, Artificial Sequence
  sgRNA
  Lrrc25_5
gcttgtcgaagaaagcccca

SEQ ID NO: 31289 - DNA, 20 bp, Artificial Sequence
  sgRNA
  Lrrc25_6
attgcaacctggagtccctg

SEQ ID NO: 31290 - DNA, 20 bp, Artificial Sequence
  sgRNA
  Lrrc25_7
gggacagctgacctgaagga

SEQ ID NO: 31291 - DNA, 20 bp, Artificial Sequence
  sgRNA
  Lrrc25_8
tccattgtgaacctgctggg

SEQ ID NO: 31292 - DNA, 20 bp, Artificial Sequence
  sgRNA
  Lrrc25_9
aaggccactgaaattgaggc

SEQ ID NO: 31293 - DNA, 20 bp, Artificial Sequence
  sgRNA
  Lrrc25_10
tgtgctcactggctctgcgg

SEQ ID NO: 31294 - DNA, 20 bp, Artificial Sequence
  sgRNA
  Lrrc25_11
accacccagcaggttcacaa

SEQ ID NO: 31295 - DNA, 20 bp, Artificial Sequence
  sgRNA
  Lrrc25_12
gattgtcacccacaaccagc

SEQ ID NO: 31296 - DNA, 20 bp, Artificial Sequence
  sgRNA
  Lrrc25_13
gaccatgagcagtcctcggc

SEQ ID NO: 31297 - DNA, 20 bp, Artificial Sequence
  sgRNA
  Lrrc25_14
ggactccaggttgcaataga

SEQ ID NO: 31298 - DNA, 20 bp, Artificial Sequence
  sgRNA
  Lrrc25_15
tgcagaccatgagcagtcct

SEQ ID NO: 31299 - DNA, 20 bp, Artificial Sequence
  sgRNA
  Lrrc25_16
tcagcccgtctattgcaacc

SEQ ID NO: 31300 - DNA, 20 bp, Artificial Sequence
  sgRNA
  Lrrc25_17
agcttgtcgaagaaagcccc

SEQ ID NO: 31301 - DNA, 20 bp, Artificial Sequence
  sgRNA
  Lrrc25_18
gctgcccggagcagttctgg

SEQ ID NO: 31302 - DNA, 20 bp, Artificial Sequence
  sgRNA
  Lrrc25_19
gggacatctgggctttgctg

SEQ ID NO: 31303 - DNA, 20 bp, Artificial Sequence
  sgRNA
  Lrrc25_20
gttctggcggagagcatacc

SEQ ID NO: 31304 - DNA, 20 bp, Artificial Sequence
  sgRNA
  Lrrc32_1
tgcagaggctaaacctacag

SEQ ID NO: 31305 - DNA, 20 bp, Artificial Sequence
  sgRNA
  Lrrc32_2
acaggcatggctctcaacag

SEQ ID NO: 31306 - DNA, 20 bp, Artificial Sequence
  sgRNA
  Lrrc32_3
gtgctggaagcattagaact

SEQ ID NO: 31307 - DNA, 20 bp, Artificial Sequence
  sgRNA
  Lrrc32_4
caatgtcctcatggatatcg

SEQ ID NO: 31308 - DNA, 20 bp, Artificial Sequence
  sgRNA
  Lrrc32_5
gagaagtccacacagcccgg

SEQ ID NO: 31309 - DNA, 20 bp, Artificial Sequence
  sgRNA
  Lrrc32_6
atgtccagtgagagcaccga

SEQ ID NO: 31310 - DNA, 20 bp, Artificial Sequence
  sgRNA
  Lrrc32_7
tggaggtcctcactgccccg

SEQ ID NO: 31311 - DNA, 20 bp, Artificial Sequence
  sgRNA
  Lrrc32_8
tgagagcgtacgcagcctcg

SEQ ID NO: 31312 - DNA, 20 bp, Artificial Sequence
  sgRNA
  Lrrc32_9
cagcattgaggccttccaga

SEQ ID NO: 31313 - DNA, 20 bp, Artificial Sequence
  sgRNA
  Lrrc32_10
agagcaagtgccctgtagga

SEQ ID NO: 31314 - DNA, 20 bp, Artificial Sequence
  sgRNA
  Lrrc32_11
tgtccagtgagagcaccgag

SEQ ID NO: 31315 - DNA, 20 bp, Artificial Sequence
  sgRNA
  Lrrc32_12
caccgtcctcgatatccatg

SEQ ID NO: 31316 - DNA, 20 bp, Artificial Sequence
  sgRNA
  Lrrc32_13
gctgaggttgaggaagcgca

SEQ ID NO: 31317 - DNA, 20 bp, Artificial Sequence
  sgRNA
  Lrrc32_14
gtcctcatggatatcgagga

SEQ ID NO: 31318 - DNA, 20 bp, Artificial Sequence
  sgRNA
  Lrrc32_15
ggatgcctccaggcccacca

SEQ ID NO: 31319 - DNA, 20 bp, Artificial Sequence
  sgRNA
  Lrrc32_16
gtactggagcttcaaggcaa

SEQ ID NO: 31320 - DNA, 20 bp, Artificial Sequence
  sgRNA
  Lrrc32_17
gcgtccagaggattgcgaga

SEQ ID NO: 31321 - DNA, 20 bp, Artificial Sequence
  sgRNA
  Lrrc32_18
ccgcagatctagcacctcca

SEQ ID NO: 31322 - DNA, 20 bp, Artificial Sequence
  sgRNA
  Lrrc32_19
cctggaagaccccagcctgg

SEQ ID NO: 31323 - DNA, 20 bp, Artificial Sequence
  sgRNA
  Lrrc32_20
cgctgtatagaagcccagtg

SEQ ID NO: 31324 - DNA, 20 bp, Artificial Sequence
  sgRNA
  Lrrc37a_1
tcttcccgagagtcctaagg

SEQ ID NO: 31325 - DNA, 20 bp, Artificial Sequence
  sgRNA
  Lrrc37a_2
tgaacatcctgaatacccat

SEQ ID NO: 31326 - DNA, 20 bp, Artificial Sequence
  sgRNA
  Lrrc37a_3
gcaggttgaactgtaatcgt

SEQ ID NO: 31327 - DNA, 20 bp, Artificial Sequence
  sgRNA
  Lrrc37a_4
tgtaactccactatatcaag

SEQ ID NO: 31328 - DNA, 20 bp, Artificial Sequence
  sgRNA
  Lrrc37a_5
gtgacattgtatgatgcggg

SEQ ID NO: 31329 - DNA, 20 bp, Artificial Sequence
  sgRNA
  Lrrc37a_6
gttgaactgtgacttcagat

SEQ ID NO: 31330 - DNA, 20 bp, Artificial Sequence
  sgRNA
  Lrrc37a_7
gtagtcatctcagcccaaaa

SEQ ID NO: 31331 - DNA, 20 bp, Artificial Sequence
  sgRNA
  Lrrc37a_8
catccaagtcctattctgga

SEQ ID NO: 31332 - DNA, 20 bp, Artificial Sequence
  sgRNA
  Lrrc37a_9
gtttaactaagacttctgac

SEQ ID NO: 31333 - DNA, 20 bp, Artificial Sequence
  sgRNA
  Lrrc37a_10
ggtactttcacagtcaagcc

SEQ ID NO: 31334 - DNA, 20 bp, Artificial Sequence
  sgRNA
  Lrrc37a_11
ccctccttccacacactacg

SEQ ID NO: 31335 - DNA, 20 bp, Artificial Sequence
  sgRNA
  Lrrc37a_12
tgtatggaaagcataccgtt

SEQ ID NO: 31336 - DNA, 20 bp, Artificial Sequence
  sgRNA
  Lrrc37a_13
gttccaacaccaggtcagga

SEQ ID NO: 31337 - DNA, 20 bp, Artificial Sequence
  sgRNA
  Lrrc37a_14
ggttcaagtgcgatgccact

SEQ ID NO: 31338 - DNA, 20 bp, Artificial Sequence
  sgRNA
  Lrrc37a_15
ttctgaatgtgaaactcccg

SEQ ID NO: 31339 - DNA, 20 bp, Artificial Sequence
  sgRNA
  Lrrc37a_16
gtatctcccagtgctccccg

SEQ ID NO: 31340 - DNA, 20 bp, Artificial Sequence
  sgRNA
  Lrrc37a_17
cccaaaacggagactccacc

SEQ ID NO: 31341 - DNA, 20 bp, Artificial Sequence
  sgRNA
  Lrrc37a_18
acagctcagcaaataccaag

SEQ ID NO: 31342 - DNA, 20 bp, Artificial Sequence
  sgRNA
  Lrrc37a_19
acaacctcatgaagtgccgg

SEQ ID NO: 31343 - DNA, 20 bp, Artificial Sequence
  sgRNA
  Lrrc37a_20
agaactttctcaaactacgc

SEQ ID NO: 31344 - DNA, 20 bp, Artificial Sequence
  sgRNA
  Lrrc38_1
ttgcaccgacccccataccg

SEQ ID NO: 31345 - DNA, 20 bp, Artificial Sequence
  sgRNA
  Lrrc38_2
tgaccagcctccccgccgag

SEQ ID NO: 31346 - DNA, 20 bp, Artificial Sequence
  sgRNA
  Lrrc38_3
caacctgcgcagcctcaacg

SEQ ID NO: 31347 - DNA, 20 bp, Artificial Sequence
  sgRNA
  Lrrc38_4
agtcacagtcacacagccag

SEQ ID NO: 31348 - DNA, 20 bp, Artificial Sequence
  sgRNA
  Lrrc38_5
acactcgctgaaactagctt

SEQ ID NO: 31349 - DNA, 20 bp, Artificial Sequence
  sgRNA
  Lrrc38_6
gcagcttgcgcacgtccagg

SEQ ID NO: 31350 - DNA, 20 bp, Artificial Sequence
  sgRNA
  Lrrc38_7
ggaagatgaagaagtcctcg

SEQ ID NO: 31351 - DNA, 20 bp, Artificial Sequence
  sgRNA
  Lrrc38_8
gtgcgcccctaacaaggaca

SEQ ID NO: 31352 - DNA, 20 bp, Artificial Sequence
  sgRNA
  Lrrc38_9
cctcatgtacaccggccaga

SEQ ID NO: 31353 - DNA, 20 bp, Artificial Sequence
  sgRNA
  Lrrc38_10
gtcggtgcaagcacagcccg

SEQ ID NO: 31354 - DNA, 20 bp, Artificial Sequence
  sgRNA
  Lrrc38_11
cccgcgatcgcgacagtcca

SEQ ID NO: 31355 - DNA, 20 bp, Artificial Sequence
  sgRNA
  Lrrc38_12
actgcccatggaggaccgga

SEQ ID NO: 31356 - DNA, 20 bp, Artificial Sequence
  sgRNA
  Lrrc38_13
cctgcgcagcctcaacgtgg

SEQ ID NO: 31357 - DNA, 20 bp, Artificial Sequence
  sgRNA
  Lrrc38_14
gagcctggccaacaaccatc

SEQ ID NO: 31358 - DNA, 20 bp, Artificial Sequence
  sgRNA
  Lrrc38_15
ggacgtgcgcaagctgctag

SEQ ID NO: 31359 - DNA, 20 bp, Artificial Sequence
  sgRNA
  Lrrc38_16
ggtagcctcttggtgctgct

SEQ ID NO: 31360 - DNA, 20 bp, Artificial Sequence
  sgRNA
  Lrrc38_17
ccgcatccagcagatccccg

SEQ ID NO: 31361 - DNA, 20 bp, Artificial Sequence
  sgRNA
  Lrrc38_18
catgggcagtgaacactgga

SEQ ID NO: 31362 - DNA, 20 bp, Artificial Sequence
  sgRNA
  Lrrc38_19
caaggactccaggctctcga

SEQ ID NO: 31363 - DNA, 20 bp, Artificial Sequence
  sgRNA
  Lrrc38_20
gaggacttcttcatcttcca

SEQ ID NO: 31364 - DNA, 20 bp, Artificial Sequence
  sgRNA
  Lrrc3b_1
taagcactctcagttgatgg

SEQ ID NO: 31365 - DNA, 20 bp, Artificial Sequence
  sgRNA
  Lrrc3b_2
ctaggattgctaacaaccca

SEQ ID NO: 31366 - DNA, 20 bp, Artificial Sequence
  sgRNA
  Lrrc3b_3
ggtgacatttaaccctccag

SEQ ID NO: 31367 - DNA, 20 bp, Artificial Sequence
  sgRNA
  Lrrc3b_4
cctgttgtcagacaagtcca

SEQ ID NO: 31368 - DNA, 20 bp, Artificial Sequence
  sgRNA
  Lrrc3b_5
gtatcatcagtacaaagctt

SEQ ID NO: 31369 - DNA, 20 bp, Artificial Sequence
  sgRNA
  Lrrc3b_6
gcctttgctcttcctctgga

SEQ ID NO: 31370 - DNA, 20 bp, Artificial Sequence
  sgRNA
  Lrrc3b_7
gatttgcaagacatcagtgt

SEQ ID NO: 31371 - DNA, 20 bp, Artificial Sequence
  sgRNA
  Lrrc3b_8
caccacataagagatcacca

SEQ ID NO: 31372 - DNA, 20 bp, Artificial Sequence
  sgRNA
  Lrrc3b_9
acagcaaaactgtttcagga

SEQ ID NO: 31373 - DNA, 20 bp, Artificial Sequence
  sgRNA
  Lrrc3b_10
gctttggaggaggagacaca

SEQ ID NO: 31374 - DNA, 20 bp, Artificial Sequence
  sgRNA
  Lrrc3b_11
agacaagtccagggtctgca

SEQ ID NO: 31375 - DNA, 20 bp, Artificial Sequence
  sgRNA
  Lrrc3b_12
gtactacgtgaggcagaatc

SEQ ID NO: 31376 - DNA, 20 bp, Artificial Sequence
  sgRNA
  Lrrc3b_13
tcagtacaaagctttggagg

SEQ ID NO: 31377 - DNA, 20 bp, Artificial Sequence
  sgRNA
  Lrrc3b_14
tctgccagtatgtgtcccaa

SEQ ID NO: 31378 - DNA, 20 bp, Artificial Sequence
  sgRNA
  Lrrc3b_15
tatgtttggctggttcacca

SEQ ID NO: 31379 - DNA, 20 bp, Artificial Sequence
  sgRNA
  Lrrc3b_16
gagtacagtcacaatgccat

SEQ ID NO: 31380 - DNA, 20 bp, Artificial Sequence
  sgRNA
  Lrrc3b_17
agagtacagtcacaatgcca

SEQ ID NO: 31381 - DNA, 20 bp, Artificial Sequence
  sgRNA
  Lrrc3b_18
ggttaagcactctcagttga

SEQ ID NO: 31382 - DNA, 20 bp, Artificial Sequence
  sgRNA
  Lrrc3b_19
tcagtgttggatgagcacgc

SEQ ID NO: 31383 - DNA, 20 bp, Artificial Sequence
  sgRNA
  Lrrc3b_20
tcattggcagcattgaggaa

SEQ ID NO: 31384 - DNA, 20 bp, Artificial Sequence
  sgRNA
  Lrrc4_1
ggctaagttgagttccacga

SEQ ID NO: 31385 - DNA, 20 bp, Artificial Sequence
  sgRNA
  Lrrc4_2
aaggtggtgtgcacccgccg

SEQ ID NO: 31386 - DNA, 20 bp, Artificial Sequence
  sgRNA
  Lrrc4_3
cccccaagtccagacgcatg

SEQ ID NO: 31387 - DNA, 20 bp, Artificial Sequence
  sgRNA
  Lrrc4_4
ccagagtgttgagactggcg

SEQ ID NO: 31388 - DNA, 20 bp, Artificial Sequence
  sgRNA
  Lrrc4_5
ggtccacctctaccaggtag

SEQ ID NO: 31389 - DNA, 20 bp, Artificial Sequence
  sgRNA
  Lrrc4_6
ggtggtctgaatgagcaccg

SEQ ID NO: 31390 - DNA, 20 bp, Artificial Sequence
  sgRNA
  Lrrc4_7
ggtgtaggtgcaactccacc

SEQ ID NO: 31391 - DNA, 20 bp, Artificial Sequence
  sgRNA
  Lrrc4_8
ttgcgccgtgaggtagacga

SEQ ID NO: 31392 - DNA, 20 bp, Artificial Sequence
  sgRNA
  Lrrc4_9
ccctcacctgatacaccgga

SEQ ID NO: 31393 - DNA, 20 bp, Artificial Sequence
  sgRNA
  Lrrc4_10
gggcagcaaccacttcacag

SEQ ID NO: 31394 - DNA, 20 bp, Artificial Sequence
  sgRNA
  Lrrc4_11
tataattcagacccatacca

SEQ ID NO: 31395 - DNA, 20 bp, Artificial Sequence
  sgRNA
  Lrrc4_12
gcagcaacagcagctccgtc

SEQ ID NO: 31396 - DNA, 20 bp, Artificial Sequence
  sgRNA
  Lrrc4_13
ttactgcaggaacagacgga

SEQ ID NO: 31397 - DNA, 20 bp, Artificial Sequence
  sgRNA
  Lrrc4_14
gctggtctgcatcttgtcag

SEQ ID NO: 31398 - DNA, 20 bp, Artificial Sequence
  sgRNA
  Lrrc4_15
gttactgcaggaacagacgg

SEQ ID NO: 31399 - DNA, 20 bp, Artificial Sequence
  sgRNA
  Lrrc4_16
cccggttgaaggcataagaa

SEQ ID NO: 31400 - DNA, 20 bp, Artificial Sequence
  sgRNA
  Lrrc4_17
caatatctctgaggatcgga

SEQ ID NO: 31401 - DNA, 20 bp, Artificial Sequence
  sgRNA
  Lrrc4_18
ggcatataccacctctacca

SEQ ID NO: 31402 - DNA, 20 bp, Artificial Sequence
  sgRNA
  Lrrc4_19
gggctaagttgagttccacg

SEQ ID NO: 31403 - DNA, 20 bp, Artificial Sequence
  sgRNA
  Lrrc4_20
ggacctcagagagtccccgg

SEQ ID NO: 31404 - DNA, 20 bp, Artificial Sequence
  sgRNA
  Lrrc4b_1
cacaggcacatccatgacgt

SEQ ID NO: 31405 - DNA, 20 bp, Artificial Sequence
  sgRNA
  Lrrc4b_2
cacggccgacacgttaagcg

SEQ ID NO: 31406 - DNA, 20 bp, Artificial Sequence
  sgRNA
  Lrrc4b_3
cctggtgcgaaagatcgagg

SEQ ID NO: 31407 - DNA, 20 bp, Artificial Sequence
  sgRNA
  Lrrc4b_4
gaggctggagtacatatctg

SEQ ID NO: 31408 - DNA, 20 bp, Artificial Sequence
  sgRNA
  Lrrc4b_5
aacggcacgctcatgacgca

SEQ ID NO: 31409 - DNA, 20 bp, Artificial Sequence
  sgRNA
  Lrrc4b_6
caatcaccaccactacgttg

SEQ ID NO: 31410 - DNA, 20 bp, Artificial Sequence
  sgRNA
  Lrrc4b_7
gggtggctccacgatgaccg

SEQ ID NO: 31411 - DNA, 20 bp, Artificial Sequence
  sgRNA
  Lrrc4b_8
gccgccttcaaggcgcacta

SEQ ID NO: 31412 - DNA, 20 bp, Artificial Sequence
  sgRNA
  Lrrc4b_9
acatcacagttacaatgcca

SEQ ID NO: 31413 - DNA, 20 bp, Artificial Sequence
  sgRNA
  Lrrc4b_10
ctacttcaccacggtgaccg

SEQ ID NO: 31414 - DNA, 20 bp, Artificial Sequence
  sgRNA
  Lrrc4b_11
gagccgctcttgaagagcag

SEQ ID NO: 31415 - DNA, 20 bp, Artificial Sequence
  sgRNA
  Lrrc4b_12
tcaggtggacacgctccagg

SEQ ID NO: 31416 - DNA, 20 bp, Artificial Sequence
  sgRNA
  Lrrc4b_13
cgacacgttaagcgtggccg

SEQ ID NO: 31417 - DNA, 20 bp, Artificial Sequence
  sgRNA
  Lrrc4b_14
gccgtagtgcgccttgaagg

SEQ ID NO: 31418 - DNA, 20 bp, Artificial Sequence
  sgRNA
  Lrrc4b_15
agccttctccgtgggccgcg

SEQ ID NO: 31419 - DNA, 20 bp, Artificial Sequence
  sgRNA
  Lrrc4b_16
gccgggtgatctgcacgcgg

SEQ ID NO: 31420 - DNA, 20 bp, Artificial Sequence
  sgRNA
  Lrrc4b_17
gccttcaaggcgcactacgg

SEQ ID NO: 31421 - DNA, 20 bp, Artificial Sequence
  sgRNA
  Lrrc4b_18
tgcgtcatgagcgtgccgtt

SEQ ID NO: 31422 - DNA, 20 bp, Artificial Sequence
  sgRNA
  Lrrc4b_19
catcacagttacaatgccag

SEQ ID NO: 31423 - DNA, 20 bp, Artificial Sequence
  sgRNA
  Lrrc4b_20
atgatctccacagtgcgcgt

SEQ ID NO: 31424 - DNA, 20 bp, Artificial Sequence
  sgRNA
  Lrrc4c_1
tggaacagtcatgacccacg

SEQ ID NO: 31425 - DNA, 20 bp, Artificial Sequence
  sgRNA
  Lrrc4c_2
tattcgaaccattgaaatcg

SEQ ID NO: 31426 - DNA, 20 bp, Artificial Sequence
  sgRNA
  Lrrc4c_3
tagtgactgaaggttatcaa

SEQ ID NO: 31427 - DNA, 20 bp, Artificial Sequence
  sgRNA
  Lrrc4c_4
gatttcccgaaggttgcaca

SEQ ID NO: 31428 - DNA, 20 bp, Artificial Sequence
  sgRNA
  Lrrc4c_5
cgtcttactaccataccgaa

SEQ ID NO: 31429 - DNA, 20 bp, Artificial Sequence
  sgRNA
  Lrrc4c_6
acgattgtcaaagagttcca

SEQ ID NO: 31430 - DNA, 20 bp, Artificial Sequence
  sgRNA
  Lrrc4c_7
aatagggccctgttaaacct

SEQ ID NO: 31431 - DNA, 20 bp, Artificial Sequence
  sgRNA
  Lrrc4c_8
tcatgctcaatcgcaggcat

SEQ ID NO: 31432 - DNA, 20 bp, Artificial Sequence
  sgRNA
  Lrrc4c_9
tccgcactttgtatgccccg

SEQ ID NO: 31433 - DNA, 20 bp, Artificial Sequence
  sgRNA
  Lrrc4c_10
tgatgcaccttcaaaaactg

SEQ ID NO: 31434 - DNA, 20 bp, Artificial Sequence
  sgRNA
  Lrrc4c_11
aaagtacgagaacggagtag

SEQ ID NO: 31435 - DNA, 20 bp, Artificial Sequence
  sgRNA
  Lrrc4c_12
aatggaacagtcatgaccca

SEQ ID NO: 31436 - DNA, 20 bp, Artificial Sequence
  sgRNA
  Lrrc4c_13
tgaggttagggatttcccga

SEQ ID NO: 31437 - DNA, 20 bp, Artificial Sequence
  sgRNA
  Lrrc4c_14
ccagtaactgacatcaacag

SEQ ID NO: 31438 - DNA, 20 bp, Artificial Sequence
  sgRNA
  Lrrc4c_15
gcagggggctccacaattac

SEQ ID NO: 31439 - DNA, 20 bp, Artificial Sequence
  sgRNA
  Lrrc4c_16
gtgttggtggagatgccatc

SEQ ID NO: 31440 - DNA, 20 bp, Artificial Sequence
  sgRNA
  Lrrc4c_17
atatcacagttacagttcca

SEQ ID NO: 31441 - DNA, 20 bp, Artificial Sequence
  sgRNA
  Lrrc4c_18
gactgttgaaatcattaacg

SEQ ID NO: 31442 - DNA, 20 bp, Artificial Sequence
  sgRNA
  Lrrc4c_19
agtccaggcggcgcaaagaa

SEQ ID NO: 31443 - DNA, 20 bp, Artificial Sequence
  sgRNA
  Lrrc4c_20
tgccatccggaacttcacga

SEQ ID NO: 31444 - DNA, 20 bp, Artificial Sequence
  sgRNA
  Lrrc52_1
tctgacagtccaagtaaacg

SEQ ID NO: 31445 - DNA, 20 bp, Artificial Sequence
  sgRNA
  Lrrc52_2
aggagcagttgcatatccag

SEQ ID NO: 31446 - DNA, 20 bp, Artificial Sequence
  sgRNA
  Lrrc52_3
atggtcgatgatgtgcaatc

SEQ ID NO: 31447 - DNA, 20 bp, Artificial Sequence
  sgRNA
  Lrrc52_4
ctgcatagatttgcacctaa

SEQ ID NO: 31448 - DNA, 20 bp, Artificial Sequence
  sgRNA
  Lrrc52_5
aatgccctccgaacgtcgag

SEQ ID NO: 31449 - DNA, 20 bp, Artificial Sequence
  sgRNA
  Lrrc52_6
tcagaacaaccggattcgag

SEQ ID NO: 31450 - DNA, 20 bp, Artificial Sequence
  sgRNA
  Lrrc52_7
atccccgctcgacgttcgga

SEQ ID NO: 31451 - DNA, 20 bp, Artificial Sequence
  sgRNA
  Lrrc52_8
tgttcagaggaatatcagct

SEQ ID NO: 31452 - DNA, 20 bp, Artificial Sequence
  sgRNA
  Lrrc52_9
catcttcgctgccggcacgg

SEQ ID NO: 31453 - DNA, 20 bp, Artificial Sequence
  sgRNA
  Lrrc52_10
tatcatccccgctcgacgtt

SEQ ID NO: 31454 - DNA, 20 bp, Artificial Sequence
  sgRNA
  Lrrc52_11
gtaagaagatgtagtcctgc

SEQ ID NO: 31455 - DNA, 20 bp, Artificial Sequence
  sgRNA
  Lrrc52_12
gagtctggagcaccaccagg

SEQ ID NO: 31456 - DNA, 20 bp, Artificial Sequence
  sgRNA
  Lrrc52_13
gttgcttcgaaaaatctggt

SEQ ID NO: 31457 - DNA, 20 bp, Artificial Sequence
  sgRNA
  Lrrc52_14
gtccaggtacctcaaagacg

SEQ ID NO: 31458 - DNA, 20 bp, Artificial Sequence
  sgRNA
  Lrrc52_15
ttgccaacaccacgtctttg

SEQ ID NO: 31459 - DNA, 20 bp, Artificial Sequence
  sgRNA
  Lrrc52_16
tgccctccgaacgtcgagcg

SEQ ID NO: 31460 - DNA, 20 bp, Artificial Sequence
  sgRNA
  Lrrc52_17
taatggcttccaccacctgg

SEQ ID NO: 31461 - DNA, 20 bp, Artificial Sequence
  sgRNA
  Lrrc52_18
tgtcaagatacaacaggtga

SEQ ID NO: 31462 - DNA, 20 bp, Artificial Sequence
  sgRNA
  Lrrc52_19
tttcgaagcaacacacactt

SEQ ID NO: 31463 - DNA, 20 bp, Artificial Sequence
  sgRNA
  Lrrc52_20
cgtatttgtcaagatacaac

SEQ ID NO: 31464 - DNA, 20 bp, Artificial Sequence
  sgRNA
  Lrrn1_1
cactacggaaagccaaacgg

SEQ ID NO: 31465 - DNA, 20 bp, Artificial Sequence
  sgRNA
  Lrrn1_2
ccatgccaccggaatacagg

SEQ ID NO: 31466 - DNA, 20 bp, Artificial Sequence
  sgRNA
  Lrrn1_3
gaggtcattacaatccacgg

SEQ ID NO: 31467 - DNA, 20 bp, Artificial Sequence
  sgRNA
  Lrrn1_4
tgggagtggaatcaaaccag

SEQ ID NO: 31468 - DNA, 20 bp, Artificial Sequence
  sgRNA
  Lrrn1_5
tatcgtgcgatatcatcggg

SEQ ID NO: 31469 - DNA, 20 bp, Artificial Sequence
  sgRNA
  Lrrn1_6
tttcgcgatgtaaatagcga

SEQ ID NO: 31470 - DNA, 20 bp, Artificial Sequence
  sgRNA
  Lrrn1_7
cattggaaataagataaccg

SEQ ID NO: 31471 - DNA, 20 bp, Artificial Sequence
  sgRNA
  Lrrn1_8
gcttctggatgtgtcaacct

SEQ ID NO: 31472 - DNA, 20 bp, Artificial Sequence
  sgRNA
  Lrrn1_9
gcggaggtcattacaatcca

SEQ ID NO: 31473 - DNA, 20 bp, Artificial Sequence
  sgRNA
  Lrrn1_10
gccatgccaccggaatacag

SEQ ID NO: 31474 - DNA, 20 bp, Artificial Sequence
  sgRNA
  Lrrn1_11
actgtcatacatccaccgtt

SEQ ID NO: 31475 - DNA, 20 bp, Artificial Sequence
  sgRNA
  Lrrn1_12
ccaaggagcagacactcgag

SEQ ID NO: 31476 - DNA, 20 bp, Artificial Sequence
  sgRNA
  Lrrn1_13
tgtccaggattccaatcaca

SEQ ID NO: 31477 - DNA, 20 bp, Artificial Sequence
  sgRNA
  Lrrn1_14
tttcaagccagaaaaggcgt

SEQ ID NO: 31478 - DNA, 20 bp, Artificial Sequence
  sgRNA
  Lrrn1_15
acatcgcgaaaaggtttaag

SEQ ID NO: 31479 - DNA, 20 bp, Artificial Sequence
  sgRNA
  Lrrn1_16
gctcacaaccctgcatctag

SEQ ID NO: 31480 - DNA, 20 bp, Artificial Sequence
  sgRNA
  Lrrn1_17
gtacagctcgttcagtggga

SEQ ID NO: 31481 - DNA, 20 bp, Artificial Sequence
  sgRNA
  Lrrn1_18
ggttgatgtagagttcttga

SEQ ID NO: 31482 - DNA, 20 bp, Artificial Sequence
  sgRNA
  Lrrn1_19
gcacctgtgcaccatctaga

SEQ ID NO: 31483 - DNA, 20 bp, Artificial Sequence
  sgRNA
  Lrrn1_20
ggtacattcctgctaacact

SEQ ID NO: 31484 - DNA, 20 bp, Artificial Sequence
  sgRNA
  Lrrn2_1
actaggactaaacaacatgg

SEQ ID NO: 31485 - DNA, 20 bp, Artificial Sequence
  sgRNA
  Lrrn2_2
tggttcgatgaaacggacgt

SEQ ID NO: 31486 - DNA, 20 bp, Artificial Sequence
  sgRNA
  Lrrn2_3
gaggtcattgcagtcgacag

SEQ ID NO: 31487 - DNA, 20 bp, Artificial Sequence
  sgRNA
  Lrrn2_4
atctcagactacgctctgga

SEQ ID NO: 31488 - DNA, 20 bp, Artificial Sequence
  sgRNA
  Lrrn2_5
tgtggcccagaacttggtag

SEQ ID NO: 31489 - DNA, 20 bp, Artificial Sequence
  sgRNA
  Lrrn2_6
gggtaccctagagttgcgga

SEQ ID NO: 31490 - DNA, 20 bp, Artificial Sequence
  sgRNA
  Lrrn2_7
aggtaccgagtgttccctga

SEQ ID NO: 31491 - DNA, 20 bp, Artificial Sequence
  sgRNA
  Lrrn2_8
cgtcaccctccgcaactcta

SEQ ID NO: 31492 - DNA, 20 bp, Artificial Sequence
  sgRNA
  Lrrn2_9
tggacatcaccaacaaccca

SEQ ID NO: 31493 - DNA, 20 bp, Artificial Sequence
  sgRNA
  Lrrn2_10
tgggcagcatctcgaaccag

SEQ ID NO: 31494 - DNA, 20 bp, Artificial Sequence
  sgRNA
  Lrrn2_11
gctctgccgcatctccccca

SEQ ID NO: 31495 - DNA, 20 bp, Artificial Sequence
  sgRNA
  Lrrn2_12
agccacccaagatagcaaga

SEQ ID NO: 31496 - DNA, 20 bp, Artificial Sequence
  sgRNA
  Lrrn2_13
ggtgtcagtcgaactccagc

SEQ ID NO: 31497 - DNA, 20 bp, Artificial Sequence
  sgRNA
  Lrrn2_14
gtactgggcctgcctgcaag

SEQ ID NO: 31498 - DNA, 20 bp, Artificial Sequence
  sgRNA
  Lrrn2_15
aggagcttcatggtcccgga

SEQ ID NO: 31499 - DNA, 20 bp, Artificial Sequence
  sgRNA
  Lrrn2_16
ttaggaccatcgacagccgc

SEQ ID NO: 31500 - DNA, 20 bp, Artificial Sequence
  sgRNA
  Lrrn2_17
gcagacactacccggacaga

SEQ ID NO: 31501 - DNA, 20 bp, Artificial Sequence
  sgRNA
  Lrrn2_18
ccttgttgccgccaatcatg

SEQ ID NO: 31502 - DNA, 20 bp, Artificial Sequence
  sgRNA
  Lrrn2_19
gtggttcgatgaaacggacg

SEQ ID NO: 31503 - DNA, 20 bp, Artificial Sequence
  sgRNA
  Lrrn2_20
tctctactgctgagacctgg

SEQ ID NO: 31504 - DNA, 20 bp, Artificial Sequence
  sgRNA
  Lrrn3_1
atcctattaacagaatacgg

SEQ ID NO: 31505 - DNA, 20 bp, Artificial Sequence
  sgRNA
  Lrrn3_2
cgtcgtctggtatttccgtg

SEQ ID NO: 31506 - DNA, 20 bp, Artificial Sequence
  sgRNA
  Lrrn3_3
ggtgaatgtaagacaatctg

SEQ ID NO: 31507 - DNA, 20 bp, Artificial Sequence
  sgRNA
  Lrrn3_4
atggatctcggggtaaacca

SEQ ID NO: 31508 - DNA, 20 bp, Artificial Sequence
  sgRNA
  Lrrn3_5
aggctgcgaagcttgacaag

SEQ ID NO: 31509 - DNA, 20 bp, Artificial Sequence
  sgRNA
  Lrrn3_6
gcaaagactctatggtgccg

SEQ ID NO: 31510 - DNA, 20 bp, Artificial Sequence
  sgRNA
  Lrrn3_7
gcataaccccaaaggaaggg

SEQ ID NO: 31511 - DNA, 20 bp, Artificial Sequence
  sgRNA
  Lrrn3_8
atatggactgagcaacttgc

SEQ ID NO: 31512 - DNA, 20 bp, Artificial Sequence
  sgRNA
  Lrrn3_9
gattacacagtcgcaacgga

SEQ ID NO: 31513 - DNA, 20 bp, Artificial Sequence
  sgRNA
  Lrrn3_10
agcggattacacagtcgcaa

SEQ ID NO: 31514 - DNA, 20 bp, Artificial Sequence
  sgRNA
  Lrrn3_11
cccagaggttgattagagga

SEQ ID NO: 31515 - DNA, 20 bp, Artificial Sequence
  sgRNA
  Lrrn3_12
attacacagtcgcaacggat

SEQ ID NO: 31516 - DNA, 20 bp, Artificial Sequence
  sgRNA
  Lrrn3_13
tcctattaacagaatacgga

SEQ ID NO: 31517 - DNA, 20 bp, Artificial Sequence
  sgRNA
  Lrrn3_14
gtacctgtgagatcaggcct

SEQ ID NO: 31518 - DNA, 20 bp, Artificial Sequence
  sgRNA
  Lrrn3_15
gtacaaccccccttcctttg

SEQ ID NO: 31519 - DNA, 20 bp, Artificial Sequence
  sgRNA
  Lrrn3_16
gtaaagctcactgaaagcca

SEQ ID NO: 31520 - DNA, 20 bp, Artificial Sequence
  sgRNA
  Lrrn3_17
ctatatggaagcatcgacag

SEQ ID NO: 31521 - DNA, 20 bp, Artificial Sequence
  sgRNA
  Lrrn3_18
ggaaataccagacgacgcct

SEQ ID NO: 31522 - DNA, 20 bp, Artificial Sequence
  sgRNA
  Lrrn3_19
gccgtggtagagggcactga

SEQ ID NO: 31523 - DNA, 20 bp, Artificial Sequence
  sgRNA
  Lrrn3_20
tgtacaaccccccttccttt

SEQ ID NO: 31524 - DNA, 20 bp, Artificial Sequence
  sgRNA
  Lrrn4_1
gagtggtgactcccgcggcg

SEQ ID NO: 31525 - DNA, 20 bp, Artificial Sequence
  sgRNA
  Lrrn4_2
caaaaactgaatgatcgaag

SEQ ID NO: 31526 - DNA, 20 bp, Artificial Sequence
  sgRNA
  Lrrn4_3
attaggctcaaggatatgtg

SEQ ID NO: 31527 - DNA, 20 bp, Artificial Sequence
  sgRNA
  Lrrn4_4
cgcccaggaggcattcgcgg

SEQ ID NO: 31528 - DNA, 20 bp, Artificial Sequence
  sgRNA
  Lrrn4_5
agtagcatagatgtccacta

SEQ ID NO: 31529 - DNA, 20 bp, Artificial Sequence
  sgRNA
  Lrrn4_6
tcaagatgactcccaacctg

SEQ ID NO: 31530 - DNA, 20 bp, Artificial Sequence
  sgRNA
  Lrrn4_7
gcttacctcagaccaagcag

SEQ ID NO: 31531 - DNA, 20 bp, Artificial Sequence
  sgRNA
  Lrrn4_8
gcggttcgccaagttcagag

SEQ ID NO: 31532 - DNA, 20 bp, Artificial Sequence
  sgRNA
  Lrrn4_9
gggtctgcagatgcttgcag

SEQ ID NO: 31533 - DNA, 20 bp, Artificial Sequence
  sgRNA
  Lrrn4_10
ctcttccgactcactcagca

SEQ ID NO: 31534 - DNA, 20 bp, Artificial Sequence
  sgRNA
  Lrrn4_11
gctagtttatagtccttcca

SEQ ID NO: 31535 - DNA, 20 bp, Artificial Sequence
  sgRNA
  Lrrn4_12
tattcacaagagacgtcctg

SEQ ID NO: 31536 - DNA, 20 bp, Artificial Sequence
  sgRNA
  Lrrn4_13
gtgtgtactggcagccaaca

SEQ ID NO: 31537 - DNA, 20 bp, Artificial Sequence
  sgRNA
  Lrrn4_14
gttctacgacacacacctgg

SEQ ID NO: 31538 - DNA, 20 bp, Artificial Sequence
  sgRNA
  Lrrn4_15
aagccaacaaaatatcacca

SEQ ID NO: 31539 - DNA, 20 bp, Artificial Sequence
  sgRNA
  Lrrn4_16
tggacatctatgctactgcc

SEQ ID NO: 31540 - DNA, 20 bp, Artificial Sequence
  sgRNA
  Lrrn4_17
tggtccttggaattcctccc

SEQ ID NO: 31541 - DNA, 20 bp, Artificial Sequence
  sgRNA
  Lrrn4_18
cctacacagagagagtcggt

SEQ ID NO: 31542 - DNA, 20 bp, Artificial Sequence
  sgRNA
  Lrrn4_19
gagtcctacacagagagagt

SEQ ID NO: 31543 - DNA, 20 bp, Artificial Sequence
  sgRNA
  Lrrn4_20
ctacacagagagagtcggta

SEQ ID NO: 31544 - DNA, 20 bp, Artificial Sequence
  sgRNA
  Lrrn4cl_1
ggcaacggtcatagtcgcaa

SEQ ID NO: 31545 - DNA, 20 bp, Artificial Sequence
  sgRNA
  Lrrn4cl_2
caaaggacataagcaacccc

SEQ ID NO: 31546 - DNA, 20 bp, Artificial Sequence
  sgRNA
  Lrrn4cl_3
ccagggtcaagatctgaggt

SEQ ID NO: 31547 - DNA, 20 bp, Artificial Sequence
  sgRNA
  Lrrn4cl_4
tctgctttgggaaagcaacg

SEQ ID NO: 31548 - DNA, 20 bp, Artificial Sequence
  sgRNA
  Lrrn4cl_5
aaggcagaaatgccaaacca

SEQ ID NO: 31549 - DNA, 20 bp, Artificial Sequence
  sgRNA
  Lrrn4cl_6
cttgggccataccttgacgt

SEQ ID NO: 31550 - DNA, 20 bp, Artificial Sequence
  sgRNA
  Lrrn4cl_7
ggctgaagaaggctacgcag

SEQ ID NO: 31551 - DNA, 20 bp, Artificial Sequence
  sgRNA
  Lrrn4cl_8
ggttgcttatgtcctttgcg

SEQ ID NO: 31552 - DNA, 20 bp, Artificial Sequence
  sgRNA
  Lrrn4cl_9
cattagcagccaccacgcaa

SEQ ID NO: 31553 - DNA, 20 bp, Artificial Sequence
  sgRNA
  Lrrn4cl_10
tcgaactgtagcattgagag

SEQ ID NO: 31554 - DNA, 20 bp, Artificial Sequence
  sgRNA
  Lrrn4cl_11
ccaacctcagatcttgaccc

SEQ ID NO: 31555 - DNA, 20 bp, Artificial Sequence
  sgRNA
  Lrrn4cl_12
cttcgaactgtagcattgag

SEQ ID NO: 31556 - DNA, 20 bp, Artificial Sequence
  sgRNA
  Lrrn4cl_13
ggcaaccccatcgctcacga

SEQ ID NO: 31557 - DNA, 20 bp, Artificial Sequence
  sgRNA
  Lrrn4cl_14
catggctgccagccacagaa

SEQ ID NO: 31558 - DNA, 20 bp, Artificial Sequence
  sgRNA
  Lrrn4cl_15
ggcatgataaacttgcgaca

SEQ ID NO: 31559 - DNA, 20 bp, Artificial Sequence
  sgRNA
  Lrrn4cl_16
tgcttatgtcctttgcgtgg

SEQ ID NO: 31560 - DNA, 20 bp, Artificial Sequence
  sgRNA
  Lrrn4cl_17
atttctgccttcgtgagcga

SEQ ID NO: 31561 - DNA, 20 bp, Artificial Sequence
  sgRNA
  Lrrn4cl_18
cccaaagcagaagccagtag

SEQ ID NO: 31562 - DNA, 20 bp, Artificial Sequence
  sgRNA
  Lrrn4cl_19
gttcgaagagcagagctgaa

SEQ ID NO: 31563 - DNA, 20 bp, Artificial Sequence
  sgRNA
  Lrrn4cl_20
atttgcacttctcccaggcg

SEQ ID NO: 31564 - DNA, 20 bp, Artificial Sequence
  sgRNA
  Lrrtm2_1
ggagttggaacgtaaatgca

SEQ ID NO: 31565 - DNA, 20 bp, Artificial Sequence
  sgRNA
  Lrrtm2_2
tgtgcagactgcttagccgg

SEQ ID NO: 31566 - DNA, 20 bp, Artificial Sequence
  sgRNA
  Lrrtm2_3
attcccacagattgccagag

SEQ ID NO: 31567 - DNA, 20 bp, Artificial Sequence
  sgRNA
  Lrrtm2_4
gtgccaaacgccacagacaa

SEQ ID NO: 31568 - DNA, 20 bp, Artificial Sequence
  sgRNA
  Lrrtm2_5
aggtggacacgccataccca

SEQ ID NO: 31569 - DNA, 20 bp, Artificial Sequence
  sgRNA
  Lrrtm2_6
gcgtactgggatagtccgca

SEQ ID NO: 31570 - DNA, 20 bp, Artificial Sequence
  sgRNA
  Lrrtm2_7
gctcaatgattcagaaccac

SEQ ID NO: 31571 - DNA, 20 bp, Artificial Sequence
  sgRNA
  Lrrtm2_8
aggcaagagcacacactctg

SEQ ID NO: 31572 - DNA, 20 bp, Artificial Sequence
  sgRNA
  Lrrtm2_9
ctgtggcgtttggcactgag

SEQ ID NO: 31573 - DNA, 20 bp, Artificial Sequence
  sgRNA
  Lrrtm2_10
ttgcgaagtttggctcgaaa

SEQ ID NO: 31574 - DNA, 20 bp, Artificial Sequence
  sgRNA
  Lrrtm2_11
gtaaaagaagacgctttcca

SEQ ID NO: 31575 - DNA, 20 bp, Artificial Sequence
  sgRNA
  Lrrtm2_12
atttacgttccaactccctg

SEQ ID NO: 31576 - DNA, 20 bp, Artificial Sequence
  sgRNA
  Lrrtm2_13
gggcagtttccaaggtcggt

SEQ ID NO: 31577 - DNA, 20 bp, Artificial Sequence
  sgRNA
  Lrrtm2_14
tggcctctctggcaatctgt

SEQ ID NO: 31578 - DNA, 20 bp, Artificial Sequence
  sgRNA
  Lrrtm2_15
ttcgagccaaacttcgcaaa

SEQ ID NO: 31579 - DNA, 20 bp, Artificial Sequence
  sgRNA
  Lrrtm2_16
aggcatagcagtcactacag

SEQ ID NO: 31580 - DNA, 20 bp, Artificial Sequence
  sgRNA
  Lrrtm2_17
gagagtaattacaggaacaa

SEQ ID NO: 31581 - DNA, 20 bp, Artificial Sequence
  sgRNA
  Lrrtm2_18
ggacctttcatcatcattaa

SEQ ID NO: 31582 - DNA, 20 bp, Artificial Sequence
  sgRNA
  Lrrtm2_19
ctgaaatccctcacgaccgt

SEQ ID NO: 31583 - DNA, 20 bp, Artificial Sequence
  sgRNA
  Lrrtm2_20
ggtctgacatgtttgacata

SEQ ID NO: 31584 - DNA, 20 bp, Artificial Sequence
  sgRNA
  Lrrtm3_1
gggggttaacgtgatcgatg

SEQ ID NO: 31585 - DNA, 20 bp, Artificial Sequence
  sgRNA
  Lrrtm3_2
caaccggcagatatactcga

SEQ ID NO: 31586 - DNA, 20 bp, Artificial Sequence
  sgRNA
  Lrrtm3_3
cactgagaaccatcccggtg

SEQ ID NO: 31587 - DNA, 20 bp, Artificial Sequence
  sgRNA
  Lrrtm3_4
tctcgtcgatattgctgatg

SEQ ID NO: 31588 - DNA, 20 bp, Artificial Sequence
  sgRNA
  Lrrtm3_5
ggaggatgaccagcaccgac

SEQ ID NO: 31589 - DNA, 20 bp, Artificial Sequence
  sgRNA
  Lrrtm3_6
aggacacgtacatcaccagg

SEQ ID NO: 31590 - DNA, 20 bp, Artificial Sequence
  sgRNA
  Lrrtm3_7
gcagctgcttcatgctcgcg

SEQ ID NO: 31591 - DNA, 20 bp, Artificial Sequence
  sgRNA
  Lrrtm3_8
ctgggatcggaacagttccg

SEQ ID NO: 31592 - DNA, 20 bp, Artificial Sequence
  sgRNA
  Lrrtm3_9
gcgaggatcagctgtagcgg

SEQ ID NO: 31593 - DNA, 20 bp, Artificial Sequence
  sgRNA
  Lrrtm3_10
atgctttcttctgctgaacg

SEQ ID NO: 31594 - DNA, 20 bp, Artificial Sequence
  sgRNA
  Lrrtm3_11
gcaaccggcagatatactcg

SEQ ID NO: 31595 - DNA, 20 bp, Artificial Sequence
  sgRNA
  Lrrtm3_12
ataccctcgagtatatctgc

SEQ ID NO: 31596 - DNA, 20 bp, Artificial Sequence
  sgRNA
  Lrrtm3_13
aatgtaattaggctactgcg

SEQ ID NO: 31597 - DNA, 20 bp, Artificial Sequence
  sgRNA
  Lrrtm3_14
gctgaacgaggatgccctaa

SEQ ID NO: 31598 - DNA, 20 bp, Artificial Sequence
  sgRNA
  Lrrtm3_15
cttccggtgccttcgcatga

SEQ ID NO: 31599 - DNA, 20 bp, Artificial Sequence
  sgRNA
  Lrrtm3_16
gctccctcatgcgaaggcac

SEQ ID NO: 31600 - DNA, 20 bp, Artificial Sequence
  sgRNA
  Lrrtm3_17
tcgacgagaatgctttcaat

SEQ ID NO: 31601 - DNA, 20 bp, Artificial Sequence
  sgRNA
  Lrrtm3_18
accggatccgaagtttagcc

SEQ ID NO: 31602 - DNA, 20 bp, Artificial Sequence
  sgRNA
  Lrrtm3_19
ggaggcttgctctcgtgctt

SEQ ID NO: 31603 - DNA, 20 bp, Artificial Sequence
  sgRNA
  Lrrtm3_20
acttctcagccagtttacca

SEQ ID NO: 31604 - DNA, 20 bp, Artificial Sequence
  sgRNA
  Lrrtm4_1
gaagttaaaagagctccacc

SEQ ID NO: 31605 - DNA, 20 bp, Artificial Sequence
  sgRNA
  Lrrtm4_2
gcagggcctaagcacataca

SEQ ID NO: 31606 - DNA, 20 bp, Artificial Sequence
  sgRNA
  Lrrtm4_3
ttaggccttgactgacagag

SEQ ID NO: 31607 - DNA, 20 bp, Artificial Sequence
  sgRNA
  Lrrtm4_4
atccctgagaacatttctgg

SEQ ID NO: 31608 - DNA, 20 bp, Artificial Sequence
  sgRNA
  Lrrtm4_5
gcaaaatgatgagtttccgg

SEQ ID NO: 31609 - DNA, 20 bp, Artificial Sequence
  sgRNA
  Lrrtm4_6
ggttggtcatagctgtaata

SEQ ID NO: 31610 - DNA, 20 bp, Artificial Sequence
  sgRNA
  Lrrtm4_7
tgagaaggttagcgatgccg

SEQ ID NO: 31611 - DNA, 20 bp, Artificial Sequence
  sgRNA
  Lrrtm4_8
cgtttcacaaaatcatcgca

SEQ ID NO: 31612 - DNA, 20 bp, Artificial Sequence
  sgRNA
  Lrrtm4_9
tccctgagaacatttctgga

SEQ ID NO: 31613 - DNA, 20 bp, Artificial Sequence
  sgRNA
  Lrrtm4_10
gaggagacggaaaaaggcga

SEQ ID NO: 31614 - DNA, 20 bp, Artificial Sequence
  sgRNA
  Lrrtm4_11
gtaggtttggggatgaacgg

SEQ ID NO: 31615 - DNA, 20 bp, Artificial Sequence
  sgRNA
  Lrrtm4_12
gactgcatccggtttgaaga

SEQ ID NO: 31616 - DNA, 20 bp, Artificial Sequence
  sgRNA
  Lrrtm4_13
gcttcattgccaccatagcc

SEQ ID NO: 31617 - DNA, 20 bp, Artificial Sequence
  sgRNA
  Lrrtm4_14
ccctttacaggaatactacg

SEQ ID NO: 31618 - DNA, 20 bp, Artificial Sequence
  sgRNA
  Lrrtm4_15
gcatccggtttgaagatggt

SEQ ID NO: 31619 - DNA, 20 bp, Artificial Sequence
  sgRNA
  Lrrtm4_16
ttatcccgaaacgcgtttgc

SEQ ID NO: 31620 - DNA, 20 bp, Artificial Sequence
  sgRNA
  Lrrtm4_17
gcagtcttgaaaaacccgta

SEQ ID NO: 31621 - DNA, 20 bp, Artificial Sequence
  sgRNA
  Lrrtm4_18
gatcgcaggttgaagagacg

SEQ ID NO: 31622 - DNA, 20 bp, Artificial Sequence
  sgRNA
  Lrrtm4_19
tcatagctgtaatacggcag

SEQ ID NO: 31623 - DNA, 20 bp, Artificial Sequence
  sgRNA
  Lrrtm4_20
acctggaatttgaaagcccg

SEQ ID NO: 31624 - DNA, 20 bp, Artificial Sequence
  sgRNA
  Lrtm1_1
agtccacggagtttgatgat

SEQ ID NO: 31625 - DNA, 20 bp, Artificial Sequence
  sgRNA
  Lrtm1_2
tctggatcgtgaacttctag

SEQ ID NO: 31626 - DNA, 20 bp, Artificial Sequence
  sgRNA
  Lrtm1_3
gagcagtgtaactgtccatg

SEQ ID NO: 31627 - DNA, 20 bp, Artificial Sequence
  sgRNA
  Lrtm1_4
acatttaaaacccgcaaatg

SEQ ID NO: 31628 - DNA, 20 bp, Artificial Sequence
  sgRNA
  Lrtm1_5
ccacccatcatcaaactccg

SEQ ID NO: 31629 - DNA, 20 bp, Artificial Sequence
  sgRNA
  Lrtm1_6
ggatcctccccacgtctctg

SEQ ID NO: 31630 - DNA, 20 bp, Artificial Sequence
  sgRNA
  Lrtm1_7
agagtttcagacccagtaag

SEQ ID NO: 31631 - DNA, 20 bp, Artificial Sequence
  sgRNA
  Lrtm1_8
agacttctgggcatcttgcg

SEQ ID NO: 31632 - DNA, 20 bp, Artificial Sequence
  sgRNA
  Lrtm1_9
actcagtcccactctgtgaa

SEQ ID NO: 31633 - DNA, 20 bp, Artificial Sequence
  sgRNA
  Lrtm1_10
gctgctttctatggaaagca

SEQ ID NO: 31634 - DNA, 20 bp, Artificial Sequence
  sgRNA
  Lrtm1_11
gagtgggactgagtacacgc

SEQ ID NO: 31635 - DNA, 20 bp, Artificial Sequence
  sgRNA
  Lrtm1_12
ccatcacagcccagtaccaa

SEQ ID NO: 31636 - DNA, 20 bp, Artificial Sequence
  sgRNA
  Lrtm1_13
gttgttagataaatttaagg

SEQ ID NO: 31637 - DNA, 20 bp, Artificial Sequence
  sgRNA
  Lrtm1_14
ggtttggcctcacactccaa

SEQ ID NO: 31638 - DNA, 20 bp, Artificial Sequence
  sgRNA
  Lrtm1_15
agtggcagtcacaaatccaa

SEQ ID NO: 31639 - DNA, 20 bp, Artificial Sequence
  sgRNA
  Lrtm1_16
tctgcaggctgcctgaaccc

SEQ ID NO: 31640 - DNA, 20 bp, Artificial Sequence
  sgRNA
  Lrtm1_17
gcagaaccatcttctccatc

SEQ ID NO: 31641 - DNA, 20 bp, Artificial Sequence
  sgRNA
  Lrtm1_18
ggtggcacaaacatttcatg

SEQ ID NO: 31642 - DNA, 20 bp, Artificial Sequence
  sgRNA
  Lrtm1_19
tgaccacagtagccacagca

SEQ ID NO: 31643 - DNA, 20 bp, Artificial Sequence
  sgRNA
  Lrtm1_20
ctagaagttcacgatccaga

SEQ ID NO: 31644 - DNA, 20 bp, Artificial Sequence
  sgRNA
  Lrtm2_1
aagtcctcgaaaatggaccg

SEQ ID NO: 31645 - DNA, 20 bp, Artificial Sequence
  sgRNA
  Lrtm2_2
gcttgcctgtaccctaccca

SEQ ID NO: 31646 - DNA, 20 bp, Artificial Sequence
  sgRNA
  Lrtm2_3
accttcgggaattcaaacac

SEQ ID NO: 31647 - DNA, 20 bp, Artificial Sequence
  sgRNA
  Lrtm2_4
caggagcaaaaggctttggg

SEQ ID NO: 31648 - DNA, 20 bp, Artificial Sequence
  sgRNA
  Lrtm2_5
tggcacagtgatcatcgccg

SEQ ID NO: 31649 - DNA, 20 bp, Artificial Sequence
  sgRNA
  Lrtm2_6
gagcccatcaaaaagccccg

SEQ ID NO: 31650 - DNA, 20 bp, Artificial Sequence
  sgRNA
  Lrtm2_7
gccagtgtttgaattcccga

SEQ ID NO: 31651 - DNA, 20 bp, Artificial Sequence
  sgRNA
  Lrtm2_8
agcccatcaaaaagccccgg

SEQ ID NO: 31652 - DNA, 20 bp, Artificial Sequence
  sgRNA
  Lrtm2_9
tgtacccccggatgtgcccg

SEQ ID NO: 31653 - DNA, 20 bp, Artificial Sequence
  sgRNA
  Lrtm2_10
ggttgcagtcacactcccac

SEQ ID NO: 31654 - DNA, 20 bp, Artificial Sequence
  sgRNA
  Lrtm2_11
agtcctcgaaaatggaccgg

SEQ ID NO: 31655 - DNA, 20 bp, Artificial Sequence
  sgRNA
  Lrtm2_12
gacaatgccacacacgaccc

SEQ ID NO: 31656 - DNA, 20 bp, Artificial Sequence
  sgRNA
  Lrtm2_13
gtccaggctctgcagacgat

SEQ ID NO: 31657 - DNA, 20 bp, Artificial Sequence
  sgRNA
  Lrtm2_14
agtagttaaacatctccatg

SEQ ID NO: 31658 - DNA, 20 bp, Artificial Sequence
  sgRNA
  Lrtm2_15
aggttgcagtcacactccca

SEQ ID NO: 31659 - DNA, 20 bp, Artificial Sequence
  sgRNA
  Lrtm2_16
ggatttgtctatcaacggct

SEQ ID NO: 31660 - DNA, 20 bp, Artificial Sequence
  sgRNA
  Lrtm2_17
ggctctgcagacgattggag

SEQ ID NO: 31661 - DNA, 20 bp, Artificial Sequence
  sgRNA
  Lrtm2_18
gcttattgttcaggagcaaa

SEQ ID NO: 31662 - DNA, 20 bp, Artificial Sequence
  sgRNA
  Lrtm2_19
aggagcccatcaaaaagccc

SEQ ID NO: 31663 - DNA, 20 bp, Artificial Sequence
  sgRNA
  Lrtm2_20
actttcttgaccagctcccc

SEQ ID NO: 31664 - DNA, 20 bp, Artificial Sequence
  sgRNA
  Lsamp_1
gcttctccagctcaacccga

SEQ ID NO: 31665 - DNA, 20 bp, Artificial Sequence
  sgRNA
  Lsamp_2
gttaaaatccacgctgcgaa

SEQ ID NO: 31666 - DNA, 20 bp, Artificial Sequence
  sgRNA
  Lsamp_3
ttaaaatccacgctgcgaac

SEQ ID NO: 31667 - DNA, 20 bp, Artificial Sequence
  sgRNA
  Lsamp_4
cagcggcaactgtttccgat

SEQ ID NO: 31668 - DNA, 20 bp, Artificial Sequence
  sgRNA
  Lsamp_5
accgtgcacttcaagccaaa

SEQ ID NO: 31669 - DNA, 20 bp, Artificial Sequence
  sgRNA
  Lsamp_6
tcttcgctggacatgacaag

SEQ ID NO: 31670 - DNA, 20 bp, Artificial Sequence
  sgRNA
  Lsamp_7
tgccaacgaggtctcctcgg

SEQ ID NO: 31671 - DNA, 20 bp, Artificial Sequence
  sgRNA
  Lsamp_8
catccaccttctggattcgg

SEQ ID NO: 31672 - DNA, 20 bp, Artificial Sequence
  sgRNA
  Lsamp_9
ggagatcctaggcatcacca

SEQ ID NO: 31673 - DNA, 20 bp, Artificial Sequence
  sgRNA
  Lsamp_10
tgagggccagtcctccctga

SEQ ID NO: 31674 - DNA, 20 bp, Artificial Sequence
  sgRNA
  Lsamp_11
gacattggtcaccgtcaggg

SEQ ID NO: 31675 - DNA, 20 bp, Artificial Sequence
  sgRNA
  Lsamp_12
cgctgaggcttcacatttga

SEQ ID NO: 31676 - DNA, 20 bp, Artificial Sequence
  sgRNA
  Lsamp_13
acaacatcaccgtgagacag

SEQ ID NO: 31677 - DNA, 20 bp, Artificial Sequence
  sgRNA
  Lsamp_14
gggtcggtgagaggaatcaa

SEQ ID NO: 31678 - DNA, 20 bp, Artificial Sequence
  sgRNA
  Lsamp_15
ttcgactccgtgatagtggg

SEQ ID NO: 31679 - DNA, 20 bp, Artificial Sequence
  sgRNA
  Lsamp_16
tcggatgtcactgtgaatga

SEQ ID NO: 31680 - DNA, 20 bp, Artificial Sequence
  sgRNA
  Lsamp_17
atacagcctccgaatccaga

SEQ ID NO: 31681 - DNA, 20 bp, Artificial Sequence
  sgRNA
  Lsamp_18
aatgtcactgaggaacacta

SEQ ID NO: 31682 - DNA, 20 bp, Artificial Sequence
  sgRNA
  Lsamp_19
ccagacgctgtgcagccagt

SEQ ID NO: 31683 - DNA, 20 bp, Artificial Sequence
  sgRNA
  Lsamp_20
gacttgtttgacatccgccg

SEQ ID NO: 31684 - DNA, 20 bp, Artificial Sequence
  sgRNA
  Lsmem1_1
agaaggaagactctacgttg

SEQ ID NO: 31685 - DNA, 20 bp, Artificial Sequence
  sgRNA
  Lsmem1_2
caaactcagtctctgcccga

SEQ ID NO: 31686 - DNA, 20 bp, Artificial Sequence
  sgRNA
  Lsmem1_3
ccaggctgaccgtcaacacc

SEQ ID NO: 31687 - DNA, 20 bp, Artificial Sequence
  sgRNA
  Lsmem1_4
gcacagccccaggaaatgga

SEQ ID NO: 31688 - DNA, 20 bp, Artificial Sequence
  sgRNA
  Lsmem1_5
tcaacaacatgattgtaaag

SEQ ID NO: 31689 - DNA, 20 bp, Artificial Sequence
  sgRNA
  Lsmem1_6
atagatgttgtgattccatc

SEQ ID NO: 31690 - DNA, 20 bp, Artificial Sequence
  sgRNA
  Lsmem1_7
atgagacccagcatcctgag

SEQ ID NO: 31691 - DNA, 20 bp, Artificial Sequence
  sgRNA
  Lsmem1_8
gccccaggaaatggaaggcg

SEQ ID NO: 31692 - DNA, 20 bp, Artificial Sequence
  sgRNA
  Lsmem1_9
tggcgaagaagaccagagcc

SEQ ID NO: 31693 - DNA, 20 bp, Artificial Sequence
  sgRNA
  Lsmem1_10
gctggcacagccccaggaaa

SEQ ID NO: 31694 - DNA, 20 bp, Artificial Sequence
  sgRNA
  Lsmem1_11
tctcatggcatccaggaaga

SEQ ID NO: 31695 - DNA, 20 bp, Artificial Sequence
  sgRNA
  Lsmem1_12
tgtaaagcggctcaaccagc

SEQ ID NO: 31696 - DNA, 20 bp, Artificial Sequence
  sgRNA
  Lsmem1_13
ttcttgacacgtcctccatc

SEQ ID NO: 31697 - DNA, 20 bp, Artificial Sequence
  sgRNA
  Lsmem1_14
ccccaggaaatggaaggcgg

SEQ ID NO: 31698 - DNA, 20 bp, Artificial Sequence
  sgRNA
  Lsmem1_15
cagccccaggaaatggaagg

SEQ ID NO: 31699 - DNA, 20 bp, Artificial Sequence
  sgRNA
  Lsmem1_16
tcaaacaggaaaccagatgg

SEQ ID NO: 31700 - DNA, 20 bp, Artificial Sequence
  sgRNA
  Lsmem1_17
cccccgccttccatttcctg

SEQ ID NO: 31701 - DNA, 20 bp, Artificial Sequence
  sgRNA
  Lsmem1_18
ggggctgctcctggtgttga

SEQ ID NO: 31702 - DNA, 20 bp, Artificial Sequence
  sgRNA
  Lsmem1_19
ctggggctgtgccagcattg

SEQ ID NO: 31703 - DNA, 20 bp, Artificial Sequence
  sgRNA
  Lsmem1_20
cctggtgttgacggtcagcc

SEQ ID NO: 31704 - DNA, 20 bp, Artificial Sequence
  sgRNA
  Ltb4r2_1
cttcgtagtatggagcttag

SEQ ID NO: 31705 - DNA, 20 bp, Artificial Sequence
  sgRNA
  Ltb4r2_2
gctatggcgtgacgctggcg

SEQ ID NO: 31706 - DNA, 20 bp, Artificial Sequence
  sgRNA
  Ltb4r2_3
cgggacggcgagcaccaggg

SEQ ID NO: 31707 - DNA, 20 bp, Artificial Sequence
  sgRNA
  Ltb4r2_4
gagcagcagcaccgcgccgt

SEQ ID NO: 31708 - DNA, 20 bp, Artificial Sequence
  sgRNA
  Ltb4r2_5
cctgtaggagattgaccgcg

SEQ ID NO: 31709 - DNA, 20 bp, Artificial Sequence
  sgRNA
  Ltb4r2_6
gctctgggctccctaccacg

SEQ ID NO: 31710 - DNA, 20 bp, Artificial Sequence
  sgRNA
  Ltb4r2_7
aagagtcgagtaaggaaccg

SEQ ID NO: 31711 - DNA, 20 bp, Artificial Sequence
  sgRNA
  Ltb4r2_8
ggtcaatctcctacaggcgg

SEQ ID NO: 31712 - DNA, 20 bp, Artificial Sequence
  sgRNA
  Ltb4r2_9
ccagaggtggcggtagaccg

SEQ ID NO: 31713 - DNA, 20 bp, Artificial Sequence
  sgRNA
  Ltb4r2_10
ttccttactcgactcttcga

SEQ ID NO: 31714 - DNA, 20 bp, Artificial Sequence
  sgRNA
  Ltb4r2_11
ccacgcggtcaatctcctac

SEQ ID NO: 31715 - DNA, 20 bp, Artificial Sequence
  sgRNA
  Ltb4r2_12
gctctatgtcttcactgcgg

SEQ ID NO: 31716 - DNA, 20 bp, Artificial Sequence
  sgRNA
  Ltb4r2_13
gcagctgcgtgcactggcga

SEQ ID NO: 31717 - DNA, 20 bp, Artificial Sequence
  sgRNA
  Ltb4r2_14
catactacgaagccattgcc

SEQ ID NO: 31718 - DNA, 20 bp, Artificial Sequence
  sgRNA
  Ltb4r2_15
gttccttactcgactcttcg

SEQ ID NO: 31719 - DNA, 20 bp, Artificial Sequence
  sgRNA
  Ltb4r2_16
cgcggtcaatctcctacagg

SEQ ID NO: 31720 - DNA, 20 bp, Artificial Sequence
  sgRNA
  Ltb4r2_17
actgagctggaagggctcgc

SEQ ID NO: 31721 - DNA, 20 bp, Artificial Sequence
  sgRNA
  Ltb4r2_18
gggcgacaaggcacacgggt

SEQ ID NO: 31722 - DNA, 20 bp, Artificial Sequence
  sgRNA
  Ltb4r2_19
ggaagggccgagtgacagcc

SEQ ID NO: 31723 - DNA, 20 bp, Artificial Sequence
  sgRNA
  Ltb4r2_20
agtagtgtctcattcccagg

SEQ ID NO: 31724 - DNA, 20 bp, Artificial Sequence
  sgRNA
  Ltbr_1
ggaagtgtcccggcttacag

SEQ ID NO: 31725 - DNA, 20 bp, Artificial Sequence
  sgRNA
  Ltbr_2
ctcattgtccagatacacac

SEQ ID NO: 31726 - DNA, 20 bp, Artificial Sequence
  sgRNA
  Ltbr_3
tgttcattataggaattatg

SEQ ID NO: 31727 - DNA, 20 bp, Artificial Sequence
  sgRNA
  Ltbr_4
agctccaggtacctcctact

SEQ ID NO: 31728 - DNA, 20 bp, Artificial Sequence
  sgRNA
  Ltbr_5
agatacacacaggacatccc

SEQ ID NO: 31729 - DNA, 20 bp, Artificial Sequence
  sgRNA
  Ltbr_6
tgcaaaccgtgtcttggctg

SEQ ID NO: 31730 - DNA, 20 bp, Artificial Sequence
  sgRNA
  Ltbr_7
gcaacatctacatatacaat

SEQ ID NO: 31731 - DNA, 20 bp, Artificial Sequence
  sgRNA
  Ltbr_8
ataattcctataatgaacac

SEQ ID NO: 31732 - DNA, 20 bp, Artificial Sequence
  sgRNA
  Ltbr_9
aatggcattcatgtgaccgg

SEQ ID NO: 31733 - DNA, 20 bp, Artificial Sequence
  sgRNA
  Ltbr_10
ggtccaggccagagagctgg

SEQ ID NO: 31734 - DNA, 20 bp, Artificial Sequence
  sgRNA
  Ltbr_11
ccataccccactcctgaaga

SEQ ID NO: 31735 - DNA, 20 bp, Artificial Sequence
  sgRNA
  Ltbr_12
gctgtctacaccctaccagg

SEQ ID NO: 31736 - DNA, 20 bp, Artificial Sequence
  sgRNA
  Ltbr_13
ttgccccttgcaccagcgat

SEQ ID NO: 31737 - DNA, 20 bp, Artificial Sequence
  sgRNA
  Ltbr_14
gagcagcagacgtcgtgcat

SEQ ID NO: 31738 - DNA, 20 bp, Artificial Sequence
  sgRNA
  Ltbr_15
tgagatccagggcctggtgg

SEQ ID NO: 31739 - DNA, 20 bp, Artificial Sequence
  sgRNA
  Ltbr_16
gcactcggctttccgatcgc

SEQ ID NO: 31740 - DNA, 20 bp, Artificial Sequence
  sgRNA
  Ltbr_17
acagatggtatccgagtagg

SEQ ID NO: 31741 - DNA, 20 bp, Artificial Sequence
  sgRNA
  Ltbr_18
tctacaccctaccaggagga

SEQ ID NO: 31742 - DNA, 20 bp, Artificial Sequence
  sgRNA
  Ltbr_19
acaagtctccagacatgggt

SEQ ID NO: 31743 - DNA, 20 bp, Artificial Sequence
  sgRNA
  Ltbr_20
aggacatccccggctgacag

SEQ ID NO: 31744 - DNA, 20 bp, Artificial Sequence
  sgRNA
  Ltk_1
cacacaaacacagtgcgatg

SEQ ID NO: 31745 - DNA, 20 bp, Artificial Sequence
  sgRNA
  Ltk_2
agaacattgtacgctgtgtg

SEQ ID NO: 31746 - DNA, 20 bp, Artificial Sequence
  sgRNA
  Ltk_3
acaccggctccccgcgacgg

SEQ ID NO: 31747 - DNA, 20 bp, Artificial Sequence
  sgRNA
  Ltk_4
ggactcaggccgtccccgag

SEQ ID NO: 31748 - DNA, 20 bp, Artificial Sequence
  sgRNA
  Ltk_5
gtcccacctgacaatagtaa

SEQ ID NO: 31749 - DNA, 20 bp, Artificial Sequence
  sgRNA
  Ltk_6
gatctccgcctacggagcgg

SEQ ID NO: 31750 - DNA, 20 bp, Artificial Sequence
  sgRNA
  Ltk_7
gctgaactcacccctgcccg

SEQ ID NO: 31751 - DNA, 20 bp, Artificial Sequence
  sgRNA
  Ltk_8
agtcttcttcctccgtcgcg

SEQ ID NO: 31752 - DNA, 20 bp, Artificial Sequence
  sgRNA
  Ltk_9
tatgggaccgaaaggatccc

SEQ ID NO: 31753 - DNA, 20 bp, Artificial Sequence
  sgRNA
  Ltk_10
taccggaggcgacctgaccg

SEQ ID NO: 31754 - DNA, 20 bp, Artificial Sequence
  sgRNA
  Ltk_11
agatgctgccaaagtcaggg

SEQ ID NO: 31755 - DNA, 20 bp, Artificial Sequence
  sgRNA
  Ltk_12
tctccagcctgggatccttt

SEQ ID NO: 31756 - DNA, 20 bp, Artificial Sequence
  sgRNA
  Ltk_13
gcctcaagaccctcaaaccc

SEQ ID NO: 31757 - DNA, 20 bp, Artificial Sequence
  sgRNA
  Ltk_14
gccctttcaaagactgccag

SEQ ID NO: 31758 - DNA, 20 bp, Artificial Sequence
  sgRNA
  Ltk_15
gccgaatgcacgtgcccaga

SEQ ID NO: 31759 - DNA, 20 bp, Artificial Sequence
  sgRNA
  Ltk_16
cctcctggttggtatgtcca

SEQ ID NO: 31760 - DNA, 20 bp, Artificial Sequence
  sgRNA
  Ltk_17
gatcctttcggtcccatagg

SEQ ID NO: 31761 - DNA, 20 bp, Artificial Sequence
  sgRNA
  Ltk_18
accagcaccggcaaaagcga

SEQ ID NO: 31762 - DNA, 20 bp, Artificial Sequence
  sgRNA
  Ltk_19
ttcggatctccacctcccca

SEQ ID NO: 31763 - DNA, 20 bp, Artificial Sequence
  sgRNA
  Ltk_20
acacttccccaaaggcacca

SEQ ID NO: 31764 - DNA, 20 bp, Artificial Sequence
  sgRNA
  Ly6d_1
ctggcagcattgtgtgacct

SEQ ID NO: 31765 - DNA, 20 bp, Artificial Sequence
  sgRNA
  Ly6d_2
tgccaactgtaagaaccctc

SEQ ID NO: 31766 - DNA, 20 bp, Artificial Sequence
  sgRNA
  Ly6d_3
cacgtgacatcgaagtgccc

SEQ ID NO: 31767 - DNA, 20 bp, Artificial Sequence
  sgRNA
  Ly6d_4
acctccgactacagccagca

SEQ ID NO: 31768 - DNA, 20 bp, Artificial Sequence
  sgRNA
  Ly6d_5
agttggacgggcagacctga

SEQ ID NO: 31769 - DNA, 20 bp, Artificial Sequence
  sgRNA
  Ly6d_6
agactgacctatgcaacgag

SEQ ID NO: 31770 - DNA, 20 bp, Artificial Sequence
  sgRNA
  Ly6d_7
ccatgtcagcagtggttccg

SEQ ID NO: 31771 - DNA, 20 bp, Artificial Sequence
  sgRNA
  Ly6d_8
tggccacagccaagacaagg

SEQ ID NO: 31772 - DNA, 20 bp, Artificial Sequence
  sgRNA
  Ly6d_9
tgaccagcctctcgttgcat

SEQ ID NO: 31773 - DNA, 20 bp, Artificial Sequence
  sgRNA
  Ly6d_10
gccctgctggctgtagtcgg

SEQ ID NO: 31774 - DNA, 20 bp, Artificial Sequence
  sgRNA
  Ly6d_11
agagagccataacagtgagc

SEQ ID NO: 31775 - DNA, 20 bp, Artificial Sequence
  sgRNA
  Ly6d_12
gcaggctgaggctcgttgcc

SEQ ID NO: 31776 - DNA, 20 bp, Artificial Sequence
  sgRNA
  Ly6d_13
cacctccgactacagccagc

SEQ ID NO: 31777 - DNA, 20 bp, Artificial Sequence
  sgRNA
  Ly6d_14
tgacctatgcaacgagaggc

SEQ ID NO: 31778 - DNA, 20 bp, Artificial Sequence
  sgRNA
  Ly6d_15
cagcagggccatgtcagcag

SEQ ID NO: 31779 - DNA, 20 bp, Artificial Sequence
  sgRNA
  Ly6d_16
ccataacagtgagcaggctg

SEQ ID NO: 31780 - DNA, 20 bp, Artificial Sequence
  sgRNA
  Ly6d_17
gaggctcgttgccaggccca

SEQ ID NO: 31781 - DNA, 20 bp, Artificial Sequence
  sgRNA
  Ly6d_18
cgtcctccttgtcttggctg

SEQ ID NO: 31782 - DNA, 20 bp, Artificial Sequence
  sgRNA
  Ly6d_19
tagtggccacagccaagaca

SEQ ID NO: 31783 - DNA, 20 bp, Artificial Sequence
  sgRNA
  Ly6d_20
ttgcagaagtagaagttgga

SEQ ID NO: 31784 - DNA, 20 bp, Artificial Sequence
  sgRNA
  Ly6e_1
tatcacgttatctgccgctg

SEQ ID NO: 31785 - DNA, 20 bp, Artificial Sequence
  sgRNA
  Ly6e_2
cttggctacaccctgaacaa

SEQ ID NO: 31786 - DNA, 20 bp, Artificial Sequence
  sgRNA
  Ly6e_3
ggtacatgagaagcacatca

SEQ ID NO: 31787 - DNA, 20 bp, Artificial Sequence
  sgRNA
  Ly6e_4
agaacaatataaactgcctg

SEQ ID NO: 31788 - DNA, 20 bp, Artificial Sequence
  sgRNA
  Ly6e_5
cctggcatgaaactggccac

SEQ ID NO: 31789 - DNA, 20 bp, Artificial Sequence
  sgRNA
  Ly6e_6
gcagagccaacaagctaagc

SEQ ID NO: 31790 - DNA, 20 bp, Artificial Sequence
  sgRNA
  Ly6e_7
agctgcgctgaagttgcaga

SEQ ID NO: 31791 - DNA, 20 bp, Artificial Sequence
  sgRNA
  Ly6e_8
cagataacgtgatacagtaa

SEQ ID NO: 31792 - DNA, 20 bp, Artificial Sequence
  sgRNA
  Ly6e_9
agaagggctgccaacagcac

SEQ ID NO: 31793 - DNA, 20 bp, Artificial Sequence
  sgRNA
  Ly6e_10
aacttgctccatgcccagaa

SEQ ID NO: 31794 - DNA, 20 bp, Artificial Sequence
  sgRNA
  Ly6e_11
tgtcaatctcaatctcggtg

SEQ ID NO: 31795 - DNA, 20 bp, Artificial Sequence
  sgRNA
  Ly6e_12
ggatactggcacgaagtccg

SEQ ID NO: 31796 - DNA, 20 bp, Artificial Sequence
  sgRNA
  Ly6e_13
ccttgttcagggtgtagcca

SEQ ID NO: 31797 - DNA, 20 bp, Artificial Sequence
  sgRNA
  Ly6e_14
cgtgccagtatcccactact

SEQ ID NO: 31798 - DNA, 20 bp, Artificial Sequence
  sgRNA
  Ly6e_15
tgaagttgcagaaggagctt

SEQ ID NO: 31799 - DNA, 20 bp, Artificial Sequence
  sgRNA
  Ly6e_16
tctttctcctggcatgaaac

SEQ ID NO: 31800 - DNA, 20 bp, Artificial Sequence
  sgRNA
  Ly6e_17
aggcaggaagactctcatgt

SEQ ID NO: 31801 - DNA, 20 bp, Artificial Sequence
  sgRNA
  Ly6e_18
gggctgccaacagcacaggc

SEQ ID NO: 31802 - DNA, 20 bp, Artificial Sequence
  sgRNA
  Ly6e_19
cctgtggccagtttcatgcc

SEQ ID NO: 31803 - DNA, 20 bp, Artificial Sequence
  sgRNA
  Ly6e_20
atcacgttatctgccgctgc

SEQ ID NO: 31804 - DNA, 20 bp, Artificial Sequence
  sgRNA
  Ly6g6c_1
gtgacatcgagtatcagctg

SEQ ID NO: 31805 - DNA, 20 bp, Artificial Sequence
  sgRNA
  Ly6g6c_2
tcgttgaagacctcccgaca

SEQ ID NO: 31806 - DNA, 20 bp, Artificial Sequence
  sgRNA
  Ly6g6c_3
cctgcctctagggaagatgt

SEQ ID NO: 31807 - DNA, 20 bp, Artificial Sequence
  sgRNA
  Ly6g6c_4
cgtttgttgtcaggcatttg

SEQ ID NO: 31808 - DNA, 20 bp, Artificial Sequence
  sgRNA
  Ly6g6c_5
ggatcgccagtcctgccgcc

SEQ ID NO: 31809 - DNA, 20 bp, Artificial Sequence
  sgRNA
  Ly6g6c_6
actgtaacagcccggctcca

SEQ ID NO: 31810 - DNA, 20 bp, Artificial Sequence
  sgRNA
  Ly6g6c_7
gcagttgacagcagattccc

SEQ ID NO: 31811 - DNA, 20 bp, Artificial Sequence
  sgRNA
  Ly6g6c_8
tgagacccagcagtagagta

SEQ ID NO: 31812 - DNA, 20 bp, Artificial Sequence
  sgRNA
  Ly6g6c_9
gttatccttgtcacagcagg

SEQ ID NO: 31813 - DNA, 20 bp, Artificial Sequence
  sgRNA
  Ly6g6c_10
agaaaacccacatcttccca

SEQ ID NO: 31814 - DNA, 20 bp, Artificial Sequence
  sgRNA
  Ly6g6c_11
tctgggaagggaaggccggg

SEQ ID NO: 31815 - DNA, 20 bp, Artificial Sequence
  sgRNA
  Ly6g6c_12
atttgtggcccggctccagg

SEQ ID NO: 31816 - DNA, 20 bp, Artificial Sequence
  sgRNA
  Ly6g6c_13
ggaatctgctgtcaactgct

SEQ ID NO: 31817 - DNA, 20 bp, Artificial Sequence
  sgRNA
  Ly6g6c_14
gtctgccctactctactgct

SEQ ID NO: 31818 - DNA, 20 bp, Artificial Sequence
  sgRNA
  Ly6g6c_15
gcagtagagtagggcagaca

SEQ ID NO: 31819 - DNA, 20 bp, Artificial Sequence
  sgRNA
  Ly6g6c_16
accagaagagccttgtcggg

SEQ ID NO: 31820 - DNA, 20 bp, Artificial Sequence
  sgRNA
  Ly6g6c_17
caaggataactgtaacagcc

SEQ ID NO: 31821 - DNA, 20 bp, Artificial Sequence
  sgRNA
  Ly6g6c_18
caggaggtgtttcatggtga

SEQ ID NO: 31822 - DNA, 20 bp, Artificial Sequence
  sgRNA
  Ly6g6c_19
gcacaccagaagagccttgt

SEQ ID NO: 31823 - DNA, 20 bp, Artificial Sequence
  sgRNA
  Ly6g6c_20
gatccacacagcccagcaca

SEQ ID NO: 31824 - DNA, 20 bp, Artificial Sequence
  sgRNA
  Ly6g6d_1
aagcagacagtgatcacttg

SEQ ID NO: 31825 - DNA, 20 bp, Artificial Sequence
  sgRNA
  Ly6g6d_2
cgcagtcatagcaccgcgtg

SEQ ID NO: 31826 - DNA, 20 bp, Artificial Sequence
  sgRNA
  Ly6g6d_3
caagtggccatagagtcagt

SEQ ID NO: 31827 - DNA, 20 bp, Artificial Sequence
  sgRNA
  Ly6g6d_4
gtgatggctcaaggtcgcgg

SEQ ID NO: 31828 - DNA, 20 bp, Artificial Sequence
  sgRNA
  Ly6g6d_5
agatctgtgcaacagcgccg

SEQ ID NO: 31829 - DNA, 20 bp, Artificial Sequence
  sgRNA
  Ly6g6d_6
gtagtgatggctcaaggtcg

SEQ ID NO: 31830 - DNA, 20 bp, Artificial Sequence
  sgRNA
  Ly6g6d_7
ccatcactacccagcctgcg

SEQ ID NO: 31831 - DNA, 20 bp, Artificial Sequence
  sgRNA
  Ly6g6d_8
gcaatgatgcgtggccacgc

SEQ ID NO: 31832 - DNA, 20 bp, Artificial Sequence
  sgRNA
  Ly6g6d_9
cacgcatcattgcaatcaag

SEQ ID NO: 31833 - DNA, 20 bp, Artificial Sequence
  sgRNA
  Ly6g6d_10
acagtgatcacttgtggtga

SEQ ID NO: 31834 - DNA, 20 bp, Artificial Sequence
  sgRNA
  Ly6g6d_11
tgagcaggatcccgaccaac

SEQ ID NO: 31835 - DNA, 20 bp, Artificial Sequence
  sgRNA
  Ly6g6d_12
tgtggtgagggcgagcgctg

SEQ ID NO: 31836 - DNA, 20 bp, Artificial Sequence
  sgRNA
  Ly6g6d_13
gcttgctccgagctgggttg

SEQ ID NO: 31837 - DNA, 20 bp, Artificial Sequence
  sgRNA
  Ly6g6d_14
ccgcaaacctcaacccagct

SEQ ID NO: 31838 - DNA, 20 bp, Artificial Sequence
  sgRNA
  Ly6g6d_15
gctgcagccaagatgcacaa

SEQ ID NO: 31839 - DNA, 20 bp, Artificial Sequence
  sgRNA
  Ly6g6d_16
tcctggcaagagccaggcca

SEQ ID NO: 31840 - DNA, 20 bp, Artificial Sequence
  sgRNA
  Ly6g6d_17
tcaagtggccatagagtcag

SEQ ID NO: 31841 - DNA, 20 bp, Artificial Sequence
  sgRNA
  Ly6g6d_18
tgcagccaagatgcacaagg

SEQ ID NO: 31842 - DNA, 20 bp, Artificial Sequence
  sgRNA
  Ly6g6d_19
agtgatcactgtctgcttgc

SEQ ID NO: 31843 - DNA, 20 bp, Artificial Sequence
  sgRNA
  Ly6g6d_20
gggggtcacggagcttgcca

SEQ ID NO: 31844 - DNA, 20 bp, Artificial Sequence
  sgRNA
  Ly6h_1
ccgcttaacgaagtcgcagg

SEQ ID NO: 31845 - DNA, 20 bp, Artificial Sequence
  sgRNA
  Ly6h_2
ctggcacaaacggtatcggt

SEQ ID NO: 31846 - DNA, 20 bp, Artificial Sequence
  sgRNA
  Ly6h_3
tagggcctgaaagaggcgcg

SEQ ID NO: 31847 - DNA, 20 bp, Artificial Sequence
  sgRNA
  Ly6h_4
gtcctggcaccacaggccat

SEQ ID NO: 31848 - DNA, 20 bp, Artificial Sequence
  sgRNA
  Ly6h_5
gcaatggctggaattggcca

SEQ ID NO: 31849 - DNA, 20 bp, Artificial Sequence
  sgRNA
  Ly6h_6
cctcctgcgacttcgttaag

SEQ ID NO: 31850 - DNA, 20 bp, Artificial Sequence
  sgRNA
  Ly6h_7
cgagaaagatttgtgcaacg

SEQ ID NO: 31851 - DNA, 20 bp, Artificial Sequence
  sgRNA
  Ly6h_8
ataccgtttgtgccagcgtg

SEQ ID NO: 31852 - DNA, 20 bp, Artificial Sequence
  sgRNA
  Ly6h_9
gctccgatagggcctgaaag

SEQ ID NO: 31853 - DNA, 20 bp, Artificial Sequence
  sgRNA
  Ly6h_10
ggcactgcttcggagcgcaa

SEQ ID NO: 31854 - DNA, 20 bp, Artificial Sequence
  sgRNA
  Ly6h_11
gatagggcctgaaagaggcg

SEQ ID NO: 31855 - DNA, 20 bp, Artificial Sequence
  sgRNA
  Ly6h_12
agatttgtgcaacggggcat

SEQ ID NO: 31856 - DNA, 20 bp, Artificial Sequence
  sgRNA
  Ly6h_13
cacgctggcacaaacggtat

SEQ ID NO: 31857 - DNA, 20 bp, Artificial Sequence
  sgRNA
  Ly6h_14
ggggtcggtgatccgcacgc

SEQ ID NO: 31858 - DNA, 20 bp, Artificial Sequence
  sgRNA
  Ly6h_15
cctgcagccatgaagagcct

SEQ ID NO: 31859 - DNA, 20 bp, Artificial Sequence
  sgRNA
  Ly6h_16
gctggcacaaacggtatcgg

SEQ ID NO: 31860 - DNA, 20 bp, Artificial Sequence
  sgRNA
  Ly6h_17
aggccagcagcgccagaccg

SEQ ID NO: 31861 - DNA, 20 bp, Artificial Sequence
  sgRNA
  Ly6h_18
gcgcctctttcaggccctat

SEQ ID NO: 31862 - DNA, 20 bp, Artificial Sequence
  sgRNA
  Ly6h_19
atagggcctgaaagaggcgc

SEQ ID NO: 31863 - DNA, 20 bp, Artificial Sequence
  sgRNA
  Ly6h_20
gcaggcagcatgctccgata

SEQ ID NO: 31864 - DNA, 20 bp, Artificial Sequence
  sgRNA
  Ly6k_1
tgtcgaaacagtgcacccga

SEQ ID NO: 31865 - DNA, 20 bp, Artificial Sequence
  sgRNA
  Ly6k_2
gatggtggattagtgctagg

SEQ ID NO: 31866 - DNA, 20 bp, Artificial Sequence
  sgRNA
  Ly6k_3
tgttctgcgcctcacacaca

SEQ ID NO: 31867 - DNA, 20 bp, Artificial Sequence
  sgRNA
  Ly6k_4
ttataaaataggaagggcat

SEQ ID NO: 31868 - DNA, 20 bp, Artificial Sequence
  sgRNA
  Ly6k_5
gtatctatgtcttctcccac

SEQ ID NO: 31869 - DNA, 20 bp, Artificial Sequence
  sgRNA
  Ly6k_6
cagcacttataaaataggaa

SEQ ID NO: 31870 - DNA, 20 bp, Artificial Sequence
  sgRNA
  Ly6k_7
aacaacctgggaaagccagt

SEQ ID NO: 31871 - DNA, 20 bp, Artificial Sequence
  sgRNA
  Ly6k_8
gctaggcgggctgactacgg

SEQ ID NO: 31872 - DNA, 20 bp, Artificial Sequence
  sgRNA
  Ly6k_9
gaactacgagcaaggccact

SEQ ID NO: 31873 - DNA, 20 bp, Artificial Sequence
  sgRNA
  Ly6k_10
tttaagagctggtcagtggg

SEQ ID NO: 31874 - DNA, 20 bp, Artificial Sequence
  sgRNA
  Ly6k_11
cgtagttctgggcttacagt

SEQ ID NO: 31875 - DNA, 20 bp, Artificial Sequence
  sgRNA
  Ly6k_12
gggactcatgtaatggtgag

SEQ ID NO: 31876 - DNA, 20 bp, Artificial Sequence
  sgRNA
  Ly6k_13
tcgaatccgtcccagtgccc

SEQ ID NO: 31877 - DNA, 20 bp, Artificial Sequence
  sgRNA
  Ly6k_14
tcagatggtggattagtgct

SEQ ID NO: 31878 - DNA, 20 bp, Artificial Sequence
  sgRNA
  Ly6k_15
agctcttaaaggaacaacct

SEQ ID NO: 31879 - DNA, 20 bp, Artificial Sequence
  sgRNA
  Ly6k_16
gaacaacctgggaaagccag

SEQ ID NO: 31880 - DNA, 20 bp, Artificial Sequence
  sgRNA
  Ly6k_17
gcactgggacggattcgagc

SEQ ID NO: 31881 - DNA, 20 bp, Artificial Sequence
  sgRNA
  Ly6k_18
attgacagcacttataaaat

SEQ ID NO: 31882 - DNA, 20 bp, Artificial Sequence
  sgRNA
  Ly6k_19
aactccttaggctcagatgg

SEQ ID NO: 31883 - DNA, 20 bp, Artificial Sequence
  sgRNA
  Ly6k_20
gctgttactgactggcttca

SEQ ID NO: 31884 - DNA, 20 bp, Artificial Sequence
  sgRNA
  Ly75_1
gtcacgaaactccataatgg

SEQ ID NO: 31885 - DNA, 20 bp, Artificial Sequence
  sgRNA
  Ly75_2
taagctgtgtccgccagacg

SEQ ID NO: 31886 - DNA, 20 bp, Artificial Sequence
  sgRNA
  Ly75_3
gcttgcttgagaaaacgtaa

SEQ ID NO: 31887 - DNA, 20 bp, Artificial Sequence
  sgRNA
  Ly75_4
tcctgtgaacgatgttatcg

SEQ ID NO: 31888 - DNA, 20 bp, Artificial Sequence
  sgRNA
  Ly75_5
aatcagctctattctgcgag

SEQ ID NO: 31889 - DNA, 20 bp, Artificial Sequence
  sgRNA
  Ly75_6
agaactatgataagtccctt

SEQ ID NO: 31890 - DNA, 20 bp, Artificial Sequence
  sgRNA
  Ly75_7
gaattcacaaggtctcccgt

SEQ ID NO: 31891 - DNA, 20 bp, Artificial Sequence
  sgRNA
  Ly75_8
gcttcttcgtagtttaagtg

SEQ ID NO: 31892 - DNA, 20 bp, Artificial Sequence
  sgRNA
  Ly75_9
gaagccactgaacaacacgc

SEQ ID NO: 31893 - DNA, 20 bp, Artificial Sequence
  sgRNA
  Ly75_10
gttccagtggtcggacggaa

SEQ ID NO: 31894 - DNA, 20 bp, Artificial Sequence
  sgRNA
  Ly75_11
tcctctctacgactgaagct

SEQ ID NO: 31895 - DNA, 20 bp, Artificial Sequence
  sgRNA
  Ly75_12
tccatgttcataccgaaccg

SEQ ID NO: 31896 - DNA, 20 bp, Artificial Sequence
  sgRNA
  Ly75_13
agtccagaagtacttccgaa

SEQ ID NO: 31897 - DNA, 20 bp, Artificial Sequence
  sgRNA
  Ly75_14
ctttggtaatatcgaggccg

SEQ ID NO: 31898 - DNA, 20 bp, Artificial Sequence
  sgRNA
  Ly75_15
gaacattcgcaggttgtccg

SEQ ID NO: 31899 - DNA, 20 bp, Artificial Sequence
  sgRNA
  Ly75_16
agaaggctccacaagcccga

SEQ ID NO: 31900 - DNA, 20 bp, Artificial Sequence
  sgRNA
  Ly75_17
agtcacagctgaacattcgc

SEQ ID NO: 31901 - DNA, 20 bp, Artificial Sequence
  sgRNA
  Ly75_18
aacgcgtgctctcaaagtgg

SEQ ID NO: 31902 - DNA, 20 bp, Artificial Sequence
  sgRNA
  Ly75_19
cggttcaagaaaattccagt

SEQ ID NO: 31903 - DNA, 20 bp, Artificial Sequence
  sgRNA
  Ly75_20
ttgttcaccccggctcagca

SEQ ID NO: 31904 - DNA, 20 bp, Artificial Sequence
  sgRNA
  Ly9_1
tgcaggtatagggtaggtcg

SEQ ID NO: 31905 - DNA, 20 bp, Artificial Sequence
  sgRNA
  Ly9_2
gaaacaatgtgacatacaca

SEQ ID NO: 31906 - DNA, 20 bp, Artificial Sequence
  sgRNA
  Ly9_3
cgagtggcccgaaattccaa

SEQ ID NO: 31907 - DNA, 20 bp, Artificial Sequence
  sgRNA
  Ly9_4
acagattccacgatgatctg

SEQ ID NO: 31908 - DNA, 20 bp, Artificial Sequence
  sgRNA
  Ly9_5
catgatgaacggaatctgcg

SEQ ID NO: 31909 - DNA, 20 bp, Artificial Sequence
  sgRNA
  Ly9_6
ggttgtcctgacctgttcag

SEQ ID NO: 31910 - DNA, 20 bp, Artificial Sequence
  sgRNA
  Ly9_7
acaaagctgtcatgtcccaa

SEQ ID NO: 31911 - DNA, 20 bp, Artificial Sequence
  sgRNA
  Ly9_8
tgtctgggtgtttaacacgt

SEQ ID NO: 31912 - DNA, 20 bp, Artificial Sequence
  sgRNA
  Ly9_9
gtgatatcagggatgctagg

SEQ ID NO: 31913 - DNA, 20 bp, Artificial Sequence
  sgRNA
  Ly9_10
gattctcgccgtaagcccaa

SEQ ID NO: 31914 - DNA, 20 bp, Artificial Sequence
  sgRNA
  Ly9_11
taagttctgcttgctacacg

SEQ ID NO: 31915 - DNA, 20 bp, Artificial Sequence
  sgRNA
  Ly9_12
ccagtacagctggacccgag

SEQ ID NO: 31916 - DNA, 20 bp, Artificial Sequence
  sgRNA
  Ly9_13
cgtcggttatcagccaagaa

SEQ ID NO: 31917 - DNA, 20 bp, Artificial Sequence
  sgRNA
  Ly9_14
tcagagctggtatctgaggt

SEQ ID NO: 31918 - DNA, 20 bp, Artificial Sequence
  sgRNA
  Ly9_15
agtcctgtgcacatgatgaa

SEQ ID NO: 31919 - DNA, 20 bp, Artificial Sequence
  sgRNA
  Ly9_16
gaaggtgcaggaatcagtat

SEQ ID NO: 31920 - DNA, 20 bp, Artificial Sequence
  sgRNA
  Ly9_17
cttgctacacgcggtctctg

SEQ ID NO: 31921 - DNA, 20 bp, Artificial Sequence
  sgRNA
  Ly9_18
ccagaagcctcagatcatcg

SEQ ID NO: 31922 - DNA, 20 bp, Artificial Sequence
  sgRNA
  Ly9_19
ccagaagaaaaacagcagcg

SEQ ID NO: 31923 - DNA, 20 bp, Artificial Sequence
  sgRNA
  Ly9_20
acatgtctgctaagaccacc

SEQ ID NO: 31924 - DNA, 20 bp, Artificial Sequence
  sgRNA
  Lynx1_1
tgccacgtgtgtgcctacaa

SEQ ID NO: 31925 - DNA, 20 bp, Artificial Sequence
  sgRNA
  Lynx1_2
cttggaatagccatcgtaca

SEQ ID NO: 31926 - DNA, 20 bp, Artificial Sequence
  sgRNA
  Lynx1_3
gccagactcacaagttcgtg

SEQ ID NO: 31927 - DNA, 20 bp, Artificial Sequence
  sgRNA
  Lynx1_4
cttcaccccataccggatga

SEQ ID NO: 31928 - DNA, 20 bp, Artificial Sequence
  sgRNA
  Lynx1_5
ggtcatacagtaggtggcca

SEQ ID NO: 31929 - DNA, 20 bp, Artificial Sequence
  sgRNA
  Lynx1_6
ctccattgtaggcacacacg

SEQ ID NO: 31930 - DNA, 20 bp, Artificial Sequence
  sgRNA
  Lynx1_7
tgccagtactacctctgcaa

SEQ ID NO: 31931 - DNA, 20 bp, Artificial Sequence
  sgRNA
  Lynx1_8
tgctttgaaaccgtgtacga

SEQ ID NO: 31932 - DNA, 20 bp, Artificial Sequence
  sgRNA
  Lynx1_9
tcgtgtggtcatacagtagg

SEQ ID NO: 31933 - DNA, 20 bp, Artificial Sequence
  sgRNA
  Lynx1_10
gcagaggtagtactggcaac

SEQ ID NO: 31934 - DNA, 20 bp, Artificial Sequence
  sgRNA
  Lynx1_11
agttcgtgtggtcatacagt

SEQ ID NO: 31935 - DNA, 20 bp, Artificial Sequence
  sgRNA
  Lynx1_12
gaggtagtactggcaacagg

SEQ ID NO: 31936 - DNA, 20 bp, Artificial Sequence
  sgRNA
  Lynx1_13
cacgtggcactccagagcct

SEQ ID NO: 31937 - DNA, 20 bp, Artificial Sequence
  sgRNA
  Lynx1_14
taccccggtgaccttggccc

SEQ ID NO: 31938 - DNA, 20 bp, Artificial Sequence
  sgRNA
  Lynx1_15
gtacacggtttcaaagcagc

SEQ ID NO: 31939 - DNA, 20 bp, Artificial Sequence
  sgRNA
  Lynx1_16
tctgctcacagtgttcctgg

SEQ ID NO: 31940 - DNA, 20 bp, Artificial Sequence
  sgRNA
  Lynx1_17
gaccagggccaaggtcaccg

SEQ ID NO: 31941 - DNA, 20 bp, Artificial Sequence
  sgRNA
  Lynx1_18
tcctcaccttcatccggtat

SEQ ID NO: 31942 - DNA, 20 bp, Artificial Sequence
  sgRNA
  Lynx1_19
agaaggtagctaggagtgct

SEQ ID NO: 31943 - DNA, 20 bp, Artificial Sequence
  sgRNA
  Lynx1_20
caaagccagcaccgttgcag

SEQ ID NO: 31944 - DNA, 20 bp, Artificial Sequence
  sgRNA
  Lypd1_1
gcaatttacgatgaactcag

SEQ ID NO: 31945 - DNA, 20 bp, Artificial Sequence
  sgRNA
  Lypd1_2
tcagctggaattcttcacac

SEQ ID NO: 31946 - DNA, 20 bp, Artificial Sequence
  sgRNA
  Lypd1_3
catgtgtcagaaagaagtga

SEQ ID NO: 31947 - DNA, 20 bp, Artificial Sequence
  sgRNA
  Lypd1_4
acacatgtcttgaacgttca

SEQ ID NO: 31948 - DNA, 20 bp, Artificial Sequence
  sgRNA
  Lypd1_5
gcaacacccctctttgcaat

SEQ ID NO: 31949 - DNA, 20 bp, Artificial Sequence
  sgRNA
  Lypd1_6
cctcggcccattgcaaagag

SEQ ID NO: 31950 - DNA, 20 bp, Artificial Sequence
  sgRNA
  Lypd1_7
cacggagttcagtttcccag

SEQ ID NO: 31951 - DNA, 20 bp, Artificial Sequence
  sgRNA
  Lypd1_8
acacggagttcagtttccca

SEQ ID NO: 31952 - DNA, 20 bp, Artificial Sequence
  sgRNA
  Lypd1_9
cctgtctcattgcttcagct

SEQ ID NO: 31953 - DNA, 20 bp, Artificial Sequence
  sgRNA
  Lypd1_10
ggcctcggcccattgcaaag

SEQ ID NO: 31954 - DNA, 20 bp, Artificial Sequence
  sgRNA
  Lypd1_11
accagtccttctgttcccct

SEQ ID NO: 31955 - DNA, 20 bp, Artificial Sequence
  sgRNA
  Lypd1_12
gtgccaagcagagggctaag

SEQ ID NO: 31956 - DNA, 20 bp, Artificial Sequence
  sgRNA
  Lypd1_13
cccctctttgcaatgggccg

SEQ ID NO: 31957 - DNA, 20 bp, Artificial Sequence
  sgRNA
  Lypd1_14
gttgcagcagctgatgcaca

SEQ ID NO: 31958 - DNA, 20 bp, Artificial Sequence
  sgRNA
  Lypd1_15
ctgacgatgcacacgacttc

SEQ ID NO: 31959 - DNA, 20 bp, Artificial Sequence
  sgRNA
  Lypd1_16
gaagtgatggagcaaagtgc

SEQ ID NO: 31960 - DNA, 20 bp, Artificial Sequence
  sgRNA
  Lypd1_17
gtgcaatttacgatgaactc

SEQ ID NO: 31961 - DNA, 20 bp, Artificial Sequence
  sgRNA
  Lypd1_18
aagccctggcctgatggccg

SEQ ID NO: 31962 - DNA, 20 bp, Artificial Sequence
  sgRNA
  Lypd1_19
gcagagctgcctctcttctt

SEQ ID NO: 31963 - DNA, 20 bp, Artificial Sequence
  sgRNA
  Lypd1_20
gggccgaggcccaagaagag

SEQ ID NO: 31964 - DNA, 20 bp, Artificial Sequence
  sgRNA
  Lypd2_1
tgcactcacaggattcgcac

SEQ ID NO: 31965 - DNA, 20 bp, Artificial Sequence
  sgRNA
  Lypd2_2
atcctactgaccaatctcca

SEQ ID NO: 31966 - DNA, 20 bp, Artificial Sequence
  sgRNA
  Lypd2_3
actgatattgggcaccttcg

SEQ ID NO: 31967 - DNA, 20 bp, Artificial Sequence
  sgRNA
  Lypd2_4
ccaatgccatccacatccga

SEQ ID NO: 31968 - DNA, 20 bp, Artificial Sequence
  sgRNA
  Lypd2_5
ggcgcaggacttggtcaccg

SEQ ID NO: 31969 - DNA, 20 bp, Artificial Sequence
  sgRNA
  Lypd2_6
gcataggtcagaattgcagc

SEQ ID NO: 31970 - DNA, 20 bp, Artificial Sequence
  sgRNA
  Lypd2_7
gcactgatattgggcacctt

SEQ ID NO: 31971 - DNA, 20 bp, Artificial Sequence
  sgRNA
  Lypd2_8
caattctgacctatgcaacg

SEQ ID NO: 31972 - DNA, 20 bp, Artificial Sequence
  sgRNA
  Lypd2_9
tggtcaccgtggagtccccc

SEQ ID NO: 31973 - DNA, 20 bp, Artificial Sequence
  sgRNA
  Lypd2_10
tctgacctatgcaacgtgga

SEQ ID NO: 31974 - DNA, 20 bp, Artificial Sequence
  sgRNA
  Lypd2_11
ccgtggagtcccccaggaaa

SEQ ID NO: 31975 - DNA, 20 bp, Artificial Sequence
  sgRNA
  Lypd2_12
gtagagcgtagtcttgcaca

SEQ ID NO: 31976 - DNA, 20 bp, Artificial Sequence
  sgRNA
  Lypd2_13
aattgcagcaggacactggc

SEQ ID NO: 31977 - DNA, 20 bp, Artificial Sequence
  sgRNA
  Lypd2_14
gtgccccatccacgttgcat

SEQ ID NO: 31978 - DNA, 20 bp, Artificial Sequence
  sgRNA
  Lypd2_15
caagagcaagaaaagtgcca

SEQ ID NO: 31979 - DNA, 20 bp, Artificial Sequence
  sgRNA
  Lypd2_16
gcaagaaaagtgccagggca

SEQ ID NO: 31980 - DNA, 20 bp, Artificial Sequence
  sgRNA
  Lypd2_17
gtgctgttggcactgatatt

SEQ ID NO: 31981 - DNA, 20 bp, Artificial Sequence
  sgRNA
  Lypd2_18
tgtgagccttcggatgtgga

SEQ ID NO: 31982 - DNA, 20 bp, Artificial Sequence
  sgRNA
  Lypd2_19
ccctttcctgggggactcca

SEQ ID NO: 31983 - DNA, 20 bp, Artificial Sequence
  sgRNA
  Lypd2_20
tgacctatgcaacgtggatg

SEQ ID NO: 31984 - DNA, 20 bp, Artificial Sequence
  sgRNA
  Lypd3_1
aggtaaggacacggtcacgt

SEQ ID NO: 31985 - DNA, 20 bp, Artificial Sequence
  sgRNA
  Lypd3_2
atcccgggcaagaacgaccg

SEQ ID NO: 31986 - DNA, 20 bp, Artificial Sequence
  sgRNA
  Lypd3_3
ttgtagcagttcacgaccgg

SEQ ID NO: 31987 - DNA, 20 bp, Artificial Sequence
  sgRNA
  Lypd3_4
gagagtgcatatgagcctaa

SEQ ID NO: 31988 - DNA, 20 bp, Artificial Sequence
  sgRNA
  Lypd3_5
cagtgatgtggaccaccgga

SEQ ID NO: 31989 - DNA, 20 bp, Artificial Sequence
  sgRNA
  Lypd3_6
cggggtggacgtctgtaccg

SEQ ID NO: 31990 - DNA, 20 bp, Artificial Sequence
  sgRNA
  Lypd3_7
ggtccaggattcacactcag

SEQ ID NO: 31991 - DNA, 20 bp, Artificial Sequence
  sgRNA
  Lypd3_8
ggttgaggcctcgcaaagtg

SEQ ID NO: 31992 - DNA, 20 bp, Artificial Sequence
  sgRNA
  Lypd3_9
tcagctacagcagtgctccg

SEQ ID NO: 31993 - DNA, 20 bp, Artificial Sequence
  sgRNA
  Lypd3_10
cgaaggtcggcgttacagcg

SEQ ID NO: 31994 - DNA, 20 bp, Artificial Sequence
  sgRNA
  Lypd3_11
ccaggacgagacctgcaccc

SEQ ID NO: 31995 - DNA, 20 bp, Artificial Sequence
  sgRNA
  Lypd3_12
ggacgtctgtaccgaggccg

SEQ ID NO: 31996 - DNA, 20 bp, Artificial Sequence
  sgRNA
  Lypd3_13
gatacttctccatattgctg

SEQ ID NO: 31997 - DNA, 20 bp, Artificial Sequence
  sgRNA
  Lypd3_14
gcgttgtagcagttcacgac

SEQ ID NO: 31998 - DNA, 20 bp, Artificial Sequence
  sgRNA
  Lypd3_15
accgtgtccttacctgtccg

SEQ ID NO: 31999 - DNA, 20 bp, Artificial Sequence
  sgRNA
  Lypd3_16
ctgagccgcgagaagtgcca

SEQ ID NO: 32000 - DNA, 20 bp, Artificial Sequence
  sgRNA
  Lypd3_17
ccatattgctgcggtcttgg

SEQ ID NO: 32001 - DNA, 20 bp, Artificial Sequence
  sgRNA
  Lypd3_18
tctcgtcctggacgcagcct

SEQ ID NO: 32002 - DNA, 20 bp, Artificial Sequence
  sgRNA
  Lypd3_19
ccgccacagagaattgcccg

SEQ ID NO: 32003 - DNA, 20 bp, Artificial Sequence
  sgRNA
  Lypd3_20
aaactcaacctcactttgcg

SEQ ID NO: 32004 - DNA, 20 bp, Artificial Sequence
  sgRNA
  Lypd4_1
tccgggcggagacacgaggt

SEQ ID NO: 32005 - DNA, 20 bp, Artificial Sequence
  sgRNA
  Lypd4_2
catggtgtgcaatcagagag

SEQ ID NO: 32006 - DNA, 20 bp, Artificial Sequence
  sgRNA
  Lypd4_3
agagataggacctgcagacg

SEQ ID NO: 32007 - DNA, 20 bp, Artificial Sequence
  sgRNA
  Lypd4_4
tagtgtggacatgggttgac

SEQ ID NO: 32008 - DNA, 20 bp, Artificial Sequence
  sgRNA
  Lypd4_5
tcctacctcgtgtctccgcc

SEQ ID NO: 32009 - DNA, 20 bp, Artificial Sequence
  sgRNA
  Lypd4_6
gaggcaatggacactccggg

SEQ ID NO: 32010 - DNA, 20 bp, Artificial Sequence
  sgRNA
  Lypd4_7
caatgtcctagataagtccg

SEQ ID NO: 32011 - DNA, 20 bp, Artificial Sequence
  sgRNA
  Lypd4_8
aataccaccttcctcatcat

SEQ ID NO: 32012 - DNA, 20 bp, Artificial Sequence
  sgRNA
  Lypd4_9
gaccgtagtgttcatcgaga

SEQ ID NO: 32013 - DNA, 20 bp, Artificial Sequence
  sgRNA
  Lypd4_10
gtaaagagatggcttctaag

SEQ ID NO: 32014 - DNA, 20 bp, Artificial Sequence
  sgRNA
  Lypd4_11
cgaggtaggagatttgtgga

SEQ ID NO: 32015 - DNA, 20 bp, Artificial Sequence
  sgRNA
  Lypd4_12
gtaacatgaggaagcagcaa

SEQ ID NO: 32016 - DNA, 20 bp, Artificial Sequence
  sgRNA
  Lypd4_13
tgtccttgcataactggaag

SEQ ID NO: 32017 - DNA, 20 bp, Artificial Sequence
  sgRNA
  Lypd4_14
caaaagctgtccaagctgcg

SEQ ID NO: 32018 - DNA, 20 bp, Artificial Sequence
  sgRNA
  Lypd4_15
taaggtggaactgtaacatg

SEQ ID NO: 32019 - DNA, 20 bp, Artificial Sequence
  sgRNA
  Lypd4_16
cattgatgacctcagtcact

SEQ ID NO: 32020 - DNA, 20 bp, Artificial Sequence
  sgRNA
  Lypd4_17
agtccgaggctgtcagtgca

SEQ ID NO: 32021 - DNA, 20 bp, Artificial Sequence
  sgRNA
  Lypd4_18
atggtgtgcaatcagagaga

SEQ ID NO: 32022 - DNA, 20 bp, Artificial Sequence
  sgRNA
  Lypd4_19
taacatgaggaagcagcaaa

SEQ ID NO: 32023 - DNA, 20 bp, Artificial Sequence
  sgRNA
  Lypd4_20
aagggagtcctgagtttcaa

SEQ ID NO: 32024 - DNA, 20 bp, Artificial Sequence
  sgRNA
  Lypd5_1
cggaccaccgcgtagtcggg

SEQ ID NO: 32025 - DNA, 20 bp, Artificial Sequence
  sgRNA
  Lypd5_2
cctaacccacagacgctcag

SEQ ID NO: 32026 - DNA, 20 bp, Artificial Sequence
  sgRNA
  Lypd5_3
gttcccctgagaagtcccga

SEQ ID NO: 32027 - DNA, 20 bp, Artificial Sequence
  sgRNA
  Lypd5_4
ggagggcgtcgtgagtcttg

SEQ ID NO: 32028 - DNA, 20 bp, Artificial Sequence
  sgRNA
  Lypd5_5
tggacatccatcgacctgca

SEQ ID NO: 32029 - DNA, 20 bp, Artificial Sequence
  sgRNA
  Lypd5_6
gacccgtcgggacttctcag

SEQ ID NO: 32030 - DNA, 20 bp, Artificial Sequence
  sgRNA
  Lypd5_7
gcagtaaccctgcaggtcga

SEQ ID NO: 32031 - DNA, 20 bp, Artificial Sequence
  sgRNA
  Lypd5_8
agtagtcagtggcgcaacca

SEQ ID NO: 32032 - DNA, 20 bp, Artificial Sequence
  sgRNA
  Lypd5_9
cgagggccacctctgcaaca

SEQ ID NO: 32033 - DNA, 20 bp, Artificial Sequence
  sgRNA
  Lypd5_10
tagtggagcagccgtcagca

SEQ ID NO: 32034 - DNA, 20 bp, Artificial Sequence
  sgRNA
  Lypd5_11
ttcccctgagaagtcccgac

SEQ ID NO: 32035 - DNA, 20 bp, Artificial Sequence
  sgRNA
  Lypd5_12
tgtacatccggacctgtcac

SEQ ID NO: 32036 - DNA, 20 bp, Artificial Sequence
  sgRNA
  Lypd5_13
gacggacgcccctagagcga

SEQ ID NO: 32037 - DNA, 20 bp, Artificial Sequence
  sgRNA
  Lypd5_14
ccgaatcctgaccctgctga

SEQ ID NO: 32038 - DNA, 20 bp, Artificial Sequence
  sgRNA
  Lypd5_15
gcaggtcgatggatgtccag

SEQ ID NO: 32039 - DNA, 20 bp, Artificial Sequence
  sgRNA
  Lypd5_16
ggaccattgtcaccaggctg

SEQ ID NO: 32040 - DNA, 20 bp, Artificial Sequence
  sgRNA
  Lypd5_17
atcgctctaggggcgtccgt

SEQ ID NO: 32041 - DNA, 20 bp, Artificial Sequence
  sgRNA
  Lypd5_18
gtgacaggtccggatgtaca

SEQ ID NO: 32042 - DNA, 20 bp, Artificial Sequence
  sgRNA
  Lypd5_19
tcaggcagagcaggctcccg

SEQ ID NO: 32043 - DNA, 20 bp, Artificial Sequence
  sgRNA
  Lypd5_20
ctttccggaccattgtcacc

SEQ ID NO: 32044 - DNA, 20 bp, Artificial Sequence
  sgRNA
  Lypd6b_1
cccctacttacgatcaagag

SEQ ID NO: 32045 - DNA, 20 bp, Artificial Sequence
  sgRNA
  Lypd6b_2
ggatggtgacagctagaatg

SEQ ID NO: 32046 - DNA, 20 bp, Artificial Sequence
  sgRNA
  Lypd6b_3
gttcatcacttcaccagcca

SEQ ID NO: 32047 - DNA, 20 bp, Artificial Sequence
  sgRNA
  Lypd6b_4
gaagacaagtggtgtccgca

SEQ ID NO: 32048 - DNA, 20 bp, Artificial Sequence
  sgRNA
  Lypd6b_5
tgatggacgtacttcttccg

SEQ ID NO: 32049 - DNA, 20 bp, Artificial Sequence
  sgRNA
  Lypd6b_6
tcgctgtaatgcacgctcag

SEQ ID NO: 32050 - DNA, 20 bp, Artificial Sequence
  sgRNA
  Lypd6b_7
agaggcacacttcttcgtga

SEQ ID NO: 32051 - DNA, 20 bp, Artificial Sequence
  sgRNA
  Lypd6b_8
acatcaacttctacaatgtg

SEQ ID NO: 32052 - DNA, 20 bp, Artificial Sequence
  sgRNA
  Lypd6b_9
gatgatcaagatctgaagga

SEQ ID NO: 32053 - DNA, 20 bp, Artificial Sequence
  sgRNA
  Lypd6b_10
ataattataactgcaatcga

SEQ ID NO: 32054 - DNA, 20 bp, Artificial Sequence
  sgRNA
  Lypd6b_11
taattataactgcaatcgat

SEQ ID NO: 32055 - DNA, 20 bp, Artificial Sequence
  sgRNA
  Lypd6b_12
tttgacctgcccaatcaggg

SEQ ID NO: 32056 - DNA, 20 bp, Artificial Sequence
  sgRNA
  Lypd6b_13
agagccaggccagcaccagg

SEQ ID NO: 32057 - DNA, 20 bp, Artificial Sequence
  sgRNA
  Lypd6b_14
tgacagctagaatgtggcag

SEQ ID NO: 32058 - DNA, 20 bp, Artificial Sequence
  sgRNA
  Lypd6b_15
cagcgaagactgcatttgtg

SEQ ID NO: 32059 - DNA, 20 bp, Artificial Sequence
  sgRNA
  Lypd6b_16
ctgccgacacagccgagatt

SEQ ID NO: 32060 - DNA, 20 bp, Artificial Sequence
  sgRNA
  Lypd6b_17
gcattctgtccaccctgatt

SEQ ID NO: 32061 - DNA, 20 bp, Artificial Sequence
  sgRNA
  Lypd6b_18
atcgatgggcagaagacaag

SEQ ID NO: 32062 - DNA, 20 bp, Artificial Sequence
  sgRNA
  Lypd6b_19
gttccgaatctcggctgtgt

SEQ ID NO: 32063 - DNA, 20 bp, Artificial Sequence
  sgRNA
  Lypd6b_20
agaagacaagtggtgtccgc

SEQ ID NO: 32064 - DNA, 20 bp, Artificial Sequence
  sgRNA
  Lypd8_1
gttctcggtgcaattcgatg

SEQ ID NO: 32065 - DNA, 20 bp, Artificial Sequence
  sgRNA
  Lypd8_2
tcacaacaaaacactctgcg

SEQ ID NO: 32066 - DNA, 20 bp, Artificial Sequence
  sgRNA
  Lypd8_3
acaatgtgtcttcatcattg

SEQ ID NO: 32067 - DNA, 20 bp, Artificial Sequence
  sgRNA
  Lypd8_4
gggccctgtacaaaccagag

SEQ ID NO: 32068 - DNA, 20 bp, Artificial Sequence
  sgRNA
  Lypd8_5
tccaactgttgtgttcccag

SEQ ID NO: 32069 - DNA, 20 bp, Artificial Sequence
  sgRNA
  Lypd8_6
gctagcctgtggggtaacag

SEQ ID NO: 32070 - DNA, 20 bp, Artificial Sequence
  sgRNA
  Lypd8_7
gttaccccacaggctagcat

SEQ ID NO: 32071 - DNA, 20 bp, Artificial Sequence
  sgRNA
  Lypd8_8
ggactgctcattgcattcag

SEQ ID NO: 32072 - DNA, 20 bp, Artificial Sequence
  sgRNA
  Lypd8_9
gaattgcaccgagaacagca

SEQ ID NO: 32073 - DNA, 20 bp, Artificial Sequence
  sgRNA
  Lypd8_10
ggcagcactggcttgcaaaa

SEQ ID NO: 32074 - DNA, 20 bp, Artificial Sequence
  sgRNA
  Lypd8_11
ggtcgagttggtatactcag

SEQ ID NO: 32075 - DNA, 20 bp, Artificial Sequence
  sgRNA
  Lypd8_12
tctggcagagtggagctgaa

SEQ ID NO: 32076 - DNA, 20 bp, Artificial Sequence
  sgRNA
  Lypd8_13
ttgcaccgagaacagcacgg

SEQ ID NO: 32077 - DNA, 20 bp, Artificial Sequence
  sgRNA
  Lypd8_14
tggtcgggtaacagaggtga

SEQ ID NO: 32078 - DNA, 20 bp, Artificial Sequence
  sgRNA
  Lypd8_15
tggtgcccatgctagcctgt

SEQ ID NO: 32079 - DNA, 20 bp, Artificial Sequence
  sgRNA
  Lypd8_16
tgagcagtccttcagttgtg

SEQ ID NO: 32080 - DNA, 20 bp, Artificial Sequence
  sgRNA
  Lypd8_17
ataacactgtgtacaattca

SEQ ID NO: 32081 - DNA, 20 bp, Artificial Sequence
  sgRNA
  Lypd8_18
gatgcctggtcgggtaacag

SEQ ID NO: 32082 - DNA, 20 bp, Artificial Sequence
  sgRNA
  Lypd8_19
cttcatcgctggtgtcattg

SEQ ID NO: 32083 - DNA, 20 bp, Artificial Sequence
  sgRNA
  Lypd8_20
aaggctgccgaagatagagg

SEQ ID NO: 32084 - DNA, 20 bp, Artificial Sequence
  sgRNA
  Lysmd3_1
taccgtacagcagtactgaa

SEQ ID NO: 32085 - DNA, 20 bp, Artificial Sequence
  sgRNA
  Lysmd3_2
caagtgtacagacaccaaga

SEQ ID NO: 32086 - DNA, 20 bp, Artificial Sequence
  sgRNA
  Lysmd3_3
aaaagcaagtacatggccac

SEQ ID NO: 32087 - DNA, 20 bp, Artificial Sequence
  sgRNA
  Lysmd3_4
gtctacgaacttcggtccag

SEQ ID NO: 32088 - DNA, 20 bp, Artificial Sequence
  sgRNA
  Lysmd3_5
cgtattacggagcagactgg

SEQ ID NO: 32089 - DNA, 20 bp, Artificial Sequence
  sgRNA
  Lysmd3_6
tgttagtcaccattcaacag

SEQ ID NO: 32090 - DNA, 20 bp, Artificial Sequence
  sgRNA
  Lysmd3_7
ttcctgggagggaaaccgtc

SEQ ID NO: 32091 - DNA, 20 bp, Artificial Sequence
  sgRNA
  Lysmd3_8
agcccttcagtactgctgta

SEQ ID NO: 32092 - DNA, 20 bp, Artificial Sequence
  sgRNA
  Lysmd3_9
tggtcatcttgctgaccaac

SEQ ID NO: 32093 - DNA, 20 bp, Artificial Sequence
  sgRNA
  Lysmd3_10
ccaacaaaaggaatacctgt

SEQ ID NO: 32094 - DNA, 20 bp, Artificial Sequence
  sgRNA
  Lysmd3_11
ctccgtaatacggatccttt

SEQ ID NO: 32095 - DNA, 20 bp, Artificial Sequence
  sgRNA
  Lysmd3_12
tgaaaatacggaacaggtgg

SEQ ID NO: 32096 - DNA, 20 bp, Artificial Sequence
  sgRNA
  Lysmd3_13
ttaaccaaagatatccagga

SEQ ID NO: 32097 - DNA, 20 bp, Artificial Sequence
  sgRNA
  Lysmd3_14
taacaaaagcattcaccgaa

SEQ ID NO: 32098 - DNA, 20 bp, Artificial Sequence
  sgRNA
  Lysmd3_15
aggcagacacgacttcattc

SEQ ID NO: 32099 - DNA, 20 bp, Artificial Sequence
  sgRNA
  Lysmd3_16
gttagtcaccattcaacagt

SEQ ID NO: 32100 - DNA, 20 bp, Artificial Sequence
  sgRNA
  Lysmd3_17
ctttcttccagtgagtcagc

SEQ ID NO: 32101 - DNA, 20 bp, Artificial Sequence
  sgRNA
  Lysmd3_18
gttgagcatcatgtgcctga

SEQ ID NO: 32102 - DNA, 20 bp, Artificial Sequence
  sgRNA
  Lysmd3_19
ctatcaaaattccagttaaa

SEQ ID NO: 32103 - DNA, 20 bp, Artificial Sequence
  sgRNA
  Lysmd3_20
gaagaaagagaaccatcagc

SEQ ID NO: 32104 - DNA, 20 bp, Artificial Sequence
  sgRNA
  Lyve1_1
taagacacctaccttgcacg

SEQ ID NO: 32105 - DNA, 20 bp, Artificial Sequence
  sgRNA
  Lyve1_2
tggaatgcaggagttaaccc

SEQ ID NO: 32106 - DNA, 20 bp, Artificial Sequence
  sgRNA
  Lyve1_3
ctggggtttgagaaaatccg

SEQ ID NO: 32107 - DNA, 20 bp, Artificial Sequence
  sgRNA
  Lyve1_4
ttatacagaacctatcacca

SEQ ID NO: 32108 - DNA, 20 bp, Artificial Sequence
  sgRNA
  Lyve1_5
tggggtttgagaaaatccga

SEQ ID NO: 32109 - DNA, 20 bp, Artificial Sequence
  sgRNA
  Lyve1_6
gtgtttgagtgtccaacacg

SEQ ID NO: 32110 - DNA, 20 bp, Artificial Sequence
  sgRNA
  Lyve1_7
tagtggtccaaatagaggcg

SEQ ID NO: 32111 - DNA, 20 bp, Artificial Sequence
  sgRNA
  Lyve1_8
gtgcctagtggtccaaatag

SEQ ID NO: 32112 - DNA, 20 bp, Artificial Sequence
  sgRNA
  Lyve1_9
caagagtccacccaaaacta

SEQ ID NO: 32113 - DNA, 20 bp, Artificial Sequence
  sgRNA
  Lyve1_10
gaaggaaatgatcgaaacca

SEQ ID NO: 32114 - DNA, 20 bp, Artificial Sequence
  sgRNA
  Lyve1_11
atttctgcgctgactctacc

SEQ ID NO: 32115 - DNA, 20 bp, Artificial Sequence
  sgRNA
  Lyve1_12
ttgccattcttcccacacct

SEQ ID NO: 32116 - DNA, 20 bp, Artificial Sequence
  sgRNA
  Lyve1_13
tagaggcgaggagtaacacc

SEQ ID NO: 32117 - DNA, 20 bp, Artificial Sequence
  sgRNA
  Lyve1_14
gggtgtttgagtgtccaaca

SEQ ID NO: 32118 - DNA, 20 bp, Artificial Sequence
  sgRNA
  Lyve1_15
gttgattcttggttgtgaaa

SEQ ID NO: 32119 - DNA, 20 bp, Artificial Sequence
  sgRNA
  Lyve1_16
gctgacagaaaactctgttg

SEQ ID NO: 32120 - DNA, 20 bp, Artificial Sequence
  sgRNA
  Lyve1_17
gaaaaccattaaaaacccag

SEQ ID NO: 32121 - DNA, 20 bp, Artificial Sequence
  sgRNA
  Lyve1_18
cgtgccatggaggtcaaagg

SEQ ID NO: 32122 - DNA, 20 bp, Artificial Sequence
  sgRNA
  Lyve1_19
atttctacatgcagaatcat

SEQ ID NO: 32123 - DNA, 20 bp, Artificial Sequence
  sgRNA
  Lyve1_20
gtagcaaacagccagcacag

SEQ ID NO: 32124 - DNA, 20 bp, Artificial Sequence
  sgRNA
  M6pr_1
atcatgctgatatataaagg

SEQ ID NO: 32125 - DNA, 20 bp, Artificial Sequence
  sgRNA
  M6pr_2
ggataaggagtcaaagaacg

SEQ ID NO: 32126 - DNA, 20 bp, Artificial Sequence
  sgRNA
  M6pr_3
aggagatcatcaccactgca

SEQ ID NO: 32127 - DNA, 20 bp, Artificial Sequence
  sgRNA
  M6pr_4
ggctgctatccatctcaaag

SEQ ID NO: 32128 - DNA, 20 bp, Artificial Sequence
  sgRNA
  M6pr_5
ggatcatgctgatatataaa

SEQ ID NO: 32129 - DNA, 20 bp, Artificial Sequence
  sgRNA
  M6pr_6
ataccagcgactggtagtgg

SEQ ID NO: 32130 - DNA, 20 bp, Artificial Sequence
  sgRNA
  M6pr_7
gatcatgctgatatataaag

SEQ ID NO: 32131 - DNA, 20 bp, Artificial Sequence
  sgRNA
  M6pr_8
gggtttcttataccagcgac

SEQ ID NO: 32132 - DNA, 20 bp, Artificial Sequence
  sgRNA
  M6pr_9
gggtgaagagtcggaagaaa

SEQ ID NO: 32133 - DNA, 20 bp, Artificial Sequence
  sgRNA
  M6pr_10
gcacattgcggggtttggat

SEQ ID NO: 32134 - DNA, 20 bp, Artificial Sequence
  sgRNA
  M6pr_11
aacgagactcacatcttcaa

SEQ ID NO: 32135 - DNA, 20 bp, Artificial Sequence
  sgRNA
  M6pr_12
tgaccagctgggtgaagagt

SEQ ID NO: 32136 - DNA, 20 bp, Artificial Sequence
  sgRNA
  M6pr_13
ggagtgggagatgaccagct

SEQ ID NO: 32137 - DNA, 20 bp, Artificial Sequence
  sgRNA
  M6pr_14
tggtgatgatctcctgcaat

SEQ ID NO: 32138 - DNA, 20 bp, Artificial Sequence
  sgRNA
  M6pr_15
cttggcaacctagtagctga

SEQ ID NO: 32139 - DNA, 20 bp, Artificial Sequence
  sgRNA
  M6pr_16
tggcccccactaccagtcgc

SEQ ID NO: 32140 - DNA, 20 bp, Artificial Sequence
  sgRNA
  M6pr_17
ctttgagatggatagcagcc

SEQ ID NO: 32141 - DNA, 20 bp, Artificial Sequence
  sgRNA
  M6pr_18
tataccagcgactggtagtg

SEQ ID NO: 32142 - DNA, 20 bp, Artificial Sequence
  sgRNA
  M6pr_19
taaggagtcaaagaacgagg

SEQ ID NO: 32143 - DNA, 20 bp, Artificial Sequence
  sgRNA
  M6pr_20
cgactggtagtgggggccaa

SEQ ID NO: 32144 - DNA, 20 bp, Artificial Sequence
  sgRNA
  Mag_1
ctgactctcatagatgaccg

SEQ ID NO: 32145 - DNA, 20 bp, Artificial Sequence
  sgRNA
  Mag_2
ggaggcaaatactatttccg

SEQ ID NO: 32146 - DNA, 20 bp, Artificial Sequence
  sgRNA
  Mag_3
ctaccccaagaactacccac

SEQ ID NO: 32147 - DNA, 20 bp, Artificial Sequence
  sgRNA
  Mag_4
ggagacacacgtgccctcga

SEQ ID NO: 32148 - DNA, 20 bp, Artificial Sequence
  sgRNA
  Mag_5
gggacttgaagaccaccggt

SEQ ID NO: 32149 - DNA, 20 bp, Artificial Sequence
  sgRNA
  Mag_6
ggagaagcagatcctagcca

SEQ ID NO: 32150 - DNA, 20 bp, Artificial Sequence
  sgRNA
  Mag_7
ctggaggtacaaatgacgcg

SEQ ID NO: 32151 - DNA, 20 bp, Artificial Sequence
  sgRNA
  Mag_8
ggtctgagtgggaataactg

SEQ ID NO: 32152 - DNA, 20 bp, Artificial Sequence
  sgRNA
  Mag_9
aacaccaccttgcagttcga

SEQ ID NO: 32153 - DNA, 20 bp, Artificial Sequence
  sgRNA
  Mag_10
accagcatcctcacgatccg

SEQ ID NO: 32154 - DNA, 20 bp, Artificial Sequence
  sgRNA
  Mag_11
tcgaccatctcagccttcga

SEQ ID NO: 32155 - DNA, 20 bp, Artificial Sequence
  sgRNA
  Mag_12
tcgaaggctgagatggtcga

SEQ ID NO: 32156 - DNA, 20 bp, Artificial Sequence
  sgRNA
  Mag_13
gtattccccatcatcctcgg

SEQ ID NO: 32157 - DNA, 20 bp, Artificial Sequence
  sgRNA
  Mag_14
tcggggaagtcgaaacggca

SEQ ID NO: 32158 - DNA, 20 bp, Artificial Sequence
  sgRNA
  Mag_15
gtaaccctcgaactgcaagg

SEQ ID NO: 32159 - DNA, 20 bp, Artificial Sequence
  sgRNA
  Mag_16
tggccaggacaaccgcacgg

SEQ ID NO: 32160 - DNA, 20 bp, Artificial Sequence
  sgRNA
  Mag_17
ctatggccaggacaaccgca

SEQ ID NO: 32161 - DNA, 20 bp, Artificial Sequence
  sgRNA
  Mag_18
ggtgccatagaggttcctgg

SEQ ID NO: 32162 - DNA, 20 bp, Artificial Sequence
  sgRNA
  Mag_19
atagacgccgtcctctcctg

SEQ ID NO: 32163 - DNA, 20 bp, Artificial Sequence
  sgRNA
  Mag_20
cgactgatgtgggccaaaat

SEQ ID NO: 32164 - DNA, 20 bp, Artificial Sequence
  sgRNA
  Malrd1_1
tgacactcctcatagccccg

SEQ ID NO: 32165 - DNA, 20 bp, Artificial Sequence
  sgRNA
  Malrd1_2
gcttcctgctggtaatactg

SEQ ID NO: 32166 - DNA, 20 bp, Artificial Sequence
  sgRNA
  Malrd1_3
tcttcagttcaattacacga

SEQ ID NO: 32167 - DNA, 20 bp, Artificial Sequence
  sgRNA
  Malrd1_4
caaacatgtgatagtacagg

SEQ ID NO: 32168 - DNA, 20 bp, Artificial Sequence
  sgRNA
  Malrd1_5
tcatcggtgcagttgtttgg

SEQ ID NO: 32169 - DNA, 20 bp, Artificial Sequence
  sgRNA
  Malrd1_6
aagacctcagtattaccagc

SEQ ID NO: 32170 - DNA, 20 bp, Artificial Sequence
  sgRNA
  Malrd1_7
gtatctggaggctaccccag

SEQ ID NO: 32171 - DNA, 20 bp, Artificial Sequence
  sgRNA
  Malrd1_8
ccctagctgaaaactccgat

SEQ ID NO: 32172 - DNA, 20 bp, Artificial Sequence
  sgRNA
  Malrd1_9
tcgtgtaattgaactgaaga

SEQ ID NO: 32173 - DNA, 20 bp, Artificial Sequence
  sgRNA
  Malrd1_10
gagaatgatgtaatgaccag

SEQ ID NO: 32174 - DNA, 20 bp, Artificial Sequence
  sgRNA
  Malrd1_11
tgtatgctgacagttcaaat

SEQ ID NO: 32175 - DNA, 20 bp, Artificial Sequence
  sgRNA
  Malrd1_12
gtcaccatgaagacccactg

SEQ ID NO: 32176 - DNA, 20 bp, Artificial Sequence
  sgRNA
  Malrd1_13
gtaaggcactgcctactggc

SEQ ID NO: 32177 - DNA, 20 bp, Artificial Sequence
  sgRNA
  Malrd1_14
ggttatatagcactctccag

SEQ ID NO: 32178 - DNA, 20 bp, Artificial Sequence
  sgRNA
  Malrd1_15
gttatatagcactctccaga

SEQ ID NO: 32179 - DNA, 20 bp, Artificial Sequence
  sgRNA
  Malrd1_16
cccacttcaagagtgccaca

SEQ ID NO: 32180 - DNA, 20 bp, Artificial Sequence
  sgRNA
  Malrd1_17
gatgctacagtccagagcag

SEQ ID NO: 32181 - DNA, 20 bp, Artificial Sequence
  sgRNA
  Malrd1_18
gctacatctagaaaattcca

SEQ ID NO: 32182 - DNA, 20 bp, Artificial Sequence
  sgRNA
  Malrd1_19
atgatgcgaaacaaaaacac

SEQ ID NO: 32183 - DNA, 20 bp, Artificial Sequence
  sgRNA
  Malrd1_20
gatgacttggattggagcat

SEQ ID NO: 32184 - DNA, 20 bp, Artificial Sequence
  sgRNA
  Mamdc4_1
tcgaagccatcgatagcctg

SEQ ID NO: 32185 - DNA, 20 bp, Artificial Sequence
  sgRNA
  Mamdc4_2
agggacgtgtaataccttgg

SEQ ID NO: 32186 - DNA, 20 bp, Artificial Sequence
  sgRNA
  Mamdc4_3
caatctggggcccatacagg

SEQ ID NO: 32187 - DNA, 20 bp, Artificial Sequence
  sgRNA
  Mamdc4_4
cctgtgtgtggcatttcggg

SEQ ID NO: 32188 - DNA, 20 bp, Artificial Sequence
  sgRNA
  Mamdc4_5
agcccaaatgtactgcccaa

SEQ ID NO: 32189 - DNA, 20 bp, Artificial Sequence
  sgRNA
  Mamdc4_6
catactactgtggtcccggt

SEQ ID NO: 32190 - DNA, 20 bp, Artificial Sequence
  sgRNA
  Mamdc4_7
ggaccgtggaaccagttaga

SEQ ID NO: 32191 - DNA, 20 bp, Artificial Sequence
  sgRNA
  Mamdc4_8
ccttggatagaccataccac

SEQ ID NO: 32192 - DNA, 20 bp, Artificial Sequence
  sgRNA
  Mamdc4_9
ccctcactgtgaactccaca

SEQ ID NO: 32193 - DNA, 20 bp, Artificial Sequence
  sgRNA
  Mamdc4_10
gcgccaggcagatctaccat

SEQ ID NO: 32194 - DNA, 20 bp, Artificial Sequence
  sgRNA
  Mamdc4_11
ccttcagtggaccataccct

SEQ ID NO: 32195 - DNA, 20 bp, Artificial Sequence
  sgRNA
  Mamdc4_12
cctcattctgaccatacaca

SEQ ID NO: 32196 - DNA, 20 bp, Artificial Sequence
  sgRNA
  Mamdc4_13
tctgagagactgcaacccca

SEQ ID NO: 32197 - DNA, 20 bp, Artificial Sequence
  sgRNA
  Mamdc4_14
gaagcactgtgcagagggcg

SEQ ID NO: 32198 - DNA, 20 bp, Artificial Sequence
  sgRNA
  Mamdc4_15
gagcctcagttcacaggtag

SEQ ID NO: 32199 - DNA, 20 bp, Artificial Sequence
  sgRNA
  Mamdc4_16
gcaccaggaacatgaaaaag

SEQ ID NO: 32200 - DNA, 20 bp, Artificial Sequence
  sgRNA
  Mamdc4_17
catctgtactcctctggccg

SEQ ID NO: 32201 - DNA, 20 bp, Artificial Sequence
  sgRNA
  Mamdc4_18
tgttcagacgaaactcagtg

SEQ ID NO: 32202 - DNA, 20 bp, Artificial Sequence
  sgRNA
  Mamdc4_19
gattgaactgtccaactctg

SEQ ID NO: 32203 - DNA, 20 bp, Artificial Sequence
  sgRNA
  Mamdc4_20
agaagctgagacattccttg

SEQ ID NO: 32204 - DNA, 20 bp, Artificial Sequence
  sgRNA
  Mansc1_1
tgctggggtacgaaacccag

SEQ ID NO: 32205 - DNA, 20 bp, Artificial Sequence
  sgRNA
  Mansc1_2
ttggagtgatgaattagcgc

SEQ ID NO: 32206 - DNA, 20 bp, Artificial Sequence
  sgRNA
  Mansc1_3
tgttcaacaaaagacatagc

SEQ ID NO: 32207 - DNA, 20 bp, Artificial Sequence
  sgRNA
  Mansc1_4
tcgctttcaaaaggcattcg

SEQ ID NO: 32208 - DNA, 20 bp, Artificial Sequence
  sgRNA
  Mansc1_5
tgaataccgtttcctacgga

SEQ ID NO: 32209 - DNA, 20 bp, Artificial Sequence
  sgRNA
  Mansc1_6
ggtggcagagacgttacgga

SEQ ID NO: 32210 - DNA, 20 bp, Artificial Sequence
  sgRNA
  Mansc1_7
tgtccgctgaagccagccaa

SEQ ID NO: 32211 - DNA, 20 bp, Artificial Sequence
  sgRNA
  Mansc1_8
gctgcctgatgtgtaaccac

SEQ ID NO: 32212 - DNA, 20 bp, Artificial Sequence
  sgRNA
  Mansc1_9
gtaataggtctcgtcctctt

SEQ ID NO: 32213 - DNA, 20 bp, Artificial Sequence
  sgRNA
  Mansc1_10
gaaacaatgccctttcaagg

SEQ ID NO: 32214 - DNA, 20 bp, Artificial Sequence
  sgRNA
  Mansc1_11
ggcagcgcatcgctgaacaa

SEQ ID NO: 32215 - DNA, 20 bp, Artificial Sequence
  sgRNA
  Mansc1_12
cgtcaccaggagccacccct

SEQ ID NO: 32216 - DNA, 20 bp, Artificial Sequence
  sgRNA
  Mansc1_13
gcacttgcgcaaacacatca

SEQ ID NO: 32217 - DNA, 20 bp, Artificial Sequence
  sgRNA
  Mansc1_14
gcaactcaggaagactgtat

SEQ ID NO: 32218 - DNA, 20 bp, Artificial Sequence
  sgRNA
  Mansc1_15
ttgaagccctccgtaggaaa

SEQ ID NO: 32219 - DNA, 20 bp, Artificial Sequence
  sgRNA
  Mansc1_16
ctacgctgacttcagacccg

SEQ ID NO: 32220 - DNA, 20 bp, Artificial Sequence
  sgRNA
  Mansc1_17
gcaggttacccaaagcccac

SEQ ID NO: 32221 - DNA, 20 bp, Artificial Sequence
  sgRNA
  Mansc1_18
caaccagcatcctacccaag

SEQ ID NO: 32222 - DNA, 20 bp, Artificial Sequence
  sgRNA
  Mansc1_19
gggtggctcctggtgacgaa

SEQ ID NO: 32223 - DNA, 20 bp, Artificial Sequence
  sgRNA
  Mansc1_20
gtggcagagacgttacggag

SEQ ID NO: 32224 - DNA, 20 bp, Artificial Sequence
  sgRNA
  Mansc4_1
caggatttaggtgcaaacac

SEQ ID NO: 32225 - DNA, 20 bp, Artificial Sequence
  sgRNA
  Mansc4_2
ccgaatggtgggatagactg

SEQ ID NO: 32226 - DNA, 20 bp, Artificial Sequence
  sgRNA
  Mansc4_3
cccagatgtgatgaaccgca

SEQ ID NO: 32227 - DNA, 20 bp, Artificial Sequence
  sgRNA
  Mansc4_4
gaaggcagttgacattgtcg

SEQ ID NO: 32228 - DNA, 20 bp, Artificial Sequence
  sgRNA
  Mansc4_5
gaatcttaaccccacatccg

SEQ ID NO: 32229 - DNA, 20 bp, Artificial Sequence
  sgRNA
  Mansc4_6
tctatcccaccattcggacg

SEQ ID NO: 32230 - DNA, 20 bp, Artificial Sequence
  sgRNA
  Mansc4_7
tggatgtcccgaggaccaca

SEQ ID NO: 32231 - DNA, 20 bp, Artificial Sequence
  sgRNA
  Mansc4_8
agtactactcggagaacacc

SEQ ID NO: 32232 - DNA, 20 bp, Artificial Sequence
  sgRNA
  Mansc4_9
agagcatccccgggaagcgg

SEQ ID NO: 32233 - DNA, 20 bp, Artificial Sequence
  sgRNA
  Mansc4_10
ccgcagctgctgcctccgga

SEQ ID NO: 32234 - DNA, 20 bp, Artificial Sequence
  sgRNA
  Mansc4_11
atgttgagtcgagatcggct

SEQ ID NO: 32235 - DNA, 20 bp, Artificial Sequence
  sgRNA
  Mansc4_12
acagcaggtaaagactgcgt

SEQ ID NO: 32236 - DNA, 20 bp, Artificial Sequence
  sgRNA
  Mansc4_13
ggaagtcaaccacggatgtg

SEQ ID NO: 32237 - DNA, 20 bp, Artificial Sequence
  sgRNA
  Mansc4_14
gcaatctctgtagaacacag

SEQ ID NO: 32238 - DNA, 20 bp, Artificial Sequence
  sgRNA
  Mansc4_15
tatgttatacagtatggcgc

SEQ ID NO: 32239 - DNA, 20 bp, Artificial Sequence
  sgRNA
  Mansc4_16
catctgagaacgaagagcca

SEQ ID NO: 32240 - DNA, 20 bp, Artificial Sequence
  sgRNA
  Mansc4_17
ccgcagtctatcccaccatt

SEQ ID NO: 32241 - DNA, 20 bp, Artificial Sequence
  sgRNA
  Mansc4_18
ccagttcctcaagtactact

SEQ ID NO: 32242 - DNA, 20 bp, Artificial Sequence
  sgRNA
  Mansc4_19
ccatcagtgaacaaaacaaa

SEQ ID NO: 32243 - DNA, 20 bp, Artificial Sequence
  sgRNA
  Mansc4_20
ggagaaatagtcttgttgcc

SEQ ID NO: 32244 - DNA, 20 bp, Artificial Sequence
  sgRNA
  Mas1_1
gtgctggacactaacatgag

SEQ ID NO: 32245 - DNA, 20 bp, Artificial Sequence
  sgRNA
  Mas1_2
atatggggtagaggaccgat

SEQ ID NO: 32246 - DNA, 20 bp, Artificial Sequence
  sgRNA
  Mas1_3
aatacacatgacatactcca

SEQ ID NO: 32247 - DNA, 20 bp, Artificial Sequence
  sgRNA
  Mas1_4
ttctcggagtgactgccggg

SEQ ID NO: 32248 - DNA, 20 bp, Artificial Sequence
  sgRNA
  Mas1_5
ctatgaagatgatgaccgcc

SEQ ID NO: 32249 - DNA, 20 bp, Artificial Sequence
  sgRNA
  Mas1_6
gaagatacggaagaacacgt

SEQ ID NO: 32250 - DNA, 20 bp, Artificial Sequence
  sgRNA
  Mas1_7
agtgcactatgggaatgggt

SEQ ID NO: 32251 - DNA, 20 bp, Artificial Sequence
  sgRNA
  Mas1_8
gcacgaaagtgcccacagaa

SEQ ID NO: 32252 - DNA, 20 bp, Artificial Sequence
  sgRNA
  Mas1_9
gtacagcttcgaagaatggg

SEQ ID NO: 32253 - DNA, 20 bp, Artificial Sequence
  sgRNA
  Mas1_10
gggtgggtgtgagctcccca

SEQ ID NO: 32254 - DNA, 20 bp, Artificial Sequence
  sgRNA
  Mas1_11
aatgcaacccaggcgccagg

SEQ ID NO: 32255 - DNA, 20 bp, Artificial Sequence
  sgRNA
  Mas1_12
actcgtagtacagcaagtag

SEQ ID NO: 32256 - DNA, 20 bp, Artificial Sequence
  sgRNA
  Mas1_13
ggtggcatctgtaccatatg

SEQ ID NO: 32257 - DNA, 20 bp, Artificial Sequence
  sgRNA
  Mas1_14
cagtgtggagaggtgcctat

SEQ ID NO: 32258 - DNA, 20 bp, Artificial Sequence
  sgRNA
  Mas1_15
ctacacaatcgtgacattat

SEQ ID NO: 32259 - DNA, 20 bp, Artificial Sequence
  sgRNA
  Mas1_16
gagtgaagaccaagaagctg

SEQ ID NO: 32260 - DNA, 20 bp, Artificial Sequence
  sgRNA
  Mas1_17
tctgctgacagccatcagtg

SEQ ID NO: 32261 - DNA, 20 bp, Artificial Sequence
  sgRNA
  Mas1_18
ccattctccacaaagcccag

SEQ ID NO: 32262 - DNA, 20 bp, Artificial Sequence
  sgRNA
  Mas1_19
cagcaagtagaggacccgca

SEQ ID NO: 32263 - DNA, 20 bp, Artificial Sequence
  sgRNA
  Mas1_20
cattctccacaaagcccaga

SEQ ID NO: 32264 - DNA, 20 bp, Artificial Sequence
  sgRNA
  Mc1r_1
atggacacatacaggcacca

SEQ ID NO: 32265 - DNA, 20 bp, Artificial Sequence
  sgRNA
  Mc1r_2
agagcacgacgggctgtcgt

SEQ ID NO: 32266 - DNA, 20 bp, Artificial Sequence
  sgRNA
  Mc1r_3
tggctagaaagaaagtgacg

SEQ ID NO: 32267 - DNA, 20 bp, Artificial Sequence
  sgRNA
  Mc1r_4
gaagcagagactggacacca

SEQ ID NO: 32268 - DNA, 20 bp, Artificial Sequence
  sgRNA
  Mc1r_5
ttgcccagctccacaaaagg

SEQ ID NO: 32269 - DNA, 20 bp, Artificial Sequence
  sgRNA
  Mc1r_6
gctgcggaaagcatagatga

SEQ ID NO: 32270 - DNA, 20 bp, Artificial Sequence
  sgRNA
  Mc1r_7
cgatgctgacacttaccatc

SEQ ID NO: 32271 - DNA, 20 bp, Artificial Sequence
  sgRNA
  Mc1r_8
cccagctccacaaaaggcgg

SEQ ID NO: 32272 - DNA, 20 bp, Artificial Sequence
  sgRNA
  Mc1r_9
tgacgctgcccagagcacga

SEQ ID NO: 32273 - DNA, 20 bp, Artificial Sequence
  sgRNA
  Mc1r_10
ccaccaaccagtcagagcct

SEQ ID NO: 32274 - DNA, 20 bp, Artificial Sequence
  sgRNA
  Mc1r_11
agtaatacatgggcgagtgc

SEQ ID NO: 32275 - DNA, 20 bp, Artificial Sequence
  sgRNA
  Mc1r_12
gcacctccttgagtgtcatg

SEQ ID NO: 32276 - DNA, 20 bp, Artificial Sequence
  sgRNA
  Mc1r_13
ccacccttactatccttctg

SEQ ID NO: 32277 - DNA, 20 bp, Artificial Sequence
  sgRNA
  Mc1r_14
ataacgcagcgcatagaaga

SEQ ID NO: 32278 - DNA, 20 bp, Artificial Sequence
  sgRNA
  Mc1r_15
aatccccagaaggatagtaa

SEQ ID NO: 32279 - DNA, 20 bp, Artificial Sequence
  sgRNA
  Mc1r_16
cacagatgagcacgtcaatg

SEQ ID NO: 32280 - DNA, 20 bp, Artificial Sequence
  sgRNA
  Mc1r_17
acatgggcgagtgcaggttg

SEQ ID NO: 32281 - DNA, 20 bp, Artificial Sequence
  sgRNA
  Mc1r_18
gaacccagaagactcttctg

SEQ ID NO: 32282 - DNA, 20 bp, Artificial Sequence
  sgRNA
  Mc1r_19
ggtctatagcaatgatgccc

SEQ ID NO: 32283 - DNA, 20 bp, Artificial Sequence
  sgRNA
  Mc1r_20
gctccgcatgacactcaagg

SEQ ID NO: 32284 - DNA, 20 bp, Artificial Sequence
  sgRNA
  Mc2r_1
atgggttatcttaagcctcg

SEQ ID NO: 32285 - DNA, 20 bp, Artificial Sequence
  sgRNA
  Mc2r_2
acaatcggagttatttcttg

SEQ ID NO: 32286 - DNA, 20 bp, Artificial Sequence
  sgRNA
  Mc2r_3
ggcgcatggtcacaatgcta

SEQ ID NO: 32287 - DNA, 20 bp, Artificial Sequence
  sgRNA
  Mc2r_4
agatagagcccagcaaagag

SEQ ID NO: 32288 - DNA, 20 bp, Artificial Sequence
  sgRNA
  Mc2r_5
ggataaaaaccagcatcaaa

SEQ ID NO: 32289 - DNA, 20 bp, Artificial Sequence
  sgRNA
  Mc2r_6
gtggtgggagaagatcacca

SEQ ID NO: 32290 - DNA, 20 bp, Artificial Sequence
  sgRNA
  Mc2r_7
agatcttcctagcatgggag

SEQ ID NO: 32291 - DNA, 20 bp, Artificial Sequence
  sgRNA
  Mc2r_8
gcagatgaaaaaatacatgg

SEQ ID NO: 32292 - DNA, 20 bp, Artificial Sequence
  sgRNA
  Mc2r_9
ctgatcatgttcagaaacat

SEQ ID NO: 32293 - DNA, 20 bp, Artificial Sequence
  sgRNA
  Mc2r_10
tggatgttctgcacagggag

SEQ ID NO: 32294 - DNA, 20 bp, Artificial Sequence
  sgRNA
  Mc2r_11
acatgtagcaaacacagtaa

SEQ ID NO: 32295 - DNA, 20 bp, Artificial Sequence
  sgRNA
  Mc2r_12
gaacatccagataattgtta

SEQ ID NO: 32296 - DNA, 20 bp, Artificial Sequence
  sgRNA
  Mc2r_13
cttcctagaaccaacatgaa

SEQ ID NO: 32297 - DNA, 20 bp, Artificial Sequence
  sgRNA
  Mc2r_14
tctgagctctgggctccgaa

SEQ ID NO: 32298 - DNA, 20 bp, Artificial Sequence
  sgRNA
  Mc2r_15
tgtcatggcacccttcatgt

SEQ ID NO: 32299 - DNA, 20 bp, Artificial Sequence
  sgRNA
  Mc2r_16
gtgctttcaaaactgccacg

SEQ ID NO: 32300 - DNA, 20 bp, Artificial Sequence
  sgRNA
  Mc2r_17
gagaacatggagcacaaagg

SEQ ID NO: 32301 - DNA, 20 bp, Artificial Sequence
  sgRNA
  Mc2r_18
tcatcaccctaacaattatc

SEQ ID NO: 32302 - DNA, 20 bp, Artificial Sequence
  sgRNA
  Mc2r_19
tgatcaacatgccattgacc

SEQ ID NO: 32303 - DNA, 20 bp, Artificial Sequence
  sgRNA
  Mc2r_20
gtattgcagggcatggaaga

SEQ ID NO: 32304 - DNA, 20 bp, Artificial Sequence
  sgRNA
  Mc3r_1
catgatgctgtggtaccgaa

SEQ ID NO: 32305 - DNA, 20 bp, Artificial Sequence
  sgRNA
  Mc3r_2
ggatatatagggtgcccatg

SEQ ID NO: 32306 - DNA, 20 bp, Artificial Sequence
  sgRNA
  Mc3r_3
gcaggtcttcatcaagccgg

SEQ ID NO: 32307 - DNA, 20 bp, Artificial Sequence
  sgRNA
  Mc3r_4
ggggtcatctgggtctgctg

SEQ ID NO: 32308 - DNA, 20 bp, Artificial Sequence
  sgRNA
  Mc3r_5
gcactgcgatgcgctggacg

SEQ ID NO: 32309 - DNA, 20 bp, Artificial Sequence
  sgRNA
  Mc3r_6
gatgaccccgatcaaggtga

SEQ ID NO: 32310 - DNA, 20 bp, Artificial Sequence
  sgRNA
  Mc3r_7
catcaccatgttcttcgcca

SEQ ID NO: 32311 - DNA, 20 bp, Artificial Sequence
  sgRNA
  Mc3r_8
gcatcggagaaacagaagac

SEQ ID NO: 32312 - DNA, 20 bp, Artificial Sequence
  sgRNA
  Mc3r_9
gcagcactcctgcatgaagg

SEQ ID NO: 32313 - DNA, 20 bp, Artificial Sequence
  sgRNA
  Mc3r_10
acgttcaaggagattctctg

SEQ ID NO: 32314 - DNA, 20 bp, Artificial Sequence
  sgRNA
  Mc3r_11
gttgatcacggcgatcatga

SEQ ID NO: 32315 - DNA, 20 bp, Artificial Sequence
  sgRNA
  Mc3r_12
agaagatgaaaacacccagc

SEQ ID NO: 32316 - DNA, 20 bp, Artificial Sequence
  sgRNA
  Mc3r_13
gtaccgaagggcatagaaga

SEQ ID NO: 32317 - DNA, 20 bp, Artificial Sequence
  sgRNA
  Mc3r_14
tgatgatgaggaccaggtgg

SEQ ID NO: 32318 - DNA, 20 bp, Artificial Sequence
  sgRNA
  Mc3r_15
ggtgcccatgaggagcacca

SEQ ID NO: 32319 - DNA, 20 bp, Artificial Sequence
  sgRNA
  Mc3r_16
tcctggccattgccatcgac

SEQ ID NO: 32320 - DNA, 20 bp, Artificial Sequence
  sgRNA
  Mc3r_17
ccagcatgtcggctgcagcc

SEQ ID NO: 32321 - DNA, 20 bp, Artificial Sequence
  sgRNA
  Mc3r_18
gcacatgatgagaaccaggt

SEQ ID NO: 32322 - DNA, 20 bp, Artificial Sequence
  sgRNA
  Mc3r_19
catctactccgagagcaaga

SEQ ID NO: 32323 - DNA, 20 bp, Artificial Sequence
  sgRNA
  Mc3r_20
ggaccagtttatccagcaca

SEQ ID NO: 32324 - DNA, 20 bp, Artificial Sequence
  sgRNA
  Mc4r_1
catagcatcctccgtccggg

SEQ ID NO: 32325 - DNA, 20 bp, Artificial Sequence
  sgRNA
  Mc4r_2
ccagtaccataacatcatga

SEQ ID NO: 32326 - DNA, 20 bp, Artificial Sequence
  sgRNA
  Mc4r_3
ggtgagcgtttcgaatgggt

SEQ ID NO: 32327 - DNA, 20 bp, Artificial Sequence
  sgRNA
  Mc4r_4
ggagaacattctagtgatcg

SEQ ID NO: 32328 - DNA, 20 bp, Artificial Sequence
  sgRNA
  Mc4r_5
cctcagttcttgactccgga

SEQ ID NO: 32329 - DNA, 20 bp, Artificial Sequence
  sgRNA
  Mc4r_6
ccttcatgttggtaccctgg

SEQ ID NO: 32330 - DNA, 20 bp, Artificial Sequence
  sgRNA
  Mc4r_7
gcaatgccagcgagtcgctg

SEQ ID NO: 32331 - DNA, 20 bp, Artificial Sequence
  sgRNA
  Mc4r_8
ggtaatcgcccccttcatgt

SEQ ID NO: 32332 - DNA, 20 bp, Artificial Sequence
  sgRNA
  Mc4r_9
ccagagtcacaaacacctcg

SEQ ID NO: 32333 - DNA, 20 bp, Artificial Sequence
  sgRNA
  Mc4r_10
cagtaaatggagaaagaacg

SEQ ID NO: 32334 - DNA, 20 bp, Artificial Sequence
  sgRNA
  Mc4r_11
gtttaacagggtaatgacga

SEQ ID NO: 32335 - DNA, 20 bp, Artificial Sequence
  sgRNA
  Mc4r_12
ataacatcatgacggttagg

SEQ ID NO: 32336 - DNA, 20 bp, Artificial Sequence
  sgRNA
  Mc4r_13
gaacatgtggacatagagag

SEQ ID NO: 32337 - DNA, 20 bp, Artificial Sequence
  sgRNA
  Mc4r_14
cagcctgctttccattgcgg

SEQ ID NO: 32338 - DNA, 20 bp, Artificial Sequence
  sgRNA
  Mc4r_15
atctgtttctatcctctggg

SEQ ID NO: 32339 - DNA, 20 bp, Artificial Sequence
  sgRNA
  Mc4r_16
ccagggtaccaacatgaagg

SEQ ID NO: 32340 - DNA, 20 bp, Artificial Sequence
  sgRNA
  Mc4r_17
ggcacagggaccatccgcca

SEQ ID NO: 32341 - DNA, 20 bp, Artificial Sequence
  sgRNA
  Mc4r_18
ctatgtccacatgttcctga

SEQ ID NO: 32342 - DNA, 20 bp, Artificial Sequence
  sgRNA
  Mc4r_19
tttcatctgtagcctggctg

SEQ ID NO: 32343 - DNA, 20 bp, Artificial Sequence
  sgRNA
  Mc4r_20
gccagggtaccaacatgaag

SEQ ID NO: 32344 - DNA, 20 bp, Artificial Sequence
  sgRNA
  Mc5r_1
aagattcaatacagtcaggg

SEQ ID NO: 32345 - DNA, 20 bp, Artificial Sequence
  sgRNA
  Mc5r_2
gttgtcgatgtgtcgcacaa

SEQ ID NO: 32346 - DNA, 20 bp, Artificial Sequence
  sgRNA
  Mc5r_3
accaccacatcatgaccgcg

SEQ ID NO: 32347 - DNA, 20 bp, Artificial Sequence
  sgRNA
  Mc5r_4
ggccagcaaactgcacatcg

SEQ ID NO: 32348 - DNA, 20 bp, Artificial Sequence
  sgRNA
  Mc5r_5
gaatcatgcttacctttgcg

SEQ ID NO: 32349 - DNA, 20 bp, Artificial Sequence
  sgRNA
  Mc5r_6
gtatatggtgacagtctccc

SEQ ID NO: 32350 - DNA, 20 bp, Artificial Sequence
  sgRNA
  Mc5r_7
tggaccttctgcataagctg

SEQ ID NO: 32351 - DNA, 20 bp, Artificial Sequence
  sgRNA
  Mc5r_8
gatgtgtcgcacaaaggtgt

SEQ ID NO: 32352 - DNA, 20 bp, Artificial Sequence
  sgRNA
  Mc5r_9
ccgcatctcttggctgcgga

SEQ ID NO: 32353 - DNA, 20 bp, Artificial Sequence
  sgRNA
  Mc5r_10
tggcccggaaccatgtcaag

SEQ ID NO: 32354 - DNA, 20 bp, Artificial Sequence
  sgRNA
  Mc5r_11
taagaggctgacgagaccca

SEQ ID NO: 32355 - DNA, 20 bp, Artificial Sequence
  sgRNA
  Mc5r_12
ctgcccacaaagaagtacat

SEQ ID NO: 32356 - DNA, 20 bp, Artificial Sequence
  sgRNA
  Mc5r_13
tgaagaaatgggcattgccg

SEQ ID NO: 32357 - DNA, 20 bp, Artificial Sequence
  sgRNA
  Mc5r_14
gctcaccagcatgtcggcca

SEQ ID NO: 32358 - DNA, 20 bp, Artificial Sequence
  sgRNA
  Mc5r_15
aatccgatgccaagaagtgg

SEQ ID NO: 32359 - DNA, 20 bp, Artificial Sequence
  sgRNA
  Mc5r_16
tcttaccctgaacgcctcag

SEQ ID NO: 32360 - DNA, 20 bp, Artificial Sequence
  sgRNA
  Mc5r_17
agacaccatgaagaacagca

SEQ ID NO: 32361 - DNA, 20 bp, Artificial Sequence
  sgRNA
  Mc5r_18
ttaccctcaccatgctactg

SEQ ID NO: 32362 - DNA, 20 bp, Artificial Sequence
  sgRNA
  Mc5r_19
ctttgtgggcagcttagccg

SEQ ID NO: 32363 - DNA, 20 bp, Artificial Sequence
  sgRNA
  Mc5r_20
aagagcagtagacgttctga

SEQ ID NO: 32364 - DNA, 20 bp, Artificial Sequence
  sgRNA
  Mcam_1
cctgccgaaaagcaccatag

SEQ ID NO: 32365 - DNA, 20 bp, Artificial Sequence
  sgRNA
  Mcam_2
actattcaagccaatgtcgt

SEQ ID NO: 32366 - DNA, 20 bp, Artificial Sequence
  sgRNA
  Mcam_3
aggaacattcgctcatcatg

SEQ ID NO: 32367 - DNA, 20 bp, Artificial Sequence
  sgRNA
  Mcam_4
ccacatgaaggaatctaagg

SEQ ID NO: 32368 - DNA, 20 bp, Artificial Sequence
  sgRNA
  Mcam_5
aattcactcttacgagtcgg

SEQ ID NO: 32369 - DNA, 20 bp, Artificial Sequence
  sgRNA
  Mcam_6
agttcaccagcagctccagg

SEQ ID NO: 32370 - DNA, 20 bp, Artificial Sequence
  sgRNA
  Mcam_7
gagtagccaccgagtcttgg

SEQ ID NO: 32371 - DNA, 20 bp, Artificial Sequence
  sgRNA
  Mcam_8
tcagctaccggctacccagt

SEQ ID NO: 32372 - DNA, 20 bp, Artificial Sequence
  sgRNA
  Mcam_9
ggacaggcaagagctcaggg

SEQ ID NO: 32373 - DNA, 20 bp, Artificial Sequence
  sgRNA
  Mcam_10
ggagacccatctttgctaca

SEQ ID NO: 32374 - DNA, 20 bp, Artificial Sequence
  sgRNA
  Mcam_11
aggcggtgctcatattcacc

SEQ ID NO: 32375 - DNA, 20 bp, Artificial Sequence
  sgRNA
  Mcam_12
tgtgtaagagcaagcgacca

SEQ ID NO: 32376 - DNA, 20 bp, Artificial Sequence
  sgRNA
  Mcam_13
ttcttgttgatagtgaagtg

SEQ ID NO: 32377 - DNA, 20 bp, Artificial Sequence
  sgRNA
  Mcam_14
actgcccctgaagtccagga

SEQ ID NO: 32378 - DNA, 20 bp, Artificial Sequence
  sgRNA
  Mcam_15
aaactggcgtgaggcccagg

SEQ ID NO: 32379 - DNA, 20 bp, Artificial Sequence
  sgRNA
  Mcam_16
aagttgcctgaggcccgtga

SEQ ID NO: 32380 - DNA, 20 bp, Artificial Sequence
  sgRNA
  Mcam_17
ttccgtgtgcaccaaggcaa

SEQ ID NO: 32381 - DNA, 20 bp, Artificial Sequence
  sgRNA
  Mcam_18
catattcaccaggttcccgc

SEQ ID NO: 32382 - DNA, 20 bp, Artificial Sequence
  sgRNA
  Mcam_19
ccaggtccagactctgacac

SEQ ID NO: 32383 - DNA, 20 bp, Artificial Sequence
  sgRNA
  Mcam_20
tttccagcaacaggcgggcg

SEQ ID NO: 32384 - DNA, 20 bp, Artificial Sequence
  sgRNA
  Mchr1_1
gagacactccttgtgcgagg

SEQ ID NO: 32385 - DNA, 20 bp, Artificial Sequence
  sgRNA
  Mchr1_2
gatggacggtggccaagtag

SEQ ID NO: 32386 - DNA, 20 bp, Artificial Sequence
  sgRNA
  Mchr1_3
tcattagcatcactcctgtg

SEQ ID NO: 32387 - DNA, 20 bp, Artificial Sequence
  sgRNA
  Mchr1_4
cagtgatgaccacaaacgga

SEQ ID NO: 32388 - DNA, 20 bp, Artificial Sequence
  sgRNA
  Mchr1_5
catccggcttcggacaaaga

SEQ ID NO: 32389 - DNA, 20 bp, Artificial Sequence
  sgRNA
  Mchr1_6
ggggccagtggacagcaacg

SEQ ID NO: 32390 - DNA, 20 bp, Artificial Sequence
  sgRNA
  Mchr1_7
acagcgcatgacgtcttcgg

SEQ ID NO: 32391 - DNA, 20 bp, Artificial Sequence
  sgRNA
  Mchr1_8
taggagacactccttgtgcg

SEQ ID NO: 32392 - DNA, 20 bp, Artificial Sequence
  sgRNA
  Mchr1_9
gaccgtgcgaagctgcccct

SEQ ID NO: 32393 - DNA, 20 bp, Artificial Sequence
  sgRNA
  Mchr1_10
ccaggcttatccccttccca

SEQ ID NO: 32394 - DNA, 20 bp, Artificial Sequence
  sgRNA
  Mchr1_11
tggccaggataatttcacat

SEQ ID NO: 32395 - DNA, 20 bp, Artificial Sequence
  sgRNA
  Mchr1_12
gcatccggcttcggacaaag

SEQ ID NO: 32396 - DNA, 20 bp, Artificial Sequence
  sgRNA
  Mchr1_13
caggcttatccccttcccag

SEQ ID NO: 32397 - DNA, 20 bp, Artificial Sequence
  sgRNA
  Mchr1_14
ttcatgatccaccagctcat

SEQ ID NO: 32398 - DNA, 20 bp, Artificial Sequence
  sgRNA
  Mchr1_15
cagcttggatttcttcacca

SEQ ID NO: 32399 - DNA, 20 bp, Artificial Sequence
  sgRNA
  Mchr1_16
agtgatgaccacaaacggaa

SEQ ID NO: 32400 - DNA, 20 bp, Artificial Sequence
  sgRNA
  Mchr1_17
aggcttatccccttcccagg

SEQ ID NO: 32401 - DNA, 20 bp, Artificial Sequence
  sgRNA
  Mchr1_18
agacgaatgtgagggtcggg

SEQ ID NO: 32402 - DNA, 20 bp, Artificial Sequence
  sgRNA
  Mchr1_19
tgagacctttcgaaaacgct

SEQ ID NO: 32403 - DNA, 20 bp, Artificial Sequence
  sgRNA
  Mchr1_20
gtacaatgcggctatcagct

SEQ ID NO: 32404 - DNA, 20 bp, Artificial Sequence
  sgRNA
  Mcoln1_1
gacataggcataccggccca

SEQ ID NO: 32405 - DNA, 20 bp, Artificial Sequence
  sgRNA
  Mcoln1_2
tttgacaataaagcgcacag

SEQ ID NO: 32406 - DNA, 20 bp, Artificial Sequence
  sgRNA
  Mcoln1_3
atacctttgacattgatcca

SEQ ID NO: 32407 - DNA, 20 bp, Artificial Sequence
  sgRNA
  Mcoln1_4
tggcccggaacttgtcacat

SEQ ID NO: 32408 - DNA, 20 bp, Artificial Sequence
  sgRNA
  Mcoln1_5
gtattcatgtggcggcggcg

SEQ ID NO: 32409 - DNA, 20 bp, Artificial Sequence
  sgRNA
  Mcoln1_6
acatctggcaagttccgtcg

SEQ ID NO: 32410 - DNA, 20 bp, Artificial Sequence
  sgRNA
  Mcoln1_7
cagaaaccatggacagcgag

SEQ ID NO: 32411 - DNA, 20 bp, Artificial Sequence
  sgRNA
  Mcoln1_8
gtgacgtgctcaccatctcg

SEQ ID NO: 32412 - DNA, 20 bp, Artificial Sequence
  sgRNA
  Mcoln1_9
atactacctgagatatccct

SEQ ID NO: 32413 - DNA, 20 bp, Artificial Sequence
  sgRNA
  Mcoln1_10
tgtctgttctcactcatcaa

SEQ ID NO: 32414 - DNA, 20 bp, Artificial Sequence
  sgRNA
  Mcoln1_11
tgcgcccgctcactgctccg

SEQ ID NO: 32415 - DNA, 20 bp, Artificial Sequence
  sgRNA
  Mcoln1_12
cttgattgccacgttgcgag

SEQ ID NO: 32416 - DNA, 20 bp, Artificial Sequence
  sgRNA
  Mcoln1_13
cagcaggaagagatgtcgga

SEQ ID NO: 32417 - DNA, 20 bp, Artificial Sequence
  sgRNA
  Mcoln1_14
gggcagtgccactcgcaacg

SEQ ID NO: 32418 - DNA, 20 bp, Artificial Sequence
  sgRNA
  Mcoln1_15
cagcagcgaatggtcctccg

SEQ ID NO: 32419 - DNA, 20 bp, Artificial Sequence
  sgRNA
  Mcoln1_16
gcaggttaattgtcttcagc

SEQ ID NO: 32420 - DNA, 20 bp, Artificial Sequence
  sgRNA
  Mcoln1_17
agaagtacttgaggcggcgg

SEQ ID NO: 32421 - DNA, 20 bp, Artificial Sequence
  sgRNA
  Mcoln1_18
ggcaagttccgtcgtggcag

SEQ ID NO: 32422 - DNA, 20 bp, Artificial Sequence
  sgRNA
  Mcoln1_19
tgtgggtcttggtctccagg

SEQ ID NO: 32423 - DNA, 20 bp, Artificial Sequence
  sgRNA
  Mcoln1_20
gtagagctgctcctgtgtgt

SEQ ID NO: 32424 - DNA, 20 bp, Artificial Sequence
  sgRNA
  Mdga1_1
cttcaacgtacgaccccggg

SEQ ID NO: 32425 - DNA, 20 bp, Artificial Sequence
  sgRNA
  Mdga1_2
cagacagtgagcgatgtccg

SEQ ID NO: 32426 - DNA, 20 bp, Artificial Sequence
  sgRNA
  Mdga1_3
gtgtccgtgcgcaatgtgtg

SEQ ID NO: 32427 - DNA, 20 bp, Artificial Sequence
  sgRNA
  Mdga1_4
gctttctttgatcatgtcgg

SEQ ID NO: 32428 - DNA, 20 bp, Artificial Sequence
  sgRNA
  Mdga1_5
gccagtgcttcatccccgcg

SEQ ID NO: 32429 - DNA, 20 bp, Artificial Sequence
  sgRNA
  Mdga1_6
gatgccgcacacattgcgca

SEQ ID NO: 32430 - DNA, 20 bp, Artificial Sequence
  sgRNA
  Mdga1_7
tttgaagcgccacacggccg

SEQ ID NO: 32431 - DNA, 20 bp, Artificial Sequence
  sgRNA
  Mdga1_8
gcttgccacgaacttcgcac

SEQ ID NO: 32432 - DNA, 20 bp, Artificial Sequence
  sgRNA
  Mdga1_9
cacatcttgtagcaacgccg

SEQ ID NO: 32433 - DNA, 20 bp, Artificial Sequence
  sgRNA
  Mdga1_10
ggccatcaagtctatccgcg

SEQ ID NO: 32434 - DNA, 20 bp, Artificial Sequence
  sgRNA
  Mdga1_11
gtggcaataagggtaacgtg

SEQ ID NO: 32435 - DNA, 20 bp, Artificial Sequence
  sgRNA
  Mdga1_12
agccggcacgcacatccaag

SEQ ID NO: 32436 - DNA, 20 bp, Artificial Sequence
  sgRNA
  Mdga1_13
gacacagtagaacttggcac

SEQ ID NO: 32437 - DNA, 20 bp, Artificial Sequence
  sgRNA
  Mdga1_14
acgcggatagacttgatggc

SEQ ID NO: 32438 - DNA, 20 bp, Artificial Sequence
  sgRNA
  Mdga1_15
ctgcgctgctcgcttctgcg

SEQ ID NO: 32439 - DNA, 20 bp, Artificial Sequence
  sgRNA
  Mdga1_16
agtgcttcatccccgcgagg

SEQ ID NO: 32440 - DNA, 20 bp, Artificial Sequence
  sgRNA
  Mdga1_17
aagaggacagagccgagtcg

SEQ ID NO: 32441 - DNA, 20 bp, Artificial Sequence
  sgRNA
  Mdga1_18
tagggcgattgctttccgca

SEQ ID NO: 32442 - DNA, 20 bp, Artificial Sequence
  sgRNA
  Mdga1_19
ccgcttccagataaagcggg

SEQ ID NO: 32443 - DNA, 20 bp, Artificial Sequence
  sgRNA
  Mdga1_20
gaaaatctgcggctacaccc

SEQ ID NO: 32444 - DNA, 20 bp, Artificial Sequence
  sgRNA
  Mdga2_1
ttactacaaggatctgacaa

SEQ ID NO: 32445 - DNA, 20 bp, Artificial Sequence
  sgRNA
  Mdga2_2
aaagttatgatgggaccctg

SEQ ID NO: 32446 - DNA, 20 bp, Artificial Sequence
  sgRNA
  Mdga2_3
gcattcttggaaatccgtca

SEQ ID NO: 32447 - DNA, 20 bp, Artificial Sequence
  sgRNA
  Mdga2_4
ttagtatgtgttacaactgg

SEQ ID NO: 32448 - DNA, 20 bp, Artificial Sequence
  sgRNA
  Mdga2_5
ggtgtcggttctgccacacg

SEQ ID NO: 32449 - DNA, 20 bp, Artificial Sequence
  sgRNA
  Mdga2_6
agcaataaagtcgatccgag

SEQ ID NO: 32450 - DNA, 20 bp, Artificial Sequence
  sgRNA
  Mdga2_7
ggttggaattggccacacat

SEQ ID NO: 32451 - DNA, 20 bp, Artificial Sequence
  sgRNA
  Mdga2_8
ttcccactcgacgaccatag

SEQ ID NO: 32452 - DNA, 20 bp, Artificial Sequence
  sgRNA
  Mdga2_9
gtaagtaccagcgtcatcag

SEQ ID NO: 32453 - DNA, 20 bp, Artificial Sequence
  sgRNA
  Mdga2_10
actcggatcgactttattgc

SEQ ID NO: 32454 - DNA, 20 bp, Artificial Sequence
  sgRNA
  Mdga2_11
ataccgcttgggtattcggc

SEQ ID NO: 32455 - DNA, 20 bp, Artificial Sequence
  sgRNA
  Mdga2_12
attggcctgtaatatcgagg

SEQ ID NO: 32456 - DNA, 20 bp, Artificial Sequence
  sgRNA
  Mdga2_13
tgagtcttggaatctgtcag

SEQ ID NO: 32457 - DNA, 20 bp, Artificial Sequence
  sgRNA
  Mdga2_14
tagagtttctccttcccgga

SEQ ID NO: 32458 - DNA, 20 bp, Artificial Sequence
  sgRNA
  Mdga2_15
ggtcccagtgcagatcggag

SEQ ID NO: 32459 - DNA, 20 bp, Artificial Sequence
  sgRNA
  Mdga2_16
ggccagagattccctccagg

SEQ ID NO: 32460 - DNA, 20 bp, Artificial Sequence
  sgRNA
  Mdga2_17
atgacacctacaaccccgtg

SEQ ID NO: 32461 - DNA, 20 bp, Artificial Sequence
  sgRNA
  Mdga2_18
aatccgctatggtcgtcgag

SEQ ID NO: 32462 - DNA, 20 bp, Artificial Sequence
  sgRNA
  Mdga2_19
tatccaagtttgttgttccg

SEQ ID NO: 32463 - DNA, 20 bp, Artificial Sequence
  sgRNA
  Mdga2_20
ctttgggacttacacatgcg

SEQ ID NO: 32464 - DNA, 20 bp, Artificial Sequence
  sgRNA
  Megf10_1
gcgatgtccataaaaaccgg

SEQ ID NO: 32465 - DNA, 20 bp, Artificial Sequence
  sgRNA
  Megf10_2
ccggacagcctaccgccacg

SEQ ID NO: 32466 - DNA, 20 bp, Artificial Sequence
  sgRNA
  Megf10_3
tttatcccgtagcgtcccag

SEQ ID NO: 32467 - DNA, 20 bp, Artificial Sequence
  sgRNA
  Megf10_4
tctttccaaagcgaccctca

SEQ ID NO: 32468 - DNA, 20 bp, Artificial Sequence
  sgRNA
  Megf10_5
catagccgtatgttcccgca

SEQ ID NO: 32469 - DNA, 20 bp, Artificial Sequence
  sgRNA
  Megf10_6
cagtgtacccaggtgaacaa

SEQ ID NO: 32470 - DNA, 20 bp, Artificial Sequence
  sgRNA
  Megf10_7
cgtacgtgccctgttcacaa

SEQ ID NO: 32471 - DNA, 20 bp, Artificial Sequence
  sgRNA
  Megf10_8
tttgatgccgtaaagcccct

SEQ ID NO: 32472 - DNA, 20 bp, Artificial Sequence
  sgRNA
  Megf10_9
gggaatgccgttgttcacct

SEQ ID NO: 32473 - DNA, 20 bp, Artificial Sequence
  sgRNA
  Megf10_10
gagtgtgcacccggattccg

SEQ ID NO: 32474 - DNA, 20 bp, Artificial Sequence
  sgRNA
  Megf10_11
atgctcccctggattctacg

SEQ ID NO: 32475 - DNA, 20 bp, Artificial Sequence
  sgRNA
  Megf10_12
gctttgtgtaaccccatcac

SEQ ID NO: 32476 - DNA, 20 bp, Artificial Sequence
  sgRNA
  Megf10_13
acggcatcaaatgtgacaag

SEQ ID NO: 32477 - DNA, 20 bp, Artificial Sequence
  sgRNA
  Megf10_14
tgccgattcctatcagatcg

SEQ ID NO: 32478 - DNA, 20 bp, Artificial Sequence
  sgRNA
  Megf10_15
cctgccgattcctatcagat

SEQ ID NO: 32479 - DNA, 20 bp, Artificial Sequence
  sgRNA
  Megf10_16
gcaatctgaacagcttaagc

SEQ ID NO: 32480 - DNA, 20 bp, Artificial Sequence
  sgRNA
  Megf10_17
gcagcaggtcataatggcaa

SEQ ID NO: 32481 - DNA, 20 bp, Artificial Sequence
  sgRNA
  Megf10_18
ccgatctgataggaatcggc

SEQ ID NO: 32482 - DNA, 20 bp, Artificial Sequence
  sgRNA
  Megf10_19
tggagatgaagtcgccggcg

SEQ ID NO: 32483 - DNA, 20 bp, Artificial Sequence
  sgRNA
  Megf10_20
tgtggaccatgtttgccagg

SEQ ID NO: 32484 - DNA, 20 bp, Artificial Sequence
  sgRNA
  Megf11_1
tataagaccgcgtataggcg

SEQ ID NO: 32485 - DNA, 20 bp, Artificial Sequence
  sgRNA
  Megf11_2
gaggacacgtgctatcacag

SEQ ID NO: 32486 - DNA, 20 bp, Artificial Sequence
  sgRNA
  Megf11_3
aggaaaccgaacgttccaaa

SEQ ID NO: 32487 - DNA, 20 bp, Artificial Sequence
  sgRNA
  Megf11_4
cgccgttctgacactgacac

SEQ ID NO: 32488 - DNA, 20 bp, Artificial Sequence
  sgRNA
  Megf11_5
tcagctataagaccgcgtat

SEQ ID NO: 32489 - DNA, 20 bp, Artificial Sequence
  sgRNA
  Megf11_6
tcaatgtagaagtcctcggg

SEQ ID NO: 32490 - DNA, 20 bp, Artificial Sequence
  sgRNA
  Megf11_7
ggttcaagtgtacccggcac

SEQ ID NO: 32491 - DNA, 20 bp, Artificial Sequence
  sgRNA
  Megf11_8
ccttcccaaaaaatgctgaa

SEQ ID NO: 32492 - DNA, 20 bp, Artificial Sequence
  sgRNA
  Megf11_9
gtatgtagctgtagcaacgg

SEQ ID NO: 32493 - DNA, 20 bp, Artificial Sequence
  sgRNA
  Megf11_10
tggctcctgcacctgccgag

SEQ ID NO: 32494 - DNA, 20 bp, Artificial Sequence
  sgRNA
  Megf11_11
ataagggtcctcgaaagcca

SEQ ID NO: 32495 - DNA, 20 bp, Artificial Sequence
  sgRNA
  Megf11_12
tctcctacaccccagccatg

SEQ ID NO: 32496 - DNA, 20 bp, Artificial Sequence
  sgRNA
  Megf11_13
ccatggccgtagaatcctgg

SEQ ID NO: 32497 - DNA, 20 bp, Artificial Sequence
  sgRNA
  Megf11_14
tcttggaccacactgactgt

SEQ ID NO: 32498 - DNA, 20 bp, Artificial Sequence
  sgRNA
  Megf11_15
accgttgccatagtagccgg

SEQ ID NO: 32499 - DNA, 20 bp, Artificial Sequence
  sgRNA
  Megf11_16
ataagactcctgcacagtca

SEQ ID NO: 32500 - DNA, 20 bp, Artificial Sequence
  sgRNA
  Megf11_17
cccgccggctactatggcaa

SEQ ID NO: 32501 - DNA, 20 bp, Artificial Sequence
  sgRNA
  Megf11_18
gggtacacttgaaccagttg

SEQ ID NO: 32502 - DNA, 20 bp, Artificial Sequence
  sgRNA
  Megf11_19
gctggggtgtaggagactcg

SEQ ID NO: 32503 - DNA, 20 bp, Artificial Sequence
  sgRNA
  Megf11_20
ctgctgacacccatatccaa

SEQ ID NO: 32504 - DNA, 20 bp, Artificial Sequence
  sgRNA
  Megf8_1
gatgtgtccctagtctaccg

SEQ ID NO: 32505 - DNA, 20 bp, Artificial Sequence
  sgRNA
  Megf8_2
gaattgcaacgcccacaccg

SEQ ID NO: 32506 - DNA, 20 bp, Artificial Sequence
  sgRNA
  Megf8_3
cacacccttactgcccgtcg

SEQ ID NO: 32507 - DNA, 20 bp, Artificial Sequence
  sgRNA
  Megf8_4
tgttctaggaaactacatgg

SEQ ID NO: 32508 - DNA, 20 bp, Artificial Sequence
  sgRNA
  Megf8_5
gctgaagcgtggaaaagccg

SEQ ID NO: 32509 - DNA, 20 bp, Artificial Sequence
  sgRNA
  Megf8_6
gctaacgtgtggacgtcccg

SEQ ID NO: 32510 - DNA, 20 bp, Artificial Sequence
  sgRNA
  Megf8_7
gcaggtgcctgaaacacgaa

SEQ ID NO: 32511 - DNA, 20 bp, Artificial Sequence
  sgRNA
  Megf8_8
tgtgcatacgcattaccagg

SEQ ID NO: 32512 - DNA, 20 bp, Artificial Sequence
  sgRNA
  Megf8_9
acagtcccgagagcaacgag

SEQ ID NO: 32513 - DNA, 20 bp, Artificial Sequence
  sgRNA
  Megf8_10
acgtaggtaatcaggccccg

SEQ ID NO: 32514 - DNA, 20 bp, Artificial Sequence
  sgRNA
  Megf8_11
ctaccatagtatgtcccagg

SEQ ID NO: 32515 - DNA, 20 bp, Artificial Sequence
  sgRNA
  Megf8_12
taggccatcaagtccccacg

SEQ ID NO: 32516 - DNA, 20 bp, Artificial Sequence
  sgRNA
  Megf8_13
gcttccatgagccaaagcgc

SEQ ID NO: 32517 - DNA, 20 bp, Artificial Sequence
  sgRNA
  Megf8_14
gcagaagtcccccaaagcgg

SEQ ID NO: 32518 - DNA, 20 bp, Artificial Sequence
  sgRNA
  Megf8_15
tgttcaggcaggttgcccgt

SEQ ID NO: 32519 - DNA, 20 bp, Artificial Sequence
  sgRNA
  Megf8_16
cctatgacgcagagtgacga

SEQ ID NO: 32520 - DNA, 20 bp, Artificial Sequence
  sgRNA
  Megf8_17
gcgtacttgttgcctctccc

SEQ ID NO: 32521 - DNA, 20 bp, Artificial Sequence
  sgRNA
  Megf8_18
ttaacctcactaccctgcag

SEQ ID NO: 32522 - DNA, 20 bp, Artificial Sequence
  sgRNA
  Megf8_19
gctggtactccaacaactgc

SEQ ID NO: 32523 - DNA, 20 bp, Artificial Sequence
  sgRNA
  Megf8_20
ggctcccgtggaatgactcg

SEQ ID NO: 32524 - DNA, 20 bp, Artificial Sequence
  sgRNA
  Megf9_1
ggacggacacactcccacca

SEQ ID NO: 32525 - DNA, 20 bp, Artificial Sequence
  sgRNA
  Megf9_2
tgggaattgccaatgcaaag

SEQ ID NO: 32526 - DNA, 20 bp, Artificial Sequence
  sgRNA
  Megf9_3
caccacagtccgcaaaaccg

SEQ ID NO: 32527 - DNA, 20 bp, Artificial Sequence
  sgRNA
  Megf9_4
ctgtgtaaccatctttacat

SEQ ID NO: 32528 - DNA, 20 bp, Artificial Sequence
  sgRNA
  Megf9_5
agcgctgcaaccagaccaca

SEQ ID NO: 32529 - DNA, 20 bp, Artificial Sequence
  sgRNA
  Megf9_6
ccaatgaagtggctcccaat

SEQ ID NO: 32530 - DNA, 20 bp, Artificial Sequence
  sgRNA
  Megf9_7
cctcgccctgttgtgctgcg

SEQ ID NO: 32531 - DNA, 20 bp, Artificial Sequence
  sgRNA
  Megf9_8
attgcctgtagaagtcactg

SEQ ID NO: 32532 - DNA, 20 bp, Artificial Sequence
  sgRNA
  Megf9_9
gtgactacagaggtggtcgg

SEQ ID NO: 32533 - DNA, 20 bp, Artificial Sequence
  sgRNA
  Megf9_10
tttcagctcgatggtccaaa

SEQ ID NO: 32534 - DNA, 20 bp, Artificial Sequence
  sgRNA
  Megf9_11
tcactgtgacacctgcaaag

SEQ ID NO: 32535 - DNA, 20 bp, Artificial Sequence
  sgRNA
  Megf9_12
tagaagtcactgcggaacac

SEQ ID NO: 32536 - DNA, 20 bp, Artificial Sequence
  sgRNA
  Megf9_13
ggttgtgcgctggtgcgaag

SEQ ID NO: 32537 - DNA, 20 bp, Artificial Sequence
  sgRNA
  Megf9_14
gaacatcacaactatcagac

SEQ ID NO: 32538 - DNA, 20 bp, Artificial Sequence
  sgRNA
  Megf9_15
cagccccttccctaagaccg

SEQ ID NO: 32539 - DNA, 20 bp, Artificial Sequence
  sgRNA
  Megf9_16
atgacaatcacactgccctg

SEQ ID NO: 32540 - DNA, 20 bp, Artificial Sequence
  sgRNA
  Megf9_17
tactgcaaagatagtctgca

SEQ ID NO: 32541 - DNA, 20 bp, Artificial Sequence
  sgRNA
  Megf9_18
aggatgctaacagctccatg

SEQ ID NO: 32542 - DNA, 20 bp, Artificial Sequence
  sgRNA
  Megf9_19
gatagttgtgatgttcacac

SEQ ID NO: 32543 - DNA, 20 bp, Artificial Sequence
  sgRNA
  Megf9_20
gagtgtgtccgtcctccgaa

SEQ ID NO: 32544 - DNA, 20 bp, Artificial Sequence
  sgRNA
  Mep1b_1
agtgactaaaaagtttcgag

SEQ ID NO: 32545 - DNA, 20 bp, Artificial Sequence
  sgRNA
  Mep1b_2
tggcatgatccaaagttcgg

SEQ ID NO: 32546 - DNA, 20 bp, Artificial Sequence
  sgRNA
  Mep1b_3
tagttagcttctccggacca

SEQ ID NO: 32547 - DNA, 20 bp, Artificial Sequence
  sgRNA
  Mep1b_4
ctataatgacgtaatcatcc

SEQ ID NO: 32548 - DNA, 20 bp, Artificial Sequence
  sgRNA
  Mep1b_5
gaggttgtatgtcagaacgg

SEQ ID NO: 32549 - DNA, 20 bp, Artificial Sequence
  sgRNA
  Mep1b_6
tctgctctccaacatcgccg

SEQ ID NO: 32550 - DNA, 20 bp, Artificial Sequence
  sgRNA
  Mep1b_7
gctggttgaacatacgctgt

SEQ ID NO: 32551 - DNA, 20 bp, Artificial Sequence
  sgRNA
  Mep1b_8
ggacgtgattggccaacgaa

SEQ ID NO: 32552 - DNA, 20 bp, Artificial Sequence
  sgRNA
  Mep1b_9
tcagagttcgaggacgtgat

SEQ ID NO: 32553 - DNA, 20 bp, Artificial Sequence
  sgRNA
  Mep1b_10
gaccacctgatgacgtgcca

SEQ ID NO: 32554 - DNA, 20 bp, Artificial Sequence
  sgRNA
  Mep1b_11
ccaactgaacatttacaccc

SEQ ID NO: 32555 - DNA, 20 bp, Artificial Sequence
  sgRNA
  Mep1b_12
aactatatctcagtgttcaa

SEQ ID NO: 32556 - DNA, 20 bp, Artificial Sequence
  sgRNA
  Mep1b_13
gacagcgtatgttcaaccag

SEQ ID NO: 32557 - DNA, 20 bp, Artificial Sequence
  sgRNA
  Mep1b_14
gggatagtgctgactggcag

SEQ ID NO: 32558 - DNA, 20 bp, Artificial Sequence
  sgRNA
  Mep1b_15
atttatttccacctgatctc

SEQ ID NO: 32559 - DNA, 20 bp, Artificial Sequence
  sgRNA
  Mep1b_16
acatcaatctctcagaaaca

SEQ ID NO: 32560 - DNA, 20 bp, Artificial Sequence
  sgRNA
  Mep1b_17
accaactgaacatttacacc

SEQ ID NO: 32561 - DNA, 20 bp, Artificial Sequence
  sgRNA
  Mep1b_18
gtagcttgttgccaaggaca

SEQ ID NO: 32562 - DNA, 20 bp, Artificial Sequence
  sgRNA
  Mep1b_19
ggccctggcacgtcatcagg

SEQ ID NO: 32563 - DNA, 20 bp, Artificial Sequence
  sgRNA
  Mep1b_20
gtgaagttgccagctcccaa

SEQ ID NO: 32564 - DNA, 20 bp, Artificial Sequence
  sgRNA
  Mertk_1
aggtacggttaggacagacg

SEQ ID NO: 32565 - DNA, 20 bp, Artificial Sequence
  sgRNA
  Mertk_2
tgtatctgatcccatatacg

SEQ ID NO: 32566 - DNA, 20 bp, Artificial Sequence
  sgRNA
  Mertk_3
gctaccggatatctcacgtg

SEQ ID NO: 32567 - DNA, 20 bp, Artificial Sequence
  sgRNA
  Mertk_4
agcgatgctgtaattagcca

SEQ ID NO: 32568 - DNA, 20 bp, Artificial Sequence
  sgRNA
  Mertk_5
ggatgacatgactgtctgcg

SEQ ID NO: 32569 - DNA, 20 bp, Artificial Sequence
  sgRNA
  Mertk_6
gcagagcctgggagtgagcg

SEQ ID NO: 32570 - DNA, 20 bp, Artificial Sequence
  sgRNA
  Mertk_7
ttcatgatggacattgccca

SEQ ID NO: 32571 - DNA, 20 bp, Artificial Sequence
  sgRNA
  Mertk_8
ccagccaatctcattccgac

SEQ ID NO: 32572 - DNA, 20 bp, Artificial Sequence
  sgRNA
  Mertk_9
agatattgacgggctcagga

SEQ ID NO: 32573 - DNA, 20 bp, Artificial Sequence
  sgRNA
  Mertk_10
tcacgagaacaaccttcgtg

SEQ ID NO: 32574 - DNA, 20 bp, Artificial Sequence
  sgRNA
  Mertk_11
gaactttgccgagaaccaga

SEQ ID NO: 32575 - DNA, 20 bp, Artificial Sequence
  sgRNA
  Mertk_12
gatcgccatcgagagcctgg

SEQ ID NO: 32576 - DNA, 20 bp, Artificial Sequence
  sgRNA
  Mertk_13
agatgtatctttcctcacga

SEQ ID NO: 32577 - DNA, 20 bp, Artificial Sequence
  sgRNA
  Mertk_14
atcgcggccattactaaagg

SEQ ID NO: 32578 - DNA, 20 bp, Artificial Sequence
  sgRNA
  Mertk_15
gaagtcggatgacatttggg

SEQ ID NO: 32579 - DNA, 20 bp, Artificial Sequence
  sgRNA
  Mertk_16
tgtgaggcccacaatgacaa

SEQ ID NO: 32580 - DNA, 20 bp, Artificial Sequence
  sgRNA
  Mertk_17
ttatattcccgattaaacac

SEQ ID NO: 32581 - DNA, 20 bp, Artificial Sequence
  sgRNA
  Mertk_18
gagaaggtgggtcgatccaa

SEQ ID NO: 32582 - DNA, 20 bp, Artificial Sequence
  sgRNA
  Mertk_19
aaaggactgacggtgtccaa

SEQ ID NO: 32583 - DNA, 20 bp, Artificial Sequence
  sgRNA
  Mertk_20
ccaatgggccctcactcacg

SEQ ID NO: 32584 - DNA, 20 bp, Artificial Sequence
  sgRNA
  Met_1
gtatcggacagagtttacca

SEQ ID NO: 32585 - DNA, 20 bp, Artificial Sequence
  sgRNA
  Met_2
taataacaagcatttctccg

SEQ ID NO: 32586 - DNA, 20 bp, Artificial Sequence
  sgRNA
  Met_3
ccctggtttactgacatacg

SEQ ID NO: 32587 - DNA, 20 bp, Artificial Sequence
  sgRNA
  Met_4
ggtggatttcatagacaacg

SEQ ID NO: 32588 - DNA, 20 bp, Artificial Sequence
  sgRNA
  Met_5
cagcgcgtcgacttattcat

SEQ ID NO: 32589 - DNA, 20 bp, Artificial Sequence
  sgRNA
  Met_6
gctaatctagggacgtcaga

SEQ ID NO: 32590 - DNA, 20 bp, Artificial Sequence
  sgRNA
  Met_7
gccggaagagtttctcagca

SEQ ID NO: 32591 - DNA, 20 bp, Artificial Sequence
  sgRNA
  Met_8
atgtcagcagaattgtcagg

SEQ ID NO: 32592 - DNA, 20 bp, Artificial Sequence
  sgRNA
  Met_9
ccgcgtatgtcagtaaacca

SEQ ID NO: 32593 - DNA, 20 bp, Artificial Sequence
  sgRNA
  Met_10
gttcatctcagacttcacta

SEQ ID NO: 32594 - DNA, 20 bp, Artificial Sequence
  sgRNA
  Met_11
tcttgagtccatgtaccgct

SEQ ID NO: 32595 - DNA, 20 bp, Artificial Sequence
  sgRNA
  Met_12
tgacgtccctagattagcaa

SEQ ID NO: 32596 - DNA, 20 bp, Artificial Sequence
  sgRNA
  Met_13
gtcgacgcgctgcaaagccg

SEQ ID NO: 32597 - DNA, 20 bp, Artificial Sequence
  sgRNA
  Met_14
cgcgtatgtcagtaaaccag

SEQ ID NO: 32598 - DNA, 20 bp, Artificial Sequence
  sgRNA
  Met_15
tgttcacgtcgggataagga

SEQ ID NO: 32599 - DNA, 20 bp, Artificial Sequence
  sgRNA
  Met_16
gtagtgttccccaatgaacg

SEQ ID NO: 32600 - DNA, 20 bp, Artificial Sequence
  sgRNA
  Met_17
gcaaagccaattcatcagga

SEQ ID NO: 32601 - DNA, 20 bp, Artificial Sequence
  sgRNA
  Met_18
gttcacgtcgggataaggag

SEQ ID NO: 32602 - DNA, 20 bp, Artificial Sequence
  sgRNA
  Met_19
agtgggtgtgaactacacag

SEQ ID NO: 32603 - DNA, 20 bp, Artificial Sequence
  sgRNA
  Met_20
ccagcctgagggccgtacct

SEQ ID NO: 32604 - DNA, 20 bp, Artificial Sequence
  sgRNA
  Mfap3_1
tgatacatgtatagagccca

SEQ ID NO: 32605 - DNA, 20 bp, Artificial Sequence
  sgRNA
  Mfap3_2
ggagtttgcccgatatattg

SEQ ID NO: 32606 - DNA, 20 bp, Artificial Sequence
  sgRNA
  Mfap3_3
attggagtgtcttctcacgg

SEQ ID NO: 32607 - DNA, 20 bp, Artificial Sequence
  sgRNA
  Mfap3_4
caggatgagtgtgattgtga

SEQ ID NO: 32608 - DNA, 20 bp, Artificial Sequence
  sgRNA
  Mfap3_5
ccatcatctgaatctccacc

SEQ ID NO: 32609 - DNA, 20 bp, Artificial Sequence
  sgRNA
  Mfap3_6
agaggtgaagatcacacgga

SEQ ID NO: 32610 - DNA, 20 bp, Artificial Sequence
  sgRNA
  Mfap3_7
cggcagttcagaataagggg

SEQ ID NO: 32611 - DNA, 20 bp, Artificial Sequence
  sgRNA
  Mfap3_8
atgagttcttcaggaccgag

SEQ ID NO: 32612 - DNA, 20 bp, Artificial Sequence
  sgRNA
  Mfap3_9
atagagcccacggtcatcaa

SEQ ID NO: 32613 - DNA, 20 bp, Artificial Sequence
  sgRNA
  Mfap3_10
tgtgaccttggccagctcga

SEQ ID NO: 32614 - DNA, 20 bp, Artificial Sequence
  sgRNA
  Mfap3_11
aatgagttcttcaggaccga

SEQ ID NO: 32615 - DNA, 20 bp, Artificial Sequence
  sgRNA
  Mfap3_12
tgtcatcagggtcatccact

SEQ ID NO: 32616 - DNA, 20 bp, Artificial Sequence
  sgRNA
  Mfap3_13
gaactttgattcgctcccag

SEQ ID NO: 32617 - DNA, 20 bp, Artificial Sequence
  sgRNA
  Mfap3_14
cagaggtgaagatcacacgg

SEQ ID NO: 32618 - DNA, 20 bp, Artificial Sequence
  sgRNA
  Mfap3_15
gcgtagcctttgatgaccgt

SEQ ID NO: 32619 - DNA, 20 bp, Artificial Sequence
  sgRNA
  Mfap3_16
cctgctttggacgctcaaag

SEQ ID NO: 32620 - DNA, 20 bp, Artificial Sequence
  sgRNA
  Mfap3_17
aatgtttgaagctgtccgag

SEQ ID NO: 32621 - DNA, 20 bp, Artificial Sequence
  sgRNA
  Mfap3_18
gggggctgagaaactccaga

SEQ ID NO: 32622 - DNA, 20 bp, Artificial Sequence
  sgRNA
  Mfap3_19
cttctcacggtggatcagta

SEQ ID NO: 32623 - DNA, 20 bp, Artificial Sequence
  sgRNA
  Mfap3_20
gcccggcagttcagaataag

SEQ ID NO: 32624 - DNA, 20 bp, Artificial Sequence
  sgRNA
  Mfap3l_1
catgggcgtgtactatatgg

SEQ ID NO: 32625 - DNA, 20 bp, Artificial Sequence
  sgRNA
  Mfap3l_2
ggtgactgctcatcatacac

SEQ ID NO: 32626 - DNA, 20 bp, Artificial Sequence
  sgRNA
  Mfap3l_3
gaactgcaggacgatcatgg

SEQ ID NO: 32627 - DNA, 20 bp, Artificial Sequence
  sgRNA
  Mfap3l_4
gaagcatccgagtcagcggt

SEQ ID NO: 32628 - DNA, 20 bp, Artificial Sequence
  sgRNA
  Mfap3l_5
tggcctcctgaacatcacca

SEQ ID NO: 32629 - DNA, 20 bp, Artificial Sequence
  sgRNA
  Mfap3l_6
tgactatggtgaaggccacg

SEQ ID NO: 32630 - DNA, 20 bp, Artificial Sequence
  sgRNA
  Mfap3l_7
ctcttcggacgtcagctccg

SEQ ID NO: 32631 - DNA, 20 bp, Artificial Sequence
  sgRNA
  Mfap3l_8
gtatacctcgtccctatctg

SEQ ID NO: 32632 - DNA, 20 bp, Artificial Sequence
  sgRNA
  Mfap3l_9
tgacgaagcatccgagtcag

SEQ ID NO: 32633 - DNA, 20 bp, Artificial Sequence
  sgRNA
  Mfap3l_10
ggatcatgtggatgaccagg

SEQ ID NO: 32634 - DNA, 20 bp, Artificial Sequence
  sgRNA
  Mfap3l_11
gtacacgcccatgtctccag

SEQ ID NO: 32635 - DNA, 20 bp, Artificial Sequence
  sgRNA
  Mfap3l_12
gactgctcatcatacacagg

SEQ ID NO: 32636 - DNA, 20 bp, Artificial Sequence
  sgRNA
  Mfap3l_13
agtgactcagttcaaaacca

SEQ ID NO: 32637 - DNA, 20 bp, Artificial Sequence
  sgRNA
  Mfap3l_14
ttctacagacataacgacca

SEQ ID NO: 32638 - DNA, 20 bp, Artificial Sequence
  sgRNA
  Mfap3l_15
gttggtcacactcttagcag

SEQ ID NO: 32639 - DNA, 20 bp, Artificial Sequence
  sgRNA
  Mfap3l_16
ctgcagttcatgatgagggg

SEQ ID NO: 32640 - DNA, 20 bp, Artificial Sequence
  sgRNA
  Mfap3l_17
gatcatgtggatgaccagga

SEQ ID NO: 32641 - DNA, 20 bp, Artificial Sequence
  sgRNA
  Mfap3l_18
gtggatactaggattaagaa

SEQ ID NO: 32642 - DNA, 20 bp, Artificial Sequence
  sgRNA
  Mfap3l_19
agaaggctctgcagtctctg

SEQ ID NO: 32643 - DNA, 20 bp, Artificial Sequence
  sgRNA
  Mfap3l_20
cgaagcatccgagtcagcgg

SEQ ID NO: 32644 - DNA, 20 bp, Artificial Sequence
  sgRNA
  Mfrp_1
tgagtgcaagtttgactacg

SEQ ID NO: 32645 - DNA, 20 bp, Artificial Sequence
  sgRNA
  Mfrp_2
aagcgtgactctgtatgtga

SEQ ID NO: 32646 - DNA, 20 bp, Artificial Sequence
  sgRNA
  Mfrp_3
cctggatatgccagacacag

SEQ ID NO: 32647 - DNA, 20 bp, Artificial Sequence
  sgRNA
  Mfrp_4
tctctgataacgatgtggaa

SEQ ID NO: 32648 - DNA, 20 bp, Artificial Sequence
  sgRNA
  Mfrp_5
ttgtcgttccgtctgccagg

SEQ ID NO: 32649 - DNA, 20 bp, Artificial Sequence
  sgRNA
  Mfrp_6
tggactaagctacaatacca

SEQ ID NO: 32650 - DNA, 20 bp, Artificial Sequence
  sgRNA
  Mfrp_7
tcaactcactcgcctctgga

SEQ ID NO: 32651 - DNA, 20 bp, Artificial Sequence
  sgRNA
  Mfrp_8
cctgctaccagactttccag

SEQ ID NO: 32652 - DNA, 20 bp, Artificial Sequence
  sgRNA
  Mfrp_9
agtcttatcccgtatcccac

SEQ ID NO: 32653 - DNA, 20 bp, Artificial Sequence
  sgRNA
  Mfrp_10
gatcttggtatcagcagcgg

SEQ ID NO: 32654 - DNA, 20 bp, Artificial Sequence
  sgRNA
  Mfrp_11
actcactcgcctctggacgg

SEQ ID NO: 32655 - DNA, 20 bp, Artificial Sequence
  sgRNA
  Mfrp_12
ccctccaccagcgttacaga

SEQ ID NO: 32656 - DNA, 20 bp, Artificial Sequence
  sgRNA
  Mfrp_13
tgactacgtggaagtgtacg

SEQ ID NO: 32657 - DNA, 20 bp, Artificial Sequence
  sgRNA
  Mfrp_14
tcttgaagattacagccagc

SEQ ID NO: 32658 - DNA, 20 bp, Artificial Sequence
  sgRNA
  Mfrp_15
ggagttccacaacttcagtc

SEQ ID NO: 32659 - DNA, 20 bp, Artificial Sequence
  sgRNA
  Mfrp_16
ccatcaatactacagagagt

SEQ ID NO: 32660 - DNA, 20 bp, Artificial Sequence
  sgRNA
  Mfrp_17
cctggcagacggaacgacaa

SEQ ID NO: 32661 - DNA, 20 bp, Artificial Sequence
  sgRNA
  Mfrp_18
ctaccaccccagcaaggaca

SEQ ID NO: 32662 - DNA, 20 bp, Artificial Sequence
  sgRNA
  Mfrp_19
acagagttctgccagagcgg

SEQ ID NO: 32663 - DNA, 20 bp, Artificial Sequence
  sgRNA
  Mfrp_20
tggcagacggaacgacaagg

SEQ ID NO: 32664 - DNA, 20 bp, Artificial Sequence
  sgRNA
  Mfsd11_1
ggtgtacggtacctgtattg

SEQ ID NO: 32665 - DNA, 20 bp, Artificial Sequence
  sgRNA
  Mfsd11_2
agagatctgaggtccaacaa

SEQ ID NO: 32666 - DNA, 20 bp, Artificial Sequence
  sgRNA
  Mfsd11_3
tgcccagaacaacgtgacaa

SEQ ID NO: 32667 - DNA, 20 bp, Artificial Sequence
  sgRNA
  Mfsd11_4
gctcatcagaatttatcgtc

SEQ ID NO: 32668 - DNA, 20 bp, Artificial Sequence
  sgRNA
  Mfsd11_5
tgacagtgataagcctcgtg

SEQ ID NO: 32669 - DNA, 20 bp, Artificial Sequence
  sgRNA
  Mfsd11_6
gttgctgtagaaaaaggcca

SEQ ID NO: 32670 - DNA, 20 bp, Artificial Sequence
  sgRNA
  Mfsd11_7
aattctgatgagcacacaat

SEQ ID NO: 32671 - DNA, 20 bp, Artificial Sequence
  sgRNA
  Mfsd11_8
ctactcggaagacagcgcgc

SEQ ID NO: 32672 - DNA, 20 bp, Artificial Sequence
  sgRNA
  Mfsd11_9
gcaactacctcctcctccac

SEQ ID NO: 32673 - DNA, 20 bp, Artificial Sequence
  sgRNA
  Mfsd11_10
gagcaataaacactgtcctt

SEQ ID NO: 32674 - DNA, 20 bp, Artificial Sequence
  sgRNA
  Mfsd11_11
agaacagaacggtccccacg

SEQ ID NO: 32675 - DNA, 20 bp, Artificial Sequence
  sgRNA
  Mfsd11_12
gcaagaacagtcgctttggc

SEQ ID NO: 32676 - DNA, 20 bp, Artificial Sequence
  sgRNA
  Mfsd11_13
gctgctgccatcgtggcccg

SEQ ID NO: 32677 - DNA, 20 bp, Artificial Sequence
  sgRNA
  Mfsd11_14
aggtccaacaatggcgacca

SEQ ID NO: 32678 - DNA, 20 bp, Artificial Sequence
  sgRNA
  Mfsd11_15
ccaacaatggcgaccacgga

SEQ ID NO: 32679 - DNA, 20 bp, Artificial Sequence
  sgRNA
  Mfsd11_16
gtgtagaaggaccatgggaa

SEQ ID NO: 32680 - DNA, 20 bp, Artificial Sequence
  sgRNA
  Mfsd11_17
agaaggctacgaagtgcacc

SEQ ID NO: 32681 - DNA, 20 bp, Artificial Sequence
  sgRNA
  Mfsd11_18
atttccacaagtctgaaagg

SEQ ID NO: 32682 - DNA, 20 bp, Artificial Sequence
  sgRNA
  Mfsd11_19
gaaggctacgaagtgcacca

SEQ ID NO: 32683 - DNA, 20 bp, Artificial Sequence
  sgRNA
  Mfsd11_20
gatgctgtgtagaaggacca

SEQ ID NO: 32684 - DNA, 20 bp, Artificial Sequence
  sgRNA
  Mfsd12_1
ctctaggtatgcgttcactg

SEQ ID NO: 32685 - DNA, 20 bp, Artificial Sequence
  sgRNA
  Mfsd12_2
atggtggcgatgaacttctg

SEQ ID NO: 32686 - DNA, 20 bp, Artificial Sequence
  sgRNA
  Mfsd12_3
tccgcctcgtagcccacgag

SEQ ID NO: 32687 - DNA, 20 bp, Artificial Sequence
  sgRNA
  Mfsd12_4
caaggcagcccattcaggcg

SEQ ID NO: 32688 - DNA, 20 bp, Artificial Sequence
  sgRNA
  Mfsd12_5
gctcaggtgggcaatctgcg

SEQ ID NO: 32689 - DNA, 20 bp, Artificial Sequence
  sgRNA
  Mfsd12_6
ctattcctgcactccgtgcg

SEQ ID NO: 32690 - DNA, 20 bp, Artificial Sequence
  sgRNA
  Mfsd12_7
gctcatagcaccatacacga

SEQ ID NO: 32691 - DNA, 20 bp, Artificial Sequence
  sgRNA
  Mfsd12_8
tcactgctgtcatcacccag

SEQ ID NO: 32692 - DNA, 20 bp, Artificial Sequence
  sgRNA
  Mfsd12_9
gaagggtccatagtacagca

SEQ ID NO: 32693 - DNA, 20 bp, Artificial Sequence
  sgRNA
  Mfsd12_10
aactggaagacgacaatgaa

SEQ ID NO: 32694 - DNA, 20 bp, Artificial Sequence
  sgRNA
  Mfsd12_11
tcctcatgaagccagtcaac

SEQ ID NO: 32695 - DNA, 20 bp, Artificial Sequence
  sgRNA
  Mfsd12_12
gccactcaagtacatcacca

SEQ ID NO: 32696 - DNA, 20 bp, Artificial Sequence
  sgRNA
  Mfsd12_13
aagccagtcaaccggcgcat

SEQ ID NO: 32697 - DNA, 20 bp, Artificial Sequence
  sgRNA
  Mfsd12_14
tctgggtgtggccgtgtacg

SEQ ID NO: 32698 - DNA, 20 bp, Artificial Sequence
  sgRNA
  Mfsd12_15
tggctgctgctgcacttgca

SEQ ID NO: 32699 - DNA, 20 bp, Artificial Sequence
  sgRNA
  Mfsd12_16
cactcaagtacatcaccagg

SEQ ID NO: 32700 - DNA, 20 bp, Artificial Sequence
  sgRNA
  Mfsd12_17
ccacacccagattatctgcc

SEQ ID NO: 32701 - DNA, 20 bp, Artificial Sequence
  sgRNA
  Mfsd12_18
gttcatcgccaccatccccc

SEQ ID NO: 32702 - DNA, 20 bp, Artificial Sequence
  sgRNA
  Mfsd12_19
gcaagctgagagaataggtc

SEQ ID NO: 32703 - DNA, 20 bp, Artificial Sequence
  sgRNA
  Mfsd12_20
gctgcagtgctgctaggtgc

SEQ ID NO: 32704 - DNA, 20 bp, Artificial Sequence
  sgRNA
  Mfsd2a_1
tcagggacggaaagttcaca

SEQ ID NO: 32705 - DNA, 20 bp, Artificial Sequence
  sgRNA
  Mfsd2a_2
gcagccggtcaactggtacg

SEQ ID NO: 32706 - DNA, 20 bp, Artificial Sequence
  sgRNA
  Mfsd2a_3
gagggacttactgtatgccg

SEQ ID NO: 32707 - DNA, 20 bp, Artificial Sequence
  sgRNA
  Mfsd2a_4
tctctacttaccagggcatg

SEQ ID NO: 32708 - DNA, 20 bp, Artificial Sequence
  sgRNA
  Mfsd2a_5
gagtgagcgtgactcagcca

SEQ ID NO: 32709 - DNA, 20 bp, Artificial Sequence
  sgRNA
  Mfsd2a_6
tctaatcgtcacttacgtgg

SEQ ID NO: 32710 - DNA, 20 bp, Artificial Sequence
  sgRNA
  Mfsd2a_7
taatgcagaagcccaccaga

SEQ ID NO: 32711 - DNA, 20 bp, Artificial Sequence
  sgRNA
  Mfsd2a_8
gctcaccatgttcatcagca

SEQ ID NO: 32712 - DNA, 20 bp, Artificial Sequence
  sgRNA
  Mfsd2a_9
cttgttctgcacctatacct

SEQ ID NO: 32713 - DNA, 20 bp, Artificial Sequence
  sgRNA
  Mfsd2a_10
tttgccaactaccagaggca

SEQ ID NO: 32714 - DNA, 20 bp, Artificial Sequence
  sgRNA
  Mfsd2a_11
gccgcttctcctcatcaatg

SEQ ID NO: 32715 - DNA, 20 bp, Artificial Sequence
  sgRNA
  Mfsd2a_12
gctcggtgccaggggagtga

SEQ ID NO: 32716 - DNA, 20 bp, Artificial Sequence
  sgRNA
  Mfsd2a_13
gcatcctccaagccagtgaa

SEQ ID NO: 32717 - DNA, 20 bp, Artificial Sequence
  sgRNA
  Mfsd2a_14
gccttcactgaccctctggt

SEQ ID NO: 32718 - DNA, 20 bp, Artificial Sequence
  sgRNA
  Mfsd2a_15
catgacccatgaccagccgg

SEQ ID NO: 32719 - DNA, 20 bp, Artificial Sequence
  sgRNA
  Mfsd2a_16
aagtaagcaatgatggccag

SEQ ID NO: 32720 - DNA, 20 bp, Artificial Sequence
  sgRNA
  Mfsd2a_17
gcagatctacctattggatg

SEQ ID NO: 32721 - DNA, 20 bp, Artificial Sequence
  sgRNA
  Mfsd2a_18
agaactctacgagtcccagc

SEQ ID NO: 32722 - DNA, 20 bp, Artificial Sequence
  sgRNA
  Mfsd2a_19
cagctgccttcctactacca

SEQ ID NO: 32723 - DNA, 20 bp, Artificial Sequence
  sgRNA
  Mfsd2a_20
gaaccactgccagataggga

SEQ ID NO: 32724 - DNA, 20 bp, Artificial Sequence
  sgRNA
  Mfsd2b_1
accacactcacggtatgcgg

SEQ ID NO: 32725 - DNA, 20 bp, Artificial Sequence
  sgRNA
  Mfsd2b_2
tccacacacaggataagtca

SEQ ID NO: 32726 - DNA, 20 bp, Artificial Sequence
  sgRNA
  Mfsd2b_3
tcacatacttaccgtagcca

SEQ ID NO: 32727 - DNA, 20 bp, Artificial Sequence
  sgRNA
  Mfsd2b_4
aaacaaggcaagtgacacct

SEQ ID NO: 32728 - DNA, 20 bp, Artificial Sequence
  sgRNA
  Mfsd2b_5
tcgcctctcagtctgtacaa

SEQ ID NO: 32729 - DNA, 20 bp, Artificial Sequence
  sgRNA
  Mfsd2b_6
gcagccaacaagatagaaaa

SEQ ID NO: 32730 - DNA, 20 bp, Artificial Sequence
  sgRNA
  Mfsd2b_7
ctacctgcaactcttcctac

SEQ ID NO: 32731 - DNA, 20 bp, Artificial Sequence
  sgRNA
  Mfsd2b_8
gcatcggtgtggcccaggcg

SEQ ID NO: 32732 - DNA, 20 bp, Artificial Sequence
  sgRNA
  Mfsd2b_9
tggcagagtctcgctccctg

SEQ ID NO: 32733 - DNA, 20 bp, Artificial Sequence
  sgRNA
  Mfsd2b_10
catccagtaggaagagttgc

SEQ ID NO: 32734 - DNA, 20 bp, Artificial Sequence
  sgRNA
  Mfsd2b_11
tggtataccagagcccacga

SEQ ID NO: 32735 - DNA, 20 bp, Artificial Sequence
  sgRNA
  Mfsd2b_12
acacctttgtacagactgag

SEQ ID NO: 32736 - DNA, 20 bp, Artificial Sequence
  sgRNA
  Mfsd2b_13
ggatgaccatggagatggca

SEQ ID NO: 32737 - DNA, 20 bp, Artificial Sequence
  sgRNA
  Mfsd2b_14
acataggccaccggtgctga

SEQ ID NO: 32738 - DNA, 20 bp, Artificial Sequence
  sgRNA
  Mfsd2b_15
gagaacccactcccacagtg

SEQ ID NO: 32739 - DNA, 20 bp, Artificial Sequence
  sgRNA
  Mfsd2b_16
gcagttgcagaccctgtggc

SEQ ID NO: 32740 - DNA, 20 bp, Artificial Sequence
  sgRNA
  Mfsd2b_17
aagtaggccagtgcgattaa

SEQ ID NO: 32741 - DNA, 20 bp, Artificial Sequence
  sgRNA
  Mfsd2b_18
cagtgtccctgccatctcca

SEQ ID NO: 32742 - DNA, 20 bp, Artificial Sequence
  sgRNA
  Mfsd2b_19
cctcccagctaagccttcgg

SEQ ID NO: 32743 - DNA, 20 bp, Artificial Sequence
  sgRNA
  Mfsd2b_20
cagcttggtgaagaagacgt

SEQ ID NO: 32744 - DNA, 20 bp, Artificial Sequence
  sgRNA
  Mfsd5_1
gccttggctctacgaaactg

SEQ ID NO: 32745 - DNA, 20 bp, Artificial Sequence
  sgRNA
  Mfsd5_2
ggcatgacttccccgccgag

SEQ ID NO: 32746 - DNA, 20 bp, Artificial Sequence
  sgRNA
  Mfsd5_3
acgacccagccagtccacaa

SEQ ID NO: 32747 - DNA, 20 bp, Artificial Sequence
  sgRNA
  Mfsd5_4
cagccctatccaactagcca

SEQ ID NO: 32748 - DNA, 20 bp, Artificial Sequence
  sgRNA
  Mfsd5_5
accgcatcgctacctccaag

SEQ ID NO: 32749 - DNA, 20 bp, Artificial Sequence
  sgRNA
  Mfsd5_6
ttgtcctccacgacagcgat

SEQ ID NO: 32750 - DNA, 20 bp, Artificial Sequence
  sgRNA
  Mfsd5_7
ggtacagcgaagaacccaga

SEQ ID NO: 32751 - DNA, 20 bp, Artificial Sequence
  sgRNA
  Mfsd5_8
gcaacatagagagtaagtga

SEQ ID NO: 32752 - DNA, 20 bp, Artificial Sequence
  sgRNA
  Mfsd5_9
tgagacacgacgctgagttg

SEQ ID NO: 32753 - DNA, 20 bp, Artificial Sequence
  sgRNA
  Mfsd5_10
cacccaacagcaacacccgg

SEQ ID NO: 32754 - DNA, 20 bp, Artificial Sequence
  sgRNA
  Mfsd5_11
tcagcattaccacttcctgg

SEQ ID NO: 32755 - DNA, 20 bp, Artificial Sequence
  sgRNA
  Mfsd5_12
gctccgtgtgggtctagcac

SEQ ID NO: 32756 - DNA, 20 bp, Artificial Sequence
  sgRNA
  Mfsd5_13
gactacttcgtgctgctggt

SEQ ID NO: 32757 - DNA, 20 bp, Artificial Sequence
  sgRNA
  Mfsd5_14
agacaggccagcaaatgcag

SEQ ID NO: 32758 - DNA, 20 bp, Artificial Sequence
  sgRNA
  Mfsd5_15
ggtctagcacaggtgtccag

SEQ ID NO: 32759 - DNA, 20 bp, Artificial Sequence
  sgRNA
  Mfsd5_16
gcaagggaaagcaggtgcat

SEQ ID NO: 32760 - DNA, 20 bp, Artificial Sequence
  sgRNA
  Mfsd5_17
ctcagcgtcgtgtctcacca

SEQ ID NO: 32761 - DNA, 20 bp, Artificial Sequence
  sgRNA
  Mfsd5_18
ttgctgcaagctcttccagg

SEQ ID NO: 32762 - DNA, 20 bp, Artificial Sequence
  sgRNA
  Mfsd5_19
actgggaaagtagagcccgc

SEQ ID NO: 32763 - DNA, 20 bp, Artificial Sequence
  sgRNA
  Mfsd5_20
gcagccacaaagggtgcgac

SEQ ID NO: 32764 - DNA, 20 bp, Artificial Sequence
  sgRNA
  Mfsd6_1
ggactgaacagaccccaaag

SEQ ID NO: 32765 - DNA, 20 bp, Artificial Sequence
  sgRNA
  Mfsd6_2
ttcctgttggtcatacacaa

SEQ ID NO: 32766 - DNA, 20 bp, Artificial Sequence
  sgRNA
  Mfsd6_3
gctaaagaaagcgacagtgg

SEQ ID NO: 32767 - DNA, 20 bp, Artificial Sequence
  sgRNA
  Mfsd6_4
ctgcaactacaccccagaag

SEQ ID NO: 32768 - DNA, 20 bp, Artificial Sequence
  sgRNA
  Mfsd6_5
gggctgctgcaactttccga

SEQ ID NO: 32769 - DNA, 20 bp, Artificial Sequence
  sgRNA
  Mfsd6_6
agagacctcagccattcccg

SEQ ID NO: 32770 - DNA, 20 bp, Artificial Sequence
  sgRNA
  Mfsd6_7
ccttgttcatcaaaacacat

SEQ ID NO: 32771 - DNA, 20 bp, Artificial Sequence
  sgRNA
  Mfsd6_8
atatcgcctcaacttcctgt

SEQ ID NO: 32772 - DNA, 20 bp, Artificial Sequence
  sgRNA
  Mfsd6_9
tctgcaactacaccccagaa

SEQ ID NO: 32773 - DNA, 20 bp, Artificial Sequence
  sgRNA
  Mfsd6_10
ggaagtctggcctcaacgcg

SEQ ID NO: 32774 - DNA, 20 bp, Artificial Sequence
  sgRNA
  Mfsd6_11
gcgacagtggaggagttcat

SEQ ID NO: 32775 - DNA, 20 bp, Artificial Sequence
  sgRNA
  Mfsd6_12
ggcaagccatgccaatccct

SEQ ID NO: 32776 - DNA, 20 bp, Artificial Sequence
  sgRNA
  Mfsd6_13
ggtggtggtgaccacagcaa

SEQ ID NO: 32777 - DNA, 20 bp, Artificial Sequence
  sgRNA
  Mfsd6_14
gcatagacaaaggtcaccca

SEQ ID NO: 32778 - DNA, 20 bp, Artificial Sequence
  sgRNA
  Mfsd6_15
tccactctcctgtccatgcg

SEQ ID NO: 32779 - DNA, 20 bp, Artificial Sequence
  sgRNA
  Mfsd6_16
gtatgaccaacaggaagttg

SEQ ID NO: 32780 - DNA, 20 bp, Artificial Sequence
  sgRNA
  Mfsd6_17
gtagcggaaccggaactgag

SEQ ID NO: 32781 - DNA, 20 bp, Artificial Sequence
  sgRNA
  Mfsd6_18
tgtgctaaagaaagcgacag

SEQ ID NO: 32782 - DNA, 20 bp, Artificial Sequence
  sgRNA
  Mfsd6_19
gtttgacaaatccaatgccc

SEQ ID NO: 32783 - DNA, 20 bp, Artificial Sequence
  sgRNA
  Mfsd6_20
atgtaaataaaccggcctgg

SEQ ID NO: 32784 - DNA, 20 bp, Artificial Sequence
  sgRNA
  Mfsd6l_1
actcctcgaaagggtcaccg

SEQ ID NO: 32785 - DNA, 20 bp, Artificial Sequence
  sgRNA
  Mfsd6l_2
ctgatcggaacagagacctg

SEQ ID NO: 32786 - DNA, 20 bp, Artificial Sequence
  sgRNA
  Mfsd6l_3
ccaccactatcttaccgctg

SEQ ID NO: 32787 - DNA, 20 bp, Artificial Sequence
  sgRNA
  Mfsd6l_4
ggtctgcagacctatttagt

SEQ ID NO: 32788 - DNA, 20 bp, Artificial Sequence
  sgRNA
  Mfsd6l_5
tgatcatgacccctacccag

SEQ ID NO: 32789 - DNA, 20 bp, Artificial Sequence
  sgRNA
  Mfsd6l_6
atttcgtagacgccactgat

SEQ ID NO: 32790 - DNA, 20 bp, Artificial Sequence
  sgRNA
  Mfsd6l_7
ttatttctacagctactcgc

SEQ ID NO: 32791 - DNA, 20 bp, Artificial Sequence
  sgRNA
  Mfsd6l_8
gtgatcatgacccctaccca

SEQ ID NO: 32792 - DNA, 20 bp, Artificial Sequence
  sgRNA
  Mfsd6l_9
atacaacaactcccaaggag

SEQ ID NO: 32793 - DNA, 20 bp, Artificial Sequence
  sgRNA
  Mfsd6l_10
cccgcaatgggacgtcccca

SEQ ID NO: 32794 - DNA, 20 bp, Artificial Sequence
  sgRNA
  Mfsd6l_11
ggatctgaaggaacatttag

SEQ ID NO: 32795 - DNA, 20 bp, Artificial Sequence
  sgRNA
  Mfsd6l_12
cttagcaacgaagttctgaa

SEQ ID NO: 32796 - DNA, 20 bp, Artificial Sequence
  sgRNA
  Mfsd6l_13
gcgggagtcaccccttatga

SEQ ID NO: 32797 - DNA, 20 bp, Artificial Sequence
  sgRNA
  Mfsd6l_14
ggcacagaagggaatccagc

SEQ ID NO: 32798 - DNA, 20 bp, Artificial Sequence
  sgRNA
  Mfsd6l_15
gctctacgaagcctgttgtg

SEQ ID NO: 32799 - DNA, 20 bp, Artificial Sequence
  sgRNA
  Mfsd6l_16
gatggtcctcgtcccaccgg

SEQ ID NO: 32800 - DNA, 20 bp, Artificial Sequence
  sgRNA
  Mfsd6l_17
aaactgttaggtgtatcagc

SEQ ID NO: 32801 - DNA, 20 bp, Artificial Sequence
  sgRNA
  Mfsd6l_18
tctctgggcaccatgttccg

SEQ ID NO: 32802 - DNA, 20 bp, Artificial Sequence
  sgRNA
  Mfsd6l_19
gccaccactatcttaccgct

SEQ ID NO: 32803 - DNA, 20 bp, Artificial Sequence
  sgRNA
  Mfsd6l_20
caaagctgctagctatggga

SEQ ID NO: 32804 - DNA, 20 bp, Artificial Sequence
  sgRNA
  Mfsd8_1
agcaatgtatgatcggacaa

SEQ ID NO: 32805 - DNA, 20 bp, Artificial Sequence
  sgRNA
  Mfsd8_2
tggaccgagaataaagccca

SEQ ID NO: 32806 - DNA, 20 bp, Artificial Sequence
  sgRNA
  Mfsd8_3
ggatatgtacgcctggaccc

SEQ ID NO: 32807 - DNA, 20 bp, Artificial Sequence
  sgRNA
  Mfsd8_4
gagcatcgtgtggatgactt

SEQ ID NO: 32808 - DNA, 20 bp, Artificial Sequence
  sgRNA
  Mfsd8_5
ttgggaaactgatttcccca

SEQ ID NO: 32809 - DNA, 20 bp, Artificial Sequence
  sgRNA
  Mfsd8_6
atacaaccacaaatcctccc

SEQ ID NO: 32810 - DNA, 20 bp, Artificial Sequence
  sgRNA
  Mfsd8_7
gcactactattccacacaca

SEQ ID NO: 32811 - DNA, 20 bp, Artificial Sequence
  sgRNA
  Mfsd8_8
gatcacagtgaacagccaac

SEQ ID NO: 32812 - DNA, 20 bp, Artificial Sequence
  sgRNA
  Mfsd8_9
gatgaacctcagattcctga

SEQ ID NO: 32813 - DNA, 20 bp, Artificial Sequence
  sgRNA
  Mfsd8_10
tcaggaaagaacaaatgcca

SEQ ID NO: 32814 - DNA, 20 bp, Artificial Sequence
  sgRNA
  Mfsd8_11
actgggccagatgaatcact

SEQ ID NO: 32815 - DNA, 20 bp, Artificial Sequence
  sgRNA
  Mfsd8_12
tcagtttcccaaaatacagt

SEQ ID NO: 32816 - DNA, 20 bp, Artificial Sequence
  sgRNA
  Mfsd8_13
gtacgcctggacccaggagc

SEQ ID NO: 32817 - DNA, 20 bp, Artificial Sequence
  sgRNA
  Mfsd8_14
tggcatttgttctttcctga

SEQ ID NO: 32818 - DNA, 20 bp, Artificial Sequence
  sgRNA
  Mfsd8_15
gtacaccccagtgattcatc

SEQ ID NO: 32819 - DNA, 20 bp, Artificial Sequence
  sgRNA
  Mfsd8_16
ggcatttgttctttcctgaa

SEQ ID NO: 32820 - DNA, 20 bp, Artificial Sequence
  sgRNA
  Mfsd8_17
ggcagttcttgtcttcatgg

SEQ ID NO: 32821 - DNA, 20 bp, Artificial Sequence
  sgRNA
  Mfsd8_18
gtacatatccagtgttagtg

SEQ ID NO: 32822 - DNA, 20 bp, Artificial Sequence
  sgRNA
  Mfsd8_19
atacttccttcaggaatctg

SEQ ID NO: 32823 - DNA, 20 bp, Artificial Sequence
  sgRNA
  Mfsd8_20
gcatgtgcttgtattagcca

SEQ ID NO: 32824 - DNA, 20 bp, Artificial Sequence
  sgRNA
  Mill1_1
gggtgacaaccaaagactgg

SEQ ID NO: 32825 - DNA, 20 bp, Artificial Sequence
  sgRNA
  Mill1_2
gaccttcaggaactatccag

SEQ ID NO: 32826 - DNA, 20 bp, Artificial Sequence
  sgRNA
  Mill1_3
ctcatcatcgaagtatctca

SEQ ID NO: 32827 - DNA, 20 bp, Artificial Sequence
  sgRNA
  Mill1_4
gaagactctcacatggacag

SEQ ID NO: 32828 - DNA, 20 bp, Artificial Sequence
  sgRNA
  Mill1_5
ggagaagcctagagtacagg

SEQ ID NO: 32829 - DNA, 20 bp, Artificial Sequence
  sgRNA
  Mill1_6
ggagcaggtacactatccac

SEQ ID NO: 32830 - DNA, 20 bp, Artificial Sequence
  sgRNA
  Mill1_7
gggtatacagacgaaaagcc

SEQ ID NO: 32831 - DNA, 20 bp, Artificial Sequence
  sgRNA
  Mill1_8
tctttgaagctcacagccga

SEQ ID NO: 32832 - DNA, 20 bp, Artificial Sequence
  sgRNA
  Mill1_9
gcaggtacactatccacagg

SEQ ID NO: 32833 - DNA, 20 bp, Artificial Sequence
  sgRNA
  Mill1_10
tctggaaactgggctatgat

SEQ ID NO: 32834 - DNA, 20 bp, Artificial Sequence
  sgRNA
  Mill1_11
ggatggcacctaccaggcct

SEQ ID NO: 32835 - DNA, 20 bp, Artificial Sequence
  sgRNA
  Mill1_12
cacagccgaaggttgcctgg

SEQ ID NO: 32836 - DNA, 20 bp, Artificial Sequence
  sgRNA
  Mill1_13
atactgaagccaggtcaggg

SEQ ID NO: 32837 - DNA, 20 bp, Artificial Sequence
  sgRNA
  Mill1_14
gaccatttctcaaggaagca

SEQ ID NO: 32838 - DNA, 20 bp, Artificial Sequence
  sgRNA
  Mill1_15
acattaagccagaaactgat

SEQ ID NO: 32839 - DNA, 20 bp, Artificial Sequence
  sgRNA
  Mill1_16
ccacaggtggatcgcagcta

SEQ ID NO: 32840 - DNA, 20 bp, Artificial Sequence
  sgRNA
  Mill1_17
ccagagcagaaccagagtag

SEQ ID NO: 32841 - DNA, 20 bp, Artificial Sequence
  sgRNA
  Mill1_18
cacatcctccaggcaacctt

SEQ ID NO: 32842 - DNA, 20 bp, Artificial Sequence
  sgRNA
  Mill1_19
cctccagagacaaggccatg

SEQ ID NO: 32843 - DNA, 20 bp, Artificial Sequence
  sgRNA
  Mill1_20
agaaatggtctgctgaatac

SEQ ID NO: 32844 - DNA, 20 bp, Artificial Sequence
  sgRNA
  Mill2_1
aggaagcgaggtatctctgg

SEQ ID NO: 32845 - DNA, 20 bp, Artificial Sequence
  sgRNA
  Mill2_2
tgtcagagcccattctctgg

SEQ ID NO: 32846 - DNA, 20 bp, Artificial Sequence
  sgRNA
  Mill2_3
cccttaatccagcatcccaa

SEQ ID NO: 32847 - DNA, 20 bp, Artificial Sequence
  sgRNA
  Mill2_4
ctgctccttagagactcacg

SEQ ID NO: 32848 - DNA, 20 bp, Artificial Sequence
  sgRNA
  Mill2_5
gtgccaccgccaatacaaca

SEQ ID NO: 32849 - DNA, 20 bp, Artificial Sequence
  sgRNA
  Mill2_6
gacattatagcgcagagtgt

SEQ ID NO: 32850 - DNA, 20 bp, Artificial Sequence
  sgRNA
  Mill2_7
actccctgttgtattggcgg

SEQ ID NO: 32851 - DNA, 20 bp, Artificial Sequence
  sgRNA
  Mill2_8
cccatcctgaagccagacca

SEQ ID NO: 32852 - DNA, 20 bp, Artificial Sequence
  sgRNA
  Mill2_9
gtatacccgtgaggccaccc

SEQ ID NO: 32853 - DNA, 20 bp, Artificial Sequence
  sgRNA
  Mill2_10
gcagtcctactgttgatctt

SEQ ID NO: 32854 - DNA, 20 bp, Artificial Sequence
  sgRNA
  Mill2_11
agttctgcccatcatagccc

SEQ ID NO: 32855 - DNA, 20 bp, Artificial Sequence
  sgRNA
  Mill2_12
tataaaccagaagagtcagg

SEQ ID NO: 32856 - DNA, 20 bp, Artificial Sequence
  sgRNA
  Mill2_13
ggatgggacctaccaggccc

SEQ ID NO: 32857 - DNA, 20 bp, Artificial Sequence
  sgRNA
  Mill2_14
aggtggaagagaaactcagg

SEQ ID NO: 32858 - DNA, 20 bp, Artificial Sequence
  sgRNA
  Mill2_15
gcaggaactatccagtaggt

SEQ ID NO: 32859 - DNA, 20 bp, Artificial Sequence
  sgRNA
  Mill2_16
tgagaccatcctgcccagcg

SEQ ID NO: 32860 - DNA, 20 bp, Artificial Sequence
  sgRNA
  Mill2_17
gtatattaggaccaggagct

SEQ ID NO: 32861 - DNA, 20 bp, Artificial Sequence
  sgRNA
  Mill2_18
gctgctccttagagactcac

SEQ ID NO: 32862 - DNA, 20 bp, Artificial Sequence
  sgRNA
  Mill2_19
tggtaggtcccatccccgct

SEQ ID NO: 32863 - DNA, 20 bp, Artificial Sequence
  sgRNA
  Mill2_20
gcagccctaagatcaacagt

SEQ ID NO: 32864 - DNA, 20 bp, Artificial Sequence
  sgRNA
  Milr1_1
atgctgcagtggattgtacg

SEQ ID NO: 32865 - DNA, 20 bp, Artificial Sequence
  sgRNA
  Milr1_2
tctgaactcaagtatgaacg

SEQ ID NO: 32866 - DNA, 20 bp, Artificial Sequence
  sgRNA
  Milr1_3
agtatccccagtaacagccc

SEQ ID NO: 32867 - DNA, 20 bp, Artificial Sequence
  sgRNA
  Milr1_4
caagggaataagatgctggc

SEQ ID NO: 32868 - DNA, 20 bp, Artificial Sequence
  sgRNA
  Milr1_5
tgctgcagtggattgtacga

SEQ ID NO: 32869 - DNA, 20 bp, Artificial Sequence
  sgRNA
  Milr1_6
tgtaccccagaagagcgaat

SEQ ID NO: 32870 - DNA, 20 bp, Artificial Sequence
  sgRNA
  Milr1_7
ccttgaatgaaacggcagag

SEQ ID NO: 32871 - DNA, 20 bp, Artificial Sequence
  sgRNA
  Milr1_8
gtatccccagtaacagccct

SEQ ID NO: 32872 - DNA, 20 bp, Artificial Sequence
  sgRNA
  Milr1_9
gcatgaagaagggaccacct

SEQ ID NO: 32873 - DNA, 20 bp, Artificial Sequence
  sgRNA
  Milr1_10
agtggcatagtgtatctcct

SEQ ID NO: 32874 - DNA, 20 bp, Artificial Sequence
  sgRNA
  Milr1_11
acagtgacagccggcatgaa

SEQ ID NO: 32875 - DNA, 20 bp, Artificial Sequence
  sgRNA
  Milr1_12
tcaggatttcaacttcacaa

SEQ ID NO: 32876 - DNA, 20 bp, Artificial Sequence
  sgRNA
  Milr1_13
ctctctgccgtttcattcaa

SEQ ID NO: 32877 - DNA, 20 bp, Artificial Sequence
  sgRNA
  Milr1_14
ctgactgtatttcatcaagt

SEQ ID NO: 32878 - DNA, 20 bp, Artificial Sequence
  sgRNA
  Milr1_15
tagaaagcaagagaagacga

SEQ ID NO: 32879 - DNA, 20 bp, Artificial Sequence
  sgRNA
  Milr1_16
cagagagaggaccagtccaa

SEQ ID NO: 32880 - DNA, 20 bp, Artificial Sequence
  sgRNA
  Milr1_17
tgcagtggattgtacgaggg

SEQ ID NO: 32881 - DNA, 20 bp, Artificial Sequence
  sgRNA
  Milr1_18
cttcaaggagatggcaccca

SEQ ID NO: 32882 - DNA, 20 bp, Artificial Sequence
  sgRNA
  Milr1_19
ggtgccatctccttgaagac

SEQ ID NO: 32883 - DNA, 20 bp, Artificial Sequence
  sgRNA
  Milr1_20
atgagagctgcccttcatgc

SEQ ID NO: 32884 - DNA, 20 bp, Artificial Sequence
  sgRNA
  Mip_1
aggaaacctagcgctcaaca

SEQ ID NO: 32885 - DNA, 20 bp, Artificial Sequence
  sgRNA
  Mip_2
tctttgctacatacgacgag

SEQ ID NO: 32886 - DNA, 20 bp, Artificial Sequence
  sgRNA
  Mip_3
ggaaggcaaaagtgaccgca

SEQ ID NO: 32887 - DNA, 20 bp, Artificial Sequence
  sgRNA
  Mip_4
gccacttgcaagacatgtag

SEQ ID NO: 32888 - DNA, 20 bp, Artificial Sequence
  sgRNA
  Mip_5
gggtgggcccgatcatcgga

SEQ ID NO: 32889 - DNA, 20 bp, Artificial Sequence
  sgRNA
  Mip_6
ggtgggcccgatcatcggag

SEQ ID NO: 32890 - DNA, 20 bp, Artificial Sequence
  sgRNA
  Mip_7
gctacattggtgcagactgt

SEQ ID NO: 32891 - DNA, 20 bp, Artificial Sequence
  sgRNA
  Mip_8
gtcaccccaccagctgtccg

SEQ ID NO: 32892 - DNA, 20 bp, Artificial Sequence
  sgRNA
  Mip_9
tcagaaacactcttgagccg

SEQ ID NO: 32893 - DNA, 20 bp, Artificial Sequence
  sgRNA
  Mip_10
cccaggggcccaacgtagcg

SEQ ID NO: 32894 - DNA, 20 bp, Artificial Sequence
  sgRNA
  Mip_11
gactccaatggacagccaga

SEQ ID NO: 32895 - DNA, 20 bp, Artificial Sequence
  sgRNA
  Mip_12
tgtaccctctggctgtccat

SEQ ID NO: 32896 - DNA, 20 bp, Artificial Sequence
  sgRNA
  Mip_13
cgtcaagaagatctccacag

SEQ ID NO: 32897 - DNA, 20 bp, Artificial Sequence
  sgRNA
  Mip_14
ttgctacatacgacgagagg

SEQ ID NO: 32898 - DNA, 20 bp, Artificial Sequence
  sgRNA
  Mip_15
gagagactgtctatcctgaa

SEQ ID NO: 32899 - DNA, 20 bp, Artificial Sequence
  sgRNA
  Mip_16
gcttggagcctcgctacgtt

SEQ ID NO: 32900 - DNA, 20 bp, Artificial Sequence
  sgRNA
  Mip_17
ggatggcaggagcaaaggag

SEQ ID NO: 32901 - DNA, 20 bp, Artificial Sequence
  sgRNA
  Mip_18
tgttgagcgctaggtttcct

SEQ ID NO: 32902 - DNA, 20 bp, Artificial Sequence
  sgRNA
  Mip_19
ggtttcctcggacagctggt

SEQ ID NO: 32903 - DNA, 20 bp, Artificial Sequence
  sgRNA
  Mip_20
gcccctacatgtcttgcaag

SEQ ID NO: 32904 - DNA, 20 bp, Artificial Sequence
  sgRNA
  Mme_1
cttgctcctgactatcatag

SEQ ID NO: 32905 - DNA, 20 bp, Artificial Sequence
  sgRNA
  Mme_2
tgttaccagatatatatggg

SEQ ID NO: 32906 - DNA, 20 bp, Artificial Sequence
  sgRNA
  Mme_3
tttgaccagctgaatgactg

SEQ ID NO: 32907 - DNA, 20 bp, Artificial Sequence
  sgRNA
  Mme_4
ctggaagggaggccaagtcg

SEQ ID NO: 32908 - DNA, 20 bp, Artificial Sequence
  sgRNA
  Mme_5
gctgcgtccaccagtcaacg

SEQ ID NO: 32909 - DNA, 20 bp, Artificial Sequence
  sgRNA
  Mme_6
atactggtataccatacact

SEQ ID NO: 32910 - DNA, 20 bp, Artificial Sequence
  sgRNA
  Mme_7
aattgactgcatactctggc

SEQ ID NO: 32911 - DNA, 20 bp, Artificial Sequence
  sgRNA
  Mme_8
gtccagaaatgctttccgca

SEQ ID NO: 32912 - DNA, 20 bp, Artificial Sequence
  sgRNA
  Mme_9
gactgcatactctggccggt

SEQ ID NO: 32913 - DNA, 20 bp, Artificial Sequence
  sgRNA
  Mme_10
aggtgtggtgtgggacctac

SEQ ID NO: 32914 - DNA, 20 bp, Artificial Sequence
  sgRNA
  Mme_11
gtctgtacatggctcaacag

SEQ ID NO: 32915 - DNA, 20 bp, Artificial Sequence
  sgRNA
  Mme_12
ggggctgcaaaatgccagcg

SEQ ID NO: 32916 - DNA, 20 bp, Artificial Sequence
  sgRNA
  Mme_13
cagaaactgcaacatggaga

SEQ ID NO: 32917 - DNA, 20 bp, Artificial Sequence
  sgRNA
  Mme_14
ggtataccatacactgggat

SEQ ID NO: 32918 - DNA, 20 bp, Artificial Sequence
  sgRNA
  Mme_15
tgactggtggacgcagcagt

SEQ ID NO: 32919 - DNA, 20 bp, Artificial Sequence
  sgRNA
  Mme_16
gcccccatagttcaatgagt

SEQ ID NO: 32920 - DNA, 20 bp, Artificial Sequence
  sgRNA
  Mme_17
ggtgtgctaactacgtcaat

SEQ ID NO: 32921 - DNA, 20 bp, Artificial Sequence
  sgRNA
  Mme_18
gcttctttagctgcttgctt

SEQ ID NO: 32922 - DNA, 20 bp, Artificial Sequence
  sgRNA
  Mme_19
tgctggagagagcaagcacg

SEQ ID NO: 32923 - DNA, 20 bp, Artificial Sequence
  sgRNA
  Mme_20
gattcatgtatgaattcttg

SEQ ID NO: 32924 - DNA, 20 bp, Artificial Sequence
  sgRNA
  Mmel1_1
gagaggacggttgtaaaacg

SEQ ID NO: 32925 - DNA, 20 bp, Artificial Sequence
  sgRNA
  Mmel1_2
tcattgatagctactcagca

SEQ ID NO: 32926 - DNA, 20 bp, Artificial Sequence
  sgRNA
  Mmel1_3
gataagtggaacgagaccat

SEQ ID NO: 32927 - DNA, 20 bp, Artificial Sequence
  sgRNA
  Mmel1_4
aacttctaccagtacgcttg

SEQ ID NO: 32928 - DNA, 20 bp, Artificial Sequence
  sgRNA
  Mmel1_5
ccgggagtactatttccagg

SEQ ID NO: 32929 - DNA, 20 bp, Artificial Sequence
  sgRNA
  Mmel1_6
tcgccagcgtacctcctcca

SEQ ID NO: 32930 - DNA, 20 bp, Artificial Sequence
  sgRNA
  Mmel1_7
ggcgcgtgtggactaccgca

SEQ ID NO: 32931 - DNA, 20 bp, Artificial Sequence
  sgRNA
  Mmel1_8
gtacggcacgaccgtggagg

SEQ ID NO: 32932 - DNA, 20 bp, Artificial Sequence
  sgRNA
  Mmel1_9
ggcgctgtacggcacgaccg

SEQ ID NO: 32933 - DNA, 20 bp, Artificial Sequence
  sgRNA
  Mmel1_10
gtaccaccgaatggacctga

SEQ ID NO: 32934 - DNA, 20 bp, Artificial Sequence
  sgRNA
  Mmel1_11
gccagcctccgcaagcgtac

SEQ ID NO: 32935 - DNA, 20 bp, Artificial Sequence
  sgRNA
  Mmel1_12
atgacgaccagaactccagc

SEQ ID NO: 32936 - DNA, 20 bp, Artificial Sequence
  sgRNA
  Mmel1_13
ggtctcgttccacttatcca

SEQ ID NO: 32937 - DNA, 20 bp, Artificial Sequence
  sgRNA
  Mmel1_14
tacgtagatgacatgccggc

SEQ ID NO: 32938 - DNA, 20 bp, Artificial Sequence
  sgRNA
  Mmel1_15
tggtccttgctgaagaaggg

SEQ ID NO: 32939 - DNA, 20 bp, Artificial Sequence
  sgRNA
  Mmel1_16
aggtgtggtgtgggtcctat

SEQ ID NO: 32940 - DNA, 20 bp, Artificial Sequence
  sgRNA
  Mmel1_17
ggataagtggaacgagacca

SEQ ID NO: 32941 - DNA, 20 bp, Artificial Sequence
  sgRNA
  Mmel1_18
cgccgtccagtccatcaaga

SEQ ID NO: 32942 - DNA, 20 bp, Artificial Sequence
  sgRNA
  Mmel1_19
ggaatccaagaagaaggccc

SEQ ID NO: 32943 - DNA, 20 bp, Artificial Sequence
  sgRNA
  Mmel1_20
tgagctgaactggatggacg

SEQ ID NO: 32944 - DNA, 20 bp, Artificial Sequence
  sgRNA
  Mmp14_1
ccatcaatactgcctacgag

SEQ ID NO: 32945 - DNA, 20 bp, Artificial Sequence
  sgRNA
  Mmp14_2
tgacgggaactttgacaccg

SEQ ID NO: 32946 - DNA, 20 bp, Artificial Sequence
  sgRNA
  Mmp14_3
agtgccctatgcctacatcc

SEQ ID NO: 32947 - DNA, 20 bp, Artificial Sequence
  sgRNA
  Mmp14_4
ttgcctgatgacgatcgccg

SEQ ID NO: 32948 - DNA, 20 bp, Artificial Sequence
  sgRNA
  Mmp14_5
ggagcagcagtagtaccggc

SEQ ID NO: 32949 - DNA, 20 bp, Artificial Sequence
  sgRNA
  Mmp14_6
gctgcatcgatcttgtccgt

SEQ ID NO: 32950 - DNA, 20 bp, Artificial Sequence
  sgRNA
  Mmp14_7
aaccctccttcaccatcaaa

SEQ ID NO: 32951 - DNA, 20 bp, Artificial Sequence
  sgRNA
  Mmp14_8
gccctatgcctacatccggg

SEQ ID NO: 32952 - DNA, 20 bp, Artificial Sequence
  sgRNA
  Mmp14_9
tactcggaaggccttccgaa

SEQ ID NO: 32953 - DNA, 20 bp, Artificial Sequence
  sgRNA
  Mmp14_10
tatccggaacaccacagcga

SEQ ID NO: 32954 - DNA, 20 bp, Artificial Sequence
  sgRNA
  Mmp14_11
atgccacattcgaggccatt

SEQ ID NO: 32955 - DNA, 20 bp, Artificial Sequence
  sgRNA
  Mmp14_12
gggctcggcagaatcaaagt

SEQ ID NO: 32956 - DNA, 20 bp, Artificial Sequence
  sgRNA
  Mmp14_13
agtgcggtttccccatcacg

SEQ ID NO: 32957 - DNA, 20 bp, Artificial Sequence
  sgRNA
  Mmp14_14
gtatggctacctacctccag

SEQ ID NO: 32958 - DNA, 20 bp, Artificial Sequence
  sgRNA
  Mmp14_15
cctctcgtaggcagtattga

SEQ ID NO: 32959 - DNA, 20 bp, Artificial Sequence
  sgRNA
  Mmp14_16
tcttcttcttcagacgccat

SEQ ID NO: 32960 - DNA, 20 bp, Artificial Sequence
  sgRNA
  Mmp14_17
atagcgcttcctccgaacat

SEQ ID NO: 32961 - DNA, 20 bp, Artificial Sequence
  sgRNA
  Mmp14_18
tggcatactcgcccacctta

SEQ ID NO: 32962 - DNA, 20 bp, Artificial Sequence
  sgRNA
  Mmp14_19
ttatccggaacaccacagcg

SEQ ID NO: 32963 - DNA, 20 bp, Artificial Sequence
  sgRNA
  Mmp14_20
ggcactctcccatactcgga

SEQ ID NO: 32964 - DNA, 20 bp, Artificial Sequence
  sgRNA
  Mmp16_1
ttccatgtactgataaaatg

SEQ ID NO: 32965 - DNA, 20 bp, Artificial Sequence
  sgRNA
  Mmp16_2
ggagcagtatttcaatgtgg

SEQ ID NO: 32966 - DNA, 20 bp, Artificial Sequence
  sgRNA
  Mmp16_3
atgacaggcccaaacctcct

SEQ ID NO: 32967 - DNA, 20 bp, Artificial Sequence
  sgRNA
  Mmp16_4
ggtgtaccagaccagacaag

SEQ ID NO: 32968 - DNA, 20 bp, Artificial Sequence
  sgRNA
  Mmp16_5
ggtctgctggaggaacagat

SEQ ID NO: 32969 - DNA, 20 bp, Artificial Sequence
  sgRNA
  Mmp16_6
aatgccatagaactgctgca

SEQ ID NO: 32970 - DNA, 20 bp, Artificial Sequence
  sgRNA
  Mmp16_7
ttacagtacagtatgtggcg

SEQ ID NO: 32971 - DNA, 20 bp, Artificial Sequence
  sgRNA
  Mmp16_8
tattgattctgccatatggt

SEQ ID NO: 32972 - DNA, 20 bp, Artificial Sequence
  sgRNA
  Mmp16_9
ttgtggacgaaagctccctg

SEQ ID NO: 32973 - DNA, 20 bp, Artificial Sequence
  sgRNA
  Mmp16_10
tggctcatcagaatcaaaat

SEQ ID NO: 32974 - DNA, 20 bp, Artificial Sequence
  sgRNA
  Mmp16_11
ggaggaacagatcggtgcgg

SEQ ID NO: 32975 - DNA, 20 bp, Artificial Sequence
  sgRNA
  Mmp16_12
cagtgtaaaccaatacaagg

SEQ ID NO: 32976 - DNA, 20 bp, Artificial Sequence
  sgRNA
  Mmp16_13
gggatccctgaatcacctca

SEQ ID NO: 32977 - DNA, 20 bp, Artificial Sequence
  sgRNA
  Mmp16_14
ttggcgagtgagaaacaaca

SEQ ID NO: 32978 - DNA, 20 bp, Artificial Sequence
  sgRNA
  Mmp16_15
caatgtctacatcatctggt

SEQ ID NO: 32979 - DNA, 20 bp, Artificial Sequence
  sgRNA
  Mmp16_16
cactctagctattcttcgaa

SEQ ID NO: 32980 - DNA, 20 bp, Artificial Sequence
  sgRNA
  Mmp16_17
tgatgggcttggggtaacca

SEQ ID NO: 32981 - DNA, 20 bp, Artificial Sequence
  sgRNA
  Mmp16_18
gtagaggtcttgtaggtgga

SEQ ID NO: 32982 - DNA, 20 bp, Artificial Sequence
  sgRNA
  Mmp16_19
gctggaggaacagatcggtg

SEQ ID NO: 32983 - DNA, 20 bp, Artificial Sequence
  sgRNA
  Mmp16_20
gtaaacgctctatgcaagag

SEQ ID NO: 32984 - DNA, 20 bp, Artificial Sequence
  sgRNA
  Mmp17_1
atcatgcaaccgtactacca

SEQ ID NO: 32985 - DNA, 20 bp, Artificial Sequence
  sgRNA
  Mmp17_2
gctgcagcgacaccaagtgt

SEQ ID NO: 32986 - DNA, 20 bp, Artificial Sequence
  sgRNA
  Mmp17_3
gtgctagaccgattgttggg

SEQ ID NO: 32987 - DNA, 20 bp, Artificial Sequence
  sgRNA
  Mmp17_4
aggctgaggtcctccgcgcg

SEQ ID NO: 32988 - DNA, 20 bp, Artificial Sequence
  sgRNA
  Mmp17_5
actttgatgacgatgagcca

SEQ ID NO: 32989 - DNA, 20 bp, Artificial Sequence
  sgRNA
  Mmp17_6
tgtagactgtgggtacccgg

SEQ ID NO: 32990 - DNA, 20 bp, Artificial Sequence
  sgRNA
  Mmp17_7
gtgccaccagggccatcgaa

SEQ ID NO: 32991 - DNA, 20 bp, Artificial Sequence
  sgRNA
  Mmp17_8
gtttaaggacaacaacgtag

SEQ ID NO: 32992 - DNA, 20 bp, Artificial Sequence
  sgRNA
  Mmp17_9
cacacccttgaacttccacg

SEQ ID NO: 32993 - DNA, 20 bp, Artificial Sequence
  sgRNA
  Mmp17_10
gctacctcgtggaagttcaa

SEQ ID NO: 32994 - DNA, 20 bp, Artificial Sequence
  sgRNA
  Mmp17_11
accgtactaccagggccccg

SEQ ID NO: 32995 - DNA, 20 bp, Artificial Sequence
  sgRNA
  Mmp17_12
tccacactgtccaggtgcag

SEQ ID NO: 32996 - DNA, 20 bp, Artificial Sequence
  sgRNA
  Mmp17_13
ggtgcatcctatttcttccg

SEQ ID NO: 32997 - DNA, 20 bp, Artificial Sequence
  sgRNA
  Mmp17_14
aggacaacaacgtagaggaa

SEQ ID NO: 32998 - DNA, 20 bp, Artificial Sequence
  sgRNA
  Mmp17_15
tggtgaccaccacacggcag

SEQ ID NO: 32999 - DNA, 20 bp, Artificial Sequence
  sgRNA
  Mmp17_16
atagcgtagcgggtcaccca

SEQ ID NO: 33000 - DNA, 20 bp, Artificial Sequence
  sgRNA
  Mmp17_17
agcgtagcgggtcacccacg

SEQ ID NO: 33001 - DNA, 20 bp, Artificial Sequence
  sgRNA
  Mmp17_18
ctgcaaacaggtccatcccg

SEQ ID NO: 33002 - DNA, 20 bp, Artificial Sequence
  sgRNA
  Mmp17_19
tagggaagtccatagcgtag

SEQ ID NO: 33003 - DNA, 20 bp, Artificial Sequence
  sgRNA
  Mmp17_20
ccgcgttgcccgctacctcg

SEQ ID NO: 33004 - DNA, 20 bp, Artificial Sequence
  sgRNA
  Mmp25_1
agaaacgcaccctgacatgg

SEQ ID NO: 33005 - DNA, 20 bp, Artificial Sequence
  sgRNA
  Mmp25_2
atcaggccttacattccagg

SEQ ID NO: 33006 - DNA, 20 bp, Artificial Sequence
  sgRNA
  Mmp25_3
cgttcagcttggacggaccg

SEQ ID NO: 33007 - DNA, 20 bp, Artificial Sequence
  sgRNA
  Mmp25_4
ctgagactggacaaatgggt

SEQ ID NO: 33008 - DNA, 20 bp, Artificial Sequence
  sgRNA
  Mmp25_5
tgccgttgccaacattcgag

SEQ ID NO: 33009 - DNA, 20 bp, Artificial Sequence
  sgRNA
  Mmp25_6
cctcctccagacttccacgg

SEQ ID NO: 33010 - DNA, 20 bp, Artificial Sequence
  sgRNA
  Mmp25_7
ctatggctacctgccaccgg

SEQ ID NO: 33011 - DNA, 20 bp, Artificial Sequence
  sgRNA
  Mmp25_8
ggcaagacatacctgatccg

SEQ ID NO: 33012 - DNA, 20 bp, Artificial Sequence
  sgRNA
  Mmp25_9
atgccgttgccaacattcga

SEQ ID NO: 33013 - DNA, 20 bp, Artificial Sequence
  sgRNA
  Mmp25_10
ggagggtccgaacaatctgc

SEQ ID NO: 33014 - DNA, 20 bp, Artificial Sequence
  sgRNA
  Mmp25_11
catcaaagttgccctcacag

SEQ ID NO: 33015 - DNA, 20 bp, Artificial Sequence
  sgRNA
  Mmp25_12
gcatccacgtcttctcctgg

SEQ ID NO: 33016 - DNA, 20 bp, Artificial Sequence
  sgRNA
  Mmp25_13
gcccttctaccagggcccgg

SEQ ID NO: 33017 - DNA, 20 bp, Artificial Sequence
  sgRNA
  Mmp25_14
gaaggtcgtgagcatgggcg

SEQ ID NO: 33018 - DNA, 20 bp, Artificial Sequence
  sgRNA
  Mmp25_15
ctttgctcgggcctaccacc

SEQ ID NO: 33019 - DNA, 20 bp, Artificial Sequence
  sgRNA
  Mmp25_16
gtactggcggtatgacgagg

SEQ ID NO: 33020 - DNA, 20 bp, Artificial Sequence
  sgRNA
  Mmp25_17
agtgcgtgtctccagagata

SEQ ID NO: 33021 - DNA, 20 bp, Artificial Sequence
  sgRNA
  Mmp25_18
gacagcttgagggtgcagcg

SEQ ID NO: 33022 - DNA, 20 bp, Artificial Sequence
  sgRNA
  Mmp25_19
tgccaccagacccgtcaaag

SEQ ID NO: 33023 - DNA, 20 bp, Artificial Sequence
  sgRNA
  Mmp25_20
tgccacataccgtttgcccc

SEQ ID NO: 33024 - DNA, 20 bp, Artificial Sequence
  sgRNA
  Mog_1
cgatgagagtcagcacaccg

SEQ ID NO: 33025 - DNA, 20 bp, Artificial Sequence
  sgRNA
  Mog_2
aattcagagtgataggacca

SEQ ID NO: 33026 - DNA, 20 bp, Artificial Sequence
  sgRNA
  Mog_3
tcacctctaccgaaatggca

SEQ ID NO: 33027 - DNA, 20 bp, Artificial Sequence
  sgRNA
  Mog_4
tctcacgttctgaatcctaa

SEQ ID NO: 33028 - DNA, 20 bp, Artificial Sequence
  sgRNA
  Mog_5
gagcaagcacctgaataccg

SEQ ID NO: 33029 - DNA, 20 bp, Artificial Sequence
  sgRNA
  Mog_6
cttcatccccaactaaagcc

SEQ ID NO: 33030 - DNA, 20 bp, Artificial Sequence
  sgRNA
  Mog_7
ggtccttgccatttcggtag

SEQ ID NO: 33031 - DNA, 20 bp, Artificial Sequence
  sgRNA
  Mog_8
catagctgcatgacaactgg

SEQ ID NO: 33032 - DNA, 20 bp, Artificial Sequence
  sgRNA
  Mog_9
ccggggttgacccaatagaa

SEQ ID NO: 33033 - DNA, 20 bp, Artificial Sequence
  sgRNA
  Mog_10
ttcccaggagagatgcggca

SEQ ID NO: 33034 - DNA, 20 bp, Artificial Sequence
  sgRNA
  Mog_11
tgtgcctacgatcctcctgc

SEQ ID NO: 33035 - DNA, 20 bp, Artificial Sequence
  sgRNA
  Mog_12
tctgaaagagactatcagtg

SEQ ID NO: 33036 - DNA, 20 bp, Artificial Sequence
  sgRNA
  Mog_13
aggtgaaccactcttgagaa

SEQ ID NO: 33037 - DNA, 20 bp, Artificial Sequence
  sgRNA
  Mog_14
gcagatgatcaaggcaacca

SEQ ID NO: 33038 - DNA, 20 bp, Artificial Sequence
  sgRNA
  Mog_15
gctgcaggaagaggaataca

SEQ ID NO: 33039 - DNA, 20 bp, Artificial Sequence
  sgRNA
  Mog_16
aatgccacgggcatggaggt

SEQ ID NO: 33040 - DNA, 20 bp, Artificial Sequence
  sgRNA
  Mog_17
agaccactcttaccaagaag

SEQ ID NO: 33041 - DNA, 20 bp, Artificial Sequence
  sgRNA
  Mog_18
ggcagcaatggagttgaaag

SEQ ID NO: 33042 - DNA, 20 bp, Artificial Sequence
  sgRNA
  Mog_19
ccttgatcatctgctacaac

SEQ ID NO: 33043 - DNA, 20 bp, Artificial Sequence
  sgRNA
  Mog_20
gtgagattctcagatgaagg

SEQ ID NO: 33044 - DNA, 20 bp, Artificial Sequence
  sgRNA
  Mpeg1_1
gaatagtatacacttcatcg

SEQ ID NO: 33045 - DNA, 20 bp, Artificial Sequence
  sgRNA
  Mpeg1_2
ttcctgataaactccaccaa

SEQ ID NO: 33046 - DNA, 20 bp, Artificial Sequence
  sgRNA
  Mpeg1_3
tggttcaggaggatcacgta

SEQ ID NO: 33047 - DNA, 20 bp, Artificial Sequence
  sgRNA
  Mpeg1_4
gctcagcttggggtttacga

SEQ ID NO: 33048 - DNA, 20 bp, Artificial Sequence
  sgRNA
  Mpeg1_5
acaccgtgaccgcttctgca

SEQ ID NO: 33049 - DNA, 20 bp, Artificial Sequence
  sgRNA
  Mpeg1_6
gtcgaacaggaccaactcca

SEQ ID NO: 33050 - DNA, 20 bp, Artificial Sequence
  sgRNA
  Mpeg1_7
tgtcttgcagaaaatcttga

SEQ ID NO: 33051 - DNA, 20 bp, Artificial Sequence
  sgRNA
  Mpeg1_8
aggatcctcagaccaaccag

SEQ ID NO: 33052 - DNA, 20 bp, Artificial Sequence
  sgRNA
  Mpeg1_9
gaaccccaactcataatcca

SEQ ID NO: 33053 - DNA, 20 bp, Artificial Sequence
  sgRNA
  Mpeg1_10
agaacctctggagcttcgta

SEQ ID NO: 33054 - DNA, 20 bp, Artificial Sequence
  sgRNA
  Mpeg1_11
gtggtacccgtttctccaag

SEQ ID NO: 33055 - DNA, 20 bp, Artificial Sequence
  sgRNA
  Mpeg1_12
ccgagtaccatagatggcca

SEQ ID NO: 33056 - DNA, 20 bp, Artificial Sequence
  sgRNA
  Mpeg1_13
gctgtatcagaattaaccaa

SEQ ID NO: 33057 - DNA, 20 bp, Artificial Sequence
  sgRNA
  Mpeg1_14
gggcatcactaaccacctag

SEQ ID NO: 33058 - DNA, 20 bp, Artificial Sequence
  sgRNA
  Mpeg1_15
atctctgaaaaagtgtcccg

SEQ ID NO: 33059 - DNA, 20 bp, Artificial Sequence
  sgRNA
  Mpeg1_16
ataagccctaaattcagcct

SEQ ID NO: 33060 - DNA, 20 bp, Artificial Sequence
  sgRNA
  Mpeg1_17
tctctgaaaaagtgtcccgg

SEQ ID NO: 33061 - DNA, 20 bp, Artificial Sequence
  sgRNA
  Mpeg1_18
ggaccaagctgtgactacca

SEQ ID NO: 33062 - DNA, 20 bp, Artificial Sequence
  sgRNA
  Mpeg1_19
ggtttaatgaagaaatgcag

SEQ ID NO: 33063 - DNA, 20 bp, Artificial Sequence
  sgRNA
  Mpeg1_20
gtggcaacctggctcataag

SEQ ID NO: 33064 - DNA, 20 bp, Artificial Sequence
  sgRNA
  Mpl_1
gctgtcggatgaacacacgg

SEQ ID NO: 33065 - DNA, 20 bp, Artificial Sequence
  sgRNA
  Mpl_2
ggaacttcagatccactggg

SEQ ID NO: 33066 - DNA, 20 bp, Artificial Sequence
  sgRNA
  Mpl_3
gtgaacggcaccttgcgctg

SEQ ID NO: 33067 - DNA, 20 bp, Artificial Sequence
  sgRNA
  Mpl_4
gctacgcagccaacccgacg

SEQ ID NO: 33068 - DNA, 20 bp, Artificial Sequence
  sgRNA
  Mpl_5
gcaagctgtagcgagctcgg

SEQ ID NO: 33069 - DNA, 20 bp, Artificial Sequence
  sgRNA
  Mpl_6
gggacacattcttcacccag

SEQ ID NO: 33070 - DNA, 20 bp, Artificial Sequence
  sgRNA
  Mpl_7
cagctacgcagccaacccga

SEQ ID NO: 33071 - DNA, 20 bp, Artificial Sequence
  sgRNA
  Mpl_8
ttcacagctatcggtaaccg

SEQ ID NO: 33072 - DNA, 20 bp, Artificial Sequence
  sgRNA
  Mpl_9
gcgggctgtgatcctggacg

SEQ ID NO: 33073 - DNA, 20 bp, Artificial Sequence
  sgRNA
  Mpl_10
ccgacagcatcccaaccgca

SEQ ID NO: 33074 - DNA, 20 bp, Artificial Sequence
  sgRNA
  Mpl_11
gtagaggtgaccacagcgca

SEQ ID NO: 33075 - DNA, 20 bp, Artificial Sequence
  sgRNA
  Mpl_12
ggttcggcatccacaaagtg

SEQ ID NO: 33076 - DNA, 20 bp, Artificial Sequence
  sgRNA
  Mpl_13
gagagcagctgaatgacgga

SEQ ID NO: 33077 - DNA, 20 bp, Artificial Sequence
  sgRNA
  Mpl_14
tgaactccgctatggcccca

SEQ ID NO: 33078 - DNA, 20 bp, Artificial Sequence
  sgRNA
  Mpl_15
agcctggtggatccaaaaag

SEQ ID NO: 33079 - DNA, 20 bp, Artificial Sequence
  sgRNA
  Mpl_16
gcacacataccgggttccaa

SEQ ID NO: 33080 - DNA, 20 bp, Artificial Sequence
  sgRNA
  Mpl_17
cagctgctgtatgcctaccg

SEQ ID NO: 33081 - DNA, 20 bp, Artificial Sequence
  sgRNA
  Mpl_18
gctgtggcggaagaagcctt

SEQ ID NO: 33082 - DNA, 20 bp, Artificial Sequence
  sgRNA
  Mpl_19
gggtccccaggagccacgaa

SEQ ID NO: 33083 - DNA, 20 bp, Artificial Sequence
  sgRNA
  Mpl_20
gcacccgctggatcaaagtc

SEQ ID NO: 33084 - DNA, 20 bp, Artificial Sequence
  sgRNA
  Mpz_1
gggacaaccttacatcgatg

SEQ ID NO: 33085 - DNA, 20 bp, Artificial Sequence
  sgRNA
  Mpz_2
aaaaacccaccggacatagt

SEQ ID NO: 33086 - DNA, 20 bp, Artificial Sequence
  sgRNA
  Mpz_3
cattgtggtttacacggaca

SEQ ID NO: 33087 - DNA, 20 bp, Artificial Sequence
  sgRNA
  Mpz_4
caacaccaccccatacctag

SEQ ID NO: 33088 - DNA, 20 bp, Artificial Sequence
  sgRNA
  Mpz_5
tcttgcccactatgtccggt

SEQ ID NO: 33089 - DNA, 20 bp, Artificial Sequence
  sgRNA
  Mpz_6
cttcaaagagcgcatccagt

SEQ ID NO: 33090 - DNA, 20 bp, Artificial Sequence
  sgRNA
  Mpz_7
tcgaaggactcctcgaagcg

SEQ ID NO: 33091 - DNA, 20 bp, Artificial Sequence
  sgRNA
  Mpz_8
cgaaggactcctcgaagcga

SEQ ID NO: 33092 - DNA, 20 bp, Artificial Sequence
  sgRNA
  Mpz_9
cctgtccgtgtaaaccacaa

SEQ ID NO: 33093 - DNA, 20 bp, Artificial Sequence
  sgRNA
  Mpz_10
gcagcaacagcaccaccccg

SEQ ID NO: 33094 - DNA, 20 bp, Artificial Sequence
  sgRNA
  Mpz_11
atggagccatccttccagcg

SEQ ID NO: 33095 - DNA, 20 bp, Artificial Sequence
  sgRNA
  Mpz_12
cgtgtaaaccacaatggcca

SEQ ID NO: 33096 - DNA, 20 bp, Artificial Sequence
  sgRNA
  Mpz_13
gtgttgggagcagtgatcgg

SEQ ID NO: 33097 - DNA, 20 bp, Artificial Sequence
  sgRNA
  Mpz_14
gacccattcactggaccaga

SEQ ID NO: 33098 - DNA, 20 bp, Artificial Sequence
  sgRNA
  Mpz_15
tggcgctaccagcctgaagg

SEQ ID NO: 33099 - DNA, 20 bp, Artificial Sequence
  sgRNA
  Mpz_16
aggactcctcgaagcgaggg

SEQ ID NO: 33100 - DNA, 20 bp, Artificial Sequence
  sgRNA
  Mpz_17
tggagccatccttccagcga

SEQ ID NO: 33101 - DNA, 20 bp, Artificial Sequence
  sgRNA
  Mpz_18
gagatttcacaaatcttcga

SEQ ID NO: 33102 - DNA, 20 bp, Artificial Sequence
  sgRNA
  Mpz_19
gtgaaatctccccttctcca

SEQ ID NO: 33103 - DNA, 20 bp, Artificial Sequence
  sgRNA
  Mpz_20
ggaccagaaggagcagtgca

SEQ ID NO: 33104 - DNA, 20 bp, Artificial Sequence
  sgRNA
  Mpzl1_1
ggatgcggtccttaccgaca

SEQ ID NO: 33105 - DNA, 20 bp, Artificial Sequence
  sgRNA
  Mpzl1_2
tggacacattaggctccacg

SEQ ID NO: 33106 - DNA, 20 bp, Artificial Sequence
  sgRNA
  Mpzl1_3
cacaactggatggttgacca

SEQ ID NO: 33107 - DNA, 20 bp, Artificial Sequence
  sgRNA
  Mpzl1_4
gtgactcggtctttaaatgg

SEQ ID NO: 33108 - DNA, 20 bp, Artificial Sequence
  sgRNA
  Mpzl1_5
actagaccctctgtgtcgga

SEQ ID NO: 33109 - DNA, 20 bp, Artificial Sequence
  sgRNA
  Mpzl1_6
gtaaagagtccgccttccgc

SEQ ID NO: 33110 - DNA, 20 bp, Artificial Sequence
  sgRNA
  Mpzl1_7
ggccgcacaacaatgtcagg

SEQ ID NO: 33111 - DNA, 20 bp, Artificial Sequence
  sgRNA
  Mpzl1_8
gcgtttgtcaccagttaagc

SEQ ID NO: 33112 - DNA, 20 bp, Artificial Sequence
  sgRNA
  Mpzl1_9
ttgtggtgaatgggacacaa

SEQ ID NO: 33113 - DNA, 20 bp, Artificial Sequence
  sgRNA
  Mpzl1_10
cactctggcggacaccacag

SEQ ID NO: 33114 - DNA, 20 bp, Artificial Sequence
  sgRNA
  Mpzl1_11
gtgcgtaaatgactgggccc

SEQ ID NO: 33115 - DNA, 20 bp, Artificial Sequence
  sgRNA
  Mpzl1_12
ggtcatgacctcttgagtgg

SEQ ID NO: 33116 - DNA, 20 bp, Artificial Sequence
  sgRNA
  Mpzl1_13
atttaaagaccgagtcacct

SEQ ID NO: 33117 - DNA, 20 bp, Artificial Sequence
  sgRNA
  Mpzl1_14
attctcctaacacaactgga

SEQ ID NO: 33118 - DNA, 20 bp, Artificial Sequence
  sgRNA
  Mpzl1_15
aagtgtccctccgacacaga

SEQ ID NO: 33119 - DNA, 20 bp, Artificial Sequence
  sgRNA
  Mpzl1_16
cccaaaccaggaacaccaac

SEQ ID NO: 33120 - DNA, 20 bp, Artificial Sequence
  sgRNA
  Mpzl1_17
gaagtgtccctccgacacag

SEQ ID NO: 33121 - DNA, 20 bp, Artificial Sequence
  sgRNA
  Mpzl1_18
acagaaggaaacattcgaag

SEQ ID NO: 33122 - DNA, 20 bp, Artificial Sequence
  sgRNA
  Mpzl1_19
acacctgtccttgtgagtag

SEQ ID NO: 33123 - DNA, 20 bp, Artificial Sequence
  sgRNA
  Mpzl1_20
tcctggtcgtcctctacaga

SEQ ID NO: 33124 - DNA, 20 bp, Artificial Sequence
  sgRNA
  Mpzl2_1
tgtggaaatttacacctccg

SEQ ID NO: 33125 - DNA, 20 bp, Artificial Sequence
  sgRNA
  Mpzl2_2
agttagcgcatctcccacag

SEQ ID NO: 33126 - DNA, 20 bp, Artificial Sequence
  sgRNA
  Mpzl2_3
aatttccgacctcgagatgg

SEQ ID NO: 33127 - DNA, 20 bp, Artificial Sequence
  sgRNA
  Mpzl2_4
cggacggttcaaagaccggg

SEQ ID NO: 33128 - DNA, 20 bp, Artificial Sequence
  sgRNA
  Mpzl2_5
gcacttccggaaaaagcgat

SEQ ID NO: 33129 - DNA, 20 bp, Artificial Sequence
  sgRNA
  Mpzl2_6
acagtgctgataaagccgag

SEQ ID NO: 33130 - DNA, 20 bp, Artificial Sequence
  sgRNA
  Mpzl2_7
cagttagcgcatctcccaca

SEQ ID NO: 33131 - DNA, 20 bp, Artificial Sequence
  sgRNA
  Mpzl2_8
gaagtggaagcacaagcgcg

SEQ ID NO: 33132 - DNA, 20 bp, Artificial Sequence
  sgRNA
  Mpzl2_9
ggaatttccgacctcgagat

SEQ ID NO: 33133 - DNA, 20 bp, Artificial Sequence
  sgRNA
  Mpzl2_10
agcacttccggaaaaagcga

SEQ ID NO: 33134 - DNA, 20 bp, Artificial Sequence
  sgRNA
  Mpzl2_11
ggacagtgctgataaagccg

SEQ ID NO: 33135 - DNA, 20 bp, Artificial Sequence
  sgRNA
  Mpzl2_12
ccaaggctaggacgagcagg

SEQ ID NO: 33136 - DNA, 20 bp, Artificial Sequence
  sgRNA
  Mpzl2_13
gagatgcgctaactgtgacg

SEQ ID NO: 33137 - DNA, 20 bp, Artificial Sequence
  sgRNA
  Mpzl2_14
gatggagacgtcatatcgct

SEQ ID NO: 33138 - DNA, 20 bp, Artificial Sequence
  sgRNA
  Mpzl2_15
cttccggaaaaagcgatggg

SEQ ID NO: 33139 - DNA, 20 bp, Artificial Sequence
  sgRNA
  Mpzl2_16
accagaccatcaacatcagg

SEQ ID NO: 33140 - DNA, 20 bp, Artificial Sequence
  sgRNA
  Mpzl2_17
gacagtgctgataaagccga

SEQ ID NO: 33141 - DNA, 20 bp, Artificial Sequence
  sgRNA
  Mpzl2_18
gatgatcatcgtagtgatcg

SEQ ID NO: 33142 - DNA, 20 bp, Artificial Sequence
  sgRNA
  Mpzl2_19
gctcgtcctagccttggcct

SEQ ID NO: 33143 - DNA, 20 bp, Artificial Sequence
  sgRNA
  Mpzl2_20
tggagacgtcatatcgctcg

SEQ ID NO: 33144 - DNA, 20 bp, Artificial Sequence
  sgRNA
  Mpzl3_1
ggccggaaatgtctacaaag

SEQ ID NO: 33145 - DNA, 20 bp, Artificial Sequence
  sgRNA
  Mpzl3_2
gtgaccgtgagctctgttag

SEQ ID NO: 33146 - DNA, 20 bp, Artificial Sequence
  sgRNA
  Mpzl3_3
agcatcggcacttatctcca

SEQ ID NO: 33147 - DNA, 20 bp, Artificial Sequence
  sgRNA
  Mpzl3_4
tttccagtacccgaccacag

SEQ ID NO: 33148 - DNA, 20 bp, Artificial Sequence
  sgRNA
  Mpzl3_5
tattgtggtacacgtctgga

SEQ ID NO: 33149 - DNA, 20 bp, Artificial Sequence
  sgRNA
  Mpzl3_6
gaatgaccaccactgctgag

SEQ ID NO: 33150 - DNA, 20 bp, Artificial Sequence
  sgRNA
  Mpzl3_7
agaggaacagtaggaggccg

SEQ ID NO: 33151 - DNA, 20 bp, Artificial Sequence
  sgRNA
  Mpzl3_8
ctgagcatcctagtcgtcca

SEQ ID NO: 33152 - DNA, 20 bp, Artificial Sequence
  sgRNA
  Mpzl3_9
gggccggaaatgtctacaaa

SEQ ID NO: 33153 - DNA, 20 bp, Artificial Sequence
  sgRNA
  Mpzl3_10
gtggaaagagagcgcagcca

SEQ ID NO: 33154 - DNA, 20 bp, Artificial Sequence
  sgRNA
  Mpzl3_11
acagcaatgactgcatgacg

SEQ ID NO: 33155 - DNA, 20 bp, Artificial Sequence
  sgRNA
  Mpzl3_12
atagcctcggacgtgagcat

SEQ ID NO: 33156 - DNA, 20 bp, Artificial Sequence
  sgRNA
  Mpzl3_13
accccactctaaaggacaat

SEQ ID NO: 33157 - DNA, 20 bp, Artificial Sequence
  sgRNA
  Mpzl3_14
attccgagaccggatctcct

SEQ ID NO: 33158 - DNA, 20 bp, Artificial Sequence
  sgRNA
  Mpzl3_15
tcttctctcccacatagcct

SEQ ID NO: 33159 - DNA, 20 bp, Artificial Sequence
  sgRNA
  Mpzl3_16
ctgctgaggggacgaagacg

SEQ ID NO: 33160 - DNA, 20 bp, Artificial Sequence
  sgRNA
  Mpzl3_17
gagctcacggtcacagaaag

SEQ ID NO: 33161 - DNA, 20 bp, Artificial Sequence
  sgRNA
  Mpzl3_18
attctgctgctggtgcgaat

SEQ ID NO: 33162 - DNA, 20 bp, Artificial Sequence
  sgRNA
  Mpzl3_19
tgtgaccgtgagctctgtta

SEQ ID NO: 33163 - DNA, 20 bp, Artificial Sequence
  sgRNA
  Mpzl3_20
tatccccctaacagagctca

SEQ ID NO: 33164 - DNA, 20 bp, Artificial Sequence
  sgRNA
  Mr1_1
acgaaaatatctcagcgagt

SEQ ID NO: 33165 - DNA, 20 bp, Artificial Sequence
  sgRNA
  Mr1_2
aggtacactcagctgctaag

SEQ ID NO: 33166 - DNA, 20 bp, Artificial Sequence
  sgRNA
  Mr1_3
agtggtaagaacaactcgaa

SEQ ID NO: 33167 - DNA, 20 bp, Artificial Sequence
  sgRNA
  Mr1_4
cgacagtgtcactcgacaga

SEQ ID NO: 33168 - DNA, 20 bp, Artificial Sequence
  sgRNA
  Mr1_5
ggagcactgtggtcgccaaa

SEQ ID NO: 33169 - DNA, 20 bp, Artificial Sequence
  sgRNA
  Mr1_6
gggatggaacctatcaaacg

SEQ ID NO: 33170 - DNA, 20 bp, Artificial Sequence
  sgRNA
  Mr1_7
ccaagaagtggattacggag

SEQ ID NO: 33171 - DNA, 20 bp, Artificial Sequence
  sgRNA
  Mr1_8
ctggcagcagacattcaagg

SEQ ID NO: 33172 - DNA, 20 bp, Artificial Sequence
  sgRNA
  Mr1_9
cccaagaagtggattacgga

SEQ ID NO: 33173 - DNA, 20 bp, Artificial Sequence
  sgRNA
  Mr1_10
gtattgcaactcatgcaggt

SEQ ID NO: 33174 - DNA, 20 bp, Artificial Sequence
  sgRNA
  Mr1_11
cagagatcgtgctcactcga

SEQ ID NO: 33175 - DNA, 20 bp, Artificial Sequence
  sgRNA
  Mr1_12
cggaggggtacttcccagcg

SEQ ID NO: 33176 - DNA, 20 bp, Artificial Sequence
  sgRNA
  Mr1_13
catgtcatggaaatttctgg

SEQ ID NO: 33177 - DNA, 20 bp, Artificial Sequence
  sgRNA
  Mr1_14
agagcttccctcattcactt

SEQ ID NO: 33178 - DNA, 20 bp, Artificial Sequence
  sgRNA
  Mr1_15
ggctgtgagttgctagaaga

SEQ ID NO: 33179 - DNA, 20 bp, Artificial Sequence
  sgRNA
  Mr1_16
tgcatactggagaaaccctg

SEQ ID NO: 33180 - DNA, 20 bp, Artificial Sequence
  sgRNA
  Mr1_17
accaagaatacagcgagcag

SEQ ID NO: 33181 - DNA, 20 bp, Artificial Sequence
  sgRNA
  Mr1_18
gatgtgagccacataatcca

SEQ ID NO: 33182 - DNA, 20 bp, Artificial Sequence
  sgRNA
  Mr1_19
gcaataccaaaagaactggc

SEQ ID NO: 33183 - DNA, 20 bp, Artificial Sequence
  sgRNA
  Mr1_20
actcacagccaatcattctc

SEQ ID NO: 33184 - DNA, 20 bp, Artificial Sequence
  sgRNA
  Mrc1_1
ttctggaatgacatcaactg

SEQ ID NO: 33185 - DNA, 20 bp, Artificial Sequence
  sgRNA
  Mrc1_2
tctcgagcacaggtcatccg

SEQ ID NO: 33186 - DNA, 20 bp, Artificial Sequence
  sgRNA
  Mrc1_3
agccatgctgtagtaccgga

SEQ ID NO: 33187 - DNA, 20 bp, Artificial Sequence
  sgRNA
  Mrc1_4
tttctcaccatatccgagct

SEQ ID NO: 33188 - DNA, 20 bp, Artificial Sequence
  sgRNA
  Mrc1_5
tgaatcccagaaattccgct

SEQ ID NO: 33189 - DNA, 20 bp, Artificial Sequence
  sgRNA
  Mrc1_6
tgaagatcacaagcgctgcg

SEQ ID NO: 33190 - DNA, 20 bp, Artificial Sequence
  sgRNA
  Mrc1_7
cggcacctatcacaatcagg

SEQ ID NO: 33191 - DNA, 20 bp, Artificial Sequence
  sgRNA
  Mrc1_8
cctacagtaatgcatttgca

SEQ ID NO: 33192 - DNA, 20 bp, Artificial Sequence
  sgRNA
  Mrc1_9
ccactgctacaggatccata

SEQ ID NO: 33193 - DNA, 20 bp, Artificial Sequence
  sgRNA
  Mrc1_10
actaggttacatctgtaaga

SEQ ID NO: 33194 - DNA, 20 bp, Artificial Sequence
  sgRNA
  Mrc1_11
gattggtggcaattcacgag

SEQ ID NO: 33195 - DNA, 20 bp, Artificial Sequence
  sgRNA
  Mrc1_12
aaaaaagctggcaagacgca

SEQ ID NO: 33196 - DNA, 20 bp, Artificial Sequence
  sgRNA
  Mrc1_13
ctaccggctgccctaatcag

SEQ ID NO: 33197 - DNA, 20 bp, Artificial Sequence
  sgRNA
  Mrc1_14
ggatctccgtgacactcagg

SEQ ID NO: 33198 - DNA, 20 bp, Artificial Sequence
  sgRNA
  Mrc1_15
agtgacacgaaagatctcat

SEQ ID NO: 33199 - DNA, 20 bp, Artificial Sequence
  sgRNA
  Mrc1_16
caatcattccgttcaccaga

SEQ ID NO: 33200 - DNA, 20 bp, Artificial Sequence
  sgRNA
  Mrc1_17
gtaacctagtggttgctcac

SEQ ID NO: 33201 - DNA, 20 bp, Artificial Sequence
  sgRNA
  Mrc1_18
tcagacggcaacttgcaacc

SEQ ID NO: 33202 - DNA, 20 bp, Artificial Sequence
  sgRNA
  Mrc1_19
ccatgagaacaacagacagg

SEQ ID NO: 33203 - DNA, 20 bp, Artificial Sequence
  sgRNA
  Mrc1_20
tttaacctggcatcaggcaa

SEQ ID NO: 33204 - DNA, 20 bp, Artificial Sequence
  sgRNA
  Mrc2_1
atggcagtgtcgtacactag

SEQ ID NO: 33205 - DNA, 20 bp, Artificial Sequence
  sgRNA
  Mrc2_2
gaaccagacattggtcgaca

SEQ ID NO: 33206 - DNA, 20 bp, Artificial Sequence
  sgRNA
  Mrc2_3
acagatcagccggacaaccc

SEQ ID NO: 33207 - DNA, 20 bp, Artificial Sequence
  sgRNA
  Mrc2_4
gtatacatgacagccagaca

SEQ ID NO: 33208 - DNA, 20 bp, Artificial Sequence
  sgRNA
  Mrc2_5
ggttccatccacatccacgt

SEQ ID NO: 33209 - DNA, 20 bp, Artificial Sequence
  sgRNA
  Mrc2_6
tgatgttggtacaagccccg

SEQ ID NO: 33210 - DNA, 20 bp, Artificial Sequence
  sgRNA
  Mrc2_7
ggctcagtgttggtccacca

SEQ ID NO: 33211 - DNA, 20 bp, Artificial Sequence
  sgRNA
  Mrc2_8
ctaccggcgccgacagagtg

SEQ ID NO: 33212 - DNA, 20 bp, Artificial Sequence
  sgRNA
  Mrc2_9
gctccgggcaaaattgtggt

SEQ ID NO: 33213 - DNA, 20 bp, Artificial Sequence
  sgRNA
  Mrc2_10
gggggaccagaggtgccata

SEQ ID NO: 33214 - DNA, 20 bp, Artificial Sequence
  sgRNA
  Mrc2_11
gatgggctcgaccgtagcgt

SEQ ID NO: 33215 - DNA, 20 bp, Artificial Sequence
  sgRNA
  Mrc2_12
ccttcaaatacgacaaccag

SEQ ID NO: 33216 - DNA, 20 bp, Artificial Sequence
  sgRNA
  Mrc2_13
tgcagctccgatcatcccag

SEQ ID NO: 33217 - DNA, 20 bp, Artificial Sequence
  sgRNA
  Mrc2_14
gagaggccttgagtcttcga

SEQ ID NO: 33218 - DNA, 20 bp, Artificial Sequence
  sgRNA
  Mrc2_15
ctgccgtcatcaaggccagg

SEQ ID NO: 33219 - DNA, 20 bp, Artificial Sequence
  sgRNA
  Mrc2_16
tgttgtggcttagcatgcta

SEQ ID NO: 33220 - DNA, 20 bp, Artificial Sequence
  sgRNA
  Mrc2_17
ggagtgggtacgctttcagg

SEQ ID NO: 33221 - DNA, 20 bp, Artificial Sequence
  sgRNA
  Mrc2_18
gaagctcacgaggctcccgt

SEQ ID NO: 33222 - DNA, 20 bp, Artificial Sequence
  sgRNA
  Mrc2_19
cacttcttgtccttgccaat

SEQ ID NO: 33223 - DNA, 20 bp, Artificial Sequence
  sgRNA
  Mrc2_20
cgctgcgtcttgcttctcgg

SEQ ID NO: 33224 - DNA, 20 bp, Artificial Sequence
  sgRNA
  Mrgpra1_1
acccacaacaactaatccaa

SEQ ID NO: 33225 - DNA, 20 bp, Artificial Sequence
  sgRNA
  Mrgpra1_2
aatctatgatgtgacctagg

SEQ ID NO: 33226 - DNA, 20 bp, Artificial Sequence
  sgRNA
  Mrgpra1_3
atgatggttctctatatcgc

SEQ ID NO: 33227 - DNA, 20 bp, Artificial Sequence
  sgRNA
  Mrgpra1_4
ggtgacagtgataccagatg

SEQ ID NO: 33228 - DNA, 20 bp, Artificial Sequence
  sgRNA
  Mrgpra1_5
tcgtgatgttgatacctcca

SEQ ID NO: 33229 - DNA, 20 bp, Artificial Sequence
  sgRNA
  Mrgpra1_6
gtttctagccctaaacacat

SEQ ID NO: 33230 - DNA, 20 bp, Artificial Sequence
  sgRNA
  Mrgpra1_7
agtcagctagagctaagttt

SEQ ID NO: 33231 - DNA, 20 bp, Artificial Sequence
  sgRNA
  Mrgpra1_8
tcgtgggatccttcaggcat

SEQ ID NO: 33232 - DNA, 20 bp, Artificial Sequence
  sgRNA
  Mrgpra1_9
acttcttcgtgggatccttc

SEQ ID NO: 33233 - DNA, 20 bp, Artificial Sequence
  sgRNA
  Mrgpra1_10
agcacaagagaaaggtaatt

SEQ ID NO: 33234 - DNA, 20 bp, Artificial Sequence
  sgRNA
  Mrgpra1_11
ctcctttgcggattgccctt

SEQ ID NO: 33235 - DNA, 20 bp, Artificial Sequence
  sgRNA
  Mrgpra1_12
ccagggatggtattgtccat

SEQ ID NO: 33236 - DNA, 20 bp, Artificial Sequence
  sgRNA
  Mrgpra1_13
gcggtgacagtgataccaga

SEQ ID NO: 33237 - DNA, 20 bp, Artificial Sequence
  sgRNA
  Mrgpra1_14
agatggggcacagtacagac

SEQ ID NO: 33238 - DNA, 20 bp, Artificial Sequence
  sgRNA
  Mrgpra1_15
agaaaccagtggatgccaaa

SEQ ID NO: 33239 - DNA, 20 bp, Artificial Sequence
  sgRNA
  Mrgpra1_16
tgagacagccaaaatcatgg

SEQ ID NO: 33240 - DNA, 20 bp, Artificial Sequence
  sgRNA
  Mrgpra1_17
tccattggattagttgttgt

SEQ ID NO: 33241 - DNA, 20 bp, Artificial Sequence
  sgRNA
  Mrgpra1_18
tgacatctccaccatgattt

SEQ ID NO: 33242 - DNA, 20 bp, Artificial Sequence
  sgRNA
  Mrgpra1_19
tcctgtgcaaacagaagccc

SEQ ID NO: 33243 - DNA, 20 bp, Artificial Sequence
  sgRNA
  Mrgpra1_20
cccaatataaaaatgaaaat

SEQ ID NO: 33244 - DNA, 20 bp, Artificial Sequence
  sgRNA
  Mrgpra2a_1
accagtgacaacaaatccaa

SEQ ID NO: 33245 - DNA, 20 bp, Artificial Sequence
  sgRNA
  Mrgpra2a_2
taatggttgtctacatcaca

SEQ ID NO: 33246 - DNA, 20 bp, Artificial Sequence
  sgRNA
  Mrgpra2a_3
cagttgatgtatgtactgga

SEQ ID NO: 33247 - DNA, 20 bp, Artificial Sequence
  sgRNA
  Mrgpra2a_4
ggaaactttgagaagaaaca

SEQ ID NO: 33248 - DNA, 20 bp, Artificial Sequence
  sgRNA
  Mrgpra2a_5
tcgtgggctctttcagacat

SEQ ID NO: 33249 - DNA, 20 bp, Artificial Sequence
  sgRNA
  Mrgpra2a_6
gatgtagacaaccattataa

SEQ ID NO: 33250 - DNA, 20 bp, Artificial Sequence
  sgRNA
  Mrgpra2a_7
gtgctttaacaccattataa

SEQ ID NO: 33251 - DNA, 20 bp, Artificial Sequence
  sgRNA
  Mrgpra2a_8
ataatggttgtctacatcac

SEQ ID NO: 33252 - DNA, 20 bp, Artificial Sequence
  sgRNA
  Mrgpra2b_1
taatgttgatacttccaggg

SEQ ID NO: 33253 - DNA, 20 bp, Artificial Sequence
  sgRNA
  Mrgpra2b_2
ttgatgtatgtactggacgg

SEQ ID NO: 33254 - DNA, 20 bp, Artificial Sequence
  sgRNA
  Mrgpra2b_3
tggaagctatgatactactg

SEQ ID NO: 33255 - DNA, 20 bp, Artificial Sequence
  sgRNA
  Mrgpra2b_4
aagcaaaaatatcatgtacg

SEQ ID NO: 33256 - DNA, 20 bp, Artificial Sequence
  sgRNA
  Mrgpra2b_5
gatgtagacaaccatcataa

SEQ ID NO: 33257 - DNA, 20 bp, Artificial Sequence
  sgRNA
  Mrgpra2b_6
tgatggttgtctacatcaca

SEQ ID NO: 33258 - DNA, 20 bp, Artificial Sequence
  sgRNA
  Mrgpra2b_7
gtgctttaacaccattatga

SEQ ID NO: 33259 - DNA, 20 bp, Artificial Sequence
  sgRNA
  Mrgpra2b_8
atgatggttgtctacatcac

SEQ ID NO: 33260 - DNA, 20 bp, Artificial Sequence
  sgRNA
  Mrgpra3_1
tcacatcataaattccacag

SEQ ID NO: 33261 - DNA, 20 bp, Artificial Sequence
  sgRNA
  Mrgpra3_2
caacctggccagtagagcca

SEQ ID NO: 33262 - DNA, 20 bp, Artificial Sequence
  sgRNA
  Mrgpra3_3
agatgatgatcatcaagtct

SEQ ID NO: 33263 - DNA, 20 bp, Artificial Sequence
  sgRNA
  Mrgpra3_4
ggcggcagtgataccagatg

SEQ ID NO: 33264 - DNA, 20 bp, Artificial Sequence
  sgRNA
  Mrgpra3_5
aggaaccaggtgatgcccca

SEQ ID NO: 33265 - DNA, 20 bp, Artificial Sequence
  sgRNA
  Mrgpra3_6
tcgtgggctccttcaggcaa

SEQ ID NO: 33266 - DNA, 20 bp, Artificial Sequence
  sgRNA
  Mrgpra3_7
tagcagttaggaccagaaga

SEQ ID NO: 33267 - DNA, 20 bp, Artificial Sequence
  sgRNA
  Mrgpra3_8
cctagcaccacagaacaacc

SEQ ID NO: 33268 - DNA, 20 bp, Artificial Sequence
  sgRNA
  Mrgpra3_9
ctcaagtttaccctacccaa

SEQ ID NO: 33269 - DNA, 20 bp, Artificial Sequence
  sgRNA
  Mrgpra3_10
tttattcaaccgttgcctga

SEQ ID NO: 33270 - DNA, 20 bp, Artificial Sequence
  sgRNA
  Mrgpra3_11
ctgttgatctgcattctgga

SEQ ID NO: 33271 - DNA, 20 bp, Artificial Sequence
  sgRNA
  Mrgpra3_12
gcggcggcagtgataccaga

SEQ ID NO: 33272 - DNA, 20 bp, Artificial Sequence
  sgRNA
  Mrgpra3_13
ctactggccaggttgttctg

SEQ ID NO: 33273 - DNA, 20 bp, Artificial Sequence
  sgRNA
  Mrgpra3_14
tgtctcaggagtgtcctgca

SEQ ID NO: 33274 - DNA, 20 bp, Artificial Sequence
  sgRNA
  Mrgpra3_15
taatctagtacaaacacacc

SEQ ID NO: 33275 - DNA, 20 bp, Artificial Sequence
  sgRNA
  Mrgpra3_16
atccagaatgcagatcaaca

SEQ ID NO: 33276 - DNA, 20 bp, Artificial Sequence
  sgRNA
  Mrgpra3_17
ggttctccagaaagccctgc

SEQ ID NO: 33277 - DNA, 20 bp, Artificial Sequence
  sgRNA
  Mrgpra3_18
ccacgaagaagtaaataatg

SEQ ID NO: 33278 - DNA, 20 bp, Artificial Sequence
  sgRNA
  Mrgpra3_19
ttactctgtgtgtcaggcat

SEQ ID NO: 33279 - DNA, 20 bp, Artificial Sequence
  sgRNA
  Mrgpra3_20
gaataaacagaccctcaaaa

SEQ ID NO: 33280 - DNA, 20 bp, Artificial Sequence
  sgRNA
  Mrgpra4_1
ttcagaatgcagatcaacag

SEQ ID NO: 33281 - DNA, 20 bp, Artificial Sequence
  sgRNA
  Mrgpra4_2
tcatgatgatgtcaaagcaa

SEQ ID NO: 33282 - DNA, 20 bp, Artificial Sequence
  sgRNA
  Mrgpra4_3
ggcggcaccgataccagatg

SEQ ID NO: 33283 - DNA, 20 bp, Artificial Sequence
  sgRNA
  Mrgpra4_4
agaaggcattcctgtgcaag

SEQ ID NO: 33284 - DNA, 20 bp, Artificial Sequence
  sgRNA
  Mrgpra4_5
ctgaaatcacggttaatcca

SEQ ID NO: 33285 - DNA, 20 bp, Artificial Sequence
  sgRNA
  Mrgpra4_6
cagaaaccagaagaagccca

SEQ ID NO: 33286 - DNA, 20 bp, Artificial Sequence
  sgRNA
  Mrgpra4_7
agaaaccagaagaagcccag

SEQ ID NO: 33287 - DNA, 20 bp, Artificial Sequence
  sgRNA
  Mrgpra4_8
tcctgtgccccatctggtat

SEQ ID NO: 33288 - DNA, 20 bp, Artificial Sequence
  sgRNA
  Mrgpra4_9
ttgtgggctccttcaggcat

SEQ ID NO: 33289 - DNA, 20 bp, Artificial Sequence
  sgRNA
  Mrgpra4_10
ggaaccagatcacagcacac

SEQ ID NO: 33290 - DNA, 20 bp, Artificial Sequence
  sgRNA
  Mrgpra4_11
caatggttcaaaatattgtt

SEQ ID NO: 33291 - DNA, 20 bp, Artificial Sequence
  sgRNA
  Mrgpra4_12
gcggcggcaccgataccaga

SEQ ID NO: 33292 - DNA, 20 bp, Artificial Sequence
  sgRNA
  Mrgpra4_13
ggactataaacaaaaacatc

SEQ ID NO: 33293 - DNA, 20 bp, Artificial Sequence
  sgRNA
  Mrgpra4_14
gcaatggttcaaaatattgt

SEQ ID NO: 33294 - DNA, 20 bp, Artificial Sequence
  sgRNA
  Mrgpra4_15
gaatgcagatcaacaggggc

SEQ ID NO: 33295 - DNA, 20 bp, Artificial Sequence
  sgRNA
  Mrgpra4_16
aggactataaacaaaaacat

SEQ ID NO: 33296 - DNA, 20 bp, Artificial Sequence
  sgRNA
  Mrgpra4_17
ccagaaaccagaagaagccc

SEQ ID NO: 33297 - DNA, 20 bp, Artificial Sequence
  sgRNA
  Mrgpra4_18
atgacagttctctacatcac

SEQ ID NO: 33298 - DNA, 20 bp, Artificial Sequence
  sgRNA
  Mrgpra4_19
aatctagtacactgaaatca

SEQ ID NO: 33299 - DNA, 20 bp, Artificial Sequence
  sgRNA
  Mrgpra4_20
ggatatttctgtcatttctt

SEQ ID NO: 33300 - DNA, 20 bp, Artificial Sequence
  sgRNA
  Mrgpra6_1
ctgtcagcccgactagtccg

SEQ ID NO: 33301 - DNA, 20 bp, Artificial Sequence
  sgRNA
  Mrgpra6_2
ggccctgaacacctcaacct

SEQ ID NO: 33302 - DNA, 20 bp, Artificial Sequence
  sgRNA
  Mrgpra6_3
tgttgtgagtgccgttgccg

SEQ ID NO: 33303 - DNA, 20 bp, Artificial Sequence
  sgRNA
  Mrgpra6_4
ctatgcatggtttcgtgcac

SEQ ID NO: 33304 - DNA, 20 bp, Artificial Sequence
  sgRNA
  Mrgpra6_5
atcgtcatcctcggactagt

SEQ ID NO: 33305 - DNA, 20 bp, Artificial Sequence
  sgRNA
  Mrgpra6_6
ggttgttctgtggcgctgga

SEQ ID NO: 33306 - DNA, 20 bp, Artificial Sequence
  sgRNA
  Mrgpra6_7
aggaaccagtagaagccaca

SEQ ID NO: 33307 - DNA, 20 bp, Artificial Sequence
  sgRNA
  Mrgpra6_8
aacttgatgatcgtcatcct

SEQ ID NO: 33308 - DNA, 20 bp, Artificial Sequence
  sgRNA
  Mrgpra6_9
gaacacctcaacctcggcaa

SEQ ID NO: 33309 - DNA, 20 bp, Artificial Sequence
  sgRNA
  Mrgpra6_10
gttgataaagatactgttgg

SEQ ID NO: 33310 - DNA, 20 bp, Artificial Sequence
  sgRNA
  Mrgpra6_11
ttgtgggctcattcaggcat

SEQ ID NO: 33311 - DNA, 20 bp, Artificial Sequence
  sgRNA
  Mrgpra6_12
cagttgataaagatactgtt

SEQ ID NO: 33312 - DNA, 20 bp, Artificial Sequence
  sgRNA
  Mrgpra6_13
gatgctgatacttctatgca

SEQ ID NO: 33313 - DNA, 20 bp, Artificial Sequence
  sgRNA
  Mrgpra6_14
agatggggcacatgacagac

SEQ ID NO: 33314 - DNA, 20 bp, Artificial Sequence
  sgRNA
  Mrgpra6_15
gaagcaccctgaaggtgtaa

SEQ ID NO: 33315 - DNA, 20 bp, Artificial Sequence
  sgRNA
  Mrgpra6_16
gagtgccgttgccgaggttg

SEQ ID NO: 33316 - DNA, 20 bp, Artificial Sequence
  sgRNA
  Mrgpra6_17
gaatgcagagcaatagagac

SEQ ID NO: 33317 - DNA, 20 bp, Artificial Sequence
  sgRNA
  Mrgpra6_18
tcgtcatcctcggactagtc

SEQ ID NO: 33318 - DNA, 20 bp, Artificial Sequence
  sgRNA
  Mrgpra6_19
ccaaatatgaagatgactat

SEQ ID NO: 33319 - DNA, 20 bp, Artificial Sequence
  sgRNA
  Mrgpra6_20
acatcaggtatgcggtagta

SEQ ID NO: 33320 - DNA, 20 bp, Artificial Sequence
  sgRNA
  Mrgpra9_1
aggaaccagtataagccaca

SEQ ID NO: 33321 - DNA, 20 bp, Artificial Sequence
  sgRNA
  Mrgpra9_2
tcttgatgctggtacttcca

SEQ ID NO: 33322 - DNA, 20 bp, Artificial Sequence
  sgRNA
  Mrgpra9_3
ggttgttctgtggcactggg

SEQ ID NO: 33323 - DNA, 20 bp, Artificial Sequence
  sgRNA
  Mrgpra9_4
gaacgtgagaagtttctgcg

SEQ ID NO: 33324 - DNA, 20 bp, Artificial Sequence
  sgRNA
  Mrgpra9_5
tgttgtgagtgccattgtgg

SEQ ID NO: 33325 - DNA, 20 bp, Artificial Sequence
  sgRNA
  Mrgpra9_6
aaacatctcagcctccacaa

SEQ ID NO: 33326 - DNA, 20 bp, Artificial Sequence
  sgRNA
  Mrgpra9_7
catttgcctttacaccttca

SEQ ID NO: 33327 - DNA, 20 bp, Artificial Sequence
  sgRNA
  Mrgpra9_8
tggaagctatgatgcgacag

SEQ ID NO: 33328 - DNA, 20 bp, Artificial Sequence
  sgRNA
  Mrgpra9_9
ggttgccctgtggcttatac

SEQ ID NO: 33329 - DNA, 20 bp, Artificial Sequence
  sgRNA
  Mrgpra9_10
ctgttattctggattaagaa

SEQ ID NO: 33330 - DNA, 20 bp, Artificial Sequence
  sgRNA
  Mrgpra9_11
tcgtgggctcattcaggcat

SEQ ID NO: 33331 - DNA, 20 bp, Artificial Sequence
  sgRNA
  Mrgpra9_12
ccaaatatgtaaatgactat

SEQ ID NO: 33332 - DNA, 20 bp, Artificial Sequence
  sgRNA
  Mrgpra9_13
aagctatgatgcgacagagg

SEQ ID NO: 33333 - DNA, 20 bp, Artificial Sequence
  sgRNA
  Mrgpra9_14
tgagacagctgaaaacatgg

SEQ ID NO: 33334 - DNA, 20 bp, Artificial Sequence
  sgRNA
  Mrgpra9_15
attctgaataggtatttctg

SEQ ID NO: 33335 - DNA, 20 bp, Artificial Sequence
  sgRNA
  Mrgpra9_16
gaatcaccctgaaggtgtaa

SEQ ID NO: 33336 - DNA, 20 bp, Artificial Sequence
  sgRNA
  Mrgpra9_17
gatgctggtacttccaggga

SEQ ID NO: 33337 - DNA, 20 bp, Artificial Sequence
  sgRNA
  Mrgpra9_18
actcacaacaacaaatccaa

SEQ ID NO: 33338 - DNA, 20 bp, Artificial Sequence
  sgRNA
  Mrgpra9_19
tcatttgcctttacaccttc

SEQ ID NO: 33339 - DNA, 20 bp, Artificial Sequence
  sgRNA
  Mrgpra9_20
gatgtagagaatcaccctga

SEQ ID NO: 33340 - DNA, 20 bp, Artificial Sequence
  sgRNA
  Mrgprd_1
tttctgccaaaatctatgaa

SEQ ID NO: 33341 - DNA, 20 bp, Artificial Sequence
  sgRNA
  Mrgprd_2
tcttccgcacccggatgaag

SEQ ID NO: 33342 - DNA, 20 bp, Artificial Sequence
  sgRNA
  Mrgprd_3
caggtcacaaggtccatggt

SEQ ID NO: 33343 - DNA, 20 bp, Artificial Sequence
  sgRNA
  Mrgprd_4
accactgatgacaggtgccg

SEQ ID NO: 33344 - DNA, 20 bp, Artificial Sequence
  sgRNA
  Mrgprd_5
aagaaccagttgatgcccaa

SEQ ID NO: 33345 - DNA, 20 bp, Artificial Sequence
  sgRNA
  Mrgprd_6
atgaccacgtacagccgccg

SEQ ID NO: 33346 - DNA, 20 bp, Artificial Sequence
  sgRNA
  Mrgprd_7
ccacacacgtggccatggcg

SEQ ID NO: 33347 - DNA, 20 bp, Artificial Sequence
  sgRNA
  Mrgprd_8
acagcctgatgcagagacgg

SEQ ID NO: 33348 - DNA, 20 bp, Artificial Sequence
  sgRNA
  Mrgprd_9
ccatctggtataagtgccac

SEQ ID NO: 33349 - DNA, 20 bp, Artificial Sequence
  sgRNA
  Mrgprd_10
tgagctgcaatggcatgcag

SEQ ID NO: 33350 - DNA, 20 bp, Artificial Sequence
  sgRNA
  Mrgprd_11
gaaatgttgactatgagcag

SEQ ID NO: 33351 - DNA, 20 bp, Artificial Sequence
  sgRNA
  Mrgprd_12
ccatcattagtacacgtgga

SEQ ID NO: 33352 - DNA, 20 bp, Artificial Sequence
  sgRNA
  Mrgprd_13
agaggaagtcagccaccgcc

SEQ ID NO: 33353 - DNA, 20 bp, Artificial Sequence
  sgRNA
  Mrgprd_14
ataccactgatgacaggtgc

SEQ ID NO: 33354 - DNA, 20 bp, Artificial Sequence
  sgRNA
  Mrgprd_15
gtgctggtcaggatcatgac

SEQ ID NO: 33355 - DNA, 20 bp, Artificial Sequence
  sgRNA
  Mrgprd_16
tgaccggcatgaagatcccc

SEQ ID NO: 33356 - DNA, 20 bp, Artificial Sequence
  sgRNA
  Mrgprd_17
gatgaccacgtacagccgcc

SEQ ID NO: 33357 - DNA, 20 bp, Artificial Sequence
  sgRNA
  Mrgprd_18
caaacaccagtgcttcaagg

SEQ ID NO: 33358 - DNA, 20 bp, Artificial Sequence
  sgRNA
  Mrgprd_19
ctatgtgctcaacctggcgg

SEQ ID NO: 33359 - DNA, 20 bp, Artificial Sequence
  sgRNA
  Mrgprd_20
catccacgtgtactaatgat

SEQ ID NO: 33360 - DNA, 20 bp, Artificial Sequence
  sgRNA
  Mrgpre_1
gctgggtgctccaaagaact

SEQ ID NO: 33361 - DNA, 20 bp, Artificial Sequence
  sgRNA
  Mrgpre_2
cacaggtggtcaggtagcgt

SEQ ID NO: 33362 - DNA, 20 bp, Artificial Sequence
  sgRNA
  Mrgpre_3
atatcagcctgaccatgctg

SEQ ID NO: 33363 - DNA, 20 bp, Artificial Sequence
  sgRNA
  Mrgpre_4
cttcctctgctgccacatgg

SEQ ID NO: 33364 - DNA, 20 bp, Artificial Sequence
  sgRNA
  Mrgpre_5
gctgcccaagaaaaagtaga

SEQ ID NO: 33365 - DNA, 20 bp, Artificial Sequence
  sgRNA
  Mrgpre_6
cctcatctccaagtgcccgc

SEQ ID NO: 33366 - DNA, 20 bp, Artificial Sequence
  sgRNA
  Mrgpre_7
ccgtgctgatggccgccagg

SEQ ID NO: 33367 - DNA, 20 bp, Artificial Sequence
  sgRNA
  Mrgpre_8
gcagcagaggaagatgaggt

SEQ ID NO: 33368 - DNA, 20 bp, Artificial Sequence
  sgRNA
  Mrgpre_9
ggttgaaagccatttctccc

SEQ ID NO: 33369 - DNA, 20 bp, Artificial Sequence
  sgRNA
  Mrgpre_10
gtttcgggaacccctccggc

SEQ ID NO: 33370 - DNA, 20 bp, Artificial Sequence
  sgRNA
  Mrgpre_11
gctccgtgctgatggccgcc

SEQ ID NO: 33371 - DNA, 20 bp, Artificial Sequence
  sgRNA
  Mrgpre_12
gtagcagaagaaccgcagca

SEQ ID NO: 33372 - DNA, 20 bp, Artificial Sequence
  sgRNA
  Mrgpre_13
acagattctcccagcaccca

SEQ ID NO: 33373 - DNA, 20 bp, Artificial Sequence
  sgRNA
  Mrgpre_14
acacaggtggtcaggtagcg

SEQ ID NO: 33374 - DNA, 20 bp, Artificial Sequence
  sgRNA
  Mrgpre_15
tgtgggcctgagcctcctgg

SEQ ID NO: 33375 - DNA, 20 bp, Artificial Sequence
  sgRNA
  Mrgpre_16
ggctgatatgtacaaattca

SEQ ID NO: 33376 - DNA, 20 bp, Artificial Sequence
  sgRNA
  Mrgpre_17
ggccacatccaagagataga

SEQ ID NO: 33377 - DNA, 20 bp, Artificial Sequence
  sgRNA
  Mrgpre_18
agaggtttcgggaacccctc

SEQ ID NO: 33378 - DNA, 20 bp, Artificial Sequence
  sgRNA
  Mrgpre_19
gacagccagaagatgccaaa

SEQ ID NO: 33379 - DNA, 20 bp, Artificial Sequence
  sgRNA
  Mrgpre_20
accagggtggggaagccccg

SEQ ID NO: 33380 - DNA, 20 bp, Artificial Sequence
  sgRNA
  Mrgprf_1
gatgtgtcctggtatgagcg

SEQ ID NO: 33381 - DNA, 20 bp, Artificial Sequence
  sgRNA
  Mrgprf_2
gctgaagaggtacatcccat

SEQ ID NO: 33382 - DNA, 20 bp, Artificial Sequence
  sgRNA
  Mrgprf_3
tcttcgaatgtagtcgggga

SEQ ID NO: 33383 - DNA, 20 bp, Artificial Sequence
  sgRNA
  Mrgprf_4
gaatgatagcatccagagca

SEQ ID NO: 33384 - DNA, 20 bp, Artificial Sequence
  sgRNA
  Mrgprf_5
acactcttcgaatgtagtcg

SEQ ID NO: 33385 - DNA, 20 bp, Artificial Sequence
  sgRNA
  Mrgprf_6
acaagtcagtgacgtactcg

SEQ ID NO: 33386 - DNA, 20 bp, Artificial Sequence
  sgRNA
  Mrgprf_7
cctccgacgccagtaccagg

SEQ ID NO: 33387 - DNA, 20 bp, Artificial Sequence
  sgRNA
  Mrgprf_8
gatccccagtctctgccagg

SEQ ID NO: 33388 - DNA, 20 bp, Artificial Sequence
  sgRNA
  Mrgprf_9
agacaagtcacagcgcctgt

SEQ ID NO: 33389 - DNA, 20 bp, Artificial Sequence
  sgRNA
  Mrgprf_10
gttgcggcagactgtaccag

SEQ ID NO: 33390 - DNA, 20 bp, Artificial Sequence
  sgRNA
  Mrgprf_11
tgttgcggcagactgtacca

SEQ ID NO: 33391 - DNA, 20 bp, Artificial Sequence
  sgRNA
  Mrgprf_12
ctctgccaagctcaatcacg

SEQ ID NO: 33392 - DNA, 20 bp, Artificial Sequence
  sgRNA
  Mrgprf_13
ctacgtgcaggatgagcgcc

SEQ ID NO: 33393 - DNA, 20 bp, Artificial Sequence
  sgRNA
  Mrgprf_14
ggaagacagagacgatcgcc

SEQ ID NO: 33394 - DNA, 20 bp, Artificial Sequence
  sgRNA
  Mrgprf_15
gctcgggagctctacagcag

SEQ ID NO: 33395 - DNA, 20 bp, Artificial Sequence
  sgRNA
  Mrgprf_16
actacattcgaagagtgtcc

SEQ ID NO: 33396 - DNA, 20 bp, Artificial Sequence
  sgRNA
  Mrgprf_17
gtgctgctagcagcgtcccc

SEQ ID NO: 33397 - DNA, 20 bp, Artificial Sequence
  sgRNA
  Mrgprf_18
caccatcccggagagcccgc

SEQ ID NO: 33398 - DNA, 20 bp, Artificial Sequence
  sgRNA
  Mrgprf_19
tgcaggatgagcgccaggca

SEQ ID NO: 33399 - DNA, 20 bp, Artificial Sequence
  sgRNA
  Mrgprf_20
gtcctggtatgagcgaggct

SEQ ID NO: 33400 - DNA, 20 bp, Artificial Sequence
  sgRNA
  Mrgprg_1
tacgatcgtgtcgggccatg

SEQ ID NO: 33401 - DNA, 20 bp, Artificial Sequence
  sgRNA
  Mrgprg_2
aggaggggaacatgtaggcg

SEQ ID NO: 33402 - DNA, 20 bp, Artificial Sequence
  sgRNA
  Mrgprg_3
ccttcttaatgtgcagaccg

SEQ ID NO: 33403 - DNA, 20 bp, Artificial Sequence
  sgRNA
  Mrgprg_4
aaaaaacggaatgagtctgc

SEQ ID NO: 33404 - DNA, 20 bp, Artificial Sequence
  sgRNA
  Mrgprg_5
aggacaactgaagtgaacct

SEQ ID NO: 33405 - DNA, 20 bp, Artificial Sequence
  sgRNA
  Mrgprg_6
gcctcactgtcagccttgca

SEQ ID NO: 33406 - DNA, 20 bp, Artificial Sequence
  sgRNA
  Mrgprg_7
actgcaggtagccctaaaca

SEQ ID NO: 33407 - DNA, 20 bp, Artificial Sequence
  sgRNA
  Mrgprg_8
tgttgccagccaacgcctgt

SEQ ID NO: 33408 - DNA, 20 bp, Artificial Sequence
  sgRNA
  Mrgprg_9
gggcccagatcacgaggcag

SEQ ID NO: 33409 - DNA, 20 bp, Artificial Sequence
  sgRNA
  Mrgprg_10
caggcaccagtagacaacca

SEQ ID NO: 33410 - DNA, 20 bp, Artificial Sequence
  sgRNA
  Mrgprg_11
gcccttcatgtagtacaaga

SEQ ID NO: 33411 - DNA, 20 bp, Artificial Sequence
  sgRNA
  Mrgprg_12
gttcttctgtcgcctacccc

SEQ ID NO: 33412 - DNA, 20 bp, Artificial Sequence
  sgRNA
  Mrgprg_13
cccctcttgtactacatgaa

SEQ ID NO: 33413 - DNA, 20 bp, Artificial Sequence
  sgRNA
  Mrgprg_14
tggtctgcctcaagtaccat

SEQ ID NO: 33414 - DNA, 20 bp, Artificial Sequence
  sgRNA
  Mrgprg_15
ctcggtctgcacattaagaa

SEQ ID NO: 33415 - DNA, 20 bp, Artificial Sequence
  sgRNA
  Mrgprg_16
gcctgtgggctgctaaaaaa

SEQ ID NO: 33416 - DNA, 20 bp, Artificial Sequence
  sgRNA
  Mrgprg_17
gccaacttgcagaacttggg

SEQ ID NO: 33417 - DNA, 20 bp, Artificial Sequence
  sgRNA
  Mrgprg_18
ccttcctgtggtttgccgtg

SEQ ID NO: 33418 - DNA, 20 bp, Artificial Sequence
  sgRNA
  Mrgprg_19
gcatgagaggaagaggaaat

SEQ ID NO: 33419 - DNA, 20 bp, Artificial Sequence
  sgRNA
  Mrgprg_20
gctcaggaaggacccactgc

SEQ ID NO: 33420 - DNA, 20 bp, Artificial Sequence
  sgRNA
  Mrvi1_1
tacctgatggggagtctccg

SEQ ID NO: 33421 - DNA, 20 bp, Artificial Sequence
  sgRNA
  Mrvi1_2
tgcccacgtattgttacctg

SEQ ID NO: 33422 - DNA, 20 bp, Artificial Sequence
  sgRNA
  Mrvi1_3
caggtcaatgacatgccccg

SEQ ID NO: 33423 - DNA, 20 bp, Artificial Sequence
  sgRNA
  Mrvi1_4
ccggccccccctgattcggg

SEQ ID NO: 33424 - DNA, 20 bp, Artificial Sequence
  sgRNA
  Mrvi1_5
gaagctgaccaagctccggg

SEQ ID NO: 33425 - DNA, 20 bp, Artificial Sequence
  sgRNA
  Mrvi1_6
gagcggttcctgacccgccg

SEQ ID NO: 33426 - DNA, 20 bp, Artificial Sequence
  sgRNA
  Mrvi1_7
ccctgaactgagtgaggccg

SEQ ID NO: 33427 - DNA, 20 bp, Artificial Sequence
  sgRNA
  Mrvi1_8
ggatctcccagggggcccat

SEQ ID NO: 33428 - DNA, 20 bp, Artificial Sequence
  sgRNA
  Mrvi1_9
ggtcaatgacatgccccgag

SEQ ID NO: 33429 - DNA, 20 bp, Artificial Sequence
  sgRNA
  Mrvi1_10
gcacagccactccaaccagg

SEQ ID NO: 33430 - DNA, 20 bp, Artificial Sequence
  sgRNA
  Mrvi1_11
tccagcagagccctgcccca

SEQ ID NO: 33431 - DNA, 20 bp, Artificial Sequence
  sgRNA
  Mrvi1_12
gctttcccaccgacacctga

SEQ ID NO: 33432 - DNA, 20 bp, Artificial Sequence
  sgRNA
  Mrvi1_13
ccgtcaggacgattgtggga

SEQ ID NO: 33433 - DNA, 20 bp, Artificial Sequence
  sgRNA
  Mrvi1_14
acagaagacggagagtcccg

SEQ ID NO: 33434 - DNA, 20 bp, Artificial Sequence
  sgRNA
  Mrvi1_15
tgatccccttcagcacgtgg

SEQ ID NO: 33435 - DNA, 20 bp, Artificial Sequence
  sgRNA
  Mrvi1_16
cctgcacagaggaggccgat

SEQ ID NO: 33436 - DNA, 20 bp, Artificial Sequence
  sgRNA
  Mrvi1_17
gctccaccaggagtcccgct

SEQ ID NO: 33437 - DNA, 20 bp, Artificial Sequence
  sgRNA
  Mrvi1_18
tcccacaatcgtcctgacgg

SEQ ID NO: 33438 - DNA, 20 bp, Artificial Sequence
  sgRNA
  Mrvi1_19
ggcagccagacgatgcaaga

SEQ ID NO: 33439 - DNA, 20 bp, Artificial Sequence
  sgRNA
  Mrvi1_20
gcgatctatgtccctcacaa

SEQ ID NO: 33440 - DNA, 20 bp, Artificial Sequence
  sgRNA
  Ms4a1_1
gttacagtactgtgtagatg

SEQ ID NO: 33441 - DNA, 20 bp, Artificial Sequence
  sgRNA
  Ms4a1_2
taccatacactcaaacagat

SEQ ID NO: 33442 - DNA, 20 bp, Artificial Sequence
  sgRNA
  Ms4a1_3
cagtcgtagatatcaacata

SEQ ID NO: 33443 - DNA, 20 bp, Artificial Sequence
  sgRNA
  Ms4a1_4
ccacacaaagcttcttcatg

SEQ ID NO: 33444 - DNA, 20 bp, Artificial Sequence
  sgRNA
  Ms4a1_5
gatcatcagcagtcccccca

SEQ ID NO: 33445 - DNA, 20 bp, Artificial Sequence
  sgRNA
  Ms4a1_6
ttcccagcagagcctacaaa

SEQ ID NO: 33446 - DNA, 20 bp, Artificial Sequence
  sgRNA
  Ms4a1_7
agagcaggaatccttgccag

SEQ ID NO: 33447 - DNA, 20 bp, Artificial Sequence
  sgRNA
  Ms4a1_8
actgctgatgatccccacag

SEQ ID NO: 33448 - DNA, 20 bp, Artificial Sequence
  sgRNA
  Ms4a1_9
cacacaaagcttcttcatga

SEQ ID NO: 33449 - DNA, 20 bp, Artificial Sequence
  sgRNA
  Ms4a1_10
gtagatatcaacatacggct

SEQ ID NO: 33450 - DNA, 20 bp, Artificial Sequence
  sgRNA
  Ms4a1_11
gatgggtgcgaagacccctg

SEQ ID NO: 33451 - DNA, 20 bp, Artificial Sequence
  sgRNA
  Ms4a1_12
gactgctgatgatccccaca

SEQ ID NO: 33452 - DNA, 20 bp, Artificial Sequence
  sgRNA
  Ms4a1_13
gtaccatacactcaaacaga

SEQ ID NO: 33453 - DNA, 20 bp, Artificial Sequence
  sgRNA
  Ms4a1_14
tgttacagtactgtgtagat

SEQ ID NO: 33454 - DNA, 20 bp, Artificial Sequence
  sgRNA
  Ms4a1_15
gtatggtaccctctctgggg

SEQ ID NO: 33455 - DNA, 20 bp, Artificial Sequence
  sgRNA
  Ms4a1_16
ggagcaggttgcatggcgag

SEQ ID NO: 33456 - DNA, 20 bp, Artificial Sequence
  sgRNA
  Ms4a1_17
ggactgctgatgatccccac

SEQ ID NO: 33457 - DNA, 20 bp, Artificial Sequence
  sgRNA
  Ms4a1_18
gcctcttccatattaccctg

SEQ ID NO: 33458 - DNA, 20 bp, Artificial Sequence
  sgRNA
  Ms4a1_19
gcagtccccccagggtaata

SEQ ID NO: 33459 - DNA, 20 bp, Artificial Sequence
  sgRNA
  Ms4a1_20
ggatcatcagcagtcccccc

SEQ ID NO: 33460 - DNA, 20 bp, Artificial Sequence
  sgRNA
  Ms4a15_1
aagaatggctgtccccgcga

SEQ ID NO: 33461 - DNA, 20 bp, Artificial Sequence
  sgRNA
  Ms4a15_2
tccattggtctaagatcagg

SEQ ID NO: 33462 - DNA, 20 bp, Artificial Sequence
  sgRNA
  Ms4a15_3
tcgaactgcatgatccctgg

SEQ ID NO: 33463 - DNA, 20 bp, Artificial Sequence
  sgRNA
  Ms4a15_4
cagacggtgcagatcctgat

SEQ ID NO: 33464 - DNA, 20 bp, Artificial Sequence
  sgRNA
  Ms4a15_5
gtcctgcttatggttcggcg

SEQ ID NO: 33465 - DNA, 20 bp, Artificial Sequence
  sgRNA
  Ms4a15_6
gcagcgtcctgcttatggtt

SEQ ID NO: 33466 - DNA, 20 bp, Artificial Sequence
  sgRNA
  Ms4a15_7
gatggtgaagatggtcaaca

SEQ ID NO: 33467 - DNA, 20 bp, Artificial Sequence
  sgRNA
  Ms4a15_8
gtgccatggcagccttcgcg

SEQ ID NO: 33468 - DNA, 20 bp, Artificial Sequence
  sgRNA
  Ms4a15_9
ggcctcgccgaaccataagc

SEQ ID NO: 33469 - DNA, 20 bp, Artificial Sequence
  sgRNA
  Ms4a15_10
cctacccaatgcctttggca

SEQ ID NO: 33470 - DNA, 20 bp, Artificial Sequence
  sgRNA
  Ms4a15_11
acctcctgcctatgacaacg

SEQ ID NO: 33471 - DNA, 20 bp, Artificial Sequence
  sgRNA
  Ms4a15_12
tatgccacgttgtcataggc

SEQ ID NO: 33472 - DNA, 20 bp, Artificial Sequence
  sgRNA
  Ms4a15_13
ggacgctgccgaagccaagg

SEQ ID NO: 33473 - DNA, 20 bp, Artificial Sequence
  sgRNA
  Ms4a15_14
gggatgctcttcatcgaagg

SEQ ID NO: 33474 - DNA, 20 bp, Artificial Sequence
  sgRNA
  Ms4a15_15
ggtctcatccaccttggctt

SEQ ID NO: 33475 - DNA, 20 bp, Artificial Sequence
  sgRNA
  Ms4a15_16
catatatgccacgttgtcat

SEQ ID NO: 33476 - DNA, 20 bp, Artificial Sequence
  sgRNA
  Ms4a15_17
gcaggacgctgccgaagcca

SEQ ID NO: 33477 - DNA, 20 bp, Artificial Sequence
  sgRNA
  Ms4a15_18
ccaatggagacgttcttgac

SEQ ID NO: 33478 - DNA, 20 bp, Artificial Sequence
  sgRNA
  Ms4a15_19
accacctgatcttagaccaa

SEQ ID NO: 33479 - DNA, 20 bp, Artificial Sequence
  sgRNA
  Ms4a15_20
cgaaggctgccatggcactg

SEQ ID NO: 33480 - DNA, 20 bp, Artificial Sequence
  sgRNA
  Ms4a6b_1
tgactttgtctccgtgacga

SEQ ID NO: 33481 - DNA, 20 bp, Artificial Sequence
  sgRNA
  Ms4a6b_2
tggtagtaatgatattcagt

SEQ ID NO: 33482 - DNA, 20 bp, Artificial Sequence
  sgRNA
  Ms4a6b_3
taacaggactgaaaacactg

SEQ ID NO: 33483 - DNA, 20 bp, Artificial Sequence
  sgRNA
  Ms4a6b_4
gtggcaatgatttcgccaaa

SEQ ID NO: 33484 - DNA, 20 bp, Artificial Sequence
  sgRNA
  Ms4a6b_5
gctctgcaagcactgctctg

SEQ ID NO: 33485 - DNA, 20 bp, Artificial Sequence
  sgRNA
  Ms4a6b_6
actcgttcctgtccaagaat

SEQ ID NO: 33486 - DNA, 20 bp, Artificial Sequence
  sgRNA
  Ms4a6b_7
tggaattctgtccatcgtca

SEQ ID NO: 33487 - DNA, 20 bp, Artificial Sequence
  sgRNA
  Ms4a6b_8
aatcattgccacagtctcac

SEQ ID NO: 33488 - DNA, 20 bp, Artificial Sequence
  sgRNA
  Ms4a6b_9
agagtcactctaacatccct

SEQ ID NO: 33489 - DNA, 20 bp, Artificial Sequence
  sgRNA
  Ms4a6b_10
ccaattgttcctcatatgag

SEQ ID NO: 33490 - DNA, 20 bp, Artificial Sequence
  sgRNA
  Ms4a6b_11
gctgtgatggtgttgagtct

SEQ ID NO: 33491 - DNA, 20 bp, Artificial Sequence
  sgRNA
  Ms4a6b_12
gcatggcagtgaggacagcc

SEQ ID NO: 33492 - DNA, 20 bp, Artificial Sequence
  sgRNA
  Ms4a6b_13
agtgtttcatttgctttcat

SEQ ID NO: 33493 - DNA, 20 bp, Artificial Sequence
  sgRNA
  Ms4a6b_14
accaattgttcctcatatga

SEQ ID NO: 33494 - DNA, 20 bp, Artificial Sequence
  sgRNA
  Ms4a6b_15
actttgtaacccctcatatg

SEQ ID NO: 33495 - DNA, 20 bp, Artificial Sequence
  sgRNA
  Ms4a6b_16
gatgctgatcagtactatgt

SEQ ID NO: 33496 - DNA, 20 bp, Artificial Sequence
  sgRNA
  Ms4a6b_17
agtagtgaccagtgagactg

SEQ ID NO: 33497 - DNA, 20 bp, Artificial Sequence
  sgRNA
  Ms4a6b_18
cattatttgagctatgtggc

SEQ ID NO: 33498 - DNA, 20 bp, Artificial Sequence
  sgRNA
  Ms4a6b_19
gagtcattatttgagctatg

SEQ ID NO: 33499 - DNA, 20 bp, Artificial Sequence
  sgRNA
  Ms4a6b_20
cccctcatatgaggaacaat

SEQ ID NO: 33500 - DNA, 20 bp, Artificial Sequence
  sgRNA
  Ms4a6c_1
agtcccagcctacccaacag

SEQ ID NO: 33501 - DNA, 20 bp, Artificial Sequence
  sgRNA
  Ms4a6c_2
aatgatggacaaaattccag

SEQ ID NO: 33502 - DNA, 20 bp, Artificial Sequence
  sgRNA
  Ms4a6c_3
actgagttaaaatatgggac

SEQ ID NO: 33503 - DNA, 20 bp, Artificial Sequence
  sgRNA
  Ms4a6c_4
atttggtgaaatcgttgtga

SEQ ID NO: 33504 - DNA, 20 bp, Artificial Sequence
  sgRNA
  Ms4a6c_5
gccatgctgtggttgagaga

SEQ ID NO: 33505 - DNA, 20 bp, Artificial Sequence
  sgRNA
  Ms4a6c_6
aatcgttgtgatggtctcat

SEQ ID NO: 33506 - DNA, 20 bp, Artificial Sequence
  sgRNA
  Ms4a6c_7
agagcaatgcaagcagagca

SEQ ID NO: 33507 - DNA, 20 bp, Artificial Sequence
  sgRNA
  Ms4a6c_8
gctctgcttgcattgctctg

SEQ ID NO: 33508 - DNA, 20 bp, Artificial Sequence
  sgRNA
  Ms4a6c_9
agtcagaatagacttggtga

SEQ ID NO: 33509 - DNA, 20 bp, Artificial Sequence
  sgRNA
  Ms4a6c_10
aacctttctacaactcagac

SEQ ID NO: 33510 - DNA, 20 bp, Artificial Sequence
  sgRNA
  Ms4a6c_11
gagaaagtcaacaaaacctt

SEQ ID NO: 33511 - DNA, 20 bp, Artificial Sequence
  sgRNA
  Ms4a6c_12
atcacaacgatttcaccaaa

SEQ ID NO: 33512 - DNA, 20 bp, Artificial Sequence
  sgRNA
  Ms4a6c_13
ctcctgtctgagttgtagaa

SEQ ID NO: 33513 - DNA, 20 bp, Artificial Sequence
  sgRNA
  Ms4a6c_14
gatgatcagcatcactgaaa

SEQ ID NO: 33514 - DNA, 20 bp, Artificial Sequence
  sgRNA
  Ms4a6c_15
caggctgtcttgcctctgtt

SEQ ID NO: 33515 - DNA, 20 bp, Artificial Sequence
  sgRNA
  Ms4a6c_16
gagttaaaatatgggacagg

SEQ ID NO: 33516 - DNA, 20 bp, Artificial Sequence
  sgRNA
  Ms4a6c_17
gtctcattggtcactacctg

SEQ ID NO: 33517 - DNA, 20 bp, Artificial Sequence
  sgRNA
  Ms4a6c_18
tggggaaagttgattccatt

SEQ ID NO: 33518 - DNA, 20 bp, Artificial Sequence
  sgRNA
  Ms4a6c_19
gatgctgatcatcagtgtgt

SEQ ID NO: 33519 - DNA, 20 bp, Artificial Sequence
  sgRNA
  Ms4a6c_20
tgtctgagttgtagaaaggt

SEQ ID NO: 33520 - DNA, 20 bp, Artificial Sequence
  sgRNA
  Ms4a6d_1
gaggacactcaggatgctca

SEQ ID NO: 33521 - DNA, 20 bp, Artificial Sequence
  sgRNA
  Ms4a6d_2
gtagccagattctaacagga

SEQ ID NO: 33522 - DNA, 20 bp, Artificial Sequence
  sgRNA
  Ms4a6d_3
agccagcttacattgctgca

SEQ ID NO: 33523 - DNA, 20 bp, Artificial Sequence
  sgRNA
  Ms4a6d_4
aatagacagaattccagaga

SEQ ID NO: 33524 - DNA, 20 bp, Artificial Sequence
  sgRNA
  Ms4a6d_5
cgatgcctgtaagagcagag

SEQ ID NO: 33525 - DNA, 20 bp, Artificial Sequence
  sgRNA
  Ms4a6d_6
caggctgtcttggctctggt

SEQ ID NO: 33526 - DNA, 20 bp, Artificial Sequence
  sgRNA
  Ms4a6d_7
aagtgactctgaagatacac

SEQ ID NO: 33527 - DNA, 20 bp, Artificial Sequence
  sgRNA
  Ms4a6d_8
gccacgaagcagctgtttaa

SEQ ID NO: 33528 - DNA, 20 bp, Artificial Sequence
  sgRNA
  Ms4a6d_9
gccattaaacagctgcttcg

SEQ ID NO: 33529 - DNA, 20 bp, Artificial Sequence
  sgRNA
  Ms4a6d_10
tcctcactgccacactgtgg

SEQ ID NO: 33530 - DNA, 20 bp, Artificial Sequence
  sgRNA
  Ms4a6d_11
ctgtcctcactgccacactg

SEQ ID NO: 33531 - DNA, 20 bp, Artificial Sequence
  sgRNA
  Ms4a6d_12
gctctgtttccaccacagtg

SEQ ID NO: 33532 - DNA, 20 bp, Artificial Sequence
  sgRNA
  Ms4a6d_13
aatcactgtgacagtctcac

SEQ ID NO: 33533 - DNA, 20 bp, Artificial Sequence
  sgRNA
  Ms4a6d_14
taacaggatggaaaacactg

SEQ ID NO: 33534 - DNA, 20 bp, Artificial Sequence
  sgRNA
  Ms4a6d_15
gtcacagtgatttcaccaaa

SEQ ID NO: 33535 - DNA, 20 bp, Artificial Sequence
  sgRNA
  Ms4a6d_16
gatgctaatcagcagtgtgt

SEQ ID NO: 33536 - DNA, 20 bp, Artificial Sequence
  sgRNA
  Ms4a6d_17
gaatctggctacccatttgt

SEQ ID NO: 33537 - DNA, 20 bp, Artificial Sequence
  sgRNA
  Ms4a6d_18
agtgtcctctctgctcttac

SEQ ID NO: 33538 - DNA, 20 bp, Artificial Sequence
  sgRNA
  Ms4a6d_19
tgccttgcagcaatgtaagc

SEQ ID NO: 33539 - DNA, 20 bp, Artificial Sequence
  sgRNA
  Ms4a6d_20
atgggtagccagattctaac

SEQ ID NO: 33540 - DNA, 20 bp, Artificial Sequence
  sgRNA
  Msln_1
tcctaggcacctcaccgacg

SEQ ID NO: 33541 - DNA, 20 bp, Artificial Sequence
  sgRNA
  Msln_2
tggatagccccccatcgaag

SEQ ID NO: 33542 - DNA, 20 bp, Artificial Sequence
  sgRNA
  Msln_3
catacacccaaggttccgac

SEQ ID NO: 33543 - DNA, 20 bp, Artificial Sequence
  sgRNA
  Msln_4
ccaatgtggatgtactccca

SEQ ID NO: 33544 - DNA, 20 bp, Artificial Sequence
  sgRNA
  Msln_5
atgtggatgtactcccacgg

SEQ ID NO: 33545 - DNA, 20 bp, Artificial Sequence
  sgRNA
  Msln_6
tggacatagccactttcaag

SEQ ID NO: 33546 - DNA, 20 bp, Artificial Sequence
  sgRNA
  Msln_7
tctatgtgacttcagccccc

SEQ ID NO: 33547 - DNA, 20 bp, Artificial Sequence
  sgRNA
  Msln_8
agactgaccacttcgatggg

SEQ ID NO: 33548 - DNA, 20 bp, Artificial Sequence
  sgRNA
  Msln_9
tcatacacccaaggttccga

SEQ ID NO: 33549 - DNA, 20 bp, Artificial Sequence
  sgRNA
  Msln_10
tcggaaccttgggtgtatga

SEQ ID NO: 33550 - DNA, 20 bp, Artificial Sequence
  sgRNA
  Msln_11
catcgtccagagcatcccca

SEQ ID NO: 33551 - DNA, 20 bp, Artificial Sequence
  sgRNA
  Msln_12
ggagactgaccacttcgatg

SEQ ID NO: 33552 - DNA, 20 bp, Artificial Sequence
  sgRNA
  Msln_13
cttccacaggaccccagcag

SEQ ID NO: 33553 - DNA, 20 bp, Artificial Sequence
  sgRNA
  Msln_14
tgtccatgctcacattgtgc

SEQ ID NO: 33554 - DNA, 20 bp, Artificial Sequence
  sgRNA
  Msln_15
ggaggtatctgacctgagca

SEQ ID NO: 33555 - DNA, 20 bp, Artificial Sequence
  sgRNA
  Msln_16
acactcctccatgctgtgaa

SEQ ID NO: 33556 - DNA, 20 bp, Artificial Sequence
  sgRNA
  Msln_17
gttgccctggaaacatggct

SEQ ID NO: 33557 - DNA, 20 bp, Artificial Sequence
  sgRNA
  Msln_18
ttaccatatcctcgtccagc

SEQ ID NO: 33558 - DNA, 20 bp, Artificial Sequence
  sgRNA
  Msln_19
agctgaccgtcatacaccca

SEQ ID NO: 33559 - DNA, 20 bp, Artificial Sequence
  sgRNA
  Msln_20
ggcgctccagagacctccgt

SEQ ID NO: 33560 - DNA, 20 bp, Artificial Sequence
  sgRNA
  Mslnl_1
ggcaagcagccaccacactg

SEQ ID NO: 33561 - DNA, 20 bp, Artificial Sequence
  sgRNA
  Mslnl_2
gcttactgtcatgcagactg

SEQ ID NO: 33562 - DNA, 20 bp, Artificial Sequence
  sgRNA
  Mslnl_3
tccactggcctatttcagcg

SEQ ID NO: 33563 - DNA, 20 bp, Artificial Sequence
  sgRNA
  Mslnl_4
gcagggagatcctgtgtccg

SEQ ID NO: 33564 - DNA, 20 bp, Artificial Sequence
  sgRNA
  Mslnl_5
tggaacccatagctgacggt

SEQ ID NO: 33565 - DNA, 20 bp, Artificial Sequence
  sgRNA
  Mslnl_6
gtaagtggccagaagtccga

SEQ ID NO: 33566 - DNA, 20 bp, Artificial Sequence
  sgRNA
  Mslnl_7
tcattcaccatgctgcccaa

SEQ ID NO: 33567 - DNA, 20 bp, Artificial Sequence
  sgRNA
  Mslnl_8
ggtattgaagttcctccaaa

SEQ ID NO: 33568 - DNA, 20 bp, Artificial Sequence
  sgRNA
  Mslnl_9
ccagtggaacatcacatccg

SEQ ID NO: 33569 - DNA, 20 bp, Artificial Sequence
  sgRNA
  Mslnl_10
gcagagacgggaacccccga

SEQ ID NO: 33570 - DNA, 20 bp, Artificial Sequence
  sgRNA
  Mslnl_11
gaaaccccatcattgcctgg

SEQ ID NO: 33571 - DNA, 20 bp, Artificial Sequence
  sgRNA
  Mslnl_12
gtattgaagttcctccaaag

SEQ ID NO: 33572 - DNA, 20 bp, Artificial Sequence
  sgRNA
  Mslnl_13
ttacccacatggcatccctg

SEQ ID NO: 33573 - DNA, 20 bp, Artificial Sequence
  sgRNA
  Mslnl_14
tgtataggcccatatcagac

SEQ ID NO: 33574 - DNA, 20 bp, Artificial Sequence
  sgRNA
  Mslnl_15
ggtgggggacactaactgcc

SEQ ID NO: 33575 - DNA, 20 bp, Artificial Sequence
  sgRNA
  Mslnl_16
cttgcattcagtcctccctt

SEQ ID NO: 33576 - DNA, 20 bp, Artificial Sequence
  sgRNA
  Mslnl_17
ggagacccagctgtgcagcg

SEQ ID NO: 33577 - DNA, 20 bp, Artificial Sequence
  sgRNA
  Mslnl_18
atccactccttggatccgcc

SEQ ID NO: 33578 - DNA, 20 bp, Artificial Sequence
  sgRNA
  Mslnl_19
tgcggctctggacaaccaga

SEQ ID NO: 33579 - DNA, 20 bp, Artificial Sequence
  sgRNA
  Mslnl_20
ccactgctcacaggacacta

SEQ ID NO: 33580 - DNA, 20 bp, Artificial Sequence
  sgRNA
  Msr1_1
gtattagtactgcaaacaca

SEQ ID NO: 33581 - DNA, 20 bp, Artificial Sequence
  sgRNA
  Msr1_2
tttcgtcagtccaggaacat

SEQ ID NO: 33582 - DNA, 20 bp, Artificial Sequence
  sgRNA
  Msr1_3
aaaagccgaccttatagaca

SEQ ID NO: 33583 - DNA, 20 bp, Artificial Sequence
  sgRNA
  Msr1_4
gaaagaagaacaagcgcacg

SEQ ID NO: 33584 - DNA, 20 bp, Artificial Sequence
  sgRNA
  Msr1_5
acgcttccagaatttcagca

SEQ ID NO: 33585 - DNA, 20 bp, Artificial Sequence
  sgRNA
  Msr1_6
gcgttccgtgtctataaggt

SEQ ID NO: 33586 - DNA, 20 bp, Artificial Sequence
  sgRNA
  Msr1_7
cagtcgaactgtcttaaggg

SEQ ID NO: 33587 - DNA, 20 bp, Artificial Sequence
  sgRNA
  Msr1_8
gcagtactaatacctgttgt

SEQ ID NO: 33588 - DNA, 20 bp, Artificial Sequence
  sgRNA
  Msr1_9
cttattcctggagcaccagg

SEQ ID NO: 33589 - DNA, 20 bp, Artificial Sequence
  sgRNA
  Msr1_10
agaactgtaaaatcaaccag

SEQ ID NO: 33590 - DNA, 20 bp, Artificial Sequence
  sgRNA
  Msr1_11
cttggtggaagatctccact

SEQ ID NO: 33591 - DNA, 20 bp, Artificial Sequence
  sgRNA
  Msr1_12
ggacaaattggcttccctgg

SEQ ID NO: 33592 - DNA, 20 bp, Artificial Sequence
  sgRNA
  Msr1_13
cagcatcctcttgttcatga

SEQ ID NO: 33593 - DNA, 20 bp, Artificial Sequence
  sgRNA
  Msr1_14
gcacaatctgtgatgatcgc

SEQ ID NO: 33594 - DNA, 20 bp, Artificial Sequence
  sgRNA
  Msr1_15
cctggaccccaaggtgaaaa

SEQ ID NO: 33595 - DNA, 20 bp, Artificial Sequence
  sgRNA
  Msr1_16
gctctgccctcatgaacaag

SEQ ID NO: 33596 - DNA, 20 bp, Artificial Sequence
  sgRNA
  Msr1_17
cctggacctaaaggacaaaa

SEQ ID NO: 33597 - DNA, 20 bp, Artificial Sequence
  sgRNA
  Msr1_18
gttgctttgctgtagattca

SEQ ID NO: 33598 - DNA, 20 bp, Artificial Sequence
  sgRNA
  Msr1_19
ccaggaacatgggaattcac

SEQ ID NO: 33599 - DNA, 20 bp, Artificial Sequence
  sgRNA
  Msr1_20
actggacaaactggtccacc

SEQ ID NO: 33600 - DNA, 20 bp, Artificial Sequence
  sgRNA
  Mst1r_1
aagtatcagactttagacga

SEQ ID NO: 33601 - DNA, 20 bp, Artificial Sequence
  sgRNA
  Mst1r_2
gggaacacaccagatcaccg

SEQ ID NO: 33602 - DNA, 20 bp, Artificial Sequence
  sgRNA
  Mst1r_3
atgtggtccgaaaccctcag

SEQ ID NO: 33603 - DNA, 20 bp, Artificial Sequence
  sgRNA
  Mst1r_4
aagacgtgtcacatgcagtg

SEQ ID NO: 33604 - DNA, 20 bp, Artificial Sequence
  sgRNA
  Mst1r_5
tgtgactgtgaacatgaccg

SEQ ID NO: 33605 - DNA, 20 bp, Artificial Sequence
  sgRNA
  Mst1r_6
gtacagagatgccttccact

SEQ ID NO: 33606 - DNA, 20 bp, Artificial Sequence
  sgRNA
  Mst1r_7
ctccgtctgtatattctccg

SEQ ID NO: 33607 - DNA, 20 bp, Artificial Sequence
  sgRNA
  Mst1r_8
ggtatcatgctgcccccgga

SEQ ID NO: 33608 - DNA, 20 bp, Artificial Sequence
  sgRNA
  Mst1r_9
gcacctaaacgccggcgccg

SEQ ID NO: 33609 - DNA, 20 bp, Artificial Sequence
  sgRNA
  Mst1r_10
acagcgacggaaaacctggt

SEQ ID NO: 33610 - DNA, 20 bp, Artificial Sequence
  sgRNA
  Mst1r_11
gctgacaagatccttcacag

SEQ ID NO: 33611 - DNA, 20 bp, Artificial Sequence
  sgRNA
  Mst1r_12
tcttcttccctgttgtcgag

SEQ ID NO: 33612 - DNA, 20 bp, Artificial Sequence
  sgRNA
  Mst1r_13
cctgatgatgtcgtacctga

SEQ ID NO: 33613 - DNA, 20 bp, Artificial Sequence
  sgRNA
  Mst1r_14
cgaggacagtacaaatagtg

SEQ ID NO: 33614 - DNA, 20 bp, Artificial Sequence
  sgRNA
  Mst1r_15
gtatgtgtccaacttctccc

SEQ ID NO: 33615 - DNA, 20 bp, Artificial Sequence
  sgRNA
  Mst1r_16
ccaaacatcctggctctcat

SEQ ID NO: 33616 - DNA, 20 bp, Artificial Sequence
  sgRNA
  Mst1r_17
ggcagatcaccacatccccc

SEQ ID NO: 33617 - DNA, 20 bp, Artificial Sequence
  sgRNA
  Mst1r_18
cgtgatgcttcgatgctggg

SEQ ID NO: 33618 - DNA, 20 bp, Artificial Sequence
  sgRNA
  Mst1r_19
ggctggagctgctaagtgca

SEQ ID NO: 33619 - DNA, 20 bp, Artificial Sequence
  sgRNA
  Mst1r_20
gctcctgcaatgctgaggcg

SEQ ID NO: 33620 - DNA, 20 bp, Artificial Sequence
  sgRNA
  Mtnr1a_1
ctcagcgtacacgatagcag

SEQ ID NO: 33621 - DNA, 20 bp, Artificial Sequence
  sgRNA
  Mtnr1a_2
aagggtaaacagccaccacg

SEQ ID NO: 33622 - DNA, 20 bp, Artificial Sequence
  sgRNA
  Mtnr1a_3
gctcgatattcaacatcacg

SEQ ID NO: 33623 - DNA, 20 bp, Artificial Sequence
  sgRNA
  Mtnr1a_4
gcccagaatgtccaccacga

SEQ ID NO: 33624 - DNA, 20 bp, Artificial Sequence
  sgRNA
  Mtnr1a_5
ggtccttcaggtcagacgga

SEQ ID NO: 33625 - DNA, 20 bp, Artificial Sequence
  sgRNA
  Mtnr1a_6
tggtccttcaggtcagacgg

SEQ ID NO: 33626 - DNA, 20 bp, Artificial Sequence
  sgRNA
  Mtnr1a_7
gttcgtggctagttactacc

SEQ ID NO: 33627 - DNA, 20 bp, Artificial Sequence
  sgRNA
  Mtnr1a_8
catctatccttaacaacgga

SEQ ID NO: 33628 - DNA, 20 bp, Artificial Sequence
  sgRNA
  Mtnr1a_9
gtccgtatataattgcgttg

SEQ ID NO: 33629 - DNA, 20 bp, Artificial Sequence
  sgRNA
  Mtnr1a_10
ggctgtttacccttatccct

SEQ ID NO: 33630 - DNA, 20 bp, Artificial Sequence
  sgRNA
  Mtnr1a_11
ggcagctgttgaagtacgcc

SEQ ID NO: 33631 - DNA, 20 bp, Artificial Sequence
  sgRNA
  Mtnr1a_12
aaggtacaggagtagatccg

SEQ ID NO: 33632 - DNA, 20 bp, Artificial Sequence
  sgRNA
  Mtnr1a_13
acacagacaggatgaccagc

SEQ ID NO: 33633 - DNA, 20 bp, Artificial Sequence
  sgRNA
  Mtnr1a_14
ccaccacgatggtaaagatg

SEQ ID NO: 33634 - DNA, 20 bp, Artificial Sequence
  sgRNA
  Mtnr1a_15
agtagatccggggatcgtac

SEQ ID NO: 33635 - DNA, 20 bp, Artificial Sequence
  sgRNA
  Mtnr1a_16
gaacactccagtacgatccc

SEQ ID NO: 33636 - DNA, 20 bp, Artificial Sequence
  sgRNA
  Mtnr1a_17
gccactcagcaggctccagg

SEQ ID NO: 33637 - DNA, 20 bp, Artificial Sequence
  sgRNA
  Mtnr1a_18
atttgtggtgagtttagctg

SEQ ID NO: 33638 - DNA, 20 bp, Artificial Sequence
  sgRNA
  Mtnr1a_19
tttagctgtggcagacctcg

SEQ ID NO: 33639 - DNA, 20 bp, Artificial Sequence
  sgRNA
  Mtnr1a_20
ctgacatctatccttaacaa

SEQ ID NO: 33640 - DNA, 20 bp, Artificial Sequence
  sgRNA
  Mtnr1b_1
aaggtgcaggaatagatgcg

SEQ ID NO: 33641 - DNA, 20 bp, Artificial Sequence
  sgRNA
  Mtnr1b_2
gacactcaggcccatcacaa

SEQ ID NO: 33642 - DNA, 20 bp, Artificial Sequence
  sgRNA
  Mtnr1b_3
actgcagacccggtggtagg

SEQ ID NO: 33643 - DNA, 20 bp, Artificial Sequence
  sgRNA
  Mtnr1b_4
taatggccacaaggatcagt

SEQ ID NO: 33644 - DNA, 20 bp, Artificial Sequence
  sgRNA
  Mtnr1b_5
cctgaaccagaacttccgca

SEQ ID NO: 33645 - DNA, 20 bp, Artificial Sequence
  sgRNA
  Mtnr1b_6
ggatcctcttgtactccctg

SEQ ID NO: 33646 - DNA, 20 bp, Artificial Sequence
  sgRNA
  Mtnr1b_7
cttgtggccattatccgtga

SEQ ID NO: 33647 - DNA, 20 bp, Artificial Sequence
  sgRNA
  Mtnr1b_8
gcaccagtacccagattcgc

SEQ ID NO: 33648 - DNA, 20 bp, Artificial Sequence
  sgRNA
  Mtnr1b_9
gcaaggccgatacagttgag

SEQ ID NO: 33649 - DNA, 20 bp, Artificial Sequence
  sgRNA
  Mtnr1b_10
ctaactgctgtgaggccagc

SEQ ID NO: 33650 - DNA, 20 bp, Artificial Sequence
  sgRNA
  Mtnr1b_11
tgcagtggccatcaacccag

SEQ ID NO: 33651 - DNA, 20 bp, Artificial Sequence
  sgRNA
  Mtnr1b_12
ccacagccgtggacttcgtg

SEQ ID NO: 33652 - DNA, 20 bp, Artificial Sequence
  sgRNA
  Mtnr1b_13
agtcgtcgtcaccacagccg

SEQ ID NO: 33653 - DNA, 20 bp, Artificial Sequence
  sgRNA
  Mtnr1b_14
caggttccccacgaagtcca

SEQ ID NO: 33654 - DNA, 20 bp, Artificial Sequence
  sgRNA
  Mtnr1b_15
ccttgcagtgggcctcccca

SEQ ID NO: 33655 - DNA, 20 bp, Artificial Sequence
  sgRNA
  Mtnr1b_16
gctaccgtgcctgtcaagga

SEQ ID NO: 33656 - DNA, 20 bp, Artificial Sequence
  sgRNA
  Mtnr1b_17
tggccattatccgtgacggt

SEQ ID NO: 33657 - DNA, 20 bp, Artificial Sequence
  sgRNA
  Mtnr1b_18
cggctgacccagaccaacta

SEQ ID NO: 33658 - DNA, 20 bp, Artificial Sequence
  sgRNA
  Mtnr1b_19
acttccgcagggagtacaag

SEQ ID NO: 33659 - DNA, 20 bp, Artificial Sequence
  sgRNA
  Mtnr1b_20
gttcaggagcccataaacaa

SEQ ID NO: 33660 - DNA, 20 bp, Artificial Sequence
  sgRNA
  Muc1_1
agctctccagtagtccacgg

SEQ ID NO: 33661 - DNA, 20 bp, Artificial Sequence
  sgRNA
  Muc1_2
ttgtagttgaggtaccactg

SEQ ID NO: 33662 - DNA, 20 bp, Artificial Sequence
  sgRNA
  Muc1_3
tggccatggtaggagaaaca

SEQ ID NO: 33663 - DNA, 20 bp, Artificial Sequence
  sgRNA
  Muc1_4
agaactggtaggtagcaccg

SEQ ID NO: 33664 - DNA, 20 bp, Artificial Sequence
  sgRNA
  Muc1_5
gctgcccatagctctttcgg

SEQ ID NO: 33665 - DNA, 20 bp, Artificial Sequence
  sgRNA
  Muc1_6
cacagtcgattctaccacca

SEQ ID NO: 33666 - DNA, 20 bp, Artificial Sequence
  sgRNA
  Muc1_7
gagcccaacacagaactggt

SEQ ID NO: 33667 - DNA, 20 bp, Artificial Sequence
  sgRNA
  Muc1_8
gtagcgtccgtgagtgtggt

SEQ ID NO: 33668 - DNA, 20 bp, Artificial Sequence
  sgRNA
  Muc1_9
gagaccccaacagacaactg

SEQ ID NO: 33669 - DNA, 20 bp, Artificial Sequence
  sgRNA
  Muc1_10
gacttgctagaagtagcagc

SEQ ID NO: 33670 - DNA, 20 bp, Artificial Sequence
  sgRNA
  Muc1_11
cgtggtggtagaatcgactg

SEQ ID NO: 33671 - DNA, 20 bp, Artificial Sequence
  sgRNA
  Muc1_12
actactaccaagaactgaag

SEQ ID NO: 33672 - DNA, 20 bp, Artificial Sequence
  sgRNA
  Muc1_13
ctggggacgaggtaccaccg

SEQ ID NO: 33673 - DNA, 20 bp, Artificial Sequence
  sgRNA
  Muc1_14
ataccctgtttctcctacca

SEQ ID NO: 33674 - DNA, 20 bp, Artificial Sequence
  sgRNA
  Muc1_15
tctactaccaaagtgacgtc

SEQ ID NO: 33675 - DNA, 20 bp, Artificial Sequence
  sgRNA
  Muc1_16
gcacgtagcgtccgtgagtg

SEQ ID NO: 33676 - DNA, 20 bp, Artificial Sequence
  sgRNA
  Muc1_17
agtgccgccgaaagagctat

SEQ ID NO: 33677 - DNA, 20 bp, Artificial Sequence
  sgRNA
  Muc1_18
gctacaactccagtcagcaa

SEQ ID NO: 33678 - DNA, 20 bp, Artificial Sequence
  sgRNA
  Muc1_19
agctctccagtagtccacag

SEQ ID NO: 33679 - DNA, 20 bp, Artificial Sequence
  sgRNA
  Muc1_20
gcttatacagcataagaagg

SEQ ID NO: 33680 - DNA, 20 bp, Artificial Sequence
  sgRNA
  Muc13_1
tggagattgactctgtaccg

SEQ ID NO: 33681 - DNA, 20 bp, Artificial Sequence
  sgRNA
  Muc13_2
agattgactctgtaccgtgg

SEQ ID NO: 33682 - DNA, 20 bp, Artificial Sequence
  sgRNA
  Muc13_3
agactgtaattattaaagtg

SEQ ID NO: 33683 - DNA, 20 bp, Artificial Sequence
  sgRNA
  Muc13_4
ttcaggaacgacattccctg

SEQ ID NO: 33684 - DNA, 20 bp, Artificial Sequence
  sgRNA
  Muc13_5
acttccataacctacgactg

SEQ ID NO: 33685 - DNA, 20 bp, Artificial Sequence
  sgRNA
  Muc13_6
aagaagcagttcctttacag

SEQ ID NO: 33686 - DNA, 20 bp, Artificial Sequence
  sgRNA
  Muc13_7
gtgcatgccgggctaccaga

SEQ ID NO: 33687 - DNA, 20 bp, Artificial Sequence
  sgRNA
  Muc13_8
gcttccaccgctaggcacgg

SEQ ID NO: 33688 - DNA, 20 bp, Artificial Sequence
  sgRNA
  Muc13_9
agctcttccaccgtgcctag

SEQ ID NO: 33689 - DNA, 20 bp, Artificial Sequence
  sgRNA
  Muc13_10
ttagggttgcagagatcact

SEQ ID NO: 33690 - DNA, 20 bp, Artificial Sequence
  sgRNA
  Muc13_11
tcttccccaaagtcagaaca

SEQ ID NO: 33691 - DNA, 20 bp, Artificial Sequence
  sgRNA
  Muc13_12
tctgcctcagtcgtaggtta

SEQ ID NO: 33692 - DNA, 20 bp, Artificial Sequence
  sgRNA
  Muc13_13
cactcatgctaatgtcccca

SEQ ID NO: 33693 - DNA, 20 bp, Artificial Sequence
  sgRNA
  Muc13_14
gctggacaggctgaacccac

SEQ ID NO: 33694 - DNA, 20 bp, Artificial Sequence
  sgRNA
  Muc13_15
gtatccgtagtaaatatatt

SEQ ID NO: 33695 - DNA, 20 bp, Artificial Sequence
  sgRNA
  Muc13_16
cagctgatcctcaccatcgt

SEQ ID NO: 33696 - DNA, 20 bp, Artificial Sequence
  sgRNA
  Muc13_17
ttcatcccgctgtagccaaa

SEQ ID NO: 33697 - DNA, 20 bp, Artificial Sequence
  sgRNA
  Muc13_18
cggcttctccaacttaggag

SEQ ID NO: 33698 - DNA, 20 bp, Artificial Sequence
  sgRNA
  Muc13_19
tacaatgcacgtgcaaacct

SEQ ID NO: 33699 - DNA, 20 bp, Artificial Sequence
  sgRNA
  Muc13_20
ggaccaactcagccttctgg

SEQ ID NO: 33700 - DNA, 20 bp, Artificial Sequence
  sgRNA
  Muc15_1
tcatttcattaccatttgcg

SEQ ID NO: 33701 - DNA, 20 bp, Artificial Sequence
  sgRNA
  Muc15_2
gggaggaacagaatatgtgg

SEQ ID NO: 33702 - DNA, 20 bp, Artificial Sequence
  sgRNA
  Muc15_3
gaatgttcggagacctgtaa

SEQ ID NO: 33703 - DNA, 20 bp, Artificial Sequence
  sgRNA
  Muc15_4
aaggttgtagataaattcaa

SEQ ID NO: 33704 - DNA, 20 bp, Artificial Sequence
  sgRNA
  Muc15_5
gtcatcataaaggcgccgat

SEQ ID NO: 33705 - DNA, 20 bp, Artificial Sequence
  sgRNA
  Muc15_6
tgtttctgaggcctcgcaaa

SEQ ID NO: 33706 - DNA, 20 bp, Artificial Sequence
  sgRNA
  Muc15_7
gctacttattgtgtggacaa

SEQ ID NO: 33707 - DNA, 20 bp, Artificial Sequence
  sgRNA
  Muc15_8
ggaaacaaagccctgaacca

SEQ ID NO: 33708 - DNA, 20 bp, Artificial Sequence
  sgRNA
  Muc15_9
ggctaagcagtgaagcaccc

SEQ ID NO: 33709 - DNA, 20 bp, Artificial Sequence
  sgRNA
  Muc15_10
gctttctcccccttctggca

SEQ ID NO: 33710 - DNA, 20 bp, Artificial Sequence
  sgRNA
  Muc15_11
gattcatccatgccagaagg

SEQ ID NO: 33711 - DNA, 20 bp, Artificial Sequence
  sgRNA
  Muc15_12
acaaagccctgaaccaaggg

SEQ ID NO: 33712 - DNA, 20 bp, Artificial Sequence
  sgRNA
  Muc15_13
tcacagctgaacctactgaa

SEQ ID NO: 33713 - DNA, 20 bp, Artificial Sequence
  sgRNA
  Muc15_14
tctgctgtggatgagttcaa

SEQ ID NO: 33714 - DNA, 20 bp, Artificial Sequence
  sgRNA
  Muc15_15
gtgtggtctttggaggtgga

SEQ ID NO: 33715 - DNA, 20 bp, Artificial Sequence
  sgRNA
  Muc15_16
cttgttggctacttattgtg

SEQ ID NO: 33716 - DNA, 20 bp, Artificial Sequence
  sgRNA
  Muc15_17
agtcattagccaggttctgg

SEQ ID NO: 33717 - DNA, 20 bp, Artificial Sequence
  sgRNA
  Muc15_18
agtggaggtatagcatccat

SEQ ID NO: 33718 - DNA, 20 bp, Artificial Sequence
  sgRNA
  Muc15_19
ataaatgtaacttcagagaa

SEQ ID NO: 33719 - DNA, 20 bp, Artificial Sequence
  sgRNA
  Muc15_20
tatgcttctttccaaatgaa

SEQ ID NO: 33720 - DNA, 20 bp, Artificial Sequence
  sgRNA
  Muc16_1
gataaactggactttcccgc

SEQ ID NO: 33721 - DNA, 20 bp, Artificial Sequence
  sgRNA
  Muc16_2
cattgaacttccatgatcca

SEQ ID NO: 33722 - DNA, 20 bp, Artificial Sequence
  sgRNA
  Muc16_3
actaagtgatagcctatcca

SEQ ID NO: 33723 - DNA, 20 bp, Artificial Sequence
  sgRNA
  Muc16_4
ccatcaaaggtaacttaccg

SEQ ID NO: 33724 - DNA, 20 bp, Artificial Sequence
  sgRNA
  Muc16_5
ccatcaccagttattaacag

SEQ ID NO: 33725 - DNA, 20 bp, Artificial Sequence
  sgRNA
  Muc16_6
ataactggatagagtcccat

SEQ ID NO: 33726 - DNA, 20 bp, Artificial Sequence
  sgRNA
  Muc16_7
ggaacgctaggtgagatcgt

SEQ ID NO: 33727 - DNA, 20 bp, Artificial Sequence
  sgRNA
  Muc16_8
atactggtcttattgaacaa

SEQ ID NO: 33728 - DNA, 20 bp, Artificial Sequence
  sgRNA
  Muc16_9
gatactaatggaggttccag

SEQ ID NO: 33729 - DNA, 20 bp, Artificial Sequence
  sgRNA
  Muc16_10
gtctgcagttagaataccgg

SEQ ID NO: 33730 - DNA, 20 bp, Artificial Sequence
  sgRNA
  Muc16_11
tctacattaatctcatccag

SEQ ID NO: 33731 - DNA, 20 bp, Artificial Sequence
  sgRNA
  Muc16_12
actggattgtcccccaacat

SEQ ID NO: 33732 - DNA, 20 bp, Artificial Sequence
  sgRNA
  Muc16_13
aagcagtatcaataacccca

SEQ ID NO: 33733 - DNA, 20 bp, Artificial Sequence
  sgRNA
  Muc16_14
gtttctgaagaagcaacagt

SEQ ID NO: 33734 - DNA, 20 bp, Artificial Sequence
  sgRNA
  Muc16_15
agtcctgcaatgcatcccca

SEQ ID NO: 33735 - DNA, 20 bp, Artificial Sequence
  sgRNA
  Muc16_16
tcatgtctactgaatatgga

SEQ ID NO: 33736 - DNA, 20 bp, Artificial Sequence
  sgRNA
  Muc16_17
tctactatggatatttccca

SEQ ID NO: 33737 - DNA, 20 bp, Artificial Sequence
  sgRNA
  Muc16_18
tccttcagaacaacaaacta

SEQ ID NO: 33738 - DNA, 20 bp, Artificial Sequence
  sgRNA
  Muc16_19
cattcgatacccatgttggg

SEQ ID NO: 33739 - DNA, 20 bp, Artificial Sequence
  sgRNA
  Muc16_20
ccagttgctgaacttcacac

SEQ ID NO: 33740 - DNA, 20 bp, Artificial Sequence
  sgRNA
  Muc3_1
ggatactcactggtacagcg

SEQ ID NO: 33741 - DNA, 20 bp, Artificial Sequence
  sgRNA
  Muc3_2
tctgccccaacggcttcggg

SEQ ID NO: 33742 - DNA, 20 bp, Artificial Sequence
  sgRNA
  Muc3_3
agaacacgaggaggatcacg

SEQ ID NO: 33743 - DNA, 20 bp, Artificial Sequence
  sgRNA
  Muc3_4
gctggcataccggagtatga

SEQ ID NO: 33744 - DNA, 20 bp, Artificial Sequence
  sgRNA
  Muc3_5
tccaccagttcctcacaccg

SEQ ID NO: 33745 - DNA, 20 bp, Artificial Sequence
  sgRNA
  Muc3_6
ctgtgagaatatagtcaacg

SEQ ID NO: 33746 - DNA, 20 bp, Artificial Sequence
  sgRNA
  Muc3_7
gggtttatgtggtttaggga

SEQ ID NO: 33747 - DNA, 20 bp, Artificial Sequence
  sgRNA
  Muc3_8
gatcccccccgaagccgttg

SEQ ID NO: 33748 - DNA, 20 bp, Artificial Sequence
  sgRNA
  Muc3_9
ttgcaaagtttgtcacactg

SEQ ID NO: 33749 - DNA, 20 bp, Artificial Sequence
  sgRNA
  Muc3_10
agataccgtcgtcaaaaacc

SEQ ID NO: 33750 - DNA, 20 bp, Artificial Sequence
  sgRNA
  Muc3_11
gcctgatcacggatactcac

SEQ ID NO: 33751 - DNA, 20 bp, Artificial Sequence
  sgRNA
  Muc3_12
gcttcagaaaagatgcgcaa

SEQ ID NO: 33752 - DNA, 20 bp, Artificial Sequence
  sgRNA
  Muc3_13
atgataaccccttcatactc

SEQ ID NO: 33753 - DNA, 20 bp, Artificial Sequence
  sgRNA
  Muc3_14
cgatcccccccgaagccgtt

SEQ ID NO: 33754 - DNA, 20 bp, Artificial Sequence
  sgRNA
  Muc3_15
ctgcgagaatggaggcacgt

SEQ ID NO: 33755 - DNA, 20 bp, Artificial Sequence
  sgRNA
  Muc3_16
acggatactcactggtacag

SEQ ID NO: 33756 - DNA, 20 bp, Artificial Sequence
  sgRNA
  Muc3_17
gtgtctgagatgtacaagtg

SEQ ID NO: 33757 - DNA, 20 bp, Artificial Sequence
  sgRNA
  Muc3_18
actgcgagaatggaggcacg

SEQ ID NO: 33758 - DNA, 20 bp, Artificial Sequence
  sgRNA
  Muc3_19
tgaagcggatggagaacacg

SEQ ID NO: 33759 - DNA, 20 bp, Artificial Sequence
  sgRNA
  Muc3_20
ggattatgatgtcatcctga

SEQ ID NO: 33760 - DNA, 20 bp, Artificial Sequence
  sgRNA
  Muc3a_1
tgtcatcgaactgctcccaa

SEQ ID NO: 33761 - DNA, 20 bp, Artificial Sequence
  sgRNA
  Muc3a_2
tcaacggccaactcacagcg

SEQ ID NO: 33762 - DNA, 20 bp, Artificial Sequence
  sgRNA
  Muc3a_3
tctgcagaaaacactgtcca

SEQ ID NO: 33763 - DNA, 20 bp, Artificial Sequence
  sgRNA
  Muc3a_4
gttggtatccaccttctcca

SEQ ID NO: 33764 - DNA, 20 bp, Artificial Sequence
  sgRNA
  Muc3a_5
ggttcacatccaaagacctg

SEQ ID NO: 33765 - DNA, 20 bp, Artificial Sequence
  sgRNA
  Muc3a_6
gtctgggtggcacgttcccg

SEQ ID NO: 33766 - DNA, 20 bp, Artificial Sequence
  sgRNA
  Muc3a_7
gcacaatgacagcccccacc

SEQ ID NO: 33767 - DNA, 20 bp, Artificial Sequence
  sgRNA
  Muc3a_8
gatctgggatgaagacatcg

SEQ ID NO: 33768 - DNA, 20 bp, Artificial Sequence
  sgRNA
  Muc3a_9
tagtgttcctcaaaaccctt

SEQ ID NO: 33769 - DNA, 20 bp, Artificial Sequence
  sgRNA
  Muc3a_10
tcgatggtgccattcacgcc

SEQ ID NO: 33770 - DNA, 20 bp, Artificial Sequence
  sgRNA
  Muc3a_11
gtagtgttcctcaaaaccct

SEQ ID NO: 33771 - DNA, 20 bp, Artificial Sequence
  sgRNA
  Muc3a_12
gctgtgagttggccgttgac

SEQ ID NO: 33772 - DNA, 20 bp, Artificial Sequence
  sgRNA
  Muc3a_13
tgaggaacactactttcctt

SEQ ID NO: 33773 - DNA, 20 bp, Artificial Sequence
  sgRNA
  Muc3a_14
ctgtccatggttgcagtcga

SEQ ID NO: 33774 - DNA, 20 bp, Artificial Sequence
  sgRNA
  Muc3a_15
ggtgatgatgaggctacctc

SEQ ID NO: 33775 - DNA, 20 bp, Artificial Sequence
  sgRNA
  Muc3a_16
gaaggtggataccaacatga

SEQ ID NO: 33776 - DNA, 20 bp, Artificial Sequence
  sgRNA
  Muc3a_17
ggaacactactttcctttgg

SEQ ID NO: 33777 - DNA, 20 bp, Artificial Sequence
  sgRNA
  Muc3a_18
atctgggatgaagacatcgc

SEQ ID NO: 33778 - DNA, 20 bp, Artificial Sequence
  sgRNA
  Muc3a_19
gggagcagttcgatgacaaa

SEQ ID NO: 33779 - DNA, 20 bp, Artificial Sequence
  sgRNA
  Muc3a_20
tgagttggccgttgactgga

SEQ ID NO: 33780 - DNA, 20 bp, Artificial Sequence
  sgRNA
  Muc4_1
gtagaaggaatcccgcaggg

SEQ ID NO: 33781 - DNA, 20 bp, Artificial Sequence
  sgRNA
  Muc4_2
cacgtagaaggaatcccgca

SEQ ID NO: 33782 - DNA, 20 bp, Artificial Sequence
  sgRNA
  Muc4_3
ctccgacttcagacccgtag

SEQ ID NO: 33783 - DNA, 20 bp, Artificial Sequence
  sgRNA
  Muc4_4
tcccgcagggaggaaccgag

SEQ ID NO: 33784 - DNA, 20 bp, Artificial Sequence
  sgRNA
  Muc4_5
cttactgcagaagcaagcca

SEQ ID NO: 33785 - DNA, 20 bp, Artificial Sequence
  sgRNA
  Muc4_6
tcaaagtaccaccatcccag

SEQ ID NO: 33786 - DNA, 20 bp, Artificial Sequence
  sgRNA
  Muc4_7
atccctcgctagaatctcca

SEQ ID NO: 33787 - DNA, 20 bp, Artificial Sequence
  sgRNA
  Muc4_8
ggttgggctggggctagtaa

SEQ ID NO: 33788 - DNA, 20 bp, Artificial Sequence
  sgRNA
  Muc4_9
taccctggagattctagcga

SEQ ID NO: 33789 - DNA, 20 bp, Artificial Sequence
  sgRNA
  Muc4_10
tgatgaatggacttgctcga

SEQ ID NO: 33790 - DNA, 20 bp, Artificial Sequence
  sgRNA
  Muc4_11
gagtcaccagacgtatggca

SEQ ID NO: 33791 - DNA, 20 bp, Artificial Sequence
  sgRNA
  Muc4_12
ggtactccagcccaagaccg

SEQ ID NO: 33792 - DNA, 20 bp, Artificial Sequence
  sgRNA
  Muc4_13
tgtcagtgagacttgtgcgg

SEQ ID NO: 33793 - DNA, 20 bp, Artificial Sequence
  sgRNA
  Muc4_14
ggaatatcgaaaccacacag

SEQ ID NO: 33794 - DNA, 20 bp, Artificial Sequence
  sgRNA
  Muc4_15
ccacttcttccccatctcga

SEQ ID NO: 33795 - DNA, 20 bp, Artificial Sequence
  sgRNA
  Muc4_16
gtaccctggagattctagcg

SEQ ID NO: 33796 - DNA, 20 bp, Artificial Sequence
  sgRNA
  Muc4_17
ctcttgatgtgatcacaccg

SEQ ID NO: 33797 - DNA, 20 bp, Artificial Sequence
  sgRNA
  Muc4_18
ggtgttgtattgagccgcaa

SEQ ID NO: 33798 - DNA, 20 bp, Artificial Sequence
  sgRNA
  Muc4_19
gcaggtctacaggctgcaca

SEQ ID NO: 33799 - DNA, 20 bp, Artificial Sequence
  sgRNA
  Muc4_20
atcagcatcagcccagaacg

SEQ ID NO: 33800 - DNA, 20 bp, Artificial Sequence
  sgRNA
  Musk_1
cacccgcagagagtcgaccg

SEQ ID NO: 33801 - DNA, 20 bp, Artificial Sequence
  sgRNA
  Musk_2
agaaaagttcagtaccgcaa

SEQ ID NO: 33802 - DNA, 20 bp, Artificial Sequence
  sgRNA
  Musk_3
tgcaggacagtaccgctgtg

SEQ ID NO: 33803 - DNA, 20 bp, Artificial Sequence
  sgRNA
  Musk_4
atggaaggaaaggcccaccg

SEQ ID NO: 33804 - DNA, 20 bp, Artificial Sequence
  sgRNA
  Musk_5
agtcccgctgaaggcaacca

SEQ ID NO: 33805 - DNA, 20 bp, Artificial Sequence
  sgRNA
  Musk_6
gttctgccgtgcactacgat

SEQ ID NO: 33806 - DNA, 20 bp, Artificial Sequence
  sgRNA
  Musk_7
agatctgtagaggccccggt

SEQ ID NO: 33807 - DNA, 20 bp, Artificial Sequence
  sgRNA
  Musk_8
caacgtggtgagggtcaccg

SEQ ID NO: 33808 - DNA, 20 bp, Artificial Sequence
  sgRNA
  Musk_9
gggttacccatcgtagtgca

SEQ ID NO: 33809 - DNA, 20 bp, Artificial Sequence
  sgRNA
  Musk_10
gctcctcaccattctgagcg

SEQ ID NO: 33810 - DNA, 20 bp, Artificial Sequence
  sgRNA
  Musk_11
ttgtagaagatagactcggg

SEQ ID NO: 33811 - DNA, 20 bp, Artificial Sequence
  sgRNA
  Musk_12
tctgggagatcttctcctat

SEQ ID NO: 33812 - DNA, 20 bp, Artificial Sequence
  sgRNA
  Musk_13
gctactgtgcccagtacaga

SEQ ID NO: 33813 - DNA, 20 bp, Artificial Sequence
  sgRNA
  Musk_14
tcttcttcaacacctcctac

SEQ ID NO: 33814 - DNA, 20 bp, Artificial Sequence
  sgRNA
  Musk_15
agaagagctcctttaccgcc

SEQ ID NO: 33815 - DNA, 20 bp, Artificial Sequence
  sgRNA
  Musk_16
gtatccatagaaaaccacgg

SEQ ID NO: 33816 - DNA, 20 bp, Artificial Sequence
  sgRNA
  Musk_17
tgcatagctaccaataagca

SEQ ID NO: 33817 - DNA, 20 bp, Artificial Sequence
  sgRNA
  Musk_18
tgctgcactctggtaccgga

SEQ ID NO: 33818 - DNA, 20 bp, Artificial Sequence
  sgRNA
  Musk_19
catccgactcagtggtgtag

SEQ ID NO: 33819 - DNA, 20 bp, Artificial Sequence
  sgRNA
  Musk_20
tgggagtaggtaccactcca

SEQ ID NO: 33820 - DNA, 20 bp, Artificial Sequence
  sgRNA
  Mxra8_1
tcactgacacgcgatcacgc

SEQ ID NO: 33821 - DNA, 20 bp, Artificial Sequence
  sgRNA
  Mxra8_2
tgtgcgcctcgaggttacag

SEQ ID NO: 33822 - DNA, 20 bp, Artificial Sequence
  sgRNA
  Mxra8_3
gactgaccgccatttagagg

SEQ ID NO: 33823 - DNA, 20 bp, Artificial Sequence
  sgRNA
  Mxra8_4
cttgtggatatgtattcggc

SEQ ID NO: 33824 - DNA, 20 bp, Artificial Sequence
  sgRNA
  Mxra8_5
gctgcatgatcgccagcgcg

SEQ ID NO: 33825 - DNA, 20 bp, Artificial Sequence
  sgRNA
  Mxra8_6
gctacacgatatcgtcacag

SEQ ID NO: 33826 - DNA, 20 bp, Artificial Sequence
  sgRNA
  Mxra8_7
atacaggtcaagcaggcggt

SEQ ID NO: 33827 - DNA, 20 bp, Artificial Sequence
  sgRNA
  Mxra8_8
gcatggtgtggacccaagac

SEQ ID NO: 33828 - DNA, 20 bp, Artificial Sequence
  sgRNA
  Mxra8_9
gctgcgcctcctctaaatgg

SEQ ID NO: 33829 - DNA, 20 bp, Artificial Sequence
  sgRNA
  Mxra8_10
acacgatatcgtcacagcgg

SEQ ID NO: 33830 - DNA, 20 bp, Artificial Sequence
  sgRNA
  Mxra8_11
ggtcagtccacacgtgcgca

SEQ ID NO: 33831 - DNA, 20 bp, Artificial Sequence
  sgRNA
  Mxra8_12
ttaagtcgcgcatactggga

SEQ ID NO: 33832 - DNA, 20 bp, Artificial Sequence
  sgRNA
  Mxra8_13
atgcatacaggtcaagcagg

SEQ ID NO: 33833 - DNA, 20 bp, Artificial Sequence
  sgRNA
  Mxra8_14
ctccagctcatcgatgcgta

SEQ ID NO: 33834 - DNA, 20 bp, Artificial Sequence
  sgRNA
  Mxra8_15
acttgtggatatgtattcgg

SEQ ID NO: 33835 - DNA, 20 bp, Artificial Sequence
  sgRNA
  Mxra8_16
ggaagggtggcccataggcg

SEQ ID NO: 33836 - DNA, 20 bp, Artificial Sequence
  sgRNA
  Mxra8_17
cttgggtccacaccatgcgg

SEQ ID NO: 33837 - DNA, 20 bp, Artificial Sequence
  sgRNA
  Mxra8_18
atatggagcctgatcccttg

SEQ ID NO: 33838 - DNA, 20 bp, Artificial Sequence
  sgRNA
  Mxra8_19
gctccagctcatcgatgcgt

SEQ ID NO: 33839 - DNA, 20 bp, Artificial Sequence
  sgRNA
  Mxra8_20
ggtccactgggacctcagcg

SEQ ID NO: 33840 - DNA, 20 bp, Artificial Sequence
  sgRNA
  Myadm_1
cctagctcatggacgtaccc

SEQ ID NO: 33841 - DNA, 20 bp, Artificial Sequence
  sgRNA
  Myadm_2
atatagccagtgatctcacc

SEQ ID NO: 33842 - DNA, 20 bp, Artificial Sequence
  sgRNA
  Myadm_3
gcagctaatatccacctgtg

SEQ ID NO: 33843 - DNA, 20 bp, Artificial Sequence
  sgRNA
  Myadm_4
cgcccgagcggaccccacag

SEQ ID NO: 33844 - DNA, 20 bp, Artificial Sequence
  sgRNA
  Myadm_5
cttggatccattgaacggcg

SEQ ID NO: 33845 - DNA, 20 bp, Artificial Sequence
  sgRNA
  Myadm_6
gtataatcagaagccagccc

SEQ ID NO: 33846 - DNA, 20 bp, Artificial Sequence
  sgRNA
  Myadm_7
gctatatggctaccgtgcca

SEQ ID NO: 33847 - DNA, 20 bp, Artificial Sequence
  sgRNA
  Myadm_8
agcttggatccattgaacgg

SEQ ID NO: 33848 - DNA, 20 bp, Artificial Sequence
  sgRNA
  Myadm_9
ggatggacaccgccagtcgt

SEQ ID NO: 33849 - DNA, 20 bp, Artificial Sequence
  sgRNA
  Myadm_10
ccaccactgtggggtccgct

SEQ ID NO: 33850 - DNA, 20 bp, Artificial Sequence
  sgRNA
  Myadm_11
ggatgacgttgtagtcgtga

SEQ ID NO: 33851 - DNA, 20 bp, Artificial Sequence
  sgRNA
  Myadm_12
tttctgggaccgacgactgg

SEQ ID NO: 33852 - DNA, 20 bp, Artificial Sequence
  sgRNA
  Myadm_13
gactgccacacaccactcca

SEQ ID NO: 33853 - DNA, 20 bp, Artificial Sequence
  sgRNA
  Myadm_14
aggtggatattagctgcagg

SEQ ID NO: 33854 - DNA, 20 bp, Artificial Sequence
  sgRNA
  Myadm_15
catcacctttgcctgctacg

SEQ ID NO: 33855 - DNA, 20 bp, Artificial Sequence
  sgRNA
  Myadm_16
acacgttggtacaatccccc

SEQ ID NO: 33856 - DNA, 20 bp, Artificial Sequence
  sgRNA
  Myadm_17
cctgatatctctgatcaaat

SEQ ID NO: 33857 - DNA, 20 bp, Artificial Sequence
  sgRNA
  Myadm_18
ctaatactacgagtgcagct

SEQ ID NO: 33858 - DNA, 20 bp, Artificial Sequence
  sgRNA
  Myadm_19
gggccaaccccgccgttcaa

SEQ ID NO: 33859 - DNA, 20 bp, Artificial Sequence
  sgRNA
  Myadm_20
gatcagacacatatgccagc

SEQ ID NO: 33860 - DNA, 20 bp, Artificial Sequence
  sgRNA
  Myadml2_1
gggggtgcatacctgcactt

SEQ ID NO: 33861 - DNA, 20 bp, Artificial Sequence
  sgRNA
  Myadml2_2
ggacacccccaaaaccacct

SEQ ID NO: 33862 - DNA, 20 bp, Artificial Sequence
  sgRNA
  Myadml2_3
agcattcgggctgtacccac

SEQ ID NO: 33863 - DNA, 20 bp, Artificial Sequence
  sgRNA
  Myadml2_4
cacagcagccttcgccatgt

SEQ ID NO: 33864 - DNA, 20 bp, Artificial Sequence
  sgRNA
  Myadml2_5
agttgccccaggaaaggcgc

SEQ ID NO: 33865 - DNA, 20 bp, Artificial Sequence
  sgRNA
  Myadml2_6
gctcaggtgggcactccagt

SEQ ID NO: 33866 - DNA, 20 bp, Artificial Sequence
  sgRNA
  Myadml2_7
ggccagcaccagaatctccg

SEQ ID NO: 33867 - DNA, 20 bp, Artificial Sequence
  sgRNA
  Myadml2_8
ccctctgtacttcacccgac

SEQ ID NO: 33868 - DNA, 20 bp, Artificial Sequence
  sgRNA
  Myadml2_9
tgatgatgtcatgacagcga

SEQ ID NO: 33869 - DNA, 20 bp, Artificial Sequence
  sgRNA
  Myadml2_10
agtgcaggtatgcaccccct

SEQ ID NO: 33870 - DNA, 20 bp, Artificial Sequence
  sgRNA
  Myadml2_11
tcgggctgtacccaccggcg

SEQ ID NO: 33871 - DNA, 20 bp, Artificial Sequence
  sgRNA
  Myadml2_12
agggtagatgacagcggccg

SEQ ID NO: 33872 - DNA, 20 bp, Artificial Sequence
  sgRNA
  Myadml2_13
cagggtcgccaacatggcga

SEQ ID NO: 33873 - DNA, 20 bp, Artificial Sequence
  sgRNA
  Myadml2_14
gagtgcccacctgagcctgc

SEQ ID NO: 33874 - DNA, 20 bp, Artificial Sequence
  sgRNA
  Myadml2_15
aggcgctgtgacctcgccgg

SEQ ID NO: 33875 - DNA, 20 bp, Artificial Sequence
  sgRNA
  Myadml2_16
tggctgtaccactttcagtt

SEQ ID NO: 33876 - DNA, 20 bp, Artificial Sequence
  sgRNA
  Myadml2_17
ggctgctgtgaagttgcccc

SEQ ID NO: 33877 - DNA, 20 bp, Artificial Sequence
  sgRNA
  Myadml2_18
cttaggcgctgtgacctcgc

SEQ ID NO: 33878 - DNA, 20 bp, Artificial Sequence
  sgRNA
  Myadml2_19
ttcagtttggttgctcaccg

SEQ ID NO: 33879 - DNA, 20 bp, Artificial Sequence
  sgRNA
  Myadml2_20
gtacagagggtagatgacag

SEQ ID NO: 33880 - DNA, 20 bp, Artificial Sequence
  sgRNA
  Myof_1
agaggacacctatacggatg

SEQ ID NO: 33881 - DNA, 20 bp, Artificial Sequence
  sgRNA
  Myof_2
ccacatccaaatgatccgag

SEQ ID NO: 33882 - DNA, 20 bp, Artificial Sequence
  sgRNA
  Myof_3
tactgcacggctgtattgag

SEQ ID NO: 33883 - DNA, 20 bp, Artificial Sequence
  sgRNA
  Myof_4
gtttctctcccagatacacg

SEQ ID NO: 33884 - DNA, 20 bp, Artificial Sequence
  sgRNA
  Myof_5
cctatggctctacagccgat

SEQ ID NO: 33885 - DNA, 20 bp, Artificial Sequence
  sgRNA
  Myof_6
tgtatcacactcacaggcgg

SEQ ID NO: 33886 - DNA, 20 bp, Artificial Sequence
  sgRNA
  Myof_7
ggtagtctcgacctccgtat

SEQ ID NO: 33887 - DNA, 20 bp, Artificial Sequence
  sgRNA
  Myof_8
catatctgaatgatcagccg

SEQ ID NO: 33888 - DNA, 20 bp, Artificial Sequence
  sgRNA
  Myof_9
catgaaggtcacccaccgga

SEQ ID NO: 33889 - DNA, 20 bp, Artificial Sequence
  sgRNA
  Myof_10
tggctcggaggatcaccaaa

SEQ ID NO: 33890 - DNA, 20 bp, Artificial Sequence
  sgRNA
  Myof_11
ggaagcagaatccgatacgg

SEQ ID NO: 33891 - DNA, 20 bp, Artificial Sequence
  sgRNA
  Myof_12
ggaggatattagtcaccgcc

SEQ ID NO: 33892 - DNA, 20 bp, Artificial Sequence
  sgRNA
  Myof_13
ataacgacttcccggcatgg

SEQ ID NO: 33893 - DNA, 20 bp, Artificial Sequence
  sgRNA
  Myof_14
gcgccacacgatgaagcgca

SEQ ID NO: 33894 - DNA, 20 bp, Artificial Sequence
  sgRNA
  Myof_15
ggcaccttcgagtttaaaga

SEQ ID NO: 33895 - DNA, 20 bp, Artificial Sequence
  sgRNA
  Myof_16
ggtggagtacaagacttggt

SEQ ID NO: 33896 - DNA, 20 bp, Artificial Sequence
  sgRNA
  Myof_17
aaagcgaaagggtcacgaca

SEQ ID NO: 33897 - DNA, 20 bp, Artificial Sequence
  sgRNA
  Myof_18
ctatcggctgtagagccata

SEQ ID NO: 33898 - DNA, 20 bp, Artificial Sequence
  sgRNA
  Myof_19
acagatgtgaactttcacca

SEQ ID NO: 33899 - DNA, 20 bp, Artificial Sequence
  sgRNA
  Myof_20
gcacagccacgaacagcaac

SEQ ID NO: 33900 - DNA, 20 bp, Artificial Sequence
  sgRNA
  Naaladl1_1
atcgctctgactcgctacgg

SEQ ID NO: 33901 - DNA, 20 bp, Artificial Sequence
  sgRNA
  Naaladl1_2
ggaaatcctgaggtgttgtg

SEQ ID NO: 33902 - DNA, 20 bp, Artificial Sequence
  sgRNA
  Naaladl1_3
agtggaaggttgttccattg

SEQ ID NO: 33903 - DNA, 20 bp, Artificial Sequence
  sgRNA
  Naaladl1_4
tggctctacagaatttacag

SEQ ID NO: 33904 - DNA, 20 bp, Artificial Sequence
  sgRNA
  Naaladl1_5
cttgcatcctcaaagccgat

SEQ ID NO: 33905 - DNA, 20 bp, Artificial Sequence
  sgRNA
  Naaladl1_6
cgtgatctacggaaaccacc

SEQ ID NO: 33906 - DNA, 20 bp, Artificial Sequence
  sgRNA
  Naaladl1_7
gcaaatatgatggacctgcg

SEQ ID NO: 33907 - DNA, 20 bp, Artificial Sequence
  sgRNA
  Naaladl1_8
catcgctctgactcgctacg

SEQ ID NO: 33908 - DNA, 20 bp, Artificial Sequence
  sgRNA
  Naaladl1_9
cttcgagaagaatctgaccg

SEQ ID NO: 33909 - DNA, 20 bp, Artificial Sequence
  sgRNA
  Naaladl1_10
gcaccagggcttcgtcccga

SEQ ID NO: 33910 - DNA, 20 bp, Artificial Sequence
  sgRNA
  Naaladl1_11
ccggtcagattcttctcgaa

SEQ ID NO: 33911 - DNA, 20 bp, Artificial Sequence
  sgRNA
  Naaladl1_12
tgttgggcgcccagagcacg

SEQ ID NO: 33912 - DNA, 20 bp, Artificial Sequence
  sgRNA
  Naaladl1_13
ggacccggctttgagccgaa

SEQ ID NO: 33913 - DNA, 20 bp, Artificial Sequence
  sgRNA
  Naaladl1_14
ccgattcccacccagcctat

SEQ ID NO: 33914 - DNA, 20 bp, Artificial Sequence
  sgRNA
  Naaladl1_15
accttgcctacacctatgac

SEQ ID NO: 33915 - DNA, 20 bp, Artificial Sequence
  sgRNA
  Naaladl1_16
cagcttgtactcacagccca

SEQ ID NO: 33916 - DNA, 20 bp, Artificial Sequence
  sgRNA
  Naaladl1_17
ccacccctcttctttccgcc

SEQ ID NO: 33917 - DNA, 20 bp, Artificial Sequence
  sgRNA
  Naaladl1_18
attgtagtaacggccctgga

SEQ ID NO: 33918 - DNA, 20 bp, Artificial Sequence
  sgRNA
  Naaladl1_19
gcgatccttgactccgtaat

SEQ ID NO: 33919 - DNA, 20 bp, Artificial Sequence
  sgRNA
  Naaladl1_20
aatgtcctgggcatcatcca

SEQ ID NO: 33920 - DNA, 20 bp, Artificial Sequence
  sgRNA
  Nagpa_1
agccaccgttctgagcgatg

SEQ ID NO: 33921 - DNA, 20 bp, Artificial Sequence
  sgRNA
  Nagpa_2
gcgatggaaccatagtcacc

SEQ ID NO: 33922 - DNA, 20 bp, Artificial Sequence
  sgRNA
  Nagpa_3
agcaccgagaaagtgcgtag

SEQ ID NO: 33923 - DNA, 20 bp, Artificial Sequence
  sgRNA
  Nagpa_4
gttcttaccagtgatctgaa

SEQ ID NO: 33924 - DNA, 20 bp, Artificial Sequence
  sgRNA
  Nagpa_5
gccaactgaggctacgccga

SEQ ID NO: 33925 - DNA, 20 bp, Artificial Sequence
  sgRNA
  Nagpa_6
ggttgccgcatcgctcagaa

SEQ ID NO: 33926 - DNA, 20 bp, Artificial Sequence
  sgRNA
  Nagpa_7
tgagcgatgcggcaaccggc

SEQ ID NO: 33927 - DNA, 20 bp, Artificial Sequence
  sgRNA
  Nagpa_8
ggaactctgccatctcccat

SEQ ID NO: 33928 - DNA, 20 bp, Artificial Sequence
  sgRNA
  Nagpa_9
tgactatggttccatcgcgt

SEQ ID NO: 33929 - DNA, 20 bp, Artificial Sequence
  sgRNA
  Nagpa_10
ggaacgtggtgagcgacggg

SEQ ID NO: 33930 - DNA, 20 bp, Artificial Sequence
  sgRNA
  Nagpa_11
tgtcgtcaatgccatcaacc

SEQ ID NO: 33931 - DNA, 20 bp, Artificial Sequence
  sgRNA
  Nagpa_12
gaggaaccggcacctcgacg

SEQ ID NO: 33932 - DNA, 20 bp, Artificial Sequence
  sgRNA
  Nagpa_13
gatggacagacggaacagcg

SEQ ID NO: 33933 - DNA, 20 bp, Artificial Sequence
  sgRNA
  Nagpa_14
accacagtggacacttggcg

SEQ ID NO: 33934 - DNA, 20 bp, Artificial Sequence
  sgRNA
  Nagpa_15
cagcaccgagaaagtgcgta

SEQ ID NO: 33935 - DNA, 20 bp, Artificial Sequence
  sgRNA
  Nagpa_16
agtggctggtgcattcacag

SEQ ID NO: 33936 - DNA, 20 bp, Artificial Sequence
  sgRNA
  Nagpa_17
tgtgtatcacccactgcagg

SEQ ID NO: 33937 - DNA, 20 bp, Artificial Sequence
  sgRNA
  Nagpa_18
gtgcgacacgaaggtgcgca

SEQ ID NO: 33938 - DNA, 20 bp, Artificial Sequence
  sgRNA
  Nagpa_19
ccatggccactgcagtcggg

SEQ ID NO: 33939 - DNA, 20 bp, Artificial Sequence
  sgRNA
  Nagpa_20
ctgtgtctcgtcacactcga

SEQ ID NO: 33940 - DNA, 20 bp, Artificial Sequence
  sgRNA
  Nalcn_1
agcgtgctcgaaccaccacg

SEQ ID NO: 33941 - DNA, 20 bp, Artificial Sequence
  sgRNA
  Nalcn_2
tgacaagcttaccaaacacg

SEQ ID NO: 33942 - DNA, 20 bp, Artificial Sequence
  sgRNA
  Nalcn_3
gtaacacaagagatacccaa

SEQ ID NO: 33943 - DNA, 20 bp, Artificial Sequence
  sgRNA
  Nalcn_4
tagtcaatgacacaaagcca

SEQ ID NO: 33944 - DNA, 20 bp, Artificial Sequence
  sgRNA
  Nalcn_5
gttcagaaacttctgccgcg

SEQ ID NO: 33945 - DNA, 20 bp, Artificial Sequence
  sgRNA
  Nalcn_6
tgctgagcggatcattcgag

SEQ ID NO: 33946 - DNA, 20 bp, Artificial Sequence
  sgRNA
  Nalcn_7
ttgtcgaagttaaagttccg

SEQ ID NO: 33947 - DNA, 20 bp, Artificial Sequence
  sgRNA
  Nalcn_8
tctctgatctaccgtcagca

SEQ ID NO: 33948 - DNA, 20 bp, Artificial Sequence
  sgRNA
  Nalcn_9
ttgtccttcctccaaaccgt

SEQ ID NO: 33949 - DNA, 20 bp, Artificial Sequence
  sgRNA
  Nalcn_10
gacggtagatcagagacgat

SEQ ID NO: 33950 - DNA, 20 bp, Artificial Sequence
  sgRNA
  Nalcn_11
cgtgcagcatcacatccgcc

SEQ ID NO: 33951 - DNA, 20 bp, Artificial Sequence
  sgRNA
  Nalcn_12
acaccagcgatccttcacat

SEQ ID NO: 33952 - DNA, 20 bp, Artificial Sequence
  sgRNA
  Nalcn_13
gccgtagcaggaacttcact

SEQ ID NO: 33953 - DNA, 20 bp, Artificial Sequence
  sgRNA
  Nalcn_14
acaagcctctcttcatcgtg

SEQ ID NO: 33954 - DNA, 20 bp, Artificial Sequence
  sgRNA
  Nalcn_15
tcagtatgtgaccttcacct

SEQ ID NO: 33955 - DNA, 20 bp, Artificial Sequence
  sgRNA
  Nalcn_16
cggatcataatgagtggccg

SEQ ID NO: 33956 - DNA, 20 bp, Artificial Sequence
  sgRNA
  Nalcn_17
tctgatgtctacagagcgat

SEQ ID NO: 33957 - DNA, 20 bp, Artificial Sequence
  sgRNA
  Nalcn_18
gtagtcaatgacacaaagcc

SEQ ID NO: 33958 - DNA, 20 bp, Artificial Sequence
  sgRNA
  Nalcn_19
atgctgagcggatcattcga

SEQ ID NO: 33959 - DNA, 20 bp, Artificial Sequence
  sgRNA
  Nalcn_20
cgaagattctcaagcgcaaa

SEQ ID NO: 33960 - DNA, 20 bp, Artificial Sequence
  sgRNA
  Ncam1_1
gaagatcttcacgttgacag

SEQ ID NO: 33961 - DNA, 20 bp, Artificial Sequence
  sgRNA
  Ncam1_2
ctcctggttctcccccaatg

SEQ ID NO: 33962 - DNA, 20 bp, Artificial Sequence
  sgRNA
  Ncam1_3
gccatcggcatcacacacca

SEQ ID NO: 33963 - DNA, 20 bp, Artificial Sequence
  sgRNA
  Ncam1_4
acctaccaaagaccttgagg

SEQ ID NO: 33964 - DNA, 20 bp, Artificial Sequence
  sgRNA
  Ncam1_5
gtatcactcaggtcaaccag

SEQ ID NO: 33965 - DNA, 20 bp, Artificial Sequence
  sgRNA
  Ncam1_6
ccttgaagttgatttccccg

SEQ ID NO: 33966 - DNA, 20 bp, Artificial Sequence
  sgRNA
  Ncam1_7
cattgtggaggtccgaacgg

SEQ ID NO: 33967 - DNA, 20 bp, Artificial Sequence
  sgRNA
  Ncam1_8
ttcactgctgatgttccggg

SEQ ID NO: 33968 - DNA, 20 bp, Artificial Sequence
  sgRNA
  Ncam1_9
gtatggttccacccggtcaa

SEQ ID NO: 33969 - DNA, 20 bp, Artificial Sequence
  sgRNA
  Ncam1_10
ggtcaggccaccccttccaa

SEQ ID NO: 33970 - DNA, 20 bp, Artificial Sequence
  sgRNA
  Ncam1_11
ccagggacttgagcatgacg

SEQ ID NO: 33971 - DNA, 20 bp, Artificial Sequence
  sgRNA
  Ncam1_12
tcacctggagaacatccacc

SEQ ID NO: 33972 - DNA, 20 bp, Artificial Sequence
  sgRNA
  Ncam1_13
gtacgactggcggccctcaa

SEQ ID NO: 33973 - DNA, 20 bp, Artificial Sequence
  sgRNA
  Ncam1_14
agctgagcccaaaccagcag

SEQ ID NO: 33974 - DNA, 20 bp, Artificial Sequence
  sgRNA
  Ncam1_15
gagtccgttcttcctccgtt

SEQ ID NO: 33975 - DNA, 20 bp, Artificial Sequence
  sgRNA
  Ncam1_16
gggcggctactgctgctaag

SEQ ID NO: 33976 - DNA, 20 bp, Artificial Sequence
  sgRNA
  Ncam1_17
tgggcctgaaacctgagacg

SEQ ID NO: 33977 - DNA, 20 bp, Artificial Sequence
  sgRNA
  Ncam1_18
cttgctcttcgggctagcag

SEQ ID NO: 33978 - DNA, 20 bp, Artificial Sequence
  sgRNA
  Ncam1_19
gcaaccacaaacccttccca

SEQ ID NO: 33979 - DNA, 20 bp, Artificial Sequence
  sgRNA
  Ncam1_20
atactctgcgttccagtcca

SEQ ID NO: 33980 - DNA, 20 bp, Artificial Sequence
  sgRNA
  Ncam2_1
gtgcccaccaatccgactag

SEQ ID NO: 33981 - DNA, 20 bp, Artificial Sequence
  sgRNA
  Ncam2_2
taccaaaatactaactgtcg

SEQ ID NO: 33982 - DNA, 20 bp, Artificial Sequence
  sgRNA
  Ncam2_3
gtgagcctgagagtatcgac

SEQ ID NO: 33983 - DNA, 20 bp, Artificial Sequence
  sgRNA
  Ncam2_4
aggaagaaagatgatactcg

SEQ ID NO: 33984 - DNA, 20 bp, Artificial Sequence
  sgRNA
  Ncam2_5
aataaacccgaatcccatgg

SEQ ID NO: 33985 - DNA, 20 bp, Artificial Sequence
  sgRNA
  Ncam2_6
ttaacttcgatgcggccatc

SEQ ID NO: 33986 - DNA, 20 bp, Artificial Sequence
  sgRNA
  Ncam2_7
gctgccctttaacttcgatg

SEQ ID NO: 33987 - DNA, 20 bp, Artificial Sequence
  sgRNA
  Ncam2_8
ggtacaaccagctgaccgca

SEQ ID NO: 33988 - DNA, 20 bp, Artificial Sequence
  sgRNA
  Ncam2_9
ttaaaactcttgccactgct

SEQ ID NO: 33989 - DNA, 20 bp, Artificial Sequence
  sgRNA
  Ncam2_10
agggttatgctacagaagga

SEQ ID NO: 33990 - DNA, 20 bp, Artificial Sequence
  sgRNA
  Ncam2_11
agcaaagtagagcttagtgt

SEQ ID NO: 33991 - DNA, 20 bp, Artificial Sequence
  sgRNA
  Ncam2_12
atgcaaacatagaagatgca

SEQ ID NO: 33992 - DNA, 20 bp, Artificial Sequence
  sgRNA
  Ncam2_13
tctataatcttcactccatg

SEQ ID NO: 33993 - DNA, 20 bp, Artificial Sequence
  sgRNA
  Ncam2_14
gcagtttctctcttctccag

SEQ ID NO: 33994 - DNA, 20 bp, Artificial Sequence
  sgRNA
  Ncam2_15
tgtcaagcgacagatgccaa

SEQ ID NO: 33995 - DNA, 20 bp, Artificial Sequence
  sgRNA
  Ncam2_16
tccagtggattgacgcaggt

SEQ ID NO: 33996 - DNA, 20 bp, Artificial Sequence
  sgRNA
  Ncam2_17
gtacaaccagctgaccgcag

SEQ ID NO: 33997 - DNA, 20 bp, Artificial Sequence
  sgRNA
  Ncam2_18
gcagatgctccaagataatg

SEQ ID NO: 33998 - DNA, 20 bp, Artificial Sequence
  sgRNA
  Ncam2_19
gcctattcatcactatcaag

SEQ ID NO: 33999 - DNA, 20 bp, Artificial Sequence
  sgRNA
  Ncam2_20
cccctcaagagttcaagcaa

SEQ ID NO: 34000 - DNA, 20 bp, Artificial Sequence
  sgRNA
  Ncmap_1
gtccaccttactcttataca

SEQ ID NO: 34001 - DNA, 20 bp, Artificial Sequence
  sgRNA
  Ncmap_2
gaagacggcgtcccccaaag

SEQ ID NO: 34002 - DNA, 20 bp, Artificial Sequence
  sgRNA
  Ncmap_3
cttctcgctgaacatgacca

SEQ ID NO: 34003 - DNA, 20 bp, Artificial Sequence
  sgRNA
  Ncmap_4
gatgatgacaaccaccacaa

SEQ ID NO: 34004 - DNA, 20 bp, Artificial Sequence
  sgRNA
  Ncmap_5
ggtcatgttcagcgagaaga

SEQ ID NO: 34005 - DNA, 20 bp, Artificial Sequence
  sgRNA
  Ncmap_6
tctccacatggacattggca

SEQ ID NO: 34006 - DNA, 20 bp, Artificial Sequence
  sgRNA
  Ncmap_7
ttctcgctgaacatgaccag

SEQ ID NO: 34007 - DNA, 20 bp, Artificial Sequence
  sgRNA
  Ncmap_8
tcttctcgctgaacatgacc

SEQ ID NO: 34008 - DNA, 20 bp, Artificial Sequence
  sgRNA
  Ncmap_9
cttcagcaggatcagcacca

SEQ ID NO: 34009 - DNA, 20 bp, Artificial Sequence
  sgRNA
  Ncmap_10
gacggcgtcccccaaagtgg

SEQ ID NO: 34010 - DNA, 20 bp, Artificial Sequence
  sgRNA
  Ncmap_11
cgaccctgccaatgtccatg

SEQ ID NO: 34011 - DNA, 20 bp, Artificial Sequence
  sgRNA
  Ncmap_12
cttgggctccagctcccgcc

SEQ ID NO: 34012 - DNA, 20 bp, Artificial Sequence
  sgRNA
  Ncmap_13
catcgtggctgccattgtgg

SEQ ID NO: 34013 - DNA, 20 bp, Artificial Sequence
  sgRNA
  Ncmap_14
gggtcgaaggtcacagtagc

SEQ ID NO: 34014 - DNA, 20 bp, Artificial Sequence
  sgRNA
  Ncmap_15
tgaccacagccaccactttg

SEQ ID NO: 34015 - DNA, 20 bp, Artificial Sequence
  sgRNA
  Ncmap_16
gaccacagccaccactttgg

SEQ ID NO: 34016 - DNA, 20 bp, Artificial Sequence
  sgRNA
  Ncmap_17
atacagggcgtcctctcccc

SEQ ID NO: 34017 - DNA, 20 bp, Artificial Sequence
  sgRNA
  Ncmap_18
gctgaacatgaccaggggag

SEQ ID NO: 34018 - DNA, 20 bp, Artificial Sequence
  sgRNA
  Ncmap_19
tcctgctgaagatgtacaac

SEQ ID NO: 34019 - DNA, 20 bp, Artificial Sequence
  sgRNA
  Ncmap_20
gccctggaccccagcagcaa

SEQ ID NO: 34020 - DNA, 20 bp, Artificial Sequence
  sgRNA
  Ncr1_1
ccgtgactagggctcacaga

SEQ ID NO: 34021 - DNA, 20 bp, Artificial Sequence
  sgRNA
  Ncr1_2
gtagatccctgcagtatgtg

SEQ ID NO: 34022 - DNA, 20 bp, Artificial Sequence
  sgRNA
  Ncr1_3
gagcagaaagaatttgcttg

SEQ ID NO: 34023 - DNA, 20 bp, Artificial Sequence
  sgRNA
  Ncr1_4
ttctcccccaaggttacctc

SEQ ID NO: 34024 - DNA, 20 bp, Artificial Sequence
  sgRNA
  Ncr1_5
gctcttacaacgactatgca

SEQ ID NO: 34025 - DNA, 20 bp, Artificial Sequence
  sgRNA
  Ncr1_6
ggtgaacatctggtgtcagg

SEQ ID NO: 34026 - DNA, 20 bp, Artificial Sequence
  sgRNA
  Ncr1_7
caggctgtggataaacccag

SEQ ID NO: 34027 - DNA, 20 bp, Artificial Sequence
  sgRNA
  Ncr1_8
atccaagcagagtttcccat

SEQ ID NO: 34028 - DNA, 20 bp, Artificial Sequence
  sgRNA
  Ncr1_9
gccctagtcacggggcccat

SEQ ID NO: 34029 - DNA, 20 bp, Artificial Sequence
  sgRNA
  Ncr1_10
gtatgacacacccaacctct

SEQ ID NO: 34030 - DNA, 20 bp, Artificial Sequence
  sgRNA
  Ncr1_11
ctctgtgagccctagtcacg

SEQ ID NO: 34031 - DNA, 20 bp, Artificial Sequence
  sgRNA
  Ncr1_12
agagaagaagtagggtcggt

SEQ ID NO: 34032 - DNA, 20 bp, Artificial Sequence
  sgRNA
  Ncr1_13
ccatttgtgaccatgatgct

SEQ ID NO: 34033 - DNA, 20 bp, Artificial Sequence
  sgRNA
  Ncr1_14
ggttgtgtgatcccagaagg

SEQ ID NO: 34034 - DNA, 20 bp, Artificial Sequence
  sgRNA
  Ncr1_15
tacacctgcttctatcagag

SEQ ID NO: 34035 - DNA, 20 bp, Artificial Sequence
  sgRNA
  Ncr1_16
actttattcatcgatctcga

SEQ ID NO: 34036 - DNA, 20 bp, Artificial Sequence
  sgRNA
  Ncr1_17
cgatggctttggtctctcca

SEQ ID NO: 34037 - DNA, 20 bp, Artificial Sequence
  sgRNA
  Ncr1_18
cagttactaccagtttcagg

SEQ ID NO: 34038 - DNA, 20 bp, Artificial Sequence
  sgRNA
  Ncr1_19
ccacagcctgaggtaacctt

SEQ ID NO: 34039 - DNA, 20 bp, Artificial Sequence
  sgRNA
  Ncr1_20
accacatccagaataaatat

SEQ ID NO: 34040 - DNA, 20 bp, Artificial Sequence
  sgRNA
  Ncstn_1
ccagcagaaccatgtaaggg

SEQ ID NO: 34041 - DNA, 20 bp, Artificial Sequence
  sgRNA
  Ncstn_2
gtgctatcaagatcacaacc

SEQ ID NO: 34042 - DNA, 20 bp, Artificial Sequence
  sgRNA
  Ncstn_3
agggacagaactcacccgtg

SEQ ID NO: 34043 - DNA, 20 bp, Artificial Sequence
  sgRNA
  Ncstn_4
ggtgactcaccgattgtgga

SEQ ID NO: 34044 - DNA, 20 bp, Artificial Sequence
  sgRNA
  Ncstn_5
gcactgtatgagcttgcagg

SEQ ID NO: 34045 - DNA, 20 bp, Artificial Sequence
  sgRNA
  Ncstn_6
agaacggcaagtttcccgtg

SEQ ID NO: 34046 - DNA, 20 bp, Artificial Sequence
  sgRNA
  Ncstn_7
gctccacagaatactctacg

SEQ ID NO: 34047 - DNA, 20 bp, Artificial Sequence
  sgRNA
  Ncstn_8
gatgcagtaggtgacgatga

SEQ ID NO: 34048 - DNA, 20 bp, Artificial Sequence
  sgRNA
  Ncstn_9
ccttacatggttctgctgga

SEQ ID NO: 34049 - DNA, 20 bp, Artificial Sequence
  sgRNA
  Ncstn_10
gggttgtggttgcggccaca

SEQ ID NO: 34050 - DNA, 20 bp, Artificial Sequence
  sgRNA
  Ncstn_11
ctgtcctgttggaattccaa

SEQ ID NO: 34051 - DNA, 20 bp, Artificial Sequence
  sgRNA
  Ncstn_12
tgaagatgagaacgaaacca

SEQ ID NO: 34052 - DNA, 20 bp, Artificial Sequence
  sgRNA
  Ncstn_13
atacgttgtagtcggataag

SEQ ID NO: 34053 - DNA, 20 bp, Artificial Sequence
  sgRNA
  Ncstn_14
gtgtgcagtgcccaaatgat

SEQ ID NO: 34054 - DNA, 20 bp, Artificial Sequence
  sgRNA
  Ncstn_15
ttacgttgtgcagtacgcct

SEQ ID NO: 34055 - DNA, 20 bp, Artificial Sequence
  sgRNA
  Ncstn_16
agagctgcatagcacacaat

SEQ ID NO: 34056 - DNA, 20 bp, Artificial Sequence
  sgRNA
  Ncstn_17
gtcaatgttctcgagccgca

SEQ ID NO: 34057 - DNA, 20 bp, Artificial Sequence
  sgRNA
  Ncstn_18
ctgactcagttcaaaggcag

SEQ ID NO: 34058 - DNA, 20 bp, Artificial Sequence
  sgRNA
  Ncstn_19
gtatttactccaactcctac

SEQ ID NO: 34059 - DNA, 20 bp, Artificial Sequence
  sgRNA
  Ncstn_20
gctccactgactcagttcaa

SEQ ID NO: 34060 - DNA, 20 bp, Artificial Sequence
  sgRNA
  Negr1_1
agatgaacctgcattgtccg

SEQ ID NO: 34061 - DNA, 20 bp, Artificial Sequence
  sgRNA
  Negr1_2
aatgtggaaatggaaactcg

SEQ ID NO: 34062 - DNA, 20 bp, Artificial Sequence
  sgRNA
  Negr1_3
ttatggaattacaagggacc

SEQ ID NO: 34063 - DNA, 20 bp, Artificial Sequence
  sgRNA
  Negr1_4
cagagcctgtcatttcctgg

SEQ ID NO: 34064 - DNA, 20 bp, Artificial Sequence
  sgRNA
  Negr1_5
agtggactgatacgatgcga

SEQ ID NO: 34065 - DNA, 20 bp, Artificial Sequence
  sgRNA
  Negr1_6
tgttgtccacggccgcccaa

SEQ ID NO: 34066 - DNA, 20 bp, Artificial Sequence
  sgRNA
  Negr1_7
tatcagtccactgcgtccag

SEQ ID NO: 34067 - DNA, 20 bp, Artificial Sequence
  sgRNA
  Negr1_8
gcagagcgtggacttccctt

SEQ ID NO: 34068 - DNA, 20 bp, Artificial Sequence
  sgRNA
  Negr1_9
cagtggactgatacgatgcg

SEQ ID NO: 34069 - DNA, 20 bp, Artificial Sequence
  sgRNA
  Negr1_10
gtatcagtccactgcgtcca

SEQ ID NO: 34070 - DNA, 20 bp, Artificial Sequence
  sgRNA
  Negr1_11
ggacatttatggaattacaa

SEQ ID NO: 34071 - DNA, 20 bp, Artificial Sequence
  sgRNA
  Negr1_12
cctcaccagcatgttgtcca

SEQ ID NO: 34072 - DNA, 20 bp, Artificial Sequence
  sgRNA
  Negr1_13
cagaagatagtgtcaacgca

SEQ ID NO: 34073 - DNA, 20 bp, Artificial Sequence
  sgRNA
  Negr1_14
ggacttcccttgggcggccg

SEQ ID NO: 34074 - DNA, 20 bp, Artificial Sequence
  sgRNA
  Negr1_15
ttgtaccactcgaaggccgg

SEQ ID NO: 34075 - DNA, 20 bp, Artificial Sequence
  sgRNA
  Negr1_16
gaagtgctcctgcgtcacat

SEQ ID NO: 34076 - DNA, 20 bp, Artificial Sequence
  sgRNA
  Negr1_17
taccactcgaaggccggcgg

SEQ ID NO: 34077 - DNA, 20 bp, Artificial Sequence
  sgRNA
  Negr1_18
gagcgtggacttcccttggg

SEQ ID NO: 34078 - DNA, 20 bp, Artificial Sequence
  sgRNA
  Negr1_19
gcgtcacattggtcactgtg

SEQ ID NO: 34079 - DNA, 20 bp, Artificial Sequence
  sgRNA
  Negr1_20
cccagtggccaaacaagtaa

SEQ ID NO: 34080 - DNA, 20 bp, Artificial Sequence
  sgRNA
  Neo1_1
cgtaaccgatggcataacct

SEQ ID NO: 34081 - DNA, 20 bp, Artificial Sequence
  sgRNA
  Neo1_2
ggttccaagattatccacag

SEQ ID NO: 34082 - DNA, 20 bp, Artificial Sequence
  sgRNA
  Neo1_3
aacaccgttatctggcaatg

SEQ ID NO: 34083 - DNA, 20 bp, Artificial Sequence
  sgRNA
  Neo1_4
actcccgctactacacagtc

SEQ ID NO: 34084 - DNA, 20 bp, Artificial Sequence
  sgRNA
  Neo1_5
gctccttcctaacgtcccga

SEQ ID NO: 34085 - DNA, 20 bp, Artificial Sequence
  sgRNA
  Neo1_6
actacaatgctagtgacgag

SEQ ID NO: 34086 - DNA, 20 bp, Artificial Sequence
  sgRNA
  Neo1_7
ctatccatggaattgtccac

SEQ ID NO: 34087 - DNA, 20 bp, Artificial Sequence
  sgRNA
  Neo1_8
tggcgtcatcactatcgtgg

SEQ ID NO: 34088 - DNA, 20 bp, Artificial Sequence
  sgRNA
  Neo1_9
tgactgtgagagcagcgact

SEQ ID NO: 34089 - DNA, 20 bp, Artificial Sequence
  sgRNA
  Neo1_10
ttacatcatctattacagca

SEQ ID NO: 34090 - DNA, 20 bp, Artificial Sequence
  sgRNA
  Neo1_11
ggaggtgcagaggagtcgcc

SEQ ID NO: 34091 - DNA, 20 bp, Artificial Sequence
  sgRNA
  Neo1_12
tcaactctagtctctcgtga

SEQ ID NO: 34092 - DNA, 20 bp, Artificial Sequence
  sgRNA
  Neo1_13
gcttcgtcactaaactttgg

SEQ ID NO: 34093 - DNA, 20 bp, Artificial Sequence
  sgRNA
  Neo1_14
taggtgacgttgcataagca

SEQ ID NO: 34094 - DNA, 20 bp, Artificial Sequence
  sgRNA
  Neo1_15
ggatctggagacttgtcaat

SEQ ID NO: 34095 - DNA, 20 bp, Artificial Sequence
  sgRNA
  Neo1_16
gctgcgtgcaaatcagtgaa

SEQ ID NO: 34096 - DNA, 20 bp, Artificial Sequence
  sgRNA
  Neo1_17
gctctcacagtcaatggtac

SEQ ID NO: 34097 - DNA, 20 bp, Artificial Sequence
  sgRNA
  Neo1_18
gctgcattgttgaaagtggt

SEQ ID NO: 34098 - DNA, 20 bp, Artificial Sequence
  sgRNA
  Neo1_19
acaatgttctggttctctgg

SEQ ID NO: 34099 - DNA, 20 bp, Artificial Sequence
  sgRNA
  Neo1_20
ggctgtgtctctactcgaag

SEQ ID NO: 34100 - DNA, 20 bp, Artificial Sequence
  sgRNA
  Neto1_1
gtgcaaaagaaactttgtgg

SEQ ID NO: 34101 - DNA, 20 bp, Artificial Sequence
  sgRNA
  Neto1_2
ccttggggtgatccgcatgt

SEQ ID NO: 34102 - DNA, 20 bp, Artificial Sequence
  sgRNA
  Neto1_3
aagttcaatgcactgccttg

SEQ ID NO: 34103 - DNA, 20 bp, Artificial Sequence
  sgRNA
  Neto1_4
ccacctgtaataaaatctag

SEQ ID NO: 34104 - DNA, 20 bp, Artificial Sequence
  sgRNA
  Neto1_5
gcgtgtgagtttgagatggg

SEQ ID NO: 34105 - DNA, 20 bp, Artificial Sequence
  sgRNA
  Neto1_6
acgtggacaaagcatgcaga

SEQ ID NO: 34106 - DNA, 20 bp, Artificial Sequence
  sgRNA
  Neto1_7
gtgaagccgtggattgcaaa

SEQ ID NO: 34107 - DNA, 20 bp, Artificial Sequence
  sgRNA
  Neto1_8
tatgagttatgtacgctcag

SEQ ID NO: 34108 - DNA, 20 bp, Artificial Sequence
  sgRNA
  Neto1_9
cttggccttcaaatcctcca

SEQ ID NO: 34109 - DNA, 20 bp, Artificial Sequence
  sgRNA
  Neto1_10
aatgacgtcatgctgcgcac

SEQ ID NO: 34110 - DNA, 20 bp, Artificial Sequence
  sgRNA
  Neto1_11
aagaatgtgttgccttcaca

SEQ ID NO: 34111 - DNA, 20 bp, Artificial Sequence
  sgRNA
  Neto1_12
gatgtaccatttgcaatcca

SEQ ID NO: 34112 - DNA, 20 bp, Artificial Sequence
  sgRNA
  Neto1_13
acaacacgctagtctgcaat

SEQ ID NO: 34113 - DNA, 20 bp, Artificial Sequence
  sgRNA
  Neto1_14
gtacataactcatagtgggg

SEQ ID NO: 34114 - DNA, 20 bp, Artificial Sequence
  sgRNA
  Neto1_15
gatcagctgaccaacaccag

SEQ ID NO: 34115 - DNA, 20 bp, Artificial Sequence
  sgRNA
  Neto1_16
ccagaactgtgtatatccct

SEQ ID NO: 34116 - DNA, 20 bp, Artificial Sequence
  sgRNA
  Neto1_17
gacacgaaaaatctgtccag

SEQ ID NO: 34117 - DNA, 20 bp, Artificial Sequence
  sgRNA
  Neto1_18
gtcgatgtcacaggcatcgg

SEQ ID NO: 34118 - DNA, 20 bp, Artificial Sequence
  sgRNA
  Neto1_19
gagcgtacataactcatagt

SEQ ID NO: 34119 - DNA, 20 bp, Artificial Sequence
  sgRNA
  Neto1_20
gctgaccaacaccagtggga

SEQ ID NO: 34120 - DNA, 20 bp, Artificial Sequence
  sgRNA
  Neto2_1
gtcagctctattcgttgacg

SEQ ID NO: 34121 - DNA, 20 bp, Artificial Sequence
  sgRNA
  Neto2_2
cacattcctgcaacccagtg

SEQ ID NO: 34122 - DNA, 20 bp, Artificial Sequence
  sgRNA
  Neto2_3
tgggatttaaaatacctcca

SEQ ID NO: 34123 - DNA, 20 bp, Artificial Sequence
  sgRNA
  Neto2_4
cctcttatagatcgttactg

SEQ ID NO: 34124 - DNA, 20 bp, Artificial Sequence
  sgRNA
  Neto2_5
tacagtgattctcatcccaa

SEQ ID NO: 34125 - DNA, 20 bp, Artificial Sequence
  sgRNA
  Neto2_6
ccgttgacctaattaatgca

SEQ ID NO: 34126 - DNA, 20 bp, Artificial Sequence
  sgRNA
  Neto2_7
cctctgacataaatttcaca

SEQ ID NO: 34127 - DNA, 20 bp, Artificial Sequence
  sgRNA
  Neto2_8
tgtgcaaaatcatttcggaa

SEQ ID NO: 34128 - DNA, 20 bp, Artificial Sequence
  sgRNA
  Neto2_9
tagtacaagtgaaacagccc

SEQ ID NO: 34129 - DNA, 20 bp, Artificial Sequence
  sgRNA
  Neto2_10
gatcacttggaaattcgaga

SEQ ID NO: 34130 - DNA, 20 bp, Artificial Sequence
  sgRNA
  Neto2_11
tgtcctctagagcctgttca

SEQ ID NO: 34131 - DNA, 20 bp, Artificial Sequence
  sgRNA
  Neto2_12
tgactcatatccaccaaaca

SEQ ID NO: 34132 - DNA, 20 bp, Artificial Sequence
  sgRNA
  Neto2_13
acagccccggaaaaaggtta

SEQ ID NO: 34133 - DNA, 20 bp, Artificial Sequence
  sgRNA
  Neto2_14
cctgcattaattaggtcaac

SEQ ID NO: 34134 - DNA, 20 bp, Artificial Sequence
  sgRNA
  Neto2_15
ccacagtaacgatctataag

SEQ ID NO: 34135 - DNA, 20 bp, Artificial Sequence
  sgRNA
  Neto2_16
agtggtggtcgtgaatgcac

SEQ ID NO: 34136 - DNA, 20 bp, Artificial Sequence
  sgRNA
  Neto2_17
agtcggagtgatccggatgt

SEQ ID NO: 34137 - DNA, 20 bp, Artificial Sequence
  sgRNA
  Neto2_18
gaaattcgagacgggccatt

SEQ ID NO: 34138 - DNA, 20 bp, Artificial Sequence
  sgRNA
  Neto2_19
gtggtcgtgaatgcaccggg

SEQ ID NO: 34139 - DNA, 20 bp, Artificial Sequence
  sgRNA
  Neto2_20
ggtcctgctttgtttcacac

SEQ ID NO: 34140 - DNA, 20 bp, Artificial Sequence
  sgRNA
  Nfam1_1
caggcaaacacatcagccac

SEQ ID NO: 34141 - DNA, 20 bp, Artificial Sequence
  sgRNA
  Nfam1_2
gaggaaacatatcagagcga

SEQ ID NO: 34142 - DNA, 20 bp, Artificial Sequence
  sgRNA
  Nfam1_3
ttcatacggatatccatggc

SEQ ID NO: 34143 - DNA, 20 bp, Artificial Sequence
  sgRNA
  Nfam1_4
ccccaatgttcagtcaaaga

SEQ ID NO: 34144 - DNA, 20 bp, Artificial Sequence
  sgRNA
  Nfam1_5
tctggtctcaaatccaccgt

SEQ ID NO: 34145 - DNA, 20 bp, Artificial Sequence
  sgRNA
  Nfam1_6
ggaggtctacgcctgtatga

SEQ ID NO: 34146 - DNA, 20 bp, Artificial Sequence
  sgRNA
  Nfam1_7
ggggcaccggcagcaaacag

SEQ ID NO: 34147 - DNA, 20 bp, Artificial Sequence
  sgRNA
  Nfam1_8
tctttgactgaacattgggg

SEQ ID NO: 34148 - DNA, 20 bp, Artificial Sequence
  sgRNA
  Nfam1_9
cctacagcgtcgagagacgg

SEQ ID NO: 34149 - DNA, 20 bp, Artificial Sequence
  sgRNA
  Nfam1_10
ggctaccagttgacacgcca

SEQ ID NO: 34150 - DNA, 20 bp, Artificial Sequence
  sgRNA
  Nfam1_11
gaacacatcggtgtttgcca

SEQ ID NO: 34151 - DNA, 20 bp, Artificial Sequence
  sgRNA
  Nfam1_12
ctacttcatagtcgaaggag

SEQ ID NO: 34152 - DNA, 20 bp, Artificial Sequence
  sgRNA
  Nfam1_13
tggcatggagaaccatacca

SEQ ID NO: 34153 - DNA, 20 bp, Artificial Sequence
  sgRNA
  Nfam1_14
ctccgtctctcgacgctgta

SEQ ID NO: 34154 - DNA, 20 bp, Artificial Sequence
  sgRNA
  Nfam1_15
gcctgtatgaaggaagagac

SEQ ID NO: 34155 - DNA, 20 bp, Artificial Sequence
  sgRNA
  Nfam1_16
cagcaaacagaggaagcacc

SEQ ID NO: 34156 - DNA, 20 bp, Artificial Sequence
  sgRNA
  Nfam1_17
gtgtagacagattctgctgg

SEQ ID NO: 34157 - DNA, 20 bp, Artificial Sequence
  sgRNA
  Nfam1_18
tctgcagctgaagaacacat

SEQ ID NO: 34158 - DNA, 20 bp, Artificial Sequence
  sgRNA
  Nfam1_19
gcctgttaagttgtttcata

SEQ ID NO: 34159 - DNA, 20 bp, Artificial Sequence
  sgRNA
  Nfam1_20
gtccctacagcgtcgagaga

SEQ ID NO: 34160 - DNA, 20 bp, Artificial Sequence
  sgRNA
  Nfasc_1
cgagcggtaccgaaccagtg

SEQ ID NO: 34161 - DNA, 20 bp, Artificial Sequence
  sgRNA
  Nfasc_2
ggaaaacctagaccccgtcg

SEQ ID NO: 34162 - DNA, 20 bp, Artificial Sequence
  sgRNA
  Nfasc_3
tgccactccgaagatcgtca

SEQ ID NO: 34163 - DNA, 20 bp, Artificial Sequence
  sgRNA
  Nfasc_4
tgatcctttataaccggaca

SEQ ID NO: 34164 - DNA, 20 bp, Artificial Sequence
  sgRNA
  Nfasc_5
gagcactgtgacgttccaaa

SEQ ID NO: 34165 - DNA, 20 bp, Artificial Sequence
  sgRNA
  Nfasc_6
actgcggaagtcgatcacca

SEQ ID NO: 34166 - DNA, 20 bp, Artificial Sequence
  sgRNA
  Nfasc_7
gctacattgtcaagtggcga

SEQ ID NO: 34167 - DNA, 20 bp, Artificial Sequence
  sgRNA
  Nfasc_8
ggtgtattcccgggacaacg

SEQ ID NO: 34168 - DNA, 20 bp, Artificial Sequence
  sgRNA
  Nfasc_9
gactgcttggtgatagttgg

SEQ ID NO: 34169 - DNA, 20 bp, Artificial Sequence
  sgRNA
  Nfasc_10
ttggtgatcgacttccgcag

SEQ ID NO: 34170 - DNA, 20 bp, Artificial Sequence
  sgRNA
  Nfasc_11
gaccccgtcgtggttcaaga

SEQ ID NO: 34171 - DNA, 20 bp, Artificial Sequence
  sgRNA
  Nfasc_12
agaggaccagttccaaccag

SEQ ID NO: 34172 - DNA, 20 bp, Artificial Sequence
  sgRNA
  Nfasc_13
ggccactccaactaaccgtt

SEQ ID NO: 34173 - DNA, 20 bp, Artificial Sequence
  sgRNA
  Nfasc_14
tcggactctgaaccgcctgg

SEQ ID NO: 34174 - DNA, 20 bp, Artificial Sequence
  sgRNA
  Nfasc_15
ttaaggacgagtcattatag

SEQ ID NO: 34175 - DNA, 20 bp, Artificial Sequence
  sgRNA
  Nfasc_16
gggaccctcggagtacttgt

SEQ ID NO: 34176 - DNA, 20 bp, Artificial Sequence
  sgRNA
  Nfasc_17
tatccaatcaggattccgtt

SEQ ID NO: 34177 - DNA, 20 bp, Artificial Sequence
  sgRNA
  Nfasc_18
gcgggcagacagcatccgag

SEQ ID NO: 34178 - DNA, 20 bp, Artificial Sequence
  sgRNA
  Nfasc_19
agtgctccccaacagtaaat

SEQ ID NO: 34179 - DNA, 20 bp, Artificial Sequence
  sgRNA
  Nfasc_20
agggcgaccagaccgaccca

SEQ ID NO: 34180 - DNA, 20 bp, Artificial Sequence
  sgRNA
  Ngfr_1
tggagcaatagacaggaatg

SEQ ID NO: 34181 - DNA, 20 bp, Artificial Sequence
  sgRNA
  Ngfr_2
acaaggtctacgcccccgga

SEQ ID NO: 34182 - DNA, 20 bp, Artificial Sequence
  sgRNA
  Ngfr_3
agggtaggcacgggtccacg

SEQ ID NO: 34183 - DNA, 20 bp, Artificial Sequence
  sgRNA
  Ngfr_4
tatgtccgctccctgtgtgg

SEQ ID NO: 34184 - DNA, 20 bp, Artificial Sequence
  sgRNA
  Ngfr_5
ctatggctactaccaggacg

SEQ ID NO: 34185 - DNA, 20 bp, Artificial Sequence
  sgRNA
  Ngfr_6
tatagactcctttacccacg

SEQ ID NO: 34186 - DNA, 20 bp, Artificial Sequence
  sgRNA
  Ngfr_7
gtgtcctcgcacaccgtgca

SEQ ID NO: 34187 - DNA, 20 bp, Artificial Sequence
  sgRNA
  Ngfr_8
gctgggccacaccttcgccc

SEQ ID NO: 34188 - DNA, 20 bp, Artificial Sequence
  sgRNA
  Ngfr_9
acaaggagccaacagccggc

SEQ ID NO: 34189 - DNA, 20 bp, Artificial Sequence
  sgRNA
  Ngfr_10
gagaaactgcacagcgacag

SEQ ID NO: 34190 - DNA, 20 bp, Artificial Sequence
  sgRNA
  Ngfr_11
acacgctgcaagcctcgcag

SEQ ID NO: 34191 - DNA, 20 bp, Artificial Sequence
  sgRNA
  Ngfr_12
gcatcgtctgcctccacaca

SEQ ID NO: 34192 - DNA, 20 bp, Artificial Sequence
  sgRNA
  Ngfr_13
accttgtgatccatcggcca

SEQ ID NO: 34193 - DNA, 20 bp, Artificial Sequence
  sgRNA
  Ngfr_14
gttacgcgagtgcacgccct

SEQ ID NO: 34194 - DNA, 20 bp, Artificial Sequence
  sgRNA
  Ngfr_15
gtgtgtgaagagtgcccaga

SEQ ID NO: 34195 - DNA, 20 bp, Artificial Sequence
  sgRNA
  Ngfr_16
gcgtagaccttgtgatccat

SEQ ID NO: 34196 - DNA, 20 bp, Artificial Sequence
  sgRNA
  Ngfr_17
tcgcattcggcgtcagccca

SEQ ID NO: 34197 - DNA, 20 bp, Artificial Sequence
  sgRNA
  Ngfr_18
ctcagatgaagccaaccacg

SEQ ID NO: 34198 - DNA, 20 bp, Artificial Sequence
  sgRNA
  Ngfr_19
aggagtctatatgctccggc

SEQ ID NO: 34199 - DNA, 20 bp, Artificial Sequence
  sgRNA
  Ngfr_20
atgctcctatggctactacc

SEQ ID NO: 34200 - DNA, 20 bp, Artificial Sequence
  sgRNA
  Nipal1_1
ctcttgcaactggccgacaa

SEQ ID NO: 34201 - DNA, 20 bp, Artificial Sequence
  sgRNA
  Nipal1_2
ggttatccacgccccacaag

SEQ ID NO: 34202 - DNA, 20 bp, Artificial Sequence
  sgRNA
  Nipal1_3
gaacgctcagagcccccagt

SEQ ID NO: 34203 - DNA, 20 bp, Artificial Sequence
  sgRNA
  Nipal1_4
ggaacggaagcctgtttaca

SEQ ID NO: 34204 - DNA, 20 bp, Artificial Sequence
  sgRNA
  Nipal1_5
gatgtcgtcatcatacccag

SEQ ID NO: 34205 - DNA, 20 bp, Artificial Sequence
  sgRNA
  Nipal1_6
gtcattggtcctgctaaaca

SEQ ID NO: 34206 - DNA, 20 bp, Artificial Sequence
  sgRNA
  Nipal1_7
gttatccacgccccacaaga

SEQ ID NO: 34207 - DNA, 20 bp, Artificial Sequence
  sgRNA
  Nipal1_8
gtaataaatgggagtcacca

SEQ ID NO: 34208 - DNA, 20 bp, Artificial Sequence
  sgRNA
  Nipal1_9
tgtgatctcgcacgaagccc

SEQ ID NO: 34209 - DNA, 20 bp, Artificial Sequence
  sgRNA
  Nipal1_10
ggtcaacaggatgaagaaca

SEQ ID NO: 34210 - DNA, 20 bp, Artificial Sequence
  sgRNA
  Nipal1_11
gggttcttcaccatcatcaa

SEQ ID NO: 34211 - DNA, 20 bp, Artificial Sequence
  sgRNA
  Nipal1_12
cccaccacaaccattccttg

SEQ ID NO: 34212 - DNA, 20 bp, Artificial Sequence
  sgRNA
  Nipal1_13
tcatggcagggctctccggg

SEQ ID NO: 34213 - DNA, 20 bp, Artificial Sequence
  sgRNA
  Nipal1_14
agaacgctcagagcccccag

SEQ ID NO: 34214 - DNA, 20 bp, Artificial Sequence
  sgRNA
  Nipal1_15
tgtgacttctccctcttgtg

SEQ ID NO: 34215 - DNA, 20 bp, Artificial Sequence
  sgRNA
  Nipal1_16
ataccactcctggaacagga

SEQ ID NO: 34216 - DNA, 20 bp, Artificial Sequence
  sgRNA
  Nipal1_17
gtacagctgaggctgccacc

SEQ ID NO: 34217 - DNA, 20 bp, Artificial Sequence
  sgRNA
  Nipal1_18
gatggtgaagaacccgctca

SEQ ID NO: 34218 - DNA, 20 bp, Artificial Sequence
  sgRNA
  Nipal1_19
attagtctgtcctttcttgg

SEQ ID NO: 34219 - DNA, 20 bp, Artificial Sequence
  sgRNA
  Nipal1_20
atgagcgcttgaatattcac

SEQ ID NO: 34220 - DNA, 20 bp, Artificial Sequence
  sgRNA
  Nipal2_1
aggcaatttcgcagcctatg

SEQ ID NO: 34221 - DNA, 20 bp, Artificial Sequence
  sgRNA
  Nipal2_2
ttactcacctagtaaatccg

SEQ ID NO: 34222 - DNA, 20 bp, Artificial Sequence
  sgRNA
  Nipal2_3
tgttcttgctgagatagcct

SEQ ID NO: 34223 - DNA, 20 bp, Artificial Sequence
  sgRNA
  Nipal2_4
cttaccaaggagtgccacca

SEQ ID NO: 34224 - DNA, 20 bp, Artificial Sequence
  sgRNA
  Nipal2_5
gatggaggcgactcaacaag

SEQ ID NO: 34225 - DNA, 20 bp, Artificial Sequence
  sgRNA
  Nipal2_6
tcactctgatcgcaccactg

SEQ ID NO: 34226 - DNA, 20 bp, Artificial Sequence
  sgRNA
  Nipal2_7
ggccagactctccgaacaca

SEQ ID NO: 34227 - DNA, 20 bp, Artificial Sequence
  sgRNA
  Nipal2_8
gtaactgacatgcaccccag

SEQ ID NO: 34228 - DNA, 20 bp, Artificial Sequence
  sgRNA
  Nipal2_9
ggtcattgtgtagagttctg

SEQ ID NO: 34229 - DNA, 20 bp, Artificial Sequence
  sgRNA
  Nipal2_10
gtctggccagatgcacaaat

SEQ ID NO: 34230 - DNA, 20 bp, Artificial Sequence
  sgRNA
  Nipal2_11
ttgtcactaaaaatactcca

SEQ ID NO: 34231 - DNA, 20 bp, Artificial Sequence
  sgRNA
  Nipal2_12
tggccagcaaaactccaaaa

SEQ ID NO: 34232 - DNA, 20 bp, Artificial Sequence
  sgRNA
  Nipal2_13
cttgacttggaaaacgcaag

SEQ ID NO: 34233 - DNA, 20 bp, Artificial Sequence
  sgRNA
  Nipal2_14
gattcaaatggcttatccta

SEQ ID NO: 34234 - DNA, 20 bp, Artificial Sequence
  sgRNA
  Nipal2_15
cagtgagaaaagcagcacca

SEQ ID NO: 34235 - DNA, 20 bp, Artificial Sequence
  sgRNA
  Nipal2_16
atcactctgatcgcaccact

SEQ ID NO: 34236 - DNA, 20 bp, Artificial Sequence
  sgRNA
  Nipal2_17
aggaatagcagagcttcagc

SEQ ID NO: 34237 - DNA, 20 bp, Artificial Sequence
  sgRNA
  Nipal2_18
tgatggaggcgactcaacaa

SEQ ID NO: 34238 - DNA, 20 bp, Artificial Sequence
  sgRNA
  Nipal2_19
cgctggttgtaaagaaaaca

SEQ ID NO: 34239 - DNA, 20 bp, Artificial Sequence
  sgRNA
  Nipal2_20
actctacacaatgaccacag

SEQ ID NO: 34240 - DNA, 20 bp, Artificial Sequence
  sgRNA
  Nipal3_1
gtacgtggcctgatagatgg

SEQ ID NO: 34241 - DNA, 20 bp, Artificial Sequence
  sgRNA
  Nipal3_2
tgcaaatgtcactagcaggt

SEQ ID NO: 34242 - DNA, 20 bp, Artificial Sequence
  sgRNA
  Nipal3_3
tggtcttgaagtaggcccgt

SEQ ID NO: 34243 - DNA, 20 bp, Artificial Sequence
  sgRNA
  Nipal3_4
cagacactgcttaccaagca

SEQ ID NO: 34244 - DNA, 20 bp, Artificial Sequence
  sgRNA
  Nipal3_5
tgtgcagagcttcctcccca

SEQ ID NO: 34245 - DNA, 20 bp, Artificial Sequence
  sgRNA
  Nipal3_6
cacgagcctgagcagcagcg

SEQ ID NO: 34246 - DNA, 20 bp, Artificial Sequence
  sgRNA
  Nipal3_7
tgacaggcgagaacatcgcc

SEQ ID NO: 34247 - DNA, 20 bp, Artificial Sequence
  sgRNA
  Nipal3_8
ctacatcctgtccacaacag

SEQ ID NO: 34248 - DNA, 20 bp, Artificial Sequence
  sgRNA
  Nipal3_9
atggaaatatagggctcgaa

SEQ ID NO: 34249 - DNA, 20 bp, Artificial Sequence
  sgRNA
  Nipal3_10
atcaagatgctcaagacgtg

SEQ ID NO: 34250 - DNA, 20 bp, Artificial Sequence
  sgRNA
  Nipal3_11
ggacgcggtagggaacccca

SEQ ID NO: 34251 - DNA, 20 bp, Artificial Sequence
  sgRNA
  Nipal3_12
aatcactcgaaacagaaaga

SEQ ID NO: 34252 - DNA, 20 bp, Artificial Sequence
  sgRNA
  Nipal3_13
gcagtaagctctcttaaact

SEQ ID NO: 34253 - DNA, 20 bp, Artificial Sequence
  sgRNA
  Nipal3_14
agaccaagacatggtggctg

SEQ ID NO: 34254 - DNA, 20 bp, Artificial Sequence
  sgRNA
  Nipal3_15
gcagctgcagacctgcactg

SEQ ID NO: 34255 - DNA, 20 bp, Artificial Sequence
  sgRNA
  Nipal3_16
gctgtgctcctcctgcatga

SEQ ID NO: 34256 - DNA, 20 bp, Artificial Sequence
  sgRNA
  Nipal3_17
acttcaagaccaagacatgg

SEQ ID NO: 34257 - DNA, 20 bp, Artificial Sequence
  sgRNA
  Nipal3_18
acgagcctgagcagcagcga

SEQ ID NO: 34258 - DNA, 20 bp, Artificial Sequence
  sgRNA
  Nipal3_19
gccaacgctggcaatcaagg

SEQ ID NO: 34259 - DNA, 20 bp, Artificial Sequence
  sgRNA
  Nipal3_20
cgtggcctgatagatggcgg

SEQ ID NO: 34260 - DNA, 20 bp, Artificial Sequence
  sgRNA
  Nipal4_1
attcctttgcccgtaacgtg

SEQ ID NO: 34261 - DNA, 20 bp, Artificial Sequence
  sgRNA
  Nipal4_2
gctacctgaaggacccaatg

SEQ ID NO: 34262 - DNA, 20 bp, Artificial Sequence
  sgRNA
  Nipal4_3
tgcctctcacgatctgacag

SEQ ID NO: 34263 - DNA, 20 bp, Artificial Sequence
  sgRNA
  Nipal4_4
ggatgacactggtgccgatg

SEQ ID NO: 34264 - DNA, 20 bp, Artificial Sequence
  sgRNA
  Nipal4_5
gcgacggttgtcacaccgct

SEQ ID NO: 34265 - DNA, 20 bp, Artificial Sequence
  sgRNA
  Nipal4_6
gtagattcaggctctctccc

SEQ ID NO: 34266 - DNA, 20 bp, Artificial Sequence
  sgRNA
  Nipal4_7
ggatgatgatagaaagaccc

SEQ ID NO: 34267 - DNA, 20 bp, Artificial Sequence
  sgRNA
  Nipal4_8
tctccgtgactgccgtcaag

SEQ ID NO: 34268 - DNA, 20 bp, Artificial Sequence
  sgRNA
  Nipal4_9
ggagcagtagaggctgacta

SEQ ID NO: 34269 - DNA, 20 bp, Artificial Sequence
  sgRNA
  Nipal4_10
aggacgctcagtgctcccag

SEQ ID NO: 34270 - DNA, 20 bp, Artificial Sequence
  sgRNA
  Nipal4_11
tccagggcttaccagttgtg

SEQ ID NO: 34271 - DNA, 20 bp, Artificial Sequence
  sgRNA
  Nipal4_12
gccctggaagaagttcctaa

SEQ ID NO: 34272 - DNA, 20 bp, Artificial Sequence
  sgRNA
  Nipal4_13
gatggtgacgaagccagaca

SEQ ID NO: 34273 - DNA, 20 bp, Artificial Sequence
  sgRNA
  Nipal4_14
ggagagagcctgaatctact

SEQ ID NO: 34274 - DNA, 20 bp, Artificial Sequence
  sgRNA
  Nipal4_15
tggagaagttgccaacttcg

SEQ ID NO: 34275 - DNA, 20 bp, Artificial Sequence
  sgRNA
  Nipal4_16
ctatgcatttgcacctgcga

SEQ ID NO: 34276 - DNA, 20 bp, Artificial Sequence
  sgRNA
  Nipal4_17
ccactccttgaagaggacga

SEQ ID NO: 34277 - DNA, 20 bp, Artificial Sequence
  sgRNA
  Nipal4_18
ggtcatacatgcccccaaag

SEQ ID NO: 34278 - DNA, 20 bp, Artificial Sequence
  sgRNA
  Nipal4_19
ggaggaggccaccaccaccg

SEQ ID NO: 34279 - DNA, 20 bp, Artificial Sequence
  sgRNA
  Nipal4_20
ggtgacaccaagccccttga

SEQ ID NO: 34280 - DNA, 20 bp, Artificial Sequence
  sgRNA
  Nkain1_1
ataccgggaccgatactgca

SEQ ID NO: 34281 - DNA, 20 bp, Artificial Sequence
  sgRNA
  Nkain1_2
catccaccaggagcgatgca

SEQ ID NO: 34282 - DNA, 20 bp, Artificial Sequence
  sgRNA
  Nkain1_3
gcacggtaccaaagatgccc

SEQ ID NO: 34283 - DNA, 20 bp, Artificial Sequence
  sgRNA
  Nkain1_4
tctttggtaccgtgcagtat

SEQ ID NO: 34284 - DNA, 20 bp, Artificial Sequence
  sgRNA
  Nkain1_5
cgatttcctgggctaccagt

SEQ ID NO: 34285 - DNA, 20 bp, Artificial Sequence
  sgRNA
  Nkain1_6
tggccaggataggagcccac

SEQ ID NO: 34286 - DNA, 20 bp, Artificial Sequence
  sgRNA
  Nkain1_7
ggaaatcgaagatctgccgc

SEQ ID NO: 34287 - DNA, 20 bp, Artificial Sequence
  sgRNA
  Nkain1_8
agaaggcgaccagcgtgcag

SEQ ID NO: 34288 - DNA, 20 bp, Artificial Sequence
  sgRNA
  Nkain1_9
gtaccgtgcagtatcggtcc

SEQ ID NO: 34289 - DNA, 20 bp, Artificial Sequence
  sgRNA
  Nkain1_10
ggaggaccaccacgtcatct

SEQ ID NO: 34290 - DNA, 20 bp, Artificial Sequence
  sgRNA
  Nkain1_11
agttcagaacaggagtcacc

SEQ ID NO: 34291 - DNA, 20 bp, Artificial Sequence
  sgRNA
  Nkain1_12
tggaccattctccatccacc

SEQ ID NO: 34292 - DNA, 20 bp, Artificial Sequence
  sgRNA
  Nkain1_13
gatgacgtggtggtcctcca

SEQ ID NO: 34293 - DNA, 20 bp, Artificial Sequence
  sgRNA
  Nkain1_14
catccctgcatcgctcctgg

SEQ ID NO: 34294 - DNA, 20 bp, Artificial Sequence
  sgRNA
  Nkain1_15
ctgcggcgcctggtatccat

SEQ ID NO: 34295 - DNA, 20 bp, Artificial Sequence
  sgRNA
  Nkain1_16
tgatatgcaggaagttggcc

SEQ ID NO: 34296 - DNA, 20 bp, Artificial Sequence
  sgRNA
  Nkain1_17
gccaacccagagtacaagcc

SEQ ID NO: 34297 - DNA, 20 bp, Artificial Sequence
  sgRNA
  Nkain1_18
agatctgcagggcactactg

SEQ ID NO: 34298 - DNA, 20 bp, Artificial Sequence
  sgRNA
  Nkain1_19
agccagtgaccgagatgacg

SEQ ID NO: 34299 - DNA, 20 bp, Artificial Sequence
  sgRNA
  Nkain1_20
tgtaaatgcgacgtcttctg

SEQ ID NO: 34300 - DNA, 20 bp, Artificial Sequence
  sgRNA
  Nkain2_1
cttactcctgttacgtaacg

SEQ ID NO: 34301 - DNA, 20 bp, Artificial Sequence
  sgRNA
  Nkain2_2
taggtgcccactgatatcca

SEQ ID NO: 34302 - DNA, 20 bp, Artificial Sequence
  sgRNA
  Nkain2_3
tggtggatggagaatggacc

SEQ ID NO: 34303 - DNA, 20 bp, Artificial Sequence
  sgRNA
  Nkain2_4
ctgagacagtgatgtagcga

SEQ ID NO: 34304 - DNA, 20 bp, Artificial Sequence
  sgRNA
  Nkain2_5
ttgactgcgggaacaacgcg

SEQ ID NO: 34305 - DNA, 20 bp, Artificial Sequence
  sgRNA
  Nkain2_6
gatccgctcatctaggcaag

SEQ ID NO: 34306 - DNA, 20 bp, Artificial Sequence
  sgRNA
  Nkain2_7
ggatccgctcatctaggcaa

SEQ ID NO: 34307 - DNA, 20 bp, Artificial Sequence
  sgRNA
  Nkain2_8
gcatctggcccgccaagttg

SEQ ID NO: 34308 - DNA, 20 bp, Artificial Sequence
  sgRNA
  Nkain2_9
tttcaatgcaccgatcttgg

SEQ ID NO: 34309 - DNA, 20 bp, Artificial Sequence
  sgRNA
  Nkain2_10
gaatagttccaaacaaccca

SEQ ID NO: 34310 - DNA, 20 bp, Artificial Sequence
  sgRNA
  Nkain2_11
gcacgcggagcgcagaacag

SEQ ID NO: 34311 - DNA, 20 bp, Artificial Sequence
  sgRNA
  Nkain2_12
tgttgtcaacacttactgcg

SEQ ID NO: 34312 - DNA, 20 bp, Artificial Sequence
  sgRNA
  Nkain2_13
ttactgcgaggacaatctgg

SEQ ID NO: 34313 - DNA, 20 bp, Artificial Sequence
  sgRNA
  Nkain2_14
tgactgcgggaacaacgcga

SEQ ID NO: 34314 - DNA, 20 bp, Artificial Sequence
  sgRNA
  Nkain2_15
ggactaccaatacatagaag

SEQ ID NO: 34315 - DNA, 20 bp, Artificial Sequence
  sgRNA
  Nkain2_16
tgttctgcgctccgcgtgcg

SEQ ID NO: 34316 - DNA, 20 bp, Artificial Sequence
  sgRNA
  Nkain2_17
tgatttccttggatatcagt

SEQ ID NO: 34317 - DNA, 20 bp, Artificial Sequence
  sgRNA
  Nkain2_18
ttggcgggccagatgcccca

SEQ ID NO: 34318 - DNA, 20 bp, Artificial Sequence
  sgRNA
  Nkain2_19
tactgcgaggacaatctgga

SEQ ID NO: 34319 - DNA, 20 bp, Artificial Sequence
  sgRNA
  Nkain2_20
atcgctacatcactgtctca

SEQ ID NO: 34320 - DNA, 20 bp, Artificial Sequence
  sgRNA
  Nkain3_1
tagaccacgttacatcatgg

SEQ ID NO: 34321 - DNA, 20 bp, Artificial Sequence
  sgRNA
  Nkain3_2
atggtaagctcaccttagag

SEQ ID NO: 34322 - DNA, 20 bp, Artificial Sequence
  sgRNA
  Nkain3_3
tctctgtacaccggtcatgg

SEQ ID NO: 34323 - DNA, 20 bp, Artificial Sequence
  sgRNA
  Nkain3_4
atatgacaactattatatgc

SEQ ID NO: 34324 - DNA, 20 bp, Artificial Sequence
  sgRNA
  Nkain3_5
tgtcgatttccagtacctag

SEQ ID NO: 34325 - DNA, 20 bp, Artificial Sequence
  sgRNA
  Nkain3_6
tgtacaccggtcatggtgga

SEQ ID NO: 34326 - DNA, 20 bp, Artificial Sequence
  sgRNA
  Nkain3_7
gtatagaccacgttacatca

SEQ ID NO: 34327 - DNA, 20 bp, Artificial Sequence
  sgRNA
  Nkain3_8
ggaaatgctgatcacataac

SEQ ID NO: 34328 - DNA, 20 bp, Artificial Sequence
  sgRNA
  Nkain3_9
tgacttccttggcttccagt

SEQ ID NO: 34329 - DNA, 20 bp, Artificial Sequence
  sgRNA
  Nkain3_10
gtaacgtggtctatactgaa

SEQ ID NO: 34330 - DNA, 20 bp, Artificial Sequence
  sgRNA
  Nkain3_11
gtagtcatccatcatgccat

SEQ ID NO: 34331 - DNA, 20 bp, Artificial Sequence
  sgRNA
  Nkain3_12
ccttcaacatctctgtacac

SEQ ID NO: 34332 - DNA, 20 bp, Artificial Sequence
  sgRNA
  Nkain3_13
acagaccagcgagcagcgcc

SEQ ID NO: 34333 - DNA, 20 bp, Artificial Sequence
  sgRNA
  Nkain3_14
gcagtatttgtacagcgctg

SEQ ID NO: 34334 - DNA, 20 bp, Artificial Sequence
  sgRNA
  Nkain3_15
ctgtacaccggtcatggtgg

SEQ ID NO: 34335 - DNA, 20 bp, Artificial Sequence
  sgRNA
  Nkain3_16
ttatgtgatcagcatttcca

SEQ ID NO: 34336 - DNA, 20 bp, Artificial Sequence
  sgRNA
  Nkain3_17
ttgacttccttggcttccag

SEQ ID NO: 34337 - DNA, 20 bp, Artificial Sequence
  sgRNA
  Nkain3_18
atcatgccatgggctgatgg

SEQ ID NO: 34338 - DNA, 20 bp, Artificial Sequence
  sgRNA
  Nkain3_19
acaggtgtcttcttcttcca

SEQ ID NO: 34339 - DNA, 20 bp, Artificial Sequence
  sgRNA
  Nkain3_20
ttccaagaatgggtgcccac

SEQ ID NO: 34340 - DNA, 20 bp, Artificial Sequence
  sgRNA
  Nlgn1_1
caaacacagtgattcgcaag

SEQ ID NO: 34341 - DNA, 20 bp, Artificial Sequence
  sgRNA
  Nlgn1_2
gcgttccggatgtcagacca

SEQ ID NO: 34342 - DNA, 20 bp, Artificial Sequence
  sgRNA
  Nlgn1_3
aaggctatgtggtatcgggc

SEQ ID NO: 34343 - DNA, 20 bp, Artificial Sequence
  sgRNA
  Nlgn1_4
gtgagccaaagttcgagtga

SEQ ID NO: 34344 - DNA, 20 bp, Artificial Sequence
  sgRNA
  Nlgn1_5
ggagacatgatgtccaccgg

SEQ ID NO: 34345 - DNA, 20 bp, Artificial Sequence
  sgRNA
  Nlgn1_6
tgattcccaacactatacca

SEQ ID NO: 34346 - DNA, 20 bp, Artificial Sequence
  sgRNA
  Nlgn1_7
gtgatggtgtacatccatgg

SEQ ID NO: 34347 - DNA, 20 bp, Artificial Sequence
  sgRNA
  Nlgn1_8
aggtctgagagtgatgtccg

SEQ ID NO: 34348 - DNA, 20 bp, Artificial Sequence
  sgRNA
  Nlgn1_9
ccaaacacagtgattcgcaa

SEQ ID NO: 34349 - DNA, 20 bp, Artificial Sequence
  sgRNA
  Nlgn1_10
gctaagtgtcactatcgcag

SEQ ID NO: 34350 - DNA, 20 bp, Artificial Sequence
  sgRNA
  Nlgn1_11
tttgtttacggaccatcaat

SEQ ID NO: 34351 - DNA, 20 bp, Artificial Sequence
  sgRNA
  Nlgn1_12
acatcactctcagacctaca

SEQ ID NO: 34352 - DNA, 20 bp, Artificial Sequence
  sgRNA
  Nlgn1_13
tcacaggtccaaaggctatg

SEQ ID NO: 34353 - DNA, 20 bp, Artificial Sequence
  sgRNA
  Nlgn1_14
atagctagagtataatctgg

SEQ ID NO: 34354 - DNA, 20 bp, Artificial Sequence
  sgRNA
  Nlgn1_15
caaacttcaacccttcccct

SEQ ID NO: 34355 - DNA, 20 bp, Artificial Sequence
  sgRNA
  Nlgn1_16
attattctgaaggtaaccgt

SEQ ID NO: 34356 - DNA, 20 bp, Artificial Sequence
  sgRNA
  Nlgn1_17
aatgttgggagttaaccaag

SEQ ID NO: 34357 - DNA, 20 bp, Artificial Sequence
  sgRNA
  Nlgn1_18
cttccatgtaagagccgcca

SEQ ID NO: 34358 - DNA, 20 bp, Artificial Sequence
  sgRNA
  Nlgn1_19
actctgtagggccaatcatg

SEQ ID NO: 34359 - DNA, 20 bp, Artificial Sequence
  sgRNA
  Nlgn1_20
cttgttccatcagtatctga

SEQ ID NO: 34360 - DNA, 20 bp, Artificial Sequence
  sgRNA
  Nlgn2_1
accagccgctcaagtacacg

SEQ ID NO: 34361 - DNA, 20 bp, Artificial Sequence
  sgRNA
  Nlgn2_2
gctcacaaaaaaacgtgacg

SEQ ID NO: 34362 - DNA, 20 bp, Artificial Sequence
  sgRNA
  Nlgn2_3
gaaagtgtaaaagtagacgg

SEQ ID NO: 34363 - DNA, 20 bp, Artificial Sequence
  sgRNA
  Nlgn2_4
ccgagatcctcatgcaacag

SEQ ID NO: 34364 - DNA, 20 bp, Artificial Sequence
  sgRNA
  Nlgn2_5
gtatcgctgcagctgaagcg

SEQ ID NO: 34365 - DNA, 20 bp, Artificial Sequence
  sgRNA
  Nlgn2_6
cgtaggctgtgttcaccacg

SEQ ID NO: 34366 - DNA, 20 bp, Artificial Sequence
  sgRNA
  Nlgn2_7
agtagtccctcgagtcaccg

SEQ ID NO: 34367 - DNA, 20 bp, Artificial Sequence
  sgRNA
  Nlgn2_8
ttgccgccctctattacaag

SEQ ID NO: 34368 - DNA, 20 bp, Artificial Sequence
  sgRNA
  Nlgn2_9
gtcccgcttgtaatagaggg

SEQ ID NO: 34369 - DNA, 20 bp, Artificial Sequence
  sgRNA
  Nlgn2_10
acagcctacgggcgagtgcg

SEQ ID NO: 34370 - DNA, 20 bp, Artificial Sequence
  sgRNA
  Nlgn2_11
gagtgggcagacgcagcgca

SEQ ID NO: 34371 - DNA, 20 bp, Artificial Sequence
  sgRNA
  Nlgn2_12
ctacgtgcagaaccagagcg

SEQ ID NO: 34372 - DNA, 20 bp, Artificial Sequence
  sgRNA
  Nlgn2_13
gactacgatgacattgccat

SEQ ID NO: 34373 - DNA, 20 bp, Artificial Sequence
  sgRNA
  Nlgn2_14
ctataccctggccttgcgcc

SEQ ID NO: 34374 - DNA, 20 bp, Artificial Sequence
  sgRNA
  Nlgn2_15
gccccaccagacacaacgcc

SEQ ID NO: 34375 - DNA, 20 bp, Artificial Sequence
  sgRNA
  Nlgn2_16
cgaacttgagaccctctccc

SEQ ID NO: 34376 - DNA, 20 bp, Artificial Sequence
  sgRNA
  Nlgn2_17
atggggacaccaaagacgta

SEQ ID NO: 34377 - DNA, 20 bp, Artificial Sequence
  sgRNA
  Nlgn2_18
gggacaatggcgagatgcgg

SEQ ID NO: 34378 - DNA, 20 bp, Artificial Sequence
  sgRNA
  Nlgn2_19
cttgtaatagagggcggcaa

SEQ ID NO: 34379 - DNA, 20 bp, Artificial Sequence
  sgRNA
  Nlgn2_20
tgttgtggctggtagcagta

SEQ ID NO: 34380 - DNA, 20 bp, Artificial Sequence
  sgRNA
  Nlgn3_1
tgatcattaccgggccacaa

SEQ ID NO: 34381 - DNA, 20 bp, Artificial Sequence
  sgRNA
  Nlgn3_2
aaacgtttctcgccgatcgg

SEQ ID NO: 34382 - DNA, 20 bp, Artificial Sequence
  sgRNA
  Nlgn3_3
gaccagctctaccttcacat

SEQ ID NO: 34383 - DNA, 20 bp, Artificial Sequence
  sgRNA
  Nlgn3_4
ctaggcgtcaaccagggtga

SEQ ID NO: 34384 - DNA, 20 bp, Artificial Sequence
  sgRNA
  Nlgn3_5
agtggcgacgatatccaagt

SEQ ID NO: 34385 - DNA, 20 bp, Artificial Sequence
  sgRNA
  Nlgn3_6
tgaacttgatagtctcccgc

SEQ ID NO: 34386 - DNA, 20 bp, Artificial Sequence
  sgRNA
  Nlgn3_7
ggtcctgtggaccaatacct

SEQ ID NO: 34387 - DNA, 20 bp, Artificial Sequence
  sgRNA
  Nlgn3_8
tgagacccgccgtaaaacac

SEQ ID NO: 34388 - DNA, 20 bp, Artificial Sequence
  sgRNA
  Nlgn3_9
ggaactctccctgctccata

SEQ ID NO: 34389 - DNA, 20 bp, Artificial Sequence
  sgRNA
  Nlgn3_10
acagctcccacatcacccgt

SEQ ID NO: 34390 - DNA, 20 bp, Artificial Sequence
  sgRNA
  Nlgn3_11
tcagccagcccgctaccatg

SEQ ID NO: 34391 - DNA, 20 bp, Artificial Sequence
  sgRNA
  Nlgn3_12
cggcgctaagaaacagggcg

SEQ ID NO: 34392 - DNA, 20 bp, Artificial Sequence
  sgRNA
  Nlgn3_13
ggtcagtgggacctaccata

SEQ ID NO: 34393 - DNA, 20 bp, Artificial Sequence
  sgRNA
  Nlgn3_14
cctataacacctttgccgca

SEQ ID NO: 34394 - DNA, 20 bp, Artificial Sequence
  sgRNA
  Nlgn3_15
acagcaatgagaatgcccct

SEQ ID NO: 34395 - DNA, 20 bp, Artificial Sequence
  sgRNA
  Nlgn3_16
cggagcagttcccaattcag

SEQ ID NO: 34396 - DNA, 20 bp, Artificial Sequence
  sgRNA
  Nlgn3_17
atagggacaccaaaaacata

SEQ ID NO: 34397 - DNA, 20 bp, Artificial Sequence
  sgRNA
  Nlgn3_18
attctcactcacccagcgaa

SEQ ID NO: 34398 - DNA, 20 bp, Artificial Sequence
  sgRNA
  Nlgn3_19
tgctgccctctattaccgta

SEQ ID NO: 34399 - DNA, 20 bp, Artificial Sequence
  sgRNA
  Nlgn3_20
gcattctcattgctgtaggc

SEQ ID NO: 34400 - DNA, 20 bp, Artificial Sequence
  sgRNA
  Nmbr_1
gatgttagggacattccgca

SEQ ID NO: 34401 - DNA, 20 bp, Artificial Sequence
  sgRNA
  Nmbr_2
ttcatcaaagaagtaacggg

SEQ ID NO: 34402 - DNA, 20 bp, Artificial Sequence
  sgRNA
  Nmbr_3
ttcacgatagctctgtacct

SEQ ID NO: 34403 - DNA, 20 bp, Artificial Sequence
  sgRNA
  Nmbr_4
agagggatggtatcacacag

SEQ ID NO: 34404 - DNA, 20 bp, Artificial Sequence
  sgRNA
  Nmbr_5
gaacacagaaacccccaccg

SEQ ID NO: 34405 - DNA, 20 bp, Artificial Sequence
  sgRNA
  Nmbr_6
actggtccacagcaacacac

SEQ ID NO: 34406 - DNA, 20 bp, Artificial Sequence
  sgRNA
  Nmbr_7
atttcctgcccgactcagat

SEQ ID NO: 34407 - DNA, 20 bp, Artificial Sequence
  sgRNA
  Nmbr_8
gctaaagcaaatgaatgccc

SEQ ID NO: 34408 - DNA, 20 bp, Artificial Sequence
  sgRNA
  Nmbr_9
ctacctaatcatcatctcgg

SEQ ID NO: 34409 - DNA, 20 bp, Artificial Sequence
  sgRNA
  Nmbr_10
gctgctgacctgcgttccag

SEQ ID NO: 34410 - DNA, 20 bp, Artificial Sequence
  sgRNA
  Nmbr_11
gttgctgtggaccagtttga

SEQ ID NO: 34411 - DNA, 20 bp, Artificial Sequence
  sgRNA
  Nmbr_12
tcctcaccaacagcgccatg

SEQ ID NO: 34412 - DNA, 20 bp, Artificial Sequence
  sgRNA
  Nmbr_13
acagcggatcaccaactccg

SEQ ID NO: 34413 - DNA, 20 bp, Artificial Sequence
  sgRNA
  Nmbr_14
gcggatcaccaactccgcgg

SEQ ID NO: 34414 - DNA, 20 bp, Artificial Sequence
  sgRNA
  Nmbr_15
tacctaatcatcatctcggt

SEQ ID NO: 34415 - DNA, 20 bp, Artificial Sequence
  sgRNA
  Nmbr_16
ataaatgctgatgataacaa

SEQ ID NO: 34416 - DNA, 20 bp, Artificial Sequence
  sgRNA
  Nmbr_17
gatgtaactcatctgtttgt

SEQ ID NO: 34417 - DNA, 20 bp, Artificial Sequence
  sgRNA
  Nmbr_18
gtataggtctttcaactaca

SEQ ID NO: 34418 - DNA, 20 bp, Artificial Sequence
  sgRNA
  Nmbr_19
catcttcatctctaacctgg

SEQ ID NO: 34419 - DNA, 20 bp, Artificial Sequence
  sgRNA
  Nmbr_20
ccgagatgatgattaggtag

SEQ ID NO: 34420 - DNA, 20 bp, Artificial Sequence
  sgRNA
  Nmur1_1
agggcacagttagttgactg

SEQ ID NO: 34421 - DNA, 20 bp, Artificial Sequence
  sgRNA
  Nmur1_2
gcaggtacgtgacacagatg

SEQ ID NO: 34422 - DNA, 20 bp, Artificial Sequence
  sgRNA
  Nmur1_3
agcacactgatggtgaccat

SEQ ID NO: 34423 - DNA, 20 bp, Artificial Sequence
  sgRNA
  Nmur1_4
tgcatctcataaagctccag

SEQ ID NO: 34424 - DNA, 20 bp, Artificial Sequence
  sgRNA
  Nmur1_5
gcaaaattacccgttccagc

SEQ ID NO: 34425 - DNA, 20 bp, Artificial Sequence
  sgRNA
  Nmur1_6
gtgtatggacactcaacgga

SEQ ID NO: 34426 - DNA, 20 bp, Artificial Sequence
  sgRNA
  Nmur1_7
tcactgatattgcagaccag

SEQ ID NO: 34427 - DNA, 20 bp, Artificial Sequence
  sgRNA
  Nmur1_8
tgtatctgctcattgggctg

SEQ ID NO: 34428 - DNA, 20 bp, Artificial Sequence
  sgRNA
  Nmur1_9
gcaatatcagtgagttcaag

SEQ ID NO: 34429 - DNA, 20 bp, Artificial Sequence
  sgRNA
  Nmur1_10
ccccaaatacttcagcctca

SEQ ID NO: 34430 - DNA, 20 bp, Artificial Sequence
  sgRNA
  Nmur1_11
tcagctatatgttcgctggt

SEQ ID NO: 34431 - DNA, 20 bp, Artificial Sequence
  sgRNA
  Nmur1_12
cctggtgtatggacactcaa

SEQ ID NO: 34432 - DNA, 20 bp, Artificial Sequence
  sgRNA
  Nmur1_13
tgtggagcgttatgtggccg

SEQ ID NO: 34433 - DNA, 20 bp, Artificial Sequence
  sgRNA
  Nmur1_14
tggctgtgaatgaggatcca

SEQ ID NO: 34434 - DNA, 20 bp, Artificial Sequence
  sgRNA
  Nmur1_15
ccagcatatcggacacagcg

SEQ ID NO: 34435 - DNA, 20 bp, Artificial Sequence
  sgRNA
  Nmur1_16
gagaccttcctgcaagccct

SEQ ID NO: 34436 - DNA, 20 bp, Artificial Sequence
  sgRNA
  Nmur1_17
aaccacatcaggttgaccac

SEQ ID NO: 34437 - DNA, 20 bp, Artificial Sequence
  sgRNA
  Nmur1_18
ccgttgagtgtccatacacc

SEQ ID NO: 34438 - DNA, 20 bp, Artificial Sequence
  sgRNA
  Nmur1_19
gagcagatacagcacactga

SEQ ID NO: 34439 - DNA, 20 bp, Artificial Sequence
  sgRNA
  Nmur1_20
gtacctgctgatcttcgtgg

SEQ ID NO: 34440 - DNA, 20 bp, Artificial Sequence
  sgRNA
  Nmur2_1
gtagcgctcaatgctaaccg

SEQ ID NO: 34441 - DNA, 20 bp, Artificial Sequence
  sgRNA
  Nmur2_2
tgagccccatgagatagtag

SEQ ID NO: 34442 - DNA, 20 bp, Artificial Sequence
  sgRNA
  Nmur2_3
cactgcgcttgggtccacac

SEQ ID NO: 34443 - DNA, 20 bp, Artificial Sequence
  sgRNA
  Nmur2_4
gtcttgaagtagcatcccac

SEQ ID NO: 34444 - DNA, 20 bp, Artificial Sequence
  sgRNA
  Nmur2_5
tgtgttcaacctcatccacg

SEQ ID NO: 34445 - DNA, 20 bp, Artificial Sequence
  sgRNA
  Nmur2_6
caacattccgaaaggccgcc

SEQ ID NO: 34446 - DNA, 20 bp, Artificial Sequence
  sgRNA
  Nmur2_7
ggttagcattgagcgctacg

SEQ ID NO: 34447 - DNA, 20 bp, Artificial Sequence
  sgRNA
  Nmur2_8
agttccagcagtttcccaac

SEQ ID NO: 34448 - DNA, 20 bp, Artificial Sequence
  sgRNA
  Nmur2_9
catcctctgtcagctccaca

SEQ ID NO: 34449 - DNA, 20 bp, Artificial Sequence
  sgRNA
  Nmur2_10
aggagagacaacattccgaa

SEQ ID NO: 34450 - DNA, 20 bp, Artificial Sequence
  sgRNA
  Nmur2_11
gcgtcctctactatctcatg

SEQ ID NO: 34451 - DNA, 20 bp, Artificial Sequence
  sgRNA
  Nmur2_12
gcacagtcaccaaacccata

SEQ ID NO: 34452 - DNA, 20 bp, Artificial Sequence
  sgRNA
  Nmur2_13
tccaacagatagcaaacacg

SEQ ID NO: 34453 - DNA, 20 bp, Artificial Sequence
  sgRNA
  Nmur2_14
cctagtctggagcttctctg

SEQ ID NO: 34454 - DNA, 20 bp, Artificial Sequence
  sgRNA
  Nmur2_15
tcttcagctttgtggacgag

SEQ ID NO: 34455 - DNA, 20 bp, Artificial Sequence
  sgRNA
  Nmur2_16
ctatgcgctgatcttcgtgg

SEQ ID NO: 34456 - DNA, 20 bp, Artificial Sequence
  sgRNA
  Nmur2_17
agaagctccagactaggctg

SEQ ID NO: 34457 - DNA, 20 bp, Artificial Sequence
  sgRNA
  Nmur2_18
gagccaagctggagagcaca

SEQ ID NO: 34458 - DNA, 20 bp, Artificial Sequence
  sgRNA
  Nmur2_19
agcgtcctctactatctcat

SEQ ID NO: 34459 - DNA, 20 bp, Artificial Sequence
  sgRNA
  Nmur2_20
cgctgatgagggtcatcggg

SEQ ID NO: 34460 - DNA, 20 bp, Artificial Sequence
  sgRNA
  Notch1_1
atatacatacccgtccactc

SEQ ID NO: 34461 - DNA, 20 bp, Artificial Sequence
  sgRNA
  Notch1_2
ctgcccaccaggcttcgtcg

SEQ ID NO: 34462 - DNA, 20 bp, Artificial Sequence
  sgRNA
  Notch1_3
cagtgtaataatcacgcatg

SEQ ID NO: 34463 - DNA, 20 bp, Artificial Sequence
  sgRNA
  Notch1_4
acctgcaaggacatgaccag

SEQ ID NO: 34464 - DNA, 20 bp, Artificial Sequence
  sgRNA
  Notch1_5
gtatgcaccacgatatcgtg

SEQ ID NO: 34465 - DNA, 20 bp, Artificial Sequence
  sgRNA
  Notch1_6
acatgctgacgtcaatgccg

SEQ ID NO: 34466 - DNA, 20 bp, Artificial Sequence
  sgRNA
  Notch1_7
gtgctgagcatgtacccgag

SEQ ID NO: 34467 - DNA, 20 bp, Artificial Sequence
  sgRNA
  Notch1_8
ttgtccccgattatttacca

SEQ ID NO: 34468 - DNA, 20 bp, Artificial Sequence
  sgRNA
  Notch1_9
gctgagtaccaatggcacgg

SEQ ID NO: 34469 - DNA, 20 bp, Artificial Sequence
  sgRNA
  Notch1_10
cttcgactgccagctcaccg

SEQ ID NO: 34470 - DNA, 20 bp, Artificial Sequence
  sgRNA
  Notch1_11
ggccatcccggcaagctccg

SEQ ID NO: 34471 - DNA, 20 bp, Artificial Sequence
  sgRNA
  Notch1_12
ttctactgcgaatgtccgca

SEQ ID NO: 34472 - DNA, 20 bp, Artificial Sequence
  sgRNA
  Notch1_13
attgccgcgggacatcgcac

SEQ ID NO: 34473 - DNA, 20 bp, Artificial Sequence
  sgRNA
  Notch1_14
gtttgttccactccacccag

SEQ ID NO: 34474 - DNA, 20 bp, Artificial Sequence
  sgRNA
  Notch1_15
gctccggcccaggtgcccat

SEQ ID NO: 34475 - DNA, 20 bp, Artificial Sequence
  sgRNA
  Notch1_16
ccatgggtctaactgctccg

SEQ ID NO: 34476 - DNA, 20 bp, Artificial Sequence
  sgRNA
  Notch1_17
gctggccctgtgtaccccga

SEQ ID NO: 34477 - DNA, 20 bp, Artificial Sequence
  sgRNA
  Notch1_18
ccgactgagtcctcgccgag

SEQ ID NO: 34478 - DNA, 20 bp, Artificial Sequence
  sgRNA
  Notch1_19
gcatgctcgagctgtccaac

SEQ ID NO: 34479 - DNA, 20 bp, Artificial Sequence
  sgRNA
  Notch1_20
gtagcccgttgaatttggca

SEQ ID NO: 34480 - DNA, 20 bp, Artificial Sequence
  sgRNA
  Notch2_1
gggctgtgtagagttcgcag

SEQ ID NO: 34481 - DNA, 20 bp, Artificial Sequence
  sgRNA
  Notch2_2
cagcaacccttgtcacaagg

SEQ ID NO: 34482 - DNA, 20 bp, Artificial Sequence
  sgRNA
  Notch2_3
agggaccagtgaaacccacg

SEQ ID NO: 34483 - DNA, 20 bp, Artificial Sequence
  sgRNA
  Notch2_4
tggccaccgttaaggcagtg

SEQ ID NO: 34484 - DNA, 20 bp, Artificial Sequence
  sgRNA
  Notch2_5
aagtcaagaccgttcccgga

SEQ ID NO: 34485 - DNA, 20 bp, Artificial Sequence
  sgRNA
  Notch2_6
gctcaacgtgtcctgtaagg

SEQ ID NO: 34486 - DNA, 20 bp, Artificial Sequence
  sgRNA
  Notch2_7
gataagctggaaagtcacga

SEQ ID NO: 34487 - DNA, 20 bp, Artificial Sequence
  sgRNA
  Notch2_8
tggcatccagatcggttaca

SEQ ID NO: 34488 - DNA, 20 bp, Artificial Sequence
  sgRNA
  Notch2_9
gatagcagctggctgaccga

SEQ ID NO: 34489 - DNA, 20 bp, Artificial Sequence
  sgRNA
  Notch2_10
gcaaggttaggcaggctcgt

SEQ ID NO: 34490 - DNA, 20 bp, Artificial Sequence
  sgRNA
  Notch2_11
agactcgagcgaatcgacgg

SEQ ID NO: 34491 - DNA, 20 bp, Artificial Sequence
  sgRNA
  Notch2_12
ccaggggtcctccatagtga

SEQ ID NO: 34492 - DNA, 20 bp, Artificial Sequence
  sgRNA
  Notch2_13
gctgacttctccccaaagta

SEQ ID NO: 34493 - DNA, 20 bp, Artificial Sequence
  sgRNA
  Notch2_14
ggattcgcgaagcttcttga

SEQ ID NO: 34494 - DNA, 20 bp, Artificial Sequence
  sgRNA
  Notch2_15
cagtggctgcccccgaacga

SEQ ID NO: 34495 - DNA, 20 bp, Artificial Sequence
  sgRNA
  Notch2_16
tatgcaccatcccatccagg

SEQ ID NO: 34496 - DNA, 20 bp, Artificial Sequence
  sgRNA
  Notch2_17
gcgaggcctgtaagattcca

SEQ ID NO: 34497 - DNA, 20 bp, Artificial Sequence
  sgRNA
  Notch2_18
catccgcaccagcatccagg

SEQ ID NO: 34498 - DNA, 20 bp, Artificial Sequence
  sgRNA
  Notch2_19
gtacatttgcacctgcccac

SEQ ID NO: 34499 - DNA, 20 bp, Artificial Sequence
  sgRNA
  Notch2_20
ctacacggggagctactgcg

SEQ ID NO: 34500 - DNA, 20 bp, Artificial Sequence
  sgRNA
  Notch3_1
aacatacccagtgtgccagg

SEQ ID NO: 34501 - DNA, 20 bp, Artificial Sequence
  sgRNA
  Notch3_2
ttgatctccacgttgcagag

SEQ ID NO: 34502 - DNA, 20 bp, Artificial Sequence
  sgRNA
  Notch3_3
ggacatcggtgtctcaatgg

SEQ ID NO: 34503 - DNA, 20 bp, Artificial Sequence
  sgRNA
  Notch3_4
gccaattcggtcaagacacg

SEQ ID NO: 34504 - DNA, 20 bp, Artificial Sequence
  sgRNA
  Notch3_5
cctggccacgtgcgtccaag

SEQ ID NO: 34505 - DNA, 20 bp, Artificial Sequence
  sgRNA
  Notch3_6
gttcacagtgactacccgta

SEQ ID NO: 34506 - DNA, 20 bp, Artificial Sequence
  sgRNA
  Notch3_7
acaacgacaggagaatcggg

SEQ ID NO: 34507 - DNA, 20 bp, Artificial Sequence
  sgRNA
  Notch3_8
aggcacacactgccaatacg

SEQ ID NO: 34508 - DNA, 20 bp, Artificial Sequence
  sgRNA
  Notch3_9
gactgcctacaagatccagg

SEQ ID NO: 34509 - DNA, 20 bp, Artificial Sequence
  sgRNA
  Notch3_10
atttgaatgcacctgccggg

SEQ ID NO: 34510 - DNA, 20 bp, Artificial Sequence
  sgRNA
  Notch3_11
gcgggcagccaaatgcaggg

SEQ ID NO: 34511 - DNA, 20 bp, Artificial Sequence
  sgRNA
  Notch3_12
atagcgggcagccaaatgca

SEQ ID NO: 34512 - DNA, 20 bp, Artificial Sequence
  sgRNA
  Notch3_13
catagccccccatgtaacca

SEQ ID NO: 34513 - DNA, 20 bp, Artificial Sequence
  sgRNA
  Notch3_14
ggtgccaccattacgacacg

SEQ ID NO: 34514 - DNA, 20 bp, Artificial Sequence
  sgRNA
  Notch3_15
gatgctcgctgggaacccgc

SEQ ID NO: 34515 - DNA, 20 bp, Artificial Sequence
  sgRNA
  Notch3_16
ggcgttcagtgcctacacaa

SEQ ID NO: 34516 - DNA, 20 bp, Artificial Sequence
  sgRNA
  Notch3_17
gtgatctgtgatctcccggt

SEQ ID NO: 34517 - DNA, 20 bp, Artificial Sequence
  sgRNA
  Notch3_18
tcccgagcggccaagaacag

SEQ ID NO: 34518 - DNA, 20 bp, Artificial Sequence
  sgRNA
  Notch3_19
aaccagaagttacccccaag

SEQ ID NO: 34519 - DNA, 20 bp, Artificial Sequence
  sgRNA
  Notch3_20
acccctgtgaacatttgggt

SEQ ID NO: 34520 - DNA, 20 bp, Artificial Sequence
  sgRNA
  Nox4_1
aagactctacacatcacatg

SEQ ID NO: 34521 - DNA, 20 bp, Artificial Sequence
  sgRNA
  Nox4_2
tcagagtcttgacttgatgg

SEQ ID NO: 34522 - DNA, 20 bp, Artificial Sequence
  sgRNA
  Nox4_3
ttaagactaatgcagccagg

SEQ ID NO: 34523 - DNA, 20 bp, Artificial Sequence
  sgRNA
  Nox4_4
acggagttccattacatcag

SEQ ID NO: 34524 - DNA, 20 bp, Artificial Sequence
  sgRNA
  Nox4_5
cggagttccattacatcaga

SEQ ID NO: 34525 - DNA, 20 bp, Artificial Sequence
  sgRNA
  Nox4_6
ggagctggctggccaacgaa

SEQ ID NO: 34526 - DNA, 20 bp, Artificial Sequence
  sgRNA
  Nox4_7
gtaaccggaacaactcatat

SEQ ID NO: 34527 - DNA, 20 bp, Artificial Sequence
  sgRNA
  Nox4_8
aaaggagcgatcagtggccg

SEQ ID NO: 34528 - DNA, 20 bp, Artificial Sequence
  sgRNA
  Nox4_9
aggtagaagctgtaaccatg

SEQ ID NO: 34529 - DNA, 20 bp, Artificial Sequence
  sgRNA
  Nox4_10
agtctcctactactttaaag

SEQ ID NO: 34530 - DNA, 20 bp, Artificial Sequence
  sgRNA
  Nox4_11
gctcggtgctcaggaccgaa

SEQ ID NO: 34531 - DNA, 20 bp, Artificial Sequence
  sgRNA
  Nox4_12
ccttcctgctgtacaaccaa

SEQ ID NO: 34532 - DNA, 20 bp, Artificial Sequence
  sgRNA
  Nox4_13
gccaggactgtccggcacat

SEQ ID NO: 34533 - DNA, 20 bp, Artificial Sequence
  sgRNA
  Nox4_14
gtttgttgctcctgatgcat

SEQ ID NO: 34534 - DNA, 20 bp, Artificial Sequence
  sgRNA
  Nox4_15
ttatcttcgaggatcacaga

SEQ ID NO: 34535 - DNA, 20 bp, Artificial Sequence
  sgRNA
  Nox4_16
acagtcctggcttatcttcg

SEQ ID NO: 34536 - DNA, 20 bp, Artificial Sequence
  sgRNA
  Nox4_17
tcaaataaaagtttccaccg

SEQ ID NO: 34537 - DNA, 20 bp, Artificial Sequence
  sgRNA
  Nox4_18
ggtgtccactttaaagtagt

SEQ ID NO: 34538 - DNA, 20 bp, Artificial Sequence
  sgRNA
  Nox4_19
aggaaacagcacttacacag

SEQ ID NO: 34539 - DNA, 20 bp, Artificial Sequence
  sgRNA
  Nox4_20
agagtcttggaaatagaact

SEQ ID NO: 34540 - DNA, 20 bp, Artificial Sequence
  sgRNA
  Npbwr1_1
gagcgccgaccgatacctgg

SEQ ID NO: 34541 - DNA, 20 bp, Artificial Sequence
  sgRNA
  Npbwr1_2
agcagtgcctgtcgtctacg

SEQ ID NO: 34542 - DNA, 20 bp, Artificial Sequence
  sgRNA
  Npbwr1_3
cagccgagcgaataccgcaa

SEQ ID NO: 34543 - DNA, 20 bp, Artificial Sequence
  sgRNA
  Npbwr1_4
ttggtgacagtcttcatgcg

SEQ ID NO: 34544 - DNA, 20 bp, Artificial Sequence
  sgRNA
  Npbwr1_5
ctacggggtaatttgcgccg

SEQ ID NO: 34545 - DNA, 20 bp, Artificial Sequence
  sgRNA
  Npbwr1_6
gtatcggtcggcgctcatga

SEQ ID NO: 34546 - DNA, 20 bp, Artificial Sequence
  sgRNA
  Npbwr1_7
ttgcacatgacctccccgaa

SEQ ID NO: 34547 - DNA, 20 bp, Artificial Sequence
  sgRNA
  Npbwr1_8
gctcggctggacgaggagca

SEQ ID NO: 34548 - DNA, 20 bp, Artificial Sequence
  sgRNA
  Npbwr1_9
gatgttgatgggcagcacga

SEQ ID NO: 34549 - DNA, 20 bp, Artificial Sequence
  sgRNA
  Npbwr1_10
cacgagggtgaagagctcat

SEQ ID NO: 34550 - DNA, 20 bp, Artificial Sequence
  sgRNA
  Npbwr1_11
ggtattcgctcggctggacg

SEQ ID NO: 34551 - DNA, 20 bp, Artificial Sequence
  sgRNA
  Npbwr1_12
tgccctttgcggtattcgct

SEQ ID NO: 34552 - DNA, 20 bp, Artificial Sequence
  sgRNA
  Npbwr1_13
gcgcttcttggcacgatcca

SEQ ID NO: 34553 - DNA, 20 bp, Artificial Sequence
  sgRNA
  Npbwr1_14
ggtcggcgctcatgacggcg

SEQ ID NO: 34554 - DNA, 20 bp, Artificial Sequence
  sgRNA
  Npbwr1_15
agagttgccagccagtccca

SEQ ID NO: 34555 - DNA, 20 bp, Artificial Sequence
  sgRNA
  Npbwr1_16
ttatcacctgagtaccatag

SEQ ID NO: 34556 - DNA, 20 bp, Artificial Sequence
  sgRNA
  Npbwr1_17
ctagctggatagcacgcagt

SEQ ID NO: 34557 - DNA, 20 bp, Artificial Sequence
  sgRNA
  Npbwr1_18
tgaccagcggcgtttgcggg

SEQ ID NO: 34558 - DNA, 20 bp, Artificial Sequence
  sgRNA
  Npbwr1_19
cgatgttgatgggcagcacg

SEQ ID NO: 34559 - DNA, 20 bp, Artificial Sequence
  sgRNA
  Npbwr1_20
ccaatactagtgtgtagaga

SEQ ID NO: 34560 - DNA, 20 bp, Artificial Sequence
  sgRNA
  Npc1_1
ggggaaggtgatcacaagcg

SEQ ID NO: 34561 - DNA, 20 bp, Artificial Sequence
  sgRNA
  Npc1_2
catcatgtgggtcacctacg

SEQ ID NO: 34562 - DNA, 20 bp, Artificial Sequence
  sgRNA
  Npc1_3
cggttcgtagatatgaacac

SEQ ID NO: 34563 - DNA, 20 bp, Artificial Sequence
  sgRNA
  Npc1_4
ccatccctacctgaaaacac

SEQ ID NO: 34564 - DNA, 20 bp, Artificial Sequence
  sgRNA
  Npc1_5
gtagtcatcgatccaggacg

SEQ ID NO: 34565 - DNA, 20 bp, Artificial Sequence
  sgRNA
  Npc1_6
ccacttacgagcgctacaga

SEQ ID NO: 34566 - DNA, 20 bp, Artificial Sequence
  sgRNA
  Npc1_7
ataactacagttcacgcaaa

SEQ ID NO: 34567 - DNA, 20 bp, Artificial Sequence
  sgRNA
  Npc1_8
ttgttcaatggaggcccgaa

SEQ ID NO: 34568 - DNA, 20 bp, Artificial Sequence
  sgRNA
  Npc1_9
ggatgaaaggaacatggtcg

SEQ ID NO: 34569 - DNA, 20 bp, Artificial Sequence
  sgRNA
  Npc1_10
tgcagacctctgactccaga

SEQ ID NO: 34570 - DNA, 20 bp, Artificial Sequence
  sgRNA
  Npc1_11
gggttatcagaaaggaacat

SEQ ID NO: 34571 - DNA, 20 bp, Artificial Sequence
  sgRNA
  Npc1_12
tagccacccaacacaagcca

SEQ ID NO: 34572 - DNA, 20 bp, Artificial Sequence
  sgRNA
  Npc1_13
aaggccttctcgttactgga

SEQ ID NO: 34573 - DNA, 20 bp, Artificial Sequence
  sgRNA
  Npc1_14
agtggctccgagtaagacca

SEQ ID NO: 34574 - DNA, 20 bp, Artificial Sequence
  sgRNA
  Npc1_15
tcaacatgttcggtgtcatg

SEQ ID NO: 34575 - DNA, 20 bp, Artificial Sequence
  sgRNA
  Npc1_16
acatgttagctcacaaaaca

SEQ ID NO: 34576 - DNA, 20 bp, Artificial Sequence
  sgRNA
  Npc1_17
cttggctgtccagcaccgca

SEQ ID NO: 34577 - DNA, 20 bp, Artificial Sequence
  sgRNA
  Npc1_18
actcgtatcattcaaggagg

SEQ ID NO: 34578 - DNA, 20 bp, Artificial Sequence
  sgRNA
  Npc1_19
ccggtcctccaaatgtaccc

SEQ ID NO: 34579 - DNA, 20 bp, Artificial Sequence
  sgRNA
  Npc1_20
gataaccccaaccccaagtg

SEQ ID NO: 34580 - DNA, 20 bp, Artificial Sequence
  sgRNA
  Npc1l1_1
aaaagcagcacacgacgtcg

SEQ ID NO: 34581 - DNA, 20 bp, Artificial Sequence
  sgRNA
  Npc1l1_2
cccagggacggactactcgg

SEQ ID NO: 34582 - DNA, 20 bp, Artificial Sequence
  sgRNA
  Npc1l1_3
ttggggccattgtataggcg

SEQ ID NO: 34583 - DNA, 20 bp, Artificial Sequence
  sgRNA
  Npc1l1_4
ggtgagaatctgcgcttacg

SEQ ID NO: 34584 - DNA, 20 bp, Artificial Sequence
  sgRNA
  Npc1l1_5
gggccgaccacagttccaca

SEQ ID NO: 34585 - DNA, 20 bp, Artificial Sequence
  sgRNA
  Npc1l1_6
cttaatgtgcaacatcagcg

SEQ ID NO: 34586 - DNA, 20 bp, Artificial Sequence
  sgRNA
  Npc1l1_7
ggcgtatcattcaggaacca

SEQ ID NO: 34587 - DNA, 20 bp, Artificial Sequence
  sgRNA
  Npc1l1_8
gtatgtccaggcccagtagg

SEQ ID NO: 34588 - DNA, 20 bp, Artificial Sequence
  sgRNA
  Npc1l1_9
gctgggggccacactaccca

SEQ ID NO: 34589 - DNA, 20 bp, Artificial Sequence
  sgRNA
  Npc1l1_10
gttctaccagcaatacctga

SEQ ID NO: 34590 - DNA, 20 bp, Artificial Sequence
  sgRNA
  Npc1l1_11
tgataccccacacagccatg

SEQ ID NO: 34591 - DNA, 20 bp, Artificial Sequence
  sgRNA
  Npc1l1_12
cttcatcaatgttactcgcg

SEQ ID NO: 34592 - DNA, 20 bp, Artificial Sequence
  sgRNA
  Npc1l1_13
catcacagctgaactacgga

SEQ ID NO: 34593 - DNA, 20 bp, Artificial Sequence
  sgRNA
  Npc1l1_14
agttcgtgtcccacattacc

SEQ ID NO: 34594 - DNA, 20 bp, Artificial Sequence
  sgRNA
  Npc1l1_15
ccatgcggggatcatcagcg

SEQ ID NO: 34595 - DNA, 20 bp, Artificial Sequence
  sgRNA
  Npc1l1_16
tgaggccgatggtgtccacg

SEQ ID NO: 34596 - DNA, 20 bp, Artificial Sequence
  sgRNA
  Npc1l1_17
gtgagaatctgcgcttacga

SEQ ID NO: 34597 - DNA, 20 bp, Artificial Sequence
  sgRNA
  Npc1l1_18
gtctgtccccgcctatacaa

SEQ ID NO: 34598 - DNA, 20 bp, Artificial Sequence
  sgRNA
  Npc1l1_19
gagctgcatagctgactacg

SEQ ID NO: 34599 - DNA, 20 bp, Artificial Sequence
  sgRNA
  Npc1l1_20
atgatcctcgtggacaccat

SEQ ID NO: 34600 - DNA, 20 bp, Artificial Sequence
  sgRNA
  Npffr1_1
tgaccagcatatgcaccacg

SEQ ID NO: 34601 - DNA, 20 bp, Artificial Sequence
  sgRNA
  Npffr1_2
caagccgctcatcttgcatg

SEQ ID NO: 34602 - DNA, 20 bp, Artificial Sequence
  sgRNA
  Npffr1_3
cactctgaccgtcacgcgag

SEQ ID NO: 34603 - DNA, 20 bp, Artificial Sequence
  sgRNA
  Npffr1_4
gagtgatgctgaaaccgccc

SEQ ID NO: 34604 - DNA, 20 bp, Artificial Sequence
  sgRNA
  Npffr1_5
gctgctgctcatcgactacg

SEQ ID NO: 34605 - DNA, 20 bp, Artificial Sequence
  sgRNA
  Npffr1_6
ggtgataaggttgtccacga

SEQ ID NO: 34606 - DNA, 20 bp, Artificial Sequence
  sgRNA
  Npffr1_7
acaagcaagcctactccgag

SEQ ID NO: 34607 - DNA, 20 bp, Artificial Sequence
  sgRNA
  Npffr1_8
atagatgtgcgcgaagagca

SEQ ID NO: 34608 - DNA, 20 bp, Artificial Sequence
  sgRNA
  Npffr1_9
gtccgtctacgccttcccgt

SEQ ID NO: 34609 - DNA, 20 bp, Artificial Sequence
  sgRNA
  Npffr1_10
cctcccagcacgagtagaga

SEQ ID NO: 34610 - DNA, 20 bp, Artificial Sequence
  sgRNA
  Npffr1_11
ctaccagcactcctctccgg

SEQ ID NO: 34611 - DNA, 20 bp, Artificial Sequence
  sgRNA
  Npffr1_12
tcactctcgttcagactcgg

SEQ ID NO: 34612 - DNA, 20 bp, Artificial Sequence
  sgRNA
  Npffr1_13
gatggcagccctgagtcgct

SEQ ID NO: 34613 - DNA, 20 bp, Artificial Sequence
  sgRNA
  Npffr1_14
tgagaagctgaccctccgga

SEQ ID NO: 34614 - DNA, 20 bp, Artificial Sequence
  sgRNA
  Npffr1_15
gccacacgcccattgcgcaa

SEQ ID NO: 34615 - DNA, 20 bp, Artificial Sequence
  sgRNA
  Npffr1_16
ttcaacgagaacttccgccg

SEQ ID NO: 34616 - DNA, 20 bp, Artificial Sequence
  sgRNA
  Npffr1_17
agaggagcatcacttcatgc

SEQ ID NO: 34617 - DNA, 20 bp, Artificial Sequence
  sgRNA
  Npffr1_18
ggtgagcagcgccttccgga

SEQ ID NO: 34618 - DNA, 20 bp, Artificial Sequence
  sgRNA
  Npffr1_19
gcttcatcgtgcttaagaac

SEQ ID NO: 34619 - DNA, 20 bp, Artificial Sequence
  sgRNA
  Npffr1_20
aagatgagcggcttggtaca

SEQ ID NO: 34620 - DNA, 20 bp, Artificial Sequence
  sgRNA
  Npffr2_1
tgtgggagctgagtctcaca

SEQ ID NO: 34621 - DNA, 20 bp, Artificial Sequence
  sgRNA
  Npffr2_2
actggccaagacacgaaatg

SEQ ID NO: 34622 - DNA, 20 bp, Artificial Sequence
  sgRNA
  Npffr2_3
ggtgcaagggatatcagttg

SEQ ID NO: 34623 - DNA, 20 bp, Artificial Sequence
  sgRNA
  Npffr2_4
agtgtgctgccgtcttgaag

SEQ ID NO: 34624 - DNA, 20 bp, Artificial Sequence
  sgRNA
  Npffr2_5
aatgaggaggatctatacca

SEQ ID NO: 34625 - DNA, 20 bp, Artificial Sequence
  sgRNA
  Npffr2_6
gatggtggcaaatagcaccg

SEQ ID NO: 34626 - DNA, 20 bp, Artificial Sequence
  sgRNA
  Npffr2_7
ttgcacatgctgcttccgaa

SEQ ID NO: 34627 - DNA, 20 bp, Artificial Sequence
  sgRNA
  Npffr2_8
gtggagatagtagttcacat

SEQ ID NO: 34628 - DNA, 20 bp, Artificial Sequence
  sgRNA
  Npffr2_9
gccataagtgatttactggt

SEQ ID NO: 34629 - DNA, 20 bp, Artificial Sequence
  sgRNA
  Npffr2_10
ctatctccaccagccccaag

SEQ ID NO: 34630 - DNA, 20 bp, Artificial Sequence
  sgRNA
  Npffr2_11
gcagcatgtgcaagatcagt

SEQ ID NO: 34631 - DNA, 20 bp, Artificial Sequence
  sgRNA
  Npffr2_12
ggtgtctcaaaacccaggtg

SEQ ID NO: 34632 - DNA, 20 bp, Artificial Sequence
  sgRNA
  Npffr2_13
gttgcagaaggcgagccagt

SEQ ID NO: 34633 - DNA, 20 bp, Artificial Sequence
  sgRNA
  Npffr2_14
gtgtgctgccgtcttgaaga

SEQ ID NO: 34634 - DNA, 20 bp, Artificial Sequence
  sgRNA
  Npffr2_15
cagtgagctttggcttaaag

SEQ ID NO: 34635 - DNA, 20 bp, Artificial Sequence
  sgRNA
  Npffr2_16
atagtctgagagcatcatca

SEQ ID NO: 34636 - DNA, 20 bp, Artificial Sequence
  sgRNA
  Npffr2_17
tgttgcagaaggcgagccag

SEQ ID NO: 34637 - DNA, 20 bp, Artificial Sequence
  sgRNA
  Npffr2_18
agcatcatcagggtccacag

SEQ ID NO: 34638 - DNA, 20 bp, Artificial Sequence
  sgRNA
  Npffr2_19
cacacaggaatccttgatag

SEQ ID NO: 34639 - DNA, 20 bp, Artificial Sequence
  sgRNA
  Npffr2_20
gatgatcacaatcgtgacaa

SEQ ID NO: 34640 - DNA, 20 bp, Artificial Sequence
  sgRNA
  Nphs1_1
aggatggagaggattacgct

SEQ ID NO: 34641 - DNA, 20 bp, Artificial Sequence
  sgRNA
  Nphs1_2
acttacataacacgttgagg

SEQ ID NO: 34642 - DNA, 20 bp, Artificial Sequence
  sgRNA
  Nphs1_3
gcgaatccgcagacgccctg

SEQ ID NO: 34643 - DNA, 20 bp, Artificial Sequence
  sgRNA
  Nphs1_4
aatgtaacccgagctgacga

SEQ ID NO: 34644 - DNA, 20 bp, Artificial Sequence
  sgRNA
  Nphs1_5
gctcgggacccaactcggag

SEQ ID NO: 34645 - DNA, 20 bp, Artificial Sequence
  sgRNA
  Nphs1_6
tccgtggtcttcaggtcgaa

SEQ ID NO: 34646 - DNA, 20 bp, Artificial Sequence
  sgRNA
  Nphs1_7
cgtactccgcatcatcgctg

SEQ ID NO: 34647 - DNA, 20 bp, Artificial Sequence
  sgRNA
  Nphs1_8
ggtcaaatatgaggacccaa

SEQ ID NO: 34648 - DNA, 20 bp, Artificial Sequence
  sgRNA
  Nphs1_9
ttaccaagtccagtcgccca

SEQ ID NO: 34649 - DNA, 20 bp, Artificial Sequence
  sgRNA
  Nphs1_10
cctggccaatcaatgacagg

SEQ ID NO: 34650 - DNA, 20 bp, Artificial Sequence
  sgRNA
  Nphs1_11
cctgacatcatcttcatcca

SEQ ID NO: 34651 - DNA, 20 bp, Artificial Sequence
  sgRNA
  Nphs1_12
gtcaaatatgaggacccaag

SEQ ID NO: 34652 - DNA, 20 bp, Artificial Sequence
  sgRNA
  Nphs1_13
ggacttggtaaggcagcaaa

SEQ ID NO: 34653 - DNA, 20 bp, Artificial Sequence
  sgRNA
  Nphs1_14
taccaagtccagtcgcccac

SEQ ID NO: 34654 - DNA, 20 bp, Artificial Sequence
  sgRNA
  Nphs1_15
gctacactgccagaactcgg

SEQ ID NO: 34655 - DNA, 20 bp, Artificial Sequence
  sgRNA
  Nphs1_16
accgttcgacctgaagacca

SEQ ID NO: 34656 - DNA, 20 bp, Artificial Sequence
  sgRNA
  Nphs1_17
agatgtcccctcagctcaaa

SEQ ID NO: 34657 - DNA, 20 bp, Artificial Sequence
  sgRNA
  Nphs1_18
tcaagttcaaggcgtcgcct

SEQ ID NO: 34658 - DNA, 20 bp, Artificial Sequence
  sgRNA
  Nphs1_19
tgtgagcgtgagccctcact

SEQ ID NO: 34659 - DNA, 20 bp, Artificial Sequence
  sgRNA
  Nphs1_20
gctgcagtgcccctccagac

SEQ ID NO: 34660 - DNA, 20 bp, Artificial Sequence
  sgRNA
  Npr1_1
ggagttcgtcgagggcgacc

SEQ ID NO: 34661 - DNA, 20 bp, Artificial Sequence
  sgRNA
  Npr1_2
accatacggaccgtccaacc

SEQ ID NO: 34662 - DNA, 20 bp, Artificial Sequence
  sgRNA
  Npr1_3
aagacagcatactataaggt

SEQ ID NO: 34663 - DNA, 20 bp, Artificial Sequence
  sgRNA
  Npr1_4
aatgctctttctacacaacg

SEQ ID NO: 34664 - DNA, 20 bp, Artificial Sequence
  sgRNA
  Npr1_5
cctcaagtcatccaactgcg

SEQ ID NO: 34665 - DNA, 20 bp, Artificial Sequence
  sgRNA
  Npr1_6
gctgtgctggaagagttcga

SEQ ID NO: 34666 - DNA, 20 bp, Artificial Sequence
  sgRNA
  Npr1_7
ccacgcgagcgacctgaccg

SEQ ID NO: 34667 - DNA, 20 bp, Artificial Sequence
  sgRNA
  Npr1_8
tgctgcatccccgctccccg

SEQ ID NO: 34668 - DNA, 20 bp, Artificial Sequence
  sgRNA
  Npr1_9
acgcgtccgtccgcgcctaa

SEQ ID NO: 34669 - DNA, 20 bp, Artificial Sequence
  sgRNA
  Npr1_10
ttaggcgcggacggacgcgt

SEQ ID NO: 34670 - DNA, 20 bp, Artificial Sequence
  sgRNA
  Npr1_11
tctcggggtccatatcccag

SEQ ID NO: 34671 - DNA, 20 bp, Artificial Sequence
  sgRNA
  Npr1_12
tcgaacctattggctcctcg

SEQ ID NO: 34672 - DNA, 20 bp, Artificial Sequence
  sgRNA
  Npr1_13
ccactatgaagaagcacggc

SEQ ID NO: 34673 - DNA, 20 bp, Artificial Sequence
  sgRNA
  Npr1_14
tgaccaacacctcgtacccg

SEQ ID NO: 34674 - DNA, 20 bp, Artificial Sequence
  sgRNA
  Npr1_15
ctcccacttgagatccaccg

SEQ ID NO: 34675 - DNA, 20 bp, Artificial Sequence
  sgRNA
  Npr1_16
ggatgacttgaggttcccat

SEQ ID NO: 34676 - DNA, 20 bp, Artificial Sequence
  sgRNA
  Npr1_17
tgcccatcgtctctttccca

SEQ ID NO: 34677 - DNA, 20 bp, Artificial Sequence
  sgRNA
  Npr1_18
tcacagagtactgtccccgt

SEQ ID NO: 34678 - DNA, 20 bp, Artificial Sequence
  sgRNA
  Npr1_19
ggatctgcagagccacctgg

SEQ ID NO: 34679 - DNA, 20 bp, Artificial Sequence
  sgRNA
  Npr1_20
accctttcaacagatccgcc

SEQ ID NO: 34680 - DNA, 20 bp, Artificial Sequence
  sgRNA
  Npr2_1
cagcggggtacacacaaccg

SEQ ID NO: 34681 - DNA, 20 bp, Artificial Sequence
  sgRNA
  Npr2_2
atggcaggacaatcgaaccc

SEQ ID NO: 34682 - DNA, 20 bp, Artificial Sequence
  sgRNA
  Npr2_3
acaggacgaaatcagtctcg

SEQ ID NO: 34683 - DNA, 20 bp, Artificial Sequence
  sgRNA
  Npr2_4
caactcggatcgctatcaca

SEQ ID NO: 34684 - DNA, 20 bp, Artificial Sequence
  sgRNA
  Npr2_5
gctcgctcatgacagcccat

SEQ ID NO: 34685 - DNA, 20 bp, Artificial Sequence
  sgRNA
  Npr2_6
gtagcagagcagttaaagcg

SEQ ID NO: 34686 - DNA, 20 bp, Artificial Sequence
  sgRNA
  Npr2_7
tttgtcagctccgaactaga

SEQ ID NO: 34687 - DNA, 20 bp, Artificial Sequence
  sgRNA
  Npr2_8
atttccggccaagcattgac

SEQ ID NO: 34688 - DNA, 20 bp, Artificial Sequence
  sgRNA
  Npr2_9
gaagcatcccagctcatcca

SEQ ID NO: 34689 - DNA, 20 bp, Artificial Sequence
  sgRNA
  Npr2_10
gggtagaatttggtacagca

SEQ ID NO: 34690 - DNA, 20 bp, Artificial Sequence
  sgRNA
  Npr2_11
gccatggccggcctgttgca

SEQ ID NO: 34691 - DNA, 20 bp, Artificial Sequence
  sgRNA
  Npr2_12
ttgaggtccacagcgcgcag

SEQ ID NO: 34692 - DNA, 20 bp, Artificial Sequence
  sgRNA
  Npr2_13
gcttctcgaatggagtcgaa

SEQ ID NO: 34693 - DNA, 20 bp, Artificial Sequence
  sgRNA
  Npr2_14
gtagatggtgacgctgtcga

SEQ ID NO: 34694 - DNA, 20 bp, Artificial Sequence
  sgRNA
  Npr2_15
gttcggagctgacaaaccgc

SEQ ID NO: 34695 - DNA, 20 bp, Artificial Sequence
  sgRNA
  Npr2_16
gagtttgtagtgacattgca

SEQ ID NO: 34696 - DNA, 20 bp, Artificial Sequence
  sgRNA
  Npr2_17
gatcctgcttcaggcccaga

SEQ ID NO: 34697 - DNA, 20 bp, Artificial Sequence
  sgRNA
  Npr2_18
gctcccacgaggacaatact

SEQ ID NO: 34698 - DNA, 20 bp, Artificial Sequence
  sgRNA
  Npr2_19
ccttcatctccacatcccca

SEQ ID NO: 34699 - DNA, 20 bp, Artificial Sequence
  sgRNA
  Npr2_20
ggatgggtcgtccaagtcaa

SEQ ID NO: 34700 - DNA, 20 bp, Artificial Sequence
  sgRNA
  Npr3_1
acagcgacgacaaactcgag

SEQ ID NO: 34701 - DNA, 20 bp, Artificial Sequence
  sgRNA
  Npr3_2
gctggcggctcaaaagatcg

SEQ ID NO: 34702 - DNA, 20 bp, Artificial Sequence
  sgRNA
  Npr3_3
tccaaacagtcaccctactg

SEQ ID NO: 34703 - DNA, 20 bp, Artificial Sequence
  sgRNA
  Npr3_4
gtggtgatcatgtgtgccag

SEQ ID NO: 34704 - DNA, 20 bp, Artificial Sequence
  sgRNA
  Npr3_5
atactcgcacctcacgcgcg

SEQ ID NO: 34705 - DNA, 20 bp, Artificial Sequence
  sgRNA
  Npr3_6
gctacagcaagaaggatggg

SEQ ID NO: 34706 - DNA, 20 bp, Artificial Sequence
  sgRNA
  Npr3_7
cctcctcctgaaaaacctcg

SEQ ID NO: 34707 - DNA, 20 bp, Artificial Sequence
  sgRNA
  Npr3_8
ccacaagactgaagagcgcg

SEQ ID NO: 34708 - DNA, 20 bp, Artificial Sequence
  sgRNA
  Npr3_9
gtaaagccagaacgtagagg

SEQ ID NO: 34709 - DNA, 20 bp, Artificial Sequence
  sgRNA
  Npr3_10
gctacgcagcgcgtactcga

SEQ ID NO: 34710 - DNA, 20 bp, Artificial Sequence
  sgRNA
  Npr3_11
tcgaatgtcaaatatccttg

SEQ ID NO: 34711 - DNA, 20 bp, Artificial Sequence
  sgRNA
  Npr3_12
tcttgtggaccgcgtggcgg

SEQ ID NO: 34712 - DNA, 20 bp, Artificial Sequence
  sgRNA
  Npr3_13
aacctcgtggaccccctcga

SEQ ID NO: 34713 - DNA, 20 bp, Artificial Sequence
  sgRNA
  Npr3_14
aacaagtacgaatcgtcccg

SEQ ID NO: 34714 - DNA, 20 bp, Artificial Sequence
  sgRNA
  Npr3_15
gtacgcgctgcgtagcgtgg

SEQ ID NO: 34715 - DNA, 20 bp, Artificial Sequence
  sgRNA
  Npr3_16
cttcagtcttgtggaccgcg

SEQ ID NO: 34716 - DNA, 20 bp, Artificial Sequence
  sgRNA
  Npr3_17
tggagggcaatggcaccggg

SEQ ID NO: 34717 - DNA, 20 bp, Artificial Sequence
  sgRNA
  Npr3_18
caccctcgagggggtccacg

SEQ ID NO: 34718 - DNA, 20 bp, Artificial Sequence
  sgRNA
  Npr3_19
gtgccagtggtgacaccatt

SEQ ID NO: 34719 - DNA, 20 bp, Artificial Sequence
  sgRNA
  Npr3_20
cgattcgtacttgttctcgc

SEQ ID NO: 34720 - DNA, 20 bp, Artificial Sequence
  sgRNA
  Npsr1_1
ggctccacgctattccgatg

SEQ ID NO: 34721 - DNA, 20 bp, Artificial Sequence
  sgRNA
  Npsr1_2
cagaacagctgataaccctg

SEQ ID NO: 34722 - DNA, 20 bp, Artificial Sequence
  sgRNA
  Npsr1_3
gtacaccagaaaggcgacga

SEQ ID NO: 34723 - DNA, 20 bp, Artificial Sequence
  sgRNA
  Npsr1_4
gcatacagcaggacaaccta

SEQ ID NO: 34724 - DNA, 20 bp, Artificial Sequence
  sgRNA
  Npsr1_5
ctatgctgcagctacaaccg

SEQ ID NO: 34725 - DNA, 20 bp, Artificial Sequence
  sgRNA
  Npsr1_6
aagtcctcatcggaatagcg

SEQ ID NO: 34726 - DNA, 20 bp, Artificial Sequence
  sgRNA
  Npsr1_7
gtatgcctctacctacgtcc

SEQ ID NO: 34727 - DNA, 20 bp, Artificial Sequence
  sgRNA
  Npsr1_8
gttaatggcactgttcaagg

SEQ ID NO: 34728 - DNA, 20 bp, Artificial Sequence
  sgRNA
  Npsr1_9
tcatggggtaaacgatggca

SEQ ID NO: 34729 - DNA, 20 bp, Artificial Sequence
  sgRNA
  Npsr1_10
tttcccaaatatgatcagcg

SEQ ID NO: 34730 - DNA, 20 bp, Artificial Sequence
  sgRNA
  Npsr1_11
gaatggagaacaggaacgag

SEQ ID NO: 34731 - DNA, 20 bp, Artificial Sequence
  sgRNA
  Npsr1_12
ggtcatgtacggggtccagt

SEQ ID NO: 34732 - DNA, 20 bp, Artificial Sequence
  sgRNA
  Npsr1_13
agaggcatagaaacgctcct

SEQ ID NO: 34733 - DNA, 20 bp, Artificial Sequence
  sgRNA
  Npsr1_14
catgaaagctgccctctgtg

SEQ ID NO: 34734 - DNA, 20 bp, Artificial Sequence
  sgRNA
  Npsr1_15
actggggaagaatctagcat

SEQ ID NO: 34735 - DNA, 20 bp, Artificial Sequence
  sgRNA
  Npsr1_16
agttgtctaatatgtcaaag

SEQ ID NO: 34736 - DNA, 20 bp, Artificial Sequence
  sgRNA
  Npsr1_17
ggcgacgatggtcatgtacg

SEQ ID NO: 34737 - DNA, 20 bp, Artificial Sequence
  sgRNA
  Npsr1_18
ggacaccaggacgtaggtag

SEQ ID NO: 34738 - DNA, 20 bp, Artificial Sequence
  sgRNA
  Npsr1_19
cagagtcgtccgctacttgc

SEQ ID NO: 34739 - DNA, 20 bp, Artificial Sequence
  sgRNA
  Npsr1_20
ttaatggcactgttcaaggc

SEQ ID NO: 34740 - DNA, 20 bp, Artificial Sequence
  sgRNA
  Nptn_1
tgacaaaatgatatacacag

SEQ ID NO: 34741 - DNA, 20 bp, Artificial Sequence
  sgRNA
  Nptn_2
gttgctggcattcttacggg

SEQ ID NO: 34742 - DNA, 20 bp, Artificial Sequence
  sgRNA
  Nptn_3
gagctattagaaatctcctg

SEQ ID NO: 34743 - DNA, 20 bp, Artificial Sequence
  sgRNA
  Nptn_4
atgatgtactgcaagtcagt

SEQ ID NO: 34744 - DNA, 20 bp, Artificial Sequence
  sgRNA
  Nptn_5
gtcagaaactaagctcacgg

SEQ ID NO: 34745 - DNA, 20 bp, Artificial Sequence
  sgRNA
  Nptn_6
tgagtgtgctgagaataacc

SEQ ID NO: 34746 - DNA, 20 bp, Artificial Sequence
  sgRNA
  Nptn_7
gtaagtcccagagtcctcca

SEQ ID NO: 34747 - DNA, 20 bp, Artificial Sequence
  sgRNA
  Nptn_8
acacaacaatgatcaccaca

SEQ ID NO: 34748 - DNA, 20 bp, Artificial Sequence
  sgRNA
  Nptn_9
aggcggtgtttacggtgaca

SEQ ID NO: 34749 - DNA, 20 bp, Artificial Sequence
  sgRNA
  Nptn_10
gctcgaatccatgttatgga

SEQ ID NO: 34750 - DNA, 20 bp, Artificial Sequence
  sgRNA
  Nptn_11
gctgtctgaaagactctgcc

SEQ ID NO: 34751 - DNA, 20 bp, Artificial Sequence
  sgRNA
  Nptn_12
tgcgccatatccactctggg

SEQ ID NO: 34752 - DNA, 20 bp, Artificial Sequence
  sgRNA
  Nptn_13
atatggcgcaagaaggagaa

SEQ ID NO: 34753 - DNA, 20 bp, Artificial Sequence
  sgRNA
  Nptn_14
ctccgtttccaccgtcctca

SEQ ID NO: 34754 - DNA, 20 bp, Artificial Sequence
  sgRNA
  Nptn_15
ggtggtacgcagaagtcaac

SEQ ID NO: 34755 - DNA, 20 bp, Artificial Sequence
  sgRNA
  Nptn_16
tttccaccgtcctcagggta

SEQ ID NO: 34756 - DNA, 20 bp, Artificial Sequence
  sgRNA
  Nptn_17
caaggtggctccgtaccctg

SEQ ID NO: 34757 - DNA, 20 bp, Artificial Sequence
  sgRNA
  Nptn_18
cacgccgtttgacccgtagg

SEQ ID NO: 34758 - DNA, 20 bp, Artificial Sequence
  sgRNA
  Nptn_19
gggccagcaacgaccccaag

SEQ ID NO: 34759 - DNA, 20 bp, Artificial Sequence
  sgRNA
  Nptn_20
gtggctccgtaccctgagga

SEQ ID NO: 34760 - DNA, 20 bp, Artificial Sequence
  sgRNA
  Npy1r_1
cagctaatcatcaacccaag

SEQ ID NO: 34761 - DNA, 20 bp, Artificial Sequence
  sgRNA
  Npy1r_2
aaagggattcagtttgcaca

SEQ ID NO: 34762 - DNA, 20 bp, Artificial Sequence
  sgRNA
  Npy1r_3
cagaatttgatagatcacaa

SEQ ID NO: 34763 - DNA, 20 bp, Artificial Sequence
  sgRNA
  Npy1r_4
catatgaatataaagcagag

SEQ ID NO: 34764 - DNA, 20 bp, Artificial Sequence
  sgRNA
  Npy1r_5
ataaaagatggggttgacgc

SEQ ID NO: 34765 - DNA, 20 bp, Artificial Sequence
  sgRNA
  Npy1r_6
gaatgattatgatcaatgcc

SEQ ID NO: 34766 - DNA, 20 bp, Artificial Sequence
  sgRNA
  Npy1r_7
tggtctccccgaagacccag

SEQ ID NO: 34767 - DNA, 20 bp, Artificial Sequence
  sgRNA
  Npy1r_8
agccatgtctaccatgcata

SEQ ID NO: 34768 - DNA, 20 bp, Artificial Sequence
  sgRNA
  Npy1r_9
tggttctcatcgctgtggaa

SEQ ID NO: 34769 - DNA, 20 bp, Artificial Sequence
  sgRNA
  Npy1r_10
atatacactgatggaccact

SEQ ID NO: 34770 - DNA, 20 bp, Artificial Sequence
  sgRNA
  Npy1r_11
cttggacacatccgtatgca

SEQ ID NO: 34771 - DNA, 20 bp, Artificial Sequence
  sgRNA
  Npy1r_12
tcaggaatccataaaagatg

SEQ ID NO: 34772 - DNA, 20 bp, Artificial Sequence
  sgRNA
  Npy1r_13
atatgaatataaagcagagt

SEQ ID NO: 34773 - DNA, 20 bp, Artificial Sequence
  sgRNA
  Npy1r_14
agctaatcatcaacccaaga

SEQ ID NO: 34774 - DNA, 20 bp, Artificial Sequence
  sgRNA
  Npy1r_15
gacgcaggtggagatcatgg

SEQ ID NO: 34775 - DNA, 20 bp, Artificial Sequence
  sgRNA
  Npy1r_16
aattcccatctgactctcac

SEQ ID NO: 34776 - DNA, 20 bp, Artificial Sequence
  sgRNA
  Npy1r_17
cgtagtcatcgtctcgagac

SEQ ID NO: 34777 - DNA, 20 bp, Artificial Sequence
  sgRNA
  Npy1r_18
cgccccataagcgagagcca

SEQ ID NO: 34778 - DNA, 20 bp, Artificial Sequence
  sgRNA
  Npy1r_19
gatggagacacactgtacaa

SEQ ID NO: 34779 - DNA, 20 bp, Artificial Sequence
  sgRNA
  Npy1r_20
gcagagaagaagccactgca

SEQ ID NO: 34780 - DNA, 20 bp, Artificial Sequence
  sgRNA
  Npy2r_1
ccagggcacactactcctag

SEQ ID NO: 34781 - DNA, 20 bp, Artificial Sequence
  sgRNA
  Npy2r_2
ggtggtagacaatgcaacga

SEQ ID NO: 34782 - DNA, 20 bp, Artificial Sequence
  sgRNA
  Npy2r_3
tcttgaatttgattaccaca

SEQ ID NO: 34783 - DNA, 20 bp, Artificial Sequence
  sgRNA
  Npy2r_4
cttactccagatacgggtgt

SEQ ID NO: 34784 - DNA, 20 bp, Artificial Sequence
  sgRNA
  Npy2r_5
gattaccacatggattacca

SEQ ID NO: 34785 - DNA, 20 bp, Artificial Sequence
  sgRNA
  Npy2r_6
gctcacagcggaaggccgag

SEQ ID NO: 34786 - DNA, 20 bp, Artificial Sequence
  sgRNA
  Npy2r_7
ggtgcaggtgatcctcatat

SEQ ID NO: 34787 - DNA, 20 bp, Artificial Sequence
  sgRNA
  Npy2r_8
tggagatcttgctctccagg

SEQ ID NO: 34788 - DNA, 20 bp, Artificial Sequence
  sgRNA
  Npy2r_9
ggtagacaatgcaacgatgg

SEQ ID NO: 34789 - DNA, 20 bp, Artificial Sequence
  sgRNA
  Npy2r_10
cccgtatctggagtaagctg

SEQ ID NO: 34790 - DNA, 20 bp, Artificial Sequence
  sgRNA
  Npy2r_11
gttggatgccattcactcgg

SEQ ID NO: 34791 - DNA, 20 bp, Artificial Sequence
  sgRNA
  Npy2r_12
tgtcgatgtccacagcgagt

SEQ ID NO: 34792 - DNA, 20 bp, Artificial Sequence
  sgRNA
  Npy2r_13
catttggtgccctatgccca

SEQ ID NO: 34793 - DNA, 20 bp, Artificial Sequence
  sgRNA
  Npy2r_14
actgctccatcatcttgcta

SEQ ID NO: 34794 - DNA, 20 bp, Artificial Sequence
  sgRNA
  Npy2r_15
tcgttgcattgtctaccacc

SEQ ID NO: 34795 - DNA, 20 bp, Artificial Sequence
  sgRNA
  Npy2r_16
agacagcaccaaactggtcg

SEQ ID NO: 34796 - DNA, 20 bp, Artificial Sequence
  sgRNA
  Npy2r_17
attcatccaaccatagagaa

SEQ ID NO: 34797 - DNA, 20 bp, Artificial Sequence
  sgRNA
  Npy2r_18
catccaacctctgctcacag

SEQ ID NO: 34798 - DNA, 20 bp, Artificial Sequence
  sgRNA
  Npy2r_19
gaggttggatgccattcact

SEQ ID NO: 34799 - DNA, 20 bp, Artificial Sequence
  sgRNA
  Npy2r_20
gagaaagatatgatgcccag

SEQ ID NO: 34800 - DNA, 20 bp, Artificial Sequence
  sgRNA
  Npy4r_1
agatgcgtatgtagcagacc

SEQ ID NO: 34801 - DNA, 20 bp, Artificial Sequence
  sgRNA
  Npy4r_2
tgaaagttaacatcttgcaa

SEQ ID NO: 34802 - DNA, 20 bp, Artificial Sequence
  sgRNA
  Npy4r_3
gatgaccacaatccccaggt

SEQ ID NO: 34803 - DNA, 20 bp, Artificial Sequence
  sgRNA
  Npy4r_4
tggtcacaaatatcaagcag

SEQ ID NO: 34804 - DNA, 20 bp, Artificial Sequence
  sgRNA
  Npy4r_5
gttcacacggacctatccaa

SEQ ID NO: 34805 - DNA, 20 bp, Artificial Sequence
  sgRNA
  Npy4r_6
gcacgcttgcagctcacgag

SEQ ID NO: 34806 - DNA, 20 bp, Artificial Sequence
  sgRNA
  Npy4r_7
agagtgttgaacacatgcag

SEQ ID NO: 34807 - DNA, 20 bp, Artificial Sequence
  sgRNA
  Npy4r_8
ggataggtccgtgtgaacag

SEQ ID NO: 34808 - DNA, 20 bp, Artificial Sequence
  sgRNA
  Npy4r_9
gccatcagagaaattatagg

SEQ ID NO: 34809 - DNA, 20 bp, Artificial Sequence
  sgRNA
  Npy4r_10
ggtggcacatcaagaagatg

SEQ ID NO: 34810 - DNA, 20 bp, Artificial Sequence
  sgRNA
  Npy4r_11
agactgtcactgacatacac

SEQ ID NO: 34811 - DNA, 20 bp, Artificial Sequence
  sgRNA
  Npy4r_12
tccgtgtgaacagtggacag

SEQ ID NO: 34812 - DNA, 20 bp, Artificial Sequence
  sgRNA
  Npy4r_13
gggccacaaggaccagtgag

SEQ ID NO: 34813 - DNA, 20 bp, Artificial Sequence
  sgRNA
  Npy4r_14
aatgagctggtgcctctcca

SEQ ID NO: 34814 - DNA, 20 bp, Artificial Sequence
  sgRNA
  Npy4r_15
gaaactctacaaccttagag

SEQ ID NO: 34815 - DNA, 20 bp, Artificial Sequence
  sgRNA
  Npy4r_16
gcatctaccagcgcctgcag

SEQ ID NO: 34816 - DNA, 20 bp, Artificial Sequence
  sgRNA
  Npy4r_17
gatgtgccacctgttggcca

SEQ ID NO: 34817 - DNA, 20 bp, Artificial Sequence
  sgRNA
  Npy4r_18
gcatgtgttcaacactctgg

SEQ ID NO: 34818 - DNA, 20 bp, Artificial Sequence
  sgRNA
  Npy4r_19
tggaagccatggccaacagg

SEQ ID NO: 34819 - DNA, 20 bp, Artificial Sequence
  sgRNA
  Npy4r_20
tcaagaagatgaggttgcca

SEQ ID NO: 34820 - DNA, 20 bp, Artificial Sequence
  sgRNA
  Npy5r_1
cttactgttaaacatactag

SEQ ID NO: 34821 - DNA, 20 bp, Artificial Sequence
  sgRNA
  Npy5r_2
ccactgatccaacaagacag

SEQ ID NO: 34822 - DNA, 20 bp, Artificial Sequence
  sgRNA
  Npy5r_3
agtatttgtgtgttgagtca

SEQ ID NO: 34823 - DNA, 20 bp, Artificial Sequence
  sgRNA
  Npy5r_4
caaatgtatagagcccaatc

SEQ ID NO: 34824 - DNA, 20 bp, Artificial Sequence
  sgRNA
  Npy5r_5
cattgaaatcggtcaccacg

SEQ ID NO: 34825 - DNA, 20 bp, Artificial Sequence
  sgRNA
  Npy5r_6
gccactccacgtcttccacg

SEQ ID NO: 34826 - DNA, 20 bp, Artificial Sequence
  sgRNA
  Npy5r_7
cctggaataaccttactgga

SEQ ID NO: 34827 - DNA, 20 bp, Artificial Sequence
  sgRNA
  Npy5r_8
gcaattctgtatgaatcaga

SEQ ID NO: 34828 - DNA, 20 bp, Artificial Sequence
  sgRNA
  Npy5r_9
catccagtaaggttattcca

SEQ ID NO: 34829 - DNA, 20 bp, Artificial Sequence
  sgRNA
  Npy5r_10
tattagtgttcgctgttagc

SEQ ID NO: 34830 - DNA, 20 bp, Artificial Sequence
  sgRNA
  Npy5r_11
gtgtccagacagtagctatc

SEQ ID NO: 34831 - DNA, 20 bp, Artificial Sequence
  sgRNA
  Npy5r_12
agaacaatacttctgctgct

SEQ ID NO: 34832 - DNA, 20 bp, Artificial Sequence
  sgRNA
  Npy5r_13
aacaatttaacagcaaacca

SEQ ID NO: 34833 - DNA, 20 bp, Artificial Sequence
  sgRNA
  Npy5r_14
acatccatccaaaaagagtc

SEQ ID NO: 34834 - DNA, 20 bp, Artificial Sequence
  sgRNA
  Npy5r_15
gctggctacggaccgagcct

SEQ ID NO: 34835 - DNA, 20 bp, Artificial Sequence
  sgRNA
  Npy5r_16
actacagtgaactttctcat

SEQ ID NO: 34836 - DNA, 20 bp, Artificial Sequence
  sgRNA
  Npy5r_17
ttatatggattccttaataa

SEQ ID NO: 34837 - DNA, 20 bp, Artificial Sequence
  sgRNA
  Npy5r_18
atagtcctcccagactggaa

SEQ ID NO: 34838 - DNA, 20 bp, Artificial Sequence
  sgRNA
  Npy5r_19
ttaaggaatccatataagat

SEQ ID NO: 34839 - DNA, 20 bp, Artificial Sequence
  sgRNA
  Npy5r_20
aagaaggtacagcaagaaga

SEQ ID NO: 34840 - DNA, 20 bp, Artificial Sequence
  sgRNA
  Nradd_1
aaggtgtggtctattcaggt

SEQ ID NO: 34841 - DNA, 20 bp, Artificial Sequence
  sgRNA
  Nradd_2
agctcggactgtagagctag

SEQ ID NO: 34842 - DNA, 20 bp, Artificial Sequence
  sgRNA
  Nradd_3
gacaggaatgatgttgctcg

SEQ ID NO: 34843 - DNA, 20 bp, Artificial Sequence
  sgRNA
  Nradd_4
gctggcgctcacataagcaa

SEQ ID NO: 34844 - DNA, 20 bp, Artificial Sequence
  sgRNA
  Nradd_5
ggcagcccagttccttagca

SEQ ID NO: 34845 - DNA, 20 bp, Artificial Sequence
  sgRNA
  Nradd_6
ggcaacagttggctaaagct

SEQ ID NO: 34846 - DNA, 20 bp, Artificial Sequence
  sgRNA
  Nradd_7
atgttgctcgaggcccctgg

SEQ ID NO: 34847 - DNA, 20 bp, Artificial Sequence
  sgRNA
  Nradd_8
aagctcggactgtagagcta

SEQ ID NO: 34848 - DNA, 20 bp, Artificial Sequence
  sgRNA
  Nradd_9
cagcctcagcttggtagccg

SEQ ID NO: 34849 - DNA, 20 bp, Artificial Sequence
  sgRNA
  Nradd_10
ccagttccttagcagggtat

SEQ ID NO: 34850 - DNA, 20 bp, Artificial Sequence
  sgRNA
  Nradd_11
gggaccctgacagggaccag

SEQ ID NO: 34851 - DNA, 20 bp, Artificial Sequence
  sgRNA
  Nradd_12
atgatgggtgagccagccaa

SEQ ID NO: 34852 - DNA, 20 bp, Artificial Sequence
  sgRNA
  Nradd_13
tattccacagcagcagcagg

SEQ ID NO: 34853 - DNA, 20 bp, Artificial Sequence
  sgRNA
  Nradd_14
gaccaaggatcactgtagct

SEQ ID NO: 34854 - DNA, 20 bp, Artificial Sequence
  sgRNA
  Nradd_15
acataagcaaaggcaacagt

SEQ ID NO: 34855 - DNA, 20 bp, Artificial Sequence
  sgRNA
  Nradd_16
tggcatttggtcacaggcca

SEQ ID NO: 34856 - DNA, 20 bp, Artificial Sequence
  sgRNA
  Nradd_17
tggtgacagcaacgtcttcg

SEQ ID NO: 34857 - DNA, 20 bp, Artificial Sequence
  sgRNA
  Nradd_18
agcatcctccagcactctga

SEQ ID NO: 34858 - DNA, 20 bp, Artificial Sequence
  sgRNA
  Nradd_19
gagccctgtattcccagcca

SEQ ID NO: 34859 - DNA, 20 bp, Artificial Sequence
  sgRNA
  Nradd_20
gctaggagagcacagtagac

SEQ ID NO: 34860 - DNA, 20 bp, Artificial Sequence
  sgRNA
  Nrcam_1
ggacgtatacttgtgtcgca

SEQ ID NO: 34861 - DNA, 20 bp, Artificial Sequence
  sgRNA
  Nrcam_2
gccggaggtaatccaatcgg

SEQ ID NO: 34862 - DNA, 20 bp, Artificial Sequence
  sgRNA
  Nrcam_3
cattagtttaccgtaaatgg

SEQ ID NO: 34863 - DNA, 20 bp, Artificial Sequence
  sgRNA
  Nrcam_4
gctgatgtgagaatccgagg

SEQ ID NO: 34864 - DNA, 20 bp, Artificial Sequence
  sgRNA
  Nrcam_5
ctatgccctcaacgtccgag

SEQ ID NO: 34865 - DNA, 20 bp, Artificial Sequence
  sgRNA
  Nrcam_6
ggattacaatattctcccga

SEQ ID NO: 34866 - DNA, 20 bp, Artificial Sequence
  sgRNA
  Nrcam_7
gtgtcgcacggaataaacta

SEQ ID NO: 34867 - DNA, 20 bp, Artificial Sequence
  sgRNA
  Nrcam_8
tgagtatgcagtcgtccaga

SEQ ID NO: 34868 - DNA, 20 bp, Artificial Sequence
  sgRNA
  Nrcam_9
tggaaatgttcgcgtcagcg

SEQ ID NO: 34869 - DNA, 20 bp, Artificial Sequence
  sgRNA
  Nrcam_10
ggtgaacggccaattcaacg

SEQ ID NO: 34870 - DNA, 20 bp, Artificial Sequence
  sgRNA
  Nrcam_11
ccaacgtttctaactccaga

SEQ ID NO: 34871 - DNA, 20 bp, Artificial Sequence
  sgRNA
  Nrcam_12
ggggtcccattccaaagtga

SEQ ID NO: 34872 - DNA, 20 bp, Artificial Sequence
  sgRNA
  Nrcam_13
cagcgccccgactatgtcaa

SEQ ID NO: 34873 - DNA, 20 bp, Artificial Sequence
  sgRNA
  Nrcam_14
tctatgcacagacatcagtg

SEQ ID NO: 34874 - DNA, 20 bp, Artificial Sequence
  sgRNA
  Nrcam_15
gatgtaaaggatgacgatgg

SEQ ID NO: 34875 - DNA, 20 bp, Artificial Sequence
  sgRNA
  Nrcam_16
gttccgataaaatgtccggt

SEQ ID NO: 34876 - DNA, 20 bp, Artificial Sequence
  sgRNA
  Nrcam_17
ggaaacatgagtgatctgca

SEQ ID NO: 34877 - DNA, 20 bp, Artificial Sequence
  sgRNA
  Nrcam_18
agaggcttccatacaccgga

SEQ ID NO: 34878 - DNA, 20 bp, Artificial Sequence
  sgRNA
  Nrcam_19
ggtgaacagtacgctggcag

SEQ ID NO: 34879 - DNA, 20 bp, Artificial Sequence
  sgRNA
  Nrcam_20
gtgccagatgatcagcgcgc

SEQ ID NO: 34880 - DNA, 20 bp, Artificial Sequence
  sgRNA
  Nrg1_1
agtcgtggagtgatgagctg

SEQ ID NO: 34881 - DNA, 20 bp, Artificial Sequence
  sgRNA
  Nrg1_2
ggtggtcggcatcatgtgtg

SEQ ID NO: 34882 - DNA, 20 bp, Artificial Sequence
  sgRNA
  Nrg1_3
gcaaggtgaccatgtcgctg

SEQ ID NO: 34883 - DNA, 20 bp, Artificial Sequence
  sgRNA
  Nrg1_4
cagccatctcataaagtgtg

SEQ ID NO: 34884 - DNA, 20 bp, Artificial Sequence
  sgRNA
  Nrg1_5
tacaggtgacatacgagccg

SEQ ID NO: 34885 - DNA, 20 bp, Artificial Sequence
  sgRNA
  Nrg1_6
aggaagctgttacattcgcg

SEQ ID NO: 34886 - DNA, 20 bp, Artificial Sequence
  sgRNA
  Nrg1_7
catgatgccgaccaccaaca

SEQ ID NO: 34887 - DNA, 20 bp, Artificial Sequence
  sgRNA
  Nrg1_8
cgggtggagacatttccgaa

SEQ ID NO: 34888 - DNA, 20 bp, Artificial Sequence
  sgRNA
  Nrg1_9
ggaagctgttacattcgcga

SEQ ID NO: 34889 - DNA, 20 bp, Artificial Sequence
  sgRNA
  Nrg1_10
gctccctcagacatgtctgg

SEQ ID NO: 34890 - DNA, 20 bp, Artificial Sequence
  sgRNA
  Nrg1_11
agaaagtcaccaatagccgg

SEQ ID NO: 34891 - DNA, 20 bp, Artificial Sequence
  sgRNA
  Nrg1_12
ggtcctggcctaacccccca

SEQ ID NO: 34892 - DNA, 20 bp, Artificial Sequence
  sgRNA
  Nrg1_13
ggatgagaccagaacagcgg

SEQ ID NO: 34893 - DNA, 20 bp, Artificial Sequence
  sgRNA
  Nrg1_14
gttgaaactgatattctaat

SEQ ID NO: 34894 - DNA, 20 bp, Artificial Sequence
  sgRNA
  Nrg1_15
agaaggaccggggatcccgc

SEQ ID NO: 34895 - DNA, 20 bp, Artificial Sequence
  sgRNA
  Nrg1_16
agacagccggttcttccggg

SEQ ID NO: 34896 - DNA, 20 bp, Artificial Sequence
  sgRNA
  Nrg1_17
tctacaggtgacatacgagc

SEQ ID NO: 34897 - DNA, 20 bp, Artificial Sequence
  sgRNA
  Nrg1_18
tatcccccagacatgtctga

SEQ ID NO: 34898 - DNA, 20 bp, Artificial Sequence
  sgRNA
  Nrg1_19
tagtcctgctctcagccaga

SEQ ID NO: 34899 - DNA, 20 bp, Artificial Sequence
  sgRNA
  Nrg1_20
ggtggcgtcacaagaagcag

SEQ ID NO: 34900 - DNA, 20 bp, Artificial Sequence
  sgRNA
  Nrg2_1
tgatgcgaatatcacgactc

SEQ ID NO: 34901 - DNA, 20 bp, Artificial Sequence
  sgRNA
  Nrg2_2
tttgccgttagggtcgaccg

SEQ ID NO: 34902 - DNA, 20 bp, Artificial Sequence
  sgRNA
  Nrg2_3
gactccatgtcaacagcggt

SEQ ID NO: 34903 - DNA, 20 bp, Artificial Sequence
  sgRNA
  Nrg2_4
ctacagaccacgtgatccgg

SEQ ID NO: 34904 - DNA, 20 bp, Artificial Sequence
  sgRNA
  Nrg2_5
aagtcctgctgtcggccgcg

SEQ ID NO: 34905 - DNA, 20 bp, Artificial Sequence
  sgRNA
  Nrg2_6
cgacagctactactaccctg

SEQ ID NO: 34906 - DNA, 20 bp, Artificial Sequence
  sgRNA
  Nrg2_7
tctggcatgtacaatcgcaa

SEQ ID NO: 34907 - DNA, 20 bp, Artificial Sequence
  sgRNA
  Nrg2_8
gttcctttcgagcggcgcac

SEQ ID NO: 34908 - DNA, 20 bp, Artificial Sequence
  sgRNA
  Nrg2_9
gactcgctgtcattgagcag

SEQ ID NO: 34909 - DNA, 20 bp, Artificial Sequence
  sgRNA
  Nrg2_10
tccttgaaccagcgatagga

SEQ ID NO: 34910 - DNA, 20 bp, Artificial Sequence
  sgRNA
  Nrg2_11
ttagagctggaaccgcctgc

SEQ ID NO: 34911 - DNA, 20 bp, Artificial Sequence
  sgRNA
  Nrg2_12
ccagcagcagacacagccgg

SEQ ID NO: 34912 - DNA, 20 bp, Artificial Sequence
  sgRNA
  Nrg2_13
ggcgtgtgctactacatcga

SEQ ID NO: 34913 - DNA, 20 bp, Artificial Sequence
  sgRNA
  Nrg2_14
tttgccccggtcgaccctaa

SEQ ID NO: 34914 - DNA, 20 bp, Artificial Sequence
  sgRNA
  Nrg2_15
gccatccttgaaccagcgat

SEQ ID NO: 34915 - DNA, 20 bp, Artificial Sequence
  sgRNA
  Nrg2_16
gtgaggccgagaacatcctt

SEQ ID NO: 34916 - DNA, 20 bp, Artificial Sequence
  sgRNA
  Nrg2_17
gcgcgagcaggtgatcagcg

SEQ ID NO: 34917 - DNA, 20 bp, Artificial Sequence
  sgRNA
  Nrg2_18
gcccatcagctaccgcctgg

SEQ ID NO: 34918 - DNA, 20 bp, Artificial Sequence
  sgRNA
  Nrg2_19
acgtggtctcagcttccctc

SEQ ID NO: 34919 - DNA, 20 bp, Artificial Sequence
  sgRNA
  Nrg2_20
acgttcagagagcctgacct

SEQ ID NO: 34920 - DNA, 20 bp, Artificial Sequence
  sgRNA
  Nrg4_1
caccggagcacgctgcgaag

SEQ ID NO: 34921 - DNA, 20 bp, Artificial Sequence
  sgRNA
  Nrg4_2
cctcctcactcttaccatcg

SEQ ID NO: 34922 - DNA, 20 bp, Artificial Sequence
  sgRNA
  Nrg4_3
aggcaaaatgacctgtgcct

SEQ ID NO: 34923 - DNA, 20 bp, Artificial Sequence
  sgRNA
  Nrg4_4
cccaagcgaaagtaatctgt

SEQ ID NO: 34924 - DNA, 20 bp, Artificial Sequence
  sgRNA
  Nrg4_5
ctaccaggctgatctcacac

SEQ ID NO: 34925 - DNA, 20 bp, Artificial Sequence
  sgRNA
  Nrg4_6
gcgccgcgatggtaagagtg

SEQ ID NO: 34926 - DNA, 20 bp, Artificial Sequence
  sgRNA
  Nrg4_7
attgcacgaatggtttaagt

SEQ ID NO: 34927 - DNA, 20 bp, Artificial Sequence
  sgRNA
  Nrg4_8
cagaaacactgggtacacca

SEQ ID NO: 34928 - DNA, 20 bp, Artificial Sequence
  sgRNA
  Nrg4_9
ccgacagattactttcgctt

SEQ ID NO: 34929 - DNA, 20 bp, Artificial Sequence
  sgRNA
  Nrg4_10
aggtgcattgaaaattacac

SEQ ID NO: 34930 - DNA, 20 bp, Artificial Sequence
  sgRNA
  Nrg4_11
ctatccccagcccattctgt

SEQ ID NO: 34931 - DNA, 20 bp, Artificial Sequence
  sgRNA
  Nrg4_12
gccgacagattactttcgct

SEQ ID NO: 34932 - DNA, 20 bp, Artificial Sequence
  sgRNA
  Nrg4_13
gacctgtgcctgggaccaca

SEQ ID NO: 34933 - DNA, 20 bp, Artificial Sequence
  sgRNA
  Nrg4_14
attcgtgcaattgggcacct

SEQ ID NO: 34934 - DNA, 20 bp, Artificial Sequence
  sgRNA
  Nrg4_15
agtccagtgtgagatcagcc

SEQ ID NO: 34935 - DNA, 20 bp, Artificial Sequence
  sgRNA
  Nrg4_16
caggaagcagagcgccgcga

SEQ ID NO: 34936 - DNA, 20 bp, Artificial Sequence
  sgRNA
  Nrg4_17
aaggtgcccaattgcacgaa

SEQ ID NO: 34937 - DNA, 20 bp, Artificial Sequence
  sgRNA
  Nrg4_18
aacacactgcatgagaactt

SEQ ID NO: 34938 - DNA, 20 bp, Artificial Sequence
  sgRNA
  Nrg4_19
tggtattgtttgtctctacc

SEQ ID NO: 34939 - DNA, 20 bp, Artificial Sequence
  sgRNA
  Nrg4_20
ggtgtacccagtgtttctga

SEQ ID NO: 34940 - DNA, 20 bp, Artificial Sequence
  sgRNA
  Nrn1_1
acttacctatttgcaccgcg

SEQ ID NO: 34941 - DNA, 20 bp, Artificial Sequence
  sgRNA
  Nrn1_2
ggaaggggcgaaagatatgt

SEQ ID NO: 34942 - DNA, 20 bp, Artificial Sequence
  sgRNA
  Nrn1_3
ggaggatttccacagctgca

SEQ ID NO: 34943 - DNA, 20 bp, Artificial Sequence
  sgRNA
  Nrn1_4
agcatggccaactacccgca

SEQ ID NO: 34944 - DNA, 20 bp, Artificial Sequence
  sgRNA
  Nrn1_5
ttgcaccgcgagacgtgaca

SEQ ID NO: 34945 - DNA, 20 bp, Artificial Sequence
  sgRNA
  Nrn1_6
gctcaagctgggcgacagca

SEQ ID NO: 34946 - DNA, 20 bp, Artificial Sequence
  sgRNA
  Nrn1_7
ggcagcttattcgaactctg

SEQ ID NO: 34947 - DNA, 20 bp, Artificial Sequence
  sgRNA
  Nrn1_8
atatatttcactgatcctcg

SEQ ID NO: 34948 - DNA, 20 bp, Artificial Sequence
  sgRNA
  Nrn1_9
ggaagtgttgagagacaagg

SEQ ID NO: 34949 - DNA, 20 bp, Artificial Sequence
  sgRNA
  Nrn1_10
tcagactgtttgctcaagct

SEQ ID NO: 34950 - DNA, 20 bp, Artificial Sequence
  sgRNA
  Nrn1_11
tcttacggattgccaggaag

SEQ ID NO: 34951 - DNA, 20 bp, Artificial Sequence
  sgRNA
  Nrn1_12
actctgcggcagcagcaacg

SEQ ID NO: 34952 - DNA, 20 bp, Artificial Sequence
  sgRNA
  Nrn1_13
accaggagcacggaaagcgc

SEQ ID NO: 34953 - DNA, 20 bp, Artificial Sequence
  sgRNA
  Nrn1_14
ggtgcaggccgtgagagcag

SEQ ID NO: 34954 - DNA, 20 bp, Artificial Sequence
  sgRNA
  Nrn1_15
gaagtgttgagagacaagga

SEQ ID NO: 34955 - DNA, 20 bp, Artificial Sequence
  sgRNA
  Nrn1_16
ccaggagcacggaaagcgcc

SEQ ID NO: 34956 - DNA, 20 bp, Artificial Sequence
  sgRNA
  Nrn1_17
cagcatggccaactacccgc

SEQ ID NO: 34957 - DNA, 20 bp, Artificial Sequence
  sgRNA
  Nrn1_18
aaaaaccctgtcacgtctcg

SEQ ID NO: 34958 - DNA, 20 bp, Artificial Sequence
  sgRNA
  Nrn1_19
gtcttgtcgtccaggccctg

SEQ ID NO: 34959 - DNA, 20 bp, Artificial Sequence
  sgRNA
  Nrn1_20
gctcttacggattgccagga

SEQ ID NO: 34960 - DNA, 20 bp, Artificial Sequence
  sgRNA
  Nrn1l_1
cttggtatatggtatcacag

SEQ ID NO: 34961 - DNA, 20 bp, Artificial Sequence
  sgRNA
  Nrn1l_2
agaggatgtgcaaattatct

SEQ ID NO: 34962 - DNA, 20 bp, Artificial Sequence
  sgRNA
  Nrn1l_3
cacagggtagccgctgacag

SEQ ID NO: 34963 - DNA, 20 bp, Artificial Sequence
  sgRNA
  Nrn1l_4
ctgttgctgctactaccact

SEQ ID NO: 34964 - DNA, 20 bp, Artificial Sequence
  sgRNA
  Nrn1l_5
tgaatgtctcatccgcctgg

SEQ ID NO: 34965 - DNA, 20 bp, Artificial Sequence
  sgRNA
  Nrn1l_6
gctgaatgtctcatccgcct

SEQ ID NO: 34966 - DNA, 20 bp, Artificial Sequence
  sgRNA
  Nrn1l_7
gcagcctgacaggacccgag

SEQ ID NO: 34967 - DNA, 20 bp, Artificial Sequence
  sgRNA
  Nrn1l_8
agcggcggcgagcaacacag

SEQ ID NO: 34968 - DNA, 20 bp, Artificial Sequence
  sgRNA
  Nrn1l_9
tagtagcagcaacagcgtca

SEQ ID NO: 34969 - DNA, 20 bp, Artificial Sequence
  sgRNA
  Nrn1l_10
gcaggcaagcgctagagcgg

SEQ ID NO: 34970 - DNA, 20 bp, Artificial Sequence
  sgRNA
  Nrn1l_11
ggtcctgtcaggctgcccag

SEQ ID NO: 34971 - DNA, 20 bp, Artificial Sequence
  sgRNA
  Nrn1l_12
gataatttgcacatcctctg

SEQ ID NO: 34972 - DNA, 20 bp, Artificial Sequence
  sgRNA
  Nrn1l_13
gacccatgccatcccccagg

SEQ ID NO: 34973 - DNA, 20 bp, Artificial Sequence
  sgRNA
  Nrn1l_14
cgctgtgataccatatacca

SEQ ID NO: 34974 - DNA, 20 bp, Artificial Sequence
  sgRNA
  Nrn1l_15
cactcacaggagcgccacag

SEQ ID NO: 34975 - DNA, 20 bp, Artificial Sequence
  sgRNA
  Nrn1l_16
ctcgacccatgccatccccc

SEQ ID NO: 34976 - DNA, 20 bp, Artificial Sequence
  sgRNA
  Nrn1l_17
tgagacattcagcaaagcct

SEQ ID NO: 34977 - DNA, 20 bp, Artificial Sequence
  sgRNA
  Nrn1l_18
ctcctgtgagtgttcgggag

SEQ ID NO: 34978 - DNA, 20 bp, Artificial Sequence
  sgRNA
  Nrn1l_19
tgctgaatgtctcatccgcc

SEQ ID NO: 34979 - DNA, 20 bp, Artificial Sequence
  sgRNA
  Nrn1l_20
ggacccgagaggcacaggcg

SEQ ID NO: 34980 - DNA, 20 bp, Artificial Sequence
  sgRNA
  Nrp1_1
ctctgactatgagacacatg

SEQ ID NO: 34981 - DNA, 20 bp, Artificial Sequence
  sgRNA
  Nrp1_2
caagactcgaatcctcccgg

SEQ ID NO: 34982 - DNA, 20 bp, Artificial Sequence
  sgRNA
  Nrp1_3
tgaactaccctgaaaatggg

SEQ ID NO: 34983 - DNA, 20 bp, Artificial Sequence
  sgRNA
  Nrp1_4
tgtcctccaaatcgaaatgt

SEQ ID NO: 34984 - DNA, 20 bp, Artificial Sequence
  sgRNA
  Nrp1_5
gatgccagaaaacatccgtc

SEQ ID NO: 34985 - DNA, 20 bp, Artificial Sequence
  sgRNA
  Nrp1_6
ggagcgctctacagaccagt

SEQ ID NO: 34986 - DNA, 20 bp, Artificial Sequence
  sgRNA
  Nrp1_7
gtagatcctgatgaaccttg

SEQ ID NO: 34987 - DNA, 20 bp, Artificial Sequence
  sgRNA
  Nrp1_8
cggtacgactggtcaccaga

SEQ ID NO: 34988 - DNA, 20 bp, Artificial Sequence
  sgRNA
  Nrp1_9
gccggacatgtgataccaga

SEQ ID NO: 34989 - DNA, 20 bp, Artificial Sequence
  sgRNA
  Nrp1_10
ctacgtggaagtaatcgatg

SEQ ID NO: 34990 - DNA, 20 bp, Artificial Sequence
  sgRNA
  Nrp1_11
cagcatccaatcaagccgac

SEQ ID NO: 34991 - DNA, 20 bp, Artificial Sequence
  sgRNA
  Nrp1_12
atagcgacagaacattcctc

SEQ ID NO: 34992 - DNA, 20 bp, Artificial Sequence
  sgRNA
  Nrp1_13
gcgagcgtggcgcacagcaa

SEQ ID NO: 34993 - DNA, 20 bp, Artificial Sequence
  sgRNA
  Nrp1_14
tgacatcccattgtgccaac

SEQ ID NO: 34994 - DNA, 20 bp, Artificial Sequence
  sgRNA
  Nrp1_15
actatgacacacctgagctt

SEQ ID NO: 34995 - DNA, 20 bp, Artificial Sequence
  sgRNA
  Nrp1_16
cgtctggtgaccagtcgtac

SEQ ID NO: 34996 - DNA, 20 bp, Artificial Sequence
  sgRNA
  Nrp1_17
gataccagaaggtcatacag

SEQ ID NO: 34997 - DNA, 20 bp, Artificial Sequence
  sgRNA
  Nrp1_18
cgacagaacattcctccggg

SEQ ID NO: 34998 - DNA, 20 bp, Artificial Sequence
  sgRNA
  Nrp1_19
tgcgattcgttactgctgta

SEQ ID NO: 34999 - DNA, 20 bp, Artificial Sequence
  sgRNA
  Nrp1_20
cgtcgtcacactcatccact

SEQ ID NO: 35000 - DNA, 20 bp, Artificial Sequence
  sgRNA
  Nrp2_1
agcgaacaatgatgcgaccg

SEQ ID NO: 35001 - DNA, 20 bp, Artificial Sequence
  sgRNA
  Nrp2_2
ggtgaacttgatgtataaca

SEQ ID NO: 35002 - DNA, 20 bp, Artificial Sequence
  sgRNA
  Nrp2_3
ccaaactccgctcgtccacg

SEQ ID NO: 35003 - DNA, 20 bp, Artificial Sequence
  sgRNA
  Nrp2_4
cagagcggctactaaccagg

SEQ ID NO: 35004 - DNA, 20 bp, Artificial Sequence
  sgRNA
  Nrp2_5
ggtcaaggagaggatccccg

SEQ ID NO: 35005 - DNA, 20 bp, Artificial Sequence
  sgRNA
  Nrp2_6
gaattcagccgacctccgca

SEQ ID NO: 35006 - DNA, 20 bp, Artificial Sequence
  sgRNA
  Nrp2_7
ctactggtattacgttatgg

SEQ ID NO: 35007 - DNA, 20 bp, Artificial Sequence
  sgRNA
  Nrp2_8
agaactttacaagccccaat

SEQ ID NO: 35008 - DNA, 20 bp, Artificial Sequence
  sgRNA
  Nrp2_9
ccaaatgccacgtctgcggg

SEQ ID NO: 35009 - DNA, 20 bp, Artificial Sequence
  sgRNA
  Nrp2_10
gtattacgttatggcggccg

SEQ ID NO: 35010 - DNA, 20 bp, Artificial Sequence
  sgRNA
  Nrp2_11
actcctttgggtcatccgtg

SEQ ID NO: 35011 - DNA, 20 bp, Artificial Sequence
  sgRNA
  Nrp2_12
ctaccaccggttccgctatg

SEQ ID NO: 35012 - DNA, 20 bp, Artificial Sequence
  sgRNA
  Nrp2_13
gggtgtacgaccatgccaag

SEQ ID NO: 35013 - DNA, 20 bp, Artificial Sequence
  sgRNA
  Nrp2_14
ccacctgcagtgccaccccg

SEQ ID NO: 35014 - DNA, 20 bp, Artificial Sequence
  sgRNA
  Nrp2_15
ggagttccagtaccaagcca

SEQ ID NO: 35015 - DNA, 20 bp, Artificial Sequence
  sgRNA
  Nrp2_16
agttcacctcagactacgcc

SEQ ID NO: 35016 - DNA, 20 bp, Artificial Sequence
  sgRNA
  Nrp2_17
cgccataacgtaataccagt

SEQ ID NO: 35017 - DNA, 20 bp, Artificial Sequence
  sgRNA
  Nrp2_18
acgttactatttgatccacc

SEQ ID NO: 35018 - DNA, 20 bp, Artificial Sequence
  sgRNA
  Nrp2_19
gtggatcaaatagtaacgtg

SEQ ID NO: 35019 - DNA, 20 bp, Artificial Sequence
  sgRNA
  Nrp2_20
gcttatccgaatgtcatcga

SEQ ID NO: 35020 - DNA, 20 bp, Artificial Sequence
  sgRNA
  Nrros_1
actccttgtagttctccgag

SEQ ID NO: 35021 - DNA, 20 bp, Artificial Sequence
  sgRNA
  Nrros_2
gcggaggtcgagagtccgaa

SEQ ID NO: 35022 - DNA, 20 bp, Artificial Sequence
  sgRNA
  Nrros_3
aactcaggttgaacacccgg

SEQ ID NO: 35023 - DNA, 20 bp, Artificial Sequence
  sgRNA
  Nrros_4
agacctgtctagcaactggg

SEQ ID NO: 35024 - DNA, 20 bp, Artificial Sequence
  sgRNA
  Nrros_5
gcagtgagtatttcttgcgt

SEQ ID NO: 35025 - DNA, 20 bp, Artificial Sequence
  sgRNA
  Nrros_6
gcattgtcgaaaaggccagt

SEQ ID NO: 35026 - DNA, 20 bp, Artificial Sequence
  sgRNA
  Nrros_7
acttcagcctcacccagtta

SEQ ID NO: 35027 - DNA, 20 bp, Artificial Sequence
  sgRNA
  Nrros_8
gagttccaaccagctcctgg

SEQ ID NO: 35028 - DNA, 20 bp, Artificial Sequence
  sgRNA
  Nrros_9
agtcttgaagtgctgctgca

SEQ ID NO: 35029 - DNA, 20 bp, Artificial Sequence
  sgRNA
  Nrros_10
agctcggtgagtgctcccgg

SEQ ID NO: 35030 - DNA, 20 bp, Artificial Sequence
  sgRNA
  Nrros_11
ctgctccaggacaacaacat

SEQ ID NO: 35031 - DNA, 20 bp, Artificial Sequence
  sgRNA
  Nrros_12
tcagttataacatcctagag

SEQ ID NO: 35032 - DNA, 20 bp, Artificial Sequence
  sgRNA
  Nrros_13
ttcccactcttgcctcagtg

SEQ ID NO: 35033 - DNA, 20 bp, Artificial Sequence
  sgRNA
  Nrros_14
gaacacccggaggttcctga

SEQ ID NO: 35034 - DNA, 20 bp, Artificial Sequence
  sgRNA
  Nrros_15
gatctcactttgtcctcaga

SEQ ID NO: 35035 - DNA, 20 bp, Artificial Sequence
  sgRNA
  Nrros_16
agagtcgtcgagcctcatga

SEQ ID NO: 35036 - DNA, 20 bp, Artificial Sequence
  sgRNA
  Nrros_17
gacgttgaggaaccgtaact

SEQ ID NO: 35037 - DNA, 20 bp, Artificial Sequence
  sgRNA
  Nrros_18
ttacaacacctcctccccgc

SEQ ID NO: 35038 - DNA, 20 bp, Artificial Sequence
  sgRNA
  Nrros_19
ggatctgagccacaaccagt

SEQ ID NO: 35039 - DNA, 20 bp, Artificial Sequence
  sgRNA
  Nrros_20
ctcttccaagatcgtccgtg

SEQ ID NO: 35040 - DNA, 20 bp, Artificial Sequence
  sgRNA
  Nrxn1_1
gctctacatcgaccgcgccg

SEQ ID NO: 35041 - DNA, 20 bp, Artificial Sequence
  sgRNA
  Nrxn1_2
gtattcagatcccttgaacg

SEQ ID NO: 35042 - DNA, 20 bp, Artificial Sequence
  sgRNA
  Nrxn1_3
tgaatggcacacagtgcgtg

SEQ ID NO: 35043 - DNA, 20 bp, Artificial Sequence
  sgRNA
  Nrxn1_4
gacgacgagcctcccaacag

SEQ ID NO: 35044 - DNA, 20 bp, Artificial Sequence
  sgRNA
  Nrxn1_5
ctcgagctcatcctgacgcg

SEQ ID NO: 35045 - DNA, 20 bp, Artificial Sequence
  sgRNA
  Nrxn1_6
ggcgcggtcgatgtagagcg

SEQ ID NO: 35046 - DNA, 20 bp, Artificial Sequence
  sgRNA
  Nrxn1_7
ggatgaagggtcgtaccacg

SEQ ID NO: 35047 - DNA, 20 bp, Artificial Sequence
  sgRNA
  Nrxn1_8
ccagctgtccacctgtaacg

SEQ ID NO: 35048 - DNA, 20 bp, Artificial Sequence
  sgRNA
  Nrxn1_9
acagtgcgtgtggttcggcg

SEQ ID NO: 35049 - DNA, 20 bp, Artificial Sequence
  sgRNA
  Nrxn1_10
gccgacacgccggtcaacga

SEQ ID NO: 35050 - DNA, 20 bp, Artificial Sequence
  sgRNA
  Nrxn1_11
tgcatctagctccaatcgaa

SEQ ID NO: 35051 - DNA, 20 bp, Artificial Sequence
  sgRNA
  Nrxn1_12
cgtcgtcgaagtagagcacg

SEQ ID NO: 35052 - DNA, 20 bp, Artificial Sequence
  sgRNA
  Nrxn1_13
ggaggtcaagtccaagcgca

SEQ ID NO: 35053 - DNA, 20 bp, Artificial Sequence
  sgRNA
  Nrxn1_14
catggcttgttgatcatcca

SEQ ID NO: 35054 - DNA, 20 bp, Artificial Sequence
  sgRNA
  Nrxn1_15
gtagtacgtttcacaaggag

SEQ ID NO: 35055 - DNA, 20 bp, Artificial Sequence
  sgRNA
  Nrxn1_16
ggtgacctgtagattgcaat

SEQ ID NO: 35056 - DNA, 20 bp, Artificial Sequence
  sgRNA
  Nrxn1_17
atagtcccgctcaccctcag

SEQ ID NO: 35057 - DNA, 20 bp, Artificial Sequence
  sgRNA
  Nrxn1_18
cgtgctctacttcgacgacg

SEQ ID NO: 35058 - DNA, 20 bp, Artificial Sequence
  sgRNA
  Nrxn1_19
gcctcagtgtgcatcaccac

SEQ ID NO: 35059 - DNA, 20 bp, Artificial Sequence
  sgRNA
  Nrxn1_20
gtaactcagcacagtccaat

SEQ ID NO: 35060 - DNA, 20 bp, Artificial Sequence
  sgRNA
  Nrxn2_1
gagtgcagataggcgcacgt

SEQ ID NO: 35061 - DNA, 20 bp, Artificial Sequence
  sgRNA
  Nrxn2_2
caatgaatggcacacggtga

SEQ ID NO: 35062 - DNA, 20 bp, Artificial Sequence
  sgRNA
  Nrxn2_3
gcagtcacagttctacccag

SEQ ID NO: 35063 - DNA, 20 bp, Artificial Sequence
  sgRNA
  Nrxn2_4
ggaagcataggcttgcagcg

SEQ ID NO: 35064 - DNA, 20 bp, Artificial Sequence
  sgRNA
  Nrxn2_5
tgttgctgacccgcgacgcg

SEQ ID NO: 35065 - DNA, 20 bp, Artificial Sequence
  sgRNA
  Nrxn2_6
gccaccaccactactcgccg

SEQ ID NO: 35066 - DNA, 20 bp, Artificial Sequence
  sgRNA
  Nrxn2_7
gagacctcttcatcgatgga

SEQ ID NO: 35067 - DNA, 20 bp, Artificial Sequence
  sgRNA
  Nrxn2_8
gcatctcgcgccgctttgag

SEQ ID NO: 35068 - DNA, 20 bp, Artificial Sequence
  sgRNA
  Nrxn2_9
acagctggccagtcaacgag

SEQ ID NO: 35069 - DNA, 20 bp, Artificial Sequence
  sgRNA
  Nrxn2_10
gagcgacggcaaatatcacg

SEQ ID NO: 35070 - DNA, 20 bp, Artificial Sequence
  sgRNA
  Nrxn2_11
agggcgcaaatagcaccccg

SEQ ID NO: 35071 - DNA, 20 bp, Artificial Sequence
  sgRNA
  Nrxn2_12
acagtcacgcagcattccaa

SEQ ID NO: 35072 - DNA, 20 bp, Artificial Sequence
  sgRNA
  Nrxn2_13
tcagaaccactgagcccaat

SEQ ID NO: 35073 - DNA, 20 bp, Artificial Sequence
  sgRNA
  Nrxn2_14
gcgcgacgacagcgactgcg

SEQ ID NO: 35074 - DNA, 20 bp, Artificial Sequence
  sgRNA
  Nrxn2_15
gccattgacgggttccacga

SEQ ID NO: 35075 - DNA, 20 bp, Artificial Sequence
  sgRNA
  Nrxn2_16
atatttgccgtcgctcacga

SEQ ID NO: 35076 - DNA, 20 bp, Artificial Sequence
  sgRNA
  Nrxn2_17
cttgcagcgtggctaacgcc

SEQ ID NO: 35077 - DNA, 20 bp, Artificial Sequence
  sgRNA
  Nrxn2_18
gccgtcatagcttaagaccg

SEQ ID NO: 35078 - DNA, 20 bp, Artificial Sequence
  sgRNA
  Nrxn2_19
ggagtcaaagacctccccgg

SEQ ID NO: 35079 - DNA, 20 bp, Artificial Sequence
  sgRNA
  Nrxn2_20
gggcgcaaatagcaccccgg

SEQ ID NO: 35080 - DNA, 20 bp, Artificial Sequence
  sgRNA
  Nrxn3_1
gatgacctgagtgactacct

SEQ ID NO: 35081 - DNA, 20 bp, Artificial Sequence
  sgRNA
  Nrxn3_2
cacaacgggctacactcaag

SEQ ID NO: 35082 - DNA, 20 bp, Artificial Sequence
  sgRNA
  Nrxn3_3
accgtccgggtagtgcggag

SEQ ID NO: 35083 - DNA, 20 bp, Artificial Sequence
  sgRNA
  Nrxn3_4
agtatggcaactcggaacct

SEQ ID NO: 35084 - DNA, 20 bp, Artificial Sequence
  sgRNA
  Nrxn3_5
catcacgctgaatatccacg

SEQ ID NO: 35085 - DNA, 20 bp, Artificial Sequence
  sgRNA
  Nrxn3_6
gtaagcctgtagggtggcga

SEQ ID NO: 35086 - DNA, 20 bp, Artificial Sequence
  sgRNA
  Nrxn3_7
tcacagggacgctcgccaca

SEQ ID NO: 35087 - DNA, 20 bp, Artificial Sequence
  sgRNA
  Nrxn3_8
gcctgattctcttcactcac

SEQ ID NO: 35088 - DNA, 20 bp, Artificial Sequence
  sgRNA
  Nrxn3_9
agatggccaatgaaactgga

SEQ ID NO: 35089 - DNA, 20 bp, Artificial Sequence
  sgRNA
  Nrxn3_10
actggtagccacaacctcca

SEQ ID NO: 35090 - DNA, 20 bp, Artificial Sequence
  sgRNA
  Nrxn3_11
ttaagacctggcaacgcaat

SEQ ID NO: 35091 - DNA, 20 bp, Artificial Sequence
  sgRNA
  Nrxn3_12
tgacaaccagtggcacaacg

SEQ ID NO: 35092 - DNA, 20 bp, Artificial Sequence
  sgRNA
  Nrxn3_13
aggtgggatgaccatccaag

SEQ ID NO: 35093 - DNA, 20 bp, Artificial Sequence
  sgRNA
  Nrxn3_14
tgataatgaacgcctccaaa

SEQ ID NO: 35094 - DNA, 20 bp, Artificial Sequence
  sgRNA
  Nrxn3_15
tgtgaagcggatcagctcag

SEQ ID NO: 35095 - DNA, 20 bp, Artificial Sequence
  sgRNA
  Nrxn3_16
acatccatataaggccgctg

SEQ ID NO: 35096 - DNA, 20 bp, Artificial Sequence
  sgRNA
  Nrxn3_17
cagcaggaacaccatttcca

SEQ ID NO: 35097 - DNA, 20 bp, Artificial Sequence
  sgRNA
  Nrxn3_18
catgctctgtactccatcga

SEQ ID NO: 35098 - DNA, 20 bp, Artificial Sequence
  sgRNA
  Nrxn3_19
ggatggcatcctaaccacaa

SEQ ID NO: 35099 - DNA, 20 bp, Artificial Sequence
  sgRNA
  Nrxn3_20
gggctaagccagccatatag

SEQ ID NO: 35100 - DNA, 20 bp, Artificial Sequence
  sgRNA
  Nt5e_1
tcatgaatttgataacggtg

SEQ ID NO: 35101 - DNA, 20 bp, Artificial Sequence
  sgRNA
  Nt5e_2
tgaataagatcatcgccctg

SEQ ID NO: 35102 - DNA, 20 bp, Artificial Sequence
  sgRNA
  Nt5e_3
tatgcctttggcaaatacct

SEQ ID NO: 35103 - DNA, 20 bp, Artificial Sequence
  sgRNA
  Nt5e_4
cctgaagcggcacgtctgag

SEQ ID NO: 35104 - DNA, 20 bp, Artificial Sequence
  sgRNA
  Nt5e_5
tctgcagcaagtcattacca

SEQ ID NO: 35105 - DNA, 20 bp, Artificial Sequence
  sgRNA
  Nt5e_6
tagtcaccgcagatgatgga

SEQ ID NO: 35106 - DNA, 20 bp, Artificial Sequence
  sgRNA
  Nt5e_7
gcgcaaacattaaggcacgg

SEQ ID NO: 35107 - DNA, 20 bp, Artificial Sequence
  sgRNA
  Nt5e_8
tggtgcagagaacttctaat

SEQ ID NO: 35108 - DNA, 20 bp, Artificial Sequence
  sgRNA
  Nt5e_9
cggccgctaaggtacccaag

SEQ ID NO: 35109 - DNA, 20 bp, Artificial Sequence
  sgRNA
  Nt5e_10
ttacaatgcacatggacacg

SEQ ID NO: 35110 - DNA, 20 bp, Artificial Sequence
  sgRNA
  Nt5e_11
ttgacctcgtccaattaaaa

SEQ ID NO: 35111 - DNA, 20 bp, Artificial Sequence
  sgRNA
  Nt5e_12
ctcaaaaccagagtgcccca

SEQ ID NO: 35112 - DNA, 20 bp, Artificial Sequence
  sgRNA
  Nt5e_13
tcgaggtgtggacatcgtgg

SEQ ID NO: 35113 - DNA, 20 bp, Artificial Sequence
  sgRNA
  Nt5e_14
gcacgttgggttcttccttg

SEQ ID NO: 35114 - DNA, 20 bp, Artificial Sequence
  sgRNA
  Nt5e_15
ggttaatatcgtacaccaca

SEQ ID NO: 35115 - DNA, 20 bp, Artificial Sequence
  sgRNA
  Nt5e_16
aattggaccactctgttcca

SEQ ID NO: 35116 - DNA, 20 bp, Artificial Sequence
  sgRNA
  Nt5e_17
tttacccagccgttgaaggg

SEQ ID NO: 35117 - DNA, 20 bp, Artificial Sequence
  sgRNA
  Nt5e_18
gatgccggagaccagtacca

SEQ ID NO: 35118 - DNA, 20 bp, Artificial Sequence
  sgRNA
  Nt5e_19
gtagcccaggtatttgccaa

SEQ ID NO: 35119 - DNA, 20 bp, Artificial Sequence
  sgRNA
  Nt5e_20
gctgcaccttggtaaagagc

SEQ ID NO: 35120 - DNA, 20 bp, Artificial Sequence
  sgRNA
  Ntm_1
tctcgtgggcaatcttcacg

SEQ ID NO: 35121 - DNA, 20 bp, Artificial Sequence
  sgRNA
  Ntm_2
acaggagtgccggtgcgtag

SEQ ID NO: 35122 - DNA, 20 bp, Artificial Sequence
  sgRNA
  Ntm_3
cagcgcctccaacgacgtgg

SEQ ID NO: 35123 - DNA, 20 bp, Artificial Sequence
  sgRNA
  Ntm_4
acaacgtgacggtcaggcag

SEQ ID NO: 35124 - DNA, 20 bp, Artificial Sequence
  sgRNA
  Ntm_5
caaccaccctaagacctcca

SEQ ID NO: 35125 - DNA, 20 bp, Artificial Sequence
  sgRNA
  Ntm_6
gatgagtacctggagatcca

SEQ ID NO: 35126 - DNA, 20 bp, Artificial Sequence
  sgRNA
  Ntm_7
gagtccccttctgccccacg

SEQ ID NO: 35127 - DNA, 20 bp, Artificial Sequence
  sgRNA
  Ntm_8
gctgtcagtgaggtcaacaa

SEQ ID NO: 35128 - DNA, 20 bp, Artificial Sequence
  sgRNA
  Ntm_9
acgtctctgaacatgactat

SEQ ID NO: 35129 - DNA, 20 bp, Artificial Sequence
  sgRNA
  Ntm_10
tgagggcccttatacctgct

SEQ ID NO: 35130 - DNA, 20 bp, Artificial Sequence
  sgRNA
  Ntm_11
tgacaaccgagtcacccggg

SEQ ID NO: 35131 - DNA, 20 bp, Artificial Sequence
  sgRNA
  Ntm_12
ctacgcaccggcactcctgt

SEQ ID NO: 35132 - DNA, 20 bp, Artificial Sequence
  sgRNA
  Ntm_13
aatgcacaattctatctcgt

SEQ ID NO: 35133 - DNA, 20 bp, Artificial Sequence
  sgRNA
  Ntm_14
aattgacaaccgagtcaccc

SEQ ID NO: 35134 - DNA, 20 bp, Artificial Sequence
  sgRNA
  Ntm_15
ccatacatctcagaagctaa

SEQ ID NO: 35135 - DNA, 20 bp, Artificial Sequence
  sgRNA
  Ntm_16
gttgacctcactgacagcac

SEQ ID NO: 35136 - DNA, 20 bp, Artificial Sequence
  sgRNA
  Ntm_17
tctatgctggaaatgacaag

SEQ ID NO: 35137 - DNA, 20 bp, Artificial Sequence
  sgRNA
  Ntm_18
cagagtccccttctgcccca

SEQ ID NO: 35138 - DNA, 20 bp, Artificial Sequence
  sgRNA
  Ntm_19
agactggtcgaaggaaagaa

SEQ ID NO: 35139 - DNA, 20 bp, Artificial Sequence
  sgRNA
  Ntm_20
tgtaggctccggtctacctg

SEQ ID NO: 35140 - DNA, 20 bp, Artificial Sequence
  sgRNA
  Ntng1_1
gaagccatatttcgtagccg

SEQ ID NO: 35141 - DNA, 20 bp, Artificial Sequence
  sgRNA
  Ntng1_2
gaccctccggatattacctg

SEQ ID NO: 35142 - DNA, 20 bp, Artificial Sequence
  sgRNA
  Ntng1_3
catggacccgaaatccgtga

SEQ ID NO: 35143 - DNA, 20 bp, Artificial Sequence
  sgRNA
  Ntng1_4
gctgttgagacccgccgttg

SEQ ID NO: 35144 - DNA, 20 bp, Artificial Sequence
  sgRNA
  Ntng1_5
tcatgtccgtggattccggc

SEQ ID NO: 35145 - DNA, 20 bp, Artificial Sequence
  sgRNA
  Ntng1_6
gcacggaagagtactccact

SEQ ID NO: 35146 - DNA, 20 bp, Artificial Sequence
  sgRNA
  Ntng1_7
gcgtgcccagacgcctacac

SEQ ID NO: 35147 - DNA, 20 bp, Artificial Sequence
  sgRNA
  Ntng1_8
aatgcttcggccactccaat

SEQ ID NO: 35148 - DNA, 20 bp, Artificial Sequence
  sgRNA
  Ntng1_9
agaacacgccacccctccga

SEQ ID NO: 35149 - DNA, 20 bp, Artificial Sequence
  sgRNA
  Ntng1_10
gcagcagtagaagcagcgag

SEQ ID NO: 35150 - DNA, 20 bp, Artificial Sequence
  sgRNA
  Ntng1_11
tgtccccacacgaaaaggta

SEQ ID NO: 35151 - DNA, 20 bp, Artificial Sequence
  sgRNA
  Ntng1_12
ggattacacagcctgccagc

SEQ ID NO: 35152 - DNA, 20 bp, Artificial Sequence
  sgRNA
  Ntng1_13
ggatggggaggtatgagccg

SEQ ID NO: 35153 - DNA, 20 bp, Artificial Sequence
  sgRNA
  Ntng1_14
gcatcctctgtgagaagcta

SEQ ID NO: 35154 - DNA, 20 bp, Artificial Sequence
  sgRNA
  Ntng1_15
tctccacaggtaatatccgg

SEQ ID NO: 35155 - DNA, 20 bp, Artificial Sequence
  sgRNA
  Ntng1_16
ctagagaaatctctcgacta

SEQ ID NO: 35156 - DNA, 20 bp, Artificial Sequence
  sgRNA
  Ntng1_17
ctccacaggtaatatccgga

SEQ ID NO: 35157 - DNA, 20 bp, Artificial Sequence
  sgRNA
  Ntng1_18
ctgcctccatgcattccaca

SEQ ID NO: 35158 - DNA, 20 bp, Artificial Sequence
  sgRNA
  Ntng1_19
gggacggagttaggaccgct

SEQ ID NO: 35159 - DNA, 20 bp, Artificial Sequence
  sgRNA
  Ntng1_20
gctattcgtggagtacccag

SEQ ID NO: 35160 - DNA, 20 bp, Artificial Sequence
  sgRNA
  Ntng2_1
cctactggcaaagcgtcacg

SEQ ID NO: 35161 - DNA, 20 bp, Artificial Sequence
  sgRNA
  Ntng2_2
tctccgcacgtgatgcctga

SEQ ID NO: 35162 - DNA, 20 bp, Artificial Sequence
  sgRNA
  Ntng2_3
tcgtcggcgaggtcacagcg

SEQ ID NO: 35163 - DNA, 20 bp, Artificial Sequence
  sgRNA
  Ntng2_4
gccccggcttatgtttgaca

SEQ ID NO: 35164 - DNA, 20 bp, Artificial Sequence
  sgRNA
  Ntng2_5
tcctacctgccgctgcccca

SEQ ID NO: 35165 - DNA, 20 bp, Artificial Sequence
  sgRNA
  Ntng2_6
cctcggtgcagagcacccgg

SEQ ID NO: 35166 - DNA, 20 bp, Artificial Sequence
  sgRNA
  Ntng2_7
cctctcatggaacaagagcg

SEQ ID NO: 35167 - DNA, 20 bp, Artificial Sequence
  sgRNA
  Ntng2_8
ctcggtgcagagcacccggt

SEQ ID NO: 35168 - DNA, 20 bp, Artificial Sequence
  sgRNA
  Ntng2_9
tgagtgtgaacacaacacca

SEQ ID NO: 35169 - DNA, 20 bp, Artificial Sequence
  sgRNA
  Ntng2_10
actgccaaaggcggagcccg

SEQ ID NO: 35170 - DNA, 20 bp, Artificial Sequence
  sgRNA
  Ntng2_11
ggagttgacagacgacgtgg

SEQ ID NO: 35171 - DNA, 20 bp, Artificial Sequence
  sgRNA
  Ntng2_12
ccaatatcgaagtcattggc

SEQ ID NO: 35172 - DNA, 20 bp, Artificial Sequence
  sgRNA
  Ntng2_13
tccctgtcaaacataagccg

SEQ ID NO: 35173 - DNA, 20 bp, Artificial Sequence
  sgRNA
  Ntng2_14
ggaggagtagaagatccttt

SEQ ID NO: 35174 - DNA, 20 bp, Artificial Sequence
  sgRNA
  Ntng2_15
cgtggagttgacagacgacg

SEQ ID NO: 35175 - DNA, 20 bp, Artificial Sequence
  sgRNA
  Ntng2_16
cgaatgccggtgtagccggg

SEQ ID NO: 35176 - DNA, 20 bp, Artificial Sequence
  sgRNA
  Ntng2_17
cttctcgaggaccatgaccg

SEQ ID NO: 35177 - DNA, 20 bp, Artificial Sequence
  sgRNA
  Ntng2_18
caggcattgggagagccgtg

SEQ ID NO: 35178 - DNA, 20 bp, Artificial Sequence
  sgRNA
  Ntng2_19
acatggacaacctgtacacg

SEQ ID NO: 35179 - DNA, 20 bp, Artificial Sequence
  sgRNA
  Ntng2_20
tgcccagcgtgagtactcct

SEQ ID NO: 35180 - DNA, 20 bp, Artificial Sequence
  sgRNA
  Ntrk1_1
gcggaggccactcttcacga

SEQ ID NO: 35181 - DNA, 20 bp, Artificial Sequence
  sgRNA
  Ntrk1_2
gacacaacaccagttgtggt

SEQ ID NO: 35182 - DNA, 20 bp, Artificial Sequence
  sgRNA
  Ntrk1_3
actaatgagaccatgcggca

SEQ ID NO: 35183 - DNA, 20 bp, Artificial Sequence
  sgRNA
  Ntrk1_4
acccagtgtcatgaagtgta

SEQ ID NO: 35184 - DNA, 20 bp, Artificial Sequence
  sgRNA
  Ntrk1_5
gctgcccgtccaccgagaag

SEQ ID NO: 35185 - DNA, 20 bp, Artificial Sequence
  sgRNA
  Ntrk1_6
gatgtctacgccatcatgcg

SEQ ID NO: 35186 - DNA, 20 bp, Artificial Sequence
  sgRNA
  Ntrk1_7
attgaccagaatcagcccca

SEQ ID NO: 35187 - DNA, 20 bp, Artificial Sequence
  sgRNA
  Ntrk1_8
acatcaggagggcaggcgcg

SEQ ID NO: 35188 - DNA, 20 bp, Artificial Sequence
  sgRNA
  Ntrk1_9
ctttgagtacatgcgccacg

SEQ ID NO: 35189 - DNA, 20 bp, Artificial Sequence
  sgRNA
  Ntrk1_10
catcagactgcctagccccg

SEQ ID NO: 35190 - DNA, 20 bp, Artificial Sequence
  sgRNA
  Ntrk1_11
gcgatcgagtgtatcacgca

SEQ ID NO: 35191 - DNA, 20 bp, Artificial Sequence
  sgRNA
  Ntrk1_12
gaatctgtcctccaatgcgt

SEQ ID NO: 35192 - DNA, 20 bp, Artificial Sequence
  sgRNA
  Ntrk1_13
gtctttgagtacatgcgcca

SEQ ID NO: 35193 - DNA, 20 bp, Artificial Sequence
  sgRNA
  Ntrk1_14
tctctgcgctggttgttcaa

SEQ ID NO: 35194 - DNA, 20 bp, Artificial Sequence
  sgRNA
  Ntrk1_15
ttcccgttgttgacatgcgt

SEQ ID NO: 35195 - DNA, 20 bp, Artificial Sequence
  sgRNA
  Ntrk1_16
gtaggggttggccgccagca

SEQ ID NO: 35196 - DNA, 20 bp, Artificial Sequence
  sgRNA
  Ntrk1_17
ccaacgctggagccagaaca

SEQ ID NO: 35197 - DNA, 20 bp, Artificial Sequence
  sgRNA
  Ntrk1_18
gcagctttgcatcaggtccg

SEQ ID NO: 35198 - DNA, 20 bp, Artificial Sequence
  sgRNA
  Ntrk1_19
ggagagggactccaacgcat

SEQ ID NO: 35199 - DNA, 20 bp, Artificial Sequence
  sgRNA
  Ntrk1_20
gatgtgctggtgctgtagca

SEQ ID NO: 35200 - DNA, 20 bp, Artificial Sequence
  sgRNA
  Ntrk2_1
atgacgttgaagcttacgtg

SEQ ID NO: 35201 - DNA, 20 bp, Artificial Sequence
  sgRNA
  Ntrk2_2
aacctgcagatacccaattg

SEQ ID NO: 35202 - DNA, 20 bp, Artificial Sequence
  sgRNA
  Ntrk2_3
aatgcaccagtggtgatctg

SEQ ID NO: 35203 - DNA, 20 bp, Artificial Sequence
  sgRNA
  Ntrk2_4
ctcagtacaccaaatcctag

SEQ ID NO: 35204 - DNA, 20 bp, Artificial Sequence
  sgRNA
  Ntrk2_5
gtatcagctatcgaacaatg

SEQ ID NO: 35205 - DNA, 20 bp, Artificial Sequence
  sgRNA
  Ntrk2_6
ggctgctcctaacctcaccg

SEQ ID NO: 35206 - DNA, 20 bp, Artificial Sequence
  sgRNA
  Ntrk2_7
tttgtttcataagatcccac

SEQ ID NO: 35207 - DNA, 20 bp, Artificial Sequence
  sgRNA
  Ntrk2_8
gggtatctgcaggttcgcca

SEQ ID NO: 35208 - DNA, 20 bp, Artificial Sequence
  sgRNA
  Ntrk2_9
gatccacgtcaccaatcaca

SEQ ID NO: 35209 - DNA, 20 bp, Artificial Sequence
  sgRNA
  Ntrk2_10
gtgatagagtgcatcaccca

SEQ ID NO: 35210 - DNA, 20 bp, Artificial Sequence
  sgRNA
  Ntrk2_11
caggcatcgtggcattcccg

SEQ ID NO: 35211 - DNA, 20 bp, Artificial Sequence
  sgRNA
  Ntrk2_12
ggtatctgcaggttcgccag

SEQ ID NO: 35212 - DNA, 20 bp, Artificial Sequence
  sgRNA
  Ntrk2_13
ccctccaccacatctccaat

SEQ ID NO: 35213 - DNA, 20 bp, Artificial Sequence
  sgRNA
  Ntrk2_14
tgctctctggaggcatccat

SEQ ID NO: 35214 - DNA, 20 bp, Artificial Sequence
  sgRNA
  Ntrk2_15
acacaatgttgcccatccga

SEQ ID NO: 35215 - DNA, 20 bp, Artificial Sequence
  sgRNA
  Ntrk2_16
gcaggagcaacatcaccagc

SEQ ID NO: 35216 - DNA, 20 bp, Artificial Sequence
  sgRNA
  Ntrk2_17
ggtgatagagtgcatcaccc

SEQ ID NO: 35217 - DNA, 20 bp, Artificial Sequence
  sgRNA
  Ntrk2_18
atgttgctgaccaaagcaat

SEQ ID NO: 35218 - DNA, 20 bp, Artificial Sequence
  sgRNA
  Ntrk2_19
gcatttgcaggacgtcgggc

SEQ ID NO: 35219 - DNA, 20 bp, Artificial Sequence
  sgRNA
  Ntrk2_20
aacactccatcttcttcgga

SEQ ID NO: 35220 - DNA, 20 bp, Artificial Sequence
  sgRNA
  Ntrk3_1
actcacatataacgcaagtg

SEQ ID NO: 35221 - DNA, 20 bp, Artificial Sequence
  sgRNA
  Ntrk3_2
ccactgcatcacatcaacca

SEQ ID NO: 35222 - DNA, 20 bp, Artificial Sequence
  sgRNA
  Ntrk3_3
ccaggctcaccacacgtgga

SEQ ID NO: 35223 - DNA, 20 bp, Artificial Sequence
  sgRNA
  Ntrk3_4
gtcaacctgactgtccgaga

SEQ ID NO: 35224 - DNA, 20 bp, Artificial Sequence
  sgRNA
  Ntrk3_5
gttccagctttccaacacgg

SEQ ID NO: 35225 - DNA, 20 bp, Artificial Sequence
  sgRNA
  Ntrk3_6
gacgtggctgtccatccacg

SEQ ID NO: 35226 - DNA, 20 bp, Artificial Sequence
  sgRNA
  Ntrk3_7
ctcgctcgtcacgttcacca

SEQ ID NO: 35227 - DNA, 20 bp, Artificial Sequence
  sgRNA
  Ntrk3_8
aatccgccagaaactacact

SEQ ID NO: 35228 - DNA, 20 bp, Artificial Sequence
  sgRNA
  Ntrk3_9
acatgccatcaacttgaccc

SEQ ID NO: 35229 - DNA, 20 bp, Artificial Sequence
  sgRNA
  Ntrk3_10
agccaggaagaccttcccaa

SEQ ID NO: 35230 - DNA, 20 bp, Artificial Sequence
  sgRNA
  Ntrk3_11
gccaatctactagtgaagat

SEQ ID NO: 35231 - DNA, 20 bp, Artificial Sequence
  sgRNA
  Ntrk3_12
ttaatattcagccgctgctg

SEQ ID NO: 35232 - DNA, 20 bp, Artificial Sequence
  sgRNA
  Ntrk3_13
tgataaagagaaccaccaga

SEQ ID NO: 35233 - DNA, 20 bp, Artificial Sequence
  sgRNA
  Ntrk3_14
agccaggtacaccatgcccg

SEQ ID NO: 35234 - DNA, 20 bp, Artificial Sequence
  sgRNA
  Ntrk3_15
tctccactgataacagccac

SEQ ID NO: 35235 - DNA, 20 bp, Artificial Sequence
  sgRNA
  Ntrk3_16
ctgatgttcatgcggaagag

SEQ ID NO: 35236 - DNA, 20 bp, Artificial Sequence
  sgRNA
  Ntrk3_17
gacgtgcattgcagagaacg

SEQ ID NO: 35237 - DNA, 20 bp, Artificial Sequence
  sgRNA
  Ntrk3_18
ctagtagattggctccaacc

SEQ ID NO: 35238 - DNA, 20 bp, Artificial Sequence
  sgRNA
  Ntrk3_19
attgccggcggccggacgat

SEQ ID NO: 35239 - DNA, 20 bp, Artificial Sequence
  sgRNA
  Ntrk3_20
aagaatgtccaggtagatcg

SEQ ID NO: 35240 - DNA, 20 bp, Artificial Sequence
  sgRNA
  Ntsr1_1
cctggtgtgcacacccacgg

SEQ ID NO: 35241 - DNA, 20 bp, Artificial Sequence
  sgRNA
  Ntsr1_2
agcactgtgcattaccacct

SEQ ID NO: 35242 - DNA, 20 bp, Artificial Sequence
  sgRNA
  Ntsr1_3
aggatggagatgatcagcat

SEQ ID NO: 35243 - DNA, 20 bp, Artificial Sequence
  sgRNA
  Ntsr1_4
cccacatccacagttcggac

SEQ ID NO: 35244 - DNA, 20 bp, Artificial Sequence
  sgRNA
  Ntsr1_5
gctgacgtagaagagagcgt

SEQ ID NO: 35245 - DNA, 20 bp, Artificial Sequence
  sgRNA
  Ntsr1_6
gctgtgctctaaactgttgt

SEQ ID NO: 35246 - DNA, 20 bp, Artificial Sequence
  sgRNA
  Ntsr1_7
gggtacagccagcagcgccg

SEQ ID NO: 35247 - DNA, 20 bp, Artificial Sequence
  sgRNA
  Ntsr1_8
ggagctgtacaacttcatct

SEQ ID NO: 35248 - DNA, 20 bp, Artificial Sequence
  sgRNA
  Ntsr1_9
ggtgctggccatcggcactg

SEQ ID NO: 35249 - DNA, 20 bp, Artificial Sequence
  sgRNA
  Ntsr1_10
agaacatgaggcgccgcacg

SEQ ID NO: 35250 - DNA, 20 bp, Artificial Sequence
  sgRNA
  Ntsr1_11
tgacagccttcactctagcg

SEQ ID NO: 35251 - DNA, 20 bp, Artificial Sequence
  sgRNA
  Ntsr1_12
gtgtgcacaccaggccacca

SEQ ID NO: 35252 - DNA, 20 bp, Artificial Sequence
  sgRNA
  Ntsr1_13
tggcctggtgtgcacaccca

SEQ ID NO: 35253 - DNA, 20 bp, Artificial Sequence
  sgRNA
  Ntsr1_14
ctcgcaggaaatagtagcca

SEQ ID NO: 35254 - DNA, 20 bp, Artificial Sequence
  sgRNA
  Ntsr1_15
cgtctccgccaacttccgcc

SEQ ID NO: 35255 - DNA, 20 bp, Artificial Sequence
  sgRNA
  Ntsr1_16
ggcggaagttggcggagacg

SEQ ID NO: 35256 - DNA, 20 bp, Artificial Sequence
  sgRNA
  Ntsr1_17
actcaggctggctacattga

SEQ ID NO: 35257 - DNA, 20 bp, Artificial Sequence
  sgRNA
  Ntsr1_18
agaaattcatcagtgccata

SEQ ID NO: 35258 - DNA, 20 bp, Artificial Sequence
  sgRNA
  Ntsr1_19
acttggggctccctgctgca

SEQ ID NO: 35259 - DNA, 20 bp, Artificial Sequence
  sgRNA
  Ntsr1_20
gacggtggctgtgtccaccg

SEQ ID NO: 35260 - DNA, 20 bp, Artificial Sequence
  sgRNA
  Ntsr2_1
cgagatcgccgaagacccag

SEQ ID NO: 35261 - DNA, 20 bp, Artificial Sequence
  sgRNA
  Ntsr2_2
gaagatgagcgaatagagcg

SEQ ID NO: 35262 - DNA, 20 bp, Artificial Sequence
  sgRNA
  Ntsr2_3
tgtcccatgataaccgccat

SEQ ID NO: 35263 - DNA, 20 bp, Artificial Sequence
  sgRNA
  Ntsr2_4
tagcaccgtgcacacacgcg

SEQ ID NO: 35264 - DNA, 20 bp, Artificial Sequence
  sgRNA
  Ntsr2_5
gtgtggtgaacagcgctccg

SEQ ID NO: 35265 - DNA, 20 bp, Artificial Sequence
  sgRNA
  Ntsr2_6
tgagctgtgcgcctacgcca

SEQ ID NO: 35266 - DNA, 20 bp, Artificial Sequence
  sgRNA
  Ntsr2_7
ggagcgctgttcaccacaca

SEQ ID NO: 35267 - DNA, 20 bp, Artificial Sequence
  sgRNA
  Ntsr2_8
tggagctctacaacttcgtg

SEQ ID NO: 35268 - DNA, 20 bp, Artificial Sequence
  sgRNA
  Ntsr2_9
ggagaaagaccctctccctg

SEQ ID NO: 35269 - DNA, 20 bp, Artificial Sequence
  sgRNA
  Ntsr2_10
gctacatccccgatgatgga

SEQ ID NO: 35270 - DNA, 20 bp, Artificial Sequence
  sgRNA
  Ntsr2_11
ccgagatcgccgaagaccca

SEQ ID NO: 35271 - DNA, 20 bp, Artificial Sequence
  sgRNA
  Ntsr2_12
gagcgcggtgaacagcacct

SEQ ID NO: 35272 - DNA, 20 bp, Artificial Sequence
  sgRNA
  Ntsr2_13
gctgacatagaagagcgtgt

SEQ ID NO: 35273 - DNA, 20 bp, Artificial Sequence
  sgRNA
  Ntsr2_14
gtagcagtacatgagcctgc

SEQ ID NO: 35274 - DNA, 20 bp, Artificial Sequence
  sgRNA
  Ntsr2_15
tattcgctcatcttcgcgct

SEQ ID NO: 35275 - DNA, 20 bp, Artificial Sequence
  sgRNA
  Ntsr2_16
ggctgccgtaccatgcccgc

SEQ ID NO: 35276 - DNA, 20 bp, Artificial Sequence
  sgRNA
  Ntsr2_17
gatcactgtcaaccacctgg

SEQ ID NO: 35277 - DNA, 20 bp, Artificial Sequence
  sgRNA
  Ntsr2_18
cgtgtggtcccactacccct

SEQ ID NO: 35278 - DNA, 20 bp, Artificial Sequence
  sgRNA
  Ntsr2_19
cgaaatggagagggccgacg

SEQ ID NO: 35279 - DNA, 20 bp, Artificial Sequence
  sgRNA
  Ntsr2_20
gggagtagagggccaccagg

SEQ ID NO: 35280 - DNA, 20 bp, Artificial Sequence
  sgRNA
  Nup210_1
gaagtccaacacacggacgt

SEQ ID NO: 35281 - DNA, 20 bp, Artificial Sequence
  sgRNA
  Nup210_2
gtgctgctggtaattccggg

SEQ ID NO: 35282 - DNA, 20 bp, Artificial Sequence
  sgRNA
  Nup210_3
ctcaagatagagctcacggg

SEQ ID NO: 35283 - DNA, 20 bp, Artificial Sequence
  sgRNA
  Nup210_4
tgctaagaatgttcgccctg

SEQ ID NO: 35284 - DNA, 20 bp, Artificial Sequence
  sgRNA
  Nup210_5
tgcttgtgatgtcttcaccg

SEQ ID NO: 35285 - DNA, 20 bp, Artificial Sequence
  sgRNA
  Nup210_6
gtagccagcatagagccgtt

SEQ ID NO: 35286 - DNA, 20 bp, Artificial Sequence
  sgRNA
  Nup210_7
gaggatgtcacccaccacca

SEQ ID NO: 35287 - DNA, 20 bp, Artificial Sequence
  sgRNA
  Nup210_8
gtacgaagtcggagaggccg

SEQ ID NO: 35288 - DNA, 20 bp, Artificial Sequence
  sgRNA
  Nup210_9
gttgctctgtcccatctgca

SEQ ID NO: 35289 - DNA, 20 bp, Artificial Sequence
  sgRNA
  Nup210_10
taggcacccaggtctaacag

SEQ ID NO: 35290 - DNA, 20 bp, Artificial Sequence
  sgRNA
  Nup210_11
gctcaaggctcgaattcagg

SEQ ID NO: 35291 - DNA, 20 bp, Artificial Sequence
  sgRNA
  Nup210_12
agcctcccagataatcacgc

SEQ ID NO: 35292 - DNA, 20 bp, Artificial Sequence
  sgRNA
  Nup210_13
ctaggtttcacagtctaccc

SEQ ID NO: 35293 - DNA, 20 bp, Artificial Sequence
  sgRNA
  Nup210_14
atagtctggttggtgccgaa

SEQ ID NO: 35294 - DNA, 20 bp, Artificial Sequence
  sgRNA
  Nup210_15
ggacctatcaaatacttcga

SEQ ID NO: 35295 - DNA, 20 bp, Artificial Sequence
  sgRNA
  Nup210_16
tgcgcatagtaaccgagcag

SEQ ID NO: 35296 - DNA, 20 bp, Artificial Sequence
  sgRNA
  Nup210_17
gcaatggctggaacacaccc

SEQ ID NO: 35297 - DNA, 20 bp, Artificial Sequence
  sgRNA
  Nup210_18
cgttgaccctaagacaggcg

SEQ ID NO: 35298 - DNA, 20 bp, Artificial Sequence
  sgRNA
  Nup210_19
gtagtggtacgaagtcggag

SEQ ID NO: 35299 - DNA, 20 bp, Artificial Sequence
  sgRNA
  Nup210_20
catcaccattccagtcaccg

SEQ ID NO: 35300 - DNA, 20 bp, Artificial Sequence
  sgRNA
  Nup210l_1
ttatccgagttgagatcgag

SEQ ID NO: 35301 - DNA, 20 bp, Artificial Sequence
  sgRNA
  Nup210l_2
atcagcgcctcggcatatcg

SEQ ID NO: 35302 - DNA, 20 bp, Artificial Sequence
  sgRNA
  Nup210l_3
cctaaaccctagtccctctg

SEQ ID NO: 35303 - DNA, 20 bp, Artificial Sequence
  sgRNA
  Nup210l_4
ccgactcgtcacggccactg

SEQ ID NO: 35304 - DNA, 20 bp, Artificial Sequence
  sgRNA
  Nup210l_5
ggtgtcttcaagaacttcgt

SEQ ID NO: 35305 - DNA, 20 bp, Artificial Sequence
  sgRNA
  Nup210l_6
tctccacactgaattccgaa

SEQ ID NO: 35306 - DNA, 20 bp, Artificial Sequence
  sgRNA
  Nup210l_7
agttgtgaaaacgtttcgag

SEQ ID NO: 35307 - DNA, 20 bp, Artificial Sequence
  sgRNA
  Nup210l_8
ggtgtcaccaacatactggc

SEQ ID NO: 35308 - DNA, 20 bp, Artificial Sequence
  sgRNA
  Nup210l_9
cttacccctcgatctcaact

SEQ ID NO: 35309 - DNA, 20 bp, Artificial Sequence
  sgRNA
  Nup210l_10
gtagaaatcatccacacccc

SEQ ID NO: 35310 - DNA, 20 bp, Artificial Sequence
  sgRNA
  Nup210l_11
gttggacgagaagacagcca

SEQ ID NO: 35311 - DNA, 20 bp, Artificial Sequence
  sgRNA
  Nup210l_12
aaggtgagagacatgcccaa

SEQ ID NO: 35312 - DNA, 20 bp, Artificial Sequence
  sgRNA
  Nup210l_13
ggaccgtgacgtcttccacc

SEQ ID NO: 35313 - DNA, 20 bp, Artificial Sequence
  sgRNA
  Nup210l_14
gagaacacgggaactcacaa

SEQ ID NO: 35314 - DNA, 20 bp, Artificial Sequence
  sgRNA
  Nup210l_15
gtagccagagacgatggcag

SEQ ID NO: 35315 - DNA, 20 bp, Artificial Sequence
  sgRNA
  Nup210l_16
gcacaggtcatacacttcca

SEQ ID NO: 35316 - DNA, 20 bp, Artificial Sequence
  sgRNA
  Nup210l_17
gttgtttgattgactccaaa

SEQ ID NO: 35317 - DNA, 20 bp, Artificial Sequence
  sgRNA
  Nup210l_18
tcaaatcagtcaccaacaag

SEQ ID NO: 35318 - DNA, 20 bp, Artificial Sequence
  sgRNA
  Nup210l_19
actggttcatgtaaaagcca

SEQ ID NO: 35319 - DNA, 20 bp, Artificial Sequence
  sgRNA
  Nup210l_20
caactcgccaagatctgcgg

SEQ ID NO: 35320 - DNA, 20 bp, Artificial Sequence
  sgRNA
  Olfr1002_1
atatctatcataagccatgg

SEQ ID NO: 35321 - DNA, 20 bp, Artificial Sequence
  sgRNA
  Olfr1002_2
tatctgcacatgccagtgag

SEQ ID NO: 35322 - DNA, 20 bp, Artificial Sequence
  sgRNA
  Olfr1002_3
cataggccttataagcactg

SEQ ID NO: 35323 - DNA, 20 bp, Artificial Sequence
  sgRNA
  Olfr1002_4
ttataccactgaatacacct

SEQ ID NO: 35324 - DNA, 20 bp, Artificial Sequence
  sgRNA
  Olfr1002_5
gatgttgtctgacatctttg

SEQ ID NO: 35325 - DNA, 20 bp, Artificial Sequence
  sgRNA
  Olfr1002_6
agatcaattctgctgatggg

SEQ ID NO: 35326 - DNA, 20 bp, Artificial Sequence
  sgRNA
  Olfr1002_7
gcatttattcttccatactg

SEQ ID NO: 35327 - DNA, 20 bp, Artificial Sequence
  sgRNA
  Olfr1002_8
ttataaggcctatgctgtaa

SEQ ID NO: 35328 - DNA, 20 bp, Artificial Sequence
  sgRNA
  Olfr1002_9
aagatgtcagacaacatctt

SEQ ID NO: 35329 - DNA, 20 bp, Artificial Sequence
  sgRNA
  Olfr1002_10
aacatatctatcataagcca

SEQ ID NO: 35330 - DNA, 20 bp, Artificial Sequence
  sgRNA
  Olfr1002_11
tggcttagaaaaaagtacat

SEQ ID NO: 35331 - DNA, 20 bp, Artificial Sequence
  sgRNA
  Olfr1002_12
ctaaagatcaattctgctga

SEQ ID NO: 35332 - DNA, 20 bp, Artificial Sequence
  sgRNA
  Olfr1002_13
taaagatcaattctgctgat

SEQ ID NO: 35333 - DNA, 20 bp, Artificial Sequence
  sgRNA
  Olfr1002_14
agcagaattgatctttagga

SEQ ID NO: 35334 - DNA, 20 bp, Artificial Sequence
  sgRNA
  Olfr1002_15
actggctgaataaacaaaac

SEQ ID NO: 35335 - DNA, 20 bp, Artificial Sequence
  sgRNA
  Olfr1002_16
gaataaatgcagaagtagta

SEQ ID NO: 35336 - DNA, 20 bp, Artificial Sequence
  sgRNA
  Olfr1002_17
tctaagccacttgtcctttg

SEQ ID NO: 35337 - DNA, 20 bp, Artificial Sequence
  sgRNA
  Olfr1002_18
tttctcaagctataaatgaa

SEQ ID NO: 35338 - DNA, 20 bp, Artificial Sequence
  sgRNA
  Olfr1002_19
ggcttagaaaaaagtacatg

SEQ ID NO: 35339 - DNA, 20 bp, Artificial Sequence
  sgRNA
  Olfr1002_20
attgatctttaggatggtga

SEQ ID NO: 35340 - DNA, 20 bp, Artificial Sequence
  sgRNA
  Olfr1006_1
tgaagcccaccacacccagg

SEQ ID NO: 35341 - DNA, 20 bp, Artificial Sequence
  sgRNA
  Olfr1006_2
tttgtcttctgagatacaag

SEQ ID NO: 35342 - DNA, 20 bp, Artificial Sequence
  sgRNA
  Olfr1006_3
accacagaaagttagccgga

SEQ ID NO: 35343 - DNA, 20 bp, Artificial Sequence
  sgRNA
  Olfr1006_4
tctacttgttgacattgtca

SEQ ID NO: 35344 - DNA, 20 bp, Artificial Sequence
  sgRNA
  Olfr1006_5
agaatgtcggtcataagcca

SEQ ID NO: 35345 - DNA, 20 bp, Artificial Sequence
  sgRNA
  Olfr1006_6
agctgggtgttacatagggg

SEQ ID NO: 35346 - DNA, 20 bp, Artificial Sequence
  sgRNA
  Olfr1006_7
gcttctcagcagacccccac

SEQ ID NO: 35347 - DNA, 20 bp, Artificial Sequence
  sgRNA
  Olfr1006_8
ccttgaatacatgaaaagca

SEQ ID NO: 35348 - DNA, 20 bp, Artificial Sequence
  sgRNA
  Olfr1006_9
cataagccatggctgccagc

SEQ ID NO: 35349 - DNA, 20 bp, Artificial Sequence
  sgRNA
  Olfr1006_10
ggtctgctgagaagcccaca

SEQ ID NO: 35350 - DNA, 20 bp, Artificial Sequence
  sgRNA
  Olfr1006_11
tctgtactgggctagtagct

SEQ ID NO: 35351 - DNA, 20 bp, Artificial Sequence
  sgRNA
  Olfr1006_12
tacgtcttcctgaggctgag

SEQ ID NO: 35352 - DNA, 20 bp, Artificial Sequence
  sgRNA
  Olfr1006_13
atacactgagtgctacctgc

SEQ ID NO: 35353 - DNA, 20 bp, Artificial Sequence
  sgRNA
  Olfr1006_14
ggatcctcaagatagccagc

SEQ ID NO: 35354 - DNA, 20 bp, Artificial Sequence
  sgRNA
  Olfr1006_15
gtagctgggtgttacatagg

SEQ ID NO: 35355 - DNA, 20 bp, Artificial Sequence
  sgRNA
  Olfr1006_16
tgacaatgtcaacaagtaga

SEQ ID NO: 35356 - DNA, 20 bp, Artificial Sequence
  sgRNA
  Olfr1006_17
gactacaaattgcagaatgt

SEQ ID NO: 35357 - DNA, 20 bp, Artificial Sequence
  sgRNA
  Olfr1006_18
catgacagagaccaggtgag

SEQ ID NO: 35358 - DNA, 20 bp, Artificial Sequence
  sgRNA
  Olfr1006_19
ctcagtgtatgctacaacac

SEQ ID NO: 35359 - DNA, 20 bp, Artificial Sequence
  sgRNA
  Olfr1006_20
aaatagagtcagctgccagt

SEQ ID NO: 35360 - DNA, 20 bp, Artificial Sequence
  sgRNA
  Olfr1008_1
ttgtaggcgagagtccagct

SEQ ID NO: 35361 - DNA, 20 bp, Artificial Sequence
  sgRNA
  Olfr1008_2
tcagcatttgaacacaaggt

SEQ ID NO: 35362 - DNA, 20 bp, Artificial Sequence
  sgRNA
  Olfr1008_3
atgaagaagaccccaaacaa

SEQ ID NO: 35363 - DNA, 20 bp, Artificial Sequence
  sgRNA
  Olfr1008_4
aacaaagaatgacatctgtg

SEQ ID NO: 35364 - DNA, 20 bp, Artificial Sequence
  sgRNA
  Olfr1008_5
ggtaaaaaatgctttcaaca

SEQ ID NO: 35365 - DNA, 20 bp, Artificial Sequence
  sgRNA
  Olfr1008_6
ggaaggtgctgtagagatat

SEQ ID NO: 35366 - DNA, 20 bp, Artificial Sequence
  sgRNA
  Olfr1008_7
ggtgaatagcagagcctgga

SEQ ID NO: 35367 - DNA, 20 bp, Artificial Sequence
  sgRNA
  Olfr1008_8
atatctctacagcaccttcc

SEQ ID NO: 35368 - DNA, 20 bp, Artificial Sequence
  sgRNA
  Olfr1008_9
tccaaggactatcagaagag

SEQ ID NO: 35369 - DNA, 20 bp, Artificial Sequence
  sgRNA
  Olfr1008_10
catctgtcccaagatgctga

SEQ ID NO: 35370 - DNA, 20 bp, Artificial Sequence
  sgRNA
  Olfr1008_11
atgtgggtctcatctgacag

SEQ ID NO: 35371 - DNA, 20 bp, Artificial Sequence
  sgRNA
  Olfr1008_12
atatcaaggggttaatcatg

SEQ ID NO: 35372 - DNA, 20 bp, Artificial Sequence
  sgRNA
  Olfr1008_13
gaatcaggacatataatcca

SEQ ID NO: 35373 - DNA, 20 bp, Artificial Sequence
  sgRNA
  Olfr1008_14
tggtcaaaatgatcatgccc

SEQ ID NO: 35374 - DNA, 20 bp, Artificial Sequence
  sgRNA
  Olfr1008_15
aatggcctatgactgctatg

SEQ ID NO: 35375 - DNA, 20 bp, Artificial Sequence
  sgRNA
  Olfr1008_16
tatatcaaggggttaatcat

SEQ ID NO: 35376 - DNA, 20 bp, Artificial Sequence
  sgRNA
  Olfr1008_17
gtctcatctgacagtggttg

SEQ ID NO: 35377 - DNA, 20 bp, Artificial Sequence
  sgRNA
  Olfr1008_18
atgggatgtccacaagcaca

SEQ ID NO: 35378 - DNA, 20 bp, Artificial Sequence
  sgRNA
  Olfr1008_19
gtatatcaaggggttaatca

SEQ ID NO: 35379 - DNA, 20 bp, Artificial Sequence
  sgRNA
  Olfr1008_20
actctttatcttgtcctcaa

SEQ ID NO: 35380 - DNA, 20 bp, Artificial Sequence
  sgRNA
  Olfr1013_1
cctctggtaaagctcgcatg

SEQ ID NO: 35381 - DNA, 20 bp, Artificial Sequence
  sgRNA
  Olfr1013_2
aacagatcctgtgatacaga

SEQ ID NO: 35382 - DNA, 20 bp, Artificial Sequence
  sgRNA
  Olfr1013_3
attgcagattaacataatga

SEQ ID NO: 35383 - DNA, 20 bp, Artificial Sequence
  sgRNA
  Olfr1013_4
ctgagctacacaaccggcga

SEQ ID NO: 35384 - DNA, 20 bp, Artificial Sequence
  sgRNA
  Olfr1013_5
gctttgaaatagccacatag

SEQ ID NO: 35385 - DNA, 20 bp, Artificial Sequence
  sgRNA
  Olfr1013_6
ccacatgcgagctttaccag

SEQ ID NO: 35386 - DNA, 20 bp, Artificial Sequence
  sgRNA
  Olfr1013_7
tttgtggtagcctcatatgt

SEQ ID NO: 35387 - DNA, 20 bp, Artificial Sequence
  sgRNA
  Olfr1013_8
atgcgagctttaccagaggt

SEQ ID NO: 35388 - DNA, 20 bp, Artificial Sequence
  sgRNA
  Olfr1013_9
atggcttgtgaataaagcag

SEQ ID NO: 35389 - DNA, 20 bp, Artificial Sequence
  sgRNA
  Olfr1013_10
ctatactgaatgttaccttt

SEQ ID NO: 35390 - DNA, 20 bp, Artificial Sequence
  sgRNA
  Olfr1013_11
gaagaactgagctacacaac

SEQ ID NO: 35391 - DNA, 20 bp, Artificial Sequence
  sgRNA
  Olfr1013_12
tgtagacagaagacaatcca

SEQ ID NO: 35392 - DNA, 20 bp, Artificial Sequence
  sgRNA
  Olfr1013_13
gtggtagcctcatatgtggg

SEQ ID NO: 35393 - DNA, 20 bp, Artificial Sequence
  sgRNA
  Olfr1013_14
gacaagagcatttccttcgc

SEQ ID NO: 35394 - DNA, 20 bp, Artificial Sequence
  sgRNA
  Olfr1013_15
gctcttgtcttctgagatgc

SEQ ID NO: 35395 - DNA, 20 bp, Artificial Sequence
  sgRNA
  Olfr1013_16
tgatgacattggaagtcaag

SEQ ID NO: 35396 - DNA, 20 bp, Artificial Sequence
  sgRNA
  Olfr1013_17
gtgtacacattgactttgat

SEQ ID NO: 35397 - DNA, 20 bp, Artificial Sequence
  sgRNA
  Olfr1013_18
atccaaggtccaggaatgat

SEQ ID NO: 35398 - DNA, 20 bp, Artificial Sequence
  sgRNA
  Olfr1013_19
ttccttagactatagatcag

SEQ ID NO: 35399 - DNA, 20 bp, Artificial Sequence
  sgRNA
  Olfr1013_20
catgcgagctttaccagagg

SEQ ID NO: 35400 - DNA, 20 bp, Artificial Sequence
  sgRNA
  Olfr1014_1
attgcagatcaacacaatga

SEQ ID NO: 35401 - DNA, 20 bp, Artificial Sequence
  sgRNA
  Olfr1014_2
gctttgagatagcgacatag

SEQ ID NO: 35402 - DNA, 20 bp, Artificial Sequence
  sgRNA
  Olfr1014_3
cccctggtaaagctctcatg

SEQ ID NO: 35403 - DNA, 20 bp, Artificial Sequence
  sgRNA
  Olfr1014_4
gttggagtctcatatttggg

SEQ ID NO: 35404 - DNA, 20 bp, Artificial Sequence
  sgRNA
  Olfr1014_5
gccacatgagagctttacca

SEQ ID NO: 35405 - DNA, 20 bp, Artificial Sequence
  sgRNA
  Olfr1014_6
ccacatgagagctttaccag

SEQ ID NO: 35406 - DNA, 20 bp, Artificial Sequence
  sgRNA
  Olfr1014_7
cattgcagatcaacacaatg

SEQ ID NO: 35407 - DNA, 20 bp, Artificial Sequence
  sgRNA
  Olfr1014_8
ggtttgttgtgaatcctacc

SEQ ID NO: 35408 - DNA, 20 bp, Artificial Sequence
  sgRNA
  Olfr1014_9
gtatactgagtgttatctgt

SEQ ID NO: 35409 - DNA, 20 bp, Artificial Sequence
  sgRNA
  Olfr1014_10
gcagaaccagctgcatgaca

SEQ ID NO: 35410 - DNA, 20 bp, Artificial Sequence
  sgRNA
  Olfr1014_11
tttctgtgatatcccacccc

SEQ ID NO: 35411 - DNA, 20 bp, Artificial Sequence
  sgRNA
  Olfr1014_12
gacatagcggtcataagcca

SEQ ID NO: 35412 - DNA, 20 bp, Artificial Sequence
  sgRNA
  Olfr1014_13
atgagagctttaccaggggt

SEQ ID NO: 35413 - DNA, 20 bp, Artificial Sequence
  sgRNA
  Olfr1014_14
tcttcttctctgctggactt

SEQ ID NO: 35414 - DNA, 20 bp, Artificial Sequence
  sgRNA
  Olfr1014_15
ttagttggagtctcatattt

SEQ ID NO: 35415 - DNA, 20 bp, Artificial Sequence
  sgRNA
  Olfr1014_16
tagctttaaggacatggctt

SEQ ID NO: 35416 - DNA, 20 bp, Artificial Sequence
  sgRNA
  Olfr1014_17
atagctttaaggacatggct

SEQ ID NO: 35417 - DNA, 20 bp, Artificial Sequence
  sgRNA
  Olfr1014_18
gtgactgagttcatcctggt

SEQ ID NO: 35418 - DNA, 20 bp, Artificial Sequence
  sgRNA
  Olfr1014_19
atggcttgggaataaagcag

SEQ ID NO: 35419 - DNA, 20 bp, Artificial Sequence
  sgRNA
  Olfr1014_20
tgccacatgagagctttacc

SEQ ID NO: 35420 - DNA, 20 bp, Artificial Sequence
  sgRNA
  Olfr1015_1
tgtgcagcctggaatcgatg

SEQ ID NO: 35421 - DNA, 20 bp, Artificial Sequence
  sgRNA
  Olfr1015_2
atagaatcagctgccaatgg

SEQ ID NO: 35422 - DNA, 20 bp, Artificial Sequence
  sgRNA
  Olfr1015_3
agtgttggcagtatgggcta

SEQ ID NO: 35423 - DNA, 20 bp, Artificial Sequence
  sgRNA
  Olfr1015_4
tgaagcccaccatactggaa

SEQ ID NO: 35424 - DNA, 20 bp, Artificial Sequence
  sgRNA
  Olfr1015_5
ggatcctcagtatagccagc

SEQ ID NO: 35425 - DNA, 20 bp, Artificial Sequence
  sgRNA
  Olfr1015_6
catatgccatggctgccagc

SEQ ID NO: 35426 - DNA, 20 bp, Artificial Sequence
  sgRNA
  Olfr1015_7
gcttctcagcagacccccat

SEQ ID NO: 35427 - DNA, 20 bp, Artificial Sequence
  sgRNA
  Olfr1015_8
ggatggcaagaatgcttgag

SEQ ID NO: 35428 - DNA, 20 bp, Artificial Sequence
  sgRNA
  Olfr1015_9
acccagttccaactactccc

SEQ ID NO: 35429 - DNA, 20 bp, Artificial Sequence
  sgRNA
  Olfr1015_10
caaaaaccctcccacatagg

SEQ ID NO: 35430 - DNA, 20 bp, Artificial Sequence
  sgRNA
  Olfr1015_11
agctactttgtctctctcca

SEQ ID NO: 35431 - DNA, 20 bp, Artificial Sequence
  sgRNA
  Olfr1015_12
cagcaggtagcactcagtgt

SEQ ID NO: 35432 - DNA, 20 bp, Artificial Sequence
  sgRNA
  Olfr1015_13
acatcctgctggctatactg

SEQ ID NO: 35433 - DNA, 20 bp, Artificial Sequence
  sgRNA
  Olfr1015_14
tgatgcttgaatagagcaat

SEQ ID NO: 35434 - DNA, 20 bp, Artificial Sequence
  sgRNA
  Olfr1015_15
tgggggcctcctatgtggga

SEQ ID NO: 35435 - DNA, 20 bp, Artificial Sequence
  sgRNA
  Olfr1015_16
cctccaataaaaaagtacat

SEQ ID NO: 35436 - DNA, 20 bp, Artificial Sequence
  sgRNA
  Olfr1015_17
gttgagataggaaattagga

SEQ ID NO: 35437 - DNA, 20 bp, Artificial Sequence
  sgRNA
  Olfr1015_18
agaagagtgtaacagagacc

SEQ ID NO: 35438 - DNA, 20 bp, Artificial Sequence
  sgRNA
  Olfr1015_19
aaatagaatcagctgccaat

SEQ ID NO: 35439 - DNA, 20 bp, Artificial Sequence
  sgRNA
  Olfr1015_20
ctcagcctcaggaagacgaa

SEQ ID NO: 35440 - DNA, 20 bp, Artificial Sequence
  sgRNA
  Olfr1016_1
atggcctgagaataaatcag

SEQ ID NO: 35441 - DNA, 20 bp, Artificial Sequence
  sgRNA
  Olfr1016_2
cacaaacaggaccaattgtg

SEQ ID NO: 35442 - DNA, 20 bp, Artificial Sequence
  sgRNA
  Olfr1016_3
gtagcagcgtcttatatggg

SEQ ID NO: 35443 - DNA, 20 bp, Artificial Sequence
  sgRNA
  Olfr1016_4
ctgagccacacagctagcaa

SEQ ID NO: 35444 - DNA, 20 bp, Artificial Sequence
  sgRNA
  Olfr1016_5
cataagccatagcagccagc

SEQ ID NO: 35445 - DNA, 20 bp, Artificial Sequence
  sgRNA
  Olfr1016_6
ggtcagtaggaagtacataa

SEQ ID NO: 35446 - DNA, 20 bp, Artificial Sequence
  sgRNA
  Olfr1016_7
ggtcagaggtgaatcccaag

SEQ ID NO: 35447 - DNA, 20 bp, Artificial Sequence
  sgRNA
  Olfr1016_8
ttgagaatccgttccaccca

SEQ ID NO: 35448 - DNA, 20 bp, Artificial Sequence
  sgRNA
  Olfr1016_9
tctaaagaatatctggtacg

SEQ ID NO: 35449 - DNA, 20 bp, Artificial Sequence
  sgRNA
  Olfr1016_10
ggatgaactcagatactgtg

SEQ ID NO: 35450 - DNA, 20 bp, Artificial Sequence
  sgRNA
  Olfr1016_11
ggcaattatgaaaatatagg

SEQ ID NO: 35451 - DNA, 20 bp, Artificial Sequence
  sgRNA
  Olfr1016_12
ggaacggattctcaagatag

SEQ ID NO: 35452 - DNA, 20 bp, Artificial Sequence
  sgRNA
  Olfr1016_13
ctacagtgagtgttacctgc

SEQ ID NO: 35453 - DNA, 20 bp, Artificial Sequence
  sgRNA
  Olfr1016_14
ccacaagccagattcaccaa

SEQ ID NO: 35454 - DNA, 20 bp, Artificial Sequence
  sgRNA
  Olfr1016_15
ggaggctaggattagagcaa

SEQ ID NO: 35455 - DNA, 20 bp, Artificial Sequence
  sgRNA
  Olfr1016_16
gtatctgagttcatcctctt

SEQ ID NO: 35456 - DNA, 20 bp, Artificial Sequence
  sgRNA
  Olfr1016_17
gtaggaagtacataagggtc

SEQ ID NO: 35457 - DNA, 20 bp, Artificial Sequence
  sgRNA
  Olfr1016_18
acaggaccaattgtgtggta

SEQ ID NO: 35458 - DNA, 20 bp, Artificial Sequence
  sgRNA
  Olfr1016_19
tcatgcgaccctgggtggaa

SEQ ID NO: 35459 - DNA, 20 bp, Artificial Sequence
  sgRNA
  Olfr1016_20
ataaatcagtggctttgaga

SEQ ID NO: 35460 - DNA, 20 bp, Artificial Sequence
  sgRNA
  Olfr1019_1
tatgcgccactaaactcact

SEQ ID NO: 35461 - DNA, 20 bp, Artificial Sequence
  sgRNA
  Olfr1019_2
atgagagtgctatagtgaag

SEQ ID NO: 35462 - DNA, 20 bp, Artificial Sequence
  sgRNA
  Olfr1019_3
gagcaagagagagctaagag

SEQ ID NO: 35463 - DNA, 20 bp, Artificial Sequence
  sgRNA
  Olfr1019_4
cattccctatcacattgacc

SEQ ID NO: 35464 - DNA, 20 bp, Artificial Sequence
  sgRNA
  Olfr1019_5
gccgctttcaagaaactgat

SEQ ID NO: 35465 - DNA, 20 bp, Artificial Sequence
  sgRNA
  Olfr1019_6
tgagtagcccaggtcaacaa

SEQ ID NO: 35466 - DNA, 20 bp, Artificial Sequence
  sgRNA
  Olfr1019_7
catgtccaagaaagtctgct

SEQ ID NO: 35467 - DNA, 20 bp, Artificial Sequence
  sgRNA
  Olfr1019_8
gataattgtgtagaacacag

SEQ ID NO: 35468 - DNA, 20 bp, Artificial Sequence
  sgRNA
  Olfr1019_9
agcccaggtcaacaaaggag

SEQ ID NO: 35469 - DNA, 20 bp, Artificial Sequence
  sgRNA
  Olfr1019_10
actttcagcctcagttactg

SEQ ID NO: 35470 - DNA, 20 bp, Artificial Sequence
  sgRNA
  Olfr1019_11
gaattcgatcagctgaaggc

SEQ ID NO: 35471 - DNA, 20 bp, Artificial Sequence
  sgRNA
  Olfr1019_12
tattggaaccacagtaactg

SEQ ID NO: 35472 - DNA, 20 bp, Artificial Sequence
  sgRNA
  Olfr1019_13
actcatcagctattgctccc

SEQ ID NO: 35473 - DNA, 20 bp, Artificial Sequence
  sgRNA
  Olfr1019_14
catgactgtaccataaaaaa

SEQ ID NO: 35474 - DNA, 20 bp, Artificial Sequence
  sgRNA
  Olfr1019_15
ggagatgaagatgataagga

SEQ ID NO: 35475 - DNA, 20 bp, Artificial Sequence
  sgRNA
  Olfr1019_16
cattgaccaggtagacaagg

SEQ ID NO: 35476 - DNA, 20 bp, Artificial Sequence
  sgRNA
  Olfr1019_17
aggtggaaaaagcctttagc

SEQ ID NO: 35477 - DNA, 20 bp, Artificial Sequence
  sgRNA
  Olfr1019_18
gtctgcttggtcctaatgct

SEQ ID NO: 35478 - DNA, 20 bp, Artificial Sequence
  sgRNA
  Olfr1019_19
acatgactgtaccataaaaa

SEQ ID NO: 35479 - DNA, 20 bp, Artificial Sequence
  sgRNA
  Olfr1019_20
agtaagatgagacccgcagg

SEQ ID NO: 35480 - DNA, 20 bp, Artificial Sequence
  sgRNA
  Olfr1020_1
atgagaactgggtatagcag

SEQ ID NO: 35481 - DNA, 20 bp, Artificial Sequence
  sgRNA
  Olfr1020_2
tgctcttatcctcagccatg

SEQ ID NO: 35482 - DNA, 20 bp, Artificial Sequence
  sgRNA
  Olfr1020_3
tcagacaatccagacttgca

SEQ ID NO: 35483 - DNA, 20 bp, Artificial Sequence
  sgRNA
  Olfr1020_4
aagaggcatcaacaaaagaa

SEQ ID NO: 35484 - DNA, 20 bp, Artificial Sequence
  sgRNA
  Olfr1020_5
gtatagcaggggattccaga

SEQ ID NO: 35485 - DNA, 20 bp, Artificial Sequence
  sgRNA
  Olfr1020_6
ctgaagatgccttcagcaga

SEQ ID NO: 35486 - DNA, 20 bp, Artificial Sequence
  sgRNA
  Olfr1020_7
acttcattcttagcaggctt

SEQ ID NO: 35487 - DNA, 20 bp, Artificial Sequence
  sgRNA
  Olfr1020_8
gaggttcactagcatcttgg

SEQ ID NO: 35488 - DNA, 20 bp, Artificial Sequence
  sgRNA
  Olfr1020_9
gattgtctgagagacccaaa

SEQ ID NO: 35489 - DNA, 20 bp, Artificial Sequence
  sgRNA
  Olfr1020_10
gatggtaacagccatgaggt

SEQ ID NO: 35490 - DNA, 20 bp, Artificial Sequence
  sgRNA
  Olfr1020_11
ggtgacagaagaagaataag

SEQ ID NO: 35491 - DNA, 20 bp, Artificial Sequence
  sgRNA
  Olfr1020_12
ccctacctctagctactcta

SEQ ID NO: 35492 - DNA, 20 bp, Artificial Sequence
  sgRNA
  Olfr1020_13
tgatcaggaataatgcaaag

SEQ ID NO: 35493 - DNA, 20 bp, Artificial Sequence
  sgRNA
  Olfr1020_14
tgaggttcactagcatcttg

SEQ ID NO: 35494 - DNA, 20 bp, Artificial Sequence
  sgRNA
  Olfr1020_15
gatgacattgaaactggaga

SEQ ID NO: 35495 - DNA, 20 bp, Artificial Sequence
  sgRNA
  Olfr1020_16
ggaaccgaagaaaaagaact

SEQ ID NO: 35496 - DNA, 20 bp, Artificial Sequence
  sgRNA
  Olfr1020_17
ccatagagtagctagaggta

SEQ ID NO: 35497 - DNA, 20 bp, Artificial Sequence
  sgRNA
  Olfr1020_18
agatggtaacagccatgagg

SEQ ID NO: 35498 - DNA, 20 bp, Artificial Sequence
  sgRNA
  Olfr1020_19
attctcccagacatgagaac

SEQ ID NO: 35499 - DNA, 20 bp, Artificial Sequence
  sgRNA
  Olfr1020_20
acaactgatgacattgaaac

SEQ ID NO: 35500 - DNA, 20 bp, Artificial Sequence
  sgRNA
  Olfr1022_1
caagctagcatgataagagg

SEQ ID NO: 35501 - DNA, 20 bp, Artificial Sequence
  sgRNA
  Olfr1022_2
tgatcagcacaatcatacac

SEQ ID NO: 35502 - DNA, 20 bp, Artificial Sequence
  sgRNA
  Olfr1022_3
gaatccagcaacaacaaaca

SEQ ID NO: 35503 - DNA, 20 bp, Artificial Sequence
  sgRNA
  Olfr1022_4
aatggcactagaccattatg

SEQ ID NO: 35504 - DNA, 20 bp, Artificial Sequence
  sgRNA
  Olfr1022_5
atttaaagcctccatcagag

SEQ ID NO: 35505 - DNA, 20 bp, Artificial Sequence
  sgRNA
  Olfr1022_6
tgatggctgcaaaaatgtac

SEQ ID NO: 35506 - DNA, 20 bp, Artificial Sequence
  sgRNA
  Olfr1022_7
gctatgaaacaggtgatcaa

SEQ ID NO: 35507 - DNA, 20 bp, Artificial Sequence
  sgRNA
  Olfr1022_8
tgcagaacggatcctcatga

SEQ ID NO: 35508 - DNA, 20 bp, Artificial Sequence
  sgRNA
  Olfr1022_9
gagcaagctagcatgataag

SEQ ID NO: 35509 - DNA, 20 bp, Artificial Sequence
  sgRNA
  Olfr1022_10
tccatcagagaggtcaatag

SEQ ID NO: 35510 - DNA, 20 bp, Artificial Sequence
  sgRNA
  Olfr1022_11
tttgcctgccttctgcagaa

SEQ ID NO: 35511 - DNA, 20 bp, Artificial Sequence
  sgRNA
  Olfr1022_12
ctttaaatacatgcagaaaa

SEQ ID NO: 35512 - DNA, 20 bp, Artificial Sequence
  sgRNA
  Olfr1022_13
ctatgaaacaggtgatcaag

SEQ ID NO: 35513 - DNA, 20 bp, Artificial Sequence
  sgRNA
  Olfr1022_14
tccttaggctatagatcaaa

SEQ ID NO: 35514 - DNA, 20 bp, Artificial Sequence
  sgRNA
  Olfr1022_15
tgacactcacgttaaaaaga

SEQ ID NO: 35515 - DNA, 20 bp, Artificial Sequence
  sgRNA
  Olfr1022_16
gtaaaaaactgcaattactt

SEQ ID NO: 35516 - DNA, 20 bp, Artificial Sequence
  sgRNA
  Olfr1022_17
atgaggatccgttctgcaga

SEQ ID NO: 35517 - DNA, 20 bp, Artificial Sequence
  sgRNA
  Olfr1022_18
ggatccgttctgcagaaggc

SEQ ID NO: 35518 - DNA, 20 bp, Artificial Sequence
  sgRNA
  Olfr1022_19
gtgatggatttcattcttgt

SEQ ID NO: 35519 - DNA, 20 bp, Artificial Sequence
  sgRNA
  Olfr1022_20
tctattgacctctctgatgg

SEQ ID NO: 35520 - DNA, 20 bp, Artificial Sequence
  sgRNA
  Olfr1023_1
aagctagcatgatcagaggg

SEQ ID NO: 35521 - DNA, 20 bp, Artificial Sequence
  sgRNA
  Olfr1023_2
aatggcactagaccgttatg

SEQ ID NO: 35522 - DNA, 20 bp, Artificial Sequence
  sgRNA
  Olfr1023_3
aaagccagctaccacaaaca

SEQ ID NO: 35523 - DNA, 20 bp, Artificial Sequence
  sgRNA
  Olfr1023_4
tcaggaagccaaacacatat

SEQ ID NO: 35524 - DNA, 20 bp, Artificial Sequence
  sgRNA
  Olfr1023_5
ttgaggatccgttcagctaa

SEQ ID NO: 35525 - DNA, 20 bp, Artificial Sequence
  sgRNA
  Olfr1023_6
gagcaagctagcatgatcag

SEQ ID NO: 35526 - DNA, 20 bp, Artificial Sequence
  sgRNA
  Olfr1023_7
tttgccttcccttagctgaa

SEQ ID NO: 35527 - DNA, 20 bp, Artificial Sequence
  sgRNA
  Olfr1023_8
ggatccgttcagctaaggga

SEQ ID NO: 35528 - DNA, 20 bp, Artificial Sequence
  sgRNA
  Olfr1023_9
tgacactcatgtcaaaaaga

SEQ ID NO: 35529 - DNA, 20 bp, Artificial Sequence
  sgRNA
  Olfr1023_10
tcttaagtacatgcagaaaa

SEQ ID NO: 35530 - DNA, 20 bp, Artificial Sequence
  sgRNA
  Olfr1023_11
gcaagctagcatgatcagag

SEQ ID NO: 35531 - DNA, 20 bp, Artificial Sequence
  sgRNA
  Olfr1023_12
agatagaagaatgatagcaa

SEQ ID NO: 35532 - DNA, 20 bp, Artificial Sequence
  sgRNA
  Olfr1023_13
tctacagacttctctgatgg

SEQ ID NO: 35533 - DNA, 20 bp, Artificial Sequence
  sgRNA
  Olfr1023_14
gtcgcattcccatatgtgtt

SEQ ID NO: 35534 - DNA, 20 bp, Artificial Sequence
  sgRNA
  Olfr1023_15
atatggtgactgttgtcatg

SEQ ID NO: 35535 - DNA, 20 bp, Artificial Sequence
  sgRNA
  Olfr1023_16
atatagctatgaaaatgaaa

SEQ ID NO: 35536 - DNA, 20 bp, Artificial Sequence
  sgRNA
  Olfr1023_17
tggccaaggaagaaatacat

SEQ ID NO: 35537 - DNA, 20 bp, Artificial Sequence
  sgRNA
  Olfr1023_18
tccttaagctatagatcaag

SEQ ID NO: 35538 - DNA, 20 bp, Artificial Sequence
  sgRNA
  Olfr1023_19
tcttctacagacttctctga

SEQ ID NO: 35539 - DNA, 20 bp, Artificial Sequence
  sgRNA
  Olfr1023_20
agcaagctagcatgatcaga

SEQ ID NO: 35540 - DNA, 20 bp, Artificial Sequence
  sgRNA
  Olfr1028_1
aaagctcgctgatattaaca

SEQ ID NO: 35541 - DNA, 20 bp, Artificial Sequence
  sgRNA
  Olfr1028_2
ggagttctgggcgatctgtg

SEQ ID NO: 35542 - DNA, 20 bp, Artificial Sequence
  sgRNA
  Olfr1028_3
cttaggcaacatgggcatgg

SEQ ID NO: 35543 - DNA, 20 bp, Artificial Sequence
  sgRNA
  Olfr1028_4
tttacagaaggtcatactga

SEQ ID NO: 35544 - DNA, 20 bp, Artificial Sequence
  sgRNA
  Olfr1028_5
ggatcaaatcagctgaagga

SEQ ID NO: 35545 - DNA, 20 bp, Artificial Sequence
  sgRNA
  Olfr1028_6
tcaacagtcttgtcagtagg

SEQ ID NO: 35546 - DNA, 20 bp, Artificial Sequence
  sgRNA
  Olfr1028_7
attcagcagaggactcacaa

SEQ ID NO: 35547 - DNA, 20 bp, Artificial Sequence
  sgRNA
  Olfr1028_8
catgcccatgttgcctaaga

SEQ ID NO: 35548 - DNA, 20 bp, Artificial Sequence
  sgRNA
  Olfr1028_9
catggtggctctgattagac

SEQ ID NO: 35549 - DNA, 20 bp, Artificial Sequence
  sgRNA
  Olfr1028_10
aggccttgaagacaatactc

SEQ ID NO: 35550 - DNA, 20 bp, Artificial Sequence
  sgRNA
  Olfr1028_11
caaacagaaacaggacaaag

SEQ ID NO: 35551 - DNA, 20 bp, Artificial Sequence
  sgRNA
  Olfr1028_12
cgtcttaggcaacatgggca

SEQ ID NO: 35552 - DNA, 20 bp, Artificial Sequence
  sgRNA
  Olfr1028_13
gtttatattgtcaccgtctt

SEQ ID NO: 35553 - DNA, 20 bp, Artificial Sequence
  sgRNA
  Olfr1028_14
cagctcccttacaatcatcc

SEQ ID NO: 35554 - DNA, 20 bp, Artificial Sequence
  sgRNA
  Olfr1028_15
cacaaggcattctctacttg

SEQ ID NO: 35555 - DNA, 20 bp, Artificial Sequence
  sgRNA
  Olfr1028_16
atcagctgaaggaaggcaca

SEQ ID NO: 35556 - DNA, 20 bp, Artificial Sequence
  sgRNA
  Olfr1028_17
ttgcctgagtattgtcttca

SEQ ID NO: 35557 - DNA, 20 bp, Artificial Sequence
  sgRNA
  Olfr1028_18
caggatgattgtaagggagc

SEQ ID NO: 35558 - DNA, 20 bp, Artificial Sequence
  sgRNA
  Olfr1028_19
tgattgtaagggagctggaa

SEQ ID NO: 35559 - DNA, 20 bp, Artificial Sequence
  sgRNA
  Olfr1028_20
caatataaacaaacagaaac

SEQ ID NO: 35560 - DNA, 20 bp, Artificial Sequence
  sgRNA
  Olfr1029_1
tgttgcctaagacggtgaca

SEQ ID NO: 35561 - DNA, 20 bp, Artificial Sequence
  sgRNA
  Olfr1029_2
aaaaccagctgatattaaca

SEQ ID NO: 35562 - DNA, 20 bp, Artificial Sequence
  sgRNA
  Olfr1029_3
attggtcaacatctgtgggg

SEQ ID NO: 35563 - DNA, 20 bp, Artificial Sequence
  sgRNA
  Olfr1029_4
caagatagcttaataagtgg

SEQ ID NO: 35564 - DNA, 20 bp, Artificial Sequence
  sgRNA
  Olfr1029_5
tcaacagtcttgtcagtggg

SEQ ID NO: 35565 - DNA, 20 bp, Artificial Sequence
  sgRNA
  Olfr1029_6
atcagctgaaggaagacgca

SEQ ID NO: 35566 - DNA, 20 bp, Artificial Sequence
  sgRNA
  Olfr1029_7
attcagcagaggacttacaa

SEQ ID NO: 35567 - DNA, 20 bp, Artificial Sequence
  sgRNA
  Olfr1029_8
cttgatggctctgattagac

SEQ ID NO: 35568 - DNA, 20 bp, Artificial Sequence
  sgRNA
  Olfr1029_9
caagcccatgttgcctaaga

SEQ ID NO: 35569 - DNA, 20 bp, Artificial Sequence
  sgRNA
  Olfr1029_10
ttcttcaacagtcttgtcag

SEQ ID NO: 35570 - DNA, 20 bp, Artificial Sequence
  sgRNA
  Olfr1029_11
taaacagaaacaggacaaag

SEQ ID NO: 35571 - DNA, 20 bp, Artificial Sequence
  sgRNA
  Olfr1029_12
caactcccttacaatcatcc

SEQ ID NO: 35572 - DNA, 20 bp, Artificial Sequence
  sgRNA
  Olfr1029_13
cgcaaggcattctctacttg

SEQ ID NO: 35573 - DNA, 20 bp, Artificial Sequence
  sgRNA
  Olfr1029_14
cttaggcaacatgggcttga

SEQ ID NO: 35574 - DNA, 20 bp, Artificial Sequence
  sgRNA
  Olfr1029_15
caggatgattgtaagggagt

SEQ ID NO: 35575 - DNA, 20 bp, Artificial Sequence
  sgRNA
  Olfr1029_16
atttaccttgtcaccgtctt

SEQ ID NO: 35576 - DNA, 20 bp, Artificial Sequence
  sgRNA
  Olfr1029_17
caaggtaaataaacagaaac

SEQ ID NO: 35577 - DNA, 20 bp, Artificial Sequence
  sgRNA
  Olfr1031_1
catggaccaatgcaatgaag

SEQ ID NO: 35578 - DNA, 20 bp, Artificial Sequence
  sgRNA
  Olfr1031_2
tccagctacaacaagcatgg

SEQ ID NO: 35579 - DNA, 20 bp, Artificial Sequence
  sgRNA
  Olfr1031_3
gaaaatctggagcatctttg

SEQ ID NO: 35580 - DNA, 20 bp, Artificial Sequence
  sgRNA
  Olfr1031_4
atcttgctaccataaagcag

SEQ ID NO: 35581 - DNA, 20 bp, Artificial Sequence
  sgRNA
  Olfr1031_5
catggctagtgagacccagg

SEQ ID NO: 35582 - DNA, 20 bp, Artificial Sequence
  sgRNA
  Olfr1031_6
gtaagtgccccatacacata

SEQ ID NO: 35583 - DNA, 20 bp, Artificial Sequence
  sgRNA
  Olfr1031_7
agagaatttgaagctccaca

SEQ ID NO: 35584 - DNA, 20 bp, Artificial Sequence
  sgRNA
  Olfr1031_8
gttcaacatgggaatgacag

SEQ ID NO: 35585 - DNA, 20 bp, Artificial Sequence
  sgRNA
  Olfr1031_9
cattgtggccacagaaagcc

SEQ ID NO: 35586 - DNA, 20 bp, Artificial Sequence
  sgRNA
  Olfr1031_10
tgtgaaagaagcaataagca

SEQ ID NO: 35587 - DNA, 20 bp, Artificial Sequence
  sgRNA
  Olfr1031_11
tcttgctaccataaagcaga

SEQ ID NO: 35588 - DNA, 20 bp, Artificial Sequence
  sgRNA
  Olfr1031_12
ttagctctacagaaggcaag

SEQ ID NO: 35589 - DNA, 20 bp, Artificial Sequence
  sgRNA
  Olfr1031_13
atatgatgacagctgtcaga

SEQ ID NO: 35590 - DNA, 20 bp, Artificial Sequence
  sgRNA
  Olfr1031_14
acatatccacaaaggataag

SEQ ID NO: 35591 - DNA, 20 bp, Artificial Sequence
  sgRNA
  Olfr1031_15
atgcaatgaagaggtaacat

SEQ ID NO: 35592 - DNA, 20 bp, Artificial Sequence
  sgRNA
  Olfr1031_16
gagcatctttggggtcacat

SEQ ID NO: 35593 - DNA, 20 bp, Artificial Sequence
  sgRNA
  Olfr1031_17
gggtgtgtggagcctggcat

SEQ ID NO: 35594 - DNA, 20 bp, Artificial Sequence
  sgRNA
  Olfr1031_18
tcctcaggctgtaaatcatg

SEQ ID NO: 35595 - DNA, 20 bp, Artificial Sequence
  sgRNA
  Olfr1031_19
gtctgtggaacaaggtaaaa

SEQ ID NO: 35596 - DNA, 20 bp, Artificial Sequence
  sgRNA
  Olfr1031_20
atgttacctcttcattgcat

SEQ ID NO: 35597 - DNA, 20 bp, Artificial Sequence
  sgRNA
  Olfr1032_1
actgggcttaaccagcagaa

SEQ ID NO: 35598 - DNA, 20 bp, Artificial Sequence
  sgRNA
  Olfr1032_2
gcacaggccatcttgataag

SEQ ID NO: 35599 - DNA, 20 bp, Artificial Sequence
  sgRNA
  Olfr1032_3
aagtcgaatgcaaaccaccc

SEQ ID NO: 35600 - DNA, 20 bp, Artificial Sequence
  sgRNA
  Olfr1032_4
atttgtcatttgttgatgtg

SEQ ID NO: 35601 - DNA, 20 bp, Artificial Sequence
  sgRNA
  Olfr1032_5
gttcaacatggggatcacgg

SEQ ID NO: 35602 - DNA, 20 bp, Artificial Sequence
  sgRNA
  Olfr1032_6
caggccatcttgataagggg

SEQ ID NO: 35603 - DNA, 20 bp, Artificial Sequence
  sgRNA
  Olfr1032_7
ttatcaagatggcctgtgca

SEQ ID NO: 35604 - DNA, 20 bp, Artificial Sequence
  sgRNA
  Olfr1032_8
agatccaccccttatcaaga

SEQ ID NO: 35605 - DNA, 20 bp, Artificial Sequence
  sgRNA
  Olfr1032_9
ggacaaagtgattagccgaa

SEQ ID NO: 35606 - DNA, 20 bp, Artificial Sequence
  sgRNA
  Olfr1032_10
tgtgaggtgagacccacagg

SEQ ID NO: 35607 - DNA, 20 bp, Artificial Sequence
  sgRNA
  Olfr1032_11
gtaactgaatttattctact

SEQ ID NO: 35608 - DNA, 20 bp, Artificial Sequence
  sgRNA
  Olfr1032_12
tgcacaggccatcttgataa

SEQ ID NO: 35609 - DNA, 20 bp, Artificial Sequence
  sgRNA
  Olfr1032_13
gacaaagtgattagccgaaa

SEQ ID NO: 35610 - DNA, 20 bp, Artificial Sequence
  sgRNA
  Olfr1032_14
tcggctaatcactttgtcca

SEQ ID NO: 35611 - DNA, 20 bp, Artificial Sequence
  sgRNA
  Olfr1032_15
acacatcaacaaatgacaaa

SEQ ID NO: 35612 - DNA, 20 bp, Artificial Sequence
  sgRNA
  Olfr1032_16
tatacaatgattatacttgc

SEQ ID NO: 35613 - DNA, 20 bp, Artificial Sequence
  sgRNA
  Olfr1032_17
aaaatattacaactgctgtg

SEQ ID NO: 35614 - DNA, 20 bp, Artificial Sequence
  sgRNA
  Olfr1032_18
caaggatgtcaaagaagcca

SEQ ID NO: 35615 - DNA, 20 bp, Artificial Sequence
  sgRNA
  Olfr1032_19
tcctcagactgtagatcatg

SEQ ID NO: 35616 - DNA, 20 bp, Artificial Sequence
  sgRNA
  Olfr1032_20
caacaaatgacaaatggctc

SEQ ID NO: 35617 - DNA, 20 bp, Artificial Sequence
  sgRNA
  Olfr1033_1
gcacaggccatcttgatgag

SEQ ID NO: 35618 - DNA, 20 bp, Artificial Sequence
  sgRNA
  Olfr1033_2
acacatcaataaatgacaaa

SEQ ID NO: 35619 - DNA, 20 bp, Artificial Sequence
  sgRNA
  Olfr1033_3
agatccacccctcatcaaga

SEQ ID NO: 35620 - DNA, 20 bp, Artificial Sequence
  sgRNA
  Olfr1033_4
tgtaaggtgagatccacagg

SEQ ID NO: 35621 - DNA, 20 bp, Artificial Sequence
  sgRNA
  Olfr1033_5
attcaacatggggatcactg

SEQ ID NO: 35622 - DNA, 20 bp, Artificial Sequence
  sgRNA
  Olfr1033_6
tcatcaagatggcctgtgca

SEQ ID NO: 35623 - DNA, 20 bp, Artificial Sequence
  sgRNA
  Olfr1033_7
tatacaatgctatttcttgc

SEQ ID NO: 35624 - DNA, 20 bp, Artificial Sequence
  sgRNA
  Olfr1033_8
cttggcaatcactttgtcca

SEQ ID NO: 35625 - DNA, 20 bp, Artificial Sequence
  sgRNA
  Olfr1033_9
gtagatcatgggattcaaca

SEQ ID NO: 35626 - DNA, 20 bp, Artificial Sequence
  sgRNA
  Olfr1033_10
tgcacaggccatcttgatga

SEQ ID NO: 35627 - DNA, 20 bp, Artificial Sequence
  sgRNA
  Olfr1033_11
atttgtcatttattgatgtg

SEQ ID NO: 35628 - DNA, 20 bp, Artificial Sequence
  sgRNA
  Olfr1033_12
ggatctcaccttacagcagt

SEQ ID NO: 35629 - DNA, 20 bp, Artificial Sequence
  sgRNA
  Olfr1033_13
caggccatcttgatgagggg

SEQ ID NO: 35630 - DNA, 20 bp, Artificial Sequence
  sgRNA
  Olfr1033_14
caaggatgtcaaggaagcca

SEQ ID NO: 35631 - DNA, 20 bp, Artificial Sequence
  sgRNA
  Olfr1033_15
ggctcaagaaaaagtacatt

SEQ ID NO: 35632 - DNA, 20 bp, Artificial Sequence
  sgRNA
  Olfr1033_16
atcccatgatctacagtctg

SEQ ID NO: 35633 - DNA, 20 bp, Artificial Sequence
  sgRNA
  Olfr1033_17
aaaatatgccaactgctgta

SEQ ID NO: 35634 - DNA, 20 bp, Artificial Sequence
  sgRNA
  Olfr1033_18
tgctgtaaggtgagatccac

SEQ ID NO: 35635 - DNA, 20 bp, Artificial Sequence
  sgRNA
  Olfr1033_19
ttcttctggttaatcccaaa

SEQ ID NO: 35636 - DNA, 20 bp, Artificial Sequence
  sgRNA
  Olfr1033_20
agatcatgggattcaacatg

SEQ ID NO: 35637 - DNA, 20 bp, Artificial Sequence
  sgRNA
  Olfr1034_1
tacataggactctgaagctg

SEQ ID NO: 35638 - DNA, 20 bp, Artificial Sequence
  sgRNA
  Olfr1034_2
tttcattgctctggtgcacg

SEQ ID NO: 35639 - DNA, 20 bp, Artificial Sequence
  sgRNA
  Olfr1034_3
cataaggcacagaaatgagg

SEQ ID NO: 35640 - DNA, 20 bp, Artificial Sequence
  sgRNA
  Olfr1034_4
ccacaggcaatcttgatgag

SEQ ID NO: 35641 - DNA, 20 bp, Artificial Sequence
  sgRNA
  Olfr1034_5
catgtatctgagaagaccaa

SEQ ID NO: 35642 - DNA, 20 bp, Artificial Sequence
  sgRNA
  Olfr1034_6
gtatctgagaagaccaacgg

SEQ ID NO: 35643 - DNA, 20 bp, Artificial Sequence
  sgRNA
  Olfr1034_7
gcatgcactcagctgatggc

SEQ ID NO: 35644 - DNA, 20 bp, Artificial Sequence
  sgRNA
  Olfr1034_8
cattgctctggtgcacgtgg

SEQ ID NO: 35645 - DNA, 20 bp, Artificial Sequence
  sgRNA
  Olfr1034_9
ttacgcatgcactcagctga

SEQ ID NO: 35646 - DNA, 20 bp, Artificial Sequence
  sgRNA
  Olfr1034_10
gatggcctttgatcgctaca

SEQ ID NO: 35647 - DNA, 20 bp, Artificial Sequence
  sgRNA
  Olfr1034_11
agaaaggcattctctacctg

SEQ ID NO: 35648 - DNA, 20 bp, Artificial Sequence
  sgRNA
  Olfr1034_12
cttcacgtattccttgtcag

SEQ ID NO: 35649 - DNA, 20 bp, Artificial Sequence
  sgRNA
  Olfr1034_13
tgtggagcagggaaagatgg

SEQ ID NO: 35650 - DNA, 20 bp, Artificial Sequence
  sgRNA
  Olfr1034_14
gatggccatgtagcgatcaa

SEQ ID NO: 35651 - DNA, 20 bp, Artificial Sequence
  sgRNA
  Olfr1034_15
agtctacaagatagttgcca

SEQ ID NO: 35652 - DNA, 20 bp, Artificial Sequence
  sgRNA
  Olfr1034_16
gcacgtggaggtctatattc

SEQ ID NO: 35653 - DNA, 20 bp, Artificial Sequence
  sgRNA
  Olfr1034_17
acaaaaacaatttcttatgt

SEQ ID NO: 35654 - DNA, 20 bp, Artificial Sequence
  sgRNA
  Olfr1034_18
aagaccaacggaggagtctg

SEQ ID NO: 35655 - DNA, 20 bp, Artificial Sequence
  sgRNA
  Olfr1034_19
acactacaaaaaagagaacc

SEQ ID NO: 35656 - DNA, 20 bp, Artificial Sequence
  sgRNA
  Olfr1034_20
ctcagctgatggcaggagaa

SEQ ID NO: 35657 - DNA, 20 bp, Artificial Sequence
  sgRNA
  Olfr1036_1
gatggccttcgatcgctacg

SEQ ID NO: 35658 - DNA, 20 bp, Artificial Sequence
  sgRNA
  Olfr1036_2
acaccacaaaaaagagaacc

SEQ ID NO: 35659 - DNA, 20 bp, Artificial Sequence
  sgRNA
  Olfr1036_3
gaggcggatacagacaaccc

SEQ ID NO: 35660 - DNA, 20 bp, Artificial Sequence
  sgRNA
  Olfr1036_4
acataggactctgaagctgc

SEQ ID NO: 35661 - DNA, 20 bp, Artificial Sequence
  sgRNA
  Olfr1036_5
tgttaagtgggatccacagg

SEQ ID NO: 35662 - DNA, 20 bp, Artificial Sequence
  sgRNA
  Olfr1036_6
cattgctctggtgctcgtgg

SEQ ID NO: 35663 - DNA, 20 bp, Artificial Sequence
  sgRNA
  Olfr1036_7
gtatctgagaaggccaacgg

SEQ ID NO: 35664 - DNA, 20 bp, Artificial Sequence
  sgRNA
  Olfr1036_8
cttcacatattccttgtcag

SEQ ID NO: 35665 - DNA, 20 bp, Artificial Sequence
  sgRNA
  Olfr1036_9
catgtatctgagaaggccaa

SEQ ID NO: 35666 - DNA, 20 bp, Artificial Sequence
  sgRNA
  Olfr1036_10
gatggccacgtagcgatcga

SEQ ID NO: 35667 - DNA, 20 bp, Artificial Sequence
  sgRNA
  Olfr1036_11
agctgtgttacgcatgcact

SEQ ID NO: 35668 - DNA, 20 bp, Artificial Sequence
  sgRNA
  Olfr1036_12
agaaaggcattctccacctg

SEQ ID NO: 35669 - DNA, 20 bp, Artificial Sequence
  sgRNA
  Olfr1036_13
gcatgcactcggctgatggc

SEQ ID NO: 35670 - DNA, 20 bp, Artificial Sequence
  sgRNA
  Olfr1036_14
tttcattgctctggtgctcg

SEQ ID NO: 35671 - DNA, 20 bp, Artificial Sequence
  sgRNA
  Olfr1036_15
agtctgcaagatagttgcca

SEQ ID NO: 35672 - DNA, 20 bp, Artificial Sequence
  sgRNA
  Olfr1036_16
ttacgcatgcactcggctga

SEQ ID NO: 35673 - DNA, 20 bp, Artificial Sequence
  sgRNA
  Olfr1036_17
ggtgttcttggttgtttaca

SEQ ID NO: 35674 - DNA, 20 bp, Artificial Sequence
  sgRNA
  Olfr1036_18
tcatattcatgtatctgaga

SEQ ID NO: 35675 - DNA, 20 bp, Artificial Sequence
  sgRNA
  Olfr1036_19
ctcggctgatggcaggagaa

SEQ ID NO: 35676 - DNA, 20 bp, Artificial Sequence
  sgRNA
  Olfr1036_20
tcaaaaactatttcttatgt

SEQ ID NO: 35677 - DNA, 20 bp, Artificial Sequence
  sgRNA
  Olfr1038-ps_1
tccacaatatgtcaagcgaa

SEQ ID NO: 35678 - DNA, 20 bp, Artificial Sequence
  sgRNA
  Olfr1038-ps_2
ggatggcagcaatgataaag

SEQ ID NO: 35679 - DNA, 20 bp, Artificial Sequence
  sgRNA
  Olfr1038-ps_3
gcccaaatccaaccattccc

SEQ ID NO: 35680 - DNA, 20 bp, Artificial Sequence
  sgRNA
  Olfr1038-ps_4
ggtagagcggattctcagga

SEQ ID NO: 35681 - DNA, 20 bp, Artificial Sequence
  sgRNA
  Olfr1038-ps_5
ccagctgtgttgcacaagca

SEQ ID NO: 35682 - DNA, 20 bp, Artificial Sequence
  sgRNA
  Olfr1038-ps_6
tgattatgacaatcaaccca

SEQ ID NO: 35683 - DNA, 20 bp, Artificial Sequence
  sgRNA
  Olfr1038-ps_7
catgcttgtgcaacacagct

SEQ ID NO: 35684 - DNA, 20 bp, Artificial Sequence
  sgRNA
  Olfr1038-ps_8
ctacagtcttaggaacaaag

SEQ ID NO: 35685 - DNA, 20 bp, Artificial Sequence
  sgRNA
  Olfr1038-ps_9
gtgttgcacaagcatggaaa

SEQ ID NO: 35686 - DNA, 20 bp, Artificial Sequence
  sgRNA
  Olfr1038-ps_10
aaagctgtacacataaggaa

SEQ ID NO: 35687 - DNA, 20 bp, Artificial Sequence
  sgRNA
  Olfr1038-ps_11
tcaaaaacatcacaaaacat

SEQ ID NO: 35688 - DNA, 20 bp, Artificial Sequence
  sgRNA
  Olfr1038-ps_12
ctctacctgcggctcccaca

SEQ ID NO: 35689 - DNA, 20 bp, Artificial Sequence
  sgRNA
  Olfr1038-ps_13
ctctacccagggaagacgca

SEQ ID NO: 35690 - DNA, 20 bp, Artificial Sequence
  sgRNA
  Olfr1038-ps_14
catcagtgttgaataatgca

SEQ ID NO: 35691 - DNA, 20 bp, Artificial Sequence
  sgRNA
  Olfr1038-ps_15
atagcgatcataggccatag

SEQ ID NO: 35692 - DNA, 20 bp, Artificial Sequence
  sgRNA
  Olfr1038-ps_16
ctgagaatccgctctaccca

SEQ ID NO: 35693 - DNA, 20 bp, Artificial Sequence
  sgRNA
  Olfr1038-ps_17
agatgcctctaagaaagctt

SEQ ID NO: 35694 - DNA, 20 bp, Artificial Sequence
  sgRNA
  Olfr1038-ps_18
gagcaggacagagctaagag

SEQ ID NO: 35695 - DNA, 20 bp, Artificial Sequence
  sgRNA
  Olfr1038-ps_19
gatggccttgcgtcttccct

SEQ ID NO: 35696 - DNA, 20 bp, Artificial Sequence
  sgRNA
  Olfr1038-ps_20
ggaggtgagaactatggaag

SEQ ID NO: 35697 - DNA, 20 bp, Artificial Sequence
  sgRNA
  Olfr1039_1
gatgaaacagcaaacctgag

SEQ ID NO: 35698 - DNA, 20 bp, Artificial Sequence
  sgRNA
  Olfr1039_2
atgaggaccacatagaggag

SEQ ID NO: 35699 - DNA, 20 bp, Artificial Sequence
  sgRNA
  Olfr1039_3
agaaatcaacgaatgccaag

SEQ ID NO: 35700 - DNA, 20 bp, Artificial Sequence
  sgRNA
  Olfr1039_4
aacaggccagagcaactaag

SEQ ID NO: 35701 - DNA, 20 bp, Artificial Sequence
  sgRNA
  Olfr1039_5
tttctcaaactatagatcag

SEQ ID NO: 35702 - DNA, 20 bp, Artificial Sequence
  sgRNA
  Olfr1039_6
ctatagtttgagaaataagg

SEQ ID NO: 35703 - DNA, 20 bp, Artificial Sequence
  sgRNA
  Olfr1039_7
catgaggaccacatagagga

SEQ ID NO: 35704 - DNA, 20 bp, Artificial Sequence
  sgRNA
  Olfr1039_8
gcatgaggaccacatagagg

SEQ ID NO: 35705 - DNA, 20 bp, Artificial Sequence
  sgRNA
  Olfr1039_9
tagatcagcggatttaacat

SEQ ID NO: 35706 - DNA, 20 bp, Artificial Sequence
  sgRNA
  Olfr1039_10
atagaggagggggttccaga

SEQ ID NO: 35707 - DNA, 20 bp, Artificial Sequence
  sgRNA
  Olfr1039_11
taggcatgaggaccacatag

SEQ ID NO: 35708 - DNA, 20 bp, Artificial Sequence
  sgRNA
  Olfr1039_12
tgaggaccacatagaggagg

SEQ ID NO: 35709 - DNA, 20 bp, Artificial Sequence
  sgRNA
  Olfr1039_13
agactttctggaatcatgga

SEQ ID NO: 35710 - DNA, 20 bp, Artificial Sequence
  sgRNA
  Olfr1039_14
aatgattgttccataaaata

SEQ ID NO: 35711 - DNA, 20 bp, Artificial Sequence
  sgRNA
  Olfr1039_15
atagatcagcggatttaaca

SEQ ID NO: 35712 - DNA, 20 bp, Artificial Sequence
  sgRNA
  Olfr1039_16
gactagaaacacagcaaaga

SEQ ID NO: 35713 - DNA, 20 bp, Artificial Sequence
  sgRNA
  Olfr1039_17
aattgtgtttggagtgactg

SEQ ID NO: 35714 - DNA, 20 bp, Artificial Sequence
  sgRNA
  Olfr1039_18
ctggaaccccctcctctatg

SEQ ID NO: 35715 - DNA, 20 bp, Artificial Sequence
  sgRNA
  Olfr1039_19
gatctatagtttgagaaata

SEQ ID NO: 35716 - DNA, 20 bp, Artificial Sequence
  sgRNA
  Olfr1039_20
agaaagtttataattgtgtt

SEQ ID NO: 35717 - DNA, 20 bp, Artificial Sequence
  sgRNA
  Olfr1040_1
aacaggcaagagcaattaag

SEQ ID NO: 35718 - DNA, 20 bp, Artificial Sequence
  sgRNA
  Olfr1040_2
aattgtgcttggagtgactg

SEQ ID NO: 35719 - DNA, 20 bp, Artificial Sequence
  sgRNA
  Olfr1040_3
atgaggaccacatagagcag

SEQ ID NO: 35720 - DNA, 20 bp, Artificial Sequence
  sgRNA
  Olfr1040_4
gataaaacagcaaacctgag

SEQ ID NO: 35721 - DNA, 20 bp, Artificial Sequence
  sgRNA
  Olfr1040_5
ggtcatctgtcaggcctacg

SEQ ID NO: 35722 - DNA, 20 bp, Artificial Sequence
  sgRNA
  Olfr1040_6
tgaggaccacatagagcaga

SEQ ID NO: 35723 - DNA, 20 bp, Artificial Sequence
  sgRNA
  Olfr1040_7
gtacatcagttcatcctcgt

SEQ ID NO: 35724 - DNA, 20 bp, Artificial Sequence
  sgRNA
  Olfr1040_8
ctacagcttgagaaatcagg

SEQ ID NO: 35725 - DNA, 20 bp, Artificial Sequence
  sgRNA
  Olfr1040_9
tgaccagaaacacagcaaag

SEQ ID NO: 35726 - DNA, 20 bp, Artificial Sequence
  sgRNA
  Olfr1040_10
gccacagaatgagaagtgga

SEQ ID NO: 35727 - DNA, 20 bp, Artificial Sequence
  sgRNA
  Olfr1040_11
atagagcagagggttccaga

SEQ ID NO: 35728 - DNA, 20 bp, Artificial Sequence
  sgRNA
  Olfr1040_12
aacagaacgaattctcagga

SEQ ID NO: 35729 - DNA, 20 bp, Artificial Sequence
  sgRNA
  Olfr1040_13
tgtggggcttgttcaggcag

SEQ ID NO: 35730 - DNA, 20 bp, Artificial Sequence
  sgRNA
  Olfr1040_14
gaacaggcaagagcaattaa

SEQ ID NO: 35731 - DNA, 20 bp, Artificial Sequence
  sgRNA
  Olfr1040_15
tatggtgatggaagtcagat

SEQ ID NO: 35732 - DNA, 20 bp, Artificial Sequence
  sgRNA
  Olfr1040_16
atatggtgatggaagtcaga

SEQ ID NO: 35733 - DNA, 20 bp, Artificial Sequence
  sgRNA
  Olfr1040_17
accttccacttctcattctg

SEQ ID NO: 35734 - DNA, 20 bp, Artificial Sequence
  sgRNA
  Olfr1040_18
ctggaaccctctgctctatg

SEQ ID NO: 35735 - DNA, 20 bp, Artificial Sequence
  sgRNA
  Olfr1040_19
cttcaacagaacgaattctc

SEQ ID NO: 35736 - DNA, 20 bp, Artificial Sequence
  sgRNA
  Olfr1040_20
tagagccacagaatgagaag

SEQ ID NO: 35737 - DNA, 20 bp, Artificial Sequence
  sgRNA
  Olfr1042_1
gacaaagcagcacaactgag

SEQ ID NO: 35738 - DNA, 20 bp, Artificial Sequence
  sgRNA
  Olfr1042_2
ctggaatcccctcctctatg

SEQ ID NO: 35739 - DNA, 20 bp, Artificial Sequence
  sgRNA
  Olfr1042_3
aaagtcaataaaagccaggt

SEQ ID NO: 35740 - DNA, 20 bp, Artificial Sequence
  sgRNA
  Olfr1042_4
catctacctaactagtgttg

SEQ ID NO: 35741 - DNA, 20 bp, Artificial Sequence
  sgRNA
  Olfr1042_5
agtcatctgtgagccccaca

SEQ ID NO: 35742 - DNA, 20 bp, Artificial Sequence
  sgRNA
  Olfr1042_6
tgtcaatcatggcctatgac

SEQ ID NO: 35743 - DNA, 20 bp, Artificial Sequence
  sgRNA
  Olfr1042_7
gagcttcaggtcagtctctt

SEQ ID NO: 35744 - DNA, 20 bp, Artificial Sequence
  sgRNA
  Olfr1042_8
catgcggaccgcatagagga

SEQ ID NO: 35745 - DNA, 20 bp, Artificial Sequence
  sgRNA
  Olfr1042_9
ctatgcggtccgcatgccta

SEQ ID NO: 35746 - DNA, 20 bp, Artificial Sequence
  sgRNA
  Olfr1042_10
ggttaggaaaaaatacatgg

SEQ ID NO: 35747 - DNA, 20 bp, Artificial Sequence
  sgRNA
  Olfr1042_11
tgtctgagttcatccttgtg

SEQ ID NO: 35748 - DNA, 20 bp, Artificial Sequence
  sgRNA
  Olfr1042_12
atagaggaggggattccaga

SEQ ID NO: 35749 - DNA, 20 bp, Artificial Sequence
  sgRNA
  Olfr1042_13
atgcggaccgcatagaggag

SEQ ID NO: 35750 - DNA, 20 bp, Artificial Sequence
  sgRNA
  Olfr1042_14
cattacccacaacactagtt

SEQ ID NO: 35751 - DNA, 20 bp, Artificial Sequence
  sgRNA
  Olfr1042_15
gcatgcggaccgcatagagg

SEQ ID NO: 35752 - DNA, 20 bp, Artificial Sequence
  sgRNA
  Olfr1042_16
ttctgtcactccaaacactc

SEQ ID NO: 35753 - DNA, 20 bp, Artificial Sequence
  sgRNA
  Olfr1042_17
aaaagtcaataaaagccagg

SEQ ID NO: 35754 - DNA, 20 bp, Artificial Sequence
  sgRNA
  Olfr1042_18
agtgtctgagttcatccttg

SEQ ID NO: 35755 - DNA, 20 bp, Artificial Sequence
  sgRNA
  Olfr1042_19
agaaaattcaccagagtgtt

SEQ ID NO: 35756 - DNA, 20 bp, Artificial Sequence
  sgRNA
  Olfr1042_20
taggcatgcggaccgcatag

SEQ ID NO: 35757 - DNA, 20 bp, Artificial Sequence
  sgRNA
  Olfr1045_1
atgtgagcgacaccaacaga

SEQ ID NO: 35758 - DNA, 20 bp, Artificial Sequence
  sgRNA
  Olfr1045_2
gaatgtgccactcagctggg

SEQ ID NO: 35759 - DNA, 20 bp, Artificial Sequence
  sgRNA
  Olfr1045_3
taaagactacagtttctgga

SEQ ID NO: 35760 - DNA, 20 bp, Artificial Sequence
  sgRNA
  Olfr1045_4
ataagacacagagaacacac

SEQ ID NO: 35761 - DNA, 20 bp, Artificial Sequence
  sgRNA
  Olfr1045_5
ggcacattcgtagtataaag

SEQ ID NO: 35762 - DNA, 20 bp, Artificial Sequence
  sgRNA
  Olfr1045_6
gtggaacctgaagttctgga

SEQ ID NO: 35763 - DNA, 20 bp, Artificial Sequence
  sgRNA
  Olfr1045_7
gaccaaggtgtaaaacacag

SEQ ID NO: 35764 - DNA, 20 bp, Artificial Sequence
  sgRNA
  Olfr1045_8
gtgtcgctcacatacttcta

SEQ ID NO: 35765 - DNA, 20 bp, Artificial Sequence
  sgRNA
  Olfr1045_9
ctaaggatccgttcagcaga

SEQ ID NO: 35766 - DNA, 20 bp, Artificial Sequence
  sgRNA
  Olfr1045_10
tcttatcagtatctagtgag

SEQ ID NO: 35767 - DNA, 20 bp, Artificial Sequence
  sgRNA
  Olfr1045_11
catcacatgtgaagcacagg

SEQ ID NO: 35768 - DNA, 20 bp, Artificial Sequence
  sgRNA
  Olfr1045_12
cacacaggatgaaacgacaa

SEQ ID NO: 35769 - DNA, 20 bp, Artificial Sequence
  sgRNA
  Olfr1045_13
gtcactgagttcattcttgt

SEQ ID NO: 35770 - DNA, 20 bp, Artificial Sequence
  sgRNA
  Olfr1045_14
actaggaagacaaagaaaag

SEQ ID NO: 35771 - DNA, 20 bp, Artificial Sequence
  sgRNA
  Olfr1045_15
ctacgaatgtgccactcagc

SEQ ID NO: 35772 - DNA, 20 bp, Artificial Sequence
  sgRNA
  Olfr1045_16
ctatactcatggaaaagaac

SEQ ID NO: 35773 - DNA, 20 bp, Artificial Sequence
  sgRNA
  Olfr1045_17
tgtcatgaatctctttaaag

SEQ ID NO: 35774 - DNA, 20 bp, Artificial Sequence
  sgRNA
  Olfr1045_18
gttcagcattgggatgacca

SEQ ID NO: 35775 - DNA, 20 bp, Artificial Sequence
  sgRNA
  Olfr1045_19
cttctgctgaacggatcctt

SEQ ID NO: 35776 - DNA, 20 bp, Artificial Sequence
  sgRNA
  Olfr1045_20
acatcgtgttgtctatccta

SEQ ID NO: 35777 - DNA, 20 bp, Artificial Sequence
  sgRNA
  Olfr1046_1
tggcaggaaaagtacgttgg

SEQ ID NO: 35778 - DNA, 20 bp, Artificial Sequence
  sgRNA
  Olfr1046_2
ggtcataagccatggctgag

SEQ ID NO: 35779 - DNA, 20 bp, Artificial Sequence
  sgRNA
  Olfr1046_3
aacagagcagagatatcaga

SEQ ID NO: 35780 - DNA, 20 bp, Artificial Sequence
  sgRNA
  Olfr1046_4
agttataggtccaaaaatga

SEQ ID NO: 35781 - DNA, 20 bp, Artificial Sequence
  sgRNA
  Olfr1046_5
ggatgaactccaaggagggg

SEQ ID NO: 35782 - DNA, 20 bp, Artificial Sequence
  sgRNA
  Olfr1046_6
tcatggcaggaaaagtacgt

SEQ ID NO: 35783 - DNA, 20 bp, Artificial Sequence
  sgRNA
  Olfr1046_7
tctcaggatgaactccaagg

SEQ ID NO: 35784 - DNA, 20 bp, Artificial Sequence
  sgRNA
  Olfr1046_8
atgatgatcacatagagaag

SEQ ID NO: 35785 - DNA, 20 bp, Artificial Sequence
  sgRNA
  Olfr1046_9
gactagtgtataaaacacag

SEQ ID NO: 35786 - DNA, 20 bp, Artificial Sequence
  sgRNA
  Olfr1046_10
tgtcagatgagagctgcacg

SEQ ID NO: 35787 - DNA, 20 bp, Artificial Sequence
  sgRNA
  Olfr1046_11
gaacagagcagagatatcag

SEQ ID NO: 35788 - DNA, 20 bp, Artificial Sequence
  sgRNA
  Olfr1046_12
tcaggatgaactccaaggag

SEQ ID NO: 35789 - DNA, 20 bp, Artificial Sequence
  sgRNA
  Olfr1046_13
ctcaggatgaactccaagga

SEQ ID NO: 35790 - DNA, 20 bp, Artificial Sequence
  sgRNA
  Olfr1046_14
cagctctcatctgacagtag

SEQ ID NO: 35791 - DNA, 20 bp, Artificial Sequence
  sgRNA
  Olfr1046_15
aattctcaggatgaactcca

SEQ ID NO: 35792 - DNA, 20 bp, Artificial Sequence
  sgRNA
  Olfr1046_16
actgtttatcctctcagcca

SEQ ID NO: 35793 - DNA, 20 bp, Artificial Sequence
  sgRNA
  Olfr1046_17
tatatcaatggattgagcat

SEQ ID NO: 35794 - DNA, 20 bp, Artificial Sequence
  sgRNA
  Olfr1046_18
atagagaagaggtttgcaga

SEQ ID NO: 35795 - DNA, 20 bp, Artificial Sequence
  sgRNA
  Olfr1046_19
tgtctcaggaaaaagtacat

SEQ ID NO: 35796 - DNA, 20 bp, Artificial Sequence
  sgRNA
  Olfr1046_20
gctgcacgtggagaaggctt

SEQ ID NO: 35797 - DNA, 20 bp, Artificial Sequence
  sgRNA
  Olfr1047_1
gagaaatagtccaaacaatg

SEQ ID NO: 35798 - DNA, 20 bp, Artificial Sequence
  sgRNA
  Olfr1047_2
ttgtagcttggagtccactg

SEQ ID NO: 35799 - DNA, 20 bp, Artificial Sequence
  sgRNA
  Olfr1047_3
tgtgtatctgagcagagcag

SEQ ID NO: 35800 - DNA, 20 bp, Artificial Sequence
  sgRNA
  Olfr1047_4
aaagttatgttgggtactag

SEQ ID NO: 35801 - DNA, 20 bp, Artificial Sequence
  sgRNA
  Olfr1047_5
tcttggttattctacatccg

SEQ ID NO: 35802 - DNA, 20 bp, Artificial Sequence
  sgRNA
  Olfr1047_6
gagcagagcagaggtaacaa

SEQ ID NO: 35803 - DNA, 20 bp, Artificial Sequence
  sgRNA
  Olfr1047_7
ataatgacagtatagagcaa

SEQ ID NO: 35804 - DNA, 20 bp, Artificial Sequence
  sgRNA
  Olfr1047_8
tcatcctcatagccattgtg

SEQ ID NO: 35805 - DNA, 20 bp, Artificial Sequence
  sgRNA
  Olfr1047_9
agacaatgactactgtcagg

SEQ ID NO: 35806 - DNA, 20 bp, Artificial Sequence
  sgRNA
  Olfr1047_10
tgaactctgctgagggcagg

SEQ ID NO: 35807 - DNA, 20 bp, Artificial Sequence
  sgRNA
  Olfr1047_11
gtgaggatgaactctgctga

SEQ ID NO: 35808 - DNA, 20 bp, Artificial Sequence
  sgRNA
  Olfr1047_12
agcagagcagaggtaacaag

SEQ ID NO: 35809 - DNA, 20 bp, Artificial Sequence
  sgRNA
  Olfr1047_13
gcttggagtccactgtggtg

SEQ ID NO: 35810 - DNA, 20 bp, Artificial Sequence
  sgRNA
  Olfr1047_14
tttctcaaactatatatcaa

SEQ ID NO: 35811 - DNA, 20 bp, Artificial Sequence
  sgRNA
  Olfr1047_15
atagagcaaaggcttacaga

SEQ ID NO: 35812 - DNA, 20 bp, Artificial Sequence
  sgRNA
  Olfr1047_16
atggggcctgaagctcaggg

SEQ ID NO: 35813 - DNA, 20 bp, Artificial Sequence
  sgRNA
  Olfr1047_17
ggatgagcaggtaagacaca

SEQ ID NO: 35814 - DNA, 20 bp, Artificial Sequence
  sgRNA
  Olfr1047_18
ggcttccatattctacacac

SEQ ID NO: 35815 - DNA, 20 bp, Artificial Sequence
  sgRNA
  Olfr1047_19
catgatcatcctcaccacag

SEQ ID NO: 35816 - DNA, 20 bp, Artificial Sequence
  sgRNA
  Olfr1047_20
atctatctaatttcactgat

SEQ ID NO: 35817 - DNA, 20 bp, Artificial Sequence
  sgRNA
  Olfr1048_1
ttctgacaagaattacacac

SEQ ID NO: 35818 - DNA, 20 bp, Artificial Sequence
  sgRNA
  Olfr1048_2
aacacagtaaaagtaacata

SEQ ID NO: 35819 - DNA, 20 bp, Artificial Sequence
  sgRNA
  Olfr1048_3
gtgaaggcgagagtccaact

SEQ ID NO: 35820 - DNA, 20 bp, Artificial Sequence
  sgRNA
  Olfr1048_4
agacgctgtcatgttctggt

SEQ ID NO: 35821 - DNA, 20 bp, Artificial Sequence
  sgRNA
  Olfr1048_5
tttactgtgttcaaatgcaa

SEQ ID NO: 35822 - DNA, 20 bp, Artificial Sequence
  sgRNA
  Olfr1048_6
tgtctgataaaataatacat

SEQ ID NO: 35823 - DNA, 20 bp, Artificial Sequence
  sgRNA
  Olfr1048_7
aatgtagaatgccatctgca

SEQ ID NO: 35824 - DNA, 20 bp, Artificial Sequence
  sgRNA
  Olfr1048_8
atatggccagtagaataaga

SEQ ID NO: 35825 - DNA, 20 bp, Artificial Sequence
  sgRNA
  Olfr1048_9
gtagagcagaggattgcaga

SEQ ID NO: 35826 - DNA, 20 bp, Artificial Sequence
  sgRNA
  Olfr1048_10
ctatgcttgtgccgtgcaga

SEQ ID NO: 35827 - DNA, 20 bp, Artificial Sequence
  sgRNA
  Olfr1048_11
tactagttatcatcacagct

SEQ ID NO: 35828 - DNA, 20 bp, Artificial Sequence
  sgRNA
  Olfr1048_12
tgtcatttaccccaagatga

SEQ ID NO: 35829 - DNA, 20 bp, Artificial Sequence
  sgRNA
  Olfr1048_13
tttctaaagctgtagatcaa

SEQ ID NO: 35830 - DNA, 20 bp, Artificial Sequence
  sgRNA
  Olfr1048_14
aagatactaagactacaaag

SEQ ID NO: 35831 - DNA, 20 bp, Artificial Sequence
  sgRNA
  Olfr1048_15
tactaagactacaaagaggg

SEQ ID NO: 35832 - DNA, 20 bp, Artificial Sequence
  sgRNA
  Olfr1048_16
agatactaagactacaaaga

SEQ ID NO: 35833 - DNA, 20 bp, Artificial Sequence
  sgRNA
  Olfr1048_17
ggcgtcttcatagtcatcta

SEQ ID NO: 35834 - DNA, 20 bp, Artificial Sequence
  sgRNA
  Olfr1048_18
caaaatttaccatcatcttg

SEQ ID NO: 35835 - DNA, 20 bp, Artificial Sequence
  sgRNA
  Olfr1048_19
tatagaatgcattctgcaga

SEQ ID NO: 35836 - DNA, 20 bp, Artificial Sequence
  sgRNA
  Olfr1048_20
atgattgcactgtagagcag

SEQ ID NO: 35837 - DNA, 20 bp, Artificial Sequence
  sgRNA
  Olfr1049_1
aatgaagcatgccatttgtg

SEQ ID NO: 35838 - DNA, 20 bp, Artificial Sequence
  sgRNA
  Olfr1049_2
cggtgattgcatagatagtg

SEQ ID NO: 35839 - DNA, 20 bp, Artificial Sequence
  sgRNA
  Olfr1049_3
ttgtaggcgagagtccagtt

SEQ ID NO: 35840 - DNA, 20 bp, Artificial Sequence
  sgRNA
  Olfr1049_4
caaaattcaccagcatcttg

SEQ ID NO: 35841 - DNA, 20 bp, Artificial Sequence
  sgRNA
  Olfr1049_5
ttatgcttgtgccacacaaa

SEQ ID NO: 35842 - DNA, 20 bp, Artificial Sequence
  sgRNA
  Olfr1049_6
cactatctatgcaatcaccg

SEQ ID NO: 35843 - DNA, 20 bp, Artificial Sequence
  sgRNA
  Olfr1049_7
tgaggaagactgcaaacagt

SEQ ID NO: 35844 - DNA, 20 bp, Artificial Sequence
  sgRNA
  Olfr1049_8
gtgaggaagactgcaaacag

SEQ ID NO: 35845 - DNA, 20 bp, Artificial Sequence
  sgRNA
  Olfr1049_9
agacgctgtcaagtgcttat

SEQ ID NO: 35846 - DNA, 20 bp, Artificial Sequence
  sgRNA
  Olfr1049_10
tttcaaatgcgttctgcaga

SEQ ID NO: 35847 - DNA, 20 bp, Artificial Sequence
  sgRNA
  Olfr1049_11
cagtctgtgtgactcccatc

SEQ ID NO: 35848 - DNA, 20 bp, Artificial Sequence
  sgRNA
  Olfr1049_12
tgcagaacgcatttgaaata

SEQ ID NO: 35849 - DNA, 20 bp, Artificial Sequence
  sgRNA
  Olfr1049_13
aaatgcgttctgcagaaggt

SEQ ID NO: 35850 - DNA, 20 bp, Artificial Sequence
  sgRNA
  Olfr1049_14
ttgtgtggcacaagcataat

SEQ ID NO: 35851 - DNA, 20 bp, Artificial Sequence
  sgRNA
  Olfr1051_1
ggcacaagcataataggtga

SEQ ID NO: 35852 - DNA, 20 bp, Artificial Sequence
  sgRNA
  Olfr1051_2
tgctatctatgcaatcaccg

SEQ ID NO: 35853 - DNA, 20 bp, Artificial Sequence
  sgRNA
  Olfr1051_3
aacagatcaaaggtagtaag

SEQ ID NO: 35854 - DNA, 20 bp, Artificial Sequence
  sgRNA
  Olfr1051_4
attatagcactatagagcag

SEQ ID NO: 35855 - DNA, 20 bp, Artificial Sequence
  sgRNA
  Olfr1051_5
gcaaggaagactgcaaacag

SEQ ID NO: 35856 - DNA, 20 bp, Artificial Sequence
  sgRNA
  Olfr1051_6
tttgatctgttcacatgtag

SEQ ID NO: 35857 - DNA, 20 bp, Artificial Sequence
  sgRNA
  Olfr1051_7
ttatgcttgtgccacacaga

SEQ ID NO: 35858 - DNA, 20 bp, Artificial Sequence
  sgRNA
  Olfr1051_8
agacgctgtcaagtgctcat

SEQ ID NO: 35859 - DNA, 20 bp, Artificial Sequence
  sgRNA
  Olfr1051_9
cggtgattgcatagatagca

SEQ ID NO: 35860 - DNA, 20 bp, Artificial Sequence
  sgRNA
  Olfr1051_10
aatgaagcatgccatctgtg

SEQ ID NO: 35861 - DNA, 20 bp, Artificial Sequence
  sgRNA
  Olfr1051_11
tttcgaatgcgttctgcaga

SEQ ID NO: 35862 - DNA, 20 bp, Artificial Sequence
  sgRNA
  Olfr1051_12
cactctgtgtgactcccatc

SEQ ID NO: 35863 - DNA, 20 bp, Artificial Sequence
  sgRNA
  Olfr1051_13
caaggaagactgcaaacagt

SEQ ID NO: 35864 - DNA, 20 bp, Artificial Sequence
  sgRNA
  Olfr1051_14
gaatgcgttctgcagaaggt

SEQ ID NO: 35865 - DNA, 20 bp, Artificial Sequence
  sgRNA
  Olfr1051_15
tgcagaacgcattcgaaata

SEQ ID NO: 35866 - DNA, 20 bp, Artificial Sequence
  sgRNA
  Olfr1051_16
ctgtgtggcacaagcataat

SEQ ID NO: 35867 - DNA, 20 bp, Artificial Sequence
  sgRNA
  Olfr1052_1
ctacaaatgataggcaactg

SEQ ID NO: 35868 - DNA, 20 bp, Artificial Sequence
  sgRNA
  Olfr1052_2
gtcactgggtcagtcatagg

SEQ ID NO: 35869 - DNA, 20 bp, Artificial Sequence
  sgRNA
  Olfr1052_3
tggacacagtatacagcaat

SEQ ID NO: 35870 - DNA, 20 bp, Artificial Sequence
  sgRNA
  Olfr1052_4
gagcagaaattcattcatgg

SEQ ID NO: 35871 - DNA, 20 bp, Artificial Sequence
  sgRNA
  Olfr1052_5
ggttaacaactgccacataa

SEQ ID NO: 35872 - DNA, 20 bp, Artificial Sequence
  sgRNA
  Olfr1052_6
ggtgtcggtgttctatacac

SEQ ID NO: 35873 - DNA, 20 bp, Artificial Sequence
  sgRNA
  Olfr1052_7
agaacaagagaaggtggtgt

SEQ ID NO: 35874 - DNA, 20 bp, Artificial Sequence
  sgRNA
  Olfr1052_8
taaatcatgggatttaacat

SEQ ID NO: 35875 - DNA, 20 bp, Artificial Sequence
  sgRNA
  Olfr1052_9
agctgagcgtattctcaaaa

SEQ ID NO: 35876 - DNA, 20 bp, Artificial Sequence
  sgRNA
  Olfr1052_10
tgacagcaagaagccttcgg

SEQ ID NO: 35877 - DNA, 20 bp, Artificial Sequence
  sgRNA
  Olfr1052_11
ggagtgctggttaccaccga

SEQ ID NO: 35878 - DNA, 20 bp, Artificial Sequence
  sgRNA
  Olfr1052_12
catgagagtatcagcagcga

SEQ ID NO: 35879 - DNA, 20 bp, Artificial Sequence
  sgRNA
  Olfr1052_13
ttacagtctcaggaacaaag

SEQ ID NO: 35880 - DNA, 20 bp, Artificial Sequence
  sgRNA
  Olfr1052_14
tttatgctgttaccttgtta

SEQ ID NO: 35881 - DNA, 20 bp, Artificial Sequence
  sgRNA
  Olfr1052_15
ggccagagcaatgagtaaat

SEQ ID NO: 35882 - DNA, 20 bp, Artificial Sequence
  sgRNA
  Olfr1052_16
gtattctgtagaacaagaga

SEQ ID NO: 35883 - DNA, 20 bp, Artificial Sequence
  sgRNA
  Olfr1052_17
ttcctgagactgtaaatcat

SEQ ID NO: 35884 - DNA, 20 bp, Artificial Sequence
  sgRNA
  Olfr1052_18
agtcaggtgagaagcacaag

SEQ ID NO: 35885 - DNA, 20 bp, Artificial Sequence
  sgRNA
  Olfr1052_19
ttctctggagttatcgccat

SEQ ID NO: 35886 - DNA, 20 bp, Artificial Sequence
  sgRNA
  Olfr1052_20
tgagaaggacttcatctcta

SEQ ID NO: 35887 - DNA, 20 bp, Artificial Sequence
  sgRNA
  Olfr1053_1
tagtcaaaatgatcataccc

SEQ ID NO: 35888 - DNA, 20 bp, Artificial Sequence
  sgRNA
  Olfr1053_2
aggctctactggtcaccagt

SEQ ID NO: 35889 - DNA, 20 bp, Artificial Sequence
  sgRNA
  Olfr1053_3
attcagtgataataaacata

SEQ ID NO: 35890 - DNA, 20 bp, Artificial Sequence
  sgRNA
  Olfr1053_4
catctgtcccaagatgctgg

SEQ ID NO: 35891 - DNA, 20 bp, Artificial Sequence
  sgRNA
  Olfr1053_5
ggttaaaaatgccttctaca

SEQ ID NO: 35892 - DNA, 20 bp, Artificial Sequence
  sgRNA
  Olfr1053_6
agttgatgtgaaaatcctac

SEQ ID NO: 35893 - DNA, 20 bp, Artificial Sequence
  sgRNA
  Olfr1053_7
ggtgaccagtagagcctgga

SEQ ID NO: 35894 - DNA, 20 bp, Artificial Sequence
  sgRNA
  Olfr1053_8
atgtgggtctcatttgacag

SEQ ID NO: 35895 - DNA, 20 bp, Artificial Sequence
  sgRNA
  Olfr1053_9
gccttctacagggtactaaa

SEQ ID NO: 35896 - DNA, 20 bp, Artificial Sequence
  sgRNA
  Olfr1053_10
tcagcatttgaacacaaaat

SEQ ID NO: 35897 - DNA, 20 bp, Artificial Sequence
  sgRNA
  Olfr1053_11
gtacctctacagcaccgtcc

SEQ ID NO: 35898 - DNA, 20 bp, Artificial Sequence
  sgRNA
  Olfr1053_12
ggacggtgctgtagaggtac

SEQ ID NO: 35899 - DNA, 20 bp, Artificial Sequence
  sgRNA
  Olfr1053_13
gactgcatagatgatgaaga

SEQ ID NO: 35900 - DNA, 20 bp, Artificial Sequence
  sgRNA
  Olfr1053_14
agactttgtcatgtgcttgt

SEQ ID NO: 35901 - DNA, 20 bp, Artificial Sequence
  sgRNA
  Olfr1053_15
agcacattcacagaaagaaa

SEQ ID NO: 35902 - DNA, 20 bp, Artificial Sequence
  sgRNA
  Olfr1053_16
tactggtgaccagtagagcc

SEQ ID NO: 35903 - DNA, 20 bp, Artificial Sequence
  sgRNA
  Olfr1053_17
acataaggaagaaagacaac

SEQ ID NO: 35904 - DNA, 20 bp, Artificial Sequence
  sgRNA
  Olfr1053_18
cataaggaagaaagacaact

SEQ ID NO: 35905 - DNA, 20 bp, Artificial Sequence
  sgRNA
  Olfr1053_19
cactaaagtataaaacactg

SEQ ID NO: 35906 - DNA, 20 bp, Artificial Sequence
  sgRNA
  Olfr1053_20
accctttagtaccctgtaga

SEQ ID NO: 35907 - DNA, 20 bp, Artificial Sequence
  sgRNA
  Olfr1054_1
ttataatattgatttcagcg

SEQ ID NO: 35908 - DNA, 20 bp, Artificial Sequence
  sgRNA
  Olfr1054_2
taggacccagcataccctat

SEQ ID NO: 35909 - DNA, 20 bp, Artificial Sequence
  sgRNA
  Olfr1054_3
gtacatgggtgtttgcaatc

SEQ ID NO: 35910 - DNA, 20 bp, Artificial Sequence
  sgRNA
  Olfr1054_4
atgagaaacaagccgaacaa

SEQ ID NO: 35911 - DNA, 20 bp, Artificial Sequence
  sgRNA
  Olfr1054_5
agaaataaggaactgccact

SEQ ID NO: 35912 - DNA, 20 bp, Artificial Sequence
  sgRNA
  Olfr1054_6
ctaggacccagcatacccta

SEQ ID NO: 35913 - DNA, 20 bp, Artificial Sequence
  sgRNA
  Olfr1054_7
acgatcctgtaatcacaaaa

SEQ ID NO: 35914 - DNA, 20 bp, Artificial Sequence
  sgRNA
  Olfr1054_8
ttgtggatcccacttgacag

SEQ ID NO: 35915 - DNA, 20 bp, Artificial Sequence
  sgRNA
  Olfr1054_9
gataatcagagtataaaaga

SEQ ID NO: 35916 - DNA, 20 bp, Artificial Sequence
  sgRNA
  Olfr1054_10
ttgcaatcgggagtccacca

SEQ ID NO: 35917 - DNA, 20 bp, Artificial Sequence
  sgRNA
  Olfr1054_11
aatatgccctagaaaggttg

SEQ ID NO: 35918 - DNA, 20 bp, Artificial Sequence
  sgRNA
  Olfr1054_12
gaatgagtagataagaaaag

SEQ ID NO: 35919 - DNA, 20 bp, Artificial Sequence
  sgRNA
  Olfr1054_13
atgatgacagtatagagtag

SEQ ID NO: 35920 - DNA, 20 bp, Artificial Sequence
  sgRNA
  Olfr1054_14
atctcactgttgggcaacat

SEQ ID NO: 35921 - DNA, 20 bp, Artificial Sequence
  sgRNA
  Olfr1054_15
aacagagcaatgatattaaa

SEQ ID NO: 35922 - DNA, 20 bp, Artificial Sequence
  sgRNA
  Olfr1054_16
tactgtcatcatgtcccata

SEQ ID NO: 35923 - DNA, 20 bp, Artificial Sequence
  sgRNA
  Olfr1054_17
agacaatgaccactgtcaag

SEQ ID NO: 35924 - DNA, 20 bp, Artificial Sequence
  sgRNA
  Olfr1054_18
gatctcactgttgggcaaca

SEQ ID NO: 35925 - DNA, 20 bp, Artificial Sequence
  sgRNA
  Olfr1054_19
atagagtagaggcttacaga

SEQ ID NO: 35926 - DNA, 20 bp, Artificial Sequence
  sgRNA
  Olfr1054_20
ttccttagactatagatcaa

SEQ ID NO: 35927 - DNA, 20 bp, Artificial Sequence
  sgRNA
  Olfr1057_1
caggaatcctccaagctgcg

SEQ ID NO: 35928 - DNA, 20 bp, Artificial Sequence
  sgRNA
  Olfr1057_2
ggttgcagatggcgacatag

SEQ ID NO: 35929 - DNA, 20 bp, Artificial Sequence
  sgRNA
  Olfr1057_3
tgatgatcgccaggtgtctg

SEQ ID NO: 35930 - DNA, 20 bp, Artificial Sequence
  sgRNA
  Olfr1057_4
ggacattatcacagtaaaag

SEQ ID NO: 35931 - DNA, 20 bp, Artificial Sequence
  sgRNA
  Olfr1057_5
tgtagcagagatctttatgc

SEQ ID NO: 35932 - DNA, 20 bp, Artificial Sequence
  sgRNA
  Olfr1057_6
ggcacattcgtagtataagg

SEQ ID NO: 35933 - DNA, 20 bp, Artificial Sequence
  sgRNA
  Olfr1057_7
gttcaacattggaattatta

SEQ ID NO: 35934 - DNA, 20 bp, Artificial Sequence
  sgRNA
  Olfr1057_8
cacctggcgatcatcaactt

SEQ ID NO: 35935 - DNA, 20 bp, Artificial Sequence
  sgRNA
  Olfr1057_9
tgccaaagttgatgatcgcc

SEQ ID NO: 35936 - DNA, 20 bp, Artificial Sequence
  sgRNA
  Olfr1057_10
gaatgtgccacgcagcttgg

SEQ ID NO: 35937 - DNA, 20 bp, Artificial Sequence
  sgRNA
  Olfr1057_11
ctccttagacactgacaaga

SEQ ID NO: 35938 - DNA, 20 bp, Artificial Sequence
  sgRNA
  Olfr1057_12
ggttcaacattggaattatt

SEQ ID NO: 35939 - DNA, 20 bp, Artificial Sequence
  sgRNA
  Olfr1057_13
cgtggcacattcgtagtata

SEQ ID NO: 35940 - DNA, 20 bp, Artificial Sequence
  sgRNA
  Olfr1057_14
tacgaatgtgccacgcagct

SEQ ID NO: 35941 - DNA, 20 bp, Artificial Sequence
  sgRNA
  Olfr1057_15
gatctttatgctggctgtga

SEQ ID NO: 35942 - DNA, 20 bp, Artificial Sequence
  sgRNA
  Olfr1057_16
cacgcagcttggaggattcc

SEQ ID NO: 35943 - DNA, 20 bp, Artificial Sequence
  sgRNA
  Olfr1057_17
atctgaccgtccagaactgc

SEQ ID NO: 35944 - DNA, 20 bp, Artificial Sequence
  sgRNA
  Olfr1057_18
agccatcttgtcagtgtcta

SEQ ID NO: 35945 - DNA, 20 bp, Artificial Sequence
  sgRNA
  Olfr1057_19
tgcaagtattatgttgaaat

SEQ ID NO: 35946 - DNA, 20 bp, Artificial Sequence
  sgRNA
  Olfr1058_1
aaccaaggtctgtagtagag

SEQ ID NO: 35947 - DNA, 20 bp, Artificial Sequence
  sgRNA
  Olfr1058_2
ttgtagtctggagtccacca

SEQ ID NO: 35948 - DNA, 20 bp, Artificial Sequence
  sgRNA
  Olfr1058_3
aggaaaagtacaaataatgg

SEQ ID NO: 35949 - DNA, 20 bp, Artificial Sequence
  sgRNA
  Olfr1058_4
gtagaaatgactaatgacat

SEQ ID NO: 35950 - DNA, 20 bp, Artificial Sequence
  sgRNA
  Olfr1058_5
gagatatcagatagattatg

SEQ ID NO: 35951 - DNA, 20 bp, Artificial Sequence
  sgRNA
  Olfr1058_6
agaacattgaaaaaaataca

SEQ ID NO: 35952 - DNA, 20 bp, Artificial Sequence
  sgRNA
  Olfr1058_7
tttctcaagctgtagatcaa

SEQ ID NO: 35953 - DNA, 20 bp, Artificial Sequence
  sgRNA
  Olfr1058_8
gcaaggctttctctacctgt

SEQ ID NO: 35954 - DNA, 20 bp, Artificial Sequence
  sgRNA
  Olfr1058_9
attcaacatggggataacca

SEQ ID NO: 35955 - DNA, 20 bp, Artificial Sequence
  sgRNA
  Olfr1058_10
tcattctcatagctattatc

SEQ ID NO: 35956 - DNA, 20 bp, Artificial Sequence
  sgRNA
  Olfr1058_11
gggcatgatcatccttacct

SEQ ID NO: 35957 - DNA, 20 bp, Artificial Sequence
  sgRNA
  Olfr1058_12
ccacagctgttgtataacca

SEQ ID NO: 35958 - DNA, 20 bp, Artificial Sequence
  sgRNA
  Olfr1058_13
cacctctctactacagacct

SEQ ID NO: 35959 - DNA, 20 bp, Artificial Sequence
  sgRNA
  Olfr1058_14
ccttggttatacaacagctg

SEQ ID NO: 35960 - DNA, 20 bp, Artificial Sequence
  sgRNA
  Olfr1058_15
atcaggatgcactctgctga

SEQ ID NO: 35961 - DNA, 20 bp, Artificial Sequence
  sgRNA
  Olfr1058_16
ctgtgggtcccacctgacaa

SEQ ID NO: 35962 - DNA, 20 bp, Artificial Sequence
  sgRNA
  Olfr1058_17
cattgtcaggtgggacccac

SEQ ID NO: 35963 - DNA, 20 bp, Artificial Sequence
  sgRNA
  Olfr1058_18
atctatctgatatctctgat

SEQ ID NO: 35964 - DNA, 20 bp, Artificial Sequence
  sgRNA
  Olfr1058_19
atatctctgattggcaactt

SEQ ID NO: 35965 - DNA, 20 bp, Artificial Sequence
  sgRNA
  Olfr1058_20
gtgtctgagaaaaaagtaca

SEQ ID NO: 35966 - DNA, 20 bp, Artificial Sequence
  sgRNA
  Olfr1061_1
gcccaagttatcgaccagtg

SEQ ID NO: 35967 - DNA, 20 bp, Artificial Sequence
  sgRNA
  Olfr1061_2
aggccaaagttaacaaaggg

SEQ ID NO: 35968 - DNA, 20 bp, Artificial Sequence
  sgRNA
  Olfr1061_3
tatactgtagagatagggaa

SEQ ID NO: 35969 - DNA, 20 bp, Artificial Sequence
  sgRNA
  Olfr1061_4
atggtacctgaaactcatgg

SEQ ID NO: 35970 - DNA, 20 bp, Artificial Sequence
  sgRNA
  Olfr1061_5
agatgtccttaaaaaaccaa

SEQ ID NO: 35971 - DNA, 20 bp, Artificial Sequence
  sgRNA
  Olfr1061_6
ggccaaagttaacaaaggga

SEQ ID NO: 35972 - DNA, 20 bp, Artificial Sequence
  sgRNA
  Olfr1061_7
ttgcagcctggaatccacta

SEQ ID NO: 35973 - DNA, 20 bp, Artificial Sequence
  sgRNA
  Olfr1061_8
aatgtcttatgaccgttatg

SEQ ID NO: 35974 - DNA, 20 bp, Artificial Sequence
  sgRNA
  Olfr1061_9
ttaactctgctgagggcaaa

SEQ ID NO: 35975 - DNA, 20 bp, Artificial Sequence
  sgRNA
  Olfr1061_10
tcatgtcacaaaaagcatgt

SEQ ID NO: 35976 - DNA, 20 bp, Artificial Sequence
  sgRNA
  Olfr1061_11
acctcactggtcgataactt

SEQ ID NO: 35977 - DNA, 20 bp, Artificial Sequence
  sgRNA
  Olfr1061_12
gaaagatgattggatagcac

SEQ ID NO: 35978 - DNA, 20 bp, Artificial Sequence
  sgRNA
  Olfr1061_13
atgagatacagtccaaacaa

SEQ ID NO: 35979 - DNA, 20 bp, Artificial Sequence
  sgRNA
  Olfr1061_14
gtgacatgatgacagtgtag

SEQ ID NO: 35980 - DNA, 20 bp, Artificial Sequence
  sgRNA
  Olfr1061_15
ctaaggattaactctgctga

SEQ ID NO: 35981 - DNA, 20 bp, Artificial Sequence
  sgRNA
  Olfr1061_16
agtgactgaattcatcctgg

SEQ ID NO: 35982 - DNA, 20 bp, Artificial Sequence
  sgRNA
  Olfr1061_17
acaattatactgtagagata

SEQ ID NO: 35983 - DNA, 20 bp, Artificial Sequence
  sgRNA
  Olfr1061_18
acataccaaagaaagatgat

SEQ ID NO: 35984 - DNA, 20 bp, Artificial Sequence
  sgRNA
  Olfr1061_19
gctatccaatcatctttctt

SEQ ID NO: 35985 - DNA, 20 bp, Artificial Sequence
  sgRNA
  Olfr1061_20
ctctgctgagggcaaatgga

SEQ ID NO: 35986 - DNA, 20 bp, Artificial Sequence
  sgRNA
  Olfr1062_1
cagaaatcctcccagctgcg

SEQ ID NO: 35987 - DNA, 20 bp, Artificial Sequence
  sgRNA
  Olfr1062_2
cacacaaggtgtcacaacaa

SEQ ID NO: 35988 - DNA, 20 bp, Artificial Sequence
  sgRNA
  Olfr1062_3
cttcttcctcagacacctgg

SEQ ID NO: 35989 - DNA, 20 bp, Artificial Sequence
  sgRNA
  Olfr1062_4
aaaatacaacagtttctgga

SEQ ID NO: 35990 - DNA, 20 bp, Artificial Sequence
  sgRNA
  Olfr1062_5
ggtatcagagatcttcatgc

SEQ ID NO: 35991 - DNA, 20 bp, Artificial Sequence
  sgRNA
  Olfr1062_6
ggcacattcatagtataagg

SEQ ID NO: 35992 - DNA, 20 bp, Artificial Sequence
  sgRNA
  Olfr1062_7
ctatgaatgtgccacgcagc

SEQ ID NO: 35993 - DNA, 20 bp, Artificial Sequence
  sgRNA
  Olfr1062_8
tatgaatgtgccacgcagct

SEQ ID NO: 35994 - DNA, 20 bp, Artificial Sequence
  sgRNA
  Olfr1062_9
gaatgtgccacgcagctggg

SEQ ID NO: 35995 - DNA, 20 bp, Artificial Sequence
  sgRNA
  Olfr1062_10
gttcaacattggtattatta

SEQ ID NO: 35996 - DNA, 20 bp, Artificial Sequence
  sgRNA
  Olfr1062_11
ggacattgtcacagtaaaag

SEQ ID NO: 35997 - DNA, 20 bp, Artificial Sequence
  sgRNA
  Olfr1062_12
ggttcaacattggtattatt

SEQ ID NO: 35998 - DNA, 20 bp, Artificial Sequence
  sgRNA
  Olfr1062_13
cgtggcacattcatagtata

SEQ ID NO: 35999 - DNA, 20 bp, Artificial Sequence
  sgRNA
  Olfr1062_14
agcgatcttgtcagtgtcta

SEQ ID NO: 36000 - DNA, 20 bp, Artificial Sequence
  sgRNA
  Olfr1062_15
aactgaccgtccagaactgc

SEQ ID NO: 36001 - DNA, 20 bp, Artificial Sequence
  sgRNA
  Olfr1062_16
gatcttcatgctggctgtga

SEQ ID NO: 36002 - DNA, 20 bp, Artificial Sequence
  sgRNA
  Olfr1062_17
cacgcagctgggaggatttc

SEQ ID NO: 36003 - DNA, 20 bp, Artificial Sequence
  sgRNA
  Olfr1062_18
tgcaagtactatgttgaaat

SEQ ID NO: 36004 - DNA, 20 bp, Artificial Sequence
  sgRNA
  Olfr1065_1
catgattgtccttacaatgg

SEQ ID NO: 36005 - DNA, 20 bp, Artificial Sequence
  sgRNA
  Olfr1065_2
atgaggattgcagctcaggg

SEQ ID NO: 36006 - DNA, 20 bp, Artificial Sequence
  sgRNA
  Olfr1065_3
ccacagttgttgaataacca

SEQ ID NO: 36007 - DNA, 20 bp, Artificial Sequence
  sgRNA
  Olfr1065_4
aggctaactgtgtagcacaa

SEQ ID NO: 36008 - DNA, 20 bp, Artificial Sequence
  sgRNA
  Olfr1065_5
gtatagctataaggatgagc

SEQ ID NO: 36009 - DNA, 20 bp, Artificial Sequence
  sgRNA
  Olfr1065_6
tcatccttatagctatactt

SEQ ID NO: 36010 - DNA, 20 bp, Artificial Sequence
  sgRNA
  Olfr1065_7
aagatgctcttcataggaca

SEQ ID NO: 36011 - DNA, 20 bp, Artificial Sequence
  sgRNA
  Olfr1065_8
tgtctaagaaagaaatacat

SEQ ID NO: 36012 - DNA, 20 bp, Artificial Sequence
  sgRNA
  Olfr1065_9
ccttggttattcaacaactg

SEQ ID NO: 36013 - DNA, 20 bp, Artificial Sequence
  sgRNA
  Olfr1065_10
agacagtgaccacagtcagg

SEQ ID NO: 36014 - DNA, 20 bp, Artificial Sequence
  sgRNA
  Olfr1065_11
tgaattcagttactactgtg

SEQ ID NO: 36015 - DNA, 20 bp, Artificial Sequence
  sgRNA
  Olfr1065_12
gcctggagtccaccattgta

SEQ ID NO: 36016 - DNA, 20 bp, Artificial Sequence
  sgRNA
  Olfr1065_13
gggcatgattgtccttacaa

SEQ ID NO: 36017 - DNA, 20 bp, Artificial Sequence
  sgRNA
  Olfr1065_14
gacagtgaccacagtcaggt

SEQ ID NO: 36018 - DNA, 20 bp, Artificial Sequence
  sgRNA
  Olfr1065_15
cttaggatgaactctgctga

SEQ ID NO: 36019 - DNA, 20 bp, Artificial Sequence
  sgRNA
  Olfr1065_16
gagctgcaatcctcattgtt

SEQ ID NO: 36020 - DNA, 20 bp, Artificial Sequence
  sgRNA
  Olfr1065_17
tcatcctaagtatagctata

SEQ ID NO: 36021 - DNA, 20 bp, Artificial Sequence
  sgRNA
  Olfr1065_18
atatcactggtgggaaattt

SEQ ID NO: 36022 - DNA, 20 bp, Artificial Sequence
  sgRNA
  Olfr1065_19
agctataaggatgagcaggt

SEQ ID NO: 36023 - DNA, 20 bp, Artificial Sequence
  sgRNA
  Olfr1065_20
actgtggtcactgtcttcta

SEQ ID NO: 36024 - DNA, 20 bp, Artificial Sequence
  sgRNA
  Olfr1066_1
gcccaagttgccaaacagtg

SEQ ID NO: 36025 - DNA, 20 bp, Artificial Sequence
  sgRNA
  Olfr1066_2
atgatgacagtatagaggag

SEQ ID NO: 36026 - DNA, 20 bp, Artificial Sequence
  sgRNA
  Olfr1066_3
atggtacctgaaactcaggg

SEQ ID NO: 36027 - DNA, 20 bp, Artificial Sequence
  sgRNA
  Olfr1066_4
acaattatactatagagata

SEQ ID NO: 36028 - DNA, 20 bp, Artificial Sequence
  sgRNA
  Olfr1066_5
gtgacatgatgacagtatag

SEQ ID NO: 36029 - DNA, 20 bp, Artificial Sequence
  sgRNA
  Olfr1066_6
actccattgacactggtaaa

SEQ ID NO: 36030 - DNA, 20 bp, Artificial Sequence
  sgRNA
  Olfr1066_7
ctaaggattaactctactga

SEQ ID NO: 36031 - DNA, 20 bp, Artificial Sequence
  sgRNA
  Olfr1066_8
accagtgtcaatggagtgag

SEQ ID NO: 36032 - DNA, 20 bp, Artificial Sequence
  sgRNA
  Olfr1066_9
tcctcaagctgtatattaag

SEQ ID NO: 36033 - DNA, 20 bp, Artificial Sequence
  sgRNA
  Olfr1066_10
attgtcttatgactgttatg

SEQ ID NO: 36034 - DNA, 20 bp, Artificial Sequence
  sgRNA
  Olfr1066_11
ttgcagcccggaatccacca

SEQ ID NO: 36035 - DNA, 20 bp, Artificial Sequence
  sgRNA
  Olfr1066_12
cgtctcttcttatagtaatt

SEQ ID NO: 36036 - DNA, 20 bp, Artificial Sequence
  sgRNA
  Olfr1066_13
ttaactctactgagggtaaa

SEQ ID NO: 36037 - DNA, 20 bp, Artificial Sequence
  sgRNA
  Olfr1066_14
ctctactgagggtaaatgga

SEQ ID NO: 36038 - DNA, 20 bp, Artificial Sequence
  sgRNA
  Olfr1066_15
gttcaacatagggataacct

SEQ ID NO: 36039 - DNA, 20 bp, Artificial Sequence
  sgRNA
  Olfr1066_16
tcatgtcacaaaaagtatgt

SEQ ID NO: 36040 - DNA, 20 bp, Artificial Sequence
  sgRNA
  Olfr1066_17
acatactaaagaaagatgat

SEQ ID NO: 36041 - DNA, 20 bp, Artificial Sequence
  sgRNA
  Olfr1066_18
tctaaggattaactctactg

SEQ ID NO: 36042 - DNA, 20 bp, Artificial Sequence
  sgRNA
  Olfr1066_19
tcttggttattcaacagctg

SEQ ID NO: 36043 - DNA, 20 bp, Artificial Sequence
  sgRNA
  Olfr1066_20
gaaagatgattggatatcac

SEQ ID NO: 36044 - DNA, 20 bp, Artificial Sequence
  sgRNA
  Olfr1076_1
aagagtatgttggctcctgg

SEQ ID NO: 36045 - DNA, 20 bp, Artificial Sequence
  sgRNA
  Olfr1076_2
atggggcctgcagttcaggg

SEQ ID NO: 36046 - DNA, 20 bp, Artificial Sequence
  sgRNA
  Olfr1076_3
agaaatgactgataatattg

SEQ ID NO: 36047 - DNA, 20 bp, Artificial Sequence
  sgRNA
  Olfr1076_4
tgtctgcaatgtcttatgac

SEQ ID NO: 36048 - DNA, 20 bp, Artificial Sequence
  sgRNA
  Olfr1076_5
tctgctctgctcaaataaaa

SEQ ID NO: 36049 - DNA, 20 bp, Artificial Sequence
  sgRNA
  Olfr1076_6
tgtcagatgagacccacaag

SEQ ID NO: 36050 - DNA, 20 bp, Artificial Sequence
  sgRNA
  Olfr1076_7
acatactgaagaaagacaat

SEQ ID NO: 36051 - DNA, 20 bp, Artificial Sequence
  sgRNA
  Olfr1076_8
aaaggtatgggattgccacc

SEQ ID NO: 36052 - DNA, 20 bp, Artificial Sequence
  sgRNA
  Olfr1076_9
ttatgtcaaaaagagtatgt

SEQ ID NO: 36053 - DNA, 20 bp, Artificial Sequence
  sgRNA
  Olfr1076_10
ctcaagatgaactctgctga

SEQ ID NO: 36054 - DNA, 20 bp, Artificial Sequence
  sgRNA
  Olfr1076_11
tttaaggtgtgatttgactt

SEQ ID NO: 36055 - DNA, 20 bp, Artificial Sequence
  sgRNA
  Olfr1076_12
taggagacaagaatgaccac

SEQ ID NO: 36056 - DNA, 20 bp, Artificial Sequence
  sgRNA
  Olfr1076_13
agatgaactctgctgagggc

SEQ ID NO: 36057 - DNA, 20 bp, Artificial Sequence
  sgRNA
  Olfr1076_14
gattattaaggtataaaaga

SEQ ID NO: 36058 - DNA, 20 bp, Artificial Sequence
  sgRNA
  Olfr1076_15
taacttgatttcttcaccag

SEQ ID NO: 36059 - DNA, 20 bp, Artificial Sequence
  sgRNA
  Olfr1076_16
tctcaagatgaactctgctg

SEQ ID NO: 36060 - DNA, 20 bp, Artificial Sequence
  sgRNA
  Olfr1076_17
aagatgtaaaatatgctctt

SEQ ID NO: 36061 - DNA, 20 bp, Artificial Sequence
  sgRNA
  Olfr1076_18
tcacaccttaaacactgaca

SEQ ID NO: 36062 - DNA, 20 bp, Artificial Sequence
  sgRNA
  Olfr1076_19
agaaggctttctccacttgt

SEQ ID NO: 36063 - DNA, 20 bp, Artificial Sequence
  sgRNA
  Olfr1076_20
gataatattgtggccacaga

SEQ ID NO: 36064 - DNA, 20 bp, Artificial Sequence
  sgRNA
  Olfr1077-ps1_1
ttgtagccttgattccacca

SEQ ID NO: 36065 - DNA, 20 bp, Artificial Sequence
  sgRNA
  Olfr1077-ps1_2
aatattccattagaaaaaca

SEQ ID NO: 36066 - DNA, 20 bp, Artificial Sequence
  sgRNA
  Olfr1077-ps1_3
tctgctttgctcaaataaag

SEQ ID NO: 36067 - DNA, 20 bp, Artificial Sequence
  sgRNA
  Olfr1077-ps1_4
tgtcagatgagatccacagg

SEQ ID NO: 36068 - DNA, 20 bp, Artificial Sequence
  sgRNA
  Olfr1077-ps1_5
tgaattcagtcaccaatgtg

SEQ ID NO: 36069 - DNA, 20 bp, Artificial Sequence
  sgRNA
  Olfr1077-ps1_6
cagtagttattgtattctat

SEQ ID NO: 36070 - DNA, 20 bp, Artificial Sequence
  sgRNA
  Olfr1077-ps1_7
taggaaacaaggatgaccag

SEQ ID NO: 36071 - DNA, 20 bp, Artificial Sequence
  sgRNA
  Olfr1077-ps1_8
gagcaaagcagagctgtcaa

SEQ ID NO: 36072 - DNA, 20 bp, Artificial Sequence
  sgRNA
  Olfr1077-ps1_9
gaatgagcagataggaaaca

SEQ ID NO: 36073 - DNA, 20 bp, Artificial Sequence
  sgRNA
  Olfr1077-ps1_10
aaaggtatgggattgtcact

SEQ ID NO: 36074 - DNA, 20 bp, Artificial Sequence
  sgRNA
  Olfr1077-ps1_11
gtttacagatggcgacataa

SEQ ID NO: 36075 - DNA, 20 bp, Artificial Sequence
  sgRNA
  Olfr1077-ps1_12
gagcgacaaatatactctaa

SEQ ID NO: 36076 - DNA, 20 bp, Artificial Sequence
  sgRNA
  Olfr1077-ps1_13
tttcttaagctgtagatcaa

SEQ ID NO: 36077 - DNA, 20 bp, Artificial Sequence
  sgRNA
  Olfr1077-ps1_14
cagtcaccaatgtgaggctg

SEQ ID NO: 36078 - DNA, 20 bp, Artificial Sequence
  sgRNA
  Olfr1077-ps1_15
ttctcactggtgggcaactt

SEQ ID NO: 36079 - DNA, 20 bp, Artificial Sequence
  sgRNA
  Olfr1077-ps1_16
ggcgttcagttatacccatc

SEQ ID NO: 36080 - DNA, 20 bp, Artificial Sequence
  sgRNA
  Olfr1077-ps1_17
acaaatatactctaaaggta

SEQ ID NO: 36081 - DNA, 20 bp, Artificial Sequence
  sgRNA
  Olfr1077-ps1_18
gaggaccatcacagtagaaa

SEQ ID NO: 36082 - DNA, 20 bp, Artificial Sequence
  sgRNA
  Olfr1077-ps1_19
tttaaggagtgactggactt

SEQ ID NO: 36083 - DNA, 20 bp, Artificial Sequence
  sgRNA
  Olfr1077-ps1_20
aaccaaggtcagtagtagca

SEQ ID NO: 36084 - DNA, 20 bp, Artificial Sequence
  sgRNA
  Olfr1079_1
gccttgattccactatggtg

SEQ ID NO: 36085 - DNA, 20 bp, Artificial Sequence
  sgRNA
  Olfr1079_2
aaccaagatctgtgatagct

SEQ ID NO: 36086 - DNA, 20 bp, Artificial Sequence
  sgRNA
  Olfr1079_3
gagaaataaatacactgtaa

SEQ ID NO: 36087 - DNA, 20 bp, Artificial Sequence
  sgRNA
  Olfr1079_4
ggcggtcagtgatgcccctg

SEQ ID NO: 36088 - DNA, 20 bp, Artificial Sequence
  sgRNA
  Olfr1079_5
ctgtggctcccatctgaccg

SEQ ID NO: 36089 - DNA, 20 bp, Artificial Sequence
  sgRNA
  Olfr1079_6
agatgagcagataggagcca

SEQ ID NO: 36090 - DNA, 20 bp, Artificial Sequence
  sgRNA
  Olfr1079_7
agatcaaaggatttaacata

SEQ ID NO: 36091 - DNA, 20 bp, Artificial Sequence
  sgRNA
  Olfr1079_8
atggaacctgcagctcaggg

SEQ ID NO: 36092 - DNA, 20 bp, Artificial Sequence
  sgRNA
  Olfr1079_9
ttgcagccttgattccacta

SEQ ID NO: 36093 - DNA, 20 bp, Artificial Sequence
  sgRNA
  Olfr1079_10
ggttacagatagccacatag

SEQ ID NO: 36094 - DNA, 20 bp, Artificial Sequence
  sgRNA
  Olfr1079_11
cccataaaagacagaaacca

SEQ ID NO: 36095 - DNA, 20 bp, Artificial Sequence
  sgRNA
  Olfr1079_12
tgaactctgctgagggaaga

SEQ ID NO: 36096 - DNA, 20 bp, Artificial Sequence
  sgRNA
  Olfr1079_13
gtgcagagcagagatatcaa

SEQ ID NO: 36097 - DNA, 20 bp, Artificial Sequence
  sgRNA
  Olfr1079_14
gatgacattgtaaccacaga

SEQ ID NO: 36098 - DNA, 20 bp, Artificial Sequence
  sgRNA
  Olfr1079_15
ctcagaatgaactctgctga

SEQ ID NO: 36099 - DNA, 20 bp, Artificial Sequence
  sgRNA
  Olfr1079_16
ggatgaagagaagatattaa

SEQ ID NO: 36100 - DNA, 20 bp, Artificial Sequence
  sgRNA
  Olfr1079_17
atttaacatagggataacta

SEQ ID NO: 36101 - DNA, 20 bp, Artificial Sequence
  sgRNA
  Olfr1079_18
gacagaaaccacggtcagat

SEQ ID NO: 36102 - DNA, 20 bp, Artificial Sequence
  sgRNA
  Olfr1079_19
atgaaaaacagtccaaacaa

SEQ ID NO: 36103 - DNA, 20 bp, Artificial Sequence
  sgRNA
  Olfr1079_20
tcctctctcctgatcatcct

SEQ ID NO: 36104 - DNA, 20 bp, Artificial Sequence
  sgRNA
  Olfr1080_1
cccaagattgccaatcactg

SEQ ID NO: 36105 - DNA, 20 bp, Artificial Sequence
  sgRNA
  Olfr1080_2
agcaaagcaacgatattaag

SEQ ID NO: 36106 - DNA, 20 bp, Artificial Sequence
  sgRNA
  Olfr1080_3
tcatgtcccataaagtatgt

SEQ ID NO: 36107 - DNA, 20 bp, Artificial Sequence
  sgRNA
  Olfr1080_4
aactgtgggaccaaaaatgt

SEQ ID NO: 36108 - DNA, 20 bp, Artificial Sequence
  sgRNA
  Olfr1080_5
agaatactgtaactactgtc

SEQ ID NO: 36109 - DNA, 20 bp, Artificial Sequence
  sgRNA
  Olfr1080_6
cagtagttacagtattctat

SEQ ID NO: 36110 - DNA, 20 bp, Artificial Sequence
  sgRNA
  Olfr1080_7
ctagaacccaacatacttta

SEQ ID NO: 36111 - DNA, 20 bp, Artificial Sequence
  sgRNA
  Olfr1080_8
tgcctgagaaagaaatacat

SEQ ID NO: 36112 - DNA, 20 bp, Artificial Sequence
  sgRNA
  Olfr1080_9
catgtcccataaagtatgtt

SEQ ID NO: 36113 - DNA, 20 bp, Artificial Sequence
  sgRNA
  Olfr1080_10
tagaacccaacatactttat

SEQ ID NO: 36114 - DNA, 20 bp, Artificial Sequence
  sgRNA
  Olfr1080_11
tcaattgaatggctagattc

SEQ ID NO: 36115 - DNA, 20 bp, Artificial Sequence
  sgRNA
  Olfr1080_12
tactgtcaggtgtgacccac

SEQ ID NO: 36116 - DNA, 20 bp, Artificial Sequence
  sgRNA
  Olfr1080_13
acagtagttacagtattcta

SEQ ID NO: 36117 - DNA, 20 bp, Artificial Sequence
  sgRNA
  Olfr1080_14
gtatttctttctcaggcatt

SEQ ID NO: 36118 - DNA, 20 bp, Artificial Sequence
  sgRNA
  Olfr1080_15
cgccaatgtatttctttctc

SEQ ID NO: 36119 - DNA, 20 bp, Artificial Sequence
  sgRNA
  Olfr1082_1
tttgtttattcgacaactgt

SEQ ID NO: 36120 - DNA, 20 bp, Artificial Sequence
  sgRNA
  Olfr1082_2
cataaatgtatagtaaagat

SEQ ID NO: 36121 - DNA, 20 bp, Artificial Sequence
  sgRNA
  Olfr1082_3
gcttggcgtctacattggtg

SEQ ID NO: 36122 - DNA, 20 bp, Artificial Sequence
  sgRNA
  Olfr1082_4
atgatgacagtgtagagcag

SEQ ID NO: 36123 - DNA, 20 bp, Artificial Sequence
  sgRNA
  Olfr1082_5
aagatgctctacaaagaaca

SEQ ID NO: 36124 - DNA, 20 bp, Artificial Sequence
  sgRNA
  Olfr1082_6
catgtcacataaagtatgtt

SEQ ID NO: 36125 - DNA, 20 bp, Artificial Sequence
  sgRNA
  Olfr1082_7
tcatgtcacataaagtatgt

SEQ ID NO: 36126 - DNA, 20 bp, Artificial Sequence
  sgRNA
  Olfr1082_8
ctttgtttattcgacaactg

SEQ ID NO: 36127 - DNA, 20 bp, Artificial Sequence
  sgRNA
  Olfr1082_9
cttatagttatgatctttgc

SEQ ID NO: 36128 - DNA, 20 bp, Artificial Sequence
  sgRNA
  Olfr1082_10
cgccaatgtatttctttctt

SEQ ID NO: 36129 - DNA, 20 bp, Artificial Sequence
  sgRNA
  Olfr1082_11
tcaattgaatggctagatac

SEQ ID NO: 36130 - DNA, 20 bp, Artificial Sequence
  sgRNA
  Olfr1084_1
cccaagattgccaaccactg

SEQ ID NO: 36131 - DNA, 20 bp, Artificial Sequence
  sgRNA
  Olfr1084_2
aacagaagaaaaaaagctag

SEQ ID NO: 36132 - DNA, 20 bp, Artificial Sequence
  sgRNA
  Olfr1084_3
aatatttatggtgactacaa

SEQ ID NO: 36133 - DNA, 20 bp, Artificial Sequence
  sgRNA
  Olfr1084_4
tcgtgtctcataaagtatgt

SEQ ID NO: 36134 - DNA, 20 bp, Artificial Sequence
  sgRNA
  Olfr1084_5
agtcatctacctgacctcag

SEQ ID NO: 36135 - DNA, 20 bp, Artificial Sequence
  sgRNA
  Olfr1084_6
acattgcagacaaaataaaa

SEQ ID NO: 36136 - DNA, 20 bp, Artificial Sequence
  sgRNA
  Olfr1084_7
acgatgacagtgtagagcag

SEQ ID NO: 36137 - DNA, 20 bp, Artificial Sequence
  sgRNA
  Olfr1084_8
cggtgtagcacaaagagagt

SEQ ID NO: 36138 - DNA, 20 bp, Artificial Sequence
  sgRNA
  Olfr1084_9
agatcaggggattcaataaa

SEQ ID NO: 36139 - DNA, 20 bp, Artificial Sequence
  sgRNA
  Olfr1084_10
ggacataagcacgacgacaa

SEQ ID NO: 36140 - DNA, 20 bp, Artificial Sequence
  sgRNA
  Olfr1084_11
cctcagtggttggcaatctt

SEQ ID NO: 36141 - DNA, 20 bp, Artificial Sequence
  sgRNA
  Olfr1084_12
gagcaaagcaatgatattaa

SEQ ID NO: 36142 - DNA, 20 bp, Artificial Sequence
  sgRNA
  Olfr1084_13
tcaattgaatgactagatac

SEQ ID NO: 36143 - DNA, 20 bp, Artificial Sequence
  sgRNA
  Olfr1084_14
atctacctgacctcagtggt

SEQ ID NO: 36144 - DNA, 20 bp, Artificial Sequence
  sgRNA
  Olfr1084_15
atacattggtgtctgtagct

SEQ ID NO: 36145 - DNA, 20 bp, Artificial Sequence
  sgRNA
  Olfr1084_16
gattgccaaccactgaggtc

SEQ ID NO: 36146 - DNA, 20 bp, Artificial Sequence
  sgRNA
  Olfr1084_17
aggacataagcacgacgaca

SEQ ID NO: 36147 - DNA, 20 bp, Artificial Sequence
  sgRNA
  Olfr1084_18
caccaatgtatttctttctt

SEQ ID NO: 36148 - DNA, 20 bp, Artificial Sequence
  sgRNA
  Olfr1084_19
tgagcaaagcaatgatatta

SEQ ID NO: 36149 - DNA, 20 bp, Artificial Sequence
  sgRNA
  Olfr1084_20
acctcagtggttggcaatct

SEQ ID NO: 36150 - DNA, 20 bp, Artificial Sequence
  sgRNA
  Olfr1085_1
gaagagcagcccaaagagtg

SEQ ID NO: 36151 - DNA, 20 bp, Artificial Sequence
  sgRNA
  Olfr1085_2
ggttacatatagccacgtaa

SEQ ID NO: 36152 - DNA, 20 bp, Artificial Sequence
  sgRNA
  Olfr1085_3
catcatcattattactaatg

SEQ ID NO: 36153 - DNA, 20 bp, Artificial Sequence
  sgRNA
  Olfr1085_4
aatatgttgggtacttgtgg

SEQ ID NO: 36154 - DNA, 20 bp, Artificial Sequence
  sgRNA
  Olfr1085_5
aatgtcttatgaccgttacg

SEQ ID NO: 36155 - DNA, 20 bp, Artificial Sequence
  sgRNA
  Olfr1085_6
agatgccatagaaagaacct

SEQ ID NO: 36156 - DNA, 20 bp, Artificial Sequence
  sgRNA
  Olfr1085_7
cagaaggacgaccagaagag

SEQ ID NO: 36157 - DNA, 20 bp, Artificial Sequence
  sgRNA
  Olfr1085_8
gaataaacagataagacaga

SEQ ID NO: 36158 - DNA, 20 bp, Artificial Sequence
  sgRNA
  Olfr1085_9
atctgctgcaggcagatgca

SEQ ID NO: 36159 - DNA, 20 bp, Artificial Sequence
  sgRNA
  Olfr1085_10
atgaagagcagcccaaagag

SEQ ID NO: 36160 - DNA, 20 bp, Artificial Sequence
  sgRNA
  Olfr1085_11
tgaagagcagcccaaagagt

SEQ ID NO: 36161 - DNA, 20 bp, Artificial Sequence
  sgRNA
  Olfr1085_12
cactgaccgtcctgagctgc

SEQ ID NO: 36162 - DNA, 20 bp, Artificial Sequence
  sgRNA
  Olfr1085_13
ctcaaatgtttgactggact

SEQ ID NO: 36163 - DNA, 20 bp, Artificial Sequence
  sgRNA
  Olfr1085_14
atgtttgagaaaaaagtaca

SEQ ID NO: 36164 - DNA, 20 bp, Artificial Sequence
  sgRNA
  Olfr1087_1
catgatcattctaaccacag

SEQ ID NO: 36165 - DNA, 20 bp, Artificial Sequence
  sgRNA
  Olfr1087_2
taggaacaatccaaacaatg

SEQ ID NO: 36166 - DNA, 20 bp, Artificial Sequence
  sgRNA
  Olfr1087_3
acactgtcatcatgtcgcaa

SEQ ID NO: 36167 - DNA, 20 bp, Artificial Sequence
  sgRNA
  Olfr1087_4
ccacagctgtagaataacca

SEQ ID NO: 36168 - DNA, 20 bp, Artificial Sequence
  sgRNA
  Olfr1087_5
ctaggaacaatccaaacaat

SEQ ID NO: 36169 - DNA, 20 bp, Artificial Sequence
  sgRNA
  Olfr1087_6
gaacagatcaaagataacaa

SEQ ID NO: 36170 - DNA, 20 bp, Artificial Sequence
  sgRNA
  Olfr1087_7
tatatcatggggtttaacat

SEQ ID NO: 36171 - DNA, 20 bp, Artificial Sequence
  sgRNA
  Olfr1087_8
tgtctaatgaaaaagtacat

SEQ ID NO: 36172 - DNA, 20 bp, Artificial Sequence
  sgRNA
  Olfr1087_9
aacaaggaccactagaaggg

SEQ ID NO: 36173 - DNA, 20 bp, Artificial Sequence
  sgRNA
  Olfr1087_10
tctcagaatgaactcggctg

SEQ ID NO: 36174 - DNA, 20 bp, Artificial Sequence
  sgRNA
  Olfr1087_11
gtgtctaatgaaaaagtaca

SEQ ID NO: 36175 - DNA, 20 bp, Artificial Sequence
  sgRNA
  Olfr1087_12
agacagtgaccactgtcagg

SEQ ID NO: 36176 - DNA, 20 bp, Artificial Sequence
  sgRNA
  Olfr1087_13
gtgactcaattcatcctgat

SEQ ID NO: 36177 - DNA, 20 bp, Artificial Sequence
  sgRNA
  Olfr1087_14
agtgactcaattcatcctga

SEQ ID NO: 36178 - DNA, 20 bp, Artificial Sequence
  sgRNA
  Olfr1087_15
ctgtggttcccacctgacag

SEQ ID NO: 36179 - DNA, 20 bp, Artificial Sequence
  sgRNA
  Olfr1087_16
ctcagaatgaactcggctga

SEQ ID NO: 36180 - DNA, 20 bp, Artificial Sequence
  sgRNA
  Olfr1087_17
agaaacaaggaccactagaa

SEQ ID NO: 36181 - DNA, 20 bp, Artificial Sequence
  sgRNA
  Olfr1087_18
tgaattgagtcactgctgtg

SEQ ID NO: 36182 - DNA, 20 bp, Artificial Sequence
  sgRNA
  Olfr1087_19
tttgatatcctcccttctag

SEQ ID NO: 36183 - DNA, 20 bp, Artificial Sequence
  sgRNA
  Olfr1087_20
gtagaggaggggcttacaga

SEQ ID NO: 36184 - DNA, 20 bp, Artificial Sequence
  sgRNA
  Olfr1089_1
actaatcggcctgagctgaa

SEQ ID NO: 36185 - DNA, 20 bp, Artificial Sequence
  sgRNA
  Olfr1089_2
agacaaaataaaaagctcac

SEQ ID NO: 36186 - DNA, 20 bp, Artificial Sequence
  sgRNA
  Olfr1089_3
tgtttgagaaagaagtacat

SEQ ID NO: 36187 - DNA, 20 bp, Artificial Sequence
  sgRNA
  Olfr1089_4
aacagagcaatggtatcaaa

SEQ ID NO: 36188 - DNA, 20 bp, Artificial Sequence
  sgRNA
  Olfr1089_5
tcatcctcataaccattctg

SEQ ID NO: 36189 - DNA, 20 bp, Artificial Sequence
  sgRNA
  Olfr1089_6
atgtaaagaatgctggacag

SEQ ID NO: 36190 - DNA, 20 bp, Artificial Sequence
  sgRNA
  Olfr1089_7
ctgaggatgaactctactga

SEQ ID NO: 36191 - DNA, 20 bp, Artificial Sequence
  sgRNA
  Olfr1089_8
tcatcctcagaatggttatg

SEQ ID NO: 36192 - DNA, 20 bp, Artificial Sequence
  sgRNA
  Olfr1089_9
tatcaaagtcccatagaaga

SEQ ID NO: 36193 - DNA, 20 bp, Artificial Sequence
  sgRNA
  Olfr1089_10
tgagtgtttgaacagagcaa

SEQ ID NO: 36194 - DNA, 20 bp, Artificial Sequence
  sgRNA
  Olfr1089_11
atgaggaacagcccaaacaa

SEQ ID NO: 36195 - DNA, 20 bp, Artificial Sequence
  sgRNA
  Olfr1089_12
ctgtaaagcacaaagataat

SEQ ID NO: 36196 - DNA, 20 bp, Artificial Sequence
  sgRNA
  Olfr1089_13
acatgggtgtttgcagtcga

SEQ ID NO: 36197 - DNA, 20 bp, Artificial Sequence
  sgRNA
  Olfr1089_14
gaatggttatgaggatgagg

SEQ ID NO: 36198 - DNA, 20 bp, Artificial Sequence
  sgRNA
  Olfr1089_15
agtagagttcatcctcagaa

SEQ ID NO: 36199 - DNA, 20 bp, Artificial Sequence
  sgRNA
  Olfr1089_16
gataatcatggtataaaaga

SEQ ID NO: 36200 - DNA, 20 bp, Artificial Sequence
  sgRNA
  Olfr1089_17
ggatgaactctactgagggc

SEQ ID NO: 36201 - DNA, 20 bp, Artificial Sequence
  sgRNA
  Olfr1089_18
tctgaggatgaactctactg

SEQ ID NO: 36202 - DNA, 20 bp, Artificial Sequence
  sgRNA
  Olfr1089_19
tcatgtcaaagaagaaatgt

SEQ ID NO: 36203 - DNA, 20 bp, Artificial Sequence
  sgRNA
  Olfr1089_20
gtacttctttctcaaacact

SEQ ID NO: 36204 - DNA, 20 bp, Artificial Sequence
  sgRNA
  Olfr109_1
ttctcatcaaccttctctcg

SEQ ID NO: 36205 - DNA, 20 bp, Artificial Sequence
  sgRNA
  Olfr109_2
gccaacaggatgcacaactg

SEQ ID NO: 36206 - DNA, 20 bp, Artificial Sequence
  sgRNA
  Olfr109_3
aatgactgagtttgtgagag

SEQ ID NO: 36207 - DNA, 20 bp, Artificial Sequence
  sgRNA
  Olfr109_4
gttgagaactgtattgccac

SEQ ID NO: 36208 - DNA, 20 bp, Artificial Sequence
  sgRNA
  Olfr109_5
accaggccgtagcagccaac

SEQ ID NO: 36209 - DNA, 20 bp, Artificial Sequence
  sgRNA
  Olfr109_6
cctcctccatgagtgaggat

SEQ ID NO: 36210 - DNA, 20 bp, Artificial Sequence
  sgRNA
  Olfr109_7
ctgcacctctcactttatgg

SEQ ID NO: 36211 - DNA, 20 bp, Artificial Sequence
  sgRNA
  Olfr109_8
ccacaggccacttctaagag

SEQ ID NO: 36212 - DNA, 20 bp, Artificial Sequence
  sgRNA
  Olfr109_9
tcactttctgggaagtacgg

SEQ ID NO: 36213 - DNA, 20 bp, Artificial Sequence
  sgRNA
  Olfr109_10
cctggatatttgttactcat

SEQ ID NO: 36214 - DNA, 20 bp, Artificial Sequence
  sgRNA
  Olfr109_11
cgtagggccatatcattcct

SEQ ID NO: 36215 - DNA, 20 bp, Artificial Sequence
  sgRNA
  Olfr109_12
tcacaggcagtatatccatg

SEQ ID NO: 36216 - DNA, 20 bp, Artificial Sequence
  sgRNA
  Olfr109_13
tcaaccttctctcgaggcgt

SEQ ID NO: 36217 - DNA, 20 bp, Artificial Sequence
  sgRNA
  Olfr109_14
cggatgtatgtgaaaccaac

SEQ ID NO: 36218 - DNA, 20 bp, Artificial Sequence
  sgRNA
  Olfr109_15
gccacaggccacttctaaga

SEQ ID NO: 36219 - DNA, 20 bp, Artificial Sequence
  sgRNA
  Olfr109_16
tcctaggaagaagtacatag

SEQ ID NO: 36220 - DNA, 20 bp, Artificial Sequence
  sgRNA
  Olfr109_17
gcaatacagttctcaaccaa

SEQ ID NO: 36221 - DNA, 20 bp, Artificial Sequence
  sgRNA
  Olfr109_18
ccgatcctcactcatggagg

SEQ ID NO: 36222 - DNA, 20 bp, Artificial Sequence
  sgRNA
  Olfr109_19
gagaaactcatccactgaag

SEQ ID NO: 36223 - DNA, 20 bp, Artificial Sequence
  sgRNA
  Olfr109_20
ggctgcagatggccacaaat

SEQ ID NO: 36224 - DNA, 20 bp, Artificial Sequence
  sgRNA
  Olfr1090_1
aatcattgttctcaccacag

SEQ ID NO: 36225 - DNA, 20 bp, Artificial Sequence
  sgRNA
  Olfr1090_2
atggggcctgcaattcagag

SEQ ID NO: 36226 - DNA, 20 bp, Artificial Sequence
  sgRNA
  Olfr1090_3
tctactctgttcacatgcag

SEQ ID NO: 36227 - DNA, 20 bp, Artificial Sequence
  sgRNA
  Olfr1090_4
aagaaagaaagctagttgtg

SEQ ID NO: 36228 - DNA, 20 bp, Artificial Sequence
  sgRNA
  Olfr1090_5
gattcagcatgggtataacg

SEQ ID NO: 36229 - DNA, 20 bp, Artificial Sequence
  sgRNA
  Olfr1090_6
tcatcctgagaactgctatg

SEQ ID NO: 36230 - DNA, 20 bp, Artificial Sequence
  sgRNA
  Olfr1090_7
attcagcatgggtataacga

SEQ ID NO: 36231 - DNA, 20 bp, Artificial Sequence
  sgRNA
  Olfr1090_8
atatacatgacctcaatggt

SEQ ID NO: 36232 - DNA, 20 bp, Artificial Sequence
  sgRNA
  Olfr1090_9
tgccatatacatgacctcaa

SEQ ID NO: 36233 - DNA, 20 bp, Artificial Sequence
  sgRNA
  Olfr1090_10
tcatcagaatgactggactg

SEQ ID NO: 36234 - DNA, 20 bp, Artificial Sequence
  sgRNA
  Olfr1090_11
aacagagtagagacagcaag

SEQ ID NO: 36235 - DNA, 20 bp, Artificial Sequence
  sgRNA
  Olfr1090_12
ttatcctcatagcagttctc

SEQ ID NO: 36236 - DNA, 20 bp, Artificial Sequence
  sgRNA
  Olfr1090_13
tcttggatattctacagctg

SEQ ID NO: 36237 - DNA, 20 bp, Artificial Sequence
  sgRNA
  Olfr1090_14
acactgtcaccactgtcagg

SEQ ID NO: 36238 - DNA, 20 bp, Artificial Sequence
  sgRNA
  Olfr1090_15
gcaaggaacagcccaaataa

SEQ ID NO: 36239 - DNA, 20 bp, Artificial Sequence
  sgRNA
  Olfr1090_16
atgaggacagtgtagagcag

SEQ ID NO: 36240 - DNA, 20 bp, Artificial Sequence
  sgRNA
  Olfr1090_17
atgtgggtcccacctgacag

SEQ ID NO: 36241 - DNA, 20 bp, Artificial Sequence
  sgRNA
  Olfr1090_18
ttgcaggcgtgagtccactg

SEQ ID NO: 36242 - DNA, 20 bp, Artificial Sequence
  sgRNA
  Olfr1090_19
acagtggtgacagtgttcta

SEQ ID NO: 36243 - DNA, 20 bp, Artificial Sequence
  sgRNA
  Olfr1090_20
tctcaggatgaactctgcag

SEQ ID NO: 36244 - DNA, 20 bp, Artificial Sequence
  sgRNA
  Olfr1093_1
atgagtggcaggtatactct

SEQ ID NO: 36245 - DNA, 20 bp, Artificial Sequence
  sgRNA
  Olfr1093_2
aagaaagagcaagcaatgca

SEQ ID NO: 36246 - DNA, 20 bp, Artificial Sequence
  sgRNA
  Olfr1093_3
gaatcctaagagaataaaca

SEQ ID NO: 36247 - DNA, 20 bp, Artificial Sequence
  sgRNA
  Olfr1093_4
ccaggaaagacaaaacactt

SEQ ID NO: 36248 - DNA, 20 bp, Artificial Sequence
  sgRNA
  Olfr1093_5
attcaacatgggtatcacaa

SEQ ID NO: 36249 - DNA, 20 bp, Artificial Sequence
  sgRNA
  Olfr1093_6
atttatctcttcactctggt

SEQ ID NO: 36250 - DNA, 20 bp, Artificial Sequence
  sgRNA
  Olfr1093_7
tggccactgtatacagaagt

SEQ ID NO: 36251 - DNA, 20 bp, Artificial Sequence
  sgRNA
  Olfr1093_8
ggagaccagaacaatcagga

SEQ ID NO: 36252 - DNA, 20 bp, Artificial Sequence
  sgRNA
  Olfr1093_9
actggagtctctatttacca

SEQ ID NO: 36253 - DNA, 20 bp, Artificial Sequence
  sgRNA
  Olfr1093_10
atacagaagtgggttgtaga

SEQ ID NO: 36254 - DNA, 20 bp, Artificial Sequence
  sgRNA
  Olfr1093_11
ttatgcttcaaatcatgaca

SEQ ID NO: 36255 - DNA, 20 bp, Artificial Sequence
  sgRNA
  Olfr1093_12
ggtaaatagagactccagtg

SEQ ID NO: 36256 - DNA, 20 bp, Artificial Sequence
  sgRNA
  Olfr1093_13
ctgaacatgcattctgctga

SEQ ID NO: 36257 - DNA, 20 bp, Artificial Sequence
  sgRNA
  Olfr1093_14
tgctatttatctcttcactc

SEQ ID NO: 36258 - DNA, 20 bp, Artificial Sequence
  sgRNA
  Olfr1093_15
ggttgtagatggctacatat

SEQ ID NO: 36259 - DNA, 20 bp, Artificial Sequence
  sgRNA
  Olfr1093_16
gcttctagtcttgtacttgg

SEQ ID NO: 36260 - DNA, 20 bp, Artificial Sequence
  sgRNA
  Olfr1093_17
tatgctggtggagttgtgca

SEQ ID NO: 36261 - DNA, 20 bp, Artificial Sequence
  sgRNA
  Olfr1093_18
gcatggtgctatccacacag

SEQ ID NO: 36262 - DNA, 20 bp, Artificial Sequence
  sgRNA
  Olfr1093_19
acagaaggacagactgaaag

SEQ ID NO: 36263 - DNA, 20 bp, Artificial Sequence
  sgRNA
  Olfr1093_20
tagatgataggattcaacat

SEQ ID NO: 36264 - DNA, 20 bp, Artificial Sequence
  sgRNA
  Olfr1095_1
ctacaaaagacaatgcactg

SEQ ID NO: 36265 - DNA, 20 bp, Artificial Sequence
  sgRNA
  Olfr1095_2
atgagtggtaaatagactcg

SEQ ID NO: 36266 - DNA, 20 bp, Artificial Sequence
  sgRNA
  Olfr1095_3
gagcaggaaatagcaagtag

SEQ ID NO: 36267 - DNA, 20 bp, Artificial Sequence
  sgRNA
  Olfr1095_4
ggtcgtgaatggctacatat

SEQ ID NO: 36268 - DNA, 20 bp, Artificial Sequence
  sgRNA
  Olfr1095_5
cacgatcatgtcatgctcca

SEQ ID NO: 36269 - DNA, 20 bp, Artificial Sequence
  sgRNA
  Olfr1095_6
tgaagatgaattcagctgaa

SEQ ID NO: 36270 - DNA, 20 bp, Artificial Sequence
  sgRNA
  Olfr1095_7
ggaaaacagaatgatcagga

SEQ ID NO: 36271 - DNA, 20 bp, Artificial Sequence
  sgRNA
  Olfr1095_8
gcactgaggaaacagtacat

SEQ ID NO: 36272 - DNA, 20 bp, Artificial Sequence
  sgRNA
  Olfr1095_9
tgctcactgcatacagtagt

SEQ ID NO: 36273 - DNA, 20 bp, Artificial Sequence
  sgRNA
  Olfr1095_10
cattggactgacagaaagac

SEQ ID NO: 36274 - DNA, 20 bp, Artificial Sequence
  sgRNA
  Olfr1095_11
catttcctattagagtaaaa

SEQ ID NO: 36275 - DNA, 20 bp, Artificial Sequence
  sgRNA
  Olfr1095_12
gaggcttgtgccataacaaa

SEQ ID NO: 36276 - DNA, 20 bp, Artificial Sequence
  sgRNA
  Olfr1095_13
tttactctaataggaaatgt

SEQ ID NO: 36277 - DNA, 20 bp, Artificial Sequence
  sgRNA
  Olfr1095_14
atcactccaaatatgttagt

SEQ ID NO: 36278 - DNA, 20 bp, Artificial Sequence
  sgRNA
  Olfr1095_15
tcatcttcaggattgacaac

SEQ ID NO: 36279 - DNA, 20 bp, Artificial Sequence
  sgRNA
  Olfr1095_16
gagtaaaaaggtaaattgct

SEQ ID NO: 36280 - DNA, 20 bp, Artificial Sequence
  sgRNA
  Olfr1095_17
atacagtagtgggtcgtgaa

SEQ ID NO: 36281 - DNA, 20 bp, Artificial Sequence
  sgRNA
  Olfr1095_18
cactgaggaaacagtacata

SEQ ID NO: 36282 - DNA, 20 bp, Artificial Sequence
  sgRNA
  Olfr1095_19
atgcaaaattccaccagcat

SEQ ID NO: 36283 - DNA, 20 bp, Artificial Sequence
  sgRNA
  Olfr1095_20
ggaaacagtacatagggttg

SEQ ID NO: 36284 - DNA, 20 bp, Artificial Sequence
  sgRNA
  Olfr1097_1
gagagtatatgagcgcctag

SEQ ID NO: 36285 - DNA, 20 bp, Artificial Sequence
  sgRNA
  Olfr1097_2
tgattacagttgagtaactg

SEQ ID NO: 36286 - DNA, 20 bp, Artificial Sequence
  sgRNA
  Olfr1097_3
gaggacaaagaaatacaact

SEQ ID NO: 36287 - DNA, 20 bp, Artificial Sequence
  sgRNA
  Olfr1097_4
tgtgggactgacagactcca

SEQ ID NO: 36288 - DNA, 20 bp, Artificial Sequence
  sgRNA
  Olfr1097_5
gatgagcgacagcaatagag

SEQ ID NO: 36289 - DNA, 20 bp, Artificial Sequence
  sgRNA
  Olfr1097_6
cactatagtataaaaaacag

SEQ ID NO: 36290 - DNA, 20 bp, Artificial Sequence
  sgRNA
  Olfr1097_7
agaggacaaagaaatacaac

SEQ ID NO: 36291 - DNA, 20 bp, Artificial Sequence
  sgRNA
  Olfr1097_8
aacattcagaagctgccaag

SEQ ID NO: 36292 - DNA, 20 bp, Artificial Sequence
  sgRNA
  Olfr1097_9
atccaaaactccaatcatgt

SEQ ID NO: 36293 - DNA, 20 bp, Artificial Sequence
  sgRNA
  Olfr1097_10
accagctaaaacgaatatag

SEQ ID NO: 36294 - DNA, 20 bp, Artificial Sequence
  sgRNA
  Olfr1097_11
aaagaagtgatgaattactt

SEQ ID NO: 36295 - DNA, 20 bp, Artificial Sequence
  sgRNA
  Olfr1097_12
agactccaaggagattcagc

SEQ ID NO: 36296 - DNA, 20 bp, Artificial Sequence
  sgRNA
  Olfr1097_13
atcactgtgtcctacatgat

SEQ ID NO: 36297 - DNA, 20 bp, Artificial Sequence
  sgRNA
  Olfr1097_14
atgagagtatatgagcgcct

SEQ ID NO: 36298 - DNA, 20 bp, Artificial Sequence
  sgRNA
  Olfr1097_15
ggaaaaaatacattggagtg

SEQ ID NO: 36299 - DNA, 20 bp, Artificial Sequence
  sgRNA
  Olfr1097_16
agtcccacaagcgtgaactc

SEQ ID NO: 36300 - DNA, 20 bp, Artificial Sequence
  sgRNA
  Olfr1097_17
tgaacctgagttcacgcttg

SEQ ID NO: 36301 - DNA, 20 bp, Artificial Sequence
  sgRNA
  Olfr1097_18
gttgtatttctttgtcctct

SEQ ID NO: 36302 - DNA, 20 bp, Artificial Sequence
  sgRNA
  Olfr1097_19
gtcctacatgattggagttt

SEQ ID NO: 36303 - DNA, 20 bp, Artificial Sequence
  sgRNA
  Olfr1097_20
gaacctgagttcacgcttgt

SEQ ID NO: 36304 - DNA, 20 bp, Artificial Sequence
  sgRNA
  Olfr1098_1
tgtgcttaaccaaaagacag

SEQ ID NO: 36305 - DNA, 20 bp, Artificial Sequence
  sgRNA
  Olfr1098_2
gagaatatatgagcgcctag

SEQ ID NO: 36306 - DNA, 20 bp, Artificial Sequence
  sgRNA
  Olfr1098_3
accagctaaaacgaatattg

SEQ ID NO: 36307 - DNA, 20 bp, Artificial Sequence
  sgRNA
  Olfr1098_4
gaaggcaaagaaatacaact

SEQ ID NO: 36308 - DNA, 20 bp, Artificial Sequence
  sgRNA
  Olfr1098_5
actggatttctgcaactcca

SEQ ID NO: 36309 - DNA, 20 bp, Artificial Sequence
  sgRNA
  Olfr1098_6
aaagaagtgatgaattaccg

SEQ ID NO: 36310 - DNA, 20 bp, Artificial Sequence
  sgRNA
  Olfr1098_7
tgaactcaggttcatttgta

SEQ ID NO: 36311 - DNA, 20 bp, Artificial Sequence
  sgRNA
  Olfr1098_8
taaccaaaagacagtggcag

SEQ ID NO: 36312 - DNA, 20 bp, Artificial Sequence
  sgRNA
  Olfr1098_9
tgattacagttgaataactg

SEQ ID NO: 36313 - DNA, 20 bp, Artificial Sequence
  sgRNA
  Olfr1098_10
gattagcgacagcaatagag

SEQ ID NO: 36314 - DNA, 20 bp, Artificial Sequence
  sgRNA
  Olfr1098_11
cactatagtataaaaaacgg

SEQ ID NO: 36315 - DNA, 20 bp, Artificial Sequence
  sgRNA
  Olfr1098_12
atcactgtgtcctacatcgt

SEQ ID NO: 36316 - DNA, 20 bp, Artificial Sequence
  sgRNA
  Olfr1098_13
tgtgggactgacagattcca

SEQ ID NO: 36317 - DNA, 20 bp, Artificial Sequence
  sgRNA
  Olfr1098_14
agtcccacaagcatgaactc

SEQ ID NO: 36318 - DNA, 20 bp, Artificial Sequence
  sgRNA
  Olfr1098_15
aatcactatagtataaaaaa

SEQ ID NO: 36319 - DNA, 20 bp, Artificial Sequence
  sgRNA
  Olfr1098_16
gaacctgagttcatgcttgt

SEQ ID NO: 36320 - DNA, 20 bp, Artificial Sequence
  sgRNA
  Olfr1098_17
agattccaaggagattcagc

SEQ ID NO: 36321 - DNA, 20 bp, Artificial Sequence
  sgRNA
  Olfr1098_18
atgagaatatatgagcgcct

SEQ ID NO: 36322 - DNA, 20 bp, Artificial Sequence
  sgRNA
  Olfr1098_19
agaaggcaaagaaatacaac

SEQ ID NO: 36323 - DNA, 20 bp, Artificial Sequence
  sgRNA
  Olfr1098_20
acattcagaacctgctaaga

SEQ ID NO: 36324 - DNA, 20 bp, Artificial Sequence
  sgRNA
  Olfr1099_1
gcatgagagggctataagtg

SEQ ID NO: 36325 - DNA, 20 bp, Artificial Sequence
  sgRNA
  Olfr1099_2
actgtcaatatgttatgcat

SEQ ID NO: 36326 - DNA, 20 bp, Artificial Sequence
  sgRNA
  Olfr1099_3
tgatgacagtagagtaactg

SEQ ID NO: 36327 - DNA, 20 bp, Artificial Sequence
  sgRNA
  Olfr1099_4
cacatatgacccagtaagga

SEQ ID NO: 36328 - DNA, 20 bp, Artificial Sequence
  sgRNA
  Olfr1099_5
agtggaactgatcttcaaaa

SEQ ID NO: 36329 - DNA, 20 bp, Artificial Sequence
  sgRNA
  Olfr1099_6
gttaagcatgggaatcacaa

SEQ ID NO: 36330 - DNA, 20 bp, Artificial Sequence
  sgRNA
  Olfr1099_7
tgttccccagaacagtgacc

SEQ ID NO: 36331 - DNA, 20 bp, Artificial Sequence
  sgRNA
  Olfr1099_8
tgtcttcaatggcctatgat

SEQ ID NO: 36332 - DNA, 20 bp, Artificial Sequence
  sgRNA
  Olfr1099_9
ataatgactgaataatgtag

SEQ ID NO: 36333 - DNA, 20 bp, Artificial Sequence
  sgRNA
  Olfr1099_10
acacatatgacccagtaagg

SEQ ID NO: 36334 - DNA, 20 bp, Artificial Sequence
  sgRNA
  Olfr1099_11
tatgaagctggacatctaga

SEQ ID NO: 36335 - DNA, 20 bp, Artificial Sequence
  sgRNA
  Olfr1099_12
ggtaactgccaggatatgag

SEQ ID NO: 36336 - DNA, 20 bp, Artificial Sequence
  sgRNA
  Olfr1099_13
gggactgacagattccaagg

SEQ ID NO: 36337 - DNA, 20 bp, Artificial Sequence
  sgRNA
  Olfr1099_14
tggaatctgtcagtcccatg

SEQ ID NO: 36338 - DNA, 20 bp, Artificial Sequence
  sgRNA
  Olfr1099_15
gataagagataacagtagag

SEQ ID NO: 36339 - DNA, 20 bp, Artificial Sequence
  sgRNA
  Olfr1099_16
gatcatagtaccataaaata

SEQ ID NO: 36340 - DNA, 20 bp, Artificial Sequence
  sgRNA
  Olfr1099_17
aacactcagtagctgccaaa

SEQ ID NO: 36341 - DNA, 20 bp, Artificial Sequence
  sgRNA
  Olfr1099_18
cataggccattgaagacaaa

SEQ ID NO: 36342 - DNA, 20 bp, Artificial Sequence
  sgRNA
  Olfr1099_19
catgggactgacagattcca

SEQ ID NO: 36343 - DNA, 20 bp, Artificial Sequence
  sgRNA
  Olfr1099_20
catgcataacatattgacag

SEQ ID NO: 36344 - DNA, 20 bp, Artificial Sequence
  sgRNA
  Olfr11_1
gactggcagtagaacacact

SEQ ID NO: 36345 - DNA, 20 bp, Artificial Sequence
  sgRNA
  Olfr11_2
atttgctgttacatcaacac

SEQ ID NO: 36346 - DNA, 20 bp, Artificial Sequence
  sgRNA
  Olfr11_3
actctccagttgccacgctg

SEQ ID NO: 36347 - DNA, 20 bp, Artificial Sequence
  sgRNA
  Olfr11_4
gtggagtttaggatccaaat

SEQ ID NO: 36348 - DNA, 20 bp, Artificial Sequence
  sgRNA
  Olfr11_5
acaggtttgtagccatatgt

SEQ ID NO: 36349 - DNA, 20 bp, Artificial Sequence
  sgRNA
  Olfr11_6
gtaatggagaggccgacata

SEQ ID NO: 36350 - DNA, 20 bp, Artificial Sequence
  sgRNA
  Olfr11_7
taggtttctctgatcaacca

SEQ ID NO: 36351 - DNA, 20 bp, Artificial Sequence
  sgRNA
  Olfr11_8
ttgaaaatccaatctgccga

SEQ ID NO: 36352 - DNA, 20 bp, Artificial Sequence
  sgRNA
  Olfr11_9
gtaagtttaccagcatttgt

SEQ ID NO: 36353 - DNA, 20 bp, Artificial Sequence
  sgRNA
  Olfr11_10
tggcaactggagagttagaa

SEQ ID NO: 36354 - DNA, 20 bp, Artificial Sequence
  sgRNA
  Olfr11_11
aagagtggaaactccagcca

SEQ ID NO: 36355 - DNA, 20 bp, Artificial Sequence
  sgRNA
  Olfr11_12
tcctaagtgtatagataagg

SEQ ID NO: 36356 - DNA, 20 bp, Artificial Sequence
  sgRNA
  Olfr11_13
ggtgcataatgactgagtaa

SEQ ID NO: 36357 - DNA, 20 bp, Artificial Sequence
  sgRNA
  Olfr11_14
tgtggagtttaggatccaaa

SEQ ID NO: 36358 - DNA, 20 bp, Artificial Sequence
  sgRNA
  Olfr11_15
gcaataattccatagaaaag

SEQ ID NO: 36359 - DNA, 20 bp, Artificial Sequence
  sgRNA
  Olfr11_16
tgagagagagaggtgttagg

SEQ ID NO: 36360 - DNA, 20 bp, Artificial Sequence
  sgRNA
  Olfr11_17
tgatggtggtagaaagtaca

SEQ ID NO: 36361 - DNA, 20 bp, Artificial Sequence
  sgRNA
  Olfr11_18
aggatacagccgccaactga

SEQ ID NO: 36362 - DNA, 20 bp, Artificial Sequence
  sgRNA
  Olfr11_19
gaggctctgccttcagttgg

SEQ ID NO: 36363 - DNA, 20 bp, Artificial Sequence
  sgRNA
  Olfr11_20
ataatgactgagtaatggag

SEQ ID NO: 36364 - DNA, 20 bp, Artificial Sequence
  sgRNA
  Olfr110_1
tctcaactcagtgttgcaca

SEQ ID NO: 36365 - DNA, 20 bp, Artificial Sequence
  sgRNA
  Olfr110_2
gtactcatttattatgaaca

SEQ ID NO: 36366 - DNA, 20 bp, Artificial Sequence
  sgRNA
  Olfr110_3
gtgtaggtgggaatcagcta

SEQ ID NO: 36367 - DNA, 20 bp, Artificial Sequence
  sgRNA
  Olfr110_4
caagacaagatgagcaaggg

SEQ ID NO: 36368 - DNA, 20 bp, Artificial Sequence
  sgRNA
  Olfr110_5
atctgattgttaccacaaaa

SEQ ID NO: 36369 - DNA, 20 bp, Artificial Sequence
  sgRNA
  Olfr110_6
gattgttaccacaaaagggc

SEQ ID NO: 36370 - DNA, 20 bp, Artificial Sequence
  sgRNA
  Olfr110_7
gctggttagcagcttcatgc

SEQ ID NO: 36371 - DNA, 20 bp, Artificial Sequence
  sgRNA
  Olfr110_8
tctagagagtaagatgagat

SEQ ID NO: 36372 - DNA, 20 bp, Artificial Sequence
  sgRNA
  Olfr110_9
tgtgcctcccctcagaggaa

SEQ ID NO: 36373 - DNA, 20 bp, Artificial Sequence
  sgRNA
  Olfr110_10
ggatccgttcctctgagggg

SEQ ID NO: 36374 - DNA, 20 bp, Artificial Sequence
  sgRNA
  Olfr110_11
ggtaggaaaggatgacgcac

SEQ ID NO: 36375 - DNA, 20 bp, Artificial Sequence
  sgRNA
  Olfr110_12
ataaattacaggattcagca

SEQ ID NO: 36376 - DNA, 20 bp, Artificial Sequence
  sgRNA
  Olfr110_13
gcagcttcatgctggacagg

SEQ ID NO: 36377 - DNA, 20 bp, Artificial Sequence
  sgRNA
  Olfr110_14
gaaaggatgacgcacaggaa

SEQ ID NO: 36378 - DNA, 20 bp, Artificial Sequence
  sgRNA
  Olfr110_15
aaggaataaggacatcaaag

SEQ ID NO: 36379 - DNA, 20 bp, Artificial Sequence
  sgRNA
  Olfr110_16
tgttaccacaaaagggcagg

SEQ ID NO: 36380 - DNA, 20 bp, Artificial Sequence
  sgRNA
  Olfr110_17
ttagcagcttcatgctggac

SEQ ID NO: 36381 - DNA, 20 bp, Artificial Sequence
  sgRNA
  Olfr110_18
ggctttgtgcctcccctcag

SEQ ID NO: 36382 - DNA, 20 bp, Artificial Sequence
  sgRNA
  Olfr110_19
ttccttagcgtataaattac

SEQ ID NO: 36383 - DNA, 20 bp, Artificial Sequence
  sgRNA
  Olfr110_20
gatctgattgttaccacaaa

SEQ ID NO: 36384 - DNA, 20 bp, Artificial Sequence
  sgRNA
  Olfr1100_1
gataagagacaccactagag

SEQ ID NO: 36385 - DNA, 20 bp, Artificial Sequence
  sgRNA
  Olfr1100_2
aagggtactacagaatcttg

SEQ ID NO: 36386 - DNA, 20 bp, Artificial Sequence
  sgRNA
  Olfr1100_3
catacaaaatatattaacag

SEQ ID NO: 36387 - DNA, 20 bp, Artificial Sequence
  sgRNA
  Olfr1100_4
tcaggacaaacagcacagta

SEQ ID NO: 36388 - DNA, 20 bp, Artificial Sequence
  sgRNA
  Olfr1100_5
gcaagacagtgctaaaattg

SEQ ID NO: 36389 - DNA, 20 bp, Artificial Sequence
  sgRNA
  Olfr1100_6
tggaatcagtcagtcccatg

SEQ ID NO: 36390 - DNA, 20 bp, Artificial Sequence
  sgRNA
  Olfr1100_7
tgataactgggtattgtaag

SEQ ID NO: 36391 - DNA, 20 bp, Artificial Sequence
  sgRNA
  Olfr1100_8
gctgtttgtcctgatatacc

SEQ ID NO: 36392 - DNA, 20 bp, Artificial Sequence
  sgRNA
  Olfr1100_9
ctcaagacttaaattcagag

SEQ ID NO: 36393 - DNA, 20 bp, Artificial Sequence
  sgRNA
  Olfr1100_10
catataggaaccagtgagaa

SEQ ID NO: 36394 - DNA, 20 bp, Artificial Sequence
  sgRNA
  Olfr1100_11
cgaggaatgacaaatgactt

SEQ ID NO: 36395 - DNA, 20 bp, Artificial Sequence
  sgRNA
  Olfr1100_12
ttctgtagtacccttctcac

SEQ ID NO: 36396 - DNA, 20 bp, Artificial Sequence
  sgRNA
  Olfr1100_13
cctgagtagtaggaattact

SEQ ID NO: 36397 - DNA, 20 bp, Artificial Sequence
  sgRNA
  Olfr1100_14
aacattcagcagcagccaag

SEQ ID NO: 36398 - DNA, 20 bp, Artificial Sequence
  sgRNA
  Olfr1100_15
agtagagagaatagacacat

SEQ ID NO: 36399 - DNA, 20 bp, Artificial Sequence
  sgRNA
  Olfr1100_16
gagtcagacttcatcctcat

SEQ ID NO: 36400 - DNA, 20 bp, Artificial Sequence
  sgRNA
  Olfr1100_17
aatggcctatgatagatatg

SEQ ID NO: 36401 - DNA, 20 bp, Artificial Sequence
  sgRNA
  Olfr1100_18
tatacctggtcactgtgctg

SEQ ID NO: 36402 - DNA, 20 bp, Artificial Sequence
  sgRNA
  Olfr1100_19
taggagatgagaagcacaag

SEQ ID NO: 36403 - DNA, 20 bp, Artificial Sequence
  sgRNA
  Olfr1100_20
cttatatttctgcagaacca

SEQ ID NO: 36404 - DNA, 20 bp, Artificial Sequence
  sgRNA
  Olfr1101_1
actgatctcagtagtcattg

SEQ ID NO: 36405 - DNA, 20 bp, Artificial Sequence
  sgRNA
  Olfr1101_2
acaaaacgacaagctagcag

SEQ ID NO: 36406 - DNA, 20 bp, Artificial Sequence
  sgRNA
  Olfr1101_3
gatgagtgacatgtagactc

SEQ ID NO: 36407 - DNA, 20 bp, Artificial Sequence
  sgRNA
  Olfr1101_4
atgtttcttgctgttagctg

SEQ ID NO: 36408 - DNA, 20 bp, Artificial Sequence
  sgRNA
  Olfr1101_5
tgttcactgcatacagaagt

SEQ ID NO: 36409 - DNA, 20 bp, Artificial Sequence
  sgRNA
  Olfr1101_6
ggactgatctcagtagtcat

SEQ ID NO: 36410 - DNA, 20 bp, Artificial Sequence
  sgRNA
  Olfr1101_7
actggcgtgtccatatatta

SEQ ID NO: 36411 - DNA, 20 bp, Artificial Sequence
  sgRNA
  Olfr1101_8
ggttgtaaatagctacatag

SEQ ID NO: 36412 - DNA, 20 bp, Artificial Sequence
  sgRNA
  Olfr1101_9
tgaagatgcattctgctgag

SEQ ID NO: 36413 - DNA, 20 bp, Artificial Sequence
  sgRNA
  Olfr1101_10
catctttgtgagctccattg

SEQ ID NO: 36414 - DNA, 20 bp, Artificial Sequence
  sgRNA
  Olfr1101_11
agaaaagtcatttcattcct

SEQ ID NO: 36415 - DNA, 20 bp, Artificial Sequence
  sgRNA
  Olfr1101_12
gcatcttcaagatagcaaac

SEQ ID NO: 36416 - DNA, 20 bp, Artificial Sequence
  sgRNA
  Olfr1101_13
atcattgcctccaatgttgg

SEQ ID NO: 36417 - DNA, 20 bp, Artificial Sequence
  sgRNA
  Olfr1101_14
attcagcatggggatgacaa

SEQ ID NO: 36418 - DNA, 20 bp, Artificial Sequence
  sgRNA
  Olfr1101_15
acacctagaaaatagtacat

SEQ ID NO: 36419 - DNA, 20 bp, Artificial Sequence
  sgRNA
  Olfr1101_16
ttcacactcatgggaaacat

SEQ ID NO: 36420 - DNA, 20 bp, Artificial Sequence
  sgRNA
  Olfr1101_17
ttgaagatgcattctgctga

SEQ ID NO: 36421 - DNA, 20 bp, Artificial Sequence
  sgRNA
  Olfr1101_18
agctagcagtggctgctgta

SEQ ID NO: 36422 - DNA, 20 bp, Artificial Sequence
  sgRNA
  Olfr1101_19
agatgcattctgctgagggg

SEQ ID NO: 36423 - DNA, 20 bp, Artificial Sequence
  sgRNA
  Olfr1101_20
gcaagaaatagccagtaaag

SEQ ID NO: 36424 - DNA, 20 bp, Artificial Sequence
  sgRNA
  Olfr1104_1
caatgaatgctaaattgctg

SEQ ID NO: 36425 - DNA, 20 bp, Artificial Sequence
  sgRNA
  Olfr1104_2
ataatcacagaatatagtaa

SEQ ID NO: 36426 - DNA, 20 bp, Artificial Sequence
  sgRNA
  Olfr1104_3
cgtgctgaaggcatctacac

SEQ ID NO: 36427 - DNA, 20 bp, Artificial Sequence
  sgRNA
  Olfr1104_4
ttgatgtagggatcacagag

SEQ ID NO: 36428 - DNA, 20 bp, Artificial Sequence
  sgRNA
  Olfr1104_5
tgtgttatcaggttgcaaat

SEQ ID NO: 36429 - DNA, 20 bp, Artificial Sequence
  sgRNA
  Olfr1104_6
gcagtaataccatacatgat

SEQ ID NO: 36430 - DNA, 20 bp, Artificial Sequence
  sgRNA
  Olfr1104_7
ctgtgtagatgccttcagca

SEQ ID NO: 36431 - DNA, 20 bp, Artificial Sequence
  sgRNA
  Olfr1104_8
gttcagcatgggaataacaa

SEQ ID NO: 36432 - DNA, 20 bp, Artificial Sequence
  sgRNA
  Olfr1104_9
tgataatgagaagagaactg

SEQ ID NO: 36433 - DNA, 20 bp, Artificial Sequence
  sgRNA
  Olfr1104_10
atgcgcctctcacctcacag

SEQ ID NO: 36434 - DNA, 20 bp, Artificial Sequence
  sgRNA
  Olfr1104_11
gtgacagtcttcatgttcag

SEQ ID NO: 36435 - DNA, 20 bp, Artificial Sequence
  sgRNA
  Olfr1104_12
ggatacagtcagcagctggc

SEQ ID NO: 36436 - DNA, 20 bp, Artificial Sequence
  sgRNA
  Olfr1104_13
ggctacctgtgcttgggtga

SEQ ID NO: 36437 - DNA, 20 bp, Artificial Sequence
  sgRNA
  Olfr1104_14
gaaggcatctacacaggaca

SEQ ID NO: 36438 - DNA, 20 bp, Artificial Sequence
  sgRNA
  Olfr1104_15
ggacagggctaaaagagctg

SEQ ID NO: 36439 - DNA, 20 bp, Artificial Sequence
  sgRNA
  Olfr1104_16
cttaggatacagtcagcagc

SEQ ID NO: 36440 - DNA, 20 bp, Artificial Sequence
  sgRNA
  Olfr1104_17
tgctgactgtatcctaagga

SEQ ID NO: 36441 - DNA, 20 bp, Artificial Sequence
  sgRNA
  Olfr1104_18
cataagccatggatcccaga

SEQ ID NO: 36442 - DNA, 20 bp, Artificial Sequence
  sgRNA
  Olfr1104_19
agaagacagtgacccctgtg

SEQ ID NO: 36443 - DNA, 20 bp, Artificial Sequence
  sgRNA
  Olfr1104_20
ccatcatctcagccatcctt

SEQ ID NO: 36444 - DNA, 20 bp, Artificial Sequence
  sgRNA
  Olfr111_1
aaacccacatgtccagcatg

SEQ ID NO: 36445 - DNA, 20 bp, Artificial Sequence
  sgRNA
  Olfr111_2
atctgattgttaccacagaa

SEQ ID NO: 36446 - DNA, 20 bp, Artificial Sequence
  sgRNA
  Olfr111_3
acagcaaagccagttcattg

SEQ ID NO: 36447 - DNA, 20 bp, Artificial Sequence
  sgRNA
  Olfr111_4
gaagatgcaccatcatctgg

SEQ ID NO: 36448 - DNA, 20 bp, Artificial Sequence
  sgRNA
  Olfr111_5
ggctgctaaccagctgcaca

SEQ ID NO: 36449 - DNA, 20 bp, Artificial Sequence
  sgRNA
  Olfr111_6
gggcaggtggaaggtcagaa

SEQ ID NO: 36450 - DNA, 20 bp, Artificial Sequence
  sgRNA
  Olfr111_7
tctgtctcccctcagaggaa

SEQ ID NO: 36451 - DNA, 20 bp, Artificial Sequence
  sgRNA
  Olfr111_8
gaggaataaggacatcaaag

SEQ ID NO: 36452 - DNA, 20 bp, Artificial Sequence
  sgRNA
  Olfr111_9
ggctttctgtctcccctcag

SEQ ID NO: 36453 - DNA, 20 bp, Artificial Sequence
  sgRNA
  Olfr111_10
ataaattataggattcagca

SEQ ID NO: 36454 - DNA, 20 bp, Artificial Sequence
  sgRNA
  Olfr111_11
gattgttaccacagaagggc

SEQ ID NO: 36455 - DNA, 20 bp, Artificial Sequence
  sgRNA
  Olfr111_12
gctggttagcagcctcatgc

SEQ ID NO: 36456 - DNA, 20 bp, Artificial Sequence
  sgRNA
  Olfr111_13
taaattataggattcagcat

SEQ ID NO: 36457 - DNA, 20 bp, Artificial Sequence
  sgRNA
  Olfr111_14
ggtaggaaaggatgatgcac

SEQ ID NO: 36458 - DNA, 20 bp, Artificial Sequence
  sgRNA
  Olfr111_15
tctagcgagtaagatgagat

SEQ ID NO: 36459 - DNA, 20 bp, Artificial Sequence
  sgRNA
  Olfr111_16
ttcctcagtgcataaattat

SEQ ID NO: 36460 - DNA, 20 bp, Artificial Sequence
  sgRNA
  Olfr111_17
aggctgctaaccagctgcac

SEQ ID NO: 36461 - DNA, 20 bp, Artificial Sequence
  sgRNA
  Olfr111_18
atcctataatttatgcactg

SEQ ID NO: 36462 - DNA, 20 bp, Artificial Sequence
  sgRNA
  Olfr111_19
gcagcctcatgctggacatg

SEQ ID NO: 36463 - DNA, 20 bp, Artificial Sequence
  sgRNA
  Olfr111_20
accttccacctgcccttctg

SEQ ID NO: 36464 - DNA, 20 bp, Artificial Sequence
  sgRNA
  Olfr1111_1
tatctgcacatgataaagca

SEQ ID NO: 36465 - DNA, 20 bp, Artificial Sequence
  sgRNA
  Olfr1111_2
aagggatacatgcaccagtg

SEQ ID NO: 36466 - DNA, 20 bp, Artificial Sequence
  sgRNA
  Olfr1111_3
ccaatgtagagtaaagcagt

SEQ ID NO: 36467 - DNA, 20 bp, Artificial Sequence
  sgRNA
  Olfr1111_4
attgctaagaaagtgataca

SEQ ID NO: 36468 - DNA, 20 bp, Artificial Sequence
  sgRNA
  Olfr1111_5
acaatattggacctacagta

SEQ ID NO: 36469 - DNA, 20 bp, Artificial Sequence
  sgRNA
  Olfr1111_6
atagcagtcaccttgttcta

SEQ ID NO: 36470 - DNA, 20 bp, Artificial Sequence
  sgRNA
  Olfr1111_7
tgatgctcaaaacagtaatg

SEQ ID NO: 36471 - DNA, 20 bp, Artificial Sequence
  sgRNA
  Olfr1111_8
catagtttacaccttaactt

SEQ ID NO: 36472 - DNA, 20 bp, Artificial Sequence
  sgRNA
  Olfr1111_9
atagcatgagtcttaatggc

SEQ ID NO: 36473 - DNA, 20 bp, Artificial Sequence
  sgRNA
  Olfr1111_10
gcatcaagtccacaggaggc

SEQ ID NO: 36474 - DNA, 20 bp, Artificial Sequence
  sgRNA
  Olfr1111_11
gtttacaccttaactttggt

SEQ ID NO: 36475 - DNA, 20 bp, Artificial Sequence
  sgRNA
  Olfr1111_12
gtaaagcagtgggttgcaaa

SEQ ID NO: 36476 - DNA, 20 bp, Artificial Sequence
  sgRNA
  Olfr1111_13
catttatgcttccatactgt

SEQ ID NO: 36477 - DNA, 20 bp, Artificial Sequence
  sgRNA
  Olfr1111_14
cccactgctttactctacat

SEQ ID NO: 36478 - DNA, 20 bp, Artificial Sequence
  sgRNA
  Olfr1111_15
gcacatgataaagcaaggag

SEQ ID NO: 36479 - DNA, 20 bp, Artificial Sequence
  sgRNA
  Olfr1111_16
gtgggatatcacaaaaaaag

SEQ ID NO: 36480 - DNA, 20 bp, Artificial Sequence
  sgRNA
  Olfr1111_17
ctattccccagacactgata

SEQ ID NO: 36481 - DNA, 20 bp, Artificial Sequence
  sgRNA
  Olfr1111_18
gtatggaagcataaatgcaa

SEQ ID NO: 36482 - DNA, 20 bp, Artificial Sequence
  sgRNA
  Olfr1111_19
ttgagcatcaagtccacagg

SEQ ID NO: 36483 - DNA, 20 bp, Artificial Sequence
  sgRNA
  Olfr1111_20
ttaactttggtgggaaatat

SEQ ID NO: 36484 - DNA, 20 bp, Artificial Sequence
  sgRNA
  Olfr1116_1
actctgtgcctcccaacgta

SEQ ID NO: 36485 - DNA, 20 bp, Artificial Sequence
  sgRNA
  Olfr1116_2
tggaatcccactgatccagg

SEQ ID NO: 36486 - DNA, 20 bp, Artificial Sequence
  sgRNA
  Olfr1116_3
ataagtaaagaatattggag

SEQ ID NO: 36487 - DNA, 20 bp, Artificial Sequence
  sgRNA
  Olfr1116_4
acataggagtctggagagca

SEQ ID NO: 36488 - DNA, 20 bp, Artificial Sequence
  sgRNA
  Olfr1116_5
actatcttcagccaaaggga

SEQ ID NO: 36489 - DNA, 20 bp, Artificial Sequence
  sgRNA
  Olfr1116_6
tatcaggtgagacgagcagg

SEQ ID NO: 36490 - DNA, 20 bp, Artificial Sequence
  sgRNA
  Olfr1116_7
tgaaactatcttcagccaaa

SEQ ID NO: 36491 - DNA, 20 bp, Artificial Sequence
  sgRNA
  Olfr1116_8
atagttgtaatcttgttcta

SEQ ID NO: 36492 - DNA, 20 bp, Artificial Sequence
  sgRNA
  Olfr1116_9
aatgaattccatcagtgtgg

SEQ ID NO: 36493 - DNA, 20 bp, Artificial Sequence
  sgRNA
  Olfr1116_10
agaacaagattacaactatc

SEQ ID NO: 36494 - DNA, 20 bp, Artificial Sequence
  sgRNA
  Olfr1116_11
ttcctcagactgtatataat

SEQ ID NO: 36495 - DNA, 20 bp, Artificial Sequence
  sgRNA
  Olfr1116_12
cgagcaggtggaaaaagcct

SEQ ID NO: 36496 - DNA, 20 bp, Artificial Sequence
  sgRNA
  Olfr1116_13
gactgcaactgtattcataa

SEQ ID NO: 36497 - DNA, 20 bp, Artificial Sequence
  sgRNA
  Olfr1116_14
tagctgcctcctggatcagt

SEQ ID NO: 36498 - DNA, 20 bp, Artificial Sequence
  sgRNA
  Olfr1116_15
atcctattatatacagtctg

SEQ ID NO: 36499 - DNA, 20 bp, Artificial Sequence
  sgRNA
  Olfr1116_16
gtagctgcctcctggatcag

SEQ ID NO: 36500 - DNA, 20 bp, Artificial Sequence
  sgRNA
  Olfr1116_17
cagtaagttactgatatggt

SEQ ID NO: 36501 - DNA, 20 bp, Artificial Sequence
  sgRNA
  Olfr1116_18
aactatcaggtgagacgagc

SEQ ID NO: 36502 - DNA, 20 bp, Artificial Sequence
  sgRNA
  Olfr1116_19
atggatttatataccctaaa

SEQ ID NO: 36503 - DNA, 20 bp, Artificial Sequence
  sgRNA
  Olfr1116_20
aagaatgaattccatcagtg

SEQ ID NO: 36504 - DNA, 20 bp, Artificial Sequence
  sgRNA
  Olfr1117-ps1_1
actgtcttcagccaaagtga

SEQ ID NO: 36505 - DNA, 20 bp, Artificial Sequence
  sgRNA
  Olfr1117-ps1_2
atagatccataagcattctt

SEQ ID NO: 36506 - DNA, 20 bp, Artificial Sequence
  sgRNA
  Olfr1117-ps1_3
acaaaactacaactatcagg

SEQ ID NO: 36507 - DNA, 20 bp, Artificial Sequence
  sgRNA
  Olfr1117-ps1_4
tgaacaggtggaaaaagcct

SEQ ID NO: 36508 - DNA, 20 bp, Artificial Sequence
  sgRNA
  Olfr1117-ps1_5
cagtaagttactgatacggt

SEQ ID NO: 36509 - DNA, 20 bp, Artificial Sequence
  sgRNA
  Olfr1117-ps1_6
tgcagtctatgttgttgcag

SEQ ID NO: 36510 - DNA, 20 bp, Artificial Sequence
  sgRNA
  Olfr1117-ps1_7
tagctgtctcctggatcagt

SEQ ID NO: 36511 - DNA, 20 bp, Artificial Sequence
  sgRNA
  Olfr1117-ps1_8
actctgtgcctcccaacata

SEQ ID NO: 36512 - DNA, 20 bp, Artificial Sequence
  sgRNA
  Olfr1117-ps1_9
agtaaattccatcagtgtgg

SEQ ID NO: 36513 - DNA, 20 bp, Artificial Sequence
  sgRNA
  Olfr1117-ps1_10
acagtaagttactgatacgg

SEQ ID NO: 36514 - DNA, 20 bp, Artificial Sequence
  sgRNA
  Olfr1117-ps1_11
tgtatatgacaattctgttg

SEQ ID NO: 36515 - DNA, 20 bp, Artificial Sequence
  sgRNA
  Olfr1117-ps1_12
aaaagccttggccatcactt

SEQ ID NO: 36516 - DNA, 20 bp, Artificial Sequence
  sgRNA
  Olfr1117-ps1_13
tatcaggtgggatgaacagg

SEQ ID NO: 36517 - DNA, 20 bp, Artificial Sequence
  sgRNA
  Olfr1117-ps1_14
tacataacagatttccaaaa

SEQ ID NO: 36518 - DNA, 20 bp, Artificial Sequence
  sgRNA
  Olfr1117-ps1_15
gactgcaactgtattcaaaa

SEQ ID NO: 36519 - DNA, 20 bp, Artificial Sequence
  sgRNA
  Olfr1117-ps1_16
gtagctgtctcctggatcag

SEQ ID NO: 36520 - DNA, 20 bp, Artificial Sequence
  sgRNA
  Olfr1117-ps1_17
aagagtaaattccatcagtg

SEQ ID NO: 36521 - DNA, 20 bp, Artificial Sequence
  sgRNA
  Olfr1117-ps1_18
tgatggaatttactcttctt

SEQ ID NO: 36522 - DNA, 20 bp, Artificial Sequence
  sgRNA
  Olfr1117-ps1_19
aaataggagtctggagagca

SEQ ID NO: 36523 - DNA, 20 bp, Artificial Sequence
  sgRNA
  Olfr1117-ps1_20
caaaactacaactatcaggt

SEQ ID NO: 36524 - DNA, 20 bp, Artificial Sequence
  sgRNA
  Olfr1118_1
aggaatcccactgatccaag

SEQ ID NO: 36525 - DNA, 20 bp, Artificial Sequence
  sgRNA
  Olfr1118_2
ataagtagagaatattgtag

SEQ ID NO: 36526 - DNA, 20 bp, Artificial Sequence
  sgRNA
  Olfr1118_3
acataggagtatggagagca

SEQ ID NO: 36527 - DNA, 20 bp, Artificial Sequence
  sgRNA
  Olfr1118_4
gtgggattcctgtacaaatt

SEQ ID NO: 36528 - DNA, 20 bp, Artificial Sequence
  sgRNA
  Olfr1118_5
acaagactacaactatcagg

SEQ ID NO: 36529 - DNA, 20 bp, Artificial Sequence
  sgRNA
  Olfr1118_6
aataaattccatcaatgtgg

SEQ ID NO: 36530 - DNA, 20 bp, Artificial Sequence
  sgRNA
  Olfr1118_7
gtagagaatattgtagaggg

SEQ ID NO: 36531 - DNA, 20 bp, Artificial Sequence
  sgRNA
  Olfr1118_8
tagctgcctcttggatcagt

SEQ ID NO: 36532 - DNA, 20 bp, Artificial Sequence
  sgRNA
  Olfr1118_9
tgaaactgtcttcagccaaa

SEQ ID NO: 36533 - DNA, 20 bp, Artificial Sequence
  sgRNA
  Olfr1118_10
tgctagcaagaggcactctg

SEQ ID NO: 36534 - DNA, 20 bp, Artificial Sequence
  sgRNA
  Olfr1118_11
tgagcaggtggaaaaagcct

SEQ ID NO: 36535 - DNA, 20 bp, Artificial Sequence
  sgRNA
  Olfr1118_12
gttgaatgcctccacattga

SEQ ID NO: 36536 - DNA, 20 bp, Artificial Sequence
  sgRNA
  Olfr1118_13
atagttgtagtcttgttcta

SEQ ID NO: 36537 - DNA, 20 bp, Artificial Sequence
  sgRNA
  Olfr1118_14
taggtctgcccaatttgtac

SEQ ID NO: 36538 - DNA, 20 bp, Artificial Sequence
  sgRNA
  Olfr1118_15
actgtcttcagccaaaggga

SEQ ID NO: 36539 - DNA, 20 bp, Artificial Sequence
  sgRNA
  Olfr1118_16
taagtagagaatattgtaga

SEQ ID NO: 36540 - DNA, 20 bp, Artificial Sequence
  sgRNA
  Olfr1118_17
gtagctgcctcttggatcag

SEQ ID NO: 36541 - DNA, 20 bp, Artificial Sequence
  sgRNA
  Olfr1118_18
agtgggattcctgtacaaat

SEQ ID NO: 36542 - DNA, 20 bp, Artificial Sequence
  sgRNA
  Olfr1118_19
aagaataaattccatcaatg

SEQ ID NO: 36543 - DNA, 20 bp, Artificial Sequence
  sgRNA
  Olfr1118_20
atgaaactgtcttcagccaa

SEQ ID NO: 36544 - DNA, 20 bp, Artificial Sequence
  sgRNA
  Olfr1122_1
atgtaacagtcacaatccca

SEQ ID NO: 36545 - DNA, 20 bp, Artificial Sequence
  sgRNA
  Olfr1122_2
aaaacagagctgtacagcac

SEQ ID NO: 36546 - DNA, 20 bp, Artificial Sequence
  sgRNA
  Olfr1122_3
atatcccaaaaagcatccac

SEQ ID NO: 36547 - DNA, 20 bp, Artificial Sequence
  sgRNA
  Olfr1122_4
ccactactcaagcttgcttg

SEQ ID NO: 36548 - DNA, 20 bp, Artificial Sequence
  sgRNA
  Olfr1122_5
atcccattatatatacactg

SEQ ID NO: 36549 - DNA, 20 bp, Artificial Sequence
  sgRNA
  Olfr1122_6
gcatatcagtcggaaacctt

SEQ ID NO: 36550 - DNA, 20 bp, Artificial Sequence
  sgRNA
  Olfr1122_7
cataggccatgactgtcagg

SEQ ID NO: 36551 - DNA, 20 bp, Artificial Sequence
  sgRNA
  Olfr1122_8
caagcaagcttgagtagtgg

SEQ ID NO: 36552 - DNA, 20 bp, Artificial Sequence
  sgRNA
  Olfr1122_9
acaaccaaaagcatatcagt

SEQ ID NO: 36553 - DNA, 20 bp, Artificial Sequence
  sgRNA
  Olfr1122_10
attcaacagtggaatcaaaa

SEQ ID NO: 36554 - DNA, 20 bp, Artificial Sequence
  sgRNA
  Olfr1122_11
aagagatagcagctttccca

SEQ ID NO: 36555 - DNA, 20 bp, Artificial Sequence
  sgRNA
  Olfr1122_12
taaaactggcaacatctgga

SEQ ID NO: 36556 - DNA, 20 bp, Artificial Sequence
  sgRNA
  Olfr1122_13
ctaaaactggcaacatctgg

SEQ ID NO: 36557 - DNA, 20 bp, Artificial Sequence
  sgRNA
  Olfr1122_14
ctgatgtccctcaactccag

SEQ ID NO: 36558 - DNA, 20 bp, Artificial Sequence
  sgRNA
  Olfr1122_15
gttgcagataatcttgccat

SEQ ID NO: 36559 - DNA, 20 bp, Artificial Sequence
  sgRNA
  Olfr1122_16
ctcatctcatctaatagttg

SEQ ID NO: 36560 - DNA, 20 bp, Artificial Sequence
  sgRNA
  Olfr1122_17
ataatgcaaaggattgcaga

SEQ ID NO: 36561 - DNA, 20 bp, Artificial Sequence
  sgRNA
  Olfr1122_18
cactactgaagcaatataga

SEQ ID NO: 36562 - DNA, 20 bp, Artificial Sequence
  sgRNA
  Olfr1122_19
gtttccgactgatatgcttt

SEQ ID NO: 36563 - DNA, 20 bp, Artificial Sequence
  sgRNA
  Olfr1122_20
ttacagaatttgttctctta

SEQ ID NO: 36564 - DNA, 20 bp, Artificial Sequence
  sgRNA
  Olfr1123_1
ggacatcagaaaaaccaagt

SEQ ID NO: 36565 - DNA, 20 bp, Artificial Sequence
  sgRNA
  Olfr1123_2
gtggacctgtgtactcagaa

SEQ ID NO: 36566 - DNA, 20 bp, Artificial Sequence
  sgRNA
  Olfr1123_3
ccagtactcaaacttgcttg

SEQ ID NO: 36567 - DNA, 20 bp, Artificial Sequence
  sgRNA
  Olfr1123_4
caggatctgtacacagttag

SEQ ID NO: 36568 - DNA, 20 bp, Artificial Sequence
  sgRNA
  Olfr1123_5
ctaactgtgtacagatcctg

SEQ ID NO: 36569 - DNA, 20 bp, Artificial Sequence
  sgRNA
  Olfr1123_6
tggtatgacactgatccagc

SEQ ID NO: 36570 - DNA, 20 bp, Artificial Sequence
  sgRNA
  Olfr1123_7
cataggccattgctgtcagg

SEQ ID NO: 36571 - DNA, 20 bp, Artificial Sequence
  sgRNA
  Olfr1123_8
agcagtctacgtagttgcga

SEQ ID NO: 36572 - DNA, 20 bp, Artificial Sequence
  sgRNA
  Olfr1123_9
atgactaaagaatagtgtag

SEQ ID NO: 36573 - DNA, 20 bp, Artificial Sequence
  sgRNA
  Olfr1123_10
ctgaaactgtcatcagccaa

SEQ ID NO: 36574 - DNA, 20 bp, Artificial Sequence
  sgRNA
  Olfr1123_11
atagtgtagaggattacaaa

SEQ ID NO: 36575 - DNA, 20 bp, Artificial Sequence
  sgRNA
  Olfr1123_12
agtgtcataccagttgtaat

SEQ ID NO: 36576 - DNA, 20 bp, Artificial Sequence
  sgRNA
  Olfr1123_13
ggagcaggtggagaaagctt

SEQ ID NO: 36577 - DNA, 20 bp, Artificial Sequence
  sgRNA
  Olfr1123_14
attctgttagagccacaaaa

SEQ ID NO: 36578 - DNA, 20 bp, Artificial Sequence
  sgRNA
  Olfr1123_15
ctgatgtccccaatctccaa

SEQ ID NO: 36579 - DNA, 20 bp, Artificial Sequence
  sgRNA
  Olfr1123_16
attcagagttggtatcaaaa

SEQ ID NO: 36580 - DNA, 20 bp, Artificial Sequence
  sgRNA
  Olfr1123_17
gagaaaatgatcagcataaa

SEQ ID NO: 36581 - DNA, 20 bp, Artificial Sequence
  sgRNA
  Olfr1123_18
gataaattcaatcagcgaag

SEQ ID NO: 36582 - DNA, 20 bp, Artificial Sequence
  sgRNA
  Olfr1123_19
atagttgtagtcttattcta

SEQ ID NO: 36583 - DNA, 20 bp, Artificial Sequence
  sgRNA
  Olfr1123_20
aggccattgctgtcaggagg

SEQ ID NO: 36584 - DNA, 20 bp, Artificial Sequence
  sgRNA
  Olfr1135_1
aatcctctgatgtatgtagt

SEQ ID NO: 36585 - DNA, 20 bp, Artificial Sequence
  sgRNA
  Olfr1135_2
caactgcagtggaatagcag

SEQ ID NO: 36586 - DNA, 20 bp, Artificial Sequence
  sgRNA
  Olfr1135_3
aatgaacccaaaaataacaa

SEQ ID NO: 36587 - DNA, 20 bp, Artificial Sequence
  sgRNA
  Olfr1135_4
aataaccctagcatgaaagt

SEQ ID NO: 36588 - DNA, 20 bp, Artificial Sequence
  sgRNA
  Olfr1135_5
aaatccgctccactgatggg

SEQ ID NO: 36589 - DNA, 20 bp, Artificial Sequence
  sgRNA
  Olfr1135_6
cagtatctatcattcctact

SEQ ID NO: 36590 - DNA, 20 bp, Artificial Sequence
  sgRNA
  Olfr1135_7
ctactaggtaaactccagct

SEQ ID NO: 36591 - DNA, 20 bp, Artificial Sequence
  sgRNA
  Olfr1135_8
ctagctggagtttacctagt

SEQ ID NO: 36592 - DNA, 20 bp, Artificial Sequence
  sgRNA
  Olfr1135_9
ataccgactacatacatcag

SEQ ID NO: 36593 - DNA, 20 bp, Artificial Sequence
  sgRNA
  Olfr1135_10
agttaagtgagaggcacagg

SEQ ID NO: 36594 - DNA, 20 bp, Artificial Sequence
  sgRNA
  Olfr1135_11
gttaagcatggggatcacca

SEQ ID NO: 36595 - DNA, 20 bp, Artificial Sequence
  sgRNA
  Olfr1135_12
tgaacctcccatcagtggag

SEQ ID NO: 36596 - DNA, 20 bp, Artificial Sequence
  sgRNA
  Olfr1135_13
tccacagaaacataacccaa

SEQ ID NO: 36597 - DNA, 20 bp, Artificial Sequence
  sgRNA
  Olfr1135_14
aagatagtagcaggatagga

SEQ ID NO: 36598 - DNA, 20 bp, Artificial Sequence
  sgRNA
  Olfr1135_15
atagacccactttcatgcta

SEQ ID NO: 36599 - DNA, 20 bp, Artificial Sequence
  sgRNA
  Olfr1135_16
acatgaagagcagtgttccc

SEQ ID NO: 36600 - DNA, 20 bp, Artificial Sequence
  sgRNA
  Olfr1135_17
tatctgagcaagatagtagc

SEQ ID NO: 36601 - DNA, 20 bp, Artificial Sequence
  sgRNA
  Olfr1135_18
gtaaatcagagggttaagca

SEQ ID NO: 36602 - DNA, 20 bp, Artificial Sequence
  sgRNA
  Olfr1135_19
tccttaggctgtaaatcaga

SEQ ID NO: 36603 - DNA, 20 bp, Artificial Sequence
  sgRNA
  Olfr1135_20
aacaaaggtgattaactcat

SEQ ID NO: 36604 - DNA, 20 bp, Artificial Sequence
  sgRNA
  Olfr1136_1
actattcttctgacaaacgt

SEQ ID NO: 36605 - DNA, 20 bp, Artificial Sequence
  sgRNA
  Olfr1136_2
tgtccacagcatacataagg

SEQ ID NO: 36606 - DNA, 20 bp, Artificial Sequence
  sgRNA
  Olfr1136_3
ttggattattatcttcaagg

SEQ ID NO: 36607 - DNA, 20 bp, Artificial Sequence
  sgRNA
  Olfr1136_4
aatgattgatctgagtagag

SEQ ID NO: 36608 - DNA, 20 bp, Artificial Sequence
  sgRNA
  Olfr1136_5
tcaggctcagaagtaaatgg

SEQ ID NO: 36609 - DNA, 20 bp, Artificial Sequence
  sgRNA
  Olfr1136_6
cgtttgtcagaagaatagtg

SEQ ID NO: 36610 - DNA, 20 bp, Artificial Sequence
  sgRNA
  Olfr1136_7
catgtccacagcatacataa

SEQ ID NO: 36611 - DNA, 20 bp, Artificial Sequence
  sgRNA
  Olfr1136_8
gataacaaggaggtaaaata

SEQ ID NO: 36612 - DNA, 20 bp, Artificial Sequence
  sgRNA
  Olfr1136_9
catagattgcagttaaaaac

SEQ ID NO: 36613 - DNA, 20 bp, Artificial Sequence
  sgRNA
  Olfr1136_10
acgtttgtcagaagaatagt

SEQ ID NO: 36614 - DNA, 20 bp, Artificial Sequence
  sgRNA
  Olfr1136_11
tgttgaatgcatgctgctgg

SEQ ID NO: 36615 - DNA, 20 bp, Artificial Sequence
  sgRNA
  Olfr1136_12
taaagattagttctactggt

SEQ ID NO: 36616 - DNA, 20 bp, Artificial Sequence
  sgRNA
  Olfr1136_13
ttatcatagggataacaagg

SEQ ID NO: 36617 - DNA, 20 bp, Artificial Sequence
  sgRNA
  Olfr1136_14
tgcgtagactataaatcaga

SEQ ID NO: 36618 - DNA, 20 bp, Artificial Sequence
  sgRNA
  Olfr1136_15
tatgtgtttggaactataga

SEQ ID NO: 36619 - DNA, 20 bp, Artificial Sequence
  sgRNA
  Olfr1136_16
tccaactgcagtcagatgag

SEQ ID NO: 36620 - DNA, 20 bp, Artificial Sequence
  sgRNA
  Olfr1136_17
agagatcagagaatgagagg

SEQ ID NO: 36621 - DNA, 20 bp, Artificial Sequence
  sgRNA
  Olfr1136_18
ttgcgtagactataaatcag

SEQ ID NO: 36622 - DNA, 20 bp, Artificial Sequence
  sgRNA
  Olfr1136_19
tttatcttgatctagagagt

SEQ ID NO: 36623 - DNA, 20 bp, Artificial Sequence
  sgRNA
  Olfr1136_20
catgaaagaagcaagactgg

SEQ ID NO: 36624 - DNA, 20 bp, Artificial Sequence
  sgRNA
  Olfr1137_1
tggtttgatacatacaacac

SEQ ID NO: 36625 - DNA, 20 bp, Artificial Sequence
  sgRNA
  Olfr1137_2
gtgtgtcagaacaggaaagg

SEQ ID NO: 36626 - DNA, 20 bp, Artificial Sequence
  sgRNA
  Olfr1137_3
actccaccgcagttggaccc

SEQ ID NO: 36627 - DNA, 20 bp, Artificial Sequence
  sgRNA
  Olfr1137_4
caaaccccttctgtattctg

SEQ ID NO: 36628 - DNA, 20 bp, Artificial Sequence
  sgRNA
  Olfr1137_5
actactctgctggaaaacat

SEQ ID NO: 36629 - DNA, 20 bp, Artificial Sequence
  sgRNA
  Olfr1137_6
gagtagtgagataaacaagc

SEQ ID NO: 36630 - DNA, 20 bp, Artificial Sequence
  sgRNA
  Olfr1137_7
ggtaaattaaagttaaaaac

SEQ ID NO: 36631 - DNA, 20 bp, Artificial Sequence
  sgRNA
  Olfr1137_8
catgtccacagaatacagaa

SEQ ID NO: 36632 - DNA, 20 bp, Artificial Sequence
  sgRNA
  Olfr1137_9
ttccgtagactgtaaatcag

SEQ ID NO: 36633 - DNA, 20 bp, Artificial Sequence
  sgRNA
  Olfr1137_10
acatgtccacagaatacaga

SEQ ID NO: 36634 - DNA, 20 bp, Artificial Sequence
  sgRNA
  Olfr1137_11
tctgaaatacatgaagagca

SEQ ID NO: 36635 - DNA, 20 bp, Artificial Sequence
  sgRNA
  Olfr1137_12
acattggtgtgtgaagctgg

SEQ ID NO: 36636 - DNA, 20 bp, Artificial Sequence
  sgRNA
  Olfr1137_13
actaggtctaccagcatcct

SEQ ID NO: 36637 - DNA, 20 bp, Artificial Sequence
  sgRNA
  Olfr1137_14
tccgtagactgtaaatcaga

SEQ ID NO: 36638 - DNA, 20 bp, Artificial Sequence
  sgRNA
  Olfr1137_15
agagatcagagaaagacagg

SEQ ID NO: 36639 - DNA, 20 bp, Artificial Sequence
  sgRNA
  Olfr1137_16
atacagaaggggtttgctga

SEQ ID NO: 36640 - DNA, 20 bp, Artificial Sequence
  sgRNA
  Olfr1137_17
ttatcatggggataatgagg

SEQ ID NO: 36641 - DNA, 20 bp, Artificial Sequence
  sgRNA
  Olfr1137_18
ttgccagaattctttctctt

SEQ ID NO: 36642 - DNA, 20 bp, Artificial Sequence
  sgRNA
  Olfr1137_19
atgtccacagaatacagaag

SEQ ID NO: 36643 - DNA, 20 bp, Artificial Sequence
  sgRNA
  Olfr1137_20
cctctcacctgactgcagtt

SEQ ID NO: 36644 - DNA, 20 bp, Artificial Sequence
  sgRNA
  Olfr1138_1
caagacagtactaacactgg

SEQ ID NO: 36645 - DNA, 20 bp, Artificial Sequence
  sgRNA
  Olfr1138_2
tgtctactgcatacaaaagg

SEQ ID NO: 36646 - DNA, 20 bp, Artificial Sequence
  sgRNA
  Olfr1138_3
gggaattaccagtaaccctg

SEQ ID NO: 36647 - DNA, 20 bp, Artificial Sequence
  sgRNA
  Olfr1138_4
tagatgtattcttagacagt

SEQ ID NO: 36648 - DNA, 20 bp, Artificial Sequence
  sgRNA
  Olfr1138_5
actgtcttgttcagacacac

SEQ ID NO: 36649 - DNA, 20 bp, Artificial Sequence
  sgRNA
  Olfr1138_6
acatgtctactgcatacaaa

SEQ ID NO: 36650 - DNA, 20 bp, Artificial Sequence
  sgRNA
  Olfr1138_7
atacaaaagggggttactaa

SEQ ID NO: 36651 - DNA, 20 bp, Artificial Sequence
  sgRNA
  Olfr1138_8
tgaagatcagttctgctgct

SEQ ID NO: 36652 - DNA, 20 bp, Artificial Sequence
  sgRNA
  Olfr1138_9
aataaacaccagtcaataat

SEQ ID NO: 36653 - DNA, 20 bp, Artificial Sequence
  sgRNA
  Olfr1138_10
cattccacttatgtttctgt

SEQ ID NO: 36654 - DNA, 20 bp, Artificial Sequence
  sgRNA
  Olfr1138_11
tcgacccacagaaacataag

SEQ ID NO: 36655 - DNA, 20 bp, Artificial Sequence
  sgRNA
  Olfr1138_12
aatcacaagtgtataaaaaa

SEQ ID NO: 36656 - DNA, 20 bp, Artificial Sequence
  sgRNA
  Olfr1138_13
gaaaaattgcaacagcagtc

SEQ ID NO: 36657 - DNA, 20 bp, Artificial Sequence
  sgRNA
  Olfr1138_14
tcctcaaactataaatcaga

SEQ ID NO: 36658 - DNA, 20 bp, Artificial Sequence
  sgRNA
  Olfr1138_15
agatcagttctgctgctggg

SEQ ID NO: 36659 - DNA, 20 bp, Artificial Sequence
  sgRNA
  Olfr1138_16
catgtctactgcatacaaaa

SEQ ID NO: 36660 - DNA, 20 bp, Artificial Sequence
  sgRNA
  Olfr1138_17
aaagatcagagaaagacagg

SEQ ID NO: 36661 - DNA, 20 bp, Artificial Sequence
  sgRNA
  Olfr1138_18
gtgtgcttccaattattgac

SEQ ID NO: 36662 - DNA, 20 bp, Artificial Sequence
  sgRNA
  Olfr1138_19
ataaatcagagggttcagca

SEQ ID NO: 36663 - DNA, 20 bp, Artificial Sequence
  sgRNA
  Olfr1138_20
ggttactggtaattcccaaa

SEQ ID NO: 36664 - DNA, 20 bp, Artificial Sequence
  sgRNA
  Olfr1140_1
catgtctacaacatacatca

SEQ ID NO: 36665 - DNA, 20 bp, Artificial Sequence
  sgRNA
  Olfr1140_2
caacagcagtggaataacag

SEQ ID NO: 36666 - DNA, 20 bp, Artificial Sequence
  sgRNA
  Olfr1140_3
atagaaccactttcatgcta

SEQ ID NO: 36667 - DNA, 20 bp, Artificial Sequence
  sgRNA
  Olfr1140_4
ctcaacatctataaagacac

SEQ ID NO: 36668 - DNA, 20 bp, Artificial Sequence
  sgRNA
  Olfr1140_5
cctacagaaacacaacccaa

SEQ ID NO: 36669 - DNA, 20 bp, Artificial Sequence
  sgRNA
  Olfr1140_6
tgcaaactataataaccttt

SEQ ID NO: 36670 - DNA, 20 bp, Artificial Sequence
  sgRNA
  Olfr1140_7
gttgagcataggtatcacca

SEQ ID NO: 36671 - DNA, 20 bp, Artificial Sequence
  sgRNA
  Olfr1140_8
tttatttctcagtttgtaca

SEQ ID NO: 36672 - DNA, 20 bp, Artificial Sequence
  sgRNA
  Olfr1140_9
ggttgagcataggtatcacc

SEQ ID NO: 36673 - DNA, 20 bp, Artificial Sequence
  sgRNA
  Olfr1140_10
cataaactccagccagaagc

SEQ ID NO: 36674 - DNA, 20 bp, Artificial Sequence
  sgRNA
  Olfr1140_11
tgatgaccctagcatgaaag

SEQ ID NO: 36675 - DNA, 20 bp, Artificial Sequence
  sgRNA
  Olfr1140_12
acatgtctacaacatacatc

SEQ ID NO: 36676 - DNA, 20 bp, Artificial Sequence
  sgRNA
  Olfr1140_13
ttctcaggctgtaaatcaga

SEQ ID NO: 36677 - DNA, 20 bp, Artificial Sequence
  sgRNA
  Olfr1140_14
aggagtatgaagaacttggc

SEQ ID NO: 36678 - DNA, 20 bp, Artificial Sequence
  sgRNA
  Olfr1140_15
catctttggtccaacagcag

SEQ ID NO: 36679 - DNA, 20 bp, Artificial Sequence
  sgRNA
  Olfr1140_16
caccagggtataaaacaatg

SEQ ID NO: 36680 - DNA, 20 bp, Artificial Sequence
  sgRNA
  Olfr1140_17
aattgcaactgcagtcaggt

SEQ ID NO: 36681 - DNA, 20 bp, Artificial Sequence
  sgRNA
  Olfr1140_18
aagctggtaacaaaatctac

SEQ ID NO: 36682 - DNA, 20 bp, Artificial Sequence
  sgRNA
  Olfr1140_19
gatttacagcctgagaaaca

SEQ ID NO: 36683 - DNA, 20 bp, Artificial Sequence
  sgRNA
  Olfr1140_20
tgtacaaactgagaaataaa

SEQ ID NO: 36684 - DNA, 20 bp, Artificial Sequence
  sgRNA
  Olfr1141_1
ctatggcatatatcacgggg

SEQ ID NO: 36685 - DNA, 20 bp, Artificial Sequence
  sgRNA
  Olfr1141_2
aagcatctgtcattcctaca

SEQ ID NO: 36686 - DNA, 20 bp, Artificial Sequence
  sgRNA
  Olfr1141_3
tcgaaaggcacaaacaacaa

SEQ ID NO: 36687 - DNA, 20 bp, Artificial Sequence
  sgRNA
  Olfr1141_4
catcttggacccaattgcag

SEQ ID NO: 36688 - DNA, 20 bp, Artificial Sequence
  sgRNA
  Olfr1141_5
tatctatggcatatatcacg

SEQ ID NO: 36689 - DNA, 20 bp, Artificial Sequence
  sgRNA
  Olfr1141_6
cgaaaggcacaaacaacaat

SEQ ID NO: 36690 - DNA, 20 bp, Artificial Sequence
  sgRNA
  Olfr1141_7
aagacagtaacagtatagga

SEQ ID NO: 36691 - DNA, 20 bp, Artificial Sequence
  sgRNA
  Olfr1141_8
gtatgctaccaattcctggc

SEQ ID NO: 36692 - DNA, 20 bp, Artificial Sequence
  sgRNA
  Olfr1141_9
gatttacagcctgagataca

SEQ ID NO: 36693 - DNA, 20 bp, Artificial Sequence
  sgRNA
  Olfr1141_10
agtcagatgcaaggtgcagg

SEQ ID NO: 36694 - DNA, 20 bp, Artificial Sequence
  sgRNA
  Olfr1141_11
ggtaaacaccagccaggaat

SEQ ID NO: 36695 - DNA, 20 bp, Artificial Sequence
  sgRNA
  Olfr1141_12
ttgaaaatccattctgccaa

SEQ ID NO: 36696 - DNA, 20 bp, Artificial Sequence
  sgRNA
  Olfr1141_13
tgaggtcagagaaaaagagg

SEQ ID NO: 36697 - DNA, 20 bp, Artificial Sequence
  sgRNA
  Olfr1141_14
tgcaacagcagtcagatgca

SEQ ID NO: 36698 - DNA, 20 bp, Artificial Sequence
  sgRNA
  Olfr1141_15
catcagagtataaaacaagg

SEQ ID NO: 36699 - DNA, 20 bp, Artificial Sequence
  sgRNA
  Olfr1141_16
atctcaggctgtaaatcagt

SEQ ID NO: 36700 - DNA, 20 bp, Artificial Sequence
  sgRNA
  Olfr1141_17
gtaaatcagtgggttcagca

SEQ ID NO: 36701 - DNA, 20 bp, Artificial Sequence
  sgRNA
  Olfr1141_18
agctgaggtcagagaaaaag

SEQ ID NO: 36702 - DNA, 20 bp, Artificial Sequence
  sgRNA
  Olfr1141_19
cagacaaaaaaagaatcgaa

SEQ ID NO: 36703 - DNA, 20 bp, Artificial Sequence
  sgRNA
  Olfr1141_20
gtattagcactttcatgtca

SEQ ID NO: 36704 - DNA, 20 bp, Artificial Sequence
  sgRNA
  Olfr1152_1
gtgtactacagcatctacaa

SEQ ID NO: 36705 - DNA, 20 bp, Artificial Sequence
  sgRNA
  Olfr1152_2
caggagagcatgtatagtgg

SEQ ID NO: 36706 - DNA, 20 bp, Artificial Sequence
  sgRNA
  Olfr1152_3
tgcagtagatatgtccagca

SEQ ID NO: 36707 - DNA, 20 bp, Artificial Sequence
  sgRNA
  Olfr1152_4
tggcaatgatggcgtttgat

SEQ ID NO: 36708 - DNA, 20 bp, Artificial Sequence
  sgRNA
  Olfr1152_5
tgtaaactacagccagaagt

SEQ ID NO: 36709 - DNA, 20 bp, Artificial Sequence
  sgRNA
  Olfr1152_6
atatctactgcatatagcaa

SEQ ID NO: 36710 - DNA, 20 bp, Artificial Sequence
  sgRNA
  Olfr1152_7
tatctactgcatatagcaag

SEQ ID NO: 36711 - DNA, 20 bp, Artificial Sequence
  sgRNA
  Olfr1152_8
tgaacctgccctcagcagaa

SEQ ID NO: 36712 - DNA, 20 bp, Artificial Sequence
  sgRNA
  Olfr1152_9
gttcaacacagggatcacca

SEQ ID NO: 36713 - DNA, 20 bp, Artificial Sequence
  sgRNA
  Olfr1152_10
tgcaactgcagttaaatgag

SEQ ID NO: 36714 - DNA, 20 bp, Artificial Sequence
  sgRNA
  Olfr1152_11
agttaaatgagaggtgcagg

SEQ ID NO: 36715 - DNA, 20 bp, Artificial Sequence
  sgRNA
  Olfr1152_12
aaatcagagggttcaacaca

SEQ ID NO: 36716 - DNA, 20 bp, Artificial Sequence
  sgRNA
  Olfr1152_13
agacatcagagaaagagagg

SEQ ID NO: 36717 - DNA, 20 bp, Artificial Sequence
  sgRNA
  Olfr1152_14
gagcaggagagcatgtatag

SEQ ID NO: 36718 - DNA, 20 bp, Artificial Sequence
  sgRNA
  Olfr1152_15
tcccaagaaaaggaactcag

SEQ ID NO: 36719 - DNA, 20 bp, Artificial Sequence
  sgRNA
  Olfr1152_16
agcagacatcagagaaagag

SEQ ID NO: 36720 - DNA, 20 bp, Artificial Sequence
  sgRNA
  Olfr1152_17
aagttggtaacacaccttgc

SEQ ID NO: 36721 - DNA, 20 bp, Artificial Sequence
  sgRNA
  Olfr1152_18
agttggaccaaagatgttat

SEQ ID NO: 36722 - DNA, 20 bp, Artificial Sequence
  sgRNA
  Olfr1152_19
tctagagaataagaagaact

SEQ ID NO: 36723 - DNA, 20 bp, Artificial Sequence
  sgRNA
  Olfr1152_20
caccaaggtgtaaaacagtg

SEQ ID NO: 36724 - DNA, 20 bp, Artificial Sequence
  sgRNA
  Olfr1153_1
tgcggtagatatgtccagag

SEQ ID NO: 36725 - DNA, 20 bp, Artificial Sequence
  sgRNA
  Olfr1153_2
cagtagcacacactcagcat

SEQ ID NO: 36726 - DNA, 20 bp, Artificial Sequence
  sgRNA
  Olfr1153_3
tcccaagagaagaaactcag

SEQ ID NO: 36727 - DNA, 20 bp, Artificial Sequence
  sgRNA
  Olfr1153_4
gaacaagatagtaataggag

SEQ ID NO: 36728 - DNA, 20 bp, Artificial Sequence
  sgRNA
  Olfr1153_5
tatctaccgcatacatcaag

SEQ ID NO: 36729 - DNA, 20 bp, Artificial Sequence
  sgRNA
  Olfr1153_6
gccaagttctgcttattccc

SEQ ID NO: 36730 - DNA, 20 bp, Artificial Sequence
  sgRNA
  Olfr1153_7
cagcaaccccttgatgtatg

SEQ ID NO: 36731 - DNA, 20 bp, Artificial Sequence
  sgRNA
  Olfr1153_8
actatcttgttcagatacag

SEQ ID NO: 36732 - DNA, 20 bp, Artificial Sequence
  sgRNA
  Olfr1153_9
gttggacccaagatgttggt

SEQ ID NO: 36733 - DNA, 20 bp, Artificial Sequence
  sgRNA
  Olfr1153_10
atatctaccgcatacatcaa

SEQ ID NO: 36734 - DNA, 20 bp, Artificial Sequence
  sgRNA
  Olfr1153_11
gtaaatcaacgggttgagca

SEQ ID NO: 36735 - DNA, 20 bp, Artificial Sequence
  sgRNA
  Olfr1153_12
cagctcaataaacccaaata

SEQ ID NO: 36736 - DNA, 20 bp, Artificial Sequence
  sgRNA
  Olfr1153_13
agatatcagagaaagagagg

SEQ ID NO: 36737 - DNA, 20 bp, Artificial Sequence
  sgRNA
  Olfr1153_14
tcctgaggctgtaaatcaac

SEQ ID NO: 36738 - DNA, 20 bp, Artificial Sequence
  sgRNA
  Olfr1153_15
gagctgatagcataccactc

SEQ ID NO: 36739 - DNA, 20 bp, Artificial Sequence
  sgRNA
  Olfr1153_16
acatgaagagcattgttccc

SEQ ID NO: 36740 - DNA, 20 bp, Artificial Sequence
  sgRNA
  Olfr1153_17
ataaggcccaccaacatctt

SEQ ID NO: 36741 - DNA, 20 bp, Artificial Sequence
  sgRNA
  Olfr1153_18
tataaaacaaagaagaatgg

SEQ ID NO: 36742 - DNA, 20 bp, Artificial Sequence
  sgRNA
  Olfr1153_19
tgcaacaacagttagatggg

SEQ ID NO: 36743 - DNA, 20 bp, Artificial Sequence
  sgRNA
  Olfr1153_20
gctcctggctgtggtttatc

SEQ ID NO: 36744 - DNA, 20 bp, Artificial Sequence
  sgRNA
  Olfr1155_1
acacagtagtcatgtcacag

SEQ ID NO: 36745 - DNA, 20 bp, Artificial Sequence
  sgRNA
  Olfr1155_2
ggcaatctacagcttcagtg

SEQ ID NO: 36746 - DNA, 20 bp, Artificial Sequence
  sgRNA
  Olfr1155_3
tggtcctatcttctacaaca

SEQ ID NO: 36747 - DNA, 20 bp, Artificial Sequence
  sgRNA
  Olfr1155_4
aacaataaaaagcagtaact

SEQ ID NO: 36748 - DNA, 20 bp, Artificial Sequence
  sgRNA
  Olfr1155_5
ggttacagacagccacaaag

SEQ ID NO: 36749 - DNA, 20 bp, Artificial Sequence
  sgRNA
  Olfr1155_6
ggaatagcagaaatctgcaa

SEQ ID NO: 36750 - DNA, 20 bp, Artificial Sequence
  sgRNA
  Olfr1155_7
tgaaccttgttgtagaagat

SEQ ID NO: 36751 - DNA, 20 bp, Artificial Sequence
  sgRNA
  Olfr1155_8
gccagaaacaacaagaagag

SEQ ID NO: 36752 - DNA, 20 bp, Artificial Sequence
  sgRNA
  Olfr1155_9
catgactactgtgtacagca

SEQ ID NO: 36753 - DNA, 20 bp, Artificial Sequence
  sgRNA
  Olfr1155_10
agagcaagagagggctatta

SEQ ID NO: 36754 - DNA, 20 bp, Artificial Sequence
  sgRNA
  Olfr1155_11
tgactactgtgtacagcagg

SEQ ID NO: 36755 - DNA, 20 bp, Artificial Sequence
  sgRNA
  Olfr1155_12
gtgcttggatcatatgcatg

SEQ ID NO: 36756 - DNA, 20 bp, Artificial Sequence
  sgRNA
  Olfr1155_13
ggttccatggaagatagtga

SEQ ID NO: 36757 - DNA, 20 bp, Artificial Sequence
  sgRNA
  Olfr1155_14
ttgccagaaacaacaagaag

SEQ ID NO: 36758 - DNA, 20 bp, Artificial Sequence
  sgRNA
  Olfr1155_15
tagtgcttggatcatatgca

SEQ ID NO: 36759 - DNA, 20 bp, Artificial Sequence
  sgRNA
  Olfr1155_16
agaaatctgcaaaggaaagg

SEQ ID NO: 36760 - DNA, 20 bp, Artificial Sequence
  sgRNA
  Olfr1155_17
gaggtcacattcgctctctt

SEQ ID NO: 36761 - DNA, 20 bp, Artificial Sequence
  sgRNA
  Olfr1155_18
tctacagcttcagtgtggtg

SEQ ID NO: 36762 - DNA, 20 bp, Artificial Sequence
  sgRNA
  Olfr1155_19
tcagtgtggtggggaacata

SEQ ID NO: 36763 - DNA, 20 bp, Artificial Sequence
  sgRNA
  Olfr1155_20
ctcagattacccagaactgc

SEQ ID NO: 36764 - DNA, 20 bp, Artificial Sequence
  sgRNA
  Olfr1156_1
cagtacaagacggagctttg

SEQ ID NO: 36765 - DNA, 20 bp, Artificial Sequence
  sgRNA
  Olfr1156_2
gtgacagtcatagcaaacct

SEQ ID NO: 36766 - DNA, 20 bp, Artificial Sequence
  sgRNA
  Olfr1156_3
gagcaagcaagacttaagag

SEQ ID NO: 36767 - DNA, 20 bp, Artificial Sequence
  sgRNA
  Olfr1156_4
gttcactgatattatcaacc

SEQ ID NO: 36768 - DNA, 20 bp, Artificial Sequence
  sgRNA
  Olfr1156_5
cataggccattacagccaat

SEQ ID NO: 36769 - DNA, 20 bp, Artificial Sequence
  sgRNA
  Olfr1156_6
gagaacacactgatgcatag

SEQ ID NO: 36770 - DNA, 20 bp, Artificial Sequence
  sgRNA
  Olfr1156_7
gaatcagtacagtcatgccc

SEQ ID NO: 36771 - DNA, 20 bp, Artificial Sequence
  sgRNA
  Olfr1156_8
tttaaatgatgtgatctcaa

SEQ ID NO: 36772 - DNA, 20 bp, Artificial Sequence
  sgRNA
  Olfr1156_9
aacaggacaccagtacaaga

SEQ ID NO: 36773 - DNA, 20 bp, Artificial Sequence
  sgRNA
  Olfr1156_10
gtacaatagtggattacaaa

SEQ ID NO: 36774 - DNA, 20 bp, Artificial Sequence
  sgRNA
  Olfr1156_11
tctagactgttaccagagtt

SEQ ID NO: 36775 - DNA, 20 bp, Artificial Sequence
  sgRNA
  Olfr1156_12
gatgaggataaacaaatagg

SEQ ID NO: 36776 - DNA, 20 bp, Artificial Sequence
  sgRNA
  Olfr1156_13
agaaatccacaaatgacagg

SEQ ID NO: 36777 - DNA, 20 bp, Artificial Sequence
  sgRNA
  Olfr1156_14
ctgaagatgcgctctgcaga

SEQ ID NO: 36778 - DNA, 20 bp, Artificial Sequence
  sgRNA
  Olfr1156_15
gattacaaatggccacgaag

SEQ ID NO: 36779 - DNA, 20 bp, Artificial Sequence
  sgRNA
  Olfr1156_16
tatcactgaagtcttcctat

SEQ ID NO: 36780 - DNA, 20 bp, Artificial Sequence
  sgRNA
  Olfr1156_17
tgatgcatagaggtagcaac

SEQ ID NO: 36781 - DNA, 20 bp, Artificial Sequence
  sgRNA
  Olfr1156_18
atttattgtcagcccaactc

SEQ ID NO: 36782 - DNA, 20 bp, Artificial Sequence
  sgRNA
  Olfr1156_19
ggatcaagttatttcttacc

SEQ ID NO: 36783 - DNA, 20 bp, Artificial Sequence
  sgRNA
  Olfr1156_20
tgatctcaagggccaagcac

SEQ ID NO: 36784 - DNA, 20 bp, Artificial Sequence
  sgRNA
  Olfr1157_1
agagaacaccactcagctcg

SEQ ID NO: 36785 - DNA, 20 bp, Artificial Sequence
  sgRNA
  Olfr1157_2
gaattggaccatacatgcca

SEQ ID NO: 36786 - DNA, 20 bp, Artificial Sequence
  sgRNA
  Olfr1157_3
gagaacacattgatgcacac

SEQ ID NO: 36787 - DNA, 20 bp, Artificial Sequence
  sgRNA
  Olfr1157_4
tgatagccgtatatagtagt

SEQ ID NO: 36788 - DNA, 20 bp, Artificial Sequence
  sgRNA
  Olfr1157_5
tcttctacttcagacaacag

SEQ ID NO: 36789 - DNA, 20 bp, Artificial Sequence
  sgRNA
  Olfr1157_6
tcagatgtccccgagctgag

SEQ ID NO: 36790 - DNA, 20 bp, Artificial Sequence
  sgRNA
  Olfr1157_7
gagcaagcaaggctcaagag

SEQ ID NO: 36791 - DNA, 20 bp, Artificial Sequence
  sgRNA
  Olfr1157_8
ggtcactgaagtcttcctac

SEQ ID NO: 36792 - DNA, 20 bp, Artificial Sequence
  sgRNA
  Olfr1157_9
tgagaatgcgctctgtagag

SEQ ID NO: 36793 - DNA, 20 bp, Artificial Sequence
  sgRNA
  Olfr1157_10
cttaaatgatgggatctcaa

SEQ ID NO: 36794 - DNA, 20 bp, Artificial Sequence
  sgRNA
  Olfr1157_11
agtcattcccaggttggcca

SEQ ID NO: 36795 - DNA, 20 bp, Artificial Sequence
  sgRNA
  Olfr1157_12
tcacatttgacttaaatgat

SEQ ID NO: 36796 - DNA, 20 bp, Artificial Sequence
  sgRNA
  Olfr1157_13
gggcggtgactccataaatg

SEQ ID NO: 36797 - DNA, 20 bp, Artificial Sequence
  sgRNA
  Olfr1157_14
cagtcatcattgtcttccat

SEQ ID NO: 36798 - DNA, 20 bp, Artificial Sequence
  sgRNA
  Olfr1157_15
ggacatctgaaaatcccagg

SEQ ID NO: 36799 - DNA, 20 bp, Artificial Sequence
  sgRNA
  Olfr1157_16
ggttacagatggctacaaaa

SEQ ID NO: 36800 - DNA, 20 bp, Artificial Sequence
  sgRNA
  Olfr1157_17
atccagacaccagtatcata

SEQ ID NO: 36801 - DNA, 20 bp, Artificial Sequence
  sgRNA
  Olfr1157_18
gaatcagtgcagtcattccc

SEQ ID NO: 36802 - DNA, 20 bp, Artificial Sequence
  sgRNA
  Olfr1157_19
ggagtagcagaaatccacaa

SEQ ID NO: 36803 - DNA, 20 bp, Artificial Sequence
  sgRNA
  Olfr1157_20
gctgagaaaaaagtacatgg

SEQ ID NO: 36804 - DNA, 20 bp, Artificial Sequence
  sgRNA
  Olfr1161_1
gaaactctgcatcagtctag

SEQ ID NO: 36805 - DNA, 20 bp, Artificial Sequence
  sgRNA
  Olfr1161_2
gcatgaaagaaccagaagtg

SEQ ID NO: 36806 - DNA, 20 bp, Artificial Sequence
  sgRNA
  Olfr1161_3
catcttgggagcaatgacag

SEQ ID NO: 36807 - DNA, 20 bp, Artificial Sequence
  sgRNA
  Olfr1161_4
cgccatctacagcatcactg

SEQ ID NO: 36808 - DNA, 20 bp, Artificial Sequence
  sgRNA
  Olfr1161_5
ctcaagatgcaatcatccag

SEQ ID NO: 36809 - DNA, 20 bp, Artificial Sequence
  sgRNA
  Olfr1161_6
gtttagcatggggatcacca

SEQ ID NO: 36810 - DNA, 20 bp, Artificial Sequence
  sgRNA
  Olfr1161_7
ggtaatctgagaagctcaat

SEQ ID NO: 36811 - DNA, 20 bp, Artificial Sequence
  sgRNA
  Olfr1161_8
agtaccatagaagatagtga

SEQ ID NO: 36812 - DNA, 20 bp, Artificial Sequence
  sgRNA
  Olfr1161_9
tgacatatggaaataacagt

SEQ ID NO: 36813 - DNA, 20 bp, Artificial Sequence
  sgRNA
  Olfr1161_10
gtaaagcagtggtctgcaga

SEQ ID NO: 36814 - DNA, 20 bp, Artificial Sequence
  sgRNA
  Olfr1161_11
ggataaacatatatgacaga

SEQ ID NO: 36815 - DNA, 20 bp, Artificial Sequence
  sgRNA
  Olfr1161_12
ctcccagctcacattcaaag

SEQ ID NO: 36816 - DNA, 20 bp, Artificial Sequence
  sgRNA
  Olfr1161_13
atggctactgtgtaaagcag

SEQ ID NO: 36817 - DNA, 20 bp, Artificial Sequence
  sgRNA
  Olfr1161_14
gtggtgggatcatatgcatg

SEQ ID NO: 36818 - DNA, 20 bp, Artificial Sequence
  sgRNA
  Olfr1161_15
ggaatagcagaaatccacaa

SEQ ID NO: 36819 - DNA, 20 bp, Artificial Sequence
  sgRNA
  Olfr1161_16
gcgagaaacaccaagaagag

SEQ ID NO: 36820 - DNA, 20 bp, Artificial Sequence
  sgRNA
  Olfr1161_17
ctgacatatggaaataacag

SEQ ID NO: 36821 - DNA, 20 bp, Artificial Sequence
  sgRNA
  Olfr1161_18
gatgcagagtttctgagaca

SEQ ID NO: 36822 - DNA, 20 bp, Artificial Sequence
  sgRNA
  Olfr1161_19
actctgcatcagtctagtgg

SEQ ID NO: 36823 - DNA, 20 bp, Artificial Sequence
  sgRNA
  Olfr1161_20
ggatgattgcatcttgagta

SEQ ID NO: 36824 - DNA, 20 bp, Artificial Sequence
  sgRNA
  Olfr1162_1
atactgtggccatgtcacca

SEQ ID NO: 36825 - DNA, 20 bp, Artificial Sequence
  sgRNA
  Olfr1162_2
gtagtctgtgaagcccaaca

SEQ ID NO: 36826 - DNA, 20 bp, Artificial Sequence
  sgRNA
  Olfr1162_3
catgtacgttatcactgtag

SEQ ID NO: 36827 - DNA, 20 bp, Artificial Sequence
  sgRNA
  Olfr1162_4
aaacaaaagagtagcaggct

SEQ ID NO: 36828 - DNA, 20 bp, Artificial Sequence
  sgRNA
  Olfr1162_5
tgatgagtgctatcatccca

SEQ ID NO: 36829 - DNA, 20 bp, Artificial Sequence
  sgRNA
  Olfr1162_6
agaactagagacagcaatga

SEQ ID NO: 36830 - DNA, 20 bp, Artificial Sequence
  sgRNA
  Olfr1162_7
acactcacatttctttccat

SEQ ID NO: 36831 - DNA, 20 bp, Artificial Sequence
  sgRNA
  Olfr1162_8
gcatagcaaaggagaatcaa

SEQ ID NO: 36832 - DNA, 20 bp, Artificial Sequence
  sgRNA
  Olfr1162_9
gtagatcagtgggttcaaca

SEQ ID NO: 36833 - DNA, 20 bp, Artificial Sequence
  sgRNA
  Olfr1162_10
agagaaagattagaaaaagg

SEQ ID NO: 36834 - DNA, 20 bp, Artificial Sequence
  sgRNA
  Olfr1162_11
tcactgtagtgggaaacctt

SEQ ID NO: 36835 - DNA, 20 bp, Artificial Sequence
  sgRNA
  Olfr1162_12
aattgtgatggcagtcaggt

SEQ ID NO: 36836 - DNA, 20 bp, Artificial Sequence
  sgRNA
  Olfr1162_13
gacaacagtgtaaaagacag

SEQ ID NO: 36837 - DNA, 20 bp, Artificial Sequence
  sgRNA
  Olfr1162_14
acaccacagccacacaggac

SEQ ID NO: 36838 - DNA, 20 bp, Artificial Sequence
  sgRNA
  Olfr1162_15
ttaaaaatcaaatctgccag

SEQ ID NO: 36839 - DNA, 20 bp, Artificial Sequence
  sgRNA
  Olfr1162_16
agatcagtgggttcaacatg

SEQ ID NO: 36840 - DNA, 20 bp, Artificial Sequence
  sgRNA
  Olfr1162_17
ggttccgtgaaaaattgtga

SEQ ID NO: 36841 - DNA, 20 bp, Artificial Sequence
  sgRNA
  Olfr1162_18
gatctacagcctaagaaaca

SEQ ID NO: 36842 - DNA, 20 bp, Artificial Sequence
  sgRNA
  Olfr1162_19
tatacagtataaggaaagta

SEQ ID NO: 36843 - DNA, 20 bp, Artificial Sequence
  sgRNA
  Olfr1162_20
ctctaggcaagtcgttaaag

SEQ ID NO: 36844 - DNA, 20 bp, Artificial Sequence
  sgRNA
  Olfr1163_1
atactgtggccatgtcaccg

SEQ ID NO: 36845 - DNA, 20 bp, Artificial Sequence
  sgRNA
  Olfr1163_2
acattggagtgtggaacttg

SEQ ID NO: 36846 - DNA, 20 bp, Artificial Sequence
  sgRNA
  Olfr1163_3
agaactagagacaacaatga

SEQ ID NO: 36847 - DNA, 20 bp, Artificial Sequence
  sgRNA
  Olfr1163_4
ttaggaaaaggggaatctga

SEQ ID NO: 36848 - DNA, 20 bp, Artificial Sequence
  sgRNA
  Olfr1163_5
agataagagggttaagcaag

SEQ ID NO: 36849 - DNA, 20 bp, Artificial Sequence
  sgRNA
  Olfr1163_6
gacaactgcataaaagaccg

SEQ ID NO: 36850 - DNA, 20 bp, Artificial Sequence
  sgRNA
  Olfr1163_7
gaatgccgtcaaagtagcct

SEQ ID NO: 36851 - DNA, 20 bp, Artificial Sequence
  sgRNA
  Olfr1163_8
tagataagagggttaagcaa

SEQ ID NO: 36852 - DNA, 20 bp, Artificial Sequence
  sgRNA
  Olfr1163_9
tgatgagcactgtcatgcca

SEQ ID NO: 36853 - DNA, 20 bp, Artificial Sequence
  sgRNA
  Olfr1163_10
ggttccatgaaaaatagtga

SEQ ID NO: 36854 - DNA, 20 bp, Artificial Sequence
  sgRNA
  Olfr1163_11
ggagttcggtacacagtaca

SEQ ID NO: 36855 - DNA, 20 bp, Artificial Sequence
  sgRNA
  Olfr1163_12
acactcacatttatttccag

SEQ ID NO: 36856 - DNA, 20 bp, Artificial Sequence
  sgRNA
  Olfr1163_13
agtgatggcagtcaagtggg

SEQ ID NO: 36857 - DNA, 20 bp, Artificial Sequence
  sgRNA
  Olfr1163_14
aaagaccgaggctactttga

SEQ ID NO: 36858 - DNA, 20 bp, Artificial Sequence
  sgRNA
  Olfr1163_15
ttctcaagctgtagataaga

SEQ ID NO: 36859 - DNA, 20 bp, Artificial Sequence
  sgRNA
  Olfr1163_16
atgtacatcatcactgtagt

SEQ ID NO: 36860 - DNA, 20 bp, Artificial Sequence
  sgRNA
  Olfr1163_17
tacacagtacagggaaagta

SEQ ID NO: 36861 - DNA, 20 bp, Artificial Sequence
  sgRNA
  Olfr1163_18
tggagttcggtacacagtac

SEQ ID NO: 36862 - DNA, 20 bp, Artificial Sequence
  sgRNA
  Olfr1163_19
gtagataagagggttaagca

SEQ ID NO: 36863 - DNA, 20 bp, Artificial Sequence
  sgRNA
  Olfr1163_20
tatctacagcttgagaaaca

SEQ ID NO: 36864 - DNA, 20 bp, Artificial Sequence
  sgRNA
  Olfr1189_1
gagtagatttccaaagactg

SEQ ID NO: 36865 - DNA, 20 bp, Artificial Sequence
  sgRNA
  Olfr1189_2
taaccagaagccctagtctg

SEQ ID NO: 36866 - DNA, 20 bp, Artificial Sequence
  sgRNA
  Olfr1189_3
agacaatagtcctctcagaa

SEQ ID NO: 36867 - DNA, 20 bp, Artificial Sequence
  sgRNA
  Olfr1189_4
tattctgttgggagttacaa

SEQ ID NO: 36868 - DNA, 20 bp, Artificial Sequence
  sgRNA
  Olfr1189_5
ttatggactccctttctgag

SEQ ID NO: 36869 - DNA, 20 bp, Artificial Sequence
  sgRNA
  Olfr1189_6
cgtgaaaatgatgactccta

SEQ ID NO: 36870 - DNA, 20 bp, Artificial Sequence
  sgRNA
  Olfr1189_7
ccatgagtgacaaagataaa

SEQ ID NO: 36871 - DNA, 20 bp, Artificial Sequence
  sgRNA
  Olfr1189_8
gtgtgctgcttgatggtagg

SEQ ID NO: 36872 - DNA, 20 bp, Artificial Sequence
  sgRNA
  Olfr1189_9
atgtagctcacatttcacag

SEQ ID NO: 36873 - DNA, 20 bp, Artificial Sequence
  sgRNA
  Olfr1189_10
atgatatttgagctacagaa

SEQ ID NO: 36874 - DNA, 20 bp, Artificial Sequence
  sgRNA
  Olfr1189_11
acatgggtgacctcagacta

SEQ ID NO: 36875 - DNA, 20 bp, Artificial Sequence
  sgRNA
  Olfr1189_12
gaaatgttctgcaaatagct

SEQ ID NO: 36876 - DNA, 20 bp, Artificial Sequence
  sgRNA
  Olfr1189_13
gacaatagtcctctcagaaa

SEQ ID NO: 36877 - DNA, 20 bp, Artificial Sequence
  sgRNA
  Olfr1189_14
cttagtcattctgaacagtg

SEQ ID NO: 36878 - DNA, 20 bp, Artificial Sequence
  sgRNA
  Olfr1189_15
ctacaccttgagaaatacag

SEQ ID NO: 36879 - DNA, 20 bp, Artificial Sequence
  sgRNA
  Olfr1189_16
atacataaagagaagctgaa

SEQ ID NO: 36880 - DNA, 20 bp, Artificial Sequence
  sgRNA
  Olfr1189_17
attcccaatagacaaagcaa

SEQ ID NO: 36881 - DNA, 20 bp, Artificial Sequence
  sgRNA
  Olfr1189_18
aatgtgagctacatgtagag

SEQ ID NO: 36882 - DNA, 20 bp, Artificial Sequence
  sgRNA
  Olfr1189_19
ttaagtcttatagttctgaa

SEQ ID NO: 36883 - DNA, 20 bp, Artificial Sequence
  sgRNA
  Olfr1189_20
cttgatggtaggaggagctt

SEQ ID NO: 36884 - DNA, 20 bp, Artificial Sequence
  sgRNA
  Olfr1191-ps1_1
gttgttgtgacagccaacag

SEQ ID NO: 36885 - DNA, 20 bp, Artificial Sequence
  sgRNA
  Olfr1191-ps1_2
actatatgactatcatggac

SEQ ID NO: 36886 - DNA, 20 bp, Artificial Sequence
  sgRNA
  Olfr1191-ps1_3
ggtccatgatagtcatatag

SEQ ID NO: 36887 - DNA, 20 bp, Artificial Sequence
  sgRNA
  Olfr1191-ps1_4
aggtttcctgggaaactact

SEQ ID NO: 36888 - DNA, 20 bp, Artificial Sequence
  sgRNA
  Olfr1191-ps1_5
ctatatgactatcatggacc

SEQ ID NO: 36889 - DNA, 20 bp, Artificial Sequence
  sgRNA
  Olfr1191-ps1_6
atgatagtcatatagtggag

SEQ ID NO: 36890 - DNA, 20 bp, Artificial Sequence
  sgRNA
  Olfr1191-ps1_7
ctgagaaagcagtcatccga

SEQ ID NO: 36891 - DNA, 20 bp, Artificial Sequence
  sgRNA
  Olfr1191-ps1_8
tctcatttggtccacaaaat

SEQ ID NO: 36892 - DNA, 20 bp, Artificial Sequence
  sgRNA
  Olfr1191-ps1_9
aacaccaacaatgtaagtgt

SEQ ID NO: 36893 - DNA, 20 bp, Artificial Sequence
  sgRNA
  Olfr1191-ps1_10
ttgctcggaacatggatcag

SEQ ID NO: 36894 - DNA, 20 bp, Artificial Sequence
  sgRNA
  Olfr1191-ps1_11
agcaatgtgagatccacaag

SEQ ID NO: 36895 - DNA, 20 bp, Artificial Sequence
  sgRNA
  Olfr1191-ps1_12
tctccactatatgactatca

SEQ ID NO: 36896 - DNA, 20 bp, Artificial Sequence
  sgRNA
  Olfr1191-ps1_13
gagaaaactgtgggctagaa

SEQ ID NO: 36897 - DNA, 20 bp, Artificial Sequence
  sgRNA
  Olfr1191-ps1_14
ggtgcatgttacaactcttt

SEQ ID NO: 36898 - DNA, 20 bp, Artificial Sequence
  sgRNA
  Olfr1191-ps1_15
agcacacttcttcaacctca

SEQ ID NO: 36899 - DNA, 20 bp, Artificial Sequence
  sgRNA
  Olfr1191-ps1_16
ggttgaagaagtgtgctttg

SEQ ID NO: 36900 - DNA, 20 bp, Artificial Sequence
  sgRNA
  Olfr1191-ps1_17
gtgggctagaaaggtttcct

SEQ ID NO: 36901 - DNA, 20 bp, Artificial Sequence
  sgRNA
  Olfr1191-ps1_18
gggtgcatgttacaactctt

SEQ ID NO: 36902 - DNA, 20 bp, Artificial Sequence
  sgRNA
  Olfr1191-ps1_19
tgtgggctagaaaggtttcc

SEQ ID NO: 36903 - DNA, 20 bp, Artificial Sequence
  sgRNA
  Olfr1191-ps1_20
gagagctttgcgtctgcctt

SEQ ID NO: 36904 - DNA, 20 bp, Artificial Sequence
  sgRNA
  Olfr1192-ps1_1
aatacatgggttgctcaacg

SEQ ID NO: 36905 - DNA, 20 bp, Artificial Sequence
  sgRNA
  Olfr1192-ps1_2
cagagagtgagagatagttg

SEQ ID NO: 36906 - DNA, 20 bp, Artificial Sequence
  sgRNA
  Olfr1192-ps1_3
gatagtaagaagaagttgac

SEQ ID NO: 36907 - DNA, 20 bp, Artificial Sequence
  sgRNA
  Olfr1192-ps1_4
tagttgaggaagaaatacat

SEQ ID NO: 36908 - DNA, 20 bp, Artificial Sequence
  sgRNA
  Olfr1192-ps1_5
tgttccaatacacacataat

SEQ ID NO: 36909 - DNA, 20 bp, Artificial Sequence
  sgRNA
  Olfr1192-ps1_6
cattaatttaggagtcactg

SEQ ID NO: 36910 - DNA, 20 bp, Artificial Sequence
  sgRNA
  Olfr1192-ps1_7
atagttgaggaagaaataca

SEQ ID NO: 36911 - DNA, 20 bp, Artificial Sequence
  sgRNA
  Olfr1192-ps1_8
gggtcatcaaggacttctga

SEQ ID NO: 36912 - DNA, 20 bp, Artificial Sequence
  sgRNA
  Olfr1192-ps1_9
tcactgtggatgtgtagcag

SEQ ID NO: 36913 - DNA, 20 bp, Artificial Sequence
  sgRNA
  Olfr1192-ps1_10
tgactgacttactggcagaa

SEQ ID NO: 36914 - DNA, 20 bp, Artificial Sequence
  sgRNA
  Olfr1192-ps1_11
gtcatcaaggacttctgaag

SEQ ID NO: 36915 - DNA, 20 bp, Artificial Sequence
  sgRNA
  Olfr1192-ps1_12
tattatgtgtgtattggaac

SEQ ID NO: 36916 - DNA, 20 bp, Artificial Sequence
  sgRNA
  Olfr1192-ps1_13
aagacctattatgtgtgtat

SEQ ID NO: 36917 - DNA, 20 bp, Artificial Sequence
  sgRNA
  Olfr1193_1
ttgctcggaacatggatcgg

SEQ ID NO: 36918 - DNA, 20 bp, Artificial Sequence
  sgRNA
  Olfr1193_2
tctcattcggtccacaaaag

SEQ ID NO: 36919 - DNA, 20 bp, Artificial Sequence
  sgRNA
  Olfr1193_3
aaaagactatatcctatgtg

SEQ ID NO: 36920 - DNA, 20 bp, Artificial Sequence
  sgRNA
  Olfr1193_4
ggttgaaaaagtgtgctttg

SEQ ID NO: 36921 - DNA, 20 bp, Artificial Sequence
  sgRNA
  Olfr1193_5
atgttgctcggaacatggat

SEQ ID NO: 36922 - DNA, 20 bp, Artificial Sequence
  sgRNA
  Olfr1193_6
ggtccatcatagtcatatag

SEQ ID NO: 36923 - DNA, 20 bp, Artificial Sequence
  sgRNA
  Olfr1193_7
tctccactatatgactatga

SEQ ID NO: 36924 - DNA, 20 bp, Artificial Sequence
  sgRNA
  Olfr1193_8
atcatagtcatatagtggag

SEQ ID NO: 36925 - DNA, 20 bp, Artificial Sequence
  sgRNA
  Olfr1193_9
atctcattcggtccacaaaa

SEQ ID NO: 36926 - DNA, 20 bp, Artificial Sequence
  sgRNA
  Olfr1193_10
ctgagaaagcagtcatctga

SEQ ID NO: 36927 - DNA, 20 bp, Artificial Sequence
  sgRNA
  Olfr1193_11
ctatatgactatgatggacc

SEQ ID NO: 36928 - DNA, 20 bp, Artificial Sequence
  sgRNA
  Olfr1193_12
attcagcatgggagtgataa

SEQ ID NO: 36929 - DNA, 20 bp, Artificial Sequence
  sgRNA
  Olfr1193_13
actatatgactatgatggac

SEQ ID NO: 36930 - DNA, 20 bp, Artificial Sequence
  sgRNA
  Olfr1193_14
aacaggtcaataatcatctt

SEQ ID NO: 36931 - DNA, 20 bp, Artificial Sequence
  sgRNA
  Olfr1193_15
aacaatgtaagtgtcagtgc

SEQ ID NO: 36932 - DNA, 20 bp, Artificial Sequence
  sgRNA
  Olfr1193_16
agcaatgtgggatccacaag

SEQ ID NO: 36933 - DNA, 20 bp, Artificial Sequence
  sgRNA
  Olfr1193_17
aatgatgacaacagcaatgt

SEQ ID NO: 36934 - DNA, 20 bp, Artificial Sequence
  sgRNA
  Olfr1193_18
acatcttattgcatctttcc

SEQ ID NO: 36935 - DNA, 20 bp, Artificial Sequence
  sgRNA
  Olfr1193_19
tcggtccacaaaaggggagc

SEQ ID NO: 36936 - DNA, 20 bp, Artificial Sequence
  sgRNA
  Olfr1193_20
aaatgatgacaacagcaatg

SEQ ID NO: 36937 - DNA, 20 bp, Artificial Sequence
  sgRNA
  Olfr1195_1
catagcggtcaacagccatg

SEQ ID NO: 36938 - DNA, 20 bp, Artificial Sequence
  sgRNA
  Olfr1195_2
acaggatcccacacagactg

SEQ ID NO: 36939 - DNA, 20 bp, Artificial Sequence
  sgRNA
  Olfr1195_3
ggaatccacaattgttctcg

SEQ ID NO: 36940 - DNA, 20 bp, Artificial Sequence
  sgRNA
  Olfr1195_4
gggttccactattggacacc

SEQ ID NO: 36941 - DNA, 20 bp, Artificial Sequence
  sgRNA
  Olfr1195_5
tttgctccacaacttcctca

SEQ ID NO: 36942 - DNA, 20 bp, Artificial Sequence
  sgRNA
  Olfr1195_6
cagatatcatcttgtccata

SEQ ID NO: 36943 - DNA, 20 bp, Artificial Sequence
  sgRNA
  Olfr1195_7
tatgaccatcatgaatcgcc

SEQ ID NO: 36944 - DNA, 20 bp, Artificial Sequence
  sgRNA
  Olfr1195_8
tgaggaatcacagtgctgag

SEQ ID NO: 36945 - DNA, 20 bp, Artificial Sequence
  sgRNA
  Olfr1195_9
tcctcagtgtgtaaatcaga

SEQ ID NO: 36946 - DNA, 20 bp, Artificial Sequence
  sgRNA
  Olfr1195_10
gccttgagtttacctttctg

SEQ ID NO: 36947 - DNA, 20 bp, Artificial Sequence
  sgRNA
  Olfr1195_11
gatagaggcctctttcagca

SEQ ID NO: 36948 - DNA, 20 bp, Artificial Sequence
  sgRNA
  Olfr1195_12
tgtggattccctgctgaaag

SEQ ID NO: 36949 - DNA, 20 bp, Artificial Sequence
  sgRNA
  Olfr1195_13
ggaatcacagtgctgagggg

SEQ ID NO: 36950 - DNA, 20 bp, Artificial Sequence
  sgRNA
  Olfr1195_14
gaacaggcaagtttcaacag

SEQ ID NO: 36951 - DNA, 20 bp, Artificial Sequence
  sgRNA
  Olfr1195_15
tttgaggaatcacagtgctg

SEQ ID NO: 36952 - DNA, 20 bp, Artificial Sequence
  sgRNA
  Olfr1195_16
gatgaggataaagatctcca

SEQ ID NO: 36953 - DNA, 20 bp, Artificial Sequence
  sgRNA
  Olfr1195_17
gattgacacaggaccccagc

SEQ ID NO: 36954 - DNA, 20 bp, Artificial Sequence
  sgRNA
  Olfr1195_18
tgtagccccgagaacaattg

SEQ ID NO: 36955 - DNA, 20 bp, Artificial Sequence
  sgRNA
  Olfr1195_19
cttgtccatagggaaggtgg

SEQ ID NO: 36956 - DNA, 20 bp, Artificial Sequence
  sgRNA
  Olfr1195_20
ccaggtctgtggaatgctgg

SEQ ID NO: 36957 - DNA, 20 bp, Artificial Sequence
  sgRNA
  Olfr1199_1
ctgaactaaagaatgcacgc

SEQ ID NO: 36958 - DNA, 20 bp, Artificial Sequence
  sgRNA
  Olfr1199_2
aatagtgatcaatcacattg

SEQ ID NO: 36959 - DNA, 20 bp, Artificial Sequence
  sgRNA
  Olfr1199_3
tgttactgtcaagacaagcc

SEQ ID NO: 36960 - DNA, 20 bp, Artificial Sequence
  sgRNA
  Olfr1199_4
acatacccggcggctcatga

SEQ ID NO: 36961 - DNA, 20 bp, Artificial Sequence
  sgRNA
  Olfr1199_5
ccaacaccccacatacccgg

SEQ ID NO: 36962 - DNA, 20 bp, Artificial Sequence
  sgRNA
  Olfr1199_6
gcactcagtgaaagagatag

SEQ ID NO: 36963 - DNA, 20 bp, Artificial Sequence
  sgRNA
  Olfr1199_7
gatagaggcctccttctgta

SEQ ID NO: 36964 - DNA, 20 bp, Artificial Sequence
  sgRNA
  Olfr1199_8
ccaccaacaccccacatacc

SEQ ID NO: 36965 - DNA, 20 bp, Artificial Sequence
  sgRNA
  Olfr1199_9
cataggagaacattagcaca

SEQ ID NO: 36966 - DNA, 20 bp, Artificial Sequence
  sgRNA
  Olfr1199_10
tgtggattccttacagaagg

SEQ ID NO: 36967 - DNA, 20 bp, Artificial Sequence
  sgRNA
  Olfr1199_11
gaaatagtgatcaatcacat

SEQ ID NO: 36968 - DNA, 20 bp, Artificial Sequence
  sgRNA
  Olfr1199_12
tattcttcttggcttgacac

SEQ ID NO: 36969 - DNA, 20 bp, Artificial Sequence
  sgRNA
  Olfr1199_13
gtagaacaggaagaaataca

SEQ ID NO: 36970 - DNA, 20 bp, Artificial Sequence
  sgRNA
  Olfr1199_14
atagatatcatcttgtccat

SEQ ID NO: 36971 - DNA, 20 bp, Artificial Sequence
  sgRNA
  Olfr1199_15
gcttgacacaggaccccagc

SEQ ID NO: 36972 - DNA, 20 bp, Artificial Sequence
  sgRNA
  Olfr1199_16
agaagggcaaactcaaggct

SEQ ID NO: 36973 - DNA, 20 bp, Artificial Sequence
  sgRNA
  Olfr1199_17
aattgtggattccttacaga

SEQ ID NO: 36974 - DNA, 20 bp, Artificial Sequence
  sgRNA
  Olfr1199_18
gtagtgcaggggtttacaga

SEQ ID NO: 36975 - DNA, 20 bp, Artificial Sequence
  sgRNA
  Olfr1199_19
gtttacagatggccacatat

SEQ ID NO: 36976 - DNA, 20 bp, Artificial Sequence
  sgRNA
  Olfr1199_20
atcacattggggccacagaa

SEQ ID NO: 36977 - DNA, 20 bp, Artificial Sequence
  sgRNA
  Olfr1201_1
atgatgactgagtaacgcaa

SEQ ID NO: 36978 - DNA, 20 bp, Artificial Sequence
  sgRNA
  Olfr1201_2
ttgtgacaatcaagttcagt

SEQ ID NO: 36979 - DNA, 20 bp, Artificial Sequence
  sgRNA
  Olfr1201_3
atgtaaaaaagaccctatcc

SEQ ID NO: 36980 - DNA, 20 bp, Artificial Sequence
  sgRNA
  Olfr1201_4
caataatggtcaatcagatt

SEQ ID NO: 36981 - DNA, 20 bp, Artificial Sequence
  sgRNA
  Olfr1201_5
tgcgaaaccatagtgcagaa

SEQ ID NO: 36982 - DNA, 20 bp, Artificial Sequence
  sgRNA
  Olfr1201_6
gtaacgcaagggtttacaga

SEQ ID NO: 36983 - DNA, 20 bp, Artificial Sequence
  sgRNA
  Olfr1201_7
catgatgactgagtaacgca

SEQ ID NO: 36984 - DNA, 20 bp, Artificial Sequence
  sgRNA
  Olfr1201_8
gttactcagtcatcatgagg

SEQ ID NO: 36985 - DNA, 20 bp, Artificial Sequence
  sgRNA
  Olfr1201_9
catccatgcagccaaataaa

SEQ ID NO: 36986 - DNA, 20 bp, Artificial Sequence
  sgRNA
  Olfr1201_10
actgttaccatcttgtccat

SEQ ID NO: 36987 - DNA, 20 bp, Artificial Sequence
  sgRNA
  Olfr1201_11
tcaagttcagtcggacactt

SEQ ID NO: 36988 - DNA, 20 bp, Artificial Sequence
  sgRNA
  Olfr1201_12
ttgtccataggaaaagtagt

SEQ ID NO: 36989 - DNA, 20 bp, Artificial Sequence
  sgRNA
  Olfr1201_13
gttgagaaatggtgttccaa

SEQ ID NO: 36990 - DNA, 20 bp, Artificial Sequence
  sgRNA
  Olfr1201_14
tagtgcagaagggagaaaaa

SEQ ID NO: 36991 - DNA, 20 bp, Artificial Sequence
  sgRNA
  Olfr1201_15
tgaaaaacaggaatcagaaa

SEQ ID NO: 36992 - DNA, 20 bp, Artificial Sequence
  sgRNA
  Olfr1201_16
gcaataatggtcaatcagat

SEQ ID NO: 36993 - DNA, 20 bp, Artificial Sequence
  sgRNA
  Olfr1201_17
ataaaataggaagaagtaca

SEQ ID NO: 36994 - DNA, 20 bp, Artificial Sequence
  sgRNA
  Olfr1201_18
tccataggaaaagtagttgg

SEQ ID NO: 36995 - DNA, 20 bp, Artificial Sequence
  sgRNA
  Olfr1201_19
tgcgttactcagtcatcatg

SEQ ID NO: 36996 - DNA, 20 bp, Artificial Sequence
  sgRNA
  Olfr1201_20
tatgaatatgcagggtacaa

SEQ ID NO: 36997 - DNA, 20 bp, Artificial Sequence
  sgRNA
  Olfr1202_1
cagacaaatgaaaccactgt

SEQ ID NO: 36998 - DNA, 20 bp, Artificial Sequence
  sgRNA
  Olfr1202_2
cactttaggtgtattgacag

SEQ ID NO: 36999 - DNA, 20 bp, Artificial Sequence
  sgRNA
  Olfr1202_3
tacaggctagatcaagcaaa

SEQ ID NO: 37000 - DNA, 20 bp, Artificial Sequence
  sgRNA
  Olfr1202_4
ctagtgggagtgtcatgggt

SEQ ID NO: 37001 - DNA, 20 bp, Artificial Sequence
  sgRNA
  Olfr1202_5
acaactctgtaacatcctag

SEQ ID NO: 37002 - DNA, 20 bp, Artificial Sequence
  sgRNA
  Olfr1202_6
gagccccaggagaacaaact

SEQ ID NO: 37003 - DNA, 20 bp, Artificial Sequence
  sgRNA
  Olfr1202_7
tgaccgagtttgttctcctg

SEQ ID NO: 37004 - DNA, 20 bp, Artificial Sequence
  sgRNA
  Olfr1202_8
ttagggagttaagaatgacc

SEQ ID NO: 37005 - DNA, 20 bp, Artificial Sequence
  sgRNA
  Olfr1202_9
atagattaatggattcaaca

SEQ ID NO: 37006 - DNA, 20 bp, Artificial Sequence
  sgRNA
  Olfr1202_10
ggtaggagacaagcagtagg

SEQ ID NO: 37007 - DNA, 20 bp, Artificial Sequence
  sgRNA
  Olfr1202_11
ggagccacagtgcagaaggc

SEQ ID NO: 37008 - DNA, 20 bp, Artificial Sequence
  sgRNA
  Olfr1202_12
cctactgcttgtctcctacc

SEQ ID NO: 37009 - DNA, 20 bp, Artificial Sequence
  sgRNA
  Olfr1202_13
tggtcattcttaactcccta

SEQ ID NO: 37010 - DNA, 20 bp, Artificial Sequence
  sgRNA
  Olfr1202_14
ggttcagatcacacataaaa

SEQ ID NO: 37011 - DNA, 20 bp, Artificial Sequence
  sgRNA
  Olfr1202_15
ttctgcactgtggctcctta

SEQ ID NO: 37012 - DNA, 20 bp, Artificial Sequence
  sgRNA
  Olfr1202_16
ggagttaagaatgaccaggt

SEQ ID NO: 37013 - DNA, 20 bp, Artificial Sequence
  sgRNA
  Olfr1202_17
ctaaggagccacagtgcaga

SEQ ID NO: 37014 - DNA, 20 bp, Artificial Sequence
  sgRNA
  Olfr1202_18
gcagattctgtgtgagcccc

SEQ ID NO: 37015 - DNA, 20 bp, Artificial Sequence
  sgRNA
  Olfr1202_19
tcaatgggtaatgtagctac

SEQ ID NO: 37016 - DNA, 20 bp, Artificial Sequence
  sgRNA
  Olfr1202_20
ttgctgattcactacataaa

SEQ ID NO: 37017 - DNA, 20 bp, Artificial Sequence
  sgRNA
  Olfr1204_1
acagagtcgtctgttcatga

SEQ ID NO: 37018 - DNA, 20 bp, Artificial Sequence
  sgRNA
  Olfr1204_2
acatagggtaccccaacagt

SEQ ID NO: 37019 - DNA, 20 bp, Artificial Sequence
  sgRNA
  Olfr1204_3
ggttaagatcacacataaag

SEQ ID NO: 37020 - DNA, 20 bp, Artificial Sequence
  sgRNA
  Olfr1204_4
gtattgacacccacatcctg

SEQ ID NO: 37021 - DNA, 20 bp, Artificial Sequence
  sgRNA
  Olfr1204_5
agtaggacacaagcagtaag

SEQ ID NO: 37022 - DNA, 20 bp, Artificial Sequence
  sgRNA
  Olfr1204_6
ctaaggacccacagtgcaga

SEQ ID NO: 37023 - DNA, 20 bp, Artificial Sequence
  sgRNA
  Olfr1204_7
ggagttaaggatgaccaagt

SEQ ID NO: 37024 - DNA, 20 bp, Artificial Sequence
  sgRNA
  Olfr1204_8
acgactctgtaacatcctag

SEQ ID NO: 37025 - DNA, 20 bp, Artificial Sequence
  sgRNA
  Olfr1204_9
ggacccacagtgcagaaggc

SEQ ID NO: 37026 - DNA, 20 bp, Artificial Sequence
  sgRNA
  Olfr1204_10
gattaatggattcaacatag

SEQ ID NO: 37027 - DNA, 20 bp, Artificial Sequence
  sgRNA
  Olfr1204_11
tggtcatccttaactcccta

SEQ ID NO: 37028 - DNA, 20 bp, Artificial Sequence
  sgRNA
  Olfr1204_12
cgactctgtaacatcctagt

SEQ ID NO: 37029 - DNA, 20 bp, Artificial Sequence
  sgRNA
  Olfr1204_13
ttctgcactgtgggtcctta

SEQ ID NO: 37030 - DNA, 20 bp, Artificial Sequence
  sgRNA
  Olfr1204_14
tgacagagtttgttctcctg

SEQ ID NO: 37031 - DNA, 20 bp, Artificial Sequence
  sgRNA
  Olfr1204_15
aggaaatctattaaattcaa

SEQ ID NO: 37032 - DNA, 20 bp, Artificial Sequence
  sgRNA
  Olfr1204_16
cagtttaggtgtattgacag

SEQ ID NO: 37033 - DNA, 20 bp, Artificial Sequence
  sgRNA
  Olfr1204_17
tgtgggtccttagggagtta

SEQ ID NO: 37034 - DNA, 20 bp, Artificial Sequence
  sgRNA
  Olfr1204_18
tcaatgggtaatgtagctgc

SEQ ID NO: 37035 - DNA, 20 bp, Artificial Sequence
  sgRNA
  Olfr1204_19
agattaatggattcaacata

SEQ ID NO: 37036 - DNA, 20 bp, Artificial Sequence
  sgRNA
  Olfr1204_20
cagacaaatgaaaccactat

SEQ ID NO: 37037 - DNA, 20 bp, Artificial Sequence
  sgRNA
  Olfr1205_1
aagttcagtcgaacacttgg

SEQ ID NO: 37038 - DNA, 20 bp, Artificial Sequence
  sgRNA
  Olfr1205_2
tgcattacccagtcatcatg

SEQ ID NO: 37039 - DNA, 20 bp, Artificial Sequence
  sgRNA
  Olfr1205_3
tctatatggggactgtagtg

SEQ ID NO: 37040 - DNA, 20 bp, Artificial Sequence
  sgRNA
  Olfr1205_4
ccatttatttggctgcatgg

SEQ ID NO: 37041 - DNA, 20 bp, Artificial Sequence
  sgRNA
  Olfr1205_5
atgcaggcaagctccaataa

SEQ ID NO: 37042 - DNA, 20 bp, Artificial Sequence
  sgRNA
  Olfr1205_6
ttgtccatagaaaaagtagt

SEQ ID NO: 37043 - DNA, 20 bp, Artificial Sequence
  sgRNA
  Olfr1205_7
caatcctagtagtataaact

SEQ ID NO: 37044 - DNA, 20 bp, Artificial Sequence
  sgRNA
  Olfr1205_8
attacccagtcatcatgagg

SEQ ID NO: 37045 - DNA, 20 bp, Artificial Sequence
  sgRNA
  Olfr1205_9
gtaatgcaagggtttacaga

SEQ ID NO: 37046 - DNA, 20 bp, Artificial Sequence
  sgRNA
  Olfr1205_10
atagtagttgtcttatcctt

SEQ ID NO: 37047 - DNA, 20 bp, Artificial Sequence
  sgRNA
  Olfr1205_11
gcaataatgatcaatcagat

SEQ ID NO: 37048 - DNA, 20 bp, Artificial Sequence
  sgRNA
  Olfr1205_12
gttgagaaagggtgatccaa

SEQ ID NO: 37049 - DNA, 20 bp, Artificial Sequence
  sgRNA
  Olfr1205_13
cctccatgcagccaaataaa

SEQ ID NO: 37050 - DNA, 20 bp, Artificial Sequence
  sgRNA
  Olfr1205_14
tccatagaaaaagtagttgg

SEQ ID NO: 37051 - DNA, 20 bp, Artificial Sequence
  sgRNA
  Olfr1205_15
tatcatgtgtgtatccatgc

SEQ ID NO: 37052 - DNA, 20 bp, Artificial Sequence
  sgRNA
  Olfr1205_16
catgcaggcaagctccaata

SEQ ID NO: 37053 - DNA, 20 bp, Artificial Sequence
  sgRNA
  Olfr1205_17
gtcaccgagtttatactact

SEQ ID NO: 37054 - DNA, 20 bp, Artificial Sequence
  sgRNA
  Olfr1205_18
tatgaatatgcagggtccaa

SEQ ID NO: 37055 - DNA, 20 bp, Artificial Sequence
  sgRNA
  Olfr1205_19
cctgccgcctcatgatgact

SEQ ID NO: 37056 - DNA, 20 bp, Artificial Sequence
  sgRNA
  Olfr1205_20
ctgtgacttacagcccttat

SEQ ID NO: 37057 - DNA, 20 bp, Artificial Sequence
  sgRNA
  Olfr1206_1
gtatcgtaagggtttacaga

SEQ ID NO: 37058 - DNA, 20 bp, Artificial Sequence
  sgRNA
  Olfr1206_2
ctgctattagtgtctaacag

SEQ ID NO: 37059 - DNA, 20 bp, Artificial Sequence
  sgRNA
  Olfr1206_3
atgtataaaagaccctatcc

SEQ ID NO: 37060 - DNA, 20 bp, Artificial Sequence
  sgRNA
  Olfr1206_4
tcaagttcagtcgaacactt

SEQ ID NO: 37061 - DNA, 20 bp, Artificial Sequence
  sgRNA
  Olfr1206_5
atgatgactgggtatcgtaa

SEQ ID NO: 37062 - DNA, 20 bp, Artificial Sequence
  sgRNA
  Olfr1206_6
gatacccagtcatcatgagc

SEQ ID NO: 37063 - DNA, 20 bp, Artificial Sequence
  sgRNA
  Olfr1206_7
tcaagatgacacagacctgc

SEQ ID NO: 37064 - DNA, 20 bp, Artificial Sequence
  sgRNA
  Olfr1206_8
cccagtcatcatgagccggc

SEQ ID NO: 37065 - DNA, 20 bp, Artificial Sequence
  sgRNA
  Olfr1206_9
gcaataatggtcaatcaaat

SEQ ID NO: 37066 - DNA, 20 bp, Artificial Sequence
  sgRNA
  Olfr1206_10
atcaaattgggcccacagaa

SEQ ID NO: 37067 - DNA, 20 bp, Artificial Sequence
  sgRNA
  Olfr1206_11
ttgtccatggaaaaagtagt

SEQ ID NO: 37068 - DNA, 20 bp, Artificial Sequence
  sgRNA
  Olfr1206_12
tgccaaaacaatctgagcag

SEQ ID NO: 37069 - DNA, 20 bp, Artificial Sequence
  sgRNA
  Olfr1206_13
tgattattcttgcctggata

SEQ ID NO: 37070 - DNA, 20 bp, Artificial Sequence
  sgRNA
  Olfr1206_14
tctccatgcagccaaataaa

SEQ ID NO: 37071 - DNA, 20 bp, Artificial Sequence
  sgRNA
  Olfr1206_15
gcattgagactgcccttctg

SEQ ID NO: 37072 - DNA, 20 bp, Artificial Sequence
  sgRNA
  Olfr1206_16
gtcacgaagtttatactact

SEQ ID NO: 37073 - DNA, 20 bp, Artificial Sequence
  sgRNA
  Olfr1206_17
catgatgactgggtatcgta

SEQ ID NO: 37074 - DNA, 20 bp, Artificial Sequence
  sgRNA
  Olfr1206_18
cattgagactgcccttctgt

SEQ ID NO: 37075 - DNA, 20 bp, Artificial Sequence
  sgRNA
  Olfr1206_19
tactgctaccatcttgtcca

SEQ ID NO: 37076 - DNA, 20 bp, Artificial Sequence
  sgRNA
  Olfr1206_20
atagttgttatcttattctt

SEQ ID NO: 37077 - DNA, 20 bp, Artificial Sequence
  sgRNA
  Olfr1209_1
ccaacaccccacagacccgg

SEQ ID NO: 37078 - DNA, 20 bp, Artificial Sequence
  sgRNA
  Olfr1209_2
aatagtgatcaatttcattg

SEQ ID NO: 37079 - DNA, 20 bp, Artificial Sequence
  sgRNA
  Olfr1209_3
catagctccaagaacaattg

SEQ ID NO: 37080 - DNA, 20 bp, Artificial Sequence
  sgRNA
  Olfr1209_4
tcaagacaagccagaccctt

SEQ ID NO: 37081 - DNA, 20 bp, Artificial Sequence
  sgRNA
  Olfr1209_5
ggtgttggtggccatagcct

SEQ ID NO: 37082 - DNA, 20 bp, Artificial Sequence
  sgRNA
  Olfr1209_6
atagctatcatcttgtccat

SEQ ID NO: 37083 - DNA, 20 bp, Artificial Sequence
  sgRNA
  Olfr1209_7
gaaaccacagtgctgaaggg

SEQ ID NO: 37084 - DNA, 20 bp, Artificial Sequence
  sgRNA
  Olfr1209_8
gaacaggcaagcttcaatag

SEQ ID NO: 37085 - DNA, 20 bp, Artificial Sequence
  sgRNA
  Olfr1209_9
cataagagaccatcagcatg

SEQ ID NO: 37086 - DNA, 20 bp, Artificial Sequence
  sgRNA
  Olfr1209_10
attgtggtcatcctgttctt

SEQ ID NO: 37087 - DNA, 20 bp, Artificial Sequence
  sgRNA
  Olfr1209_11
gcttacagatggccacatat

SEQ ID NO: 37088 - DNA, 20 bp, Artificial Sequence
  sgRNA
  Olfr1209_12
gcactcagtgaaagatatag

SEQ ID NO: 37089 - DNA, 20 bp, Artificial Sequence
  sgRNA
  Olfr1209_13
taagaaaccacagtgctgaa

SEQ ID NO: 37090 - DNA, 20 bp, Artificial Sequence
  sgRNA
  Olfr1209_14
ctttctccataacttcttca

SEQ ID NO: 37091 - DNA, 20 bp, Artificial Sequence
  sgRNA
  Olfr1209_15
tcctcctcccttcagcactg

SEQ ID NO: 37092 - DNA, 20 bp, Artificial Sequence
  sgRNA
  Olfr1209_16
acaggatgaccacaataatg

SEQ ID NO: 37093 - DNA, 20 bp, Artificial Sequence
  sgRNA
  Olfr1209_17
acaggatcccacccaggcta

SEQ ID NO: 37094 - DNA, 20 bp, Artificial Sequence
  sgRNA
  Olfr1209_18
gaagttatggagaaagaaag

SEQ ID NO: 37095 - DNA, 20 bp, Artificial Sequence
  sgRNA
  Olfr1209_19
agatgcaaggtccaaagaac

SEQ ID NO: 37096 - DNA, 20 bp, Artificial Sequence
  sgRNA
  Olfr1209_20
atcaagacaagccagaccct

SEQ ID NO: 37097 - DNA, 20 bp, Artificial Sequence
  sgRNA
  Olfr1211_1
tatggggatagcatggacag

SEQ ID NO: 37098 - DNA, 20 bp, Artificial Sequence
  sgRNA
  Olfr1211_2
tggggcagtctatcaatgct

SEQ ID NO: 37099 - DNA, 20 bp, Artificial Sequence
  sgRNA
  Olfr1211_3
caatcacttctactgctgca

SEQ ID NO: 37100 - DNA, 20 bp, Artificial Sequence
  sgRNA
  Olfr1211_4
agagaagcatgcatccaata

SEQ ID NO: 37101 - DNA, 20 bp, Artificial Sequence
  sgRNA
  Olfr1211_5
agtgtggaagaggttggcag

SEQ ID NO: 37102 - DNA, 20 bp, Artificial Sequence
  sgRNA
  Olfr1211_6
ttatcaaaggagaaagcaga

SEQ ID NO: 37103 - DNA, 20 bp, Artificial Sequence
  sgRNA
  Olfr1211_7
aagagaagcatgcatccaat

SEQ ID NO: 37104 - DNA, 20 bp, Artificial Sequence
  sgRNA
  Olfr1211_8
gcacacttatggggatagca

SEQ ID NO: 37105 - DNA, 20 bp, Artificial Sequence
  sgRNA
  Olfr1211_9
gtaacagaattcatattcct

SEQ ID NO: 37106 - DNA, 20 bp, Artificial Sequence
  sgRNA
  Olfr1211_10
tcaaaggagaaagcagatgg

SEQ ID NO: 37107 - DNA, 20 bp, Artificial Sequence
  sgRNA
  Olfr1211_11
acagagcctccagttcatga

SEQ ID NO: 37108 - DNA, 20 bp, Artificial Sequence
  sgRNA
  Olfr1211_12
tgaaagctcacagttctgaa

SEQ ID NO: 37109 - DNA, 20 bp, Artificial Sequence
  sgRNA
  Olfr1211_13
tgaattctgttacaaaactc

SEQ ID NO: 37110 - DNA, 20 bp, Artificial Sequence
  sgRNA
  Olfr1211_14
cgtgcataaataaatataca

SEQ ID NO: 37111 - DNA, 20 bp, Artificial Sequence
  sgRNA
  Olfr1211_15
gcttgcaaattgctacatag

SEQ ID NO: 37112 - DNA, 20 bp, Artificial Sequence
  sgRNA
  Olfr1211_16
acaaaaccacaactgcaatg

SEQ ID NO: 37113 - DNA, 20 bp, Artificial Sequence
  sgRNA
  Olfr1211_17
ttatggggatagcatggaca

SEQ ID NO: 37114 - DNA, 20 bp, Artificial Sequence
  sgRNA
  Olfr1211_18
aaaatgctatgaagaaagtg

SEQ ID NO: 37115 - DNA, 20 bp, Artificial Sequence
  sgRNA
  Olfr1211_19
actcttccatcatgaactgg

SEQ ID NO: 37116 - DNA, 20 bp, Artificial Sequence
  sgRNA
  Olfr1211_20
aggctctgtggcacacttat

SEQ ID NO: 37117 - DNA, 20 bp, Artificial Sequence
  sgRNA
  Olfr1212_1
agtgattgtcctaatatcca

SEQ ID NO: 37118 - DNA, 20 bp, Artificial Sequence
  sgRNA
  Olfr1212_2
agtaatgcatgcatccagga

SEQ ID NO: 37119 - DNA, 20 bp, Artificial Sequence
  sgRNA
  Olfr1212_3
actcttccataatgaactgg

SEQ ID NO: 37120 - DNA, 20 bp, Artificial Sequence
  sgRNA
  Olfr1212_4
ctgtgtcatacagccttcaa

SEQ ID NO: 37121 - DNA, 20 bp, Artificial Sequence
  sgRNA
  Olfr1212_5
gtaacagagttcattctcct

SEQ ID NO: 37122 - DNA, 20 bp, Artificial Sequence
  sgRNA
  Olfr1212_6
cactctggtggggatagcat

SEQ ID NO: 37123 - DNA, 20 bp, Artificial Sequence
  sgRNA
  Olfr1212_7
gcttgcaaatagctacatat

SEQ ID NO: 37124 - DNA, 20 bp, Artificial Sequence
  sgRNA
  Olfr1212_8
acagagcctccagttcatta

SEQ ID NO: 37125 - DNA, 20 bp, Artificial Sequence
  sgRNA
  Olfr1212_9
attatggaagagtagtgtaa

SEQ ID NO: 37126 - DNA, 20 bp, Artificial Sequence
  sgRNA
  Olfr1212_10
ataatgaactggaggctctg

SEQ ID NO: 37127 - DNA, 20 bp, Artificial Sequence
  sgRNA
  Olfr1212_11
taagaagtcacagttctgaa

SEQ ID NO: 37128 - DNA, 20 bp, Artificial Sequence
  sgRNA
  Olfr1212_12
tacatatcggtcataagcca

SEQ ID NO: 37129 - DNA, 20 bp, Artificial Sequence
  sgRNA
  Olfr1212_13
acagagtcaacaatcatctt

SEQ ID NO: 37130 - DNA, 20 bp, Artificial Sequence
  sgRNA
  Olfr1212_14
tctatgttgctaatctccta

SEQ ID NO: 37131 - DNA, 20 bp, Artificial Sequence
  sgRNA
  Olfr1212_15
gtctacatggcaacaattgg

SEQ ID NO: 37132 - DNA, 20 bp, Artificial Sequence
  sgRNA
  Olfr1212_16
tggtggggatagcatgggca

SEQ ID NO: 37133 - DNA, 20 bp, Artificial Sequence
  sgRNA
  Olfr1212_17
gtgcatatatgaatatgcat

SEQ ID NO: 37134 - DNA, 20 bp, Artificial Sequence
  sgRNA
  Olfr1212_18
aagaaatgaaaaatgccatt

SEQ ID NO: 37135 - DNA, 20 bp, Artificial Sequence
  sgRNA
  Olfr1212_19
caagcagtgcaggagtgcag

SEQ ID NO: 37136 - DNA, 20 bp, Artificial Sequence
  sgRNA
  Olfr1212_20
tttgtctacatggcaacaat

SEQ ID NO: 37137 - DNA, 20 bp, Artificial Sequence
  sgRNA
  Olfr1214_1
ttgtggacatgacttatgag

SEQ ID NO: 37138 - DNA, 20 bp, Artificial Sequence
  sgRNA
  Olfr1214_2
tagtgcaggactgtagacaa

SEQ ID NO: 37139 - DNA, 20 bp, Artificial Sequence
  sgRNA
  Olfr1214_3
atcatgaatcggaggctctg

SEQ ID NO: 37140 - DNA, 20 bp, Artificial Sequence
  sgRNA
  Olfr1214_4
ggtcataggccatggctgcg

SEQ ID NO: 37141 - DNA, 20 bp, Artificial Sequence
  sgRNA
  Olfr1214_5
actctttcatcatgaatcgg

SEQ ID NO: 37142 - DNA, 20 bp, Artificial Sequence
  sgRNA
  Olfr1214_6
tgttgcccacaagagttgca

SEQ ID NO: 37143 - DNA, 20 bp, Artificial Sequence
  sgRNA
  Olfr1214_7
taaaccataggattaagcag

SEQ ID NO: 37144 - DNA, 20 bp, Artificial Sequence
  sgRNA
  Olfr1214_8
tgagagcccacagctcagaa

SEQ ID NO: 37145 - DNA, 20 bp, Artificial Sequence
  sgRNA
  Olfr1214_9
ggtcattgtcctcgcagcca

SEQ ID NO: 37146 - DNA, 20 bp, Artificial Sequence
  sgRNA
  Olfr1214_10
aggaaatgataaatgccatc

SEQ ID NO: 37147 - DNA, 20 bp, Artificial Sequence
  sgRNA
  Olfr1214_11
tatgaaatgatcaataacat

SEQ ID NO: 37148 - DNA, 20 bp, Artificial Sequence
  sgRNA
  Olfr1214_12
gcactttcttactgctgtag

SEQ ID NO: 37149 - DNA, 20 bp, Artificial Sequence
  sgRNA
  Olfr1214_13
atgatgaaagagtagtgcaa

SEQ ID NO: 37150 - DNA, 20 bp, Artificial Sequence
  sgRNA
  Olfr1214_14
cacaggtagaaagagcctta

SEQ ID NO: 37151 - DNA, 20 bp, Artificial Sequence
  sgRNA
  Olfr1214_15
gtctacagtcctgcactact

SEQ ID NO: 37152 - DNA, 20 bp, Artificial Sequence
  sgRNA
  Olfr1214_16
tgtcacacctaagatgattg

SEQ ID NO: 37153 - DNA, 20 bp, Artificial Sequence
  sgRNA
  Olfr1214_17
catcttaggtgtgacaacag

SEQ ID NO: 37154 - DNA, 20 bp, Artificial Sequence
  sgRNA
  Olfr1214_18
ccgtgcatatattaatatac

SEQ ID NO: 37155 - DNA, 20 bp, Artificial Sequence
  sgRNA
  Olfr1214_19
cctgtatattaatatatgca

SEQ ID NO: 37156 - DNA, 20 bp, Artificial Sequence
  sgRNA
  Olfr1214_20
actactctttcatcatgaat

SEQ ID NO: 37157 - DNA, 20 bp, Artificial Sequence
  sgRNA
  Olfr1215_1
tggaggcaacatgacaattg

SEQ ID NO: 37158 - DNA, 20 bp, Artificial Sequence
  sgRNA
  Olfr1215_2
gaataaatctataatcatcg

SEQ ID NO: 37159 - DNA, 20 bp, Artificial Sequence
  sgRNA
  Olfr1215_3
ggctctgtggcatcctagtg

SEQ ID NO: 37160 - DNA, 20 bp, Artificial Sequence
  sgRNA
  Olfr1215_4
gcttacaaatggctacatac

SEQ ID NO: 37161 - DNA, 20 bp, Artificial Sequence
  sgRNA
  Olfr1215_5
gtaactgagttcgtactcct

SEQ ID NO: 37162 - DNA, 20 bp, Artificial Sequence
  sgRNA
  Olfr1215_6
tgagaacccacagttctgaa

SEQ ID NO: 37163 - DNA, 20 bp, Artificial Sequence
  sgRNA
  Olfr1215_7
ataggggaaccaagcaacac

SEQ ID NO: 37164 - DNA, 20 bp, Artificial Sequence
  sgRNA
  Olfr1215_8
gcaacaaaaatataacaaat

SEQ ID NO: 37165 - DNA, 20 bp, Artificial Sequence
  sgRNA
  Olfr1215_9
tagtggggatagcctttgca

SEQ ID NO: 37166 - DNA, 20 bp, Artificial Sequence
  sgRNA
  Olfr1215_10
gaggctctgtggcatcctag

SEQ ID NO: 37167 - DNA, 20 bp, Artificial Sequence
  sgRNA
  Olfr1215_11
acgtctcccttcagaactgt

SEQ ID NO: 37168 - DNA, 20 bp, Artificial Sequence
  sgRNA
  Olfr1215_12
gtggggatagcctttgcagg

SEQ ID NO: 37169 - DNA, 20 bp, Artificial Sequence
  sgRNA
  Olfr1215_13
agagaacaagatgacaacat

SEQ ID NO: 37170 - DNA, 20 bp, Artificial Sequence
  sgRNA
  Olfr1215_14
ataattgaagagtagtgcaa

SEQ ID NO: 37171 - DNA, 20 bp, Artificial Sequence
  sgRNA
  Olfr1215_15
aataaatctataatcatcgt

SEQ ID NO: 37172 - DNA, 20 bp, Artificial Sequence
  sgRNA
  Olfr1215_16
taaaccacaggattgagtaa

SEQ ID NO: 37173 - DNA, 20 bp, Artificial Sequence
  sgRNA
  Olfr1215_17
agtggggatagcctttgcag

SEQ ID NO: 37174 - DNA, 20 bp, Artificial Sequence
  sgRNA
  Olfr1215_18
tggcagctatggcttatgac

SEQ ID NO: 37175 - DNA, 20 bp, Artificial Sequence
  sgRNA
  Olfr1215_19
gtagtgcaagggcttacaaa

SEQ ID NO: 37176 - DNA, 20 bp, Artificial Sequence
  sgRNA
  Olfr1215_20
gcttcgagtcctgtgttgct

SEQ ID NO: 37177 - DNA, 20 bp, Artificial Sequence
  sgRNA
  Olfr1216_1
attcttccatccttactcgg

SEQ ID NO: 37178 - DNA, 20 bp, Artificial Sequence
  sgRNA
  Olfr1216_2
agggggtaacatgattattg

SEQ ID NO: 37179 - DNA, 20 bp, Artificial Sequence
  sgRNA
  Olfr1216_3
ttgtgtcatgcaacagccaa

SEQ ID NO: 37180 - DNA, 20 bp, Artificial Sequence
  sgRNA
  Olfr1216_4
tagaagagacacaagcatcc

SEQ ID NO: 37181 - DNA, 20 bp, Artificial Sequence
  sgRNA
  Olfr1216_5
ttaccgagttcataatctta

SEQ ID NO: 37182 - DNA, 20 bp, Artificial Sequence
  sgRNA
  Olfr1216_6
acagagcctccgagtaagga

SEQ ID NO: 37183 - DNA, 20 bp, Artificial Sequence
  sgRNA
  Olfr1216_7
tataagggtgtccttctcat

SEQ ID NO: 37184 - DNA, 20 bp, Artificial Sequence
  sgRNA
  Olfr1216_8
catggcctatgaccgttacg

SEQ ID NO: 37185 - DNA, 20 bp, Artificial Sequence
  sgRNA
  Olfr1216_9
ataacattgggtccacataa

SEQ ID NO: 37186 - DNA, 20 bp, Artificial Sequence
  sgRNA
  Olfr1216_10
aagccctaagattatgaact

SEQ ID NO: 37187 - DNA, 20 bp, Artificial Sequence
  sgRNA
  Olfr1216_11
aggatggaagaatagtgcaa

SEQ ID NO: 37188 - DNA, 20 bp, Artificial Sequence
  sgRNA
  Olfr1216_12
caggacattgacaaatataa

SEQ ID NO: 37189 - DNA, 20 bp, Artificial Sequence
  sgRNA
  Olfr1216_13
ttctactgttacacccaaga

SEQ ID NO: 37190 - DNA, 20 bp, Artificial Sequence
  sgRNA
  Olfr1216_14
tgggggagctcagcagtgca

SEQ ID NO: 37191 - DNA, 20 bp, Artificial Sequence
  sgRNA
  Olfr1216_15
gtttgcaaatagccacgtaa

SEQ ID NO: 37192 - DNA, 20 bp, Artificial Sequence
  sgRNA
  Olfr1216_16
gtctacatggcaactgtagg

SEQ ID NO: 37193 - DNA, 20 bp, Artificial Sequence
  sgRNA
  Olfr1216_17
tttctgctcctgagaagaaa

SEQ ID NO: 37194 - DNA, 20 bp, Artificial Sequence
  sgRNA
  Olfr1216_18
catataatgatcaataacat

SEQ ID NO: 37195 - DNA, 20 bp, Artificial Sequence
  sgRNA
  Olfr1216_19
tggtctacatggcaactgta

SEQ ID NO: 37196 - DNA, 20 bp, Artificial Sequence
  sgRNA
  Olfr1216_20
atataatgatcaataacatt

SEQ ID NO: 37197 - DNA, 20 bp, Artificial Sequence
  sgRNA
  Olfr1217_1
actttcacagaacctgaatg

SEQ ID NO: 37198 - DNA, 20 bp, Artificial Sequence
  sgRNA
  Olfr1217_2
actcttccatcatgacccag

SEQ ID NO: 37199 - DNA, 20 bp, Artificial Sequence
  sgRNA
  Olfr1217_3
agaagtgcatgcatccagga

SEQ ID NO: 37200 - DNA, 20 bp, Artificial Sequence
  sgRNA
  Olfr1217_4
tggggcagaagtgattgtct

SEQ ID NO: 37201 - DNA, 20 bp, Artificial Sequence
  sgRNA
  Olfr1217_5
tgagagcccagagttctgaa

SEQ ID NO: 37202 - DNA, 20 bp, Artificial Sequence
  sgRNA
  Olfr1217_6
ttagttgtggtatcttgggc

SEQ ID NO: 37203 - DNA, 20 bp, Artificial Sequence
  sgRNA
  Olfr1217_7
gttgtggtatcttgggcagg

SEQ ID NO: 37204 - DNA, 20 bp, Artificial Sequence
  sgRNA
  Olfr1217_8
ttatctacattgcaactatt

SEQ ID NO: 37205 - DNA, 20 bp, Artificial Sequence
  sgRNA
  Olfr1217_9
accataggagacaatcaata

SEQ ID NO: 37206 - DNA, 20 bp, Artificial Sequence
  sgRNA
  Olfr1217_10
agttatatgggacccacagg

SEQ ID NO: 37207 - DNA, 20 bp, Artificial Sequence
  sgRNA
  Olfr1217_11
tcaggttctgtgaaagtccc

SEQ ID NO: 37208 - DNA, 20 bp, Artificial Sequence
  sgRNA
  Olfr1217_12
actttgcagctgcctttatg

SEQ ID NO: 37209 - DNA, 20 bp, Artificial Sequence
  sgRNA
  Olfr1217_13
taaaattccacagagcctct

SEQ ID NO: 37210 - DNA, 20 bp, Artificial Sequence
  sgRNA
  Olfr1217_14
ttgcatatattaatatgcat

SEQ ID NO: 37211 - DNA, 20 bp, Artificial Sequence
  sgRNA
  Olfr1217_15
ctaaaattccacagagcctc

SEQ ID NO: 37212 - DNA, 20 bp, Artificial Sequence
  sgRNA
  Olfr1217_16
gacaccactgctcaatccta

SEQ ID NO: 37213 - DNA, 20 bp, Artificial Sequence
  sgRNA
  Olfr1217_17
ctgagagcccagagttctga

SEQ ID NO: 37214 - DNA, 20 bp, Artificial Sequence
  sgRNA
  Olfr1217_18
acgtcgcccttcagaactct

SEQ ID NO: 37215 - DNA, 20 bp, Artificial Sequence
  sgRNA
  Olfr1217_19
acaaaagtacaacagttata

SEQ ID NO: 37216 - DNA, 20 bp, Artificial Sequence
  sgRNA
  Olfr1217_20
aacagttatatgggacccac

SEQ ID NO: 37217 - DNA, 20 bp, Artificial Sequence
  sgRNA
  Olfr1218_1
aatcatcttgggtatgacag

SEQ ID NO: 37218 - DNA, 20 bp, Artificial Sequence
  sgRNA
  Olfr1218_2
ttgcatcatgcaacagccaa

SEQ ID NO: 37219 - DNA, 20 bp, Artificial Sequence
  sgRNA
  Olfr1218_3
gcttgcaaatagccacgtag

SEQ ID NO: 37220 - DNA, 20 bp, Artificial Sequence
  sgRNA
  Olfr1218_4
cagtgcagggctgtacatga

SEQ ID NO: 37221 - DNA, 20 bp, Artificial Sequence
  sgRNA
  Olfr1218_5
tagtctatcttgcaactata

SEQ ID NO: 37222 - DNA, 20 bp, Artificial Sequence
  sgRNA
  Olfr1218_6
aggatggaaaaatagtgcaa

SEQ ID NO: 37223 - DNA, 20 bp, Artificial Sequence
  sgRNA
  Olfr1218_7
tgggggatcccagcagtgca

SEQ ID NO: 37224 - DNA, 20 bp, Artificial Sequence
  sgRNA
  Olfr1218_8
tgaactcagtaacaaaactc

SEQ ID NO: 37225 - DNA, 20 bp, Artificial Sequence
  sgRNA
  Olfr1218_9
acgccaagaagaaatacatg

SEQ ID NO: 37226 - DNA, 20 bp, Artificial Sequence
  sgRNA
  Olfr1218_10
cgccaagaagaaatacatgg

SEQ ID NO: 37227 - DNA, 20 bp, Artificial Sequence
  sgRNA
  Olfr1218_11
gtctatcttgcaactatagg

SEQ ID NO: 37228 - DNA, 20 bp, Artificial Sequence
  sgRNA
  Olfr1218_12
agagacacatagatccagga

SEQ ID NO: 37229 - DNA, 20 bp, Artificial Sequence
  sgRNA
  Olfr1218_13
gaacgccaagaagaaataca

SEQ ID NO: 37230 - DNA, 20 bp, Artificial Sequence
  sgRNA
  Olfr1218_14
tttctgttcctgagaagaaa

SEQ ID NO: 37231 - DNA, 20 bp, Artificial Sequence
  sgRNA
  Olfr1218_15
atgtacagccctgcactgct

SEQ ID NO: 37232 - DNA, 20 bp, Artificial Sequence
  sgRNA
  Olfr1218_16
ttactgagttcataatcttg

SEQ ID NO: 37233 - DNA, 20 bp, Artificial Sequence
  sgRNA
  Olfr1218_17
taaactgtaggatttagcaa

SEQ ID NO: 37234 - DNA, 20 bp, Artificial Sequence
  sgRNA
  Olfr1218_18
tgtgtaatgatcaatgacat

SEQ ID NO: 37235 - DNA, 20 bp, Artificial Sequence
  sgRNA
  Olfr1218_19
ttcctgaaagtgtaaactgt

SEQ ID NO: 37236 - DNA, 20 bp, Artificial Sequence
  sgRNA
  Olfr1218_20
aacgccaagaagaaatacat

SEQ ID NO: 37237 - DNA, 20 bp, Artificial Sequence
  sgRNA
  Olfr1219_1
gcagtctacaattatctttg

SEQ ID NO: 37238 - DNA, 20 bp, Artificial Sequence
  sgRNA
  Olfr1219_2
actcttccatcatgactcgg

SEQ ID NO: 37239 - DNA, 20 bp, Artificial Sequence
  sgRNA
  Olfr1219_3
actttcacagaacctgtatg

SEQ ID NO: 37240 - DNA, 20 bp, Artificial Sequence
  sgRNA
  Olfr1219_4
tgtaatgatcaatgacattg

SEQ ID NO: 37241 - DNA, 20 bp, Artificial Sequence
  sgRNA
  Olfr1219_5
gagcccacagttctgaaggt

SEQ ID NO: 37242 - DNA, 20 bp, Artificial Sequence
  sgRNA
  Olfr1219_6
aatgtggaagagattaatag

SEQ ID NO: 37243 - DNA, 20 bp, Artificial Sequence
  sgRNA
  Olfr1219_7
acagagcctccgagtcatga

SEQ ID NO: 37244 - DNA, 20 bp, Artificial Sequence
  sgRNA
  Olfr1219_8
ttaatgcatccagtaaggac

SEQ ID NO: 37245 - DNA, 20 bp, Artificial Sequence
  sgRNA
  Olfr1219_9
catgatggaagagtagtgaa

SEQ ID NO: 37246 - DNA, 20 bp, Artificial Sequence
  sgRNA
  Olfr1219_10
acgccgaccttcagaactgt

SEQ ID NO: 37247 - DNA, 20 bp, Artificial Sequence
  sgRNA
  Olfr1219_11
tatcaagaagaagtacatgg

SEQ ID NO: 37248 - DNA, 20 bp, Artificial Sequence
  sgRNA
  Olfr1219_12
agaatgctatcggaaaaatg

SEQ ID NO: 37249 - DNA, 20 bp, Artificial Sequence
  sgRNA
  Olfr1219_13
agcagtctacaattatcttt

SEQ ID NO: 37250 - DNA, 20 bp, Artificial Sequence
  sgRNA
  Olfr1219_14
atatcaagaagaagtacatg

SEQ ID NO: 37251 - DNA, 20 bp, Artificial Sequence
  sgRNA
  Olfr1219_15
gtagtggtgtcttgggcagg

SEQ ID NO: 37252 - DNA, 20 bp, Artificial Sequence
  sgRNA
  Olfr1219_16
ttgcatatattaataggcat

SEQ ID NO: 37253 - DNA, 20 bp, Artificial Sequence
  sgRNA
  Olfr1219_17
aattatatgggacccacagg

SEQ ID NO: 37254 - DNA, 20 bp, Artificial Sequence
  sgRNA
  Olfr1219_18
acaggttctgtgaaagtccc

SEQ ID NO: 37255 - DNA, 20 bp, Artificial Sequence
  sgRNA
  Olfr1219_19
acattgcagctgcctttctg

SEQ ID NO: 37256 - DNA, 20 bp, Artificial Sequence
  sgRNA
  Olfr1219_20
accataagagacaagcaata

SEQ ID NO: 37257 - DNA, 20 bp, Artificial Sequence
  sgRNA
  Olfr1220_1
gtatacctagcaacaatcgg

SEQ ID NO: 37258 - DNA, 20 bp, Artificial Sequence
  sgRNA
  Olfr1220_2
gactctccaggtcatgatgg

SEQ ID NO: 37259 - DNA, 20 bp, Artificial Sequence
  sgRNA
  Olfr1220_3
tgcaagtatccaataaggac

SEQ ID NO: 37260 - DNA, 20 bp, Artificial Sequence
  sgRNA
  Olfr1220_4
aatatagttatcaataacat

SEQ ID NO: 37261 - DNA, 20 bp, Artificial Sequence
  sgRNA
  Olfr1220_5
tgggagaacccagcaatgca

SEQ ID NO: 37262 - DNA, 20 bp, Artificial Sequence
  sgRNA
  Olfr1220_6
gtcatcttgttctctctgag

SEQ ID NO: 37263 - DNA, 20 bp, Artificial Sequence
  sgRNA
  Olfr1220_7
tgttgcctccgattgttgct

SEQ ID NO: 37264 - DNA, 20 bp, Artificial Sequence
  sgRNA
  Olfr1220_8
aatgtgcagaagatctaaag

SEQ ID NO: 37265 - DNA, 20 bp, Artificial Sequence
  sgRNA
  Olfr1220_9
attcccatatgagaaatatg

SEQ ID NO: 37266 - DNA, 20 bp, Artificial Sequence
  sgRNA
  Olfr1220_10
gtttgcaaatggccacatac

SEQ ID NO: 37267 - DNA, 20 bp, Artificial Sequence
  sgRNA
  Olfr1220_11
acatatttctcatatgggaa

SEQ ID NO: 37268 - DNA, 20 bp, Artificial Sequence
  sgRNA
  Olfr1220_12
ggtcattgtcttggcagcca

SEQ ID NO: 37269 - DNA, 20 bp, Artificial Sequence
  sgRNA
  Olfr1220_13
aagaaatctaaaataagctt

SEQ ID NO: 37270 - DNA, 20 bp, Artificial Sequence
  sgRNA
  Olfr1220_14
gtgcatatattaatatacat

SEQ ID NO: 37271 - DNA, 20 bp, Artificial Sequence
  sgRNA
  Olfr1220_15
atatagttatcaataacatt

SEQ ID NO: 37272 - DNA, 20 bp, Artificial Sequence
  sgRNA
  Olfr1220_16
acagactctccaggtcatga

SEQ ID NO: 37273 - DNA, 20 bp, Artificial Sequence
  sgRNA
  Olfr1220_17
gtgcaagcaagcttgagtaa

SEQ ID NO: 37274 - DNA, 20 bp, Artificial Sequence
  sgRNA
  Olfr1220_18
ctgagaggccatagttccga

SEQ ID NO: 37275 - DNA, 20 bp, Artificial Sequence
  sgRNA
  Olfr1220_19
taagtcgtccttcggaacta

SEQ ID NO: 37276 - DNA, 20 bp, Artificial Sequence
  sgRNA
  Olfr1220_20
actttgcagctaccgttctg

SEQ ID NO: 37277 - DNA, 20 bp, Artificial Sequence
  sgRNA
  Olfr1221_1
gtaacacctaagatgatcgt

SEQ ID NO: 37278 - DNA, 20 bp, Artificial Sequence
  sgRNA
  Olfr1221_2
tgccatacacttctttactg

SEQ ID NO: 37279 - DNA, 20 bp, Artificial Sequence
  sgRNA
  Olfr1221_3
tgtgttggtaggcatagcat

SEQ ID NO: 37280 - DNA, 20 bp, Artificial Sequence
  sgRNA
  Olfr1221_4
tgttgccaccaatagttgca

SEQ ID NO: 37281 - DNA, 20 bp, Artificial Sequence
  sgRNA
  Olfr1221_5
ttgtgttctgagaaagaccc

SEQ ID NO: 37282 - DNA, 20 bp, Artificial Sequence
  sgRNA
  Olfr1221_6
ggaacaagtcacacatataa

SEQ ID NO: 37283 - DNA, 20 bp, Artificial Sequence
  sgRNA
  Olfr1221_7
atatcgcccttcagaactgt

SEQ ID NO: 37284 - DNA, 20 bp, Artificial Sequence
  sgRNA
  Olfr1221_8
ataccaagaagaagtacata

SEQ ID NO: 37285 - DNA, 20 bp, Artificial Sequence
  sgRNA
  Olfr1221_9
ccctcttgctcataatggac

SEQ ID NO: 37286 - DNA, 20 bp, Artificial Sequence
  sgRNA
  Olfr1221_10
gtttgcaaatagccacataa

SEQ ID NO: 37287 - DNA, 20 bp, Artificial Sequence
  sgRNA
  Olfr1221_11
ggagtatgaactcattgaca

SEQ ID NO: 37288 - DNA, 20 bp, Artificial Sequence
  sgRNA
  Olfr1221_12
ataatggacaggtagtgcaa

SEQ ID NO: 37289 - DNA, 20 bp, Artificial Sequence
  sgRNA
  Olfr1221_13
taggggagcccagcagtgca

SEQ ID NO: 37290 - DNA, 20 bp, Artificial Sequence
  sgRNA
  Olfr1221_14
cctgtccattatgagcaaga

SEQ ID NO: 37291 - DNA, 20 bp, Artificial Sequence
  sgRNA
  Olfr1221_15
agaagtgtatggcaaacaat

SEQ ID NO: 37292 - DNA, 20 bp, Artificial Sequence
  sgRNA
  Olfr1221_16
ataaagctctctccacctgt

SEQ ID NO: 37293 - DNA, 20 bp, Artificial Sequence
  sgRNA
  Olfr1221_17
agagtgccataaggaaaatg

SEQ ID NO: 37294 - DNA, 20 bp, Artificial Sequence
  sgRNA
  Olfr1221_18
aataccaagaagaagtacat

SEQ ID NO: 37295 - DNA, 20 bp, Artificial Sequence
  sgRNA
  Olfr1221_19
actttgcaattaccattctg

SEQ ID NO: 37296 - DNA, 20 bp, Artificial Sequence
  sgRNA
  Olfr1221_20
ggtgattgtactgtcagcta

SEQ ID NO: 37297 - DNA, 20 bp, Artificial Sequence
  sgRNA
  Olfr1222_1
tgggggaaacatgataattg

SEQ ID NO: 37298 - DNA, 20 bp, Artificial Sequence
  sgRNA
  Olfr1222_2
ctgtggcactctcgtaatgg

SEQ ID NO: 37299 - DNA, 20 bp, Artificial Sequence
  sgRNA
  Olfr1222_3
tagaggaagtgcaagcatcc

SEQ ID NO: 37300 - DNA, 20 bp, Artificial Sequence
  sgRNA
  Olfr1222_4
ttgtgtgatgcaacattcaa

SEQ ID NO: 37301 - DNA, 20 bp, Artificial Sequence
  sgRNA
  Olfr1222_5
ataaaattgggcccacagaa

SEQ ID NO: 37302 - DNA, 20 bp, Artificial Sequence
  sgRNA
  Olfr1222_6
actcttccatcatgaccagg

SEQ ID NO: 37303 - DNA, 20 bp, Artificial Sequence
  sgRNA
  Olfr1222_7
cgttgcagctacccttctgt

SEQ ID NO: 37304 - DNA, 20 bp, Artificial Sequence
  sgRNA
  Olfr1222_8
tgtgacctcttagagagaag

SEQ ID NO: 37305 - DNA, 20 bp, Artificial Sequence
  sgRNA
  Olfr1222_9
gtcatcctcttctctctaag

SEQ ID NO: 37306 - DNA, 20 bp, Artificial Sequence
  sgRNA
  Olfr1222_10
gtgcatatattagcatacat

SEQ ID NO: 37307 - DNA, 20 bp, Artificial Sequence
  sgRNA
  Olfr1222_11
tgggggaactcaacagtgca

SEQ ID NO: 37308 - DNA, 20 bp, Artificial Sequence
  sgRNA
  Olfr1222_12
gtagtgaagaggcttgcaga

SEQ ID NO: 37309 - DNA, 20 bp, Artificial Sequence
  sgRNA
  Olfr1222_13
gtaatggtggcctggacagg

SEQ ID NO: 37310 - DNA, 20 bp, Artificial Sequence
  sgRNA
  Olfr1222_14
taaaccataggattgaacaa

SEQ ID NO: 37311 - DNA, 20 bp, Artificial Sequence
  sgRNA
  Olfr1222_15
gctctgtggcactctcgtaa

SEQ ID NO: 37312 - DNA, 20 bp, Artificial Sequence
  sgRNA
  Olfr1222_16
cctcaactcctgcaaagaag

SEQ ID NO: 37313 - DNA, 20 bp, Artificial Sequence
  sgRNA
  Olfr1222_17
gatgcaacattcaaaggaga

SEQ ID NO: 37314 - DNA, 20 bp, Artificial Sequence
  sgRNA
  Olfr1222_18
atgccatcaggaaaatgtgt

SEQ ID NO: 37315 - DNA, 20 bp, Artificial Sequence
  sgRNA
  Olfr1222_19
catgtatgctaatatatgca

SEQ ID NO: 37316 - DNA, 20 bp, Artificial Sequence
  sgRNA
  Olfr1222_20
ctaagaggtcacagctcaga

SEQ ID NO: 37317 - DNA, 20 bp, Artificial Sequence
  sgRNA
  Olfr1223_1
tgaaatgctcaataacattg

SEQ ID NO: 37318 - DNA, 20 bp, Artificial Sequence
  sgRNA
  Olfr1223_2
cattctggtagggatagcct

SEQ ID NO: 37319 - DNA, 20 bp, Artificial Sequence
  sgRNA
  Olfr1223_3
atgggggagccaaaaagtgc

SEQ ID NO: 37320 - DNA, 20 bp, Artificial Sequence
  sgRNA
  Olfr1223_4
ttgtaccatacaacattcaa

SEQ ID NO: 37321 - DNA, 20 bp, Artificial Sequence
  sgRNA
  Olfr1223_5
gatctcacagttctgaaggg

SEQ ID NO: 37322 - DNA, 20 bp, Artificial Sequence
  sgRNA
  Olfr1223_6
agtaaagctctatctacctg

SEQ ID NO: 37323 - DNA, 20 bp, Artificial Sequence
  sgRNA
  Olfr1223_7
atgccatcaaaaaaatatgg

SEQ ID NO: 37324 - DNA, 20 bp, Artificial Sequence
  sgRNA
  Olfr1223_8
tataccataggatttagtaa

SEQ ID NO: 37325 - DNA, 20 bp, Artificial Sequence
  sgRNA
  Olfr1223_9
agactctgtgtcattctggt

SEQ ID NO: 37326 - DNA, 20 bp, Artificial Sequence
  sgRNA
  Olfr1223_10
agacaaaaagaagtacatgg

SEQ ID NO: 37327 - DNA, 20 bp, Artificial Sequence
  sgRNA
  Olfr1223_11
tgctgtccacttcttcactg

SEQ ID NO: 37328 - DNA, 20 bp, Artificial Sequence
  sgRNA
  Olfr1223_12
gactctgtgtcattctggta

SEQ ID NO: 37329 - DNA, 20 bp, Artificial Sequence
  sgRNA
  Olfr1223_13
tgagatctcacagttctgaa

SEQ ID NO: 37330 - DNA, 20 bp, Artificial Sequence
  sgRNA
  Olfr1223_14
agaatgccatcaaaaaaata

SEQ ID NO: 37331 - DNA, 20 bp, Artificial Sequence
  sgRNA
  Olfr1223_15
acagagtctctggttcatga

SEQ ID NO: 37332 - DNA, 20 bp, Artificial Sequence
  sgRNA
  Olfr1223_16
gacaccattactaaatccta

SEQ ID NO: 37333 - DNA, 20 bp, Artificial Sequence
  sgRNA
  Olfr1223_17
tgttgcctccaatagttgca

SEQ ID NO: 37334 - DNA, 20 bp, Artificial Sequence
  sgRNA
  Olfr1223_18
catacaacattcaaaggaga

SEQ ID NO: 37335 - DNA, 20 bp, Artificial Sequence
  sgRNA
  Olfr1223_19
tgcaggctagctttagtaat

SEQ ID NO: 37336 - DNA, 20 bp, Artificial Sequence
  sgRNA
  Olfr1223_20
tatgaaatgctcaataacat

SEQ ID NO: 37337 - DNA, 20 bp, Artificial Sequence
  sgRNA
  Olfr1224-ps1_1
gaaaccacagttctgaaggt

SEQ ID NO: 37338 - DNA, 20 bp, Artificial Sequence
  sgRNA
  Olfr1224-ps1_2
tgtttcctccaatagttgca

SEQ ID NO: 37339 - DNA, 20 bp, Artificial Sequence
  sgRNA
  Olfr1224-ps1_3
gcttgcaaatagctacatag

SEQ ID NO: 37340 - DNA, 20 bp, Artificial Sequence
  sgRNA
  Olfr1224-ps1_4
agaaacacatgcatccagga

SEQ ID NO: 37341 - DNA, 20 bp, Artificial Sequence
  sgRNA
  Olfr1224-ps1_5
tgtccacttcttcacagggg

SEQ ID NO: 37342 - DNA, 20 bp, Artificial Sequence
  sgRNA
  Olfr1224-ps1_6
agatagaaagaagtacatgg

SEQ ID NO: 37343 - DNA, 20 bp, Artificial Sequence
  sgRNA
  Olfr1224-ps1_7
gtgcaggcaagctttagtaa

SEQ ID NO: 37344 - DNA, 20 bp, Artificial Sequence
  sgRNA
  Olfr1224-ps1_8
ctagtcggaatagcttgggc

SEQ ID NO: 37345 - DNA, 20 bp, Artificial Sequence
  sgRNA
  Olfr1224-ps1_9
tgctgtccacttcttcacag

SEQ ID NO: 37346 - DNA, 20 bp, Artificial Sequence
  sgRNA
  Olfr1224-ps1_10
catcctagtcggaatagctt

SEQ ID NO: 37347 - DNA, 20 bp, Artificial Sequence
  sgRNA
  Olfr1224-ps1_11
gtcactgagttcatactgct

SEQ ID NO: 37348 - DNA, 20 bp, Artificial Sequence
  sgRNA
  Olfr1224-ps1_12
gtattcagtcctgcactttc

SEQ ID NO: 37349 - DNA, 20 bp, Artificial Sequence
  sgRNA
  Olfr1224-ps1_13
ttgctgtccacttcttcaca

SEQ ID NO: 37350 - DNA, 20 bp, Artificial Sequence
  sgRNA
  Olfr1224-ps1_14
agaatgccatcaagaaaatg

SEQ ID NO: 37351 - DNA, 20 bp, Artificial Sequence
  sgRNA
  Olfr1224-ps1_15
ctgcccaagctattccgact

SEQ ID NO: 37352 - DNA, 20 bp, Artificial Sequence
  sgRNA
  Olfr1224-ps1_16
ctgagaaaccacagttctga

SEQ ID NO: 37353 - DNA, 20 bp, Artificial Sequence
  sgRNA
  Olfr1224-ps1_17
atgccatcaagaaaatgtgg

SEQ ID NO: 37354 - DNA, 20 bp, Artificial Sequence
  sgRNA
  Olfr1224-ps1_18
taagccaaaggatttagcat

SEQ ID NO: 37355 - DNA, 20 bp, Artificial Sequence
  sgRNA
  Olfr1224-ps1_19
gcatcctagtcggaatagct

SEQ ID NO: 37356 - DNA, 20 bp, Artificial Sequence
  sgRNA
  Olfr1224-ps1_20
actttgcagttgcccttctg

SEQ ID NO: 37357 - DNA, 20 bp, Artificial Sequence
  sgRNA
  Olfr1225_1
ggtgatagtactgtcagcca

SEQ ID NO: 37358 - DNA, 20 bp, Artificial Sequence
  sgRNA
  Olfr1225_2
actcttccatcatgaaccgg

SEQ ID NO: 37359 - DNA, 20 bp, Artificial Sequence
  sgRNA
  Olfr1225_3
tatcaagaagaagtacattg

SEQ ID NO: 37360 - DNA, 20 bp, Artificial Sequence
  sgRNA
  Olfr1225_4
atctatcttgcaactattgg

SEQ ID NO: 37361 - DNA, 20 bp, Artificial Sequence
  sgRNA
  Olfr1225_5
ttgagttctgtgaaagtccc

SEQ ID NO: 37362 - DNA, 20 bp, Artificial Sequence
  sgRNA
  Olfr1225_6
tttaaagccctctcaacctg

SEQ ID NO: 37363 - DNA, 20 bp, Artificial Sequence
  sgRNA
  Olfr1225_7
agagtacaagatgacaccat

SEQ ID NO: 37364 - DNA, 20 bp, Artificial Sequence
  sgRNA
  Olfr1225_8
ttgtagacttcttctatgat

SEQ ID NO: 37365 - DNA, 20 bp, Artificial Sequence
  sgRNA
  Olfr1225_9
tatgggatccacaggttgag

SEQ ID NO: 37366 - DNA, 20 bp, Artificial Sequence
  sgRNA
  Olfr1225_10
tgagagcccacagctctgaa

SEQ ID NO: 37367 - DNA, 20 bp, Artificial Sequence
  sgRNA
  Olfr1225_11
tgaactcagtgacacagctc

SEQ ID NO: 37368 - DNA, 20 bp, Artificial Sequence
  sgRNA
  Olfr1225_12
gtgcatatgttaatatgcat

SEQ ID NO: 37369 - DNA, 20 bp, Artificial Sequence
  sgRNA
  Olfr1225_13
taaactacagaattgagcaa

SEQ ID NO: 37370 - DNA, 20 bp, Artificial Sequence
  sgRNA
  Olfr1225_14
caatcttgtgatggtgtcct

SEQ ID NO: 37371 - DNA, 20 bp, Artificial Sequence
  sgRNA
  Olfr1225_15
aactacagaattgagcaatg

SEQ ID NO: 37372 - DNA, 20 bp, Artificial Sequence
  sgRNA
  Olfr1225_16
acagagcctccggttcatga

SEQ ID NO: 37373 - DNA, 20 bp, Artificial Sequence
  sgRNA
  Olfr1225_17
tggatcccatattattgttg

SEQ ID NO: 37374 - DNA, 20 bp, Artificial Sequence
  sgRNA
  Olfr1225_18
agaatgccatcaggaaaatg

SEQ ID NO: 37375 - DNA, 20 bp, Artificial Sequence
  sgRNA
  Olfr1225_19
aggaaatgaagaatgccatc

SEQ ID NO: 37376 - DNA, 20 bp, Artificial Sequence
  sgRNA
  Olfr1225_20
gctctgtggcaatcttgtga

SEQ ID NO: 37377 - DNA, 20 bp, Artificial Sequence
  sgRNA
  Olfr1226_1
tattaagaagaagtacattg

SEQ ID NO: 37378 - DNA, 20 bp, Artificial Sequence
  sgRNA
  Olfr1226_2
ggtcataggccatggctgaa

SEQ ID NO: 37379 - DNA, 20 bp, Artificial Sequence
  sgRNA
  Olfr1226_3
atcatgaccaggagactctg

SEQ ID NO: 37380 - DNA, 20 bp, Artificial Sequence
  sgRNA
  Olfr1226_4
ttgtgtcatgcagcattcaa

SEQ ID NO: 37381 - DNA, 20 bp, Artificial Sequence
  sgRNA
  Olfr1226_5
ggtgattgtcctttcagcca

SEQ ID NO: 37382 - DNA, 20 bp, Artificial Sequence
  sgRNA
  Olfr1226_6
agaatgctattaggaaactg

SEQ ID NO: 37383 - DNA, 20 bp, Artificial Sequence
  sgRNA
  Olfr1226_7
tgaactcagtgacactactg

SEQ ID NO: 37384 - DNA, 20 bp, Artificial Sequence
  sgRNA
  Olfr1226_8
tataccataggattcagaag

SEQ ID NO: 37385 - DNA, 20 bp, Artificial Sequence
  sgRNA
  Olfr1226_9
gagcccacagttctgaaggg

SEQ ID NO: 37386 - DNA, 20 bp, Artificial Sequence
  sgRNA
  Olfr1226_10
actgtggaagagatggaaag

SEQ ID NO: 37387 - DNA, 20 bp, Artificial Sequence
  sgRNA
  Olfr1226_11
gggaaatgaagaatgctatt

SEQ ID NO: 37388 - DNA, 20 bp, Artificial Sequence
  sgRNA
  Olfr1226_12
agagaacaagatgacactat

SEQ ID NO: 37389 - DNA, 20 bp, Artificial Sequence
  sgRNA
  Olfr1226_13
agaagtgcaagcatccagaa

SEQ ID NO: 37390 - DNA, 20 bp, Artificial Sequence
  sgRNA
  Olfr1226_14
gagtctcctggtcatgatgg

SEQ ID NO: 37391 - DNA, 20 bp, Artificial Sequence
  sgRNA
  Olfr1226_15
ttaggaaactgtggaagaga

SEQ ID NO: 37392 - DNA, 20 bp, Artificial Sequence
  sgRNA
  Olfr1226_16
acgccgcccttcagaactgt

SEQ ID NO: 37393 - DNA, 20 bp, Artificial Sequence
  sgRNA
  Olfr1226_17
tacgccgcccttcagaactg

SEQ ID NO: 37394 - DNA, 20 bp, Artificial Sequence
  sgRNA
  Olfr1226_18
tgcaagcatccagaaaggac

SEQ ID NO: 37395 - DNA, 20 bp, Artificial Sequence
  sgRNA
  Olfr1226_19
tgtaatgtgggatccacagg

SEQ ID NO: 37396 - DNA, 20 bp, Artificial Sequence
  sgRNA
  Olfr1226_20
ttcctgaaagtatataccat

SEQ ID NO: 37397 - DNA, 20 bp, Artificial Sequence
  sgRNA
  Olfr1228_1
gaggtctaccatcatcttag

SEQ ID NO: 37398 - DNA, 20 bp, Artificial Sequence
  sgRNA
  Olfr1228_2
gagtctcctggtcataatgg

SEQ ID NO: 37399 - DNA, 20 bp, Artificial Sequence
  sgRNA
  Olfr1228_3
tgggggcaacattatgattg

SEQ ID NO: 37400 - DNA, 20 bp, Artificial Sequence
  sgRNA
  Olfr1228_4
cacagtatgttctcaacatt

SEQ ID NO: 37401 - DNA, 20 bp, Artificial Sequence
  sgRNA
  Olfr1228_5
gagctcacagctctgaaggg

SEQ ID NO: 37402 - DNA, 20 bp, Artificial Sequence
  sgRNA
  Olfr1228_6
gtgcatatattaaaaagcat

SEQ ID NO: 37403 - DNA, 20 bp, Artificial Sequence
  sgRNA
  Olfr1228_7
agaggtctaccatcatctta

SEQ ID NO: 37404 - DNA, 20 bp, Artificial Sequence
  sgRNA
  Olfr1228_8
aatgtggaagaaactaatag

SEQ ID NO: 37405 - DNA, 20 bp, Artificial Sequence
  sgRNA
  Olfr1228_9
tgggagagctcagcagtgca

SEQ ID NO: 37406 - DNA, 20 bp, Artificial Sequence
  sgRNA
  Olfr1228_10
tggtcttcctttcatagaag

SEQ ID NO: 37407 - DNA, 20 bp, Artificial Sequence
  sgRNA
  Olfr1228_11
actactcctccattatgacc

SEQ ID NO: 37408 - DNA, 20 bp, Artificial Sequence
  sgRNA
  Olfr1228_12
attatgaccaggagactctg

SEQ ID NO: 37409 - DNA, 20 bp, Artificial Sequence
  sgRNA
  Olfr1228_13
tggtagacctcttctatgaa

SEQ ID NO: 37410 - DNA, 20 bp, Artificial Sequence
  sgRNA
  Olfr1228_14
gcttgcaaatggccacataa

SEQ ID NO: 37411 - DNA, 20 bp, Artificial Sequence
  sgRNA
  Olfr1228_15
cataatggaggagtagtgaa

SEQ ID NO: 37412 - DNA, 20 bp, Artificial Sequence
  sgRNA
  Olfr1228_16
tgagagctcacagctctgaa

SEQ ID NO: 37413 - DNA, 20 bp, Artificial Sequence
  sgRNA
  Olfr1228_17
tatgatggtggcaaatacaa

SEQ ID NO: 37414 - DNA, 20 bp, Artificial Sequence
  sgRNA
  Olfr1228_18
agaatgccattagaaaaatg

SEQ ID NO: 37415 - DNA, 20 bp, Artificial Sequence
  sgRNA
  Olfr1228_19
gtgatggtatcttggacagg

SEQ ID NO: 37416 - DNA, 20 bp, Artificial Sequence
  sgRNA
  Olfr1228_20
cgtaaagctctctccacatg

SEQ ID NO: 37417 - DNA, 20 bp, Artificial Sequence
  sgRNA
  Olfr1229_1
tagagtaccacagagcctca

SEQ ID NO: 37418 - DNA, 20 bp, Artificial Sequence
  sgRNA
  Olfr1229_2
ggtgactgttgtttctactc

SEQ ID NO: 37419 - DNA, 20 bp, Artificial Sequence
  sgRNA
  Olfr1229_3
gcttgcaaatagcaacatag

SEQ ID NO: 37420 - DNA, 20 bp, Artificial Sequence
  sgRNA
  Olfr1229_4
gtgcaagcaagttccagtaa

SEQ ID NO: 37421 - DNA, 20 bp, Artificial Sequence
  sgRNA
  Olfr1229_5
aggctctgtggtactctagt

SEQ ID NO: 37422 - DNA, 20 bp, Artificial Sequence
  sgRNA
  Olfr1229_6
gtttctactccggcactgct

SEQ ID NO: 37423 - DNA, 20 bp, Artificial Sequence
  sgRNA
  Olfr1229_7
actcttccatcatgaccctg

SEQ ID NO: 37424 - DNA, 20 bp, Artificial Sequence
  sgRNA
  Olfr1229_8
gaggctctgtggtactctag

SEQ ID NO: 37425 - DNA, 20 bp, Artificial Sequence
  sgRNA
  Olfr1229_9
tttgtcaaaggaaaaggcag

SEQ ID NO: 37426 - DNA, 20 bp, Artificial Sequence
  sgRNA
  Olfr1229_10
acagagcctcagggtcatga

SEQ ID NO: 37427 - DNA, 20 bp, Artificial Sequence
  sgRNA
  Olfr1229_11
ttgtcaaaggaaaaggcagt

SEQ ID NO: 37428 - DNA, 20 bp, Artificial Sequence
  sgRNA
  Olfr1229_12
tcaaaggaaaaggcagtggg

SEQ ID NO: 37429 - DNA, 20 bp, Artificial Sequence
  sgRNA
  Olfr1229_13
ccaatagagacaagaaggcc

SEQ ID NO: 37430 - DNA, 20 bp, Artificial Sequence
  sgRNA
  Olfr1229_14
ttggattctgtgaaagtccc

SEQ ID NO: 37431 - DNA, 20 bp, Artificial Sequence
  sgRNA
  Olfr1229_15
gaaggccaggaagaaataca

SEQ ID NO: 37432 - DNA, 20 bp, Artificial Sequence
  sgRNA
  Olfr1229_16
ataaatcataggattaagca

SEQ ID NO: 37433 - DNA, 20 bp, Artificial Sequence
  sgRNA
  Olfr1229_17
taaatcataggattaagcaa

SEQ ID NO: 37434 - DNA, 20 bp, Artificial Sequence
  sgRNA
  Olfr1229_18
ggtgattgtcctgtcagcca

SEQ ID NO: 37435 - DNA, 20 bp, Artificial Sequence
  sgRNA
  Olfr1229_19
cttgcatatgtaaatatgca

SEQ ID NO: 37436 - DNA, 20 bp, Artificial Sequence
  sgRNA
  Olfr1229_20
actttgcagctgcctttctg

SEQ ID NO: 37437 - DNA, 20 bp, Artificial Sequence
  sgRNA
  Olfr1230_1
cagtaggtttcccaaaagtg

SEQ ID NO: 37438 - DNA, 20 bp, Artificial Sequence
  sgRNA
  Olfr1230_2
accatcagccagcatactcg

SEQ ID NO: 37439 - DNA, 20 bp, Artificial Sequence
  sgRNA
  Olfr1230_3
gttgttgcaactagcctgca

SEQ ID NO: 37440 - DNA, 20 bp, Artificial Sequence
  sgRNA
  Olfr1230_4
taacagtgagtccgaatctg

SEQ ID NO: 37441 - DNA, 20 bp, Artificial Sequence
  sgRNA
  Olfr1230_5
gcatactcggggactaacaa

SEQ ID NO: 37442 - DNA, 20 bp, Artificial Sequence
  sgRNA
  Olfr1230_6
gatcatccttctcatcgtga

SEQ ID NO: 37443 - DNA, 20 bp, Artificial Sequence
  sgRNA
  Olfr1230_7
ttacagttacaatgatcagt

SEQ ID NO: 37444 - DNA, 20 bp, Artificial Sequence
  sgRNA
  Olfr1230_8
atgtagctctcacttcacag

SEQ ID NO: 37445 - DNA, 20 bp, Artificial Sequence
  sgRNA
  Olfr1230_9
agagtagatgacatccaaaa

SEQ ID NO: 37446 - DNA, 20 bp, Artificial Sequence
  sgRNA
  Olfr1230_10
tctataggataagtgaccac

SEQ ID NO: 37447 - DNA, 20 bp, Artificial Sequence
  sgRNA
  Olfr1230_11
aggaaactgtggatgaaaag

SEQ ID NO: 37448 - DNA, 20 bp, Artificial Sequence
  sgRNA
  Olfr1230_12
atacataaagagcagctgaa

SEQ ID NO: 37449 - DNA, 20 bp, Artificial Sequence
  sgRNA
  Olfr1230_13
ggaacagaggattactacat

SEQ ID NO: 37450 - DNA, 20 bp, Artificial Sequence
  sgRNA
  Olfr1230_14
ttatcctatagataatgcaa

SEQ ID NO: 37451 - DNA, 20 bp, Artificial Sequence
  sgRNA
  Olfr1230_15
gatagccacatagctgtcat

SEQ ID NO: 37452 - DNA, 20 bp, Artificial Sequence
  sgRNA
  Olfr1230_16
gatcacatgatcaatgacat

SEQ ID NO: 37453 - DNA, 20 bp, Artificial Sequence
  sgRNA
  Olfr1230_17
acaatggtcgtgtagtgtag

SEQ ID NO: 37454 - DNA, 20 bp, Artificial Sequence
  sgRNA
  Olfr1230_18
tgcaggctagttgcaacaac

SEQ ID NO: 37455 - DNA, 20 bp, Artificial Sequence
  sgRNA
  Olfr1230_19
aacatgctctgaggaaactg

SEQ ID NO: 37456 - DNA, 20 bp, Artificial Sequence
  sgRNA
  Olfr1230_20
cataggccatcacgatgaga

SEQ ID NO: 37457 - DNA, 20 bp, Artificial Sequence
  sgRNA
  Olfr1232_1
ccaataaagacagaaaagcc

SEQ ID NO: 37458 - DNA, 20 bp, Artificial Sequence
  sgRNA
  Olfr1232_2
ttgtttacattgcaactatg

SEQ ID NO: 37459 - DNA, 20 bp, Artificial Sequence
  sgRNA
  Olfr1232_3
gatgattcttctgacagcca

SEQ ID NO: 37460 - DNA, 20 bp, Artificial Sequence
  sgRNA
  Olfr1232_4
aaggccaaagatgtgagtgt

SEQ ID NO: 37461 - DNA, 20 bp, Artificial Sequence
  sgRNA
  Olfr1232_5
acaagaccacaacagcaacg

SEQ ID NO: 37462 - DNA, 20 bp, Artificial Sequence
  sgRNA
  Olfr1232_6
agacagcaagataaagccat

SEQ ID NO: 37463 - DNA, 20 bp, Artificial Sequence
  sgRNA
  Olfr1232_7
tgagatcccagagttctgaa

SEQ ID NO: 37464 - DNA, 20 bp, Artificial Sequence
  sgRNA
  Olfr1232_8
tgttgaacacttcttgggtg

SEQ ID NO: 37465 - DNA, 20 bp, Artificial Sequence
  sgRNA
  Olfr1232_9
atgatggaagagtagtgtaa

SEQ ID NO: 37466 - DNA, 20 bp, Artificial Sequence
  sgRNA
  Olfr1232_10
tgggagagcccagcagtgta

SEQ ID NO: 37467 - DNA, 20 bp, Artificial Sequence
  sgRNA
  Olfr1232_11
attgtggaagaaattggtaa

SEQ ID NO: 37468 - DNA, 20 bp, Artificial Sequence
  sgRNA
  Olfr1232_12
tttcttccacaatttcctta

SEQ ID NO: 37469 - DNA, 20 bp, Artificial Sequence
  sgRNA
  Olfr1232_13
gcttacaaatagcaacatag

SEQ ID NO: 37470 - DNA, 20 bp, Artificial Sequence
  sgRNA
  Olfr1232_14
gtaactgaatttgtcttcct

SEQ ID NO: 37471 - DNA, 20 bp, Artificial Sequence
  sgRNA
  Olfr1232_15
gtaaatgataggattaagca

SEQ ID NO: 37472 - DNA, 20 bp, Artificial Sequence
  sgRNA
  Olfr1232_16
ttgcatatataaatatacat

SEQ ID NO: 37473 - DNA, 20 bp, Artificial Sequence
  sgRNA
  Olfr1232_17
tcaaaggagaaagcactgtg

SEQ ID NO: 37474 - DNA, 20 bp, Artificial Sequence
  sgRNA
  Olfr1232_18
tttgttgaacacttcttggg

SEQ ID NO: 37475 - DNA, 20 bp, Artificial Sequence
  sgRNA
  Olfr1232_19
agagagtctaaaatcatctt

SEQ ID NO: 37476 - DNA, 20 bp, Artificial Sequence
  sgRNA
  Olfr1232_20
ttggattctgggaaagtccc

SEQ ID NO: 37477 - DNA, 20 bp, Artificial Sequence
  sgRNA
  Olfr1234_1
ttgagtcatacaagcccgga

SEQ ID NO: 37478 - DNA, 20 bp, Artificial Sequence
  sgRNA
  Olfr1234_2
catacaaagccctataaggt

SEQ ID NO: 37479 - DNA, 20 bp, Artificial Sequence
  sgRNA
  Olfr1234_3
acacactcgtcgattcatga

SEQ ID NO: 37480 - DNA, 20 bp, Artificial Sequence
  sgRNA
  Olfr1234_4
agaagtacataggagagccg

SEQ ID NO: 37481 - DNA, 20 bp, Artificial Sequence
  sgRNA
  Olfr1234_5
gtgatatagcccacttacga

SEQ ID NO: 37482 - DNA, 20 bp, Artificial Sequence
  sgRNA
  Olfr1234_6
gcaccaatacctaccttata

SEQ ID NO: 37483 - DNA, 20 bp, Artificial Sequence
  sgRNA
  Olfr1234_7
aatctagctccatcgtaagt

SEQ ID NO: 37484 - DNA, 20 bp, Artificial Sequence
  sgRNA
  Olfr1234_8
ttaaggcacatagtctggaa

SEQ ID NO: 37485 - DNA, 20 bp, Artificial Sequence
  sgRNA
  Olfr1234_9
acagtcacagacttatcaat

SEQ ID NO: 37486 - DNA, 20 bp, Artificial Sequence
  sgRNA
  Olfr1234_10
tcagaatccagaaggccaaa

SEQ ID NO: 37487 - DNA, 20 bp, Artificial Sequence
  sgRNA
  Olfr1234_11
catacaagcccggaaggaga

SEQ ID NO: 37488 - DNA, 20 bp, Artificial Sequence
  sgRNA
  Olfr1234_12
gaagtacataggagagccga

SEQ ID NO: 37489 - DNA, 20 bp, Artificial Sequence
  sgRNA
  Olfr1234_13
ttaattctcctagtttctta

SEQ ID NO: 37490 - DNA, 20 bp, Artificial Sequence
  sgRNA
  Olfr1234_14
gattctgagtgaggcccaga

SEQ ID NO: 37491 - DNA, 20 bp, Artificial Sequence
  sgRNA
  Olfr1234_15
catgcatctttctatatgca

SEQ ID NO: 37492 - DNA, 20 bp, Artificial Sequence
  sgRNA
  Olfr1234_16
ataatgaagaggtttacaga

SEQ ID NO: 37493 - DNA, 20 bp, Artificial Sequence
  sgRNA
  Olfr1234_17
tttcatttctgcattcctca

SEQ ID NO: 37494 - DNA, 20 bp, Artificial Sequence
  sgRNA
  Olfr1234_18
atgatggtcaaataatgaag

SEQ ID NO: 37495 - DNA, 20 bp, Artificial Sequence
  sgRNA
  Olfr1234_19
atgtgcatcccacattactg

SEQ ID NO: 37496 - DNA, 20 bp, Artificial Sequence
  sgRNA
  Olfr1234_20
atcatggctagccactccct

SEQ ID NO: 37497 - DNA, 20 bp, Artificial Sequence
  sgRNA
  Olfr1240_1
ttacttaattgggctcactg

SEQ ID NO: 37498 - DNA, 20 bp, Artificial Sequence
  sgRNA
  Olfr1240_2
tcactgtctccacaatgagt

SEQ ID NO: 37499 - DNA, 20 bp, Artificial Sequence
  sgRNA
  Olfr1240_3
tatttggaccacaaaaaggg

SEQ ID NO: 37500 - DNA, 20 bp, Artificial Sequence
  sgRNA
  Olfr1240_4
atttccgtttcagcttgcat

SEQ ID NO: 37501 - DNA, 20 bp, Artificial Sequence
  sgRNA
  Olfr1240_5
ttaagtctcatagtgaggaa

SEQ ID NO: 37502 - DNA, 20 bp, Artificial Sequence
  sgRNA
  Olfr1240_6
gatcctgtgtaagacccagc

SEQ ID NO: 37503 - DNA, 20 bp, Artificial Sequence
  sgRNA
  Olfr1240_7
tcaggtttgcattctcctat

SEQ ID NO: 37504 - DNA, 20 bp, Artificial Sequence
  sgRNA
  Olfr1240_8
gtacatgctaagcccagtaa

SEQ ID NO: 37505 - DNA, 20 bp, Artificial Sequence
  sgRNA
  Olfr1240_9
ggtcttacacaggatcctgc

SEQ ID NO: 37506 - DNA, 20 bp, Artificial Sequence
  sgRNA
  Olfr1240_10
cgtaggccatgaagaccaaa

SEQ ID NO: 37507 - DNA, 20 bp, Artificial Sequence
  sgRNA
  Olfr1240_11
tggtggagcaatttgtatga

SEQ ID NO: 37508 - DNA, 20 bp, Artificial Sequence
  sgRNA
  Olfr1240_12
tgtgacatgtacccattact

SEQ ID NO: 37509 - DNA, 20 bp, Artificial Sequence
  sgRNA
  Olfr1240_13
tggtatttggaccacaaaaa

SEQ ID NO: 37510 - DNA, 20 bp, Artificial Sequence
  sgRNA
  Olfr1240_14
gcaaacctgacgattcatga

SEQ ID NO: 37511 - DNA, 20 bp, Artificial Sequence
  sgRNA
  Olfr1240_15
gatagccacatagcgatcgt

SEQ ID NO: 37512 - DNA, 20 bp, Artificial Sequence
  sgRNA
  Olfr1240_16
gtgaccaaaacctccagcac

SEQ ID NO: 37513 - DNA, 20 bp, Artificial Sequence
  sgRNA
  Olfr1240_17
agtctcatagtgaggaaggg

SEQ ID NO: 37514 - DNA, 20 bp, Artificial Sequence
  sgRNA
  Olfr1240_18
gtactgacacttacttaatt

SEQ ID NO: 37515 - DNA, 20 bp, Artificial Sequence
  sgRNA
  Olfr1240_19
tacatgctaagcccagtaat

SEQ ID NO: 37516 - DNA, 20 bp, Artificial Sequence
  sgRNA
  Olfr1240_20
ctgcagctcccacatcatag

SEQ ID NO: 37517 - DNA, 20 bp, Artificial Sequence
  sgRNA
  Olfr1241_1
ccagaagtgacagataggca

SEQ ID NO: 37518 - DNA, 20 bp, Artificial Sequence
  sgRNA
  Olfr1241_2
atttgatcatcatgaatagg

SEQ ID NO: 37519 - DNA, 20 bp, Artificial Sequence
  sgRNA
  Olfr1241_3
taggtaatctactcattgtg

SEQ ID NO: 37520 - DNA, 20 bp, Artificial Sequence
  sgRNA
  Olfr1241_4
ggcctcactcaagatcatgt

SEQ ID NO: 37521 - DNA, 20 bp, Artificial Sequence
  sgRNA
  Olfr1241_5
tcatagccagtccctcctta

SEQ ID NO: 37522 - DNA, 20 bp, Artificial Sequence
  sgRNA
  Olfr1241_6
ggtacatgtcacagataaag

SEQ ID NO: 37523 - DNA, 20 bp, Artificial Sequence
  sgRNA
  Olfr1241_7
cataggccatcaccattaga

SEQ ID NO: 37524 - DNA, 20 bp, Artificial Sequence
  sgRNA
  Olfr1241_8
gttgagctacagagtgtgca

SEQ ID NO: 37525 - DNA, 20 bp, Artificial Sequence
  sgRNA
  Olfr1241_9
cccaggaaaccaccaatagg

SEQ ID NO: 37526 - DNA, 20 bp, Artificial Sequence
  sgRNA
  Olfr1241_10
ggtcttccttctaatggtga

SEQ ID NO: 37527 - DNA, 20 bp, Artificial Sequence
  sgRNA
  Olfr1241_11
tgctatctcacccaagttga

SEQ ID NO: 37528 - DNA, 20 bp, Artificial Sequence
  sgRNA
  Olfr1241_12
agacctcagcaccaccaagt

SEQ ID NO: 37529 - DNA, 20 bp, Artificial Sequence
  sgRNA
  Olfr1241_13
gagcaagtctaccatcaact

SEQ ID NO: 37530 - DNA, 20 bp, Artificial Sequence
  sgRNA
  Olfr1241_14
acatattattggcctcactg

SEQ ID NO: 37531 - DNA, 20 bp, Artificial Sequence
  sgRNA
  Olfr1241_15
gcgggtttgcttcctcctat

SEQ ID NO: 37532 - DNA, 20 bp, Artificial Sequence
  sgRNA
  Olfr1241_16
tacattggagtccctaagga

SEQ ID NO: 37533 - DNA, 20 bp, Artificial Sequence
  sgRNA
  Olfr1241_17
ctaacatacatgaagataca

SEQ ID NO: 37534 - DNA, 20 bp, Artificial Sequence
  sgRNA
  Olfr1241_18
attacatttggaccacaaaa

SEQ ID NO: 37535 - DNA, 20 bp, Artificial Sequence
  sgRNA
  Olfr1241_19
tttgatcatcatgaataggc

SEQ ID NO: 37536 - DNA, 20 bp, Artificial Sequence
  sgRNA
  Olfr1241_20
cagcccaggaaaccaccaat

SEQ ID NO: 37537 - DNA, 20 bp, Artificial Sequence
  sgRNA
  Olfr1242_1
gtgacatgaatcaattactc

SEQ ID NO: 37538 - DNA, 20 bp, Artificial Sequence
  sgRNA
  Olfr1242_2
atttgaccatcatgaaccag

SEQ ID NO: 37539 - DNA, 20 bp, Artificial Sequence
  sgRNA
  Olfr1242_3
atcactgtcatggccaatgg

SEQ ID NO: 37540 - DNA, 20 bp, Artificial Sequence
  sgRNA
  Olfr1242_4
gtacattggggagtttaagg

SEQ ID NO: 37541 - DNA, 20 bp, Artificial Sequence
  sgRNA
  Olfr1242_5
gcacaccctctggttcatga

SEQ ID NO: 37542 - DNA, 20 bp, Artificial Sequence
  sgRNA
  Olfr1242_6
atgtcttccttcccgactgt

SEQ ID NO: 37543 - DNA, 20 bp, Artificial Sequence
  sgRNA
  Olfr1242_7
tttgaccatcatgaaccaga

SEQ ID NO: 37544 - DNA, 20 bp, Artificial Sequence
  sgRNA
  Olfr1242_8
ataagtgctctacaaacagc

SEQ ID NO: 37545 - DNA, 20 bp, Artificial Sequence
  sgRNA
  Olfr1242_9
atagaagaatgcacaccctc

SEQ ID NO: 37546 - DNA, 20 bp, Artificial Sequence
  sgRNA
  Olfr1242_10
ctattgctgatagctggagt

SEQ ID NO: 37547 - DNA, 20 bp, Artificial Sequence
  sgRNA
  Olfr1242_11
tctagcatatataaaactac

SEQ ID NO: 37548 - DNA, 20 bp, Artificial Sequence
  sgRNA
  Olfr1242_12
acagcaatatatttatccac

SEQ ID NO: 37549 - DNA, 20 bp, Artificial Sequence
  sgRNA
  Olfr1242_13
aaaactctattaaaaagctc

SEQ ID NO: 37550 - DNA, 20 bp, Artificial Sequence
  sgRNA
  Olfr1242_14
ctagcatatataaaactaca

SEQ ID NO: 37551 - DNA, 20 bp, Artificial Sequence
  sgRNA
  Olfr1242_15
acctgtctccaactttccag

SEQ ID NO: 37552 - DNA, 20 bp, Artificial Sequence
  sgRNA
  Olfr1242_16
tgtgacatgaatcaattact

SEQ ID NO: 37553 - DNA, 20 bp, Artificial Sequence
  sgRNA
  Olfr1242_17
gtcttagtcaagatcctgct

SEQ ID NO: 37554 - DNA, 20 bp, Artificial Sequence
  sgRNA
  Olfr1242_18
actctcttaagacccacagt

SEQ ID NO: 37555 - DNA, 20 bp, Artificial Sequence
  sgRNA
  Olfr1242_19
atatatcaatggattcagca

SEQ ID NO: 37556 - DNA, 20 bp, Artificial Sequence
  sgRNA
  Olfr1242_20
cttaagacccacagtcggga

SEQ ID NO: 37557 - DNA, 20 bp, Artificial Sequence
  sgRNA
  Olfr1243_1
tgtgatatgaatccattact

SEQ ID NO: 37558 - DNA, 20 bp, Artificial Sequence
  sgRNA
  Olfr1243_2
acccagcattgtcacaatgt

SEQ ID NO: 37559 - DNA, 20 bp, Artificial Sequence
  sgRNA
  Olfr1243_3
atttgaccatcatgaatcag

SEQ ID NO: 37560 - DNA, 20 bp, Artificial Sequence
  sgRNA
  Olfr1243_4
tattgcaataaaaagcatcc

SEQ ID NO: 37561 - DNA, 20 bp, Artificial Sequence
  sgRNA
  Olfr1243_5
gcacacccgctgattcatga

SEQ ID NO: 37562 - DNA, 20 bp, Artificial Sequence
  sgRNA
  Olfr1243_6
ctagcatatataaaaataca

SEQ ID NO: 37563 - DNA, 20 bp, Artificial Sequence
  sgRNA
  Olfr1243_7
ggcatcactgtcattgccaa

SEQ ID NO: 37564 - DNA, 20 bp, Artificial Sequence
  sgRNA
  Olfr1243_8
tttgaccatcatgaatcagc

SEQ ID NO: 37565 - DNA, 20 bp, Artificial Sequence
  sgRNA
  Olfr1243_9
catgatgtgggaactacagg

SEQ ID NO: 37566 - DNA, 20 bp, Artificial Sequence
  sgRNA
  Olfr1243_10
ctctcttaagacccacagcc

SEQ ID NO: 37567 - DNA, 20 bp, Artificial Sequence
  sgRNA
  Olfr1243_11
ctgtagttcccacatcatgg

SEQ ID NO: 37568 - DNA, 20 bp, Artificial Sequence
  sgRNA
  Olfr1243_12
ggcaagaaagaagtacattg

SEQ ID NO: 37569 - DNA, 20 bp, Artificial Sequence
  sgRNA
  Olfr1243_13
accttactcaagatcctgct

SEQ ID NO: 37570 - DNA, 20 bp, Artificial Sequence
  sgRNA
  Olfr1243_14
tcaccgtcactgcaatgagc

SEQ ID NO: 37571 - DNA, 20 bp, Artificial Sequence
  sgRNA
  Olfr1243_15
aaaattctataaaaaagctc

SEQ ID NO: 37572 - DNA, 20 bp, Artificial Sequence
  sgRNA
  Olfr1243_16
tggcaatgacagtgatgcca

SEQ ID NO: 37573 - DNA, 20 bp, Artificial Sequence
  sgRNA
  Olfr1243_17
cttaagacccacagccagga

SEQ ID NO: 37574 - DNA, 20 bp, Artificial Sequence
  sgRNA
  Olfr1243_18
atctcacccaatttgattat

SEQ ID NO: 37575 - DNA, 20 bp, Artificial Sequence
  sgRNA
  Olfr1243_19
acattggggagtttaaggaa

SEQ ID NO: 37576 - DNA, 20 bp, Artificial Sequence
  sgRNA
  Olfr1243_20
tatatcaatggattaagcat

SEQ ID NO: 37577 - DNA, 20 bp, Artificial Sequence
  sgRNA
  Olfr1245_1
caccattagcaataacagtg

SEQ ID NO: 37578 - DNA, 20 bp, Artificial Sequence
  sgRNA
  Olfr1245_2
gcaaacccttcgattcatga

SEQ ID NO: 37579 - DNA, 20 bp, Artificial Sequence
  sgRNA
  Olfr1245_3
gtacattggagaacccaagg

SEQ ID NO: 37580 - DNA, 20 bp, Artificial Sequence
  sgRNA
  Olfr1245_4
actcatctacattgtaacca

SEQ ID NO: 37581 - DNA, 20 bp, Artificial Sequence
  sgRNA
  Olfr1245_5
tgactgtcaccacaataagc

SEQ ID NO: 37582 - DNA, 20 bp, Artificial Sequence
  sgRNA
  Olfr1245_6
ataacattaggaccacaaaa

SEQ ID NO: 37583 - DNA, 20 bp, Artificial Sequence
  sgRNA
  Olfr1245_7
acattggagaacccaaggag

SEQ ID NO: 37584 - DNA, 20 bp, Artificial Sequence
  sgRNA
  Olfr1245_8
ccaagagtgatagagaggca

SEQ ID NO: 37585 - DNA, 20 bp, Artificial Sequence
  sgRNA
  Olfr1245_9
aataaatccacaatcaactt

SEQ ID NO: 37586 - DNA, 20 bp, Artificial Sequence
  sgRNA
  Olfr1245_10
ggtgaagatcacaatacaca

SEQ ID NO: 37587 - DNA, 20 bp, Artificial Sequence
  sgRNA
  Olfr1245_11
ttaagactcatagtcaggaa

SEQ ID NO: 37588 - DNA, 20 bp, Artificial Sequence
  sgRNA
  Olfr1245_12
gtgatcttcaccctcctcct

SEQ ID NO: 37589 - DNA, 20 bp, Artificial Sequence
  sgRNA
  Olfr1245_13
tcaatgggaaagttgtaaac

SEQ ID NO: 37590 - DNA, 20 bp, Artificial Sequence
  sgRNA
  Olfr1245_14
ggatgattccataggagcct

SEQ ID NO: 37591 - DNA, 20 bp, Artificial Sequence
  sgRNA
  Olfr1245_15
tcactttgttgataattgcc

SEQ ID NO: 37592 - DNA, 20 bp, Artificial Sequence
  sgRNA
  Olfr1245_16
aaacttgtatgaaaaagctc

SEQ ID NO: 37593 - DNA, 20 bp, Artificial Sequence
  sgRNA
  Olfr1245_17
catgcaagctgtaaaagaga

SEQ ID NO: 37594 - DNA, 20 bp, Artificial Sequence
  sgRNA
  Olfr1245_18
tttggccatcatgaatcgaa

SEQ ID NO: 37595 - DNA, 20 bp, Artificial Sequence
  sgRNA
  Olfr1245_19
cattaggaccacaaaaagga

SEQ ID NO: 37596 - DNA, 20 bp, Artificial Sequence
  sgRNA
  Olfr1245_20
tacattggagaacccaagga

SEQ ID NO: 37597 - DNA, 20 bp, Artificial Sequence
  sgRNA
  Olfr1246_1
gcacacaagtcccaataatg

SEQ ID NO: 37598 - DNA, 20 bp, Artificial Sequence
  sgRNA
  Olfr1246_2
gataaagactacaatgcaca

SEQ ID NO: 37599 - DNA, 20 bp, Artificial Sequence
  sgRNA
  Olfr1246_3
aagttgaataaacaatgtcc

SEQ ID NO: 37600 - DNA, 20 bp, Artificial Sequence
  sgRNA
  Olfr1246_4
tttgaccatcatgaatcgaa

SEQ ID NO: 37601 - DNA, 20 bp, Artificial Sequence
  sgRNA
  Olfr1246_5
ggtcttaccctcattgccaa

SEQ ID NO: 37602 - DNA, 20 bp, Artificial Sequence
  sgRNA
  Olfr1246_6
gggacatgtcacacataaag

SEQ ID NO: 37603 - DNA, 20 bp, Artificial Sequence
  sgRNA
  Olfr1246_7
cttaccctcattgccaatgg

SEQ ID NO: 37604 - DNA, 20 bp, Artificial Sequence
  sgRNA
  Olfr1246_8
tatttggaccacagaaagga

SEQ ID NO: 37605 - DNA, 20 bp, Artificial Sequence
  sgRNA
  Olfr1246_9
gctcatctacattgtgacaa

SEQ ID NO: 37606 - DNA, 20 bp, Artificial Sequence
  sgRNA
  Olfr1246_10
acattggggagcccaaagag

SEQ ID NO: 37607 - DNA, 20 bp, Artificial Sequence
  sgRNA
  Olfr1246_11
tcaagaattatagtcaggaa

SEQ ID NO: 37608 - DNA, 20 bp, Artificial Sequence
  sgRNA
  Olfr1246_12
gggctcactcaggatcctgc

SEQ ID NO: 37609 - DNA, 20 bp, Artificial Sequence
  sgRNA
  Olfr1246_13
tcactagaaaagttataaac

SEQ ID NO: 37610 - DNA, 20 bp, Artificial Sequence
  sgRNA
  Olfr1246_14
tcaccatcagcacaatgagc

SEQ ID NO: 37611 - DNA, 20 bp, Artificial Sequence
  sgRNA
  Olfr1246_15
ggctccaccattggcaatga

SEQ ID NO: 37612 - DNA, 20 bp, Artificial Sequence
  sgRNA
  Olfr1246_16
gagggtaagaccaatgaagt

SEQ ID NO: 37613 - DNA, 20 bp, Artificial Sequence
  sgRNA
  Olfr1246_17
ctggcatacatgaaaatgca

SEQ ID NO: 37614 - DNA, 20 bp, Artificial Sequence
  sgRNA
  Olfr1246_18
agaattatagtcaggaaggg

SEQ ID NO: 37615 - DNA, 20 bp, Artificial Sequence
  sgRNA
  Olfr1246_19
ccaggaatgaaagacaggca

SEQ ID NO: 37616 - DNA, 20 bp, Artificial Sequence
  sgRNA
  Olfr1246_20
ataatatttggaccacagaa

SEQ ID NO: 37617 - DNA, 20 bp, Artificial Sequence
  sgRNA
  Olfr1247_1
cattattggcaactaccgtg

SEQ ID NO: 37618 - DNA, 20 bp, Artificial Sequence
  sgRNA
  Olfr1247_2
gtacattggggaattcaagg

SEQ ID NO: 37619 - DNA, 20 bp, Artificial Sequence
  sgRNA
  Olfr1247_3
atgtgcaaatcccccaaccc

SEQ ID NO: 37620 - DNA, 20 bp, Artificial Sequence
  sgRNA
  Olfr1247_4
catgtacattgtgactattg

SEQ ID NO: 37621 - DNA, 20 bp, Artificial Sequence
  sgRNA
  Olfr1247_5
cataggccatcaccaccaga

SEQ ID NO: 37622 - DNA, 20 bp, Artificial Sequence
  sgRNA
  Olfr1247_6
ggagcttaagataattccat

SEQ ID NO: 37623 - DNA, 20 bp, Artificial Sequence
  sgRNA
  Olfr1247_7
gcctcactcaggatcctact

SEQ ID NO: 37624 - DNA, 20 bp, Artificial Sequence
  sgRNA
  Olfr1247_8
atgacattaggtccacagaa

SEQ ID NO: 37625 - DNA, 20 bp, Artificial Sequence
  sgRNA
  Olfr1247_9
ctaacatacatgaatataca

SEQ ID NO: 37626 - DNA, 20 bp, Artificial Sequence
  sgRNA
  Olfr1247_10
ttcctgactgtgagtcttaa

SEQ ID NO: 37627 - DNA, 20 bp, Artificial Sequence
  sgRNA
  Olfr1247_11
atgacagttaaatagtgcag

SEQ ID NO: 37628 - DNA, 20 bp, Artificial Sequence
  sgRNA
  Olfr1247_12
cctaatgtcattgatcactt

SEQ ID NO: 37629 - DNA, 20 bp, Artificial Sequence
  sgRNA
  Olfr1247_13
ccatgagtgacagaaaggca

SEQ ID NO: 37630 - DNA, 20 bp, Artificial Sequence
  sgRNA
  Olfr1247_14
acagaaatagatttatcaat

SEQ ID NO: 37631 - DNA, 20 bp, Artificial Sequence
  sgRNA
  Olfr1247_15
gtatataaacttcctttctg

SEQ ID NO: 37632 - DNA, 20 bp, Artificial Sequence
  sgRNA
  Olfr1247_16
tgtccttctgggcctcactc

SEQ ID NO: 37633 - DNA, 20 bp, Artificial Sequence
  sgRNA
  Olfr1247_17
gcccagtaggatcctgagtg

SEQ ID NO: 37634 - DNA, 20 bp, Artificial Sequence
  sgRNA
  Olfr1247_18
gacaaagactaccatacaca

SEQ ID NO: 37635 - DNA, 20 bp, Artificial Sequence
  sgRNA
  Olfr1247_19
actaagtctttaagcaactt

SEQ ID NO: 37636 - DNA, 20 bp, Artificial Sequence
  sgRNA
  Olfr1247_20
tgctgaggtcttccttctgg

SEQ ID NO: 37637 - DNA, 20 bp, Artificial Sequence
  sgRNA
  Olfr1248_1
gtacatgcaagtcctaacaa

SEQ ID NO: 37638 - DNA, 20 bp, Artificial Sequence
  sgRNA
  Olfr1248_2
tctgaccataatgaaacggc

SEQ ID NO: 37639 - DNA, 20 bp, Artificial Sequence
  sgRNA
  Olfr1248_3
ggcaaggaaaaagtacattg

SEQ ID NO: 37640 - DNA, 20 bp, Artificial Sequence
  sgRNA
  Olfr1248_4
atctacattgtgaaaatagt

SEQ ID NO: 37641 - DNA, 20 bp, Artificial Sequence
  sgRNA
  Olfr1248_5
agactgatagtcaggaaggg

SEQ ID NO: 37642 - DNA, 20 bp, Artificial Sequence
  sgRNA
  Olfr1248_6
actatctgaccataatgaaa

SEQ ID NO: 37643 - DNA, 20 bp, Artificial Sequence
  sgRNA
  Olfr1248_7
ttaagactgatagtcaggaa

SEQ ID NO: 37644 - DNA, 20 bp, Artificial Sequence
  sgRNA
  Olfr1248_8
gcaggtttgcattctcttgg

SEQ ID NO: 37645 - DNA, 20 bp, Artificial Sequence
  sgRNA
  Olfr1248_9
ggtatatgtcacaagcaaaa

SEQ ID NO: 37646 - DNA, 20 bp, Artificial Sequence
  sgRNA
  Olfr1248_10
cttaagactgatagtcagga

SEQ ID NO: 37647 - DNA, 20 bp, Artificial Sequence
  sgRNA
  Olfr1248_11
ggtttgcattctcttggtgg

SEQ ID NO: 37648 - DNA, 20 bp, Artificial Sequence
  sgRNA
  Olfr1248_12
tgtgacatatacccattgtt

SEQ ID NO: 37649 - DNA, 20 bp, Artificial Sequence
  sgRNA
  Olfr1248_13
gatggccacatagtgatcat

SEQ ID NO: 37650 - DNA, 20 bp, Artificial Sequence
  sgRNA
  Olfr1248_14
attatggtcagatagtgcag

SEQ ID NO: 37651 - DNA, 20 bp, Artificial Sequence
  sgRNA
  Olfr1248_15
gatggcctatgatcactatg

SEQ ID NO: 37652 - DNA, 20 bp, Artificial Sequence
  sgRNA
  Olfr1248_16
gcaaacctgccgtttcatta

SEQ ID NO: 37653 - DNA, 20 bp, Artificial Sequence
  sgRNA
  Olfr1248_17
tacatgcaagtcctaacaat

SEQ ID NO: 37654 - DNA, 20 bp, Artificial Sequence
  sgRNA
  Olfr1248_18
tgctaactacagtgagtcca

SEQ ID NO: 37655 - DNA, 20 bp, Artificial Sequence
  sgRNA
  Olfr1248_19
ttccataggagacaagaagg

SEQ ID NO: 37656 - DNA, 20 bp, Artificial Sequence
  sgRNA
  Olfr1248_20
ttatggagcaatgtctatag

SEQ ID NO: 37657 - DNA, 20 bp, Artificial Sequence
  sgRNA
  Olfr125_1
agtgagtttgcaatagactg

SEQ ID NO: 37658 - DNA, 20 bp, Artificial Sequence
  sgRNA
  Olfr125_2
acatgggagaatgcagacgt

SEQ ID NO: 37659 - DNA, 20 bp, Artificial Sequence
  sgRNA
  Olfr125_3
tgcagtgatagctgtatgga

SEQ ID NO: 37660 - DNA, 20 bp, Artificial Sequence
  sgRNA
  Olfr125_4
attcattaatgagattgcag

SEQ ID NO: 37661 - DNA, 20 bp, Artificial Sequence
  sgRNA
  Olfr125_5
gcaaactcactcatggacaa

SEQ ID NO: 37662 - DNA, 20 bp, Artificial Sequence
  sgRNA
  Olfr125_6
tattaaacagacaaaggctg

SEQ ID NO: 37663 - DNA, 20 bp, Artificial Sequence
  sgRNA
  Olfr125_7
gctgacagggaatctgaagg

SEQ ID NO: 37664 - DNA, 20 bp, Artificial Sequence
  sgRNA
  Olfr125_8
ttagtccgactatcagctga

SEQ ID NO: 37665 - DNA, 20 bp, Artificial Sequence
  sgRNA
  Olfr125_9
ataattgtctcatactgcag

SEQ ID NO: 37666 - DNA, 20 bp, Artificial Sequence
  sgRNA
  Olfr125_10
gattgcccatgatggccaac

SEQ ID NO: 37667 - DNA, 20 bp, Artificial Sequence
  sgRNA
  Olfr125_11
accggtatgttgccatctgt

SEQ ID NO: 37668 - DNA, 20 bp, Artificial Sequence
  sgRNA
  Olfr125_12
agcagagatccaaaaaagag

SEQ ID NO: 37669 - DNA, 20 bp, Artificial Sequence
  sgRNA
  Olfr125_13
ataattctcttcccacaaag

SEQ ID NO: 37670 - DNA, 20 bp, Artificial Sequence
  sgRNA
  Olfr125_14
attcaaagcctgcagctgag

SEQ ID NO: 37671 - DNA, 20 bp, Artificial Sequence
  sgRNA
  Olfr125_15
gctcatcagagaaccccatg

SEQ ID NO: 37672 - DNA, 20 bp, Artificial Sequence
  sgRNA
  Olfr125_16
ctatctgggctcctacacac

SEQ ID NO: 37673 - DNA, 20 bp, Artificial Sequence
  sgRNA
  Olfr125_17
gcactgaatgtaaaatctga

SEQ ID NO: 37674 - DNA, 20 bp, Artificial Sequence
  sgRNA
  Olfr125_18
agtgtgcagtgatagctgta

SEQ ID NO: 37675 - DNA, 20 bp, Artificial Sequence
  sgRNA
  Olfr125_19
tgcttcaagaagtagtacat

SEQ ID NO: 37676 - DNA, 20 bp, Artificial Sequence
  sgRNA
  Olfr125_20
gccgacagatggcaacatac

SEQ ID NO: 37677 - DNA, 20 bp, Artificial Sequence
  sgRNA
  Olfr1250_1
tttgtggagcacttattcgg

SEQ ID NO: 37678 - DNA, 20 bp, Artificial Sequence
  sgRNA
  Olfr1250_2
gtacatgcaagtcctagcaa

SEQ ID NO: 37679 - DNA, 20 bp, Artificial Sequence
  sgRNA
  Olfr1250_3
tttgaccataatgaatcggc

SEQ ID NO: 37680 - DNA, 20 bp, Artificial Sequence
  sgRNA
  Olfr1250_4
tgggcaacctgctcattgtg

SEQ ID NO: 37681 - DNA, 20 bp, Artificial Sequence
  sgRNA
  Olfr1250_5
gcaggtttgcattctcttgt

SEQ ID NO: 37682 - DNA, 20 bp, Artificial Sequence
  sgRNA
  Olfr1250_6
gcaaaatgatcaatgacatt

SEQ ID NO: 37683 - DNA, 20 bp, Artificial Sequence
  sgRNA
  Olfr1250_7
tgtactgacacctatttcct

SEQ ID NO: 37684 - DNA, 20 bp, Artificial Sequence
  sgRNA
  Olfr1250_8
gagaacaaccaccatgatgt

SEQ ID NO: 37685 - DNA, 20 bp, Artificial Sequence
  sgRNA
  Olfr1250_9
gcacttattcggtggttctg

SEQ ID NO: 37686 - DNA, 20 bp, Artificial Sequence
  sgRNA
  Olfr1250_10
ggtttgcattctcttgttgg

SEQ ID NO: 37687 - DNA, 20 bp, Artificial Sequence
  sgRNA
  Olfr1250_11
agagaacaaccaccatgatg

SEQ ID NO: 37688 - DNA, 20 bp, Artificial Sequence
  sgRNA
  Olfr1250_12
agcaaaatgatcaatgacat

SEQ ID NO: 37689 - DNA, 20 bp, Artificial Sequence
  sgRNA
  Olfr1250_13
tacagtgagtccaaggaaat

SEQ ID NO: 37690 - DNA, 20 bp, Artificial Sequence
  sgRNA
  Olfr1250_14
ttgttggtggtgtcctgggc

SEQ ID NO: 37691 - DNA, 20 bp, Artificial Sequence
  sgRNA
  Olfr1250_15
tctcttgttggtggtgtcct

SEQ ID NO: 37692 - DNA, 20 bp, Artificial Sequence
  sgRNA
  Olfr1250_16
ttctcttgttggtggtgtcc

SEQ ID NO: 37693 - DNA, 20 bp, Artificial Sequence
  sgRNA
  Olfr1251_1
tacatgcaagtagcaatagt

SEQ ID NO: 37694 - DNA, 20 bp, Artificial Sequence
  sgRNA
  Olfr1251_2
cccaggccatcaccaagaag

SEQ ID NO: 37695 - DNA, 20 bp, Artificial Sequence
  sgRNA
  Olfr1251_3
gatgtacattgcaacaatgg

SEQ ID NO: 37696 - DNA, 20 bp, Artificial Sequence
  sgRNA
  Olfr1251_4
gtatataatcttccattctg

SEQ ID NO: 37697 - DNA, 20 bp, Artificial Sequence
  sgRNA
  Olfr1251_5
ctgtggttcccatatcactg

SEQ ID NO: 37698 - DNA, 20 bp, Artificial Sequence
  sgRNA
  Olfr1251_6
agtgatatgggaaccacagg

SEQ ID NO: 37699 - DNA, 20 bp, Artificial Sequence
  sgRNA
  Olfr1251_7
gtacatgcaagtagcaatag

SEQ ID NO: 37700 - DNA, 20 bp, Artificial Sequence
  sgRNA
  Olfr1251_8
gaagaaagacgtattctaca

SEQ ID NO: 37701 - DNA, 20 bp, Artificial Sequence
  sgRNA
  Olfr1251_9
ttcagaaatgaaaatttcca

SEQ ID NO: 37702 - DNA, 20 bp, Artificial Sequence
  sgRNA
  Olfr1251_10
agatctaaggattattccat

SEQ ID NO: 37703 - DNA, 20 bp, Artificial Sequence
  sgRNA
  Olfr1251_11
ttattccataggagagtagg

SEQ ID NO: 37704 - DNA, 20 bp, Artificial Sequence
  sgRNA
  Olfr1251_12
attctcctcctactctccta

SEQ ID NO: 37705 - DNA, 20 bp, Artificial Sequence
  sgRNA
  Olfr1251_13
tgtactgatacctatttcat

SEQ ID NO: 37706 - DNA, 20 bp, Artificial Sequence
  sgRNA
  Olfr1251_14
tcactgttcctacgatgagc

SEQ ID NO: 37707 - DNA, 20 bp, Artificial Sequence
  sgRNA
  Olfr1251_15
attcaacatgggagtgacaa

SEQ ID NO: 37708 - DNA, 20 bp, Artificial Sequence
  sgRNA
  Olfr1251_16
tttcatttctgaatttctca

SEQ ID NO: 37709 - DNA, 20 bp, Artificial Sequence
  sgRNA
  Olfr1251_17
atctctcaagaatcacagtc

SEQ ID NO: 37710 - DNA, 20 bp, Artificial Sequence
  sgRNA
  Olfr1251_18
atgtatcctcttcttggtga

SEQ ID NO: 37711 - DNA, 20 bp, Artificial Sequence
  sgRNA
  Olfr1251_19
ggattattccataggagagt

SEQ ID NO: 37712 - DNA, 20 bp, Artificial Sequence
  sgRNA
  Olfr1251_20
gacagaaagaccaatgaaat

SEQ ID NO: 37713 - DNA, 20 bp, Artificial Sequence
  sgRNA
  Olfr1252_1
ggtacatgtcacatccaaag

SEQ ID NO: 37714 - DNA, 20 bp, Artificial Sequence
  sgRNA
  Olfr1252_2
gtacattggggatcccaagg

SEQ ID NO: 37715 - DNA, 20 bp, Artificial Sequence
  sgRNA
  Olfr1252_3
tacagtgagtccaaggaagt

SEQ ID NO: 37716 - DNA, 20 bp, Artificial Sequence
  sgRNA
  Olfr1252_4
ggtttgcattctcttattgg

SEQ ID NO: 37717 - DNA, 20 bp, Artificial Sequence
  sgRNA
  Olfr1252_5
gatcctgagtgagaccaagg

SEQ ID NO: 37718 - DNA, 20 bp, Artificial Sequence
  sgRNA
  Olfr1252_6
gcaggtttgcattctcttat

SEQ ID NO: 37719 - DNA, 20 bp, Artificial Sequence
  sgRNA
  Olfr1252_7
aaatttgtatggcaaagctg

SEQ ID NO: 37720 - DNA, 20 bp, Artificial Sequence
  sgRNA
  Olfr1252_8
tatcctccttggtctcactc

SEQ ID NO: 37721 - DNA, 20 bp, Artificial Sequence
  sgRNA
  Olfr1252_9
ttccataagagacaaggagg

SEQ ID NO: 37722 - DNA, 20 bp, Artificial Sequence
  sgRNA
  Olfr1252_10
caggatcctgagtgagacca

SEQ ID NO: 37723 - DNA, 20 bp, Artificial Sequence
  sgRNA
  Olfr1252_11
tccaaagtggtcaatgacat

SEQ ID NO: 37724 - DNA, 20 bp, Artificial Sequence
  sgRNA
  Olfr1252_12
acattggggatcccaaggag

SEQ ID NO: 37725 - DNA, 20 bp, Artificial Sequence
  sgRNA
  Olfr1252_13
gtcctcctccttgtctctta

SEQ ID NO: 37726 - DNA, 20 bp, Artificial Sequence
  sgRNA
  Olfr1252_14
taattccataagagacaagg

SEQ ID NO: 37727 - DNA, 20 bp, Artificial Sequence
  sgRNA
  Olfr1252_15
aaataattccataagagaca

SEQ ID NO: 37728 - DNA, 20 bp, Artificial Sequence
  sgRNA
  Olfr1252_16
gtgggagctgcaggtagaca

SEQ ID NO: 37729 - DNA, 20 bp, Artificial Sequence
  sgRNA
  Olfr1252_17
cccaatgtcattgaccactt

SEQ ID NO: 37730 - DNA, 20 bp, Artificial Sequence
  sgRNA
  Olfr1252_18
ttattggtggtgtcctgggc

SEQ ID NO: 37731 - DNA, 20 bp, Artificial Sequence
  sgRNA
  Olfr1252_19
tgtgggagctgcaggtagac

SEQ ID NO: 37732 - DNA, 20 bp, Artificial Sequence
  sgRNA
  Olfr1252_20
catggagattaaaatttgta

SEQ ID NO: 37733 - DNA, 20 bp, Artificial Sequence
  sgRNA
  Olfr1253_1
gatgaagatgacaatacaca

SEQ ID NO: 37734 - DNA, 20 bp, Artificial Sequence
  sgRNA
  Olfr1253_2
ggttgatattgtcattctcg

SEQ ID NO: 37735 - DNA, 20 bp, Artificial Sequence
  sgRNA
  Olfr1253_3
atgtacaaaacctcccaccc

SEQ ID NO: 37736 - DNA, 20 bp, Artificial Sequence
  sgRNA
  Olfr1253_4
tatgcaagctctgaaggaga

SEQ ID NO: 37737 - DNA, 20 bp, Artificial Sequence
  sgRNA
  Olfr1253_5
ctgcatttcccatatcactg

SEQ ID NO: 37738 - DNA, 20 bp, Artificial Sequence
  sgRNA
  Olfr1253_6
tccagaatcacagtaaggaa

SEQ ID NO: 37739 - DNA, 20 bp, Artificial Sequence
  sgRNA
  Olfr1253_7
ggattattgcataagaaagt

SEQ ID NO: 37740 - DNA, 20 bp, Artificial Sequence
  sgRNA
  Olfr1253_8
agaatcacagtaaggaaggg

SEQ ID NO: 37741 - DNA, 20 bp, Artificial Sequence
  sgRNA
  Olfr1253_9
atgataatcaaataatgcag

SEQ ID NO: 37742 - DNA, 20 bp, Artificial Sequence
  sgRNA
  Olfr1253_10
atatattaaaggattcagca

SEQ ID NO: 37743 - DNA, 20 bp, Artificial Sequence
  sgRNA
  Olfr1253_11
tttgattatcatgaatcgac

SEQ ID NO: 37744 - DNA, 20 bp, Artificial Sequence
  sgRNA
  Olfr1253_12
atctctccagaatcacagta

SEQ ID NO: 37745 - DNA, 20 bp, Artificial Sequence
  sgRNA
  Olfr1253_13
gtatataatcttcctttctg

SEQ ID NO: 37746 - DNA, 20 bp, Artificial Sequence
  sgRNA
  Olfr1253_14
ggcctcactatcattgctaa

SEQ ID NO: 37747 - DNA, 20 bp, Artificial Sequence
  sgRNA
  Olfr1253_15
agtgatatgggaaatgcagg

SEQ ID NO: 37748 - DNA, 20 bp, Artificial Sequence
  sgRNA
  Olfr1253_16
atgatattgggaccgcagaa

SEQ ID NO: 37749 - DNA, 20 bp, Artificial Sequence
  sgRNA
  Olfr1253_17
tgtgattctggagagatctt

SEQ ID NO: 37750 - DNA, 20 bp, Artificial Sequence
  sgRNA
  Olfr1253_18
tacatgcaagtagtaataat

SEQ ID NO: 37751 - DNA, 20 bp, Artificial Sequence
  sgRNA
  Olfr1253_19
tattgtcattctcgtggcaa

SEQ ID NO: 37752 - DNA, 20 bp, Artificial Sequence
  sgRNA
  Olfr1253_20
attcagcatgggagtgacaa

SEQ ID NO: 37753 - DNA, 20 bp, Artificial Sequence
  sgRNA
  Olfr1254_1
caataatggatacatatcac

SEQ ID NO: 37754 - DNA, 20 bp, Artificial Sequence
  sgRNA
  Olfr1254_2
aataatcaaattgcctgcca

SEQ ID NO: 37755 - DNA, 20 bp, Artificial Sequence
  sgRNA
  Olfr1254_3
gcaaacccggtgattcatga

SEQ ID NO: 37756 - DNA, 20 bp, Artificial Sequence
  sgRNA
  Olfr1254_4
aacaaagagaacttgagcca

SEQ ID NO: 37757 - DNA, 20 bp, Artificial Sequence
  sgRNA
  Olfr1254_5
tggcaatgacagtaagacca

SEQ ID NO: 37758 - DNA, 20 bp, Artificial Sequence
  sgRNA
  Olfr1254_6
tcaccaggagaatgcaaacc

SEQ ID NO: 37759 - DNA, 20 bp, Artificial Sequence
  sgRNA
  Olfr1254_7
tgatggcaacctgggttgga

SEQ ID NO: 37760 - DNA, 20 bp, Artificial Sequence
  sgRNA
  Olfr1254_8
ggtctcactcaggatcctgt

SEQ ID NO: 37761 - DNA, 20 bp, Artificial Sequence
  sgRNA
  Olfr1254_9
tctcctggtgatggcaacct

SEQ ID NO: 37762 - DNA, 20 bp, Artificial Sequence
  sgRNA
  Olfr1254_10
cgatggagcaatctgtatgg

SEQ ID NO: 37763 - DNA, 20 bp, Artificial Sequence
  sgRNA
  Olfr1254_11
ccatgagtgacagataggca

SEQ ID NO: 37764 - DNA, 20 bp, Artificial Sequence
  sgRNA
  Olfr1254_12
gtttagaatgattccatagg

SEQ ID NO: 37765 - DNA, 20 bp, Artificial Sequence
  sgRNA
  Olfr1254_13
cataagccattgctaccaga

SEQ ID NO: 37766 - DNA, 20 bp, Artificial Sequence
  sgRNA
  Olfr1254_14
gatcttccttctggtagcaa

SEQ ID NO: 37767 - DNA, 20 bp, Artificial Sequence
  sgRNA
  Olfr1254_15
actcatgtacattgtgacca

SEQ ID NO: 37768 - DNA, 20 bp, Artificial Sequence
  sgRNA
  Olfr1254_16
gagcacacaagcaccaataa

SEQ ID NO: 37769 - DNA, 20 bp, Artificial Sequence
  sgRNA
  Olfr1254_17
atagtaactgatttatcaac

SEQ ID NO: 37770 - DNA, 20 bp, Artificial Sequence
  sgRNA
  Olfr1254_18
tattctactgggtctcactc

SEQ ID NO: 37771 - DNA, 20 bp, Artificial Sequence
  sgRNA
  Olfr1254_19
gtgagaactgcaagtggaca

SEQ ID NO: 37772 - DNA, 20 bp, Artificial Sequence
  sgRNA
  Olfr1254_20
tgcaactgagatcttccttc

SEQ ID NO: 37773 - DNA, 20 bp, Artificial Sequence
  sgRNA
  Olfr1255_1
tgacagtgaccacaatgagc

SEQ ID NO: 37774 - DNA, 20 bp, Artificial Sequence
  sgRNA
  Olfr1255_2
aaattgtatctatcaaggag

SEQ ID NO: 37775 - DNA, 20 bp, Artificial Sequence
  sgRNA
  Olfr1255_3
gcatagcttgtggctcatga

SEQ ID NO: 37776 - DNA, 20 bp, Artificial Sequence
  sgRNA
  Olfr1255_4
aaaggatctgaatagttgca

SEQ ID NO: 37777 - DNA, 20 bp, Artificial Sequence
  sgRNA
  Olfr1255_5
ctacaccctcagaaattctg

SEQ ID NO: 37778 - DNA, 20 bp, Artificial Sequence
  sgRNA
  Olfr1255_6
cataagccatcactgtcaac

SEQ ID NO: 37779 - DNA, 20 bp, Artificial Sequence
  sgRNA
  Olfr1255_7
agattaaaggattcagtaga

SEQ ID NO: 37780 - DNA, 20 bp, Artificial Sequence
  sgRNA
  Olfr1255_8
agaactatagcttagaaggc

SEQ ID NO: 37781 - DNA, 20 bp, Artificial Sequence
  sgRNA
  Olfr1255_9
tgcaaacaagttccaacaat

SEQ ID NO: 37782 - DNA, 20 bp, Artificial Sequence
  sgRNA
  Olfr1255_10
tgtgatgtgtgacacacagg

SEQ ID NO: 37783 - DNA, 20 bp, Artificial Sequence
  sgRNA
  Olfr1255_11
ggtacaagtcacacataaaa

SEQ ID NO: 37784 - DNA, 20 bp, Artificial Sequence
  sgRNA
  Olfr1255_12
tctttgttgctgccaacagt

SEQ ID NO: 37785 - DNA, 20 bp, Artificial Sequence
  sgRNA
  Olfr1255_13
actgcaacagctttatcaat

SEQ ID NO: 37786 - DNA, 20 bp, Artificial Sequence
  sgRNA
  Olfr1255_14
gtgactgagttcatcttgat

SEQ ID NO: 37787 - DNA, 20 bp, Artificial Sequence
  sgRNA
  Olfr1255_15
ggtcactgtcatcaacagcc

SEQ ID NO: 37788 - DNA, 20 bp, Artificial Sequence
  sgRNA
  Olfr1255_16
gatcatcctgttgacagtga

SEQ ID NO: 37789 - DNA, 20 bp, Artificial Sequence
  sgRNA
  Olfr1255_17
ttcaggcaacctgctcattg

SEQ ID NO: 37790 - DNA, 20 bp, Artificial Sequence
  sgRNA
  Olfr1255_18
tagattaaaggattcagtag

SEQ ID NO: 37791 - DNA, 20 bp, Artificial Sequence
  sgRNA
  Olfr1255_19
tcaattggcagagtggtcac

SEQ ID NO: 37792 - DNA, 20 bp, Artificial Sequence
  sgRNA
  Olfr1255_20
ctgtacatgataacaatttc

SEQ ID NO: 37793 - DNA, 20 bp, Artificial Sequence
  sgRNA
  Olfr1256_1
tcccaccatagtcaaaacat

SEQ ID NO: 37794 - DNA, 20 bp, Artificial Sequence
  sgRNA
  Olfr1256_2
ctgttgatattatcttggat

SEQ ID NO: 37795 - DNA, 20 bp, Artificial Sequence
  sgRNA
  Olfr1256_3
ggcctcttagtgatggccaa

SEQ ID NO: 37796 - DNA, 20 bp, Artificial Sequence
  sgRNA
  Olfr1256_4
gtaactaccagtaacagcct

SEQ ID NO: 37797 - DNA, 20 bp, Artificial Sequence
  sgRNA
  Olfr1256_5
gcacctttggattctctgag

SEQ ID NO: 37798 - DNA, 20 bp, Artificial Sequence
  sgRNA
  Olfr1256_6
cgtgcatacatgaaaataca

SEQ ID NO: 37799 - DNA, 20 bp, Artificial Sequence
  sgRNA
  Olfr1256_7
agaaatacattggtgagccc

SEQ ID NO: 37800 - DNA, 20 bp, Artificial Sequence
  sgRNA
  Olfr1256_8
gggcctctcagagaatccaa

SEQ ID NO: 37801 - DNA, 20 bp, Artificial Sequence
  sgRNA
  Olfr1256_9
ctaaagaaccttaatcagga

SEQ ID NO: 37802 - DNA, 20 bp, Artificial Sequence
  sgRNA
  Olfr1256_10
ctagcaagaaagaaatacat

SEQ ID NO: 37803 - DNA, 20 bp, Artificial Sequence
  sgRNA
  Olfr1256_11
agaaccttaatcaggaaggg

SEQ ID NO: 37804 - DNA, 20 bp, Artificial Sequence
  sgRNA
  Olfr1256_12
atacaaacaagtttcagtaa

SEQ ID NO: 37805 - DNA, 20 bp, Artificial Sequence
  sgRNA
  Olfr1256_13
atgatagttgaatagtgcaa

SEQ ID NO: 37806 - DNA, 20 bp, Artificial Sequence
  sgRNA
  Olfr1256_14
taaagaaccttaatcaggaa

SEQ ID NO: 37807 - DNA, 20 bp, Artificial Sequence
  sgRNA
  Olfr1256_15
caaatgctatgaagaagctg

SEQ ID NO: 37808 - DNA, 20 bp, Artificial Sequence
  sgRNA
  Olfr1256_16
gaggcccaagaggacaaagt

SEQ ID NO: 37809 - DNA, 20 bp, Artificial Sequence
  sgRNA
  Olfr1256_17
atagtgcaagggcttacaga

SEQ ID NO: 37810 - DNA, 20 bp, Artificial Sequence
  sgRNA
  Olfr1256_18
tcttagtgatggccaatgga

SEQ ID NO: 37811 - DNA, 20 bp, Artificial Sequence
  sgRNA
  Olfr1256_19
attcaactatcatgaagcaa

SEQ ID NO: 37812 - DNA, 20 bp, Artificial Sequence
  sgRNA
  Olfr1256_20
atttatggacttccattctg

SEQ ID NO: 37813 - DNA, 20 bp, Artificial Sequence
  sgRNA
  Olfr1257_1
aatgaacaggatctgtatgg

SEQ ID NO: 37814 - DNA, 20 bp, Artificial Sequence
  sgRNA
  Olfr1257_2
cagtttaggggtgctaacag

SEQ ID NO: 37815 - DNA, 20 bp, Artificial Sequence
  sgRNA
  Olfr1257_3
gattccaagagtgtgagtat

SEQ ID NO: 37816 - DNA, 20 bp, Artificial Sequence
  sgRNA
  Olfr1257_4
catgcatccattaaatggga

SEQ ID NO: 37817 - DNA, 20 bp, Artificial Sequence
  sgRNA
  Olfr1257_5
gagtcatgcatccattaaat

SEQ ID NO: 37818 - DNA, 20 bp, Artificial Sequence
  sgRNA
  Olfr1257_6
catgatcgttgcataatgaa

SEQ ID NO: 37819 - DNA, 20 bp, Artificial Sequence
  sgRNA
  Olfr1257_7
agactatgtagcctgctagt

SEQ ID NO: 37820 - DNA, 20 bp, Artificial Sequence
  sgRNA
  Olfr1257_8
agtgctacccaatttcttaa

SEQ ID NO: 37821 - DNA, 20 bp, Artificial Sequence
  sgRNA
  Olfr1257_9
ctgtatttcacacataacag

SEQ ID NO: 37822 - DNA, 20 bp, Artificial Sequence
  sgRNA
  Olfr1257_10
cataggccattactgtcagc

SEQ ID NO: 37823 - DNA, 20 bp, Artificial Sequence
  sgRNA
  Olfr1257_11
tgtggttctttagggagcgc

SEQ ID NO: 37824 - DNA, 20 bp, Artificial Sequence
  sgRNA
  Olfr1257_12
gtgcatacaaggttgagcaa

SEQ ID NO: 37825 - DNA, 20 bp, Artificial Sequence
  sgRNA
  Olfr1257_13
ggttctctgtgagtcccaga

SEQ ID NO: 37826 - DNA, 20 bp, Artificial Sequence
  sgRNA
  Olfr1257_14
ctaaagaaccacagtgcaga

SEQ ID NO: 37827 - DNA, 20 bp, Artificial Sequence
  sgRNA
  Olfr1257_15
ataagccaggaaaaagtaca

SEQ ID NO: 37828 - DNA, 20 bp, Artificial Sequence
  sgRNA
  Olfr1257_16
cctaaagaaccacagtgcag

SEQ ID NO: 37829 - DNA, 20 bp, Artificial Sequence
  sgRNA
  Olfr1257_17
cataggagaccaatagaaga

SEQ ID NO: 37830 - DNA, 20 bp, Artificial Sequence
  sgRNA
  Olfr1257_18
gccatgacactcccactagc

SEQ ID NO: 37831 - DNA, 20 bp, Artificial Sequence
  sgRNA
  Olfr1257_19
ggagcgcaggatggcaacat

SEQ ID NO: 37832 - DNA, 20 bp, Artificial Sequence
  sgRNA
  Olfr1257_20
tgaatctgctatcagtttag

SEQ ID NO: 37833 - DNA, 20 bp, Artificial Sequence
  sgRNA
  Olfr1258_1
tgtgggtatcagtgcatgca

SEQ ID NO: 37834 - DNA, 20 bp, Artificial Sequence
  sgRNA
  Olfr1258_2
attcaatggatgcatgaccc

SEQ ID NO: 37835 - DNA, 20 bp, Artificial Sequence
  sgRNA
  Olfr1258_3
atcactgccagtccatcgct

SEQ ID NO: 37836 - DNA, 20 bp, Artificial Sequence
  sgRNA
  Olfr1258_4
cccataccactcctaccagc

SEQ ID NO: 37837 - DNA, 20 bp, Artificial Sequence
  sgRNA
  Olfr1258_5
cgtcatctacatcatctcca

SEQ ID NO: 37838 - DNA, 20 bp, Artificial Sequence
  sgRNA
  Olfr1258_6
cataggccatcacagtaagc

SEQ ID NO: 37839 - DNA, 20 bp, Artificial Sequence
  sgRNA
  Olfr1258_7
gcactgatacccacattctg

SEQ ID NO: 37840 - DNA, 20 bp, Artificial Sequence
  sgRNA
  Olfr1258_8
ttaagaaaccacagtgcaga

SEQ ID NO: 37841 - DNA, 20 bp, Artificial Sequence
  sgRNA
  Olfr1258_9
gaaatgctccccaaagacct

SEQ ID NO: 37842 - DNA, 20 bp, Artificial Sequence
  sgRNA
  Olfr1258_10
ccatctacacaatttcttaa

SEQ ID NO: 37843 - DNA, 20 bp, Artificial Sequence
  sgRNA
  Olfr1258_11
cataggagaccaacagaagg

SEQ ID NO: 37844 - DNA, 20 bp, Artificial Sequence
  sgRNA
  Olfr1258_12
gtgcatgcaaggttaagcaa

SEQ ID NO: 37845 - DNA, 20 bp, Artificial Sequence
  sgRNA
  Olfr1258_13
gcttgcagattgccacatag

SEQ ID NO: 37846 - DNA, 20 bp, Artificial Sequence
  sgRNA
  Olfr1258_14
tgttatgtgggagacacaag

SEQ ID NO: 37847 - DNA, 20 bp, Artificial Sequence
  sgRNA
  Olfr1258_15
gtaggagtggtatgggtcgg

SEQ ID NO: 37848 - DNA, 20 bp, Artificial Sequence
  sgRNA
  Olfr1258_16
taagaaaccacagtgcagag

SEQ ID NO: 37849 - DNA, 20 bp, Artificial Sequence
  sgRNA
  Olfr1258_17
tacaaccatcatgagcagaa

SEQ ID NO: 37850 - DNA, 20 bp, Artificial Sequence
  sgRNA
  Olfr1258_18
acatacccttctgctcatga

SEQ ID NO: 37851 - DNA, 20 bp, Artificial Sequence
  sgRNA
  Olfr1258_19
cgctaagaaaaagtacatag

SEQ ID NO: 37852 - DNA, 20 bp, Artificial Sequence
  sgRNA
  Olfr1258_20
tgaacgtagaatgaccacat

SEQ ID NO: 37853 - DNA, 20 bp, Artificial Sequence
  sgRNA
  Olfr1259_1
tggcagccacaaagagacca

SEQ ID NO: 37854 - DNA, 20 bp, Artificial Sequence
  sgRNA
  Olfr1259_2
tgatagtgaccacaatgagg

SEQ ID NO: 37855 - DNA, 20 bp, Artificial Sequence
  sgRNA
  Olfr1259_3
gatcatcctattgacagtga

SEQ ID NO: 37856 - DNA, 20 bp, Artificial Sequence
  sgRNA
  Olfr1259_4
ttgtatctatcaaggagagg

SEQ ID NO: 37857 - DNA, 20 bp, Artificial Sequence
  sgRNA
  Olfr1259_5
ctgtgtgtctcatatcacag

SEQ ID NO: 37858 - DNA, 20 bp, Artificial Sequence
  sgRNA
  Olfr1259_6
tgtgatatgagacacacagg

SEQ ID NO: 37859 - DNA, 20 bp, Artificial Sequence
  sgRNA
  Olfr1259_7
tgatgatagtgaccacaatg

SEQ ID NO: 37860 - DNA, 20 bp, Artificial Sequence
  sgRNA
  Olfr1259_8
acagcaacacctttatcaag

SEQ ID NO: 37861 - DNA, 20 bp, Artificial Sequence
  sgRNA
  Olfr1259_9
cataggccatcactgtcaat

SEQ ID NO: 37862 - DNA, 20 bp, Artificial Sequence
  sgRNA
  Olfr1259_10
ggtcactatcatcaacagcc

SEQ ID NO: 37863 - DNA, 20 bp, Artificial Sequence
  sgRNA
  Olfr1259_11
gatacaagtcacacataaaa

SEQ ID NO: 37864 - DNA, 20 bp, Artificial Sequence
  sgRNA
  Olfr1259_12
tcaagtggcaaagtggtcac

SEQ ID NO: 37865 - DNA, 20 bp, Artificial Sequence
  sgRNA
  Olfr1259_13
tatgagacacacaggtggag

SEQ ID NO: 37866 - DNA, 20 bp, Artificial Sequence
  sgRNA
  Olfr1259_14
cactgtgatatgagacacac

SEQ ID NO: 37867 - DNA, 20 bp, Artificial Sequence
  sgRNA
  Olfr1259_15
acacatccttggtctctttg

SEQ ID NO: 37868 - DNA, 20 bp, Artificial Sequence
  sgRNA
  Olfr1259_16
tctttgtggctgccaacagt

SEQ ID NO: 37869 - DNA, 20 bp, Artificial Sequence
  sgRNA
  Olfr1259_17
accactttgccacttgataa

SEQ ID NO: 37870 - DNA, 20 bp, Artificial Sequence
  sgRNA
  Olfr1259_18
ttcaggcaacctcctcattg

SEQ ID NO: 37871 - DNA, 20 bp, Artificial Sequence
  sgRNA
  Olfr1259_19
atgagacacacaggtggaga

SEQ ID NO: 37872 - DNA, 20 bp, Artificial Sequence
  sgRNA
  Olfr1259_20
tttaaagaactatagcttag

SEQ ID NO: 37873 - DNA, 20 bp, Artificial Sequence
  sgRNA
  Olfr1260_1
agagcagcagccatctacga

SEQ ID NO: 37874 - DNA, 20 bp, Artificial Sequence
  sgRNA
  Olfr1260_2
catacacattagcccgctgt

SEQ ID NO: 37875 - DNA, 20 bp, Artificial Sequence
  sgRNA
  Olfr1260_3
acaatgaacaggagagtatg

SEQ ID NO: 37876 - DNA, 20 bp, Artificial Sequence
  sgRNA
  Olfr1260_4
gcaagagtttctgcacatct

SEQ ID NO: 37877 - DNA, 20 bp, Artificial Sequence
  sgRNA
  Olfr1260_5
ctaaggtaaacgaatatgca

SEQ ID NO: 37878 - DNA, 20 bp, Artificial Sequence
  sgRNA
  Olfr1260_6
tgactgttacaataatgagc

SEQ ID NO: 37879 - DNA, 20 bp, Artificial Sequence
  sgRNA
  Olfr1260_7
gcaaaagatgagtacataag

SEQ ID NO: 37880 - DNA, 20 bp, Artificial Sequence
  sgRNA
  Olfr1260_8
gtagtgtagtggcttacaga

SEQ ID NO: 37881 - DNA, 20 bp, Artificial Sequence
  sgRNA
  Olfr1260_9
ggttctgtgtcagcccaagc

SEQ ID NO: 37882 - DNA, 20 bp, Artificial Sequence
  sgRNA
  Olfr1260_10
gatcatcctgctcacagcga

SEQ ID NO: 37883 - DNA, 20 bp, Artificial Sequence
  sgRNA
  Olfr1260_11
ataagaggaccactgtaata

SEQ ID NO: 37884 - DNA, 20 bp, Artificial Sequence
  sgRNA
  Olfr1260_12
tctttgttgctgccaacagc

SEQ ID NO: 37885 - DNA, 20 bp, Artificial Sequence
  sgRNA
  Olfr1260_13
ctgtgcctcccatattacag

SEQ ID NO: 37886 - DNA, 20 bp, Artificial Sequence
  sgRNA
  Olfr1260_14
acagccacagctttgtcaaa

SEQ ID NO: 37887 - DNA, 20 bp, Artificial Sequence
  sgRNA
  Olfr1260_15
aaatcccccagcccaggccg

SEQ ID NO: 37888 - DNA, 20 bp, Artificial Sequence
  sgRNA
  Olfr1260_16
cttcccctttgacaaagctg

SEQ ID NO: 37889 - DNA, 20 bp, Artificial Sequence
  sgRNA
  Olfr1260_17
attcgtttaccttaggccca

SEQ ID NO: 37890 - DNA, 20 bp, Artificial Sequence
  sgRNA
  Olfr1260_18
gaggaccactgtaatatggg

SEQ ID NO: 37891 - DNA, 20 bp, Artificial Sequence
  sgRNA
  Olfr1260_19
tggctgctgctcttccacca

SEQ ID NO: 37892 - DNA, 20 bp, Artificial Sequence
  sgRNA
  Olfr1260_20
tgcagggtacaaagaataag

SEQ ID NO: 37893 - DNA, 20 bp, Artificial Sequence
  sgRNA
  Olfr1261_1
tcttaggattcatccatgga

SEQ ID NO: 37894 - DNA, 20 bp, Artificial Sequence
  sgRNA
  Olfr1261_2
acacagaggtcggttcatga

SEQ ID NO: 37895 - DNA, 20 bp, Artificial Sequence
  sgRNA
  Olfr1261_3
accatctatgacggacaagt

SEQ ID NO: 37896 - DNA, 20 bp, Artificial Sequence
  sgRNA
  Olfr1261_4
taaacacagtgacccgctgt

SEQ ID NO: 37897 - DNA, 20 bp, Artificial Sequence
  sgRNA
  Olfr1261_5
tttgacttcctcatttctga

SEQ ID NO: 37898 - DNA, 20 bp, Artificial Sequence
  sgRNA
  Olfr1261_6
tgtgatttctcagggagcga

SEQ ID NO: 37899 - DNA, 20 bp, Artificial Sequence
  sgRNA
  Olfr1261_7
agattacagcagcccccacc

SEQ ID NO: 37900 - DNA, 20 bp, Artificial Sequence
  sgRNA
  Olfr1261_8
acaaaatctgtatccctcca

SEQ ID NO: 37901 - DNA, 20 bp, Artificial Sequence
  sgRNA
  Olfr1261_9
gtaatcttaggattcatcca

SEQ ID NO: 37902 - DNA, 20 bp, Artificial Sequence
  sgRNA
  Olfr1261_10
tgggccacagaatggtaact

SEQ ID NO: 37903 - DNA, 20 bp, Artificial Sequence
  sgRNA
  Olfr1261_11
gtaggaaagaaagaagtaca

SEQ ID NO: 37904 - DNA, 20 bp, Artificial Sequence
  sgRNA
  Olfr1261_12
cagaaatgaggaagtcaaaa

SEQ ID NO: 37905 - DNA, 20 bp, Artificial Sequence
  sgRNA
  Olfr1261_13
atggcccagttaccattctg

SEQ ID NO: 37906 - DNA, 20 bp, Artificial Sequence
  sgRNA
  Olfr1261_14
tctgtgtgtattcctggtgg

SEQ ID NO: 37907 - DNA, 20 bp, Artificial Sequence
  sgRNA
  Olfr1261_15
taggaaagaaagaagtacat

SEQ ID NO: 37908 - DNA, 20 bp, Artificial Sequence
  sgRNA
  Olfr1261_16
tcagaaatgaggaagtcaaa

SEQ ID NO: 37909 - DNA, 20 bp, Artificial Sequence
  sgRNA
  Olfr1261_17
tcctacttgtccgtcataga

SEQ ID NO: 37910 - DNA, 20 bp, Artificial Sequence
  sgRNA
  Olfr1261_18
gtgggggctgctgtaatctt

SEQ ID NO: 37911 - DNA, 20 bp, Artificial Sequence
  sgRNA
  Olfr1261_19
aagaaagaagtacatgggag

SEQ ID NO: 37912 - DNA, 20 bp, Artificial Sequence
  sgRNA
  Olfr1261_20
aatcatcttgctgatgtcca

SEQ ID NO: 37913 - DNA, 20 bp, Artificial Sequence
  sgRNA
  Olfr1262_1
gcactgacactcacactctg

SEQ ID NO: 37914 - DNA, 20 bp, Artificial Sequence
  sgRNA
  Olfr1262_2
acatacatgtcggttcatga

SEQ ID NO: 37915 - DNA, 20 bp, Artificial Sequence
  sgRNA
  Olfr1262_3
atagcccaattacccttctg

SEQ ID NO: 37916 - DNA, 20 bp, Artificial Sequence
  sgRNA
  Olfr1262_4
accatctatgatggacaagt

SEQ ID NO: 37917 - DNA, 20 bp, Artificial Sequence
  sgRNA
  Olfr1262_5
gtgcaggccaactccaaaag

SEQ ID NO: 37918 - DNA, 20 bp, Artificial Sequence
  sgRNA
  Olfr1262_6
ggttcaacagaggagtcact

SEQ ID NO: 37919 - DNA, 20 bp, Artificial Sequence
  sgRNA
  Olfr1262_7
tgtgattccttagggagcga

SEQ ID NO: 37920 - DNA, 20 bp, Artificial Sequence
  sgRNA
  Olfr1262_8
tggtagcagctggaatcgtg

SEQ ID NO: 37921 - DNA, 20 bp, Artificial Sequence
  sgRNA
  Olfr1262_9
gttcaacagaggagtcacta

SEQ ID NO: 37922 - DNA, 20 bp, Artificial Sequence
  sgRNA
  Olfr1262_10
taaggaatcacagtgcagaa

SEQ ID NO: 37923 - DNA, 20 bp, Artificial Sequence
  sgRNA
  Olfr1262_11
ccactgatagctgccaacag

SEQ ID NO: 37924 - DNA, 20 bp, Artificial Sequence
  sgRNA
  Olfr1262_12
ctaagaaaatacatacatgt

SEQ ID NO: 37925 - DNA, 20 bp, Artificial Sequence
  sgRNA
  Olfr1262_13
ttctgcactgtgattcctta

SEQ ID NO: 37926 - DNA, 20 bp, Artificial Sequence
  sgRNA
  Olfr1262_14
gggttatgaagaagctcctg

SEQ ID NO: 37927 - DNA, 20 bp, Artificial Sequence
  sgRNA
  Olfr1262_15
tagatcagagggttcaacag

SEQ ID NO: 37928 - DNA, 20 bp, Artificial Sequence
  sgRNA
  Olfr1262_16
tggtcatccttcgctcccta

SEQ ID NO: 37929 - DNA, 20 bp, Artificial Sequence
  sgRNA
  Olfr1262_17
agggttatgaagaagctcct

SEQ ID NO: 37930 - DNA, 20 bp, Artificial Sequence
  sgRNA
  Olfr1262_18
cactgatagctgccaacagc

SEQ ID NO: 37931 - DNA, 20 bp, Artificial Sequence
  sgRNA
  Olfr1262_19
tacaaagaataagacaacaa

SEQ ID NO: 37932 - DNA, 20 bp, Artificial Sequence
  sgRNA
  Olfr1262_20
ggaatcgtggggtttgttca

SEQ ID NO: 37933 - DNA, 20 bp, Artificial Sequence
  sgRNA
  Olfr1263_1
aatgaatcctaagattacag

SEQ ID NO: 37934 - DNA, 20 bp, Artificial Sequence
  sgRNA
  Olfr1263_2
gggaccacagaagggtaact

SEQ ID NO: 37935 - DNA, 20 bp, Artificial Sequence
  sgRNA
  Olfr1263_3
atgatggtcatgtagtgtaa

SEQ ID NO: 37936 - DNA, 20 bp, Artificial Sequence
  sgRNA
  Olfr1263_4
tttaataccactcctggagt

SEQ ID NO: 37937 - DNA, 20 bp, Artificial Sequence
  sgRNA
  Olfr1263_5
gtaatcttaggattcattca

SEQ ID NO: 37938 - DNA, 20 bp, Artificial Sequence
  sgRNA
  Olfr1263_6
ggagcgaagaatgaccacat

SEQ ID NO: 37939 - DNA, 20 bp, Artificial Sequence
  sgRNA
  Olfr1263_7
agattacagcggcacccacc

SEQ ID NO: 37940 - DNA, 20 bp, Artificial Sequence
  sgRNA
  Olfr1263_8
atggtattgggaccacagaa

SEQ ID NO: 37941 - DNA, 20 bp, Artificial Sequence
  sgRNA
  Olfr1263_9
atggcccagttacccttctg

SEQ ID NO: 37942 - DNA, 20 bp, Artificial Sequence
  sgRNA
  Olfr1263_10
acacagaggttggctcatga

SEQ ID NO: 37943 - DNA, 20 bp, Artificial Sequence
  sgRNA
  Olfr1263_11
aatcatcttgttgattgcca

SEQ ID NO: 37944 - DNA, 20 bp, Artificial Sequence
  sgRNA
  Olfr1263_12
gtgggtgccgctgtaatctt

SEQ ID NO: 37945 - DNA, 20 bp, Artificial Sequence
  sgRNA
  Olfr1263_13
gtattaaatcacacataaaa

SEQ ID NO: 37946 - DNA, 20 bp, Artificial Sequence
  sgRNA
  Olfr1263_14
gtcacagaattcattctcct

SEQ ID NO: 37947 - DNA, 20 bp, Artificial Sequence
  sgRNA
  Olfr1263_15
agcaatacaaactttattta

SEQ ID NO: 37948 - DNA, 20 bp, Artificial Sequence
  sgRNA
  Olfr1263_16
atcacacataaaatggttga

SEQ ID NO: 37949 - DNA, 20 bp, Artificial Sequence
  sgRNA
  Olfr1263_17
gatggtattgggaccacaga

SEQ ID NO: 37950 - DNA, 20 bp, Artificial Sequence
  sgRNA
  Olfr1263_18
cataaaatggttgatggtat

SEQ ID NO: 37951 - DNA, 20 bp, Artificial Sequence
  sgRNA
  Olfr1263_19
ataaaatggttgatggtatt

SEQ ID NO: 37952 - DNA, 20 bp, Artificial Sequence
  sgRNA
  Olfr1263_20
catgatggtcatgtagtgta

SEQ ID NO: 37953 - DNA, 20 bp, Artificial Sequence
  sgRNA
  Olfr1264_1
ccgccaccagcacgacacaa

SEQ ID NO: 37954 - DNA, 20 bp, Artificial Sequence
  sgRNA
  Olfr1264_2
gatgacgtatgtgttggtgc

SEQ ID NO: 37955 - DNA, 20 bp, Artificial Sequence
  sgRNA
  Olfr1264_3
aaggcaactgaaaaatcaga

SEQ ID NO: 37956 - DNA, 20 bp, Artificial Sequence
  sgRNA
  Olfr1264_4
aagtttaggcgccaaagaag

SEQ ID NO: 37957 - DNA, 20 bp, Artificial Sequence
  sgRNA
  Olfr1264_5
tctataggtaaagtagtcga

SEQ ID NO: 37958 - DNA, 20 bp, Artificial Sequence
  sgRNA
  Olfr1264_6
ttatgctgggactttctcag

SEQ ID NO: 37959 - DNA, 20 bp, Artificial Sequence
  sgRNA
  Olfr1264_7
tgcggtcccacagtgcagag

SEQ ID NO: 37960 - DNA, 20 bp, Artificial Sequence
  sgRNA
  Olfr1264_8
gtgcaagatgacaatgtacg

SEQ ID NO: 37961 - DNA, 20 bp, Artificial Sequence
  sgRNA
  Olfr1264_9
ttgtcatcttgcactctttg

SEQ ID NO: 37962 - DNA, 20 bp, Artificial Sequence
  sgRNA
  Olfr1264_10
gcgtgtgaagagctttctca

SEQ ID NO: 37963 - DNA, 20 bp, Artificial Sequence
  sgRNA
  Olfr1264_11
tttgcggtcccacagtgcag

SEQ ID NO: 37964 - DNA, 20 bp, Artificial Sequence
  sgRNA
  Olfr1264_12
ctgtggggctcacttcactg

SEQ ID NO: 37965 - DNA, 20 bp, Artificial Sequence
  sgRNA
  Olfr1264_13
tttggagctcatttcctggg

SEQ ID NO: 37966 - DNA, 20 bp, Artificial Sequence
  sgRNA
  Olfr1264_14
agaaatacatgggagaagcc

SEQ ID NO: 37967 - DNA, 20 bp, Artificial Sequence
  sgRNA
  Olfr1264_15
gaaagctctgtctacctgtg

SEQ ID NO: 37968 - DNA, 20 bp, Artificial Sequence
  sgRNA
  Olfr1264_16
gggacgactctttcttatga

SEQ ID NO: 37969 - DNA, 20 bp, Artificial Sequence
  sgRNA
  Olfr1264_17
gaatgatctcaacacctccc

SEQ ID NO: 37970 - DNA, 20 bp, Artificial Sequence
  sgRNA
  Olfr1264_18
gatccagagacttctctttg

SEQ ID NO: 37971 - DNA, 20 bp, Artificial Sequence
  sgRNA
  Olfr1264_19
tctttcttatgagggctgca

SEQ ID NO: 37972 - DNA, 20 bp, Artificial Sequence
  sgRNA
  Olfr1264_20
tgcaccaacacatacgtcat

SEQ ID NO: 37973 - DNA, 20 bp, Artificial Sequence
  sgRNA
  Olfr1265_1
ctatccatgctgttcctacg

SEQ ID NO: 37974 - DNA, 20 bp, Artificial Sequence
  sgRNA
  Olfr1265_2
cctactgattgttgccaatg

SEQ ID NO: 37975 - DNA, 20 bp, Artificial Sequence
  sgRNA
  Olfr1265_3
gggactctcttctaacaaag

SEQ ID NO: 37976 - DNA, 20 bp, Artificial Sequence
  sgRNA
  Olfr1265_4
aataatgatcgatgatattg

SEQ ID NO: 37977 - DNA, 20 bp, Artificial Sequence
  sgRNA
  Olfr1265_5
actctcttctaacaaagagg

SEQ ID NO: 37978 - DNA, 20 bp, Artificial Sequence
  sgRNA
  Olfr1265_6
gtaggaacagcatggatagg

SEQ ID NO: 37979 - DNA, 20 bp, Artificial Sequence
  sgRNA
  Olfr1265_7
ataatgctggtgtagtgcag

SEQ ID NO: 37980 - DNA, 20 bp, Artificial Sequence
  sgRNA
  Olfr1265_8
cgaggactgcacacacattt

SEQ ID NO: 37981 - DNA, 20 bp, Artificial Sequence
  sgRNA
  Olfr1265_9
aatgtgtgtgcagtcctcgt

SEQ ID NO: 37982 - DNA, 20 bp, Artificial Sequence
  sgRNA
  Olfr1265_10
cagtcctcgtaggaacagca

SEQ ID NO: 37983 - DNA, 20 bp, Artificial Sequence
  sgRNA
  Olfr1265_11
ctaagaactcagagtgctga

SEQ ID NO: 37984 - DNA, 20 bp, Artificial Sequence
  sgRNA
  Olfr1265_12
ggtcctcttagcatcctatg

SEQ ID NO: 37985 - DNA, 20 bp, Artificial Sequence
  sgRNA
  Olfr1265_13
cagcactctgagttcttaga

SEQ ID NO: 37986 - DNA, 20 bp, Artificial Sequence
  sgRNA
  Olfr1265_14
gagcaggcaagtttaagcaa

SEQ ID NO: 37987 - DNA, 20 bp, Artificial Sequence
  sgRNA
  Olfr1265_15
atggaacaagatgaccacat

SEQ ID NO: 37988 - DNA, 20 bp, Artificial Sequence
  sgRNA
  Olfr1265_16
gatattcctgctcacagtga

SEQ ID NO: 37989 - DNA, 20 bp, Artificial Sequence
  sgRNA
  Olfr1265_17
ccgcattggcaacaatcagt

SEQ ID NO: 37990 - DNA, 20 bp, Artificial Sequence
  sgRNA
  Olfr1265_18
tgaccacataggatgctaag

SEQ ID NO: 37991 - DNA, 20 bp, Artificial Sequence
  sgRNA
  Olfr1265_19
cataatgctggtgtagtgca

SEQ ID NO: 37992 - DNA, 20 bp, Artificial Sequence
  sgRNA
  Olfr1265_20
tctaagaactcagagtgctg

SEQ ID NO: 37993 - DNA, 20 bp, Artificial Sequence
  sgRNA
  Olfr1267-ps1_1
gcaaaactttggccacctgt

SEQ ID NO: 37994 - DNA, 20 bp, Artificial Sequence
  sgRNA
  Olfr1267-ps1_2
gggactctctcccaatcaag

SEQ ID NO: 37995 - DNA, 20 bp, Artificial Sequence
  sgRNA
  Olfr1267-ps1_3
ggctgctgattgttgccaat

SEQ ID NO: 37996 - DNA, 20 bp, Artificial Sequence
  sgRNA
  Olfr1267-ps1_4
ccatccatgctgttcccagg

SEQ ID NO: 37997 - DNA, 20 bp, Artificial Sequence
  sgRNA
  Olfr1267-ps1_5
ggagtatcagatctccacaa

SEQ ID NO: 37998 - DNA, 20 bp, Artificial Sequence
  sgRNA
  Olfr1267-ps1_6
tctcagcagcaccaacgaag

SEQ ID NO: 37999 - DNA, 20 bp, Artificial Sequence
  sgRNA
  Olfr1267-ps1_7
agcaggcaagtttaagcaca

SEQ ID NO: 38000 - DNA, 20 bp, Artificial Sequence
  sgRNA
  Olfr1267-ps1_8
tgaccacatacgatgctaag

SEQ ID NO: 38001 - DNA, 20 bp, Artificial Sequence
  sgRNA
  Olfr1267-ps1_9
gagtcaagaaagaagtacat

SEQ ID NO: 38002 - DNA, 20 bp, Artificial Sequence
  sgRNA
  Olfr1267-ps1_10
cctgaaccatagacacttca

SEQ ID NO: 38003 - DNA, 20 bp, Artificial Sequence
  sgRNA
  Olfr1267-ps1_11
tgagggatggcgcaaaactt

SEQ ID NO: 38004 - DNA, 20 bp, Artificial Sequence
  sgRNA
  Olfr1267-ps1_12
agtgtgtgtgcagtcctcct

SEQ ID NO: 38005 - DNA, 20 bp, Artificial Sequence
  sgRNA
  Olfr1267-ps1_13
gctcagacaccttcctcatt

SEQ ID NO: 38006 - DNA, 20 bp, Artificial Sequence
  sgRNA
  Olfr1267-ps1_14
gatggcctatgactgctatg

SEQ ID NO: 38007 - DNA, 20 bp, Artificial Sequence
  sgRNA
  Olfr1267-ps1_15
ggaacacatcacagaaataa

SEQ ID NO: 38008 - DNA, 20 bp, Artificial Sequence
  sgRNA
  Olfr1267-ps1_16
ggtcctcttagcatcgtatg

SEQ ID NO: 38009 - DNA, 20 bp, Artificial Sequence
  sgRNA
  Olfr1267-ps1_17
gctatttctgctcttgtaca

SEQ ID NO: 38010 - DNA, 20 bp, Artificial Sequence
  sgRNA
  Olfr1267-ps1_18
tcttgactctctctcctttg

SEQ ID NO: 38011 - DNA, 20 bp, Artificial Sequence
  sgRNA
  Olfr1267-ps1_19
gaacccagagtgctgaggga

SEQ ID NO: 38012 - DNA, 20 bp, Artificial Sequence
  sgRNA
  Olfr1267-ps1_20
ggaggactgcacacacactt

SEQ ID NO: 38013 - DNA, 20 bp, Artificial Sequence
  sgRNA
  Olfr1268-ps1_1
aagccagcttcaacaccggg

SEQ ID NO: 38014 - DNA, 20 bp, Artificial Sequence
  sgRNA
  Olfr1268-ps1_2
ctacgaatgacaagtagccg

SEQ ID NO: 38015 - DNA, 20 bp, Artificial Sequence
  sgRNA
  Olfr1268-ps1_3
gagcaagccagcttcaacac

SEQ ID NO: 38016 - DNA, 20 bp, Artificial Sequence
  sgRNA
  Olfr1268-ps1_4
tgactatcgtggccagcaaa

SEQ ID NO: 38017 - DNA, 20 bp, Artificial Sequence
  sgRNA
  Olfr1268-ps1_5
ctacttctgtgacgtccacc

SEQ ID NO: 38018 - DNA, 20 bp, Artificial Sequence
  sgRNA
  Olfr1268-ps1_6
tggtcattctgaattctctg

SEQ ID NO: 38019 - DNA, 20 bp, Artificial Sequence
  sgRNA
  Olfr1268-ps1_7
cagccacaaccttgtctaca

SEQ ID NO: 38020 - DNA, 20 bp, Artificial Sequence
  sgRNA
  Olfr1268-ps1_8
tctacagggaaggtgataca

SEQ ID NO: 38021 - DNA, 20 bp, Artificial Sequence
  sgRNA
  Olfr1268-ps1_9
ccatgaagagactcgtgggg

SEQ ID NO: 38022 - DNA, 20 bp, Artificial Sequence
  sgRNA
  Olfr1268-ps1_10
tgatgactaacaggctaatg

SEQ ID NO: 38023 - DNA, 20 bp, Artificial Sequence
  sgRNA
  Olfr1268-ps1_11
cataggccatcactgtcaga

SEQ ID NO: 38024 - DNA, 20 bp, Artificial Sequence
  sgRNA
  Olfr1268-ps1_12
gctgggcaatggccttattg

SEQ ID NO: 38025 - DNA, 20 bp, Artificial Sequence
  sgRNA
  Olfr1268-ps1_13
aatgccatgaagagactcgt

SEQ ID NO: 38026 - DNA, 20 bp, Artificial Sequence
  sgRNA
  Olfr1268-ps1_14
gccgaggaagaaatacatgg

SEQ ID NO: 38027 - DNA, 20 bp, Artificial Sequence
  sgRNA
  Olfr1268-ps1_15
agcctgttagtcatcatcaa

SEQ ID NO: 38028 - DNA, 20 bp, Artificial Sequence
  sgRNA
  Olfr1268-ps1_16
ctgttagtcatcatcaatgg

SEQ ID NO: 38029 - DNA, 20 bp, Artificial Sequence
  sgRNA
  Olfr1268-ps1_17
tccatgctgcccctaccagg

SEQ ID NO: 38030 - DNA, 20 bp, Artificial Sequence
  sgRNA
  Olfr1268-ps1_18
gcttgcagatggcgacatag

SEQ ID NO: 38031 - DNA, 20 bp, Artificial Sequence
  sgRNA
  Olfr1268-ps1_19
ctcatgtagacaaaagagca

SEQ ID NO: 38032 - DNA, 20 bp, Artificial Sequence
  sgRNA
  Olfr1268-ps1_20
ttactctttcagaaacactg

SEQ ID NO: 38033 - DNA, 20 bp, Artificial Sequence
  sgRNA
  Olfr1269_1
caacaatcagcaaaccaatg

SEQ ID NO: 38034 - DNA, 20 bp, Artificial Sequence
  sgRNA
  Olfr1269_2
agtgtgtgtgcagtcctcat

SEQ ID NO: 38035 - DNA, 20 bp, Artificial Sequence
  sgRNA
  Olfr1269_3
ggggctctcttccaatcaag

SEQ ID NO: 38036 - DNA, 20 bp, Artificial Sequence
  sgRNA
  Olfr1269_4
gagtttgggagctgttgtgg

SEQ ID NO: 38037 - DNA, 20 bp, Artificial Sequence
  sgRNA
  Olfr1269_5
gtggtcctcttagcatccta

SEQ ID NO: 38038 - DNA, 20 bp, Artificial Sequence
  sgRNA
  Olfr1269_6
ctatccatgctgttcccatg

SEQ ID NO: 38039 - DNA, 20 bp, Artificial Sequence
  sgRNA
  Olfr1269_7
cagcactctgagttctcaga

SEQ ID NO: 38040 - DNA, 20 bp, Artificial Sequence
  sgRNA
  Olfr1269_8
gtttgctgattgttgtcaat

SEQ ID NO: 38041 - DNA, 20 bp, Artificial Sequence
  sgRNA
  Olfr1269_9
gatgagaagtatttgagcaa

SEQ ID NO: 38042 - DNA, 20 bp, Artificial Sequence
  sgRNA
  Olfr1269_10
cagtcctcatgggaacagca

SEQ ID NO: 38043 - DNA, 20 bp, Artificial Sequence
  sgRNA
  Olfr1269_11
tgactccataggatgctaag

SEQ ID NO: 38044 - DNA, 20 bp, Artificial Sequence
  sgRNA
  Olfr1269_12
aggagatccaagatgagttt

SEQ ID NO: 38045 - DNA, 20 bp, Artificial Sequence
  sgRNA
  Olfr1269_13
tcatgatgctagtatagtgc

SEQ ID NO: 38046 - DNA, 20 bp, Artificial Sequence
  sgRNA
  Olfr1269_14
tgaggactgcacacacactt

SEQ ID NO: 38047 - DNA, 20 bp, Artificial Sequence
  sgRNA
  Olfr1269_15
atggaacaagatgactccat

SEQ ID NO: 38048 - DNA, 20 bp, Artificial Sequence
  sgRNA
  Olfr1269_16
tctgagaactcagagtgctg

SEQ ID NO: 38049 - DNA, 20 bp, Artificial Sequence
  sgRNA
  Olfr1269_17
aatcagcaaaccaatgagga

SEQ ID NO: 38050 - DNA, 20 bp, Artificial Sequence
  sgRNA
  Olfr1269_18
aagtgtgtgtgcagtcctca

SEQ ID NO: 38051 - DNA, 20 bp, Artificial Sequence
  sgRNA
  Olfr1269_19
cgcaaagcactgtccacctg

SEQ ID NO: 38052 - DNA, 20 bp, Artificial Sequence
  sgRNA
  Olfr1269_20
catgatgctagtatagtgca

SEQ ID NO: 38053 - DNA, 20 bp, Artificial Sequence
  sgRNA
  Olfr1270_1
caatgaccattgcaacaatg

SEQ ID NO: 38054 - DNA, 20 bp, Artificial Sequence
  sgRNA
  Olfr1270_2
gttaaaaccatctcgctgaa

SEQ ID NO: 38055 - DNA, 20 bp, Artificial Sequence
  sgRNA
  Olfr1270_3
tgtggagagtgtcattgtaa

SEQ ID NO: 38056 - DNA, 20 bp, Artificial Sequence
  sgRNA
  Olfr1270_4
ccaccagggacaaggagctg

SEQ ID NO: 38057 - DNA, 20 bp, Artificial Sequence
  sgRNA
  Olfr1270_5
atttggatcctggaaaaggc

SEQ ID NO: 38058 - DNA, 20 bp, Artificial Sequence
  sgRNA
  Olfr1270_6
tctcatgtagaggaagatgg

SEQ ID NO: 38059 - DNA, 20 bp, Artificial Sequence
  sgRNA
  Olfr1270_7
tcttcagtgaaagtagagga

SEQ ID NO: 38060 - DNA, 20 bp, Artificial Sequence
  sgRNA
  Olfr1270_8
gcacatttggatcctggaaa

SEQ ID NO: 38061 - DNA, 20 bp, Artificial Sequence
  sgRNA
  Olfr1270_9
gtgcaagccagcttgaataa

SEQ ID NO: 38062 - DNA, 20 bp, Artificial Sequence
  sgRNA
  Olfr1270_10
tctcagccactcccaagaaa

SEQ ID NO: 38063 - DNA, 20 bp, Artificial Sequence
  sgRNA
  Olfr1270_11
tcatcatccttgtcaatttg

SEQ ID NO: 38064 - DNA, 20 bp, Artificial Sequence
  sgRNA
  Olfr1270_12
ggagctgaggaagatgtaca

SEQ ID NO: 38065 - DNA, 20 bp, Artificial Sequence
  sgRNA
  Olfr1270_13
gtcattgtaatggccaatag

SEQ ID NO: 38066 - DNA, 20 bp, Artificial Sequence
  sgRNA
  Olfr1270_14
tagaggaaggtctcatgtag

SEQ ID NO: 38067 - DNA, 20 bp, Artificial Sequence
  sgRNA
  Olfr1270_15
gacaaggatgatgacatagg

SEQ ID NO: 38068 - DNA, 20 bp, Artificial Sequence
  sgRNA
  Olfr1270_16
tcaagtgtgtcacgtgctgg

SEQ ID NO: 38069 - DNA, 20 bp, Artificial Sequence
  sgRNA
  Olfr1270_17
agagtaacagatctccacca

SEQ ID NO: 38070 - DNA, 20 bp, Artificial Sequence
  sgRNA
  Olfr1270_18
cttgtcttcagtgaaagtag

SEQ ID NO: 38071 - DNA, 20 bp, Artificial Sequence
  sgRNA
  Olfr1270_19
cttcttccatttcttgggag

SEQ ID NO: 38072 - DNA, 20 bp, Artificial Sequence
  sgRNA
  Olfr1270_20
cctcagctccttgtccctgg

SEQ ID NO: 38073 - DNA, 20 bp, Artificial Sequence
  sgRNA
  Olfr1271_1
taagtcagtgatgaacttag

SEQ ID NO: 38074 - DNA, 20 bp, Artificial Sequence
  sgRNA
  Olfr1271_2
gcagtgacacctttatggag

SEQ ID NO: 38075 - DNA, 20 bp, Artificial Sequence
  sgRNA
  Olfr1271_3
aagaccgttgcccagcaatg

SEQ ID NO: 38076 - DNA, 20 bp, Artificial Sequence
  sgRNA
  Olfr1271_4
tcaagtgtgtcacatgttgg

SEQ ID NO: 38077 - DNA, 20 bp, Artificial Sequence
  sgRNA
  Olfr1271_5
tttattgtaatggctaacag

SEQ ID NO: 38078 - DNA, 20 bp, Artificial Sequence
  sgRNA
  Olfr1271_6
tcttcagtgaaggcagagga

SEQ ID NO: 38079 - DNA, 20 bp, Artificial Sequence
  sgRNA
  Olfr1271_7
ctgcaagcaagcttaagtaa

SEQ ID NO: 38080 - DNA, 20 bp, Artificial Sequence
  sgRNA
  Olfr1271_8
acagtggtcatcctgtactt

SEQ ID NO: 38081 - DNA, 20 bp, Artificial Sequence
  sgRNA
  Olfr1271_9
gatgcaggtcacagaagtag

SEQ ID NO: 38082 - DNA, 20 bp, Artificial Sequence
  sgRNA
  Olfr1271_10
atgatgatcatgtaatgaag

SEQ ID NO: 38083 - DNA, 20 bp, Artificial Sequence
  sgRNA
  Olfr1271_11
cttgtcttcagtgaaggcag

SEQ ID NO: 38084 - DNA, 20 bp, Artificial Sequence
  sgRNA
  Olfr1271_12
ggagtagcagatctccacca

SEQ ID NO: 38085 - DNA, 20 bp, Artificial Sequence
  sgRNA
  Olfr1271_13
ctggccacattgctgggcaa

SEQ ID NO: 38086 - DNA, 20 bp, Artificial Sequence
  sgRNA
  Olfr1271_14
atgcaccaggtccaaagtac

SEQ ID NO: 38087 - DNA, 20 bp, Artificial Sequence
  sgRNA
  Olfr1271_15
atagacaatggggttcagca

SEQ ID NO: 38088 - DNA, 20 bp, Artificial Sequence
  sgRNA
  Olfr1271_16
tttcaacaacaccaaagaaa

SEQ ID NO: 38089 - DNA, 20 bp, Artificial Sequence
  sgRNA
  Olfr1271_17
gtcttcagtgaaggcagagg

SEQ ID NO: 38090 - DNA, 20 bp, Artificial Sequence
  sgRNA
  Olfr1271_18
tagacagcccttcagagaga

SEQ ID NO: 38091 - DNA, 20 bp, Artificial Sequence
  sgRNA
  Olfr1271_19
tatggagaggtttattgtaa

SEQ ID NO: 38092 - DNA, 20 bp, Artificial Sequence
  sgRNA
  Olfr1271_20
aggagtagcagatctccacc

SEQ ID NO: 38093 - DNA, 20 bp, Artificial Sequence
  sgRNA
  Olfr1272_1
gttaaaaccatctccctgaa

SEQ ID NO: 38094 - DNA, 20 bp, Artificial Sequence
  sgRNA
  Olfr1272_2
atgtgcctctcacatcacag

SEQ ID NO: 38095 - DNA, 20 bp, Artificial Sequence
  sgRNA
  Olfr1272_3
cataagccatcaccacaagc

SEQ ID NO: 38096 - DNA, 20 bp, Artificial Sequence
  sgRNA
  Olfr1272_4
tttctgagagtatagatgat

SEQ ID NO: 38097 - DNA, 20 bp, Artificial Sequence
  sgRNA
  Olfr1272_5
ttctgcagagggaagacgca

SEQ ID NO: 38098 - DNA, 20 bp, Artificial Sequence
  sgRNA
  Olfr1272_6
caagtgtgtcacatgttggt

SEQ ID NO: 38099 - DNA, 20 bp, Artificial Sequence
  sgRNA
  Olfr1272_7
gggcaacagtcttattgttg

SEQ ID NO: 38100 - DNA, 20 bp, Artificial Sequence
  sgRNA
  Olfr1272_8
acagtggtcatcctgttctt

SEQ ID NO: 38101 - DNA, 20 bp, Artificial Sequence
  sgRNA
  Olfr1272_9
ctatactctcagaaatgcag

SEQ ID NO: 38102 - DNA, 20 bp, Artificial Sequence
  sgRNA
  Olfr1272_10
attcttctcccatttcttgg

SEQ ID NO: 38103 - DNA, 20 bp, Artificial Sequence
  sgRNA
  Olfr1272_11
ctcagcaacccccaagaaat

SEQ ID NO: 38104 - DNA, 20 bp, Artificial Sequence
  sgRNA
  Olfr1272_12
tttgccccacaatttcttca

SEQ ID NO: 38105 - DNA, 20 bp, Artificial Sequence
  sgRNA
  Olfr1272_13
tctgagccagacagcccttc

SEQ ID NO: 38106 - DNA, 20 bp, Artificial Sequence
  sgRNA
  Olfr1272_14
aatgccatgaagaaattgtg

SEQ ID NO: 38107 - DNA, 20 bp, Artificial Sequence
  sgRNA
  Olfr1272_15
gtgtgtcacatgttggtggg

SEQ ID NO: 38108 - DNA, 20 bp, Artificial Sequence
  sgRNA
  Olfr1272_16
ggttaaaaccatctccctga

SEQ ID NO: 38109 - DNA, 20 bp, Artificial Sequence
  sgRNA
  Olfr1272_17
tgtgatgtgagaggcacatg

SEQ ID NO: 38110 - DNA, 20 bp, Artificial Sequence
  sgRNA
  Olfr1272_18
gtgagaggcacatgtggaga

SEQ ID NO: 38111 - DNA, 20 bp, Artificial Sequence
  sgRNA
  Olfr1272_19
atattcttctcccatttctt

SEQ ID NO: 38112 - DNA, 20 bp, Artificial Sequence
  sgRNA
  Olfr1272_20
tgtgagaggcacatgtggag

SEQ ID NO: 38113 - DNA, 20 bp, Artificial Sequence
  sgRNA
  Olfr1273-ps_1
caagtgtgtcacatgctggt

SEQ ID NO: 38114 - DNA, 20 bp, Artificial Sequence
  sgRNA
  Olfr1273-ps_2
cactaattgtcacaacaatg

SEQ ID NO: 38115 - DNA, 20 bp, Artificial Sequence
  sgRNA
  Olfr1273-ps_3
tgcactgatacctttatgga

SEQ ID NO: 38116 - DNA, 20 bp, Artificial Sequence
  sgRNA
  Olfr1273-ps_4
ctactatggacaacgagctg

SEQ ID NO: 38117 - DNA, 20 bp, Artificial Sequence
  sgRNA
  Olfr1273-ps_5
attacattgggaccacagaa

SEQ ID NO: 38118 - DNA, 20 bp, Artificial Sequence
  sgRNA
  Olfr1273-ps_6
agagatttgctactcctcta

SEQ ID NO: 38119 - DNA, 20 bp, Artificial Sequence
  sgRNA
  Olfr1273-ps_7
ctatacactcagaaatgcag

SEQ ID NO: 38120 - DNA, 20 bp, Artificial Sequence
  sgRNA
  Olfr1273-ps_8
gatggcctatgatcgctacg

SEQ ID NO: 38121 - DNA, 20 bp, Artificial Sequence
  sgRNA
  Olfr1273-ps_9
atctggatcctggaaaaggc

SEQ ID NO: 38122 - DNA, 20 bp, Artificial Sequence
  sgRNA
  Olfr1273-ps_10
ggagtagcaaatctctacta

SEQ ID NO: 38123 - DNA, 20 bp, Artificial Sequence
  sgRNA
  Olfr1273-ps_11
aggtggcaggtccaaaaaac

SEQ ID NO: 38124 - DNA, 20 bp, Artificial Sequence
  sgRNA
  Olfr1273-ps_12
gttaaaaccatttctctgaa

SEQ ID NO: 38125 - DNA, 20 bp, Artificial Sequence
  sgRNA
  Olfr1273-ps_13
cagacagcccttcagagaaa

SEQ ID NO: 38126 - DNA, 20 bp, Artificial Sequence
  sgRNA
  Olfr1273-ps_14
attcttcttccatttcttgg

SEQ ID NO: 38127 - DNA, 20 bp, Artificial Sequence
  sgRNA
  Olfr1273-ps_15
gaagtagtggtcaattacat

SEQ ID NO: 38128 - DNA, 20 bp, Artificial Sequence
  sgRNA
  Olfr1273-ps_16
ttgttgtgatggccaacagt

SEQ ID NO: 38129 - DNA, 20 bp, Artificial Sequence
  sgRNA
  Olfr1273-ps_17
aatgccatgaagaaattgta

SEQ ID NO: 38130 - DNA, 20 bp, Artificial Sequence
  sgRNA
  Olfr1273-ps_18
tattcttcttccatttcttg

SEQ ID NO: 38131 - DNA, 20 bp, Artificial Sequence
  sgRNA
  Olfr1273-ps_19
cgagctgaggaagatgtaca

SEQ ID NO: 38132 - DNA, 20 bp, Artificial Sequence
  sgRNA
  Olfr1273-ps_20
gataaccactgtgatgtgtg

SEQ ID NO: 38133 - DNA, 20 bp, Artificial Sequence
  sgRNA
  Olfr1274-ps_1
cattaagattctatggacca

SEQ ID NO: 38134 - DNA, 20 bp, Artificial Sequence
  sgRNA
  Olfr1274-ps_2
gatgagaaggacctgggcaa

SEQ ID NO: 38135 - DNA, 20 bp, Artificial Sequence
  sgRNA
  Olfr1274-ps_3
cctggtccatagaatcttaa

SEQ ID NO: 38136 - DNA, 20 bp, Artificial Sequence
  sgRNA
  Olfr1274-ps_4
gtttggaaatcttctcatgg

SEQ ID NO: 38137 - DNA, 20 bp, Artificial Sequence
  sgRNA
  Olfr1274-ps_5
cataggccatcatcgtaagc

SEQ ID NO: 38138 - DNA, 20 bp, Artificial Sequence
  sgRNA
  Olfr1274-ps_6
cagcactctgagttctcagg

SEQ ID NO: 38139 - DNA, 20 bp, Artificial Sequence
  sgRNA
  Olfr1274-ps_7
gcggaagatgagaaggacct

SEQ ID NO: 38140 - DNA, 20 bp, Artificial Sequence
  sgRNA
  Olfr1274-ps_8
gagaagatttccaaacacaa

SEQ ID NO: 38141 - DNA, 20 bp, Artificial Sequence
  sgRNA
  Olfr1274-ps_9
gtagtgcagaggcttgcaaa

SEQ ID NO: 38142 - DNA, 20 bp, Artificial Sequence
  sgRNA
  Olfr1274-ps_10
agaaagccattaagattcta

SEQ ID NO: 38143 - DNA, 20 bp, Artificial Sequence
  sgRNA
  Olfr1274-ps_11
caccagcatcatgaaccgac

SEQ ID NO: 38144 - DNA, 20 bp, Artificial Sequence
  sgRNA
  Olfr1274-ps_12
gttgaggaggggagttatca

SEQ ID NO: 38145 - DNA, 20 bp, Artificial Sequence
  sgRNA
  Olfr1274-ps_13
cacctgtcggttcatgatgc

SEQ ID NO: 38146 - DNA, 20 bp, Artificial Sequence
  sgRNA
  Olfr1274-ps_14
ccattaagattctatggacc

SEQ ID NO: 38147 - DNA, 20 bp, Artificial Sequence
  sgRNA
  Olfr1274-ps_15
gtggaacaagatgactgcat

SEQ ID NO: 38148 - DNA, 20 bp, Artificial Sequence
  sgRNA
  Olfr1274-ps_16
gatgttcctgcttacgatga

SEQ ID NO: 38149 - DNA, 20 bp, Artificial Sequence
  sgRNA
  Olfr1274-ps_17
gaaggacctgggcaagggaa

SEQ ID NO: 38150 - DNA, 20 bp, Artificial Sequence
  sgRNA
  Olfr1274-ps_18
agatgagaaggacctgggca

SEQ ID NO: 38151 - DNA, 20 bp, Artificial Sequence
  sgRNA
  Olfr1274-ps_19
agggcaagcggaagatgaga

SEQ ID NO: 38152 - DNA, 20 bp, Artificial Sequence
  sgRNA
  Olfr1274-ps_20
ttgtacatggccattgtgtt

SEQ ID NO: 38153 - DNA, 20 bp, Artificial Sequence
  sgRNA
  Olfr1289_1
agctacactacagttatgcg

SEQ ID NO: 38154 - DNA, 20 bp, Artificial Sequence
  sgRNA
  Olfr1289_2
gaaagtacataggcgaatgg

SEQ ID NO: 38155 - DNA, 20 bp, Artificial Sequence
  sgRNA
  Olfr1289_3
gaagggtaagcttatagcaa

SEQ ID NO: 38156 - DNA, 20 bp, Artificial Sequence
  sgRNA
  Olfr1289_4
taacctatatgtctctgcac

SEQ ID NO: 38157 - DNA, 20 bp, Artificial Sequence
  sgRNA
  Olfr1289_5
gctataagcttacccttctg

SEQ ID NO: 38158 - DNA, 20 bp, Artificial Sequence
  sgRNA
  Olfr1289_6
tcttctggaatcaatcaaca

SEQ ID NO: 38159 - DNA, 20 bp, Artificial Sequence
  sgRNA
  Olfr1289_7
cttctggaatcaatcaacat

SEQ ID NO: 38160 - DNA, 20 bp, Artificial Sequence
  sgRNA
  Olfr1289_8
atcaaaggccatggctacaa

SEQ ID NO: 38161 - DNA, 20 bp, Artificial Sequence
  sgRNA
  Olfr1289_9
acagaaagtacataggcgaa

SEQ ID NO: 38162 - DNA, 20 bp, Artificial Sequence
  sgRNA
  Olfr1289_10
aatgggactctccaattctc

SEQ ID NO: 38163 - DNA, 20 bp, Artificial Sequence
  sgRNA
  Olfr1289_11
tacccttctgtggtcccaat

SEQ ID NO: 38164 - DNA, 20 bp, Artificial Sequence
  sgRNA
  Olfr1289_12
ttagcattgtggctactgca

SEQ ID NO: 38165 - DNA, 20 bp, Artificial Sequence
  sgRNA
  Olfr1289_13
accctattgggaccacagaa

SEQ ID NO: 38166 - DNA, 20 bp, Artificial Sequence
  sgRNA
  Olfr1289_14
ataactgtagtgtagcttag

SEQ ID NO: 38167 - DNA, 20 bp, Artificial Sequence
  sgRNA
  Olfr1289_15
cactccccccaaaaaagtga

SEQ ID NO: 38168 - DNA, 20 bp, Artificial Sequence
  sgRNA
  Olfr1289_16
ggtcattagaataataccat

SEQ ID NO: 38169 - DNA, 20 bp, Artificial Sequence
  sgRNA
  Olfr1289_17
tcacagttatgacaataaga

SEQ ID NO: 38170 - DNA, 20 bp, Artificial Sequence
  sgRNA
  Olfr1289_18
acccttctgtggtcccaata

SEQ ID NO: 38171 - DNA, 20 bp, Artificial Sequence
  sgRNA
  Olfr1289_19
gatctgaagttcccgagaat

SEQ ID NO: 38172 - DNA, 20 bp, Artificial Sequence
  sgRNA
  Olfr1289_20
ttgcctgtgcagagacatat

SEQ ID NO: 38173 - DNA, 20 bp, Artificial Sequence
  sgRNA
  Olfr1291-ps1_1
ttgcctgtgcagacacaaat

SEQ ID NO: 38174 - DNA, 20 bp, Artificial Sequence
  sgRNA
  Olfr1291-ps1_2
agttcactgcaaaggccaat

SEQ ID NO: 38175 - DNA, 20 bp, Artificial Sequence
  sgRNA
  Olfr1291-ps1_3
cattccccccaaagaagtga

SEQ ID NO: 38176 - DNA, 20 bp, Artificial Sequence
  sgRNA
  Olfr1291-ps1_4
ataattatagtatagtgtag

SEQ ID NO: 38177 - DNA, 20 bp, Artificial Sequence
  sgRNA
  Olfr1291-ps1_5
cactatactataattatgcg

SEQ ID NO: 38178 - DNA, 20 bp, Artificial Sequence
  sgRNA
  Olfr1291-ps1_6
ttacagtcatgacaataaga

SEQ ID NO: 38179 - DNA, 20 bp, Artificial Sequence
  sgRNA
  Olfr1291-ps1_7
atatctgggcaaaacagcca

SEQ ID NO: 38180 - DNA, 20 bp, Artificial Sequence
  sgRNA
  Olfr1291-ps1_8
gtcaaagcccatggctatga

SEQ ID NO: 38181 - DNA, 20 bp, Artificial Sequence
  sgRNA
  Olfr1291-ps1_9
atggtgaccctcatagccat

SEQ ID NO: 38182 - DNA, 20 bp, Artificial Sequence
  sgRNA
  Olfr1291-ps1_10
tacatatctgtcaaagccca

SEQ ID NO: 38183 - DNA, 20 bp, Artificial Sequence
  sgRNA
  Olfr1291-ps1_11
ttggccaacaggaaatacat

SEQ ID NO: 38184 - DNA, 20 bp, Artificial Sequence
  sgRNA
  Olfr1291-ps1_12
gatggtgaccctcatagcca

SEQ ID NO: 38185 - DNA, 20 bp, Artificial Sequence
  sgRNA
  Olfr1291-ps1_13
cgcaaagtcatctctgtcca

SEQ ID NO: 38186 - DNA, 20 bp, Artificial Sequence
  sgRNA
  Olfr1291-ps1_14
ctctcctatgtatttcctgt

SEQ ID NO: 38187 - DNA, 20 bp, Artificial Sequence
  sgRNA
  Olfr1291-ps1_15
atgcgaggcaatgtatgtgt

SEQ ID NO: 38188 - DNA, 20 bp, Artificial Sequence
  sgRNA
  Olfr1291-ps1_16
cagatcgatgaatgaaaggt

SEQ ID NO: 38189 - DNA, 20 bp, Artificial Sequence
  sgRNA
  Olfr1291-ps1_17
tgtcaaagcccatggctatg

SEQ ID NO: 38190 - DNA, 20 bp, Artificial Sequence
  sgRNA
  Olfr1291-ps1_18
gaagtgaaggagaaatatct

SEQ ID NO: 38191 - DNA, 20 bp, Artificial Sequence
  sgRNA
  Olfr1291-ps1_19
aaagggtaagttcactgcaa

SEQ ID NO: 38192 - DNA, 20 bp, Artificial Sequence
  sgRNA
  Olfr1291-ps1_20
gacacagatcgatgaatgaa

SEQ ID NO: 38193 - DNA, 20 bp, Artificial Sequence
  sgRNA
  Olfr1293-ps_1
ttactgtcatgacaataaga

SEQ ID NO: 38194 - DNA, 20 bp, Artificial Sequence
  sgRNA
  Olfr1293-ps_2
cgctacacaataattatgcg

SEQ ID NO: 38195 - DNA, 20 bp, Artificial Sequence
  sgRNA
  Olfr1293-ps_3
gaagtccctgagaatcagag

SEQ ID NO: 38196 - DNA, 20 bp, Artificial Sequence
  sgRNA
  Olfr1293-ps_4
gacacagatcaatgaatgag

SEQ ID NO: 38197 - DNA, 20 bp, Artificial Sequence
  sgRNA
  Olfr1293-ps_5
gctggtgaccctcatagcca

SEQ ID NO: 38198 - DNA, 20 bp, Artificial Sequence
  sgRNA
  Olfr1293-ps_6
attggcctctctgattctca

SEQ ID NO: 38199 - DNA, 20 bp, Artificial Sequence
  sgRNA
  Olfr1293-ps_7
atatctgtgcaaaacagcca

SEQ ID NO: 38200 - DNA, 20 bp, Artificial Sequence
  sgRNA
  Olfr1293-ps_8
ataattattgtgtagcgtag

SEQ ID NO: 38201 - DNA, 20 bp, Artificial Sequence
  sgRNA
  Olfr1293-ps_9
gtcaaaggccatggctatga

SEQ ID NO: 38202 - DNA, 20 bp, Artificial Sequence
  sgRNA
  Olfr1293-ps_10
ttgcctgtgcagacacatat

SEQ ID NO: 38203 - DNA, 20 bp, Artificial Sequence
  sgRNA
  Olfr1293-ps_11
agttgacggcaaaggccaat

SEQ ID NO: 38204 - DNA, 20 bp, Artificial Sequence
  sgRNA
  Olfr1293-ps_12
ttggccagaaggaaatacat

SEQ ID NO: 38205 - DNA, 20 bp, Artificial Sequence
  sgRNA
  Olfr1293-ps_13
aaagggtaagttgacggcaa

SEQ ID NO: 38206 - DNA, 20 bp, Artificial Sequence
  sgRNA
  Olfr1293-ps_14
aattgctacatatctgtcaa

SEQ ID NO: 38207 - DNA, 20 bp, Artificial Sequence
  sgRNA
  Olfr1293-ps_15
cactccccccaaagaagtga

SEQ ID NO: 38208 - DNA, 20 bp, Artificial Sequence
  sgRNA
  Olfr1293-ps_16
tacatatctgtcaaaggcca

SEQ ID NO: 38209 - DNA, 20 bp, Artificial Sequence
  sgRNA
  Olfr1293-ps_17
accacaaaagggtaagttga

SEQ ID NO: 38210 - DNA, 20 bp, Artificial Sequence
  sgRNA
  Olfr1293-ps_18
cacaaagtcatctctgtcca

SEQ ID NO: 38211 - DNA, 20 bp, Artificial Sequence
  sgRNA
  Olfr1293-ps_19
caggcataaatgaaaatgca

SEQ ID NO: 38212 - DNA, 20 bp, Artificial Sequence
  sgRNA
  Olfr1293-ps_20
cagatcaatgaatgagaggt

SEQ ID NO: 38213 - DNA, 20 bp, Artificial Sequence
  sgRNA
  Olfr13_1
gtaagggtaaaagtaacacg

SEQ ID NO: 38214 - DNA, 20 bp, Artificial Sequence
  sgRNA
  Olfr13_2
caggcagatgagccccacga

SEQ ID NO: 38215 - DNA, 20 bp, Artificial Sequence
  sgRNA
  Olfr13_3
aggacatcaccactaggaga

SEQ ID NO: 38216 - DNA, 20 bp, Artificial Sequence
  sgRNA
  Olfr13_4
tgatggcagagtaacggagt

SEQ ID NO: 38217 - DNA, 20 bp, Artificial Sequence
  sgRNA
  Olfr13_5
ggatcttcaggatagcacca

SEQ ID NO: 38218 - DNA, 20 bp, Artificial Sequence
  sgRNA
  Olfr13_6
tgtacgttggacccagacac

SEQ ID NO: 38219 - DNA, 20 bp, Artificial Sequence
  sgRNA
  Olfr13_7
gcaaactctccagctcatga

SEQ ID NO: 38220 - DNA, 20 bp, Artificial Sequence
  sgRNA
  Olfr13_8
tggggaatggaaccatcgtg

SEQ ID NO: 38221 - DNA, 20 bp, Artificial Sequence
  sgRNA
  Olfr13_9
gggtccaacgtacatgacaa

SEQ ID NO: 38222 - DNA, 20 bp, Artificial Sequence
  sgRNA
  Olfr13_10
tagtggtgatgtcctatgac

SEQ ID NO: 38223 - DNA, 20 bp, Artificial Sequence
  sgRNA
  Olfr13_11
ggtgacagattgcaacatac

SEQ ID NO: 38224 - DNA, 20 bp, Artificial Sequence
  sgRNA
  Olfr13_12
actttctgagacacacagaa

SEQ ID NO: 38225 - DNA, 20 bp, Artificial Sequence
  sgRNA
  Olfr13_13
ggtcataggacatcaccact

SEQ ID NO: 38226 - DNA, 20 bp, Artificial Sequence
  sgRNA
  Olfr13_14
ctgaagatccagtcagaaga

SEQ ID NO: 38227 - DNA, 20 bp, Artificial Sequence
  sgRNA
  Olfr13_15
agctcatgatggcagagtaa

SEQ ID NO: 38228 - DNA, 20 bp, Artificial Sequence
  sgRNA
  Olfr13_16
gcagggtgaaggcatagaag

SEQ ID NO: 38229 - DNA, 20 bp, Artificial Sequence
  sgRNA
  Olfr13_17
tccaacgtacatgacaatgg

SEQ ID NO: 38230 - DNA, 20 bp, Artificial Sequence
  sgRNA
  Olfr13_18
cacagaatgccttctcctag

SEQ ID NO: 38231 - DNA, 20 bp, Artificial Sequence
  sgRNA
  Olfr13_19
ccaggaccatcgtctcattg

SEQ ID NO: 38232 - DNA, 20 bp, Artificial Sequence
  sgRNA
  Olfr13_20
aaaacaatccgaccacacag

SEQ ID NO: 38233 - DNA, 20 bp, Artificial Sequence
  sgRNA
  Olfr1303_1
ccaatctgagaagtttagga

SEQ ID NO: 38234 - DNA, 20 bp, Artificial Sequence
  sgRNA
  Olfr1303_2
gcttaatatgtagagcaccg

SEQ ID NO: 38235 - DNA, 20 bp, Artificial Sequence
  sgRNA
  Olfr1303_3
agtggagatggtgctacttg

SEQ ID NO: 38236 - DNA, 20 bp, Artificial Sequence
  sgRNA
  Olfr1303_4
agaaacaaaacacatacacg

SEQ ID NO: 38237 - DNA, 20 bp, Artificial Sequence
  sgRNA
  Olfr1303_5
tctttcagctcacatcacag

SEQ ID NO: 38238 - DNA, 20 bp, Artificial Sequence
  sgRNA
  Olfr1303_6
tctccactccaccaactaaa

SEQ ID NO: 38239 - DNA, 20 bp, Artificial Sequence
  sgRNA
  Olfr1303_7
tgtgagctgaaagagtggag

SEQ ID NO: 38240 - DNA, 20 bp, Artificial Sequence
  sgRNA
  Olfr1303_8
aaaacattattaacctttag

SEQ ID NO: 38241 - DNA, 20 bp, Artificial Sequence
  sgRNA
  Olfr1303_9
gtgagctgaaagagtggaga

SEQ ID NO: 38242 - DNA, 20 bp, Artificial Sequence
  sgRNA
  Olfr1303_10
ccttcctaaacttctcagat

SEQ ID NO: 38243 - DNA, 20 bp, Artificial Sequence
  sgRNA
  Olfr1303_11
tgtctatctgggagttagga

SEQ ID NO: 38244 - DNA, 20 bp, Artificial Sequence
  sgRNA
  Olfr1303_12
agtatatttgggccacagaa

SEQ ID NO: 38245 - DNA, 20 bp, Artificial Sequence
  sgRNA
  Olfr1303_13
ctactctgtttatatatacg

SEQ ID NO: 38246 - DNA, 20 bp, Artificial Sequence
  sgRNA
  Olfr1303_14
tgtgatgtgagctgaaagag

SEQ ID NO: 38247 - DNA, 20 bp, Artificial Sequence
  sgRNA
  Olfr1303_15
tgaaagagtggagagggctt

SEQ ID NO: 38248 - DNA, 20 bp, Artificial Sequence
  sgRNA
  Olfr1303_16
ttctttatccatttagttgg

SEQ ID NO: 38249 - DNA, 20 bp, Artificial Sequence
  sgRNA
  Olfr1303_17
aagagatgaaggtagtaata

SEQ ID NO: 38250 - DNA, 20 bp, Artificial Sequence
  sgRNA
  Olfr1303_18
cttctgtggcccaaatatac

SEQ ID NO: 38251 - DNA, 20 bp, Artificial Sequence
  sgRNA
  Olfr1303_19
aaaagctgtccagtatattt

SEQ ID NO: 38252 - DNA, 20 bp, Artificial Sequence
  sgRNA
  Olfr1303_20
tctatctgggagttaggatg

SEQ ID NO: 38253 - DNA, 20 bp, Artificial Sequence
  sgRNA
  Olfr1309_1
cgggatcactaatatatggg

SEQ ID NO: 38254 - DNA, 20 bp, Artificial Sequence
  sgRNA
  Olfr1309_2
tacaagggggaattcagatg

SEQ ID NO: 38255 - DNA, 20 bp, Artificial Sequence
  sgRNA
  Olfr1309_3
aaaaagaacagacacactcg

SEQ ID NO: 38256 - DNA, 20 bp, Artificial Sequence
  sgRNA
  Olfr1309_4
tttctgtggtccaaatacac

SEQ ID NO: 38257 - DNA, 20 bp, Artificial Sequence
  sgRNA
  Olfr1309_5
tatacatccccagaaggaga

SEQ ID NO: 38258 - DNA, 20 bp, Artificial Sequence
  sgRNA
  Olfr1309_6
agctaagaggaaatacaagg

SEQ ID NO: 38259 - DNA, 20 bp, Artificial Sequence
  sgRNA
  Olfr1309_7
tgactgagagattagctaag

SEQ ID NO: 38260 - DNA, 20 bp, Artificial Sequence
  sgRNA
  Olfr1309_8
aaaagaacagacacactcgt

SEQ ID NO: 38261 - DNA, 20 bp, Artificial Sequence
  sgRNA
  Olfr1309_9
ctgatgtcggaagcaatgta

SEQ ID NO: 38262 - DNA, 20 bp, Artificial Sequence
  sgRNA
  Olfr1309_10
tctttcagcacacatcactg

SEQ ID NO: 38263 - DNA, 20 bp, Artificial Sequence
  sgRNA
  Olfr1309_11
ttagctaagaggaaatacaa

SEQ ID NO: 38264 - DNA, 20 bp, Artificial Sequence
  sgRNA
  Olfr1309_12
atgaataagaccaatgaccc

SEQ ID NO: 38265 - DNA, 20 bp, Artificial Sequence
  sgRNA
  Olfr1309_13
tcctcgggatcactaatata

SEQ ID NO: 38266 - DNA, 20 bp, Artificial Sequence
  sgRNA
  Olfr1309_14
agtgtatttggaccacagaa

SEQ ID NO: 38267 - DNA, 20 bp, Artificial Sequence
  sgRNA
  Olfr1309_15
tcatggtcactgtcaacagt

SEQ ID NO: 38268 - DNA, 20 bp, Artificial Sequence
  sgRNA
  Olfr1309_16
ggaattcagatgaggatcca

SEQ ID NO: 38269 - DNA, 20 bp, Artificial Sequence
  sgRNA
  Olfr1309_17
cattggtcttattcattcag

SEQ ID NO: 38270 - DNA, 20 bp, Artificial Sequence
  sgRNA
  Olfr1309_18
tgtgggctcctttcttctac

SEQ ID NO: 38271 - DNA, 20 bp, Artificial Sequence
  sgRNA
  Olfr1309_19
ttacagtgagcacaatgaca

SEQ ID NO: 38272 - DNA, 20 bp, Artificial Sequence
  sgRNA
  Olfr1309_20
atgatgatcaggtaatgcag

SEQ ID NO: 38273 - DNA, 20 bp, Artificial Sequence
  sgRNA
  Olfr1310_1
gtgtggacacatacacactg

SEQ ID NO: 38274 - DNA, 20 bp, Artificial Sequence
  sgRNA
  Olfr1310_2
acataggggattgtaactga

SEQ ID NO: 38275 - DNA, 20 bp, Artificial Sequence
  sgRNA
  Olfr1310_3
cctgggactctccaactcat

SEQ ID NO: 38276 - DNA, 20 bp, Artificial Sequence
  sgRNA
  Olfr1310_4
aactcagctgagtcactgag

SEQ ID NO: 38277 - DNA, 20 bp, Artificial Sequence
  sgRNA
  Olfr1310_5
agttcattagggccacagaa

SEQ ID NO: 38278 - DNA, 20 bp, Artificial Sequence
  sgRNA
  Olfr1310_6
ttatggttactgctaacagt

SEQ ID NO: 38279 - DNA, 20 bp, Artificial Sequence
  sgRNA
  Olfr1310_7
gcttacatatggcaacatat

SEQ ID NO: 38280 - DNA, 20 bp, Artificial Sequence
  sgRNA
  Olfr1310_8
tctcggtgccacctactgca

SEQ ID NO: 38281 - DNA, 20 bp, Artificial Sequence
  sgRNA
  Olfr1310_9
gatgcaacccccaaaagaga

SEQ ID NO: 38282 - DNA, 20 bp, Artificial Sequence
  sgRNA
  Olfr1310_10
caagcaagtttaataaacct

SEQ ID NO: 38283 - DNA, 20 bp, Artificial Sequence
  sgRNA
  Olfr1310_11
gcctaataggaagtacatag

SEQ ID NO: 38284 - DNA, 20 bp, Artificial Sequence
  sgRNA
  Olfr1310_12
gatgatcagaattaaaaagg

SEQ ID NO: 38285 - DNA, 20 bp, Artificial Sequence
  sgRNA
  Olfr1310_13
ttgcctaataggaagtacat

SEQ ID NO: 38286 - DNA, 20 bp, Artificial Sequence
  sgRNA
  Olfr1310_14
gtagtgcagaggcttacata

SEQ ID NO: 38287 - DNA, 20 bp, Artificial Sequence
  sgRNA
  Olfr1310_15
agtaataactgcatcaaaga

SEQ ID NO: 38288 - DNA, 20 bp, Artificial Sequence
  sgRNA
  Olfr1310_16
tttatggttactgctaacag

SEQ ID NO: 38289 - DNA, 20 bp, Artificial Sequence
  sgRNA
  Olfr1310_17
aaaagctgtctagttcatta

SEQ ID NO: 38290 - DNA, 20 bp, Artificial Sequence
  sgRNA
  Olfr1310_18
ttcctaagtgtataaatcac

SEQ ID NO: 38291 - DNA, 20 bp, Artificial Sequence
  sgRNA
  Olfr1310_19
aatgacatgagctgacaaag

SEQ ID NO: 38292 - DNA, 20 bp, Artificial Sequence
  sgRNA
  Olfr1310_20
catgtatagaagaagattaa

SEQ ID NO: 38293 - DNA, 20 bp, Artificial Sequence
  sgRNA
  Olfr1325_1
ataaccagattatacctgag

SEQ ID NO: 38294 - DNA, 20 bp, Artificial Sequence
  sgRNA
  Olfr1325_2
gtgtccagaagacaacactc

SEQ ID NO: 38295 - DNA, 20 bp, Artificial Sequence
  sgRNA
  Olfr1325_3
cagtgttgtacccttgatca

SEQ ID NO: 38296 - DNA, 20 bp, Artificial Sequence
  sgRNA
  Olfr1325_4
tctttccaatcagtttctgt

SEQ ID NO: 38297 - DNA, 20 bp, Artificial Sequence
  sgRNA
  Olfr1325_5
aatgaattcaccatgatcaa

SEQ ID NO: 38298 - DNA, 20 bp, Artificial Sequence
  sgRNA
  Olfr1325_6
gaatccatccaactaaggcc

SEQ ID NO: 38299 - DNA, 20 bp, Artificial Sequence
  sgRNA
  Olfr1325_7
ggattcttaaaacagccttg

SEQ ID NO: 38300 - DNA, 20 bp, Artificial Sequence
  sgRNA
  Olfr1325_8
gaaagccctgaaagcaagct

SEQ ID NO: 38301 - DNA, 20 bp, Artificial Sequence
  sgRNA
  Olfr1325_9
tttcagggctttcttagcac

SEQ ID NO: 38302 - DNA, 20 bp, Artificial Sequence
  sgRNA
  Olfr1325_10
ttaccaagaaagaaatacat

SEQ ID NO: 38303 - DNA, 20 bp, Artificial Sequence
  sgRNA
  Olfr1325_11
cgtgaaagctgttctcagga

SEQ ID NO: 38304 - DNA, 20 bp, Artificial Sequence
  sgRNA
  Olfr1325_12
gctttaagcctggccttagt

SEQ ID NO: 38305 - DNA, 20 bp, Artificial Sequence
  sgRNA
  Olfr1325_13
ctcttacctttgcatcctca

SEQ ID NO: 38306 - DNA, 20 bp, Artificial Sequence
  sgRNA
  Olfr1325_14
tttcacgtccttatttctta

SEQ ID NO: 38307 - DNA, 20 bp, Artificial Sequence
  sgRNA
  Olfr1325_15
gagcaaaatatctcacaatg

SEQ ID NO: 38308 - DNA, 20 bp, Artificial Sequence
  sgRNA
  Olfr1325_16
agtcaatcatttctcctgtg

SEQ ID NO: 38309 - DNA, 20 bp, Artificial Sequence
  sgRNA
  Olfr1325_17
acgtgaaagctgttctcagg

SEQ ID NO: 38310 - DNA, 20 bp, Artificial Sequence
  sgRNA
  Olfr1325_18
gggcagaacagtgagaagaa

SEQ ID NO: 38311 - DNA, 20 bp, Artificial Sequence
  sgRNA
  Olfr1325_19
catgatcaagggtacaacac

SEQ ID NO: 38312 - DNA, 20 bp, Artificial Sequence
  sgRNA
  Olfr1325_20
attgagagttgcctcctact

SEQ ID NO: 38313 - DNA, 20 bp, Artificial Sequence
  sgRNA
  Olfr1352_1
cttctgtgaattgaatcagg

SEQ ID NO: 38314 - DNA, 20 bp, Artificial Sequence
  sgRNA
  Olfr1352_2
aacttgcagcctgttatatg

SEQ ID NO: 38315 - DNA, 20 bp, Artificial Sequence
  sgRNA
  Olfr1352_3
atgataccagtataatgcag

SEQ ID NO: 38316 - DNA, 20 bp, Artificial Sequence
  sgRNA
  Olfr1352_4
tacaaagcatgatggtgctg

SEQ ID NO: 38317 - DNA, 20 bp, Artificial Sequence
  sgRNA
  Olfr1352_5
gatgcaatctgcatagctaa

SEQ ID NO: 38318 - DNA, 20 bp, Artificial Sequence
  sgRNA
  Olfr1352_6
cataggccattacagccagg

SEQ ID NO: 38319 - DNA, 20 bp, Artificial Sequence
  sgRNA
  Olfr1352_7
ggaattggacaacttcctcc

SEQ ID NO: 38320 - DNA, 20 bp, Artificial Sequence
  sgRNA
  Olfr1352_8
agccctgaagaggctcttag

SEQ ID NO: 38321 - DNA, 20 bp, Artificial Sequence
  sgRNA
  Olfr1352_9
tgtgacttactgcagaactg

SEQ ID NO: 38322 - DNA, 20 bp, Artificial Sequence
  sgRNA
  Olfr1352_10
gagtaaaggatgccaaacag

SEQ ID NO: 38323 - DNA, 20 bp, Artificial Sequence
  sgRNA
  Olfr1352_11
gagcaatgtccacagttcag

SEQ ID NO: 38324 - DNA, 20 bp, Artificial Sequence
  sgRNA
  Olfr1352_12
gatggcagatggccacataa

SEQ ID NO: 38325 - DNA, 20 bp, Artificial Sequence
  sgRNA
  Olfr1352_13
catgaccacatcattgagaa

SEQ ID NO: 38326 - DNA, 20 bp, Artificial Sequence
  sgRNA
  Olfr1352_14
gaagtaaaataaggagacaa

SEQ ID NO: 38327 - DNA, 20 bp, Artificial Sequence
  sgRNA
  Olfr1352_15
tttatacttcccctgaactg

SEQ ID NO: 38328 - DNA, 20 bp, Artificial Sequence
  sgRNA
  Olfr1352_16
tgtggacattgctcgtatgg

SEQ ID NO: 38329 - DNA, 20 bp, Artificial Sequence
  sgRNA
  Olfr1352_17
caccactgtgtacatcacag

SEQ ID NO: 38330 - DNA, 20 bp, Artificial Sequence
  sgRNA
  Olfr1352_18
ttagagagaaaaaagtacat

SEQ ID NO: 38331 - DNA, 20 bp, Artificial Sequence
  sgRNA
  Olfr1352_19
tacccctaagagcctcttca

SEQ ID NO: 38332 - DNA, 20 bp, Artificial Sequence
  sgRNA
  Olfr1352_20
cagtgatcaagtacatggag

SEQ ID NO: 38333 - DNA, 20 bp, Artificial Sequence
  sgRNA
  Olfr1354_1
ggtaaaacagatgtccacaa

SEQ ID NO: 38334 - DNA, 20 bp, Artificial Sequence
  sgRNA
  Olfr1354_2
tgatgaccatgatgataagc

SEQ ID NO: 38335 - DNA, 20 bp, Artificial Sequence
  sgRNA
  Olfr1354_3
ccaacagctctgtatactga

SEQ ID NO: 38336 - DNA, 20 bp, Artificial Sequence
  sgRNA
  Olfr1354_4
aacatgtgagttgagacagc

SEQ ID NO: 38337 - DNA, 20 bp, Artificial Sequence
  sgRNA
  Olfr1354_5
acaatgactgtgtaatataa

SEQ ID NO: 38338 - DNA, 20 bp, Artificial Sequence
  sgRNA
  Olfr1354_6
gtacaagattcattatgagt

SEQ ID NO: 38339 - DNA, 20 bp, Artificial Sequence
  sgRNA
  Olfr1354_7
ttccttagactataaataaa

SEQ ID NO: 38340 - DNA, 20 bp, Artificial Sequence
  sgRNA
  Olfr1354_8
aataaaggggttcagcatcg

SEQ ID NO: 38341 - DNA, 20 bp, Artificial Sequence
  sgRNA
  Olfr1354_9
ccatcagtatacagagctgt

SEQ ID NO: 38342 - DNA, 20 bp, Artificial Sequence
  sgRNA
  Olfr1354_10
tccttagactataaataaag

SEQ ID NO: 38343 - DNA, 20 bp, Artificial Sequence
  sgRNA
  Olfr1354_11
caatgactgtgtaatataat

SEQ ID NO: 38344 - DNA, 20 bp, Artificial Sequence
  sgRNA
  Olfr1354_12
acccctttatttatagtcta

SEQ ID NO: 38345 - DNA, 20 bp, Artificial Sequence
  sgRNA
  Olfr1354_13
tgggaacctgcttatcatca

SEQ ID NO: 38346 - DNA, 20 bp, Artificial Sequence
  sgRNA
  Olfr1354_14
aaataaaggggttcagcatc

SEQ ID NO: 38347 - DNA, 20 bp, Artificial Sequence
  sgRNA
  Olfr1354_15
taaataaaggggttcagcat

SEQ ID NO: 38348 - DNA, 20 bp, Artificial Sequence
  sgRNA
  Olfr1354_16
attccttagactataaataa

SEQ ID NO: 38349 - DNA, 20 bp, Artificial Sequence
  sgRNA
  Olfr1356_1
aacctgtccatagctgacat

SEQ ID NO: 38350 - DNA, 20 bp, Artificial Sequence
  sgRNA
  Olfr1356_2
tgtcacaatgttattaacaa

SEQ ID NO: 38351 - DNA, 20 bp, Artificial Sequence
  sgRNA
  Olfr1356_3
ggatagtcttaacacagtca

SEQ ID NO: 38352 - DNA, 20 bp, Artificial Sequence
  sgRNA
  Olfr1356_4
agatgaatttgctttgtgtg

SEQ ID NO: 38353 - DNA, 20 bp, Artificial Sequence
  sgRNA
  Olfr1356_5
gactatgctgtacatcagtg

SEQ ID NO: 38354 - DNA, 20 bp, Artificial Sequence
  sgRNA
  Olfr1356_6
agtcttctgtgaatcccagg

SEQ ID NO: 38355 - DNA, 20 bp, Artificial Sequence
  sgRNA
  Olfr1356_7
ggtgaagccgatgtcagcta

SEQ ID NO: 38356 - DNA, 20 bp, Artificial Sequence
  sgRNA
  Olfr1356_8
acacagtcaaggtctcaggt

SEQ ID NO: 38357 - DNA, 20 bp, Artificial Sequence
  sgRNA
  Olfr1356_9
gttgcttctttctatgtacc

SEQ ID NO: 38358 - DNA, 20 bp, Artificial Sequence
  sgRNA
  Olfr1356_10
ctaagaattccttcagctgg

SEQ ID NO: 38359 - DNA, 20 bp, Artificial Sequence
  sgRNA
  Olfr1356_11
ggtcataggccatcactgat

SEQ ID NO: 38360 - DNA, 20 bp, Artificial Sequence
  sgRNA
  Olfr1356_12
acatgggcatgtgcaggtgg

SEQ ID NO: 38361 - DNA, 20 bp, Artificial Sequence
  sgRNA
  Olfr1356_13
tctataaccatagtcatagc

SEQ ID NO: 38362 - DNA, 20 bp, Artificial Sequence
  sgRNA
  Olfr1356_14
cacctccaccactatcccca

SEQ ID NO: 38363 - DNA, 20 bp, Artificial Sequence
  sgRNA
  Olfr1356_15
gcttcttggtgaagggacca

SEQ ID NO: 38364 - DNA, 20 bp, Artificial Sequence
  sgRNA
  Olfr1356_16
gcggatattctgcagaacct

SEQ ID NO: 38365 - DNA, 20 bp, Artificial Sequence
  sgRNA
  Olfr1356_17
agccgatgtcagctatggac

SEQ ID NO: 38366 - DNA, 20 bp, Artificial Sequence
  sgRNA
  Olfr1356_18
gttggagaggaataagtaca

SEQ ID NO: 38367 - DNA, 20 bp, Artificial Sequence
  sgRNA
  Olfr1356_19
atgtacctggtcaccatcac

SEQ ID NO: 38368 - DNA, 20 bp, Artificial Sequence
  sgRNA
  Olfr1356_20
gaggaacaaggacatgcaga

SEQ ID NO: 38369 - DNA, 20 bp, Artificial Sequence
  sgRNA
  Olfr1357_1
agctgtctatagtcccaaag

SEQ ID NO: 38370 - DNA, 20 bp, Artificial Sequence
  sgRNA
  Olfr1357_2
tggacaggaacagtccaaag

SEQ ID NO: 38371 - DNA, 20 bp, Artificial Sequence
  sgRNA
  Olfr1357_3
gcaaaaaaagatgtcaacca

SEQ ID NO: 38372 - DNA, 20 bp, Artificial Sequence
  sgRNA
  Olfr1357_4
tctgcgcactactggtgggt

SEQ ID NO: 38373 - DNA, 20 bp, Artificial Sequence
  sgRNA
  Olfr1357_5
aggacatgaaggcagccctg

SEQ ID NO: 38374 - DNA, 20 bp, Artificial Sequence
  sgRNA
  Olfr1357_6
gaagacagtgaccagataca

SEQ ID NO: 38375 - DNA, 20 bp, Artificial Sequence
  sgRNA
  Olfr1357_7
ccatctcatgggactctcag

SEQ ID NO: 38376 - DNA, 20 bp, Artificial Sequence
  sgRNA
  Olfr1357_8
caatggccatcactgccaga

SEQ ID NO: 38377 - DNA, 20 bp, Artificial Sequence
  sgRNA
  Olfr1357_9
tttgctgccaagcttcctca

SEQ ID NO: 38378 - DNA, 20 bp, Artificial Sequence
  sgRNA
  Olfr1357_10
gtagcggagtgggtaggcaa

SEQ ID NO: 38379 - DNA, 20 bp, Artificial Sequence
  sgRNA
  Olfr1357_11
ggctcatgagcactgagtag

SEQ ID NO: 38380 - DNA, 20 bp, Artificial Sequence
  sgRNA
  Olfr1357_12
cagtaaatatccagtaaaga

SEQ ID NO: 38381 - DNA, 20 bp, Artificial Sequence
  sgRNA
  Olfr1357_13
tggcagtgatggccattgac

SEQ ID NO: 38382 - DNA, 20 bp, Artificial Sequence
  sgRNA
  Olfr1357_14
ttgtggctcacacctcactg

SEQ ID NO: 38383 - DNA, 20 bp, Artificial Sequence
  sgRNA
  Olfr1357_15
cagtgaccagatacatggac

SEQ ID NO: 38384 - DNA, 20 bp, Artificial Sequence
  sgRNA
  Olfr1357_16
cagctcctcccagaaagaca

SEQ ID NO: 38385 - DNA, 20 bp, Artificial Sequence
  sgRNA
  Olfr1357_17
acatgtctgcgcactactgg

SEQ ID NO: 38386 - DNA, 20 bp, Artificial Sequence
  sgRNA
  Olfr1357_18
tgagcaggagagtttcagga

SEQ ID NO: 38387 - DNA, 20 bp, Artificial Sequence
  sgRNA
  Olfr1357_19
tccacttgccctgagcagaa

SEQ ID NO: 38388 - DNA, 20 bp, Artificial Sequence
  sgRNA
  Olfr1357_20
gacaagtgtgtaccaaggac

SEQ ID NO: 38389 - DNA, 20 bp, Artificial Sequence
  sgRNA
  Olfr1369-ps1_1
atgattaccaaataatgcaa

SEQ ID NO: 38390 - DNA, 20 bp, Artificial Sequence
  sgRNA
  Olfr1369-ps1_2
atctacctgtacctacaacc

SEQ ID NO: 38391 - DNA, 20 bp, Artificial Sequence
  sgRNA
  Olfr1369-ps1_3
atcatcttgacacatagacg

SEQ ID NO: 38392 - DNA, 20 bp, Artificial Sequence
  sgRNA
  Olfr1369-ps1_4
gtacctacaacccggtaaca

SEQ ID NO: 38393 - DNA, 20 bp, Artificial Sequence
  sgRNA
  Olfr1369-ps1_5
aggatgttatgtccacatcg

SEQ ID NO: 38394 - DNA, 20 bp, Artificial Sequence
  sgRNA
  Olfr1369-ps1_6
catgattaccaaataatgca

SEQ ID NO: 38395 - DNA, 20 bp, Artificial Sequence
  sgRNA
  Olfr1369-ps1_7
ccaggaaagataaattcctg

SEQ ID NO: 38396 - DNA, 20 bp, Artificial Sequence
  sgRNA
  Olfr1369-ps1_8
agtgatgatggtgtaaaaaa

SEQ ID NO: 38397 - DNA, 20 bp, Artificial Sequence
  sgRNA
  Olfr1369-ps1_9
tgatggtgtaaaaaagggtg

SEQ ID NO: 38398 - DNA, 20 bp, Artificial Sequence
  sgRNA
  Olfr1369-ps1_10
tgttaccgggttgtaggtac

SEQ ID NO: 38399 - DNA, 20 bp, Artificial Sequence
  sgRNA
  Olfr1369-ps1_11
atgtgtcaagatgatagtca

SEQ ID NO: 38400 - DNA, 20 bp, Artificial Sequence
  sgRNA
  Olfr1369-ps1_12
catggtcaggatagcttgtg

SEQ ID NO: 38401 - DNA, 20 bp, Artificial Sequence
  sgRNA
  Olfr1369-ps1_13
gataatacttccatagaata

SEQ ID NO: 38402 - DNA, 20 bp, Artificial Sequence
  sgRNA
  Olfr1369-ps1_14
cacacaagctatcctgacca

SEQ ID NO: 38403 - DNA, 20 bp, Artificial Sequence
  sgRNA
  Olfr1369-ps1_15
ttgtaagcccttgcattatt

SEQ ID NO: 38404 - DNA, 20 bp, Artificial Sequence
  sgRNA
  Olfr1369-ps1_16
aggccctgttaccgggttgt

SEQ ID NO: 38405 - DNA, 20 bp, Artificial Sequence
  sgRNA
  Olfr1369-ps1_17
aaagggtgaggaacttgccc

SEQ ID NO: 38406 - DNA, 20 bp, Artificial Sequence
  sgRNA
  Olfr1369-ps1_18
gagtgatgatggtgtaaaaa

SEQ ID NO: 38407 - DNA, 20 bp, Artificial Sequence
  sgRNA
  Olfr1369-ps1_19
accacagatttgccaaaata

SEQ ID NO: 38408 - DNA, 20 bp, Artificial Sequence
  sgRNA
  Olfr1369-ps1_20
tgtacctacaacccggtaac

SEQ ID NO: 38409 - DNA, 20 bp, Artificial Sequence
  sgRNA
  Olfr137_1
gccagcagttggcaaaaacg

SEQ ID NO: 38410 - DNA, 20 bp, Artificial Sequence
  sgRNA
  Olfr137_2
agaagtggtctactttgcga

SEQ ID NO: 38411 - DNA, 20 bp, Artificial Sequence
  sgRNA
  Olfr137_3
tgcaaatgagatgactctca

SEQ ID NO: 38412 - DNA, 20 bp, Artificial Sequence
  sgRNA
  Olfr137_4
agaggttaaatagcagctgg

SEQ ID NO: 38413 - DNA, 20 bp, Artificial Sequence
  sgRNA
  Olfr137_5
actttgcgatggccacacag

SEQ ID NO: 38414 - DNA, 20 bp, Artificial Sequence
  sgRNA
  Olfr137_6
gctcctatgctgccattgca

SEQ ID NO: 38415 - DNA, 20 bp, Artificial Sequence
  sgRNA
  Olfr137_7
tgagagtcatctcatttgca

SEQ ID NO: 38416 - DNA, 20 bp, Artificial Sequence
  sgRNA
  Olfr137_8
ataagtacagagtaatgcaa

SEQ ID NO: 38417 - DNA, 20 bp, Artificial Sequence
  sgRNA
  Olfr137_9
agtggtaaagccacataccc

SEQ ID NO: 38418 - DNA, 20 bp, Artificial Sequence
  sgRNA
  Olfr137_10
atttcaatgcaagttgggaa

SEQ ID NO: 38419 - DNA, 20 bp, Artificial Sequence
  sgRNA
  Olfr137_11
gaaaactttctgaagtcgag

SEQ ID NO: 38420 - DNA, 20 bp, Artificial Sequence
  sgRNA
  Olfr137_12
ggaggctgagtaggtatgag

SEQ ID NO: 38421 - DNA, 20 bp, Artificial Sequence
  sgRNA
  Olfr137_13
gaggctgagtaggtatgaga

SEQ ID NO: 38422 - DNA, 20 bp, Artificial Sequence
  sgRNA
  Olfr137_14
gttgaggctaggtgtgacaa

SEQ ID NO: 38423 - DNA, 20 bp, Artificial Sequence
  sgRNA
  Olfr137_15
atttgcatggatatcaacac

SEQ ID NO: 38424 - DNA, 20 bp, Artificial Sequence
  sgRNA
  Olfr137_16
ttctacatgatgacactgat

SEQ ID NO: 38425 - DNA, 20 bp, Artificial Sequence
  sgRNA
  Olfr137_17
atgtgagaggggcaataagg

SEQ ID NO: 38426 - DNA, 20 bp, Artificial Sequence
  sgRNA
  Olfr137_18
gtttacacacagctacatag

SEQ ID NO: 38427 - DNA, 20 bp, Artificial Sequence
  sgRNA
  Olfr137_19
tgagaggaagaagtacatag

SEQ ID NO: 38428 - DNA, 20 bp, Artificial Sequence
  sgRNA
  Olfr137_20
ttccaggacagtccatgcaa

SEQ ID NO: 38429 - DNA, 20 bp, Artificial Sequence
  sgRNA
  Olfr1387_1
tggtcctgtcaagtcctcgg

SEQ ID NO: 38430 - DNA, 20 bp, Artificial Sequence
  sgRNA
  Olfr1387_2
tgaactctctgatccaaaca

SEQ ID NO: 38431 - DNA, 20 bp, Artificial Sequence
  sgRNA
  Olfr1387_3
caaaatcaaacattctgtgg

SEQ ID NO: 38432 - DNA, 20 bp, Artificial Sequence
  sgRNA
  Olfr1387_4
tcttgcaagaacaatgatgg

SEQ ID NO: 38433 - DNA, 20 bp, Artificial Sequence
  sgRNA
  Olfr1387_5
agcctagtatcagtactgca

SEQ ID NO: 38434 - DNA, 20 bp, Artificial Sequence
  sgRNA
  Olfr1387_6
tcaacctccgaggacttgac

SEQ ID NO: 38435 - DNA, 20 bp, Artificial Sequence
  sgRNA
  Olfr1387_7
ataatgctggtatagtggag

SEQ ID NO: 38436 - DNA, 20 bp, Artificial Sequence
  sgRNA
  Olfr1387_8
tgatggtcctgtcaagtcct

SEQ ID NO: 38437 - DNA, 20 bp, Artificial Sequence
  sgRNA
  Olfr1387_9
ctgtggaagttgctagggag

SEQ ID NO: 38438 - DNA, 20 bp, Artificial Sequence
  sgRNA
  Olfr1387_10
gatccaaacagggcttgtga

SEQ ID NO: 38439 - DNA, 20 bp, Artificial Sequence
  sgRNA
  Olfr1387_11
agatggccagtgccctgcag

SEQ ID NO: 38440 - DNA, 20 bp, Artificial Sequence
  sgRNA
  Olfr1387_12
tatgaaccccatcctctgca

SEQ ID NO: 38441 - DNA, 20 bp, Artificial Sequence
  sgRNA
  Olfr1387_13
ttgatggccacagagtcgca

SEQ ID NO: 38442 - DNA, 20 bp, Artificial Sequence
  sgRNA
  Olfr1387_14
ttgtgggtcccacctcatgg

SEQ ID NO: 38443 - DNA, 20 bp, Artificial Sequence
  sgRNA
  Olfr1387_15
catagatattctgaaagcaa

SEQ ID NO: 38444 - DNA, 20 bp, Artificial Sequence
  sgRNA
  Olfr1387_16
aaaagagagaaaccaccatg

SEQ ID NO: 38445 - DNA, 20 bp, Artificial Sequence
  sgRNA
  Olfr1387_17
gatgacacacagcagcatag

SEQ ID NO: 38446 - DNA, 20 bp, Artificial Sequence
  sgRNA
  Olfr1387_18
gtgatggccatgcgactctg

SEQ ID NO: 38447 - DNA, 20 bp, Artificial Sequence
  sgRNA
  Olfr1387_19
gggctctgtggaagttgcta

SEQ ID NO: 38448 - DNA, 20 bp, Artificial Sequence
  sgRNA
  Olfr1387_20
gatcaaaggattgaacatgg

SEQ ID NO: 38449 - DNA, 20 bp, Artificial Sequence
  sgRNA
  Olfr1388_1
tacagagtgtgtgctattgg

SEQ ID NO: 38450 - DNA, 20 bp, Artificial Sequence
  sgRNA
  Olfr1388_2
tccccagctgtgtcatacac

SEQ ID NO: 38451 - DNA, 20 bp, Artificial Sequence
  sgRNA
  Olfr1388_3
agagaggcatgaccatcatg

SEQ ID NO: 38452 - DNA, 20 bp, Artificial Sequence
  sgRNA
  Olfr1388_4
tgaggaaacaaaaagaacag

SEQ ID NO: 38453 - DNA, 20 bp, Artificial Sequence
  sgRNA
  Olfr1388_5
aacccaggataagtgccgca

SEQ ID NO: 38454 - DNA, 20 bp, Artificial Sequence
  sgRNA
  Olfr1388_6
ttcctatgctcatatcacca

SEQ ID NO: 38455 - DNA, 20 bp, Artificial Sequence
  sgRNA
  Olfr1388_7
tgagttgccaaagagagtga

SEQ ID NO: 38456 - DNA, 20 bp, Artificial Sequence
  sgRNA
  Olfr1388_8
acacagctggggatgcataa

SEQ ID NO: 38457 - DNA, 20 bp, Artificial Sequence
  sgRNA
  Olfr1388_9
gtgaactctctgactcagac

SEQ ID NO: 38458 - DNA, 20 bp, Artificial Sequence
  sgRNA
  Olfr1388_10
ttcctcagcgtataaatcag

SEQ ID NO: 38459 - DNA, 20 bp, Artificial Sequence
  sgRNA
  Olfr1388_11
gttcctatgctcatatcacc

SEQ ID NO: 38460 - DNA, 20 bp, Artificial Sequence
  sgRNA
  Olfr1388_12
gagggagtagaaaattgaaa

SEQ ID NO: 38461 - DNA, 20 bp, Artificial Sequence
  sgRNA
  Olfr1388_13
cacacctattctgaaagtga

SEQ ID NO: 38462 - DNA, 20 bp, Artificial Sequence
  sgRNA
  Olfr1388_14
ttcagtcgatagccacagag

SEQ ID NO: 38463 - DNA, 20 bp, Artificial Sequence
  sgRNA
  Olfr1388_15
ctatgctcatatcaccaggg

SEQ ID NO: 38464 - DNA, 20 bp, Artificial Sequence
  sgRNA
  Olfr1388_16
gcacacactctgtagatgcc

SEQ ID NO: 38465 - DNA, 20 bp, Artificial Sequence
  sgRNA
  Olfr1388_17
gatgcccatattcctcaagt

SEQ ID NO: 38466 - DNA, 20 bp, Artificial Sequence
  sgRNA
  Olfr1388_18
tttcctcacaggccaacttg

SEQ ID NO: 38467 - DNA, 20 bp, Artificial Sequence
  sgRNA
  Olfr1388_19
gggctctgtggaaagtgcta

SEQ ID NO: 38468 - DNA, 20 bp, Artificial Sequence
  sgRNA
  Olfr1388_20
gccagtgtatgacacagctg

SEQ ID NO: 38469 - DNA, 20 bp, Artificial Sequence
  sgRNA
  Olfr1389_1
tggtcctatccaacccacag

SEQ ID NO: 38470 - DNA, 20 bp, Artificial Sequence
  sgRNA
  Olfr1389_2
tgaagacactaatggaacgg

SEQ ID NO: 38471 - DNA, 20 bp, Artificial Sequence
  sgRNA
  Olfr1389_3
agaagaagtgattcagccga

SEQ ID NO: 38472 - DNA, 20 bp, Artificial Sequence
  sgRNA
  Olfr1389_4
aagaggaaaacttccagttg

SEQ ID NO: 38473 - DNA, 20 bp, Artificial Sequence
  sgRNA
  Olfr1389_5
ttcagccgatggctacagag

SEQ ID NO: 38474 - DNA, 20 bp, Artificial Sequence
  sgRNA
  Olfr1389_6
ccatgcccctctgtagccat

SEQ ID NO: 38475 - DNA, 20 bp, Artificial Sequence
  sgRNA
  Olfr1389_7
gattcagccgatggctacag

SEQ ID NO: 38476 - DNA, 20 bp, Artificial Sequence
  sgRNA
  Olfr1389_8
cacagatattcagagaacga

SEQ ID NO: 38477 - DNA, 20 bp, Artificial Sequence
  sgRNA
  Olfr1389_9
gggaaaggcttcatattagt

SEQ ID NO: 38478 - DNA, 20 bp, Artificial Sequence
  sgRNA
  Olfr1389_10
acacagctgagggtgcataa

SEQ ID NO: 38479 - DNA, 20 bp, Artificial Sequence
  sgRNA
  Olfr1389_11
gataggaccatcagctatgg

SEQ ID NO: 38480 - DNA, 20 bp, Artificial Sequence
  sgRNA
  Olfr1389_12
cagaggttaatgagaagctg

SEQ ID NO: 38481 - DNA, 20 bp, Artificial Sequence
  sgRNA
  Olfr1389_13
ccagtccctgacacagctga

SEQ ID NO: 38482 - DNA, 20 bp, Artificial Sequence
  sgRNA
  Olfr1389_14
ttgtgggtcccacctcattg

SEQ ID NO: 38483 - DNA, 20 bp, Artificial Sequence
  sgRNA
  Olfr1389_15
gtgaactctgtgattcagac

SEQ ID NO: 38484 - DNA, 20 bp, Artificial Sequence
  sgRNA
  Olfr1389_16
attcagccgatggctacaga

SEQ ID NO: 38485 - DNA, 20 bp, Artificial Sequence
  sgRNA
  Olfr1389_17
ttaacctctgtgggttggat

SEQ ID NO: 38486 - DNA, 20 bp, Artificial Sequence
  sgRNA
  Olfr1389_18
gggactggccatctcctcct

SEQ ID NO: 38487 - DNA, 20 bp, Artificial Sequence
  sgRNA
  Olfr1389_19
gggctctgtggaaagtactt

SEQ ID NO: 38488 - DNA, 20 bp, Artificial Sequence
  sgRNA
  Olfr1389_20
ttgtgaagacactaatggaa

SEQ ID NO: 38489 - DNA, 20 bp, Artificial Sequence
  sgRNA
  Olfr1404_1
catgcgtggtataatagtca

SEQ ID NO: 38490 - DNA, 20 bp, Artificial Sequence
  sgRNA
  Olfr1404_2
tgatgactgaataccttagg

SEQ ID NO: 38491 - DNA, 20 bp, Artificial Sequence
  sgRNA
  Olfr1404_3
actgggaattggcctaggca

SEQ ID NO: 38492 - DNA, 20 bp, Artificial Sequence
  sgRNA
  Olfr1404_4
tattgtgagtattattcacc

SEQ ID NO: 38493 - DNA, 20 bp, Artificial Sequence
  sgRNA
  Olfr1404_5
tcttattctaccaatgggcg

SEQ ID NO: 38494 - DNA, 20 bp, Artificial Sequence
  sgRNA
  Olfr1404_6
atacactctgcggaataagg

SEQ ID NO: 38495 - DNA, 20 bp, Artificial Sequence
  sgRNA
  Olfr1404_7
gagatgaagaccacgcccat

SEQ ID NO: 38496 - DNA, 20 bp, Artificial Sequence
  sgRNA
  Olfr1404_8
aggaggtcagaaagcatgcg

SEQ ID NO: 38497 - DNA, 20 bp, Artificial Sequence
  sgRNA
  Olfr1404_9
ataccaaaggattcagtaga

SEQ ID NO: 38498 - DNA, 20 bp, Artificial Sequence
  sgRNA
  Olfr1404_10
agtctcgaaaagcaatcgtg

SEQ ID NO: 38499 - DNA, 20 bp, Artificial Sequence
  sgRNA
  Olfr1404_11
gtaacagagttcctgtttga

SEQ ID NO: 38500 - DNA, 20 bp, Artificial Sequence
  sgRNA
  Olfr1404_12
ataacaaatctatcacagaa

SEQ ID NO: 38501 - DNA, 20 bp, Artificial Sequence
  sgRNA
  Olfr1404_13
ctaagtcccagagcttgctg

SEQ ID NO: 38502 - DNA, 20 bp, Artificial Sequence
  sgRNA
  Olfr1404_14
catgatgactgaatacctta

SEQ ID NO: 38503 - DNA, 20 bp, Artificial Sequence
  sgRNA
  Olfr1404_15
cttggactatagccatgcct

SEQ ID NO: 38504 - DNA, 20 bp, Artificial Sequence
  sgRNA
  Olfr1404_16
acagtggtcatcatccacta

SEQ ID NO: 38505 - DNA, 20 bp, Artificial Sequence
  sgRNA
  Olfr1404_17
ttccgcagagtgtataccaa

SEQ ID NO: 38506 - DNA, 20 bp, Artificial Sequence
  sgRNA
  Olfr1404_18
ctaaggtattcagtcatcat

SEQ ID NO: 38507 - DNA, 20 bp, Artificial Sequence
  sgRNA
  Olfr1404_19
atgccctacgcagagccatg

SEQ ID NO: 38508 - DNA, 20 bp, Artificial Sequence
  sgRNA
  Olfr1404_20
gggtcactgggaattggcct

SEQ ID NO: 38509 - DNA, 20 bp, Artificial Sequence
  sgRNA
  Olfr141_1
aaagcctactagcatatttg

SEQ ID NO: 38510 - DNA, 20 bp, Artificial Sequence
  sgRNA
  Olfr141_2
ataagtggtatatagactcg

SEQ ID NO: 38511 - DNA, 20 bp, Artificial Sequence
  sgRNA
  Olfr141_3
caggaaatagcaagaagagg

SEQ ID NO: 38512 - DNA, 20 bp, Artificial Sequence
  sgRNA
  Olfr141_4
ggtcatgaatggctacatat

SEQ ID NO: 38513 - DNA, 20 bp, Artificial Sequence
  sgRNA
  Olfr141_5
gcataggatgcaatgataag

SEQ ID NO: 38514 - DNA, 20 bp, Artificial Sequence
  sgRNA
  Olfr141_6
ctttcagcctgtctttctgt

SEQ ID NO: 38515 - DNA, 20 bp, Artificial Sequence
  sgRNA
  Olfr141_7
atacagaagtgggtcatgaa

SEQ ID NO: 38516 - DNA, 20 bp, Artificial Sequence
  sgRNA
  Olfr141_8
gagcaggaaatagcaagaag

SEQ ID NO: 38517 - DNA, 20 bp, Artificial Sequence
  sgRNA
  Olfr141_9
cactatcatgtcatgctcca

SEQ ID NO: 38518 - DNA, 20 bp, Artificial Sequence
  sgRNA
  Olfr141_10
tcatcttcagaattgacaac

SEQ ID NO: 38519 - DNA, 20 bp, Artificial Sequence
  sgRNA
  Olfr141_11
ggagaccaggacaatcagaa

SEQ ID NO: 38520 - DNA, 20 bp, Artificial Sequence
  sgRNA
  Olfr141_12
tgaagatgaattcatctgaa

SEQ ID NO: 38521 - DNA, 20 bp, Artificial Sequence
  sgRNA
  Olfr141_13
ggtgatatctgtagaataac

SEQ ID NO: 38522 - DNA, 20 bp, Artificial Sequence
  sgRNA
  Olfr141_14
cattggaccgacagaaagac

SEQ ID NO: 38523 - DNA, 20 bp, Artificial Sequence
  sgRNA
  Olfr141_15
atcattgcatcctatgctgg

SEQ ID NO: 38524 - DNA, 20 bp, Artificial Sequence
  sgRNA
  Olfr141_16
tgctcactgcatacagaagt

SEQ ID NO: 38525 - DNA, 20 bp, Artificial Sequence
  sgRNA
  Olfr141_17
acactgagaaaacagtacat

SEQ ID NO: 38526 - DNA, 20 bp, Artificial Sequence
  sgRNA
  Olfr141_18
atcaccccaaatatgctagt

SEQ ID NO: 38527 - DNA, 20 bp, Artificial Sequence
  sgRNA
  Olfr141_19
tttactctgataggaaatgt

SEQ ID NO: 38528 - DNA, 20 bp, Artificial Sequence
  sgRNA
  Olfr141_20
cactgagaaaacagtacata

SEQ ID NO: 38529 - DNA, 20 bp, Artificial Sequence
  sgRNA
  Olfr1414_1
ctgcactgacttctctactg

SEQ ID NO: 38530 - DNA, 20 bp, Artificial Sequence
  sgRNA
  Olfr1414_2
acaaacataccagatctcca

SEQ ID NO: 38531 - DNA, 20 bp, Artificial Sequence
  sgRNA
  Olfr1414_3
agatgcgtttcctctgcagg

SEQ ID NO: 38532 - DNA, 20 bp, Artificial Sequence
  sgRNA
  Olfr1414_4
aagctggacacagagccctg

SEQ ID NO: 38533 - DNA, 20 bp, Artificial Sequence
  sgRNA
  Olfr1414_5
aacataccagatctccaagg

SEQ ID NO: 38534 - DNA, 20 bp, Artificial Sequence
  sgRNA
  Olfr1414_6
gtggccataggagagaacgg

SEQ ID NO: 38535 - DNA, 20 bp, Artificial Sequence
  sgRNA
  Olfr1414_7
gtagatcaaggggttcaaga

SEQ ID NO: 38536 - DNA, 20 bp, Artificial Sequence
  sgRNA
  Olfr1414_8
ggaagccgtccagcatctta

SEQ ID NO: 38537 - DNA, 20 bp, Artificial Sequence
  sgRNA
  Olfr1414_9
tggacggcttcctcctgcag

SEQ ID NO: 38538 - DNA, 20 bp, Artificial Sequence
  sgRNA
  Olfr1414_10
catctccccgatcctcaagc

SEQ ID NO: 38539 - DNA, 20 bp, Artificial Sequence
  sgRNA
  Olfr1414_11
atttaaagatgccttaagaa

SEQ ID NO: 38540 - DNA, 20 bp, Artificial Sequence
  sgRNA
  Olfr1414_12
gggagcttgacccaagccca

SEQ ID NO: 38541 - DNA, 20 bp, Artificial Sequence
  sgRNA
  Olfr1414_13
gatgcccaggaagtagtaca

SEQ ID NO: 38542 - DNA, 20 bp, Artificial Sequence
  sgRNA
  Olfr1414_14
gatgccttaagaaaggcctt

SEQ ID NO: 38543 - DNA, 20 bp, Artificial Sequence
  sgRNA
  Olfr1414_15
atcatccctaagatgctgga

SEQ ID NO: 38544 - DNA, 20 bp, Artificial Sequence
  sgRNA
  Olfr1414_16
gttggagctccgggtatcga

SEQ ID NO: 38545 - DNA, 20 bp, Artificial Sequence
  sgRNA
  Olfr1414_17
tcctcaggcagtagatcaag

SEQ ID NO: 38546 - DNA, 20 bp, Artificial Sequence
  sgRNA
  Olfr1414_18
gagcaaagctgtgtagaaaa

SEQ ID NO: 38547 - DNA, 20 bp, Artificial Sequence
  sgRNA
  Olfr1414_19
cctgggcatcatgtccacct

SEQ ID NO: 38548 - DNA, 20 bp, Artificial Sequence
  sgRNA
  Olfr1414_20
gcaggccagcttgaggatcg

SEQ ID NO: 38549 - DNA, 20 bp, Artificial Sequence
  sgRNA
  Olfr1415_1
cttaatcacagagactgtga

SEQ ID NO: 38550 - DNA, 20 bp, Artificial Sequence
  sgRNA
  Olfr1415_2
gtacatgggtctgtgcaggg

SEQ ID NO: 38551 - DNA, 20 bp, Artificial Sequence
  sgRNA
  Olfr1415_3
tacacactctgtacacacca

SEQ ID NO: 38552 - DNA, 20 bp, Artificial Sequence
  sgRNA
  Olfr1415_4
tggatggcttcctcttgcag

SEQ ID NO: 38553 - DNA, 20 bp, Artificial Sequence
  sgRNA
  Olfr1415_5
ctaggaaagacaaggaaccc

SEQ ID NO: 38554 - DNA, 20 bp, Artificial Sequence
  sgRNA
  Olfr1415_6
gatgctgtgaaaaggaccct

SEQ ID NO: 38555 - DNA, 20 bp, Artificial Sequence
  sgRNA
  Olfr1415_7
gtagccataggaaagaatgg

SEQ ID NO: 38556 - DNA, 20 bp, Artificial Sequence
  sgRNA
  Olfr1415_8
gatgtagccataggaaagaa

SEQ ID NO: 38557 - DNA, 20 bp, Artificial Sequence
  sgRNA
  Olfr1415_9
ggaaccacagaaggtggcac

SEQ ID NO: 38558 - DNA, 20 bp, Artificial Sequence
  sgRNA
  Olfr1415_10
ggatgctgtgaaaaggaccc

SEQ ID NO: 38559 - DNA, 20 bp, Artificial Sequence
  sgRNA
  Olfr1415_11
tctcacatatataaaaagca

SEQ ID NO: 38560 - DNA, 20 bp, Artificial Sequence
  sgRNA
  Olfr1415_12
ttcctatggctacatcaccc

SEQ ID NO: 38561 - DNA, 20 bp, Artificial Sequence
  sgRNA
  Olfr1415_13
tgtggtcaccttcttctatg

SEQ ID NO: 38562 - DNA, 20 bp, Artificial Sequence
  sgRNA
  Olfr1415_14
gtagtacatgggtctgtgca

SEQ ID NO: 38563 - DNA, 20 bp, Artificial Sequence
  sgRNA
  Olfr1415_15
tccttaggcaataaatcaag

SEQ ID NO: 38564 - DNA, 20 bp, Artificial Sequence
  sgRNA
  Olfr1415_16
aggaaacgcatctctttcac

SEQ ID NO: 38565 - DNA, 20 bp, Artificial Sequence
  sgRNA
  Olfr1415_17
aagcatggccacatagaaga

SEQ ID NO: 38566 - DNA, 20 bp, Artificial Sequence
  sgRNA
  Olfr1415_18
aagctggacacatagccctg

SEQ ID NO: 38567 - DNA, 20 bp, Artificial Sequence
  sgRNA
  Olfr1415_19
ataaatcaaggggtttaaga

SEQ ID NO: 38568 - DNA, 20 bp, Artificial Sequence
  sgRNA
  Olfr1415_20
gaaggcacttgcaaaagaga

SEQ ID NO: 38569 - DNA, 20 bp, Artificial Sequence
  sgRNA
  Olfr1416_1
tacacactctgtacatacca

SEQ ID NO: 38570 - DNA, 20 bp, Artificial Sequence
  sgRNA
  Olfr1416_2
aagctggacacacagccctg

SEQ ID NO: 38571 - DNA, 20 bp, Artificial Sequence
  sgRNA
  Olfr1416_3
gtagaccttaatcacagaga

SEQ ID NO: 38572 - DNA, 20 bp, Artificial Sequence
  sgRNA
  Olfr1416_4
ctaggaaagacaaggatccc

SEQ ID NO: 38573 - DNA, 20 bp, Artificial Sequence
  sgRNA
  Olfr1416_5
attcatcatgggcgtgagga

SEQ ID NO: 38574 - DNA, 20 bp, Artificial Sequence
  sgRNA
  Olfr1416_6
ggatcccaggaagtagtaca

SEQ ID NO: 38575 - DNA, 20 bp, Artificial Sequence
  sgRNA
  Olfr1416_7
ggatgctgtgagaagaactt

SEQ ID NO: 38576 - DNA, 20 bp, Artificial Sequence
  sgRNA
  Olfr1416_8
gtacacactctgtacatacc

SEQ ID NO: 38577 - DNA, 20 bp, Artificial Sequence
  sgRNA
  Olfr1416_9
tgtggtcaccttcttctaca

SEQ ID NO: 38578 - DNA, 20 bp, Artificial Sequence
  sgRNA
  Olfr1416_10
gatcccaggaagtagtacat

SEQ ID NO: 38579 - DNA, 20 bp, Artificial Sequence
  sgRNA
  Olfr1416_11
cttcatgtatgtgcgacccc

SEQ ID NO: 38580 - DNA, 20 bp, Artificial Sequence
  sgRNA
  Olfr1416_12
ggagccacagaaggtggcgc

SEQ ID NO: 38581 - DNA, 20 bp, Artificial Sequence
  sgRNA
  Olfr1416_13
gatgctgtgagaagaacttt

SEQ ID NO: 38582 - DNA, 20 bp, Artificial Sequence
  sgRNA
  Olfr1416_14
gtggccataggagagaatgg

SEQ ID NO: 38583 - DNA, 20 bp, Artificial Sequence
  sgRNA
  Olfr1416_15
ctgtgcttcccacctcactg

SEQ ID NO: 38584 - DNA, 20 bp, Artificial Sequence
  sgRNA
  Olfr1416_16
tagatcaaaggattcatcat

SEQ ID NO: 38585 - DNA, 20 bp, Artificial Sequence
  sgRNA
  Olfr1416_17
gatcatggccatgtagaaga

SEQ ID NO: 38586 - DNA, 20 bp, Artificial Sequence
  sgRNA
  Olfr1416_18
ttcctcagacagtagatcaa

SEQ ID NO: 38587 - DNA, 20 bp, Artificial Sequence
  sgRNA
  Olfr1416_19
tgtgagaagaactttgggat

SEQ ID NO: 38588 - DNA, 20 bp, Artificial Sequence
  sgRNA
  Olfr1416_20
gtagatcaaaggattcatca

SEQ ID NO: 38589 - DNA, 20 bp, Artificial Sequence
  sgRNA
  Olfr142_1
tcaagtgtgtcacatgctgg

SEQ ID NO: 38590 - DNA, 20 bp, Artificial Sequence
  sgRNA
  Olfr142_2
gaacttagggacaattgtag

SEQ ID NO: 38591 - DNA, 20 bp, Artificial Sequence
  sgRNA
  Olfr142_3
gcactgacacctttatggag

SEQ ID NO: 38592 - DNA, 20 bp, Artificial Sequence
  sgRNA
  Olfr142_4
gggcaacagtcttattcttg

SEQ ID NO: 38593 - DNA, 20 bp, Artificial Sequence
  sgRNA
  Olfr142_5
tttattgtgatggccaacag

SEQ ID NO: 38594 - DNA, 20 bp, Artificial Sequence
  sgRNA
  Olfr142_6
ctgcactgacacctttatgg

SEQ ID NO: 38595 - DNA, 20 bp, Artificial Sequence
  sgRNA
  Olfr142_7
gttgcaggtcacagaagtag

SEQ ID NO: 38596 - DNA, 20 bp, Artificial Sequence
  sgRNA
  Olfr142_8
cttatcttcagtgaaggtgg

SEQ ID NO: 38597 - DNA, 20 bp, Artificial Sequence
  sgRNA
  Olfr142_9
ggaagcgttctgcagagggg

SEQ ID NO: 38598 - DNA, 20 bp, Artificial Sequence
  sgRNA
  Olfr142_10
gacaatggggttcagcatag

SEQ ID NO: 38599 - DNA, 20 bp, Artificial Sequence
  sgRNA
  Olfr142_11
atgcaccaggcacaaagaac

SEQ ID NO: 38600 - DNA, 20 bp, Artificial Sequence
  sgRNA
  Olfr142_12
acgaatgtcctggaagcaaa

SEQ ID NO: 38601 - DNA, 20 bp, Artificial Sequence
  sgRNA
  Olfr142_13
aaaatgctatacgaatgtcc

SEQ ID NO: 38602 - DNA, 20 bp, Artificial Sequence
  sgRNA
  Olfr142_14
tcttcagtgaaggtggagga

SEQ ID NO: 38603 - DNA, 20 bp, Artificial Sequence
  sgRNA
  Olfr142_15
aagcttatcttcagtgaagg

SEQ ID NO: 38604 - DNA, 20 bp, Artificial Sequence
  sgRNA
  Olfr142_16
gtcatcctgttctttgtgcc

SEQ ID NO: 38605 - DNA, 20 bp, Artificial Sequence
  sgRNA
  Olfr142_17
cagacagcccttcagagaga

SEQ ID NO: 38606 - DNA, 20 bp, Artificial Sequence
  sgRNA
  Olfr142_18
cacaagcttatcttcagtga

SEQ ID NO: 38607 - DNA, 20 bp, Artificial Sequence
  sgRNA
  Olfr142_19
tatagtctctctcttcatct

SEQ ID NO: 38608 - DNA, 20 bp, Artificial Sequence
  sgRNA
  Olfr142_20
ttcaacaacaccaaagaaat

SEQ ID NO: 38609 - DNA, 20 bp, Artificial Sequence
  sgRNA
  Olfr1420_1
aatgaagctgatgatataca

SEQ ID NO: 38610 - DNA, 20 bp, Artificial Sequence
  sgRNA
  Olfr1420_2
catagaaagaaggtttgcca

SEQ ID NO: 38611 - DNA, 20 bp, Artificial Sequence
  sgRNA
  Olfr1420_3
tggaagattaaaatagttag

SEQ ID NO: 38612 - DNA, 20 bp, Artificial Sequence
  sgRNA
  Olfr1420_4
atggacaatcacagcaattg

SEQ ID NO: 38613 - DNA, 20 bp, Artificial Sequence
  sgRNA
  Olfr1420_5
gtagtggtcctcctacagta

SEQ ID NO: 38614 - DNA, 20 bp, Artificial Sequence
  sgRNA
  Olfr1420_6
ttgcagtcatggcttacgac

SEQ ID NO: 38615 - DNA, 20 bp, Artificial Sequence
  sgRNA
  Olfr1420_7
ctgctcctctcacatcgtag

SEQ ID NO: 38616 - DNA, 20 bp, Artificial Sequence
  sgRNA
  Olfr1420_8
ggtagcagatcgcaacaaac

SEQ ID NO: 38617 - DNA, 20 bp, Artificial Sequence
  sgRNA
  Olfr1420_9
aaatcaccatctgcacccca

SEQ ID NO: 38618 - DNA, 20 bp, Artificial Sequence
  sgRNA
  Olfr1420_10
ggtcaggtacatcaccaaga

SEQ ID NO: 38619 - DNA, 20 bp, Artificial Sequence
  sgRNA
  Olfr1420_11
acgaaagaagaattgtacct

SEQ ID NO: 38620 - DNA, 20 bp, Artificial Sequence
  sgRNA
  Olfr1420_12
agatagagatcagagttagg

SEQ ID NO: 38621 - DNA, 20 bp, Artificial Sequence
  sgRNA
  Olfr1420_13
tacggatccggtctgctgaa

SEQ ID NO: 38622 - DNA, 20 bp, Artificial Sequence
  sgRNA
  Olfr1420_14
ttacggatccggtctgctga

SEQ ID NO: 38623 - DNA, 20 bp, Artificial Sequence
  sgRNA
  Olfr1420_15
tccattctcacctgaccctg

SEQ ID NO: 38624 - DNA, 20 bp, Artificial Sequence
  sgRNA
  Olfr1420_16
tggcaaaccttctttctatg

SEQ ID NO: 38625 - DNA, 20 bp, Artificial Sequence
  sgRNA
  Olfr1420_17
ttgtgtgtagagatgatggt

SEQ ID NO: 38626 - DNA, 20 bp, Artificial Sequence
  sgRNA
  Olfr1420_18
cagcaggaatcccagcacca

SEQ ID NO: 38627 - DNA, 20 bp, Artificial Sequence
  sgRNA
  Olfr1420_19
cgtaagccatgactgcaagc

SEQ ID NO: 38628 - DNA, 20 bp, Artificial Sequence
  sgRNA
  Olfr1420_20
tgatgagtgtgtatctcaga

SEQ ID NO: 38629 - DNA, 20 bp, Artificial Sequence
  sgRNA
  Olfr1423_1
aaggtccaccaagacctttg

SEQ ID NO: 38630 - DNA, 20 bp, Artificial Sequence
  sgRNA
  Olfr1423_2
gcggtgcacagccctcatcg

SEQ ID NO: 38631 - DNA, 20 bp, Artificial Sequence
  sgRNA
  Olfr1423_3
caggcaagtttgagaacctg

SEQ ID NO: 38632 - DNA, 20 bp, Artificial Sequence
  sgRNA
  Olfr1423_4
acaaaacaagacataagacc

SEQ ID NO: 38633 - DNA, 20 bp, Artificial Sequence
  sgRNA
  Olfr1423_5
tgaccatcatgagtagtaag

SEQ ID NO: 38634 - DNA, 20 bp, Artificial Sequence
  sgRNA
  Olfr1423_6
gggagatctgcacaatcgag

SEQ ID NO: 38635 - DNA, 20 bp, Artificial Sequence
  sgRNA
  Olfr1423_7
gatgcagggtacaaaatgca

SEQ ID NO: 38636 - DNA, 20 bp, Artificial Sequence
  sgRNA
  Olfr1423_8
ggagaagcagatgtctagaa

SEQ ID NO: 38637 - DNA, 20 bp, Artificial Sequence
  sgRNA
  Olfr1423_9
gatgatctcaaacaatggcc

SEQ ID NO: 38638 - DNA, 20 bp, Artificial Sequence
  sgRNA
  Olfr1423_10
atgatgttgaggtctcaggc

SEQ ID NO: 38639 - DNA, 20 bp, Artificial Sequence
  sgRNA
  Olfr1423_11
tgtacgtgacaactctgctt

SEQ ID NO: 38640 - DNA, 20 bp, Artificial Sequence
  sgRNA
  Olfr1423_12
ccagaaggaagataaaccat

SEQ ID NO: 38641 - DNA, 20 bp, Artificial Sequence
  sgRNA
  Olfr1423_13
tgaccatgtaggacaccaga

SEQ ID NO: 38642 - DNA, 20 bp, Artificial Sequence
  sgRNA
  Olfr1423_14
cagaaggaagataaaccata

SEQ ID NO: 38643 - DNA, 20 bp, Artificial Sequence
  sgRNA
  Olfr1423_15
catcaggagctcaagaacaa

SEQ ID NO: 38644 - DNA, 20 bp, Artificial Sequence
  sgRNA
  Olfr1423_16
agcagatgtctagaacggca

SEQ ID NO: 38645 - DNA, 20 bp, Artificial Sequence
  sgRNA
  Olfr1423_17
atggcctggtcactacccta

SEQ ID NO: 38646 - DNA, 20 bp, Artificial Sequence
  sgRNA
  Olfr1423_18
gcaccgcttactactcatga

SEQ ID NO: 38647 - DNA, 20 bp, Artificial Sequence
  sgRNA
  Olfr1423_19
gaaggtccaccaagaccttt

SEQ ID NO: 38648 - DNA, 20 bp, Artificial Sequence
  sgRNA
  Olfr1423_20
tgtctgctccaccaagcaga

SEQ ID NO: 38649 - DNA, 20 bp, Artificial Sequence
  sgRNA
  Olfr1424_1
gatggctctagatcgatacg

SEQ ID NO: 38650 - DNA, 20 bp, Artificial Sequence
  sgRNA
  Olfr1424_2
aagatccacaagaaccttgg

SEQ ID NO: 38651 - DNA, 20 bp, Artificial Sequence
  sgRNA
  Olfr1424_3
gcaagcaagtttgatgacct

SEQ ID NO: 38652 - DNA, 20 bp, Artificial Sequence
  sgRNA
  Olfr1424_4
gcagagttgtcacatacacc

SEQ ID NO: 38653 - DNA, 20 bp, Artificial Sequence
  sgRNA
  Olfr1424_5
ttgcaccacccacatcactg

SEQ ID NO: 38654 - DNA, 20 bp, Artificial Sequence
  sgRNA
  Olfr1424_6
ggtaagatccacaagaacct

SEQ ID NO: 38655 - DNA, 20 bp, Artificial Sequence
  sgRNA
  Olfr1424_7
tctggcatagacataaatgc

SEQ ID NO: 38656 - DNA, 20 bp, Artificial Sequence
  sgRNA
  Olfr1424_8
gctgactttgggtaaggcca

SEQ ID NO: 38657 - DNA, 20 bp, Artificial Sequence
  sgRNA
  Olfr1424_9
aatgcaggggacaaaatgca

SEQ ID NO: 38658 - DNA, 20 bp, Artificial Sequence
  sgRNA
  Olfr1424_10
tggcatagacataaatgcag

SEQ ID NO: 38659 - DNA, 20 bp, Artificial Sequence
  sgRNA
  Olfr1424_11
ttacttgctgactttgggta

SEQ ID NO: 38660 - DNA, 20 bp, Artificial Sequence
  sgRNA
  Olfr1424_12
gtaagatccacaagaacctt

SEQ ID NO: 38661 - DNA, 20 bp, Artificial Sequence
  sgRNA
  Olfr1424_13
ctggcatagacataaatgca

SEQ ID NO: 38662 - DNA, 20 bp, Artificial Sequence
  sgRNA
  Olfr1424_14
cagagatgactttatctgtg

SEQ ID NO: 38663 - DNA, 20 bp, Artificial Sequence
  sgRNA
  Olfr1424_15
ttcctcagagtgtagatcaa

SEQ ID NO: 38664 - DNA, 20 bp, Artificial Sequence
  sgRNA
  Olfr1424_16
agtgatgtgggtggtgcaag

SEQ ID NO: 38665 - DNA, 20 bp, Artificial Sequence
  sgRNA
  Olfr1424_17
gatgactttatctgtgggga

SEQ ID NO: 38666 - DNA, 20 bp, Artificial Sequence
  sgRNA
  Olfr1424_18
acagagatgactttatctgt

SEQ ID NO: 38667 - DNA, 20 bp, Artificial Sequence
  sgRNA
  Olfr1424_19
taagatccacaagaaccttg

SEQ ID NO: 38668 - DNA, 20 bp, Artificial Sequence
  sgRNA
  Olfr1424_20
aagcaagtttgatgacctgg

SEQ ID NO: 38669 - DNA, 20 bp, Artificial Sequence
  sgRNA
  Olfr1425_1
aaggtccaccagaaccttgg

SEQ ID NO: 38670 - DNA, 20 bp, Artificial Sequence
  sgRNA
  Olfr1425_2
ccactattaacccaatgcaa

SEQ ID NO: 38671 - DNA, 20 bp, Artificial Sequence
  sgRNA
  Olfr1425_3
gatggctctagatcgatatg

SEQ ID NO: 38672 - DNA, 20 bp, Artificial Sequence
  sgRNA
  Olfr1425_4
ccaaagtcaagaagtgagca

SEQ ID NO: 38673 - DNA, 20 bp, Artificial Sequence
  sgRNA
  Olfr1425_5
gcagggtgatcacagtgatg

SEQ ID NO: 38674 - DNA, 20 bp, Artificial Sequence
  sgRNA
  Olfr1425_6
ggtgatcacagtgatgtggg

SEQ ID NO: 38675 - DNA, 20 bp, Artificial Sequence
  sgRNA
  Olfr1425_7
ttccttagagtgtagatcaa

SEQ ID NO: 38676 - DNA, 20 bp, Artificial Sequence
  sgRNA
  Olfr1425_8
gatcaaggggttcaacagag

SEQ ID NO: 38677 - DNA, 20 bp, Artificial Sequence
  sgRNA
  Olfr1425_9
gaaggtccaccagaaccttg

SEQ ID NO: 38678 - DNA, 20 bp, Artificial Sequence
  sgRNA
  Olfr1425_10
agatcaaggggttcaacaga

SEQ ID NO: 38679 - DNA, 20 bp, Artificial Sequence
  sgRNA
  Olfr1425_11
aaagacttggaccttcttat

SEQ ID NO: 38680 - DNA, 20 bp, Artificial Sequence
  sgRNA
  Olfr1425_12
gagaaggtccaccagaacct

SEQ ID NO: 38681 - DNA, 20 bp, Artificial Sequence
  sgRNA
  Olfr1425_13
tccttagagtgtagatcaag

SEQ ID NO: 38682 - DNA, 20 bp, Artificial Sequence
  sgRNA
  Olfr1425_14
cagaggggagatgactgtaa

SEQ ID NO: 38683 - DNA, 20 bp, Artificial Sequence
  sgRNA
  Olfr1425_15
gatctacactctaaggaacc

SEQ ID NO: 38684 - DNA, 20 bp, Artificial Sequence
  sgRNA
  Olfr1425_16
accccttgatctacactcta

SEQ ID NO: 38685 - DNA, 20 bp, Artificial Sequence
  sgRNA
  Olfr1425_17
cactgcccccaaggttctgg

SEQ ID NO: 38686 - DNA, 20 bp, Artificial Sequence
  sgRNA
  Olfr1425_18
gactgtaaaggtgacagaga

SEQ ID NO: 38687 - DNA, 20 bp, Artificial Sequence
  sgRNA
  Olfr1425_19
agaaggtccaccagaacctt

SEQ ID NO: 38688 - DNA, 20 bp, Artificial Sequence
  sgRNA
  Olfr1425_20
gttccttagagtgtagatca

SEQ ID NO: 38689 - DNA, 20 bp, Artificial Sequence
  sgRNA
  Olfr1426_1
aaggtctaccagaaccttgg

SEQ ID NO: 38690 - DNA, 20 bp, Artificial Sequence
  sgRNA
  Olfr1426_2
atgtgaccatcatgagcaga

SEQ ID NO: 38691 - DNA, 20 bp, Artificial Sequence
  sgRNA
  Olfr1426_3
gatgatttccaataatggcc

SEQ ID NO: 38692 - DNA, 20 bp, Artificial Sequence
  sgRNA
  Olfr1426_4
caggcaagtttgatgacctg

SEQ ID NO: 38693 - DNA, 20 bp, Artificial Sequence
  sgRNA
  Olfr1426_5
caaaccacagagtagcaacc

SEQ ID NO: 38694 - DNA, 20 bp, Artificial Sequence
  sgRNA
  Olfr1426_6
gcttagatctcattcaggag

SEQ ID NO: 38695 - DNA, 20 bp, Artificial Sequence
  sgRNA
  Olfr1426_7
gcaacgccctctgctcatga

SEQ ID NO: 38696 - DNA, 20 bp, Artificial Sequence
  sgRNA
  Olfr1426_8
accccttgatctatacactg

SEQ ID NO: 38697 - DNA, 20 bp, Artificial Sequence
  sgRNA
  Olfr1426_9
gagaaggtctaccagaacct

SEQ ID NO: 38698 - DNA, 20 bp, Artificial Sequence
  sgRNA
  Olfr1426_10
cttagatctcattcaggaga

SEQ ID NO: 38699 - DNA, 20 bp, Artificial Sequence
  sgRNA
  Olfr1426_11
gaaggtctaccagaaccttg

SEQ ID NO: 38700 - DNA, 20 bp, Artificial Sequence
  sgRNA
  Olfr1426_12
ttcctcagtgtatagatcaa

SEQ ID NO: 38701 - DNA, 20 bp, Artificial Sequence
  sgRNA
  Olfr1426_13
tgagcagagggcgttgcatt

SEQ ID NO: 38702 - DNA, 20 bp, Artificial Sequence
  sgRNA
  Olfr1426_14
gcgttgcattgggttaatag

SEQ ID NO: 38703 - DNA, 20 bp, Artificial Sequence
  sgRNA
  Olfr1426_15
tcctcagtgtatagatcaag

SEQ ID NO: 38704 - DNA, 20 bp, Artificial Sequence
  sgRNA
  Olfr1426_16
gatctcattcaggagagggc

SEQ ID NO: 38705 - DNA, 20 bp, Artificial Sequence
  sgRNA
  Olfr1426_17
atgagcagagggcgttgcat

SEQ ID NO: 38706 - DNA, 20 bp, Artificial Sequence
  sgRNA
  Olfr1426_18
agtagcaaccaggccattat

SEQ ID NO: 38707 - DNA, 20 bp, Artificial Sequence
  sgRNA
  Olfr1426_19
gcagtgtgaccacagtgatg

SEQ ID NO: 38708 - DNA, 20 bp, Artificial Sequence
  sgRNA
  Olfr1426_20
atgatgcttagatctcattc

SEQ ID NO: 38709 - DNA, 20 bp, Artificial Sequence
  sgRNA
  Olfr1428_1
tttctgataaaagatccacc

SEQ ID NO: 38710 - DNA, 20 bp, Artificial Sequence
  sgRNA
  Olfr1428_2
gctgggaaacaccctcattg

SEQ ID NO: 38711 - DNA, 20 bp, Artificial Sequence
  sgRNA
  Olfr1428_3
ttactgtgatgtaccccagg

SEQ ID NO: 38712 - DNA, 20 bp, Artificial Sequence
  sgRNA
  Olfr1428_4
atgtaaaccaccacccaccc

SEQ ID NO: 38713 - DNA, 20 bp, Artificial Sequence
  sgRNA
  Olfr1428_5
ggagatcatgagaagttcga

SEQ ID NO: 38714 - DNA, 20 bp, Artificial Sequence
  sgRNA
  Olfr1428_6
tatggctgtgtccatgggca

SEQ ID NO: 38715 - DNA, 20 bp, Artificial Sequence
  sgRNA
  Olfr1428_7
cacagtccccaagttcctgg

SEQ ID NO: 38716 - DNA, 20 bp, Artificial Sequence
  sgRNA
  Olfr1428_8
cctgcaatagatataaacac

SEQ ID NO: 38717 - DNA, 20 bp, Artificial Sequence
  sgRNA
  Olfr1428_9
cataatggttacatagtgca

SEQ ID NO: 38718 - DNA, 20 bp, Artificial Sequence
  sgRNA
  Olfr1428_10
gtgtatgtaacaactgtgct

SEQ ID NO: 38719 - DNA, 20 bp, Artificial Sequence
  sgRNA
  Olfr1428_11
agtgatggtaaccacaatga

SEQ ID NO: 38720 - DNA, 20 bp, Artificial Sequence
  sgRNA
  Olfr1428_12
ctgcaatagatataaacaca

SEQ ID NO: 38721 - DNA, 20 bp, Artificial Sequence
  sgRNA
  Olfr1428_13
gcaggggtttagcaattgca

SEQ ID NO: 38722 - DNA, 20 bp, Artificial Sequence
  sgRNA
  Olfr1428_14
gagcaggaagaaccacaaca

SEQ ID NO: 38723 - DNA, 20 bp, Artificial Sequence
  sgRNA
  Olfr1428_15
catgatgtgagaggtgcagg

SEQ ID NO: 38724 - DNA, 20 bp, Artificial Sequence
  sgRNA
  Olfr1428_16
ccatacctctctcctcataa

SEQ ID NO: 38725 - DNA, 20 bp, Artificial Sequence
  sgRNA
  Olfr1428_17
ttgtggttcttcctgctctt

SEQ ID NO: 38726 - DNA, 20 bp, Artificial Sequence
  sgRNA
  Olfr1428_18
gtaaaaggcatccaaggtgt

SEQ ID NO: 38727 - DNA, 20 bp, Artificial Sequence
  sgRNA
  Olfr1428_19
ctgcacctctcacatcatgg

SEQ ID NO: 38728 - DNA, 20 bp, Artificial Sequence
  sgRNA
  Olfr1428_20
ataatggttacatagtgcag

SEQ ID NO: 38729 - DNA, 20 bp, Artificial Sequence
  sgRNA
  Olfr1434_1
ggtcagtgctgtaatataca

SEQ ID NO: 38730 - DNA, 20 bp, Artificial Sequence
  sgRNA
  Olfr1434_2
ggaaatcggagaatcccagg

SEQ ID NO: 38731 - DNA, 20 bp, Artificial Sequence
  sgRNA
  Olfr1434_3
acattgttaatatgacaagt

SEQ ID NO: 38732 - DNA, 20 bp, Artificial Sequence
  sgRNA
  Olfr1434_4
ctataaaggacagattactg

SEQ ID NO: 38733 - DNA, 20 bp, Artificial Sequence
  sgRNA
  Olfr1434_5
ggacgaggcgatatacccat

SEQ ID NO: 38734 - DNA, 20 bp, Artificial Sequence
  sgRNA
  Olfr1434_6
agtgatcttcatgatggacg

SEQ ID NO: 38735 - DNA, 20 bp, Artificial Sequence
  sgRNA
  Olfr1434_7
agatcacttcagcaaatggt

SEQ ID NO: 38736 - DNA, 20 bp, Artificial Sequence
  sgRNA
  Olfr1434_8
tgctgaagtgatcttcatga

SEQ ID NO: 38737 - DNA, 20 bp, Artificial Sequence
  sgRNA
  Olfr1434_9
atacccataggacaccatga

SEQ ID NO: 38738 - DNA, 20 bp, Artificial Sequence
  sgRNA
  Olfr1434_10
agattcactcagtcccatag

SEQ ID NO: 38739 - DNA, 20 bp, Artificial Sequence
  sgRNA
  Olfr1434_11
ttagccatcatggtgtccta

SEQ ID NO: 38740 - DNA, 20 bp, Artificial Sequence
  sgRNA
  Olfr1434_12
tagccatcatggtgtcctat

SEQ ID NO: 38741 - DNA, 20 bp, Artificial Sequence
  sgRNA
  Olfr1434_13
gatatagcagaagtctataa

SEQ ID NO: 38742 - DNA, 20 bp, Artificial Sequence
  sgRNA
  Olfr1434_14
atgaagatcacttcagcaaa

SEQ ID NO: 38743 - DNA, 20 bp, Artificial Sequence
  sgRNA
  Olfr1434_15
tgcatctgtcttctatagtg

SEQ ID NO: 38744 - DNA, 20 bp, Artificial Sequence
  sgRNA
  Olfr1434_16
gtttctctcttctatagttc

SEQ ID NO: 38745 - DNA, 20 bp, Artificial Sequence
  sgRNA
  Olfr1434_17
tgcaaatctgtcaaagctgg

SEQ ID NO: 38746 - DNA, 20 bp, Artificial Sequence
  sgRNA
  Olfr1434_18
gatcactcaatttatcctcc

SEQ ID NO: 38747 - DNA, 20 bp, Artificial Sequence
  sgRNA
  Olfr1434_19
gtgctgtaatatacagggtg

SEQ ID NO: 38748 - DNA, 20 bp, Artificial Sequence
  sgRNA
  Olfr1434_20
ataggacaccatgatggcta

SEQ ID NO: 38749 - DNA, 20 bp, Artificial Sequence
  sgRNA
  Olfr1436_1
gcaggatagatttaacaact

SEQ ID NO: 38750 - DNA, 20 bp, Artificial Sequence
  sgRNA
  Olfr1436_2
ggaaatcagagaatcctagg

SEQ ID NO: 38751 - DNA, 20 bp, Artificial Sequence
  sgRNA
  Olfr1436_3
catccttattaaaacaacaa

SEQ ID NO: 38752 - DNA, 20 bp, Artificial Sequence
  sgRNA
  Olfr1436_4
agaagttgaaaagcatcttt

SEQ ID NO: 38753 - DNA, 20 bp, Artificial Sequence
  sgRNA
  Olfr1436_5
tgcaggatagatttaacaac

SEQ ID NO: 38754 - DNA, 20 bp, Artificial Sequence
  sgRNA
  Olfr1436_6
actaaaatagacaaaagcag

SEQ ID NO: 38755 - DNA, 20 bp, Artificial Sequence
  sgRNA
  Olfr1436_7
gaagaaatgtctgatgacgt

SEQ ID NO: 38756 - DNA, 20 bp, Artificial Sequence
  sgRNA
  Olfr1436_8
agcagtggaggtgtagaata

SEQ ID NO: 38757 - DNA, 20 bp, Artificial Sequence
  sgRNA
  Olfr1436_9
caggatagatttaacaactg

SEQ ID NO: 38758 - DNA, 20 bp, Artificial Sequence
  sgRNA
  Olfr1436_10
aaaatagacaaaagcagtgg

SEQ ID NO: 38759 - DNA, 20 bp, Artificial Sequence
  sgRNA
  Olfr1436_11
gattactatgttgaaccctt

SEQ ID NO: 38760 - DNA, 20 bp, Artificial Sequence
  sgRNA
  Olfr1436_12
aggcaaactatcagctttgt

SEQ ID NO: 38761 - DNA, 20 bp, Artificial Sequence
  sgRNA
  Olfr1436_13
aagaagttgaaaagcatctt

SEQ ID NO: 38762 - DNA, 20 bp, Artificial Sequence
  sgRNA
  Olfr1436_14
gtgctgtaatatacagtgta

SEQ ID NO: 38763 - DNA, 20 bp, Artificial Sequence
  sgRNA
  Olfr1436_15
agctacacagctggatttat

SEQ ID NO: 38764 - DNA, 20 bp, Artificial Sequence
  sgRNA
  Olfr1436_16
atgctgcagctccacttctg

SEQ ID NO: 38765 - DNA, 20 bp, Artificial Sequence
  sgRNA
  Olfr1436_17
tgacgttgggtccacagaag

SEQ ID NO: 38766 - DNA, 20 bp, Artificial Sequence
  sgRNA
  Olfr1436_18
atttataggttctgtatctc

SEQ ID NO: 38767 - DNA, 20 bp, Artificial Sequence
  sgRNA
  Olfr1436_19
aagcagtggaggtgtagaat

SEQ ID NO: 38768 - DNA, 20 bp, Artificial Sequence
  sgRNA
  Olfr1436_20
aaggcaaactatcagctttg

SEQ ID NO: 38769 - DNA, 20 bp, Artificial Sequence
  sgRNA
  Olfr1437_1
accatctgagcgcaaagtgt

SEQ ID NO: 38770 - DNA, 20 bp, Artificial Sequence
  sgRNA
  Olfr1437_2
tgtatattacaaccctgacc

SEQ ID NO: 38771 - DNA, 20 bp, Artificial Sequence
  sgRNA
  Olfr1437_3
caggatagatttaacagctg

SEQ ID NO: 38772 - DNA, 20 bp, Artificial Sequence
  sgRNA
  Olfr1437_4
agattcactcagtcccattg

SEQ ID NO: 38773 - DNA, 20 bp, Artificial Sequence
  sgRNA
  Olfr1437_5
ctttgcgctcagatggtgat

SEQ ID NO: 38774 - DNA, 20 bp, Artificial Sequence
  sgRNA
  Olfr1437_6
actcaaatatacaaaagcac

SEQ ID NO: 38775 - DNA, 20 bp, Artificial Sequence
  sgRNA
  Olfr1437_7
agctacacagcaggaatcat

SEQ ID NO: 38776 - DNA, 20 bp, Artificial Sequence
  sgRNA
  Olfr1437_8
actttgcgctcagatggtga

SEQ ID NO: 38777 - DNA, 20 bp, Artificial Sequence
  sgRNA
  Olfr1437_9
gattcctatgttgaaccctt

SEQ ID NO: 38778 - DNA, 20 bp, Artificial Sequence
  sgRNA
  Olfr1437_10
tgacgttaggtccacagaag

SEQ ID NO: 38779 - DNA, 20 bp, Artificial Sequence
  sgRNA
  Olfr1437_11
agcactggaggtgtagaata

SEQ ID NO: 38780 - DNA, 20 bp, Artificial Sequence
  sgRNA
  Olfr1437_12
taaaccaaagggttcaacat

SEQ ID NO: 38781 - DNA, 20 bp, Artificial Sequence
  sgRNA
  Olfr1437_13
gggttgtaatatacaggatg

SEQ ID NO: 38782 - DNA, 20 bp, Artificial Sequence
  sgRNA
  Olfr1437_14
aagggacaggttccaggtca

SEQ ID NO: 38783 - DNA, 20 bp, Artificial Sequence
  sgRNA
  Olfr1437_15
gtatatttgagttccagctc

SEQ ID NO: 38784 - DNA, 20 bp, Artificial Sequence
  sgRNA
  Olfr1437_16
caccatctgagcgcaaagtg

SEQ ID NO: 38785 - DNA, 20 bp, Artificial Sequence
  sgRNA
  Olfr1437_17
aatcatgggttctctatctc

SEQ ID NO: 38786 - DNA, 20 bp, Artificial Sequence
  sgRNA
  Olfr1437_18
tactttatgtttgccacaat

SEQ ID NO: 38787 - DNA, 20 bp, Artificial Sequence
  sgRNA
  Olfr1437_19
aggtcagggttgtaatatac

SEQ ID NO: 38788 - DNA, 20 bp, Artificial Sequence
  sgRNA
  Olfr1437_20
acccacactttgcgctcaga

SEQ ID NO: 38789 - DNA, 20 bp, Artificial Sequence
  sgRNA
  Olfr1438-ps1_1
gctgatctgagaatcccagg

SEQ ID NO: 38790 - DNA, 20 bp, Artificial Sequence
  sgRNA
  Olfr1438-ps1_2
ggatcaactcagctaaaggt

SEQ ID NO: 38791 - DNA, 20 bp, Artificial Sequence
  sgRNA
  Olfr1438-ps1_3
aggacattaaaaatgctgtg

SEQ ID NO: 38792 - DNA, 20 bp, Artificial Sequence
  sgRNA
  Olfr1438-ps1_4
tgagcctcatcaccctcatt

SEQ ID NO: 38793 - DNA, 20 bp, Artificial Sequence
  sgRNA
  Olfr1438-ps1_5
tgagagccatgtagagcagt

SEQ ID NO: 38794 - DNA, 20 bp, Artificial Sequence
  sgRNA
  Olfr1438-ps1_6
ttattccctcggacaggaca

SEQ ID NO: 38795 - DNA, 20 bp, Artificial Sequence
  sgRNA
  Olfr1438-ps1_7
cataagagatgaggaccact

SEQ ID NO: 38796 - DNA, 20 bp, Artificial Sequence
  sgRNA
  Olfr1438-ps1_8
tgacatctttaccagccagg

SEQ ID NO: 38797 - DNA, 20 bp, Artificial Sequence
  sgRNA
  Olfr1438-ps1_9
actgctgtgaccctcttcta

SEQ ID NO: 38798 - DNA, 20 bp, Artificial Sequence
  sgRNA
  Olfr1438-ps1_10
tctaccagcatgatttctgt

SEQ ID NO: 38799 - DNA, 20 bp, Artificial Sequence
  sgRNA
  Olfr1438-ps1_11
tgccaccttgtcctgtccga

SEQ ID NO: 38800 - DNA, 20 bp, Artificial Sequence
  sgRNA
  Olfr1438-ps1_12
gtgactgtccatcctaatga

SEQ ID NO: 38801 - DNA, 20 bp, Artificial Sequence
  sgRNA
  Olfr1438-ps1_13
tttatatcctgaccttagcc

SEQ ID NO: 38802 - DNA, 20 bp, Artificial Sequence
  sgRNA
  Olfr1438-ps1_14
gagaccagagccatagaaga

SEQ ID NO: 38803 - DNA, 20 bp, Artificial Sequence
  sgRNA
  Olfr1438-ps1_15
atgccaccttgtcctgtccg

SEQ ID NO: 38804 - DNA, 20 bp, Artificial Sequence
  sgRNA
  Olfr1438-ps1_16
aataaaggtcaccacctggc

SEQ ID NO: 38805 - DNA, 20 bp, Artificial Sequence
  sgRNA
  Olfr1438-ps1_17
tgaataacagatgtccagga

SEQ ID NO: 38806 - DNA, 20 bp, Artificial Sequence
  sgRNA
  Olfr1438-ps1_18
gtggctggtgcctatatggg

SEQ ID NO: 38807 - DNA, 20 bp, Artificial Sequence
  sgRNA
  Olfr1438-ps1_19
cctcatcaccctcattagga

SEQ ID NO: 38808 - DNA, 20 bp, Artificial Sequence
  sgRNA
  Olfr1438-ps1_20
gctggtaaagatgtcagagc

SEQ ID NO: 38809 - DNA, 20 bp, Artificial Sequence
  sgRNA
  Olfr1442_1
gctgattatgataaacagag

SEQ ID NO: 38810 - DNA, 20 bp, Artificial Sequence
  sgRNA
  Olfr1442_2
tgagatcatctgagcaacac

SEQ ID NO: 38811 - DNA, 20 bp, Artificial Sequence
  sgRNA
  Olfr1442_3
ataatggcctgctatactgg

SEQ ID NO: 38812 - DNA, 20 bp, Artificial Sequence
  sgRNA
  Olfr1442_4
aattgttggagctacagctg

SEQ ID NO: 38813 - DNA, 20 bp, Artificial Sequence
  sgRNA
  Olfr1442_5
gtgcgttcgtcagtcctagg

SEQ ID NO: 38814 - DNA, 20 bp, Artificial Sequence
  sgRNA
  Olfr1442_6
catggtgtagaacacagaca

SEQ ID NO: 38815 - DNA, 20 bp, Artificial Sequence
  sgRNA
  Olfr1442_7
gacgaacgcaccagaactga

SEQ ID NO: 38816 - DNA, 20 bp, Artificial Sequence
  sgRNA
  Olfr1442_8
tccttagactgtaaaccata

SEQ ID NO: 38817 - DNA, 20 bp, Artificial Sequence
  sgRNA
  Olfr1442_9
gaattcctccatccacactg

SEQ ID NO: 38818 - DNA, 20 bp, Artificial Sequence
  sgRNA
  Olfr1442_10
tcccaagtttccaatcacat

SEQ ID NO: 38819 - DNA, 20 bp, Artificial Sequence
  sgRNA
  Olfr1442_11
tgacgaacgcaccagaactg

SEQ ID NO: 38820 - DNA, 20 bp, Artificial Sequence
  sgRNA
  Olfr1442_12
catgatggtggtataatgca

SEQ ID NO: 38821 - DNA, 20 bp, Artificial Sequence
  sgRNA
  Olfr1442_13
agaagtccagccaaaattgt

SEQ ID NO: 38822 - DNA, 20 bp, Artificial Sequence
  sgRNA
  Olfr1442_14
ttagcaagaaaacagtacat

SEQ ID NO: 38823 - DNA, 20 bp, Artificial Sequence
  sgRNA
  Olfr1442_15
agctgattatgataaacaga

SEQ ID NO: 38824 - DNA, 20 bp, Artificial Sequence
  sgRNA
  Olfr1442_16
gttagcaagaaaacagtaca

SEQ ID NO: 38825 - DNA, 20 bp, Artificial Sequence
  sgRNA
  Olfr1442_17
ttacagtctaaggaacaagg

SEQ ID NO: 38826 - DNA, 20 bp, Artificial Sequence
  sgRNA
  Olfr1442_18
catccccatgcttaacccta

SEQ ID NO: 38827 - DNA, 20 bp, Artificial Sequence
  sgRNA
  Olfr1442_19
aataacagtcccgtagaaaa

SEQ ID NO: 38828 - DNA, 20 bp, Artificial Sequence
  sgRNA
  Olfr1442_20
aaaagatgtccaccagagac

SEQ ID NO: 38829 - DNA, 20 bp, Artificial Sequence
  sgRNA
  Olfr1443_1
tacatgtgcatgtctgacca

SEQ ID NO: 38830 - DNA, 20 bp, Artificial Sequence
  sgRNA
  Olfr1443_2
agagcaagagagaaccatga

SEQ ID NO: 38831 - DNA, 20 bp, Artificial Sequence
  sgRNA
  Olfr1443_3
ggagtaaaagatgtctacca

SEQ ID NO: 38832 - DNA, 20 bp, Artificial Sequence
  sgRNA
  Olfr1443_4
tcaacatgactggaaacttg

SEQ ID NO: 38833 - DNA, 20 bp, Artificial Sequence
  sgRNA
  Olfr1443_5
gaattcctctatccatactg

SEQ ID NO: 38834 - DNA, 20 bp, Artificial Sequence
  sgRNA
  Olfr1443_6
ctacttctgcaagtccaatg

SEQ ID NO: 38835 - DNA, 20 bp, Artificial Sequence
  sgRNA
  Olfr1443_7
tccttaagctatagaccaca

SEQ ID NO: 38836 - DNA, 20 bp, Artificial Sequence
  sgRNA
  Olfr1443_8
agctgagcgcatcttgaaga

SEQ ID NO: 38837 - DNA, 20 bp, Artificial Sequence
  sgRNA
  Olfr1443_9
gaaaaagtgatggaccacat

SEQ ID NO: 38838 - DNA, 20 bp, Artificial Sequence
  sgRNA
  Olfr1443_10
tgatagacacatcagtgaga

SEQ ID NO: 38839 - DNA, 20 bp, Artificial Sequence
  sgRNA
  Olfr1443_11
tgtagttggagtcatagtgg

SEQ ID NO: 38840 - DNA, 20 bp, Artificial Sequence
  sgRNA
  Olfr1443_12
atagtggtggtataatgcag

SEQ ID NO: 38841 - DNA, 20 bp, Artificial Sequence
  sgRNA
  Olfr1443_13
acatgtagttggagtcatag

SEQ ID NO: 38842 - DNA, 20 bp, Artificial Sequence
  sgRNA
  Olfr1443_14
gcccagctccagccactcca

SEQ ID NO: 38843 - DNA, 20 bp, Artificial Sequence
  sgRNA
  Olfr1443_15
caaaacttgctccatatagg

SEQ ID NO: 38844 - DNA, 20 bp, Artificial Sequence
  sgRNA
  Olfr1443_16
gttgttgctggacttcttgt

SEQ ID NO: 38845 - DNA, 20 bp, Artificial Sequence
  sgRNA
  Olfr1443_17
catagtggtggtataatgca

SEQ ID NO: 38846 - DNA, 20 bp, Artificial Sequence
  sgRNA
  Olfr1443_18
gtttgcacactgctgcatag

SEQ ID NO: 38847 - DNA, 20 bp, Artificial Sequence
  sgRNA
  Olfr1443_19
agaagtccagcaacaactgt

SEQ ID NO: 38848 - DNA, 20 bp, Artificial Sequence
  sgRNA
  Olfr1443_20
ttaccaagaaaaatgtacat

SEQ ID NO: 38849 - DNA, 20 bp, Artificial Sequence
  sgRNA
  Olfr1444_1
caaaagatagcactcaacag

SEQ ID NO: 38850 - DNA, 20 bp, Artificial Sequence
  sgRNA
  Olfr1444_2
gtgtgtaccatcctaaccat

SEQ ID NO: 38851 - DNA, 20 bp, Artificial Sequence
  sgRNA
  Olfr1444_3
catttccaatcagagtgaca

SEQ ID NO: 38852 - DNA, 20 bp, Artificial Sequence
  sgRNA
  Olfr1444_4
tgagtatcccagatctacaa

SEQ ID NO: 38853 - DNA, 20 bp, Artificial Sequence
  sgRNA
  Olfr1444_5
tactcacactaaaagacgca

SEQ ID NO: 38854 - DNA, 20 bp, Artificial Sequence
  sgRNA
  Olfr1444_6
gcccagttctggtcagtcca

SEQ ID NO: 38855 - DNA, 20 bp, Artificial Sequence
  sgRNA
  Olfr1444_7
ctactcacactaaaagacgc

SEQ ID NO: 38856 - DNA, 20 bp, Artificial Sequence
  sgRNA
  Olfr1444_8
gccacaggtgtaagagccaa

SEQ ID NO: 38857 - DNA, 20 bp, Artificial Sequence
  sgRNA
  Olfr1444_9
tcactctgattggaaatgga

SEQ ID NO: 38858 - DNA, 20 bp, Artificial Sequence
  sgRNA
  Olfr1444_10
gcctacacactgctgcatgg

SEQ ID NO: 38859 - DNA, 20 bp, Artificial Sequence
  sgRNA
  Olfr1444_11
tggtggctgcacttcagtca

SEQ ID NO: 38860 - DNA, 20 bp, Artificial Sequence
  sgRNA
  Olfr1444_12
cagcacacacatcagtaaat

SEQ ID NO: 38861 - DNA, 20 bp, Artificial Sequence
  sgRNA
  Olfr1444_13
ggtcatctgtcaaccccagc

SEQ ID NO: 38862 - DNA, 20 bp, Artificial Sequence
  sgRNA
  Olfr1444_14
agatgaataaaaatatcagg

SEQ ID NO: 38863 - DNA, 20 bp, Artificial Sequence
  sgRNA
  Olfr1444_15
cacaccagttgtcatggtgg

SEQ ID NO: 38864 - DNA, 20 bp, Artificial Sequence
  sgRNA
  Olfr1444_16
gagaagtgaagagtgctcta

SEQ ID NO: 38865 - DNA, 20 bp, Artificial Sequence
  sgRNA
  Olfr1444_17
agctgtagctcccaagatgg

SEQ ID NO: 38866 - DNA, 20 bp, Artificial Sequence
  sgRNA
  Olfr1444_18
gtgtgtgctggagcatgcaa

SEQ ID NO: 38867 - DNA, 20 bp, Artificial Sequence
  sgRNA
  Olfr1444_19
tacaccaccaccatgacaac

SEQ ID NO: 38868 - DNA, 20 bp, Artificial Sequence
  sgRNA
  Olfr1444_20
tgacagaattcatcctgctg

SEQ ID NO: 38869 - DNA, 20 bp, Artificial Sequence
  sgRNA
  Olfr1445_1
accataacacacaatgcttg

SEQ ID NO: 38870 - DNA, 20 bp, Artificial Sequence
  sgRNA
  Olfr1445_2
gaacatgatagggccaggag

SEQ ID NO: 38871 - DNA, 20 bp, Artificial Sequence
  sgRNA
  Olfr1445_3
atggtggtggtgtactgcag

SEQ ID NO: 38872 - DNA, 20 bp, Artificial Sequence
  sgRNA
  Olfr1445_4
agagtggtatctggagctct

SEQ ID NO: 38873 - DNA, 20 bp, Artificial Sequence
  sgRNA
  Olfr1445_5
ggtcaagagtgcattcaaaa

SEQ ID NO: 38874 - DNA, 20 bp, Artificial Sequence
  sgRNA
  Olfr1445_6
tgactgagttcattctcaca

SEQ ID NO: 38875 - DNA, 20 bp, Artificial Sequence
  sgRNA
  Olfr1445_7
ttcatctgaaggacgccaga

SEQ ID NO: 38876 - DNA, 20 bp, Artificial Sequence
  sgRNA
  Olfr1445_8
gtcactcccaaagtaatgcc

SEQ ID NO: 38877 - DNA, 20 bp, Artificial Sequence
  sgRNA
  Olfr1445_9
cctagttccagtcacaccat

SEQ ID NO: 38878 - DNA, 20 bp, Artificial Sequence
  sgRNA
  Olfr1445_10
agacacttctgtcagtgaga

SEQ ID NO: 38879 - DNA, 20 bp, Artificial Sequence
  sgRNA
  Olfr1445_11
ttatattcatcactattctg

SEQ ID NO: 38880 - DNA, 20 bp, Artificial Sequence
  sgRNA
  Olfr1445_12
ctacagcctgagaaacaaag

SEQ ID NO: 38881 - DNA, 20 bp, Artificial Sequence
  sgRNA
  Olfr1445_13
gagtgcattcaaaaaggctg

SEQ ID NO: 38882 - DNA, 20 bp, Artificial Sequence
  sgRNA
  Olfr1445_14
ttctcaggctgtagaccaaa

SEQ ID NO: 38883 - DNA, 20 bp, Artificial Sequence
  sgRNA
  Olfr1445_15
cataagccatggcagccaag

SEQ ID NO: 38884 - DNA, 20 bp, Artificial Sequence
  sgRNA
  Olfr1445_16
atataaacagataggatatc

SEQ ID NO: 38885 - DNA, 20 bp, Artificial Sequence
  sgRNA
  Olfr1445_17
tgtctgaacatgatagggcc

SEQ ID NO: 38886 - DNA, 20 bp, Artificial Sequence
  sgRNA
  Olfr1445_18
gtagaccaaagggttcagca

SEQ ID NO: 38887 - DNA, 20 bp, Artificial Sequence
  sgRNA
  Olfr1445_19
gcttacaaagaagaagaatt

SEQ ID NO: 38888 - DNA, 20 bp, Artificial Sequence
  sgRNA
  Olfr1445_20
agtgatgaatataaacagat

SEQ ID NO: 38889 - DNA, 20 bp, Artificial Sequence
  sgRNA
  Olfr1446_1
caaccaaggacagattacca

SEQ ID NO: 38890 - DNA, 20 bp, Artificial Sequence
  sgRNA
  Olfr1446_2
tagaagctcagtcatcactg

SEQ ID NO: 38891 - DNA, 20 bp, Artificial Sequence
  sgRNA
  Olfr1446_3
ataattctccacagtagcaa

SEQ ID NO: 38892 - DNA, 20 bp, Artificial Sequence
  sgRNA
  Olfr1446_4
tgactaaaagtgtgtataca

SEQ ID NO: 38893 - DNA, 20 bp, Artificial Sequence
  sgRNA
  Olfr1446_5
gtgatgactgagcttctaat

SEQ ID NO: 38894 - DNA, 20 bp, Artificial Sequence
  sgRNA
  Olfr1446_6
catgaaactgatcccataag

SEQ ID NO: 38895 - DNA, 20 bp, Artificial Sequence
  sgRNA
  Olfr1446_7
gcctagctccaatcattcca

SEQ ID NO: 38896 - DNA, 20 bp, Artificial Sequence
  sgRNA
  Olfr1446_8
tacatctgtattctacacaa

SEQ ID NO: 38897 - DNA, 20 bp, Artificial Sequence
  sgRNA
  Olfr1446_9
ctacagcatgaggaacaagg

SEQ ID NO: 38898 - DNA, 20 bp, Artificial Sequence
  sgRNA
  Olfr1446_10
ggattatcactgcctcttat

SEQ ID NO: 38899 - DNA, 20 bp, Artificial Sequence
  sgRNA
  Olfr1446_11
ttcctcatgctgtagactag

SEQ ID NO: 38900 - DNA, 20 bp, Artificial Sequence
  sgRNA
  Olfr1446_12
gagtaaatatgtctgcaata

SEQ ID NO: 38901 - DNA, 20 bp, Artificial Sequence
  sgRNA
  Olfr1446_13
agaagctcagtcatcactgt

SEQ ID NO: 38902 - DNA, 20 bp, Artificial Sequence
  sgRNA
  Olfr1446_14
tgtaactttgtctatgtcca

SEQ ID NO: 38903 - DNA, 20 bp, Artificial Sequence
  sgRNA
  Olfr1446_15
agccgagtgcatctttaaga

SEQ ID NO: 38904 - DNA, 20 bp, Artificial Sequence
  sgRNA
  Olfr1446_16
gtctatgtccatggaatgat

SEQ ID NO: 38905 - DNA, 20 bp, Artificial Sequence
  sgRNA
  Olfr1446_17
caccatcttaaagatgcact

SEQ ID NO: 38906 - DNA, 20 bp, Artificial Sequence
  sgRNA
  Olfr1446_18
agtctacagcatgaggaaca

SEQ ID NO: 38907 - DNA, 20 bp, Artificial Sequence
  sgRNA
  Olfr1446_19
tactgtggagaattatctgt

SEQ ID NO: 38908 - DNA, 20 bp, Artificial Sequence
  sgRNA
  Olfr1446_20
ctcggcttcaggacatcaca

SEQ ID NO: 38909 - DNA, 20 bp, Artificial Sequence
  sgRNA
  Olfr1447_1
ccaccagagaaagattacca

SEQ ID NO: 38910 - DNA, 20 bp, Artificial Sequence
  sgRNA
  Olfr1447_2
tgggctactaataggaaaca

SEQ ID NO: 38911 - DNA, 20 bp, Artificial Sequence
  sgRNA
  Olfr1447_3
tatgtctgcaatatggatgg

SEQ ID NO: 38912 - DNA, 20 bp, Artificial Sequence
  sgRNA
  Olfr1447_4
tgactaaaagtatgtataca

SEQ ID NO: 38913 - DNA, 20 bp, Artificial Sequence
  sgRNA
  Olfr1447_5
agtagcccattcatgactgt

SEQ ID NO: 38914 - DNA, 20 bp, Artificial Sequence
  sgRNA
  Olfr1447_6
gcccagctccaatcattcca

SEQ ID NO: 38915 - DNA, 20 bp, Artificial Sequence
  sgRNA
  Olfr1447_7
aacatctgtattctacacca

SEQ ID NO: 38916 - DNA, 20 bp, Artificial Sequence
  sgRNA
  Olfr1447_8
agctgagtgcatctttaaga

SEQ ID NO: 38917 - DNA, 20 bp, Artificial Sequence
  sgRNA
  Olfr1447_9
attcagcataggaatgacca

SEQ ID NO: 38918 - DNA, 20 bp, Artificial Sequence
  sgRNA
  Olfr1447_10
gtcatgaatgggctactaat

SEQ ID NO: 38919 - DNA, 20 bp, Artificial Sequence
  sgRNA
  Olfr1447_11
atagttctccacagtagcaa

SEQ ID NO: 38920 - DNA, 20 bp, Artificial Sequence
  sgRNA
  Olfr1447_12
tagtagcccattcatgactg

SEQ ID NO: 38921 - DNA, 20 bp, Artificial Sequence
  sgRNA
  Olfr1447_13
atgtatacatggcttatcac

SEQ ID NO: 38922 - DNA, 20 bp, Artificial Sequence
  sgRNA
  Olfr1447_14
ctcagcttcaggacatcaca

SEQ ID NO: 38923 - DNA, 20 bp, Artificial Sequence
  sgRNA
  Olfr1447_15
tactgtggagaactatctgt

SEQ ID NO: 38924 - DNA, 20 bp, Artificial Sequence
  sgRNA
  Olfr1447_16
ccttggtaatctttctctgg

SEQ ID NO: 38925 - DNA, 20 bp, Artificial Sequence
  sgRNA
  Olfr1447_17
gagtgaatatgtctgcaata

SEQ ID NO: 38926 - DNA, 20 bp, Artificial Sequence
  sgRNA
  Olfr1447_18
tcacacccacagtcatgaat

SEQ ID NO: 38927 - DNA, 20 bp, Artificial Sequence
  sgRNA
  Olfr1447_19
atcctctagtctacagcctg

SEQ ID NO: 38928 - DNA, 20 bp, Artificial Sequence
  sgRNA
  Olfr1447_20
ctgagcagcacaatcattgt

SEQ ID NO: 38929 - DNA, 20 bp, Artificial Sequence
  sgRNA
  Olfr1448_1
acaagtatttgtagtcatgg

SEQ ID NO: 38930 - DNA, 20 bp, Artificial Sequence
  sgRNA
  Olfr1448_2
accatatcccataacacttg

SEQ ID NO: 38931 - DNA, 20 bp, Artificial Sequence
  sgRNA
  Olfr1448_3
gagcacgatagggccaggag

SEQ ID NO: 38932 - DNA, 20 bp, Artificial Sequence
  sgRNA
  Olfr1448_4
ccaccagagatagatgactg

SEQ ID NO: 38933 - DNA, 20 bp, Artificial Sequence
  sgRNA
  Olfr1448_5
tgtctgagcacgatagggcc

SEQ ID NO: 38934 - DNA, 20 bp, Artificial Sequence
  sgRNA
  Olfr1448_6
gatgacagtcccatagaaga

SEQ ID NO: 38935 - DNA, 20 bp, Artificial Sequence
  sgRNA
  Olfr1448_7
ataggtgtctgagcacgata

SEQ ID NO: 38936 - DNA, 20 bp, Artificial Sequence
  sgRNA
  Olfr1448_8
tcctcaggctatagaccaaa

SEQ ID NO: 38937 - DNA, 20 bp, Artificial Sequence
  sgRNA
  Olfr1448_9
acccaattcttcttcttcgt

SEQ ID NO: 38938 - DNA, 20 bp, Artificial Sequence
  sgRNA
  Olfr1448_10
attcaggaagccacagacat

SEQ ID NO: 38939 - DNA, 20 bp, Artificial Sequence
  sgRNA
  Olfr1448_11
ggcatctgtgttctatacca

SEQ ID NO: 38940 - DNA, 20 bp, Artificial Sequence
  sgRNA
  Olfr1448_12
ctgcagtctccatcttctat

SEQ ID NO: 38941 - DNA, 20 bp, Artificial Sequence
  sgRNA
  Olfr1448_13
ggtgcatttaaaaaagctgt

SEQ ID NO: 38942 - DNA, 20 bp, Artificial Sequence
  sgRNA
  Olfr1448_14
ctatagcctgaggaacaaag

SEQ ID NO: 38943 - DNA, 20 bp, Artificial Sequence
  sgRNA
  Olfr1448_15
gcccagttccagtcacacca

SEQ ID NO: 38944 - DNA, 20 bp, Artificial Sequence
  sgRNA
  Olfr1448_16
tataggtgtctgagcacgat

SEQ ID NO: 38945 - DNA, 20 bp, Artificial Sequence
  sgRNA
  Olfr1448_17
tatcacattgaacttgcaga

SEQ ID NO: 38946 - DNA, 20 bp, Artificial Sequence
  sgRNA
  Olfr1448_18
gtgactgagttcattctcgc

SEQ ID NO: 38947 - DNA, 20 bp, Artificial Sequence
  sgRNA
  Olfr1448_19
ttcatctgaaggacgccaca

SEQ ID NO: 38948 - DNA, 20 bp, Artificial Sequence
  sgRNA
  Olfr1448_20
gcccacgaagaagaagaatt

SEQ ID NO: 38949 - DNA, 20 bp, Artificial Sequence
  sgRNA
  Olfr145_1
aaaaggagtaagcacacctg

SEQ ID NO: 38950 - DNA, 20 bp, Artificial Sequence
  sgRNA
  Olfr145_2
gactaccagctcatttacat

SEQ ID NO: 38951 - DNA, 20 bp, Artificial Sequence
  sgRNA
  Olfr145_3
tttcaccatgaatgctgtgt

SEQ ID NO: 38952 - DNA, 20 bp, Artificial Sequence
  sgRNA
  Olfr145_4
gtgagagttcagtccaatca

SEQ ID NO: 38953 - DNA, 20 bp, Artificial Sequence
  sgRNA
  Olfr145_5
tgtcatatgccattgctgat

SEQ ID NO: 38954 - DNA, 20 bp, Artificial Sequence
  sgRNA
  Olfr145_6
acaaggacgacactttcccc

SEQ ID NO: 38955 - DNA, 20 bp, Artificial Sequence
  sgRNA
  Olfr145_7
tgatgcgaaggatactggag

SEQ ID NO: 38956 - DNA, 20 bp, Artificial Sequence
  sgRNA
  Olfr145_8
ccttcgcatcagttccacag

SEQ ID NO: 38957 - DNA, 20 bp, Artificial Sequence
  sgRNA
  Olfr145_9
gtttcaccatgaatgctgtg

SEQ ID NO: 38958 - DNA, 20 bp, Artificial Sequence
  sgRNA
  Olfr145_10
cttcgcatcagttccacaga

SEQ ID NO: 38959 - DNA, 20 bp, Artificial Sequence
  sgRNA
  Olfr145_11
tcacatacacacctagcaaa

SEQ ID NO: 38960 - DNA, 20 bp, Artificial Sequence
  sgRNA
  Olfr145_12
tatcagcaatggcatatgac

SEQ ID NO: 38961 - DNA, 20 bp, Artificial Sequence
  sgRNA
  Olfr145_13
aggtttctacatggtcacca

SEQ ID NO: 38962 - DNA, 20 bp, Artificial Sequence
  sgRNA
  Olfr145_14
gcaaaaggagtaagcacacc

SEQ ID NO: 38963 - DNA, 20 bp, Artificial Sequence
  sgRNA
  Olfr145_15
gcatcagttccacagagggc

SEQ ID NO: 38964 - DNA, 20 bp, Artificial Sequence
  sgRNA
  Olfr145_16
gagggcataagaaataaaga

SEQ ID NO: 38965 - DNA, 20 bp, Artificial Sequence
  sgRNA
  Olfr145_17
gtacatcagaggattacaga

SEQ ID NO: 38966 - DNA, 20 bp, Artificial Sequence
  sgRNA
  Olfr145_18
ggagtagcagaaatctataa

SEQ ID NO: 38967 - DNA, 20 bp, Artificial Sequence
  sgRNA
  Olfr145_19
tctgtttctaggtttctaca

SEQ ID NO: 38968 - DNA, 20 bp, Artificial Sequence
  sgRNA
  Olfr145_20
gtccttcatcctatcagcaa

SEQ ID NO: 38969 - DNA, 20 bp, Artificial Sequence
  sgRNA
  Olfr1451_1
ttgatgtggttggaaacacg

SEQ ID NO: 38970 - DNA, 20 bp, Artificial Sequence
  sgRNA
  Olfr1451_2
aagaactcagaaatgaccat

SEQ ID NO: 38971 - DNA, 20 bp, Artificial Sequence
  sgRNA
  Olfr1451_3
catcctggtagagtaatgca

SEQ ID NO: 38972 - DNA, 20 bp, Artificial Sequence
  sgRNA
  Olfr1451_4
cattagatttacaaaaagag

SEQ ID NO: 38973 - DNA, 20 bp, Artificial Sequence
  sgRNA
  Olfr1451_5
cataggccattgatgctaag

SEQ ID NO: 38974 - DNA, 20 bp, Artificial Sequence
  sgRNA
  Olfr1451_6
ggcattgtaggagaccacct

SEQ ID NO: 38975 - DNA, 20 bp, Artificial Sequence
  sgRNA
  Olfr1451_7
ctttatctgcatccatagaa

SEQ ID NO: 38976 - DNA, 20 bp, Artificial Sequence
  sgRNA
  Olfr1451_8
tgtttccaaccacatcaatg

SEQ ID NO: 38977 - DNA, 20 bp, Artificial Sequence
  sgRNA
  Olfr1451_9
tatgtccccaacatgaaaaa

SEQ ID NO: 38978 - DNA, 20 bp, Artificial Sequence
  sgRNA
  Olfr1451_10
ttgaagatgaagtcagacca

SEQ ID NO: 38979 - DNA, 20 bp, Artificial Sequence
  sgRNA
  Olfr1451_11
atcctggtagagtaatgcag

SEQ ID NO: 38980 - DNA, 20 bp, Artificial Sequence
  sgRNA
  Olfr1451_12
ctacaaaagacaagttgcaa

SEQ ID NO: 38981 - DNA, 20 bp, Artificial Sequence
  sgRNA
  Olfr1451_13
ttgggactaactgatgaccc

SEQ ID NO: 38982 - DNA, 20 bp, Artificial Sequence
  sgRNA
  Olfr1451_14
gcacagatgttcttctttgt

SEQ ID NO: 38983 - DNA, 20 bp, Artificial Sequence
  sgRNA
  Olfr1451_15
cctcatttacctcattgatg

SEQ ID NO: 38984 - DNA, 20 bp, Artificial Sequence
  sgRNA
  Olfr1451_16
acccagctccagccattcta

SEQ ID NO: 38985 - DNA, 20 bp, Artificial Sequence
  sgRNA
  Olfr1451_17
atatggagactacagtgagg

SEQ ID NO: 38986 - DNA, 20 bp, Artificial Sequence
  sgRNA
  Olfr1451_18
gagggtgaacatgatacaaa

SEQ ID NO: 38987 - DNA, 20 bp, Artificial Sequence
  sgRNA
  Olfr1451_19
tcctcaggctataaaccaaa

SEQ ID NO: 38988 - DNA, 20 bp, Artificial Sequence
  sgRNA
  Olfr1451_20
atctgcatccatagaatggc

SEQ ID NO: 38989 - DNA, 20 bp, Artificial Sequence
  sgRNA
  Olfr1452-ps1_1
gaatgcctgtatctataccg

SEQ ID NO: 38990 - DNA, 20 bp, Artificial Sequence
  sgRNA
  Olfr1452-ps1_2
tcctcaagctgtacaccaga

SEQ ID NO: 38991 - DNA, 20 bp, Artificial Sequence
  sgRNA
  Olfr1452-ps1_3
atgtgtatatggatgatcgc

SEQ ID NO: 38992 - DNA, 20 bp, Artificial Sequence
  sgRNA
  Olfr1452-ps1_4
aggagaaagatgataaagag

SEQ ID NO: 38993 - DNA, 20 bp, Artificial Sequence
  sgRNA
  Olfr1452-ps1_5
gttcagcagggggatcacca

SEQ ID NO: 38994 - DNA, 20 bp, Artificial Sequence
  sgRNA
  Olfr1452-ps1_6
gagcatcaaggacaatcagc

SEQ ID NO: 38995 - DNA, 20 bp, Artificial Sequence
  sgRNA
  Olfr1452-ps1_7
gcctagttccagtcatgcta

SEQ ID NO: 38996 - DNA, 20 bp, Artificial Sequence
  sgRNA
  Olfr1452-ps1_8
ttaccaagaaaaatatacat

SEQ ID NO: 38997 - DNA, 20 bp, Artificial Sequence
  sgRNA
  Olfr1452-ps1_9
tgataaagagaggaagctgt

SEQ ID NO: 38998 - DNA, 20 bp, Artificial Sequence
  sgRNA
  Olfr1452-ps1_10
aggtgtcactccaaaagtca

SEQ ID NO: 38999 - DNA, 20 bp, Artificial Sequence
  sgRNA
  Olfr1452-ps1_11
agtgaaatgagaagcacagg

SEQ ID NO: 39000 - DNA, 20 bp, Artificial Sequence
  sgRNA
  Olfr1452-ps1_12
cctcatctacaccatcactc

SEQ ID NO: 39001 - DNA, 20 bp, Artificial Sequence
  sgRNA
  Olfr1452-ps1_13
caggttgcccaccagagtga

SEQ ID NO: 39002 - DNA, 20 bp, Artificial Sequence
  sgRNA
  Olfr1452-ps1_14
gtacaccagagggttcagca

SEQ ID NO: 39003 - DNA, 20 bp, Artificial Sequence
  sgRNA
  Olfr1452-ps1_15
tgtacaccagagggttcagc

SEQ ID NO: 39004 - DNA, 20 bp, Artificial Sequence
  sgRNA
  Olfr1452-ps1_16
tgaatgcctgtatctatacc

SEQ ID NO: 39005 - DNA, 20 bp, Artificial Sequence
  sgRNA
  Olfr1452-ps1_17
atggtgctagcatagtgtag

SEQ ID NO: 39006 - DNA, 20 bp, Artificial Sequence
  sgRNA
  Olfr1452-ps1_18
atagcgatcataagccattg

SEQ ID NO: 39007 - DNA, 20 bp, Artificial Sequence
  sgRNA
  Olfr1452-ps1_19
cataagccattgaggccaac

SEQ ID NO: 39008 - DNA, 20 bp, Artificial Sequence
  sgRNA
  Olfr1452-ps1_20
agtgacacagttcttcctgc

SEQ ID NO: 39009 - DNA, 20 bp, Artificial Sequence
  sgRNA
  Olfr1453_1
aagatacaatcattactgca

SEQ ID NO: 39010 - DNA, 20 bp, Artificial Sequence
  sgRNA
  Olfr1453_2
ttcttcaacagtaactccaa

SEQ ID NO: 39011 - DNA, 20 bp, Artificial Sequence
  sgRNA
  Olfr1453_3
tagtatagatggaagcactg

SEQ ID NO: 39012 - DNA, 20 bp, Artificial Sequence
  sgRNA
  Olfr1453_4
atggtggtagcataatgtag

SEQ ID NO: 39013 - DNA, 20 bp, Artificial Sequence
  sgRNA
  Olfr1453_5
tgtgatatcctgcagatgag

SEQ ID NO: 39014 - DNA, 20 bp, Artificial Sequence
  sgRNA
  Olfr1453_6
agagactgctgtgaagtgcg

SEQ ID NO: 39015 - DNA, 20 bp, Artificial Sequence
  sgRNA
  Olfr1453_7
gtaactccaaaggtcatagc

SEQ ID NO: 39016 - DNA, 20 bp, Artificial Sequence
  sgRNA
  Olfr1453_8
cagtgcttccatctatacta

SEQ ID NO: 39017 - DNA, 20 bp, Artificial Sequence
  sgRNA
  Olfr1453_9
aggaggaacgtgatagagag

SEQ ID NO: 39018 - DNA, 20 bp, Artificial Sequence
  sgRNA
  Olfr1453_10
gttcaacatgcagatgacca

SEQ ID NO: 39019 - DNA, 20 bp, Artificial Sequence
  sgRNA
  Olfr1453_11
ctgaagatccactcatctgc

SEQ ID NO: 39020 - DNA, 20 bp, Artificial Sequence
  sgRNA
  Olfr1453_12
cataggccattgaggctaaa

SEQ ID NO: 39021 - DNA, 20 bp, Artificial Sequence
  sgRNA
  Olfr1453_13
ggatattaagatgattataa

SEQ ID NO: 39022 - DNA, 20 bp, Artificial Sequence
  sgRNA
  Olfr1453_14
gcctagctccagtcacacca

SEQ ID NO: 39023 - DNA, 20 bp, Artificial Sequence
  sgRNA
  Olfr1453_15
tcctcaggctgtaaaccaga

SEQ ID NO: 39024 - DNA, 20 bp, Artificial Sequence
  sgRNA
  Olfr1453_16
ccactaaagacaggttacct

SEQ ID NO: 39025 - DNA, 20 bp, Artificial Sequence
  sgRNA
  Olfr1453_17
catctgcatgttgaaccctc

SEQ ID NO: 39026 - DNA, 20 bp, Artificial Sequence
  sgRNA
  Olfr1453_18
ggtttacagcctgaggagca

SEQ ID NO: 39027 - DNA, 20 bp, Artificial Sequence
  sgRNA
  Olfr1453_19
tgcatctgtgttctacacca

SEQ ID NO: 39028 - DNA, 20 bp, Artificial Sequence
  sgRNA
  Olfr1453_20
tgagtggatcttcagtatgt

SEQ ID NO: 39029 - DNA, 20 bp, Artificial Sequence
  sgRNA
  Olfr1454_1
atgtgtgtgtgtctactcat

SEQ ID NO: 39030 - DNA, 20 bp, Artificial Sequence
  sgRNA
  Olfr1454_2
agagtaacagaagtccacca

SEQ ID NO: 39031 - DNA, 20 bp, Artificial Sequence
  sgRNA
  Olfr1454_3
gaaaaaatgatggactacat

SEQ ID NO: 39032 - DNA, 20 bp, Artificial Sequence
  sgRNA
  Olfr1454_4
cataggccattgagaccaaa

SEQ ID NO: 39033 - DNA, 20 bp, Artificial Sequence
  sgRNA
  Olfr1454_5
tgatgtggaaaactaccttt

SEQ ID NO: 39034 - DNA, 20 bp, Artificial Sequence
  sgRNA
  Olfr1454_6
tcctcaagctgtaaaccaga

SEQ ID NO: 39035 - DNA, 20 bp, Artificial Sequence
  sgRNA
  Olfr1454_7
ctaaagttgcagtcagctgc

SEQ ID NO: 39036 - DNA, 20 bp, Artificial Sequence
  sgRNA
  Olfr1454_8
gtgggactcaccaatgaccc

SEQ ID NO: 39037 - DNA, 20 bp, Artificial Sequence
  sgRNA
  Olfr1454_9
gatgatatagatgaggagga

SEQ ID NO: 39038 - DNA, 20 bp, Artificial Sequence
  sgRNA
  Olfr1454_10
gagaatccaagagaatcaac

SEQ ID NO: 39039 - DNA, 20 bp, Artificial Sequence
  sgRNA
  Olfr1454_11
ttcctcaagctgtaaaccag

SEQ ID NO: 39040 - DNA, 20 bp, Artificial Sequence
  sgRNA
  Olfr1454_12
gttcaacatcgggatgacca

SEQ ID NO: 39041 - DNA, 20 bp, Artificial Sequence
  sgRNA
  Olfr1454_13
taatgcatctacagtataaa

SEQ ID NO: 39042 - DNA, 20 bp, Artificial Sequence
  sgRNA
  Olfr1454_14
gtcactccaaaagtcatagc

SEQ ID NO: 39043 - DNA, 20 bp, Artificial Sequence
  sgRNA
  Olfr1454_15
aacagaagtccaccaaggac

SEQ ID NO: 39044 - DNA, 20 bp, Artificial Sequence
  sgRNA
  Olfr1454_16
gactacattggactcacaga

SEQ ID NO: 39045 - DNA, 20 bp, Artificial Sequence
  sgRNA
  Olfr1454_17
agagtggaagctgcaggcct

SEQ ID NO: 39046 - DNA, 20 bp, Artificial Sequence
  sgRNA
  Olfr1454_18
gtcatagctggatttcttat

SEQ ID NO: 39047 - DNA, 20 bp, Artificial Sequence
  sgRNA
  Olfr1454_19
ggatattatgatgagtataa

SEQ ID NO: 39048 - DNA, 20 bp, Artificial Sequence
  sgRNA
  Olfr1454_20
ggtttacagcttgaggaaca

SEQ ID NO: 39049 - DNA, 20 bp, Artificial Sequence
  sgRNA
  Olfr1457_1
agaagctcagtcatgacact

SEQ ID NO: 39050 - DNA, 20 bp, Artificial Sequence
  sgRNA
  Olfr1457_2
agtgtttccagtgttgatgg

SEQ ID NO: 39051 - DNA, 20 bp, Artificial Sequence
  sgRNA
  Olfr1457_3
atagtgctggcatagtgcaa

SEQ ID NO: 39052 - DNA, 20 bp, Artificial Sequence
  sgRNA
  Olfr1457_4
ttacctagaaaaatgtacat

SEQ ID NO: 39053 - DNA, 20 bp, Artificial Sequence
  sgRNA
  Olfr1457_5
gtcatgactgagcttctaat

SEQ ID NO: 39054 - DNA, 20 bp, Artificial Sequence
  sgRNA
  Olfr1457_6
tccgcagactgtagaccaga

SEQ ID NO: 39055 - DNA, 20 bp, Artificial Sequence
  sgRNA
  Olfr1457_7
gtatgcatctatctttctat

SEQ ID NO: 39056 - DNA, 20 bp, Artificial Sequence
  sgRNA
  Olfr1457_8
cctcatttacaccatcaccc

SEQ ID NO: 39057 - DNA, 20 bp, Artificial Sequence
  sgRNA
  Olfr1457_9
ttccgcagactgtagaccag

SEQ ID NO: 39058 - DNA, 20 bp, Artificial Sequence
  sgRNA
  Olfr1457_10
gctaaaatgcactcaagtgc

SEQ ID NO: 39059 - DNA, 20 bp, Artificial Sequence
  sgRNA
  Olfr1457_11
gtgaagtgtgaggcacaagt

SEQ ID NO: 39060 - DNA, 20 bp, Artificial Sequence
  sgRNA
  Olfr1457_12
atttacaccatcaccctggt

SEQ ID NO: 39061 - DNA, 20 bp, Artificial Sequence
  sgRNA
  Olfr1457_13
aggagaaatatcaagaagag

SEQ ID NO: 39062 - DNA, 20 bp, Artificial Sequence
  sgRNA
  Olfr1457_14
tcagccccagatttcccacc

SEQ ID NO: 39063 - DNA, 20 bp, Artificial Sequence
  sgRNA
  Olfr1457_15
cagccccagatttcccacca

SEQ ID NO: 39064 - DNA, 20 bp, Artificial Sequence
  sgRNA
  Olfr1457_16
ctgaatgcctccatcaacac

SEQ ID NO: 39065 - DNA, 20 bp, Artificial Sequence
  sgRNA
  Olfr1457_17
catttacaccatcaccctgg

SEQ ID NO: 39066 - DNA, 20 bp, Artificial Sequence
  sgRNA
  Olfr1457_18
gagtgtggagacaagagtcc

SEQ ID NO: 39067 - DNA, 20 bp, Artificial Sequence
  sgRNA
  Olfr1457_19
ctcaagtgctggatatggga

SEQ ID NO: 39068 - DNA, 20 bp, Artificial Sequence
  sgRNA
  Olfr1457_20
gtgacagagtttcttctgct

SEQ ID NO: 39069 - DNA, 20 bp, Artificial Sequence
  sgRNA
  Olfr1458_1
tctacatcatcacccttgta

SEQ ID NO: 39070 - DNA, 20 bp, Artificial Sequence
  sgRNA
  Olfr1458_2
taccttctgtgagttaaacg

SEQ ID NO: 39071 - DNA, 20 bp, Artificial Sequence
  sgRNA
  Olfr1458_3
aatggtacgcttcatcctga

SEQ ID NO: 39072 - DNA, 20 bp, Artificial Sequence
  sgRNA
  Olfr1458_4
tcatagacatgctaatgaca

SEQ ID NO: 39073 - DNA, 20 bp, Artificial Sequence
  sgRNA
  Olfr1458_5
tcctcagactgtaaaccaga

SEQ ID NO: 39074 - DNA, 20 bp, Artificial Sequence
  sgRNA
  Olfr1458_6
gcccaggtccagtcattcca

SEQ ID NO: 39075 - DNA, 20 bp, Artificial Sequence
  sgRNA
  Olfr1458_7
cagccccaggttccctacaa

SEQ ID NO: 39076 - DNA, 20 bp, Artificial Sequence
  sgRNA
  Olfr1458_8
gtttacatactgctgcatag

SEQ ID NO: 39077 - DNA, 20 bp, Artificial Sequence
  sgRNA
  Olfr1458_9
cctaagtaacctgtccctag

SEQ ID NO: 39078 - DNA, 20 bp, Artificial Sequence
  sgRNA
  Olfr1458_10
tcacccttgtagggaacctg

SEQ ID NO: 39079 - DNA, 20 bp, Artificial Sequence
  sgRNA
  Olfr1458_11
gaccacgtttaactcacaga

SEQ ID NO: 39080 - DNA, 20 bp, Artificial Sequence
  sgRNA
  Olfr1458_12
agaagaaatgtgatgaagag

SEQ ID NO: 39081 - DNA, 20 bp, Artificial Sequence
  sgRNA
  Olfr1458_13
aagagtaacagaagtccact

SEQ ID NO: 39082 - DNA, 20 bp, Artificial Sequence
  sgRNA
  Olfr1458_14
gcacacacgtgttgtcatgg

SEQ ID NO: 39083 - DNA, 20 bp, Artificial Sequence
  sgRNA
  Olfr1458_15
gttcaacatagggatgacca

SEQ ID NO: 39084 - DNA, 20 bp, Artificial Sequence
  sgRNA
  Olfr1458_16
gatcatcggtgagtcccatc

SEQ ID NO: 39085 - DNA, 20 bp, Artificial Sequence
  sgRNA
  Olfr1458_17
tgatgaagaggggaagctgc

SEQ ID NO: 39086 - DNA, 20 bp, Artificial Sequence
  sgRNA
  Olfr1458_18
gagagtccaggagaatcaac

SEQ ID NO: 39087 - DNA, 20 bp, Artificial Sequence
  sgRNA
  Olfr1458_19
agagacagctgtgaaatgtg

SEQ ID NO: 39088 - DNA, 20 bp, Artificial Sequence
  sgRNA
  Olfr1458_20
ttcctcagactgtaaaccag

SEQ ID NO: 39089 - DNA, 20 bp, Artificial Sequence
  sgRNA
  Olfr1459_1
gaatcaataggatcagtccc

SEQ ID NO: 39090 - DNA, 20 bp, Artificial Sequence
  sgRNA
  Olfr1459_2
ctcttcaacaatcactccaa

SEQ ID NO: 39091 - DNA, 20 bp, Artificial Sequence
  sgRNA
  Olfr1459_3
aaccacattagactcacaga

SEQ ID NO: 39092 - DNA, 20 bp, Artificial Sequence
  sgRNA
  Olfr1459_4
aacatgtctatcagagcaag

SEQ ID NO: 39093 - DNA, 20 bp, Artificial Sequence
  sgRNA
  Olfr1459_5
gagagtctaagagaatcaat

SEQ ID NO: 39094 - DNA, 20 bp, Artificial Sequence
  sgRNA
  Olfr1459_6
gttacctttgtaggaaacct

SEQ ID NO: 39095 - DNA, 20 bp, Artificial Sequence
  sgRNA
  Olfr1459_7
gaatgcttccatctatacta

SEQ ID NO: 39096 - DNA, 20 bp, Artificial Sequence
  sgRNA
  Olfr1459_8
tcctcaggctatagaccaga

SEQ ID NO: 39097 - DNA, 20 bp, Artificial Sequence
  sgRNA
  Olfr1459_9
gtcatagctggaatcctcac

SEQ ID NO: 39098 - DNA, 20 bp, Artificial Sequence
  sgRNA
  Olfr1459_10
ggatattaagatgagtataa

SEQ ID NO: 39099 - DNA, 20 bp, Artificial Sequence
  sgRNA
  Olfr1459_11
ttacttaagaaaatgtacat

SEQ ID NO: 39100 - DNA, 20 bp, Artificial Sequence
  sgRNA
  Olfr1459_12
tgcatagcgatcataggcca

SEQ ID NO: 39101 - DNA, 20 bp, Artificial Sequence
  sgRNA
  Olfr1459_13
cataggccatggagactaaa

SEQ ID NO: 39102 - DNA, 20 bp, Artificial Sequence
  sgRNA
  Olfr1459_14
tgtcagtgtccatggagtga

SEQ ID NO: 39103 - DNA, 20 bp, Artificial Sequence
  sgRNA
  Olfr1459_15
tattgattctcttagactct

SEQ ID NO: 39104 - DNA, 20 bp, Artificial Sequence
  sgRNA
  Olfr1459_16
gcccagctcccatcactcca

SEQ ID NO: 39105 - DNA, 20 bp, Artificial Sequence
  sgRNA
  Olfr1459_17
gttacttaagaaaatgtaca

SEQ ID NO: 39106 - DNA, 20 bp, Artificial Sequence
  sgRNA
  Olfr1459_18
gtgtgtgcatctttagtcat

SEQ ID NO: 39107 - DNA, 20 bp, Artificial Sequence
  sgRNA
  Olfr1459_19
aacagtatagatgaggagga

SEQ ID NO: 39108 - DNA, 20 bp, Artificial Sequence
  sgRNA
  Olfr1459_20
gaagacagctgttaagtgtg

SEQ ID NO: 39109 - DNA, 20 bp, Artificial Sequence
  sgRNA
  Olfr146_1
caatgaaggacagactactg

SEQ ID NO: 39110 - DNA, 20 bp, Artificial Sequence
  sgRNA
  Olfr146_2
aatgctggtgaaatttgtga

SEQ ID NO: 39111 - DNA, 20 bp, Artificial Sequence
  sgRNA
  Olfr146_3
aaactcctaaaacgagagaa

SEQ ID NO: 39112 - DNA, 20 bp, Artificial Sequence
  sgRNA
  Olfr146_4
tgtttcagaaagttacatgc

SEQ ID NO: 39113 - DNA, 20 bp, Artificial Sequence
  sgRNA
  Olfr146_5
cccatcatcttcccattcga

SEQ ID NO: 39114 - DNA, 20 bp, Artificial Sequence
  sgRNA
  Olfr146_6
tcctaagactgtaaatcagg

SEQ ID NO: 39115 - DNA, 20 bp, Artificial Sequence
  sgRNA
  Olfr146_7
ccatcgaatgggaagatgat

SEQ ID NO: 39116 - DNA, 20 bp, Artificial Sequence
  sgRNA
  Olfr146_8
tgatgaaagcataagaactg

SEQ ID NO: 39117 - DNA, 20 bp, Artificial Sequence
  sgRNA
  Olfr146_9
ataagaactgaggatggtca

SEQ ID NO: 39118 - DNA, 20 bp, Artificial Sequence
  sgRNA
  Olfr146_10
cctcagtggatttaatgcgt

SEQ ID NO: 39119 - DNA, 20 bp, Artificial Sequence
  sgRNA
  Olfr146_11
gtaaagtaaggggctacaga

SEQ ID NO: 39120 - DNA, 20 bp, Artificial Sequence
  sgRNA
  Olfr146_12
ttcctaagactgtaaatcag

SEQ ID NO: 39121 - DNA, 20 bp, Artificial Sequence
  sgRNA
  Olfr146_13
tgatgctactgtaaagtaag

SEQ ID NO: 39122 - DNA, 20 bp, Artificial Sequence
  sgRNA
  Olfr146_14
actgaggaagaagtacatag

SEQ ID NO: 39123 - DNA, 20 bp, Artificial Sequence
  sgRNA
  Olfr146_15
agattggcagaagtcaatga

SEQ ID NO: 39124 - DNA, 20 bp, Artificial Sequence
  sgRNA
  Olfr146_16
gttgttctgttaagccagaa

SEQ ID NO: 39125 - DNA, 20 bp, Artificial Sequence
  sgRNA
  Olfr146_17
aaggaagaatttgttcactg

SEQ ID NO: 39126 - DNA, 20 bp, Artificial Sequence
  sgRNA
  Olfr146_18
ctacgcattaaatccactga

SEQ ID NO: 39127 - DNA, 20 bp, Artificial Sequence
  sgRNA
  Olfr146_19
ggctttagatcttccctcag

SEQ ID NO: 39128 - DNA, 20 bp, Artificial Sequence
  sgRNA
  Olfr146_20
gttgagcatgggaacaatga

SEQ ID NO: 39129 - DNA, 20 bp, Artificial Sequence
  sgRNA
  Olfr1461_1
tatgtatctgtctgatcatg

SEQ ID NO: 39130 - DNA, 20 bp, Artificial Sequence
  sgRNA
  Olfr1461_2
tcactcctaaagtcatagct

SEQ ID NO: 39131 - DNA, 20 bp, Artificial Sequence
  sgRNA
  Olfr1461_3
ccaccagggacaagttacca

SEQ ID NO: 39132 - DNA, 20 bp, Artificial Sequence
  sgRNA
  Olfr1461_4
gagagtccaagaaaatcagc

SEQ ID NO: 39133 - DNA, 20 bp, Artificial Sequence
  sgRNA
  Olfr1461_5
agagtaacaaacgtccacca

SEQ ID NO: 39134 - DNA, 20 bp, Artificial Sequence
  sgRNA
  Olfr1461_6
ttaaacatgcgctcaagagc

SEQ ID NO: 39135 - DNA, 20 bp, Artificial Sequence
  sgRNA
  Olfr1461_7
gtatgtatctgtctgatcat

SEQ ID NO: 39136 - DNA, 20 bp, Artificial Sequence
  sgRNA
  Olfr1461_8
agttaagtgggagacacagg

SEQ ID NO: 39137 - DNA, 20 bp, Artificial Sequence
  sgRNA
  Olfr1461_9
tctacatcatcaccctggta

SEQ ID NO: 39138 - DNA, 20 bp, Artificial Sequence
  sgRNA
  Olfr1461_10
gttcagcattggaatgacca

SEQ ID NO: 39139 - DNA, 20 bp, Artificial Sequence
  sgRNA
  Olfr1461_11
cctcatctacatcatcaccc

SEQ ID NO: 39140 - DNA, 20 bp, Artificial Sequence
  sgRNA
  Olfr1461_12
gtcatagctgggctgctaat

SEQ ID NO: 39141 - DNA, 20 bp, Artificial Sequence
  sgRNA
  Olfr1461_13
tgtctgatcatggggtgcta

SEQ ID NO: 39142 - DNA, 20 bp, Artificial Sequence
  sgRNA
  Olfr1461_14
ccttggtaacttgtccctgg

SEQ ID NO: 39143 - DNA, 20 bp, Artificial Sequence
  sgRNA
  Olfr1461_15
tgtgtctgtgttctacacca

SEQ ID NO: 39144 - DNA, 20 bp, Artificial Sequence
  sgRNA
  Olfr1461_16
aggagaaagatgacaaagag

SEQ ID NO: 39145 - DNA, 20 bp, Artificial Sequence
  sgRNA
  Olfr1461_17
catggttgtggtataatgta

SEQ ID NO: 39146 - DNA, 20 bp, Artificial Sequence
  sgRNA
  Olfr1461_18
gcatatcacagaaaaaatga

SEQ ID NO: 39147 - DNA, 20 bp, Artificial Sequence
  sgRNA
  Olfr1461_19
tcctcaggctgtaaactaaa

SEQ ID NO: 39148 - DNA, 20 bp, Artificial Sequence
  sgRNA
  Olfr1461_20
aagagtaacaaacgtccacc

SEQ ID NO: 39149 - DNA, 20 bp, Artificial Sequence
  sgRNA
  Olfr1462_1
gacctttggagtgattgttg

SEQ ID NO: 39150 - DNA, 20 bp, Artificial Sequence
  sgRNA
  Olfr1462_2
gaatcaacaggataatccct

SEQ ID NO: 39151 - DNA, 20 bp, Artificial Sequence
  sgRNA
  Olfr1462_3
aacacataagtgtgttgtca

SEQ ID NO: 39152 - DNA, 20 bp, Artificial Sequence
  sgRNA
  Olfr1462_4
gaatgcttccatctatacag

SEQ ID NO: 39153 - DNA, 20 bp, Artificial Sequence
  sgRNA
  Olfr1462_5
gccaacctccagtcactcca

SEQ ID NO: 39154 - DNA, 20 bp, Artificial Sequence
  sgRNA
  Olfr1462_6
ggtgaagaatgcattcacaa

SEQ ID NO: 39155 - DNA, 20 bp, Artificial Sequence
  sgRNA
  Olfr1462_7
cataggccatggacactaaa

SEQ ID NO: 39156 - DNA, 20 bp, Artificial Sequence
  sgRNA
  Olfr1462_8
ggaataacagaagtccacta

SEQ ID NO: 39157 - DNA, 20 bp, Artificial Sequence
  sgRNA
  Olfr1462_9
tgtaaagtgtgaggtacaag

SEQ ID NO: 39158 - DNA, 20 bp, Artificial Sequence
  sgRNA
  Olfr1462_10
ctacagcatgaggaataagg

SEQ ID NO: 39159 - DNA, 20 bp, Artificial Sequence
  sgRNA
  Olfr1462_11
tctacatcatcactctggtg

SEQ ID NO: 39160 - DNA, 20 bp, Artificial Sequence
  sgRNA
  Olfr1462_12
tcctcatgctgtagaccaga

SEQ ID NO: 39161 - DNA, 20 bp, Artificial Sequence
  sgRNA
  Olfr1462_13
cagctgtcttcatttactat

SEQ ID NO: 39162 - DNA, 20 bp, Artificial Sequence
  sgRNA
  Olfr1462_14
gttcaacatagggatgacaa

SEQ ID NO: 39163 - DNA, 20 bp, Artificial Sequence
  sgRNA
  Olfr1462_15
gtcatggctggatttcttac

SEQ ID NO: 39164 - DNA, 20 bp, Artificial Sequence
  sgRNA
  Olfr1462_16
agtgtccatggagtgactgg

SEQ ID NO: 39165 - DNA, 20 bp, Artificial Sequence
  sgRNA
  Olfr1462_17
ctaaagataaactcatctga

SEQ ID NO: 39166 - DNA, 20 bp, Artificial Sequence
  sgRNA
  Olfr1462_18
gagtgatgatgtagatgagg

SEQ ID NO: 39167 - DNA, 20 bp, Artificial Sequence
  sgRNA
  Olfr1462_19
ttactcaagaaaatgtacat

SEQ ID NO: 39168 - DNA, 20 bp, Artificial Sequence
  sgRNA
  Olfr1462_20
aggaggaaggtaatgaagag

SEQ ID NO: 39169 - DNA, 20 bp, Artificial Sequence
  sgRNA
  Olfr1463_1
agagactaaatgtatctcca

SEQ ID NO: 39170 - DNA, 20 bp, Artificial Sequence
  sgRNA
  Olfr1463_2
agctatcacaccaaaagtca

SEQ ID NO: 39171 - DNA, 20 bp, Artificial Sequence
  sgRNA
  Olfr1463_3
gaatcagcagaatcaacccc

SEQ ID NO: 39172 - DNA, 20 bp, Artificial Sequence
  sgRNA
  Olfr1463_4
atggtagtagcatagtgtaa

SEQ ID NO: 39173 - DNA, 20 bp, Artificial Sequence
  sgRNA
  Olfr1463_5
gtatgtatgtgtctgatcat

SEQ ID NO: 39174 - DNA, 20 bp, Artificial Sequence
  sgRNA
  Olfr1463_6
actcatggctctctcttgct

SEQ ID NO: 39175 - DNA, 20 bp, Artificial Sequence
  sgRNA
  Olfr1463_7
gccaagctctagacattcaa

SEQ ID NO: 39176 - DNA, 20 bp, Artificial Sequence
  sgRNA
  Olfr1463_8
ttaaacatgcacacaggagc

SEQ ID NO: 39177 - DNA, 20 bp, Artificial Sequence
  sgRNA
  Olfr1463_9
gcatgtcacaaaaaaaatga

SEQ ID NO: 39178 - DNA, 20 bp, Artificial Sequence
  sgRNA
  Olfr1463_10
gatcatcagtaagtcccagc

SEQ ID NO: 39179 - DNA, 20 bp, Artificial Sequence
  sgRNA
  Olfr1463_11
ttgagtgtctcagtttacct

SEQ ID NO: 39180 - DNA, 20 bp, Artificial Sequence
  sgRNA
  Olfr1463_12
gtcatggctgggcttctatt

SEQ ID NO: 39181 - DNA, 20 bp, Artificial Sequence
  sgRNA
  Olfr1463_13
acaatcttaaacatgcacac

SEQ ID NO: 39182 - DNA, 20 bp, Artificial Sequence
  sgRNA
  Olfr1463_14
tcacaccaaaagtcatggct

SEQ ID NO: 39183 - DNA, 20 bp, Artificial Sequence
  sgRNA
  Olfr1463_15
tggctctctcttgctcggat

SEQ ID NO: 39184 - DNA, 20 bp, Artificial Sequence
  sgRNA
  Olfr1463_16
aggagaaaaatgatgaagag

SEQ ID NO: 39185 - DNA, 20 bp, Artificial Sequence
  sgRNA
  Olfr1463_17
ctgagcagcacagctattgt

SEQ ID NO: 39186 - DNA, 20 bp, Artificial Sequence
  sgRNA
  Olfr1463_18
caaccccaggttccctacca

SEQ ID NO: 39187 - DNA, 20 bp, Artificial Sequence
  sgRNA
  Olfr1463_19
agcaataaagtgggaagcac

SEQ ID NO: 39188 - DNA, 20 bp, Artificial Sequence
  sgRNA
  Olfr1463_20
aataaaaacagcaataaagt

SEQ ID NO: 39189 - DNA, 20 bp, Artificial Sequence
  sgRNA
  Olfr1465_1
ggtgtccccaatgtgaatgg

SEQ ID NO: 39190 - DNA, 20 bp, Artificial Sequence
  sgRNA
  Olfr1465_2
tcacacccaaagtcatgagt

SEQ ID NO: 39191 - DNA, 20 bp, Artificial Sequence
  sgRNA
  Olfr1465_3
tgattagaagtatcatgaag

SEQ ID NO: 39192 - DNA, 20 bp, Artificial Sequence
  sgRNA
  Olfr1465_4
cacacctgaagtcatagtgg

SEQ ID NO: 39193 - DNA, 20 bp, Artificial Sequence
  sgRNA
  Olfr1465_5
gaaggtgtccccaatgtgaa

SEQ ID NO: 39194 - DNA, 20 bp, Artificial Sequence
  sgRNA
  Olfr1465_6
atagtggtggcatagtgcaa

SEQ ID NO: 39195 - DNA, 20 bp, Artificial Sequence
  sgRNA
  Olfr1465_7
aatcatctacaccatcaccc

SEQ ID NO: 39196 - DNA, 20 bp, Artificial Sequence
  sgRNA
  Olfr1465_8
ccttcaatctttctttctgt

SEQ ID NO: 39197 - DNA, 20 bp, Artificial Sequence
  sgRNA
  Olfr1465_9
ggaggcaatcaggaaaccac

SEQ ID NO: 39198 - DNA, 20 bp, Artificial Sequence
  sgRNA
  Olfr1465_10
tctataggttcctatgcctg

SEQ ID NO: 39199 - DNA, 20 bp, Artificial Sequence
  sgRNA
  Olfr1465_11
ctgattgcctccattcacat

SEQ ID NO: 39200 - DNA, 20 bp, Artificial Sequence
  sgRNA
  Olfr1465_12
gattgcctccattcacattg

SEQ ID NO: 39201 - DNA, 20 bp, Artificial Sequence
  sgRNA
  Olfr1465_13
aggagcccactcatgacttt

SEQ ID NO: 39202 - DNA, 20 bp, Artificial Sequence
  sgRNA
  Olfr1465_14
tttccccagatttcctacca

SEQ ID NO: 39203 - DNA, 20 bp, Artificial Sequence
  sgRNA
  Olfr1465_15
catatgccattgaggccaac

SEQ ID NO: 39204 - DNA, 20 bp, Artificial Sequence
  sgRNA
  Olfr1465_16
attagaagtatcatgaagag

SEQ ID NO: 39205 - DNA, 20 bp, Artificial Sequence
  sgRNA
  Olfr1465_17
cctacagaaagaaagattga

SEQ ID NO: 39206 - DNA, 20 bp, Artificial Sequence
  sgRNA
  Olfr1465_18
gagtgtggagacacgagtcc

SEQ ID NO: 39207 - DNA, 20 bp, Artificial Sequence
  sgRNA
  Olfr1465_19
agtgaagtgtgcggcacaag

SEQ ID NO: 39208 - DNA, 20 bp, Artificial Sequence
  sgRNA
  Olfr1465_20
acaaggtcatatcctataat

SEQ ID NO: 39209 - DNA, 20 bp, Artificial Sequence
  sgRNA
  Olfr1466_1
atggtggtagcatagtatag

SEQ ID NO: 39210 - DNA, 20 bp, Artificial Sequence
  sgRNA
  Olfr1466_2
agagtaaataacatccacca

SEQ ID NO: 39211 - DNA, 20 bp, Artificial Sequence
  sgRNA
  Olfr1466_3
tgtatttccaagataaactg

SEQ ID NO: 39212 - DNA, 20 bp, Artificial Sequence
  sgRNA
  Olfr1466_4
tctcatctacatcattaccc

SEQ ID NO: 39213 - DNA, 20 bp, Artificial Sequence
  sgRNA
  Olfr1466_5
gtatgtatgtgtttcatcat

SEQ ID NO: 39214 - DNA, 20 bp, Artificial Sequence
  sgRNA
  Olfr1466_6
acatacacttggagtcatgg

SEQ ID NO: 39215 - DNA, 20 bp, Artificial Sequence
  sgRNA
  Olfr1466_7
ggatgttatttactcttcag

SEQ ID NO: 39216 - DNA, 20 bp, Artificial Sequence
  sgRNA
  Olfr1466_8
tgtgtctgtcttctacacca

SEQ ID NO: 39217 - DNA, 20 bp, Artificial Sequence
  sgRNA
  Olfr1466_9
aagagtaaataacatccacc

SEQ ID NO: 39218 - DNA, 20 bp, Artificial Sequence
  sgRNA
  Olfr1466_10
gaatcaacaggatcatcccc

SEQ ID NO: 39219 - DNA, 20 bp, Artificial Sequence
  sgRNA
  Olfr1466_11
tcatgggctgctatgctctt

SEQ ID NO: 39220 - DNA, 20 bp, Artificial Sequence
  sgRNA
  Olfr1466_12
agaagaaaaatgatgaaaag

SEQ ID NO: 39221 - DNA, 20 bp, Artificial Sequence
  sgRNA
  Olfr1466_13
tttccttgctaacttgtccc

SEQ ID NO: 39222 - DNA, 20 bp, Artificial Sequence
  sgRNA
  Olfr1466_14
cactgctgcatagcgatcac

SEQ ID NO: 39223 - DNA, 20 bp, Artificial Sequence
  sgRNA
  Olfr1466_15
gtcatggctggtctcataat

SEQ ID NO: 39224 - DNA, 20 bp, Artificial Sequence
  sgRNA
  Olfr1466_16
ctctagacatgcaatggaca

SEQ ID NO: 39225 - DNA, 20 bp, Artificial Sequence
  sgRNA
  Olfr1466_17
ccttgctaacttgtccctgg

SEQ ID NO: 39226 - DNA, 20 bp, Artificial Sequence
  sgRNA
  Olfr1466_18
tctacatcattaccctggta

SEQ ID NO: 39227 - DNA, 20 bp, Artificial Sequence
  sgRNA
  Olfr1466_19
catggtggtagcatagtata

SEQ ID NO: 39228 - DNA, 20 bp, Artificial Sequence
  sgRNA
  Olfr1466_20
atgaaacacatacatacact

SEQ ID NO: 39229 - DNA, 20 bp, Artificial Sequence
  sgRNA
  Olfr1467_1
tgctatttatacaatcaccg

SEQ ID NO: 39230 - DNA, 20 bp, Artificial Sequence
  sgRNA
  Olfr1467_2
tgactacaagtgtgtgtacg

SEQ ID NO: 39231 - DNA, 20 bp, Artificial Sequence
  sgRNA
  Olfr1467_3
ggtgaaatgtatctcctatg

SEQ ID NO: 39232 - DNA, 20 bp, Artificial Sequence
  sgRNA
  Olfr1467_4
gtatacaagaaccagctcac

SEQ ID NO: 39233 - DNA, 20 bp, Artificial Sequence
  sgRNA
  Olfr1467_5
gaccatggtgtagaacaccg

SEQ ID NO: 39234 - DNA, 20 bp, Artificial Sequence
  sgRNA
  Olfr1467_6
agctgattgcatcttcacga

SEQ ID NO: 39235 - DNA, 20 bp, Artificial Sequence
  sgRNA
  Olfr1467_7
ggacacagataaaattgcct

SEQ ID NO: 39236 - DNA, 20 bp, Artificial Sequence
  sgRNA
  Olfr1467_8
gtgtgtacgtggctgatcat

SEQ ID NO: 39237 - DNA, 20 bp, Artificial Sequence
  sgRNA
  Olfr1467_9
gcaagaaatgtgatgaagag

SEQ ID NO: 39238 - DNA, 20 bp, Artificial Sequence
  sgRNA
  Olfr1467_10
gccaagttccaatcactcta

SEQ ID NO: 39239 - DNA, 20 bp, Artificial Sequence
  sgRNA
  Olfr1467_11
tcctcaagctgtagaccaga

SEQ ID NO: 39240 - DNA, 20 bp, Artificial Sequence
  sgRNA
  Olfr1467_12
tgcctcggtgttctacacca

SEQ ID NO: 39241 - DNA, 20 bp, Artificial Sequence
  sgRNA
  Olfr1467_13
gtagaccagagggttcagca

SEQ ID NO: 39242 - DNA, 20 bp, Artificial Sequence
  sgRNA
  Olfr1467_14
catccccagattccccacca

SEQ ID NO: 39243 - DNA, 20 bp, Artificial Sequence
  sgRNA
  Olfr1467_15
tactgtggagaattacctgt

SEQ ID NO: 39244 - DNA, 20 bp, Artificial Sequence
  sgRNA
  Olfr1467_16
atcagctgcaggacatcaca

SEQ ID NO: 39245 - DNA, 20 bp, Artificial Sequence
  sgRNA
  Olfr1467_17
ggtgacaaaaatgaacacat

SEQ ID NO: 39246 - DNA, 20 bp, Artificial Sequence
  sgRNA
  Olfr1467_18
ggagactgcagtgaagtggg

SEQ ID NO: 39247 - DNA, 20 bp, Artificial Sequence
  sgRNA
  Olfr1467_19
tgacagatatgccagtgagc

SEQ ID NO: 39248 - DNA, 20 bp, Artificial Sequence
  sgRNA
  Olfr1467_20
aatactagttccatagaaaa

SEQ ID NO: 39249 - DNA, 20 bp, Artificial Sequence
  sgRNA
  Olfr1469_1
gactgaaagtgtccccaatg

SEQ ID NO: 39250 - DNA, 20 bp, Artificial Sequence
  sgRNA
  Olfr1469_2
gcacacatttgcagtcatgg

SEQ ID NO: 39251 - DNA, 20 bp, Artificial Sequence
  sgRNA
  Olfr1469_3
cctcatctataccatcaccc

SEQ ID NO: 39252 - DNA, 20 bp, Artificial Sequence
  sgRNA
  Olfr1469_4
tcacacccacagtcatgact

SEQ ID NO: 39253 - DNA, 20 bp, Artificial Sequence
  sgRNA
  Olfr1469_5
ttgtgcctcacacttcattg

SEQ ID NO: 39254 - DNA, 20 bp, Artificial Sequence
  sgRNA
  Olfr1469_6
gatcatggtatagaacacag

SEQ ID NO: 39255 - DNA, 20 bp, Artificial Sequence
  sgRNA
  Olfr1469_7
ttccgcatgctatagaccag

SEQ ID NO: 39256 - DNA, 20 bp, Artificial Sequence
  sgRNA
  Olfr1469_8
ggaggcattcaaaaaaccac

SEQ ID NO: 39257 - DNA, 20 bp, Artificial Sequence
  sgRNA
  Olfr1469_9
attagcccagtcatgactgt

SEQ ID NO: 39258 - DNA, 20 bp, Artificial Sequence
  sgRNA
  Olfr1469_10
aggagaaatgtaatgaaaag

SEQ ID NO: 39259 - DNA, 20 bp, Artificial Sequence
  sgRNA
  Olfr1469_11
gaaagtgtccccaatgtgga

SEQ ID NO: 39260 - DNA, 20 bp, Artificial Sequence
  sgRNA
  Olfr1469_12
tgtataggttcctatacctg

SEQ ID NO: 39261 - DNA, 20 bp, Artificial Sequence
  sgRNA
  Olfr1469_13
ccagggtgatggtatagatg

SEQ ID NO: 39262 - DNA, 20 bp, Artificial Sequence
  sgRNA
  Olfr1469_14
catccccagatttcccacca

SEQ ID NO: 39263 - DNA, 20 bp, Artificial Sequence
  sgRNA
  Olfr1469_15
tattagcccagtcatgactg

SEQ ID NO: 39264 - DNA, 20 bp, Artificial Sequence
  sgRNA
  Olfr1469_16
ctcaagttctggatatcgaa

SEQ ID NO: 39265 - DNA, 20 bp, Artificial Sequence
  sgRNA
  Olfr1469_17
tcatccccagatttcccacc

SEQ ID NO: 39266 - DNA, 20 bp, Artificial Sequence
  sgRNA
  Olfr1469_18
acagtcatgactgggctaat

SEQ ID NO: 39267 - DNA, 20 bp, Artificial Sequence
  sgRNA
  Olfr1469_19
atagaccagaggattcagca

SEQ ID NO: 39268 - DNA, 20 bp, Artificial Sequence
  sgRNA
  Olfr1469_20
catctataccatcaccctgg

SEQ ID NO: 39269 - DNA, 20 bp, Artificial Sequence
  sgRNA
  Olfr147_1
agaattccatctcctatgcg

SEQ ID NO: 39270 - DNA, 20 bp, Artificial Sequence
  sgRNA
  Olfr147_2
aataatctacataatcacag

SEQ ID NO: 39271 - DNA, 20 bp, Artificial Sequence
  sgRNA
  Olfr147_3
tctgagcatacagcctgtgt

SEQ ID NO: 39272 - DNA, 20 bp, Artificial Sequence
  sgRNA
  Olfr147_4
gatatcacagaacagatctg

SEQ ID NO: 39273 - DNA, 20 bp, Artificial Sequence
  sgRNA
  Olfr147_5
gctggatcctctgcccacac

SEQ ID NO: 39274 - DNA, 20 bp, Artificial Sequence
  sgRNA
  Olfr147_6
tatcacagaacagatctgag

SEQ ID NO: 39275 - DNA, 20 bp, Artificial Sequence
  sgRNA
  Olfr147_7
atatcacagaacagatctga

SEQ ID NO: 39276 - DNA, 20 bp, Artificial Sequence
  sgRNA
  Olfr147_8
ttatgtagattattagaaac

SEQ ID NO: 39277 - DNA, 20 bp, Artificial Sequence
  sgRNA
  Olfr147_9
atctacataatcacagtggt

SEQ ID NO: 39278 - DNA, 20 bp, Artificial Sequence
  sgRNA
  Olfr147_10
atacaatagtggattacaga

SEQ ID NO: 39279 - DNA, 20 bp, Artificial Sequence
  sgRNA
  Olfr147_11
ggttgtggttctcatagttg

SEQ ID NO: 39280 - DNA, 20 bp, Artificial Sequence
  sgRNA
  Olfr147_12
gatgacattgacattgcaga

SEQ ID NO: 39281 - DNA, 20 bp, Artificial Sequence
  sgRNA
  Olfr147_13
catgcaccccgcataggaga

SEQ ID NO: 39282 - DNA, 20 bp, Artificial Sequence
  sgRNA
  Olfr147_14
aaccacaacctcattgacat

SEQ ID NO: 39283 - DNA, 20 bp, Artificial Sequence
  sgRNA
  Olfr147_15
agagtaacagagatcaatga

SEQ ID NO: 39284 - DNA, 20 bp, Artificial Sequence
  sgRNA
  Olfr147_16
gaagaatgtcacataagtaa

SEQ ID NO: 39285 - DNA, 20 bp, Artificial Sequence
  sgRNA
  Olfr147_17
tcctcaaactgtaaatcaga

SEQ ID NO: 39286 - DNA, 20 bp, Artificial Sequence
  sgRNA
  Olfr147_18
gtgcaggaaagttgaaggag

SEQ ID NO: 39287 - DNA, 20 bp, Artificial Sequence
  sgRNA
  Olfr147_19
gttgtggttctcatagttgt

SEQ ID NO: 39288 - DNA, 20 bp, Artificial Sequence
  sgRNA
  Olfr147_20
tcttctggatctatggaaca

SEQ ID NO: 39289 - DNA, 20 bp, Artificial Sequence
  sgRNA
  Olfr1490_1
aagttgttggccaaaatgtg

SEQ ID NO: 39290 - DNA, 20 bp, Artificial Sequence
  sgRNA
  Olfr1490_2
cagcactaccaagtccaatg

SEQ ID NO: 39291 - DNA, 20 bp, Artificial Sequence
  sgRNA
  Olfr1490_3
gtgttatagtcatgatgaga

SEQ ID NO: 39292 - DNA, 20 bp, Artificial Sequence
  sgRNA
  Olfr1490_4
agattatcaatccataagcc

SEQ ID NO: 39293 - DNA, 20 bp, Artificial Sequence
  sgRNA
  Olfr1490_5
tgtacccagtgtgtatacca

SEQ ID NO: 39294 - DNA, 20 bp, Artificial Sequence
  sgRNA
  Olfr1490_6
cataggccatgatagccagg

SEQ ID NO: 39295 - DNA, 20 bp, Artificial Sequence
  sgRNA
  Olfr1490_7
caccacctatgccttgatag

SEQ ID NO: 39296 - DNA, 20 bp, Artificial Sequence
  sgRNA
  Olfr1490_8
gcacacacgagacgcatcag

SEQ ID NO: 39297 - DNA, 20 bp, Artificial Sequence
  sgRNA
  Olfr1490_9
tgggatggtaactggagacg

SEQ ID NO: 39298 - DNA, 20 bp, Artificial Sequence
  sgRNA
  Olfr1490_10
gacggggcgcaagtacatga

SEQ ID NO: 39299 - DNA, 20 bp, Artificial Sequence
  sgRNA
  Olfr1490_11
cactatcaaggcataggtgg

SEQ ID NO: 39300 - DNA, 20 bp, Artificial Sequence
  sgRNA
  Olfr1490_12
gtggtggcaatgaaaaagaa

SEQ ID NO: 39301 - DNA, 20 bp, Artificial Sequence
  sgRNA
  Olfr1490_13
gagacaaactgatcttgctt

SEQ ID NO: 39302 - DNA, 20 bp, Artificial Sequence
  sgRNA
  Olfr1490_14
caaattccatgaacaatgag

SEQ ID NO: 39303 - DNA, 20 bp, Artificial Sequence
  sgRNA
  Olfr1490_15
gtactgcaaaggatgacaga

SEQ ID NO: 39304 - DNA, 20 bp, Artificial Sequence
  sgRNA
  Olfr1490_16
gttcctgtccttacagcttg

SEQ ID NO: 39305 - DNA, 20 bp, Artificial Sequence
  sgRNA
  Olfr1490_17
gtctccctggtatacacact

SEQ ID NO: 39306 - DNA, 20 bp, Artificial Sequence
  sgRNA
  Olfr1490_18
cttgggatggtaactggaga

SEQ ID NO: 39307 - DNA, 20 bp, Artificial Sequence
  sgRNA
  Olfr1490_19
tagtgctgattgcttcctcc

SEQ ID NO: 39308 - DNA, 20 bp, Artificial Sequence
  sgRNA
  Olfr1490_20
atacgtagctctggacgttt

SEQ ID NO: 39309 - DNA, 20 bp, Artificial Sequence
  sgRNA
  Olfr1491_1
ccaggatgcccactacgtag

SEQ ID NO: 39310 - DNA, 20 bp, Artificial Sequence
  sgRNA
  Olfr1491_2
agatcatcagatacagcagg

SEQ ID NO: 39311 - DNA, 20 bp, Artificial Sequence
  sgRNA
  Olfr1491_3
ccaggaaagacagactactg

SEQ ID NO: 39312 - DNA, 20 bp, Artificial Sequence
  sgRNA
  Olfr1491_4
aagatgttagaaagcatcag

SEQ ID NO: 39313 - DNA, 20 bp, Artificial Sequence
  sgRNA
  Olfr1491_5
gcagctctgatgatgaggac

SEQ ID NO: 39314 - DNA, 20 bp, Artificial Sequence
  sgRNA
  Olfr1491_6
tcatcagagctgctcgagcg

SEQ ID NO: 39315 - DNA, 20 bp, Artificial Sequence
  sgRNA
  Olfr1491_7
tgtagaccagggctatttgc

SEQ ID NO: 39316 - DNA, 20 bp, Artificial Sequence
  sgRNA
  Olfr1491_8
ctctgcagagggtcgccaaa

SEQ ID NO: 39317 - DNA, 20 bp, Artificial Sequence
  sgRNA
  Olfr1491_9
gtaatgtccacagaagggca

SEQ ID NO: 39318 - DNA, 20 bp, Artificial Sequence
  sgRNA
  Olfr1491_10
gttgagtaatggagtcacaa

SEQ ID NO: 39319 - DNA, 20 bp, Artificial Sequence
  sgRNA
  Olfr1491_11
gtggtcttgctacagtatgg

SEQ ID NO: 39320 - DNA, 20 bp, Artificial Sequence
  sgRNA
  Olfr1491_12
tgatgaggttgtagtgcaga

SEQ ID NO: 39321 - DNA, 20 bp, Artificial Sequence
  sgRNA
  Olfr1491_13
agtcacaaaggtgtagacca

SEQ ID NO: 39322 - DNA, 20 bp, Artificial Sequence
  sgRNA
  Olfr1491_14
tttgacatccttgttcctaa

SEQ ID NO: 39323 - DNA, 20 bp, Artificial Sequence
  sgRNA
  Olfr1491_15
tccaggtaatgtccacagaa

SEQ ID NO: 39324 - DNA, 20 bp, Artificial Sequence
  sgRNA
  Olfr1491_16
accctctgatttataccctt

SEQ ID NO: 39325 - DNA, 20 bp, Artificial Sequence
  sgRNA
  Olfr1491_17
ttcttcttcctcactctggg

SEQ ID NO: 39326 - DNA, 20 bp, Artificial Sequence
  sgRNA
  Olfr1491_18
ggtaatgtccacagaagggc

SEQ ID NO: 39327 - DNA, 20 bp, Artificial Sequence
  sgRNA
  Olfr1491_19
gggtgtgtgcaaggaagtgt

SEQ ID NO: 39328 - DNA, 20 bp, Artificial Sequence
  sgRNA
  Olfr1491_20
tgaggaccggcaaatagccc

SEQ ID NO: 39329 - DNA, 20 bp, Artificial Sequence
  sgRNA
  Olfr1493-ps1_1
gactacatatgccttgatag

SEQ ID NO: 39330 - DNA, 20 bp, Artificial Sequence
  sgRNA
  Olfr1493-ps1_2
ggttcccagtgtgtacacca

SEQ ID NO: 39331 - DNA, 20 bp, Artificial Sequence
  sgRNA
  Olfr1493-ps1_3
caaactccatcaacactgag

SEQ ID NO: 39332 - DNA, 20 bp, Artificial Sequence
  sgRNA
  Olfr1493-ps1_4
gttcgggcgcaggtacatga

SEQ ID NO: 39333 - DNA, 20 bp, Artificial Sequence
  sgRNA
  Olfr1493-ps1_5
tacagcaatggctaatgcgg

SEQ ID NO: 39334 - DNA, 20 bp, Artificial Sequence
  sgRNA
  Olfr1493-ps1_6
cataagccaggcttattcca

SEQ ID NO: 39335 - DNA, 20 bp, Artificial Sequence
  sgRNA
  Olfr1493-ps1_7
agatgaactgatctttcttg

SEQ ID NO: 39336 - DNA, 20 bp, Artificial Sequence
  sgRNA
  Olfr1493-ps1_8
agatgatcaatgcataagcc

SEQ ID NO: 39337 - DNA, 20 bp, Artificial Sequence
  sgRNA
  Olfr1493-ps1_9
gtactgtaaaggatgacaga

SEQ ID NO: 39338 - DNA, 20 bp, Artificial Sequence
  sgRNA
  Olfr1493-ps1_10
cataggccatggaagccagg

SEQ ID NO: 39339 - DNA, 20 bp, Artificial Sequence
  sgRNA
  Olfr1493-ps1_11
gtagtcgcaatgaaaaagaa

SEQ ID NO: 39340 - DNA, 20 bp, Artificial Sequence
  sgRNA
  Olfr1493-ps1_12
tgtgacgaccagctgctgag

SEQ ID NO: 39341 - DNA, 20 bp, Artificial Sequence
  sgRNA
  Olfr1493-ps1_13
aataaagaagaccatctgag

SEQ ID NO: 39342 - DNA, 20 bp, Artificial Sequence
  sgRNA
  Olfr1493-ps1_14
tgaactgatctttcttgggg

SEQ ID NO: 39343 - DNA, 20 bp, Artificial Sequence
  sgRNA
  Olfr1493-ps1_15
tctggtaagaaccttctcta

SEQ ID NO: 39344 - DNA, 20 bp, Artificial Sequence
  sgRNA
  Olfr1493-ps1_16
ggagaaccactcagtgttga

SEQ ID NO: 39345 - DNA, 20 bp, Artificial Sequence
  sgRNA
  Olfr1493-ps1_17
ctaggcgattgggataggca

SEQ ID NO: 39346 - DNA, 20 bp, Artificial Sequence
  sgRNA
  Olfr1493-ps1_18
ctcagcagctggtcgtcaca

SEQ ID NO: 39347 - DNA, 20 bp, Artificial Sequence
  sgRNA
  Olfr1493-ps1_19
ggtcttgtccttacagcttg

SEQ ID NO: 39348 - DNA, 20 bp, Artificial Sequence
  sgRNA
  Olfr1493-ps1_20
ctattcctgataggctgccc

SEQ ID NO: 39349 - DNA, 20 bp, Artificial Sequence
  sgRNA
  Olfr1494_1
ccaagacagacagactactg

SEQ ID NO: 39350 - DNA, 20 bp, Artificial Sequence
  sgRNA
  Olfr1494_2
tgaggctgtagtgtagaggg

SEQ ID NO: 39351 - DNA, 20 bp, Artificial Sequence
  sgRNA
  Olfr1494_3
ctgtatttgatgatcctctg

SEQ ID NO: 39352 - DNA, 20 bp, Artificial Sequence
  sgRNA
  Olfr1494_4
aagatgttagaaagcatcaa

SEQ ID NO: 39353 - DNA, 20 bp, Artificial Sequence
  sgRNA
  Olfr1494_5
ggatcatcaaatacagcagg

SEQ ID NO: 39354 - DNA, 20 bp, Artificial Sequence
  sgRNA
  Olfr1494_6
tttcacatctttattccgaa

SEQ ID NO: 39355 - DNA, 20 bp, Artificial Sequence
  sgRNA
  Olfr1494_7
cgtgacaaaggtgtagacca

SEQ ID NO: 39356 - DNA, 20 bp, Artificial Sequence
  sgRNA
  Olfr1494_8
tgatggctgcattaccacag

SEQ ID NO: 39357 - DNA, 20 bp, Artificial Sequence
  sgRNA
  Olfr1494_9
gatgctttctaacatctttg

SEQ ID NO: 39358 - DNA, 20 bp, Artificial Sequence
  sgRNA
  Olfr1494_10
gctgcagccttgtatatctg

SEQ ID NO: 39359 - DNA, 20 bp, Artificial Sequence
  sgRNA
  Olfr1494_11
cttcgcatgcgctctgcaga

SEQ ID NO: 39360 - DNA, 20 bp, Artificial Sequence
  sgRNA
  Olfr1494_12
ccaggatgcccactacatag

SEQ ID NO: 39361 - DNA, 20 bp, Artificial Sequence
  sgRNA
  Olfr1494_13
agcggggcctcagatataca

SEQ ID NO: 39362 - DNA, 20 bp, Artificial Sequence
  sgRNA
  Olfr1494_14
tcctggtcatgtccacagaa

SEQ ID NO: 39363 - DNA, 20 bp, Artificial Sequence
  sgRNA
  Olfr1494_15
atcctctgatttacaccctt

SEQ ID NO: 39364 - DNA, 20 bp, Artificial Sequence
  sgRNA
  Olfr1494_16
tgatgaggctgtagtgtaga

SEQ ID NO: 39365 - DNA, 20 bp, Artificial Sequence
  sgRNA
  Olfr1494_17
attgagtaatggcgtgacaa

SEQ ID NO: 39366 - DNA, 20 bp, Artificial Sequence
  sgRNA
  Olfr1494_18
ctctgcagagggtcgccaga

SEQ ID NO: 39367 - DNA, 20 bp, Artificial Sequence
  sgRNA
  Olfr1494_19
caggcagtcctctatgtagt

SEQ ID NO: 39368 - DNA, 20 bp, Artificial Sequence
  sgRNA
  Olfr1494_20
actgcagcaagaccacagtg

SEQ ID NO: 39369 - DNA, 20 bp, Artificial Sequence
  sgRNA
  Olfr1495_1
taataggagccacatcacag

SEQ ID NO: 39370 - DNA, 20 bp, Artificial Sequence
  sgRNA
  Olfr1495_2
ctaggatactaactacatag

SEQ ID NO: 39371 - DNA, 20 bp, Artificial Sequence
  sgRNA
  Olfr1495_3
caataccaccattatctggg

SEQ ID NO: 39372 - DNA, 20 bp, Artificial Sequence
  sgRNA
  Olfr1495_4
ccggaacattggttaagaca

SEQ ID NO: 39373 - DNA, 20 bp, Artificial Sequence
  sgRNA
  Olfr1495_5
ctacgcatgcattctgcaga

SEQ ID NO: 39374 - DNA, 20 bp, Artificial Sequence
  sgRNA
  Olfr1495_6
gttcacatggatgtcagcac

SEQ ID NO: 39375 - DNA, 20 bp, Artificial Sequence
  sgRNA
  Olfr1495_7
ttctgcagagggacgccaga

SEQ ID NO: 39376 - DNA, 20 bp, Artificial Sequence
  sgRNA
  Olfr1495_8
tcaaggcggtgtctacagaa

SEQ ID NO: 39377 - DNA, 20 bp, Artificial Sequence
  sgRNA
  Olfr1495_9
ccacaaatgacagactgccc

SEQ ID NO: 39378 - DNA, 20 bp, Artificial Sequence
  sgRNA
  Olfr1495_10
aagatgttggaaagaatcaa

SEQ ID NO: 39379 - DNA, 20 bp, Artificial Sequence
  sgRNA
  Olfr1495_11
gtagcaaaaccacagtgaga

SEQ ID NO: 39380 - DNA, 20 bp, Artificial Sequence
  sgRNA
  Olfr1495_12
ggaagtggttgatttcaagg

SEQ ID NO: 39381 - DNA, 20 bp, Artificial Sequence
  sgRNA
  Olfr1495_13
tcaaagagcctattaccatc

SEQ ID NO: 39382 - DNA, 20 bp, Artificial Sequence
  sgRNA
  Olfr1495_14
gcacaggccaggcgcataat

SEQ ID NO: 39383 - DNA, 20 bp, Artificial Sequence
  sgRNA
  Olfr1495_15
ggaatgggactgtcagaact

SEQ ID NO: 39384 - DNA, 20 bp, Artificial Sequence
  sgRNA
  Olfr1495_16
ccagaaactgtgtgtccaga

SEQ ID NO: 39385 - DNA, 20 bp, Artificial Sequence
  sgRNA
  Olfr1495_17
tttgatatctttattcctga

SEQ ID NO: 39386 - DNA, 20 bp, Artificial Sequence
  sgRNA
  Olfr1495_18
gcacaccacccagataatgg

SEQ ID NO: 39387 - DNA, 20 bp, Artificial Sequence
  sgRNA
  Olfr1495_19
agtaccaaagatataaacca

SEQ ID NO: 39388 - DNA, 20 bp, Artificial Sequence
  sgRNA
  Olfr1495_20
tgtggctcctattatgcgcc

SEQ ID NO: 39389 - DNA, 20 bp, Artificial Sequence
  sgRNA
  Olfr1496_1
gcaggaaagtttgatcagag

SEQ ID NO: 39390 - DNA, 20 bp, Artificial Sequence
  sgRNA
  Olfr1496_2
tgtttgtataattcagaggg

SEQ ID NO: 39391 - DNA, 20 bp, Artificial Sequence
  sgRNA
  Olfr1496_3
aagatgtatatccaaaccaa

SEQ ID NO: 39392 - DNA, 20 bp, Artificial Sequence
  sgRNA
  Olfr1496_4
ggccagaagagtatgtgtca

SEQ ID NO: 39393 - DNA, 20 bp, Artificial Sequence
  sgRNA
  Olfr1496_5
tttattgatgagcttcctaa

SEQ ID NO: 39394 - DNA, 20 bp, Artificial Sequence
  sgRNA
  Olfr1496_6
gaaaaagtaaacccctacaa

SEQ ID NO: 39395 - DNA, 20 bp, Artificial Sequence
  sgRNA
  Olfr1496_7
tgtactgagaatttcatcca

SEQ ID NO: 39396 - DNA, 20 bp, Artificial Sequence
  sgRNA
  Olfr1496_8
tgatgtttgtataattcaga

SEQ ID NO: 39397 - DNA, 20 bp, Artificial Sequence
  sgRNA
  Olfr1496_9
aggacatgaaaggtgccctt

SEQ ID NO: 39398 - DNA, 20 bp, Artificial Sequence
  sgRNA
  Olfr1496_10
atacaaacatcatgcacccc

SEQ ID NO: 39399 - DNA, 20 bp, Artificial Sequence
  sgRNA
  Olfr1496_11
gtcacagaagaagtgttgga

SEQ ID NO: 39400 - DNA, 20 bp, Artificial Sequence
  sgRNA
  Olfr1496_12
aggaaatatcagcaaaagat

SEQ ID NO: 39401 - DNA, 20 bp, Artificial Sequence
  sgRNA
  Olfr1496_13
tagatgaaagggtttaacat

SEQ ID NO: 39402 - DNA, 20 bp, Artificial Sequence
  sgRNA
  Olfr1496_14
agtctcataattctggccat

SEQ ID NO: 39403 - DNA, 20 bp, Artificial Sequence
  sgRNA
  Olfr1496_15
agtcaatccatttcctatga

SEQ ID NO: 39404 - DNA, 20 bp, Artificial Sequence
  sgRNA
  Olfr1496_16
aatatcagcaaaagataggt

SEQ ID NO: 39405 - DNA, 20 bp, Artificial Sequence
  sgRNA
  Olfr1496_17
tggtgcagtactcttcacag

SEQ ID NO: 39406 - DNA, 20 bp, Artificial Sequence
  sgRNA
  Olfr1496_18
cctcagggtgagtggatgaa

SEQ ID NO: 39407 - DNA, 20 bp, Artificial Sequence
  sgRNA
  Olfr1496_19
gacataggagaagagaatga

SEQ ID NO: 39408 - DNA, 20 bp, Artificial Sequence
  sgRNA
  Olfr1496_20
gagcaggaaagtttgatcag

SEQ ID NO: 39409 - DNA, 20 bp, Artificial Sequence
  sgRNA
  Olfr1497_1
attgttaaaactcgtatgtg

SEQ ID NO: 39410 - DNA, 20 bp, Artificial Sequence
  sgRNA
  Olfr1497_2
cattcactgaacatcctgag

SEQ ID NO: 39411 - DNA, 20 bp, Artificial Sequence
  sgRNA
  Olfr1497_3
acattggtgtttgaagtcgg

SEQ ID NO: 39412 - DNA, 20 bp, Artificial Sequence
  sgRNA
  Olfr1497_4
atgactgagaaggcccgtgt

SEQ ID NO: 39413 - DNA, 20 bp, Artificial Sequence
  sgRNA
  Olfr1497_5
cgtaggccatgattgccaag

SEQ ID NO: 39414 - DNA, 20 bp, Artificial Sequence
  sgRNA
  Olfr1497_6
acagcacagccagcatctga

SEQ ID NO: 39415 - DNA, 20 bp, Artificial Sequence
  sgRNA
  Olfr1497_7
tattccccagcagggtagcg

SEQ ID NO: 39416 - DNA, 20 bp, Artificial Sequence
  sgRNA
  Olfr1497_8
agatgtccacaaaggaaagg

SEQ ID NO: 39417 - DNA, 20 bp, Artificial Sequence
  sgRNA
  Olfr1497_9
cagaaagaactcagtcacga

SEQ ID NO: 39418 - DNA, 20 bp, Artificial Sequence
  sgRNA
  Olfr1497_10
ggtagaaactcaaaaataaa

SEQ ID NO: 39419 - DNA, 20 bp, Artificial Sequence
  sgRNA
  Olfr1497_11
tgtcatgcctgcttgcattg

SEQ ID NO: 39420 - DNA, 20 bp, Artificial Sequence
  sgRNA
  Olfr1497_12
gagaagatcaaagatttcca

SEQ ID NO: 39421 - DNA, 20 bp, Artificial Sequence
  sgRNA
  Olfr1497_13
ggacagctacattcaagagg

SEQ ID NO: 39422 - DNA, 20 bp, Artificial Sequence
  sgRNA
  Olfr1497_14
ccccagttaccagacctaca

SEQ ID NO: 39423 - DNA, 20 bp, Artificial Sequence
  sgRNA
  Olfr1497_15
tggggacagctacattcaag

SEQ ID NO: 39424 - DNA, 20 bp, Artificial Sequence
  sgRNA
  Olfr1497_16
gagatcaccacaatgcaagc

SEQ ID NO: 39425 - DNA, 20 bp, Artificial Sequence
  sgRNA
  Olfr1497_17
cattcctgtattccccagca

SEQ ID NO: 39426 - DNA, 20 bp, Artificial Sequence
  sgRNA
  Olfr1497_18
gacagtccgaataaagccac

SEQ ID NO: 39427 - DNA, 20 bp, Artificial Sequence
  sgRNA
  Olfr1497_19
atgcaaatccgctcagctgg

SEQ ID NO: 39428 - DNA, 20 bp, Artificial Sequence
  sgRNA
  Olfr1497_20
gctaccctgctggggaatac

SEQ ID NO: 39429 - DNA, 20 bp, Artificial Sequence
  sgRNA
  Olfr1499_1
ccaacacagagagatgactc

SEQ ID NO: 39430 - DNA, 20 bp, Artificial Sequence
  sgRNA
  Olfr1499_2
gctttactgaccatccagag

SEQ ID NO: 39431 - DNA, 20 bp, Artificial Sequence
  sgRNA
  Olfr1499_3
tactggtggcctatgtatgt

SEQ ID NO: 39432 - DNA, 20 bp, Artificial Sequence
  sgRNA
  Olfr1499_4
tctatctggtcaccatccta

SEQ ID NO: 39433 - DNA, 20 bp, Artificial Sequence
  sgRNA
  Olfr1499_5
tctgaagctggacatccatc

SEQ ID NO: 39434 - DNA, 20 bp, Artificial Sequence
  sgRNA
  Olfr1499_6
gcttcagaaagctcactagc

SEQ ID NO: 39435 - DNA, 20 bp, Artificial Sequence
  sgRNA
  Olfr1499_7
cagcatggccaggatctgag

SEQ ID NO: 39436 - DNA, 20 bp, Artificial Sequence
  sgRNA
  Olfr1499_8
cataggacatcactgccaac

SEQ ID NO: 39437 - DNA, 20 bp, Artificial Sequence
  sgRNA
  Olfr1499_9
tcttatatacatgaaggtga

SEQ ID NO: 39438 - DNA, 20 bp, Artificial Sequence
  sgRNA
  Olfr1499_10
gtaactgaattcattcttgt

SEQ ID NO: 39439 - DNA, 20 bp, Artificial Sequence
  sgRNA
  Olfr1499_11
catggtcattcttatccaga

SEQ ID NO: 39440 - DNA, 20 bp, Artificial Sequence
  sgRNA
  Olfr1499_12
gaggaacctcccactctgga

SEQ ID NO: 39441 - DNA, 20 bp, Artificial Sequence
  sgRNA
  Olfr1499_13
tgactgtcttgatgataagc

SEQ ID NO: 39442 - DNA, 20 bp, Artificial Sequence
  sgRNA
  Olfr1499_14
actgcaggccagcttcagga

SEQ ID NO: 39443 - DNA, 20 bp, Artificial Sequence
  sgRNA
  Olfr1499_15
gtcaccatcctagggaactt

SEQ ID NO: 39444 - DNA, 20 bp, Artificial Sequence
  sgRNA
  Olfr1499_16
ataaagtcttcaggtggcag

SEQ ID NO: 39445 - DNA, 20 bp, Artificial Sequence
  sgRNA
  Olfr1499_17
tgtcttgatgataagcaggt

SEQ ID NO: 39446 - DNA, 20 bp, Artificial Sequence
  sgRNA
  Olfr1499_18
ttatcatcaagacagtcatg

SEQ ID NO: 39447 - DNA, 20 bp, Artificial Sequence
  sgRNA
  Olfr1499_19
cccagataacccacatacat

SEQ ID NO: 39448 - DNA, 20 bp, Artificial Sequence
  sgRNA
  Olfr1499_20
aagtacagaatgtttcctgt

SEQ ID NO: 39449 - DNA, 20 bp, Artificial Sequence
  sgRNA
  Olfr15_1
tggagacacaagtctcaatg

SEQ ID NO: 39450 - DNA, 20 bp, Artificial Sequence
  sgRNA
  Olfr15_2
agatgctgaaaaatttatgg

SEQ ID NO: 39451 - DNA, 20 bp, Artificial Sequence
  sgRNA
  Olfr15_3
agtgaatgttgactgaatca

SEQ ID NO: 39452 - DNA, 20 bp, Artificial Sequence
  sgRNA
  Olfr15_4
gcagaggcgaggattcatga

SEQ ID NO: 39453 - DNA, 20 bp, Artificial Sequence
  sgRNA
  Olfr15_5
tttccccagcaatcttccca

SEQ ID NO: 39454 - DNA, 20 bp, Artificial Sequence
  sgRNA
  Olfr15_6
ggcctcttacttgttgacgc

SEQ ID NO: 39455 - DNA, 20 bp, Artificial Sequence
  sgRNA
  Olfr15_7
ctactctgtggtcacaccca

SEQ ID NO: 39456 - DNA, 20 bp, Artificial Sequence
  sgRNA
  Olfr15_8
tcgtggtgatggcatttgat

SEQ ID NO: 39457 - DNA, 20 bp, Artificial Sequence
  sgRNA
  Olfr15_9
gcgtcaacaagtaagaggcc

SEQ ID NO: 39458 - DNA, 20 bp, Artificial Sequence
  sgRNA
  Olfr15_10
agacacaagtctcaatgagg

SEQ ID NO: 39459 - DNA, 20 bp, Artificial Sequence
  sgRNA
  Olfr15_11
tctgggagcttcattctgat

SEQ ID NO: 39460 - DNA, 20 bp, Artificial Sequence
  sgRNA
  Olfr15_12
atcggtatgtggcagtttgt

SEQ ID NO: 39461 - DNA, 20 bp, Artificial Sequence
  sgRNA
  Olfr15_13
acaagacaatcagctatggt

SEQ ID NO: 39462 - DNA, 20 bp, Artificial Sequence
  sgRNA
  Olfr15_14
ctttgattactgctcttagc

SEQ ID NO: 39463 - DNA, 20 bp, Artificial Sequence
  sgRNA
  Olfr15_15
agtaaaggcaaggtctagag

SEQ ID NO: 39464 - DNA, 20 bp, Artificial Sequence
  sgRNA
  Olfr15_16
ctctgtggagggacgtcgaa

SEQ ID NO: 39465 - DNA, 20 bp, Artificial Sequence
  sgRNA
  Olfr15_17
catcagaatgaagctcccag

SEQ ID NO: 39466 - DNA, 20 bp, Artificial Sequence
  sgRNA
  Olfr15_18
atgaagatccgctctgtgga

SEQ ID NO: 39467 - DNA, 20 bp, Artificial Sequence
  sgRNA
  Olfr15_19
tgtttgtaccttcttcactg

SEQ ID NO: 39468 - DNA, 20 bp, Artificial Sequence
  sgRNA
  Olfr15_20
ttcgacgtccctccacagag

SEQ ID NO: 39469 - DNA, 20 bp, Artificial Sequence
  sgRNA
  Olfr1500_1
tgtggagcctgcgatccatg

SEQ ID NO: 39470 - DNA, 20 bp, Artificial Sequence
  sgRNA
  Olfr1500_2
aacagcacagccattgtctg

SEQ ID NO: 39471 - DNA, 20 bp, Artificial Sequence
  sgRNA
  Olfr1500_3
ataaagcaaaggctggcaca

SEQ ID NO: 39472 - DNA, 20 bp, Artificial Sequence
  sgRNA
  Olfr1500_4
tcctcaccaaggcactgagg

SEQ ID NO: 39473 - DNA, 20 bp, Artificial Sequence
  sgRNA
  Olfr1500_5
tggcccggcctcctgctgaa

SEQ ID NO: 39474 - DNA, 20 bp, Artificial Sequence
  sgRNA
  Olfr1500_6
ccacaggtcagctttaacag

SEQ ID NO: 39475 - DNA, 20 bp, Artificial Sequence
  sgRNA
  Olfr1500_7
tgtcactgttcctcagacaa

SEQ ID NO: 39476 - DNA, 20 bp, Artificial Sequence
  sgRNA
  Olfr1500_8
gctcagtgaatgctatgagg

SEQ ID NO: 39477 - DNA, 20 bp, Artificial Sequence
  sgRNA
  Olfr1500_9
tgtcatccctgcatgcatgg

SEQ ID NO: 39478 - DNA, 20 bp, Artificial Sequence
  sgRNA
  Olfr1500_10
gcttagaaggaagtacattg

SEQ ID NO: 39479 - DNA, 20 bp, Artificial Sequence
  sgRNA
  Olfr1500_11
attgtttccacaaaaagaga

SEQ ID NO: 39480 - DNA, 20 bp, Artificial Sequence
  sgRNA
  Olfr1500_12
cccagccacaaaacttagaa

SEQ ID NO: 39481 - DNA, 20 bp, Artificial Sequence
  sgRNA
  Olfr1500_13
tctatctcttcactttgcta

SEQ ID NO: 39482 - DNA, 20 bp, Artificial Sequence
  sgRNA
  Olfr1500_14
caatcaccaccatgcatgca

SEQ ID NO: 39483 - DNA, 20 bp, Artificial Sequence
  sgRNA
  Olfr1500_15
tcatcattgtggccattctg

SEQ ID NO: 39484 - DNA, 20 bp, Artificial Sequence
  sgRNA
  Olfr1500_16
agaagagtgacactgcagtg

SEQ ID NO: 39485 - DNA, 20 bp, Artificial Sequence
  sgRNA
  Olfr1500_17
cattgtttccacaaaaagag

SEQ ID NO: 39486 - DNA, 20 bp, Artificial Sequence
  sgRNA
  Olfr1500_18
cgtaggccatgagagccaag

SEQ ID NO: 39487 - DNA, 20 bp, Artificial Sequence
  sgRNA
  Olfr1500_19
attatggtgacataaagcaa

SEQ ID NO: 39488 - DNA, 20 bp, Artificial Sequence
  sgRNA
  Olfr1500_20
caggtcagctttaacagagg

SEQ ID NO: 39489 - DNA, 20 bp, Artificial Sequence
  sgRNA
  Olfr1502_1
gtagtaggagcatatatctg

SEQ ID NO: 39490 - DNA, 20 bp, Artificial Sequence
  sgRNA
  Olfr1502_2
catgctgggaaatttgggca

SEQ ID NO: 39491 - DNA, 20 bp, Artificial Sequence
  sgRNA
  Olfr1502_3
atagtggaatctcccacttg

SEQ ID NO: 39492 - DNA, 20 bp, Artificial Sequence
  sgRNA
  Olfr1502_4
ggtgatgactgaagtatagc

SEQ ID NO: 39493 - DNA, 20 bp, Artificial Sequence
  sgRNA
  Olfr1502_5
gtaacggaattcatcctaat

SEQ ID NO: 39494 - DNA, 20 bp, Artificial Sequence
  sgRNA
  Olfr1502_6
tagtggttcaaaaaaatccc

SEQ ID NO: 39495 - DNA, 20 bp, Artificial Sequence
  sgRNA
  Olfr1502_7
atatatctgtggagtgtgtg

SEQ ID NO: 39496 - DNA, 20 bp, Artificial Sequence
  sgRNA
  Olfr1502_8
gtagattagtgggttcagca

SEQ ID NO: 39497 - DNA, 20 bp, Artificial Sequence
  sgRNA
  Olfr1502_9
gctgcattcaagaaggtgac

SEQ ID NO: 39498 - DNA, 20 bp, Artificial Sequence
  sgRNA
  Olfr1502_10
ggtggtcattaaagcctatt

SEQ ID NO: 39499 - DNA, 20 bp, Artificial Sequence
  sgRNA
  Olfr1502_11
cacaactttatcttcatcca

SEQ ID NO: 39500 - DNA, 20 bp, Artificial Sequence
  sgRNA
  Olfr1502_12
tagattagtgggttcagcat

SEQ ID NO: 39501 - DNA, 20 bp, Artificial Sequence
  sgRNA
  Olfr1502_13
tccttaggctgtagattagt

SEQ ID NO: 39502 - DNA, 20 bp, Artificial Sequence
  sgRNA
  Olfr1502_14
ctaagaaataccagcaatag

SEQ ID NO: 39503 - DNA, 20 bp, Artificial Sequence
  sgRNA
  Olfr1502_15
ctgggcagcacaacatctat

SEQ ID NO: 39504 - DNA, 20 bp, Artificial Sequence
  sgRNA
  Olfr1502_16
catgcccaaatttcccagca

SEQ ID NO: 39505 - DNA, 20 bp, Artificial Sequence
  sgRNA
  Olfr1502_17
gaaggtgactggtaaatgcc

SEQ ID NO: 39506 - DNA, 20 bp, Artificial Sequence
  sgRNA
  Olfr1502_18
gcatatatctgtggagtgtg

SEQ ID NO: 39507 - DNA, 20 bp, Artificial Sequence
  sgRNA
  Olfr1502_19
gtcaccatgctgggaaattt

SEQ ID NO: 39508 - DNA, 20 bp, Artificial Sequence
  sgRNA
  Olfr1502_20
aatctacagcctaaggaaca

SEQ ID NO: 39509 - DNA, 20 bp, Artificial Sequence
  sgRNA
  Olfr1505_1
atatgtctgtggaatgtgtg

SEQ ID NO: 39510 - DNA, 20 bp, Artificial Sequence
  sgRNA
  Olfr1505_2
catgctgggaaacttgggca

SEQ ID NO: 39511 - DNA, 20 bp, Artificial Sequence
  sgRNA
  Olfr1505_3
tatctgaggggtgatgactg

SEQ ID NO: 39512 - DNA, 20 bp, Artificial Sequence
  sgRNA
  Olfr1505_4
ctttaatgaccaccccaagt

SEQ ID NO: 39513 - DNA, 20 bp, Artificial Sequence
  sgRNA
  Olfr1505_5
gtaacggaattcattctaat

SEQ ID NO: 39514 - DNA, 20 bp, Artificial Sequence
  sgRNA
  Olfr1505_6
ggtaaaacagtcgtttccta

SEQ ID NO: 39515 - DNA, 20 bp, Artificial Sequence
  sgRNA
  Olfr1505_7
tagacaagtgggttcagcat

SEQ ID NO: 39516 - DNA, 20 bp, Artificial Sequence
  sgRNA
  Olfr1505_8
gtcaccatgctgggaaactt

SEQ ID NO: 39517 - DNA, 20 bp, Artificial Sequence
  sgRNA
  Olfr1505_9
gtagacaagtgggttcagca

SEQ ID NO: 39518 - DNA, 20 bp, Artificial Sequence
  sgRNA
  Olfr1505_10
tagtggttcaaagaaatccc

SEQ ID NO: 39519 - DNA, 20 bp, Artificial Sequence
  sgRNA
  Olfr1505_11
tgtctacagcctaagaaaca

SEQ ID NO: 39520 - DNA, 20 bp, Artificial Sequence
  sgRNA
  Olfr1505_12
gctgcattcaagaaggttac

SEQ ID NO: 39521 - DNA, 20 bp, Artificial Sequence
  sgRNA
  Olfr1505_13
ctaagaaataccagaaatag

SEQ ID NO: 39522 - DNA, 20 bp, Artificial Sequence
  sgRNA
  Olfr1505_14
gtagtaggagcatatgtctg

SEQ ID NO: 39523 - DNA, 20 bp, Artificial Sequence
  sgRNA
  Olfr1505_15
tagaatgaattccgttactg

SEQ ID NO: 39524 - DNA, 20 bp, Artificial Sequence
  sgRNA
  Olfr1505_16
tttcttaggctgtagacaag

SEQ ID NO: 39525 - DNA, 20 bp, Artificial Sequence
  sgRNA
  Olfr1505_17
gcatatgtctgtggaatgtg

SEQ ID NO: 39526 - DNA, 20 bp, Artificial Sequence
  sgRNA
  Olfr1505_18
gaaggttactggtaaatggc

SEQ ID NO: 39527 - DNA, 20 bp, Artificial Sequence
  sgRNA
  Olfr1505_19
ttcttaggctgtagacaagt

SEQ ID NO: 39528 - DNA, 20 bp, Artificial Sequence
  sgRNA
  Olfr1505_20
tcaagaaggttactggtaaa

SEQ ID NO: 39529 - DNA, 20 bp, Artificial Sequence
  sgRNA
  Olfr1506_1
tactagcatcatgaaccgac

SEQ ID NO: 39530 - DNA, 20 bp, Artificial Sequence
  sgRNA
  Olfr1506_2
agatgagaagaacttgggca

SEQ ID NO: 39531 - DNA, 20 bp, Artificial Sequence
  sgRNA
  Olfr1506_3
aatcagcagaccaatgagga

SEQ ID NO: 39532 - DNA, 20 bp, Artificial Sequence
  sgRNA
  Olfr1506_4
catatctgtatggggctgca

SEQ ID NO: 39533 - DNA, 20 bp, Artificial Sequence
  sgRNA
  Olfr1507_1
caggccagttcgatcacctg

SEQ ID NO: 39534 - DNA, 20 bp, Artificial Sequence
  sgRNA
  Olfr1507_2
tacaaatccgaaagtacaga

SEQ ID NO: 39535 - DNA, 20 bp, Artificial Sequence
  sgRNA
  Olfr1507_3
tggaaggtgtgtatggtgct

SEQ ID NO: 39536 - DNA, 20 bp, Artificial Sequence
  sgRNA
  Olfr1507_4
ctggaccacacagtcatcaa

SEQ ID NO: 39537 - DNA, 20 bp, Artificial Sequence
  sgRNA
  Olfr1507_5
attattgtcatatacctcaa

SEQ ID NO: 39538 - DNA, 20 bp, Artificial Sequence
  sgRNA
  Olfr1507_6
agttaatcaggagaaaagag

SEQ ID NO: 39539 - DNA, 20 bp, Artificial Sequence
  sgRNA
  Olfr1507_7
agctcattaggaccacagta

SEQ ID NO: 39540 - DNA, 20 bp, Artificial Sequence
  sgRNA
  Olfr1507_8
gcagatacaatcttgtcctc

SEQ ID NO: 39541 - DNA, 20 bp, Artificial Sequence
  sgRNA
  Olfr1507_9
gaggggccatgtggacagca

SEQ ID NO: 39542 - DNA, 20 bp, Artificial Sequence
  sgRNA
  Olfr1507_10
aaggtgtgtatggtgctagg

SEQ ID NO: 39543 - DNA, 20 bp, Artificial Sequence
  sgRNA
  Olfr1507_11
aagttaatcaggagaaaaga

SEQ ID NO: 39544 - DNA, 20 bp, Artificial Sequence
  sgRNA
  Olfr1507_12
cccagccatcagccttccag

SEQ ID NO: 39545 - DNA, 20 bp, Artificial Sequence
  sgRNA
  Olfr1507_13
atacaatcttgtcctctgga

SEQ ID NO: 39546 - DNA, 20 bp, Artificial Sequence
  sgRNA
  Olfr1507_14
atacctcaaaggtttacaaa

SEQ ID NO: 39547 - DNA, 20 bp, Artificial Sequence
  sgRNA
  Olfr1507_15
gattatggggttcagcagag

SEQ ID NO: 39548 - DNA, 20 bp, Artificial Sequence
  sgRNA
  Olfr1507_16
acatgggagtatggagtcgg

SEQ ID NO: 39549 - DNA, 20 bp, Artificial Sequence
  sgRNA
  Olfr1507_17
tatggtccctgctgtccaca

SEQ ID NO: 39550 - DNA, 20 bp, Artificial Sequence
  sgRNA
  Olfr1507_18
aatgaactggaaggtgtgta

SEQ ID NO: 39551 - DNA, 20 bp, Artificial Sequence
  sgRNA
  Olfr1507_19
gtatgattgttatgacaatg

SEQ ID NO: 39552 - DNA, 20 bp, Artificial Sequence
  sgRNA
  Olfr1507_20
ggtgtgtatggtgctaggag

SEQ ID NO: 39553 - DNA, 20 bp, Artificial Sequence
  sgRNA
  Olfr1508_1
agatctctgtgcaggcaaag

SEQ ID NO: 39554 - DNA, 20 bp, Artificial Sequence
  sgRNA
  Olfr1508_2
atcccattatctacaccctt

SEQ ID NO: 39555 - DNA, 20 bp, Artificial Sequence
  sgRNA
  Olfr1508_3
taacaatcatatatgaccgc

SEQ ID NO: 39556 - DNA, 20 bp, Artificial Sequence
  sgRNA
  Olfr1508_4
acatgggagtatggagccgg

SEQ ID NO: 39557 - DNA, 20 bp, Artificial Sequence
  sgRNA
  Olfr1508_5
gcagcagccctatggacagg

SEQ ID NO: 39558 - DNA, 20 bp, Artificial Sequence
  sgRNA
  Olfr1508_6
acacaaccttgtcctcagga

SEQ ID NO: 39559 - DNA, 20 bp, Artificial Sequence
  sgRNA
  Olfr1508_7
cagcagccctatggacaggg

SEQ ID NO: 39560 - DNA, 20 bp, Artificial Sequence
  sgRNA
  Olfr1508_8
gtgaggtgagagatatggaa

SEQ ID NO: 39561 - DNA, 20 bp, Artificial Sequence
  sgRNA
  Olfr1508_9
atctcatcaggaccacagta

SEQ ID NO: 39562 - DNA, 20 bp, Artificial Sequence
  sgRNA
  Olfr1508_10
ggatggtcccccctgtccat

SEQ ID NO: 39563 - DNA, 20 bp, Artificial Sequence
  sgRNA
  Olfr1508_11
ggtgagagatatggaatgga

SEQ ID NO: 39564 - DNA, 20 bp, Artificial Sequence
  sgRNA
  Olfr1508_12
gaagaacatctggaccacac

SEQ ID NO: 39565 - DNA, 20 bp, Artificial Sequence
  sgRNA
  Olfr1508_13
attattgtcatatactgcaa

SEQ ID NO: 39566 - DNA, 20 bp, Artificial Sequence
  sgRNA
  Olfr1508_14
gatggtcccccctgtccata

SEQ ID NO: 39567 - DNA, 20 bp, Artificial Sequence
  sgRNA
  Olfr1508_15
ttctcattgtctccaacagt

SEQ ID NO: 39568 - DNA, 20 bp, Artificial Sequence
  sgRNA
  Olfr1508_16
ggcagcagccctatggacag

SEQ ID NO: 39569 - DNA, 20 bp, Artificial Sequence
  sgRNA
  Olfr1508_17
tacaaatccattagtacaaa

SEQ ID NO: 39570 - DNA, 20 bp, Artificial Sequence
  sgRNA
  Olfr1508_18
tggcagcagccctatggaca

SEQ ID NO: 39571 - DNA, 20 bp, Artificial Sequence
  sgRNA
  Olfr1508_19
acagacacaaccttgtcctc

SEQ ID NO: 39572 - DNA, 20 bp, Artificial Sequence
  sgRNA
  Olfr1508_20
cttgtcctcaggaaggctgg

SEQ ID NO: 39573 - DNA, 20 bp, Artificial Sequence
  sgRNA
  Olfr1509_1
ccaacacccagttgtcagtg

SEQ ID NO: 39574 - DNA, 20 bp, Artificial Sequence
  sgRNA
  Olfr1509_2
actattcgtctaccctactg

SEQ ID NO: 39575 - DNA, 20 bp, Artificial Sequence
  sgRNA
  Olfr1509_3
agactatggtaacaacaatg

SEQ ID NO: 39576 - DNA, 20 bp, Artificial Sequence
  sgRNA
  Olfr1509_4
tgggcacggtgacagatgag

SEQ ID NO: 39577 - DNA, 20 bp, Artificial Sequence
  sgRNA
  Olfr1509_5
ctgctcagcccacttcatgg

SEQ ID NO: 39578 - DNA, 20 bp, Artificial Sequence
  sgRNA
  Olfr1509_6
acacgatcagaatccctgta

SEQ ID NO: 39579 - DNA, 20 bp, Artificial Sequence
  sgRNA
  Olfr1509_7
gcacagatacataccttaca

SEQ ID NO: 39580 - DNA, 20 bp, Artificial Sequence
  sgRNA
  Olfr1509_8
cagcttctccatcgacaagg

SEQ ID NO: 39581 - DNA, 20 bp, Artificial Sequence
  sgRNA
  Olfr1509_9
cgtacctcctgtcatcaagc

SEQ ID NO: 39582 - DNA, 20 bp, Artificial Sequence
  sgRNA
  Olfr1509_10
gatacatggcccaaagaaca

SEQ ID NO: 39583 - DNA, 20 bp, Artificial Sequence
  sgRNA
  Olfr1509_11
tctctgcctgagatgcttca

SEQ ID NO: 39584 - DNA, 20 bp, Artificial Sequence
  sgRNA
  Olfr1509_12
ccaaggctagaaaacatacg

SEQ ID NO: 39585 - DNA, 20 bp, Artificial Sequence
  sgRNA
  Olfr1509_13
accgtgcccaagatgcttga

SEQ ID NO: 39586 - DNA, 20 bp, Artificial Sequence
  sgRNA
  Olfr1509_14
aaatgagaggattcaacaaa

SEQ ID NO: 39587 - DNA, 20 bp, Artificial Sequence
  sgRNA
  Olfr1509_15
accctcaagcatcttgggca

SEQ ID NO: 39588 - DNA, 20 bp, Artificial Sequence
  sgRNA
  Olfr1509_16
attctgatcgtgtccaatag

SEQ ID NO: 39589 - DNA, 20 bp, Artificial Sequence
  sgRNA
  Olfr1509_17
caggccagcttgatgacagg

SEQ ID NO: 39590 - DNA, 20 bp, Artificial Sequence
  sgRNA
  Olfr1509_18
ataatgtttgggccacagta

SEQ ID NO: 39591 - DNA, 20 bp, Artificial Sequence
  sgRNA
  Olfr1509_19
ttcctcaaagtgtaaatgag

SEQ ID NO: 39592 - DNA, 20 bp, Artificial Sequence
  sgRNA
  Olfr1509_20
aacagtctgcagaaggtcgt

SEQ ID NO: 39593 - DNA, 20 bp, Artificial Sequence
  sgRNA
  Olfr151_1
cgaggatccccagaaagagg

SEQ ID NO: 39594 - DNA, 20 bp, Artificial Sequence
  sgRNA
  Olfr151_2
gcctgttagttagccccccg

SEQ ID NO: 39595 - DNA, 20 bp, Artificial Sequence
  sgRNA
  Olfr151_3
cttcgcatcagctccaacga

SEQ ID NO: 39596 - DNA, 20 bp, Artificial Sequence
  sgRNA
  Olfr151_4
ctacgaggatccccagaaag

SEQ ID NO: 39597 - DNA, 20 bp, Artificial Sequence
  sgRNA
  Olfr151_5
acagtgacagagtttatcct

SEQ ID NO: 39598 - DNA, 20 bp, Artificial Sequence
  sgRNA
  Olfr151_6
ggggatcctcgtagtcacca

SEQ ID NO: 39599 - DNA, 20 bp, Artificial Sequence
  sgRNA
  Olfr151_7
tgacagagtttatcctcggg

SEQ ID NO: 39600 - DNA, 20 bp, Artificial Sequence
  sgRNA
  Olfr151_8
tgctgaaccgatgagtccta

SEQ ID NO: 39601 - DNA, 20 bp, Artificial Sequence
  sgRNA
  Olfr151_9
gtctatgccgtaggactcat

SEQ ID NO: 39602 - DNA, 20 bp, Artificial Sequence
  sgRNA
  Olfr151_10
ccttcgcatcagctccaacg

SEQ ID NO: 39603 - DNA, 20 bp, Artificial Sequence
  sgRNA
  Olfr151_11
agtgacagagtttatcctcg

SEQ ID NO: 39604 - DNA, 20 bp, Artificial Sequence
  sgRNA
  Olfr151_12
ttcctaccatggtgactacg

SEQ ID NO: 39605 - DNA, 20 bp, Artificial Sequence
  sgRNA
  Olfr151_13
gcatcagctccaacgagggc

SEQ ID NO: 39606 - DNA, 20 bp, Artificial Sequence
  sgRNA
  Olfr151_14
cacagaagctacattctccc

SEQ ID NO: 39607 - DNA, 20 bp, Artificial Sequence
  sgRNA
  Olfr151_15
atcctcgtagtcaccatggt

SEQ ID NO: 39608 - DNA, 20 bp, Artificial Sequence
  sgRNA
  Olfr151_16
tgcagctgtggcttgttcta

SEQ ID NO: 39609 - DNA, 20 bp, Artificial Sequence
  sgRNA
  Olfr151_17
aacaagccacagctgcaaag

SEQ ID NO: 39610 - DNA, 20 bp, Artificial Sequence
  sgRNA
  Olfr151_18
gtgacagagtttatcctcgg

SEQ ID NO: 39611 - DNA, 20 bp, Artificial Sequence
  sgRNA
  Olfr151_19
ctacagctagttccctggcc

SEQ ID NO: 39612 - DNA, 20 bp, Artificial Sequence
  sgRNA
  Olfr151_20
cccagaaagaggaggaagag

SEQ ID NO: 39613 - DNA, 20 bp, Artificial Sequence
  sgRNA
  Olfr1510_1
aagtcgaggaacaatgactg

SEQ ID NO: 39614 - DNA, 20 bp, Artificial Sequence
  sgRNA
  Olfr1510_2
gggcaatctgaaggtcagag

SEQ ID NO: 39615 - DNA, 20 bp, Artificial Sequence
  sgRNA
  Olfr1510_3
aaaattatgcacaatcctag

SEQ ID NO: 39616 - DNA, 20 bp, Artificial Sequence
  sgRNA
  Olfr1510_4
gagctgcacaaccaccaaat

SEQ ID NO: 39617 - DNA, 20 bp, Artificial Sequence
  sgRNA
  Olfr1510_5
tgagctgcacaaccaccaaa

SEQ ID NO: 39618 - DNA, 20 bp, Artificial Sequence
  sgRNA
  Olfr1510_6
atttggttgggcccacagta

SEQ ID NO: 39619 - DNA, 20 bp, Artificial Sequence
  sgRNA
  Olfr1510_7
gagtggtttgaatagaccca

SEQ ID NO: 39620 - DNA, 20 bp, Artificial Sequence
  sgRNA
  Olfr1510_8
gccctgaagaggctaacagc

SEQ ID NO: 39621 - DNA, 20 bp, Artificial Sequence
  sgRNA
  Olfr1510_9
ttatgcacaatcctagtggc

SEQ ID NO: 39622 - DNA, 20 bp, Artificial Sequence
  sgRNA
  Olfr1510_10
acctgctgttagcctcttca

SEQ ID NO: 39623 - DNA, 20 bp, Artificial Sequence
  sgRNA
  Olfr1510_11
ccacccaagctccagccact

SEQ ID NO: 39624 - DNA, 20 bp, Artificial Sequence
  sgRNA
  Olfr1510_12
gcaggtagaagggatgtggg

SEQ ID NO: 39625 - DNA, 20 bp, Artificial Sequence
  sgRNA
  Olfr1510_13
ccttcagattgccctactgt

SEQ ID NO: 39626 - DNA, 20 bp, Artificial Sequence
  sgRNA
  Olfr1510_14
gaggctaacagcaggtagaa

SEQ ID NO: 39627 - DNA, 20 bp, Artificial Sequence
  sgRNA
  Olfr1510_15
ggtttgaatagacccatgga

SEQ ID NO: 39628 - DNA, 20 bp, Artificial Sequence
  sgRNA
  Olfr1510_16
aatgggatagccttgctggc

SEQ ID NO: 39629 - DNA, 20 bp, Artificial Sequence
  sgRNA
  Olfr1510_17
gataaaataatctatttggt

SEQ ID NO: 39630 - DNA, 20 bp, Artificial Sequence
  sgRNA
  Olfr1510_18
agcaaggctatcccatttgg

SEQ ID NO: 39631 - DNA, 20 bp, Artificial Sequence
  sgRNA
  Olfr1510_19
atccgctcatctacaccctg

SEQ ID NO: 39632 - DNA, 20 bp, Artificial Sequence
  sgRNA
  Olfr1510_20
acagcaactgctccgtcaaa

SEQ ID NO: 39633 - DNA, 20 bp, Artificial Sequence
  sgRNA
  Olfr1511_1
gaagttgtgcacaattctag

SEQ ID NO: 39634 - DNA, 20 bp, Artificial Sequence
  sgRNA
  Olfr1511_2
aatccgaggaacaatgactg

SEQ ID NO: 39635 - DNA, 20 bp, Artificial Sequence
  sgRNA
  Olfr1511_3
ccttccgattgccctactgt

SEQ ID NO: 39636 - DNA, 20 bp, Artificial Sequence
  sgRNA
  Olfr1511_4
cactaccccaatgtccacaa

SEQ ID NO: 39637 - DNA, 20 bp, Artificial Sequence
  sgRNA
  Olfr1511_5
aatgcgataaccttgctggc

SEQ ID NO: 39638 - DNA, 20 bp, Artificial Sequence
  sgRNA
  Olfr1511_6
gctaccctgtgctcatgaat

SEQ ID NO: 39639 - DNA, 20 bp, Artificial Sequence
  sgRNA
  Olfr1511_7
gtgaagtttaatataatccg

SEQ ID NO: 39640 - DNA, 20 bp, Artificial Sequence
  sgRNA
  Olfr1511_8
tctcctcagtcattgttcct

SEQ ID NO: 39641 - DNA, 20 bp, Artificial Sequence
  sgRNA
  Olfr1511_9
acttccttgggcccacagta

SEQ ID NO: 39642 - DNA, 20 bp, Artificial Sequence
  sgRNA
  Olfr1511_10
acagcaactgctccatcaaa

SEQ ID NO: 39643 - DNA, 20 bp, Artificial Sequence
  sgRNA
  Olfr1511_11
acttcccattcatgagcaca

SEQ ID NO: 39644 - DNA, 20 bp, Artificial Sequence
  sgRNA
  Olfr1511_12
acctgctcttagcctcttca

SEQ ID NO: 39645 - DNA, 20 bp, Artificial Sequence
  sgRNA
  Olfr1511_13
gagtagcttgaatagaccca

SEQ ID NO: 39646 - DNA, 20 bp, Artificial Sequence
  sgRNA
  Olfr1511_14
aaatgcgataaccttgctgg

SEQ ID NO: 39647 - DNA, 20 bp, Artificial Sequence
  sgRNA
  Olfr1511_15
gcaggtagaagggatgtgga

SEQ ID NO: 39648 - DNA, 20 bp, Artificial Sequence
  sgRNA
  Olfr1511_16
gccctgaagaggctaagagc

SEQ ID NO: 39649 - DNA, 20 bp, Artificial Sequence
  sgRNA
  Olfr1511_17
cccacagtagggcaatcgga

SEQ ID NO: 39650 - DNA, 20 bp, Artificial Sequence
  sgRNA
  Olfr1511_18
gaggctaagagcaggtagaa

SEQ ID NO: 39651 - DNA, 20 bp, Artificial Sequence
  sgRNA
  Olfr1511_19
agcaaggttatcgcatttgg

SEQ ID NO: 39652 - DNA, 20 bp, Artificial Sequence
  sgRNA
  Olfr1511_20
tgggcccacagtagggcaat

SEQ ID NO: 39653 - DNA, 20 bp, Artificial Sequence
  sgRNA
  Olfr1512_1
ggtcaccaactcattgactg

SEQ ID NO: 39654 - DNA, 20 bp, Artificial Sequence
  sgRNA
  Olfr1512_2
agtggtgtataggaaacact

SEQ ID NO: 39655 - DNA, 20 bp, Artificial Sequence
  sgRNA
  Olfr1512_3
taagttgagtatcttgctgg

SEQ ID NO: 39656 - DNA, 20 bp, Artificial Sequence
  sgRNA
  Olfr1512_4
ggaatgtcctcagcctggga

SEQ ID NO: 39657 - DNA, 20 bp, Artificial Sequence
  sgRNA
  Olfr1512_5
tcgaaggtagatgaaggcac

SEQ ID NO: 39658 - DNA, 20 bp, Artificial Sequence
  sgRNA
  Olfr1512_6
ttagccttgaggagaatggt

SEQ ID NO: 39659 - DNA, 20 bp, Artificial Sequence
  sgRNA
  Olfr1512_7
acacatcccccaaatgggat

SEQ ID NO: 39660 - DNA, 20 bp, Artificial Sequence
  sgRNA
  Olfr1512_8
gtgtttcctatacaccacta

SEQ ID NO: 39661 - DNA, 20 bp, Artificial Sequence
  sgRNA
  Olfr1512_9
cgaagggccttctcaacatg

SEQ ID NO: 39662 - DNA, 20 bp, Artificial Sequence
  sgRNA
  Olfr1512_10
gagctgcgtgtcggcgcaga

SEQ ID NO: 39663 - DNA, 20 bp, Artificial Sequence
  sgRNA
  Olfr1512_11
gcgcgcatggagctgcgtgt

SEQ ID NO: 39664 - DNA, 20 bp, Artificial Sequence
  sgRNA
  Olfr1512_12
ctacaccctgaggaaccagg

SEQ ID NO: 39665 - DNA, 20 bp, Artificial Sequence
  sgRNA
  Olfr1512_13
actgggaacttcccagaaag

SEQ ID NO: 39666 - DNA, 20 bp, Artificial Sequence
  sgRNA
  Olfr1512_14
cgaaggtagatgaaggcaca

SEQ ID NO: 39667 - DNA, 20 bp, Artificial Sequence
  sgRNA
  Olfr1512_15
aggaggtgaagttagccttg

SEQ ID NO: 39668 - DNA, 20 bp, Artificial Sequence
  sgRNA
  Olfr1512_16
gtcaggtcgaaggtagatga

SEQ ID NO: 39669 - DNA, 20 bp, Artificial Sequence
  sgRNA
  Olfr1512_17
gctctctccgtcatcgacat

SEQ ID NO: 39670 - DNA, 20 bp, Artificial Sequence
  sgRNA
  Olfr1512_18
gacctttgtggacattggag

SEQ ID NO: 39671 - DNA, 20 bp, Artificial Sequence
  sgRNA
  Olfr1512_19
agatgtacatggggcgcgca

SEQ ID NO: 39672 - DNA, 20 bp, Artificial Sequence
  sgRNA
  Olfr1512_20
tgagccacacatcccccaaa

SEQ ID NO: 39673 - DNA, 20 bp, Artificial Sequence
  sgRNA
  Olfr1513_1
cgatgacggaaagagcacca

SEQ ID NO: 39674 - DNA, 20 bp, Artificial Sequence
  sgRNA
  Olfr1513_2
taagttgagtaccttgctcg

SEQ ID NO: 39675 - DNA, 20 bp, Artificial Sequence
  sgRNA
  Olfr1513_3
ggtgaacaactcattgactg

SEQ ID NO: 39676 - DNA, 20 bp, Artificial Sequence
  sgRNA
  Olfr1513_4
aggaatgtcctcagcccggg

SEQ ID NO: 39677 - DNA, 20 bp, Artificial Sequence
  sgRNA
  Olfr1513_5
tgggtggctggcttaatcca

SEQ ID NO: 39678 - DNA, 20 bp, Artificial Sequence
  sgRNA
  Olfr1513_6
gcgagcatggagctgcgtgt

SEQ ID NO: 39679 - DNA, 20 bp, Artificial Sequence
  sgRNA
  Olfr1513_7
gagctgcgtgtcggtgcaga

SEQ ID NO: 39680 - DNA, 20 bp, Artificial Sequence
  sgRNA
  Olfr1513_8
cacatagtacacagtaacca

SEQ ID NO: 39681 - DNA, 20 bp, Artificial Sequence
  sgRNA
  Olfr1513_9
atggctgtcaggtcgcaggt

SEQ ID NO: 39682 - DNA, 20 bp, Artificial Sequence
  sgRNA
  Olfr1513_10
ggaatgtcctcagcccggga

SEQ ID NO: 39683 - DNA, 20 bp, Artificial Sequence
  sgRNA
  Olfr1513_11
ggttcctcagggtatagatg

SEQ ID NO: 39684 - DNA, 20 bp, Artificial Sequence
  sgRNA
  Olfr1513_12
catcccatttgggggatgcg

SEQ ID NO: 39685 - DNA, 20 bp, Artificial Sequence
  sgRNA
  Olfr1513_13
atcccctcatctataccctg

SEQ ID NO: 39686 - DNA, 20 bp, Artificial Sequence
  sgRNA
  Olfr1513_14
atacagtactgcccagaaag

SEQ ID NO: 39687 - DNA, 20 bp, Artificial Sequence
  sgRNA
  Olfr1513_15
ctataccctgaggaaccagg

SEQ ID NO: 39688 - DNA, 20 bp, Artificial Sequence
  sgRNA
  Olfr1513_16
gctctttccgtcatcgacat

SEQ ID NO: 39689 - DNA, 20 bp, Artificial Sequence
  sgRNA
  Olfr1513_17
gctcgtggctggagcttggg

SEQ ID NO: 39690 - DNA, 20 bp, Artificial Sequence
  sgRNA
  Olfr1513_18
tacctgcgacctgacagcca

SEQ ID NO: 39691 - DNA, 20 bp, Artificial Sequence
  sgRNA
  Olfr1513_19
atgtggggcccatgtaacca

SEQ ID NO: 39692 - DNA, 20 bp, Artificial Sequence
  sgRNA
  Olfr1513_20
tgagccacgcatcccccaaa

SEQ ID NO: 39693 - DNA, 20 bp, Artificial Sequence
  sgRNA
  Olfr152_1
cggacacatccattaacgag

SEQ ID NO: 39694 - DNA, 20 bp, Artificial Sequence
  sgRNA
  Olfr152_2
gcacaattaaccatatgcag

SEQ ID NO: 39695 - DNA, 20 bp, Artificial Sequence
  sgRNA
  Olfr152_3
caatgactgaggaataacaa

SEQ ID NO: 39696 - DNA, 20 bp, Artificial Sequence
  sgRNA
  Olfr152_4
aaaactgcagtgcacagccg

SEQ ID NO: 39697 - DNA, 20 bp, Artificial Sequence
  sgRNA
  Olfr152_5
tgtgccctgatagatggcca

SEQ ID NO: 39698 - DNA, 20 bp, Artificial Sequence
  sgRNA
  Olfr152_6
gccgtgttggaaatcctaac

SEQ ID NO: 39699 - DNA, 20 bp, Artificial Sequence
  sgRNA
  Olfr152_7
ggtcaggtgagaggcacacg

SEQ ID NO: 39700 - DNA, 20 bp, Artificial Sequence
  sgRNA
  Olfr152_8
aagaaatctatctcttacct

SEQ ID NO: 39701 - DNA, 20 bp, Artificial Sequence
  sgRNA
  Olfr152_9
attgcaactgtgtacaacaa

SEQ ID NO: 39702 - DNA, 20 bp, Artificial Sequence
  sgRNA
  Olfr152_10
gccctgatagatggccacgg

SEQ ID NO: 39703 - DNA, 20 bp, Artificial Sequence
  sgRNA
  Olfr152_11
gtacaacaaaggattgcaga

SEQ ID NO: 39704 - DNA, 20 bp, Artificial Sequence
  sgRNA
  Olfr152_12
attgtgctgtcatatgttgg

SEQ ID NO: 39705 - DNA, 20 bp, Artificial Sequence
  sgRNA
  Olfr152_13
gtacaggaaagcttcagcag

SEQ ID NO: 39706 - DNA, 20 bp, Artificial Sequence
  sgRNA
  Olfr152_14
catataacgtcagaaacaca

SEQ ID NO: 39707 - DNA, 20 bp, Artificial Sequence
  sgRNA
  Olfr152_15
ggaaagtagccactcgttaa

SEQ ID NO: 39708 - DNA, 20 bp, Artificial Sequence
  sgRNA
  Olfr152_16
gttaatggatgtgtccgtac

SEQ ID NO: 39709 - DNA, 20 bp, Artificial Sequence
  sgRNA
  Olfr152_17
gagaagtgtgccctgataga

SEQ ID NO: 39710 - DNA, 20 bp, Artificial Sequence
  sgRNA
  Olfr152_18
ggaataacaaaggtctacaa

SEQ ID NO: 39711 - DNA, 20 bp, Artificial Sequence
  sgRNA
  Olfr152_19
tgaagattcgctctacaagt

SEQ ID NO: 39712 - DNA, 20 bp, Artificial Sequence
  sgRNA
  Olfr152_20
aacaaaggtctacaaaggag

SEQ ID NO: 39713 - DNA, 20 bp, Artificial Sequence
  sgRNA
  Olfr154_1
ataccgatcataagccatgg

SEQ ID NO: 39714 - DNA, 20 bp, Artificial Sequence
  sgRNA
  Olfr154_2
gatttggaccacagtatgga

SEQ ID NO: 39715 - DNA, 20 bp, Artificial Sequence
  sgRNA
  Olfr154_3
tatttgcacatgccagtgag

SEQ ID NO: 39716 - DNA, 20 bp, Artificial Sequence
  sgRNA
  Olfr154_4
ttacaaagcctatgctgtaa

SEQ ID NO: 39717 - DNA, 20 bp, Artificial Sequence
  sgRNA
  Olfr154_5
gttcaacatagggataacag

SEQ ID NO: 39718 - DNA, 20 bp, Artificial Sequence
  sgRNA
  Olfr154_6
tggcctccatggcttatgat

SEQ ID NO: 39719 - DNA, 20 bp, Artificial Sequence
  sgRNA
  Olfr154_7
cttctctctggatatcaata

SEQ ID NO: 39720 - DNA, 20 bp, Artificial Sequence
  sgRNA
  Olfr154_8
gcatttgtccttccatactg

SEQ ID NO: 39721 - DNA, 20 bp, Artificial Sequence
  sgRNA
  Olfr154_9
aacataccgatcataagcca

SEQ ID NO: 39722 - DNA, 20 bp, Artificial Sequence
  sgRNA
  Olfr154_10
agcagaactgatctttagga

SEQ ID NO: 39723 - DNA, 20 bp, Artificial Sequence
  sgRNA
  Olfr154_11
gatgttgtctgacatgtttg

SEQ ID NO: 39724 - DNA, 20 bp, Artificial Sequence
  sgRNA
  Olfr154_12
agatcagttctgctgatggg

SEQ ID NO: 39725 - DNA, 20 bp, Artificial Sequence
  sgRNA
  Olfr154_13
aacatgtcagacaacatctt

SEQ ID NO: 39726 - DNA, 20 bp, Artificial Sequence
  sgRNA
  Olfr154_14
ggacaaatgcagaaataata

SEQ ID NO: 39727 - DNA, 20 bp, Artificial Sequence
  sgRNA
  Olfr154_15
ctaaagatcagttctgctga

SEQ ID NO: 39728 - DNA, 20 bp, Artificial Sequence
  sgRNA
  Olfr154_16
actggctaaataaacaaagc

SEQ ID NO: 39729 - DNA, 20 bp, Artificial Sequence
  sgRNA
  Olfr154_17
cataggctttgtaagcacta

SEQ ID NO: 39730 - DNA, 20 bp, Artificial Sequence
  sgRNA
  Olfr154_18
tctcagccacttgtcctttg

SEQ ID NO: 39731 - DNA, 20 bp, Artificial Sequence
  sgRNA
  Olfr154_19
actgatctttaggatggtga

SEQ ID NO: 39732 - DNA, 20 bp, Artificial Sequence
  sgRNA
  Olfr154_20
catcagcagaactgatcttt

SEQ ID NO: 39733 - DNA, 20 bp, Artificial Sequence
  sgRNA
  Olfr1564_1
acttcaatagaggtggaaca

SEQ ID NO: 39734 - DNA, 20 bp, Artificial Sequence
  sgRNA
  Olfr1564_2
aatgtattggaggtggcaaa

SEQ ID NO: 39735 - DNA, 20 bp, Artificial Sequence
  sgRNA
  Olfr1564_3
ctacaatgaaggtatatgag

SEQ ID NO: 39736 - DNA, 20 bp, Artificial Sequence
  sgRNA
  Olfr1564_4
catgggctatgaccgctacg

SEQ ID NO: 39737 - DNA, 20 bp, Artificial Sequence
  sgRNA
  Olfr1564_5
ctgggaggagatactctgat

SEQ ID NO: 39738 - DNA, 20 bp, Artificial Sequence
  sgRNA
  Olfr1564_6
gtagcggtcatagcccatga

SEQ ID NO: 39739 - DNA, 20 bp, Artificial Sequence
  sgRNA
  Olfr1564_7
tgacggtgagtagaaaggaa

SEQ ID NO: 39740 - DNA, 20 bp, Artificial Sequence
  sgRNA
  Olfr1564_8
atgtggagagaatgtattgg

SEQ ID NO: 39741 - DNA, 20 bp, Artificial Sequence
  sgRNA
  Olfr1564_9
tggagagaatgtattggagg

SEQ ID NO: 39742 - DNA, 20 bp, Artificial Sequence
  sgRNA
  Olfr1564_10
tatctcctcccagagacttg

SEQ ID NO: 39743 - DNA, 20 bp, Artificial Sequence
  sgRNA
  Olfr1564_11
tcctttctactcaccgtcat

SEQ ID NO: 39744 - DNA, 20 bp, Artificial Sequence
  sgRNA
  Olfr1564_12
tctgtggaaataatttgttg

SEQ ID NO: 39745 - DNA, 20 bp, Artificial Sequence
  sgRNA
  Olfr1564_13
aagggccccaagtctctggg

SEQ ID NO: 39746 - DNA, 20 bp, Artificial Sequence
  sgRNA
  Olfr1564_14
gaagaaatggtggatctcat

SEQ ID NO: 39747 - DNA, 20 bp, Artificial Sequence
  sgRNA
  Olfr1564_15
gcccatgacggtgagtagaa

SEQ ID NO: 39748 - DNA, 20 bp, Artificial Sequence
  sgRNA
  Olfr1564_16
caatgaaggtatatgagagg

SEQ ID NO: 39749 - DNA, 20 bp, Artificial Sequence
  sgRNA
  Olfr1564_17
gaagggggtgaggactgtat

SEQ ID NO: 39750 - DNA, 20 bp, Artificial Sequence
  sgRNA
  Olfr1564_18
gtatctcctcccagagactt

SEQ ID NO: 39751 - DNA, 20 bp, Artificial Sequence
  sgRNA
  Olfr1564_19
gacggtgagtagaaaggaat

SEQ ID NO: 39752 - DNA, 20 bp, Artificial Sequence
  sgRNA
  Olfr1564_20
agtatctcctcccagagact

SEQ ID NO: 39753 - DNA, 20 bp, Artificial Sequence
  sgRNA
  Olfr16_1
taaagacccacaaaccaaca

SEQ ID NO: 39754 - DNA, 20 bp, Artificial Sequence
  sgRNA
  Olfr16_2
acacactggtcattgtccca

SEQ ID NO: 39755 - DNA, 20 bp, Artificial Sequence
  sgRNA
  Olfr16_3
attgattatctcattgacag

SEQ ID NO: 39756 - DNA, 20 bp, Artificial Sequence
  sgRNA
  Olfr16_4
ggttaggaaaaccacaaaga

SEQ ID NO: 39757 - DNA, 20 bp, Artificial Sequence
  sgRNA
  Olfr16_5
tatacaatcatcatgagcaa

SEQ ID NO: 39758 - DNA, 20 bp, Artificial Sequence
  sgRNA
  Olfr16_6
tccaccaccgtgccacaaaa

SEQ ID NO: 39759 - DNA, 20 bp, Artificial Sequence
  sgRNA
  Olfr16_7
ttacaaccttcccatatcct

SEQ ID NO: 39760 - DNA, 20 bp, Artificial Sequence
  sgRNA
  Olfr16_8
tggttaggaaaaccacaaag

SEQ ID NO: 39761 - DNA, 20 bp, Artificial Sequence
  sgRNA
  Olfr16_9
tagacaacagggttcagcaa

SEQ ID NO: 39762 - DNA, 20 bp, Artificial Sequence
  sgRNA
  Olfr16_10
gatgctctatgcagagctgt

SEQ ID NO: 39763 - DNA, 20 bp, Artificial Sequence
  sgRNA
  Olfr16_11
tttgggtttgaggtaggcaa

SEQ ID NO: 39764 - DNA, 20 bp, Artificial Sequence
  sgRNA
  Olfr16_12
gtagacaacagggttcagca

SEQ ID NO: 39765 - DNA, 20 bp, Artificial Sequence
  sgRNA
  Olfr16_13
tcctgaggctgtagacaaca

SEQ ID NO: 39766 - DNA, 20 bp, Artificial Sequence
  sgRNA
  Olfr16_14
tgtaggtcacagagagaaga

SEQ ID NO: 39767 - DNA, 20 bp, Artificial Sequence
  sgRNA
  Olfr16_15
aatgggttatgatcgttatg

SEQ ID NO: 39768 - DNA, 20 bp, Artificial Sequence
  sgRNA
  Olfr16_16
ttgtaattcttgtgcccata

SEQ ID NO: 39769 - DNA, 20 bp, Artificial Sequence
  sgRNA
  Olfr16_17
aaggttgtaaaaaatcaggc

SEQ ID NO: 39770 - DNA, 20 bp, Artificial Sequence
  sgRNA
  Olfr16_18
gttcagcaagggagtgatga

SEQ ID NO: 39771 - DNA, 20 bp, Artificial Sequence
  sgRNA
  Olfr16_19
tgctttctgctcacagcaat

SEQ ID NO: 39772 - DNA, 20 bp, Artificial Sequence
  sgRNA
  Olfr16_20
ggagataaatatcagcccta

SEQ ID NO: 39773 - DNA, 20 bp, Artificial Sequence
  sgRNA
  Olfr160_1
ggggatctacataatcacca

SEQ ID NO: 39774 - DNA, 20 bp, Artificial Sequence
  sgRNA
  Olfr160_2
gagcaagagagcttcatgag

SEQ ID NO: 39775 - DNA, 20 bp, Artificial Sequence
  sgRNA
  Olfr160_3
tgcaccccacataggagatg

SEQ ID NO: 39776 - DNA, 20 bp, Artificial Sequence
  sgRNA
  Olfr160_4
ccacgagtgacaggttactg

SEQ ID NO: 39777 - DNA, 20 bp, Artificial Sequence
  sgRNA
  Olfr160_5
cttcgcatcagctccaatga

SEQ ID NO: 39778 - DNA, 20 bp, Artificial Sequence
  sgRNA
  Olfr160_6
tgacagagtttatcctcaga

SEQ ID NO: 39779 - DNA, 20 bp, Artificial Sequence
  sgRNA
  Olfr160_7
acaagcccacagctgcaaag

SEQ ID NO: 39780 - DNA, 20 bp, Artificial Sequence
  sgRNA
  Olfr160_8
tggtgattatgtagatcccc

SEQ ID NO: 39781 - DNA, 20 bp, Artificial Sequence
  sgRNA
  Olfr160_9
tgttgagcctatgagtccca

SEQ ID NO: 39782 - DNA, 20 bp, Artificial Sequence
  sgRNA
  Olfr160_10
gtctatgccatgggactcat

SEQ ID NO: 39783 - DNA, 20 bp, Artificial Sequence
  sgRNA
  Olfr160_11
ttatgtagatccccaggaag

SEQ ID NO: 39784 - DNA, 20 bp, Artificial Sequence
  sgRNA
  Olfr160_12
tagtacctatgatatagaaa

SEQ ID NO: 39785 - DNA, 20 bp, Artificial Sequence
  sgRNA
  Olfr160_13
gcctgttagttagccctctg

SEQ ID NO: 39786 - DNA, 20 bp, Artificial Sequence
  sgRNA
  Olfr160_14
agctacattctcctgggcca

SEQ ID NO: 39787 - DNA, 20 bp, Artificial Sequence
  sgRNA
  Olfr160_15
gcatcagctccaatgagggc

SEQ ID NO: 39788 - DNA, 20 bp, Artificial Sequence
  sgRNA
  Olfr160_16
ggaaatgagtacggttaagc

SEQ ID NO: 39789 - DNA, 20 bp, Artificial Sequence
  sgRNA
  Olfr160_17
aaccaccagcagagagcaga

SEQ ID NO: 39790 - DNA, 20 bp, Artificial Sequence
  sgRNA
  Olfr160_18
gcagctgtgggcttgttcta

SEQ ID NO: 39791 - DNA, 20 bp, Artificial Sequence
  sgRNA
  Olfr160_19
gacagccatttctatatcat

SEQ ID NO: 39792 - DNA, 20 bp, Artificial Sequence
  sgRNA
  Olfr160_20
catgcccagatttcccacca

SEQ ID NO: 39793 - DNA, 20 bp, Artificial Sequence
  sgRNA
  Olfr161_1
ggctcaactctacttctgtg

SEQ ID NO: 39794 - DNA, 20 bp, Artificial Sequence
  sgRNA
  Olfr161_2
agagaaaatacagctgtgtg

SEQ ID NO: 39795 - DNA, 20 bp, Artificial Sequence
  sgRNA
  Olfr161_3
aagaaaggcacaaagctgat

SEQ ID NO: 39796 - DNA, 20 bp, Artificial Sequence
  sgRNA
  Olfr161_4
cagtaccttagggacagtgg

SEQ ID NO: 39797 - DNA, 20 bp, Artificial Sequence
  sgRNA
  Olfr161_5
tgatgattcttgctgttgca

SEQ ID NO: 39798 - DNA, 20 bp, Artificial Sequence
  sgRNA
  Olfr161_6
tgagcaagagagtttcagca

SEQ ID NO: 39799 - DNA, 20 bp, Artificial Sequence
  sgRNA
  Olfr161_7
tcttgttgttgggtcctgga

SEQ ID NO: 39800 - DNA, 20 bp, Artificial Sequence
  sgRNA
  Olfr161_8
gagcaagagagtttcagcag

SEQ ID NO: 39801 - DNA, 20 bp, Artificial Sequence
  sgRNA
  Olfr161_9
gtgcaacagagcattcagac

SEQ ID NO: 39802 - DNA, 20 bp, Artificial Sequence
  sgRNA
  Olfr161_10
ccagctgagtgagaagatga

SEQ ID NO: 39803 - DNA, 20 bp, Artificial Sequence
  sgRNA
  Olfr161_11
ccaggacccaacaacaagaa

SEQ ID NO: 39804 - DNA, 20 bp, Artificial Sequence
  sgRNA
  Olfr161_12
tgacatggacaatttcctgc

SEQ ID NO: 39805 - DNA, 20 bp, Artificial Sequence
  sgRNA
  Olfr161_13
agtcacttcacagaagaagt

SEQ ID NO: 39806 - DNA, 20 bp, Artificial Sequence
  sgRNA
  Olfr161_14
cagctgagtgagaagatgag

SEQ ID NO: 39807 - DNA, 20 bp, Artificial Sequence
  sgRNA
  Olfr161_15
agatgaggggttgaaataca

SEQ ID NO: 39808 - DNA, 20 bp, Artificial Sequence
  sgRNA
  Olfr161_16
gaaggctttccatcttcctg

SEQ ID NO: 39809 - DNA, 20 bp, Artificial Sequence
  sgRNA
  Olfr161_17
tcacttcacagaagaagtgg

SEQ ID NO: 39810 - DNA, 20 bp, Artificial Sequence
  sgRNA
  Olfr161_18
gaggcacccagagaacgaaa

SEQ ID NO: 39811 - DNA, 20 bp, Artificial Sequence
  sgRNA
  Olfr161_19
ggaactcagagacactggac

SEQ ID NO: 39812 - DNA, 20 bp, Artificial Sequence
  sgRNA
  Olfr161_20
gatgagctgctgttgctgct

SEQ ID NO: 39813 - DNA, 20 bp, Artificial Sequence
  sgRNA
  Olfr166_1
tgccatagtcaggaagaaga

SEQ ID NO: 39814 - DNA, 20 bp, Artificial Sequence
  sgRNA
  Olfr166_2
tgatgagcatcaaaagtagc

SEQ ID NO: 39815 - DNA, 20 bp, Artificial Sequence
  sgRNA
  Olfr166_3
ttggatccacacgaatgagg

SEQ ID NO: 39816 - DNA, 20 bp, Artificial Sequence
  sgRNA
  Olfr166_4
atggacctagaatggcagta

SEQ ID NO: 39817 - DNA, 20 bp, Artificial Sequence
  sgRNA
  Olfr166_5
tagttgaaggaaaagtacca

SEQ ID NO: 39818 - DNA, 20 bp, Artificial Sequence
  sgRNA
  Olfr166_6
agcaaaaaggacccgaccat

SEQ ID NO: 39819 - DNA, 20 bp, Artificial Sequence
  sgRNA
  Olfr166_7
ttatagtctgaggaataagg

SEQ ID NO: 39820 - DNA, 20 bp, Artificial Sequence
  sgRNA
  Olfr166_8
cctgactatggcatgttctg

SEQ ID NO: 39821 - DNA, 20 bp, Artificial Sequence
  sgRNA
  Olfr166_9
taaatgatggggttgagcat

SEQ ID NO: 39822 - DNA, 20 bp, Artificial Sequence
  sgRNA
  Olfr166_10
ataaatgatggggttgagca

SEQ ID NO: 39823 - DNA, 20 bp, Artificial Sequence
  sgRNA
  Olfr166_11
cctcagaacatgccatagtc

SEQ ID NO: 39824 - DNA, 20 bp, Artificial Sequence
  sgRNA
  Olfr166_12
gccagaatcttatcttctgt

SEQ ID NO: 39825 - DNA, 20 bp, Artificial Sequence
  sgRNA
  Olfr166_13
gtcttctctctggctttgtg

SEQ ID NO: 39826 - DNA, 20 bp, Artificial Sequence
  sgRNA
  Olfr166_14
agtaccaaggactcttgtca

SEQ ID NO: 39827 - DNA, 20 bp, Artificial Sequence
  sgRNA
  Olfr166_15
ctgactatggcatgttctga

SEQ ID NO: 39828 - DNA, 20 bp, Artificial Sequence
  sgRNA
  Olfr166_16
tatcacagcttcctatggtc

SEQ ID NO: 39829 - DNA, 20 bp, Artificial Sequence
  sgRNA
  Olfr166_17
tcaaaagtagcaggcctgtt

SEQ ID NO: 39830 - DNA, 20 bp, Artificial Sequence
  sgRNA
  Olfr166_18
aatgatggggttgagcatgg

SEQ ID NO: 39831 - DNA, 20 bp, Artificial Sequence
  sgRNA
  Olfr166_19
ctgcttccacaaaaccaaac

SEQ ID NO: 39832 - DNA, 20 bp, Artificial Sequence
  sgRNA
  Olfr166_20
catcatctttgtcttctctc

SEQ ID NO: 39833 - DNA, 20 bp, Artificial Sequence
  sgRNA
  Olfr167_1
tctggcttgcacagacacat

SEQ ID NO: 39834 - DNA, 20 bp, Artificial Sequence
  sgRNA
  Olfr167_2
tgcatatccagtatgagcac

SEQ ID NO: 39835 - DNA, 20 bp, Artificial Sequence
  sgRNA
  Olfr167_3
gtgtgtggagatgtgaatcc

SEQ ID NO: 39836 - DNA, 20 bp, Artificial Sequence
  sgRNA
  Olfr167_4
ctgaaatccacacccaatga

SEQ ID NO: 39837 - DNA, 20 bp, Artificial Sequence
  sgRNA
  Olfr167_5
accgtatgcattctagggcg

SEQ ID NO: 39838 - DNA, 20 bp, Artificial Sequence
  sgRNA
  Olfr167_6
tccccgccctagaatgcata

SEQ ID NO: 39839 - DNA, 20 bp, Artificial Sequence
  sgRNA
  Olfr167_7
gtcctcttctggggatcgga

SEQ ID NO: 39840 - DNA, 20 bp, Artificial Sequence
  sgRNA
  Olfr167_8
ctaccgtatgcattctaggg

SEQ ID NO: 39841 - DNA, 20 bp, Artificial Sequence
  sgRNA
  Olfr167_9
gagggatcttgggcgtagat

SEQ ID NO: 39842 - DNA, 20 bp, Artificial Sequence
  sgRNA
  Olfr167_10
agtagaaagttacaacagtg

SEQ ID NO: 39843 - DNA, 20 bp, Artificial Sequence
  sgRNA
  Olfr167_11
ggccatagatgccaacaaaa

SEQ ID NO: 39844 - DNA, 20 bp, Artificial Sequence
  sgRNA
  Olfr167_12
gtctgtgtgatgatgataac

SEQ ID NO: 39845 - DNA, 20 bp, Artificial Sequence
  sgRNA
  Olfr167_13
cgtagataggtgtaagcaaa

SEQ ID NO: 39846 - DNA, 20 bp, Artificial Sequence
  sgRNA
  Olfr167_14
agtatgagcacaggaattaa

SEQ ID NO: 39847 - DNA, 20 bp, Artificial Sequence
  sgRNA
  Olfr167_15
tgtcctcttctggggatcgg

SEQ ID NO: 39848 - DNA, 20 bp, Artificial Sequence
  sgRNA
  Olfr167_16
atatgtgtggcatagtggag

SEQ ID NO: 39849 - DNA, 20 bp, Artificial Sequence
  sgRNA
  Olfr167_17
tgtggagatgtgaatccagg

SEQ ID NO: 39850 - DNA, 20 bp, Artificial Sequence
  sgRNA
  Olfr167_18
tgaatggaaacacaagaaag

SEQ ID NO: 39851 - DNA, 20 bp, Artificial Sequence
  sgRNA
  Olfr167_19
atggctctggatctgcagta

SEQ ID NO: 39852 - DNA, 20 bp, Artificial Sequence
  sgRNA
  Olfr167_20
ttgttcccaccatcaaaaat

SEQ ID NO: 39853 - DNA, 20 bp, Artificial Sequence
  sgRNA
  Olfr168_1
caagccctcagaacctgcca

SEQ ID NO: 39854 - DNA, 20 bp, Artificial Sequence
  sgRNA
  Olfr168_2
tcatgcgaatgggatagtga

SEQ ID NO: 39855 - DNA, 20 bp, Artificial Sequence
  sgRNA
  Olfr168_3
aatgatccacctcattcgtg

SEQ ID NO: 39856 - DNA, 20 bp, Artificial Sequence
  sgRNA
  Olfr168_4
ataaacccaagtgtccatac

SEQ ID NO: 39857 - DNA, 20 bp, Artificial Sequence
  sgRNA
  Olfr168_5
tatcacagcttcctatggta

SEQ ID NO: 39858 - DNA, 20 bp, Artificial Sequence
  sgRNA
  Olfr168_6
gggccatgacaagagtcctt

SEQ ID NO: 39859 - DNA, 20 bp, Artificial Sequence
  sgRNA
  Olfr168_7
agcaaaaaggaccctaccat

SEQ ID NO: 39860 - DNA, 20 bp, Artificial Sequence
  sgRNA
  Olfr168_8
accccatcatctatagtctg

SEQ ID NO: 39861 - DNA, 20 bp, Artificial Sequence
  sgRNA
  Olfr168_9
ttgaccatggcaggttctga

SEQ ID NO: 39862 - DNA, 20 bp, Artificial Sequence
  sgRNA
  Olfr168_10
tcatggaagagaatgtccca

SEQ ID NO: 39863 - DNA, 20 bp, Artificial Sequence
  sgRNA
  Olfr168_11
tgatgagcatcataagtagt

SEQ ID NO: 39864 - DNA, 20 bp, Artificial Sequence
  sgRNA
  Olfr168_12
ctatagtctgaggaataagg

SEQ ID NO: 39865 - DNA, 20 bp, Artificial Sequence
  sgRNA
  Olfr168_13
attatcttgctcatgcgaat

SEQ ID NO: 39866 - DNA, 20 bp, Artificial Sequence
  sgRNA
  Olfr168_14
tcataagtagtaggccagtt

SEQ ID NO: 39867 - DNA, 20 bp, Artificial Sequence
  sgRNA
  Olfr168_15
gatgatggggttgagcatgg

SEQ ID NO: 39868 - DNA, 20 bp, Artificial Sequence
  sgRNA
  Olfr168_16
tcaagtgatttcattctctt

SEQ ID NO: 39869 - DNA, 20 bp, Artificial Sequence
  sgRNA
  Olfr168_17
tttgaccatggcaggttctg

SEQ ID NO: 39870 - DNA, 20 bp, Artificial Sequence
  sgRNA
  Olfr168_18
ttcctcagactatagatgat

SEQ ID NO: 39871 - DNA, 20 bp, Artificial Sequence
  sgRNA
  Olfr168_19
tcagaatcttatcttctgtt

SEQ ID NO: 39872 - DNA, 20 bp, Artificial Sequence
  sgRNA
  Olfr168_20
cattgctgagtttccaaaca

SEQ ID NO: 39873 - DNA, 20 bp, Artificial Sequence
  sgRNA
  Olfr169_1
tatacatgacaatttcaaca

SEQ ID NO: 39874 - DNA, 20 bp, Artificial Sequence
  sgRNA
  Olfr169_2
actaagcaggaaatacattg

SEQ ID NO: 39875 - DNA, 20 bp, Artificial Sequence
  sgRNA
  Olfr169_3
tgatgagggataactccagt

SEQ ID NO: 39876 - DNA, 20 bp, Artificial Sequence
  sgRNA
  Olfr169_4
gaacgaggcgtttatgtgag

SEQ ID NO: 39877 - DNA, 20 bp, Artificial Sequence
  sgRNA
  Olfr169_5
ttccacctgttccttccaca

SEQ ID NO: 39878 - DNA, 20 bp, Artificial Sequence
  sgRNA
  Olfr169_6
aaccatgtggaaggaacagg

SEQ ID NO: 39879 - DNA, 20 bp, Artificial Sequence
  sgRNA
  Olfr169_7
acattatgacaacaaccatg

SEQ ID NO: 39880 - DNA, 20 bp, Artificial Sequence
  sgRNA
  Olfr169_8
agtgatcaatggctcttgag

SEQ ID NO: 39881 - DNA, 20 bp, Artificial Sequence
  sgRNA
  Olfr169_9
tgaaggagagatgactaagc

SEQ ID NO: 39882 - DNA, 20 bp, Artificial Sequence
  sgRNA
  Olfr169_10
actgcatttggaatacagtg

SEQ ID NO: 39883 - DNA, 20 bp, Artificial Sequence
  sgRNA
  Olfr169_11
attccaaatgcagtcatcag

SEQ ID NO: 39884 - DNA, 20 bp, Artificial Sequence
  sgRNA
  Olfr169_12
ttacgaaagctgtagattat

SEQ ID NO: 39885 - DNA, 20 bp, Artificial Sequence
  sgRNA
  Olfr169_13
gttgttgtcataatgtacta

SEQ ID NO: 39886 - DNA, 20 bp, Artificial Sequence
  sgRNA
  Olfr169_14
tgactaagcaggaaatacat

SEQ ID NO: 39887 - DNA, 20 bp, Artificial Sequence
  sgRNA
  Olfr169_15
gtattccaaatgcagtcatc

SEQ ID NO: 39888 - DNA, 20 bp, Artificial Sequence
  sgRNA
  Olfr169_16
tatgacaacaaccatgtgga

SEQ ID NO: 39889 - DNA, 20 bp, Artificial Sequence
  sgRNA
  Olfr169_17
gcttagtcatctctccttca

SEQ ID NO: 39890 - DNA, 20 bp, Artificial Sequence
  sgRNA
  Olfr169_18
atggctcttgagtggcagaa

SEQ ID NO: 39891 - DNA, 20 bp, Artificial Sequence
  sgRNA
  Olfr169_19
gtagattatggggttgagtg

SEQ ID NO: 39892 - DNA, 20 bp, Artificial Sequence
  sgRNA
  Olfr169_20
tcgtaataaagatgtcctta

SEQ ID NO: 39893 - DNA, 20 bp, Artificial Sequence
  sgRNA
  Olfr17_1
tgggaacccggagaaccaag

SEQ ID NO: 39894 - DNA, 20 bp, Artificial Sequence
  sgRNA
  Olfr17_2
gatcacagatcgccatgtag

SEQ ID NO: 39895 - DNA, 20 bp, Artificial Sequence
  sgRNA
  Olfr17_3
gcacagactagggctatgac

SEQ ID NO: 39896 - DNA, 20 bp, Artificial Sequence
  sgRNA
  Olfr17_4
gttgagtactctgatactcc

SEQ ID NO: 39897 - DNA, 20 bp, Artificial Sequence
  sgRNA
  Olfr17_5
tagagcctccagttcaaata

SEQ ID NO: 39898 - DNA, 20 bp, Artificial Sequence
  sgRNA
  Olfr17_6
ccatgtttgggccacaaaaa

SEQ ID NO: 39899 - DNA, 20 bp, Artificial Sequence
  sgRNA
  Olfr17_7
tagccactgtgcaaaccaca

SEQ ID NO: 39900 - DNA, 20 bp, Artificial Sequence
  sgRNA
  Olfr17_8
atttacctagtcacactcat

SEQ ID NO: 39901 - DNA, 20 bp, Artificial Sequence
  sgRNA
  Olfr17_9
tcaggggaggtgtttgagcg

SEQ ID NO: 39902 - DNA, 20 bp, Artificial Sequence
  sgRNA
  Olfr17_10
ggatgtatcagcacagacta

SEQ ID NO: 39903 - DNA, 20 bp, Artificial Sequence
  sgRNA
  Olfr17_11
ttaggatgccttcagctgaa

SEQ ID NO: 39904 - DNA, 20 bp, Artificial Sequence
  sgRNA
  Olfr17_12
acatctgagtagcacagcca

SEQ ID NO: 39905 - DNA, 20 bp, Artificial Sequence
  sgRNA
  Olfr17_13
gcatcctctctaccatcttt

SEQ ID NO: 39906 - DNA, 20 bp, Artificial Sequence
  sgRNA
  Olfr17_14
tgtagaagagggagacaacg

SEQ ID NO: 39907 - DNA, 20 bp, Artificial Sequence
  sgRNA
  Olfr17_15
ttagagcctccagttcaaat

SEQ ID NO: 39908 - DNA, 20 bp, Artificial Sequence
  sgRNA
  Olfr17_16
catatgccattgtggccagg

SEQ ID NO: 39909 - DNA, 20 bp, Artificial Sequence
  sgRNA
  Olfr17_17
catgggagtgacaactgtgt

SEQ ID NO: 39910 - DNA, 20 bp, Artificial Sequence
  sgRNA
  Olfr17_18
ggtagagaggatgcggacat

SEQ ID NO: 39911 - DNA, 20 bp, Artificial Sequence
  sgRNA
  Olfr17_19
gatggcagtgctgtagaaga

SEQ ID NO: 39912 - DNA, 20 bp, Artificial Sequence
  sgRNA
  Olfr17_20
tagcagagcctgtacttcat

SEQ ID NO: 39913 - DNA, 20 bp, Artificial Sequence
  sgRNA
  Olfr170_1
gagcaaggagtttatgtgag

SEQ ID NO: 39914 - DNA, 20 bp, Artificial Sequence
  sgRNA
  Olfr170_2
actgagcagaaaatacattg

SEQ ID NO: 39915 - DNA, 20 bp, Artificial Sequence
  sgRNA
  Olfr170_3
gcacagggtagcaaagtggg

SEQ ID NO: 39916 - DNA, 20 bp, Artificial Sequence
  sgRNA
  Olfr170_4
agtgtagtacaaaagctgtg

SEQ ID NO: 39917 - DNA, 20 bp, Artificial Sequence
  sgRNA
  Olfr170_5
gacacaacacactatgagca

SEQ ID NO: 39918 - DNA, 20 bp, Artificial Sequence
  sgRNA
  Olfr170_6
gtagcaaagtgggtggcaga

SEQ ID NO: 39919 - DNA, 20 bp, Artificial Sequence
  sgRNA
  Olfr170_7
tcagcacagggtagcaaagt

SEQ ID NO: 39920 - DNA, 20 bp, Artificial Sequence
  sgRNA
  Olfr170_8
tgactgagcagaaaatacat

SEQ ID NO: 39921 - DNA, 20 bp, Artificial Sequence
  sgRNA
  Olfr170_9
atcagcacagggtagcaaag

SEQ ID NO: 39922 - DNA, 20 bp, Artificial Sequence
  sgRNA
  Olfr170_10
gttgagtttgggtgtcaaga

SEQ ID NO: 39923 - DNA, 20 bp, Artificial Sequence
  sgRNA
  Olfr170_11
ttgctaccctgtgctgatga

SEQ ID NO: 39924 - DNA, 20 bp, Artificial Sequence
  sgRNA
  Olfr170_12
tagattatggggttgagttt

SEQ ID NO: 39925 - DNA, 20 bp, Artificial Sequence
  sgRNA
  Olfr170_13
gactgagcagaaaatacatt

SEQ ID NO: 39926 - DNA, 20 bp, Artificial Sequence
  sgRNA
  Olfr170_14
ttcggaataaagatgtcctc

SEQ ID NO: 39927 - DNA, 20 bp, Artificial Sequence
  sgRNA
  Olfr170_15
gcagaaaatacattggggta

SEQ ID NO: 39928 - DNA, 20 bp, Artificial Sequence
  sgRNA
  Olfr170_16
atagattatggggttgagtt

SEQ ID NO: 39929 - DNA, 20 bp, Artificial Sequence
  sgRNA
  Olfr170_17
tagttgtcataatgtactat

SEQ ID NO: 39930 - DNA, 20 bp, Artificial Sequence
  sgRNA
  Olfr170_18
tttgctaccctgtgctgatg

SEQ ID NO: 39931 - DNA, 20 bp, Artificial Sequence
  sgRNA
  Olfr170_19
ttcacagaaaaagtgatcaa

SEQ ID NO: 39932 - DNA, 20 bp, Artificial Sequence
  sgRNA
  Olfr170_20
ctcatatatgtgaaaatgac

SEQ ID NO: 39933 - DNA, 20 bp, Artificial Sequence
  sgRNA
  Olfr171_1
actgagcaggaaatacattg

SEQ ID NO: 39934 - DNA, 20 bp, Artificial Sequence
  sgRNA
  Olfr171_2
ctgatgagggataacttcag

SEQ ID NO: 39935 - DNA, 20 bp, Artificial Sequence
  sgRNA
  Olfr171_3
aggacatgactgccaagaga

SEQ ID NO: 39936 - DNA, 20 bp, Artificial Sequence
  sgRNA
  Olfr171_4
agttaagcttatctttgaag

SEQ ID NO: 39937 - DNA, 20 bp, Artificial Sequence
  sgRNA
  Olfr171_5
aagaggagaacagtcccaaa

SEQ ID NO: 39938 - DNA, 20 bp, Artificial Sequence
  sgRNA
  Olfr171_6
tgaaggagagatgactgagc

SEQ ID NO: 39939 - DNA, 20 bp, Artificial Sequence
  sgRNA
  Olfr171_7
tgactgagcaggaaatacat

SEQ ID NO: 39940 - DNA, 20 bp, Artificial Sequence
  sgRNA
  Olfr171_8
taacagcgacttcatccttt

SEQ ID NO: 39941 - DNA, 20 bp, Artificial Sequence
  sgRNA
  Olfr171_9
aggtggtgagtgccttctct

SEQ ID NO: 39942 - DNA, 20 bp, Artificial Sequence
  sgRNA
  Olfr171_10
tagttgtcataatgtactac

SEQ ID NO: 39943 - DNA, 20 bp, Artificial Sequence
  sgRNA
  Olfr171_11
atagattatggggttgagtg

SEQ ID NO: 39944 - DNA, 20 bp, Artificial Sequence
  sgRNA
  Olfr171_12
ctcatatatgtgaaaatgaa

SEQ ID NO: 39945 - DNA, 20 bp, Artificial Sequence
  sgRNA
  Olfr171_13
gactgagcaggaaatacatt

SEQ ID NO: 39946 - DNA, 20 bp, Artificial Sequence
  sgRNA
  Olfr171_14
ggataacttcagtgggctcc

SEQ ID NO: 39947 - DNA, 20 bp, Artificial Sequence
  sgRNA
  Olfr171_15
ttcagtgggctcctggctgc

SEQ ID NO: 39948 - DNA, 20 bp, Artificial Sequence
  sgRNA
  Olfr172_1
gcagtctgcagtttcaacag

SEQ ID NO: 39949 - DNA, 20 bp, Artificial Sequence
  sgRNA
  Olfr172_2
attgacataggggtcaacac

SEQ ID NO: 39950 - DNA, 20 bp, Artificial Sequence
  sgRNA
  Olfr172_3
gctctgccttcagatgatca

SEQ ID NO: 39951 - DNA, 20 bp, Artificial Sequence
  sgRNA
  Olfr172_4
acaaaccaccctgaaatgaa

SEQ ID NO: 39952 - DNA, 20 bp, Artificial Sequence
  sgRNA
  Olfr172_5
aggctcccgtgatcatctga

SEQ ID NO: 39953 - DNA, 20 bp, Artificial Sequence
  sgRNA
  Olfr172_6
aatacaagctcattgacata

SEQ ID NO: 39954 - DNA, 20 bp, Artificial Sequence
  sgRNA
  Olfr172_7
tcatggtgtggtactgcagt

SEQ ID NO: 39955 - DNA, 20 bp, Artificial Sequence
  sgRNA
  Olfr172_8
ggtggtttgtaaatcctgtg

SEQ ID NO: 39956 - DNA, 20 bp, Artificial Sequence
  sgRNA
  Olfr172_9
atcacgggagccttcatagt

SEQ ID NO: 39957 - DNA, 20 bp, Artificial Sequence
  sgRNA
  Olfr172_10
ggtcataggccattgctgac

SEQ ID NO: 39958 - DNA, 20 bp, Artificial Sequence
  sgRNA
  Olfr172_11
atagaaggcccttcatttca

SEQ ID NO: 39959 - DNA, 20 bp, Artificial Sequence
  sgRNA
  Olfr172_12
agttggaaacctgcattcta

SEQ ID NO: 39960 - DNA, 20 bp, Artificial Sequence
  sgRNA
  Olfr172_13
atacaagctcattgacatag

SEQ ID NO: 39961 - DNA, 20 bp, Artificial Sequence
  sgRNA
  Olfr172_14
tattgtgaaaacttggattg

SEQ ID NO: 39962 - DNA, 20 bp, Artificial Sequence
  sgRNA
  Olfr172_15
cctattgtgaaaacttggat

SEQ ID NO: 39963 - DNA, 20 bp, Artificial Sequence
  sgRNA
  Olfr172_16
aaaagaatactgcaaataga

SEQ ID NO: 39964 - DNA, 20 bp, Artificial Sequence
  sgRNA
  Olfr172_17
caatacaagctcattgacat

SEQ ID NO: 39965 - DNA, 20 bp, Artificial Sequence
  sgRNA
  Olfr172_18
ctgctttctcctgtcagcaa

SEQ ID NO: 39966 - DNA, 20 bp, Artificial Sequence
  sgRNA
  Olfr172_19
ctctgccttcagatgatcac

SEQ ID NO: 39967 - DNA, 20 bp, Artificial Sequence
  sgRNA
  Olfr172_20
aaaccaaatttgctagaaga

SEQ ID NO: 39968 - DNA, 20 bp, Artificial Sequence
  sgRNA
  Olfr173_1
gttgatataggggtcaacac

SEQ ID NO: 39969 - DNA, 20 bp, Artificial Sequence
  sgRNA
  Olfr173_2
aagctcccgtcgtcatctga

SEQ ID NO: 39970 - DNA, 20 bp, Artificial Sequence
  sgRNA
  Olfr173_3
acagaccaccctgaaatgaa

SEQ ID NO: 39971 - DNA, 20 bp, Artificial Sequence
  sgRNA
  Olfr173_4
tgcattctatggttcatgtg

SEQ ID NO: 39972 - DNA, 20 bp, Artificial Sequence
  sgRNA
  Olfr173_5
gctctgccttcagatgacga

SEQ ID NO: 39973 - DNA, 20 bp, Artificial Sequence
  sgRNA
  Olfr173_6
tcgtggtgtggtactgcagt

SEQ ID NO: 39974 - DNA, 20 bp, Artificial Sequence
  sgRNA
  Olfr173_7
tcaatccaagtcttcacaat

SEQ ID NO: 39975 - DNA, 20 bp, Artificial Sequence
  sgRNA
  Olfr173_8
atacaagctcgttgatatag

SEQ ID NO: 39976 - DNA, 20 bp, Artificial Sequence
  sgRNA
  Olfr173_9
ggtggtctgtaaatcctgtg

SEQ ID NO: 39977 - DNA, 20 bp, Artificial Sequence
  sgRNA
  Olfr173_10
aaaagaatactgcaaacaga

SEQ ID NO: 39978 - DNA, 20 bp, Artificial Sequence
  sgRNA
  Olfr173_11
ctctgccttcagatgacgac

SEQ ID NO: 39979 - DNA, 20 bp, Artificial Sequence
  sgRNA
  Olfr173_12
aatacaagctcgttgatata

SEQ ID NO: 39980 - DNA, 20 bp, Artificial Sequence
  sgRNA
  Olfr173_13
ctgctttcttctgtcagcaa

SEQ ID NO: 39981 - DNA, 20 bp, Artificial Sequence
  sgRNA
  Olfr173_14
agaccaaatttgctagaaga

SEQ ID NO: 39982 - DNA, 20 bp, Artificial Sequence
  sgRNA
  Olfr173_15
ggtgtgaagagaacgttctt

SEQ ID NO: 39983 - DNA, 20 bp, Artificial Sequence
  sgRNA
  Olfr173_16
gaggacaaactcacgtttca

SEQ ID NO: 39984 - DNA, 20 bp, Artificial Sequence
  sgRNA
  Olfr173_17
acgacgggagctttcatagc

SEQ ID NO: 39985 - DNA, 20 bp, Artificial Sequence
  sgRNA
  Olfr173_18
gcagagcttcttggacatcg

SEQ ID NO: 39986 - DNA, 20 bp, Artificial Sequence
  sgRNA
  Olfr173_19
agctggaaacctgcattcta

SEQ ID NO: 39987 - DNA, 20 bp, Artificial Sequence
  sgRNA
  Olfr173_20
caaactcacgtttcatggtg

SEQ ID NO: 39988 - DNA, 20 bp, Artificial Sequence
  sgRNA
  Olfr175-ps1_1
gaagtatctttaagtctggg

SEQ ID NO: 39989 - DNA, 20 bp, Artificial Sequence
  sgRNA
  Olfr175-ps1_2
cacatgagagtctgtatagg

SEQ ID NO: 39990 - DNA, 20 bp, Artificial Sequence
  sgRNA
  Olfr175-ps1_3
catcttaggagtgatggcac

SEQ ID NO: 39991 - DNA, 20 bp, Artificial Sequence
  sgRNA
  Olfr175-ps1_4
ctatgtgaatcatggaatgc

SEQ ID NO: 39992 - DNA, 20 bp, Artificial Sequence
  sgRNA
  Olfr175-ps1_5
cgaccaagttctatcaacga

SEQ ID NO: 39993 - DNA, 20 bp, Artificial Sequence
  sgRNA
  Olfr175-ps1_6
tttccttcgttgatagaact

SEQ ID NO: 39994 - DNA, 20 bp, Artificial Sequence
  sgRNA
  Olfr175-ps1_7
gctggtggccttgatctaca

SEQ ID NO: 39995 - DNA, 20 bp, Artificial Sequence
  sgRNA
  Olfr175-ps1_8
taccatctatctggtcacca

SEQ ID NO: 39996 - DNA, 20 bp, Artificial Sequence
  sgRNA
  Olfr175-ps1_9
ggtgttatctaccatctatc

SEQ ID NO: 39997 - DNA, 20 bp, Artificial Sequence
  sgRNA
  Olfr175-ps1_10
cataggccatggctgccaga

SEQ ID NO: 39998 - DNA, 20 bp, Artificial Sequence
  sgRNA
  Olfr175-ps1_11
agaaatcaagactataataa

SEQ ID NO: 39999 - DNA, 20 bp, Artificial Sequence
  sgRNA
  Olfr175-ps1_12
agagtataaaaaatagcaac

SEQ ID NO: 40000 - DNA, 20 bp, Artificial Sequence
  sgRNA
  Olfr175-ps1_13
gatagatggtagataacacc

SEQ ID NO: 40001 - DNA, 20 bp, Artificial Sequence
  sgRNA
  Olfr175-ps1_14
ctgcattccatgattcacat

SEQ ID NO: 40002 - DNA, 20 bp, Artificial Sequence
  sgRNA
  Olfr175-ps1_15
aactgcagactgcttccttc

SEQ ID NO: 40003 - DNA, 20 bp, Artificial Sequence
  sgRNA
  Olfr175-ps1_16
atgagagtctgtataggggg

SEQ ID NO: 40004 - DNA, 20 bp, Artificial Sequence
  sgRNA
  Olfr175-ps1_17
tgcattccatgattcacata

SEQ ID NO: 40005 - DNA, 20 bp, Artificial Sequence
  sgRNA
  Olfr175-ps1_18
ttctcagactataaataaag

SEQ ID NO: 40006 - DNA, 20 bp, Artificial Sequence
  sgRNA
  Olfr175-ps1_19
aacaggaatccatgagagcc

SEQ ID NO: 40007 - DNA, 20 bp, Artificial Sequence
  sgRNA
  Olfr175-ps1_20
acaacagagttcatcctcat

SEQ ID NO: 40008 - DNA, 20 bp, Artificial Sequence
  sgRNA
  Olfr177_1
ggttgcatatagccacatag

SEQ ID NO: 40009 - DNA, 20 bp, Artificial Sequence
  sgRNA
  Olfr177_2
cagcccaagatttcccacca

SEQ ID NO: 40010 - DNA, 20 bp, Artificial Sequence
  sgRNA
  Olfr177_3
gaagtgtctttaagtctggg

SEQ ID NO: 40011 - DNA, 20 bp, Artificial Sequence
  sgRNA
  Olfr177_4
atgagagtctgtatagggga

SEQ ID NO: 40012 - DNA, 20 bp, Artificial Sequence
  sgRNA
  Olfr177_5
agaaatgaggactatagtaa

SEQ ID NO: 40013 - DNA, 20 bp, Artificial Sequence
  sgRNA
  Olfr177_6
ctacattccatgattcacat

SEQ ID NO: 40014 - DNA, 20 bp, Artificial Sequence
  sgRNA
  Olfr177_7
gaccaagttcacttaatgaa

SEQ ID NO: 40015 - DNA, 20 bp, Artificial Sequence
  sgRNA
  Olfr177_8
cgaccaagttcacttaatga

SEQ ID NO: 40016 - DNA, 20 bp, Artificial Sequence
  sgRNA
  Olfr177_9
tgttcaggttaactttctgc

SEQ ID NO: 40017 - DNA, 20 bp, Artificial Sequence
  sgRNA
  Olfr177_10
ggatgcagatataagaaatg

SEQ ID NO: 40018 - DNA, 20 bp, Artificial Sequence
  sgRNA
  Olfr177_11
gcaacagagttcatcctcat

SEQ ID NO: 40019 - DNA, 20 bp, Artificial Sequence
  sgRNA
  Olfr177_12
aacaggagtccatcagagcc

SEQ ID NO: 40020 - DNA, 20 bp, Artificial Sequence
  sgRNA
  Olfr177_13
tcaccatggtgggaaatctt

SEQ ID NO: 40021 - DNA, 20 bp, Artificial Sequence
  sgRNA
  Olfr177_14
ctatgtgaatcatggaatgt

SEQ ID NO: 40022 - DNA, 20 bp, Artificial Sequence
  sgRNA
  Olfr177_15
tacattccatgattcacata

SEQ ID NO: 40023 - DNA, 20 bp, Artificial Sequence
  sgRNA
  Olfr177_16
tacccttcattaagtgaact

SEQ ID NO: 40024 - DNA, 20 bp, Artificial Sequence
  sgRNA
  Olfr177_17
ttggtcgaatatacatgtag

SEQ ID NO: 40025 - DNA, 20 bp, Artificial Sequence
  sgRNA
  Olfr177_18
acgaggttctatgtagatca

SEQ ID NO: 40026 - DNA, 20 bp, Artificial Sequence
  sgRNA
  Olfr177_19
acagaagtgtctttaagtct

SEQ ID NO: 40027 - DNA, 20 bp, Artificial Sequence
  sgRNA
  Olfr177_20
agagtataaaatatagcaac

SEQ ID NO: 40028 - DNA, 20 bp, Artificial Sequence
  sgRNA
  Olfr178_1
tgtacaggagagtctataca

SEQ ID NO: 40029 - DNA, 20 bp, Artificial Sequence
  sgRNA
  Olfr178_2
ggtgatctgagaatcccacc

SEQ ID NO: 40030 - DNA, 20 bp, Artificial Sequence
  sgRNA
  Olfr178_3
gagacaccctacatgaagaa

SEQ ID NO: 40031 - DNA, 20 bp, Artificial Sequence
  sgRNA
  Olfr178_4
cagcccaagattccccacca

SEQ ID NO: 40032 - DNA, 20 bp, Artificial Sequence
  sgRNA
  Olfr178_5
ttacagcctgagaaatactg

SEQ ID NO: 40033 - DNA, 20 bp, Artificial Sequence
  sgRNA
  Olfr178_6
gtacaggagagtctatacag

SEQ ID NO: 40034 - DNA, 20 bp, Artificial Sequence
  sgRNA
  Olfr178_7
gaccacacaattcatcctgg

SEQ ID NO: 40035 - DNA, 20 bp, Artificial Sequence
  sgRNA
  Olfr178_8
tcaagatgaaatctaaagat

SEQ ID NO: 40036 - DNA, 20 bp, Artificial Sequence
  sgRNA
  Olfr178_9
tgatttccattcttcatgta

SEQ ID NO: 40037 - DNA, 20 bp, Artificial Sequence
  sgRNA
  Olfr178_10
tctttattactgtcatcaaa

SEQ ID NO: 40038 - DNA, 20 bp, Artificial Sequence
  sgRNA
  Olfr178_11
ttactacctcagtatttctc

SEQ ID NO: 40039 - DNA, 20 bp, Artificial Sequence
  sgRNA
  Olfr178_12
tctaatatacatgagaagac

SEQ ID NO: 40040 - DNA, 20 bp, Artificial Sequence
  sgRNA
  Olfr178_13
tacatgggtgtatggagacg

SEQ ID NO: 40041 - DNA, 20 bp, Artificial Sequence
  sgRNA
  Olfr178_14
accacacaattcatcctggt

SEQ ID NO: 40042 - DNA, 20 bp, Artificial Sequence
  sgRNA
  Olfr178_15
ctgatttccattcttcatgt

SEQ ID NO: 40043 - DNA, 20 bp, Artificial Sequence
  sgRNA
  Olfr178_16
gtaatggtaagaaattgaat

SEQ ID NO: 40044 - DNA, 20 bp, Artificial Sequence
  sgRNA
  Olfr178_17
ttcaagatgaaatctaaaga

SEQ ID NO: 40045 - DNA, 20 bp, Artificial Sequence
  sgRNA
  Olfr178_18
ctacatgaagaatggaaatc

SEQ ID NO: 40046 - DNA, 20 bp, Artificial Sequence
  sgRNA
  Olfr178_19
atgaaatctaaagatgggag

SEQ ID NO: 40047 - DNA, 20 bp, Artificial Sequence
  sgRNA
  Olfr178_20
cagtaataaagacataccag

SEQ ID NO: 40048 - DNA, 20 bp, Artificial Sequence
  sgRNA
  Olfr18_1
accaacaagccacaaagacg

SEQ ID NO: 40049 - DNA, 20 bp, Artificial Sequence
  sgRNA
  Olfr18_2
taaaggtatcagaacaggca

SEQ ID NO: 40050 - DNA, 20 bp, Artificial Sequence
  sgRNA
  Olfr18_3
atctcagaattccacctcat

SEQ ID NO: 40051 - DNA, 20 bp, Artificial Sequence
  sgRNA
  Olfr18_4
acttacctacttcaagagtg

SEQ ID NO: 40052 - DNA, 20 bp, Artificial Sequence
  sgRNA
  Olfr18_5
acaaggacacagctgaactg

SEQ ID NO: 40053 - DNA, 20 bp, Artificial Sequence
  sgRNA
  Olfr18_6
ttagaatgccatcacctggt

SEQ ID NO: 40054 - DNA, 20 bp, Artificial Sequence
  sgRNA
  Olfr18_7
cttagaatgccatcacctgg

SEQ ID NO: 40055 - DNA, 20 bp, Artificial Sequence
  sgRNA
  Olfr18_8
tttcctctctaacttatcct

SEQ ID NO: 40056 - DNA, 20 bp, Artificial Sequence
  sgRNA
  Olfr18_9
acataaagagggccatgtgg

SEQ ID NO: 40057 - DNA, 20 bp, Artificial Sequence
  sgRNA
  Olfr18_10
agtgaaactgacatcagcca

SEQ ID NO: 40058 - DNA, 20 bp, Artificial Sequence
  sgRNA
  Olfr18_11
aagaaaccaggacataaaga

SEQ ID NO: 40059 - DNA, 20 bp, Artificial Sequence
  sgRNA
  Olfr18_12
ccaacaagccacaaagacga

SEQ ID NO: 40060 - DNA, 20 bp, Artificial Sequence
  sgRNA
  Olfr18_13
gcaaggttgagaagttgaga

SEQ ID NO: 40061 - DNA, 20 bp, Artificial Sequence
  sgRNA
  Olfr18_14
gtagtgcaaaggatgacaga

SEQ ID NO: 40062 - DNA, 20 bp, Artificial Sequence
  sgRNA
  Olfr18_15
tctatgctgatgcatgatga

SEQ ID NO: 40063 - DNA, 20 bp, Artificial Sequence
  sgRNA
  Olfr18_16
ttatatttcccaccaggtga

SEQ ID NO: 40064 - DNA, 20 bp, Artificial Sequence
  sgRNA
  Olfr18_17
gacgagggttcataatgaac

SEQ ID NO: 40065 - DNA, 20 bp, Artificial Sequence
  sgRNA
  Olfr18_18
tgatggcattctaagaatgg

SEQ ID NO: 40066 - DNA, 20 bp, Artificial Sequence
  sgRNA
  Olfr18_19
agacggatcacagaagaaat

SEQ ID NO: 40067 - DNA, 20 bp, Artificial Sequence
  sgRNA
  Olfr18_20
tagtctgcttctaactgcaa

SEQ ID NO: 40068 - DNA, 20 bp, Artificial Sequence
  sgRNA
  Olfr180_1
gtacaggagagtctatatag

SEQ ID NO: 40069 - DNA, 20 bp, Artificial Sequence
  sgRNA
  Olfr180_2
acgaggctccaagtagatca

SEQ ID NO: 40070 - DNA, 20 bp, Artificial Sequence
  sgRNA
  Olfr180_3
gtaatggtgaagacttgaat

SEQ ID NO: 40071 - DNA, 20 bp, Artificial Sequence
  sgRNA
  Olfr180_4
gagacaccctacatgaatca

SEQ ID NO: 40072 - DNA, 20 bp, Artificial Sequence
  sgRNA
  Olfr180_5
tatattagaccatttgacga

SEQ ID NO: 40073 - DNA, 20 bp, Artificial Sequence
  sgRNA
  Olfr180_6
gctggtggccgtgatctact

SEQ ID NO: 40074 - DNA, 20 bp, Artificial Sequence
  sgRNA
  Olfr180_7
gttccagaatccttgccaga

SEQ ID NO: 40075 - DNA, 20 bp, Artificial Sequence
  sgRNA
  Olfr180_8
gatactctagaagagccaca

SEQ ID NO: 40076 - DNA, 20 bp, Artificial Sequence
  sgRNA
  Olfr180_9
gcttctgattccacatccag

SEQ ID NO: 40077 - DNA, 20 bp, Artificial Sequence
  sgRNA
  Olfr180_10
tgcattccttgattcatgta

SEQ ID NO: 40078 - DNA, 20 bp, Artificial Sequence
  sgRNA
  Olfr180_11
aggtaataaagacataccag

SEQ ID NO: 40079 - DNA, 20 bp, Artificial Sequence
  sgRNA
  Olfr180_12
ctgcattccttgattcatgt

SEQ ID NO: 40080 - DNA, 20 bp, Artificial Sequence
  sgRNA
  Olfr180_13
ctacatgaatcaaggaatgc

SEQ ID NO: 40081 - DNA, 20 bp, Artificial Sequence
  sgRNA
  Olfr180_14
tctttattaccttcgtcaaa

SEQ ID NO: 40082 - DNA, 20 bp, Artificial Sequence
  sgRNA
  Olfr180_15
tgtacaggagagtctatata

SEQ ID NO: 40083 - DNA, 20 bp, Artificial Sequence
  sgRNA
  Olfr180_16
accacacagttcatcctggt

SEQ ID NO: 40084 - DNA, 20 bp, Artificial Sequence
  sgRNA
  Olfr180_17
gaccacacagttcatcctgg

SEQ ID NO: 40085 - DNA, 20 bp, Artificial Sequence
  sgRNA
  Olfr180_18
agaagcaactgtgagccatc

SEQ ID NO: 40086 - DNA, 20 bp, Artificial Sequence
  sgRNA
  Olfr180_19
tcccaccaggatgaactgtg

SEQ ID NO: 40087 - DNA, 20 bp, Artificial Sequence
  sgRNA
  Olfr180_20
tcttctagagtatctcactt

SEQ ID NO: 40088 - DNA, 20 bp, Artificial Sequence
  sgRNA
  Olfr181_1
tctatctggtcaccatagtg

SEQ ID NO: 40089 - DNA, 20 bp, Artificial Sequence
  sgRNA
  Olfr181_2
gtacaggagagtttatacaa

SEQ ID NO: 40090 - DNA, 20 bp, Artificial Sequence
  sgRNA
  Olfr181_3
ctgtatgtatcaaggaatgc

SEQ ID NO: 40091 - DNA, 20 bp, Artificial Sequence
  sgRNA
  Olfr181_4
tcatggtgtggtactgcaga

SEQ ID NO: 40092 - DNA, 20 bp, Artificial Sequence
  sgRNA
  Olfr181_5
gctgtaagagaccaagacag

SEQ ID NO: 40093 - DNA, 20 bp, Artificial Sequence
  sgRNA
  Olfr181_6
tttcccagaaagatgtacat

SEQ ID NO: 40094 - DNA, 20 bp, Artificial Sequence
  sgRNA
  Olfr181_7
cactatggtgaccagataga

SEQ ID NO: 40095 - DNA, 20 bp, Artificial Sequence
  sgRNA
  Olfr181_8
agtaacaaagacatacctgt

SEQ ID NO: 40096 - DNA, 20 bp, Artificial Sequence
  sgRNA
  Olfr181_9
attgtataaaatacacctac

SEQ ID NO: 40097 - DNA, 20 bp, Artificial Sequence
  sgRNA
  Olfr181_10
gtaatggtaaagacttgaat

SEQ ID NO: 40098 - DNA, 20 bp, Artificial Sequence
  sgRNA
  Olfr181_11
gctgttctctgccatctatc

SEQ ID NO: 40099 - DNA, 20 bp, Artificial Sequence
  sgRNA
  Olfr181_12
tgtgatctgagaatcctatg

SEQ ID NO: 40100 - DNA, 20 bp, Artificial Sequence
  sgRNA
  Olfr181_13
atttcccagaaagatgtaca

SEQ ID NO: 40101 - DNA, 20 bp, Artificial Sequence
  sgRNA
  Olfr181_14
gatagatggcagagaacagc

SEQ ID NO: 40102 - DNA, 20 bp, Artificial Sequence
  sgRNA
  Olfr181_15
tgtacaggagagtttataca

SEQ ID NO: 40103 - DNA, 20 bp, Artificial Sequence
  sgRNA
  Olfr181_16
tcaccatagtggggaatctt

SEQ ID NO: 40104 - DNA, 20 bp, Artificial Sequence
  sgRNA
  Olfr181_17
acagtagagttcatcctcat

SEQ ID NO: 40105 - DNA, 20 bp, Artificial Sequence
  sgRNA
  Olfr181_18
tctgggaaatctggctctga

SEQ ID NO: 40106 - DNA, 20 bp, Artificial Sequence
  sgRNA
  Olfr181_19
ctgcattccttgatacatac

SEQ ID NO: 40107 - DNA, 20 bp, Artificial Sequence
  sgRNA
  Olfr181_20
atctatctggtcaccatagt

SEQ ID NO: 40108 - DNA, 20 bp, Artificial Sequence
  sgRNA
  Olfr183_1
caagggcaaggtgatttctg

SEQ ID NO: 40109 - DNA, 20 bp, Artificial Sequence
  sgRNA
  Olfr183_2
tgataaccatgtatccacaa

SEQ ID NO: 40110 - DNA, 20 bp, Artificial Sequence
  sgRNA
  Olfr183_3
cagaccaaggttcccgacaa

SEQ ID NO: 40111 - DNA, 20 bp, Artificial Sequence
  sgRNA
  Olfr183_4
aataggagaggtttccactg

SEQ ID NO: 40112 - DNA, 20 bp, Artificial Sequence
  sgRNA
  Olfr183_5
ttagccttatcatttatagg

SEQ ID NO: 40113 - DNA, 20 bp, Artificial Sequence
  sgRNA
  Olfr183_6
tatcatccacagtgacaccg

SEQ ID NO: 40114 - DNA, 20 bp, Artificial Sequence
  sgRNA
  Olfr183_7
ttaaaaaagaagtctgacaa

SEQ ID NO: 40115 - DNA, 20 bp, Artificial Sequence
  sgRNA
  Olfr183_8
agataattggatttaatacg

SEQ ID NO: 40116 - DNA, 20 bp, Artificial Sequence
  sgRNA
  Olfr183_9
agtatattaccaagaacact

SEQ ID NO: 40117 - DNA, 20 bp, Artificial Sequence
  sgRNA
  Olfr183_10
gagaacaaactcagtccata

SEQ ID NO: 40118 - DNA, 20 bp, Artificial Sequence
  sgRNA
  Olfr183_11
agtataaagatacagacaag

SEQ ID NO: 40119 - DNA, 20 bp, Artificial Sequence
  sgRNA
  Olfr183_12
ttaccaagaacactaggaat

SEQ ID NO: 40120 - DNA, 20 bp, Artificial Sequence
  sgRNA
  Olfr183_13
ctataaatgataaggctaat

SEQ ID NO: 40121 - DNA, 20 bp, Artificial Sequence
  sgRNA
  Olfr183_14
ctatttaatctcttggacaa

SEQ ID NO: 40122 - DNA, 20 bp, Artificial Sequence
  sgRNA
  Olfr183_15
ataaagatacagacaagagg

SEQ ID NO: 40123 - DNA, 20 bp, Artificial Sequence
  sgRNA
  Olfr183_16
ctattagccttatcatttat

SEQ ID NO: 40124 - DNA, 20 bp, Artificial Sequence
  sgRNA
  Olfr183_17
ggagaggtttccactgtggt

SEQ ID NO: 40125 - DNA, 20 bp, Artificial Sequence
  sgRNA
  Olfr183_18
tgtggtcacactgattgcaa

SEQ ID NO: 40126 - DNA, 20 bp, Artificial Sequence
  sgRNA
  Olfr183_19
gtagataattggatttaata

SEQ ID NO: 40127 - DNA, 20 bp, Artificial Sequence
  sgRNA
  Olfr183_20
aagaacactaggaataggag

SEQ ID NO: 40128 - DNA, 20 bp, Artificial Sequence
  sgRNA
  Olfr186_1
tgaatactgaaactagtagg

SEQ ID NO: 40129 - DNA, 20 bp, Artificial Sequence
  sgRNA
  Olfr186_2
gtacaggaaatattatacaa

SEQ ID NO: 40130 - DNA, 20 bp, Artificial Sequence
  sgRNA
  Olfr186_3
tgtggtcccgccaaatgcga

SEQ ID NO: 40131 - DNA, 20 bp, Artificial Sequence
  sgRNA
  Olfr186_4
ctacaaaagccaaactccca

SEQ ID NO: 40132 - DNA, 20 bp, Artificial Sequence
  sgRNA
  Olfr186_5
cctgcatctcaacaaacaga

SEQ ID NO: 40133 - DNA, 20 bp, Artificial Sequence
  sgRNA
  Olfr186_6
tgacagagtttgttctcaca

SEQ ID NO: 40134 - DNA, 20 bp, Artificial Sequence
  sgRNA
  Olfr186_7
ctactagtttcagtattcat

SEQ ID NO: 40135 - DNA, 20 bp, Artificial Sequence
  sgRNA
  Olfr186_8
gatatatcatcaagaatagt

SEQ ID NO: 40136 - DNA, 20 bp, Artificial Sequence
  sgRNA
  Olfr186_9
ctacagcctgagaaacaagc

SEQ ID NO: 40137 - DNA, 20 bp, Artificial Sequence
  sgRNA
  Olfr186_10
ttaaaaatgaagtctctcca

SEQ ID NO: 40138 - DNA, 20 bp, Artificial Sequence
  sgRNA
  Olfr186_11
agtctattggtcataataac

SEQ ID NO: 40139 - DNA, 20 bp, Artificial Sequence
  sgRNA
  Olfr186_12
agatgagagcaatcagacct

SEQ ID NO: 40140 - DNA, 20 bp, Artificial Sequence
  sgRNA
  Olfr186_13
gattatgttagaattacaga

SEQ ID NO: 40141 - DNA, 20 bp, Artificial Sequence
  sgRNA
  Olfr186_14
tatatctcatcactgttgtg

SEQ ID NO: 40142 - DNA, 20 bp, Artificial Sequence
  sgRNA
  Olfr186_15
acatagggatatgcaggtgg

SEQ ID NO: 40143 - DNA, 20 bp, Artificial Sequence
  sgRNA
  Olfr186_16
caacatattaggagtcactg

SEQ ID NO: 40144 - DNA, 20 bp, Artificial Sequence
  sgRNA
  Olfr186_17
cagggctcacagatcatcaa

SEQ ID NO: 40145 - DNA, 20 bp, Artificial Sequence
  sgRNA
  Olfr186_18
agaaggccttccttatacct

SEQ ID NO: 40146 - DNA, 20 bp, Artificial Sequence
  sgRNA
  Olfr186_19
ctagtttcagtattcatagg

SEQ ID NO: 40147 - DNA, 20 bp, Artificial Sequence
  sgRNA
  Olfr186_20
gtacatagggatatgcaggt

SEQ ID NO: 40148 - DNA, 20 bp, Artificial Sequence
  sgRNA
  Olfr187_1
aacagagggatgttccacag

SEQ ID NO: 40149 - DNA, 20 bp, Artificial Sequence
  sgRNA
  Olfr187_2
gaccattggtcataactact

SEQ ID NO: 40150 - DNA, 20 bp, Artificial Sequence
  sgRNA
  Olfr187_3
caaactgacgtttcccacaa

SEQ ID NO: 40151 - DNA, 20 bp, Artificial Sequence
  sgRNA
  Olfr187_4
ataaaagtgatgtatcatgt

SEQ ID NO: 40152 - DNA, 20 bp, Artificial Sequence
  sgRNA
  Olfr187_5
cataggccatcgctgccaag

SEQ ID NO: 40153 - DNA, 20 bp, Artificial Sequence
  sgRNA
  Olfr187_6
tacccagtagttatgaccaa

SEQ ID NO: 40154 - DNA, 20 bp, Artificial Sequence
  sgRNA
  Olfr187_7
gcttccaagaaacagataca

SEQ ID NO: 40155 - DNA, 20 bp, Artificial Sequence
  sgRNA
  Olfr187_8
gggcccatagtataaagaca

SEQ ID NO: 40156 - DNA, 20 bp, Artificial Sequence
  sgRNA
  Olfr187_9
aacaaactctgttagcaggg

SEQ ID NO: 40157 - DNA, 20 bp, Artificial Sequence
  sgRNA
  Olfr187_10
ccaagaagaccaggaacaga

SEQ ID NO: 40158 - DNA, 20 bp, Artificial Sequence
  sgRNA
  Olfr187_11
ataactactgggtagagtaa

SEQ ID NO: 40159 - DNA, 20 bp, Artificial Sequence
  sgRNA
  Olfr187_12
tagccacacacacagaccat

SEQ ID NO: 40160 - DNA, 20 bp, Artificial Sequence
  sgRNA
  Olfr187_13
gatagatcaccaagaagacc

SEQ ID NO: 40161 - DNA, 20 bp, Artificial Sequence
  sgRNA
  Olfr187_14
ctaacagagtttgttctcac

SEQ ID NO: 40162 - DNA, 20 bp, Artificial Sequence
  sgRNA
  Olfr187_15
catctacttctgaagatgca

SEQ ID NO: 40163 - DNA, 20 bp, Artificial Sequence
  sgRNA
  Olfr187_16
gtgcacatacatgaagagaa

SEQ ID NO: 40164 - DNA, 20 bp, Artificial Sequence
  sgRNA
  Olfr187_17
aattccagcaacaaaagaca

SEQ ID NO: 40165 - DNA, 20 bp, Artificial Sequence
  sgRNA
  Olfr187_18
ttccaagaaacagatacatg

SEQ ID NO: 40166 - DNA, 20 bp, Artificial Sequence
  sgRNA
  Olfr187_19
catagtataaagacacggat

SEQ ID NO: 40167 - DNA, 20 bp, Artificial Sequence
  sgRNA
  Olfr187_20
accaagaagaccaggaacag

SEQ ID NO: 40168 - DNA, 20 bp, Artificial Sequence
  sgRNA
  Olfr19_1
ccaaaactaaaaatccacag

SEQ ID NO: 40169 - DNA, 20 bp, Artificial Sequence
  sgRNA
  Olfr19_2
gaatatacagacaaagaaca

SEQ ID NO: 40170 - DNA, 20 bp, Artificial Sequence
  sgRNA
  Olfr19_3
catcaccatgtcattaggaa

SEQ ID NO: 40171 - DNA, 20 bp, Artificial Sequence
  sgRNA
  Olfr19_4
gattaagctcacaaacaaag

SEQ ID NO: 40172 - DNA, 20 bp, Artificial Sequence
  sgRNA
  Olfr19_5
gtgcaatctcatcatcacag

SEQ ID NO: 40173 - DNA, 20 bp, Artificial Sequence
  sgRNA
  Olfr19_6
tttgcagctatactgctggg

SEQ ID NO: 40174 - DNA, 20 bp, Artificial Sequence
  sgRNA
  Olfr19_7
agaataatgaaacaactgag

SEQ ID NO: 40175 - DNA, 20 bp, Artificial Sequence
  sgRNA
  Olfr19_8
gaggatcctctgaaattccc

SEQ ID NO: 40176 - DNA, 20 bp, Artificial Sequence
  sgRNA
  Olfr19_9
gcagctatactgctgggtgg

SEQ ID NO: 40177 - DNA, 20 bp, Artificial Sequence
  sgRNA
  Olfr19_10
ttaagctcacaaacaaagtg

SEQ ID NO: 40178 - DNA, 20 bp, Artificial Sequence
  sgRNA
  Olfr19_11
cgtgcaatctcatcatcaca

SEQ ID NO: 40179 - DNA, 20 bp, Artificial Sequence
  sgRNA
  Olfr19_12
tgatgaccatatagtgcaga

SEQ ID NO: 40180 - DNA, 20 bp, Artificial Sequence
  sgRNA
  Olfr19_13
gtatattcactagcatcttt

SEQ ID NO: 40181 - DNA, 20 bp, Artificial Sequence
  sgRNA
  Olfr19_14
tgatgagattgcacgtatgg

SEQ ID NO: 40182 - DNA, 20 bp, Artificial Sequence
  sgRNA
  Olfr19_15
tattctcctgggaatttcag

SEQ ID NO: 40183 - DNA, 20 bp, Artificial Sequence
  sgRNA
  Olfr19_16
ttattctattctacactctt

SEQ ID NO: 40184 - DNA, 20 bp, Artificial Sequence
  sgRNA
  Olfr19_17
tgcagagttcaatggcactg

SEQ ID NO: 40185 - DNA, 20 bp, Artificial Sequence
  sgRNA
  Olfr19_18
attaagctcacaaacaaagt

SEQ ID NO: 40186 - DNA, 20 bp, Artificial Sequence
  sgRNA
  Olfr19_19
agtaaagcagatgtctgcaa

SEQ ID NO: 40187 - DNA, 20 bp, Artificial Sequence
  sgRNA
  Olfr19_20
ggtgacagattgccacatat

SEQ ID NO: 40188 - DNA, 20 bp, Artificial Sequence
  sgRNA
  Olfr190_1
tctatctcattactattgta

SEQ ID NO: 40189 - DNA, 20 bp, Artificial Sequence
  sgRNA
  Olfr190_2
tgcttccctatcatccacag

SEQ ID NO: 40190 - DNA, 20 bp, Artificial Sequence
  sgRNA
  Olfr190_3
attaagagtagtgtcagtac

SEQ ID NO: 40191 - DNA, 20 bp, Artificial Sequence
  sgRNA
  Olfr190_4
gaattccacctacaaaagac

SEQ ID NO: 40192 - DNA, 20 bp, Artificial Sequence
  sgRNA
  Olfr190_5
ggacacaagaacaatcacaa

SEQ ID NO: 40193 - DNA, 20 bp, Artificial Sequence
  sgRNA
  Olfr190_6
agtaatggattctctgaaaa

SEQ ID NO: 40194 - DNA, 20 bp, Artificial Sequence
  sgRNA
  Olfr190_7
caagaacaatcacaacggtg

SEQ ID NO: 40195 - DNA, 20 bp, Artificial Sequence
  sgRNA
  Olfr190_8
accagaaaaaacaagaacaa

SEQ ID NO: 40196 - DNA, 20 bp, Artificial Sequence
  sgRNA
  Olfr190_9
cctgagaaacaagcaagtaa

SEQ ID NO: 40197 - DNA, 20 bp, Artificial Sequence
  sgRNA
  Olfr190_10
cgtcaatagcactagtgtat

SEQ ID NO: 40198 - DNA, 20 bp, Artificial Sequence
  sgRNA
  Olfr190_11
gtctgtccaaagcatgaaga

SEQ ID NO: 40199 - DNA, 20 bp, Artificial Sequence
  sgRNA
  Olfr190_12
agaaagccttcttcatgctt

SEQ ID NO: 40200 - DNA, 20 bp, Artificial Sequence
  sgRNA
  Olfr190_13
attactattgtagggaacct

SEQ ID NO: 40201 - DNA, 20 bp, Artificial Sequence
  sgRNA
  Olfr190_14
atgtttcttgttgggagcta

SEQ ID NO: 40202 - DNA, 20 bp, Artificial Sequence
  sgRNA
  Olfr190_15
cacagagtctccagagctac

SEQ ID NO: 40203 - DNA, 20 bp, Artificial Sequence
  sgRNA
  Olfr190_16
actacagaatgtttcttgtt

SEQ ID NO: 40204 - DNA, 20 bp, Artificial Sequence
  sgRNA
  Olfr190_17
aaaatatacatgatgagaag

SEQ ID NO: 40205 - DNA, 20 bp, Artificial Sequence
  sgRNA
  Olfr190_18
tactacagaatgtttcttgt

SEQ ID NO: 40206 - DNA, 20 bp, Artificial Sequence
  sgRNA
  Olfr190_19
ccattacttgcttgtttctc

SEQ ID NO: 40207 - DNA, 20 bp, Artificial Sequence
  sgRNA
  Olfr190_20
aacaagggcacctgtagctc

SEQ ID NO: 40208 - DNA, 20 bp, Artificial Sequence
  sgRNA
  Olfr191_1
attcatgctttaattcacga

SEQ ID NO: 40209 - DNA, 20 bp, Artificial Sequence
  sgRNA
  Olfr191_2
atttgtagtgagtgcaacca

SEQ ID NO: 40210 - DNA, 20 bp, Artificial Sequence
  sgRNA
  Olfr191_3
ccaaaaacagcaggaacagg

SEQ ID NO: 40211 - DNA, 20 bp, Artificial Sequence
  sgRNA
  Olfr191_4
agatgagaatgatcagacca

SEQ ID NO: 40212 - DNA, 20 bp, Artificial Sequence
  sgRNA
  Olfr191_5
acccaattatctacagtctg

SEQ ID NO: 40213 - DNA, 20 bp, Artificial Sequence
  sgRNA
  Olfr191_6
tgccaagagaaaacattccg

SEQ ID NO: 40214 - DNA, 20 bp, Artificial Sequence
  sgRNA
  Olfr191_7
gataaatgaccaaaaacagc

SEQ ID NO: 40215 - DNA, 20 bp, Artificial Sequence
  sgRNA
  Olfr191_8
gcataacatcacaataaaaa

SEQ ID NO: 40216 - DNA, 20 bp, Artificial Sequence
  sgRNA
  Olfr191_9
gaccaaaaacagcaggaaca

SEQ ID NO: 40217 - DNA, 20 bp, Artificial Sequence
  sgRNA
  Olfr191_10
tgagcaagtaaaaaaatcac

SEQ ID NO: 40218 - DNA, 20 bp, Artificial Sequence
  sgRNA
  Olfr191_11
atgaatgaatccacctaaaa

SEQ ID NO: 40219 - DNA, 20 bp, Artificial Sequence
  sgRNA
  Olfr191_12
aatcactggcaaaatgttta

SEQ ID NO: 40220 - DNA, 20 bp, Artificial Sequence
  sgRNA
  Olfr191_13
tgaccaaaaacagcaggaac

SEQ ID NO: 40221 - DNA, 20 bp, Artificial Sequence
  sgRNA
  Olfr191_14
ttcctcagactgtagataat

SEQ ID NO: 40222 - DNA, 20 bp, Artificial Sequence
  sgRNA
  Olfr191_15
tcctcagactgtagataatt

SEQ ID NO: 40223 - DNA, 20 bp, Artificial Sequence
  sgRNA
  Olfr193_1
atttggaatcagtgcaacca

SEQ ID NO: 40224 - DNA, 20 bp, Artificial Sequence
  sgRNA
  Olfr193_2
gcataacatcacaataaaag

SEQ ID NO: 40225 - DNA, 20 bp, Artificial Sequence
  sgRNA
  Olfr193_3
atgaatgaatccacctacaa

SEQ ID NO: 40226 - DNA, 20 bp, Artificial Sequence
  sgRNA
  Olfr193_4
gacttgttcatctgccccag

SEQ ID NO: 40227 - DNA, 20 bp, Artificial Sequence
  sgRNA
  Olfr193_5
tgccaaaagaaaacattccg

SEQ ID NO: 40228 - DNA, 20 bp, Artificial Sequence
  sgRNA
  Olfr193_6
ctcccaagaaaaaagtacat

SEQ ID NO: 40229 - DNA, 20 bp, Artificial Sequence
  sgRNA
  Olfr193_7
attcatgctttaattcatga

SEQ ID NO: 40230 - DNA, 20 bp, Artificial Sequence
  sgRNA
  Olfr193_8
acccaattatctatagtttg

SEQ ID NO: 40231 - DNA, 20 bp, Artificial Sequence
  sgRNA
  Olfr193_9
aaaagtacataggaatgtga

SEQ ID NO: 40232 - DNA, 20 bp, Artificial Sequence
  sgRNA
  Olfr193_10
ttcctcaaactatagataat

SEQ ID NO: 40233 - DNA, 20 bp, Artificial Sequence
  sgRNA
  Olfr193_11
tcctcaaactatagataatt

SEQ ID NO: 40234 - DNA, 20 bp, Artificial Sequence
  sgRNA
  Olfr193_12
catctatctcatcaccattg

SEQ ID NO: 40235 - DNA, 20 bp, Artificial Sequence
  sgRNA
  Olfr195_1
aggagattctgtataatgga

SEQ ID NO: 40236 - DNA, 20 bp, Artificial Sequence
  sgRNA
  Olfr195_2
tgcatcctatgattgaagta

SEQ ID NO: 40237 - DNA, 20 bp, Artificial Sequence
  sgRNA
  Olfr195_3
cagccctagattccccacca

SEQ ID NO: 40238 - DNA, 20 bp, Artificial Sequence
  sgRNA
  Olfr195_4
aggatcccatggtcatttga

SEQ ID NO: 40239 - DNA, 20 bp, Artificial Sequence
  sgRNA
  Olfr195_5
ttcacaatgaaatctaaaga

SEQ ID NO: 40240 - DNA, 20 bp, Artificial Sequence
  sgRNA
  Olfr195_6
gtacaggagattctgtataa

SEQ ID NO: 40241 - DNA, 20 bp, Artificial Sequence
  sgRNA
  Olfr195_7
ggagtaagacactagaacta

SEQ ID NO: 40242 - DNA, 20 bp, Artificial Sequence
  sgRNA
  Olfr195_8
gctctgccttcaaatgacca

SEQ ID NO: 40243 - DNA, 20 bp, Artificial Sequence
  sgRNA
  Olfr195_9
ggtgatctgagaaccccacc

SEQ ID NO: 40244 - DNA, 20 bp, Artificial Sequence
  sgRNA
  Olfr195_10
tcatgctgtggtactgcagt

SEQ ID NO: 40245 - DNA, 20 bp, Artificial Sequence
  sgRNA
  Olfr195_11
tctccttcattggctgaatg

SEQ ID NO: 40246 - DNA, 20 bp, Artificial Sequence
  sgRNA
  Olfr195_12
gcagagaacaccaggaacag

SEQ ID NO: 40247 - DNA, 20 bp, Artificial Sequence
  sgRNA
  Olfr195_13
gacaaatgaattcatcctgg

SEQ ID NO: 40248 - DNA, 20 bp, Artificial Sequence
  sgRNA
  Olfr195_14
agtgatggcacaagagcagc

SEQ ID NO: 40249 - DNA, 20 bp, Artificial Sequence
  sgRNA
  Olfr195_15
accatgggatcctacatagc

SEQ ID NO: 40250 - DNA, 20 bp, Artificial Sequence
  sgRNA
  Olfr195_16
ctctgccttcaaatgaccat

SEQ ID NO: 40251 - DNA, 20 bp, Artificial Sequence
  sgRNA
  Olfr195_17
tgttgaggttaactttctgc

SEQ ID NO: 40252 - DNA, 20 bp, Artificial Sequence
  sgRNA
  Olfr195_18
aaaagccctacttcaatcat

SEQ ID NO: 40253 - DNA, 20 bp, Artificial Sequence
  sgRNA
  Olfr195_19
attcacaatgaaatctaaag

SEQ ID NO: 40254 - DNA, 20 bp, Artificial Sequence
  sgRNA
  Olfr195_20
tcctgctatgtaggatccca

SEQ ID NO: 40255 - DNA, 20 bp, Artificial Sequence
  sgRNA
  Olfr196_1
gataaatgaccaagaacagc

SEQ ID NO: 40256 - DNA, 20 bp, Artificial Sequence
  sgRNA
  Olfr196_2
gcattaggtaattgagagaa

SEQ ID NO: 40257 - DNA, 20 bp, Artificial Sequence
  sgRNA
  Olfr196_3
acataggaatgtgaaggtga

SEQ ID NO: 40258 - DNA, 20 bp, Artificial Sequence
  sgRNA
  Olfr196_4
tgccaagagaaaacattctg

SEQ ID NO: 40259 - DNA, 20 bp, Artificial Sequence
  sgRNA
  Olfr196_5
agtagacgatcaagatatga

SEQ ID NO: 40260 - DNA, 20 bp, Artificial Sequence
  sgRNA
  Olfr196_6
atatcttgatcgtctacttg

SEQ ID NO: 40261 - DNA, 20 bp, Artificial Sequence
  sgRNA
  Olfr196_7
catagtacaaagagacagag

SEQ ID NO: 40262 - DNA, 20 bp, Artificial Sequence
  sgRNA
  Olfr196_8
gactcagtcatctgccacag

SEQ ID NO: 40263 - DNA, 20 bp, Artificial Sequence
  sgRNA
  Olfr196_9
tcgtctacttgtggagatgc

SEQ ID NO: 40264 - DNA, 20 bp, Artificial Sequence
  sgRNA
  Olfr196_10
ctcccaagaaataagtacat

SEQ ID NO: 40265 - DNA, 20 bp, Artificial Sequence
  sgRNA
  Olfr196_11
cagagaaaataaaaagcatt

SEQ ID NO: 40266 - DNA, 20 bp, Artificial Sequence
  sgRNA
  Olfr196_12
agcattaggtaattgagaga

SEQ ID NO: 40267 - DNA, 20 bp, Artificial Sequence
  sgRNA
  Olfr196_13
ttcctatgtacttatttctt

SEQ ID NO: 40268 - DNA, 20 bp, Artificial Sequence
  sgRNA
  Olfr196_14
taagcaagtaaaaaattcac

SEQ ID NO: 40269 - DNA, 20 bp, Artificial Sequence
  sgRNA
  Olfr196_15
attgagagaagggtcattac

SEQ ID NO: 40270 - DNA, 20 bp, Artificial Sequence
  sgRNA
  Olfr196_16
aaaaagtctaagagcatctt

SEQ ID NO: 40271 - DNA, 20 bp, Artificial Sequence
  sgRNA
  Olfr196_17
gaaagagatcagtttgctct

SEQ ID NO: 40272 - DNA, 20 bp, Artificial Sequence
  sgRNA
  Olfr198_1
gagcccaaggttgcccacca

SEQ ID NO: 40273 - DNA, 20 bp, Artificial Sequence
  sgRNA
  Olfr198_2
ggaaccaaagaaataaaact

SEQ ID NO: 40274 - DNA, 20 bp, Artificial Sequence
  sgRNA
  Olfr198_3
tcatcactggataaagcaaa

SEQ ID NO: 40275 - DNA, 20 bp, Artificial Sequence
  sgRNA
  Olfr198_4
agtcacagaagatgaagcac

SEQ ID NO: 40276 - DNA, 20 bp, Artificial Sequence
  sgRNA
  Olfr198_5
gctcattgctctcatctgga

SEQ ID NO: 40277 - DNA, 20 bp, Artificial Sequence
  sgRNA
  Olfr198_6
agatgagagcaatgagccca

SEQ ID NO: 40278 - DNA, 20 bp, Artificial Sequence
  sgRNA
  Olfr198_7
tcttcacctgatccagaccc

SEQ ID NO: 40279 - DNA, 20 bp, Artificial Sequence
  sgRNA
  Olfr198_8
caccatctacctcatcacca

SEQ ID NO: 40280 - DNA, 20 bp, Artificial Sequence
  sgRNA
  Olfr198_9
gttcattgtaggatcagtgc

SEQ ID NO: 40281 - DNA, 20 bp, Artificial Sequence
  sgRNA
  Olfr198_10
atacagtctgaggaacaaag

SEQ ID NO: 40282 - DNA, 20 bp, Artificial Sequence
  sgRNA
  Olfr198_11
tatataaaaggatttagaaa

SEQ ID NO: 40283 - DNA, 20 bp, Artificial Sequence
  sgRNA
  Olfr198_12
aggctattggacatcatcac

SEQ ID NO: 40284 - DNA, 20 bp, Artificial Sequence
  sgRNA
  Olfr198_13
gtatataaaaggatttagaa

SEQ ID NO: 40285 - DNA, 20 bp, Artificial Sequence
  sgRNA
  Olfr198_14
ctgaaaatattaaaaccaga

SEQ ID NO: 40286 - DNA, 20 bp, Artificial Sequence
  sgRNA
  Olfr198_15
atcttcacctgatccagacc

SEQ ID NO: 40287 - DNA, 20 bp, Artificial Sequence
  sgRNA
  Olfr198_16
caccatggtgatgaggtaga

SEQ ID NO: 40288 - DNA, 20 bp, Artificial Sequence
  sgRNA
  Olfr198_17
ttcctcagactgtatataaa

SEQ ID NO: 40289 - DNA, 20 bp, Artificial Sequence
  sgRNA
  Olfr198_18
tcaccatggtgggcaacctt

SEQ ID NO: 40290 - DNA, 20 bp, Artificial Sequence
  sgRNA
  Olfr198_19
ggttgcccaccatggtgatg

SEQ ID NO: 40291 - DNA, 20 bp, Artificial Sequence
  sgRNA
  Olfr198_20
ggcaagaaggacagagaagt

SEQ ID NO: 40292 - DNA, 20 bp, Artificial Sequence
  sgRNA
  Olfr199_1
agaaaggagaaagcattccg

SEQ ID NO: 40293 - DNA, 20 bp, Artificial Sequence
  sgRNA
  Olfr199_2
catcaacactcgataaagca

SEQ ID NO: 40294 - DNA, 20 bp, Artificial Sequence
  sgRNA
  Olfr199_3
ttgaacaaagcactcagcca

SEQ ID NO: 40295 - DNA, 20 bp, Artificial Sequence
  sgRNA
  Olfr199_4
agcaccaagtaagtatgcca

SEQ ID NO: 40296 - DNA, 20 bp, Artificial Sequence
  sgRNA
  Olfr199_5
ctgtactcagtttatagccg

SEQ ID NO: 40297 - DNA, 20 bp, Artificial Sequence
  sgRNA
  Olfr199_6
tcaacactcgataaagcaag

SEQ ID NO: 40298 - DNA, 20 bp, Artificial Sequence
  sgRNA
  Olfr199_7
gggcagcctttaacttggga

SEQ ID NO: 40299 - DNA, 20 bp, Artificial Sequence
  sgRNA
  Olfr199_8
ggttacaaatggccagatag

SEQ ID NO: 40300 - DNA, 20 bp, Artificial Sequence
  sgRNA
  Olfr199_9
caccgaccatcccaagttaa

SEQ ID NO: 40301 - DNA, 20 bp, Artificial Sequence
  sgRNA
  Olfr199_10
agacttgtatagaagttgca

SEQ ID NO: 40302 - DNA, 20 bp, Artificial Sequence
  sgRNA
  Olfr199_11
gctgaggaataagtacatag

SEQ ID NO: 40303 - DNA, 20 bp, Artificial Sequence
  sgRNA
  Olfr199_12
ggtcataggccatcacagaa

SEQ ID NO: 40304 - DNA, 20 bp, Artificial Sequence
  sgRNA
  Olfr199_13
aacagggcagcctttaactt

SEQ ID NO: 40305 - DNA, 20 bp, Artificial Sequence
  sgRNA
  Olfr199_14
gtacttattcctcagcagcc

SEQ ID NO: 40306 - DNA, 20 bp, Artificial Sequence
  sgRNA
  Olfr199_15
atcaacactcgataaagcaa

SEQ ID NO: 40307 - DNA, 20 bp, Artificial Sequence
  sgRNA
  Olfr199_16
ctgagaaagaagtctgataa

SEQ ID NO: 40308 - DNA, 20 bp, Artificial Sequence
  sgRNA
  Olfr199_17
ataaagcaaggggttacaaa

SEQ ID NO: 40309 - DNA, 20 bp, Artificial Sequence
  sgRNA
  Olfr199_18
gagtagatgggcactgcatg

SEQ ID NO: 40310 - DNA, 20 bp, Artificial Sequence
  sgRNA
  Olfr199_19
agcctttaacttgggatggt

SEQ ID NO: 40311 - DNA, 20 bp, Artificial Sequence
  sgRNA
  Olfr199_20
taaattcagtgatcagagtg

SEQ ID NO: 40312 - DNA, 20 bp, Artificial Sequence
  sgRNA
  Olfr2_1
aaatagtagtgcccgcagtg

SEQ ID NO: 40313 - DNA, 20 bp, Artificial Sequence
  sgRNA
  Olfr2_2
caatgacaggatagtggagt

SEQ ID NO: 40314 - DNA, 20 bp, Artificial Sequence
  sgRNA
  Olfr2_3
atttctcgcctgtcttactg

SEQ ID NO: 40315 - DNA, 20 bp, Artificial Sequence
  sgRNA
  Olfr2_4
ccagcagaataaaaatggcc

SEQ ID NO: 40316 - DNA, 20 bp, Artificial Sequence
  sgRNA
  Olfr2_5
aatgaggaaaactttaacca

SEQ ID NO: 40317 - DNA, 20 bp, Artificial Sequence
  sgRNA
  Olfr2_6
agccggctactgacaatgac

SEQ ID NO: 40318 - DNA, 20 bp, Artificial Sequence
  sgRNA
  Olfr2_7
ttgcgcaagcagtagatgat

SEQ ID NO: 40319 - DNA, 20 bp, Artificial Sequence
  sgRNA
  Olfr2_8
ttagccaagaaaaaatacat

SEQ ID NO: 40320 - DNA, 20 bp, Artificial Sequence
  sgRNA
  Olfr2_9
gtgcatgacaagttgagcaa

SEQ ID NO: 40321 - DNA, 20 bp, Artificial Sequence
  sgRNA
  Olfr2_10
tggacagctgatctcctttg

SEQ ID NO: 40322 - DNA, 20 bp, Artificial Sequence
  sgRNA
  Olfr2_11
aggttgaaaaggccttatgg

SEQ ID NO: 40323 - DNA, 20 bp, Artificial Sequence
  sgRNA
  Olfr2_12
gagtacagagaccagcttgt

SEQ ID NO: 40324 - DNA, 20 bp, Artificial Sequence
  sgRNA
  Olfr2_13
ttcagtcagcaccaacacgt

SEQ ID NO: 40325 - DNA, 20 bp, Artificial Sequence
  sgRNA
  Olfr2_14
gcttcctatatggccatcac

SEQ ID NO: 40326 - DNA, 20 bp, Artificial Sequence
  sgRNA
  Olfr2_15
cctggcatagatgaaaatac

SEQ ID NO: 40327 - DNA, 20 bp, Artificial Sequence
  sgRNA
  Olfr2_16
tctgctggatttcttggtat

SEQ ID NO: 40328 - DNA, 20 bp, Artificial Sequence
  sgRNA
  Olfr2_17
cataggccatgacagcaaga

SEQ ID NO: 40329 - DNA, 20 bp, Artificial Sequence
  sgRNA
  Olfr2_18
tagatgatgggattgagcaa

SEQ ID NO: 40330 - DNA, 20 bp, Artificial Sequence
  sgRNA
  Olfr2_19
cagctgtccatgattctcct

SEQ ID NO: 40331 - DNA, 20 bp, Artificial Sequence
  sgRNA
  Olfr2_20
tatggcggccagcagctgag

SEQ ID NO: 40332 - DNA, 20 bp, Artificial Sequence
  sgRNA
  Olfr201_1
ttgagcaaagcactcaacca

SEQ ID NO: 40333 - DNA, 20 bp, Artificial Sequence
  sgRNA
  Olfr201_2
agtctattagacatcaacac

SEQ ID NO: 40334 - DNA, 20 bp, Artificial Sequence
  sgRNA
  Olfr201_3
agataggagaaagcattccg

SEQ ID NO: 40335 - DNA, 20 bp, Artificial Sequence
  sgRNA
  Olfr201_4
aatcattctgggagtcacag

SEQ ID NO: 40336 - DNA, 20 bp, Artificial Sequence
  sgRNA
  Olfr201_5
tcaacactggataaagcaag

SEQ ID NO: 40337 - DNA, 20 bp, Artificial Sequence
  sgRNA
  Olfr201_6
gaacagggcagcctttagcg

SEQ ID NO: 40338 - DNA, 20 bp, Artificial Sequence
  sgRNA
  Olfr201_7
atagccgtgacatacttact

SEQ ID NO: 40339 - DNA, 20 bp, Artificial Sequence
  sgRNA
  Olfr201_8
gggcagcctttagcgtggga

SEQ ID NO: 40340 - DNA, 20 bp, Artificial Sequence
  sgRNA
  Olfr201_9
ctgagaaagaagtctgaaaa

SEQ ID NO: 40341 - DNA, 20 bp, Artificial Sequence
  sgRNA
  Olfr201_10
aacagggcagcctttagcgt

SEQ ID NO: 40342 - DNA, 20 bp, Artificial Sequence
  sgRNA
  Olfr201_11
ggttacagatggccagatag

SEQ ID NO: 40343 - DNA, 20 bp, Artificial Sequence
  sgRNA
  Olfr201_12
atcaacactggataaagcaa

SEQ ID NO: 40344 - DNA, 20 bp, Artificial Sequence
  sgRNA
  Olfr201_13
gatggtcggtgagtcccatg

SEQ ID NO: 40345 - DNA, 20 bp, Artificial Sequence
  sgRNA
  Olfr201_14
ggtcataggccatcacagat

SEQ ID NO: 40346 - DNA, 20 bp, Artificial Sequence
  sgRNA
  Olfr201_15
actgaggaataagtacatag

SEQ ID NO: 40347 - DNA, 20 bp, Artificial Sequence
  sgRNA
  Olfr201_16
ataaagcaaggggttacaga

SEQ ID NO: 40348 - DNA, 20 bp, Artificial Sequence
  sgRNA
  Olfr201_17
taaacaaatgggttgagcag

SEQ ID NO: 40349 - DNA, 20 bp, Artificial Sequence
  sgRNA
  Olfr201_18
ggtcactgagtttatcctca

SEQ ID NO: 40350 - DNA, 20 bp, Artificial Sequence
  sgRNA
  Olfr201_19
catcaacactggataaagca

SEQ ID NO: 40351 - DNA, 20 bp, Artificial Sequence
  sgRNA
  Olfr201_20
tgaaaccaagatggttacaa

SEQ ID NO: 40352 - DNA, 20 bp, Artificial Sequence
  sgRNA
  Olfr202_1
ttgggtgaagcactcaacca

SEQ ID NO: 40353 - DNA, 20 bp, Artificial Sequence
  sgRNA
  Olfr202_2
acatcaccaccggataaagg

SEQ ID NO: 40354 - DNA, 20 bp, Artificial Sequence
  sgRNA
  Olfr202_3
tctgaattcaacaattcacg

SEQ ID NO: 40355 - DNA, 20 bp, Artificial Sequence
  sgRNA
  Olfr202_4
cataggccatcactagcagg

SEQ ID NO: 40356 - DNA, 20 bp, Artificial Sequence
  sgRNA
  Olfr202_5
tcaccaccggataaaggagg

SEQ ID NO: 40357 - DNA, 20 bp, Artificial Sequence
  sgRNA
  Olfr202_6
atagaaatagtctataacgt

SEQ ID NO: 40358 - DNA, 20 bp, Artificial Sequence
  sgRNA
  Olfr202_7
catcaccaccggataaagga

SEQ ID NO: 40359 - DNA, 20 bp, Artificial Sequence
  sgRNA
  Olfr202_8
taaccccctcctttatccgg

SEQ ID NO: 40360 - DNA, 20 bp, Artificial Sequence
  sgRNA
  Olfr202_9
cagaatggcaaagagcacac

SEQ ID NO: 40361 - DNA, 20 bp, Artificial Sequence
  sgRNA
  Olfr202_10
agcttgttggacatcaccac

SEQ ID NO: 40362 - DNA, 20 bp, Artificial Sequence
  sgRNA
  Olfr202_11
gctgctgaggaagacgtaca

SEQ ID NO: 40363 - DNA, 20 bp, Artificial Sequence
  sgRNA
  Olfr202_12
tcttcagctggctcagaccc

SEQ ID NO: 40364 - DNA, 20 bp, Artificial Sequence
  sgRNA
  Olfr202_13
tagcaggaggaaacattctg

SEQ ID NO: 40365 - DNA, 20 bp, Artificial Sequence
  sgRNA
  Olfr202_14
ggtagatgatgaggaaaacc

SEQ ID NO: 40366 - DNA, 20 bp, Artificial Sequence
  sgRNA
  Olfr202_15
ctgaattcaacaattcacgt

SEQ ID NO: 40367 - DNA, 20 bp, Artificial Sequence
  sgRNA
  Olfr202_16
cctcatcctctgtgaccccc

SEQ ID NO: 40368 - DNA, 20 bp, Artificial Sequence
  sgRNA
  Olfr202_17
catcatctacctcaccacca

SEQ ID NO: 40369 - DNA, 20 bp, Artificial Sequence
  sgRNA
  Olfr202_18
atctacctcaccaccatggt

SEQ ID NO: 40370 - DNA, 20 bp, Artificial Sequence
  sgRNA
  Olfr202_19
agatgagagcaatcagtcca

SEQ ID NO: 40371 - DNA, 20 bp, Artificial Sequence
  sgRNA
  Olfr202_20
aaaattgacaagcatcctgg

SEQ ID NO: 40372 - DNA, 20 bp, Artificial Sequence
  sgRNA
  Olfr211_1
aatcatgacactgttcacgt

SEQ ID NO: 40373 - DNA, 20 bp, Artificial Sequence
  sgRNA
  Olfr211_2
ttcaacacagccattcacac

SEQ ID NO: 40374 - DNA, 20 bp, Artificial Sequence
  sgRNA
  Olfr211_3
ggtcgtaggccatgacagtg

SEQ ID NO: 40375 - DNA, 20 bp, Artificial Sequence
  sgRNA
  Olfr211_4
tgataaggacattacctgtg

SEQ ID NO: 40376 - DNA, 20 bp, Artificial Sequence
  sgRNA
  Olfr211_5
gctcttctctgcattatagc

SEQ ID NO: 40377 - DNA, 20 bp, Artificial Sequence
  sgRNA
  Olfr211_6
catgcacaccacaatgaggt

SEQ ID NO: 40378 - DNA, 20 bp, Artificial Sequence
  sgRNA
  Olfr211_7
tgaagatgcggacatcagaa

SEQ ID NO: 40379 - DNA, 20 bp, Artificial Sequence
  sgRNA
  Olfr211_8
gatgaagccgtatgacacaa

SEQ ID NO: 40380 - DNA, 20 bp, Artificial Sequence
  sgRNA
  Olfr211_9
aatacatgcacaccacaatg

SEQ ID NO: 40381 - DNA, 20 bp, Artificial Sequence
  sgRNA
  Olfr211_10
gcagagaagagcaaattggc

SEQ ID NO: 40382 - DNA, 20 bp, Artificial Sequence
  sgRNA
  Olfr211_11
aggaaccccatctcctacgg

SEQ ID NO: 40383 - DNA, 20 bp, Artificial Sequence
  sgRNA
  Olfr211_12
cattatgcccaaggccctga

SEQ ID NO: 40384 - DNA, 20 bp, Artificial Sequence
  sgRNA
  Olfr211_13
tgaggggtctggtgtcaaag

SEQ ID NO: 40385 - DNA, 20 bp, Artificial Sequence
  sgRNA
  Olfr211_14
tgtgagggccacacagtaaa

SEQ ID NO: 40386 - DNA, 20 bp, Artificial Sequence
  sgRNA
  Olfr211_15
ccatgtaaggaaatagagct

SEQ ID NO: 40387 - DNA, 20 bp, Artificial Sequence
  sgRNA
  Olfr211_16
agtgaggaggagcaactctg

SEQ ID NO: 40388 - DNA, 20 bp, Artificial Sequence
  sgRNA
  Olfr211_17
tatgtaggcatagaagacag

SEQ ID NO: 40389 - DNA, 20 bp, Artificial Sequence
  sgRNA
  Olfr211_18
ctttgacaccagacccctca

SEQ ID NO: 40390 - DNA, 20 bp, Artificial Sequence
  sgRNA
  Olfr211_19
aagaggaaccccatctccta

SEQ ID NO: 40391 - DNA, 20 bp, Artificial Sequence
  sgRNA
  Olfr211_20
atcatggtgctgtaatgcag

SEQ ID NO: 40392 - DNA, 20 bp, Artificial Sequence
  sgRNA
  Olfr218_1
tggcctggtaaggattaagg

SEQ ID NO: 40393 - DNA, 20 bp, Artificial Sequence
  sgRNA
  Olfr218_2
ggtcataacccattgctgtg

SEQ ID NO: 40394 - DNA, 20 bp, Artificial Sequence
  sgRNA
  Olfr218_3
actgggaattggcctgagca

SEQ ID NO: 40395 - DNA, 20 bp, Artificial Sequence
  sgRNA
  Olfr218_4
tgttgccagacagagtcaga

SEQ ID NO: 40396 - DNA, 20 bp, Artificial Sequence
  sgRNA
  Olfr218_5
ggatgatgaccacagtaagg

SEQ ID NO: 40397 - DNA, 20 bp, Artificial Sequence
  sgRNA
  Olfr218_6
gatgagcctgtcctgcccta

SEQ ID NO: 40398 - DNA, 20 bp, Artificial Sequence
  sgRNA
  Olfr218_7
ggtcaaagaggctctacgaa

SEQ ID NO: 40399 - DNA, 20 bp, Artificial Sequence
  sgRNA
  Olfr218_8
ataacaaacccatcacagaa

SEQ ID NO: 40400 - DNA, 20 bp, Artificial Sequence
  sgRNA
  Olfr218_9
ggtagagatgataacaacat

SEQ ID NO: 40401 - DNA, 20 bp, Artificial Sequence
  sgRNA
  Olfr218_10
caaagtcccagacttcccta

SEQ ID NO: 40402 - DNA, 20 bp, Artificial Sequence
  sgRNA
  Olfr218_11
gaggaactcggccacaactg

SEQ ID NO: 40403 - DNA, 20 bp, Artificial Sequence
  sgRNA
  Olfr218_12
attattccacgaatgctagc

SEQ ID NO: 40404 - DNA, 20 bp, Artificial Sequence
  sgRNA
  Olfr218_13
ataccttagaggattgcaga

SEQ ID NO: 40405 - DNA, 20 bp, Artificial Sequence
  sgRNA
  Olfr218_14
gagtcagaaggtacagcgtt

SEQ ID NO: 40406 - DNA, 20 bp, Artificial Sequence
  sgRNA
  Olfr218_15
caagactcatgggtaacaca

SEQ ID NO: 40407 - DNA, 20 bp, Artificial Sequence
  sgRNA
  Olfr218_16
actgtggtcatcatccacta

SEQ ID NO: 40408 - DNA, 20 bp, Artificial Sequence
  sgRNA
  Olfr218_17
tggcctccttaatccttacc

SEQ ID NO: 40409 - DNA, 20 bp, Artificial Sequence
  sgRNA
  Olfr218_18
tataccactgggttcagtag

SEQ ID NO: 40410 - DNA, 20 bp, Artificial Sequence
  sgRNA
  Olfr218_19
agctggagaaaccttcaaag

SEQ ID NO: 40411 - DNA, 20 bp, Artificial Sequence
  sgRNA
  Olfr218_20
agtggatgatgaccacagta

SEQ ID NO: 40412 - DNA, 20 bp, Artificial Sequence
  sgRNA
  Olfr220_1
gctggttggtcataataaca

SEQ ID NO: 40413 - DNA, 20 bp, Artificial Sequence
  sgRNA
  Olfr220_2
atagctcgactgcgctactg

SEQ ID NO: 40414 - DNA, 20 bp, Artificial Sequence
  sgRNA
  Olfr220_3
tatgtactcagtgcagacaa

SEQ ID NO: 40415 - DNA, 20 bp, Artificial Sequence
  sgRNA
  Olfr220_4
ggtaacctatctgctgacac

SEQ ID NO: 40416 - DNA, 20 bp, Artificial Sequence
  sgRNA
  Olfr220_5
gtagcgtagtggattgcaaa

SEQ ID NO: 40417 - DNA, 20 bp, Artificial Sequence
  sgRNA
  Olfr220_6
gtgtcagcagataggttacc

SEQ ID NO: 40418 - DNA, 20 bp, Artificial Sequence
  sgRNA
  Olfr220_7
gtatatgatggggttgagaa

SEQ ID NO: 40419 - DNA, 20 bp, Artificial Sequence
  sgRNA
  Olfr220_8
aggcatacatgagcttagga

SEQ ID NO: 40420 - DNA, 20 bp, Artificial Sequence
  sgRNA
  Olfr220_9
actcctcaatgtctcctgcg

SEQ ID NO: 40421 - DNA, 20 bp, Artificial Sequence
  sgRNA
  Olfr220_10
gctggtagacttcctcagca

SEQ ID NO: 40422 - DNA, 20 bp, Artificial Sequence
  sgRNA
  Olfr220_11
tcgcaggagacattgaggag

SEQ ID NO: 40423 - DNA, 20 bp, Artificial Sequence
  sgRNA
  Olfr220_12
atgtcacaaccacacaaaga

SEQ ID NO: 40424 - DNA, 20 bp, Artificial Sequence
  sgRNA
  Olfr220_13
gatgtcacaaccacacaaag

SEQ ID NO: 40425 - DNA, 20 bp, Artificial Sequence
  sgRNA
  Olfr220_14
ataataacagggtagcgtag

SEQ ID NO: 40426 - DNA, 20 bp, Artificial Sequence
  sgRNA
  Olfr220_15
ggatcttgagaatggtgaca

SEQ ID NO: 40427 - DNA, 20 bp, Artificial Sequence
  sgRNA
  Olfr220_16
agttacaactgtcagatgag

SEQ ID NO: 40428 - DNA, 20 bp, Artificial Sequence
  sgRNA
  Olfr220_17
tcctggccatacgcagtgat

SEQ ID NO: 40429 - DNA, 20 bp, Artificial Sequence
  sgRNA
  Olfr220_18
agatgctcttgtccttgctg

SEQ ID NO: 40430 - DNA, 20 bp, Artificial Sequence
  sgRNA
  Olfr220_19
catgactgccatgatcaaga

SEQ ID NO: 40431 - DNA, 20 bp, Artificial Sequence
  sgRNA
  Olfr220_20
acatctctaggaaagagagg

SEQ ID NO: 40432 - DNA, 20 bp, Artificial Sequence
  sgRNA
  Olfr221_1
actatggtcggatagaggag

SEQ ID NO: 40433 - DNA, 20 bp, Artificial Sequence
  sgRNA
  Olfr221_2
acacagcgaagtgtccacgc

SEQ ID NO: 40434 - DNA, 20 bp, Artificial Sequence
  sgRNA
  Olfr221_3
aatgagatagcactcgctgg

SEQ ID NO: 40435 - DNA, 20 bp, Artificial Sequence
  sgRNA
  Olfr221_4
tttctgctactcttctacgg

SEQ ID NO: 40436 - DNA, 20 bp, Artificial Sequence
  sgRNA
  Olfr221_5
agttgccgtgatctacacag

SEQ ID NO: 40437 - DNA, 20 bp, Artificial Sequence
  sgRNA
  Olfr221_6
ctacaaatgcgttcaaacca

SEQ ID NO: 40438 - DNA, 20 bp, Artificial Sequence
  sgRNA
  Olfr221_7
tgtacgccatcactgtgctg

SEQ ID NO: 40439 - DNA, 20 bp, Artificial Sequence
  sgRNA
  Olfr221_8
acattgggagacactatggt

SEQ ID NO: 40440 - DNA, 20 bp, Artificial Sequence
  sgRNA
  Olfr221_9
ataggagcccccaatcagag

SEQ ID NO: 40441 - DNA, 20 bp, Artificial Sequence
  sgRNA
  Olfr221_10
aactaacctgagccacgaga

SEQ ID NO: 40442 - DNA, 20 bp, Artificial Sequence
  sgRNA
  Olfr221_11
gtttgaacgcatttgtagga

SEQ ID NO: 40443 - DNA, 20 bp, Artificial Sequence
  sgRNA
  Olfr221_12
tagtaagtaggagatcaaga

SEQ ID NO: 40444 - DNA, 20 bp, Artificial Sequence
  sgRNA
  Olfr221_13
gagacactatggtcggatag

SEQ ID NO: 40445 - DNA, 20 bp, Artificial Sequence
  sgRNA
  Olfr221_14
ggatttctgctactcttcta

SEQ ID NO: 40446 - DNA, 20 bp, Artificial Sequence
  sgRNA
  Olfr221_15
cctggtttgaacgcatttgt

SEQ ID NO: 40447 - DNA, 20 bp, Artificial Sequence
  sgRNA
  Olfr221_16
gatcaccgctgtgtagatca

SEQ ID NO: 40448 - DNA, 20 bp, Artificial Sequence
  sgRNA
  Olfr221_17
agaacgccttgaacctgccc

SEQ ID NO: 40449 - DNA, 20 bp, Artificial Sequence
  sgRNA
  Olfr221_18
agagtacataggcgtgtgca

SEQ ID NO: 40450 - DNA, 20 bp, Artificial Sequence
  sgRNA
  Olfr221_19
cattctgtccctgtcctgcg

SEQ ID NO: 40451 - DNA, 20 bp, Artificial Sequence
  sgRNA
  Olfr221_20
acagctcaaaaggttgaagc

SEQ ID NO: 40452 - DNA, 20 bp, Artificial Sequence
  sgRNA
  Olfr222_1
cagaagaccatcagttacgg

SEQ ID NO: 40453 - DNA, 20 bp, Artificial Sequence
  sgRNA
  Olfr222_2
attcgccgtagtatcagcac

SEQ ID NO: 40454 - DNA, 20 bp, Artificial Sequence
  sgRNA
  Olfr222_3
ggccgccaagacaacgcact

SEQ ID NO: 40455 - DNA, 20 bp, Artificial Sequence
  sgRNA
  Olfr222_4
ggtgcatgatgatagcatag

SEQ ID NO: 40456 - DNA, 20 bp, Artificial Sequence
  sgRNA
  Olfr222_5
gctgaacaacttcttctgcg

SEQ ID NO: 40457 - DNA, 20 bp, Artificial Sequence
  sgRNA
  Olfr222_6
gccgccatccagttactcac

SEQ ID NO: 40458 - DNA, 20 bp, Artificial Sequence
  sgRNA
  Olfr222_7
agaagttgttcagcacctgc

SEQ ID NO: 40459 - DNA, 20 bp, Artificial Sequence
  sgRNA
  Olfr222_8
gctgtcctgtgctgatacta

SEQ ID NO: 40460 - DNA, 20 bp, Artificial Sequence
  sgRNA
  Olfr222_9
tctacattctggctatgctg

SEQ ID NO: 40461 - DNA, 20 bp, Artificial Sequence
  sgRNA
  Olfr222_10
ggtgattatagaatagaaga

SEQ ID NO: 40462 - DNA, 20 bp, Artificial Sequence
  sgRNA
  Olfr222_11
catcagttacggtggctgca

SEQ ID NO: 40463 - DNA, 20 bp, Artificial Sequence
  sgRNA
  Olfr222_12
gggtgattatagaatagaag

SEQ ID NO: 40464 - DNA, 20 bp, Artificial Sequence
  sgRNA
  Olfr222_13
gacttgctcttcccacctgt

SEQ ID NO: 40465 - DNA, 20 bp, Artificial Sequence
  sgRNA
  Olfr222_14
tgtcaggatgacctgaacaa

SEQ ID NO: 40466 - DNA, 20 bp, Artificial Sequence
  sgRNA
  Olfr222_15
tgtggagctgaggatccagc

SEQ ID NO: 40467 - DNA, 20 bp, Artificial Sequence
  sgRNA
  Olfr222_16
tatcatcctggtatcccagc

SEQ ID NO: 40468 - DNA, 20 bp, Artificial Sequence
  sgRNA
  Olfr222_17
gagcaatgaagccgtaggag

SEQ ID NO: 40469 - DNA, 20 bp, Artificial Sequence
  sgRNA
  Olfr222_18
cgaagactcctggcaaggac

SEQ ID NO: 40470 - DNA, 20 bp, Artificial Sequence
  sgRNA
  Olfr222_19
tgggcatttccgacaggcca

SEQ ID NO: 40471 - DNA, 20 bp, Artificial Sequence
  sgRNA
  Olfr222_20
atgatgatagcatagcggag

SEQ ID NO: 40472 - DNA, 20 bp, Artificial Sequence
  sgRNA
  Olfr224_1
atgttcttatacatgtcact

SEQ ID NO: 40473 - DNA, 20 bp, Artificial Sequence
  sgRNA
  Olfr224_2
gagtatcaacaggatcagga

SEQ ID NO: 40474 - DNA, 20 bp, Artificial Sequence
  sgRNA
  Olfr224_3
tccaacaggttgatatcagg

SEQ ID NO: 40475 - DNA, 20 bp, Artificial Sequence
  sgRNA
  Olfr224_4
ccgagatccacagaatggga

SEQ ID NO: 40476 - DNA, 20 bp, Artificial Sequence
  sgRNA
  Olfr224_5
tcttgtggttccccaggacg

SEQ ID NO: 40477 - DNA, 20 bp, Artificial Sequence
  sgRNA
  Olfr224_6
caatgatcctaggatccaac

SEQ ID NO: 40478 - DNA, 20 bp, Artificial Sequence
  sgRNA
  Olfr224_7
tggatcctaggatcattgga

SEQ ID NO: 40479 - DNA, 20 bp, Artificial Sequence
  sgRNA
  Olfr224_8
tgaagccatccaatgatcct

SEQ ID NO: 40480 - DNA, 20 bp, Artificial Sequence
  sgRNA
  Olfr224_9
tcaggaggagacacaccctg

SEQ ID NO: 40481 - DNA, 20 bp, Artificial Sequence
  sgRNA
  Olfr224_10
agagtatcaacaggatcagg

SEQ ID NO: 40482 - DNA, 20 bp, Artificial Sequence
  sgRNA
  Olfr224_11
tggacagtcatatttcaccc

SEQ ID NO: 40483 - DNA, 20 bp, Artificial Sequence
  sgRNA
  Olfr224_12
acagtcatatttcaccctgg

SEQ ID NO: 40484 - DNA, 20 bp, Artificial Sequence
  sgRNA
  Olfr224_13
ttggctgaagagtcccacca

SEQ ID NO: 40485 - DNA, 20 bp, Artificial Sequence
  sgRNA
  Olfr224_14
aatagcagcgccatagaaga

SEQ ID NO: 40486 - DNA, 20 bp, Artificial Sequence
  sgRNA
  Olfr224_15
tcatcctgagaacagtgaga

SEQ ID NO: 40487 - DNA, 20 bp, Artificial Sequence
  sgRNA
  Olfr224_16
gggtgtcagagagtatcaac

SEQ ID NO: 40488 - DNA, 20 bp, Artificial Sequence
  sgRNA
  Olfr224_17
gcagggcagggtgtttagat

SEQ ID NO: 40489 - DNA, 20 bp, Artificial Sequence
  sgRNA
  Olfr224_18
atctcccgagatccacagaa

SEQ ID NO: 40490 - DNA, 20 bp, Artificial Sequence
  sgRNA
  Olfr224_19
taagaacatctgcatcccac

SEQ ID NO: 40491 - DNA, 20 bp, Artificial Sequence
  sgRNA
  Olfr224_20
gttcaacagaggggtaagta

SEQ ID NO: 40492 - DNA, 20 bp, Artificial Sequence
  sgRNA
  Olfr228_1
tatactgtaaatgtaaggaa

SEQ ID NO: 40493 - DNA, 20 bp, Artificial Sequence
  sgRNA
  Olfr228_2
catcatttatctgatcacac

SEQ ID NO: 40494 - DNA, 20 bp, Artificial Sequence
  sgRNA
  Olfr228_3
gtttacaaatggcgacatag

SEQ ID NO: 40495 - DNA, 20 bp, Artificial Sequence
  sgRNA
  Olfr228_4
agcagagcagagatatcaag

SEQ ID NO: 40496 - DNA, 20 bp, Artificial Sequence
  sgRNA
  Olfr228_5
aatctgctcttagaaaaaca

SEQ ID NO: 40497 - DNA, 20 bp, Artificial Sequence
  sgRNA
  Olfr228_6
atagaggagtggtttacaaa

SEQ ID NO: 40498 - DNA, 20 bp, Artificial Sequence
  sgRNA
  Olfr228_7
taggaagcaagaatgaccag

SEQ ID NO: 40499 - DNA, 20 bp, Artificial Sequence
  sgRNA
  Olfr228_8
gtagatcaagggatttaaca

SEQ ID NO: 40500 - DNA, 20 bp, Artificial Sequence
  sgRNA
  Olfr228_9
acaaatatactgtaaatgta

SEQ ID NO: 40501 - DNA, 20 bp, Artificial Sequence
  sgRNA
  Olfr228_10
aagagtgtgttgggttctag

SEQ ID NO: 40502 - DNA, 20 bp, Artificial Sequence
  sgRNA
  Olfr228_11
gataatattgtgtccacaga

SEQ ID NO: 40503 - DNA, 20 bp, Artificial Sequence
  sgRNA
  Olfr228_12
ctgtgggtctcatctgacag

SEQ ID NO: 40504 - DNA, 20 bp, Artificial Sequence
  sgRNA
  Olfr228_13
tagatcaagggatttaacat

SEQ ID NO: 40505 - DNA, 20 bp, Artificial Sequence
  sgRNA
  Olfr228_14
acatattgaagaaagttaac

SEQ ID NO: 40506 - DNA, 20 bp, Artificial Sequence
  sgRNA
  Olfr228_15
gatttaacatggggattatt

SEQ ID NO: 40507 - DNA, 20 bp, Artificial Sequence
  sgRNA
  Olfr228_16
atttaacatggggattatta

SEQ ID NO: 40508 - DNA, 20 bp, Artificial Sequence
  sgRNA
  Olfr228_17
taacttgattacttcaccac

SEQ ID NO: 40509 - DNA, 20 bp, Artificial Sequence
  sgRNA
  Olfr228_18
tttaaggagtcactggactt

SEQ ID NO: 40510 - DNA, 20 bp, Artificial Sequence
  sgRNA
  Olfr228_19
cactgtcagatgagacccac

SEQ ID NO: 40511 - DNA, 20 bp, Artificial Sequence
  sgRNA
  Olfr228_20
ctccttaaaaactgacaagg

SEQ ID NO: 40512 - DNA, 20 bp, Artificial Sequence
  sgRNA
  Olfr231_1
ctgtacggatacatcgctgg

SEQ ID NO: 40513 - DNA, 20 bp, Artificial Sequence
  sgRNA
  Olfr231_2
tcaatagaatgaaaaacaag

SEQ ID NO: 40514 - DNA, 20 bp, Artificial Sequence
  sgRNA
  Olfr231_3
ctttgtatccaactaacagc

SEQ ID NO: 40515 - DNA, 20 bp, Artificial Sequence
  sgRNA
  Olfr231_4
ggacagcaacaaagatcact

SEQ ID NO: 40516 - DNA, 20 bp, Artificial Sequence
  sgRNA
  Olfr231_5
gatgattcggatataggaca

SEQ ID NO: 40517 - DNA, 20 bp, Artificial Sequence
  sgRNA
  Olfr231_6
gctggaaagcatcttgggaa

SEQ ID NO: 40518 - DNA, 20 bp, Artificial Sequence
  sgRNA
  Olfr231_7
aaatgaaagacgctattggg

SEQ ID NO: 40519 - DNA, 20 bp, Artificial Sequence
  sgRNA
  Olfr231_8
tcgcaatccatgcaatctca

SEQ ID NO: 40520 - DNA, 20 bp, Artificial Sequence
  sgRNA
  Olfr231_9
aagaggccaccttcatacag

SEQ ID NO: 40521 - DNA, 20 bp, Artificial Sequence
  sgRNA
  Olfr231_10
ggatgccctcagcagaaggg

SEQ ID NO: 40522 - DNA, 20 bp, Artificial Sequence
  sgRNA
  Olfr231_11
tggtactccctgagattgca

SEQ ID NO: 40523 - DNA, 20 bp, Artificial Sequence
  sgRNA
  Olfr231_12
tgatgattcggatataggac

SEQ ID NO: 40524 - DNA, 20 bp, Artificial Sequence
  sgRNA
  Olfr231_13
tataggacagggcaattaca

SEQ ID NO: 40525 - DNA, 20 bp, Artificial Sequence
  sgRNA
  Olfr231_14
acaggccaaactgagcacag

SEQ ID NO: 40526 - DNA, 20 bp, Artificial Sequence
  sgRNA
  Olfr231_15
gtacaggccaaactgagcac

SEQ ID NO: 40527 - DNA, 20 bp, Artificial Sequence
  sgRNA
  Olfr231_16
aagtcatgatggtagggtaa

SEQ ID NO: 40528 - DNA, 20 bp, Artificial Sequence
  sgRNA
  Olfr231_17
actaggctggaaagcatctt

SEQ ID NO: 40529 - DNA, 20 bp, Artificial Sequence
  sgRNA
  Olfr231_18
gtgttcccacctctgtatga

SEQ ID NO: 40530 - DNA, 20 bp, Artificial Sequence
  sgRNA
  Olfr231_19
attgcgactttgcctttctg

SEQ ID NO: 40531 - DNA, 20 bp, Artificial Sequence
  sgRNA
  Olfr231_20
aagaagaccatctccctagg

SEQ ID NO: 40532 - DNA, 20 bp, Artificial Sequence
  sgRNA
  Olfr237-ps1_1
taggcatggaatgaaggaga

SEQ ID NO: 40533 - DNA, 20 bp, Artificial Sequence
  sgRNA
  Olfr237-ps1_2
attccaagctgacctagctg

SEQ ID NO: 40534 - DNA, 20 bp, Artificial Sequence
  sgRNA
  Olfr237-ps1_3
acatgggtgtgtgcagtctg

SEQ ID NO: 40535 - DNA, 20 bp, Artificial Sequence
  sgRNA
  Olfr237-ps1_4
aggacatcaccactaaaatc

SEQ ID NO: 40536 - DNA, 20 bp, Artificial Sequence
  sgRNA
  Olfr237-ps1_5
gcttgtgtgttcatattagt

SEQ ID NO: 40537 - DNA, 20 bp, Artificial Sequence
  sgRNA
  Olfr237-ps1_6
tcttctggctctggtccatt

SEQ ID NO: 40538 - DNA, 20 bp, Artificial Sequence
  sgRNA
  Olfr237-ps1_7
ggatcctcaggattgccacc

SEQ ID NO: 40539 - DNA, 20 bp, Artificial Sequence
  sgRNA
  Olfr237-ps1_8
cttgtgtgttcatattagtg

SEQ ID NO: 40540 - DNA, 20 bp, Artificial Sequence
  sgRNA
  Olfr237-ps1_9
gtcaggggagggtcgaagaa

SEQ ID NO: 40541 - DNA, 20 bp, Artificial Sequence
  sgRNA
  Olfr237-ps1_10
gatacaagaatgtttgcatt

SEQ ID NO: 40542 - DNA, 20 bp, Artificial Sequence
  sgRNA
  Olfr237-ps1_11
ggagaccagcactaagcaca

SEQ ID NO: 40543 - DNA, 20 bp, Artificial Sequence
  sgRNA
  Olfr237-ps1_12
aatcctgaggatccagtcag

SEQ ID NO: 40544 - DNA, 20 bp, Artificial Sequence
  sgRNA
  Olfr237-ps1_13
aagaatgtttgcattaggca

SEQ ID NO: 40545 - DNA, 20 bp, Artificial Sequence
  sgRNA
  Olfr237-ps1_14
aggagaccagcactaagcac

SEQ ID NO: 40546 - DNA, 20 bp, Artificial Sequence
  sgRNA
  Olfr237-ps1_15
tagtggtgatgtcctatgat

SEQ ID NO: 40547 - DNA, 20 bp, Artificial Sequence
  sgRNA
  Olfr237-ps1_16
caatcctgaggatccagtca

SEQ ID NO: 40548 - DNA, 20 bp, Artificial Sequence
  sgRNA
  Olfr237-ps1_17
agatgattccattccccaga

SEQ ID NO: 40549 - DNA, 20 bp, Artificial Sequence
  sgRNA
  Olfr237-ps1_18
catctttggaataatctgcc

SEQ ID NO: 40550 - DNA, 20 bp, Artificial Sequence
  sgRNA
  Olfr237-ps1_19
ggggcccctgtgcttagtgc

SEQ ID NO: 40551 - DNA, 20 bp, Artificial Sequence
  sgRNA
  Olfr237-ps1_20
ctggggaatggaatcatctt

SEQ ID NO: 40552 - DNA, 20 bp, Artificial Sequence
  sgRNA
  Olfr239_1
ccaggcaggcacaaccacgg

SEQ ID NO: 40553 - DNA, 20 bp, Artificial Sequence
  sgRNA
  Olfr239_2
gtagcggtcataacccatga

SEQ ID NO: 40554 - DNA, 20 bp, Artificial Sequence
  sgRNA
  Olfr239_3
atgcggagagaatgtactgg

SEQ ID NO: 40555 - DNA, 20 bp, Artificial Sequence
  sgRNA
  Olfr239_4
gaacatgacaagcaaaatgg

SEQ ID NO: 40556 - DNA, 20 bp, Artificial Sequence
  sgRNA
  Olfr239_5
agatcccccaaaacttcaca

SEQ ID NO: 40557 - DNA, 20 bp, Artificial Sequence
  sgRNA
  Olfr239_6
ttaccaggcaggcacaacca

SEQ ID NO: 40558 - DNA, 20 bp, Artificial Sequence
  sgRNA
  Olfr239_7
gtggaacatgacaagcaaaa

SEQ ID NO: 40559 - DNA, 20 bp, Artificial Sequence
  sgRNA
  Olfr239_8
tgacggttagtagaaaggaa

SEQ ID NO: 40560 - DNA, 20 bp, Artificial Sequence
  sgRNA
  Olfr239_9
tcctttctactaaccgtcat

SEQ ID NO: 40561 - DNA, 20 bp, Artificial Sequence
  sgRNA
  Olfr239_10
acagaaggtgaggttgaaaa

SEQ ID NO: 40562 - DNA, 20 bp, Artificial Sequence
  sgRNA
  Olfr239_11
ccgcatgccaacttcaatag

SEQ ID NO: 40563 - DNA, 20 bp, Artificial Sequence
  sgRNA
  Olfr239_12
accaggcaggcacaaccacg

SEQ ID NO: 40564 - DNA, 20 bp, Artificial Sequence
  sgRNA
  Olfr239_13
gacggttagtagaaaggaat

SEQ ID NO: 40565 - DNA, 20 bp, Artificial Sequence
  sgRNA
  Olfr239_14
ctgcctggtaacctggtcct

SEQ ID NO: 40566 - DNA, 20 bp, Artificial Sequence
  sgRNA
  Olfr239_15
cattgggtccacagaaggtg

SEQ ID NO: 40567 - DNA, 20 bp, Artificial Sequence
  sgRNA
  Olfr239_16
taccaggcaggcacaaccac

SEQ ID NO: 40568 - DNA, 20 bp, Artificial Sequence
  sgRNA
  Olfr239_17
ttcctttctactaaccgtca

SEQ ID NO: 40569 - DNA, 20 bp, Artificial Sequence
  sgRNA
  Olfr239_18
acccatgacggttagtagaa

SEQ ID NO: 40570 - DNA, 20 bp, Artificial Sequence
  sgRNA
  Olfr239_19
agcaaaatggtggatctcat

SEQ ID NO: 40571 - DNA, 20 bp, Artificial Sequence
  sgRNA
  Olfr239_20
gatctcattgggtccacaga

SEQ ID NO: 40572 - DNA, 20 bp, Artificial Sequence
  sgRNA
  Olfr24_1
tgaagcaggaatatacccat

SEQ ID NO: 40573 - DNA, 20 bp, Artificial Sequence
  sgRNA
  Olfr24_2
agccagacagaaatcaacca

SEQ ID NO: 40574 - DNA, 20 bp, Artificial Sequence
  sgRNA
  Olfr24_3
gcaggaaagtcggagaagtg

SEQ ID NO: 40575 - DNA, 20 bp, Artificial Sequence
  sgRNA
  Olfr24_4
ctgcatgtacatgatcacag

SEQ ID NO: 40576 - DNA, 20 bp, Artificial Sequence
  sgRNA
  Olfr24_5
tagctgtgatggcttacgac

SEQ ID NO: 40577 - DNA, 20 bp, Artificial Sequence
  sgRNA
  Olfr24_6
acacagatagactccaatgg

SEQ ID NO: 40578 - DNA, 20 bp, Artificial Sequence
  sgRNA
  Olfr24_7
ggccaggaagaaatacatag

SEQ ID NO: 40579 - DNA, 20 bp, Artificial Sequence
  sgRNA
  Olfr24_8
tttgccacagaataccagac

SEQ ID NO: 40580 - DNA, 20 bp, Artificial Sequence
  sgRNA
  Olfr24_9
ttgtgtctgtgcaggaaagt

SEQ ID NO: 40581 - DNA, 20 bp, Artificial Sequence
  sgRNA
  Olfr24_10
cctgctggttggtgtcccat

SEQ ID NO: 40582 - DNA, 20 bp, Artificial Sequence
  sgRNA
  Olfr24_11
ggtgaggtcacagaagtagt

SEQ ID NO: 40583 - DNA, 20 bp, Artificial Sequence
  sgRNA
  Olfr24_12
catgaggaggatgtgagtga

SEQ ID NO: 40584 - DNA, 20 bp, Artificial Sequence
  sgRNA
  Olfr24_13
agaataccagacgggccatg

SEQ ID NO: 40585 - DNA, 20 bp, Artificial Sequence
  sgRNA
  Olfr24_14
aatcatcgtggccatcatga

SEQ ID NO: 40586 - DNA, 20 bp, Artificial Sequence
  sgRNA
  Olfr24_15
ataccagacgggccatgagg

SEQ ID NO: 40587 - DNA, 20 bp, Artificial Sequence
  sgRNA
  Olfr24_16
ggtgacaaatggccacaaac

SEQ ID NO: 40588 - DNA, 20 bp, Artificial Sequence
  sgRNA
  Olfr24_17
ccttctccttcacagctgtg

SEQ ID NO: 40589 - DNA, 20 bp, Artificial Sequence
  sgRNA
  Olfr24_18
cttcctggccaatctctcct

SEQ ID NO: 40590 - DNA, 20 bp, Artificial Sequence
  sgRNA
  Olfr24_19
aatggtggtaccatagaaaa

SEQ ID NO: 40591 - DNA, 20 bp, Artificial Sequence
  sgRNA
  Olfr24_20
cccatgggacaccaaccagc

SEQ ID NO: 40592 - DNA, 20 bp, Artificial Sequence
  sgRNA
  Olfr248_1
agagacaggtctgtacaagt

SEQ ID NO: 40593 - DNA, 20 bp, Artificial Sequence
  sgRNA
  Olfr248_2
tgttgcatgtggacaacatg

SEQ ID NO: 40594 - DNA, 20 bp, Artificial Sequence
  sgRNA
  Olfr248_3
cacagcctatgtctgaaatg

SEQ ID NO: 40595 - DNA, 20 bp, Artificial Sequence
  sgRNA
  Olfr248_4
cataccccatcactgtgaga

SEQ ID NO: 40596 - DNA, 20 bp, Artificial Sequence
  sgRNA
  Olfr248_5
gggtcttgagaacagaagaa

SEQ ID NO: 40597 - DNA, 20 bp, Artificial Sequence
  sgRNA
  Olfr248_6
tctgaagccagaaaactccg

SEQ ID NO: 40598 - DNA, 20 bp, Artificial Sequence
  sgRNA
  Olfr248_7
gcaagcaacctgaccatcat

SEQ ID NO: 40599 - DNA, 20 bp, Artificial Sequence
  sgRNA
  Olfr248_8
tatgagtgtgtcatctcccc

SEQ ID NO: 40600 - DNA, 20 bp, Artificial Sequence
  sgRNA
  Olfr248_9
tctcaagaccccttcagccg

SEQ ID NO: 40601 - DNA, 20 bp, Artificial Sequence
  sgRNA
  Olfr248_10
acaacatgtggccactgctt

SEQ ID NO: 40602 - DNA, 20 bp, Artificial Sequence
  sgRNA
  Olfr248_11
gtatccttctcacagtgatg

SEQ ID NO: 40603 - DNA, 20 bp, Artificial Sequence
  sgRNA
  Olfr248_12
tctggcttcagataaacaac

SEQ ID NO: 40604 - DNA, 20 bp, Artificial Sequence
  sgRNA
  Olfr248_13
gacaaccgcatttcagacat

SEQ ID NO: 40605 - DNA, 20 bp, Artificial Sequence
  sgRNA
  Olfr248_14
gtagatccaccagcatcttg

SEQ ID NO: 40606 - DNA, 20 bp, Artificial Sequence
  sgRNA
  Olfr248_15
ggatgaacacataagtcagg

SEQ ID NO: 40607 - DNA, 20 bp, Artificial Sequence
  sgRNA
  Olfr248_16
gcactgagaaagtagtacat

SEQ ID NO: 40608 - DNA, 20 bp, Artificial Sequence
  sgRNA
  Olfr248_17
cgcatttcagacataggctg

SEQ ID NO: 40609 - DNA, 20 bp, Artificial Sequence
  sgRNA
  Olfr248_18
cagtgagatgtgaggcacag

SEQ ID NO: 40610 - DNA, 20 bp, Artificial Sequence
  sgRNA
  Olfr248_19
ttgtttaccctcggctgaag

SEQ ID NO: 40611 - DNA, 20 bp, Artificial Sequence
  sgRNA
  Olfr248_20
ctgaagccagaaaactccgg

SEQ ID NO: 40612 - DNA, 20 bp, Artificial Sequence
  sgRNA
  Olfr26_1
gaacaggagagattgagcag

SEQ ID NO: 40613 - DNA, 20 bp, Artificial Sequence
  sgRNA
  Olfr26_2
catctatgtggtaacagcag

SEQ ID NO: 40614 - DNA, 20 bp, Artificial Sequence
  sgRNA
  Olfr26_3
gattgtctactcagagtgca

SEQ ID NO: 40615 - DNA, 20 bp, Artificial Sequence
  sgRNA
  Olfr26_4
atacagcaatggtctacaga

SEQ ID NO: 40616 - DNA, 20 bp, Artificial Sequence
  sgRNA
  Olfr26_5
tgaaccctccaataataaat

SEQ ID NO: 40617 - DNA, 20 bp, Artificial Sequence
  sgRNA
  Olfr26_6
agaacaggagagattgagca

SEQ ID NO: 40618 - DNA, 20 bp, Artificial Sequence
  sgRNA
  Olfr26_7
tgatcagcaggatcatgccc

SEQ ID NO: 40619 - DNA, 20 bp, Artificial Sequence
  sgRNA
  Olfr26_8
gtaacagcagtgggaaacct

SEQ ID NO: 40620 - DNA, 20 bp, Artificial Sequence
  sgRNA
  Olfr26_9
tttctttgtgatctttgtgg

SEQ ID NO: 40621 - DNA, 20 bp, Artificial Sequence
  sgRNA
  Olfr26_10
gctctcatcttatggctgtg

SEQ ID NO: 40622 - DNA, 20 bp, Artificial Sequence
  sgRNA
  Olfr26_11
agaaggcttgaaatacatga

SEQ ID NO: 40623 - DNA, 20 bp, Artificial Sequence
  sgRNA
  Olfr26_12
gctgcaggttccaaaggatt

SEQ ID NO: 40624 - DNA, 20 bp, Artificial Sequence
  sgRNA
  Olfr26_13
atatattaatggattgagca

SEQ ID NO: 40625 - DNA, 20 bp, Artificial Sequence
  sgRNA
  Olfr26_14
cattggggagattctttgta

SEQ ID NO: 40626 - DNA, 20 bp, Artificial Sequence
  sgRNA
  Olfr26_15
gagatagcaacagctagagt

SEQ ID NO: 40627 - DNA, 20 bp, Artificial Sequence
  sgRNA
  Olfr26_16
aacagctagagtaggcacca

SEQ ID NO: 40628 - DNA, 20 bp, Artificial Sequence
  sgRNA
  Olfr26_17
attgagcatggggatcactg

SEQ ID NO: 40629 - DNA, 20 bp, Artificial Sequence
  sgRNA
  Olfr26_18
aggatgtgaagaaagcattg

SEQ ID NO: 40630 - DNA, 20 bp, Artificial Sequence
  sgRNA
  Olfr26_19
ttctcctatttattattgga

SEQ ID NO: 40631 - DNA, 20 bp, Artificial Sequence
  sgRNA
  Olfr26_20
catacgccatggcagtcagc

SEQ ID NO: 40632 - DNA, 20 bp, Artificial Sequence
  sgRNA
  Olfr262_1
agactcactcaaccccatgg

SEQ ID NO: 40633 - DNA, 20 bp, Artificial Sequence
  sgRNA
  Olfr262_2
accatcagtacacaaagagt

SEQ ID NO: 40634 - DNA, 20 bp, Artificial Sequence
  sgRNA
  Olfr262_3
ctatgatggaaaggttgcac

SEQ ID NO: 40635 - DNA, 20 bp, Artificial Sequence
  sgRNA
  Olfr262_4
caggacagaactaacaactg

SEQ ID NO: 40636 - DNA, 20 bp, Artificial Sequence
  sgRNA
  Olfr262_5
gtaaatctgtgaatcccaag

SEQ ID NO: 40637 - DNA, 20 bp, Artificial Sequence
  sgRNA
  Olfr262_6
acaagactcactcaacccca

SEQ ID NO: 40638 - DNA, 20 bp, Artificial Sequence
  sgRNA
  Olfr262_7
gttgcacaggaagaaataca

SEQ ID NO: 40639 - DNA, 20 bp, Artificial Sequence
  sgRNA
  Olfr262_8
ggttacaaatagcagcatac

SEQ ID NO: 40640 - DNA, 20 bp, Artificial Sequence
  sgRNA
  Olfr262_9
gaatcccaagaggatgaact

SEQ ID NO: 40641 - DNA, 20 bp, Artificial Sequence
  sgRNA
  Olfr262_10
tgacattagttccacaaaaa

SEQ ID NO: 40642 - DNA, 20 bp, Artificial Sequence
  sgRNA
  Olfr262_11
gtatatcaatgggttcagca

SEQ ID NO: 40643 - DNA, 20 bp, Artificial Sequence
  sgRNA
  Olfr262_12
taatcgatgcatacagaaga

SEQ ID NO: 40644 - DNA, 20 bp, Artificial Sequence
  sgRNA
  Olfr262_13
tcttcagactgtatatcaat

SEQ ID NO: 40645 - DNA, 20 bp, Artificial Sequence
  sgRNA
  Olfr262_14
ttcagctaagggcagatcca

SEQ ID NO: 40646 - DNA, 20 bp, Artificial Sequence
  sgRNA
  Olfr262_15
gatactggaggtatagaata

SEQ ID NO: 40647 - DNA, 20 bp, Artificial Sequence
  sgRNA
  Olfr262_16
aatagcagcataccggtcat

SEQ ID NO: 40648 - DNA, 20 bp, Artificial Sequence
  sgRNA
  Olfr262_17
caccatcagtacacaaagag

SEQ ID NO: 40649 - DNA, 20 bp, Artificial Sequence
  sgRNA
  Olfr262_18
gatcacccagttcatcctct

SEQ ID NO: 40650 - DNA, 20 bp, Artificial Sequence
  sgRNA
  Olfr262_19
agctgtcaagtgagaagcac

SEQ ID NO: 40651 - DNA, 20 bp, Artificial Sequence
  sgRNA
  Olfr262_20
agcagtgagcccagagagat

SEQ ID NO: 40652 - DNA, 20 bp, Artificial Sequence
  sgRNA
  Olfr263_1
aggatgttgtgtccacatcg

SEQ ID NO: 40653 - DNA, 20 bp, Artificial Sequence
  sgRNA
  Olfr263_2
atcatcttgacgcatagacg

SEQ ID NO: 40654 - DNA, 20 bp, Artificial Sequence
  sgRNA
  Olfr263_3
agaaggtgacaactccagag

SEQ ID NO: 40655 - DNA, 20 bp, Artificial Sequence
  sgRNA
  Olfr263_4
tacacaagctatcctgacca

SEQ ID NO: 40656 - DNA, 20 bp, Artificial Sequence
  sgRNA
  Olfr263_5
gtatctacaacccggtaaca

SEQ ID NO: 40657 - DNA, 20 bp, Artificial Sequence
  sgRNA
  Olfr263_6
atgattacaaagtaatgcaa

SEQ ID NO: 40658 - DNA, 20 bp, Artificial Sequence
  sgRNA
  Olfr263_7
atctacatgtatctacaacc

SEQ ID NO: 40659 - DNA, 20 bp, Artificial Sequence
  sgRNA
  Olfr263_8
agtgatgatggtgtaaaaga

SEQ ID NO: 40660 - DNA, 20 bp, Artificial Sequence
  sgRNA
  Olfr263_9
atgcactgaaaaaactcatg

SEQ ID NO: 40661 - DNA, 20 bp, Artificial Sequence
  sgRNA
  Olfr263_10
ccaggaaagatagattcctg

SEQ ID NO: 40662 - DNA, 20 bp, Artificial Sequence
  sgRNA
  Olfr263_11
tccttacttcggcaaatctg

SEQ ID NO: 40663 - DNA, 20 bp, Artificial Sequence
  sgRNA
  Olfr263_12
gatgatagttccatagaata

SEQ ID NO: 40664 - DNA, 20 bp, Artificial Sequence
  sgRNA
  Olfr263_13
tgatggtgtaaaagagggtg

SEQ ID NO: 40665 - DNA, 20 bp, Artificial Sequence
  sgRNA
  Olfr263_14
atgcgtcaagatgatagtca

SEQ ID NO: 40666 - DNA, 20 bp, Artificial Sequence
  sgRNA
  Olfr263_15
catgattacaaagtaatgca

SEQ ID NO: 40667 - DNA, 20 bp, Artificial Sequence
  sgRNA
  Olfr263_16
cctcaggaatctatctttcc

SEQ ID NO: 40668 - DNA, 20 bp, Artificial Sequence
  sgRNA
  Olfr263_17
accacagatttgccgaagta

SEQ ID NO: 40669 - DNA, 20 bp, Artificial Sequence
  sgRNA
  Olfr263_18
gagtgatgatggtgtaaaag

SEQ ID NO: 40670 - DNA, 20 bp, Artificial Sequence
  sgRNA
  Olfr263_19
ttgttgtgaaacacaaatcc

SEQ ID NO: 40671 - DNA, 20 bp, Artificial Sequence
  sgRNA
  Olfr263_20
tcgatgtggacacaacatcc

SEQ ID NO: 40672 - DNA, 20 bp, Artificial Sequence
  sgRNA
  Olfr267_1
tggtaaccagatacatgaca

SEQ ID NO: 40673 - DNA, 20 bp, Artificial Sequence
  sgRNA
  Olfr267_2
ttgatgatgttcccacagag

SEQ ID NO: 40674 - DNA, 20 bp, Artificial Sequence
  sgRNA
  Olfr267_3
tactgaccaccagcataacc

SEQ ID NO: 40675 - DNA, 20 bp, Artificial Sequence
  sgRNA
  Olfr267_4
cgccagaagtatacactctg

SEQ ID NO: 40676 - DNA, 20 bp, Artificial Sequence
  sgRNA
  Olfr267_5
cataaccaggtccatgagca

SEQ ID NO: 40677 - DNA, 20 bp, Artificial Sequence
  sgRNA
  Olfr267_6
gatgcaatgataaaactgct

SEQ ID NO: 40678 - DNA, 20 bp, Artificial Sequence
  sgRNA
  Olfr267_7
agataagagtacagttaccc

SEQ ID NO: 40679 - DNA, 20 bp, Artificial Sequence
  sgRNA
  Olfr267_8
tgtacctgtccctttccatg

SEQ ID NO: 40680 - DNA, 20 bp, Artificial Sequence
  sgRNA
  Olfr267_9
acttgcctgttcatgatgat

SEQ ID NO: 40681 - DNA, 20 bp, Artificial Sequence
  sgRNA
  Olfr267_10
tttccaagaaacaagtacat

SEQ ID NO: 40682 - DNA, 20 bp, Artificial Sequence
  sgRNA
  Olfr267_11
ctgaggatcagttcaacaga

SEQ ID NO: 40683 - DNA, 20 bp, Artificial Sequence
  sgRNA
  Olfr267_12
cccacagaggggaatctgca

SEQ ID NO: 40684 - DNA, 20 bp, Artificial Sequence
  sgRNA
  Olfr267_13
tatacactctgtggacccca

SEQ ID NO: 40685 - DNA, 20 bp, Artificial Sequence
  sgRNA
  Olfr267_14
gatgtacctgtccctttcca

SEQ ID NO: 40686 - DNA, 20 bp, Artificial Sequence
  sgRNA
  Olfr267_15
gcagatggccaccatctcct

SEQ ID NO: 40687 - DNA, 20 bp, Artificial Sequence
  sgRNA
  Olfr267_16
tctgaggatcagttcaacag

SEQ ID NO: 40688 - DNA, 20 bp, Artificial Sequence
  sgRNA
  Olfr267_17
tggccatctgtaaccctctg

SEQ ID NO: 40689 - DNA, 20 bp, Artificial Sequence
  sgRNA
  Olfr267_18
tcatcctttctacaattctg

SEQ ID NO: 40690 - DNA, 20 bp, Artificial Sequence
  sgRNA
  Olfr267_19
aacagaacaatctctaacct

SEQ ID NO: 40691 - DNA, 20 bp, Artificial Sequence
  sgRNA
  Olfr267_20
ggtaccccatcatcatgaac

SEQ ID NO: 40692 - DNA, 20 bp, Artificial Sequence
  sgRNA
  Olfr270_1
gaatgtgcttatcatgacag

SEQ ID NO: 40693 - DNA, 20 bp, Artificial Sequence
  sgRNA
  Olfr270_2
agtgcaaacagtcttgacaa

SEQ ID NO: 40694 - DNA, 20 bp, Artificial Sequence
  sgRNA
  Olfr270_3
caaagtattatatgtgcaca

SEQ ID NO: 40695 - DNA, 20 bp, Artificial Sequence
  sgRNA
  Olfr270_4
gagcatttgaggaatggatg

SEQ ID NO: 40696 - DNA, 20 bp, Artificial Sequence
  sgRNA
  Olfr270_5
ctgttcagcccacctaaccg

SEQ ID NO: 40697 - DNA, 20 bp, Artificial Sequence
  sgRNA
  Olfr270_6
gtacctcagtggattgcaaa

SEQ ID NO: 40698 - DNA, 20 bp, Artificial Sequence
  sgRNA
  Olfr270_7
ccttggttgtgctctacaaa

SEQ ID NO: 40699 - DNA, 20 bp, Artificial Sequence
  sgRNA
  Olfr270_8
ctctgtagaacccaagccaa

SEQ ID NO: 40700 - DNA, 20 bp, Artificial Sequence
  sgRNA
  Olfr270_9
acacaaaaattaacatcaga

SEQ ID NO: 40701 - DNA, 20 bp, Artificial Sequence
  sgRNA
  Olfr270_10
aagaagagccaggatctcac

SEQ ID NO: 40702 - DNA, 20 bp, Artificial Sequence
  sgRNA
  Olfr270_11
gtgacagaattctttctcgt

SEQ ID NO: 40703 - DNA, 20 bp, Artificial Sequence
  sgRNA
  Olfr270_12
acaatggtgttacctttctg

SEQ ID NO: 40704 - DNA, 20 bp, Artificial Sequence
  sgRNA
  Olfr270_13
ccatttgtagagcacaacca

SEQ ID NO: 40705 - DNA, 20 bp, Artificial Sequence
  sgRNA
  Olfr270_14
accatagaataagatgacca

SEQ ID NO: 40706 - DNA, 20 bp, Artificial Sequence
  sgRNA
  Olfr270_15
gggtttcatgtacataaaaa

SEQ ID NO: 40707 - DNA, 20 bp, Artificial Sequence
  sgRNA
  Olfr270_16
actctgtagaacccaagcca

SEQ ID NO: 40708 - DNA, 20 bp, Artificial Sequence
  sgRNA
  Olfr270_17
ataagatgaccacggttagg

SEQ ID NO: 40709 - DNA, 20 bp, Artificial Sequence
  sgRNA
  Olfr270_18
cattctgagaattaattctg

SEQ ID NO: 40710 - DNA, 20 bp, Artificial Sequence
  sgRNA
  Olfr270_19
tgagcagactgtttcccagg

SEQ ID NO: 40711 - DNA, 20 bp, Artificial Sequence
  sgRNA
  Olfr270_20
atgtacttgataatcctcct

SEQ ID NO: 40712 - DNA, 20 bp, Artificial Sequence
  sgRNA
  Olfr271-ps1_1
gaggccataaaaaatctgaa

SEQ ID NO: 40713 - DNA, 20 bp, Artificial Sequence
  sgRNA
  Olfr271-ps1_2
ttctgagagaaagcttacca

SEQ ID NO: 40714 - DNA, 20 bp, Artificial Sequence
  sgRNA
  Olfr271-ps1_3
tcagcattcgatctgctgag

SEQ ID NO: 40715 - DNA, 20 bp, Artificial Sequence
  sgRNA
  Olfr271-ps1_4
gatgtatgcagtcatcctag

SEQ ID NO: 40716 - DNA, 20 bp, Artificial Sequence
  sgRNA
  Olfr271-ps1_5
gagatgacaatgaggaccag

SEQ ID NO: 40717 - DNA, 20 bp, Artificial Sequence
  sgRNA
  Olfr271-ps1_6
ggaaaatcggacttatttgg

SEQ ID NO: 40718 - DNA, 20 bp, Artificial Sequence
  sgRNA
  Olfr271-ps1_7
gcagtcatcctagtgggcaa

SEQ ID NO: 40719 - DNA, 20 bp, Artificial Sequence
  sgRNA
  Olfr271-ps1_8
ataatgagagggtatctcaa

SEQ ID NO: 40720 - DNA, 20 bp, Artificial Sequence
  sgRNA
  Olfr271-ps1_9
acttatatccatgttctatg

SEQ ID NO: 40721 - DNA, 20 bp, Artificial Sequence
  sgRNA
  Olfr271-ps1_10
gatgtttcttggcttggcca

SEQ ID NO: 40722 - DNA, 20 bp, Artificial Sequence
  sgRNA
  Olfr271-ps1_11
agtcatcaccccatagaaca

SEQ ID NO: 40723 - DNA, 20 bp, Artificial Sequence
  sgRNA
  Olfr271-ps1_12
aactcttgctcataatgaga

SEQ ID NO: 40724 - DNA, 20 bp, Artificial Sequence
  sgRNA
  Olfr271-ps1_13
acaacagagtgcgtgctcct

SEQ ID NO: 40725 - DNA, 20 bp, Artificial Sequence
  sgRNA
  Olfr271-ps1_14
acatctgtactgcacagcca

SEQ ID NO: 40726 - DNA, 20 bp, Artificial Sequence
  sgRNA
  Olfr271-ps1_15
gtatctcaaagggttgcaga

SEQ ID NO: 40727 - DNA, 20 bp, Artificial Sequence
  sgRNA
  Olfr271-ps1_16
atgtatgcagtcatcctagt

SEQ ID NO: 40728 - DNA, 20 bp, Artificial Sequence
  sgRNA
  Olfr271-ps1_17
cctatgtgaccatggcaaca

SEQ ID NO: 40729 - DNA, 20 bp, Artificial Sequence
  sgRNA
  Olfr271-ps1_18
tacaaactgcatttgtgatg

SEQ ID NO: 40730 - DNA, 20 bp, Artificial Sequence
  sgRNA
  Olfr271-ps1_19
tagattaaaggattcatcaa

SEQ ID NO: 40731 - DNA, 20 bp, Artificial Sequence
  sgRNA
  Olfr271-ps1_20
ttgatgacatttccacagaa

SEQ ID NO: 40732 - DNA, 20 bp, Artificial Sequence
  sgRNA
  Olfr272_1
ttgaatcatacactcagaga

SEQ ID NO: 40733 - DNA, 20 bp, Artificial Sequence
  sgRNA
  Olfr272_2
tcaacgtgatcagcctaaca

SEQ ID NO: 40734 - DNA, 20 bp, Artificial Sequence
  sgRNA
  Olfr272_3
atgtgtacttctaggcacga

SEQ ID NO: 40735 - DNA, 20 bp, Artificial Sequence
  sgRNA
  Olfr272_4
atgacattattagtgcagaa

SEQ ID NO: 40736 - DNA, 20 bp, Artificial Sequence
  sgRNA
  Olfr272_5
tgatcacccgaagctgcaga

SEQ ID NO: 40737 - DNA, 20 bp, Artificial Sequence
  sgRNA
  Olfr272_6
ccaagtctaaagacaccgct

SEQ ID NO: 40738 - DNA, 20 bp, Artificial Sequence
  sgRNA
  Olfr272_7
ggaagctactgagaattagg

SEQ ID NO: 40739 - DNA, 20 bp, Artificial Sequence
  sgRNA
  Olfr272_8
tgatgacaggatacctcagt

SEQ ID NO: 40740 - DNA, 20 bp, Artificial Sequence
  sgRNA
  Olfr272_9
ggtaacagatggccataaag

SEQ ID NO: 40741 - DNA, 20 bp, Artificial Sequence
  sgRNA
  Olfr272_10
ccagcggtgtctttagactt

SEQ ID NO: 40742 - DNA, 20 bp, Artificial Sequence
  sgRNA
  Olfr272_11
gagacagcaataactagcaa

SEQ ID NO: 40743 - DNA, 20 bp, Artificial Sequence
  sgRNA
  Olfr272_12
ggcaggccatcaaagcgtga

SEQ ID NO: 40744 - DNA, 20 bp, Artificial Sequence
  sgRNA
  Olfr272_13
ttctgctgaaggaaaacgga

SEQ ID NO: 40745 - DNA, 20 bp, Artificial Sequence
  sgRNA
  Olfr272_14
gctttgatggcctgccccag

SEQ ID NO: 40746 - DNA, 20 bp, Artificial Sequence
  sgRNA
  Olfr272_15
ctgctctgcccacctgacag

SEQ ID NO: 40747 - DNA, 20 bp, Artificial Sequence
  sgRNA
  Olfr272_16
gtatcctgtcatcatgagca

SEQ ID NO: 40748 - DNA, 20 bp, Artificial Sequence
  sgRNA
  Olfr272_17
gcctagaagtacacattctg

SEQ ID NO: 40749 - DNA, 20 bp, Artificial Sequence
  sgRNA
  Olfr272_18
gggtcatcaccccatagaag

SEQ ID NO: 40750 - DNA, 20 bp, Artificial Sequence
  sgRNA
  Olfr272_19
atacctcagtgggtaacaga

SEQ ID NO: 40751 - DNA, 20 bp, Artificial Sequence
  sgRNA
  Olfr272_20
ttacagaggaaaaaatacat

SEQ ID NO: 40752 - DNA, 20 bp, Artificial Sequence
  sgRNA
  Olfr273_1
gctgccagagaaccatgatg

SEQ ID NO: 40753 - DNA, 20 bp, Artificial Sequence
  sgRNA
  Olfr273_2
ggccatatttgatatgacca

SEQ ID NO: 40754 - DNA, 20 bp, Artificial Sequence
  sgRNA
  Olfr273_3
ttaggctcaccaatgttgaa

SEQ ID NO: 40755 - DNA, 20 bp, Artificial Sequence
  sgRNA
  Olfr273_4
ctagtgattctaactggcaa

SEQ ID NO: 40756 - DNA, 20 bp, Artificial Sequence
  sgRNA
  Olfr273_5
tgcaaacatcccttgccatg

SEQ ID NO: 40757 - DNA, 20 bp, Artificial Sequence
  sgRNA
  Olfr273_6
tcattctcaagattgtgtgg

SEQ ID NO: 40758 - DNA, 20 bp, Artificial Sequence
  sgRNA
  Olfr273_7
gaaaggcagccgcatggcaa

SEQ ID NO: 40759 - DNA, 20 bp, Artificial Sequence
  sgRNA
  Olfr273_8
atgatgatggagtatctcag

SEQ ID NO: 40760 - DNA, 20 bp, Artificial Sequence
  sgRNA
  Olfr273_9
cccacagaaaggcagccgca

SEQ ID NO: 40761 - DNA, 20 bp, Artificial Sequence
  sgRNA
  Olfr273_10
atatgatcaccacagtcagg

SEQ ID NO: 40762 - DNA, 20 bp, Artificial Sequence
  sgRNA
  Olfr273_11
tgatgatggagtatctcaga

SEQ ID NO: 40763 - DNA, 20 bp, Artificial Sequence
  sgRNA
  Olfr273_12
tgagaatgaactcagccaca

SEQ ID NO: 40764 - DNA, 20 bp, Artificial Sequence
  sgRNA
  Olfr273_13
tgactagtagtggaagaacc

SEQ ID NO: 40765 - DNA, 20 bp, Artificial Sequence
  sgRNA
  Olfr273_14
tatgatcaccacagtcaggt

SEQ ID NO: 40766 - DNA, 20 bp, Artificial Sequence
  sgRNA
  Olfr273_15
tgtgtggaggatgaacaggt

SEQ ID NO: 40767 - DNA, 20 bp, Artificial Sequence
  sgRNA
  Olfr273_16
gaatgcctttcgtctccctg

SEQ ID NO: 40768 - DNA, 20 bp, Artificial Sequence
  sgRNA
  Olfr273_17
agttcattctcaagattgtg

SEQ ID NO: 40769 - DNA, 20 bp, Artificial Sequence
  sgRNA
  Olfr273_18
ggaattcagaaacaaacgtc

SEQ ID NO: 40770 - DNA, 20 bp, Artificial Sequence
  sgRNA
  Olfr273_19
ccatgcggctgcctttctgt

SEQ ID NO: 40771 - DNA, 20 bp, Artificial Sequence
  sgRNA
  Olfr273_20
gagaaaaagatgactagtag

SEQ ID NO: 40772 - DNA, 20 bp, Artificial Sequence
  sgRNA
  Olfr275_1
aagagagaagtacatctgcg

SEQ ID NO: 40773 - DNA, 20 bp, Artificial Sequence
  sgRNA
  Olfr275_2
gaaacaaagtttgccagcat

SEQ ID NO: 40774 - DNA, 20 bp, Artificial Sequence
  sgRNA
  Olfr275_3
cagcataattaactgtacca

SEQ ID NO: 40775 - DNA, 20 bp, Artificial Sequence
  sgRNA
  Olfr275_4
ataataatgggatatctcag

SEQ ID NO: 40776 - DNA, 20 bp, Artificial Sequence
  sgRNA
  Olfr275_5
accagatgtccagaaatgag

SEQ ID NO: 40777 - DNA, 20 bp, Artificial Sequence
  sgRNA
  Olfr275_6
ttgaggatcagctcaatgga

SEQ ID NO: 40778 - DNA, 20 bp, Artificial Sequence
  sgRNA
  Olfr275_7
atacggtgacttcaattctg

SEQ ID NO: 40779 - DNA, 20 bp, Artificial Sequence
  sgRNA
  Olfr275_8
atgtgcagcccacttgactg

SEQ ID NO: 40780 - DNA, 20 bp, Artificial Sequence
  sgRNA
  Olfr275_9
atgagaatcaaggatagtga

SEQ ID NO: 40781 - DNA, 20 bp, Artificial Sequence
  sgRNA
  Olfr275_10
cagcagacacagcacaaata

SEQ ID NO: 40782 - DNA, 20 bp, Artificial Sequence
  sgRNA
  Olfr275_11
accctcctgttcataataat

SEQ ID NO: 40783 - DNA, 20 bp, Artificial Sequence
  sgRNA
  Olfr275_12
agggtctgtgtacagattgc

SEQ ID NO: 40784 - DNA, 20 bp, Artificial Sequence
  sgRNA
  Olfr275_13
tagataataggatttagcat

SEQ ID NO: 40785 - DNA, 20 bp, Artificial Sequence
  sgRNA
  Olfr275_14
tgtcataggccatcatagag

SEQ ID NO: 40786 - DNA, 20 bp, Artificial Sequence
  sgRNA
  Olfr275_15
tcccattattatgaacagga

SEQ ID NO: 40787 - DNA, 20 bp, Artificial Sequence
  sgRNA
  Olfr275_16
acagaaccaccacagtcaag

SEQ ID NO: 40788 - DNA, 20 bp, Artificial Sequence
  sgRNA
  Olfr275_17
gttggagaggatagatgcat

SEQ ID NO: 40789 - DNA, 20 bp, Artificial Sequence
  sgRNA
  Olfr275_18
ccagaaatgagaggttgctg

SEQ ID NO: 40790 - DNA, 20 bp, Artificial Sequence
  sgRNA
  Olfr275_19
aattctggctctcttaaaat

SEQ ID NO: 40791 - DNA, 20 bp, Artificial Sequence
  sgRNA
  Olfr275_20
ctatcctctccaacatcttg

SEQ ID NO: 40792 - DNA, 20 bp, Artificial Sequence
  sgRNA
  Olfr285_1
agtggcattagtggagacat

SEQ ID NO: 40793 - DNA, 20 bp, Artificial Sequence
  sgRNA
  Olfr285_2
aggatccccacactagcacc

SEQ ID NO: 40794 - DNA, 20 bp, Artificial Sequence
  sgRNA
  Olfr285_3
agtccaaactcacagctagg

SEQ ID NO: 40795 - DNA, 20 bp, Artificial Sequence
  sgRNA
  Olfr285_4
acaaaaaccatccctgtgaa

SEQ ID NO: 40796 - DNA, 20 bp, Artificial Sequence
  sgRNA
  Olfr285_5
cctgaacatgagctccacca

SEQ ID NO: 40797 - DNA, 20 bp, Artificial Sequence
  sgRNA
  Olfr285_6
ctgaacatgagctccaccag

SEQ ID NO: 40798 - DNA, 20 bp, Artificial Sequence
  sgRNA
  Olfr285_7
tcatctgaccatagagtaga

SEQ ID NO: 40799 - DNA, 20 bp, Artificial Sequence
  sgRNA
  Olfr285_8
gatgaacgactggttctgcc

SEQ ID NO: 40800 - DNA, 20 bp, Artificial Sequence
  sgRNA
  Olfr285_9
aggtgggcatgacgtagcgc

SEQ ID NO: 40801 - DNA, 20 bp, Artificial Sequence
  sgRNA
  Olfr285_10
tgacccagaaaaaagtacat

SEQ ID NO: 40802 - DNA, 20 bp, Artificial Sequence
  sgRNA
  Olfr285_11
aaaagtacatgggagagcgg

SEQ ID NO: 40803 - DNA, 20 bp, Artificial Sequence
  sgRNA
  Olfr285_12
agaacataccacgagaagga

SEQ ID NO: 40804 - DNA, 20 bp, Artificial Sequence
  sgRNA
  Olfr285_13
tggtctgtctgatgatgcac

SEQ ID NO: 40805 - DNA, 20 bp, Artificial Sequence
  sgRNA
  Olfr285_14
accaaagtacaacgtcacta

SEQ ID NO: 40806 - DNA, 20 bp, Artificial Sequence
  sgRNA
  Olfr285_15
agtacaacgtcactatggtg

SEQ ID NO: 40807 - DNA, 20 bp, Artificial Sequence
  sgRNA
  Olfr285_16
tcctgaacatgagctccacc

SEQ ID NO: 40808 - DNA, 20 bp, Artificial Sequence
  sgRNA
  Olfr285_17
gtgcatcatcagacagacca

SEQ ID NO: 40809 - DNA, 20 bp, Artificial Sequence
  sgRNA
  Olfr285_18
acatgagctccaccaggggt

SEQ ID NO: 40810 - DNA, 20 bp, Artificial Sequence
  sgRNA
  Olfr285_19
atcatctgaccatagagtag

SEQ ID NO: 40811 - DNA, 20 bp, Artificial Sequence
  sgRNA
  Olfr285_20
tctgaccatagagtagaggg

SEQ ID NO: 40812 - DNA, 20 bp, Artificial Sequence
  sgRNA
  Olfr286_1
tctggcttccatcctccgca

SEQ ID NO: 40813 - DNA, 20 bp, Artificial Sequence
  sgRNA
  Olfr286_2
tcaggcccgtgtgtacttcg

SEQ ID NO: 40814 - DNA, 20 bp, Artificial Sequence
  sgRNA
  Olfr286_3
tagtgatcgctctctcctgt

SEQ ID NO: 40815 - DNA, 20 bp, Artificial Sequence
  sgRNA
  Olfr286_4
ggtatagaaaaagacaacca

SEQ ID NO: 40816 - DNA, 20 bp, Artificial Sequence
  sgRNA
  Olfr286_5
ggaatgtcatgtaatcaaga

SEQ ID NO: 40817 - DNA, 20 bp, Artificial Sequence
  sgRNA
  Olfr286_6
cttgattacatgacattccg

SEQ ID NO: 40818 - DNA, 20 bp, Artificial Sequence
  sgRNA
  Olfr286_7
tgtcaggcccgtgtgtactt

SEQ ID NO: 40819 - DNA, 20 bp, Artificial Sequence
  sgRNA
  Olfr286_8
atacatctgagtcaaacagg

SEQ ID NO: 40820 - DNA, 20 bp, Artificial Sequence
  sgRNA
  Olfr286_9
tttctctgcagaacggacct

SEQ ID NO: 40821 - DNA, 20 bp, Artificial Sequence
  sgRNA
  Olfr286_10
tgaatccccgaagtacacac

SEQ ID NO: 40822 - DNA, 20 bp, Artificial Sequence
  sgRNA
  Olfr286_11
atgaatccccgaagtacaca

SEQ ID NO: 40823 - DNA, 20 bp, Artificial Sequence
  sgRNA
  Olfr286_12
catgtaagagaacatggctg

SEQ ID NO: 40824 - DNA, 20 bp, Artificial Sequence
  sgRNA
  Olfr286_13
gaccccaaaagggagactcg

SEQ ID NO: 40825 - DNA, 20 bp, Artificial Sequence
  sgRNA
  Olfr286_14
ccagatggaccaacatctgt

SEQ ID NO: 40826 - DNA, 20 bp, Artificial Sequence
  sgRNA
  Olfr286_15
ggaagtgacaatgagcacca

SEQ ID NO: 40827 - DNA, 20 bp, Artificial Sequence
  sgRNA
  Olfr286_16
gaggatggaagccagaatgc

SEQ ID NO: 40828 - DNA, 20 bp, Artificial Sequence
  sgRNA
  Olfr286_17
tgtcttccccctacctgcgg

SEQ ID NO: 40829 - DNA, 20 bp, Artificial Sequence
  sgRNA
  Olfr286_18
gaagtgacaatgagcaccat

SEQ ID NO: 40830 - DNA, 20 bp, Artificial Sequence
  sgRNA
  Olfr286_19
gcagggcctcctccgcaggt

SEQ ID NO: 40831 - DNA, 20 bp, Artificial Sequence
  sgRNA
  Olfr286_20
tcaccttcagactgaactca

SEQ ID NO: 40832 - DNA, 20 bp, Artificial Sequence
  sgRNA
  Olfr287_1
agtgatcgctctctcctgcg

SEQ ID NO: 40833 - DNA, 20 bp, Artificial Sequence
  sgRNA
  Olfr287_2
tagaaagaccaagtacatct

SEQ ID NO: 40834 - DNA, 20 bp, Artificial Sequence
  sgRNA
  Olfr287_3
atggaccaacatctgcggga

SEQ ID NO: 40835 - DNA, 20 bp, Artificial Sequence
  sgRNA
  Olfr287_4
tctgggcatagttcagtggg

SEQ ID NO: 40836 - DNA, 20 bp, Artificial Sequence
  sgRNA
  Olfr287_5
gggcctcctcctcaggtagg

SEQ ID NO: 40837 - DNA, 20 bp, Artificial Sequence
  sgRNA
  Olfr287_6
gttgcacatgggggtgataa

SEQ ID NO: 40838 - DNA, 20 bp, Artificial Sequence
  sgRNA
  Olfr287_7
gtcacagtgctgctgttctt

SEQ ID NO: 40839 - DNA, 20 bp, Artificial Sequence
  sgRNA
  Olfr287_8
cctggcctccatcctccgca

SEQ ID NO: 40840 - DNA, 20 bp, Artificial Sequence
  sgRNA
  Olfr287_9
ggtgtagaaaaagacaacca

SEQ ID NO: 40841 - DNA, 20 bp, Artificial Sequence
  sgRNA
  Olfr287_10
tgggggtgataatggtgtag

SEQ ID NO: 40842 - DNA, 20 bp, Artificial Sequence
  sgRNA
  Olfr287_11
tatcacccccatgtgcaacc

SEQ ID NO: 40843 - DNA, 20 bp, Artificial Sequence
  sgRNA
  Olfr287_12
gcagggcctcctcctcaggt

SEQ ID NO: 40844 - DNA, 20 bp, Artificial Sequence
  sgRNA
  Olfr287_13
catgtaagaaaacatggctg

SEQ ID NO: 40845 - DNA, 20 bp, Artificial Sequence
  sgRNA
  Olfr287_14
agggcctcctcctcaggtag

SEQ ID NO: 40846 - DNA, 20 bp, Artificial Sequence
  sgRNA
  Olfr287_15
cagggcctcctcctcaggta

SEQ ID NO: 40847 - DNA, 20 bp, Artificial Sequence
  sgRNA
  Olfr287_16
aggaaatgaagggggctatg

SEQ ID NO: 40848 - DNA, 20 bp, Artificial Sequence
  sgRNA
  Olfr287_17
tacctgaggaggaggccctg

SEQ ID NO: 40849 - DNA, 20 bp, Artificial Sequence
  sgRNA
  Olfr287_18
aaatgaagggggctatgggg

SEQ ID NO: 40850 - DNA, 20 bp, Artificial Sequence
  sgRNA
  Olfr287_19
tgtcttccccctacctgagg

SEQ ID NO: 40851 - DNA, 20 bp, Artificial Sequence
  sgRNA
  Olfr287_20
tcacagtgctgctgttcttc

SEQ ID NO: 40852 - DNA, 20 bp, Artificial Sequence
  sgRNA
  Olfr288_1
aagagacaaaggagacagtg

SEQ ID NO: 40853 - DNA, 20 bp, Artificial Sequence
  sgRNA
  Olfr288_2
ggtgaagagcaatgcccgtg

SEQ ID NO: 40854 - DNA, 20 bp, Artificial Sequence
  sgRNA
  Olfr288_3
tcaacttcatggtgaacttg

SEQ ID NO: 40855 - DNA, 20 bp, Artificial Sequence
  sgRNA
  Olfr288_4
cataggccatgaaagccaag

SEQ ID NO: 40856 - DNA, 20 bp, Artificial Sequence
  sgRNA
  Olfr288_5
gggcctcctcctcaagccat

SEQ ID NO: 40857 - DNA, 20 bp, Artificial Sequence
  sgRNA
  Olfr288_6
catgatgatggtatagagga

SEQ ID NO: 40858 - DNA, 20 bp, Artificial Sequence
  sgRNA
  Olfr288_7
catcatgcccatgtgcaacc

SEQ ID NO: 40859 - DNA, 20 bp, Artificial Sequence
  sgRNA
  Olfr288_8
aaaagatgaccacagtcagg

SEQ ID NO: 40860 - DNA, 20 bp, Artificial Sequence
  sgRNA
  Olfr288_9
gcatgatgatggtatagagg

SEQ ID NO: 40861 - DNA, 20 bp, Artificial Sequence
  sgRNA
  Olfr288_10
ggtcttcctatggcttgagg

SEQ ID NO: 40862 - DNA, 20 bp, Artificial Sequence
  sgRNA
  Olfr288_11
cctggcctccatcctccaca

SEQ ID NO: 40863 - DNA, 20 bp, Artificial Sequence
  sgRNA
  Olfr288_12
acagtgctgctgctgttctt

SEQ ID NO: 40864 - DNA, 20 bp, Artificial Sequence
  sgRNA
  Olfr288_13
gttgcacatgggcatgatga

SEQ ID NO: 40865 - DNA, 20 bp, Artificial Sequence
  sgRNA
  Olfr288_14
tgggcatgatgatggtatag

SEQ ID NO: 40866 - DNA, 20 bp, Artificial Sequence
  sgRNA
  Olfr288_15
aagtagaaaaggtcttccta

SEQ ID NO: 40867 - DNA, 20 bp, Artificial Sequence
  sgRNA
  Olfr288_16
gatgaccacagtcaggtggg

SEQ ID NO: 40868 - DNA, 20 bp, Artificial Sequence
  sgRNA
  Olfr288_17
acaaaaagatgaccacagtc

SEQ ID NO: 40869 - DNA, 20 bp, Artificial Sequence
  sgRNA
  Olfr288_18
aaagatgaccacagtcaggt

SEQ ID NO: 40870 - DNA, 20 bp, Artificial Sequence
  sgRNA
  Olfr288_19
tcctggcctccatcctccac

SEQ ID NO: 40871 - DNA, 20 bp, Artificial Sequence
  sgRNA
  Olfr288_20
ggaggccctgtggaggatgg

SEQ ID NO: 40872 - DNA, 20 bp, Artificial Sequence
  sgRNA
  Olfr292_1
gattcaattccttaccacga

SEQ ID NO: 40873 - DNA, 20 bp, Artificial Sequence
  sgRNA
  Olfr292_2
catctgaacacagaattggt

SEQ ID NO: 40874 - DNA, 20 bp, Artificial Sequence
  sgRNA
  Olfr292_3
cagccacagaaatatttctg

SEQ ID NO: 40875 - DNA, 20 bp, Artificial Sequence
  sgRNA
  Olfr292_4
acagaaacagcacactgagt

SEQ ID NO: 40876 - DNA, 20 bp, Artificial Sequence
  sgRNA
  Olfr292_5
ctgtctgccattggtctcag

SEQ ID NO: 40877 - DNA, 20 bp, Artificial Sequence
  sgRNA
  Olfr292_6
gtgtcatctgaacacagaat

SEQ ID NO: 40878 - DNA, 20 bp, Artificial Sequence
  sgRNA
  Olfr292_7
attatttctgggattgctgg

SEQ ID NO: 40879 - DNA, 20 bp, Artificial Sequence
  sgRNA
  Olfr292_8
atacatgagaggtttacaga

SEQ ID NO: 40880 - DNA, 20 bp, Artificial Sequence
  sgRNA
  Olfr292_9
ataatcacaggatacatgag

SEQ ID NO: 40881 - DNA, 20 bp, Artificial Sequence
  sgRNA
  Olfr292_10
gttcctgtcaaaggagaaag

SEQ ID NO: 40882 - DNA, 20 bp, Artificial Sequence
  sgRNA
  Olfr292_11
acagaaatatttctgtggct

SEQ ID NO: 40883 - DNA, 20 bp, Artificial Sequence
  sgRNA
  Olfr292_12
ttcctgtcaaaggagaaaga

SEQ ID NO: 40884 - DNA, 20 bp, Artificial Sequence
  sgRNA
  Olfr292_13
tgatgataagattcccaaac

SEQ ID NO: 40885 - DNA, 20 bp, Artificial Sequence
  sgRNA
  Olfr292_14
atagcggtcttgggccatcg

SEQ ID NO: 40886 - DNA, 20 bp, Artificial Sequence
  sgRNA
  Olfr292_15
tgaccacagaaatatttctg

SEQ ID NO: 40887 - DNA, 20 bp, Artificial Sequence
  sgRNA
  Olfr292_16
agcaatcccagaaataattg

SEQ ID NO: 40888 - DNA, 20 bp, Artificial Sequence
  sgRNA
  Olfr292_17
ggatatcacagaagaactga

SEQ ID NO: 40889 - DNA, 20 bp, Artificial Sequence
  sgRNA
  Olfr292_18
ctgtttctgttggtgtacct

SEQ ID NO: 40890 - DNA, 20 bp, Artificial Sequence
  sgRNA
  Olfr292_19
gactatattagagtgacaga

SEQ ID NO: 40891 - DNA, 20 bp, Artificial Sequence
  sgRNA
  Olfr292_20
ttacttcttctgtctgccat

SEQ ID NO: 40892 - DNA, 20 bp, Artificial Sequence
  sgRNA
  Olfr293_1
tgtggctggatgtgtagcac

SEQ ID NO: 40893 - DNA, 20 bp, Artificial Sequence
  sgRNA
  Olfr293_2
atactgcattcagatgacac

SEQ ID NO: 40894 - DNA, 20 bp, Artificial Sequence
  sgRNA
  Olfr293_3
tgtacatgggaagcctgtta

SEQ ID NO: 40895 - DNA, 20 bp, Artificial Sequence
  sgRNA
  Olfr293_4
ctgactgccattggtctcag

SEQ ID NO: 40896 - DNA, 20 bp, Artificial Sequence
  sgRNA
  Olfr293_5
cagaaaccacaataatgtga

SEQ ID NO: 40897 - DNA, 20 bp, Artificial Sequence
  sgRNA
  Olfr293_6
catgaactcggtaaccaagg

SEQ ID NO: 40898 - DNA, 20 bp, Artificial Sequence
  sgRNA
  Olfr293_7
gacacttgcaaggataagag

SEQ ID NO: 40899 - DNA, 20 bp, Artificial Sequence
  sgRNA
  Olfr293_8
ggcttcccatgtacaccagc

SEQ ID NO: 40900 - DNA, 20 bp, Artificial Sequence
  sgRNA
  Olfr293_9
gggatgtcacagaagaaatg

SEQ ID NO: 40901 - DNA, 20 bp, Artificial Sequence
  sgRNA
  Olfr293_10
acttccaatgttactactgg

SEQ ID NO: 40902 - DNA, 20 bp, Artificial Sequence
  sgRNA
  Olfr293_11
aagacctccagtagtaacat

SEQ ID NO: 40903 - DNA, 20 bp, Artificial Sequence
  sgRNA
  Olfr293_12
tgaccacaggaacatttctg

SEQ ID NO: 40904 - DNA, 20 bp, Artificial Sequence
  sgRNA
  Olfr293_13
tggaagtatggacacttgca

SEQ ID NO: 40905 - DNA, 20 bp, Artificial Sequence
  sgRNA
  Olfr293_14
cctagttaccaattccacct

SEQ ID NO: 40906 - DNA, 20 bp, Artificial Sequence
  sgRNA
  Olfr293_15
ggtggaattggtaactaggg

SEQ ID NO: 40907 - DNA, 20 bp, Artificial Sequence
  sgRNA
  Olfr293_16
gtgacatcccctctttgctg

SEQ ID NO: 40908 - DNA, 20 bp, Artificial Sequence
  sgRNA
  Olfr293_17
ctgttcctgctggtgtacat

SEQ ID NO: 40909 - DNA, 20 bp, Artificial Sequence
  sgRNA
  Olfr293_18
acagaaaccacaataatgtg

SEQ ID NO: 40910 - DNA, 20 bp, Artificial Sequence
  sgRNA
  Olfr293_19
actcagcgtgctgttcctgc

SEQ ID NO: 40911 - DNA, 20 bp, Artificial Sequence
  sgRNA
  Olfr293_20
gctgttcctgctggtgtaca

SEQ ID NO: 40912 - DNA, 20 bp, Artificial Sequence
  sgRNA
  Olfr294_1
tagtcgtaactgtatgctga

SEQ ID NO: 40913 - DNA, 20 bp, Artificial Sequence
  sgRNA
  Olfr294_2
aataaagaatacatccaaca

SEQ ID NO: 40914 - DNA, 20 bp, Artificial Sequence
  sgRNA
  Olfr294_3
agtcattaaaaacaattgga

SEQ ID NO: 40915 - DNA, 20 bp, Artificial Sequence
  sgRNA
  Olfr294_4
ctgaactacagactgtgtgt

SEQ ID NO: 40916 - DNA, 20 bp, Artificial Sequence
  sgRNA
  Olfr294_5
gcaattgatgctgaacgtga

SEQ ID NO: 40917 - DNA, 20 bp, Artificial Sequence
  sgRNA
  Olfr294_6
gcaaaaaattctctgcccaa

SEQ ID NO: 40918 - DNA, 20 bp, Artificial Sequence
  sgRNA
  Olfr294_7
cgtaactgtatgctgatggt

SEQ ID NO: 40919 - DNA, 20 bp, Artificial Sequence
  sgRNA
  Olfr294_8
attgatgctgaacgtgaggg

SEQ ID NO: 40920 - DNA, 20 bp, Artificial Sequence
  sgRNA
  Olfr294_9
ttaagtgaagtgaatccctt

SEQ ID NO: 40921 - DNA, 20 bp, Artificial Sequence
  sgRNA
  Olfr294_10
gatgaaccctgttattctag

SEQ ID NO: 40922 - DNA, 20 bp, Artificial Sequence
  sgRNA
  Olfr294_11
gagcaaccgagaatcccata

SEQ ID NO: 40923 - DNA, 20 bp, Artificial Sequence
  sgRNA
  Olfr294_12
acagttacgactactcatga

SEQ ID NO: 40924 - DNA, 20 bp, Artificial Sequence
  sgRNA
  Olfr294_13
aagcttggttgtaaaatgtg

SEQ ID NO: 40925 - DNA, 20 bp, Artificial Sequence
  sgRNA
  Olfr294_14
aagaagtcattaaaaacaat

SEQ ID NO: 40926 - DNA, 20 bp, Artificial Sequence
  sgRNA
  Olfr294_15
attcttcaagaaaaagtaca

SEQ ID NO: 40927 - DNA, 20 bp, Artificial Sequence
  sgRNA
  Olfr294_16
tctcatcacgctcatcaccc

SEQ ID NO: 40928 - DNA, 20 bp, Artificial Sequence
  sgRNA
  Olfr294_17
tgatgagcgtgatgagaagt

SEQ ID NO: 40929 - DNA, 20 bp, Artificial Sequence
  sgRNA
  Olfr294_18
aagtcattaaaaacaattgg

SEQ ID NO: 40930 - DNA, 20 bp, Artificial Sequence
  sgRNA
  Olfr294_19
cttaagtgaagtgaatccct

SEQ ID NO: 40931 - DNA, 20 bp, Artificial Sequence
  sgRNA
  Olfr294_20
gagttctaagtatctgtcca

SEQ ID NO: 40932 - DNA, 20 bp, Artificial Sequence
  sgRNA
  Olfr295_1
acaagaacagcacagtgagt

SEQ ID NO: 40933 - DNA, 20 bp, Artificial Sequence
  sgRNA
  Olfr295_2
tcaactctctcactgatcac

SEQ ID NO: 40934 - DNA, 20 bp, Artificial Sequence
  sgRNA
  Olfr295_3
atagagaagaggcttacaga

SEQ ID NO: 40935 - DNA, 20 bp, Artificial Sequence
  sgRNA
  Olfr295_4
acatgggtgtattcagggtc

SEQ ID NO: 40936 - DNA, 20 bp, Artificial Sequence
  sgRNA
  Olfr295_5
tgatgataagattccccaac

SEQ ID NO: 40937 - DNA, 20 bp, Artificial Sequence
  sgRNA
  Olfr295_6
actatttctgagattgctga

SEQ ID NO: 40938 - DNA, 20 bp, Artificial Sequence
  sgRNA
  Olfr295_7
tgatcacaggagcatttctt

SEQ ID NO: 40939 - DNA, 20 bp, Artificial Sequence
  sgRNA
  Olfr295_8
acaggagcatttctttggct

SEQ ID NO: 40940 - DNA, 20 bp, Artificial Sequence
  sgRNA
  Olfr295_9
gatgtacctgggcagcctgt

SEQ ID NO: 40941 - DNA, 20 bp, Artificial Sequence
  sgRNA
  Olfr295_10
caggaagaactcaggcacca

SEQ ID NO: 40942 - DNA, 20 bp, Artificial Sequence
  sgRNA
  Olfr295_11
catattatcaactgtcttga

SEQ ID NO: 40943 - DNA, 20 bp, Artificial Sequence
  sgRNA
  Olfr295_12
gaagaactcaggcaccaggg

SEQ ID NO: 40944 - DNA, 20 bp, Artificial Sequence
  sgRNA
  Olfr295_13
gattccccaacaggctgccc

SEQ ID NO: 40945 - DNA, 20 bp, Artificial Sequence
  sgRNA
  Olfr295_14
ctgttcttgttgatgtacct

SEQ ID NO: 40946 - DNA, 20 bp, Artificial Sequence
  sgRNA
  Olfr295_15
agcaatctcagaaatagttg

SEQ ID NO: 40947 - DNA, 20 bp, Artificial Sequence
  sgRNA
  Olfr295_16
gtcttgaaggttcctgtcaa

SEQ ID NO: 40948 - DNA, 20 bp, Artificial Sequence
  sgRNA
  Olfr295_17
aagtctcagcaaaaacttcc

SEQ ID NO: 40949 - DNA, 20 bp, Artificial Sequence
  sgRNA
  Olfr295_18
aaaggatagctggaaagttt

SEQ ID NO: 40950 - DNA, 20 bp, Artificial Sequence
  sgRNA
  Olfr295_19
gctgttcttgttgatgtacc

SEQ ID NO: 40951 - DNA, 20 bp, Artificial Sequence
  sgRNA
  Olfr295_20
atttctttggctgggtgtgc

SEQ ID NO: 40952 - DNA, 20 bp, Artificial Sequence
  sgRNA
  Olfr296-ps1_1
gttcctctcaaaggagagag

SEQ ID NO: 40953 - DNA, 20 bp, Artificial Sequence
  sgRNA
  Olfr296-ps1_2
tcaactctctcactgataac

SEQ ID NO: 40954 - DNA, 20 bp, Artificial Sequence
  sgRNA
  Olfr296-ps1_3
acagacaccacaaaatgtga

SEQ ID NO: 40955 - DNA, 20 bp, Artificial Sequence
  sgRNA
  Olfr296-ps1_4
tggaggtttgaaatatacat

SEQ ID NO: 40956 - DNA, 20 bp, Artificial Sequence
  sgRNA
  Olfr296-ps1_5
tttcctctctctcctttgag

SEQ ID NO: 40957 - DNA, 20 bp, Artificial Sequence
  sgRNA
  Olfr296-ps1_6
tgaatgtgtgcacagttgca

SEQ ID NO: 40958 - DNA, 20 bp, Artificial Sequence
  sgRNA
  Olfr296-ps1_7
caggagaaactcaggcacca

SEQ ID NO: 40959 - DNA, 20 bp, Artificial Sequence
  sgRNA
  Olfr296-ps1_8
actatttctgagattgttgg

SEQ ID NO: 40960 - DNA, 20 bp, Artificial Sequence
  sgRNA
  Olfr296-ps1_9
gagaaactcaggcaccaggg

SEQ ID NO: 40961 - DNA, 20 bp, Artificial Sequence
  sgRNA
  Olfr296-ps1_10
aattccccaaaaggctgccc

SEQ ID NO: 40962 - DNA, 20 bp, Artificial Sequence
  sgRNA
  Olfr296-ps1_11
caaaatgtgagggacacagg

SEQ ID NO: 40963 - DNA, 20 bp, Artificial Sequence
  sgRNA
  Olfr296-ps1_12
tgataacaggaacatttctg

SEQ ID NO: 40964 - DNA, 20 bp, Artificial Sequence
  sgRNA
  Olfr296-ps1_13
attctgcattcagatgacac

SEQ ID NO: 40965 - DNA, 20 bp, Artificial Sequence
  sgRNA
  Olfr296-ps1_14
acatgggtgtattcagggta

SEQ ID NO: 40966 - DNA, 20 bp, Artificial Sequence
  sgRNA
  Olfr296-ps1_15
aacaatctcagaaatagttg

SEQ ID NO: 40967 - DNA, 20 bp, Artificial Sequence
  sgRNA
  Olfr296-ps1_16
agtctcagcaaaaaacttcc

SEQ ID NO: 40968 - DNA, 20 bp, Artificial Sequence
  sgRNA
  Olfr296-ps1_17
ctgttcttgttggtgtacct

SEQ ID NO: 40969 - DNA, 20 bp, Artificial Sequence
  sgRNA
  Olfr296-ps1_18
ctaaaatggacagattcctt

SEQ ID NO: 40970 - DNA, 20 bp, Artificial Sequence
  sgRNA
  Olfr296-ps1_19
cacagttgcaaggataagag

SEQ ID NO: 40971 - DNA, 20 bp, Artificial Sequence
  sgRNA
  Olfr296-ps1_20
actcagcatgctgttcttgt

SEQ ID NO: 40972 - DNA, 20 bp, Artificial Sequence
  sgRNA
  Olfr297_1
catacctgaaaggataagtg

SEQ ID NO: 40973 - DNA, 20 bp, Artificial Sequence
  sgRNA
  Olfr297_2
cagtcacagaaatgttcctg

SEQ ID NO: 40974 - DNA, 20 bp, Artificial Sequence
  sgRNA
  Olfr297_3
gcaggaacagcacactgagt

SEQ ID NO: 40975 - DNA, 20 bp, Artificial Sequence
  sgRNA
  Olfr297_4
ggcagctcacagaagaactg

SEQ ID NO: 40976 - DNA, 20 bp, Artificial Sequence
  sgRNA
  Olfr297_5
actacttctgagattgctgg

SEQ ID NO: 40977 - DNA, 20 bp, Artificial Sequence
  sgRNA
  Olfr297_6
aatatgctacaatgatgtga

SEQ ID NO: 40978 - DNA, 20 bp, Artificial Sequence
  sgRNA
  Olfr297_7
tggaggtcttagatatgcat

SEQ ID NO: 40979 - DNA, 20 bp, Artificial Sequence
  sgRNA
  Olfr297_8
tatggcaatgaaagtaaagc

SEQ ID NO: 40980 - DNA, 20 bp, Artificial Sequence
  sgRNA
  Olfr297_9
tgaaagtgttcatacctgaa

SEQ ID NO: 40981 - DNA, 20 bp, Artificial Sequence
  sgRNA
  Olfr297_10
atagcggtcctgagccatga

SEQ ID NO: 40982 - DNA, 20 bp, Artificial Sequence
  sgRNA
  Olfr297_11
gcaggtaccactaaggccaa

SEQ ID NO: 40983 - DNA, 20 bp, Artificial Sequence
  sgRNA
  Olfr297_12
gtgagctgcctgctttgctg

SEQ ID NO: 40984 - DNA, 20 bp, Artificial Sequence
  sgRNA
  Olfr297_13
tctcagcaaaaacctccagg

SEQ ID NO: 40985 - DNA, 20 bp, Artificial Sequence
  sgRNA
  Olfr297_14
acaggaacatttctgtgact

SEQ ID NO: 40986 - DNA, 20 bp, Artificial Sequence
  sgRNA
  Olfr297_15
gtttaagaatggaggaacag

SEQ ID NO: 40987 - DNA, 20 bp, Artificial Sequence
  sgRNA
  Olfr297_16
gtttctcaccatcatggctc

SEQ ID NO: 40988 - DNA, 20 bp, Artificial Sequence
  sgRNA
  Olfr297_17
agcaatctcagaagtagttg

SEQ ID NO: 40989 - DNA, 20 bp, Artificial Sequence
  sgRNA
  Olfr297_18
catggctcaggaccgctatg

SEQ ID NO: 40990 - DNA, 20 bp, Artificial Sequence
  sgRNA
  Olfr297_19
aagtaaagcaggtaccacta

SEQ ID NO: 40991 - DNA, 20 bp, Artificial Sequence
  sgRNA
  Olfr297_20
taaactctctcactgaccac

SEQ ID NO: 40992 - DNA, 20 bp, Artificial Sequence
  sgRNA
  Olfr298_1
tatgagaccatcatgagtag

SEQ ID NO: 40993 - DNA, 20 bp, Artificial Sequence
  sgRNA
  Olfr298_2
aataaagaagatatccaaca

SEQ ID NO: 40994 - DNA, 20 bp, Artificial Sequence
  sgRNA
  Olfr298_3
gaaaaactgtgggatcacaa

SEQ ID NO: 40995 - DNA, 20 bp, Artificial Sequence
  sgRNA
  Olfr298_4
ccagggtgatgagtgtgatg

SEQ ID NO: 40996 - DNA, 20 bp, Artificial Sequence
  sgRNA
  Olfr298_5
atatgtgagccacaaaacca

SEQ ID NO: 40997 - DNA, 20 bp, Artificial Sequence
  sgRNA
  Olfr298_6
agtcattaaaaacacttgga

SEQ ID NO: 40998 - DNA, 20 bp, Artificial Sequence
  sgRNA
  Olfr298_7
tatgtgagccacaaaaccat

SEQ ID NO: 40999 - DNA, 20 bp, Artificial Sequence
  sgRNA
  Olfr298_8
atcacaatggagccacagaa

SEQ ID NO: 41000 - DNA, 20 bp, Artificial Sequence
  sgRNA
  Olfr298_9
gttacatgaagtgaaccact

SEQ ID NO: 41001 - DNA, 20 bp, Artificial Sequence
  sgRNA
  Olfr298_10
atgtcaagcgtgctttgaag

SEQ ID NO: 41002 - DNA, 20 bp, Artificial Sequence
  sgRNA
  Olfr298_11
attgatggtacaactgaggg

SEQ ID NO: 41003 - DNA, 20 bp, Artificial Sequence
  sgRNA
  Olfr298_12
ttgtaccatcaatttcagac

SEQ ID NO: 41004 - DNA, 20 bp, Artificial Sequence
  sgRNA
  Olfr298_13
aaagagtactccaatagccc

SEQ ID NO: 41005 - DNA, 20 bp, Artificial Sequence
  sgRNA
  Olfr298_14
gcttgacatcactatttctc

SEQ ID NO: 41006 - DNA, 20 bp, Artificial Sequence
  sgRNA
  Olfr298_15
aatggagccacagaaaggca

SEQ ID NO: 41007 - DNA, 20 bp, Artificial Sequence
  sgRNA
  Olfr298_16
tgaaaacagtgagatggggg

SEQ ID NO: 41008 - DNA, 20 bp, Artificial Sequence
  sgRNA
  Olfr298_17
tgatgagtgtgatgaggagg

SEQ ID NO: 41009 - DNA, 20 bp, Artificial Sequence
  sgRNA
  Olfr298_18
ctcctgctctgacatacttg

SEQ ID NO: 41010 - DNA, 20 bp, Artificial Sequence
  sgRNA
  Olfr298_19
gggtgatgagtgtgatgagg

SEQ ID NO: 41011 - DNA, 20 bp, Artificial Sequence
  sgRNA
  Olfr298_20
cctcatcacactcatcaccc

SEQ ID NO: 41012 - DNA, 20 bp, Artificial Sequence
  sgRNA
  Olfr299_1
actggtggttcatgatcaca

SEQ ID NO: 41013 - DNA, 20 bp, Artificial Sequence
  sgRNA
  Olfr299_2
ctacaatagacagattcctg

SEQ ID NO: 41014 - DNA, 20 bp, Artificial Sequence
  sgRNA
  Olfr299_3
cagtcacagaaatattcctc

SEQ ID NO: 41015 - DNA, 20 bp, Artificial Sequence
  sgRNA
  Olfr299_4
atgaaagcttcaacaaagag

SEQ ID NO: 41016 - DNA, 20 bp, Artificial Sequence
  sgRNA
  Olfr299_5
ctaatctctgccattatcat

SEQ ID NO: 41017 - DNA, 20 bp, Artificial Sequence
  sgRNA
  Olfr299_6
tcaactctctcactggccag

SEQ ID NO: 41018 - DNA, 20 bp, Artificial Sequence
  sgRNA
  Olfr299_7
cagacaccacaacaatgtga

SEQ ID NO: 41019 - DNA, 20 bp, Artificial Sequence
  sgRNA
  Olfr299_8
gcagctgcaaccaatgataa

SEQ ID NO: 41020 - DNA, 20 bp, Artificial Sequence
  sgRNA
  Olfr299_9
aatgataagagagctatgta

SEQ ID NO: 41021 - DNA, 20 bp, Artificial Sequence
  sgRNA
  Olfr299_10
gcttgtttcaactctctcac

SEQ ID NO: 41022 - DNA, 20 bp, Artificial Sequence
  sgRNA
  Olfr299_11
gaggaactcagtcaccaggg

SEQ ID NO: 41023 - DNA, 20 bp, Artificial Sequence
  sgRNA
  Olfr299_12
atgatcacagggtagagcag

SEQ ID NO: 41024 - DNA, 20 bp, Artificial Sequence
  sgRNA
  Olfr299_13
ccaggaggaactcagtcacc

SEQ ID NO: 41025 - DNA, 20 bp, Artificial Sequence
  sgRNA
  Olfr299_14
acttctaatgttggtactgg

SEQ ID NO: 41026 - DNA, 20 bp, Artificial Sequence
  sgRNA
  Olfr299_15
agaggaatatttctgtgact

SEQ ID NO: 41027 - DNA, 20 bp, Artificial Sequence
  sgRNA
  Olfr299_16
tgataggatttaagaatggt

SEQ ID NO: 41028 - DNA, 20 bp, Artificial Sequence
  sgRNA
  Olfr299_17
acagacaccacaacaatgtg

SEQ ID NO: 41029 - DNA, 20 bp, Artificial Sequence
  sgRNA
  Olfr299_18
catgaaagcttcaacaaaga

SEQ ID NO: 41030 - DNA, 20 bp, Artificial Sequence
  sgRNA
  Olfr299_19
gagagttgaaacaagcattt

SEQ ID NO: 41031 - DNA, 20 bp, Artificial Sequence
  sgRNA
  Olfr299_20
acatgaaagcttcaacaaag

SEQ ID NO: 41032 - DNA, 20 bp, Artificial Sequence
  sgRNA
  Olfr3_1
ctgctgtgaagattaccagt

SEQ ID NO: 41033 - DNA, 20 bp, Artificial Sequence
  sgRNA
  Olfr3_2
cagctactagcatggcacaa

SEQ ID NO: 41034 - DNA, 20 bp, Artificial Sequence
  sgRNA
  Olfr3_3
cccatcagaccagagcaggg

SEQ ID NO: 41035 - DNA, 20 bp, Artificial Sequence
  sgRNA
  Olfr3_4
tgtaccttattacagtgctg

SEQ ID NO: 41036 - DNA, 20 bp, Artificial Sequence
  sgRNA
  Olfr3_5
tgacacatcactcaaccaac

SEQ ID NO: 41037 - DNA, 20 bp, Artificial Sequence
  sgRNA
  Olfr3_6
agaacaggacaacttaagca

SEQ ID NO: 41038 - DNA, 20 bp, Artificial Sequence
  sgRNA
  Olfr3_7
gtaaagccttgtccacttgc

SEQ ID NO: 41039 - DNA, 20 bp, Artificial Sequence
  sgRNA
  Olfr3_8
ccttggttgtgggaacctgg

SEQ ID NO: 41040 - DNA, 20 bp, Artificial Sequence
  sgRNA
  Olfr3_9
gcccatacccattacctatg

SEQ ID NO: 41041 - DNA, 20 bp, Artificial Sequence
  sgRNA
  Olfr3_10
ctgtgaaacacactcctcat

SEQ ID NO: 41042 - DNA, 20 bp, Artificial Sequence
  sgRNA
  Olfr3_11
ttgcgggtcccatctctcag

SEQ ID NO: 41043 - DNA, 20 bp, Artificial Sequence
  sgRNA
  Olfr3_12
tttcccatcagaccagagca

SEQ ID NO: 41044 - DNA, 20 bp, Artificial Sequence
  sgRNA
  Olfr3_13
ctccaggttcccacaaccaa

SEQ ID NO: 41045 - DNA, 20 bp, Artificial Sequence
  sgRNA
  Olfr3_14
ttacagatacccttggttgt

SEQ ID NO: 41046 - DNA, 20 bp, Artificial Sequence
  sgRNA
  Olfr3_15
gagatgaggatgcatagaaa

SEQ ID NO: 41047 - DNA, 20 bp, Artificial Sequence
  sgRNA
  Olfr3_16
ggttccccagcactgtaata

SEQ ID NO: 41048 - DNA, 20 bp, Artificial Sequence
  sgRNA
  Olfr3_17
gtaatggagaggatgacaga

SEQ ID NO: 41049 - DNA, 20 bp, Artificial Sequence
  sgRNA
  Olfr3_18
gtgtctgagttccttctcct

SEQ ID NO: 41050 - DNA, 20 bp, Artificial Sequence
  sgRNA
  Olfr3_19
cctccctgctctggtctgat

SEQ ID NO: 41051 - DNA, 20 bp, Artificial Sequence
  sgRNA
  Olfr3_20
atgatagtgatgtaatggag

SEQ ID NO: 41052 - DNA, 20 bp, Artificial Sequence
  sgRNA
  Olfr300-ps1_1
tgtcagtcggaagtatcaag

SEQ ID NO: 41053 - DNA, 20 bp, Artificial Sequence
  sgRNA
  Olfr300-ps1_2
ccactgactccaatgtcagt

SEQ ID NO: 41054 - DNA, 20 bp, Artificial Sequence
  sgRNA
  Olfr300-ps1_3
tggaggtcgtagatacacat

SEQ ID NO: 41055 - DNA, 20 bp, Artificial Sequence
  sgRNA
  Olfr300-ps1_4
actgagggatcacattagag

SEQ ID NO: 41056 - DNA, 20 bp, Artificial Sequence
  sgRNA
  Olfr300-ps1_5
aatggccacataacgatcct

SEQ ID NO: 41057 - DNA, 20 bp, Artificial Sequence
  sgRNA
  Olfr300-ps1_6
gagagttaatacaggcactg

SEQ ID NO: 41058 - DNA, 20 bp, Artificial Sequence
  sgRNA
  Olfr300-ps1_7
cagccacagaaatattcctg

SEQ ID NO: 41059 - DNA, 20 bp, Artificial Sequence
  sgRNA
  Olfr300-ps1_8
ttaactctctcactgaccac

SEQ ID NO: 41060 - DNA, 20 bp, Artificial Sequence
  sgRNA
  Olfr300-ps1_9
aatgacaagtgagctaagta

SEQ ID NO: 41061 - DNA, 20 bp, Artificial Sequence
  sgRNA
  Olfr300-ps1_10
ttcccatcaaaagagagaga

SEQ ID NO: 41062 - DNA, 20 bp, Artificial Sequence
  sgRNA
  Olfr300-ps1_11
gatagaggagaggtttgaaa

SEQ ID NO: 41063 - DNA, 20 bp, Artificial Sequence
  sgRNA
  Olfr300-ps1_12
attcccatcaaaagagagag

SEQ ID NO: 41064 - DNA, 20 bp, Artificial Sequence
  sgRNA
  Olfr300-ps1_13
catggcccaggatcgttatg

SEQ ID NO: 41065 - DNA, 20 bp, Artificial Sequence
  sgRNA
  Olfr300-ps1_14
ttgatacttccgactgacat

SEQ ID NO: 41066 - DNA, 20 bp, Artificial Sequence
  sgRNA
  Olfr300-ps1_15
ccgactgacattggagtcag

SEQ ID NO: 41067 - DNA, 20 bp, Artificial Sequence
  sgRNA
  Olfr300-ps1_16
cagaaacaaacagataaagg

SEQ ID NO: 41068 - DNA, 20 bp, Artificial Sequence
  sgRNA
  Olfr300-ps1_17
tgaccacaggaatatttctg

SEQ ID NO: 41069 - DNA, 20 bp, Artificial Sequence
  sgRNA
  Olfr300-ps1_18
tagatgatagggtttaagaa

SEQ ID NO: 41070 - DNA, 20 bp, Artificial Sequence
  sgRNA
  Olfr300-ps1_19
ttgctaaacttgggagctca

SEQ ID NO: 41071 - DNA, 20 bp, Artificial Sequence
  sgRNA
  Olfr300-ps1_20
tgtatctgtgtagcctgtta

SEQ ID NO: 41072 - DNA, 20 bp, Artificial Sequence
  sgRNA
  Olfr301_1
gaccacaggaatatttctgt

SEQ ID NO: 41073 - DNA, 20 bp, Artificial Sequence
  sgRNA
  Olfr301_2
ctaaaatggatagattcctg

SEQ ID NO: 41074 - DNA, 20 bp, Artificial Sequence
  sgRNA
  Olfr301_3
tgtacctgtacagcctgata

SEQ ID NO: 41075 - DNA, 20 bp, Artificial Sequence
  sgRNA
  Olfr301_4
tcatctgaacacagaaccag

SEQ ID NO: 41076 - DNA, 20 bp, Artificial Sequence
  sgRNA
  Olfr301_5
gcagctaccactgaccaaaa

SEQ ID NO: 41077 - DNA, 20 bp, Artificial Sequence
  sgRNA
  Olfr301_6
tatatatctaaaacctccag

SEQ ID NO: 41078 - DNA, 20 bp, Artificial Sequence
  sgRNA
  Olfr301_7
gctacttctaatgttaccac

SEQ ID NO: 41079 - DNA, 20 bp, Artificial Sequence
  sgRNA
  Olfr301_8
catgaactcggtaaccaggg

SEQ ID NO: 41080 - DNA, 20 bp, Artificial Sequence
  sgRNA
  Olfr301_9
gattccctatcaggctgtac

SEQ ID NO: 41081 - DNA, 20 bp, Artificial Sequence
  sgRNA
  Olfr301_10
gtgatattccttcattgctg

SEQ ID NO: 41082 - DNA, 20 bp, Artificial Sequence
  sgRNA
  Olfr301_11
atagaggagaggtttgcaaa

SEQ ID NO: 41083 - DNA, 20 bp, Artificial Sequence
  sgRNA
  Olfr301_12
acttctaatgttaccactgg

SEQ ID NO: 41084 - DNA, 20 bp, Artificial Sequence
  sgRNA
  Olfr301_13
ggctgtacaggtacaccagc

SEQ ID NO: 41085 - DNA, 20 bp, Artificial Sequence
  sgRNA
  Olfr301_14
tagaaacagacagataaaga

SEQ ID NO: 41086 - DNA, 20 bp, Artificial Sequence
  sgRNA
  Olfr301_15
ccagcatgaactcggtaacc

SEQ ID NO: 41087 - DNA, 20 bp, Artificial Sequence
  sgRNA
  Olfr301_16
ggtaacattagaagtagcta

SEQ ID NO: 41088 - DNA, 20 bp, Artificial Sequence
  sgRNA
  Olfr301_17
ggaatatcacagaagaactg

SEQ ID NO: 41089 - DNA, 20 bp, Artificial Sequence
  sgRNA
  Olfr301_18
tgaaagtgtgcacacttgca

SEQ ID NO: 41090 - DNA, 20 bp, Artificial Sequence
  sgRNA
  Olfr301_19
atttaagaatggaggaacaa

SEQ ID NO: 41091 - DNA, 20 bp, Artificial Sequence
  sgRNA
  Olfr301_20
aaggacaagtgagctaagta

SEQ ID NO: 41092 - DNA, 20 bp, Artificial Sequence
  sgRNA
  Olfr304_1
atgattgcctcataacacag

SEQ ID NO: 41093 - DNA, 20 bp, Artificial Sequence
  sgRNA
  Olfr304_2
caggaaatccttagtaacga

SEQ ID NO: 41094 - DNA, 20 bp, Artificial Sequence
  sgRNA
  Olfr304_3
ttgggattgggatggacaca

SEQ ID NO: 41095 - DNA, 20 bp, Artificial Sequence
  sgRNA
  Olfr304_4
gagtaacctgctcatcatca

SEQ ID NO: 41096 - DNA, 20 bp, Artificial Sequence
  sgRNA
  Olfr304_5
gcagcaaaatctctgtccca

SEQ ID NO: 41097 - DNA, 20 bp, Artificial Sequence
  sgRNA
  Olfr304_6
gcaggaaatccttagtaacg

SEQ ID NO: 41098 - DNA, 20 bp, Artificial Sequence
  sgRNA
  Olfr304_7
tatgaggcaatcatgagtag

SEQ ID NO: 41099 - DNA, 20 bp, Artificial Sequence
  sgRNA
  Olfr304_8
ttaatgacttcgttctcagc

SEQ ID NO: 41100 - DNA, 20 bp, Artificial Sequence
  sgRNA
  Olfr304_9
atagacggtatatctgaggg

SEQ ID NO: 41101 - DNA, 20 bp, Artificial Sequence
  sgRNA
  Olfr304_10
gttaagtagtatgaatccct

SEQ ID NO: 41102 - DNA, 20 bp, Artificial Sequence
  sgRNA
  Olfr304_11
gtaatagacggtatatctga

SEQ ID NO: 41103 - DNA, 20 bp, Artificial Sequence
  sgRNA
  Olfr304_12
gtgatgttccctcgttacta

SEQ ID NO: 41104 - DNA, 20 bp, Artificial Sequence
  sgRNA
  Olfr304_13
tgctttggactgacctctag

SEQ ID NO: 41105 - DNA, 20 bp, Artificial Sequence
  sgRNA
  Olfr304_14
atttatataagtcttgggat

SEQ ID NO: 41106 - DNA, 20 bp, Artificial Sequence
  sgRNA
  Olfr304_15
gtgatgtcaagtgttctctg

SEQ ID NO: 41107 - DNA, 20 bp, Artificial Sequence
  sgRNA
  Olfr304_16
aacagtctgtctgtaataga

SEQ ID NO: 41108 - DNA, 20 bp, Artificial Sequence
  sgRNA
  Olfr304_17
acacaaggaagacatccaac

SEQ ID NO: 41109 - DNA, 20 bp, Artificial Sequence
  sgRNA
  Olfr304_18
gagagcaaatggcaacatag

SEQ ID NO: 41110 - DNA, 20 bp, Artificial Sequence
  sgRNA
  Olfr304_19
ataacacagaggagagcaaa

SEQ ID NO: 41111 - DNA, 20 bp, Artificial Sequence
  sgRNA
  Olfr304_20
cagatagacaaagcaagcag

SEQ ID NO: 41112 - DNA, 20 bp, Artificial Sequence
  sgRNA
  Olfr305_1
catgagctacagattctatg

SEQ ID NO: 41113 - DNA, 20 bp, Artificial Sequence
  sgRNA
  Olfr305_2
gtgatgatgagcgtttcctg

SEQ ID NO: 41114 - DNA, 20 bp, Artificial Sequence
  sgRNA
  Olfr305_3
catcatcattctcatcactg

SEQ ID NO: 41115 - DNA, 20 bp, Artificial Sequence
  sgRNA
  Olfr305_4
caaatacttctcctgatcca

SEQ ID NO: 41116 - DNA, 20 bp, Artificial Sequence
  sgRNA
  Olfr305_5
gtaactggattcatacttat

SEQ ID NO: 41117 - DNA, 20 bp, Artificial Sequence
  sgRNA
  Olfr305_6
ggttactcattaaaattccc

SEQ ID NO: 41118 - DNA, 20 bp, Artificial Sequence
  sgRNA
  Olfr305_7
ataatgacctcataatgtag

SEQ ID NO: 41119 - DNA, 20 bp, Artificial Sequence
  sgRNA
  Olfr305_8
attacaggattgagtgctgg

SEQ ID NO: 41120 - DNA, 20 bp, Artificial Sequence
  sgRNA
  Olfr305_9
ggtaggaatcttcaacacag

SEQ ID NO: 41121 - DNA, 20 bp, Artificial Sequence
  sgRNA
  Olfr305_10
ttgcagtcccctacattatg

SEQ ID NO: 41122 - DNA, 20 bp, Artificial Sequence
  sgRNA
  Olfr305_11
gtaagtgatgctgaatttga

SEQ ID NO: 41123 - DNA, 20 bp, Artificial Sequence
  sgRNA
  Olfr305_12
ataatgtaggggactgcaaa

SEQ ID NO: 41124 - DNA, 20 bp, Artificial Sequence
  sgRNA
  Olfr305_13
agtgatgctgaatttgaggg

SEQ ID NO: 41125 - DNA, 20 bp, Artificial Sequence
  sgRNA
  Olfr305_14
cataatgacctcataatgta

SEQ ID NO: 41126 - DNA, 20 bp, Artificial Sequence
  sgRNA
  Olfr305_15
cacaagaaagacatccaaaa

SEQ ID NO: 41127 - DNA, 20 bp, Artificial Sequence
  sgRNA
  Olfr305_16
agtgatgatgagcgtttcct

SEQ ID NO: 41128 - DNA, 20 bp, Artificial Sequence
  sgRNA
  Olfr305_17
ggaacatcacagaaaatctg

SEQ ID NO: 41129 - DNA, 20 bp, Artificial Sequence
  sgRNA
  Olfr305_18
acacaagaaagacatccaaa

SEQ ID NO: 41130 - DNA, 20 bp, Artificial Sequence
  sgRNA
  Olfr305_19
tggggcactggattattctt

SEQ ID NO: 41131 - DNA, 20 bp, Artificial Sequence
  sgRNA
  Olfr305_20
tcataatgacctcataatgt

SEQ ID NO: 41132 - DNA, 20 bp, Artificial Sequence
  sgRNA
  Olfr307_1
gggcttccaggtatatccca

SEQ ID NO: 41133 - DNA, 20 bp, Artificial Sequence
  sgRNA
  Olfr307_2
gaaaaattgtggtatcacat

SEQ ID NO: 41134 - DNA, 20 bp, Artificial Sequence
  sgRNA
  Olfr307_3
aacacccatcatcagcacac

SEQ ID NO: 41135 - DNA, 20 bp, Artificial Sequence
  sgRNA
  Olfr307_4
aagaagtcattaaaaatacc

SEQ ID NO: 41136 - DNA, 20 bp, Artificial Sequence
  sgRNA
  Olfr307_5
atgtgaaaagtgctctcagg

SEQ ID NO: 41137 - DNA, 20 bp, Artificial Sequence
  sgRNA
  Olfr307_6
agttaggtggggaatacagg

SEQ ID NO: 41138 - DNA, 20 bp, Artificial Sequence
  sgRNA
  Olfr307_7
cttcactggatttctcctga

SEQ ID NO: 41139 - DNA, 20 bp, Artificial Sequence
  sgRNA
  Olfr307_8
tgtttggagctgtaggtcaa

SEQ ID NO: 41140 - DNA, 20 bp, Artificial Sequence
  sgRNA
  Olfr307_9
aacaaaaaagacatccaaca

SEQ ID NO: 41141 - DNA, 20 bp, Artificial Sequence
  sgRNA
  Olfr307_10
cgtcaggagaaatccagtga

SEQ ID NO: 41142 - DNA, 20 bp, Artificial Sequence
  sgRNA
  Olfr307_11
cacacctgtgtgctgatgat

SEQ ID NO: 41143 - DNA, 20 bp, Artificial Sequence
  sgRNA
  Olfr307_12
ggctgtcaaagaacgccgtc

SEQ ID NO: 41144 - DNA, 20 bp, Artificial Sequence
  sgRNA
  Olfr307_13
ttaacaacgaactttgggat

SEQ ID NO: 41145 - DNA, 20 bp, Artificial Sequence
  sgRNA
  Olfr307_14
caggagttacagactttatg

SEQ ID NO: 41146 - DNA, 20 bp, Artificial Sequence
  sgRNA
  Olfr307_15
atagttcaggggaaaacaaa

SEQ ID NO: 41147 - DNA, 20 bp, Artificial Sequence
  sgRNA
  Olfr307_16
atgatggcaccatagttcag

SEQ ID NO: 41148 - DNA, 20 bp, Artificial Sequence
  sgRNA
  Olfr307_17
aggctattaacaacgaactt

SEQ ID NO: 41149 - DNA, 20 bp, Artificial Sequence
  sgRNA
  Olfr307_18
atacactatcaatttcagag

SEQ ID NO: 41150 - DNA, 20 bp, Artificial Sequence
  sgRNA
  Olfr307_19
gttcttccttgggatatacc

SEQ ID NO: 41151 - DNA, 20 bp, Artificial Sequence
  sgRNA
  Olfr307_20
acaggtgtggttattcatga

SEQ ID NO: 41152 - DNA, 20 bp, Artificial Sequence
  sgRNA
  Olfr308_1
ctggcctgtaccagtacaca

SEQ ID NO: 41153 - DNA, 20 bp, Artificial Sequence
  sgRNA
  Olfr308_2
ccatattaccaccaatggtg

SEQ ID NO: 41154 - DNA, 20 bp, Artificial Sequence
  sgRNA
  Olfr308_3
gtagaggaaaacagatggca

SEQ ID NO: 41155 - DNA, 20 bp, Artificial Sequence
  sgRNA
  Olfr308_4
gaagaaatgattgatagcat

SEQ ID NO: 41156 - DNA, 20 bp, Artificial Sequence
  sgRNA
  Olfr308_5
gtacaggccagggcaatcca

SEQ ID NO: 41157 - DNA, 20 bp, Artificial Sequence
  sgRNA
  Olfr308_6
atatcatcagaaccattctg

SEQ ID NO: 41158 - DNA, 20 bp, Artificial Sequence
  sgRNA
  Olfr308_7
tcttctgcgacattgcaccc

SEQ ID NO: 41159 - DNA, 20 bp, Artificial Sequence
  sgRNA
  Olfr308_8
agttcatgtcctgaatacag

SEQ ID NO: 41160 - DNA, 20 bp, Artificial Sequence
  sgRNA
  Olfr308_9
cataagccatggctgccaag

SEQ ID NO: 41161 - DNA, 20 bp, Artificial Sequence
  sgRNA
  Olfr308_10
gcagactgttcataatagtc

SEQ ID NO: 41162 - DNA, 20 bp, Artificial Sequence
  sgRNA
  Olfr308_11
ttatactcttcgtaacaagg

SEQ ID NO: 41163 - DNA, 20 bp, Artificial Sequence
  sgRNA
  Olfr308_12
tgatggatgttcgaacatgg

SEQ ID NO: 41164 - DNA, 20 bp, Artificial Sequence
  sgRNA
  Olfr308_13
cctggcctgtaccagtacac

SEQ ID NO: 41165 - DNA, 20 bp, Artificial Sequence
  sgRNA
  Olfr308_14
aggaggtcagagaaattcta

SEQ ID NO: 41166 - DNA, 20 bp, Artificial Sequence
  sgRNA
  Olfr308_15
ataatagtctggtagtgtag

SEQ ID NO: 41167 - DNA, 20 bp, Artificial Sequence
  sgRNA
  Olfr308_16
gaaaacagatggcaaggtag

SEQ ID NO: 41168 - DNA, 20 bp, Artificial Sequence
  sgRNA
  Olfr308_17
ttacgaagagtataaatgaa

SEQ ID NO: 41169 - DNA, 20 bp, Artificial Sequence
  sgRNA
  Olfr308_18
gtgatgtacctcctcaccat

SEQ ID NO: 41170 - DNA, 20 bp, Artificial Sequence
  sgRNA
  Olfr308_19
actggaggacctgagatcca

SEQ ID NO: 41171 - DNA, 20 bp, Artificial Sequence
  sgRNA
  Olfr308_20
ttgcacagaatacttcctct

SEQ ID NO: 41172 - DNA, 20 bp, Artificial Sequence
  sgRNA
  Olfr309_1
tagtcctgtaagagtcaatg

SEQ ID NO: 41173 - DNA, 20 bp, Artificial Sequence
  sgRNA
  Olfr309_2
aatgagaccagtgtgcaccc

SEQ ID NO: 41174 - DNA, 20 bp, Artificial Sequence
  sgRNA
  Olfr309_3
gatggtgctctttactacaa

SEQ ID NO: 41175 - DNA, 20 bp, Artificial Sequence
  sgRNA
  Olfr309_4
aaaaattcaatttcatatgg

SEQ ID NO: 41176 - DNA, 20 bp, Artificial Sequence
  sgRNA
  Olfr309_5
agtaaagtctcccacagcca

SEQ ID NO: 41177 - DNA, 20 bp, Artificial Sequence
  sgRNA
  Olfr309_6
ataatagtactatagcgaag

SEQ ID NO: 41178 - DNA, 20 bp, Artificial Sequence
  sgRNA
  Olfr309_7
gattatgtccaccacagcca

SEQ ID NO: 41179 - DNA, 20 bp, Artificial Sequence
  sgRNA
  Olfr309_8
gcaagcctacacatgtatag

SEQ ID NO: 41180 - DNA, 20 bp, Artificial Sequence
  sgRNA
  Olfr309_9
tattaccaagtagagccaca

SEQ ID NO: 41181 - DNA, 20 bp, Artificial Sequence
  sgRNA
  Olfr309_10
ctacaggacaaagcaagcag

SEQ ID NO: 41182 - DNA, 20 bp, Artificial Sequence
  sgRNA
  Olfr309_11
agtaaagggacaccaccatg

SEQ ID NO: 41183 - DNA, 20 bp, Artificial Sequence
  sgRNA
  Olfr309_12
tacctttgataaagacaagg

SEQ ID NO: 41184 - DNA, 20 bp, Artificial Sequence
  sgRNA
  Olfr309_13
gtatgttgctgatatcaccc

SEQ ID NO: 41185 - DNA, 20 bp, Artificial Sequence
  sgRNA
  Olfr309_14
aggtatagctggatgcaggt

SEQ ID NO: 41186 - DNA, 20 bp, Artificial Sequence
  sgRNA
  Olfr309_15
ccaccacagccaaggccaga

SEQ ID NO: 41187 - DNA, 20 bp, Artificial Sequence
  sgRNA
  Olfr309_16
gtgctcatcgcacctcatgg

SEQ ID NO: 41188 - DNA, 20 bp, Artificial Sequence
  sgRNA
  Olfr309_17
acaggacaaagcaagcagcg

SEQ ID NO: 41189 - DNA, 20 bp, Artificial Sequence
  sgRNA
  Olfr309_18
gagtaaagtctcccacagcc

SEQ ID NO: 41190 - DNA, 20 bp, Artificial Sequence
  sgRNA
  Olfr309_19
ggaagcaaatggccacatag

SEQ ID NO: 41191 - DNA, 20 bp, Artificial Sequence
  sgRNA
  Olfr309_20
tcttcttgccttctgttgtg

SEQ ID NO: 41192 - DNA, 20 bp, Artificial Sequence
  sgRNA
  Olfr31_1
catggggctgttcaacacag

SEQ ID NO: 41193 - DNA, 20 bp, Artificial Sequence
  sgRNA
  Olfr31_2
acactttctatacctcaccc

SEQ ID NO: 41194 - DNA, 20 bp, Artificial Sequence
  sgRNA
  Olfr31_3
tgataatccaacagatccgg

SEQ ID NO: 41195 - DNA, 20 bp, Artificial Sequence
  sgRNA
  Olfr31_4
tctacagaaaggaaaactca

SEQ ID NO: 41196 - DNA, 20 bp, Artificial Sequence
  sgRNA
  Olfr31_5
tggttatctcatcctatgcg

SEQ ID NO: 41197 - DNA, 20 bp, Artificial Sequence
  sgRNA
  Olfr31_6
atacatcaccgtctcataga

SEQ ID NO: 41198 - DNA, 20 bp, Artificial Sequence
  sgRNA
  Olfr31_7
ccacggacttcactttcatg

SEQ ID NO: 41199 - DNA, 20 bp, Artificial Sequence
  sgRNA
  Olfr31_8
gtaagagtgtggtaccatat

SEQ ID NO: 41200 - DNA, 20 bp, Artificial Sequence
  sgRNA
  Olfr31_9
ctttctatacctcaccctgg

SEQ ID NO: 41201 - DNA, 20 bp, Artificial Sequence
  sgRNA
  Olfr31_10
cattggccaccagtgcagtg

SEQ ID NO: 41202 - DNA, 20 bp, Artificial Sequence
  sgRNA
  Olfr31_11
aaagaactcggctcccacca

SEQ ID NO: 41203 - DNA, 20 bp, Artificial Sequence
  sgRNA
  Olfr31_12
atctctcgtgatctacagaa

SEQ ID NO: 41204 - DNA, 20 bp, Artificial Sequence
  sgRNA
  Olfr31_13
gatggggaatggtaagagtg

SEQ ID NO: 41205 - DNA, 20 bp, Artificial Sequence
  sgRNA
  Olfr31_14
actcggctcccaccagggtg

SEQ ID NO: 41206 - DNA, 20 bp, Artificial Sequence
  sgRNA
  Olfr31_15
gattaaccacttcttctgtg

SEQ ID NO: 41207 - DNA, 20 bp, Artificial Sequence
  sgRNA
  Olfr31_16
agacacagccctctatgaga

SEQ ID NO: 41208 - DNA, 20 bp, Artificial Sequence
  sgRNA
  Olfr31_17
gaggcccagaagaaagaact

SEQ ID NO: 41209 - DNA, 20 bp, Artificial Sequence
  sgRNA
  Olfr31_18
aggaacaaagatgtgtctgg

SEQ ID NO: 41210 - DNA, 20 bp, Artificial Sequence
  sgRNA
  Olfr31_19
ccccatgaaagtgaagtccg

SEQ ID NO: 41211 - DNA, 20 bp, Artificial Sequence
  sgRNA
  Olfr31_20
tgtggcaaatacaagacctg

SEQ ID NO: 41212 - DNA, 20 bp, Artificial Sequence
  sgRNA
  Olfr310_1
taaccacaggaatatgtctg

SEQ ID NO: 41213 - DNA, 20 bp, Artificial Sequence
  sgRNA
  Olfr310_2
tgtgcacacttgcaatgaca

SEQ ID NO: 41214 - DNA, 20 bp, Artificial Sequence
  sgRNA
  Olfr310_3
atgatcacaggatagagcag

SEQ ID NO: 41215 - DNA, 20 bp, Artificial Sequence
  sgRNA
  Olfr310_4
ggctgcacagatacaccagc

SEQ ID NO: 41216 - DNA, 20 bp, Artificial Sequence
  sgRNA
  Olfr310_5
gtgcacacttgcaatgacaa

SEQ ID NO: 41217 - DNA, 20 bp, Artificial Sequence
  sgRNA
  Olfr310_6
agtgactgagttcttcctgg

SEQ ID NO: 41218 - DNA, 20 bp, Artificial Sequence
  sgRNA
  Olfr310_7
tggaggtcgtagatacacaa

SEQ ID NO: 41219 - DNA, 20 bp, Artificial Sequence
  sgRNA
  Olfr310_8
aatcactgtgctgttcctgc

SEQ ID NO: 41220 - DNA, 20 bp, Artificial Sequence
  sgRNA
  Olfr310_9
ctgactgtcattggagtcag

SEQ ID NO: 41221 - DNA, 20 bp, Artificial Sequence
  sgRNA
  Olfr310_10
gagagttgatacaggtactg

SEQ ID NO: 41222 - DNA, 20 bp, Artificial Sequence
  sgRNA
  Olfr310_11
tcaactctctcactaaccac

SEQ ID NO: 41223 - DNA, 20 bp, Artificial Sequence
  sgRNA
  Olfr310_12
gtattgaagattcccgtcaa

SEQ ID NO: 41224 - DNA, 20 bp, Artificial Sequence
  sgRNA
  Olfr310_13
acaggaatatgtctgtggct

SEQ ID NO: 41225 - DNA, 20 bp, Artificial Sequence
  sgRNA
  Olfr310_14
tagacaattgggtttaagaa

SEQ ID NO: 41226 - DNA, 20 bp, Artificial Sequence
  sgRNA
  Olfr310_15
ccaggaagaactcagtcact

SEQ ID NO: 41227 - DNA, 20 bp, Artificial Sequence
  sgRNA
  Olfr310_16
ttcccgtcaaaggagagaga

SEQ ID NO: 41228 - DNA, 20 bp, Artificial Sequence
  sgRNA
  Olfr310_17
atagagcagaggcttgcaga

SEQ ID NO: 41229 - DNA, 20 bp, Artificial Sequence
  sgRNA
  Olfr310_18
tgtatctgtgcagcctgtta

SEQ ID NO: 41230 - DNA, 20 bp, Artificial Sequence
  sgRNA
  Olfr310_19
cagccacagacatattcctg

SEQ ID NO: 41231 - DNA, 20 bp, Artificial Sequence
  sgRNA
  Olfr310_20
cacaataatgtgaggaacac

SEQ ID NO: 41232 - DNA, 20 bp, Artificial Sequence
  sgRNA
  Olfr316_1
tgtgtgcactgatgcagtga

SEQ ID NO: 41233 - DNA, 20 bp, Artificial Sequence
  sgRNA
  Olfr316_2
acccagggtcagaaaaacaa

SEQ ID NO: 41234 - DNA, 20 bp, Artificial Sequence
  sgRNA
  Olfr316_3
tcatgtccatgatggagagc

SEQ ID NO: 41235 - DNA, 20 bp, Artificial Sequence
  sgRNA
  Olfr316_4
actggtcatcctcatcaggc

SEQ ID NO: 41236 - DNA, 20 bp, Artificial Sequence
  sgRNA
  Olfr316_5
gggtcagaaaaacaaaggct

SEQ ID NO: 41237 - DNA, 20 bp, Artificial Sequence
  sgRNA
  Olfr316_6
gagggcttcagacccaccca

SEQ ID NO: 41238 - DNA, 20 bp, Artificial Sequence
  sgRNA
  Olfr316_7
ctgtgggacagacttcacct

SEQ ID NO: 41239 - DNA, 20 bp, Artificial Sequence
  sgRNA
  Olfr316_8
caccttgcattctcctggaa

SEQ ID NO: 41240 - DNA, 20 bp, Artificial Sequence
  sgRNA
  Olfr316_9
agaacaagctggccacagtc

SEQ ID NO: 41241 - DNA, 20 bp, Artificial Sequence
  sgRNA
  Olfr316_10
aggaggtcatgggggccctg

SEQ ID NO: 41242 - DNA, 20 bp, Artificial Sequence
  sgRNA
  Olfr316_11
agtggtgacatagaacaagc

SEQ ID NO: 41243 - DNA, 20 bp, Artificial Sequence
  sgRNA
  Olfr316_12
ccaggagaatgcaaggtgtg

SEQ ID NO: 41244 - DNA, 20 bp, Artificial Sequence
  sgRNA
  Olfr316_13
tgccatcttgggcacagtgg

SEQ ID NO: 41245 - DNA, 20 bp, Artificial Sequence
  sgRNA
  Olfr316_14
atcctggaaaagaccaacca

SEQ ID NO: 41246 - DNA, 20 bp, Artificial Sequence
  sgRNA
  Olfr316_15
agaatgcaaggtgtgtggct

SEQ ID NO: 41247 - DNA, 20 bp, Artificial Sequence
  sgRNA
  Olfr316_16
acaccttgcattctcctgga

SEQ ID NO: 41248 - DNA, 20 bp, Artificial Sequence
  sgRNA
  Olfr316_17
ccacacaccttgcattctcc

SEQ ID NO: 41249 - DNA, 20 bp, Artificial Sequence
  sgRNA
  Olfr316_18
tcacactggtcatcctcatc

SEQ ID NO: 41250 - DNA, 20 bp, Artificial Sequence
  sgRNA
  Olfr316_19
cacacagcccagaaaggaaa

SEQ ID NO: 41251 - DNA, 20 bp, Artificial Sequence
  sgRNA
  Olfr316_20
ggagggcttcagacccaccc

SEQ ID NO: 41252 - DNA, 20 bp, Artificial Sequence
  sgRNA
  Olfr317_1
agaggaagtgatccaccctg

SEQ ID NO: 41253 - DNA, 20 bp, Artificial Sequence
  sgRNA
  Olfr317_2
aacgacagctgtgttgacac

SEQ ID NO: 41254 - DNA, 20 bp, Artificial Sequence
  sgRNA
  Olfr317_3
tgaggttatagagcagctgt

SEQ ID NO: 41255 - DNA, 20 bp, Artificial Sequence
  sgRNA
  Olfr317_4
tggagacatagccaaggagt

SEQ ID NO: 41256 - DNA, 20 bp, Artificial Sequence
  sgRNA
  Olfr317_5
ggagaccaagatgaacacca

SEQ ID NO: 41257 - DNA, 20 bp, Artificial Sequence
  sgRNA
  Olfr317_6
ctatggttacattgtaagag

SEQ ID NO: 41258 - DNA, 20 bp, Artificial Sequence
  sgRNA
  Olfr317_7
gtttgcagatcgccacaaat

SEQ ID NO: 41259 - DNA, 20 bp, Artificial Sequence
  sgRNA
  Olfr317_8
gaatcagctcagctgcagga

SEQ ID NO: 41260 - DNA, 20 bp, Artificial Sequence
  sgRNA
  Olfr317_9
accccgctgtgggcaccaca

SEQ ID NO: 41261 - DNA, 20 bp, Artificial Sequence
  sgRNA
  Olfr317_10
ctagttctagatggaccaga

SEQ ID NO: 41262 - DNA, 20 bp, Artificial Sequence
  sgRNA
  Olfr317_11
accctgtggtgcccacagcg

SEQ ID NO: 41263 - DNA, 20 bp, Artificial Sequence
  sgRNA
  Olfr317_12
gtgtggctcgcacctcaccg

SEQ ID NO: 41264 - DNA, 20 bp, Artificial Sequence
  sgRNA
  Olfr317_13
tgaccggcctgagctggaga

SEQ ID NO: 41265 - DNA, 20 bp, Artificial Sequence
  sgRNA
  Olfr317_14
ccgagagacagggaaagtaa

SEQ ID NO: 41266 - DNA, 20 bp, Artificial Sequence
  sgRNA
  Olfr317_15
tgttgcccagcagggtcagg

SEQ ID NO: 41267 - DNA, 20 bp, Artificial Sequence
  sgRNA
  Olfr317_16
gctagttctagatggaccag

SEQ ID NO: 41268 - DNA, 20 bp, Artificial Sequence
  sgRNA
  Olfr317_17
agaaaagcgagaccacggtg

SEQ ID NO: 41269 - DNA, 20 bp, Artificial Sequence
  sgRNA
  Olfr317_18
cagaaagcatttaatacgtg

SEQ ID NO: 41270 - DNA, 20 bp, Artificial Sequence
  sgRNA
  Olfr317_19
gatcgccacaaatcggtcat

SEQ ID NO: 41271 - DNA, 20 bp, Artificial Sequence
  sgRNA
  Olfr317_20
attgccttcatcctggcaat

SEQ ID NO: 41272 - DNA, 20 bp, Artificial Sequence
  sgRNA
  Olfr318_1
acccaaggtcagaaacacaa

SEQ ID NO: 41273 - DNA, 20 bp, Artificial Sequence
  sgRNA
  Olfr318_2
gtcttcggtccagcctgatg

SEQ ID NO: 41274 - DNA, 20 bp, Artificial Sequence
  sgRNA
  Olfr318_3
tcttcctactcatgagcaca

SEQ ID NO: 41275 - DNA, 20 bp, Artificial Sequence
  sgRNA
  Olfr318_4
gaggactgtatgctcatact

SEQ ID NO: 41276 - DNA, 20 bp, Artificial Sequence
  sgRNA
  Olfr318_5
atactggaaaagaccaacta

SEQ ID NO: 41277 - DNA, 20 bp, Artificial Sequence
  sgRNA
  Olfr318_6
tgaattctgtcccacagctg

SEQ ID NO: 41278 - DNA, 20 bp, Artificial Sequence
  sgRNA
  Olfr318_7
ccatgagagccactgcaaag

SEQ ID NO: 41279 - DNA, 20 bp, Artificial Sequence
  sgRNA
  Olfr318_8
agaatgtaaggagtgtggct

SEQ ID NO: 41280 - DNA, 20 bp, Artificial Sequence
  sgRNA
  Olfr318_9
ctccttacattctcctggaa

SEQ ID NO: 41281 - DNA, 20 bp, Artificial Sequence
  sgRNA
  Olfr318_10
tttgtgtttctgaccttggg

SEQ ID NO: 41282 - DNA, 20 bp, Artificial Sequence
  sgRNA
  Olfr318_11
gggacagaattcaccttagt

SEQ ID NO: 41283 - DNA, 20 bp, Artificial Sequence
  sgRNA
  Olfr318_12
gtcccttccaggagaatgta

SEQ ID NO: 41284 - DNA, 20 bp, Artificial Sequence
  sgRNA
  Olfr318_13
agtggtgacatagaacaggc

SEQ ID NO: 41285 - DNA, 20 bp, Artificial Sequence
  sgRNA
  Olfr318_14
tctcatgggcaacatcacac

SEQ ID NO: 41286 - DNA, 20 bp, Artificial Sequence
  sgRNA
  Olfr318_15
ggcaatcagtgtgaagagga

SEQ ID NO: 41287 - DNA, 20 bp, Artificial Sequence
  sgRNA
  Olfr318_16
agagagtggtgacatagaac

SEQ ID NO: 41288 - DNA, 20 bp, Artificial Sequence
  sgRNA
  Olfr318_17
ccacactccttacattctcc

SEQ ID NO: 41289 - DNA, 20 bp, Artificial Sequence
  sgRNA
  Olfr318_18
tcatgtcgatgatggagagc

SEQ ID NO: 41290 - DNA, 20 bp, Artificial Sequence
  sgRNA
  Olfr318_19
ccaggagaatgtaaggagtg

SEQ ID NO: 41291 - DNA, 20 bp, Artificial Sequence
  sgRNA
  Olfr318_20
aggtcagaaacacaaaggtt

SEQ ID NO: 41292 - DNA, 20 bp, Artificial Sequence
  sgRNA
  Olfr319_1
gatgtgtcttcacacacaag

SEQ ID NO: 41293 - DNA, 20 bp, Artificial Sequence
  sgRNA
  Olfr319_2
taacttcatctcagacacca

SEQ ID NO: 41294 - DNA, 20 bp, Artificial Sequence
  sgRNA
  Olfr319_3
gtcttctatccagcctgatg

SEQ ID NO: 41295 - DNA, 20 bp, Artificial Sequence
  sgRNA
  Olfr319_4
accatcctagacccacagaa

SEQ ID NO: 41296 - DNA, 20 bp, Artificial Sequence
  sgRNA
  Olfr319_5
tctaccactgtgcccaagat

SEQ ID NO: 41297 - DNA, 20 bp, Artificial Sequence
  sgRNA
  Olfr319_6
tgtcttcacacacaagtggc

SEQ ID NO: 41298 - DNA, 20 bp, Artificial Sequence
  sgRNA
  Olfr319_7
ttggatctcacatcctaaaa

SEQ ID NO: 41299 - DNA, 20 bp, Artificial Sequence
  sgRNA
  Olfr319_8
ttatgtttatgagtcttgct

SEQ ID NO: 41300 - DNA, 20 bp, Artificial Sequence
  sgRNA
  Olfr319_9
tcctaaaacggaaatggcct

SEQ ID NO: 41301 - DNA, 20 bp, Artificial Sequence
  sgRNA
  Olfr319_10
gccagtctgttctatgtcac

SEQ ID NO: 41302 - DNA, 20 bp, Artificial Sequence
  sgRNA
  Olfr319_11
tcctttctgtgggtctagga

SEQ ID NO: 41303 - DNA, 20 bp, Artificial Sequence
  sgRNA
  Olfr319_12
atactggaaaagaccaacca

SEQ ID NO: 41304 - DNA, 20 bp, Artificial Sequence
  sgRNA
  Olfr319_13
ctatagtctgaggaacaagg

SEQ ID NO: 41305 - DNA, 20 bp, Artificial Sequence
  sgRNA
  Olfr319_14
ctgcgggacagacttcacct

SEQ ID NO: 41306 - DNA, 20 bp, Artificial Sequence
  sgRNA
  Olfr319_15
gaggaacaaggaggtcattg

SEQ ID NO: 41307 - DNA, 20 bp, Artificial Sequence
  sgRNA
  Olfr319_16
agctcccatcttgggcacag

SEQ ID NO: 41308 - DNA, 20 bp, Artificial Sequence
  sgRNA
  Olfr319_17
tgtatgcgctaaagcattga

SEQ ID NO: 41309 - DNA, 20 bp, Artificial Sequence
  sgRNA
  Olfr319_18
accggtgacatagaacagac

SEQ ID NO: 41310 - DNA, 20 bp, Artificial Sequence
  sgRNA
  Olfr319_19
aggggagcaacacaaggaca

SEQ ID NO: 41311 - DNA, 20 bp, Artificial Sequence
  sgRNA
  Olfr319_20
tgacaatcatatgctcatat

SEQ ID NO: 41312 - DNA, 20 bp, Artificial Sequence
  sgRNA
  Olfr320_1
ctctaccactgtgcccaagg

SEQ ID NO: 41313 - DNA, 20 bp, Artificial Sequence
  sgRNA
  Olfr320_2
tgtcttcacacaccagtgga

SEQ ID NO: 41314 - DNA, 20 bp, Artificial Sequence
  sgRNA
  Olfr320_3
ctatgaaagccactgcaaag

SEQ ID NO: 41315 - DNA, 20 bp, Artificial Sequence
  sgRNA
  Olfr320_4
gagggcttcagatccaccca

SEQ ID NO: 41316 - DNA, 20 bp, Artificial Sequence
  sgRNA
  Olfr320_5
cttggttgttgtactccaga

SEQ ID NO: 41317 - DNA, 20 bp, Artificial Sequence
  sgRNA
  Olfr320_6
ctgtgggacagacttcagct

SEQ ID NO: 41318 - DNA, 20 bp, Artificial Sequence
  sgRNA
  Olfr320_7
ggttccatctctccttccac

SEQ ID NO: 41319 - DNA, 20 bp, Artificial Sequence
  sgRNA
  Olfr320_8
agagtccagtaacatagaac

SEQ ID NO: 41320 - DNA, 20 bp, Artificial Sequence
  sgRNA
  Olfr320_9
gcctttgtgtttctgaccct

SEQ ID NO: 41321 - DNA, 20 bp, Artificial Sequence
  sgRNA
  Olfr320_10
gatgaatgggttcagaacaa

SEQ ID NO: 41322 - DNA, 20 bp, Artificial Sequence
  sgRNA
  Olfr320_11
tcctggaagggacaaagtag

SEQ ID NO: 41323 - DNA, 20 bp, Artificial Sequence
  sgRNA
  Olfr320_12
ggagggcttcagatccaccc

SEQ ID NO: 41324 - DNA, 20 bp, Artificial Sequence
  sgRNA
  Olfr320_13
gggtcagaaacacaaaggct

SEQ ID NO: 41325 - DNA, 20 bp, Artificial Sequence
  sgRNA
  Olfr320_14
acccagggtcagaaacacaa

SEQ ID NO: 41326 - DNA, 20 bp, Artificial Sequence
  sgRNA
  Olfr320_15
gaaagccactgcaaagagga

SEQ ID NO: 41327 - DNA, 20 bp, Artificial Sequence
  sgRNA
  Olfr320_16
gggacagacttcagcttggt

SEQ ID NO: 41328 - DNA, 20 bp, Artificial Sequence
  sgRNA
  Olfr320_17
tttgtgtttctgaccctggg

SEQ ID NO: 41329 - DNA, 20 bp, Artificial Sequence
  sgRNA
  Olfr320_18
ccatgtgtccatcctggaaa

SEQ ID NO: 41330 - DNA, 20 bp, Artificial Sequence
  sgRNA
  Olfr320_19
tttcataggcaacatcacac

SEQ ID NO: 41331 - DNA, 20 bp, Artificial Sequence
  sgRNA
  Olfr320_20
gtccctttcctgaacccatc

SEQ ID NO: 41332 - DNA, 20 bp, Artificial Sequence
  sgRNA
  Olfr322_1
cactgcggcagtgttgacac

SEQ ID NO: 41333 - DNA, 20 bp, Artificial Sequence
  sgRNA
  Olfr322_2
ggcctatgaccgctttgtgg

SEQ ID NO: 41334 - DNA, 20 bp, Artificial Sequence
  sgRNA
  Olfr322_3
ggtcacaggagacatagcca

SEQ ID NO: 41335 - DNA, 20 bp, Artificial Sequence
  sgRNA
  Olfr322_4
cagcagggttaggaggtagg

SEQ ID NO: 41336 - DNA, 20 bp, Artificial Sequence
  sgRNA
  Olfr322_5
gtgtggttcacatctcaccg

SEQ ID NO: 41337 - DNA, 20 bp, Artificial Sequence
  sgRNA
  Olfr322_6
gctggttccatacggaccag

SEQ ID NO: 41338 - DNA, 20 bp, Artificial Sequence
  sgRNA
  Olfr322_7
agtggcctggagctgcggcg

SEQ ID NO: 41339 - DNA, 20 bp, Artificial Sequence
  sgRNA
  Olfr322_8
gcttgcagaccgccacaaag

SEQ ID NO: 41340 - DNA, 20 bp, Artificial Sequence
  sgRNA
  Olfr322_9
ctggttccatacggaccaga

SEQ ID NO: 41341 - DNA, 20 bp, Artificial Sequence
  sgRNA
  Olfr322_10
gcctattgccaggacgaaga

SEQ ID NO: 41342 - DNA, 20 bp, Artificial Sequence
  sgRNA
  Olfr322_11
ggtgaagctgaggtcaagga

SEQ ID NO: 41343 - DNA, 20 bp, Artificial Sequence
  sgRNA
  Olfr322_12
aaatccgctccgctgcaggg

SEQ ID NO: 41344 - DNA, 20 bp, Artificial Sequence
  sgRNA
  Olfr322_13
cagaaggcattcaacacgtg

SEQ ID NO: 41345 - DNA, 20 bp, Artificial Sequence
  sgRNA
  Olfr322_14
acaacacgatgcctattgcc

SEQ ID NO: 41346 - DNA, 20 bp, Artificial Sequence
  sgRNA
  Olfr322_15
tgtgagaaagaagtacatgg

SEQ ID NO: 41347 - DNA, 20 bp, Artificial Sequence
  sgRNA
  Olfr322_16
ccgagagacagggaaagtga

SEQ ID NO: 41348 - DNA, 20 bp, Artificial Sequence
  sgRNA
  Olfr322_17
tacaaatccgctccgctgca

SEQ ID NO: 41349 - DNA, 20 bp, Artificial Sequence
  sgRNA
  Olfr322_18
gaagacggtgccttccactg

SEQ ID NO: 41350 - DNA, 20 bp, Artificial Sequence
  sgRNA
  Olfr322_19
cagctactctataacctcag

SEQ ID NO: 41351 - DNA, 20 bp, Artificial Sequence
  sgRNA
  Olfr322_20
aagtgagggctggttccata

SEQ ID NO: 41352 - DNA, 20 bp, Artificial Sequence
  sgRNA
  Olfr323_1
aggacagctggattaacgga

SEQ ID NO: 41353 - DNA, 20 bp, Artificial Sequence
  sgRNA
  Olfr323_2
gatttggtacacatccacca

SEQ ID NO: 41354 - DNA, 20 bp, Artificial Sequence
  sgRNA
  Olfr323_3
ccatgttgcctgtaatggtg

SEQ ID NO: 41355 - DNA, 20 bp, Artificial Sequence
  sgRNA
  Olfr323_4
cgtacccacccctgtcaccc

SEQ ID NO: 41356 - DNA, 20 bp, Artificial Sequence
  sgRNA
  Olfr323_5
gaatcccctccacttccggc

SEQ ID NO: 41357 - DNA, 20 bp, Artificial Sequence
  sgRNA
  Olfr323_6
gctgtggtcaccatctacta

SEQ ID NO: 41358 - DNA, 20 bp, Artificial Sequence
  sgRNA
  Olfr323_7
gttcagcagtggagtgacca

SEQ ID NO: 41359 - DNA, 20 bp, Artificial Sequence
  sgRNA
  Olfr323_8
gatcatggtcccgtagtaga

SEQ ID NO: 41360 - DNA, 20 bp, Artificial Sequence
  sgRNA
  Olfr323_9
ggaggacactatgaaaacgt

SEQ ID NO: 41361 - DNA, 20 bp, Artificial Sequence
  sgRNA
  Olfr323_10
ggctcatgagaagagagtag

SEQ ID NO: 41362 - DNA, 20 bp, Artificial Sequence
  sgRNA
  Olfr323_11
ctactctcttctcatgagcc

SEQ ID NO: 41363 - DNA, 20 bp, Artificial Sequence
  sgRNA
  Olfr323_12
tcatcctgccggaagtggag

SEQ ID NO: 41364 - DNA, 20 bp, Artificial Sequence
  sgRNA
  Olfr323_13
caggacagctggattaacgg

SEQ ID NO: 41365 - DNA, 20 bp, Artificial Sequence
  sgRNA
  Olfr323_14
agaaaacgtcttcatcctgc

SEQ ID NO: 41366 - DNA, 20 bp, Artificial Sequence
  sgRNA
  Olfr323_15
ggctctgtagaccccacact

SEQ ID NO: 41367 - DNA, 20 bp, Artificial Sequence
  sgRNA
  Olfr323_16
ttgccgcaatggcttatgac

SEQ ID NO: 41368 - DNA, 20 bp, Artificial Sequence
  sgRNA
  Olfr323_17
caacatggtgatcatctgcg

SEQ ID NO: 41369 - DNA, 20 bp, Artificial Sequence
  sgRNA
  Olfr323_18
tatgaaaacgtaggacacca

SEQ ID NO: 41370 - DNA, 20 bp, Artificial Sequence
  sgRNA
  Olfr323_19
ggacagcagcaggggtaccg

SEQ ID NO: 41371 - DNA, 20 bp, Artificial Sequence
  sgRNA
  Olfr323_20
ggtggcagatggccaggtac

SEQ ID NO: 41372 - DNA, 20 bp, Artificial Sequence
  sgRNA
  Olfr325_1
aacataaagacatcagcagg

SEQ ID NO: 41373 - DNA, 20 bp, Artificial Sequence
  sgRNA
  Olfr325_2
tgaccacagcaagcaggaca

SEQ ID NO: 41374 - DNA, 20 bp, Artificial Sequence
  sgRNA
  Olfr325_3
gtacattggtgtgtgaaggt

SEQ ID NO: 41375 - DNA, 20 bp, Artificial Sequence
  sgRNA
  Olfr325_4
tccacagaatgggaaagtca

SEQ ID NO: 41376 - DNA, 20 bp, Artificial Sequence
  sgRNA
  Olfr325_5
agatcagtgggttcaacaga

SEQ ID NO: 41377 - DNA, 20 bp, Artificial Sequence
  sgRNA
  Olfr325_6
gatcagtgggttcaacagag

SEQ ID NO: 41378 - DNA, 20 bp, Artificial Sequence
  sgRNA
  Olfr325_7
tttaaagattcttgaaagaa

SEQ ID NO: 41379 - DNA, 20 bp, Artificial Sequence
  sgRNA
  Olfr325_8
tccaacataaagacatcagc

SEQ ID NO: 41380 - DNA, 20 bp, Artificial Sequence
  sgRNA
  Olfr325_9
tcagcaggaggcacaccctg

SEQ ID NO: 41381 - DNA, 20 bp, Artificial Sequence
  sgRNA
  Olfr325_10
ttcctaaaactatagatcag

SEQ ID NO: 41382 - DNA, 20 bp, Artificial Sequence
  sgRNA
  Olfr325_11
tagatcagtgggttcaacag

SEQ ID NO: 41383 - DNA, 20 bp, Artificial Sequence
  sgRNA
  Olfr325_12
tacatagcggtcataagaca

SEQ ID NO: 41384 - DNA, 20 bp, Artificial Sequence
  sgRNA
  Olfr325_13
tcctaaaactatagatcagt

SEQ ID NO: 41385 - DNA, 20 bp, Artificial Sequence
  sgRNA
  Olfr325_14
ctttaaagattcttgaaaga

SEQ ID NO: 41386 - DNA, 20 bp, Artificial Sequence
  sgRNA
  Olfr325_15
cagggctgtggagggaggca

SEQ ID NO: 41387 - DNA, 20 bp, Artificial Sequence
  sgRNA
  Olfr325_16
atgtctttatgttggatcct

SEQ ID NO: 41388 - DNA, 20 bp, Artificial Sequence
  sgRNA
  Olfr325_17
cttctttcaagaatctttaa

SEQ ID NO: 41389 - DNA, 20 bp, Artificial Sequence
  sgRNA
  Olfr325_18
tgggaaagtcatggtgatag

SEQ ID NO: 41390 - DNA, 20 bp, Artificial Sequence
  sgRNA
  Olfr325_19
acaccctgtcctgcttgctg

SEQ ID NO: 41391 - DNA, 20 bp, Artificial Sequence
  sgRNA
  Olfr325_20
atgaccacagcaagcaggac

SEQ ID NO: 41392 - DNA, 20 bp, Artificial Sequence
  sgRNA
  Olfr328_1
aaaggaggagacaaatcctg

SEQ ID NO: 41393 - DNA, 20 bp, Artificial Sequence
  sgRNA
  Olfr328_2
ccgggatccacagattggga

SEQ ID NO: 41394 - DNA, 20 bp, Artificial Sequence
  sgRNA
  Olfr328_3
gatgacagatggctacatag

SEQ ID NO: 41395 - DNA, 20 bp, Artificial Sequence
  sgRNA
  Olfr328_4
tcctgtacctgtcaatagga

SEQ ID NO: 41396 - DNA, 20 bp, Artificial Sequence
  sgRNA
  Olfr328_5
gccaacagacagataaaagg

SEQ ID NO: 41397 - DNA, 20 bp, Artificial Sequence
  sgRNA
  Olfr328_6
attctgaccctcctattgac

SEQ ID NO: 41398 - DNA, 20 bp, Artificial Sequence
  sgRNA
  Olfr328_7
tctcaagatgaactcagcag

SEQ ID NO: 41399 - DNA, 20 bp, Artificial Sequence
  sgRNA
  Olfr328_8
accctcctattgacaggtac

SEQ ID NO: 41400 - DNA, 20 bp, Artificial Sequence
  sgRNA
  Olfr328_9
ggagccaacagacagataaa

SEQ ID NO: 41401 - DNA, 20 bp, Artificial Sequence
  sgRNA
  Olfr328_10
tgggaaggtcatagtgacag

SEQ ID NO: 41402 - DNA, 20 bp, Artificial Sequence
  sgRNA
  Olfr328_11
aggagagctttgtgacagca

SEQ ID NO: 41403 - DNA, 20 bp, Artificial Sequence
  sgRNA
  Olfr328_12
ttatctgtctgttggctcct

SEQ ID NO: 41404 - DNA, 20 bp, Artificial Sequence
  sgRNA
  Olfr328_13
gttcaacagaggggtgacta

SEQ ID NO: 41405 - DNA, 20 bp, Artificial Sequence
  sgRNA
  Olfr328_14
atgttcctgtacctgtcaat

SEQ ID NO: 41406 - DNA, 20 bp, Artificial Sequence
  sgRNA
  Olfr328_15
tcatcttgagaacagtgaga

SEQ ID NO: 41407 - DNA, 20 bp, Artificial Sequence
  sgRNA
  Olfr328_16
ctcaagatgaactcagcaga

SEQ ID NO: 41408 - DNA, 20 bp, Artificial Sequence
  sgRNA
  Olfr328_17
actatgaccttcccaatctg

SEQ ID NO: 41409 - DNA, 20 bp, Artificial Sequence
  sgRNA
  Olfr328_18
agatgaactcagcagagggc

SEQ ID NO: 41410 - DNA, 20 bp, Artificial Sequence
  sgRNA
  Olfr328_19
tgtccttctcaggggtgtgg

SEQ ID NO: 41411 - DNA, 20 bp, Artificial Sequence
  sgRNA
  Olfr328_20
tggctcctgggatctttgga

SEQ ID NO: 41412 - DNA, 20 bp, Artificial Sequence
  sgRNA
  Olfr329-ps_1
ataccggagtggataacaaa

SEQ ID NO: 41413 - DNA, 20 bp, Artificial Sequence
  sgRNA
  Olfr329-ps_2
tggacagtcagatttcaccc

SEQ ID NO: 41414 - DNA, 20 bp, Artificial Sequence
  sgRNA
  Olfr329-ps_3
tcctctacctgacactagta

SEQ ID NO: 41415 - DNA, 20 bp, Artificial Sequence
  sgRNA
  Olfr329-ps_4
accctactagtgtcaggtag

SEQ ID NO: 41416 - DNA, 20 bp, Artificial Sequence
  sgRNA
  Olfr329-ps_5
gattagtgggttcaaaagag

SEQ ID NO: 41417 - DNA, 20 bp, Artificial Sequence
  sgRNA
  Olfr329-ps_6
agtagagttgttcatccagg

SEQ ID NO: 41418 - DNA, 20 bp, Artificial Sequence
  sgRNA
  Olfr329-ps_7
ttgactgaagagtcccacca

SEQ ID NO: 41419 - DNA, 20 bp, Artificial Sequence
  sgRNA
  Olfr329-ps_8
ggagaagcagagaccagaaa

SEQ ID NO: 41420 - DNA, 20 bp, Artificial Sequence
  sgRNA
  Olfr329-ps_9
ccatgactttcccattctgt

SEQ ID NO: 41421 - DNA, 20 bp, Artificial Sequence
  sgRNA
  Olfr329-ps_10
gaagctatgaagaaactgtt

SEQ ID NO: 41422 - DNA, 20 bp, Artificial Sequence
  sgRNA
  Olfr329-ps_11
gataacaaatggccacatag

SEQ ID NO: 41423 - DNA, 20 bp, Artificial Sequence
  sgRNA
  Olfr329-ps_12
agattagtgggttcaaaaga

SEQ ID NO: 41424 - DNA, 20 bp, Artificial Sequence
  sgRNA
  Olfr329-ps_13
attgactgaagagtcccacc

SEQ ID NO: 41425 - DNA, 20 bp, Artificial Sequence
  sgRNA
  Olfr329-ps_14
tgggaaagtcatggtgacag

SEQ ID NO: 41426 - DNA, 20 bp, Artificial Sequence
  sgRNA
  Olfr329-ps_15
agaagctatgaagaaactgt

SEQ ID NO: 41427 - DNA, 20 bp, Artificial Sequence
  sgRNA
  Olfr329-ps_16
gtacatgggtgtgtgaaggt

SEQ ID NO: 41428 - DNA, 20 bp, Artificial Sequence
  sgRNA
  Olfr329-ps_17
attctgaccctactagtgtc

SEQ ID NO: 41429 - DNA, 20 bp, Artificial Sequence
  sgRNA
  Olfr329-ps_18
catgtcttatgaccgctatg

SEQ ID NO: 41430 - DNA, 20 bp, Artificial Sequence
  sgRNA
  Olfr329-ps_19
tagattagtgggttcaaaag

SEQ ID NO: 41431 - DNA, 20 bp, Artificial Sequence
  sgRNA
  Olfr329-ps_20
ttcctctacctgacactagt

SEQ ID NO: 41432 - DNA, 20 bp, Artificial Sequence
  sgRNA
  Olfr330_1
tccaacagacagacatcagg

SEQ ID NO: 41433 - DNA, 20 bp, Artificial Sequence
  sgRNA
  Olfr330_2
aacctgctagtgtcacatag

SEQ ID NO: 41434 - DNA, 20 bp, Artificial Sequence
  sgRNA
  Olfr330_3
gagtaccagcaggatcagga

SEQ ID NO: 41435 - DNA, 20 bp, Artificial Sequence
  sgRNA
  Olfr330_4
ccgggatccacagaatggga

SEQ ID NO: 41436 - DNA, 20 bp, Artificial Sequence
  sgRNA
  Olfr330_5
gatagcagcaccatagaaga

SEQ ID NO: 41437 - DNA, 20 bp, Artificial Sequence
  sgRNA
  Olfr330_6
gatggcagatggccacatag

SEQ ID NO: 41438 - DNA, 20 bp, Artificial Sequence
  sgRNA
  Olfr330_7
agatagcagcaccatagaag

SEQ ID NO: 41439 - DNA, 20 bp, Artificial Sequence
  sgRNA
  Olfr330_8
tggatcctgggatctttgga

SEQ ID NO: 41440 - DNA, 20 bp, Artificial Sequence
  sgRNA
  Olfr330_9
cgtaggacatggcagccaga

SEQ ID NO: 41441 - DNA, 20 bp, Artificial Sequence
  sgRNA
  Olfr330_10
tgaagccatccaaagatccc

SEQ ID NO: 41442 - DNA, 20 bp, Artificial Sequence
  sgRNA
  Olfr330_11
ggacaggataccggagtgga

SEQ ID NO: 41443 - DNA, 20 bp, Artificial Sequence
  sgRNA
  Olfr330_12
tggccatctgccatccactc

SEQ ID NO: 41444 - DNA, 20 bp, Artificial Sequence
  sgRNA
  Olfr330_13
ttcctctatgtgacactagc

SEQ ID NO: 41445 - DNA, 20 bp, Artificial Sequence
  sgRNA
  Olfr330_14
catgtcctacgaccgctatg

SEQ ID NO: 41446 - DNA, 20 bp, Artificial Sequence
  sgRNA
  Olfr330_15
ataccggagtggatggcaga

SEQ ID NO: 41447 - DNA, 20 bp, Artificial Sequence
  sgRNA
  Olfr330_16
ggatccaacagacagacatc

SEQ ID NO: 41448 - DNA, 20 bp, Artificial Sequence
  sgRNA
  Olfr330_17
ctgttggatcctgggatctt

SEQ ID NO: 41449 - DNA, 20 bp, Artificial Sequence
  sgRNA
  Olfr330_18
cacatagcggtcgtaggaca

SEQ ID NO: 41450 - DNA, 20 bp, Artificial Sequence
  sgRNA
  Olfr330_19
tcctcctgatgtctgtctgt

SEQ ID NO: 41451 - DNA, 20 bp, Artificial Sequence
  sgRNA
  Olfr330_20
acactctgccctgcttgctg

SEQ ID NO: 41452 - DNA, 20 bp, Artificial Sequence
  sgRNA
  Olfr331_1
tcagcaggagacacaccctg

SEQ ID NO: 41453 - DNA, 20 bp, Artificial Sequence
  sgRNA
  Olfr331_2
tcctctacctgacattagca

SEQ ID NO: 41454 - DNA, 20 bp, Artificial Sequence
  sgRNA
  Olfr331_3
gagtatcagcaggatcagga

SEQ ID NO: 41455 - DNA, 20 bp, Artificial Sequence
  sgRNA
  Olfr331_4
aggagagctttgtcacagca

SEQ ID NO: 41456 - DNA, 20 bp, Artificial Sequence
  sgRNA
  Olfr331_5
gatagcagcaccatagtaga

SEQ ID NO: 41457 - DNA, 20 bp, Artificial Sequence
  sgRNA
  Olfr331_6
actgtggtcaccctctacta

SEQ ID NO: 41458 - DNA, 20 bp, Artificial Sequence
  sgRNA
  Olfr331_7
cataggacatggcagcaaga

SEQ ID NO: 41459 - DNA, 20 bp, Artificial Sequence
  sgRNA
  Olfr331_8
ggatgtcagagagtatcagc

SEQ ID NO: 41460 - DNA, 20 bp, Artificial Sequence
  sgRNA
  Olfr331_9
ggtgaacatgaagccatcca

SEQ ID NO: 41461 - DNA, 20 bp, Artificial Sequence
  sgRNA
  Olfr331_10
tccaacagacagacatcagc

SEQ ID NO: 41462 - DNA, 20 bp, Artificial Sequence
  sgRNA
  Olfr331_11
atactggagtggatgacaga

SEQ ID NO: 41463 - DNA, 20 bp, Artificial Sequence
  sgRNA
  Olfr331_12
atgaggacaggatactggag

SEQ ID NO: 41464 - DNA, 20 bp, Artificial Sequence
  sgRNA
  Olfr331_13
aaaagtacattggtatgtgg

SEQ ID NO: 41465 - DNA, 20 bp, Artificial Sequence
  sgRNA
  Olfr331_14
agatagcagcaccatagtag

SEQ ID NO: 41466 - DNA, 20 bp, Artificial Sequence
  sgRNA
  Olfr331_15
attggtatgtggaggtggat

SEQ ID NO: 41467 - DNA, 20 bp, Artificial Sequence
  sgRNA
  Olfr331_16
agtacattggtatgtggagg

SEQ ID NO: 41468 - DNA, 20 bp, Artificial Sequence
  sgRNA
  Olfr331_17
tcctgctgatgtctgtctgt

SEQ ID NO: 41469 - DNA, 20 bp, Artificial Sequence
  sgRNA
  Olfr331_18
ctgttggatcctgggatcct

SEQ ID NO: 41470 - DNA, 20 bp, Artificial Sequence
  sgRNA
  Olfr331_19
taaaaaagtacattggtatg

SEQ ID NO: 41471 - DNA, 20 bp, Artificial Sequence
  sgRNA
  Olfr350_1
gatcatatgccattgaagtg

SEQ ID NO: 41472 - DNA, 20 bp, Artificial Sequence
  sgRNA
  Olfr350_2
ctacaccaccatcatgagag

SEQ ID NO: 41473 - DNA, 20 bp, Artificial Sequence
  sgRNA
  Olfr350_3
tgagcatgagagcttcagca

SEQ ID NO: 41474 - DNA, 20 bp, Artificial Sequence
  sgRNA
  Olfr350_4
agaaggatagccgggccagg

SEQ ID NO: 41475 - DNA, 20 bp, Artificial Sequence
  sgRNA
  Olfr350_5
tatacactctgcataaggaa

SEQ ID NO: 41476 - DNA, 20 bp, Artificial Sequence
  sgRNA
  Olfr350_6
tcacttcaatggcatatgat

SEQ ID NO: 41477 - DNA, 20 bp, Artificial Sequence
  sgRNA
  Olfr350_7
aatacagagacaccacagag

SEQ ID NO: 41478 - DNA, 20 bp, Artificial Sequence
  sgRNA
  Olfr350_8
tgcttctgtgatgtacacag

SEQ ID NO: 41479 - DNA, 20 bp, Artificial Sequence
  sgRNA
  Olfr350_9
acagagctcctctctcatga

SEQ ID NO: 41480 - DNA, 20 bp, Artificial Sequence
  sgRNA
  Olfr350_10
ggatagccgggccaggagga

SEQ ID NO: 41481 - DNA, 20 bp, Artificial Sequence
  sgRNA
  Olfr350_11
tgaaagtttcatctaacaaa

SEQ ID NO: 41482 - DNA, 20 bp, Artificial Sequence
  sgRNA
  Olfr350_12
cactctgcataaggaatgga

SEQ ID NO: 41483 - DNA, 20 bp, Artificial Sequence
  sgRNA
  Olfr350_13
tcctttacttctactgacaa

SEQ ID NO: 41484 - DNA, 20 bp, Artificial Sequence
  sgRNA
  Olfr350_14
acatgccttgctcctctggc

SEQ ID NO: 41485 - DNA, 20 bp, Artificial Sequence
  sgRNA
  Olfr350_15
atatgtatcttgatctctta

SEQ ID NO: 41486 - DNA, 20 bp, Artificial Sequence
  sgRNA
  Olfr350_16
gttagatgaaactttcagaa

SEQ ID NO: 41487 - DNA, 20 bp, Artificial Sequence
  sgRNA
  Olfr350_17
accccttcatttatagcata

SEQ ID NO: 41488 - DNA, 20 bp, Artificial Sequence
  sgRNA
  Olfr350_18
tccgtatgctataaatgaag

SEQ ID NO: 41489 - DNA, 20 bp, Artificial Sequence
  sgRNA
  Olfr350_19
agagcttcagcaaggcagca

SEQ ID NO: 41490 - DNA, 20 bp, Artificial Sequence
  sgRNA
  Olfr350_20
gtagtgcaggggatgacaga

SEQ ID NO: 41491 - DNA, 20 bp, Artificial Sequence
  sgRNA
  Olfr351_1
gttggtgagaacccaacaca

SEQ ID NO: 41492 - DNA, 20 bp, Artificial Sequence
  sgRNA
  Olfr351_2
tattaaacccatgtcagcaa

SEQ ID NO: 41493 - DNA, 20 bp, Artificial Sequence
  sgRNA
  Olfr351_3
catgagtactgtacccccta

SEQ ID NO: 41494 - DNA, 20 bp, Artificial Sequence
  sgRNA
  Olfr351_4
tgttgtttaatgttcagaca

SEQ ID NO: 41495 - DNA, 20 bp, Artificial Sequence
  sgRNA
  Olfr351_5
agaaggacagtcgagccatg

SEQ ID NO: 41496 - DNA, 20 bp, Artificial Sequence
  sgRNA
  Olfr351_6
agataacaatgcatacaaaa

SEQ ID NO: 41497 - DNA, 20 bp, Artificial Sequence
  sgRNA
  Olfr351_7
cattgtatttgccatcctaa

SEQ ID NO: 41498 - DNA, 20 bp, Artificial Sequence
  sgRNA
  Olfr351_8
agctgctgcgatgtatacag

SEQ ID NO: 41499 - DNA, 20 bp, Artificial Sequence
  sgRNA
  Olfr351_9
ctaaaggttcgaacccctgg

SEQ ID NO: 41500 - DNA, 20 bp, Artificial Sequence
  sgRNA
  Olfr351_10
aggggttcgaacctttagga

SEQ ID NO: 41501 - DNA, 20 bp, Artificial Sequence
  sgRNA
  Olfr351_11
ctgtagagactacagaggga

SEQ ID NO: 41502 - DNA, 20 bp, Artificial Sequence
  sgRNA
  Olfr351_12
attattgtggaatagtggag

SEQ ID NO: 41503 - DNA, 20 bp, Artificial Sequence
  sgRNA
  Olfr351_13
gtgtagttcccacctctgtg

SEQ ID NO: 41504 - DNA, 20 bp, Artificial Sequence
  sgRNA
  Olfr351_14
tgatctggacagcttcctcc

SEQ ID NO: 41505 - DNA, 20 bp, Artificial Sequence
  sgRNA
  Olfr351_15
ggcctttgtaccgccaccag

SEQ ID NO: 41506 - DNA, 20 bp, Artificial Sequence
  sgRNA
  Olfr351_16
cttatggtatttgccttagg

SEQ ID NO: 41507 - DNA, 20 bp, Artificial Sequence
  sgRNA
  Olfr351_17
aaggttcgaacccctggtgg

SEQ ID NO: 41508 - DNA, 20 bp, Artificial Sequence
  sgRNA
  Olfr351_18
aggcctttgtaccgccacca

SEQ ID NO: 41509 - DNA, 20 bp, Artificial Sequence
  sgRNA
  Olfr351_19
tagaaacaaggatatgaaag

SEQ ID NO: 41510 - DNA, 20 bp, Artificial Sequence
  sgRNA
  Olfr351_20
cctgactcacactctcctca

SEQ ID NO: 41511 - DNA, 20 bp, Artificial Sequence
  sgRNA
  Olfr353_1
catgtcagcaaacgacaagt

SEQ ID NO: 41512 - DNA, 20 bp, Artificial Sequence
  sgRNA
  Olfr353_2
gtgggtcacagctaatagct

SEQ ID NO: 41513 - DNA, 20 bp, Artificial Sequence
  sgRNA
  Olfr353_3
agaaggacagtcgagtcatg

SEQ ID NO: 41514 - DNA, 20 bp, Artificial Sequence
  sgRNA
  Olfr353_4
gagacaaccagtataggaga

SEQ ID NO: 41515 - DNA, 20 bp, Artificial Sequence
  sgRNA
  Olfr353_5
agcagctgcgatgtatacgg

SEQ ID NO: 41516 - DNA, 20 bp, Artificial Sequence
  sgRNA
  Olfr353_6
ccgtggtctctccagaggaa

SEQ ID NO: 41517 - DNA, 20 bp, Artificial Sequence
  sgRNA
  Olfr353_7
ttagggtccagacttctggc

SEQ ID NO: 41518 - DNA, 20 bp, Artificial Sequence
  sgRNA
  Olfr353_8
agatgacaatgcttacaaag

SEQ ID NO: 41519 - DNA, 20 bp, Artificial Sequence
  sgRNA
  Olfr353_9
tgtagcagctgcgatgtata

SEQ ID NO: 41520 - DNA, 20 bp, Artificial Sequence
  sgRNA
  Olfr353_10
gagatgacaatgcttacaaa

SEQ ID NO: 41521 - DNA, 20 bp, Artificial Sequence
  sgRNA
  Olfr353_11
tgttggtgagaacccagcac

SEQ ID NO: 41522 - DNA, 20 bp, Artificial Sequence
  sgRNA
  Olfr353_12
tgctacaacatccttctccg

SEQ ID NO: 41523 - DNA, 20 bp, Artificial Sequence
  sgRNA
  Olfr353_13
cccttcctctggagagacca

SEQ ID NO: 41524 - DNA, 20 bp, Artificial Sequence
  sgRNA
  Olfr353_14
aacttgtcgtttgctgacat

SEQ ID NO: 41525 - DNA, 20 bp, Artificial Sequence
  sgRNA
  Olfr353_15
cttagggtccagacttctgg

SEQ ID NO: 41526 - DNA, 20 bp, Artificial Sequence
  sgRNA
  Olfr353_16
cttctccgtggtctctccag

SEQ ID NO: 41527 - DNA, 20 bp, Artificial Sequence
  sgRNA
  Olfr353_17
gcatagtatttgctgtcctt

SEQ ID NO: 41528 - DNA, 20 bp, Artificial Sequence
  sgRNA
  Olfr353_18
atgacaaagaagcctcttta

SEQ ID NO: 41529 - DNA, 20 bp, Artificial Sequence
  sgRNA
  Olfr353_19
taaggacagcaaatactatg

SEQ ID NO: 41530 - DNA, 20 bp, Artificial Sequence
  sgRNA
  Olfr353_20
atgtacttattcatgatgtt

SEQ ID NO: 41531 - DNA, 20 bp, Artificial Sequence
  sgRNA
  Olfr354_1
gagctgatgatcattaccat

SEQ ID NO: 41532 - DNA, 20 bp, Artificial Sequence
  sgRNA
  Olfr354_2
attaatgctgtgtacatgct

SEQ ID NO: 41533 - DNA, 20 bp, Artificial Sequence
  sgRNA
  Olfr354_3
aggaagatgccaaatagaag

SEQ ID NO: 41534 - DNA, 20 bp, Artificial Sequence
  sgRNA
  Olfr354_4
ttgactctgggtataaatgt

SEQ ID NO: 41535 - DNA, 20 bp, Artificial Sequence
  sgRNA
  Olfr354_5
ggaagtctgaagcaacagat

SEQ ID NO: 41536 - DNA, 20 bp, Artificial Sequence
  sgRNA
  Olfr354_6
catatgccatcacagccaga

SEQ ID NO: 41537 - DNA, 20 bp, Artificial Sequence
  sgRNA
  Olfr354_7
catcaactcactctacagag

SEQ ID NO: 41538 - DNA, 20 bp, Artificial Sequence
  sgRNA
  Olfr354_8
gcaagtttcagcagagcact

SEQ ID NO: 41539 - DNA, 20 bp, Artificial Sequence
  sgRNA
  Olfr354_9
tgtgagcacagaaagccaca

SEQ ID NO: 41540 - DNA, 20 bp, Artificial Sequence
  sgRNA
  Olfr354_10
tgagctgatgatcattacca

SEQ ID NO: 41541 - DNA, 20 bp, Artificial Sequence
  sgRNA
  Olfr354_11
gggcatgtacctggtcacta

SEQ ID NO: 41542 - DNA, 20 bp, Artificial Sequence
  sgRNA
  Olfr354_12
gctggcagatggctacatag

SEQ ID NO: 41543 - DNA, 20 bp, Artificial Sequence
  sgRNA
  Olfr354_13
tctgtagagtgagttgatgg

SEQ ID NO: 41544 - DNA, 20 bp, Artificial Sequence
  sgRNA
  Olfr354_14
gatcatcagctcattaatgt

SEQ ID NO: 41545 - DNA, 20 bp, Artificial Sequence
  sgRNA
  Olfr354_15
tctcttctatggatctctga

SEQ ID NO: 41546 - DNA, 20 bp, Artificial Sequence
  sgRNA
  Olfr354_16
agggatacccaacacagccc

SEQ ID NO: 41547 - DNA, 20 bp, Artificial Sequence
  sgRNA
  Olfr354_17
gtaatggagtggctggcaga

SEQ ID NO: 41548 - DNA, 20 bp, Artificial Sequence
  sgRNA
  Olfr354_18
actgggatcacagtagaaat

SEQ ID NO: 41549 - DNA, 20 bp, Artificial Sequence
  sgRNA
  Olfr354_19
gggactctctgaacagccag

SEQ ID NO: 41550 - DNA, 20 bp, Artificial Sequence
  sgRNA
  Olfr354_20
aagacacccagaataggaga

SEQ ID NO: 41551 - DNA, 20 bp, Artificial Sequence
  sgRNA
  Olfr357_1
agtattgaggagtaacggag

SEQ ID NO: 41552 - DNA, 20 bp, Artificial Sequence
  sgRNA
  Olfr357_2
ttgggctaagcagcccacat

SEQ ID NO: 41553 - DNA, 20 bp, Artificial Sequence
  sgRNA
  Olfr357_3
agagaggaatctgttcaact

SEQ ID NO: 41554 - DNA, 20 bp, Artificial Sequence
  sgRNA
  Olfr357_4
ttgtaacatcttgggaactg

SEQ ID NO: 41555 - DNA, 20 bp, Artificial Sequence
  sgRNA
  Olfr357_5
gcccctttctagttactcag

SEQ ID NO: 41556 - DNA, 20 bp, Artificial Sequence
  sgRNA
  Olfr357_6
ctacaggagatcttcatcag

SEQ ID NO: 41557 - DNA, 20 bp, Artificial Sequence
  sgRNA
  Olfr357_7
tgtacatgactgtcacaatg

SEQ ID NO: 41558 - DNA, 20 bp, Artificial Sequence
  sgRNA
  Olfr357_8
actgtggtagccatattcta

SEQ ID NO: 41559 - DNA, 20 bp, Artificial Sequence
  sgRNA
  Olfr357_9
atatggctaccacagtgagg

SEQ ID NO: 41560 - DNA, 20 bp, Artificial Sequence
  sgRNA
  Olfr357_10
tctagttactcagtggtcaa

SEQ ID NO: 41561 - DNA, 20 bp, Artificial Sequence
  sgRNA
  Olfr357_11
tcatcatctcagcagtcctc

SEQ ID NO: 41562 - DNA, 20 bp, Artificial Sequence
  sgRNA
  Olfr357_12
cgttactcctcaatactgac

SEQ ID NO: 41563 - DNA, 20 bp, Artificial Sequence
  sgRNA
  Olfr357_13
cagtcagtattgaggagtaa

SEQ ID NO: 41564 - DNA, 20 bp, Artificial Sequence
  sgRNA
  Olfr357_14
ctgtggttcccacctcactg

SEQ ID NO: 41565 - DNA, 20 bp, Artificial Sequence
  sgRNA
  Olfr357_15
gtattgaggagtaacggaga

SEQ ID NO: 41566 - DNA, 20 bp, Artificial Sequence
  sgRNA
  Olfr357_16
attctacggcactctcacat

SEQ ID NO: 41567 - DNA, 20 bp, Artificial Sequence
  sgRNA
  Olfr357_17
tatacatgagtagaaaaaga

SEQ ID NO: 41568 - DNA, 20 bp, Artificial Sequence
  sgRNA
  Olfr357_18
catgaggaaggtgtgcagca

SEQ ID NO: 41569 - DNA, 20 bp, Artificial Sequence
  sgRNA
  Olfr357_19
gtaacggagagggtgacaga

SEQ ID NO: 41570 - DNA, 20 bp, Artificial Sequence
  sgRNA
  Olfr357_20
ggtgaagcagatgtctgcca

SEQ ID NO: 41571 - DNA, 20 bp, Artificial Sequence
  sgRNA
  Olfr362_1
aaaagaactgagtcaaacag

SEQ ID NO: 41572 - DNA, 20 bp, Artificial Sequence
  sgRNA
  Olfr362_2
atgaaccaacagctgtggca

SEQ ID NO: 41573 - DNA, 20 bp, Artificial Sequence
  sgRNA
  Olfr362_3
gcatctccagcccaacacag

SEQ ID NO: 41574 - DNA, 20 bp, Artificial Sequence
  sgRNA
  Olfr362_4
acaataaaaagaggaaagtg

SEQ ID NO: 41575 - DNA, 20 bp, Artificial Sequence
  sgRNA
  Olfr362_5
gtacacaccatgctgcatgt

SEQ ID NO: 41576 - DNA, 20 bp, Artificial Sequence
  sgRNA
  Olfr362_6
gaactcccggaatcaagaca

SEQ ID NO: 41577 - DNA, 20 bp, Artificial Sequence
  sgRNA
  Olfr362_7
gatgagtcccacatgcagca

SEQ ID NO: 41578 - DNA, 20 bp, Artificial Sequence
  sgRNA
  Olfr362_8
gccatacaggaagccaacca

SEQ ID NO: 41579 - DNA, 20 bp, Artificial Sequence
  sgRNA
  Olfr362_9
ctgtctcagtagtctgtgga

SEQ ID NO: 41580 - DNA, 20 bp, Artificial Sequence
  sgRNA
  Olfr362_10
cctatgtattatctcttgcg

SEQ ID NO: 41581 - DNA, 20 bp, Artificial Sequence
  sgRNA
  Olfr362_11
tgagctggctatattcttgg

SEQ ID NO: 41582 - DNA, 20 bp, Artificial Sequence
  sgRNA
  Olfr362_12
cggtgatcacaaaagaagtg

SEQ ID NO: 41583 - DNA, 20 bp, Artificial Sequence
  sgRNA
  Olfr362_13
ctgtggatcccacctcacca

SEQ ID NO: 41584 - DNA, 20 bp, Artificial Sequence
  sgRNA
  Olfr362_14
ggcataggaaagtacaataa

SEQ ID NO: 41585 - DNA, 20 bp, Artificial Sequence
  sgRNA
  Olfr362_15
gtcccaagtctatcatggag

SEQ ID NO: 41586 - DNA, 20 bp, Artificial Sequence
  sgRNA
  Olfr362_16
ggcctctccatgatagactt

SEQ ID NO: 41587 - DNA, 20 bp, Artificial Sequence
  sgRNA
  Olfr362_17
ggtgatcccaattcgggcat

SEQ ID NO: 41588 - DNA, 20 bp, Artificial Sequence
  sgRNA
  Olfr362_18
agtcacattccccaatatgg

SEQ ID NO: 41589 - DNA, 20 bp, Artificial Sequence
  sgRNA
  Olfr362_19
cttgctccttgggttctcaa

SEQ ID NO: 41590 - DNA, 20 bp, Artificial Sequence
  sgRNA
  Olfr362_20
tccacagactactgagacag

SEQ ID NO: 41591 - DNA, 20 bp, Artificial Sequence
  sgRNA
  Olfr368_1
tagacgtggtgacataactg

SEQ ID NO: 41592 - DNA, 20 bp, Artificial Sequence
  sgRNA
  Olfr368_2
ggcacaggctacataaggga

SEQ ID NO: 41593 - DNA, 20 bp, Artificial Sequence
  sgRNA
  Olfr368_3
taacaggcagcactcagcat

SEQ ID NO: 41594 - DNA, 20 bp, Artificial Sequence
  sgRNA
  Olfr368_4
ggtgaaagttgtatgtacaa

SEQ ID NO: 41595 - DNA, 20 bp, Artificial Sequence
  sgRNA
  Olfr368_5
tctatgcctggcgctccttg

SEQ ID NO: 41596 - DNA, 20 bp, Artificial Sequence
  sgRNA
  Olfr368_6
gtcagctgagggccgtcgga

SEQ ID NO: 41597 - DNA, 20 bp, Artificial Sequence
  sgRNA
  Olfr368_7
tcttggggatcacaaatcgt

SEQ ID NO: 41598 - DNA, 20 bp, Artificial Sequence
  sgRNA
  Olfr368_8
agcaggctgacgagatagat

SEQ ID NO: 41599 - DNA, 20 bp, Artificial Sequence
  sgRNA
  Olfr368_9
ggcaaagacaaacatctgga

SEQ ID NO: 41600 - DNA, 20 bp, Artificial Sequence
  sgRNA
  Olfr368_10
ggagggcacaggctacataa

SEQ ID NO: 41601 - DNA, 20 bp, Artificial Sequence
  sgRNA
  Olfr368_11
ggaatagaaggcatccagca

SEQ ID NO: 41602 - DNA, 20 bp, Artificial Sequence
  sgRNA
  Olfr368_12
tactcattcgtatagatgcc

SEQ ID NO: 41603 - DNA, 20 bp, Artificial Sequence
  sgRNA
  Olfr368_13
ttgcaggagatggcaagcag

SEQ ID NO: 41604 - DNA, 20 bp, Artificial Sequence
  sgRNA
  Olfr368_14
cttggggatcacaaatcgtt

SEQ ID NO: 41605 - DNA, 20 bp, Artificial Sequence
  sgRNA
  Olfr368_15
atagagaagagggttcccaa

SEQ ID NO: 41606 - DNA, 20 bp, Artificial Sequence
  sgRNA
  Olfr368_16
ctccagctatgccctggaca

SEQ ID NO: 41607 - DNA, 20 bp, Artificial Sequence
  sgRNA
  Olfr368_17
gcactcagcatcggccaacc

SEQ ID NO: 41608 - DNA, 20 bp, Artificial Sequence
  sgRNA
  Olfr368_18
cagcaggctgacgagataga

SEQ ID NO: 41609 - DNA, 20 bp, Artificial Sequence
  sgRNA
  Olfr368_19
gccaatggcagaggaataga

SEQ ID NO: 41610 - DNA, 20 bp, Artificial Sequence
  sgRNA
  Olfr368_20
cggcaaagacaaacatctgg

SEQ ID NO: 41611 - DNA, 20 bp, Artificial Sequence
  sgRNA
  Olfr370_1
gaagggtagacgaaacacca

SEQ ID NO: 41612 - DNA, 20 bp, Artificial Sequence
  sgRNA
  Olfr370_2
catcttgggcacaatgacga

SEQ ID NO: 41613 - DNA, 20 bp, Artificial Sequence
  sgRNA
  Olfr370_3
cacgtatcgatcataaccca

SEQ ID NO: 41614 - DNA, 20 bp, Artificial Sequence
  sgRNA
  Olfr370_4
gctcagagtgaacaaataga

SEQ ID NO: 41615 - DNA, 20 bp, Artificial Sequence
  sgRNA
  Olfr370_5
acatttggatggcgcagccg

SEQ ID NO: 41616 - DNA, 20 bp, Artificial Sequence
  sgRNA
  Olfr370_6
ggaaggaatgagaacagccg

SEQ ID NO: 41617 - DNA, 20 bp, Artificial Sequence
  sgRNA
  Olfr370_7
ataccaggatcaagaagaga

SEQ ID NO: 41618 - DNA, 20 bp, Artificial Sequence
  sgRNA
  Olfr370_8
tgtacctgcccagcgtggaa

SEQ ID NO: 41619 - DNA, 20 bp, Artificial Sequence
  sgRNA
  Olfr370_9
catgggttatgatcgatacg

SEQ ID NO: 41620 - DNA, 20 bp, Artificial Sequence
  sgRNA
  Olfr370_10
cataacccatggctgccagc

SEQ ID NO: 41621 - DNA, 20 bp, Artificial Sequence
  sgRNA
  Olfr370_11
gcaccgtgtagcgcagaggg

SEQ ID NO: 41622 - DNA, 20 bp, Artificial Sequence
  sgRNA
  Olfr370_12
agtgcactatgacaacaatg

SEQ ID NO: 41623 - DNA, 20 bp, Artificial Sequence
  sgRNA
  Olfr370_13
atgagcaccgtgtagcgcag

SEQ ID NO: 41624 - DNA, 20 bp, Artificial Sequence
  sgRNA
  Olfr370_14
cttcaaatcagctcttcata

SEQ ID NO: 41625 - DNA, 20 bp, Artificial Sequence
  sgRNA
  Olfr370_15
gggccttaggtagataaaag

SEQ ID NO: 41626 - DNA, 20 bp, Artificial Sequence
  sgRNA
  Olfr370_16
agttgattggaagagcggaa

SEQ ID NO: 41627 - DNA, 20 bp, Artificial Sequence
  sgRNA
  Olfr370_17
ggtggaaacaattacagcgt

SEQ ID NO: 41628 - DNA, 20 bp, Artificial Sequence
  sgRNA
  Olfr370_18
gtgtgtctgtggcttcactg

SEQ ID NO: 41629 - DNA, 20 bp, Artificial Sequence
  sgRNA
  Olfr370_19
tgagcaccgtgtagcgcaga

SEQ ID NO: 41630 - DNA, 20 bp, Artificial Sequence
  sgRNA
  Olfr370_20
gagggtggtgagatgccaac

SEQ ID NO: 41631 - DNA, 20 bp, Artificial Sequence
  sgRNA
  Olfr38_1
agccaatctgacgacagcaa

SEQ ID NO: 41632 - DNA, 20 bp, Artificial Sequence
  sgRNA
  Olfr38_2
aaggctggtcatcacatcat

SEQ ID NO: 41633 - DNA, 20 bp, Artificial Sequence
  sgRNA
  Olfr38_3
ctcaatcccacccaagccca

SEQ ID NO: 41634 - DNA, 20 bp, Artificial Sequence
  sgRNA
  Olfr38_4
gagagtcccagtcactggaa

SEQ ID NO: 41635 - DNA, 20 bp, Artificial Sequence
  sgRNA
  Olfr38_5
ttgtgcctctcaccttacta

SEQ ID NO: 41636 - DNA, 20 bp, Artificial Sequence
  sgRNA
  Olfr38_6
gagacatcaacttctcctga

SEQ ID NO: 41637 - DNA, 20 bp, Artificial Sequence
  sgRNA
  Olfr38_7
gggcatggcagaaattatta

SEQ ID NO: 41638 - DNA, 20 bp, Artificial Sequence
  sgRNA
  Olfr38_8
tgtggactgtatctttaaga

SEQ ID NO: 41639 - DNA, 20 bp, Artificial Sequence
  sgRNA
  Olfr38_9
ttaaagatacagtccacaga

SEQ ID NO: 41640 - DNA, 20 bp, Artificial Sequence
  sgRNA
  Olfr38_10
aagccaatctgacgacagca

SEQ ID NO: 41641 - DNA, 20 bp, Artificial Sequence
  sgRNA
  Olfr38_11
ttacagcctaaggaataaag

SEQ ID NO: 41642 - DNA, 20 bp, Artificial Sequence
  sgRNA
  Olfr38_12
cttaaagatacagtccacag

SEQ ID NO: 41643 - DNA, 20 bp, Artificial Sequence
  sgRNA
  Olfr38_13
aacccttgctgtcgtcagat

SEQ ID NO: 41644 - DNA, 20 bp, Artificial Sequence
  sgRNA
  Olfr38_14
agatacagtccacagaggga

SEQ ID NO: 41645 - DNA, 20 bp, Artificial Sequence
  sgRNA
  Olfr38_15
aacttctcctgaaggacaga

SEQ ID NO: 41646 - DNA, 20 bp, Artificial Sequence
  sgRNA
  Olfr38_16
ggactgtatctttaagatgg

SEQ ID NO: 41647 - DNA, 20 bp, Artificial Sequence
  sgRNA
  Olfr38_17
acttctcctgaaggacagag

SEQ ID NO: 41648 - DNA, 20 bp, Artificial Sequence
  sgRNA
  Olfr38_18
gtaaatcatggggttcagca

SEQ ID NO: 41649 - DNA, 20 bp, Artificial Sequence
  sgRNA
  Olfr38_19
gtgagaggcacaagtgtgaa

SEQ ID NO: 41650 - DNA, 20 bp, Artificial Sequence
  sgRNA
  Olfr38_20
atatatttatttgtgcacat

SEQ ID NO: 41651 - DNA, 20 bp, Artificial Sequence
  sgRNA
  Olfr39_1
cattaatagactatgaaaca

SEQ ID NO: 41652 - DNA, 20 bp, Artificial Sequence
  sgRNA
  Olfr39_2
taaaaaaatagacttgagtg

SEQ ID NO: 41653 - DNA, 20 bp, Artificial Sequence
  sgRNA
  Olfr39_3
aacacatgtctacaaatgag

SEQ ID NO: 41654 - DNA, 20 bp, Artificial Sequence
  sgRNA
  Olfr39_4
caataatatcgcattatatg

SEQ ID NO: 41655 - DNA, 20 bp, Artificial Sequence
  sgRNA
  Olfr39_5
catcagtcccagctgaactg

SEQ ID NO: 41656 - DNA, 20 bp, Artificial Sequence
  sgRNA
  Olfr39_6
gaccacagtatacatcactg

SEQ ID NO: 41657 - DNA, 20 bp, Artificial Sequence
  sgRNA
  Olfr39_7
gggtttacctcagttcagct

SEQ ID NO: 41658 - DNA, 20 bp, Artificial Sequence
  sgRNA
  Olfr39_8
tgatgactgtgtagtttaag

SEQ ID NO: 41659 - DNA, 20 bp, Artificial Sequence
  sgRNA
  Olfr39_9
gacaggaaacacacataaca

SEQ ID NO: 41660 - DNA, 20 bp, Artificial Sequence
  sgRNA
  Olfr39_10
tcattaatagactatgaaac

SEQ ID NO: 41661 - DNA, 20 bp, Artificial Sequence
  sgRNA
  Olfr39_11
ctacaaatgagaggttggag

SEQ ID NO: 41662 - DNA, 20 bp, Artificial Sequence
  sgRNA
  Olfr39_12
gctgggactgatgtttctca

SEQ ID NO: 41663 - DNA, 20 bp, Artificial Sequence
  sgRNA
  Olfr39_13
atgatgactgtgtagtttaa

SEQ ID NO: 41664 - DNA, 20 bp, Artificial Sequence
  sgRNA
  Olfr39_14
aagaatatcccgaaaagaat

SEQ ID NO: 41665 - DNA, 20 bp, Artificial Sequence
  sgRNA
  Olfr39_15
agcctcagtgatgtatactg

SEQ ID NO: 41666 - DNA, 20 bp, Artificial Sequence
  sgRNA
  Olfr39_16
catctgagagacccagtagc

SEQ ID NO: 41667 - DNA, 20 bp, Artificial Sequence
  sgRNA
  Olfr39_17
ctatcacaattcctgctact

SEQ ID NO: 41668 - DNA, 20 bp, Artificial Sequence
  sgRNA
  Olfr39_18
gcttccttgtgctaatgtgc

SEQ ID NO: 41669 - DNA, 20 bp, Artificial Sequence
  sgRNA
  Olfr39_19
ctgtggatctcacctctgtg

SEQ ID NO: 41670 - DNA, 20 bp, Artificial Sequence
  sgRNA
  Olfr39_20
caaggaagcaacagaagtga

SEQ ID NO: 41671 - DNA, 20 bp, Artificial Sequence
  sgRNA
  Olfr401_1
tgtggatgtcgccacagtgt

SEQ ID NO: 41672 - DNA, 20 bp, Artificial Sequence
  sgRNA
  Olfr401_2
tgtgtgagacaagctccata

SEQ ID NO: 41673 - DNA, 20 bp, Artificial Sequence
  sgRNA
  Olfr401_3
ctgtggtcatgtaagccaag

SEQ ID NO: 41674 - DNA, 20 bp, Artificial Sequence
  sgRNA
  Olfr401_4
attcgggtgctataggtgag

SEQ ID NO: 41675 - DNA, 20 bp, Artificial Sequence
  sgRNA
  Olfr401_5
aagagccgacccaacataga

SEQ ID NO: 41676 - DNA, 20 bp, Artificial Sequence
  sgRNA
  Olfr401_6
gcactgagtttcataatggc

SEQ ID NO: 41677 - DNA, 20 bp, Artificial Sequence
  sgRNA
  Olfr401_7
ccaaaattctctgcactgaa

SEQ ID NO: 41678 - DNA, 20 bp, Artificial Sequence
  sgRNA
  Olfr401_8
gctggcagatggctaggaag

SEQ ID NO: 41679 - DNA, 20 bp, Artificial Sequence
  sgRNA
  Olfr401_9
gggaccacagaagcgaagtg

SEQ ID NO: 41680 - DNA, 20 bp, Artificial Sequence
  sgRNA
  Olfr401_10
gcctgtgagtaccctccaga

SEQ ID NO: 41681 - DNA, 20 bp, Artificial Sequence
  sgRNA
  Olfr401_11
gtagaagttgtcaatcacat

SEQ ID NO: 41682 - DNA, 20 bp, Artificial Sequence
  sgRNA
  Olfr401_12
atatggaactgtaagcctgt

SEQ ID NO: 41683 - DNA, 20 bp, Artificial Sequence
  sgRNA
  Olfr401_13
gcttacatgaccacagttgg

SEQ ID NO: 41684 - DNA, 20 bp, Artificial Sequence
  sgRNA
  Olfr401_14
agctgccacattgatataag

SEQ ID NO: 41685 - DNA, 20 bp, Artificial Sequence
  sgRNA
  Olfr401_15
caatgcactaacccacactg

SEQ ID NO: 41686 - DNA, 20 bp, Artificial Sequence
  sgRNA
  Olfr401_16
cataatggcaggaaccccca

SEQ ID NO: 41687 - DNA, 20 bp, Artificial Sequence
  sgRNA
  Olfr401_17
tcttcctgccttcagcagag

SEQ ID NO: 41688 - DNA, 20 bp, Artificial Sequence
  sgRNA
  Olfr401_18
attgctgaaggaacaagccc

SEQ ID NO: 41689 - DNA, 20 bp, Artificial Sequence
  sgRNA
  Olfr401_19
tctgcactgaatggttcatt

SEQ ID NO: 41690 - DNA, 20 bp, Artificial Sequence
  sgRNA
  Olfr401_20
ctattccctctatgttgggt

SEQ ID NO: 41691 - DNA, 20 bp, Artificial Sequence
  sgRNA
  Olfr402_1
gaatgaactacactatacag

SEQ ID NO: 41692 - DNA, 20 bp, Artificial Sequence
  sgRNA
  Olfr402_2
gaccaagagccgaaccaaca

SEQ ID NO: 41693 - DNA, 20 bp, Artificial Sequence
  sgRNA
  Olfr402_3
ctgttgtcatgtaagccaag

SEQ ID NO: 41694 - DNA, 20 bp, Artificial Sequence
  sgRNA
  Olfr402_4
tgagctgctgctctttggag

SEQ ID NO: 41695 - DNA, 20 bp, Artificial Sequence
  sgRNA
  Olfr402_5
ggagtgggtttcataatggc

SEQ ID NO: 41696 - DNA, 20 bp, Artificial Sequence
  sgRNA
  Olfr402_6
cactatacagaggatcttgg

SEQ ID NO: 41697 - DNA, 20 bp, Artificial Sequence
  sgRNA
  Olfr402_7
cataagccatggctgtcaac

SEQ ID NO: 41698 - DNA, 20 bp, Artificial Sequence
  sgRNA
  Olfr402_8
cataatggcaggaaccccta

SEQ ID NO: 41699 - DNA, 20 bp, Artificial Sequence
  sgRNA
  Olfr402_9
ctgtttcctgttgacagcca

SEQ ID NO: 41700 - DNA, 20 bp, Artificial Sequence
  sgRNA
  Olfr402_10
gtccttatctgaaaatttgg

SEQ ID NO: 41701 - DNA, 20 bp, Artificial Sequence
  sgRNA
  Olfr402_11
attgctaaaggcacaagccc

SEQ ID NO: 41702 - DNA, 20 bp, Artificial Sequence
  sgRNA
  Olfr402_12
gcagaactgcagctgccaca

SEQ ID NO: 41703 - DNA, 20 bp, Artificial Sequence
  sgRNA
  Olfr402_13
gctggcagatggccaggaag

SEQ ID NO: 41704 - DNA, 20 bp, Artificial Sequence
  sgRNA
  Olfr402_14
gttgccatgttctatggcac

SEQ ID NO: 41705 - DNA, 20 bp, Artificial Sequence
  sgRNA
  Olfr402_15
agataaaaatgagtgccata

SEQ ID NO: 41706 - DNA, 20 bp, Artificial Sequence
  sgRNA
  Olfr402_16
gtgtgtcagtgcattgctaa

SEQ ID NO: 41707 - DNA, 20 bp, Artificial Sequence
  sgRNA
  Olfr402_17
ctttggagtgggtttcataa

SEQ ID NO: 41708 - DNA, 20 bp, Artificial Sequence
  sgRNA
  Olfr402_18
caggaagcggtcataagcca

SEQ ID NO: 41709 - DNA, 20 bp, Artificial Sequence
  sgRNA
  Olfr402_19
tgggccacagaagtgaagtg

SEQ ID NO: 41710 - DNA, 20 bp, Artificial Sequence
  sgRNA
  Olfr402_20
ctgtatagtgtagttcattc

SEQ ID NO: 41711 - DNA, 20 bp, Artificial Sequence
  sgRNA
  Olfr403_1
acagctagattgtccttctg

SEQ ID NO: 41712 - DNA, 20 bp, Artificial Sequence
  sgRNA
  Olfr403_2
attagcatttgcaatcaccc

SEQ ID NO: 41713 - DNA, 20 bp, Artificial Sequence
  sgRNA
  Olfr403_3
acatcatcttcacattgaag

SEQ ID NO: 41714 - DNA, 20 bp, Artificial Sequence
  sgRNA
  Olfr403_4
ggcgactgatagccacagct

SEQ ID NO: 41715 - DNA, 20 bp, Artificial Sequence
  sgRNA
  Olfr403_5
tgtggaaaagacccggacat

SEQ ID NO: 41716 - DNA, 20 bp, Artificial Sequence
  sgRNA
  Olfr403_6
gcatcatcatctcctatgtc

SEQ ID NO: 41717 - DNA, 20 bp, Artificial Sequence
  sgRNA
  Olfr403_7
taattgttgcataatgaagc

SEQ ID NO: 41718 - DNA, 20 bp, Artificial Sequence
  sgRNA
  Olfr403_8
tcccaggagagtgaaatcta

SEQ ID NO: 41719 - DNA, 20 bp, Artificial Sequence
  sgRNA
  Olfr403_9
accatagatttcactctcct

SEQ ID NO: 41720 - DNA, 20 bp, Artificial Sequence
  sgRNA
  Olfr403_10
catcatcatctcctatgtcc

SEQ ID NO: 41721 - DNA, 20 bp, Artificial Sequence
  sgRNA
  Olfr403_11
attgtccttctgtggcaata

SEQ ID NO: 41722 - DNA, 20 bp, Artificial Sequence
  sgRNA
  Olfr403_12
taccatagatttcactctcc

SEQ ID NO: 41723 - DNA, 20 bp, Artificial Sequence
  sgRNA
  Olfr409-ps1_1
ggagaaccagaatatgagga

SEQ ID NO: 41724 - DNA, 20 bp, Artificial Sequence
  sgRNA
  Olfr409-ps1_2
ggtacatccacagaaagacc

SEQ ID NO: 41725 - DNA, 20 bp, Artificial Sequence
  sgRNA
  Olfr409-ps1_3
tgatccgggtttcagagcaa

SEQ ID NO: 41726 - DNA, 20 bp, Artificial Sequence
  sgRNA
  Olfr409-ps1_4
ctacgaaacaaagacatgaa

SEQ ID NO: 41727 - DNA, 20 bp, Artificial Sequence
  sgRNA
  Olfr409-ps1_5
gggtggaaatagccacaaag

SEQ ID NO: 41728 - DNA, 20 bp, Artificial Sequence
  sgRNA
  Olfr409-ps1_6
aattgtgtcagccatcttca

SEQ ID NO: 41729 - DNA, 20 bp, Artificial Sequence
  sgRNA
  Olfr409-ps1_7
atacaaggatgagcaaaagg

SEQ ID NO: 41730 - DNA, 20 bp, Artificial Sequence
  sgRNA
  Olfr409-ps1_8
tatgccttccttgggcagaa

SEQ ID NO: 41731 - DNA, 20 bp, Artificial Sequence
  sgRNA
  Olfr409-ps1_9
tgaagacaactgcactcccc

SEQ ID NO: 41732 - DNA, 20 bp, Artificial Sequence
  sgRNA
  Olfr409-ps1_10
atttccaccctctccactac

SEQ ID NO: 41733 - DNA, 20 bp, Artificial Sequence
  sgRNA
  Olfr409-ps1_11
agaaggagaaccagaatatg

SEQ ID NO: 41734 - DNA, 20 bp, Artificial Sequence
  sgRNA
  Olfr409-ps1_12
gttctccttctactctaaga

SEQ ID NO: 41735 - DNA, 20 bp, Artificial Sequence
  sgRNA
  Olfr409-ps1_13
gagcaagggatctttattag

SEQ ID NO: 41736 - DNA, 20 bp, Artificial Sequence
  sgRNA
  Olfr409-ps1_14
agctgctgtcatgtatacag

SEQ ID NO: 41737 - DNA, 20 bp, Artificial Sequence
  sgRNA
  Olfr409-ps1_15
caatttggatataagataca

SEQ ID NO: 41738 - DNA, 20 bp, Artificial Sequence
  sgRNA
  Olfr409-ps1_16
ggtctttctgtggatgtacc

SEQ ID NO: 41739 - DNA, 20 bp, Artificial Sequence
  sgRNA
  Olfr409-ps1_17
agatcccttgctctgaaacc

SEQ ID NO: 41740 - DNA, 20 bp, Artificial Sequence
  sgRNA
  Olfr409-ps1_18
tccacagaaagaccaggaag

SEQ ID NO: 41741 - DNA, 20 bp, Artificial Sequence
  sgRNA
  Olfr409-ps1_19
tcctcttcctggtctttctg

SEQ ID NO: 41742 - DNA, 20 bp, Artificial Sequence
  sgRNA
  Olfr409-ps1_20
ccttcatgtctttgtttcgt

SEQ ID NO: 41743 - DNA, 20 bp, Artificial Sequence
  sgRNA
  Olfr410_1
gaatgaaccacactatccag

SEQ ID NO: 41744 - DNA, 20 bp, Artificial Sequence
  sgRNA
  Olfr410_2
agtcaaccccaactagcaga

SEQ ID NO: 41745 - DNA, 20 bp, Artificial Sequence
  sgRNA
  Olfr410_3
gactaagagccgaaccaaca

SEQ ID NO: 41746 - DNA, 20 bp, Artificial Sequence
  sgRNA
  Olfr410_4
ggggccacagaagtgaagtg

SEQ ID NO: 41747 - DNA, 20 bp, Artificial Sequence
  sgRNA
  Olfr410_5
caggaagcgatcataagcca

SEQ ID NO: 41748 - DNA, 20 bp, Artificial Sequence
  sgRNA
  Olfr410_6
gttccaccaagacagcagcc

SEQ ID NO: 41749 - DNA, 20 bp, Artificial Sequence
  sgRNA
  Olfr410_7
tttcacctcttatatgcatg

SEQ ID NO: 41750 - DNA, 20 bp, Artificial Sequence
  sgRNA
  Olfr410_8
agctgccacatgcatataag

SEQ ID NO: 41751 - DNA, 20 bp, Artificial Sequence
  sgRNA
  Olfr410_9
cactatccagaggatcttgg

SEQ ID NO: 41752 - DNA, 20 bp, Artificial Sequence
  sgRNA
  Olfr410_10
ggagtgggtttcatcatggc

SEQ ID NO: 41753 - DNA, 20 bp, Artificial Sequence
  sgRNA
  Olfr410_11
cttcttccatctgctagttg

SEQ ID NO: 41754 - DNA, 20 bp, Artificial Sequence
  sgRNA
  Olfr410_12
gatgccagcaccatagaata

SEQ ID NO: 41755 - DNA, 20 bp, Artificial Sequence
  sgRNA
  Olfr410_13
ccaagatcctctggatagtg

SEQ ID NO: 41756 - DNA, 20 bp, Artificial Sequence
  sgRNA
  Olfr410_14
gtagaagtgattgatcacat

SEQ ID NO: 41757 - DNA, 20 bp, Artificial Sequence
  sgRNA
  Olfr410_15
catcatggcaggaaccccca

SEQ ID NO: 41758 - DNA, 20 bp, Artificial Sequence
  sgRNA
  Olfr410_16
gagctgttgctctttggagt

SEQ ID NO: 41759 - DNA, 20 bp, Artificial Sequence
  sgRNA
  Olfr410_17
ccccaggaagaagtacatgg

SEQ ID NO: 41760 - DNA, 20 bp, Artificial Sequence
  sgRNA
  Olfr410_18
tctttctgccttcagcagag

SEQ ID NO: 41761 - DNA, 20 bp, Artificial Sequence
  sgRNA
  Olfr410_19
gttgccatattctatggtgc

SEQ ID NO: 41762 - DNA, 20 bp, Artificial Sequence
  sgRNA
  Olfr410_20
cataagcgtacaattccata

SEQ ID NO: 41763 - DNA, 20 bp, Artificial Sequence
  sgRNA
  Olfr412_1
gcgaaatgtatgtcctgctg

SEQ ID NO: 41764 - DNA, 20 bp, Artificial Sequence
  sgRNA
  Olfr412_2
atggctgtagtgtaatggag

SEQ ID NO: 41765 - DNA, 20 bp, Artificial Sequence
  sgRNA
  Olfr412_3
ccaaggctaccaaagacacc

SEQ ID NO: 41766 - DNA, 20 bp, Artificial Sequence
  sgRNA
  Olfr412_4
tgaccagagtaaccttctgt

SEQ ID NO: 41767 - DNA, 20 bp, Artificial Sequence
  sgRNA
  Olfr412_5
gaggaacaaggacatgcacg

SEQ ID NO: 41768 - DNA, 20 bp, Artificial Sequence
  sgRNA
  Olfr412_6
agacccacagaaggttactc

SEQ ID NO: 41769 - DNA, 20 bp, Artificial Sequence
  sgRNA
  Olfr412_7
tggctgtagtgtaatggagg

SEQ ID NO: 41770 - DNA, 20 bp, Artificial Sequence
  sgRNA
  Olfr412_8
acacagtgtcccatagaaga

SEQ ID NO: 41771 - DNA, 20 bp, Artificial Sequence
  sgRNA
  Olfr412_9
gaacctccgagagtcccagg

SEQ ID NO: 41772 - DNA, 20 bp, Artificial Sequence
  sgRNA
  Olfr412_10
aaggaagacgaagcagcccg

SEQ ID NO: 41773 - DNA, 20 bp, Artificial Sequence
  sgRNA
  Olfr412_11
agagggccaccacagccaga

SEQ ID NO: 41774 - DNA, 20 bp, Artificial Sequence
  sgRNA
  Olfr412_12
cctggtgtctttggtagcct

SEQ ID NO: 41775 - DNA, 20 bp, Artificial Sequence
  sgRNA
  Olfr412_13
tggacaggaaggtccagaat

SEQ ID NO: 41776 - DNA, 20 bp, Artificial Sequence
  sgRNA
  Olfr412_14
agccaggatgagattgtcca

SEQ ID NO: 41777 - DNA, 20 bp, Artificial Sequence
  sgRNA
  Olfr412_15
agccactgtgatgtatgcag

SEQ ID NO: 41778 - DNA, 20 bp, Artificial Sequence
  sgRNA
  Olfr412_16
tacacagtgtcccatagaag

SEQ ID NO: 41779 - DNA, 20 bp, Artificial Sequence
  sgRNA
  Olfr412_17
caccactgcatacatcacag

SEQ ID NO: 41780 - DNA, 20 bp, Artificial Sequence
  sgRNA
  Olfr412_18
aggttactctggtcatgagg

SEQ ID NO: 41781 - DNA, 20 bp, Artificial Sequence
  sgRNA
  Olfr412_19
gtccatgtacctggtcacag

SEQ ID NO: 41782 - DNA, 20 bp, Artificial Sequence
  sgRNA
  Olfr412_20
ggtcatatgccattacagcc

SEQ ID NO: 41783 - DNA, 20 bp, Artificial Sequence
  sgRNA
  Olfr414_1
catgagactagggtaacgaa

SEQ ID NO: 41784 - DNA, 20 bp, Artificial Sequence
  sgRNA
  Olfr414_2
gttccttgtctgaacaagtg

SEQ ID NO: 41785 - DNA, 20 bp, Artificial Sequence
  sgRNA
  Olfr414_3
gagtgcctggaagggtcgag

SEQ ID NO: 41786 - DNA, 20 bp, Artificial Sequence
  sgRNA
  Olfr414_4
gacggtagagtctcttatgg

SEQ ID NO: 41787 - DNA, 20 bp, Artificial Sequence
  sgRNA
  Olfr414_5
agatgaccaccactgccagg

SEQ ID NO: 41788 - DNA, 20 bp, Artificial Sequence
  sgRNA
  Olfr414_6
ccaagacaaactcctccacg

SEQ ID NO: 41789 - DNA, 20 bp, Artificial Sequence
  sgRNA
  Olfr414_7
gaatcatgaccagcgccagc

SEQ ID NO: 41790 - DNA, 20 bp, Artificial Sequence
  sgRNA
  Olfr414_8
gggaagatgccaccatccta

SEQ ID NO: 41791 - DNA, 20 bp, Artificial Sequence
  sgRNA
  Olfr414_9
tcgtgcataggtgaagagag

SEQ ID NO: 41792 - DNA, 20 bp, Artificial Sequence
  sgRNA
  Olfr414_10
ccatcattgtagccatcctg

SEQ ID NO: 41793 - DNA, 20 bp, Artificial Sequence
  sgRNA
  Olfr414_11
atgagactagggtaacgaag

SEQ ID NO: 41794 - DNA, 20 bp, Artificial Sequence
  sgRNA
  Olfr414_12
ctactgcttgagaaacaagg

SEQ ID NO: 41795 - DNA, 20 bp, Artificial Sequence
  sgRNA
  Olfr414_13
caggatggctacaatgatgg

SEQ ID NO: 41796 - DNA, 20 bp, Artificial Sequence
  sgRNA
  Olfr414_14
gaaggatgccttcagaaaga

SEQ ID NO: 41797 - DNA, 20 bp, Artificial Sequence
  sgRNA
  Olfr414_15
gcatgagactagggtaacga

SEQ ID NO: 41798 - DNA, 20 bp, Artificial Sequence
  sgRNA
  Olfr414_16
cacttgttcagacaaggaac

SEQ ID NO: 41799 - DNA, 20 bp, Artificial Sequence
  sgRNA
  Olfr414_17
agtagatgaccaccactgcc

SEQ ID NO: 41800 - DNA, 20 bp, Artificial Sequence
  sgRNA
  Olfr414_18
tttccaggttatcctactgt

SEQ ID NO: 41801 - DNA, 20 bp, Artificial Sequence
  sgRNA
  Olfr414_19
ttgaaggtgtacatggctcg

SEQ ID NO: 41802 - DNA, 20 bp, Artificial Sequence
  sgRNA
  Olfr414_20
tctaccgtcctgggtaagaa

SEQ ID NO: 41803 - DNA, 20 bp, Artificial Sequence
  sgRNA
  Olfr417_1
agagccaggtctgtacaagt

SEQ ID NO: 41804 - DNA, 20 bp, Artificial Sequence
  sgRNA
  Olfr417_2
cacagcctgtgactgaaatg

SEQ ID NO: 41805 - DNA, 20 bp, Artificial Sequence
  sgRNA
  Olfr417_3
tcattagaagaggatatctg

SEQ ID NO: 41806 - DNA, 20 bp, Artificial Sequence
  sgRNA
  Olfr417_4
cataccccatcaaagtgaga

SEQ ID NO: 41807 - DNA, 20 bp, Artificial Sequence
  sgRNA
  Olfr417_5
gtatccttctcactttgatg

SEQ ID NO: 41808 - DNA, 20 bp, Artificial Sequence
  sgRNA
  Olfr417_6
ggatcttgaggacagaagaa

SEQ ID NO: 41809 - DNA, 20 bp, Artificial Sequence
  sgRNA
  Olfr417_7
tttgtttaccctcagctgaa

SEQ ID NO: 41810 - DNA, 20 bp, Artificial Sequence
  sgRNA
  Olfr417_8
gagtgaccatatacaggcaa

SEQ ID NO: 41811 - DNA, 20 bp, Artificial Sequence
  sgRNA
  Olfr417_9
ggccatcatgggtttaactt

SEQ ID NO: 41812 - DNA, 20 bp, Artificial Sequence
  sgRNA
  Olfr417_10
acaacttgtggcctctgctt

SEQ ID NO: 41813 - DNA, 20 bp, Artificial Sequence
  sgRNA
  Olfr417_11
gctggtggatctgatagaca

SEQ ID NO: 41814 - DNA, 20 bp, Artificial Sequence
  sgRNA
  Olfr417_12
attagaagaggatatctgag

SEQ ID NO: 41815 - DNA, 20 bp, Artificial Sequence
  sgRNA
  Olfr417_13
ggttgcagatagccagaaat

SEQ ID NO: 41816 - DNA, 20 bp, Artificial Sequence
  sgRNA
  Olfr417_14
ttagaagaggatatctgagg

SEQ ID NO: 41817 - DNA, 20 bp, Artificial Sequence
  sgRNA
  Olfr417_15
atgaagccagaaaactccgg

SEQ ID NO: 41818 - DNA, 20 bp, Artificial Sequence
  sgRNA
  Olfr417_16
gcactgagaaagaagtacat

SEQ ID NO: 41819 - DNA, 20 bp, Artificial Sequence
  sgRNA
  Olfr417_17
agtggatgaggaccacagtg

SEQ ID NO: 41820 - DNA, 20 bp, Artificial Sequence
  sgRNA
  Olfr417_18
caacagatgcaaaaacaaag

SEQ ID NO: 41821 - DNA, 20 bp, Artificial Sequence
  sgRNA
  Olfr417_19
cattagaagaggatatctga

SEQ ID NO: 41822 - DNA, 20 bp, Artificial Sequence
  sgRNA
  Olfr417_20
tgtacagacctggctctttg

SEQ ID NO: 41823 - DNA, 20 bp, Artificial Sequence
  sgRNA
  Olfr419_1
acggctggcataatgaagtg

SEQ ID NO: 41824 - DNA, 20 bp, Artificial Sequence
  sgRNA
  Olfr419_2
acacattgggaatcatccca

SEQ ID NO: 41825 - DNA, 20 bp, Artificial Sequence
  sgRNA
  Olfr419_3
aaggtatccactcaggaagg

SEQ ID NO: 41826 - DNA, 20 bp, Artificial Sequence
  sgRNA
  Olfr419_4
ccacaggcgaggcttagcac

SEQ ID NO: 41827 - DNA, 20 bp, Artificial Sequence
  sgRNA
  Olfr419_5
ttgtgcctcacacctcacag

SEQ ID NO: 41828 - DNA, 20 bp, Artificial Sequence
  sgRNA
  Olfr419_6
gccttgtatccccacaggcg

SEQ ID NO: 41829 - DNA, 20 bp, Artificial Sequence
  sgRNA
  Olfr419_7
gctctgagaaatgctttccg

SEQ ID NO: 41830 - DNA, 20 bp, Artificial Sequence
  sgRNA
  Olfr419_8
agccagctactctcttgaga

SEQ ID NO: 41831 - DNA, 20 bp, Artificial Sequence
  sgRNA
  Olfr419_9
gggtctcaagtacatgaagg

SEQ ID NO: 41832 - DNA, 20 bp, Artificial Sequence
  sgRNA
  Olfr419_10
tattgctgtcacctacactg

SEQ ID NO: 41833 - DNA, 20 bp, Artificial Sequence
  sgRNA
  Olfr419_11
gagtcattcccagtccaaaa

SEQ ID NO: 41834 - DNA, 20 bp, Artificial Sequence
  sgRNA
  Olfr419_12
acagtggtcgtgattcacta

SEQ ID NO: 41835 - DNA, 20 bp, Artificial Sequence
  sgRNA
  Olfr419_13
ctctgagaaatgctttccgg

SEQ ID NO: 41836 - DNA, 20 bp, Artificial Sequence
  sgRNA
  Olfr419_14
actgtctgtgcccagctagt

SEQ ID NO: 41837 - DNA, 20 bp, Artificial Sequence
  sgRNA
  Olfr419_15
agtgaatcacgaccactgtg

SEQ ID NO: 41838 - DNA, 20 bp, Artificial Sequence
  sgRNA
  Olfr419_16
ctgagaatcccttctgccga

SEQ ID NO: 41839 - DNA, 20 bp, Artificial Sequence
  sgRNA
  Olfr419_17
ctctctggcctggttatggg

SEQ ID NO: 41840 - DNA, 20 bp, Artificial Sequence
  sgRNA
  Olfr419_18
taaacaataggattgaggag

SEQ ID NO: 41841 - DNA, 20 bp, Artificial Sequence
  sgRNA
  Olfr419_19
caaatcccatgacagacagg

SEQ ID NO: 41842 - DNA, 20 bp, Artificial Sequence
  sgRNA
  Olfr419_20
ttctccgtccctcggcagaa

SEQ ID NO: 41843 - DNA, 20 bp, Artificial Sequence
  sgRNA
  Olfr420_1
ctagcctgcttagtgaacga

SEQ ID NO: 41844 - DNA, 20 bp, Artificial Sequence
  sgRNA
  Olfr420_2
ccgtaattatctccacagca

SEQ ID NO: 41845 - DNA, 20 bp, Artificial Sequence
  sgRNA
  Olfr420_3
tggagatccaggcaatctca

SEQ ID NO: 41846 - DNA, 20 bp, Artificial Sequence
  sgRNA
  Olfr420_4
ggaccactgtgatgataacc

SEQ ID NO: 41847 - DNA, 20 bp, Artificial Sequence
  sgRNA
  Olfr420_5
acgtggaaaatgctttacgg

SEQ ID NO: 41848 - DNA, 20 bp, Artificial Sequence
  sgRNA
  Olfr420_6
gccacagacacagcaaccga

SEQ ID NO: 41849 - DNA, 20 bp, Artificial Sequence
  sgRNA
  Olfr420_7
agtaaggtgcgagacgcacg

SEQ ID NO: 41850 - DNA, 20 bp, Artificial Sequence
  sgRNA
  Olfr420_8
ctgtgtgcccagctgaccct

SEQ ID NO: 41851 - DNA, 20 bp, Artificial Sequence
  sgRNA
  Olfr420_9
tacggcggccttcagctgaa

SEQ ID NO: 41852 - DNA, 20 bp, Artificial Sequence
  sgRNA
  Olfr420_10
taccacctgaatcatgacga

SEQ ID NO: 41853 - DNA, 20 bp, Artificial Sequence
  sgRNA
  Olfr420_11
gaagccataaaaaagcacat

SEQ ID NO: 41854 - DNA, 20 bp, Artificial Sequence
  sgRNA
  Olfr420_12
gaacctggttatcatcacag

SEQ ID NO: 41855 - DNA, 20 bp, Artificial Sequence
  sgRNA
  Olfr420_13
tagatgatgggattgaagaa

SEQ ID NO: 41856 - DNA, 20 bp, Artificial Sequence
  sgRNA
  Olfr420_14
cagaatctccccaggagcaa

SEQ ID NO: 41857 - DNA, 20 bp, Artificial Sequence
  sgRNA
  Olfr420_15
tgatggtaggataatgaaga

SEQ ID NO: 41858 - DNA, 20 bp, Artificial Sequence
  sgRNA
  Olfr420_16
ggtcaagctggcatcttaat

SEQ ID NO: 41859 - DNA, 20 bp, Artificial Sequence
  sgRNA
  Olfr420_17
aggtgattagagccacaaaa

SEQ ID NO: 41860 - DNA, 20 bp, Artificial Sequence
  sgRNA
  Olfr420_18
gatccaggcaatctcaggga

SEQ ID NO: 41861 - DNA, 20 bp, Artificial Sequence
  sgRNA
  Olfr420_19
tctatgctttcattatcgtt

SEQ ID NO: 41862 - DNA, 20 bp, Artificial Sequence
  sgRNA
  Olfr420_20
aactgcaaaggccagagcaa

SEQ ID NO: 41863 - DNA, 20 bp, Artificial Sequence
  sgRNA
  Olfr424_1
atcttcaaccagaatcatgg

SEQ ID NO: 41864 - DNA, 20 bp, Artificial Sequence
  sgRNA
  Olfr424_2
acccaactatcatgactccc

SEQ ID NO: 41865 - DNA, 20 bp, Artificial Sequence
  sgRNA
  Olfr424_3
aaacttccatcttcaaactg

SEQ ID NO: 41866 - DNA, 20 bp, Artificial Sequence
  sgRNA
  Olfr424_4
caggcatccaatcaaagaga

SEQ ID NO: 41867 - DNA, 20 bp, Artificial Sequence
  sgRNA
  Olfr424_5
tgagaaacgcagatacatga

SEQ ID NO: 41868 - DNA, 20 bp, Artificial Sequence
  sgRNA
  Olfr424_6
gtaccggagaggattacaga

SEQ ID NO: 41869 - DNA, 20 bp, Artificial Sequence
  sgRNA
  Olfr424_7
aagtagagaaagccttccga

SEQ ID NO: 41870 - DNA, 20 bp, Artificial Sequence
  sgRNA
  Olfr424_8
gcaatagctgtgtctaaaat

SEQ ID NO: 41871 - DNA, 20 bp, Artificial Sequence
  sgRNA
  Olfr424_9
gtacatgccaaacgcaacac

SEQ ID NO: 41872 - DNA, 20 bp, Artificial Sequence
  sgRNA
  Olfr424_10
gagaggtgagcacagagccg

SEQ ID NO: 41873 - DNA, 20 bp, Artificial Sequence
  sgRNA
  Olfr424_11
tagatgatagggttgaaaaa

SEQ ID NO: 41874 - DNA, 20 bp, Artificial Sequence
  sgRNA
  Olfr424_12
tagctgtgtctaaaattggt

SEQ ID NO: 41875 - DNA, 20 bp, Artificial Sequence
  sgRNA
  Olfr424_13
ggatttccccagtttgaaga

SEQ ID NO: 41876 - DNA, 20 bp, Artificial Sequence
  sgRNA
  Olfr424_14
atttggttggggccacagaa

SEQ ID NO: 41877 - DNA, 20 bp, Artificial Sequence
  sgRNA
  Olfr424_15
agatctgatgaatttggttg

SEQ ID NO: 41878 - DNA, 20 bp, Artificial Sequence
  sgRNA
  Olfr424_16
tgaagatgtggttcatgcag

SEQ ID NO: 41879 - DNA, 20 bp, Artificial Sequence
  sgRNA
  Olfr424_17
ggtgtcttcttgatgttcta

SEQ ID NO: 41880 - DNA, 20 bp, Artificial Sequence
  sgRNA
  Olfr424_18
cattcacttggaaattcaga

SEQ ID NO: 41881 - DNA, 20 bp, Artificial Sequence
  sgRNA
  Olfr424_19
tgttgcttccagagattgct

SEQ ID NO: 41882 - DNA, 20 bp, Artificial Sequence
  sgRNA
  Olfr424_20
acatcaagaagacaccaaga

SEQ ID NO: 41883 - DNA, 20 bp, Artificial Sequence
  sgRNA
  Olfr429_1
aatcttgatacaaagtgact

SEQ ID NO: 41884 - DNA, 20 bp, Artificial Sequence
  sgRNA
  Olfr429_2
gtacaagccaaactcagcac

SEQ ID NO: 41885 - DNA, 20 bp, Artificial Sequence
  sgRNA
  Olfr429_3
gatgctgacaaatctgtaca

SEQ ID NO: 41886 - DNA, 20 bp, Artificial Sequence
  sgRNA
  Olfr429_4
acaggtaaatctggacacct

SEQ ID NO: 41887 - DNA, 20 bp, Artificial Sequence
  sgRNA
  Olfr429_5
ccttgactacgaccgagcct

SEQ ID NO: 41888 - DNA, 20 bp, Artificial Sequence
  sgRNA
  Olfr429_6
agtagactactgccaaggct

SEQ ID NO: 41889 - DNA, 20 bp, Artificial Sequence
  sgRNA
  Olfr429_7
atgctgacaaatctgtacat

SEQ ID NO: 41890 - DNA, 20 bp, Artificial Sequence
  sgRNA
  Olfr429_8
tctggacaccttggaagtga

SEQ ID NO: 41891 - DNA, 20 bp, Artificial Sequence
  sgRNA
  Olfr429_9
caaggctcggtcgtagtcaa

SEQ ID NO: 41892 - DNA, 20 bp, Artificial Sequence
  sgRNA
  Olfr429_10
gcgcaacaaggaaatcaagg

SEQ ID NO: 41893 - DNA, 20 bp, Artificial Sequence
  sgRNA
  Olfr429_11
ttgcgcaagctataaatgaa

SEQ ID NO: 41894 - DNA, 20 bp, Artificial Sequence
  sgRNA
  Olfr429_12
catatgccattgctgtcagg

SEQ ID NO: 41895 - DNA, 20 bp, Artificial Sequence
  sgRNA
  Olfr429_13
tgtgtagcccagctccaaga

SEQ ID NO: 41896 - DNA, 20 bp, Artificial Sequence
  sgRNA
  Olfr429_14
gccagtggtggaaatttcct

SEQ ID NO: 41897 - DNA, 20 bp, Artificial Sequence
  sgRNA
  Olfr429_15
tgacagcaatggcatatgac

SEQ ID NO: 41898 - DNA, 20 bp, Artificial Sequence
  sgRNA
  Olfr429_16
ctttgtatcaagattgccat

SEQ ID NO: 41899 - DNA, 20 bp, Artificial Sequence
  sgRNA
  Olfr429_17
ttatctgcaagtaggagctg

SEQ ID NO: 41900 - DNA, 20 bp, Artificial Sequence
  sgRNA
  Olfr429_18
gattgccattggttgctggt

SEQ ID NO: 41901 - DNA, 20 bp, Artificial Sequence
  sgRNA
  Olfr429_19
tgcgcaagctataaatgaag

SEQ ID NO: 41902 - DNA, 20 bp, Artificial Sequence
  sgRNA
  Olfr429_20
gtgtgcctcccatctcactg

SEQ ID NO: 41903 - DNA, 20 bp, Artificial Sequence
  sgRNA
  Olfr43_1
acagctagactgtccttctg

SEQ ID NO: 41904 - DNA, 20 bp, Artificial Sequence
  sgRNA
  Olfr43_2
taattgttgcataatgaagt

SEQ ID NO: 41905 - DNA, 20 bp, Artificial Sequence
  sgRNA
  Olfr43_3
gatgtacttcatgataggct

SEQ ID NO: 41906 - DNA, 20 bp, Artificial Sequence
  sgRNA
  Olfr43_4
catgttcccaaacactgtga

SEQ ID NO: 41907 - DNA, 20 bp, Artificial Sequence
  sgRNA
  Olfr43_5
gcacagatgtacttcatgat

SEQ ID NO: 41908 - DNA, 20 bp, Artificial Sequence
  sgRNA
  Olfr43_6
gcatcatcatctcctacgtc

SEQ ID NO: 41909 - DNA, 20 bp, Artificial Sequence
  sgRNA
  Olfr43_7
tgtggaaaagacccggacgt

SEQ ID NO: 41910 - DNA, 20 bp, Artificial Sequence
  sgRNA
  Olfr43_8
aggacagtctagctgtgagt

SEQ ID NO: 41911 - DNA, 20 bp, Artificial Sequence
  sgRNA
  Olfr43_9
catcatcatctcctacgtcc

SEQ ID NO: 41912 - DNA, 20 bp, Artificial Sequence
  sgRNA
  Olfr43_10
ggacagtctagctgtgagta

SEQ ID NO: 41913 - DNA, 20 bp, Artificial Sequence
  sgRNA
  Olfr43_11
gtctagctgtgagtagggtg

SEQ ID NO: 41914 - DNA, 20 bp, Artificial Sequence
  sgRNA
  Olfr43_12
actgtccttctgtggcaata

SEQ ID NO: 41915 - DNA, 20 bp, Artificial Sequence
  sgRNA
  Olfr430_1
gtgctgtggtcataattgaa

SEQ ID NO: 41916 - DNA, 20 bp, Artificial Sequence
  sgRNA
  Olfr430_2
catcttcctagtcatacgac

SEQ ID NO: 41917 - DNA, 20 bp, Artificial Sequence
  sgRNA
  Olfr430_3
tctcattatagttacagaag

SEQ ID NO: 41918 - DNA, 20 bp, Artificial Sequence
  sgRNA
  Olfr430_4
attagctagcatcttaggga

SEQ ID NO: 41919 - DNA, 20 bp, Artificial Sequence
  sgRNA
  Olfr430_5
agtagactacggctagagtg

SEQ ID NO: 41920 - DNA, 20 bp, Artificial Sequence
  sgRNA
  Olfr430_6
gtagcattcagaggccccaa

SEQ ID NO: 41921 - DNA, 20 bp, Artificial Sequence
  sgRNA
  Olfr430_7
tgttagcacagagtagacta

SEQ ID NO: 41922 - DNA, 20 bp, Artificial Sequence
  sgRNA
  Olfr430_8
aactcattcaggccatcaag

SEQ ID NO: 41923 - DNA, 20 bp, Artificial Sequence
  sgRNA
  Olfr430_9
ttatcatggcctcttatggg

SEQ ID NO: 41924 - DNA, 20 bp, Artificial Sequence
  sgRNA
  Olfr430_10
atctcattatagttacagaa

SEQ ID NO: 41925 - DNA, 20 bp, Artificial Sequence
  sgRNA
  Olfr430_11
acactgacaaagtggtacat

SEQ ID NO: 41926 - DNA, 20 bp, Artificial Sequence
  sgRNA
  Olfr430_12
agaagatgagcaccacaatg

SEQ ID NO: 41927 - DNA, 20 bp, Artificial Sequence
  sgRNA
  Olfr430_13
cataattgaagggtagtgga

SEQ ID NO: 41928 - DNA, 20 bp, Artificial Sequence
  sgRNA
  Olfr430_14
cataggccatggctgtaaga

SEQ ID NO: 41929 - DNA, 20 bp, Artificial Sequence
  sgRNA
  Olfr430_15
gtatacctgttcaccattgg

SEQ ID NO: 41930 - DNA, 20 bp, Artificial Sequence
  sgRNA
  Olfr430_16
gtggtacatgggtttgtgga

SEQ ID NO: 41931 - DNA, 20 bp, Artificial Sequence
  sgRNA
  Olfr430_17
ttgcaggccaggctcaaaag

SEQ ID NO: 41932 - DNA, 20 bp, Artificial Sequence
  sgRNA
  Olfr430_18
gatggccaggtatcgatcat

SEQ ID NO: 41933 - DNA, 20 bp, Artificial Sequence
  sgRNA
  Olfr430_19
tcataattgaagggtagtgg

SEQ ID NO: 41934 - DNA, 20 bp, Artificial Sequence
  sgRNA
  Olfr430_20
aagactatagataatgggat

SEQ ID NO: 41935 - DNA, 20 bp, Artificial Sequence
  sgRNA
  Olfr434_1
ggtcataggacatcacaaca

SEQ ID NO: 41936 - DNA, 20 bp, Artificial Sequence
  sgRNA
  Olfr434_2
tctatactctcaccatactg

SEQ ID NO: 41937 - DNA, 20 bp, Artificial Sequence
  sgRNA
  Olfr434_3
ctgtgtcatgcatccagcaa

SEQ ID NO: 41938 - DNA, 20 bp, Artificial Sequence
  sgRNA
  Olfr434_4
ccatatcgacaatggccagg

SEQ ID NO: 41939 - DNA, 20 bp, Artificial Sequence
  sgRNA
  Olfr434_5
tttgcacagtgacctcttga

SEQ ID NO: 41940 - DNA, 20 bp, Artificial Sequence
  sgRNA
  Olfr434_6
agactagtacaaagcatagg

SEQ ID NO: 41941 - DNA, 20 bp, Artificial Sequence
  sgRNA
  Olfr434_7
aggagactagtacaaagcat

SEQ ID NO: 41942 - DNA, 20 bp, Artificial Sequence
  sgRNA
  Olfr434_8
gcctcaggatgagaactaaa

SEQ ID NO: 41943 - DNA, 20 bp, Artificial Sequence
  sgRNA
  Olfr434_9
ggtggcagatagctacatac

SEQ ID NO: 41944 - DNA, 20 bp, Artificial Sequence
  sgRNA
  Olfr434_10
ctacagtctgaggaatgctg

SEQ ID NO: 41945 - DNA, 20 bp, Artificial Sequence
  sgRNA
  Olfr434_11
ttgttgtgatgtcctatgac

SEQ ID NO: 41946 - DNA, 20 bp, Artificial Sequence
  sgRNA
  Olfr434_12
gagactagtacaaagcatag

SEQ ID NO: 41947 - DNA, 20 bp, Artificial Sequence
  sgRNA
  Olfr434_13
gcacccagaggagcagcaga

SEQ ID NO: 41948 - DNA, 20 bp, Artificial Sequence
  sgRNA
  Olfr434_14
gactagtacaaagcataggg

SEQ ID NO: 41949 - DNA, 20 bp, Artificial Sequence
  sgRNA
  Olfr434_15
gtccgaacaccacaccaacc

SEQ ID NO: 41950 - DNA, 20 bp, Artificial Sequence
  sgRNA
  Olfr434_16
gtagattagggggttcagca

SEQ ID NO: 41951 - DNA, 20 bp, Artificial Sequence
  sgRNA
  Olfr434_17
tccatttagttctcatcctg

SEQ ID NO: 41952 - DNA, 20 bp, Artificial Sequence
  sgRNA
  Olfr434_18
ggatcctcaggatggccacc

SEQ ID NO: 41953 - DNA, 20 bp, Artificial Sequence
  sgRNA
  Olfr434_19
aaggagcacacattcagtgt

SEQ ID NO: 41954 - DNA, 20 bp, Artificial Sequence
  sgRNA
  Olfr434_20
tgctgacacaacactcaatc

SEQ ID NO: 41955 - DNA, 20 bp, Artificial Sequence
  sgRNA
  Olfr435_1
gctctaggcagattagccca

SEQ ID NO: 41956 - DNA, 20 bp, Artificial Sequence
  sgRNA
  Olfr435_2
cataggacatcaccacaagg

SEQ ID NO: 41957 - DNA, 20 bp, Artificial Sequence
  sgRNA
  Olfr435_3
tgggcttggtctcatccaag

SEQ ID NO: 41958 - DNA, 20 bp, Artificial Sequence
  sgRNA
  Olfr435_4
caacagtggccaaattggag

SEQ ID NO: 41959 - DNA, 20 bp, Artificial Sequence
  sgRNA
  Olfr435_5
attgcacagtgacctcctaa

SEQ ID NO: 41960 - DNA, 20 bp, Artificial Sequence
  sgRNA
  Olfr435_6
ggaccaaatggaccagagca

SEQ ID NO: 41961 - DNA, 20 bp, Artificial Sequence
  sgRNA
  Olfr435_7
ctctaggcagattagcccaa

SEQ ID NO: 41962 - DNA, 20 bp, Artificial Sequence
  sgRNA
  Olfr435_8
ccccactaaggcaaacacac

SEQ ID NO: 41963 - DNA, 20 bp, Artificial Sequence
  sgRNA
  Olfr435_9
gatcataggacatcaccaca

SEQ ID NO: 41964 - DNA, 20 bp, Artificial Sequence
  sgRNA
  Olfr435_10
gctacatctttacattgtta

SEQ ID NO: 41965 - DNA, 20 bp, Artificial Sequence
  sgRNA
  Olfr435_11
gcatcctggtgactatcctg

SEQ ID NO: 41966 - DNA, 20 bp, Artificial Sequence
  sgRNA
  Olfr435_12
tctccttgctctggtccatt

SEQ ID NO: 41967 - DNA, 20 bp, Artificial Sequence
  sgRNA
  Olfr435_13
ggatcctcaggatagtcacc

SEQ ID NO: 41968 - DNA, 20 bp, Artificial Sequence
  sgRNA
  Olfr435_14
gggggctatgtacatgacaa

SEQ ID NO: 41969 - DNA, 20 bp, Artificial Sequence
  sgRNA
  Olfr435_15
tagggaatgggtttaccctt

SEQ ID NO: 41970 - DNA, 20 bp, Artificial Sequence
  sgRNA
  Olfr435_16
ggatcttctgcagctcttca

SEQ ID NO: 41971 - DNA, 20 bp, Artificial Sequence
  sgRNA
  Olfr435_17
ctgaggtcaagggtgccctt

SEQ ID NO: 41972 - DNA, 20 bp, Artificial Sequence
  sgRNA
  Olfr435_18
ggctaatctgcctagagccc

SEQ ID NO: 41973 - DNA, 20 bp, Artificial Sequence
  sgRNA
  Olfr435_19
cctgtgtgtttgccttagtg

SEQ ID NO: 41974 - DNA, 20 bp, Artificial Sequence
  sgRNA
  Olfr435_20
tgctcccaaatgtcaaaaat

SEQ ID NO: 41975 - DNA, 20 bp, Artificial Sequence
  sgRNA
  Olfr437_1
caaaatcaagcactccgaag

SEQ ID NO: 41976 - DNA, 20 bp, Artificial Sequence
  sgRNA
  Olfr437_2
atgtggatttagcctctctg

SEQ ID NO: 41977 - DNA, 20 bp, Artificial Sequence
  sgRNA
  Olfr437_3
agacgaaaacacatgcagct

SEQ ID NO: 41978 - DNA, 20 bp, Artificial Sequence
  sgRNA
  Olfr437_4
gatgcatggggcaaatgaga

SEQ ID NO: 41979 - DNA, 20 bp, Artificial Sequence
  sgRNA
  Olfr437_5
ggtcacagacttcatcctcg

SEQ ID NO: 41980 - DNA, 20 bp, Artificial Sequence
  sgRNA
  Olfr437_6
gtggaaggcttccttcacct

SEQ ID NO: 41981 - DNA, 20 bp, Artificial Sequence
  sgRNA
  Olfr437_7
ccctgactctgatcagcgag

SEQ ID NO: 41982 - DNA, 20 bp, Artificial Sequence
  sgRNA
  Olfr437_8
tgaccaagatgtgacagcca

SEQ ID NO: 41983 - DNA, 20 bp, Artificial Sequence
  sgRNA
  Olfr437_9
gatacaagcattgagcaaag

SEQ ID NO: 41984 - DNA, 20 bp, Artificial Sequence
  sgRNA
  Olfr437_10
agattattccatttgcgagc

SEQ ID NO: 41985 - DNA, 20 bp, Artificial Sequence
  sgRNA
  Olfr437_11
cctctcgctgatcagagtca

SEQ ID NO: 41986 - DNA, 20 bp, Artificial Sequence
  sgRNA
  Olfr437_12
caggctgaagatgtacagca

SEQ ID NO: 41987 - DNA, 20 bp, Artificial Sequence
  sgRNA
  Olfr437_13
gaattgtgtgtgccacagag

SEQ ID NO: 41988 - DNA, 20 bp, Artificial Sequence
  sgRNA
  Olfr437_14
gtatttggcctttgccgctt

SEQ ID NO: 41989 - DNA, 20 bp, Artificial Sequence
  sgRNA
  Olfr437_15
ataaggttggacaacatctt

SEQ ID NO: 41990 - DNA, 20 bp, Artificial Sequence
  sgRNA
  Olfr437_16
gtgggactccagctcagcgc

SEQ ID NO: 41991 - DNA, 20 bp, Artificial Sequence
  sgRNA
  Olfr437_17
ctatagtctgaggaacaccc

SEQ ID NO: 41992 - DNA, 20 bp, Artificial Sequence
  sgRNA
  Olfr437_18
cgctgagctggagtcccacg

SEQ ID NO: 41993 - DNA, 20 bp, Artificial Sequence
  sgRNA
  Olfr437_19
acattgggttaaagagactg

SEQ ID NO: 41994 - DNA, 20 bp, Artificial Sequence
  sgRNA
  Olfr437_20
tcttcttctgcagtgctctg

SEQ ID NO: 41995 - DNA, 20 bp, Artificial Sequence
  sgRNA
  Olfr441_1
tatacatggaatgaaggaga

SEQ ID NO: 41996 - DNA, 20 bp, Artificial Sequence
  sgRNA
  Olfr441_2
atgatgacagtgtagtgaag

SEQ ID NO: 41997 - DNA, 20 bp, Artificial Sequence
  sgRNA
  Olfr441_3
ttaaatggacaagagccaaa

SEQ ID NO: 41998 - DNA, 20 bp, Artificial Sequence
  sgRNA
  Olfr441_4
agaggaaacactccacagct

SEQ ID NO: 41999 - DNA, 20 bp, Artificial Sequence
  sgRNA
  Olfr441_5
gagaccagcaccatgcacag

SEQ ID NO: 42000 - DNA, 20 bp, Artificial Sequence
  sgRNA
  Olfr441_6
catcctgagaatccagtcag

SEQ ID NO: 42001 - DNA, 20 bp, Artificial Sequence
  sgRNA
  Olfr441_7
gatggcaacaaacctatcat

SEQ ID NO: 42002 - DNA, 20 bp, Artificial Sequence
  sgRNA
  Olfr441_8
caatcagacatggatcacag

SEQ ID NO: 42003 - DNA, 20 bp, Artificial Sequence
  sgRNA
  Olfr441_9
gctgctgtctcctggatagt

SEQ ID NO: 42004 - DNA, 20 bp, Artificial Sequence
  sgRNA
  Olfr441_10
ccatcctgagaatccagtca

SEQ ID NO: 42005 - DNA, 20 bp, Artificial Sequence
  sgRNA
  Olfr441_11
gcctcaggatgagaattaaa

SEQ ID NO: 42006 - DNA, 20 bp, Artificial Sequence
  sgRNA
  Olfr441_12
caggcactctatggaagcaa

SEQ ID NO: 42007 - DNA, 20 bp, Artificial Sequence
  sgRNA
  Olfr441_13
tgacagtgtagtgaaggggg

SEQ ID NO: 42008 - DNA, 20 bp, Artificial Sequence
  sgRNA
  Olfr441_14
attgaaaaggctataaaaca

SEQ ID NO: 42009 - DNA, 20 bp, Artificial Sequence
  sgRNA
  Olfr441_15
actttatgaggcccacagaa

SEQ ID NO: 42010 - DNA, 20 bp, Artificial Sequence
  sgRNA
  Olfr441_16
ccctgactggattctcagga

SEQ ID NO: 42011 - DNA, 20 bp, Artificial Sequence
  sgRNA
  Olfr441_17
gggaccactgtgcatggtgc

SEQ ID NO: 42012 - DNA, 20 bp, Artificial Sequence
  sgRNA
  Olfr441_18
ggattctcaggatggccacc

SEQ ID NO: 42013 - DNA, 20 bp, Artificial Sequence
  sgRNA
  Olfr441_19
ctgagaatccagtcagggga

SEQ ID NO: 42014 - DNA, 20 bp, Artificial Sequence
  sgRNA
  Olfr441_20
ggttcaacataggattgaaa

SEQ ID NO: 42015 - DNA, 20 bp, Artificial Sequence
  sgRNA
  Olfr444_1
agaggaaacactccacactc

SEQ ID NO: 42016 - DNA, 20 bp, Artificial Sequence
  sgRNA
  Olfr444_2
tgatgacagtatagtgaagg

SEQ ID NO: 42017 - DNA, 20 bp, Artificial Sequence
  sgRNA
  Olfr444_3
tgtccaggcagattactaca

SEQ ID NO: 42018 - DNA, 20 bp, Artificial Sequence
  sgRNA
  Olfr444_4
tatgcacagaatgaaggaga

SEQ ID NO: 42019 - DNA, 20 bp, Artificial Sequence
  sgRNA
  Olfr444_5
cttccacagtgatctccgga

SEQ ID NO: 42020 - DNA, 20 bp, Artificial Sequence
  sgRNA
  Olfr444_6
gcgccctccggagatcactg

SEQ ID NO: 42021 - DNA, 20 bp, Artificial Sequence
  sgRNA
  Olfr444_7
ccttccacagtgatctccgg

SEQ ID NO: 42022 - DNA, 20 bp, Artificial Sequence
  sgRNA
  Olfr444_8
ccccactaagatgaacacac

SEQ ID NO: 42023 - DNA, 20 bp, Artificial Sequence
  sgRNA
  Olfr444_9
cctgtgtgttcatcttagtg

SEQ ID NO: 42024 - DNA, 20 bp, Artificial Sequence
  sgRNA
  Olfr444_10
ctatccaggagacagctgcc

SEQ ID NO: 42025 - DNA, 20 bp, Artificial Sequence
  sgRNA
  Olfr444_11
ccaaatgaaccagagccaaa

SEQ ID NO: 42026 - DNA, 20 bp, Artificial Sequence
  sgRNA
  Olfr444_12
attccaagcagacctgagtg

SEQ ID NO: 42027 - DNA, 20 bp, Artificial Sequence
  sgRNA
  Olfr444_13
ggagactagcactaagcaca

SEQ ID NO: 42028 - DNA, 20 bp, Artificial Sequence
  sgRNA
  Olfr444_14
gagactagcactaagcacag

SEQ ID NO: 42029 - DNA, 20 bp, Artificial Sequence
  sgRNA
  Olfr444_15
atcacagaggtaactctgct

SEQ ID NO: 42030 - DNA, 20 bp, Artificial Sequence
  sgRNA
  Olfr444_16
acagagagaaaagcccaaag

SEQ ID NO: 42031 - DNA, 20 bp, Artificial Sequence
  sgRNA
  Olfr444_17
ggatcctcaggatggtcacc

SEQ ID NO: 42032 - DNA, 20 bp, Artificial Sequence
  sgRNA
  Olfr444_18
ctgaggtcaagggcgccctc

SEQ ID NO: 42033 - DNA, 20 bp, Artificial Sequence
  sgRNA
  Olfr444_19
catgatgacagtatagtgaa

SEQ ID NO: 42034 - DNA, 20 bp, Artificial Sequence
  sgRNA
  Olfr444_20
gcctgtgtgttcatcttagt

SEQ ID NO: 42035 - DNA, 20 bp, Artificial Sequence
  sgRNA
  Olfr446_1
aatgagcgtgatatggagtg

SEQ ID NO: 42036 - DNA, 20 bp, Artificial Sequence
  sgRNA
  Olfr446_2
aatacacactgatcatgagc

SEQ ID NO: 42037 - DNA, 20 bp, Artificial Sequence
  sgRNA
  Olfr446_3
catatttgtcagcatcttag

SEQ ID NO: 42038 - DNA, 20 bp, Artificial Sequence
  sgRNA
  Olfr446_4
acaggagcatctccagagag

SEQ ID NO: 42039 - DNA, 20 bp, Artificial Sequence
  sgRNA
  Olfr446_5
tgatatggagtgaggccaag

SEQ ID NO: 42040 - DNA, 20 bp, Artificial Sequence
  sgRNA
  Olfr446_6
ggagactaacaccaagcaca

SEQ ID NO: 42041 - DNA, 20 bp, Artificial Sequence
  sgRNA
  Olfr446_7
gagactaacaccaagcacag

SEQ ID NO: 42042 - DNA, 20 bp, Artificial Sequence
  sgRNA
  Olfr446_8
ggattccgagaatggccacc

SEQ ID NO: 42043 - DNA, 20 bp, Artificial Sequence
  sgRNA
  Olfr446_9
ctcggaatccactcagggga

SEQ ID NO: 42044 - DNA, 20 bp, Artificial Sequence
  sgRNA
  Olfr446_10
ccattctcggaatccactca

SEQ ID NO: 42045 - DNA, 20 bp, Artificial Sequence
  sgRNA
  Olfr446_11
acatgatttgacagaaaaaa

SEQ ID NO: 42046 - DNA, 20 bp, Artificial Sequence
  sgRNA
  Olfr446_12
acacccagcaagtagcagcc

SEQ ID NO: 42047 - DNA, 20 bp, Artificial Sequence
  sgRNA
  Olfr446_13
aaaagagcccaaccacacag

SEQ ID NO: 42048 - DNA, 20 bp, Artificial Sequence
  sgRNA
  Olfr446_14
ctgttcttcccacctctgtg

SEQ ID NO: 42049 - DNA, 20 bp, Artificial Sequence
  sgRNA
  Olfr446_15
ctgtgctatcgccatgtaca

SEQ ID NO: 42050 - DNA, 20 bp, Artificial Sequence
  sgRNA
  Olfr446_16
tctctgttcttgggaatgct

SEQ ID NO: 42051 - DNA, 20 bp, Artificial Sequence
  sgRNA
  Olfr446_17
gtgccttgagacgagttctt

SEQ ID NO: 42052 - DNA, 20 bp, Artificial Sequence
  sgRNA
  Olfr446_18
ctcctatacacgaatcctgg

SEQ ID NO: 42053 - DNA, 20 bp, Artificial Sequence
  sgRNA
  Olfr446_19
aggagactaacaccaagcac

SEQ ID NO: 42054 - DNA, 20 bp, Artificial Sequence
  sgRNA
  Olfr446_20
gagcccaaccacacagaggt

SEQ ID NO: 42055 - DNA, 20 bp, Artificial Sequence
  sgRNA
  Olfr447_1
caacaatactagatggacca

SEQ ID NO: 42056 - DNA, 20 bp, Artificial Sequence
  sgRNA
  Olfr447_2
cacggaatgtctcctactgg

SEQ ID NO: 42057 - DNA, 20 bp, Artificial Sequence
  sgRNA
  Olfr447_3
ttggcttggctggatccatg

SEQ ID NO: 42058 - DNA, 20 bp, Artificial Sequence
  sgRNA
  Olfr447_4
atgatagcagtatatcggag

SEQ ID NO: 42059 - DNA, 20 bp, Artificial Sequence
  sgRNA
  Olfr447_5
cataggacatcaccaccagt

SEQ ID NO: 42060 - DNA, 20 bp, Artificial Sequence
  sgRNA
  Olfr447_6
tgtacattgggcctcaacac

SEQ ID NO: 42061 - DNA, 20 bp, Artificial Sequence
  sgRNA
  Olfr447_7
ttgttaccattacccttctg

SEQ ID NO: 42062 - DNA, 20 bp, Artificial Sequence
  sgRNA
  Olfr447_8
ggttgagcataggattaaaa

SEQ ID NO: 42063 - DNA, 20 bp, Artificial Sequence
  sgRNA
  Olfr447_9
gatggtcccatttcccagca

SEQ ID NO: 42064 - DNA, 20 bp, Artificial Sequence
  sgRNA
  Olfr447_10
gcagggtgaaggcatagaac

SEQ ID NO: 42065 - DNA, 20 bp, Artificial Sequence
  sgRNA
  Olfr447_11
tgaagattaagtcacagcag

SEQ ID NO: 42066 - DNA, 20 bp, Artificial Sequence
  sgRNA
  Olfr447_12
ggatggtcccatttcccagc

SEQ ID NO: 42067 - DNA, 20 bp, Artificial Sequence
  sgRNA
  Olfr447_13
gccaagccaatctctttcgc

SEQ ID NO: 42068 - DNA, 20 bp, Artificial Sequence
  sgRNA
  Olfr447_14
agctcatgatagcagtatat

SEQ ID NO: 42069 - DNA, 20 bp, Artificial Sequence
  sgRNA
  Olfr447_15
gaagaggacactcttaaagg

SEQ ID NO: 42070 - DNA, 20 bp, Artificial Sequence
  sgRNA
  Olfr447_16
gcataggattaaaaaggcta

SEQ ID NO: 42071 - DNA, 20 bp, Artificial Sequence
  sgRNA
  Olfr447_17
agtccaggcagataagtccc

SEQ ID NO: 42072 - DNA, 20 bp, Artificial Sequence
  sgRNA
  Olfr447_18
aggcccaatgtacatgacaa

SEQ ID NO: 42073 - DNA, 20 bp, Artificial Sequence
  sgRNA
  Olfr447_19
acacacggaatgtctcctac

SEQ ID NO: 42074 - DNA, 20 bp, Artificial Sequence
  sgRNA
  Olfr447_20
ccagatgctggtaaacctca

SEQ ID NO: 42075 - DNA, 20 bp, Artificial Sequence
  sgRNA
  Olfr448_1
cggatgcagatgctcctctg

SEQ ID NO: 42076 - DNA, 20 bp, Artificial Sequence
  sgRNA
  Olfr448_2
ttgtaagggttggcagatgg

SEQ ID NO: 42077 - DNA, 20 bp, Artificial Sequence
  sgRNA
  Olfr448_3
agcatatgaaatatcgacga

SEQ ID NO: 42078 - DNA, 20 bp, Artificial Sequence
  sgRNA
  Olfr448_4
aaatgtctgcattatacatg

SEQ ID NO: 42079 - DNA, 20 bp, Artificial Sequence
  sgRNA
  Olfr448_5
gcctcaggataagaacaacg

SEQ ID NO: 42080 - DNA, 20 bp, Artificial Sequence
  sgRNA
  Olfr448_6
gctgaggaggaatccctgca

SEQ ID NO: 42081 - DNA, 20 bp, Artificial Sequence
  sgRNA
  Olfr448_7
atgatgacagagtattgtaa

SEQ ID NO: 42082 - DNA, 20 bp, Artificial Sequence
  sgRNA
  Olfr448_8
gataagaacaacgtggacca

SEQ ID NO: 42083 - DNA, 20 bp, Artificial Sequence
  sgRNA
  Olfr448_9
tccacgttgttcttatcctg

SEQ ID NO: 42084 - DNA, 20 bp, Artificial Sequence
  sgRNA
  Olfr448_10
gtattgtaagggttggcaga

SEQ ID NO: 42085 - DNA, 20 bp, Artificial Sequence
  sgRNA
  Olfr448_11
gcagagtgaaagtatagagc

SEQ ID NO: 42086 - DNA, 20 bp, Artificial Sequence
  sgRNA
  Olfr448_12
agggattcctcctcagcccg

SEQ ID NO: 42087 - DNA, 20 bp, Artificial Sequence
  sgRNA
  Olfr448_13
gcacccagaaactcagcaga

SEQ ID NO: 42088 - DNA, 20 bp, Artificial Sequence
  sgRNA
  Olfr448_14
ggttctgtatttatcttagt

SEQ ID NO: 42089 - DNA, 20 bp, Artificial Sequence
  sgRNA
  Olfr448_15
tggtgatgatgtcctatgat

SEQ ID NO: 42090 - DNA, 20 bp, Artificial Sequence
  sgRNA
  Olfr448_16
tggggaacggagtcattctg

SEQ ID NO: 42091 - DNA, 20 bp, Artificial Sequence
  sgRNA
  Olfr448_17
gatggcggcataccgatcat

SEQ ID NO: 42092 - DNA, 20 bp, Artificial Sequence
  sgRNA
  Olfr448_18
gaaaccagcacaaagcacag

SEQ ID NO: 42093 - DNA, 20 bp, Artificial Sequence
  sgRNA
  Olfr448_19
catcctgaagatccagtcag

SEQ ID NO: 42094 - DNA, 20 bp, Artificial Sequence
  sgRNA
  Olfr448_20
gcagggagaagaggccacag

SEQ ID NO: 42095 - DNA, 20 bp, Artificial Sequence
  sgRNA
  Olfr449_1
aagtacataggcttgtgtag

SEQ ID NO: 42096 - DNA, 20 bp, Artificial Sequence
  sgRNA
  Olfr449_2
tggtggggtagtgtaatggg

SEQ ID NO: 42097 - DNA, 20 bp, Artificial Sequence
  sgRNA
  Olfr449_3
tgacccaggaaccaagagct

SEQ ID NO: 42098 - DNA, 20 bp, Artificial Sequence
  sgRNA
  Olfr449_4
tataggccacaagaaacatc

SEQ ID NO: 42099 - DNA, 20 bp, Artificial Sequence
  sgRNA
  Olfr449_5
agaagatggtaaccaccacg

SEQ ID NO: 42100 - DNA, 20 bp, Artificial Sequence
  sgRNA
  Olfr449_6
acataggcttgtgtagtggt

SEQ ID NO: 42101 - DNA, 20 bp, Artificial Sequence
  sgRNA
  Olfr449_7
actgtgttacgcatgccaac

SEQ ID NO: 42102 - DNA, 20 bp, Artificial Sequence
  sgRNA
  Olfr449_8
tgttggcatgcgtaacacag

SEQ ID NO: 42103 - DNA, 20 bp, Artificial Sequence
  sgRNA
  Olfr449_9
tgtgcaggagagattaagaa

SEQ ID NO: 42104 - DNA, 20 bp, Artificial Sequence
  sgRNA
  Olfr449_10
ggtctccaagaaagacaggt

SEQ ID NO: 42105 - DNA, 20 bp, Artificial Sequence
  sgRNA
  Olfr449_11
ttattgcctaaggaaccgag

SEQ ID NO: 42106 - DNA, 20 bp, Artificial Sequence
  sgRNA
  Olfr449_12
tcgggcatacataaaaatag

SEQ ID NO: 42107 - DNA, 20 bp, Artificial Sequence
  sgRNA
  Olfr449_13
gatgccaaagccaatgaccc

SEQ ID NO: 42108 - DNA, 20 bp, Artificial Sequence
  sgRNA
  Olfr449_14
gtcggttctgttgcaccagt

SEQ ID NO: 42109 - DNA, 20 bp, Artificial Sequence
  sgRNA
  Olfr449_15
aatagtggctgagtagaaga

SEQ ID NO: 42110 - DNA, 20 bp, Artificial Sequence
  sgRNA
  Olfr449_16
gctgaacagcagcttgggca

SEQ ID NO: 42111 - DNA, 20 bp, Artificial Sequence
  sgRNA
  Olfr449_17
attgagagcaggggtcacaa

SEQ ID NO: 42112 - DNA, 20 bp, Artificial Sequence
  sgRNA
  Olfr449_18
gtgcaggagagattaagaac

SEQ ID NO: 42113 - DNA, 20 bp, Artificial Sequence
  sgRNA
  Olfr449_19
cattggggccacagaagctg

SEQ ID NO: 42114 - DNA, 20 bp, Artificial Sequence
  sgRNA
  Olfr449_20
cagtgattgacagcggaaag

SEQ ID NO: 42115 - DNA, 20 bp, Artificial Sequence
  sgRNA
  Olfr452_1
atatacttatttgtgcacat

SEQ ID NO: 42116 - DNA, 20 bp, Artificial Sequence
  sgRNA
  Olfr452_2
attggatgaaatgtccacac

SEQ ID NO: 42117 - DNA, 20 bp, Artificial Sequence
  sgRNA
  Olfr452_3
caaggctggtcatcacatcg

SEQ ID NO: 42118 - DNA, 20 bp, Artificial Sequence
  sgRNA
  Olfr452_4
ctcgatcccacccaagccca

SEQ ID NO: 42119 - DNA, 20 bp, Artificial Sequence
  sgRNA
  Olfr452_5
actgtggtaacattatgcta

SEQ ID NO: 42120 - DNA, 20 bp, Artificial Sequence
  sgRNA
  Olfr452_6
aaatgtccacacaggccaat

SEQ ID NO: 42121 - DNA, 20 bp, Artificial Sequence
  sgRNA
  Olfr452_7
aattctagctgtggtccgat

SEQ ID NO: 42122 - DNA, 20 bp, Artificial Sequence
  sgRNA
  Olfr452_8
ctgaaaatccagtctacaga

SEQ ID NO: 42123 - DNA, 20 bp, Artificial Sequence
  sgRNA
  Olfr452_9
catcaatacagcataaaaaa

SEQ ID NO: 42124 - DNA, 20 bp, Artificial Sequence
  sgRNA
  Olfr452_10
acttctcttgaaggactgag

SEQ ID NO: 42125 - DNA, 20 bp, Artificial Sequence
  sgRNA
  Olfr452_11
gcatcaatacagcataaaaa

SEQ ID NO: 42126 - DNA, 20 bp, Artificial Sequence
  sgRNA
  Olfr452_12
tctgaaaatccagtctacag

SEQ ID NO: 42127 - DNA, 20 bp, Artificial Sequence
  sgRNA
  Olfr452_13
gaccacagctagaatttcac

SEQ ID NO: 42128 - DNA, 20 bp, Artificial Sequence
  sgRNA
  Olfr452_14
ggtggagatgatttgaatgt

SEQ ID NO: 42129 - DNA, 20 bp, Artificial Sequence
  sgRNA
  Olfr452_15
attcagtcatcatgcataca

SEQ ID NO: 42130 - DNA, 20 bp, Artificial Sequence
  sgRNA
  Olfr452_16
aaccatgatcacaatctcat

SEQ ID NO: 42131 - DNA, 20 bp, Artificial Sequence
  sgRNA
  Olfr452_17
agcataatgttaccacagtg

SEQ ID NO: 42132 - DNA, 20 bp, Artificial Sequence
  sgRNA
  Olfr452_18
ttatagtctaaggaataagg

SEQ ID NO: 42133 - DNA, 20 bp, Artificial Sequence
  sgRNA
  Olfr452_19
ttccttagactataaatcat

SEQ ID NO: 42134 - DNA, 20 bp, Artificial Sequence
  sgRNA
  Olfr452_20
cttggcctttccaatgactg

SEQ ID NO: 42135 - DNA, 20 bp, Artificial Sequence
  sgRNA
  Olfr453_1
tagtcctgtatgcattatgg

SEQ ID NO: 42136 - DNA, 20 bp, Artificial Sequence
  sgRNA
  Olfr453_2
tgtacttggtgacagtattg

SEQ ID NO: 42137 - DNA, 20 bp, Artificial Sequence
  sgRNA
  Olfr453_3
tggcataagacacatccacc

SEQ ID NO: 42138 - DNA, 20 bp, Artificial Sequence
  sgRNA
  Olfr453_4
cgttcgtgcacatgggcagt

SEQ ID NO: 42139 - DNA, 20 bp, Artificial Sequence
  sgRNA
  Olfr453_5
attatggcggagtatctcag

SEQ ID NO: 42140 - DNA, 20 bp, Artificial Sequence
  sgRNA
  Olfr453_6
atgtacacgttcgtgcacat

SEQ ID NO: 42141 - DNA, 20 bp, Artificial Sequence
  sgRNA
  Olfr453_7
gattgcacactgccacataa

SEQ ID NO: 42142 - DNA, 20 bp, Artificial Sequence
  sgRNA
  Olfr453_8
gatagcaacttcattggcag

SEQ ID NO: 42143 - DNA, 20 bp, Artificial Sequence
  sgRNA
  Olfr453_9
tgatctggatgtaggatagg

SEQ ID NO: 42144 - DNA, 20 bp, Artificial Sequence
  sgRNA
  Olfr453_10
cataggccatcattgctaat

SEQ ID NO: 42145 - DNA, 20 bp, Artificial Sequence
  sgRNA
  Olfr453_11
gcccagagagaaaaataact

SEQ ID NO: 42146 - DNA, 20 bp, Artificial Sequence
  sgRNA
  Olfr453_12
ggcataagacacatccacca

SEQ ID NO: 42147 - DNA, 20 bp, Artificial Sequence
  sgRNA
  Olfr453_13
ccaagtacatcagcaagaac

SEQ ID NO: 42148 - DNA, 20 bp, Artificial Sequence
  sgRNA
  Olfr453_14
tttcttagactgtaaatcat

SEQ ID NO: 42149 - DNA, 20 bp, Artificial Sequence
  sgRNA
  Olfr453_15
gcgagctgcttgctgtggtg

SEQ ID NO: 42150 - DNA, 20 bp, Artificial Sequence
  sgRNA
  Olfr453_16
cctcaaaatccagtccaaag

SEQ ID NO: 42151 - DNA, 20 bp, Artificial Sequence
  sgRNA
  Olfr453_17
agtcatcaggagaatgatgc

SEQ ID NO: 42152 - DNA, 20 bp, Artificial Sequence
  sgRNA
  Olfr453_18
gcatagtcctgtatgcatta

SEQ ID NO: 42153 - DNA, 20 bp, Artificial Sequence
  sgRNA
  Olfr453_19
tacaggactatgcagtagga

SEQ ID NO: 42154 - DNA, 20 bp, Artificial Sequence
  sgRNA
  Olfr453_20
atacatgaatttatcctcct

SEQ ID NO: 42155 - DNA, 20 bp, Artificial Sequence
  sgRNA
  Olfr459_1
ataatttgagcaattggccc

SEQ ID NO: 42156 - DNA, 20 bp, Artificial Sequence
  sgRNA
  Olfr459_2
gaacaattgtagttgtaacc

SEQ ID NO: 42157 - DNA, 20 bp, Artificial Sequence
  sgRNA
  Olfr459_3
agtgtagctcttgggatcca

SEQ ID NO: 42158 - DNA, 20 bp, Artificial Sequence
  sgRNA
  Olfr459_4
tgaccacccagatgcaagtg

SEQ ID NO: 42159 - DNA, 20 bp, Artificial Sequence
  sgRNA
  Olfr459_5
tgtgaaacctaagcaaacac

SEQ ID NO: 42160 - DNA, 20 bp, Artificial Sequence
  sgRNA
  Olfr459_6
agaagcccccaaagcatcaa

SEQ ID NO: 42161 - DNA, 20 bp, Artificial Sequence
  sgRNA
  Olfr459_7
tggtccctagagcgaggtaa

SEQ ID NO: 42162 - DNA, 20 bp, Artificial Sequence
  sgRNA
  Olfr459_8
gagatattgtctgctttcca

SEQ ID NO: 42163 - DNA, 20 bp, Artificial Sequence
  sgRNA
  Olfr459_9
ggcagcagagtacaacagag

SEQ ID NO: 42164 - DNA, 20 bp, Artificial Sequence
  sgRNA
  Olfr459_10
tcgaaatgataaagtcaaag

SEQ ID NO: 42165 - DNA, 20 bp, Artificial Sequence
  sgRNA
  Olfr459_11
cagccgcacttgcatctggg

SEQ ID NO: 42166 - DNA, 20 bp, Artificial Sequence
  sgRNA
  Olfr459_12
atgatgacgctatacctcaa

SEQ ID NO: 42167 - DNA, 20 bp, Artificial Sequence
  sgRNA
  Olfr459_13
gcgtgaccacagaaaccagc

SEQ ID NO: 42168 - DNA, 20 bp, Artificial Sequence
  sgRNA
  Olfr459_14
tcttccggccagaagctgag

SEQ ID NO: 42169 - DNA, 20 bp, Artificial Sequence
  sgRNA
  Olfr459_15
agactggccagatttcagaa

SEQ ID NO: 42170 - DNA, 20 bp, Artificial Sequence
  sgRNA
  Olfr459_16
ggtggagatgatataggtgt

SEQ ID NO: 42171 - DNA, 20 bp, Artificial Sequence
  sgRNA
  Olfr459_17
tcttcctttacctcgctcta

SEQ ID NO: 42172 - DNA, 20 bp, Artificial Sequence
  sgRNA
  Olfr459_18
gaggatggtggagatgatat

SEQ ID NO: 42173 - DNA, 20 bp, Artificial Sequence
  sgRNA
  Olfr459_19
aagcagacaatatctctgaa

SEQ ID NO: 42174 - DNA, 20 bp, Artificial Sequence
  sgRNA
  Olfr459_20
gattacagacagccacataa

SEQ ID NO: 42175 - DNA, 20 bp, Artificial Sequence
  sgRNA
  Olfr460_1
tccaagcaaagaaaactccg

SEQ ID NO: 42176 - DNA, 20 bp, Artificial Sequence
  sgRNA
  Olfr460_2
taactactgcaaatcaaatg

SEQ ID NO: 42177 - DNA, 20 bp, Artificial Sequence
  sgRNA
  Olfr460_3
tgcaaagtatatctttggct

SEQ ID NO: 42178 - DNA, 20 bp, Artificial Sequence
  sgRNA
  Olfr460_4
tagcaaaaaggatgtggcgt

SEQ ID NO: 42179 - DNA, 20 bp, Artificial Sequence
  sgRNA
  Olfr460_5
gacagctacataacgatcca

SEQ ID NO: 42180 - DNA, 20 bp, Artificial Sequence
  sgRNA
  Olfr460_6
gcgtttcactccatcccgaa

SEQ ID NO: 42181 - DNA, 20 bp, Artificial Sequence
  sgRNA
  Olfr460_7
ggcagccgactacaataggg

SEQ ID NO: 42182 - DNA, 20 bp, Artificial Sequence
  sgRNA
  Olfr460_8
acctgcgtcgtcattggcta

SEQ ID NO: 42183 - DNA, 20 bp, Artificial Sequence
  sgRNA
  Olfr460_9
acaaagtcatagaagccctt

SEQ ID NO: 42184 - DNA, 20 bp, Artificial Sequence
  sgRNA
  Olfr460_10
gcacaataacagttgtaacc

SEQ ID NO: 42185 - DNA, 20 bp, Artificial Sequence
  sgRNA
  Olfr460_11
ataatttgagcaactggcct

SEQ ID NO: 42186 - DNA, 20 bp, Artificial Sequence
  sgRNA
  Olfr460_12
tgtgaaacccaagcagaccc

SEQ ID NO: 42187 - DNA, 20 bp, Artificial Sequence
  sgRNA
  Olfr460_13
gcaacttgctctggggacca

SEQ ID NO: 42188 - DNA, 20 bp, Artificial Sequence
  sgRNA
  Olfr460_14
agcgtttcactccatcccga

SEQ ID NO: 42189 - DNA, 20 bp, Artificial Sequence
  sgRNA
  Olfr460_15
aagatatactttgcattcca

SEQ ID NO: 42190 - DNA, 20 bp, Artificial Sequence
  sgRNA
  Olfr460_16
tttgcttggagcaatggccg

SEQ ID NO: 42191 - DNA, 20 bp, Artificial Sequence
  sgRNA
  Olfr460_17
gccgtagccaatgacgacgc

SEQ ID NO: 42192 - DNA, 20 bp, Artificial Sequence
  sgRNA
  Olfr460_18
tgatgacactgtacctcaaa

SEQ ID NO: 42193 - DNA, 20 bp, Artificial Sequence
  sgRNA
  Olfr460_19
ggtggcaatgatgtaggtgt

SEQ ID NO: 42194 - DNA, 20 bp, Artificial Sequence
  sgRNA
  Olfr460_20
gaggatggtggcaatgatgt

SEQ ID NO: 42195 - DNA, 20 bp, Artificial Sequence
  sgRNA
  Olfr462_1
aggcaagtctcagcacttgg

SEQ ID NO: 42196 - DNA, 20 bp, Artificial Sequence
  sgRNA
  Olfr462_2
tcaacactgtgtagtactgg

SEQ ID NO: 42197 - DNA, 20 bp, Artificial Sequence
  sgRNA
  Olfr462_3
cactgacaggaagaagacca

SEQ ID NO: 42198 - DNA, 20 bp, Artificial Sequence
  sgRNA
  Olfr462_4
agatggtcttcttctcagag

SEQ ID NO: 42199 - DNA, 20 bp, Artificial Sequence
  sgRNA
  Olfr462_5
ggcagtatccatcagccaca

SEQ ID NO: 42200 - DNA, 20 bp, Artificial Sequence
  sgRNA
  Olfr462_6
aggcagcactgaagagacta

SEQ ID NO: 42201 - DNA, 20 bp, Artificial Sequence
  sgRNA
  Olfr462_7
agacctgtgccatgcagcct

SEQ ID NO: 42202 - DNA, 20 bp, Artificial Sequence
  sgRNA
  Olfr462_8
gatggcctatgaccgcctgg

SEQ ID NO: 42203 - DNA, 20 bp, Artificial Sequence
  sgRNA
  Olfr462_9
gatggatactgccttgtcca

SEQ ID NO: 42204 - DNA, 20 bp, Artificial Sequence
  sgRNA
  Olfr462_10
catgcagcctcggtaggaga

SEQ ID NO: 42205 - DNA, 20 bp, Artificial Sequence
  sgRNA
  Olfr462_11
acagtgttgagtgttcatga

SEQ ID NO: 42206 - DNA, 20 bp, Artificial Sequence
  sgRNA
  Olfr462_12
gccgggagatagccaccagg

SEQ ID NO: 42207 - DNA, 20 bp, Artificial Sequence
  sgRNA
  Olfr462_13
aagaagaccatctcctaccg

SEQ ID NO: 42208 - DNA, 20 bp, Artificial Sequence
  sgRNA
  Olfr462_14
actgccttgtccatggtgaa

SEQ ID NO: 42209 - DNA, 20 bp, Artificial Sequence
  sgRNA
  Olfr462_15
ttggggccacagaatggcaa

SEQ ID NO: 42210 - DNA, 20 bp, Artificial Sequence
  sgRNA
  Olfr462_16
agaccgtgactatgatgagg

SEQ ID NO: 42211 - DNA, 20 bp, Artificial Sequence
  sgRNA
  Olfr462_17
cccagatctctgagaagccc

SEQ ID NO: 42212 - DNA, 20 bp, Artificial Sequence
  sgRNA
  Olfr462_18
ggtcataggccatcactgac

SEQ ID NO: 42213 - DNA, 20 bp, Artificial Sequence
  sgRNA
  Olfr462_19
ctaccgaggctgcatggcac

SEQ ID NO: 42214 - DNA, 20 bp, Artificial Sequence
  sgRNA
  Olfr462_20
gacacccatgtacggttccc

SEQ ID NO: 42215 - DNA, 20 bp, Artificial Sequence
  sgRNA
  Olfr463_1
tgaacagccagctttgtatg

SEQ ID NO: 42216 - DNA, 20 bp, Artificial Sequence
  sgRNA
  Olfr463_2
ggtcataagccattactgag

SEQ ID NO: 42217 - DNA, 20 bp, Artificial Sequence
  sgRNA
  Olfr463_3
aagaagactatctcctaccg

SEQ ID NO: 42218 - DNA, 20 bp, Artificial Sequence
  sgRNA
  Olfr463_4
aaaccgtaactatgatgagg

SEQ ID NO: 42219 - DNA, 20 bp, Artificial Sequence
  sgRNA
  Olfr463_5
agatctgtaccatgcagcct

SEQ ID NO: 42220 - DNA, 20 bp, Artificial Sequence
  sgRNA
  Olfr463_6
aatggcttatgaccgcctgg

SEQ ID NO: 42221 - DNA, 20 bp, Artificial Sequence
  sgRNA
  Olfr463_7
gtcgggaaatagccaccagg

SEQ ID NO: 42222 - DNA, 20 bp, Artificial Sequence
  sgRNA
  Olfr463_8
ttgggtccacagaacggcaa

SEQ ID NO: 42223 - DNA, 20 bp, Artificial Sequence
  sgRNA
  Olfr463_9
agtaatggcttatgaccgcc

SEQ ID NO: 42224 - DNA, 20 bp, Artificial Sequence
  sgRNA
  Olfr463_10
ggctgtgtccatcagccata

SEQ ID NO: 42225 - DNA, 20 bp, Artificial Sequence
  sgRNA
  Olfr463_11
ccaccagccccatacaaagc

SEQ ID NO: 42226 - DNA, 20 bp, Artificial Sequence
  sgRNA
  Olfr463_12
aggacattgggtccacagaa

SEQ ID NO: 42227 - DNA, 20 bp, Artificial Sequence
  sgRNA
  Olfr463_13
tactgagaggaagaagacca

SEQ ID NO: 42228 - DNA, 20 bp, Artificial Sequence
  sgRNA
  Olfr463_14
gatggacacagccttgtcca

SEQ ID NO: 42229 - DNA, 20 bp, Artificial Sequence
  sgRNA
  Olfr463_15
aagcaagtctcagtacttgg

SEQ ID NO: 42230 - DNA, 20 bp, Artificial Sequence
  sgRNA
  Olfr463_16
tgtcagagtttgtcttcctg

SEQ ID NO: 42231 - DNA, 20 bp, Artificial Sequence
  sgRNA
  Olfr463_17
gcgctttgctagtctcttca

SEQ ID NO: 42232 - DNA, 20 bp, Artificial Sequence
  sgRNA
  Olfr463_18
gcaagcaagtctcagtactt

SEQ ID NO: 42233 - DNA, 20 bp, Artificial Sequence
  sgRNA
  Olfr463_19
aaacctcctcatcatagtta

SEQ ID NO: 42234 - DNA, 20 bp, Artificial Sequence
  sgRNA
  Olfr463_20
acagccttgtccatggtgaa

SEQ ID NO: 42235 - DNA, 20 bp, Artificial Sequence
  sgRNA
  Olfr464_1
tgaacaccaagctgtgcgtg

SEQ ID NO: 42236 - DNA, 20 bp, Artificial Sequence
  sgRNA
  Olfr464_2
aaggatatttcccaccacag

SEQ ID NO: 42237 - DNA, 20 bp, Artificial Sequence
  sgRNA
  Olfr464_3
ggtcataggccatcacggag

SEQ ID NO: 42238 - DNA, 20 bp, Artificial Sequence
  sgRNA
  Olfr464_4
actaagaccatctcgtacca

SEQ ID NO: 42239 - DNA, 20 bp, Artificial Sequence
  sgRNA
  Olfr464_5
ggccgtgtccatcagctaca

SEQ ID NO: 42240 - DNA, 20 bp, Artificial Sequence
  sgRNA
  Olfr464_6
agtgcgacctcagcatcacc

SEQ ID NO: 42241 - DNA, 20 bp, Artificial Sequence
  sgRNA
  Olfr464_7
catgcagccctggtacgaga

SEQ ID NO: 42242 - DNA, 20 bp, Artificial Sequence
  sgRNA
  Olfr464_8
atggacacggccttgtccaa

SEQ ID NO: 42243 - DNA, 20 bp, Artificial Sequence
  sgRNA
  Olfr464_9
ctggagtagatatagatgca

SEQ ID NO: 42244 - DNA, 20 bp, Artificial Sequence
  sgRNA
  Olfr464_10
tttcgaagcagaaaatacat

SEQ ID NO: 42245 - DNA, 20 bp, Artificial Sequence
  sgRNA
  Olfr464_11
gtctacatcaccactgtggt

SEQ ID NO: 42246 - DNA, 20 bp, Artificial Sequence
  sgRNA
  Olfr464_12
ggccttgtccaagggaaagg

SEQ ID NO: 42247 - DNA, 20 bp, Artificial Sequence
  sgRNA
  Olfr464_13
gtgtgtctacatcaccactg

SEQ ID NO: 42248 - DNA, 20 bp, Artificial Sequence
  sgRNA
  Olfr464_14
tctggagtagatatagatgc

SEQ ID NO: 42249 - DNA, 20 bp, Artificial Sequence
  sgRNA
  Olfr464_15
gacacccatgtgatgttctg

SEQ ID NO: 42250 - DNA, 20 bp, Artificial Sequence
  sgRNA
  Olfr464_16
gctgggagatggctatgtag

SEQ ID NO: 42251 - DNA, 20 bp, Artificial Sequence
  sgRNA
  Olfr464_17
gaccgtgtagctgatggaca

SEQ ID NO: 42252 - DNA, 20 bp, Artificial Sequence
  sgRNA
  Olfr464_18
tgatgctgaggtcgcactca

SEQ ID NO: 42253 - DNA, 20 bp, Artificial Sequence
  sgRNA
  Olfr464_19
catgaacaccaagctgtgcg

SEQ ID NO: 42254 - DNA, 20 bp, Artificial Sequence
  sgRNA
  Olfr464_20
atgaacaccaagctgtgcgt

SEQ ID NO: 42255 - DNA, 20 bp, Artificial Sequence
  sgRNA
  Olfr465-ps1_1
ataaatcacaggattcaggc

SEQ ID NO: 42256 - DNA, 20 bp, Artificial Sequence
  sgRNA
  Olfr465-ps1_2
agtttcccactagtgctccc

SEQ ID NO: 42257 - DNA, 20 bp, Artificial Sequence
  sgRNA
  Olfr465-ps1_3
atttacctgggagcactagt

SEQ ID NO: 42258 - DNA, 20 bp, Artificial Sequence
  sgRNA
  Olfr465-ps1_4
ggctcagtggatgtgtctat

SEQ ID NO: 42259 - DNA, 20 bp, Artificial Sequence
  sgRNA
  Olfr465-ps1_5
aagcaagtctaagaagtgat

SEQ ID NO: 42260 - DNA, 20 bp, Artificial Sequence
  sgRNA
  Olfr465-ps1_6
attatggcctcatagtgtag

SEQ ID NO: 42261 - DNA, 20 bp, Artificial Sequence
  sgRNA
  Olfr465-ps1_7
aatataacagatatcaatca

SEQ ID NO: 42262 - DNA, 20 bp, Artificial Sequence
  sgRNA
  Olfr465-ps1_8
ctacatttggaccacagaaa

SEQ ID NO: 42263 - DNA, 20 bp, Artificial Sequence
  sgRNA
  Olfr465-ps1_9
ataaggtcaccacagtaaga

SEQ ID NO: 42264 - DNA, 20 bp, Artificial Sequence
  sgRNA
  Olfr465-ps1_10
atcacaggattcaggctggg

SEQ ID NO: 42265 - DNA, 20 bp, Artificial Sequence
  sgRNA
  Olfr465-ps1_11
aaggtcaccacagtaagatg

SEQ ID NO: 42266 - DNA, 20 bp, Artificial Sequence
  sgRNA
  Olfr465-ps1_12
ctgtataccccatcttactg

SEQ ID NO: 42267 - DNA, 20 bp, Artificial Sequence
  sgRNA
  Olfr465-ps1_13
atgctggtctatagtagtaa

SEQ ID NO: 42268 - DNA, 20 bp, Artificial Sequence
  sgRNA
  Olfr465-ps1_14
ataggacatcaccaaaagca

SEQ ID NO: 42269 - DNA, 20 bp, Artificial Sequence
  sgRNA
  Olfr465-ps1_15
gtaaatcaagaagaaaagtg

SEQ ID NO: 42270 - DNA, 20 bp, Artificial Sequence
  sgRNA
  Olfr465-ps1_16
cttcagaaagaaatacatag

SEQ ID NO: 42271 - DNA, 20 bp, Artificial Sequence
  sgRNA
  Olfr465-ps1_17
agaagcctgtgttcagatgg

SEQ ID NO: 42272 - DNA, 20 bp, Artificial Sequence
  sgRNA
  Olfr465-ps1_18
tatgggtctgttcatgccac

SEQ ID NO: 42273 - DNA, 20 bp, Artificial Sequence
  sgRNA
  Olfr465-ps1_19
atagtgtagaggaaagcaaa

SEQ ID NO: 42274 - DNA, 20 bp, Artificial Sequence
  sgRNA
  Olfr465-ps1_20
aaacttgtaaaacacatccc

SEQ ID NO: 42275 - DNA, 20 bp, Artificial Sequence
  sgRNA
  Olfr469_1
agattgtgcttctctccacc

SEQ ID NO: 42276 - DNA, 20 bp, Artificial Sequence
  sgRNA
  Olfr469_2
aaggcagaacaaaatgaggc

SEQ ID NO: 42277 - DNA, 20 bp, Artificial Sequence
  sgRNA
  Olfr469_3
tgcacaggatgatgctgaag

SEQ ID NO: 42278 - DNA, 20 bp, Artificial Sequence
  sgRNA
  Olfr469_4
tataaaacgatcataagcca

SEQ ID NO: 42279 - DNA, 20 bp, Artificial Sequence
  sgRNA
  Olfr469_5
gcttctctccaccaggaagt

SEQ ID NO: 42280 - DNA, 20 bp, Artificial Sequence
  sgRNA
  Olfr469_6
aatgcttgccaacttcctgg

SEQ ID NO: 42281 - DNA, 20 bp, Artificial Sequence
  sgRNA
  Olfr469_7
tgctgaagaggacaacttta

SEQ ID NO: 42282 - DNA, 20 bp, Artificial Sequence
  sgRNA
  Olfr469_8
tcagtggagaagcttgattt

SEQ ID NO: 42283 - DNA, 20 bp, Artificial Sequence
  sgRNA
  Olfr469_9
acaaaatgaggcaggaacta

SEQ ID NO: 42284 - DNA, 20 bp, Artificial Sequence
  sgRNA
  Olfr469_10
cagtgtggttcgcatcctcc

SEQ ID NO: 42285 - DNA, 20 bp, Artificial Sequence
  sgRNA
  Olfr469_11
catcacataaatgaatgtta

SEQ ID NO: 42286 - DNA, 20 bp, Artificial Sequence
  sgRNA
  Olfr469_12
tactgtgactataatgacaa

SEQ ID NO: 42287 - DNA, 20 bp, Artificial Sequence
  sgRNA
  Olfr469_13
caaaatgcttgccaacttcc

SEQ ID NO: 42288 - DNA, 20 bp, Artificial Sequence
  sgRNA
  Olfr469_14
aaaaagcacctgagaaaagc

SEQ ID NO: 42289 - DNA, 20 bp, Artificial Sequence
  sgRNA
  Olfr469_15
gtcagtggagaagcttgatt

SEQ ID NO: 42290 - DNA, 20 bp, Artificial Sequence
  sgRNA
  Olfr47_1
ccccactaaagtgaacacac

SEQ ID NO: 42291 - DNA, 20 bp, Artificial Sequence
  sgRNA
  Olfr47_2
tgacagtgtagtgtagcggg

SEQ ID NO: 42292 - DNA, 20 bp, Artificial Sequence
  sgRNA
  Olfr47_3
ctgtgtcatgcatcctgcaa

SEQ ID NO: 42293 - DNA, 20 bp, Artificial Sequence
  sgRNA
  Olfr47_4
agtccaggcagatcattgca

SEQ ID NO: 42294 - DNA, 20 bp, Artificial Sequence
  sgRNA
  Olfr47_5
tttgcacagtgccctccgga

SEQ ID NO: 42295 - DNA, 20 bp, Artificial Sequence
  sgRNA
  Olfr47_6
agtcaagggtgccctccgga

SEQ ID NO: 42296 - DNA, 20 bp, Artificial Sequence
  sgRNA
  Olfr47_7
aggagactagtacaaagcac

SEQ ID NO: 42297 - DNA, 20 bp, Artificial Sequence
  sgRNA
  Olfr47_8
gagactagtacaaagcacag

SEQ ID NO: 42298 - DNA, 20 bp, Artificial Sequence
  sgRNA
  Olfr47_9
cctgtgtgttcactttagtg

SEQ ID NO: 42299 - DNA, 20 bp, Artificial Sequence
  sgRNA
  Olfr47_10
gaatcctcaggattgccacc

SEQ ID NO: 42300 - DNA, 20 bp, Artificial Sequence
  sgRNA
  Olfr47_11
gtcaggggagagacgcagaa

SEQ ID NO: 42301 - DNA, 20 bp, Artificial Sequence
  sgRNA
  Olfr47_12
aatcctgaggattcagtcag

SEQ ID NO: 42302 - DNA, 20 bp, Artificial Sequence
  sgRNA
  Olfr47_13
tttctttgcacagtgccctc

SEQ ID NO: 42303 - DNA, 20 bp, Artificial Sequence
  sgRNA
  Olfr47_14
gcctgtgtgttcactttagt

SEQ ID NO: 42304 - DNA, 20 bp, Artificial Sequence
  sgRNA
  Olfr47_15
ggagactagtacaaagcaca

SEQ ID NO: 42305 - DNA, 20 bp, Artificial Sequence
  sgRNA
  Olfr47_16
ctttgcacagtgccctccgg

SEQ ID NO: 42306 - DNA, 20 bp, Artificial Sequence
  sgRNA
  Olfr47_17
gcaatcctgaggattcagtc

SEQ ID NO: 42307 - DNA, 20 bp, Artificial Sequence
  sgRNA
  Olfr47_18
tttcatgaggtccacagaag

SEQ ID NO: 42308 - DNA, 20 bp, Artificial Sequence
  sgRNA
  Olfr47_19
ctgaggaatgctgaagtcaa

SEQ ID NO: 42309 - DNA, 20 bp, Artificial Sequence
  sgRNA
  Olfr47_20
gcctcaggatgagaagtaaa

SEQ ID NO: 42310 - DNA, 20 bp, Artificial Sequence
  sgRNA
  Olfr470_1
ggttcccagacacattcacc

SEQ ID NO: 42311 - DNA, 20 bp, Artificial Sequence
  sgRNA
  Olfr470_2
tatcaaaggagtcaaatcac

SEQ ID NO: 42312 - DNA, 20 bp, Artificial Sequence
  sgRNA
  Olfr470_3
aaagctggatggtacaccca

SEQ ID NO: 42313 - DNA, 20 bp, Artificial Sequence
  sgRNA
  Olfr470_4
ctacgtcaacagaagccaag

SEQ ID NO: 42314 - DNA, 20 bp, Artificial Sequence
  sgRNA
  Olfr470_5
gcccaaatccagctactcca

SEQ ID NO: 42315 - DNA, 20 bp, Artificial Sequence
  sgRNA
  Olfr470_6
gcttctctccagcaggaagt

SEQ ID NO: 42316 - DNA, 20 bp, Artificial Sequence
  sgRNA
  Olfr470_7
aatgcttgccaacttcctgc

SEQ ID NO: 42317 - DNA, 20 bp, Artificial Sequence
  sgRNA
  Olfr470_8
cattcaccaggtagatgcac

SEQ ID NO: 42318 - DNA, 20 bp, Artificial Sequence
  sgRNA
  Olfr470_9
aaggcagagcaaaatgaggc

SEQ ID NO: 42319 - DNA, 20 bp, Artificial Sequence
  sgRNA
  Olfr470_10
aatagagagtcactgcagtg

SEQ ID NO: 42320 - DNA, 20 bp, Artificial Sequence
  sgRNA
  Olfr470_11
gagagtcactgcagtgaggt

SEQ ID NO: 42321 - DNA, 20 bp, Artificial Sequence
  sgRNA
  Olfr470_12
gacaaaggcagagcaaaatg

SEQ ID NO: 42322 - DNA, 20 bp, Artificial Sequence
  sgRNA
  Olfr470_13
ctccacggaccagaacaagg

SEQ ID NO: 42323 - DNA, 20 bp, Artificial Sequence
  sgRNA
  Olfr470_14
ctactccacggaccagaaca

SEQ ID NO: 42324 - DNA, 20 bp, Artificial Sequence
  sgRNA
  Olfr470_15
gcaaaatgaggcaggaacta

SEQ ID NO: 42325 - DNA, 20 bp, Artificial Sequence
  sgRNA
  Olfr470_16
agagagtcactgcagtgagg

SEQ ID NO: 42326 - DNA, 20 bp, Artificial Sequence
  sgRNA
  Olfr470_17
caccaccttgttctggtccg

SEQ ID NO: 42327 - DNA, 20 bp, Artificial Sequence
  sgRNA
  Olfr470_18
gaatagtgattgactctatt

SEQ ID NO: 42328 - DNA, 20 bp, Artificial Sequence
  sgRNA
  Olfr470_19
actgcagtgactctctatta

SEQ ID NO: 42329 - DNA, 20 bp, Artificial Sequence
  sgRNA
  Olfr470_20
ccttaatctcattgttcctg

SEQ ID NO: 42330 - DNA, 20 bp, Artificial Sequence
  sgRNA
  Olfr478_1
agttgcagggacactgacat

SEQ ID NO: 42331 - DNA, 20 bp, Artificial Sequence
  sgRNA
  Olfr478_2
gacaacagaacctagctgga

SEQ ID NO: 42332 - DNA, 20 bp, Artificial Sequence
  sgRNA
  Olfr478_3
ggttgcaaattgccatgaag

SEQ ID NO: 42333 - DNA, 20 bp, Artificial Sequence
  sgRNA
  Olfr478_4
ctatgtcagcaaaagccaag

SEQ ID NO: 42334 - DNA, 20 bp, Artificial Sequence
  sgRNA
  Olfr478_5
tgaatgaaggaacagttgca

SEQ ID NO: 42335 - DNA, 20 bp, Artificial Sequence
  sgRNA
  Olfr478_6
agattgtatgtctttccacc

SEQ ID NO: 42336 - DNA, 20 bp, Artificial Sequence
  sgRNA
  Olfr478_7
ggtgctctgaagagacagat

SEQ ID NO: 42337 - DNA, 20 bp, Artificial Sequence
  sgRNA
  Olfr478_8
ttgctcttaattgcttacat

SEQ ID NO: 42338 - DNA, 20 bp, Artificial Sequence
  sgRNA
  Olfr478_9
agacatacaatctcctacat

SEQ ID NO: 42339 - DNA, 20 bp, Artificial Sequence
  sgRNA
  Olfr478_10
ttagtcttctgtggacccaa

SEQ ID NO: 42340 - DNA, 20 bp, Artificial Sequence
  sgRNA
  Olfr478_11
gatcactgtcacaacaatga

SEQ ID NO: 42341 - DNA, 20 bp, Artificial Sequence
  sgRNA
  Olfr478_12
agtggagtgcatcttcaaga

SEQ ID NO: 42342 - DNA, 20 bp, Artificial Sequence
  sgRNA
  Olfr478_13
aatggcttatgaccgcttca

SEQ ID NO: 42343 - DNA, 20 bp, Artificial Sequence
  sgRNA
  Olfr478_14
gaggatgtagatgtaggaga

SEQ ID NO: 42344 - DNA, 20 bp, Artificial Sequence
  sgRNA
  Olfr478_15
ttgaagatgcactccactga

SEQ ID NO: 42345 - DNA, 20 bp, Artificial Sequence
  sgRNA
  Olfr478_16
agaagacaacagaacctagc

SEQ ID NO: 42346 - DNA, 20 bp, Artificial Sequence
  sgRNA
  Olfr478_17
actgttccttcattcacagc

SEQ ID NO: 42347 - DNA, 20 bp, Artificial Sequence
  sgRNA
  Olfr478_18
cagcaaaagccaagtggctg

SEQ ID NO: 42348 - DNA, 20 bp, Artificial Sequence
  sgRNA
  Olfr478_19
gcatcttcaagatggtgatg

SEQ ID NO: 42349 - DNA, 20 bp, Artificial Sequence
  sgRNA
  Olfr478_20
ggccttctgtcgaccctcag

SEQ ID NO: 42350 - DNA, 20 bp, Artificial Sequence
  sgRNA
  Olfr480_1
ggtaggaagttccaactagg

SEQ ID NO: 42351 - DNA, 20 bp, Artificial Sequence
  sgRNA
  Olfr480_2
aaagggaacatttatccctg

SEQ ID NO: 42352 - DNA, 20 bp, Artificial Sequence
  sgRNA
  Olfr480_3
ggagtacccaatgtctagaa

SEQ ID NO: 42353 - DNA, 20 bp, Artificial Sequence
  sgRNA
  Olfr480_4
gaacaagaaagcttcaatag

SEQ ID NO: 42354 - DNA, 20 bp, Artificial Sequence
  sgRNA
  Olfr480_5
gttacacccatcatgctgag

SEQ ID NO: 42355 - DNA, 20 bp, Artificial Sequence
  sgRNA
  Olfr480_6
gcatcttcaggattgacaca

SEQ ID NO: 42356 - DNA, 20 bp, Artificial Sequence
  sgRNA
  Olfr480_7
gttggaacttcctacctagg

SEQ ID NO: 42357 - DNA, 20 bp, Artificial Sequence
  sgRNA
  Olfr480_8
tgattgctaaaacacattgg

SEQ ID NO: 42358 - DNA, 20 bp, Artificial Sequence
  sgRNA
  Olfr480_9
ggctcaactctgtattgtgg

SEQ ID NO: 42359 - DNA, 20 bp, Artificial Sequence
  sgRNA
  Olfr480_10
acagtctgcatcctcctagt

SEQ ID NO: 42360 - DNA, 20 bp, Artificial Sequence
  sgRNA
  Olfr480_11
agtcattccagcaatctctt

SEQ ID NO: 42361 - DNA, 20 bp, Artificial Sequence
  sgRNA
  Olfr480_12
ctctactgaaggtcgccaga

SEQ ID NO: 42362 - DNA, 20 bp, Artificial Sequence
  sgRNA
  Olfr480_13
aagcattcacccatccacct

SEQ ID NO: 42363 - DNA, 20 bp, Artificial Sequence
  sgRNA
  Olfr480_14
ctgaggggctttctcagaaa

SEQ ID NO: 42364 - DNA, 20 bp, Artificial Sequence
  sgRNA
  Olfr480_15
atttggcctttctagacatt

SEQ ID NO: 42365 - DNA, 20 bp, Artificial Sequence
  sgRNA
  Olfr480_16
tttctgaaactgtagatgag

SEQ ID NO: 42366 - DNA, 20 bp, Artificial Sequence
  sgRNA
  Olfr480_17
attcacccatccacctaggt

SEQ ID NO: 42367 - DNA, 20 bp, Artificial Sequence
  sgRNA
  Olfr480_18
gctaaggaaaaggtacatgg

SEQ ID NO: 42368 - DNA, 20 bp, Artificial Sequence
  sgRNA
  Olfr480_19
caatgtctagaaaggccaaa

SEQ ID NO: 42369 - DNA, 20 bp, Artificial Sequence
  sgRNA
  Olfr480_20
ctacagtttcagaaacaaag

SEQ ID NO: 42370 - DNA, 20 bp, Artificial Sequence
  sgRNA
  Olfr482_1
aacatgaggtaacagccaca

SEQ ID NO: 42371 - DNA, 20 bp, Artificial Sequence
  sgRNA
  Olfr482_2
ctaagtcaacagaagccaag

SEQ ID NO: 42372 - DNA, 20 bp, Artificial Sequence
  sgRNA
  Olfr482_3
aaatatagaaacagtgacaa

SEQ ID NO: 42373 - DNA, 20 bp, Artificial Sequence
  sgRNA
  Olfr482_4
caacttgacacagacttgtg

SEQ ID NO: 42374 - DNA, 20 bp, Artificial Sequence
  sgRNA
  Olfr482_5
gcatcttcaggacagtgatg

SEQ ID NO: 42375 - DNA, 20 bp, Artificial Sequence
  sgRNA
  Olfr482_6
ttctgatgtcagtgtccctg

SEQ ID NO: 42376 - DNA, 20 bp, Artificial Sequence
  sgRNA
  Olfr482_7
aattaagccagcagaacatg

SEQ ID NO: 42377 - DNA, 20 bp, Artificial Sequence
  sgRNA
  Olfr482_8
agtacttgaatgcttccttc

SEQ ID NO: 42378 - DNA, 20 bp, Artificial Sequence
  sgRNA
  Olfr482_9
agatggtattattctctgcc

SEQ ID NO: 42379 - DNA, 20 bp, Artificial Sequence
  sgRNA
  Olfr482_10
gaggatataggtataggaga

SEQ ID NO: 42380 - DNA, 20 bp, Artificial Sequence
  sgRNA
  Olfr482_11
aataataccatctcctacat

SEQ ID NO: 42381 - DNA, 20 bp, Artificial Sequence
  sgRNA
  Olfr482_12
attggatgttctatacagtt

SEQ ID NO: 42382 - DNA, 20 bp, Artificial Sequence
  sgRNA
  Olfr482_13
ggctgaggaaaaagtacata

SEQ ID NO: 42383 - DNA, 20 bp, Artificial Sequence
  sgRNA
  Olfr482_14
ggaaaaagtacatagggtga

SEQ ID NO: 42384 - DNA, 20 bp, Artificial Sequence
  sgRNA
  Olfr482_15
agtgatgaggatataggtat

SEQ ID NO: 42385 - DNA, 20 bp, Artificial Sequence
  sgRNA
  Olfr482_16
gaacatgaggtaacagccac

SEQ ID NO: 42386 - DNA, 20 bp, Artificial Sequence
  sgRNA
  Olfr482_17
gaacaagagagctcaatcaa

SEQ ID NO: 42387 - DNA, 20 bp, Artificial Sequence
  sgRNA
  Olfr482_18
cacttggcttctgttgactt

SEQ ID NO: 42388 - DNA, 20 bp, Artificial Sequence
  sgRNA
  Olfr482_19
agaggatgactttaaggact

SEQ ID NO: 42389 - DNA, 20 bp, Artificial Sequence
  sgRNA
  Olfr482_20
atatttaatttgctcttctg

SEQ ID NO: 42390 - DNA, 20 bp, Artificial Sequence
  sgRNA
  Olfr483_1
tggtgaagaggacaactctg

SEQ ID NO: 42391 - DNA, 20 bp, Artificial Sequence
  sgRNA
  Olfr483_2
aaagtaaactgtgacgatga

SEQ ID NO: 42392 - DNA, 20 bp, Artificial Sequence
  sgRNA
  Olfr483_3
agccaaaaggaagcattcaa

SEQ ID NO: 42393 - DNA, 20 bp, Artificial Sequence
  sgRNA
  Olfr483_4
agagacactgacatcagagc

SEQ ID NO: 42394 - DNA, 20 bp, Artificial Sequence
  sgRNA
  Olfr483_5
agattgtgcttctctccaac

SEQ ID NO: 42395 - DNA, 20 bp, Artificial Sequence
  sgRNA
  Olfr483_6
tataagatcccacaaccagc

SEQ ID NO: 42396 - DNA, 20 bp, Artificial Sequence
  sgRNA
  Olfr483_7
aggtggagaaggccttatgt

SEQ ID NO: 42397 - DNA, 20 bp, Artificial Sequence
  sgRNA
  Olfr483_8
atccgttgaatgcttccttt

SEQ ID NO: 42398 - DNA, 20 bp, Artificial Sequence
  sgRNA
  Olfr483_9
ttgctgaggctgtagatgag

SEQ ID NO: 42399 - DNA, 20 bp, Artificial Sequence
  sgRNA
  Olfr483_10
tgacgatgagggaagcatta

SEQ ID NO: 42400 - DNA, 20 bp, Artificial Sequence
  sgRNA
  Olfr483_11
tatgcttgtcaacttcctgt

SEQ ID NO: 42401 - DNA, 20 bp, Artificial Sequence
  sgRNA
  Olfr483_12
gtctgtgtccagctggttgt

SEQ ID NO: 42402 - DNA, 20 bp, Artificial Sequence
  sgRNA
  Olfr483_13
gagcaggagagttctgctaa

SEQ ID NO: 42403 - DNA, 20 bp, Artificial Sequence
  sgRNA
  Olfr483_14
agtctgtgtccagctggttg

SEQ ID NO: 42404 - DNA, 20 bp, Artificial Sequence
  sgRNA
  Olfr483_15
attgctgaggctgtagatga

SEQ ID NO: 42405 - DNA, 20 bp, Artificial Sequence
  sgRNA
  Olfr483_16
aggaagttgacaagcatact

SEQ ID NO: 42406 - DNA, 20 bp, Artificial Sequence
  sgRNA
  Olfr483_17
ctccactgagggccgacata

SEQ ID NO: 42407 - DNA, 20 bp, Artificial Sequence
  sgRNA
  Olfr483_18
ggccttatgtcggccctcag

SEQ ID NO: 42408 - DNA, 20 bp, Artificial Sequence
  sgRNA
  Olfr483_19
cacacaagtctgtgtccagc

SEQ ID NO: 42409 - DNA, 20 bp, Artificial Sequence
  sgRNA
  Olfr483_20
cagatagatgcacaagatga

SEQ ID NO: 42410 - DNA, 20 bp, Artificial Sequence
  sgRNA
  Olfr484_1
ggttcccagacacagtaacc

SEQ ID NO: 42411 - DNA, 20 bp, Artificial Sequence
  sgRNA
  Olfr484_2
caagaataaaaaagaaactg

SEQ ID NO: 42412 - DNA, 20 bp, Artificial Sequence
  sgRNA
  Olfr484_3
cacacaagtctgtgtccagt

SEQ ID NO: 42413 - DNA, 20 bp, Artificial Sequence
  sgRNA
  Olfr484_4
aactgtgccagcagaaaatg

SEQ ID NO: 42414 - DNA, 20 bp, Artificial Sequence
  sgRNA
  Olfr484_5
cagtaaccaggtagatgcac

SEQ ID NO: 42415 - DNA, 20 bp, Artificial Sequence
  sgRNA
  Olfr484_6
ggtgtctgtgttctatatgg

SEQ ID NO: 42416 - DNA, 20 bp, Artificial Sequence
  sgRNA
  Olfr484_7
ctccacagaccaaaataagg

SEQ ID NO: 42417 - DNA, 20 bp, Artificial Sequence
  sgRNA
  Olfr484_8
agagatcctgacatcagaac

SEQ ID NO: 42418 - DNA, 20 bp, Artificial Sequence
  sgRNA
  Olfr484_9
tctgtggagtatcttgactt

SEQ ID NO: 42419 - DNA, 20 bp, Artificial Sequence
  sgRNA
  Olfr484_10
atgagattaagggggctctg

SEQ ID NO: 42420 - DNA, 20 bp, Artificial Sequence
  sgRNA
  Olfr484_11
acagagacactgcagtgaga

SEQ ID NO: 42421 - DNA, 20 bp, Artificial Sequence
  sgRNA
  Olfr484_12
tcaggaataatgagattaag

SEQ ID NO: 42422 - DNA, 20 bp, Artificial Sequence
  sgRNA
  Olfr484_13
atactccacagaccaaaata

SEQ ID NO: 42423 - DNA, 20 bp, Artificial Sequence
  sgRNA
  Olfr484_14
actgcagtgtctctgttcta

SEQ ID NO: 42424 - DNA, 20 bp, Artificial Sequence
  sgRNA
  Olfr484_15
aggacttgaatgcttccttc

SEQ ID NO: 42425 - DNA, 20 bp, Artificial Sequence
  sgRNA
  Olfr484_16
catcacgtaaatgaatgtaa

SEQ ID NO: 42426 - DNA, 20 bp, Artificial Sequence
  sgRNA
  Olfr484_17
cagagacactgcagtgagat

SEQ ID NO: 42427 - DNA, 20 bp, Artificial Sequence
  sgRNA
  Olfr484_18
acacagacaccaccttattt

SEQ ID NO: 42428 - DNA, 20 bp, Artificial Sequence
  sgRNA
  Olfr484_19
agctctcctgttctgatgtc

SEQ ID NO: 42429 - DNA, 20 bp, Artificial Sequence
  sgRNA
  Olfr484_20
gaggatataggtgtaagaaa

SEQ ID NO: 42430 - DNA, 20 bp, Artificial Sequence
  sgRNA
  Olfr485_1
gccaaaatccacctactccg

SEQ ID NO: 42431 - DNA, 20 bp, Artificial Sequence
  sgRNA
  Olfr485_2
ggttcccagacacagtcact

SEQ ID NO: 42432 - DNA, 20 bp, Artificial Sequence
  sgRNA
  Olfr485_3
ctaaagatgcactccactga

SEQ ID NO: 42433 - DNA, 20 bp, Artificial Sequence
  sgRNA
  Olfr485_4
cctatggctttcctggacaa

SEQ ID NO: 42434 - DNA, 20 bp, Artificial Sequence
  sgRNA
  Olfr485_5
gttctggtccccggagtagg

SEQ ID NO: 42435 - DNA, 20 bp, Artificial Sequence
  sgRNA
  Olfr485_6
ccatgtcaacagaagccaag

SEQ ID NO: 42436 - DNA, 20 bp, Artificial Sequence
  sgRNA
  Olfr485_7
gcatctttaggatggtaatg

SEQ ID NO: 42437 - DNA, 20 bp, Artificial Sequence
  sgRNA
  Olfr485_8
tgctgaagagaatgactctg

SEQ ID NO: 42438 - DNA, 20 bp, Artificial Sequence
  sgRNA
  Olfr485_9
actgcagtcactctttctta

SEQ ID NO: 42439 - DNA, 20 bp, Artificial Sequence
  sgRNA
  Olfr485_10
agatgagaggattcaacatg

SEQ ID NO: 42440 - DNA, 20 bp, Artificial Sequence
  sgRNA
  Olfr485_11
cataagatcctacaaccaac

SEQ ID NO: 42441 - DNA, 20 bp, Artificial Sequence
  sgRNA
  Olfr485_12
cataagccataacagccaga

SEQ ID NO: 42442 - DNA, 20 bp, Artificial Sequence
  sgRNA
  Olfr485_13
tgatgagaaggaatgtgctg

SEQ ID NO: 42443 - DNA, 20 bp, Artificial Sequence
  sgRNA
  Olfr485_14
ctccggggaccagaacaagg

SEQ ID NO: 42444 - DNA, 20 bp, Artificial Sequence
  sgRNA
  Olfr485_15
agacatagcatctcctacct

SEQ ID NO: 42445 - DNA, 20 bp, Artificial Sequence
  sgRNA
  Olfr485_16
agatgctatgtctctcagtc

SEQ ID NO: 42446 - DNA, 20 bp, Artificial Sequence
  sgRNA
  Olfr485_17
ccattgtccaggaaagccat

SEQ ID NO: 42447 - DNA, 20 bp, Artificial Sequence
  sgRNA
  Olfr485_18
agtggagtgcatctttagga

SEQ ID NO: 42448 - DNA, 20 bp, Artificial Sequence
  sgRNA
  Olfr485_19
cagtcactaggtagatgcac

SEQ ID NO: 42449 - DNA, 20 bp, Artificial Sequence
  sgRNA
  Olfr485_20
aagaaagagtgactgcagtg

SEQ ID NO: 42450 - DNA, 20 bp, Artificial Sequence
  sgRNA
  Olfr486_1
ggttgcaggatcttatgtag

SEQ ID NO: 42451 - DNA, 20 bp, Artificial Sequence
  sgRNA
  Olfr486_2
agagactccaatgagaagga

SEQ ID NO: 42452 - DNA, 20 bp, Artificial Sequence
  sgRNA
  Olfr486_3
agagtatgactttaaggact

SEQ ID NO: 42453 - DNA, 20 bp, Artificial Sequence
  sgRNA
  Olfr486_4
ccatatcaacagaagccaag

SEQ ID NO: 42454 - DNA, 20 bp, Artificial Sequence
  sgRNA
  Olfr486_5
gttgcaggatcttatgtagg

SEQ ID NO: 42455 - DNA, 20 bp, Artificial Sequence
  sgRNA
  Olfr486_6
agtggaacgaatcttcaaga

SEQ ID NO: 42456 - DNA, 20 bp, Artificial Sequence
  sgRNA
  Olfr486_7
gttctggtctctggagtagg

SEQ ID NO: 42457 - DNA, 20 bp, Artificial Sequence
  sgRNA
  Olfr486_8
ggtgtctctgttctacatgc

SEQ ID NO: 42458 - DNA, 20 bp, Artificial Sequence
  sgRNA
  Olfr486_9
ctactccagagaccagaaca

SEQ ID NO: 42459 - DNA, 20 bp, Artificial Sequence
  sgRNA
  Olfr486_10
agagagtgactgcagtaaga

SEQ ID NO: 42460 - DNA, 20 bp, Artificial Sequence
  sgRNA
  Olfr486_11
agtaagatgggaagtgcagg

SEQ ID NO: 42461 - DNA, 20 bp, Artificial Sequence
  sgRNA
  Olfr486_12
cataagatcctgcaaccaac

SEQ ID NO: 42462 - DNA, 20 bp, Artificial Sequence
  sgRNA
  Olfr486_13
ctcacaagtgtgtatccagt

SEQ ID NO: 42463 - DNA, 20 bp, Artificial Sequence
  sgRNA
  Olfr486_14
ctccagagaccagaacaagg

SEQ ID NO: 42464 - DNA, 20 bp, Artificial Sequence
  sgRNA
  Olfr486_15
cttgaagattcgttccactg

SEQ ID NO: 42465 - DNA, 20 bp, Artificial Sequence
  sgRNA
  Olfr486_16
agatgaggggattcaacacg

SEQ ID NO: 42466 - DNA, 20 bp, Artificial Sequence
  sgRNA
  Olfr486_17
tagaagagactccaatgaga

SEQ ID NO: 42467 - DNA, 20 bp, Artificial Sequence
  sgRNA
  Olfr486_18
tggttgcaggatcttatgta

SEQ ID NO: 42468 - DNA, 20 bp, Artificial Sequence
  sgRNA
  Olfr486_19
gagagtgactgcagtaagat

SEQ ID NO: 42469 - DNA, 20 bp, Artificial Sequence
  sgRNA
  Olfr486_20
gtgatgaagatatagaagta

SEQ ID NO: 42470 - DNA, 20 bp, Artificial Sequence
  sgRNA
  Olfr487_1
agaaactccaatgagaagga

SEQ ID NO: 42471 - DNA, 20 bp, Artificial Sequence
  sgRNA
  Olfr487_2
ggttgtaggtacttatgtag

SEQ ID NO: 42472 - DNA, 20 bp, Artificial Sequence
  sgRNA
  Olfr487_3
aagagaatgactttaaggac

SEQ ID NO: 42473 - DNA, 20 bp, Artificial Sequence
  sgRNA
  Olfr487_4
ctgtatgccacatccaaggt

SEQ ID NO: 42474 - DNA, 20 bp, Artificial Sequence
  sgRNA
  Olfr487_5
cataagtacctacaaccaac

SEQ ID NO: 42475 - DNA, 20 bp, Artificial Sequence
  sgRNA
  Olfr487_6
agatgagaggattcaacacg

SEQ ID NO: 42476 - DNA, 20 bp, Artificial Sequence
  sgRNA
  Olfr487_7
gcccaagtccatctactcca

SEQ ID NO: 42477 - DNA, 20 bp, Artificial Sequence
  sgRNA
  Olfr487_8
agtggtgtctctgttctacg

SEQ ID NO: 42478 - DNA, 20 bp, Artificial Sequence
  sgRNA
  Olfr487_9
tggttgtaggtacttatgta

SEQ ID NO: 42479 - DNA, 20 bp, Artificial Sequence
  sgRNA
  Olfr487_10
ggtgtctctgttctacgtgg

SEQ ID NO: 42480 - DNA, 20 bp, Artificial Sequence
  sgRNA
  Olfr487_11
gttgtaggtacttatgtagg

SEQ ID NO: 42481 - DNA, 20 bp, Artificial Sequence
  sgRNA
  Olfr487_12
tagatgagaggattcaacac

SEQ ID NO: 42482 - DNA, 20 bp, Artificial Sequence
  sgRNA
  Olfr487_13
ctccagggaccagaacaaag

SEQ ID NO: 42483 - DNA, 20 bp, Artificial Sequence
  sgRNA
  Olfr487_14
acagagacaccactttgttc

SEQ ID NO: 42484 - DNA, 20 bp, Artificial Sequence
  sgRNA
  Olfr487_15
gggcatcacataaatgaata

SEQ ID NO: 42485 - DNA, 20 bp, Artificial Sequence
  sgRNA
  Olfr487_16
tccctggagtagatggactt

SEQ ID NO: 42486 - DNA, 20 bp, Artificial Sequence
  sgRNA
  Olfr487_17
tggaagaaactccaatgaga

SEQ ID NO: 42487 - DNA, 20 bp, Artificial Sequence
  sgRNA
  Olfr487_18
agtgaggtgggacatgcagg

SEQ ID NO: 42488 - DNA, 20 bp, Artificial Sequence
  sgRNA
  Olfr487_19
gttctggtccctggagtaga

SEQ ID NO: 42489 - DNA, 20 bp, Artificial Sequence
  sgRNA
  Olfr487_20
gtccctggagtagatggact

SEQ ID NO: 42490 - DNA, 20 bp, Artificial Sequence
  sgRNA
  Olfr488_1
caactggatacagaatcgtg

SEQ ID NO: 42491 - DNA, 20 bp, Artificial Sequence
  sgRNA
  Olfr488_2
tgacagaagatgaaatgcct

SEQ ID NO: 42492 - DNA, 20 bp, Artificial Sequence
  sgRNA
  Olfr488_3
agagactctaatgagaagga

SEQ ID NO: 42493 - DNA, 20 bp, Artificial Sequence
  sgRNA
  Olfr488_4
agaggacaattctaaggaat

SEQ ID NO: 42494 - DNA, 20 bp, Artificial Sequence
  sgRNA
  Olfr488_5
ctaggtcaacagtagctaag

SEQ ID NO: 42495 - DNA, 20 bp, Artificial Sequence
  sgRNA
  Olfr488_6
aatttggtagaataaagcag

SEQ ID NO: 42496 - DNA, 20 bp, Artificial Sequence
  sgRNA
  Olfr488_7
ggtagtgtctctgttctaca

SEQ ID NO: 42497 - DNA, 20 bp, Artificial Sequence
  sgRNA
  Olfr488_8
gccaaagtccacctactcca

SEQ ID NO: 42498 - DNA, 20 bp, Artificial Sequence
  sgRNA
  Olfr488_9
ggtttccaaacacagtcacc

SEQ ID NO: 42499 - DNA, 20 bp, Artificial Sequence
  sgRNA
  Olfr488_10
tgagctgaatgccacatcca

SEQ ID NO: 42500 - DNA, 20 bp, Artificial Sequence
  sgRNA
  Olfr488_11
agtgtctctgttctacatgg

SEQ ID NO: 42501 - DNA, 20 bp, Artificial Sequence
  sgRNA
  Olfr488_12
gacacttgaatgcttccttc

SEQ ID NO: 42502 - DNA, 20 bp, Artificial Sequence
  sgRNA
  Olfr488_13
agtggagcgcatctttagga

SEQ ID NO: 42503 - DNA, 20 bp, Artificial Sequence
  sgRNA
  Olfr488_14
ctaaagatgcgctccactga

SEQ ID NO: 42504 - DNA, 20 bp, Artificial Sequence
  sgRNA
  Olfr488_15
cacacgattctgtatccagt

SEQ ID NO: 42505 - DNA, 20 bp, Artificial Sequence
  sgRNA
  Olfr488_16
gggaagagactctaatgaga

SEQ ID NO: 42506 - DNA, 20 bp, Artificial Sequence
  sgRNA
  Olfr488_17
cacttagctactgttgacct

SEQ ID NO: 42507 - DNA, 20 bp, Artificial Sequence
  sgRNA
  Olfr488_18
ctactccagggaccagaaca

SEQ ID NO: 42508 - DNA, 20 bp, Artificial Sequence
  sgRNA
  Olfr488_19
atttggtagaataaagcagt

SEQ ID NO: 42509 - DNA, 20 bp, Artificial Sequence
  sgRNA
  Olfr488_20
tgctgaagaggacaattcta

SEQ ID NO: 42510 - DNA, 20 bp, Artificial Sequence
  sgRNA
  Olfr490_1
gaacacgagagctcagctaa

SEQ ID NO: 42511 - DNA, 20 bp, Artificial Sequence
  sgRNA
  Olfr490_2
acaatttcataccttggatg

SEQ ID NO: 42512 - DNA, 20 bp, Artificial Sequence
  sgRNA
  Olfr490_3
tggtgaataggacaattcta

SEQ ID NO: 42513 - DNA, 20 bp, Artificial Sequence
  sgRNA
  Olfr490_4
aaagaaggaaagtaaaaagg

SEQ ID NO: 42514 - DNA, 20 bp, Artificial Sequence
  sgRNA
  Olfr490_5
agtggaacgcatcttgagga

SEQ ID NO: 42515 - DNA, 20 bp, Artificial Sequence
  sgRNA
  Olfr490_6
gcctaagtccagctattcaa

SEQ ID NO: 42516 - DNA, 20 bp, Artificial Sequence
  sgRNA
  Olfr490_7
aataatctctgtgttctaca

SEQ ID NO: 42517 - DNA, 20 bp, Artificial Sequence
  sgRNA
  Olfr490_8
agaagcacaatttcatacct

SEQ ID NO: 42518 - DNA, 20 bp, Artificial Sequence
  sgRNA
  Olfr490_9
tgtaggatcctacaatcaac

SEQ ID NO: 42519 - DNA, 20 bp, Artificial Sequence
  sgRNA
  Olfr490_10
ttgtaggatcctacattgct

SEQ ID NO: 42520 - DNA, 20 bp, Artificial Sequence
  sgRNA
  Olfr490_11
gttctggtccattgaatagc

SEQ ID NO: 42521 - DNA, 20 bp, Artificial Sequence
  sgRNA
  Olfr490_12
tgcaactgaatgcttccttt

SEQ ID NO: 42522 - DNA, 20 bp, Artificial Sequence
  sgRNA
  Olfr490_13
tgaattctgacactgcagtg

SEQ ID NO: 42523 - DNA, 20 bp, Artificial Sequence
  sgRNA
  Olfr490_14
ataaagtgactgcagtgaga

SEQ ID NO: 42524 - DNA, 20 bp, Artificial Sequence
  sgRNA
  Olfr490_15
cttaggaataatgagattaa

SEQ ID NO: 42525 - DNA, 20 bp, Artificial Sequence
  sgRNA
  Olfr490_16
gaggatataggaataggaaa

SEQ ID NO: 42526 - DNA, 20 bp, Artificial Sequence
  sgRNA
  Olfr490_17
ataggacaattctaaggact

SEQ ID NO: 42527 - DNA, 20 bp, Artificial Sequence
  sgRNA
  Olfr490_18
gcatcttgaggatggtgatg

SEQ ID NO: 42528 - DNA, 20 bp, Artificial Sequence
  sgRNA
  Olfr490_19
gtctgtgtccagttgattgt

SEQ ID NO: 42529 - DNA, 20 bp, Artificial Sequence
  sgRNA
  Olfr490_20
ggctttctggcgaccttcag

SEQ ID NO: 42530 - DNA, 20 bp, Artificial Sequence
  sgRNA
  Olfr492_1
gttgtaggatcttatacagg

SEQ ID NO: 42531 - DNA, 20 bp, Artificial Sequence
  sgRNA
  Olfr492_2
tggttgtaggatcttataca

SEQ ID NO: 42532 - DNA, 20 bp, Artificial Sequence
  sgRNA
  Olfr492_3
gccacatccaaggtaggcaa

SEQ ID NO: 42533 - DNA, 20 bp, Artificial Sequence
  sgRNA
  Olfr492_4
ttgtaggatcttatacaggg

SEQ ID NO: 42534 - DNA, 20 bp, Artificial Sequence
  sgRNA
  Olfr492_5
caatgtcaacagagcccacg

SEQ ID NO: 42535 - DNA, 20 bp, Artificial Sequence
  sgRNA
  Olfr492_6
tatgcttgtcaactttctgg

SEQ ID NO: 42536 - DNA, 20 bp, Artificial Sequence
  sgRNA
  Olfr492_7
tgatgagaaggattgtgctg

SEQ ID NO: 42537 - DNA, 20 bp, Artificial Sequence
  sgRNA
  Olfr492_8
cacacaaacctgtatccagt

SEQ ID NO: 42538 - DNA, 20 bp, Artificial Sequence
  sgRNA
  Olfr492_9
agtgaggtaggaggtacagg

SEQ ID NO: 42539 - DNA, 20 bp, Artificial Sequence
  sgRNA
  Olfr492_10
gttctggtcagtggagtagt

SEQ ID NO: 42540 - DNA, 20 bp, Artificial Sequence
  sgRNA
  Olfr492_11
ggtgctctcaagagacagct

SEQ ID NO: 42541 - DNA, 20 bp, Artificial Sequence
  sgRNA
  Olfr492_12
cacgtgggctctgttgacat

SEQ ID NO: 42542 - DNA, 20 bp, Artificial Sequence
  sgRNA
  Olfr492_13
ggttgtaggatcttatacag

SEQ ID NO: 42543 - DNA, 20 bp, Artificial Sequence
  sgRNA
  Olfr492_14
aactgaggcagaaaaaattg

SEQ ID NO: 42544 - DNA, 20 bp, Artificial Sequence
  sgRNA
  Olfr492_15
agtgactgcagtgaggtagg

SEQ ID NO: 42545 - DNA, 20 bp, Artificial Sequence
  sgRNA
  Olfr492_16
ggctaagaaaaaagtacata

SEQ ID NO: 42546 - DNA, 20 bp, Artificial Sequence
  sgRNA
  Olfr492_17
ccttaatatcattatttctg

SEQ ID NO: 42547 - DNA, 20 bp, Artificial Sequence
  sgRNA
  Olfr492_18
accattgcctaccttggatg

SEQ ID NO: 42548 - DNA, 20 bp, Artificial Sequence
  sgRNA
  Olfr492_19
ggtgatgaggatgtaggtat

SEQ ID NO: 42549 - DNA, 20 bp, Artificial Sequence
  sgRNA
  Olfr492_20
gtaggaggtacaggtggaga

SEQ ID NO: 42550 - DNA, 20 bp, Artificial Sequence
  sgRNA
  Olfr493_1
cataaaccgatcataagcca

SEQ ID NO: 42551 - DNA, 20 bp, Artificial Sequence
  sgRNA
  Olfr493_2
agaggatgactctaaagact

SEQ ID NO: 42552 - DNA, 20 bp, Artificial Sequence
  sgRNA
  Olfr493_3
gaacaggagagcgccaccaa

SEQ ID NO: 42553 - DNA, 20 bp, Artificial Sequence
  sgRNA
  Olfr493_4
tatgcttgccaacttcctgg

SEQ ID NO: 42554 - DNA, 20 bp, Artificial Sequence
  sgRNA
  Olfr493_5
ggtacacccaagataggaaa

SEQ ID NO: 42555 - DNA, 20 bp, Artificial Sequence
  sgRNA
  Olfr493_6
tggctaccatggcttatgat

SEQ ID NO: 42556 - DNA, 20 bp, Artificial Sequence
  sgRNA
  Olfr493_7
tataagatcctacaatcaac

SEQ ID NO: 42557 - DNA, 20 bp, Artificial Sequence
  sgRNA
  Olfr493_8
aggtggagaaggccttgtgg

SEQ ID NO: 42558 - DNA, 20 bp, Artificial Sequence
  sgRNA
  Olfr493_9
tcagtggagaagctcgactt

SEQ ID NO: 42559 - DNA, 20 bp, Artificial Sequence
  sgRNA
  Olfr493_10
gtctgtatccagttgattgt

SEQ ID NO: 42560 - DNA, 20 bp, Artificial Sequence
  sgRNA
  Olfr493_11
agttactatgatcacaatgt

SEQ ID NO: 42561 - DNA, 20 bp, Artificial Sequence
  sgRNA
  Olfr493_12
tgattgtaggatcttatata

SEQ ID NO: 42562 - DNA, 20 bp, Artificial Sequence
  sgRNA
  Olfr493_13
gtagatgagtgggttcaaca

SEQ ID NO: 42563 - DNA, 20 bp, Artificial Sequence
  sgRNA
  Olfr493_14
attgtaggatcttatatagg

SEQ ID NO: 42564 - DNA, 20 bp, Artificial Sequence
  sgRNA
  Olfr493_15
ctggatggtacacccaagat

SEQ ID NO: 42565 - DNA, 20 bp, Artificial Sequence
  sgRNA
  Olfr493_16
agatgagtgggttcaacatg

SEQ ID NO: 42566 - DNA, 20 bp, Artificial Sequence
  sgRNA
  Olfr493_17
tagatgagtgggttcaacat

SEQ ID NO: 42567 - DNA, 20 bp, Artificial Sequence
  sgRNA
  Olfr493_18
gtcagtggagaagctcgact

SEQ ID NO: 42568 - DNA, 20 bp, Artificial Sequence
  sgRNA
  Olfr493_19
tgatgtcagtgtctctgaag

SEQ ID NO: 42569 - DNA, 20 bp, Artificial Sequence
  sgRNA
  Olfr493_20
ctccactgagggccgccaca

SEQ ID NO: 42570 - DNA, 20 bp, Artificial Sequence
  sgRNA
  Olfr494_1
gtcctgtatccagttagtcg

SEQ ID NO: 42571 - DNA, 20 bp, Artificial Sequence
  sgRNA
  Olfr494_2
tggtaaagaggatgactctg

SEQ ID NO: 42572 - DNA, 20 bp, Artificial Sequence
  sgRNA
  Olfr494_3
agaacatgcaatgtaggaga

SEQ ID NO: 42573 - DNA, 20 bp, Artificial Sequence
  sgRNA
  Olfr494_4
gactgaaccagcagaaaatg

SEQ ID NO: 42574 - DNA, 20 bp, Artificial Sequence
  sgRNA
  Olfr494_5
tataagatcccacgactaac

SEQ ID NO: 42575 - DNA, 20 bp, Artificial Sequence
  sgRNA
  Olfr494_6
tcctgtatccagttagtcgt

SEQ ID NO: 42576 - DNA, 20 bp, Artificial Sequence
  sgRNA
  Olfr494_7
gtcgtgggatcttatatagg

SEQ ID NO: 42577 - DNA, 20 bp, Artificial Sequence
  sgRNA
  Olfr494_8
ttatcttctgtggaccaaat

SEQ ID NO: 42578 - DNA, 20 bp, Artificial Sequence
  sgRNA
  Olfr494_9
ttagtcgtgggatcttatat

SEQ ID NO: 42579 - DNA, 20 bp, Artificial Sequence
  sgRNA
  Olfr494_10
ctccacagaccagaataagg

SEQ ID NO: 42580 - DNA, 20 bp, Artificial Sequence
  sgRNA
  Olfr494_11
tgcacaagatgatggtaaag

SEQ ID NO: 42581 - DNA, 20 bp, Artificial Sequence
  sgRNA
  Olfr494_12
attgcatgttctattcagtt

SEQ ID NO: 42582 - DNA, 20 bp, Artificial Sequence
  sgRNA
  Olfr494_13
acacagacaccaccttattc

SEQ ID NO: 42583 - DNA, 20 bp, Artificial Sequence
  sgRNA
  Olfr494_14
tcccacgactaactggatac

SEQ ID NO: 42584 - DNA, 20 bp, Artificial Sequence
  sgRNA
  Olfr494_15
ctccactgagggcagacaca

SEQ ID NO: 42585 - DNA, 20 bp, Artificial Sequence
  sgRNA
  Olfr494_16
catcatcttgtgcatctacc

SEQ ID NO: 42586 - DNA, 20 bp, Artificial Sequence
  sgRNA
  Olfr494_17
ttggcttagctgctttcttt

SEQ ID NO: 42587 - DNA, 20 bp, Artificial Sequence
  sgRNA
  Olfr494_18
gaggaagttgacaagcatat

SEQ ID NO: 42588 - DNA, 20 bp, Artificial Sequence
  sgRNA
  Olfr494_19
ctactccacagaccagaata

SEQ ID NO: 42589 - DNA, 20 bp, Artificial Sequence
  sgRNA
  Olfr494_20
caggtagatgcacaagatga

SEQ ID NO: 42590 - DNA, 20 bp, Artificial Sequence
  sgRNA
  Olfr495_1
tgtcgcaaggaaaacagctg

SEQ ID NO: 42591 - DNA, 20 bp, Artificial Sequence
  sgRNA
  Olfr495_2
atacatggggtgatgaagct

SEQ ID NO: 42592 - DNA, 20 bp, Artificial Sequence
  sgRNA
  Olfr495_3
agaggatgtctctcagaact

SEQ ID NO: 42593 - DNA, 20 bp, Artificial Sequence
  sgRNA
  Olfr495_4
gttgtaggatcttatataca

SEQ ID NO: 42594 - DNA, 20 bp, Artificial Sequence
  sgRNA
  Olfr495_5
ggaagcactcaactgtcgca

SEQ ID NO: 42595 - DNA, 20 bp, Artificial Sequence
  sgRNA
  Olfr495_6
cggtcaccagatagatgcac

SEQ ID NO: 42596 - DNA, 20 bp, Artificial Sequence
  sgRNA
  Olfr495_7
cagagaagcctgtatccagt

SEQ ID NO: 42597 - DNA, 20 bp, Artificial Sequence
  sgRNA
  Olfr495_8
ggccttgtatcgactttctg

SEQ ID NO: 42598 - DNA, 20 bp, Artificial Sequence
  sgRNA
  Olfr495_9
ggtgttgtctgtattctaca

SEQ ID NO: 42599 - DNA, 20 bp, Artificial Sequence
  sgRNA
  Olfr495_10
agaacagagtaactgcagtg

SEQ ID NO: 42600 - DNA, 20 bp, Artificial Sequence
  sgRNA
  Olfr495_11
gaggaataatgagattaagg

SEQ ID NO: 42601 - DNA, 20 bp, Artificial Sequence
  sgRNA
  Olfr495_12
tgaggaataatgagattaag

SEQ ID NO: 42602 - DNA, 20 bp, Artificial Sequence
  sgRNA
  Olfr495_13
tggctgagaaaaaaatacat

SEQ ID NO: 42603 - DNA, 20 bp, Artificial Sequence
  sgRNA
  Olfr495_14
agaacatccaatgtaggaaa

SEQ ID NO: 42604 - DNA, 20 bp, Artificial Sequence
  sgRNA
  Olfr495_15
tgaactctgtcactatagta

SEQ ID NO: 42605 - DNA, 20 bp, Artificial Sequence
  sgRNA
  Olfr495_16
acagagtaactgcagtgagg

SEQ ID NO: 42606 - DNA, 20 bp, Artificial Sequence
  sgRNA
  Olfr495_17
ggctgagaaaaaaatacatg

SEQ ID NO: 42607 - DNA, 20 bp, Artificial Sequence
  sgRNA
  Olfr495_18
agtaactgcagtgaggtggg

SEQ ID NO: 42608 - DNA, 20 bp, Artificial Sequence
  sgRNA
  Olfr495_19
ccaaataccatttcctacat

SEQ ID NO: 42609 - DNA, 20 bp, Artificial Sequence
  sgRNA
  Olfr495_20
ctccacagaaagtcgataca

SEQ ID NO: 42610 - DNA, 20 bp, Artificial Sequence
  sgRNA
  Olfr497_1
tagtgaagagtacaactctg

SEQ ID NO: 42611 - DNA, 20 bp, Artificial Sequence
  sgRNA
  Olfr497_2
tgggtgtgacagatgatgaa

SEQ ID NO: 42612 - DNA, 20 bp, Artificial Sequence
  sgRNA
  Olfr497_3
cacaaaagtctgtgtccagt

SEQ ID NO: 42613 - DNA, 20 bp, Artificial Sequence
  sgRNA
  Olfr497_4
ctgacccaaagaaatcagcc

SEQ ID NO: 42614 - DNA, 20 bp, Artificial Sequence
  sgRNA
  Olfr497_5
gaaaaagtaaaacatgatga

SEQ ID NO: 42615 - DNA, 20 bp, Artificial Sequence
  sgRNA
  Olfr497_6
gccacatccaaggtaggaaa

SEQ ID NO: 42616 - DNA, 20 bp, Artificial Sequence
  sgRNA
  Olfr497_7
aatggagtgcatcttcagga

SEQ ID NO: 42617 - DNA, 20 bp, Artificial Sequence
  sgRNA
  Olfr497_8
atttggtccacagaagagaa

SEQ ID NO: 42618 - DNA, 20 bp, Artificial Sequence
  sgRNA
  Olfr497_9
ggtttcccatcacagtcacc

SEQ ID NO: 42619 - DNA, 20 bp, Artificial Sequence
  sgRNA
  Olfr497_10
tgaactctgtcactgcagta

SEQ ID NO: 42620 - DNA, 20 bp, Artificial Sequence
  sgRNA
  Olfr497_11
ctgaagatgcactccattga

SEQ ID NO: 42621 - DNA, 20 bp, Artificial Sequence
  sgRNA
  Olfr497_12
atgtggcattcagcagagcc

SEQ ID NO: 42622 - DNA, 20 bp, Artificial Sequence
  sgRNA
  Olfr497_13
cagtatggttcccaacctcc

SEQ ID NO: 42623 - DNA, 20 bp, Artificial Sequence
  sgRNA
  Olfr497_14
agataagtgggttcaacatg

SEQ ID NO: 42624 - DNA, 20 bp, Artificial Sequence
  sgRNA
  Olfr497_15
cgagactctgatgagaagga

SEQ ID NO: 42625 - DNA, 20 bp, Artificial Sequence
  sgRNA
  Olfr497_16
tatcatcctgtgcatctacc

SEQ ID NO: 42626 - DNA, 20 bp, Artificial Sequence
  sgRNA
  Olfr497_17
gtcagttgaatgcttccttc

SEQ ID NO: 42627 - DNA, 20 bp, Artificial Sequence
  sgRNA
  Olfr497_18
gggacgagactctgatgaga

SEQ ID NO: 42628 - DNA, 20 bp, Artificial Sequence
  sgRNA
  Olfr497_19
aggaagttgagaagcatatt

SEQ ID NO: 42629 - DNA, 20 bp, Artificial Sequence
  sgRNA
  Olfr497_20
ctccattgagggcagacaca

SEQ ID NO: 42630 - DNA, 20 bp, Artificial Sequence
  sgRNA
  Olfr498_1
tgtcccaaaaaaagcagccg

SEQ ID NO: 42631 - DNA, 20 bp, Artificial Sequence
  sgRNA
  Olfr498_2
agaggatgtctctaagaact

SEQ ID NO: 42632 - DNA, 20 bp, Artificial Sequence
  sgRNA
  Olfr498_3
gaacaggagagttccaacaa

SEQ ID NO: 42633 - DNA, 20 bp, Artificial Sequence
  sgRNA
  Olfr498_4
gcctgtatccagttggtggt

SEQ ID NO: 42634 - DNA, 20 bp, Artificial Sequence
  sgRNA
  Olfr498_5
atgttctattcagtttacct

SEQ ID NO: 42635 - DNA, 20 bp, Artificial Sequence
  sgRNA
  Olfr498_6
tacaaatcgatcataagcca

SEQ ID NO: 42636 - DNA, 20 bp, Artificial Sequence
  sgRNA
  Olfr498_7
gtactttattctcagccact

SEQ ID NO: 42637 - DNA, 20 bp, Artificial Sequence
  sgRNA
  Olfr498_8
gtggtaggatcttatataca

SEQ ID NO: 42638 - DNA, 20 bp, Artificial Sequence
  sgRNA
  Olfr498_9
gaggctctaaagagacacct

SEQ ID NO: 42639 - DNA, 20 bp, Artificial Sequence
  sgRNA
  Olfr498_10
agagactctgataagaagga

SEQ ID NO: 42640 - DNA, 20 bp, Artificial Sequence
  sgRNA
  Olfr498_11
aagaaaatactttcttacca

SEQ ID NO: 42641 - DNA, 20 bp, Artificial Sequence
  sgRNA
  Olfr498_12
agaacagaataactgcagtg

SEQ ID NO: 42642 - DNA, 20 bp, Artificial Sequence
  sgRNA
  Olfr498_13
tataagatcctaccaccaac

SEQ ID NO: 42643 - DNA, 20 bp, Artificial Sequence
  sgRNA
  Olfr498_14
tggctgagaataaagtacat

SEQ ID NO: 42644 - DNA, 20 bp, Artificial Sequence
  sgRNA
  Olfr498_15
agaagcctgtatccagttgg

SEQ ID NO: 42645 - DNA, 20 bp, Artificial Sequence
  sgRNA
  Olfr498_16
atttggtccacagaagaaca

SEQ ID NO: 42646 - DNA, 20 bp, Artificial Sequence
  sgRNA
  Olfr498_17
ggccttgcatcgactttcgg

SEQ ID NO: 42647 - DNA, 20 bp, Artificial Sequence
  sgRNA
  Olfr498_18
agtgaggtgagaggtacagg

SEQ ID NO: 42648 - DNA, 20 bp, Artificial Sequence
  sgRNA
  Olfr498_19
ctccaccgaaagtcgatgca

SEQ ID NO: 42649 - DNA, 20 bp, Artificial Sequence
  sgRNA
  Olfr498_20
aggaaggtagcaagcatatt

SEQ ID NO: 42650 - DNA, 20 bp, Artificial Sequence
  sgRNA
  Olfr502_1
tgaatgagggaacaactgca

SEQ ID NO: 42651 - DNA, 20 bp, Artificial Sequence
  sgRNA
  Olfr502_2
cagctggacacaaacctgtg

SEQ ID NO: 42652 - DNA, 20 bp, Artificial Sequence
  sgRNA
  Olfr502_3
agaggacaactctaaggact

SEQ ID NO: 42653 - DNA, 20 bp, Artificial Sequence
  sgRNA
  Olfr502_4
accatctcctatctaggatg

SEQ ID NO: 42654 - DNA, 20 bp, Artificial Sequence
  sgRNA
  Olfr502_5
gggtgctctgaaaagacagt

SEQ ID NO: 42655 - DNA, 20 bp, Artificial Sequence
  sgRNA
  Olfr502_6
gtttgtgtccagctgcttgt

SEQ ID NO: 42656 - DNA, 20 bp, Artificial Sequence
  sgRNA
  Olfr502_7
aggtagagaaagccttctgt

SEQ ID NO: 42657 - DNA, 20 bp, Artificial Sequence
  sgRNA
  Olfr502_8
gccacatcctagataggaga

SEQ ID NO: 42658 - DNA, 20 bp, Artificial Sequence
  sgRNA
  Olfr502_9
tataagatcctacaagcagc

SEQ ID NO: 42659 - DNA, 20 bp, Artificial Sequence
  sgRNA
  Olfr502_10
tataaatcggtcataagcca

SEQ ID NO: 42660 - DNA, 20 bp, Artificial Sequence
  sgRNA
  Olfr502_11
gttgttccctcattcacagc

SEQ ID NO: 42661 - DNA, 20 bp, Artificial Sequence
  sgRNA
  Olfr502_12
tgacaaagaggacaactcta

SEQ ID NO: 42662 - DNA, 20 bp, Artificial Sequence
  sgRNA
  Olfr502_13
agatggtgtttctctccacc

SEQ ID NO: 42663 - DNA, 20 bp, Artificial Sequence
  sgRNA
  Olfr502_14
ggtggtatctgtgttctaca

SEQ ID NO: 42664 - DNA, 20 bp, Artificial Sequence
  sgRNA
  Olfr502_15
atggagccagctgtgaatga

SEQ ID NO: 42665 - DNA, 20 bp, Artificial Sequence
  sgRNA
  Olfr502_16
agaaaagagtgactgcagtg

SEQ ID NO: 42666 - DNA, 20 bp, Artificial Sequence
  sgRNA
  Olfr502_17
ggctacaaattgctataaat

SEQ ID NO: 42667 - DNA, 20 bp, Artificial Sequence
  sgRNA
  Olfr502_18
tgaatcctgtcactgcagtg

SEQ ID NO: 42668 - DNA, 20 bp, Artificial Sequence
  sgRNA
  Olfr502_19
cttgtaggatcttatatagg

SEQ ID NO: 42669 - DNA, 20 bp, Artificial Sequence
  sgRNA
  Olfr502_20
ggtatctgtgttctacatgg

SEQ ID NO: 42670 - DNA, 20 bp, Artificial Sequence
  sgRNA
  Olfr503_1
tctgtagccaagttgccctg

SEQ ID NO: 42671 - DNA, 20 bp, Artificial Sequence
  sgRNA
  Olfr503_2
tattgcctcgaaagtagggt

SEQ ID NO: 42672 - DNA, 20 bp, Artificial Sequence
  sgRNA
  Olfr503_3
tcttcatccataccttcatg

SEQ ID NO: 42673 - DNA, 20 bp, Artificial Sequence
  sgRNA
  Olfr503_4
agaagatgcacagggctttg

SEQ ID NO: 42674 - DNA, 20 bp, Artificial Sequence
  sgRNA
  Olfr503_5
gtaatgcagagggtagcaaa

SEQ ID NO: 42675 - DNA, 20 bp, Artificial Sequence
  sgRNA
  Olfr503_6
aagtgcctaccctactttcg

SEQ ID NO: 42676 - DNA, 20 bp, Artificial Sequence
  sgRNA
  Olfr503_7
attatattgcctcgaaagta

SEQ ID NO: 42677 - DNA, 20 bp, Artificial Sequence
  sgRNA
  Olfr503_8
ttcaccttgacattgccaca

SEQ ID NO: 42678 - DNA, 20 bp, Artificial Sequence
  sgRNA
  Olfr503_9
agaatggtggagtaatgcag

SEQ ID NO: 42679 - DNA, 20 bp, Artificial Sequence
  sgRNA
  Olfr503_10
ttgtgtgccccccaaagtgg

SEQ ID NO: 42680 - DNA, 20 bp, Artificial Sequence
  sgRNA
  Olfr503_11
tataggagattgtgatacac

SEQ ID NO: 42681 - DNA, 20 bp, Artificial Sequence
  sgRNA
  Olfr503_12
caatgatgtggcaagatgga

SEQ ID NO: 42682 - DNA, 20 bp, Artificial Sequence
  sgRNA
  Olfr503_13
gaatggtggagtaatgcaga

SEQ ID NO: 42683 - DNA, 20 bp, Artificial Sequence
  sgRNA
  Olfr503_14
tgtgcatgtgttccaggcct

SEQ ID NO: 42684 - DNA, 20 bp, Artificial Sequence
  sgRNA
  Olfr503_15
tatcatgattctgagggcag

SEQ ID NO: 42685 - DNA, 20 bp, Artificial Sequence
  sgRNA
  Olfr503_16
tgtgtgccccccaaagtggt

SEQ ID NO: 42686 - DNA, 20 bp, Artificial Sequence
  sgRNA
  Olfr503_17
gttgccctgtggcaatgtca

SEQ ID NO: 42687 - DNA, 20 bp, Artificial Sequence
  sgRNA
  Olfr503_18
cacttggagagaaatatgaa

SEQ ID NO: 42688 - DNA, 20 bp, Artificial Sequence
  sgRNA
  Olfr503_19
ggtagcaaatggctacatag

SEQ ID NO: 42689 - DNA, 20 bp, Artificial Sequence
  sgRNA
  Olfr503_20
gcaacttggctacagacatg

SEQ ID NO: 42690 - DNA, 20 bp, Artificial Sequence
  sgRNA
  Olfr504_1
tcttgaacaataattccact

SEQ ID NO: 42691 - DNA, 20 bp, Artificial Sequence
  sgRNA
  Olfr504_2
taaccttggaatcacaagcc

SEQ ID NO: 42692 - DNA, 20 bp, Artificial Sequence
  sgRNA
  Olfr504_3
gctgccagctgtgaatgccc

SEQ ID NO: 42693 - DNA, 20 bp, Artificial Sequence
  sgRNA
  Olfr504_4
ataattgatgaatagtggag

SEQ ID NO: 42694 - DNA, 20 bp, Artificial Sequence
  sgRNA
  Olfr504_5
gatagagcaaagtcaatggt

SEQ ID NO: 42695 - DNA, 20 bp, Artificial Sequence
  sgRNA
  Olfr504_6
actcaggcagggcttccaaa

SEQ ID NO: 42696 - DNA, 20 bp, Artificial Sequence
  sgRNA
  Olfr504_7
tgctctatctctcagcaata

SEQ ID NO: 42697 - DNA, 20 bp, Artificial Sequence
  sgRNA
  Olfr504_8
gagagatagagcaaagtcaa

SEQ ID NO: 42698 - DNA, 20 bp, Artificial Sequence
  sgRNA
  Olfr504_9
gagaaaggatacctaagaaa

SEQ ID NO: 42699 - DNA, 20 bp, Artificial Sequence
  sgRNA
  Olfr504_10
tgattccaaggttagagcac

SEQ ID NO: 42700 - DNA, 20 bp, Artificial Sequence
  sgRNA
  Olfr504_11
tgcctgtgcttgcatcccag

SEQ ID NO: 42701 - DNA, 20 bp, Artificial Sequence
  sgRNA
  Olfr504_12
cattgcctgtgctctaacct

SEQ ID NO: 42702 - DNA, 20 bp, Artificial Sequence
  sgRNA
  Olfr504_13
aggaccagacaactcaggca

SEQ ID NO: 42703 - DNA, 20 bp, Artificial Sequence
  sgRNA
  Olfr504_14
gtctggtatctgcctctgca

SEQ ID NO: 42704 - DNA, 20 bp, Artificial Sequence
  sgRNA
  Olfr504_15
gttggaatggggagtgaact

SEQ ID NO: 42705 - DNA, 20 bp, Artificial Sequence
  sgRNA
  Olfr504_16
cacttaggaccagacaactc

SEQ ID NO: 42706 - DNA, 20 bp, Artificial Sequence
  sgRNA
  Olfr504_17
tttccagttaatcctggcat

SEQ ID NO: 42707 - DNA, 20 bp, Artificial Sequence
  sgRNA
  Olfr504_18
ctacaatgacagtatagaag

SEQ ID NO: 42708 - DNA, 20 bp, Artificial Sequence
  sgRNA
  Olfr504_19
atagagcaaagtcaatggta

SEQ ID NO: 42709 - DNA, 20 bp, Artificial Sequence
  sgRNA
  Olfr504_20
ggctttaaagatcaaggagt

SEQ ID NO: 42710 - DNA, 20 bp, Artificial Sequence
  sgRNA
  Olfr506_1
gaacaagagagttcaactag

SEQ ID NO: 42711 - DNA, 20 bp, Artificial Sequence
  sgRNA
  Olfr506_2
attgggattaacagatgagc

SEQ ID NO: 42712 - DNA, 20 bp, Artificial Sequence
  sgRNA
  Olfr506_3
accattacatacctaggatg

SEQ ID NO: 42713 - DNA, 20 bp, Artificial Sequence
  sgRNA
  Olfr506_4
agtaaagaacgaaagggtga

SEQ ID NO: 42714 - DNA, 20 bp, Artificial Sequence
  sgRNA
  Olfr506_5
acaagagagttcaactagag

SEQ ID NO: 42715 - DNA, 20 bp, Artificial Sequence
  sgRNA
  Olfr506_6
tgtatgctactacaagcaac

SEQ ID NO: 42716 - DNA, 20 bp, Artificial Sequence
  sgRNA
  Olfr506_7
cttgtagtagcatacataag

SEQ ID NO: 42717 - DNA, 20 bp, Artificial Sequence
  sgRNA
  Olfr506_8
tggtaaagagaacaactcta

SEQ ID NO: 42718 - DNA, 20 bp, Artificial Sequence
  sgRNA
  Olfr506_9
tgaactctgtcaatgcagtg

SEQ ID NO: 42719 - DNA, 20 bp, Artificial Sequence
  sgRNA
  Olfr506_10
ggtgctctgaagagacaact

SEQ ID NO: 42720 - DNA, 20 bp, Artificial Sequence
  sgRNA
  Olfr506_11
cacaaagcgatcataagcca

SEQ ID NO: 42721 - DNA, 20 bp, Artificial Sequence
  sgRNA
  Olfr506_12
gccacatcctaggtatgtaa

SEQ ID NO: 42722 - DNA, 20 bp, Artificial Sequence
  sgRNA
  Olfr506_13
aacaagagagttcaactaga

SEQ ID NO: 42723 - DNA, 20 bp, Artificial Sequence
  sgRNA
  Olfr506_14
gacagtgccaacagatatag

SEQ ID NO: 42724 - DNA, 20 bp, Artificial Sequence
  sgRNA
  Olfr506_15
aaagaacgaaagggtgaagg

SEQ ID NO: 42725 - DNA, 20 bp, Artificial Sequence
  sgRNA
  Olfr506_16
attcttgccactatatctgt

SEQ ID NO: 42726 - DNA, 20 bp, Artificial Sequence
  sgRNA
  Olfr506_17
catggcttatgatcgctttg

SEQ ID NO: 42727 - DNA, 20 bp, Artificial Sequence
  sgRNA
  Olfr506_18
caagctggatgccacatcct

SEQ ID NO: 42728 - DNA, 20 bp, Artificial Sequence
  sgRNA
  Olfr506_19
cagtgtggtttccatcctcc

SEQ ID NO: 42729 - DNA, 20 bp, Artificial Sequence
  sgRNA
  Olfr506_20
aagagaacaactctaaggac

SEQ ID NO: 42730 - DNA, 20 bp, Artificial Sequence
  sgRNA
  Olfr507_1
aaaatgaatcaagaattagc

SEQ ID NO: 42731 - DNA, 20 bp, Artificial Sequence
  sgRNA
  Olfr507_2
gctagtgggatcttatatag

SEQ ID NO: 42732 - DNA, 20 bp, Artificial Sequence
  sgRNA
  Olfr507_3
agaggacaactttaaggact

SEQ ID NO: 42733 - DNA, 20 bp, Artificial Sequence
  sgRNA
  Olfr507_4
ctatgtcaacagaagccaag

SEQ ID NO: 42734 - DNA, 20 bp, Artificial Sequence
  sgRNA
  Olfr507_5
gtctgtatccagttgctagt

SEQ ID NO: 42735 - DNA, 20 bp, Artificial Sequence
  sgRNA
  Olfr507_6
ctagtgggatcttatatagg

SEQ ID NO: 42736 - DNA, 20 bp, Artificial Sequence
  sgRNA
  Olfr507_7
tataagatcccactagcaac

SEQ ID NO: 42737 - DNA, 20 bp, Artificial Sequence
  sgRNA
  Olfr507_8
agtctgtatccagttgctag

SEQ ID NO: 42738 - DNA, 20 bp, Artificial Sequence
  sgRNA
  Olfr507_9
gtagattagggggttcaaca

SEQ ID NO: 42739 - DNA, 20 bp, Artificial Sequence
  sgRNA
  Olfr507_10
catcattgtgatcacagtgt

SEQ ID NO: 42740 - DNA, 20 bp, Artificial Sequence
  sgRNA
  Olfr507_11
tcctaaggctgtagattagg

SEQ ID NO: 42741 - DNA, 20 bp, Artificial Sequence
  sgRNA
  Olfr507_12
cagtgtggttcccatccttc

SEQ ID NO: 42742 - DNA, 20 bp, Artificial Sequence
  sgRNA
  Olfr507_13
agaaaacagtgactgctgtg

SEQ ID NO: 42743 - DNA, 20 bp, Artificial Sequence
  sgRNA
  Olfr507_14
catggcttatgatcacttca

SEQ ID NO: 42744 - DNA, 20 bp, Artificial Sequence
  sgRNA
  Olfr507_15
tggtgaagaggacaacttta

SEQ ID NO: 42745 - DNA, 20 bp, Artificial Sequence
  sgRNA
  Olfr507_16
catgaagtgatcataagcca

SEQ ID NO: 42746 - DNA, 20 bp, Artificial Sequence
  sgRNA
  Olfr507_17
aaacagtgactgctgtgagg

SEQ ID NO: 42747 - DNA, 20 bp, Artificial Sequence
  sgRNA
  Olfr507_18
acacagacaacaccttgttt

SEQ ID NO: 42748 - DNA, 20 bp, Artificial Sequence
  sgRNA
  Olfr507_19
tgctagtgggatcttatata

SEQ ID NO: 42749 - DNA, 20 bp, Artificial Sequence
  sgRNA
  Olfr507_20
gtcatttcttctggctgcca

SEQ ID NO: 42750 - DNA, 20 bp, Artificial Sequence
  sgRNA
  Olfr508_1
ctgcgtggcatagagcagag

SEQ ID NO: 42751 - DNA, 20 bp, Artificial Sequence
  sgRNA
  Olfr508_2
gtcacacccatcatgctgaa

SEQ ID NO: 42752 - DNA, 20 bp, Artificial Sequence
  sgRNA
  Olfr508_3
attcacacatccacctaggt

SEQ ID NO: 42753 - DNA, 20 bp, Artificial Sequence
  sgRNA
  Olfr508_4
acacaataaataaaatggca

SEQ ID NO: 42754 - DNA, 20 bp, Artificial Sequence
  sgRNA
  Olfr508_5
aagcattcacacatccacct

SEQ ID NO: 42755 - DNA, 20 bp, Artificial Sequence
  sgRNA
  Olfr508_6
ctgcacctcccacctcactg

SEQ ID NO: 42756 - DNA, 20 bp, Artificial Sequence
  sgRNA
  Olfr508_7
gcatcttcaagattgagaca

SEQ ID NO: 42757 - DNA, 20 bp, Artificial Sequence
  sgRNA
  Olfr508_8
tcattccagcaatctcttca

SEQ ID NO: 42758 - DNA, 20 bp, Artificial Sequence
  sgRNA
  Olfr508_9
gctgagcaaaaggtacatgg

SEQ ID NO: 42759 - DNA, 20 bp, Artificial Sequence
  sgRNA
  Olfr508_10
tatttggtctacaaaaggac

SEQ ID NO: 42760 - DNA, 20 bp, Artificial Sequence
  sgRNA
  Olfr508_11
gactgtggaggacatctgcg

SEQ ID NO: 42761 - DNA, 20 bp, Artificial Sequence
  sgRNA
  Olfr508_12
gtgggagcttcctacctagg

SEQ ID NO: 42762 - DNA, 20 bp, Artificial Sequence
  sgRNA
  Olfr508_13
agaggccatgaaaaaattga

SEQ ID NO: 42763 - DNA, 20 bp, Artificial Sequence
  sgRNA
  Olfr508_14
caatgtctacaaatgccaaa

SEQ ID NO: 42764 - DNA, 20 bp, Artificial Sequence
  sgRNA
  Olfr508_15
agaaagcccttcagcatgat

SEQ ID NO: 42765 - DNA, 20 bp, Artificial Sequence
  sgRNA
  Olfr508_16
atagagtgaccgcagtgagg

SEQ ID NO: 42766 - DNA, 20 bp, Artificial Sequence
  sgRNA
  Olfr508_17
ctgcggtcactctattctat

SEQ ID NO: 42767 - DNA, 20 bp, Artificial Sequence
  sgRNA
  Olfr508_18
cacagtctgtattctcctag

SEQ ID NO: 42768 - DNA, 20 bp, Artificial Sequence
  sgRNA
  Olfr508_19
tggctgagcaaaaggtacat

SEQ ID NO: 42769 - DNA, 20 bp, Artificial Sequence
  sgRNA
  Olfr508_20
ttactccacagaccagaaca

SEQ ID NO: 42770 - DNA, 20 bp, Artificial Sequence
  sgRNA
  Olfr510_1
agaggatgactctaagaact

SEQ ID NO: 42771 - DNA, 20 bp, Artificial Sequence
  sgRNA
  Olfr510_2
aaaatgaatcaagaattatg

SEQ ID NO: 42772 - DNA, 20 bp, Artificial Sequence
  sgRNA
  Olfr510_3
tatggttgtcaacttcctgg

SEQ ID NO: 42773 - DNA, 20 bp, Artificial Sequence
  sgRNA
  Olfr510_4
tgtgtatccaattgcttgta

SEQ ID NO: 42774 - DNA, 20 bp, Artificial Sequence
  sgRNA
  Olfr510_5
ataacagagtgactacagtg

SEQ ID NO: 42775 - DNA, 20 bp, Artificial Sequence
  sgRNA
  Olfr510_6
ggtgctctgaagaaacagct

SEQ ID NO: 42776 - DNA, 20 bp, Artificial Sequence
  sgRNA
  Olfr510_7
ggagcagtatatcctacatt

SEQ ID NO: 42777 - DNA, 20 bp, Artificial Sequence
  sgRNA
  Olfr510_8
agtggaatgcatcttcagga

SEQ ID NO: 42778 - DNA, 20 bp, Artificial Sequence
  sgRNA
  Olfr510_9
atatactgctcctctccacc

SEQ ID NO: 42779 - DNA, 20 bp, Artificial Sequence
  sgRNA
  Olfr510_10
tgaactctgtgactacagtg

SEQ ID NO: 42780 - DNA, 20 bp, Artificial Sequence
  sgRNA
  Olfr510_11
ggtgatatctgtgttctaca

SEQ ID NO: 42781 - DNA, 20 bp, Artificial Sequence
  sgRNA
  Olfr510_12
tataagaccctacaagcaat

SEQ ID NO: 42782 - DNA, 20 bp, Artificial Sequence
  sgRNA
  Olfr510_13
agaagagatggctatgtcaa

SEQ ID NO: 42783 - DNA, 20 bp, Artificial Sequence
  sgRNA
  Olfr510_14
gattcccagacacagtcacc

SEQ ID NO: 42784 - DNA, 20 bp, Artificial Sequence
  sgRNA
  Olfr510_15
acagagtgactacagtgagg

SEQ ID NO: 42785 - DNA, 20 bp, Artificial Sequence
  sgRNA
  Olfr510_16
agtatatcctacattgggtg

SEQ ID NO: 42786 - DNA, 20 bp, Artificial Sequence
  sgRNA
  Olfr510_17
gactcagaaaaaagtacatg

SEQ ID NO: 42787 - DNA, 20 bp, Artificial Sequence
  sgRNA
  Olfr510_18
gatatctgtgttctacatgg

SEQ ID NO: 42788 - DNA, 20 bp, Artificial Sequence
  sgRNA
  Olfr510_19
ggtgatgaggatgcaggtat

SEQ ID NO: 42789 - DNA, 20 bp, Artificial Sequence
  sgRNA
  Olfr510_20
tgactcagaaaaaagtacat

SEQ ID NO: 42790 - DNA, 20 bp, Artificial Sequence
  sgRNA
  Olfr512_1
gagtactctacagaccacat

SEQ ID NO: 42791 - DNA, 20 bp, Artificial Sequence
  sgRNA
  Olfr512_2
tgataactgtgctgaaacag

SEQ ID NO: 42792 - DNA, 20 bp, Artificial Sequence
  sgRNA
  Olfr512_3
tcatggggtaggatagagga

SEQ ID NO: 42793 - DNA, 20 bp, Artificial Sequence
  sgRNA
  Olfr512_4
catgccagttctagcacagg

SEQ ID NO: 42794 - DNA, 20 bp, Artificial Sequence
  sgRNA
  Olfr512_5
gcccaaatccaggtactcac

SEQ ID NO: 42795 - DNA, 20 bp, Artificial Sequence
  sgRNA
  Olfr512_6
ggtgagatgagaagcacacg

SEQ ID NO: 42796 - DNA, 20 bp, Artificial Sequence
  sgRNA
  Olfr512_7
gttccaatattgtaatgagg

SEQ ID NO: 42797 - DNA, 20 bp, Artificial Sequence
  sgRNA
  Olfr512_8
gaattctcttcaccatcctg

SEQ ID NO: 42798 - DNA, 20 bp, Artificial Sequence
  sgRNA
  Olfr512_9
ggggaccatgacaatgaaaa

SEQ ID NO: 42799 - DNA, 20 bp, Artificial Sequence
  sgRNA
  Olfr512_10
gatcataagccattgctccc

SEQ ID NO: 42800 - DNA, 20 bp, Artificial Sequence
  sgRNA
  Olfr512_11
ggtctgtagagtactcatca

SEQ ID NO: 42801 - DNA, 20 bp, Artificial Sequence
  sgRNA
  Olfr512_12
gatagttagaaaatctcaag

SEQ ID NO: 42802 - DNA, 20 bp, Artificial Sequence
  sgRNA
  Olfr512_13
gggctgtagataaattatac

SEQ ID NO: 42803 - DNA, 20 bp, Artificial Sequence
  sgRNA
  Olfr512_14
gcacatgccagttctagcac

SEQ ID NO: 42804 - DNA, 20 bp, Artificial Sequence
  sgRNA
  Olfr512_15
tgagtactctacagaccaca

SEQ ID NO: 42805 - DNA, 20 bp, Artificial Sequence
  sgRNA
  Olfr512_16
cagtcaccagatagataact

SEQ ID NO: 42806 - DNA, 20 bp, Artificial Sequence
  sgRNA
  Olfr512_17
ttgtgcaaaacaacctccaa

SEQ ID NO: 42807 - DNA, 20 bp, Artificial Sequence
  sgRNA
  Olfr512_18
aaaacaacctccaaaggaaa

SEQ ID NO: 42808 - DNA, 20 bp, Artificial Sequence
  sgRNA
  Olfr512_19
agggttccaatattgtaatg

SEQ ID NO: 42809 - DNA, 20 bp, Artificial Sequence
  sgRNA
  Olfr512_20
gactttcctagttatctatc

SEQ ID NO: 42810 - DNA, 20 bp, Artificial Sequence
  sgRNA
  Olfr514_1
aaagatgacagtaacaatgg

SEQ ID NO: 42811 - DNA, 20 bp, Artificial Sequence
  sgRNA
  Olfr514_2
ctgcgcaaaacaacccccaa

SEQ ID NO: 42812 - DNA, 20 bp, Artificial Sequence
  sgRNA
  Olfr514_3
agctactgtgtcggtcacat

SEQ ID NO: 42813 - DNA, 20 bp, Artificial Sequence
  sgRNA
  Olfr514_4
taatcattgggtaggttaga

SEQ ID NO: 42814 - DNA, 20 bp, Artificial Sequence
  sgRNA
  Olfr514_5
ggaagtgagaaaatcccaac

SEQ ID NO: 42815 - DNA, 20 bp, Artificial Sequence
  sgRNA
  Olfr514_6
gctgtagaagagggtgacag

SEQ ID NO: 42816 - DNA, 20 bp, Artificial Sequence
  sgRNA
  Olfr514_7
acaggtacatggggatatgt

SEQ ID NO: 42817 - DNA, 20 bp, Artificial Sequence
  sgRNA
  Olfr514_8
tgaggatgccatccactact

SEQ ID NO: 42818 - DNA, 20 bp, Artificial Sequence
  sgRNA
  Olfr514_9
tgaaggaatagacttcaaac

SEQ ID NO: 42819 - DNA, 20 bp, Artificial Sequence
  sgRNA
  Olfr514_10
tgtggttgagttcatcctgt

SEQ ID NO: 42820 - DNA, 20 bp, Artificial Sequence
  sgRNA
  Olfr514_11
gaaattggtggtgtgctcat

SEQ ID NO: 42821 - DNA, 20 bp, Artificial Sequence
  sgRNA
  Olfr514_12
ttctgtctcccagtagtgga

SEQ ID NO: 42822 - DNA, 20 bp, Artificial Sequence
  sgRNA
  Olfr514_13
gcatgctgtgctgtagaaga

SEQ ID NO: 42823 - DNA, 20 bp, Artificial Sequence
  sgRNA
  Olfr514_14
tttgctcataatcattgggt

SEQ ID NO: 42824 - DNA, 20 bp, Artificial Sequence
  sgRNA
  Olfr514_15
tatcatgacagctactgtgt

SEQ ID NO: 42825 - DNA, 20 bp, Artificial Sequence
  sgRNA
  Olfr514_16
tttgaagtctattccttcac

SEQ ID NO: 42826 - DNA, 20 bp, Artificial Sequence
  sgRNA
  Olfr514_17
ggggaccaggacaagcaaaa

SEQ ID NO: 42827 - DNA, 20 bp, Artificial Sequence
  sgRNA
  Olfr514_18
acatggggatatgtaggctg

SEQ ID NO: 42828 - DNA, 20 bp, Artificial Sequence
  sgRNA
  Olfr514_19
ggaatagacttcaaacagga

SEQ ID NO: 42829 - DNA, 20 bp, Artificial Sequence
  sgRNA
  Olfr514_20
acatgtgtacttggagttca

SEQ ID NO: 42830 - DNA, 20 bp, Artificial Sequence
  sgRNA
  Olfr516_1
catcacacctgaaatactgg

SEQ ID NO: 42831 - DNA, 20 bp, Artificial Sequence
  sgRNA
  Olfr516_2
gactactctgcagaccacat

SEQ ID NO: 42832 - DNA, 20 bp, Artificial Sequence
  sgRNA
  Olfr516_3
tcacggggtaagatagagga

SEQ ID NO: 42833 - DNA, 20 bp, Artificial Sequence
  sgRNA
  Olfr516_4
acatagggatgtgcaaactc

SEQ ID NO: 42834 - DNA, 20 bp, Artificial Sequence
  sgRNA
  Olfr516_5
tgactactctgcagaccaca

SEQ ID NO: 42835 - DNA, 20 bp, Artificial Sequence
  sgRNA
  Olfr516_6
ataatcacggggtaagatag

SEQ ID NO: 42836 - DNA, 20 bp, Artificial Sequence
  sgRNA
  Olfr516_7
tgatgactgtactgaaacag

SEQ ID NO: 42837 - DNA, 20 bp, Artificial Sequence
  sgRNA
  Olfr516_8
acaagagtatcaacaggaag

SEQ ID NO: 42838 - DNA, 20 bp, Artificial Sequence
  sgRNA
  Olfr516_9
tttgcagaaacaggtacata

SEQ ID NO: 42839 - DNA, 20 bp, Artificial Sequence
  sgRNA
  Olfr516_10
tataagacaagagtatcaac

SEQ ID NO: 42840 - DNA, 20 bp, Artificial Sequence
  sgRNA
  Olfr516_11
ggtctgcagagtagtcatca

SEQ ID NO: 42841 - DNA, 20 bp, Artificial Sequence
  sgRNA
  Olfr516_12
agacaagagtatcaacagga

SEQ ID NO: 42842 - DNA, 20 bp, Artificial Sequence
  sgRNA
  Olfr516_13
gacaagagtatcaacaggaa

SEQ ID NO: 42843 - DNA, 20 bp, Artificial Sequence
  sgRNA
  Olfr516_14
tacttcattcttctctttgg

SEQ ID NO: 42844 - DNA, 20 bp, Artificial Sequence
  sgRNA
  Olfr516_15
gtcaggaccaccagtatttc

SEQ ID NO: 42845 - DNA, 20 bp, Artificial Sequence
  sgRNA
  Olfr516_16
tctgcaaaatttatctttag

SEQ ID NO: 42846 - DNA, 20 bp, Artificial Sequence
  sgRNA
  Olfr517_1
ctggggtttcacatgagatg

SEQ ID NO: 42847 - DNA, 20 bp, Artificial Sequence
  sgRNA
  Olfr517_2
gaggatgacagacataatga

SEQ ID NO: 42848 - DNA, 20 bp, Artificial Sequence
  sgRNA
  Olfr517_3
gactactttgcagaccatat

SEQ ID NO: 42849 - DNA, 20 bp, Artificial Sequence
  sgRNA
  Olfr517_4
cgaactatcctgaactccaa

SEQ ID NO: 42850 - DNA, 20 bp, Artificial Sequence
  sgRNA
  Olfr517_5
gtgtgcctctcatctcacct

SEQ ID NO: 42851 - DNA, 20 bp, Artificial Sequence
  sgRNA
  Olfr517_6
gatagttcgaaaatcccaag

SEQ ID NO: 42852 - DNA, 20 bp, Artificial Sequence
  sgRNA
  Olfr517_7
gccatagaagagggtgaccg

SEQ ID NO: 42853 - DNA, 20 bp, Artificial Sequence
  sgRNA
  Olfr517_8
gacaaaagaatcagcacgaa

SEQ ID NO: 42854 - DNA, 20 bp, Artificial Sequence
  sgRNA
  Olfr517_9
ggggaaactgaacacccata

SEQ ID NO: 42855 - DNA, 20 bp, Artificial Sequence
  sgRNA
  Olfr517_10
gtgttcagtttcccctactg

SEQ ID NO: 42856 - DNA, 20 bp, Artificial Sequence
  sgRNA
  Olfr517_11
atttcattggagccacagta

SEQ ID NO: 42857 - DNA, 20 bp, Artificial Sequence
  sgRNA
  Olfr517_12
tgagatgtggttaatttcat

SEQ ID NO: 42858 - DNA, 20 bp, Artificial Sequence
  sgRNA
  Olfr517_13
tatgcaggctccggtccagg

SEQ ID NO: 42859 - DNA, 20 bp, Artificial Sequence
  sgRNA
  Olfr517_14
ggaggatgacagacataatg

SEQ ID NO: 42860 - DNA, 20 bp, Artificial Sequence
  sgRNA
  Olfr517_15
catttccagtcagagtcacc

SEQ ID NO: 42861 - DNA, 20 bp, Artificial Sequence
  sgRNA
  Olfr517_16
atgcaagctccagtactgct

SEQ ID NO: 42862 - DNA, 20 bp, Artificial Sequence
  sgRNA
  Olfr517_17
tcacagggtaggatagagga

SEQ ID NO: 42863 - DNA, 20 bp, Artificial Sequence
  sgRNA
  Olfr517_18
cattatgtctgtcatcctcc

SEQ ID NO: 42864 - DNA, 20 bp, Artificial Sequence
  sgRNA
  Olfr517_19
ggtcaccctcttctatggca

SEQ ID NO: 42865 - DNA, 20 bp, Artificial Sequence
  sgRNA
  Olfr517_20
tgcaagctccagtactgctg

SEQ ID NO: 42866 - DNA, 20 bp, Artificial Sequence
  sgRNA
  Olfr518_1
ataatcatagggtaagacag

SEQ ID NO: 42867 - DNA, 20 bp, Artificial Sequence
  sgRNA
  Olfr518_2
tttgcagaaacagatacatg

SEQ ID NO: 42868 - DNA, 20 bp, Artificial Sequence
  sgRNA
  Olfr518_3
ctgcccttggagttcaggga

SEQ ID NO: 42869 - DNA, 20 bp, Artificial Sequence
  sgRNA
  Olfr518_4
atgggtatctgggatcatgg

SEQ ID NO: 42870 - DNA, 20 bp, Artificial Sequence
  sgRNA
  Olfr518_5
gctccactgcagcaacaaga

SEQ ID NO: 42871 - DNA, 20 bp, Artificial Sequence
  sgRNA
  Olfr518_6
gggtcaccagataaattacc

SEQ ID NO: 42872 - DNA, 20 bp, Artificial Sequence
  sgRNA
  Olfr518_7
agaggcgcaaaatataagag

SEQ ID NO: 42873 - DNA, 20 bp, Artificial Sequence
  sgRNA
  Olfr518_8
gatggcagattgcagcaaat

SEQ ID NO: 42874 - DNA, 20 bp, Artificial Sequence
  sgRNA
  Olfr518_9
gcgcctctaagagcagctcg

SEQ ID NO: 42875 - DNA, 20 bp, Artificial Sequence
  sgRNA
  Olfr518_10
gtttctgcaaaatttatctg

SEQ ID NO: 42876 - DNA, 20 bp, Artificial Sequence
  sgRNA
  Olfr518_11
ggaaatggttgctttctcgc

SEQ ID NO: 42877 - DNA, 20 bp, Artificial Sequence
  sgRNA
  Olfr518_12
tgtgcaagctctggtccagg

SEQ ID NO: 42878 - DNA, 20 bp, Artificial Sequence
  sgRNA
  Olfr518_13
ctgccttccctgaactccaa

SEQ ID NO: 42879 - DNA, 20 bp, Artificial Sequence
  sgRNA
  Olfr518_14
ggctactgtgcagaccacat

SEQ ID NO: 42880 - DNA, 20 bp, Artificial Sequence
  sgRNA
  Olfr518_15
ttgcgcctctaagagcagct

SEQ ID NO: 42881 - DNA, 20 bp, Artificial Sequence
  sgRNA
  Olfr518_16
ggctccactgcagcaacaag

SEQ ID NO: 42882 - DNA, 20 bp, Artificial Sequence
  sgRNA
  Olfr518_17
tttgaagtctacgccttcac

SEQ ID NO: 42883 - DNA, 20 bp, Artificial Sequence
  sgRNA
  Olfr518_18
ggaaggcagaaaagcccagg

SEQ ID NO: 42884 - DNA, 20 bp, Artificial Sequence
  sgRNA
  Olfr518_19
tgaaggcgtagacttcaaac

SEQ ID NO: 42885 - DNA, 20 bp, Artificial Sequence
  sgRNA
  Olfr518_20
ccctatgattatgaacaaaa

SEQ ID NO: 42886 - DNA, 20 bp, Artificial Sequence
  sgRNA
  Olfr519_1
acacatcaccaatttcacaa

SEQ ID NO: 42887 - DNA, 20 bp, Artificial Sequence
  sgRNA
  Olfr519_2
tctgcagaaacaaatacatg

SEQ ID NO: 42888 - DNA, 20 bp, Artificial Sequence
  sgRNA
  Olfr519_3
gatcaaaatggtgcttgtga

SEQ ID NO: 42889 - DNA, 20 bp, Artificial Sequence
  sgRNA
  Olfr519_4
ctttccctactgtgaccaca

SEQ ID NO: 42890 - DNA, 20 bp, Artificial Sequence
  sgRNA
  Olfr519_5
ataatcactgggtaggtcag

SEQ ID NO: 42891 - DNA, 20 bp, Artificial Sequence
  sgRNA
  Olfr519_6
gtcatgatactcaagaccca

SEQ ID NO: 42892 - DNA, 20 bp, Artificial Sequence
  sgRNA
  Olfr519_7
gccatagaagaggatgacag

SEQ ID NO: 42893 - DNA, 20 bp, Artificial Sequence
  sgRNA
  Olfr519_8
acaaaagtatcaacaagaag

SEQ ID NO: 42894 - DNA, 20 bp, Artificial Sequence
  sgRNA
  Olfr519_9
gaaattggtgatgtgtccat

SEQ ID NO: 42895 - DNA, 20 bp, Artificial Sequence
  sgRNA
  Olfr519_10
taatcactgggtaggtcaga

SEQ ID NO: 42896 - DNA, 20 bp, Artificial Sequence
  sgRNA
  Olfr519_11
gatgacagaggtgagatgag

SEQ ID NO: 42897 - DNA, 20 bp, Artificial Sequence
  sgRNA
  Olfr519_12
acttatctacagcccaaatc

SEQ ID NO: 42898 - DNA, 20 bp, Artificial Sequence
  sgRNA
  Olfr519_13
ttctgcagaaacaaatacat

SEQ ID NO: 42899 - DNA, 20 bp, Artificial Sequence
  sgRNA
  Olfr519_14
tcactgggtaggtcagaggg

SEQ ID NO: 42900 - DNA, 20 bp, Artificial Sequence
  sgRNA
  Olfr519_15
gacaaaagtatcaacaagaa

SEQ ID NO: 42901 - DNA, 20 bp, Artificial Sequence
  sgRNA
  Olfr519_16
ggggaccatgacgatcaaaa

SEQ ID NO: 42902 - DNA, 20 bp, Artificial Sequence
  sgRNA
  Olfr519_17
gaggaatctcacagaagaga

SEQ ID NO: 42903 - DNA, 20 bp, Artificial Sequence
  sgRNA
  Olfr519_18
acctctgtcatcctcttcta

SEQ ID NO: 42904 - DNA, 20 bp, Artificial Sequence
  sgRNA
  Olfr519_19
attctgcagaaacaaataca

SEQ ID NO: 42905 - DNA, 20 bp, Artificial Sequence
  sgRNA
  Olfr519_20
agacaaaagtatcaacaaga

SEQ ID NO: 42906 - DNA, 20 bp, Artificial Sequence
  sgRNA
  Olfr52_1
gagtgtgaatcaatgccatg

SEQ ID NO: 42907 - DNA, 20 bp, Artificial Sequence
  sgRNA
  Olfr52_2
ttgtgaccatatacaataga

SEQ ID NO: 42908 - DNA, 20 bp, Artificial Sequence
  sgRNA
  Olfr52_3
ttaactccttgcgatctgtg

SEQ ID NO: 42909 - DNA, 20 bp, Artificial Sequence
  sgRNA
  Olfr52_4
tgtgagaaagcagcctaact

SEQ ID NO: 42910 - DNA, 20 bp, Artificial Sequence
  sgRNA
  Olfr52_5
tgtgaaagatgccctgaaga

SEQ ID NO: 42911 - DNA, 20 bp, Artificial Sequence
  sgRNA
  Olfr52_6
gagcaagttagcctgagaag

SEQ ID NO: 42912 - DNA, 20 bp, Artificial Sequence
  sgRNA
  Olfr52_7
agctgagcgcatcctcagaa

SEQ ID NO: 42913 - DNA, 20 bp, Artificial Sequence
  sgRNA
  Olfr52_8
tcttatctgtatcaagagaa

SEQ ID NO: 42914 - DNA, 20 bp, Artificial Sequence
  sgRNA
  Olfr52_9
gtagatcaaagggttcaaca

SEQ ID NO: 42915 - DNA, 20 bp, Artificial Sequence
  sgRNA
  Olfr52_10
catcatgtgagagctacagg

SEQ ID NO: 42916 - DNA, 20 bp, Artificial Sequence
  sgRNA
  Olfr52_11
tagaatggcaataggatagg

SEQ ID NO: 42917 - DNA, 20 bp, Artificial Sequence
  sgRNA
  Olfr52_12
attgtccatgaccctcttca

SEQ ID NO: 42918 - DNA, 20 bp, Artificial Sequence
  sgRNA
  Olfr52_13
gatcactgtgtagaagacag

SEQ ID NO: 42919 - DNA, 20 bp, Artificial Sequence
  sgRNA
  Olfr52_14
ctatagctatagtttcctca

SEQ ID NO: 42920 - DNA, 20 bp, Artificial Sequence
  sgRNA
  Olfr52_15
tgcgctcagctgaaggaaga

SEQ ID NO: 42921 - DNA, 20 bp, Artificial Sequence
  sgRNA
  Olfr52_16
cacctgtagctctcacatga

SEQ ID NO: 42922 - DNA, 20 bp, Artificial Sequence
  sgRNA
  Olfr52_17
atgaggaaactatagctata

SEQ ID NO: 42923 - DNA, 20 bp, Artificial Sequence
  sgRNA
  Olfr52_18
atggcaataggataggcgga

SEQ ID NO: 42924 - DNA, 20 bp, Artificial Sequence
  sgRNA
  Olfr52_19
tgtgggcctcacagatcgca

SEQ ID NO: 42925 - DNA, 20 bp, Artificial Sequence
  sgRNA
  Olfr52_20
tcctgaggctgtagatcaaa

SEQ ID NO: 42926 - DNA, 20 bp, Artificial Sequence
  sgRNA
  Olfr520_1
agtggtaaagacctctcaga

SEQ ID NO: 42927 - DNA, 20 bp, Artificial Sequence
  sgRNA
  Olfr520_2
tctaccgtcttctacctggt

SEQ ID NO: 42928 - DNA, 20 bp, Artificial Sequence
  sgRNA
  Olfr520_3
cagaagcccatgagcgtctg

SEQ ID NO: 42929 - DNA, 20 bp, Artificial Sequence
  sgRNA
  Olfr520_4
agaggatgtctagagccgag

SEQ ID NO: 42930 - DNA, 20 bp, Artificial Sequence
  sgRNA
  Olfr520_5
gtcattatataccatctgag

SEQ ID NO: 42931 - DNA, 20 bp, Artificial Sequence
  sgRNA
  Olfr520_6
aatgcccaccaggtagaaga

SEQ ID NO: 42932 - DNA, 20 bp, Artificial Sequence
  sgRNA
  Olfr520_7
tgacgtcaggattcgcacat

SEQ ID NO: 42933 - DNA, 20 bp, Artificial Sequence
  sgRNA
  Olfr520_8
gttagctcggtaagccacat

SEQ ID NO: 42934 - DNA, 20 bp, Artificial Sequence
  sgRNA
  Olfr520_9
tcaggattcgcacataggag

SEQ ID NO: 42935 - DNA, 20 bp, Artificial Sequence
  sgRNA
  Olfr520_10
gggagtagtgtcagaacaag

SEQ ID NO: 42936 - DNA, 20 bp, Artificial Sequence
  sgRNA
  Olfr520_11
actactccccagacgctcat

SEQ ID NO: 42937 - DNA, 20 bp, Artificial Sequence
  sgRNA
  Olfr520_12
ttaccgagctaacctgccct

SEQ ID NO: 42938 - DNA, 20 bp, Artificial Sequence
  sgRNA
  Olfr520_13
ggatgagcaggtagaacaga

SEQ ID NO: 42939 - DNA, 20 bp, Artificial Sequence
  sgRNA
  Olfr520_14
gctcggccaccacagccacc

SEQ ID NO: 42940 - DNA, 20 bp, Artificial Sequence
  sgRNA
  Olfr520_15
gagaggtctttaccactgct

SEQ ID NO: 42941 - DNA, 20 bp, Artificial Sequence
  sgRNA
  Olfr520_16
gttctacctgctcatcctgg

SEQ ID NO: 42942 - DNA, 20 bp, Artificial Sequence
  sgRNA
  Olfr520_17
gaatcctgacgtcagtgctt

SEQ ID NO: 42943 - DNA, 20 bp, Artificial Sequence
  sgRNA
  Olfr520_18
aggactggaccagagccagg

SEQ ID NO: 42944 - DNA, 20 bp, Artificial Sequence
  sgRNA
  Olfr520_19
ttaccactgctgggacaggc

SEQ ID NO: 42945 - DNA, 20 bp, Artificial Sequence
  sgRNA
  Olfr520_20
agccacataggctatggcaa

SEQ ID NO: 42946 - DNA, 20 bp, Artificial Sequence
  sgRNA
  Olfr547_1
caaggagtttgtgagaacgg

SEQ ID NO: 42947 - DNA, 20 bp, Artificial Sequence
  sgRNA
  Olfr547_2
ctgagtgatacagcgatcca

SEQ ID NO: 42948 - DNA, 20 bp, Artificial Sequence
  sgRNA
  Olfr547_3
ctattgtgaacacataggct

SEQ ID NO: 42949 - DNA, 20 bp, Artificial Sequence
  sgRNA
  Olfr547_4
tacatgggtccatggagact

SEQ ID NO: 42950 - DNA, 20 bp, Artificial Sequence
  sgRNA
  Olfr547_5
tcttcacgacgcttacacag

SEQ ID NO: 42951 - DNA, 20 bp, Artificial Sequence
  sgRNA
  Olfr547_6
gtaagcgtcgtgaagatccc

SEQ ID NO: 42952 - DNA, 20 bp, Artificial Sequence
  sgRNA
  Olfr547_7
atagcatccgagtaaacatt

SEQ ID NO: 42953 - DNA, 20 bp, Artificial Sequence
  sgRNA
  Olfr547_8
gcatcattatcctcttctat

SEQ ID NO: 42954 - DNA, 20 bp, Artificial Sequence
  sgRNA
  Olfr547_9
acctcatatccacatcctgc

SEQ ID NO: 42955 - DNA, 20 bp, Artificial Sequence
  sgRNA
  Olfr547_10
gcaggatgtggatatgaggt

SEQ ID NO: 42956 - DNA, 20 bp, Artificial Sequence
  sgRNA
  Olfr547_11
ttctgtcctaatattaacag

SEQ ID NO: 42957 - DNA, 20 bp, Artificial Sequence
  sgRNA
  Olfr547_12
gaatgcagacattagccagc

SEQ ID NO: 42958 - DNA, 20 bp, Artificial Sequence
  sgRNA
  Olfr547_13
gcatgcgaaagacggcacgg

SEQ ID NO: 42959 - DNA, 20 bp, Artificial Sequence
  sgRNA
  Olfr547_14
tgtgctggtcctctaggcca

SEQ ID NO: 42960 - DNA, 20 bp, Artificial Sequence
  sgRNA
  Olfr547_15
acgacgcttacacagaggtt

SEQ ID NO: 42961 - DNA, 20 bp, Artificial Sequence
  sgRNA
  Olfr547_16
agatcccaggcccatagaag

SEQ ID NO: 42962 - DNA, 20 bp, Artificial Sequence
  sgRNA
  Olfr547_17
ctttctctgcatgctggtgg

SEQ ID NO: 42963 - DNA, 20 bp, Artificial Sequence
  sgRNA
  Olfr547_18
cgacgcttacacagaggttc

SEQ ID NO: 42964 - DNA, 20 bp, Artificial Sequence
  sgRNA
  Olfr547_19
ccaccagcatgcagagaaag

SEQ ID NO: 42965 - DNA, 20 bp, Artificial Sequence
  sgRNA
  Olfr547_20
cttgattgggaaaatcagag

SEQ ID NO: 42966 - DNA, 20 bp, Artificial Sequence
  sgRNA
  Olfr55_1
atgtggagagaatgtactgg

SEQ ID NO: 42967 - DNA, 20 bp, Artificial Sequence
  sgRNA
  Olfr55_2
catgggttatgaccgctacg

SEQ ID NO: 42968 - DNA, 20 bp, Artificial Sequence
  sgRNA
  Olfr55_3
gaacatgacaagtaaaatgg

SEQ ID NO: 42969 - DNA, 20 bp, Artificial Sequence
  sgRNA
  Olfr55_4
atgtacctcttcactctgct

SEQ ID NO: 42970 - DNA, 20 bp, Artificial Sequence
  sgRNA
  Olfr55_5
ggttgcctagcagagtgaag

SEQ ID NO: 42971 - DNA, 20 bp, Artificial Sequence
  sgRNA
  Olfr55_6
tcctttctactcactgtcat

SEQ ID NO: 42972 - DNA, 20 bp, Artificial Sequence
  sgRNA
  Olfr55_7
atattccccaaaacttcaca

SEQ ID NO: 42973 - DNA, 20 bp, Artificial Sequence
  sgRNA
  Olfr55_8
tgacagtgagtagaaaggaa

SEQ ID NO: 42974 - DNA, 20 bp, Artificial Sequence
  sgRNA
  Olfr55_9
agtaaaatggtggatctcat

SEQ ID NO: 42975 - DNA, 20 bp, Artificial Sequence
  sgRNA
  Olfr55_10
gtggaacatgacaagtaaaa

SEQ ID NO: 42976 - DNA, 20 bp, Artificial Sequence
  sgRNA
  Olfr55_11
gagtgaagaggtacatgagc

SEQ ID NO: 42977 - DNA, 20 bp, Artificial Sequence
  sgRNA
  Olfr55_12
gacagtgagtagaaaggaat

SEQ ID NO: 42978 - DNA, 20 bp, Artificial Sequence
  sgRNA
  Olfr55_13
tggagagaatgtactggagg

SEQ ID NO: 42979 - DNA, 20 bp, Artificial Sequence
  sgRNA
  Olfr55_14
ttcctttctactcactgtca

SEQ ID NO: 42980 - DNA, 20 bp, Artificial Sequence
  sgRNA
  Olfr55_15
acccatgacagtgagtagaa

SEQ ID NO: 42981 - DNA, 20 bp, Artificial Sequence
  sgRNA
  Olfr55_16
gtaaaatggtggatctcatt

SEQ ID NO: 42982 - DNA, 20 bp, Artificial Sequence
  sgRNA
  Olfr55_17
tggagtgaagtgtggtgagc

SEQ ID NO: 42983 - DNA, 20 bp, Artificial Sequence
  sgRNA
  Olfr55_18
ggcatgtggagagaatgtac

SEQ ID NO: 42984 - DNA, 20 bp, Artificial Sequence
  sgRNA
  Olfr552_1
agacgtttccattactgtcg

SEQ ID NO: 42985 - DNA, 20 bp, Artificial Sequence
  sgRNA
  Olfr552_2
actccatgatagcaaaggaa

SEQ ID NO: 42986 - DNA, 20 bp, Artificial Sequence
  sgRNA
  Olfr552_3
cttctgctcagcctatacct

SEQ ID NO: 42987 - DNA, 20 bp, Artificial Sequence
  sgRNA
  Olfr552_4
aggccaatcttgatgatgag

SEQ ID NO: 42988 - DNA, 20 bp, Artificial Sequence
  sgRNA
  Olfr552_5
ccagtggccttcttgttgat

SEQ ID NO: 42989 - DNA, 20 bp, Artificial Sequence
  sgRNA
  Olfr552_6
gggacatgtgtgtcgcatat

SEQ ID NO: 42990 - DNA, 20 bp, Artificial Sequence
  sgRNA
  Olfr552_7
tctccagcttgcctcccagg

SEQ ID NO: 42991 - DNA, 20 bp, Artificial Sequence
  sgRNA
  Olfr552_8
tagatgataggattgaccat

SEQ ID NO: 42992 - DNA, 20 bp, Artificial Sequence
  sgRNA
  Olfr552_9
ccatcaacaagaaggccact

SEQ ID NO: 42993 - DNA, 20 bp, Artificial Sequence
  sgRNA
  Olfr552_10
aacccgaatgatgaaaagga

SEQ ID NO: 42994 - DNA, 20 bp, Artificial Sequence
  sgRNA
  Olfr552_11
gtgaacacatggctgtggtg

SEQ ID NO: 42995 - DNA, 20 bp, Artificial Sequence
  sgRNA
  Olfr552_12
tgctgactccatgatagcaa

SEQ ID NO: 42996 - DNA, 20 bp, Artificial Sequence
  sgRNA
  Olfr552_13
tcactgtgcctcgacagtaa

SEQ ID NO: 42997 - DNA, 20 bp, Artificial Sequence
  sgRNA
  Olfr552_14
atgactgaggagatgactac

SEQ ID NO: 42998 - DNA, 20 bp, Artificial Sequence
  sgRNA
  Olfr552_15
tatggcaacataacgatcga

SEQ ID NO: 42999 - DNA, 20 bp, Artificial Sequence
  sgRNA
  Olfr552_16
agccacacgatgcatgactg

SEQ ID NO: 43000 - DNA, 20 bp, Artificial Sequence
  sgRNA
  Olfr552_17
aggatggtggtatagtgcag

SEQ ID NO: 43001 - DNA, 20 bp, Artificial Sequence
  sgRNA
  Olfr552_18
tcatgcatcgtgtggctcgt

SEQ ID NO: 43002 - DNA, 20 bp, Artificial Sequence
  sgRNA
  Olfr552_19
tcaacaagaaggccactggg

SEQ ID NO: 43003 - DNA, 20 bp, Artificial Sequence
  sgRNA
  Olfr552_20
ccgatccctgaaccagaaca

SEQ ID NO: 43004 - DNA, 20 bp, Artificial Sequence
  sgRNA
  Olfr554_1
taccacttatgatccgcctg

SEQ ID NO: 43005 - DNA, 20 bp, Artificial Sequence
  sgRNA
  Olfr554_2
gctctacccttaccacagct

SEQ ID NO: 43006 - DNA, 20 bp, Artificial Sequence
  sgRNA
  Olfr554_3
aatggagagccatatgtgca

SEQ ID NO: 43007 - DNA, 20 bp, Artificial Sequence
  sgRNA
  Olfr554_4
acacagtggtgggtcgtttg

SEQ ID NO: 43008 - DNA, 20 bp, Artificial Sequence
  sgRNA
  Olfr554_5
gtacgaacagcatagacaat

SEQ ID NO: 43009 - DNA, 20 bp, Artificial Sequence
  sgRNA
  Olfr554_6
gtaaagaactcctctgagga

SEQ ID NO: 43010 - DNA, 20 bp, Artificial Sequence
  sgRNA
  Olfr554_7
catcacataggaggcagcaa

SEQ ID NO: 43011 - DNA, 20 bp, Artificial Sequence
  sgRNA
  Olfr554_8
ggtacgaacagcatagacaa

SEQ ID NO: 43012 - DNA, 20 bp, Artificial Sequence
  sgRNA
  Olfr554_9
gcaggcggatcataagtggt

SEQ ID NO: 43013 - DNA, 20 bp, Artificial Sequence
  sgRNA
  Olfr554_10
gtgctcactcacacagtggt

SEQ ID NO: 43014 - DNA, 20 bp, Artificial Sequence
  sgRNA
  Olfr554_11
gggaacatagaaaatcagaa

SEQ ID NO: 43015 - DNA, 20 bp, Artificial Sequence
  sgRNA
  Olfr554_12
cctgaaaatcatcacatagg

SEQ ID NO: 43016 - DNA, 20 bp, Artificial Sequence
  sgRNA
  Olfr554_13
gtgacgcagtggattgcaga

SEQ ID NO: 43017 - DNA, 20 bp, Artificial Sequence
  sgRNA
  Olfr554_14
catggtgctcactcacacag

SEQ ID NO: 43018 - DNA, 20 bp, Artificial Sequence
  sgRNA
  Olfr554_15
gctgtggttgccttgacctg

SEQ ID NO: 43019 - DNA, 20 bp, Artificial Sequence
  sgRNA
  Olfr554_16
atatggctctccattccctt

SEQ ID NO: 43020 - DNA, 20 bp, Artificial Sequence
  sgRNA
  Olfr554_17
ttaaaactctggggacatgt

SEQ ID NO: 43021 - DNA, 20 bp, Artificial Sequence
  sgRNA
  Olfr554_18
caatccactgcgtcacagca

SEQ ID NO: 43022 - DNA, 20 bp, Artificial Sequence
  sgRNA
  Olfr554_19
ataagagaagaaacagcaat

SEQ ID NO: 43023 - DNA, 20 bp, Artificial Sequence
  sgRNA
  Olfr554_20
aggcggatcataagtggtag

SEQ ID NO: 43024 - DNA, 20 bp, Artificial Sequence
  sgRNA
  Olfr556_1
tcagatgtactttgtccatg

SEQ ID NO: 43025 - DNA, 20 bp, Artificial Sequence
  sgRNA
  Olfr556_2
taagacagctatgctataca

SEQ ID NO: 43026 - DNA, 20 bp, Artificial Sequence
  sgRNA
  Olfr556_3
ggaatgaggaactacattgg

SEQ ID NO: 43027 - DNA, 20 bp, Artificial Sequence
  sgRNA
  Olfr556_4
atctgagcccacaatgatgg

SEQ ID NO: 43028 - DNA, 20 bp, Artificial Sequence
  sgRNA
  Olfr556_5
ataggaatgaggaactacat

SEQ ID NO: 43029 - DNA, 20 bp, Artificial Sequence
  sgRNA
  Olfr556_6
actacattggaggcacaaaa

SEQ ID NO: 43030 - DNA, 20 bp, Artificial Sequence
  sgRNA
  Olfr556_7
cttccactgtgcattccttg

SEQ ID NO: 43031 - DNA, 20 bp, Artificial Sequence
  sgRNA
  Olfr556_8
gccatcctacaaccacacaa

SEQ ID NO: 43032 - DNA, 20 bp, Artificial Sequence
  sgRNA
  Olfr556_9
aatagcacttgagtgtgcag

SEQ ID NO: 43033 - DNA, 20 bp, Artificial Sequence
  sgRNA
  Olfr556_10
tgtcctcaaggaatgcacag

SEQ ID NO: 43034 - DNA, 20 bp, Artificial Sequence
  sgRNA
  Olfr556_11
gataagaagactgaaaccct

SEQ ID NO: 43035 - DNA, 20 bp, Artificial Sequence
  sgRNA
  Olfr556_12
gtattaggaccagacaaatc

SEQ ID NO: 43036 - DNA, 20 bp, Artificial Sequence
  sgRNA
  Olfr556_13
gtacataggctcttgtagag

SEQ ID NO: 43037 - DNA, 20 bp, Artificial Sequence
  sgRNA
  Olfr556_14
gtcctaataccataaatgat

SEQ ID NO: 43038 - DNA, 20 bp, Artificial Sequence
  sgRNA
  Olfr556_15
tctccacagcagtggccgca

SEQ ID NO: 43039 - DNA, 20 bp, Artificial Sequence
  sgRNA
  Olfr556_16
tatccgctcccggatttgtc

SEQ ID NO: 43040 - DNA, 20 bp, Artificial Sequence
  sgRNA
  Olfr556_17
ccatctatgtggcctggcta

SEQ ID NO: 43041 - DNA, 20 bp, Artificial Sequence
  sgRNA
  Olfr556_18
ggaccagacaaatccgggag

SEQ ID NO: 43042 - DNA, 20 bp, Artificial Sequence
  sgRNA
  Olfr556_19
tgggatggcatccatctatg

SEQ ID NO: 43043 - DNA, 20 bp, Artificial Sequence
  sgRNA
  Olfr556_20
gtaatgtaagggcttgcaga

SEQ ID NO: 43044 - DNA, 20 bp, Artificial Sequence
  sgRNA
  Olfr557_1
caatggtagaaagcatggcg

SEQ ID NO: 43045 - DNA, 20 bp, Artificial Sequence
  sgRNA
  Olfr557_2
cttatgctttatgtatgcag

SEQ ID NO: 43046 - DNA, 20 bp, Artificial Sequence
  sgRNA
  Olfr557_3
aaagaagaatacaaatcccc

SEQ ID NO: 43047 - DNA, 20 bp, Artificial Sequence
  sgRNA
  Olfr557_4
agcacagaagcatggcgtaa

SEQ ID NO: 43048 - DNA, 20 bp, Artificial Sequence
  sgRNA
  Olfr557_5
gttggagctttcaactcgag

SEQ ID NO: 43049 - DNA, 20 bp, Artificial Sequence
  sgRNA
  Olfr557_6
tgttggagctttcaactcga

SEQ ID NO: 43050 - DNA, 20 bp, Artificial Sequence
  sgRNA
  Olfr557_7
acatacggataacccttgaa

SEQ ID NO: 43051 - DNA, 20 bp, Artificial Sequence
  sgRNA
  Olfr557_8
gtggcgatgagagggaccaa

SEQ ID NO: 43052 - DNA, 20 bp, Artificial Sequence
  sgRNA
  Olfr557_9
agaagaccaggacagcacag

SEQ ID NO: 43053 - DNA, 20 bp, Artificial Sequence
  sgRNA
  Olfr557_10
ctatcagtggtacataggct

SEQ ID NO: 43054 - DNA, 20 bp, Artificial Sequence
  sgRNA
  Olfr557_11
agatattagccataaccaca

SEQ ID NO: 43055 - DNA, 20 bp, Artificial Sequence
  sgRNA
  Olfr557_12
tcagtggtacataggctggg

SEQ ID NO: 43056 - DNA, 20 bp, Artificial Sequence
  sgRNA
  Olfr557_13
tcttcatcattcgtgtggag

SEQ ID NO: 43057 - DNA, 20 bp, Artificial Sequence
  sgRNA
  Olfr557_14
tcccacatctttggtccatg

SEQ ID NO: 43058 - DNA, 20 bp, Artificial Sequence
  sgRNA
  Olfr557_15
agaagagaggaccaagtcaa

SEQ ID NO: 43059 - DNA, 20 bp, Artificial Sequence
  sgRNA
  Olfr557_16
gtaccactgatagcccaatg

SEQ ID NO: 43060 - DNA, 20 bp, Artificial Sequence
  sgRNA
  Olfr557_17
aatatgacagacgcttcaaa

SEQ ID NO: 43061 - DNA, 20 bp, Artificial Sequence
  sgRNA
  Olfr557_18
gatgcctaccagtagaaaat

SEQ ID NO: 43062 - DNA, 20 bp, Artificial Sequence
  sgRNA
  Olfr557_19
tggcctagcttccctagcca

SEQ ID NO: 43063 - DNA, 20 bp, Artificial Sequence
  sgRNA
  Olfr557_20
gaccaaggagatccgttcaa

SEQ ID NO: 43064 - DNA, 20 bp, Artificial Sequence
  sgRNA
  Olfr558_1
atgccaatcttggcaacacg

SEQ ID NO: 43065 - DNA, 20 bp, Artificial Sequence
  sgRNA
  Olfr558_2
gtccataaatgatattgaca

SEQ ID NO: 43066 - DNA, 20 bp, Artificial Sequence
  sgRNA
  Olfr558_3
tagcacagcaataaggtaga

SEQ ID NO: 43067 - DNA, 20 bp, Artificial Sequence
  sgRNA
  Olfr558_4
cagacaagcatcaaactgga

SEQ ID NO: 43068 - DNA, 20 bp, Artificial Sequence
  sgRNA
  Olfr558_5
gtaccagacaagcatcaaac

SEQ ID NO: 43069 - DNA, 20 bp, Artificial Sequence
  sgRNA
  Olfr558_6
actccatgccagacaaggaa

SEQ ID NO: 43070 - DNA, 20 bp, Artificial Sequence
  sgRNA
  Olfr558_7
agtggaattgaaccaaaaga

SEQ ID NO: 43071 - DNA, 20 bp, Artificial Sequence
  sgRNA
  Olfr558_8
gcttcatgacatcttggtgt

SEQ ID NO: 43072 - DNA, 20 bp, Artificial Sequence
  sgRNA
  Olfr558_9
tcgtgttgccaagattggca

SEQ ID NO: 43073 - DNA, 20 bp, Artificial Sequence
  sgRNA
  Olfr558_10
tagacaatggggttgagcac

SEQ ID NO: 43074 - DNA, 20 bp, Artificial Sequence
  sgRNA
  Olfr558_11
gagaagtgagtccaaaccaa

SEQ ID NO: 43075 - DNA, 20 bp, Artificial Sequence
  sgRNA
  Olfr558_12
catgccagacaaggaatgga

SEQ ID NO: 43076 - DNA, 20 bp, Artificial Sequence
  sgRNA
  Olfr558_13
atgcaaagaaagatatacat

SEQ ID NO: 43077 - DNA, 20 bp, Artificial Sequence
  sgRNA
  Olfr558_14
ctagcacagcaataaggtag

SEQ ID NO: 43078 - DNA, 20 bp, Artificial Sequence
  sgRNA
  Olfr558_15
gcctttcattggattgtcga

SEQ ID NO: 43079 - DNA, 20 bp, Artificial Sequence
  sgRNA
  Olfr558_16
attgtcatcatctcagccat

SEQ ID NO: 43080 - DNA, 20 bp, Artificial Sequence
  sgRNA
  Olfr558_17
gtaggcagtaggaatgagaa

SEQ ID NO: 43081 - DNA, 20 bp, Artificial Sequence
  sgRNA
  Olfr558_18
tggtgcaccgtttcagcaag

SEQ ID NO: 43082 - DNA, 20 bp, Artificial Sequence
  sgRNA
  Olfr558_19
gcatggatgaggtggaaatg

SEQ ID NO: 43083 - DNA, 20 bp, Artificial Sequence
  sgRNA
  Olfr558_20
ccttacctgtcttcatcaaa

SEQ ID NO: 43084 - DNA, 20 bp, Artificial Sequence
  sgRNA
  Olfr56_1
gagcagggtgtcgaaaaggg

SEQ ID NO: 43085 - DNA, 20 bp, Artificial Sequence
  sgRNA
  Olfr56_2
atataccgtgagccacagta

SEQ ID NO: 43086 - DNA, 20 bp, Artificial Sequence
  sgRNA
  Olfr56_3
caatgttacagaccagcatg

SEQ ID NO: 43087 - DNA, 20 bp, Artificial Sequence
  sgRNA
  Olfr56_4
gggggtcagtgtagatgagt

SEQ ID NO: 43088 - DNA, 20 bp, Artificial Sequence
  sgRNA
  Olfr56_5
agttatgctggtcttcaccg

SEQ ID NO: 43089 - DNA, 20 bp, Artificial Sequence
  sgRNA
  Olfr56_6
ctaggagcgcgatatcgcct

SEQ ID NO: 43090 - DNA, 20 bp, Artificial Sequence
  sgRNA
  Olfr56_7
gaccagcatgaggtccatga

SEQ ID NO: 43091 - DNA, 20 bp, Artificial Sequence
  sgRNA
  Olfr56_8
ccagtcccgaaaaaaggccc

SEQ ID NO: 43092 - DNA, 20 bp, Artificial Sequence
  sgRNA
  Olfr56_9
gacatttccacagagcgcca

SEQ ID NO: 43093 - DNA, 20 bp, Artificial Sequence
  sgRNA
  Olfr56_10
ttcctatgctcgcatcttgg

SEQ ID NO: 43094 - DNA, 20 bp, Artificial Sequence
  sgRNA
  Olfr56_11
agagagagacagctgtcagg

SEQ ID NO: 43095 - DNA, 20 bp, Artificial Sequence
  sgRNA
  Olfr56_12
agctgtctctctcttctacg

SEQ ID NO: 43096 - DNA, 20 bp, Artificial Sequence
  sgRNA
  Olfr56_13
gccacagccggcaaaagaga

SEQ ID NO: 43097 - DNA, 20 bp, Artificial Sequence
  sgRNA
  Olfr56_14
agaccagcatgaggtccatg

SEQ ID NO: 43098 - DNA, 20 bp, Artificial Sequence
  sgRNA
  Olfr56_15
tgaacgaatcgtctgtagat

SEQ ID NO: 43099 - DNA, 20 bp, Artificial Sequence
  sgRNA
  Olfr56_16
tctgggagaagatgcctagg

SEQ ID NO: 43100 - DNA, 20 bp, Artificial Sequence
  sgRNA
  Olfr56_17
agcccccaagatgcgagcat

SEQ ID NO: 43101 - DNA, 20 bp, Artificial Sequence
  sgRNA
  Olfr56_18
tgtcaggtgggaggaacaag

SEQ ID NO: 43102 - DNA, 20 bp, Artificial Sequence
  sgRNA
  Olfr56_19
gccggctgtggcatacaaat

SEQ ID NO: 43103 - DNA, 20 bp, Artificial Sequence
  sgRNA
  Olfr56_20
gaaaggactggaccgctgca

SEQ ID NO: 43104 - DNA, 20 bp, Artificial Sequence
  sgRNA
  Olfr566_1
acagagcacgcattatcact

SEQ ID NO: 43105 - DNA, 20 bp, Artificial Sequence
  sgRNA
  Olfr566_2
gaatcatggtatatctaaga

SEQ ID NO: 43106 - DNA, 20 bp, Artificial Sequence
  sgRNA
  Olfr566_3
cagtggcagagagcacagag

SEQ ID NO: 43107 - DNA, 20 bp, Artificial Sequence
  sgRNA
  Olfr566_4
tccagctgtgagcagactct

SEQ ID NO: 43108 - DNA, 20 bp, Artificial Sequence
  sgRNA
  Olfr566_5
gcatggagtatctatccctg

SEQ ID NO: 43109 - DNA, 20 bp, Artificial Sequence
  sgRNA
  Olfr566_6
atatggtcggtcagcaccca

SEQ ID NO: 43110 - DNA, 20 bp, Artificial Sequence
  sgRNA
  Olfr566_7
gtatcgcctcctctgaagaa

SEQ ID NO: 43111 - DNA, 20 bp, Artificial Sequence
  sgRNA
  Olfr566_8
gggtagaagaaggtaaacat

SEQ ID NO: 43112 - DNA, 20 bp, Artificial Sequence
  sgRNA
  Olfr566_9
tatagaatctggagtgctag

SEQ ID NO: 43113 - DNA, 20 bp, Artificial Sequence
  sgRNA
  Olfr566_10
ctgtctctggtacatcgata

SEQ ID NO: 43114 - DNA, 20 bp, Artificial Sequence
  sgRNA
  Olfr566_11
ggtcttgtgcctttcttcag

SEQ ID NO: 43115 - DNA, 20 bp, Artificial Sequence
  sgRNA
  Olfr566_12
cttgtgcctttcttcagagg

SEQ ID NO: 43116 - DNA, 20 bp, Artificial Sequence
  sgRNA
  Olfr566_13
gcctagagtctgctcacagc

SEQ ID NO: 43117 - DNA, 20 bp, Artificial Sequence
  sgRNA
  Olfr566_14
gtttaaggagcagaagcagt

SEQ ID NO: 43118 - DNA, 20 bp, Artificial Sequence
  sgRNA
  Olfr566_15
aggttcatgcagactatgct

SEQ ID NO: 43119 - DNA, 20 bp, Artificial Sequence
  sgRNA
  Olfr566_16
acagagaggaaatagtacat

SEQ ID NO: 43120 - DNA, 20 bp, Artificial Sequence
  sgRNA
  Olfr566_17
tgagcacagggggtagaaga

SEQ ID NO: 43121 - DNA, 20 bp, Artificial Sequence
  sgRNA
  Olfr566_18
ggtttaaggagcagaagcag

SEQ ID NO: 43122 - DNA, 20 bp, Artificial Sequence
  sgRNA
  Olfr566_19
ctgtgagcagactctaggcc

SEQ ID NO: 43123 - DNA, 20 bp, Artificial Sequence
  sgRNA
  Olfr566_20
caactaccttgagaatcctg

SEQ ID NO: 43124 - DNA, 20 bp, Artificial Sequence
  sgRNA
  Olfr568_1
tctctcgagcttcaaaccag

SEQ ID NO: 43125 - DNA, 20 bp, Artificial Sequence
  sgRNA
  Olfr568_2
tgttcccagaaaggtaaagg

SEQ ID NO: 43126 - DNA, 20 bp, Artificial Sequence
  sgRNA
  Olfr568_3
tcaggcctgggataccagtg

SEQ ID NO: 43127 - DNA, 20 bp, Artificial Sequence
  sgRNA
  Olfr568_4
gagcacaactggcaacatga

SEQ ID NO: 43128 - DNA, 20 bp, Artificial Sequence
  sgRNA
  Olfr568_5
ttcaaaccagaggacaccaa

SEQ ID NO: 43129 - DNA, 20 bp, Artificial Sequence
  sgRNA
  Olfr568_6
agagctggatgacatctaca

SEQ ID NO: 43130 - DNA, 20 bp, Artificial Sequence
  sgRNA
  Olfr568_7
ttgcactattctctactaca

SEQ ID NO: 43131 - DNA, 20 bp, Artificial Sequence
  sgRNA
  Olfr568_8
attccatgaaagtaaaccca

SEQ ID NO: 43132 - DNA, 20 bp, Artificial Sequence
  sgRNA
  Olfr568_9
ccactattcttaccaatgcc

SEQ ID NO: 43133 - DNA, 20 bp, Artificial Sequence
  sgRNA
  Olfr568_10
agatcggatgatcagtacat

SEQ ID NO: 43134 - DNA, 20 bp, Artificial Sequence
  sgRNA
  Olfr568_11
aagcaatgctgaggacagat

SEQ ID NO: 43135 - DNA, 20 bp, Artificial Sequence
  sgRNA
  Olfr568_12
ttatagggttgagcacagga

SEQ ID NO: 43136 - DNA, 20 bp, Artificial Sequence
  sgRNA
  Olfr568_13
aatctgggcaatcctggcat

SEQ ID NO: 43137 - DNA, 20 bp, Artificial Sequence
  sgRNA
  Olfr568_14
tgttgtctgtacatgagagc

SEQ ID NO: 43138 - DNA, 20 bp, Artificial Sequence
  sgRNA
  Olfr568_15
cagttgtgctctttgtcaag

SEQ ID NO: 43139 - DNA, 20 bp, Artificial Sequence
  sgRNA
  Olfr568_16
atgacggtgtggacaaaggc

SEQ ID NO: 43140 - DNA, 20 bp, Artificial Sequence
  sgRNA
  Olfr568_17
tcttcacactgtagattata

SEQ ID NO: 43141 - DNA, 20 bp, Artificial Sequence
  sgRNA
  Olfr568_18
tagattatagggttgagcac

SEQ ID NO: 43142 - DNA, 20 bp, Artificial Sequence
  sgRNA
  Olfr568_19
cataggacagcaagatgcaa

SEQ ID NO: 43143 - DNA, 20 bp, Artificial Sequence
  sgRNA
  Olfr568_20
gctcacgaacgatcaccagc

SEQ ID NO: 43144 - DNA, 20 bp, Artificial Sequence
  sgRNA
  Olfr569_1
tagtttaatgactacagatg

SEQ ID NO: 43145 - DNA, 20 bp, Artificial Sequence
  sgRNA
  Olfr569_2
aattcggattatgtatagga

SEQ ID NO: 43146 - DNA, 20 bp, Artificial Sequence
  sgRNA
  Olfr569_3
gttgcttggaatcccagggt

SEQ ID NO: 43147 - DNA, 20 bp, Artificial Sequence
  sgRNA
  Olfr569_4
gcacatggctgtgctcaagt

SEQ ID NO: 43148 - DNA, 20 bp, Artificial Sequence
  sgRNA
  Olfr569_5
ggtcaattcggattatgtat

SEQ ID NO: 43149 - DNA, 20 bp, Artificial Sequence
  sgRNA
  Olfr569_6
tatggacaactcgtggcacg

SEQ ID NO: 43150 - DNA, 20 bp, Artificial Sequence
  sgRNA
  Olfr569_7
catctgtagtcattaaacta

SEQ ID NO: 43151 - DNA, 20 bp, Artificial Sequence
  sgRNA
  Olfr569_8
gtgggtgaggaaggtaaaaa

SEQ ID NO: 43152 - DNA, 20 bp, Artificial Sequence
  sgRNA
  Olfr569_9
ggacaactcgtggcacgtgg

SEQ ID NO: 43153 - DNA, 20 bp, Artificial Sequence
  sgRNA
  Olfr569_10
tagccaacaaggccaggaag

SEQ ID NO: 43154 - DNA, 20 bp, Artificial Sequence
  sgRNA
  Olfr569_11
ctaaaatgctggccatacta

SEQ ID NO: 43155 - DNA, 20 bp, Artificial Sequence
  sgRNA
  Olfr569_12
tcatgttgcttggaatccca

SEQ ID NO: 43156 - DNA, 20 bp, Artificial Sequence
  sgRNA
  Olfr569_13
acatctgtagtcattaaact

SEQ ID NO: 43157 - DNA, 20 bp, Artificial Sequence
  sgRNA
  Olfr569_14
ccaagcaacatgaagaacag

SEQ ID NO: 43158 - DNA, 20 bp, Artificial Sequence
  sgRNA
  Olfr569_15
aacatgatatggacaactcg

SEQ ID NO: 43159 - DNA, 20 bp, Artificial Sequence
  sgRNA
  Olfr569_16
atcagggacagggtcatccg

SEQ ID NO: 43160 - DNA, 20 bp, Artificial Sequence
  sgRNA
  Olfr569_17
gaggtacatgggctcatgca

SEQ ID NO: 43161 - DNA, 20 bp, Artificial Sequence
  sgRNA
  Olfr569_18
ttctaactccatagataata

SEQ ID NO: 43162 - DNA, 20 bp, Artificial Sequence
  sgRNA
  Olfr569_19
gcaacatgaagaacagggga

SEQ ID NO: 43163 - DNA, 20 bp, Artificial Sequence
  sgRNA
  Olfr569_20
atacaacgcctgcctcatcc

SEQ ID NO: 43164 - DNA, 20 bp, Artificial Sequence
  sgRNA
  Olfr571_1
gtacattggtcgatgcaatg

SEQ ID NO: 43165 - DNA, 20 bp, Artificial Sequence
  sgRNA
  Olfr571_2
cagggtgggcattaacacgg

SEQ ID NO: 43166 - DNA, 20 bp, Artificial Sequence
  sgRNA
  Olfr571_3
ggcccactaatagaaaagtg

SEQ ID NO: 43167 - DNA, 20 bp, Artificial Sequence
  sgRNA
  Olfr571_4
gcagatggagactcaagcat

SEQ ID NO: 43168 - DNA, 20 bp, Artificial Sequence
  sgRNA
  Olfr571_5
ggagcgtgtgagcaggcgga

SEQ ID NO: 43169 - DNA, 20 bp, Artificial Sequence
  sgRNA
  Olfr571_6
gaactgggttcatcagtgga

SEQ ID NO: 43170 - DNA, 20 bp, Artificial Sequence
  sgRNA
  Olfr571_7
cgagccaacaggattggcag

SEQ ID NO: 43171 - DNA, 20 bp, Artificial Sequence
  sgRNA
  Olfr571_8
tagcagggtgggcattaaca

SEQ ID NO: 43172 - DNA, 20 bp, Artificial Sequence
  sgRNA
  Olfr571_9
aggttactacccacaaaggt

SEQ ID NO: 43173 - DNA, 20 bp, Artificial Sequence
  sgRNA
  Olfr571_10
ttgctgacagtaccacaacc

SEQ ID NO: 43174 - DNA, 20 bp, Artificial Sequence
  sgRNA
  Olfr571_11
gcccactaatagaaaagtgg

SEQ ID NO: 43175 - DNA, 20 bp, Artificial Sequence
  sgRNA
  Olfr571_12
catgccatattgccgtccac

SEQ ID NO: 43176 - DNA, 20 bp, Artificial Sequence
  sgRNA
  Olfr571_13
tctgcccctgccaatcctgt

SEQ ID NO: 43177 - DNA, 20 bp, Artificial Sequence
  sgRNA
  Olfr571_14
gcaggaagtggacataggag

SEQ ID NO: 43178 - DNA, 20 bp, Artificial Sequence
  sgRNA
  Olfr571_15
acgtttgcccagccttccag

SEQ ID NO: 43179 - DNA, 20 bp, Artificial Sequence
  sgRNA
  Olfr571_16
actcaagcatcggaaagcaa

SEQ ID NO: 43180 - DNA, 20 bp, Artificial Sequence
  sgRNA
  Olfr571_17
aatgtgtcaggacctgtgga

SEQ ID NO: 43181 - DNA, 20 bp, Artificial Sequence
  sgRNA
  Olfr571_18
gaggattgtaccattgccaa

SEQ ID NO: 43182 - DNA, 20 bp, Artificial Sequence
  sgRNA
  Olfr571_19
tgctcgccatggccttcgat

SEQ ID NO: 43183 - DNA, 20 bp, Artificial Sequence
  sgRNA
  Olfr571_20
ctagcttgcccagaagcatg

SEQ ID NO: 43184 - DNA, 20 bp, Artificial Sequence
  sgRNA
  Olfr574_1
cgtgagcaagttctaatcca

SEQ ID NO: 43185 - DNA, 20 bp, Artificial Sequence
  sgRNA
  Olfr574_2
tctcccgggcatgaaaccaa

SEQ ID NO: 43186 - DNA, 20 bp, Artificial Sequence
  sgRNA
  Olfr574_3
ctcttcacagccataactga

SEQ ID NO: 43187 - DNA, 20 bp, Artificial Sequence
  sgRNA
  Olfr574_4
ggaaagtagcatacttcaga

SEQ ID NO: 43188 - DNA, 20 bp, Artificial Sequence
  sgRNA
  Olfr574_5
ggtattattgaagatcagca

SEQ ID NO: 43189 - DNA, 20 bp, Artificial Sequence
  sgRNA
  Olfr574_6
cgatgttcagaacagtgcga

SEQ ID NO: 43190 - DNA, 20 bp, Artificial Sequence
  sgRNA
  Olfr574_7
ttccgattcaaggatgcaag

SEQ ID NO: 43191 - DNA, 20 bp, Artificial Sequence
  sgRNA
  Olfr574_8
tgtttgtcattatcattgaa

SEQ ID NO: 43192 - DNA, 20 bp, Artificial Sequence
  sgRNA
  Olfr574_9
gttccgattcaaggatgcaa

SEQ ID NO: 43193 - DNA, 20 bp, Artificial Sequence
  sgRNA
  Olfr574_10
tctcttcagttctactccca

SEQ ID NO: 43194 - DNA, 20 bp, Artificial Sequence
  sgRNA
  Olfr574_11
aatacacatacaccaacccc

SEQ ID NO: 43195 - DNA, 20 bp, Artificial Sequence
  sgRNA
  Olfr574_12
tttcttcagctctacctgaa

SEQ ID NO: 43196 - DNA, 20 bp, Artificial Sequence
  sgRNA
  Olfr574_13
tcgcactgttctgaacatcg

SEQ ID NO: 43197 - DNA, 20 bp, Artificial Sequence
  sgRNA
  Olfr574_14
atccagggaaggccgtaagg

SEQ ID NO: 43198 - DNA, 20 bp, Artificial Sequence
  sgRNA
  Olfr574_15
aaaatactacagatcaccct

SEQ ID NO: 43199 - DNA, 20 bp, Artificial Sequence
  sgRNA
  Olfr574_16
agtgcgaaggatcaggacgt

SEQ ID NO: 43200 - DNA, 20 bp, Artificial Sequence
  sgRNA
  Olfr574_17
gtatgaggagccttagagga

SEQ ID NO: 43201 - DNA, 20 bp, Artificial Sequence
  sgRNA
  Olfr574_18
gagacggtgtgccacagaca

SEQ ID NO: 43202 - DNA, 20 bp, Artificial Sequence
  sgRNA
  Olfr574_19
ggaacagctggaatatggct

SEQ ID NO: 43203 - DNA, 20 bp, Artificial Sequence
  sgRNA
  Olfr574_20
gccacagacagggtgatcat

SEQ ID NO: 43204 - DNA, 20 bp, Artificial Sequence
  sgRNA
  Olfr576_1
agggatggagatccactcgt

SEQ ID NO: 43205 - DNA, 20 bp, Artificial Sequence
  sgRNA
  Olfr576_2
gtacatgggctcgtgaagag

SEQ ID NO: 43206 - DNA, 20 bp, Artificial Sequence
  sgRNA
  Olfr576_3
tcttgggcaaaacaggcatt

SEQ ID NO: 43207 - DNA, 20 bp, Artificial Sequence
  sgRNA
  Olfr576_4
agacataatcagaagcacag

SEQ ID NO: 43208 - DNA, 20 bp, Artificial Sequence
  sgRNA
  Olfr576_5
gtattgcatctctagcagaa

SEQ ID NO: 43209 - DNA, 20 bp, Artificial Sequence
  sgRNA
  Olfr576_6
gccgcagagttgctaaaata

SEQ ID NO: 43210 - DNA, 20 bp, Artificial Sequence
  sgRNA
  Olfr576_7
gtatcttaaagggttgtgaa

SEQ ID NO: 43211 - DNA, 20 bp, Artificial Sequence
  sgRNA
  Olfr576_8
gcccaagagttctttatcca

SEQ ID NO: 43212 - DNA, 20 bp, Artificial Sequence
  sgRNA
  Olfr576_9
gtacatgaggaagataggga

SEQ ID NO: 43213 - DNA, 20 bp, Artificial Sequence
  sgRNA
  Olfr576_10
ggttgtgaatggcaagaaag

SEQ ID NO: 43214 - DNA, 20 bp, Artificial Sequence
  sgRNA
  Olfr576_11
ctatgtgcccatcatcaccc

SEQ ID NO: 43215 - DNA, 20 bp, Artificial Sequence
  sgRNA
  Olfr576_12
tgatggcaataaggtacatg

SEQ ID NO: 43216 - DNA, 20 bp, Artificial Sequence
  sgRNA
  Olfr576_13
actccatgacagtgaagcca

SEQ ID NO: 43217 - DNA, 20 bp, Artificial Sequence
  sgRNA
  Olfr576_14
aaagcgatgtatggcagcca

SEQ ID NO: 43218 - DNA, 20 bp, Artificial Sequence
  sgRNA
  Olfr576_15
gcaataaggattacaagtag

SEQ ID NO: 43219 - DNA, 20 bp, Artificial Sequence
  sgRNA
  Olfr576_16
ttgtgtactgtataaagact

SEQ ID NO: 43220 - DNA, 20 bp, Artificial Sequence
  sgRNA
  Olfr576_17
gactggaatatgcccacgag

SEQ ID NO: 43221 - DNA, 20 bp, Artificial Sequence
  sgRNA
  Olfr576_18
tcagtttccttagtgtgaaa

SEQ ID NO: 43222 - DNA, 20 bp, Artificial Sequence
  sgRNA
  Olfr576_19
ggatagaactgtatcttaaa

SEQ ID NO: 43223 - DNA, 20 bp, Artificial Sequence
  sgRNA
  Olfr576_20
catatcagagacagccaaca

SEQ ID NO: 43224 - DNA, 20 bp, Artificial Sequence
  sgRNA
  Olfr577_1
ctattctgacaatcactgtg

SEQ ID NO: 43225 - DNA, 20 bp, Artificial Sequence
  sgRNA
  Olfr577_2
ctcaaacggttcccttactg

SEQ ID NO: 43226 - DNA, 20 bp, Artificial Sequence
  sgRNA
  Olfr577_3
agttacccaggatggaaacc

SEQ ID NO: 43227 - DNA, 20 bp, Artificial Sequence
  sgRNA
  Olfr577_4
gatgcctagcactgtaggga

SEQ ID NO: 43228 - DNA, 20 bp, Artificial Sequence
  sgRNA
  Olfr577_5
tgaccacctgaactagatgg

SEQ ID NO: 43229 - DNA, 20 bp, Artificial Sequence
  sgRNA
  Olfr577_6
tatgcatgtgctccagccca

SEQ ID NO: 43230 - DNA, 20 bp, Artificial Sequence
  sgRNA
  Olfr577_7
caatagggttcatcacagga

SEQ ID NO: 43231 - DNA, 20 bp, Artificial Sequence
  sgRNA
  Olfr577_8
ggtacatgagacagagtgga

SEQ ID NO: 43232 - DNA, 20 bp, Artificial Sequence
  sgRNA
  Olfr577_9
gggcctgtttcccaaagcgg

SEQ ID NO: 43233 - DNA, 20 bp, Artificial Sequence
  sgRNA
  Olfr577_10
ataggaatgtgagagaacta

SEQ ID NO: 43234 - DNA, 20 bp, Artificial Sequence
  sgRNA
  Olfr577_11
agatgcctagcactgtaggg

SEQ ID NO: 43235 - DNA, 20 bp, Artificial Sequence
  sgRNA
  Olfr577_12
gggtacaaagagagagacca

SEQ ID NO: 43236 - DNA, 20 bp, Artificial Sequence
  sgRNA
  Olfr577_13
gcagtggatgaaaaagagct

SEQ ID NO: 43237 - DNA, 20 bp, Artificial Sequence
  sgRNA
  Olfr577_14
ggtgcgcagaataagtgcat

SEQ ID NO: 43238 - DNA, 20 bp, Artificial Sequence
  sgRNA
  Olfr577_15
gaccacctgaactagatggg

SEQ ID NO: 43239 - DNA, 20 bp, Artificial Sequence
  sgRNA
  Olfr577_16
gtacatgagacagagtggaa

SEQ ID NO: 43240 - DNA, 20 bp, Artificial Sequence
  sgRNA
  Olfr577_17
ggaaaatgagtgcaacacta

SEQ ID NO: 43241 - DNA, 20 bp, Artificial Sequence
  sgRNA
  Olfr577_18
gattgtgcagttacccagga

SEQ ID NO: 43242 - DNA, 20 bp, Artificial Sequence
  sgRNA
  Olfr577_19
cgtattgtccattgcctcaa

SEQ ID NO: 43243 - DNA, 20 bp, Artificial Sequence
  sgRNA
  Olfr577_20
tgtaccctccctacagtgct

SEQ ID NO: 43244 - DNA, 20 bp, Artificial Sequence
  sgRNA
  Olfr578_1
ataggcatgggctaacacgt

SEQ ID NO: 43245 - DNA, 20 bp, Artificial Sequence
  sgRNA
  Olfr578_2
ggatgacatggagaatagtg

SEQ ID NO: 43246 - DNA, 20 bp, Artificial Sequence
  sgRNA
  Olfr578_3
ggatggtagaataacgcagt

SEQ ID NO: 43247 - DNA, 20 bp, Artificial Sequence
  sgRNA
  Olfr578_4
tcattgtcaatcatatctat

SEQ ID NO: 43248 - DNA, 20 bp, Artificial Sequence
  sgRNA
  Olfr578_5
gtatgagaggaatataagca

SEQ ID NO: 43249 - DNA, 20 bp, Artificial Sequence
  sgRNA
  Olfr578_6
ctaccatcctgacgcccaga

SEQ ID NO: 43250 - DNA, 20 bp, Artificial Sequence
  sgRNA
  Olfr578_7
catgggctaacacgtgggat

SEQ ID NO: 43251 - DNA, 20 bp, Artificial Sequence
  sgRNA
  Olfr578_8
aataggcatgggctaacacg

SEQ ID NO: 43252 - DNA, 20 bp, Artificial Sequence
  sgRNA
  Olfr578_9
atcagaagatgtacaatgcg

SEQ ID NO: 43253 - DNA, 20 bp, Artificial Sequence
  sgRNA
  Olfr578_10
acatcagaagatgtacaatg

SEQ ID NO: 43254 - DNA, 20 bp, Artificial Sequence
  sgRNA
  Olfr578_11
tacaggtattgagagcacgg

SEQ ID NO: 43255 - DNA, 20 bp, Artificial Sequence
  sgRNA
  Olfr578_12
aatccttctgggcgtcagga

SEQ ID NO: 43256 - DNA, 20 bp, Artificial Sequence
  sgRNA
  Olfr578_13
ctttgcctagtacagcatgg

SEQ ID NO: 43257 - DNA, 20 bp, Artificial Sequence
  sgRNA
  Olfr578_14
caagggataagccaatcatg

SEQ ID NO: 43258 - DNA, 20 bp, Artificial Sequence
  sgRNA
  Olfr578_15
atagccaagaaatagtacat

SEQ ID NO: 43259 - DNA, 20 bp, Artificial Sequence
  sgRNA
  Olfr578_16
acggaggcgctcctgacggg

SEQ ID NO: 43260 - DNA, 20 bp, Artificial Sequence
  sgRNA
  Olfr578_17
caaggtctggaagaattcca

SEQ ID NO: 43261 - DNA, 20 bp, Artificial Sequence
  sgRNA
  Olfr578_18
tcactattctccatgtcatc

SEQ ID NO: 43262 - DNA, 20 bp, Artificial Sequence
  sgRNA
  Olfr578_19
ttatcccttgtgcatcgctt

SEQ ID NO: 43263 - DNA, 20 bp, Artificial Sequence
  sgRNA
  Olfr578_20
actccactaaagacaaggtg

SEQ ID NO: 43264 - DNA, 20 bp, Artificial Sequence
  sgRNA
  Olfr582_1
aggatgctggaatgtctgag

SEQ ID NO: 43265 - DNA, 20 bp, Artificial Sequence
  sgRNA
  Olfr582_2
atgtgctcacagtaagactg

SEQ ID NO: 43266 - DNA, 20 bp, Artificial Sequence
  sgRNA
  Olfr582_3
ggtcaattcggattatgtga

SEQ ID NO: 43267 - DNA, 20 bp, Artificial Sequence
  sgRNA
  Olfr582_4
atacatgacacagaatggaa

SEQ ID NO: 43268 - DNA, 20 bp, Artificial Sequence
  sgRNA
  Olfr582_5
ccagtcttactgtgagcaca

SEQ ID NO: 43269 - DNA, 20 bp, Artificial Sequence
  sgRNA
  Olfr582_6
atatatgatgggattgagca

SEQ ID NO: 43270 - DNA, 20 bp, Artificial Sequence
  sgRNA
  Olfr582_7
ggtgctcatggatatggcct

SEQ ID NO: 43271 - DNA, 20 bp, Artificial Sequence
  sgRNA
  Olfr582_8
gggtagctgtgatggtgaga

SEQ ID NO: 43272 - DNA, 20 bp, Artificial Sequence
  sgRNA
  Olfr582_9
catctgtagtcatcaaacta

SEQ ID NO: 43273 - DNA, 20 bp, Artificial Sequence
  sgRNA
  Olfr582_10
catgtgctcacagtaagact

SEQ ID NO: 43274 - DNA, 20 bp, Artificial Sequence
  sgRNA
  Olfr582_11
gcaagatgaaaaatgtagaa

SEQ ID NO: 43275 - DNA, 20 bp, Artificial Sequence
  sgRNA
  Olfr582_12
aacatgatgtgaacaattcg

SEQ ID NO: 43276 - DNA, 20 bp, Artificial Sequence
  sgRNA
  Olfr582_13
atgatgggattgagcatggg

SEQ ID NO: 43277 - DNA, 20 bp, Artificial Sequence
  sgRNA
  Olfr582_14
atctgtagtcatcaaactag

SEQ ID NO: 43278 - DNA, 20 bp, Artificial Sequence
  sgRNA
  Olfr582_15
tgtgaacaattcggggcaca

SEQ ID NO: 43279 - DNA, 20 bp, Artificial Sequence
  sgRNA
  Olfr582_16
ccaaaatgctggccatactc

SEQ ID NO: 43280 - DNA, 20 bp, Artificial Sequence
  sgRNA
  Olfr582_17
aactctgtctctgatctgct

SEQ ID NO: 43281 - DNA, 20 bp, Artificial Sequence
  sgRNA
  Olfr582_18
atgatcatgaaaccagagta

SEQ ID NO: 43282 - DNA, 20 bp, Artificial Sequence
  sgRNA
  Olfr582_19
acatctgtagtcatcaaact

SEQ ID NO: 43283 - DNA, 20 bp, Artificial Sequence
  sgRNA
  Olfr582_20
tatggccttggaccgctatg

SEQ ID NO: 43284 - DNA, 20 bp, Artificial Sequence
  sgRNA
  Olfr583_1
actcgggcaaatagcatctg

SEQ ID NO: 43285 - DNA, 20 bp, Artificial Sequence
  sgRNA
  Olfr583_2
gtagagtgtgcattatcact

SEQ ID NO: 43286 - DNA, 20 bp, Artificial Sequence
  sgRNA
  Olfr583_3
caaccaccttgagaatcctg

SEQ ID NO: 43287 - DNA, 20 bp, Artificial Sequence
  sgRNA
  Olfr583_4
tccagccatgagcagactct

SEQ ID NO: 43288 - DNA, 20 bp, Artificial Sequence
  sgRNA
  Olfr583_5
ccagagacagactaaacgta

SEQ ID NO: 43289 - DNA, 20 bp, Artificial Sequence
  sgRNA
  Olfr583_6
tgatctcattctgaccacag

SEQ ID NO: 43290 - DNA, 20 bp, Artificial Sequence
  sgRNA
  Olfr583_7
gcagggaatatctacccctg

SEQ ID NO: 43291 - DNA, 20 bp, Artificial Sequence
  sgRNA
  Olfr583_8
accagagacagactaaacgt

SEQ ID NO: 43292 - DNA, 20 bp, Artificial Sequence
  sgRNA
  Olfr583_9
gctgttgccagagagggcgg

SEQ ID NO: 43293 - DNA, 20 bp, Artificial Sequence
  sgRNA
  Olfr583_10
atattgctttctctgaagaa

SEQ ID NO: 43294 - DNA, 20 bp, Artificial Sequence
  sgRNA
  Olfr583_11
ccatgagcagactctaggcc

SEQ ID NO: 43295 - DNA, 20 bp, Artificial Sequence
  sgRNA
  Olfr583_12
tgagcacagggggcaaaaga

SEQ ID NO: 43296 - DNA, 20 bp, Artificial Sequence
  sgRNA
  Olfr583_13
cctggcctagagtctgctca

SEQ ID NO: 43297 - DNA, 20 bp, Artificial Sequence
  sgRNA
  Olfr583_14
gggcaaaagaaggtaaacat

SEQ ID NO: 43298 - DNA, 20 bp, Artificial Sequence
  sgRNA
  Olfr583_15
ggtttaaggagcagaagtag

SEQ ID NO: 43299 - DNA, 20 bp, Artificial Sequence
  sgRNA
  Olfr583_16
aattctagaattattcagat

SEQ ID NO: 43300 - DNA, 20 bp, Artificial Sequence
  sgRNA
  Olfr583_17
cttcagagaaagcaatattg

SEQ ID NO: 43301 - DNA, 20 bp, Artificial Sequence
  sgRNA
  Olfr583_18
ggcaaatagcatctgtggac

SEQ ID NO: 43302 - DNA, 20 bp, Artificial Sequence
  sgRNA
  Olfr583_19
gcctagagtctgctcatggc

SEQ ID NO: 43303 - DNA, 20 bp, Artificial Sequence
  sgRNA
  Olfr583_20
tttctctgaagaaaggcaca

SEQ ID NO: 43304 - DNA, 20 bp, Artificial Sequence
  sgRNA
  Olfr584_1
actggggaatgatcttgttg

SEQ ID NO: 43305 - DNA, 20 bp, Artificial Sequence
  sgRNA
  Olfr584_2
tgatgactgcagatgtggtg

SEQ ID NO: 43306 - DNA, 20 bp, Artificial Sequence
  sgRNA
  Olfr584_3
ccaaaatgctggctatactc

SEQ ID NO: 43307 - DNA, 20 bp, Artificial Sequence
  sgRNA
  Olfr584_4
gatagccacataacggtcca

SEQ ID NO: 43308 - DNA, 20 bp, Artificial Sequence
  sgRNA
  Olfr584_5
tcagagacagggttacccga

SEQ ID NO: 43309 - DNA, 20 bp, Artificial Sequence
  sgRNA
  Olfr584_6
aacatgatgtgaacaactcg

SEQ ID NO: 43310 - DNA, 20 bp, Artificial Sequence
  sgRNA
  Olfr584_7
aaccaaacagatcagagaca

SEQ ID NO: 43311 - DNA, 20 bp, Artificial Sequence
  sgRNA
  Olfr584_8
atcagagacagggttacccg

SEQ ID NO: 43312 - DNA, 20 bp, Artificial Sequence
  sgRNA
  Olfr584_9
tggagaccatgaaacagaag

SEQ ID NO: 43313 - DNA, 20 bp, Artificial Sequence
  sgRNA
  Olfr584_10
atgatgggattgagcatagg

SEQ ID NO: 43314 - DNA, 20 bp, Artificial Sequence
  sgRNA
  Olfr584_11
ctggagaccatgaaacagaa

SEQ ID NO: 43315 - DNA, 20 bp, Artificial Sequence
  sgRNA
  Olfr584_12
gtgctgttgtgatggtgaga

SEQ ID NO: 43316 - DNA, 20 bp, Artificial Sequence
  sgRNA
  Olfr584_13
atgatcttgttggggcagaa

SEQ ID NO: 43317 - DNA, 20 bp, Artificial Sequence
  sgRNA
  Olfr584_14
caaacatgatgtgaacaact

SEQ ID NO: 43318 - DNA, 20 bp, Artificial Sequence
  sgRNA
  Olfr584_15
tttgtggctttctctgttgt

SEQ ID NO: 43319 - DNA, 20 bp, Artificial Sequence
  sgRNA
  Olfr584_16
ggtgctgttgtgatggtgag

SEQ ID NO: 43320 - DNA, 20 bp, Artificial Sequence
  sgRNA
  Olfr584_17
tggtgaggatgctggaatgt

SEQ ID NO: 43321 - DNA, 20 bp, Artificial Sequence
  sgRNA
  Olfr584_18
gactggggaatgatcttgtt

SEQ ID NO: 43322 - DNA, 20 bp, Artificial Sequence
  sgRNA
  Olfr584_19
cctggagaccatgaaacaga

SEQ ID NO: 43323 - DNA, 20 bp, Artificial Sequence
  sgRNA
  Olfr584_20
aaccctgtctctgatctgtt

SEQ ID NO: 43324 - DNA, 20 bp, Artificial Sequence
  sgRNA
  Olfr585_1
actcgggcaaataacatctg

SEQ ID NO: 43325 - DNA, 20 bp, Artificial Sequence
  sgRNA
  Olfr585_2
atctggataacagtaggagt

SEQ ID NO: 43326 - DNA, 20 bp, Artificial Sequence
  sgRNA
  Olfr585_3
cctggactagagtctgctca

SEQ ID NO: 43327 - DNA, 20 bp, Artificial Sequence
  sgRNA
  Olfr585_4
gtagagtgcgcattatcact

SEQ ID NO: 43328 - DNA, 20 bp, Artificial Sequence
  sgRNA
  Olfr585_5
gttgatctcattctgacgac

SEQ ID NO: 43329 - DNA, 20 bp, Artificial Sequence
  sgRNA
  Olfr585_6
aatcacatctggataacagt

SEQ ID NO: 43330 - DNA, 20 bp, Artificial Sequence
  sgRNA
  Olfr585_7
agaatcatagtatatctaag

SEQ ID NO: 43331 - DNA, 20 bp, Artificial Sequence
  sgRNA
  Olfr585_8
ccagagacaggctaaacata

SEQ ID NO: 43332 - DNA, 20 bp, Artificial Sequence
  sgRNA
  Olfr585_9
gggcaaaagaagataaacat

SEQ ID NO: 43333 - DNA, 20 bp, Artificial Sequence
  sgRNA
  Olfr585_10
ttatcaaccttcttgttgac

SEQ ID NO: 43334 - DNA, 20 bp, Artificial Sequence
  sgRNA
  Olfr585_11
gactagagtctgctcacggc

SEQ ID NO: 43335 - DNA, 20 bp, Artificial Sequence
  sgRNA
  Olfr585_12
catctggataacagtaggag

SEQ ID NO: 43336 - DNA, 20 bp, Artificial Sequence
  sgRNA
  Olfr585_13
ttgatctcattctgacgaca

SEQ ID NO: 43337 - DNA, 20 bp, Artificial Sequence
  sgRNA
  Olfr585_14
ctcatctgaagaacgacaca

SEQ ID NO: 43338 - DNA, 20 bp, Artificial Sequence
  sgRNA
  Olfr585_15
cttgtgtcgttcttcagatg

SEQ ID NO: 43339 - DNA, 20 bp, Artificial Sequence
  sgRNA
  Olfr585_16
cttcagatgaggcaatattg

SEQ ID NO: 43340 - DNA, 20 bp, Artificial Sequence
  sgRNA
  Olfr585_17
ggcttaaggagcagaagtag

SEQ ID NO: 43341 - DNA, 20 bp, Artificial Sequence
  sgRNA
  Olfr585_18
tacagaaagagacaggctta

SEQ ID NO: 43342 - DNA, 20 bp, Artificial Sequence
  sgRNA
  Olfr585_19
gtgggacacacaagtgctga

SEQ ID NO: 43343 - DNA, 20 bp, Artificial Sequence
  sgRNA
  Olfr585_20
ccgtgagcagactctagtcc

SEQ ID NO: 43344 - DNA, 20 bp, Artificial Sequence
  sgRNA
  Olfr587-ps1_1
gagacgctatcactattgcc

SEQ ID NO: 43345 - DNA, 20 bp, Artificial Sequence
  sgRNA
  Olfr587-ps1_2
gagcccatatttatcctgaa

SEQ ID NO: 43346 - DNA, 20 bp, Artificial Sequence
  sgRNA
  Olfr587-ps1_3
gcctgcttgctacggagcat

SEQ ID NO: 43347 - DNA, 20 bp, Artificial Sequence
  sgRNA
  Olfr587-ps1_4
gcttatttagtagccttcat

SEQ ID NO: 43348 - DNA, 20 bp, Artificial Sequence
  sgRNA
  Olfr587-ps1_5
tgatagcgtctcagtagcaa

SEQ ID NO: 43349 - DNA, 20 bp, Artificial Sequence
  sgRNA
  Olfr587-ps1_6
tcccatagtccacatcctca

SEQ ID NO: 43350 - DNA, 20 bp, Artificial Sequence
  sgRNA
  Olfr587-ps1_7
gacggcagattgctatgaag

SEQ ID NO: 43351 - DNA, 20 bp, Artificial Sequence
  sgRNA
  Olfr587-ps1_8
ttctacttaacctaaacttg

SEQ ID NO: 43352 - DNA, 20 bp, Artificial Sequence
  sgRNA
  Olfr587-ps1_9
gtgtagacatagacatacct

SEQ ID NO: 43353 - DNA, 20 bp, Artificial Sequence
  sgRNA
  Olfr587-ps1_10
gcaggtagatgtcagccatg

SEQ ID NO: 43354 - DNA, 20 bp, Artificial Sequence
  sgRNA
  Olfr587-ps1_11
gttgatcctggcatcagagc

SEQ ID NO: 43355 - DNA, 20 bp, Artificial Sequence
  sgRNA
  Olfr587-ps1_12
gtacatgggctgatgtagtg

SEQ ID NO: 43356 - DNA, 20 bp, Artificial Sequence
  sgRNA
  Olfr587-ps1_13
gcaagtttaggttaagtaga

SEQ ID NO: 43357 - DNA, 20 bp, Artificial Sequence
  sgRNA
  Olfr587-ps1_14
ccacaatgctgactgtgctg

SEQ ID NO: 43358 - DNA, 20 bp, Artificial Sequence
  sgRNA
  Olfr587-ps1_15
aggatggtagaatagtgcag

SEQ ID NO: 43359 - DNA, 20 bp, Artificial Sequence
  sgRNA
  Olfr587-ps1_16
gcttacaccaagatgttctg

SEQ ID NO: 43360 - DNA, 20 bp, Artificial Sequence
  sgRNA
  Olfr587-ps1_17
catgggagagggcattgacc

SEQ ID NO: 43361 - DNA, 20 bp, Artificial Sequence
  sgRNA
  Olfr587-ps1_18
cagtcagtgccaagatggaa

SEQ ID NO: 43362 - DNA, 20 bp, Artificial Sequence
  sgRNA
  Olfr587-ps1_19
tgagacgctatcactattgc

SEQ ID NO: 43363 - DNA, 20 bp, Artificial Sequence
  sgRNA
  Olfr587-ps1_20
aaacccttcaggataaatat

SEQ ID NO: 43364 - DNA, 20 bp, Artificial Sequence
  sgRNA
  Olfr589_1
agaatggtgctgtaccgaag

SEQ ID NO: 43365 - DNA, 20 bp, Artificial Sequence
  sgRNA
  Olfr589_2
ttggcattgctgtgctagtg

SEQ ID NO: 43366 - DNA, 20 bp, Artificial Sequence
  sgRNA
  Olfr589_3
gtgagcacatgggtcttgca

SEQ ID NO: 43367 - DNA, 20 bp, Artificial Sequence
  sgRNA
  Olfr589_4
tgtgaagagactctagtcct

SEQ ID NO: 43368 - DNA, 20 bp, Artificial Sequence
  sgRNA
  Olfr589_5
tccttcatgacacatcgctt

SEQ ID NO: 43369 - DNA, 20 bp, Artificial Sequence
  sgRNA
  Olfr589_6
tggccatctgtatcccactt

SEQ ID NO: 43370 - DNA, 20 bp, Artificial Sequence
  sgRNA
  Olfr589_7
aaaatattattgcaagtacg

SEQ ID NO: 43371 - DNA, 20 bp, Artificial Sequence
  sgRNA
  Olfr589_8
gatccccagcaacaagaaag

SEQ ID NO: 43372 - DNA, 20 bp, Artificial Sequence
  sgRNA
  Olfr589_9
gttctcaccccatatatgac

SEQ ID NO: 43373 - DNA, 20 bp, Artificial Sequence
  sgRNA
  Olfr589_10
gtaccgaagtgggatacaga

SEQ ID NO: 43374 - DNA, 20 bp, Artificial Sequence
  sgRNA
  Olfr589_11
acataagccataaattacat

SEQ ID NO: 43375 - DNA, 20 bp, Artificial Sequence
  sgRNA
  Olfr589_12
agaagtatatgtatataacg

SEQ ID NO: 43376 - DNA, 20 bp, Artificial Sequence
  sgRNA
  Olfr589_13
gctgaatcctgtcatatatg

SEQ ID NO: 43377 - DNA, 20 bp, Artificial Sequence
  sgRNA
  Olfr589_14
atagccagaaaatagaacat

SEQ ID NO: 43378 - DNA, 20 bp, Artificial Sequence
  sgRNA
  Olfr589_15
gcaaccatccctaaaatgct

SEQ ID NO: 43379 - DNA, 20 bp, Artificial Sequence
  sgRNA
  Olfr589_16
atgatgtgatgcccacagaa

SEQ ID NO: 43380 - DNA, 20 bp, Artificial Sequence
  sgRNA
  Olfr589_17
gctgtcttgtgcaagtgtca

SEQ ID NO: 43381 - DNA, 20 bp, Artificial Sequence
  sgRNA
  Olfr589_18
aataaggtcgtttctatgat

SEQ ID NO: 43382 - DNA, 20 bp, Artificial Sequence
  sgRNA
  Olfr589_19
tggcattgctgtgctagtga

SEQ ID NO: 43383 - DNA, 20 bp, Artificial Sequence
  sgRNA
  Olfr589_20
ccagcaacaagaaagtggaa

SEQ ID NO: 43384 - DNA, 20 bp, Artificial Sequence
  sgRNA
  Olfr592_1
gctctgtcttgataactacc

SEQ ID NO: 43385 - DNA, 20 bp, Artificial Sequence
  sgRNA
  Olfr592_2
gatgggcatcagcatatgtg

SEQ ID NO: 43386 - DNA, 20 bp, Artificial Sequence
  sgRNA
  Olfr592_3
gccaagcatacggggcacag

SEQ ID NO: 43387 - DNA, 20 bp, Artificial Sequence
  sgRNA
  Olfr592_4
ccagacctgggatcccaatg

SEQ ID NO: 43388 - DNA, 20 bp, Artificial Sequence
  sgRNA
  Olfr592_5
gatgcccatgaaataaactt

SEQ ID NO: 43389 - DNA, 20 bp, Artificial Sequence
  sgRNA
  Olfr592_6
gagcacagatggctacataa

SEQ ID NO: 43390 - DNA, 20 bp, Artificial Sequence
  sgRNA
  Olfr592_7
ttaaccgtgcatcctgagat

SEQ ID NO: 43391 - DNA, 20 bp, Artificial Sequence
  sgRNA
  Olfr592_8
gcccatgaaataaacttcgg

SEQ ID NO: 43392 - DNA, 20 bp, Artificial Sequence
  sgRNA
  Olfr592_9
gagccaagtcgactgaagaa

SEQ ID NO: 43393 - DNA, 20 bp, Artificial Sequence
  sgRNA
  Olfr592_10
gtagtggagtggagcacaga

SEQ ID NO: 43394 - DNA, 20 bp, Artificial Sequence
  sgRNA
  Olfr592_11
gcctcccatctcaggatgca

SEQ ID NO: 43395 - DNA, 20 bp, Artificial Sequence
  sgRNA
  Olfr592_12
cagaatatgccaagcatacg

SEQ ID NO: 43396 - DNA, 20 bp, Artificial Sequence
  sgRNA
  Olfr592_13
catgtgttcacaataggaat

SEQ ID NO: 43397 - DNA, 20 bp, Artificial Sequence
  sgRNA
  Olfr592_14
ggcattgcaaaattgtcctg

SEQ ID NO: 43398 - DNA, 20 bp, Artificial Sequence
  sgRNA
  Olfr592_15
gccaccgaagtttatttcat

SEQ ID NO: 43399 - DNA, 20 bp, Artificial Sequence
  sgRNA
  Olfr592_16
tcttgttgccaacctctatt

SEQ ID NO: 43400 - DNA, 20 bp, Artificial Sequence
  sgRNA
  Olfr592_17
accagaatatgccaagcata

SEQ ID NO: 43401 - DNA, 20 bp, Artificial Sequence
  sgRNA
  Olfr592_18
gttctcacactgtaaatgat

SEQ ID NO: 43402 - DNA, 20 bp, Artificial Sequence
  sgRNA
  Olfr592_19
cattcctattgtgaacacat

SEQ ID NO: 43403 - DNA, 20 bp, Artificial Sequence
  sgRNA
  Olfr592_20
cctccatgccagtaaaggca

SEQ ID NO: 43404 - DNA, 20 bp, Artificial Sequence
  sgRNA
  Olfr620_1
caggatcctgaaaatcggag

SEQ ID NO: 43405 - DNA, 20 bp, Artificial Sequence
  sgRNA
  Olfr620_2
gaagtaccatacaatttccc

SEQ ID NO: 43406 - DNA, 20 bp, Artificial Sequence
  sgRNA
  Olfr620_3
cagtggacaaccccatgcat

SEQ ID NO: 43407 - DNA, 20 bp, Artificial Sequence
  sgRNA
  Olfr620_4
agtaataaatttctaaacca

SEQ ID NO: 43408 - DNA, 20 bp, Artificial Sequence
  sgRNA
  Olfr620_5
agatacgagtgagaattcag

SEQ ID NO: 43409 - DNA, 20 bp, Artificial Sequence
  sgRNA
  Olfr620_6
ggtgatcagcaacttgttag

SEQ ID NO: 43410 - DNA, 20 bp, Artificial Sequence
  sgRNA
  Olfr620_7
gcacagtcttacttcattca

SEQ ID NO: 43411 - DNA, 20 bp, Artificial Sequence
  sgRNA
  Olfr620_8
tctgtctattgcatccaggg

SEQ ID NO: 43412 - DNA, 20 bp, Artificial Sequence
  sgRNA
  Olfr620_9
ggttgcaaatggcaatgtag

SEQ ID NO: 43413 - DNA, 20 bp, Artificial Sequence
  sgRNA
  Olfr620_10
cctccatcctaaccaatgac

SEQ ID NO: 43414 - DNA, 20 bp, Artificial Sequence
  sgRNA
  Olfr620_11
attgaagcggatatctccac

SEQ ID NO: 43415 - DNA, 20 bp, Artificial Sequence
  sgRNA
  Olfr620_12
gcaccaagacttaattagaa

SEQ ID NO: 43416 - DNA, 20 bp, Artificial Sequence
  sgRNA
  Olfr620_13
taatggggttcatcaaaggt

SEQ ID NO: 43417 - DNA, 20 bp, Artificial Sequence
  sgRNA
  Olfr620_14
caatagacagaactgtgtac

SEQ ID NO: 43418 - DNA, 20 bp, Artificial Sequence
  sgRNA
  Olfr620_15
attctttataatctatgtga

SEQ ID NO: 43419 - DNA, 20 bp, Artificial Sequence
  sgRNA
  Olfr620_16
cttcccaaagcggtgaacca

SEQ ID NO: 43420 - DNA, 20 bp, Artificial Sequence
  sgRNA
  Olfr620_17
gaccatagatgctattgaag

SEQ ID NO: 43421 - DNA, 20 bp, Artificial Sequence
  sgRNA
  Olfr620_18
gcaggcagaaagaatgggag

SEQ ID NO: 43422 - DNA, 20 bp, Artificial Sequence
  sgRNA
  Olfr620_19
attcagcggttgttcttgaa

SEQ ID NO: 43423 - DNA, 20 bp, Artificial Sequence
  sgRNA
  Olfr620_20
ccatggtcagaccaatgatg

SEQ ID NO: 43424 - DNA, 20 bp, Artificial Sequence
  sgRNA
  Olfr623_1
tgtactatggttcaatcaca

SEQ ID NO: 43425 - DNA, 20 bp, Artificial Sequence
  sgRNA
  Olfr623_2
ggttgtggtcatccttaatg

SEQ ID NO: 43426 - DNA, 20 bp, Artificial Sequence
  sgRNA
  Olfr623_3
atatcttaatgggttgcgaa

SEQ ID NO: 43427 - DNA, 20 bp, Artificial Sequence
  sgRNA
  Olfr623_4
gatgggatttctccagacct

SEQ ID NO: 43428 - DNA, 20 bp, Artificial Sequence
  sgRNA
  Olfr623_5
tgacagggttcataaatggg

SEQ ID NO: 43429 - DNA, 20 bp, Artificial Sequence
  sgRNA
  Olfr623_6
attgaatgtgatgtcagcac

SEQ ID NO: 43430 - DNA, 20 bp, Artificial Sequence
  sgRNA
  Olfr623_7
gcctatatcttcatattgct

SEQ ID NO: 43431 - DNA, 20 bp, Artificial Sequence
  sgRNA
  Olfr623_8
ttattaccttaatatcagta

SEQ ID NO: 43432 - DNA, 20 bp, Artificial Sequence
  sgRNA
  Olfr623_9
actccacaatagagaaacta

SEQ ID NO: 43433 - DNA, 20 bp, Artificial Sequence
  sgRNA
  Olfr623_10
ggatggtggtatatcttaat

SEQ ID NO: 43434 - DNA, 20 bp, Artificial Sequence
  sgRNA
  Olfr623_11
gtttctctattgtggagtcg

SEQ ID NO: 43435 - DNA, 20 bp, Artificial Sequence
  sgRNA
  Olfr623_12
atgcaaaatacaacaacaat

SEQ ID NO: 43436 - DNA, 20 bp, Artificial Sequence
  sgRNA
  Olfr623_13
atcttcatattgcttggcaa

SEQ ID NO: 43437 - DNA, 20 bp, Artificial Sequence
  sgRNA
  Olfr623_14
gtcttaatactgaagatgac

SEQ ID NO: 43438 - DNA, 20 bp, Artificial Sequence
  sgRNA
  Olfr623_15
catagtacacccagcactgt

SEQ ID NO: 43439 - DNA, 20 bp, Artificial Sequence
  sgRNA
  Olfr623_16
accaccatgcccacagtgct

SEQ ID NO: 43440 - DNA, 20 bp, Artificial Sequence
  sgRNA
  Olfr623_17
tcttaatactgaagatgaca

SEQ ID NO: 43441 - DNA, 20 bp, Artificial Sequence
  sgRNA
  Olfr623_18
ccacagtgctgggtgtacta

SEQ ID NO: 43442 - DNA, 20 bp, Artificial Sequence
  sgRNA
  Olfr623_19
attgttatatgtacaatatg

SEQ ID NO: 43443 - DNA, 20 bp, Artificial Sequence
  sgRNA
  Olfr623_20
agagaaactatggataaaat

SEQ ID NO: 43444 - DNA, 20 bp, Artificial Sequence
  sgRNA
  Olfr624_1
actccatgaaggacaaacca

SEQ ID NO: 43445 - DNA, 20 bp, Artificial Sequence
  sgRNA
  Olfr624_2
cagaatcctgaaaatcggag

SEQ ID NO: 43446 - DNA, 20 bp, Artificial Sequence
  sgRNA
  Olfr624_3
gagcatagaaactgttaaag

SEQ ID NO: 43447 - DNA, 20 bp, Artificial Sequence
  sgRNA
  Olfr624_4
ggggctgtctactgtgcaca

SEQ ID NO: 43448 - DNA, 20 bp, Artificial Sequence
  sgRNA
  Olfr624_5
ccatagtcagaccaataatg

SEQ ID NO: 43449 - DNA, 20 bp, Artificial Sequence
  sgRNA
  Olfr624_6
acagtctctgaattctcact

SEQ ID NO: 43450 - DNA, 20 bp, Artificial Sequence
  sgRNA
  Olfr624_7
accatagtcagaccaataat

SEQ ID NO: 43451 - DNA, 20 bp, Artificial Sequence
  sgRNA
  Olfr624_8
ggtgcagacttgactctgtt

SEQ ID NO: 43452 - DNA, 20 bp, Artificial Sequence
  sgRNA
  Olfr624_9
acggtgctgggaattctttg

SEQ ID NO: 43453 - DNA, 20 bp, Artificial Sequence
  sgRNA
  Olfr624_10
tccagtaagaacaaatctag

SEQ ID NO: 43454 - DNA, 20 bp, Artificial Sequence
  sgRNA
  Olfr624_11
acacggtgctgggaattctt

SEQ ID NO: 43455 - DNA, 20 bp, Artificial Sequence
  sgRNA
  Olfr624_12
taatggggttcatcaagggt

SEQ ID NO: 43456 - DNA, 20 bp, Artificial Sequence
  sgRNA
  Olfr624_13
acctctagatttgttcttac

SEQ ID NO: 43457 - DNA, 20 bp, Artificial Sequence
  sgRNA
  Olfr624_14
cagtttctatgctctgtctc

SEQ ID NO: 43458 - DNA, 20 bp, Artificial Sequence
  sgRNA
  Olfr624_15
ataatggggttcatcaaggg

SEQ ID NO: 43459 - DNA, 20 bp, Artificial Sequence
  sgRNA
  Olfr624_16
ccccattattggtctgacta

SEQ ID NO: 43460 - DNA, 20 bp, Artificial Sequence
  sgRNA
  Olfr624_17
gtatataatggggttcatca

SEQ ID NO: 43461 - DNA, 20 bp, Artificial Sequence
  sgRNA
  Olfr624_18
atctatgcaatggtgttcct

SEQ ID NO: 43462 - DNA, 20 bp, Artificial Sequence
  sgRNA
  Olfr624_19
tctactgtgcacacggtgct

SEQ ID NO: 43463 - DNA, 20 bp, Artificial Sequence
  sgRNA
  Olfr624_20
cacggtgctgggaattcttt

SEQ ID NO: 43464 - DNA, 20 bp, Artificial Sequence
  sgRNA
  Olfr63_1
agcatgtcagacagcattcg

SEQ ID NO: 43465 - DNA, 20 bp, Artificial Sequence
  sgRNA
  Olfr63_2
taagtgcatgataatgcagg

SEQ ID NO: 43466 - DNA, 20 bp, Artificial Sequence
  sgRNA
  Olfr63_3
atgtgaaggagaaaaacaat

SEQ ID NO: 43467 - DNA, 20 bp, Artificial Sequence
  sgRNA
  Olfr63_4
tgtatttgttcactcttctg

SEQ ID NO: 43468 - DNA, 20 bp, Artificial Sequence
  sgRNA
  Olfr63_5
tgtgccggccctcagtagat

SEQ ID NO: 43469 - DNA, 20 bp, Artificial Sequence
  sgRNA
  Olfr63_6
ggacttgaggtaaattatgg

SEQ ID NO: 43470 - DNA, 20 bp, Artificial Sequence
  sgRNA
  Olfr63_7
gtactgtgagtagagtcccc

SEQ ID NO: 43471 - DNA, 20 bp, Artificial Sequence
  sgRNA
  Olfr63_8
ccacaagccgagcacaacct

SEQ ID NO: 43472 - DNA, 20 bp, Artificial Sequence
  sgRNA
  Olfr63_9
ttgagaatcccatctactga

SEQ ID NO: 43473 - DNA, 20 bp, Artificial Sequence
  sgRNA
  Olfr63_10
tcttcagctccttattcctg

SEQ ID NO: 43474 - DNA, 20 bp, Artificial Sequence
  sgRNA
  Olfr63_11
actgtagtgattgtgcacta

SEQ ID NO: 43475 - DNA, 20 bp, Artificial Sequence
  sgRNA
  Olfr63_12
ataagtgcatgataatgcag

SEQ ID NO: 43476 - DNA, 20 bp, Artificial Sequence
  sgRNA
  Olfr63_13
agatgggattctcaagatgg

SEQ ID NO: 43477 - DNA, 20 bp, Artificial Sequence
  sgRNA
  Olfr63_14
ataatttacctcaagtccag

SEQ ID NO: 43478 - DNA, 20 bp, Artificial Sequence
  sgRNA
  Olfr63_15
ctataattaaaagcttccac

SEQ ID NO: 43479 - DNA, 20 bp, Artificial Sequence
  sgRNA
  Olfr63_16
gtgtgtgtcacacccctcat

SEQ ID NO: 43480 - DNA, 20 bp, Artificial Sequence
  sgRNA
  Olfr63_17
atagcatgtcagacagcatt

SEQ ID NO: 43481 - DNA, 20 bp, Artificial Sequence
  sgRNA
  Olfr63_18
tgaggggtgtgacacacacc

SEQ ID NO: 43482 - DNA, 20 bp, Artificial Sequence
  sgRNA
  Olfr63_19
catagcccatgaccacgagc

SEQ ID NO: 43483 - DNA, 20 bp, Artificial Sequence
  sgRNA
  Olfr63_20
tgagcctccaaggttgtgct

SEQ ID NO: 43484 - DNA, 20 bp, Artificial Sequence
  sgRNA
  Olfr631_1
cctatatggactgtcactgg

SEQ ID NO: 43485 - DNA, 20 bp, Artificial Sequence
  sgRNA
  Olfr631_2
cctctgaacggtaataatgg

SEQ ID NO: 43486 - DNA, 20 bp, Artificial Sequence
  sgRNA
  Olfr631_3
ccaaaaaatacccaccatgg

SEQ ID NO: 43487 - DNA, 20 bp, Artificial Sequence
  sgRNA
  Olfr631_4
aacgatcaaaggacatgacg

SEQ ID NO: 43488 - DNA, 20 bp, Artificial Sequence
  sgRNA
  Olfr631_5
cctccattattaccgttcag

SEQ ID NO: 43489 - DNA, 20 bp, Artificial Sequence
  sgRNA
  Olfr631_6
aggacagcgcaatgagcacg

SEQ ID NO: 43490 - DNA, 20 bp, Artificial Sequence
  sgRNA
  Olfr631_7
ttaccgttcagagggtaatg

SEQ ID NO: 43491 - DNA, 20 bp, Artificial Sequence
  sgRNA
  Olfr631_8
taccgttcagagggtaatga

SEQ ID NO: 43492 - DNA, 20 bp, Artificial Sequence
  sgRNA
  Olfr631_9
tgctggccctcactgacctg

SEQ ID NO: 43493 - DNA, 20 bp, Artificial Sequence
  sgRNA
  Olfr631_10
acaccaggaagtgatacacc

SEQ ID NO: 43494 - DNA, 20 bp, Artificial Sequence
  sgRNA
  Olfr631_11
gcctatgtgtcatcctcagg

SEQ ID NO: 43495 - DNA, 20 bp, Artificial Sequence
  sgRNA
  Olfr631_12
ccaccagtgacagtccatat

SEQ ID NO: 43496 - DNA, 20 bp, Artificial Sequence
  sgRNA
  Olfr631_13
agccctatgttctacctcag

SEQ ID NO: 43497 - DNA, 20 bp, Artificial Sequence
  sgRNA
  Olfr631_14
tggattcatcctatacacgg

SEQ ID NO: 43498 - DNA, 20 bp, Artificial Sequence
  sgRNA
  Olfr631_15
agtagggaaaatccttcagg

SEQ ID NO: 43499 - DNA, 20 bp, Artificial Sequence
  sgRNA
  Olfr631_16
tgccctcattaccctctgaa

SEQ ID NO: 43500 - DNA, 20 bp, Artificial Sequence
  sgRNA
  Olfr631_17
aggcctatgtgtcatcctca

SEQ ID NO: 43501 - DNA, 20 bp, Artificial Sequence
  sgRNA
  Olfr631_18
ggctggtctggcttcccaag

SEQ ID NO: 43502 - DNA, 20 bp, Artificial Sequence
  sgRNA
  Olfr631_19
tgacagccccaggtcagtga

SEQ ID NO: 43503 - DNA, 20 bp, Artificial Sequence
  sgRNA
  Olfr631_20
gcagaacatctggatttggc

SEQ ID NO: 43504 - DNA, 20 bp, Artificial Sequence
  sgRNA
  Olfr635_1
ccatgaaagagaacccatgg

SEQ ID NO: 43505 - DNA, 20 bp, Artificial Sequence
  sgRNA
  Olfr635_2
gcggataacggttaggatgg

SEQ ID NO: 43506 - DNA, 20 bp, Artificial Sequence
  sgRNA
  Olfr635_3
agggaatggagatccagaga

SEQ ID NO: 43507 - DNA, 20 bp, Artificial Sequence
  sgRNA
  Olfr635_4
ctgacatcagagtcaacagc

SEQ ID NO: 43508 - DNA, 20 bp, Artificial Sequence
  sgRNA
  Olfr635_5
gctctgtgcggataacggtt

SEQ ID NO: 43509 - DNA, 20 bp, Artificial Sequence
  sgRNA
  Olfr635_6
ggtggagagatggctctgtg

SEQ ID NO: 43510 - DNA, 20 bp, Artificial Sequence
  sgRNA
  Olfr635_7
ctacagtcatgcagctcctt

SEQ ID NO: 43511 - DNA, 20 bp, Artificial Sequence
  sgRNA
  Olfr635_8
tgtgcggataacggttagga

SEQ ID NO: 43512 - DNA, 20 bp, Artificial Sequence
  sgRNA
  Olfr635_9
agatggctctgtgcggataa

SEQ ID NO: 43513 - DNA, 20 bp, Artificial Sequence
  sgRNA
  Olfr635_10
gtagaggcagaataagggaa

SEQ ID NO: 43514 - DNA, 20 bp, Artificial Sequence
  sgRNA
  Olfr635_11
gatggtgtagaggcagaata

SEQ ID NO: 43515 - DNA, 20 bp, Artificial Sequence
  sgRNA
  Olfr635_12
ggtgtttcccatgatggaga

SEQ ID NO: 43516 - DNA, 20 bp, Artificial Sequence
  sgRNA
  Olfr635_13
gatggtggtgtttcccatga

SEQ ID NO: 43517 - DNA, 20 bp, Artificial Sequence
  sgRNA
  Olfr635_14
catccgagaaatcagctttg

SEQ ID NO: 43518 - DNA, 20 bp, Artificial Sequence
  sgRNA
  Olfr635_15
gcccagttcttcttcctcca

SEQ ID NO: 43519 - DNA, 20 bp, Artificial Sequence
  sgRNA
  Olfr635_16
atggtgtagaggcagaataa

SEQ ID NO: 43520 - DNA, 20 bp, Artificial Sequence
  sgRNA
  Olfr635_17
actcttcaggataagtgcat

SEQ ID NO: 43521 - DNA, 20 bp, Artificial Sequence
  sgRNA
  Olfr635_18
tcatcacaggaggtgctagc

SEQ ID NO: 43522 - DNA, 20 bp, Artificial Sequence
  sgRNA
  Olfr635_19
cccatggaggaagaagaact

SEQ ID NO: 43523 - DNA, 20 bp, Artificial Sequence
  sgRNA
  Olfr635_20
cccagttcttcttcctccat

SEQ ID NO: 43524 - DNA, 20 bp, Artificial Sequence
  sgRNA
  Olfr638_1
tgtgcggatgacagttagga

SEQ ID NO: 43525 - DNA, 20 bp, Artificial Sequence
  sgRNA
  Olfr638_2
tttcccgaatgttgaaccag

SEQ ID NO: 43526 - DNA, 20 bp, Artificial Sequence
  sgRNA
  Olfr638_3
ctgacatcagagtcaacaga

SEQ ID NO: 43527 - DNA, 20 bp, Artificial Sequence
  sgRNA
  Olfr638_4
ccatgaatgagaacccatgg

SEQ ID NO: 43528 - DNA, 20 bp, Artificial Sequence
  sgRNA
  Olfr638_5
gcacaggtattcttcctcca

SEQ ID NO: 43529 - DNA, 20 bp, Artificial Sequence
  sgRNA
  Olfr638_6
gctctgtgcggatgacagtt

SEQ ID NO: 43530 - DNA, 20 bp, Artificial Sequence
  sgRNA
  Olfr638_7
ctttgaggcctgctttgcac

SEQ ID NO: 43531 - DNA, 20 bp, Artificial Sequence
  sgRNA
  Olfr638_8
gagaagcatgcttcgcaaag

SEQ ID NO: 43532 - DNA, 20 bp, Artificial Sequence
  sgRNA
  Olfr638_9
tggtgtagaggcagaagaag

SEQ ID NO: 43533 - DNA, 20 bp, Artificial Sequence
  sgRNA
  Olfr638_10
tcgcctcctgttgcaaagaa

SEQ ID NO: 43534 - DNA, 20 bp, Artificial Sequence
  sgRNA
  Olfr638_11
tatggtgtagaggcagaaga

SEQ ID NO: 43535 - DNA, 20 bp, Artificial Sequence
  sgRNA
  Olfr638_12
cagatggtacggatttgctc

SEQ ID NO: 43536 - DNA, 20 bp, Artificial Sequence
  sgRNA
  Olfr638_13
gggccagcatagagaggaag

SEQ ID NO: 43537 - DNA, 20 bp, Artificial Sequence
  sgRNA
  Olfr638_14
ggtgttgcccatgatggata

SEQ ID NO: 43538 - DNA, 20 bp, Artificial Sequence
  sgRNA
  Olfr638_15
agaggacctgcatgactgta

SEQ ID NO: 43539 - DNA, 20 bp, Artificial Sequence
  sgRNA
  Olfr638_16
aggtcctctggttcaacatt

SEQ ID NO: 43540 - DNA, 20 bp, Artificial Sequence
  sgRNA
  Olfr638_17
cgtggagagatggctctgtg

SEQ ID NO: 43541 - DNA, 20 bp, Artificial Sequence
  sgRNA
  Olfr638_18
cggtgaggatgaagtagaaa

SEQ ID NO: 43542 - DNA, 20 bp, Artificial Sequence
  sgRNA
  Olfr638_19
ggtcctctggttcaacattc

SEQ ID NO: 43543 - DNA, 20 bp, Artificial Sequence
  sgRNA
  Olfr638_20
ctacagtcatgcaggtcctc

SEQ ID NO: 43544 - DNA, 20 bp, Artificial Sequence
  sgRNA
  Olfr640_1
atggcggtaattgaaacaga

SEQ ID NO: 43545 - DNA, 20 bp, Artificial Sequence
  sgRNA
  Olfr640_2
gatctgatgaaagtggcatg

SEQ ID NO: 43546 - DNA, 20 bp, Artificial Sequence
  sgRNA
  Olfr640_3
gcggctattggtaagcacag

SEQ ID NO: 43547 - DNA, 20 bp, Artificial Sequence
  sgRNA
  Olfr640_4
ggcattcctgggatgaacac

SEQ ID NO: 43548 - DNA, 20 bp, Artificial Sequence
  sgRNA
  Olfr640_5
ggatacccagacccatagcc

SEQ ID NO: 43549 - DNA, 20 bp, Artificial Sequence
  sgRNA
  Olfr640_6
agcacattgcccttgcaaaa

SEQ ID NO: 43550 - DNA, 20 bp, Artificial Sequence
  sgRNA
  Olfr640_7
cagaaggtagcaagtacggt

SEQ ID NO: 43551 - DNA, 20 bp, Artificial Sequence
  sgRNA
  Olfr640_8
gtacggtaggaagtgtagat

SEQ ID NO: 43552 - DNA, 20 bp, Artificial Sequence
  sgRNA
  Olfr640_9
aatgcctgtcagctgtagtg

SEQ ID NO: 43553 - DNA, 20 bp, Artificial Sequence
  sgRNA
  Olfr640_10
tccatgttaacaatatctat

SEQ ID NO: 43554 - DNA, 20 bp, Artificial Sequence
  sgRNA
  Olfr640_11
ccactttcatcagatctgga

SEQ ID NO: 43555 - DNA, 20 bp, Artificial Sequence
  sgRNA
  Olfr640_12
ctttcatcagatctggatgg

SEQ ID NO: 43556 - DNA, 20 bp, Artificial Sequence
  sgRNA
  Olfr640_13
gacaggcatcaaaatcaaca

SEQ ID NO: 43557 - DNA, 20 bp, Artificial Sequence
  sgRNA
  Olfr640_14
ccagacccatagccaggatg

SEQ ID NO: 43558 - DNA, 20 bp, Artificial Sequence
  sgRNA
  Olfr640_15
gcttggcctgtgttcatccc

SEQ ID NO: 43559 - DNA, 20 bp, Artificial Sequence
  sgRNA
  Olfr640_16
ggatgaacacaggccaagct

SEQ ID NO: 43560 - DNA, 20 bp, Artificial Sequence
  sgRNA
  Olfr640_17
tgaccagagcaaggatactg

SEQ ID NO: 43561 - DNA, 20 bp, Artificial Sequence
  sgRNA
  Olfr640_18
aatagccgcatcctggctat

SEQ ID NO: 43562 - DNA, 20 bp, Artificial Sequence
  sgRNA
  Olfr640_19
gtatccttgctctggtcatt

SEQ ID NO: 43563 - DNA, 20 bp, Artificial Sequence
  sgRNA
  Olfr640_20
cattgagagagagcatagag

SEQ ID NO: 43564 - DNA, 20 bp, Artificial Sequence
  sgRNA
  Olfr641_1
cctttgtgtgatgtatgccg

SEQ ID NO: 43565 - DNA, 20 bp, Artificial Sequence
  sgRNA
  Olfr641_2
cacatcactgaaagacaaca

SEQ ID NO: 43566 - DNA, 20 bp, Artificial Sequence
  sgRNA
  Olfr641_3
aggcaagcttcatcatgtct

SEQ ID NO: 43567 - DNA, 20 bp, Artificial Sequence
  sgRNA
  Olfr641_4
cagcaatgaattcattggtg

SEQ ID NO: 43568 - DNA, 20 bp, Artificial Sequence
  sgRNA
  Olfr641_5
acatgcggaatatggcacgg

SEQ ID NO: 43569 - DNA, 20 bp, Artificial Sequence
  sgRNA
  Olfr641_6
ggtggaggctctccagacca

SEQ ID NO: 43570 - DNA, 20 bp, Artificial Sequence
  sgRNA
  Olfr641_7
gcagaaggttctcagcacgg

SEQ ID NO: 43571 - DNA, 20 bp, Artificial Sequence
  sgRNA
  Olfr641_8
agaacattggatttgcagat

SEQ ID NO: 43572 - DNA, 20 bp, Artificial Sequence
  sgRNA
  Olfr641_9
gaatcacagtatttgccccg

SEQ ID NO: 43573 - DNA, 20 bp, Artificial Sequence
  sgRNA
  Olfr641_10
cagtcaggagaaaggaggca

SEQ ID NO: 43574 - DNA, 20 bp, Artificial Sequence
  sgRNA
  Olfr641_11
acggcatacatcacacaaag

SEQ ID NO: 43575 - DNA, 20 bp, Artificial Sequence
  sgRNA
  Olfr641_12
tcaccaatgaattcattgct

SEQ ID NO: 43576 - DNA, 20 bp, Artificial Sequence
  sgRNA
  Olfr641_13
tcttgtgtctacctttggca

SEQ ID NO: 43577 - DNA, 20 bp, Artificial Sequence
  sgRNA
  Olfr641_14
gatgtatgccgtggccctcg

SEQ ID NO: 43578 - DNA, 20 bp, Artificial Sequence
  sgRNA
  Olfr641_15
aggacagtggcataatgcaa

SEQ ID NO: 43579 - DNA, 20 bp, Artificial Sequence
  sgRNA
  Olfr641_16
gaggacatgtatgtatcgtg

SEQ ID NO: 43580 - DNA, 20 bp, Artificial Sequence
  sgRNA
  Olfr641_17
catcccagcaatgaattcat

SEQ ID NO: 43581 - DNA, 20 bp, Artificial Sequence
  sgRNA
  Olfr641_18
gtaggagtgggaaagaacat

SEQ ID NO: 43582 - DNA, 20 bp, Artificial Sequence
  sgRNA
  Olfr641_19
aatcacagtatttgccccga

SEQ ID NO: 43583 - DNA, 20 bp, Artificial Sequence
  sgRNA
  Olfr641_20
gataccagtcaggagaaagg

SEQ ID NO: 43584 - DNA, 20 bp, Artificial Sequence
  sgRNA
  Olfr646_1
agtatgtgtgagtcatgaca

SEQ ID NO: 43585 - DNA, 20 bp, Artificial Sequence
  sgRNA
  Olfr646_2
tgctgggatagtccgtagtg

SEQ ID NO: 43586 - DNA, 20 bp, Artificial Sequence
  sgRNA
  Olfr646_3
tatgacagtatggttgagga

SEQ ID NO: 43587 - DNA, 20 bp, Artificial Sequence
  sgRNA
  Olfr646_4
ctgggcgaggcatccaccaa

SEQ ID NO: 43588 - DNA, 20 bp, Artificial Sequence
  sgRNA
  Olfr646_5
agtacctgtggatctcacct

SEQ ID NO: 43589 - DNA, 20 bp, Artificial Sequence
  sgRNA
  Olfr646_6
ggatggttgtatatctcagt

SEQ ID NO: 43590 - DNA, 20 bp, Artificial Sequence
  sgRNA
  Olfr646_7
ggccatggcaaggagaaccg

SEQ ID NO: 43591 - DNA, 20 bp, Artificial Sequence
  sgRNA
  Olfr646_8
tcgattgtgaccaaagcgat

SEQ ID NO: 43592 - DNA, 20 bp, Artificial Sequence
  sgRNA
  Olfr646_9
ggacacaaaacatctgggcg

SEQ ID NO: 43593 - DNA, 20 bp, Artificial Sequence
  sgRNA
  Olfr646_10
agaaaaccagaatgacacca

SEQ ID NO: 43594 - DNA, 20 bp, Artificial Sequence
  sgRNA
  Olfr646_11
ctcgattgtgaccaaagcga

SEQ ID NO: 43595 - DNA, 20 bp, Artificial Sequence
  sgRNA
  Olfr646_12
attagaatggagccatagaa

SEQ ID NO: 43596 - DNA, 20 bp, Artificial Sequence
  sgRNA
  Olfr646_13
tcttcctaactgggatccca

SEQ ID NO: 43597 - DNA, 20 bp, Artificial Sequence
  sgRNA
  Olfr646_14
atcccgtgatgctcaacaca

SEQ ID NO: 43598 - DNA, 20 bp, Artificial Sequence
  sgRNA
  Olfr646_15
aagccgactccgaatctcct

SEQ ID NO: 43599 - DNA, 20 bp, Artificial Sequence
  sgRNA
  Olfr646_16
gggctatgacagtatggttg

SEQ ID NO: 43600 - DNA, 20 bp, Artificial Sequence
  sgRNA
  Olfr646_17
gttcttgcaccgtagatgat

SEQ ID NO: 43601 - DNA, 20 bp, Artificial Sequence
  sgRNA
  Olfr646_18
gctgccctcatccttatcat

SEQ ID NO: 43602 - DNA, 20 bp, Artificial Sequence
  sgRNA
  Olfr646_19
gaagacggaagacagcccgg

SEQ ID NO: 43603 - DNA, 20 bp, Artificial Sequence
  sgRNA
  Olfr646_20
agaaggggatggcaatccag

SEQ ID NO: 43604 - DNA, 20 bp, Artificial Sequence
  sgRNA
  Olfr648_1
agggaatgccaatccacacg

SEQ ID NO: 43605 - DNA, 20 bp, Artificial Sequence
  sgRNA
  Olfr648_2
aatcttgacgatagtcttgg

SEQ ID NO: 43606 - DNA, 20 bp, Artificial Sequence
  sgRNA
  Olfr648_3
ggaggaagaacatttgtgtg

SEQ ID NO: 43607 - DNA, 20 bp, Artificial Sequence
  sgRNA
  Olfr648_4
atgtgctcacagtacgtgtg

SEQ ID NO: 43608 - DNA, 20 bp, Artificial Sequence
  sgRNA
  Olfr648_5
atgtgagcagttacaacccg

SEQ ID NO: 43609 - DNA, 20 bp, Artificial Sequence
  sgRNA
  Olfr648_6
gcaagatgatacagaagctt

SEQ ID NO: 43610 - DNA, 20 bp, Artificial Sequence
  sgRNA
  Olfr648_7
ccttctctacctcatcacag

SEQ ID NO: 43611 - DNA, 20 bp, Artificial Sequence
  sgRNA
  Olfr648_8
ctaggacaaagctatagtgg

SEQ ID NO: 43612 - DNA, 20 bp, Artificial Sequence
  sgRNA
  Olfr648_9
tctacctcatcacagtggag

SEQ ID NO: 43613 - DNA, 20 bp, Artificial Sequence
  sgRNA
  Olfr648_10
agatatccgcacatgcaagc

SEQ ID NO: 43614 - DNA, 20 bp, Artificial Sequence
  sgRNA
  Olfr648_11
gatgatacagaagcttcgga

SEQ ID NO: 43615 - DNA, 20 bp, Artificial Sequence
  sgRNA
  Olfr648_12
atgatgtagatcacacagaa

SEQ ID NO: 43616 - DNA, 20 bp, Artificial Sequence
  sgRNA
  Olfr648_13
gtgagcacataggtgttgcc

SEQ ID NO: 43617 - DNA, 20 bp, Artificial Sequence
  sgRNA
  Olfr648_14
gatctcatcctgtctacaga

SEQ ID NO: 43618 - DNA, 20 bp, Artificial Sequence
  sgRNA
  Olfr648_15
aagatagtagcatatctcaa

SEQ ID NO: 43619 - DNA, 20 bp, Artificial Sequence
  sgRNA
  Olfr648_16
agcctgggatccccaccaaa

SEQ ID NO: 43620 - DNA, 20 bp, Artificial Sequence
  sgRNA
  Olfr648_17
gcgaggatggagaaaaaggc

SEQ ID NO: 43621 - DNA, 20 bp, Artificial Sequence
  sgRNA
  Olfr648_18
cctagattcagccattctaa

SEQ ID NO: 43622 - DNA, 20 bp, Artificial Sequence
  sgRNA
  Olfr648_19
tgtgatctacatcatagctg

SEQ ID NO: 43623 - DNA, 20 bp, Artificial Sequence
  sgRNA
  Olfr648_20
aggcaggtgtgtaaaacatg

SEQ ID NO: 43624 - DNA, 20 bp, Artificial Sequence
  sgRNA
  Olfr65_1
ccatagtacactcagcactg

SEQ ID NO: 43625 - DNA, 20 bp, Artificial Sequence
  sgRNA
  Olfr65_2
atctccatattacttggcaa

SEQ ID NO: 43626 - DNA, 20 bp, Artificial Sequence
  sgRNA
  Olfr65_3
ataccttagtgggttgcgaa

SEQ ID NO: 43627 - DNA, 20 bp, Artificial Sequence
  sgRNA
  Olfr65_4
actccacaatagagagagtg

SEQ ID NO: 43628 - DNA, 20 bp, Artificial Sequence
  sgRNA
  Olfr65_5
tgacagggttcataaaaggg

SEQ ID NO: 43629 - DNA, 20 bp, Artificial Sequence
  sgRNA
  Olfr65_6
gcctatatctccatattact

SEQ ID NO: 43630 - DNA, 20 bp, Artificial Sequence
  sgRNA
  Olfr65_7
attgtgatgtggacgacatg

SEQ ID NO: 43631 - DNA, 20 bp, Artificial Sequence
  sgRNA
  Olfr65_8
ttattaccttagtatctgta

SEQ ID NO: 43632 - DNA, 20 bp, Artificial Sequence
  sgRNA
  Olfr65_9
attgaatgtgatgtcagcgc

SEQ ID NO: 43633 - DNA, 20 bp, Artificial Sequence
  sgRNA
  Olfr65_10
ccacagtgctgagtgtacta

SEQ ID NO: 43634 - DNA, 20 bp, Artificial Sequence
  sgRNA
  Olfr65_11
tgttgtggttgtatttgcaa

SEQ ID NO: 43635 - DNA, 20 bp, Artificial Sequence
  sgRNA
  Olfr65_12
tcttccccattcctgctcac

SEQ ID NO: 43636 - DNA, 20 bp, Artificial Sequence
  sgRNA
  Olfr65_13
ttgccattcgcaacccacta

SEQ ID NO: 43637 - DNA, 20 bp, Artificial Sequence
  sgRNA
  Olfr65_14
gatactaaggtaataaagat

SEQ ID NO: 43638 - DNA, 20 bp, Artificial Sequence
  sgRNA
  Olfr65_15
agtcttgagaatcaaaacgt

SEQ ID NO: 43639 - DNA, 20 bp, Artificial Sequence
  sgRNA
  Olfr65_16
attgcaaatacaaccacaac

SEQ ID NO: 43640 - DNA, 20 bp, Artificial Sequence
  sgRNA
  Olfr65_17
tgtactatggttaaatcaca

SEQ ID NO: 43641 - DNA, 20 bp, Artificial Sequence
  sgRNA
  Olfr65_18
tcttaatgctatagatgaca

SEQ ID NO: 43642 - DNA, 20 bp, Artificial Sequence
  sgRNA
  Olfr65_19
agacgtagctcattgtgatg

SEQ ID NO: 43643 - DNA, 20 bp, Artificial Sequence
  sgRNA
  Olfr65_20
gtcttaatgctatagatgac

SEQ ID NO: 43644 - DNA, 20 bp, Artificial Sequence
  sgRNA
  Olfr650-ps1_1
gtgagcatatgggtatcgcc

SEQ ID NO: 43645 - DNA, 20 bp, Artificial Sequence
  sgRNA
  Olfr650-ps1_2
gcaggatatggacatagcgt

SEQ ID NO: 43646 - DNA, 20 bp, Artificial Sequence
  sgRNA
  Olfr650-ps1_3
gctacaccaccatcctaaca

SEQ ID NO: 43647 - DNA, 20 bp, Artificial Sequence
  sgRNA
  Olfr650-ps1_4
gctttaggagaaagatacat

SEQ ID NO: 43648 - DNA, 20 bp, Artificial Sequence
  sgRNA
  Olfr650-ps1_5
taggcgggatgaccacatag

SEQ ID NO: 43649 - DNA, 20 bp, Artificial Sequence
  sgRNA
  Olfr650-ps1_6
agcaggatatggacatagcg

SEQ ID NO: 43650 - DNA, 20 bp, Artificial Sequence
  sgRNA
  Olfr650-ps1_7
gtgtttcccaccaaacctgt

SEQ ID NO: 43651 - DNA, 20 bp, Artificial Sequence
  sgRNA
  Olfr650-ps1_8
acctagccagaagttggcca

SEQ ID NO: 43652 - DNA, 20 bp, Artificial Sequence
  sgRNA
  Olfr650-ps1_9
ggatggacagccacatttgt

SEQ ID NO: 43653 - DNA, 20 bp, Artificial Sequence
  sgRNA
  Olfr650-ps1_10
gctgttcacagcagccacac

SEQ ID NO: 43654 - DNA, 20 bp, Artificial Sequence
  sgRNA
  Olfr650-ps1_11
agaggcggaataccgctcag

SEQ ID NO: 43655 - DNA, 20 bp, Artificial Sequence
  sgRNA
  Olfr650-ps1_12
tctttgcctacaggtttggt

SEQ ID NO: 43656 - DNA, 20 bp, Artificial Sequence
  sgRNA
  Olfr650-ps1_13
atatgtacataggctcatgg

SEQ ID NO: 43657 - DNA, 20 bp, Artificial Sequence
  sgRNA
  Olfr650-ps1_14
tttgtaggtgctccagccca

SEQ ID NO: 43658 - DNA, 20 bp, Artificial Sequence
  sgRNA
  Olfr650-ps1_15
gtaggcaaagacagagaaga

SEQ ID NO: 43659 - DNA, 20 bp, Artificial Sequence
  sgRNA
  Olfr650-ps1_16
tattatgtacatagctgccc

SEQ ID NO: 43660 - DNA, 20 bp, Artificial Sequence
  sgRNA
  Olfr650-ps1_17
aatgtttacaaatatcacca

SEQ ID NO: 43661 - DNA, 20 bp, Artificial Sequence
  sgRNA
  Olfr650-ps1_18
gctagaacctagccagaagt

SEQ ID NO: 43662 - DNA, 20 bp, Artificial Sequence
  sgRNA
  Olfr650-ps1_19
cagcccataccagacattaa

SEQ ID NO: 43663 - DNA, 20 bp, Artificial Sequence
  sgRNA
  Olfr650-ps1_20
gggctgggatatagaacagc

SEQ ID NO: 43664 - DNA, 20 bp, Artificial Sequence
  sgRNA
  Olfr657_1
gcctggcatgtgatgatagg

SEQ ID NO: 43665 - DNA, 20 bp, Artificial Sequence
  sgRNA
  Olfr657_2
ataattgatgaatagcggag

SEQ ID NO: 43666 - DNA, 20 bp, Artificial Sequence
  sgRNA
  Olfr657_3
tttcttaggtatcctctctg

SEQ ID NO: 43667 - DNA, 20 bp, Artificial Sequence
  sgRNA
  Olfr657_4
tcttgaacaataattccgct

SEQ ID NO: 43668 - DNA, 20 bp, Artificial Sequence
  sgRNA
  Olfr657_5
aggaccagagaactcaggcg

SEQ ID NO: 43669 - DNA, 20 bp, Artificial Sequence
  sgRNA
  Olfr657_6
ttaggaccagagaactcagg

SEQ ID NO: 43670 - DNA, 20 bp, Artificial Sequence
  sgRNA
  Olfr657_7
ggtagagcaaagtaaatggt

SEQ ID NO: 43671 - DNA, 20 bp, Artificial Sequence
  sgRNA
  Olfr657_8
actcaggcggggcttccaaa

SEQ ID NO: 43672 - DNA, 20 bp, Artificial Sequence
  sgRNA
  Olfr657_9
cgtttgtccctattgctgaa

SEQ ID NO: 43673 - DNA, 20 bp, Artificial Sequence
  sgRNA
  Olfr657_10
tgactccaaggtttgagcac

SEQ ID NO: 43674 - DNA, 20 bp, Artificial Sequence
  sgRNA
  Olfr657_11
cattgcctgtgctcaaacct

SEQ ID NO: 43675 - DNA, 20 bp, Artificial Sequence
  sgRNA
  Olfr657_12
ctctgtactcagactcaatt

SEQ ID NO: 43676 - DNA, 20 bp, Artificial Sequence
  sgRNA
  Olfr657_13
gttggaatggggagtgacct

SEQ ID NO: 43677 - DNA, 20 bp, Artificial Sequence
  sgRNA
  Olfr657_14
agtgatttcagtaactcact

SEQ ID NO: 43678 - DNA, 20 bp, Artificial Sequence
  sgRNA
  Olfr657_15
tgctctacctttcagcaata

SEQ ID NO: 43679 - DNA, 20 bp, Artificial Sequence
  sgRNA
  Olfr657_16
gtagagcaaagtaaatggta

SEQ ID NO: 43680 - DNA, 20 bp, Artificial Sequence
  sgRNA
  Olfr657_17
tgcctgtgcttgcagcccag

SEQ ID NO: 43681 - DNA, 20 bp, Artificial Sequence
  sgRNA
  Olfr657_18
atgacaatattatgagaccc

SEQ ID NO: 43682 - DNA, 20 bp, Artificial Sequence
  sgRNA
  Olfr657_19
ggcccatgtccaccacagag

SEQ ID NO: 43683 - DNA, 20 bp, Artificial Sequence
  sgRNA
  Olfr657_20
cacttaggaccagagaactc

SEQ ID NO: 43684 - DNA, 20 bp, Artificial Sequence
  sgRNA
  Olfr658_1
tctgtagccaagttgtcctg

SEQ ID NO: 43685 - DNA, 20 bp, Artificial Sequence
  sgRNA
  Olfr658_2
aagcgcctaccctactgtcg

SEQ ID NO: 43686 - DNA, 20 bp, Artificial Sequence
  sgRNA
  Olfr658_3
tcttcatccataccttcacg

SEQ ID NO: 43687 - DNA, 20 bp, Artificial Sequence
  sgRNA
  Olfr658_4
agaatggtggagtaacgcag

SEQ ID NO: 43688 - DNA, 20 bp, Artificial Sequence
  sgRNA
  Olfr658_5
tattgcctcgacagtagggt

SEQ ID NO: 43689 - DNA, 20 bp, Artificial Sequence
  sgRNA
  Olfr658_6
tcgacagtagggtaggcgct

SEQ ID NO: 43690 - DNA, 20 bp, Artificial Sequence
  sgRNA
  Olfr658_7
gaatggtggagtaacgcaga

SEQ ID NO: 43691 - DNA, 20 bp, Artificial Sequence
  sgRNA
  Olfr658_8
gtattgtgtgccccccaaag

SEQ ID NO: 43692 - DNA, 20 bp, Artificial Sequence
  sgRNA
  Olfr658_9
gacacagtctcgtatctgtt

SEQ ID NO: 43693 - DNA, 20 bp, Artificial Sequence
  sgRNA
  Olfr658_10
cgcttggtgagaaatgtgaa

SEQ ID NO: 43694 - DNA, 20 bp, Artificial Sequence
  sgRNA
  Olfr658_11
gtaacgcagagggtagcaga

SEQ ID NO: 43695 - DNA, 20 bp, Artificial Sequence
  sgRNA
  Olfr658_12
tgtgtgccccccaaagcggt

SEQ ID NO: 43696 - DNA, 20 bp, Artificial Sequence
  sgRNA
  Olfr658_13
gtgtcataaggattctttca

SEQ ID NO: 43697 - DNA, 20 bp, Artificial Sequence
  sgRNA
  Olfr658_14
ggtagcagatggctacatag

SEQ ID NO: 43698 - DNA, 20 bp, Artificial Sequence
  sgRNA
  Olfr658_15
ttgtgtgccccccaaagcgg

SEQ ID NO: 43699 - DNA, 20 bp, Artificial Sequence
  sgRNA
  Olfr658_16
tgtgcatgtcttccaggcct

SEQ ID NO: 43700 - DNA, 20 bp, Artificial Sequence
  sgRNA
  Olfr658_17
gacattgccacaggacaact

SEQ ID NO: 43701 - DNA, 20 bp, Artificial Sequence
  sgRNA
  Olfr658_18
attatattgcctcgacagta

SEQ ID NO: 43702 - DNA, 20 bp, Artificial Sequence
  sgRNA
  Olfr658_19
catccataccttcacgggga

SEQ ID NO: 43703 - DNA, 20 bp, Artificial Sequence
  sgRNA
  Olfr658_20
gaccactgccctcagaatca

SEQ ID NO: 43704 - DNA, 20 bp, Artificial Sequence
  sgRNA
  Olfr66_1
actagccattgtagaatcgg

SEQ ID NO: 43705 - DNA, 20 bp, Artificial Sequence
  sgRNA
  Olfr66_2
aggcatgattgggggcacga

SEQ ID NO: 43706 - DNA, 20 bp, Artificial Sequence
  sgRNA
  Olfr66_3
gcttggaaatgattcaccac

SEQ ID NO: 43707 - DNA, 20 bp, Artificial Sequence
  sgRNA
  Olfr66_4
aaccagagggagattgcaca

SEQ ID NO: 43708 - DNA, 20 bp, Artificial Sequence
  sgRNA
  Olfr66_5
gatgctcctttcctactgac

SEQ ID NO: 43709 - DNA, 20 bp, Artificial Sequence
  sgRNA
  Olfr66_6
caagacccccgattctacaa

SEQ ID NO: 43710 - DNA, 20 bp, Artificial Sequence
  sgRNA
  Olfr66_7
tgtcctggtgctaaaccaga

SEQ ID NO: 43711 - DNA, 20 bp, Artificial Sequence
  sgRNA
  Olfr66_8
gtctactgtccaaacacagt

SEQ ID NO: 43712 - DNA, 20 bp, Artificial Sequence
  sgRNA
  Olfr66_9
actccaaatgatgaagagaa

SEQ ID NO: 43713 - DNA, 20 bp, Artificial Sequence
  sgRNA
  Olfr66_10
tcgtggttagtgtcatccca

SEQ ID NO: 43714 - DNA, 20 bp, Artificial Sequence
  sgRNA
  Olfr66_11
ccagagggagattgcacaag

SEQ ID NO: 43715 - DNA, 20 bp, Artificial Sequence
  sgRNA
  Olfr66_12
gtgtcctggtgctaaaccag

SEQ ID NO: 43716 - DNA, 20 bp, Artificial Sequence
  sgRNA
  Olfr66_13
agataatgatgagcgcatcg

SEQ ID NO: 43717 - DNA, 20 bp, Artificial Sequence
  sgRNA
  Olfr66_14
agaaagcccgtcagtaggaa

SEQ ID NO: 43718 - DNA, 20 bp, Artificial Sequence
  sgRNA
  Olfr66_15
cagtgccatcttcatcaccc

SEQ ID NO: 43719 - DNA, 20 bp, Artificial Sequence
  sgRNA
  Olfr66_16
ccccttgtgcaatctccctc

SEQ ID NO: 43720 - DNA, 20 bp, Artificial Sequence
  sgRNA
  Olfr66_17
tgatgctcctttcctactga

SEQ ID NO: 43721 - DNA, 20 bp, Artificial Sequence
  sgRNA
  Olfr66_18
caaaagagaggcatgattgg

SEQ ID NO: 43722 - DNA, 20 bp, Artificial Sequence
  sgRNA
  Olfr66_19
cactagccattgtagaatcg

SEQ ID NO: 43723 - DNA, 20 bp, Artificial Sequence
  sgRNA
  Olfr66_20
agaaagggatagagatccag

SEQ ID NO: 43724 - DNA, 20 bp, Artificial Sequence
  sgRNA
  Olfr664_1
atgtggtcattgccaaggca

SEQ ID NO: 43725 - DNA, 20 bp, Artificial Sequence
  sgRNA
  Olfr664_2
acagactcacaactgcccgt

SEQ ID NO: 43726 - DNA, 20 bp, Artificial Sequence
  sgRNA
  Olfr664_3
tctttacacaccgctttggg

SEQ ID NO: 43727 - DNA, 20 bp, Artificial Sequence
  sgRNA
  Olfr664_4
tctgttgctaaaatatcctg

SEQ ID NO: 43728 - DNA, 20 bp, Artificial Sequence
  sgRNA
  Olfr664_5
aatgaacctcttccagacca

SEQ ID NO: 43729 - DNA, 20 bp, Artificial Sequence
  sgRNA
  Olfr664_6
aagcgcctgccatactgcaa

SEQ ID NO: 43730 - DNA, 20 bp, Artificial Sequence
  sgRNA
  Olfr664_7
tgggacatatgtgatgacga

SEQ ID NO: 43731 - DNA, 20 bp, Artificial Sequence
  sgRNA
  Olfr664_8
gtcaaagcccccaatcagga

SEQ ID NO: 43732 - DNA, 20 bp, Artificial Sequence
  sgRNA
  Olfr664_9
tgtcaaagcccccaatcagg

SEQ ID NO: 43733 - DNA, 20 bp, Artificial Sequence
  sgRNA
  Olfr664_10
tgctgtacatggtaaatagt

SEQ ID NO: 43734 - DNA, 20 bp, Artificial Sequence
  sgRNA
  Olfr664_11
agaatagtggcatagcgcag

SEQ ID NO: 43735 - DNA, 20 bp, Artificial Sequence
  sgRNA
  Olfr664_12
tgtaagagcaatgctgtaca

SEQ ID NO: 43736 - DNA, 20 bp, Artificial Sequence
  sgRNA
  Olfr664_13
ggatggtatgccgcccaaag

SEQ ID NO: 43737 - DNA, 20 bp, Artificial Sequence
  sgRNA
  Olfr664_14
gtgtgtaaagaaggtgaaga

SEQ ID NO: 43738 - DNA, 20 bp, Artificial Sequence
  sgRNA
  Olfr664_15
atgacattacccttgcagta

SEQ ID NO: 43739 - DNA, 20 bp, Artificial Sequence
  sgRNA
  Olfr664_16
gataacagatagccacatag

SEQ ID NO: 43740 - DNA, 20 bp, Artificial Sequence
  sgRNA
  Olfr664_17
gcacatgagcacatctgtga

SEQ ID NO: 43741 - DNA, 20 bp, Artificial Sequence
  sgRNA
  Olfr664_18
gcacatctgtgaaggaaaga

SEQ ID NO: 43742 - DNA, 20 bp, Artificial Sequence
  sgRNA
  Olfr664_19
tatgcagagagtgttgggaa

SEQ ID NO: 43743 - DNA, 20 bp, Artificial Sequence
  sgRNA
  Olfr664_20
ccatgaacccaatagtgtat

SEQ ID NO: 43744 - DNA, 20 bp, Artificial Sequence
  sgRNA
  Olfr666_1
gggcactgtggttgtacaca

SEQ ID NO: 43745 - DNA, 20 bp, Artificial Sequence
  sgRNA
  Olfr666_2
tgtacatgattgctgtagtg

SEQ ID NO: 43746 - DNA, 20 bp, Artificial Sequence
  sgRNA
  Olfr666_3
aagcgcttgccctattgcag

SEQ ID NO: 43747 - DNA, 20 bp, Artificial Sequence
  sgRNA
  Olfr666_4
actccattccagtcaacatg

SEQ ID NO: 43748 - DNA, 20 bp, Artificial Sequence
  sgRNA
  Olfr666_5
atatcgtagaggatagcaga

SEQ ID NO: 43749 - DNA, 20 bp, Artificial Sequence
  sgRNA
  Olfr666_6
cacaaaccctgtgattgcca

SEQ ID NO: 43750 - DNA, 20 bp, Artificial Sequence
  sgRNA
  Olfr666_7
ataagactgcctctgcaata

SEQ ID NO: 43751 - DNA, 20 bp, Artificial Sequence
  sgRNA
  Olfr666_8
acacaaggtgacatcagtga

SEQ ID NO: 43752 - DNA, 20 bp, Artificial Sequence
  sgRNA
  Olfr666_9
gtcttacactatgatattga

SEQ ID NO: 43753 - DNA, 20 bp, Artificial Sequence
  sgRNA
  Olfr666_10
ggacaaagaacatctggaca

SEQ ID NO: 43754 - DNA, 20 bp, Artificial Sequence
  sgRNA
  Olfr666_11
gatagcagatggctacatag

SEQ ID NO: 43755 - DNA, 20 bp, Artificial Sequence
  sgRNA
  Olfr666_12
gaccagccttggcaatcaca

SEQ ID NO: 43756 - DNA, 20 bp, Artificial Sequence
  sgRNA
  Olfr666_13
acacagcatattgggcactg

SEQ ID NO: 43757 - DNA, 20 bp, Artificial Sequence
  sgRNA
  Olfr666_14
tggcaatcacagggtttgtg

SEQ ID NO: 43758 - DNA, 20 bp, Artificial Sequence
  sgRNA
  Olfr666_15
caatcaatagagcaaccatg

SEQ ID NO: 43759 - DNA, 20 bp, Artificial Sequence
  sgRNA
  Olfr666_16
agaccagccttggcaatcac

SEQ ID NO: 43760 - DNA, 20 bp, Artificial Sequence
  sgRNA
  Olfr666_17
tctgcaatagggcaagcgct

SEQ ID NO: 43761 - DNA, 20 bp, Artificial Sequence
  sgRNA
  Olfr666_18
attgctgtagtggggaactg

SEQ ID NO: 43762 - DNA, 20 bp, Artificial Sequence
  sgRNA
  Olfr666_19
ttctttgtccacatgttgac

SEQ ID NO: 43763 - DNA, 20 bp, Artificial Sequence
  sgRNA
  Olfr666_20
acatgtggacaaagaacatc

SEQ ID NO: 43764 - DNA, 20 bp, Artificial Sequence
  sgRNA
  Olfr668_1
caatcaataaagcaaccatg

SEQ ID NO: 43765 - DNA, 20 bp, Artificial Sequence
  sgRNA
  Olfr668_2
acaccaggtaacatcagtga

SEQ ID NO: 43766 - DNA, 20 bp, Artificial Sequence
  sgRNA
  Olfr668_3
tgtggtcacagtaagtatgg

SEQ ID NO: 43767 - DNA, 20 bp, Artificial Sequence
  sgRNA
  Olfr668_4
gacaagccttggcaatcaca

SEQ ID NO: 43768 - DNA, 20 bp, Artificial Sequence
  sgRNA
  Olfr668_5
ataagaatgcttctacaata

SEQ ID NO: 43769 - DNA, 20 bp, Artificial Sequence
  sgRNA
  Olfr668_6
atatcgtagaggattgcaga

SEQ ID NO: 43770 - DNA, 20 bp, Artificial Sequence
  sgRNA
  Olfr668_7
catgtggtcacagtaagtat

SEQ ID NO: 43771 - DNA, 20 bp, Artificial Sequence
  sgRNA
  Olfr668_8
acacagcatattgggcacag

SEQ ID NO: 43772 - DNA, 20 bp, Artificial Sequence
  sgRNA
  Olfr668_9
tctccttcactgatgttacc

SEQ ID NO: 43773 - DNA, 20 bp, Artificial Sequence
  sgRNA
  Olfr668_10
gaatgttgcaagacaagcct

SEQ ID NO: 43774 - DNA, 20 bp, Artificial Sequence
  sgRNA
  Olfr668_11
tctacaatagggcaagcgct

SEQ ID NO: 43775 - DNA, 20 bp, Artificial Sequence
  sgRNA
  Olfr668_12
cactatgatattgagagcag

SEQ ID NO: 43776 - DNA, 20 bp, Artificial Sequence
  sgRNA
  Olfr668_13
agacaagccttggcaatcac

SEQ ID NO: 43777 - DNA, 20 bp, Artificial Sequence
  sgRNA
  Olfr668_14
ccaggaagtagaacatgggc

SEQ ID NO: 43778 - DNA, 20 bp, Artificial Sequence
  sgRNA
  Olfr668_15
gaacaaagaacatttgggca

SEQ ID NO: 43779 - DNA, 20 bp, Artificial Sequence
  sgRNA
  Olfr668_16
cttgtcttgcaacattcttg

SEQ ID NO: 43780 - DNA, 20 bp, Artificial Sequence
  sgRNA
  Olfr668_17
attcaggataaagaattctg

SEQ ID NO: 43781 - DNA, 20 bp, Artificial Sequence
  sgRNA
  Olfr668_18
aaggccaggaagtagaacat

SEQ ID NO: 43782 - DNA, 20 bp, Artificial Sequence
  sgRNA
  Olfr668_19
cttcatgtacatgattgctg

SEQ ID NO: 43783 - DNA, 20 bp, Artificial Sequence
  sgRNA
  Olfr668_20
tggcaatcacagggttggtg

SEQ ID NO: 43784 - DNA, 20 bp, Artificial Sequence
  sgRNA
  Olfr669_1
tgtgcacggattcacaggtg

SEQ ID NO: 43785 - DNA, 20 bp, Artificial Sequence
  sgRNA
  Olfr669_2
catagtaaatgagatataca

SEQ ID NO: 43786 - DNA, 20 bp, Artificial Sequence
  sgRNA
  Olfr669_3
ataactttaccacagacatg

SEQ ID NO: 43787 - DNA, 20 bp, Artificial Sequence
  sgRNA
  Olfr669_4
taacacacctctcaagaagg

SEQ ID NO: 43788 - DNA, 20 bp, Artificial Sequence
  sgRNA
  Olfr669_5
acaggctgaccactgcccgg

SEQ ID NO: 43789 - DNA, 20 bp, Artificial Sequence
  sgRNA
  Olfr669_6
tatgggagatgacattgctt

SEQ ID NO: 43790 - DNA, 20 bp, Artificial Sequence
  sgRNA
  Olfr669_7
gcccagctttggcaatgaca

SEQ ID NO: 43791 - DNA, 20 bp, Artificial Sequence
  sgRNA
  Olfr669_8
attaagaatgaaagactgcg

SEQ ID NO: 43792 - DNA, 20 bp, Artificial Sequence
  sgRNA
  Olfr669_9
cttctgccgagcatctgcag

SEQ ID NO: 43793 - DNA, 20 bp, Artificial Sequence
  sgRNA
  Olfr669_10
catgtggtcacaatatgtat

SEQ ID NO: 43794 - DNA, 20 bp, Artificial Sequence
  sgRNA
  Olfr669_11
accctgtcattgccaaagct

SEQ ID NO: 43795 - DNA, 20 bp, Artificial Sequence
  sgRNA
  Olfr669_12
aggacaggctgaccactgcc

SEQ ID NO: 43796 - DNA, 20 bp, Artificial Sequence
  sgRNA
  Olfr669_13
gggcttgccaccttcttgag

SEQ ID NO: 43797 - DNA, 20 bp, Artificial Sequence
  sgRNA
  Olfr669_14
gcacaaagaacatctgaact

SEQ ID NO: 43798 - DNA, 20 bp, Artificial Sequence
  sgRNA
  Olfr669_15
atagcgtagtgggtagcaaa

SEQ ID NO: 43799 - DNA, 20 bp, Artificial Sequence
  sgRNA
  Olfr669_16
tttgaaccagaaaatgaaga

SEQ ID NO: 43800 - DNA, 20 bp, Artificial Sequence
  sgRNA
  Olfr669_17
atgtacatcatctccctagt

SEQ ID NO: 43801 - DNA, 20 bp, Artificial Sequence
  sgRNA
  Olfr669_18
atattgtgaccacatgtctg

SEQ ID NO: 43802 - DNA, 20 bp, Artificial Sequence
  sgRNA
  Olfr669_19
caatgatatgaagagaagga

SEQ ID NO: 43803 - DNA, 20 bp, Artificial Sequence
  sgRNA
  Olfr669_20
cagtggttgtgcaagtaaac

SEQ ID NO: 43804 - DNA, 20 bp, Artificial Sequence
  sgRNA
  Olfr671_1
ccagtggaagaaccatgtag

SEQ ID NO: 43805 - DNA, 20 bp, Artificial Sequence
  sgRNA
  Olfr671_2
atgttagattccattgacct

SEQ ID NO: 43806 - DNA, 20 bp, Artificial Sequence
  sgRNA
  Olfr671_3
tctatctcattgcagtcctg

SEQ ID NO: 43807 - DNA, 20 bp, Artificial Sequence
  sgRNA
  Olfr671_4
gcttacaaatggcaatgtag

SEQ ID NO: 43808 - DNA, 20 bp, Artificial Sequence
  sgRNA
  Olfr671_5
gacttctgtgacgttataca

SEQ ID NO: 43809 - DNA, 20 bp, Artificial Sequence
  sgRNA
  Olfr671_6
ataaaacagcaccattcccc

SEQ ID NO: 43810 - DNA, 20 bp, Artificial Sequence
  sgRNA
  Olfr671_7
agtgctgcggagcctctaca

SEQ ID NO: 43811 - DNA, 20 bp, Artificial Sequence
  sgRNA
  Olfr671_8
tactcgctcccgaatctgct

SEQ ID NO: 43812 - DNA, 20 bp, Artificial Sequence
  sgRNA
  Olfr671_9
aatgtagcggtcaaagccca

SEQ ID NO: 43813 - DNA, 20 bp, Artificial Sequence
  sgRNA
  Olfr671_10
ttgcaggtattgcagtgctg

SEQ ID NO: 43814 - DNA, 20 bp, Artificial Sequence
  sgRNA
  Olfr671_11
tttcttggccaatctctatg

SEQ ID NO: 43815 - DNA, 20 bp, Artificial Sequence
  sgRNA
  Olfr671_12
aatgagatagagtaaacaaa

SEQ ID NO: 43816 - DNA, 20 bp, Artificial Sequence
  sgRNA
  Olfr671_13
atgctttgatggccacagta

SEQ ID NO: 43817 - DNA, 20 bp, Artificial Sequence
  sgRNA
  Olfr671_14
aatgctttgatggccacagt

SEQ ID NO: 43818 - DNA, 20 bp, Artificial Sequence
  sgRNA
  Olfr671_15
atgagatagagtaaacaaaa

SEQ ID NO: 43819 - DNA, 20 bp, Artificial Sequence
  sgRNA
  Olfr671_16
cactggtgtttctcctactg

SEQ ID NO: 43820 - DNA, 20 bp, Artificial Sequence
  sgRNA
  Olfr671_17
ctcaaggctctcaatacctg

SEQ ID NO: 43821 - DNA, 20 bp, Artificial Sequence
  sgRNA
  Olfr671_18
catacttactgtgagcacat

SEQ ID NO: 43822 - DNA, 20 bp, Artificial Sequence
  sgRNA
  Olfr671_19
ctactgaggctaccctactg

SEQ ID NO: 43823 - DNA, 20 bp, Artificial Sequence
  sgRNA
  Olfr671_20
catccacttcttcacggcca

SEQ ID NO: 43824 - DNA, 20 bp, Artificial Sequence
  sgRNA
  Olfr675_1
tgtgtgcatattctagccct

SEQ ID NO: 43825 - DNA, 20 bp, Artificial Sequence
  sgRNA
  Olfr675_2
tctaaccaacaaagtcattg

SEQ ID NO: 43826 - DNA, 20 bp, Artificial Sequence
  sgRNA
  Olfr675_3
aagtatgaggaatgatgtga

SEQ ID NO: 43827 - DNA, 20 bp, Artificial Sequence
  sgRNA
  Olfr675_4
gcttacaaatggcaacgtag

SEQ ID NO: 43828 - DNA, 20 bp, Artificial Sequence
  sgRNA
  Olfr675_5
tgtgctgaggagcctataca

SEQ ID NO: 43829 - DNA, 20 bp, Artificial Sequence
  sgRNA
  Olfr675_6
ctactggaagaaccatgtat

SEQ ID NO: 43830 - DNA, 20 bp, Artificial Sequence
  sgRNA
  Olfr675_7
atgatgtgatggccacagta

SEQ ID NO: 43831 - DNA, 20 bp, Artificial Sequence
  sgRNA
  Olfr675_8
gggtaaggaccaagcaaatt

SEQ ID NO: 43832 - DNA, 20 bp, Artificial Sequence
  sgRNA
  Olfr675_9
ttgcaggtattgctgtgctg

SEQ ID NO: 43833 - DNA, 20 bp, Artificial Sequence
  sgRNA
  Olfr675_10
aatgagatagagaaaacaaa

SEQ ID NO: 43834 - DNA, 20 bp, Artificial Sequence
  sgRNA
  Olfr675_11
caggtcaatggaatccagca

SEQ ID NO: 43835 - DNA, 20 bp, Artificial Sequence
  sgRNA
  Olfr675_12
tttccatgaccgtgaagaag

SEQ ID NO: 43836 - DNA, 20 bp, Artificial Sequence
  sgRNA
  Olfr675_13
gacttctgtgatgttataca

SEQ ID NO: 43837 - DNA, 20 bp, Artificial Sequence
  sgRNA
  Olfr675_14
aagaaaatgtggatacattg

SEQ ID NO: 43838 - DNA, 20 bp, Artificial Sequence
  sgRNA
  Olfr675_15
tacttgctcccgaatttgct

SEQ ID NO: 43839 - DNA, 20 bp, Artificial Sequence
  sgRNA
  Olfr675_16
aatgatgtgatggccacagt

SEQ ID NO: 43840 - DNA, 20 bp, Artificial Sequence
  sgRNA
  Olfr675_17
catacttactgtgaacacat

SEQ ID NO: 43841 - DNA, 20 bp, Artificial Sequence
  sgRNA
  Olfr675_18
ctcaaggctctcaatacttg

SEQ ID NO: 43842 - DNA, 20 bp, Artificial Sequence
  sgRNA
  Olfr675_19
atgagatagagaaaacaaaa

SEQ ID NO: 43843 - DNA, 20 bp, Artificial Sequence
  sgRNA
  Olfr675_20
aatacttgtggctctcatat

SEQ ID NO: 43844 - DNA, 20 bp, Artificial Sequence
  sgRNA
  Olfr677_1
ctccgggagatcagtttcgg

SEQ ID NO: 43845 - DNA, 20 bp, Artificial Sequence
  sgRNA
  Olfr677_2
cagatcaattatcgacaatg

SEQ ID NO: 43846 - DNA, 20 bp, Artificial Sequence
  sgRNA
  Olfr677_3
aggattgtggtgtactggag

SEQ ID NO: 43847 - DNA, 20 bp, Artificial Sequence
  sgRNA
  Olfr677_4
tgtgtatctgacttcccttg

SEQ ID NO: 43848 - DNA, 20 bp, Artificial Sequence
  sgRNA
  Olfr677_5
agtgatttcccatatccttg

SEQ ID NO: 43849 - DNA, 20 bp, Artificial Sequence
  sgRNA
  Olfr677_6
tgatgggtgcacaagctaat

SEQ ID NO: 43850 - DNA, 20 bp, Artificial Sequence
  sgRNA
  Olfr677_7
agctcgaaggataagcacat

SEQ ID NO: 43851 - DNA, 20 bp, Artificial Sequence
  sgRNA
  Olfr677_8
ccaatcctggaatccctacc

SEQ ID NO: 43852 - DNA, 20 bp, Artificial Sequence
  sgRNA
  Olfr677_9
cttagaatgagaaacacaaa

SEQ ID NO: 43853 - DNA, 20 bp, Artificial Sequence
  sgRNA
  Olfr677_10
atgatgtggtgaccacaaaa

SEQ ID NO: 43854 - DNA, 20 bp, Artificial Sequence
  sgRNA
  Olfr677_11
cctaccaggataaagaaaga

SEQ ID NO: 43855 - DNA, 20 bp, Artificial Sequence
  sgRNA
  Olfr677_12
tttccatgcctgtaaacacg

SEQ ID NO: 43856 - DNA, 20 bp, Artificial Sequence
  sgRNA
  Olfr677_13
gaattcggaaaacagctcga

SEQ ID NO: 43857 - DNA, 20 bp, Artificial Sequence
  sgRNA
  Olfr677_14
gtttgcagatggcaacaaag

SEQ ID NO: 43858 - DNA, 20 bp, Artificial Sequence
  sgRNA
  Olfr677_15
agtgtttagcgccttcaatc

SEQ ID NO: 43859 - DNA, 20 bp, Artificial Sequence
  sgRNA
  Olfr677_16
ttctgactccataaatgaca

SEQ ID NO: 43860 - DNA, 20 bp, Artificial Sequence
  sgRNA
  Olfr677_17
ttgaaggcgctaaacacttg

SEQ ID NO: 43861 - DNA, 20 bp, Artificial Sequence
  sgRNA
  Olfr677_18
agtatgtgtgaggcatgatg

SEQ ID NO: 43862 - DNA, 20 bp, Artificial Sequence
  sgRNA
  Olfr677_19
tagatgatgttgatcttgat

SEQ ID NO: 43863 - DNA, 20 bp, Artificial Sequence
  sgRNA
  Olfr677_20
cttcaatcgggcatcttgag

SEQ ID NO: 43864 - DNA, 20 bp, Artificial Sequence
  sgRNA
  Olfr678_1
gtatcatactgtacctcagt

SEQ ID NO: 43865 - DNA, 20 bp, Artificial Sequence
  sgRNA
  Olfr678_2
ataatccggacaccacagaa

SEQ ID NO: 43866 - DNA, 20 bp, Artificial Sequence
  sgRNA
  Olfr678_3
agaagggaaagccaatccac

SEQ ID NO: 43867 - DNA, 20 bp, Artificial Sequence
  sgRNA
  Olfr678_4
tatataatccatacatgcac

SEQ ID NO: 43868 - DNA, 20 bp, Artificial Sequence
  sgRNA
  Olfr678_5
tcctcctgatagggatccca

SEQ ID NO: 43869 - DNA, 20 bp, Artificial Sequence
  sgRNA
  Olfr678_6
acttctagccaacctatatg

SEQ ID NO: 43870 - DNA, 20 bp, Artificial Sequence
  sgRNA
  Olfr678_7
ggattggtcgctttctcagt

SEQ ID NO: 43871 - DNA, 20 bp, Artificial Sequence
  sgRNA
  Olfr678_8
tcctgactccatagataaca

SEQ ID NO: 43872 - DNA, 20 bp, Artificial Sequence
  sgRNA
  Olfr678_9
tgccaacatgacactgacat

SEQ ID NO: 43873 - DNA, 20 bp, Artificial Sequence
  sgRNA
  Olfr678_10
gaagtatgtggatgtagtga

SEQ ID NO: 43874 - DNA, 20 bp, Artificial Sequence
  sgRNA
  Olfr678_11
gccctgggatccctatcagg

SEQ ID NO: 43875 - DNA, 20 bp, Artificial Sequence
  sgRNA
  Olfr678_12
ggtgcaactcttccagccct

SEQ ID NO: 43876 - DNA, 20 bp, Artificial Sequence
  sgRNA
  Olfr678_13
ggatgtagtgagggatattg

SEQ ID NO: 43877 - DNA, 20 bp, Artificial Sequence
  sgRNA
  Olfr678_14
gctagcatgtgccaatatca

SEQ ID NO: 43878 - DNA, 20 bp, Artificial Sequence
  sgRNA
  Olfr678_15
gatccctatcaggaggaagg

SEQ ID NO: 43879 - DNA, 20 bp, Artificial Sequence
  sgRNA
  Olfr678_16
caggaggaacaaccacatat

SEQ ID NO: 43880 - DNA, 20 bp, Artificial Sequence
  sgRNA
  Olfr678_17
ggtcaatgttatttatggat

SEQ ID NO: 43881 - DNA, 20 bp, Artificial Sequence
  sgRNA
  Olfr678_18
agaaaatacccagcatcttg

SEQ ID NO: 43882 - DNA, 20 bp, Artificial Sequence
  sgRNA
  Olfr678_19
gccctgaaccctgttatcta

SEQ ID NO: 43883 - DNA, 20 bp, Artificial Sequence
  sgRNA
  Olfr678_20
gtcctgactccatagataac

SEQ ID NO: 43884 - DNA, 20 bp, Artificial Sequence
  sgRNA
  Olfr679_1
ggagtcgtgctgaaagaatg

SEQ ID NO: 43885 - DNA, 20 bp, Artificial Sequence
  sgRNA
  Olfr679_2
ctatagcaaactgataaaga

SEQ ID NO: 43886 - DNA, 20 bp, Artificial Sequence
  sgRNA
  Olfr679_3
tgatggatggatatctcagt

SEQ ID NO: 43887 - DNA, 20 bp, Artificial Sequence
  sgRNA
  Olfr679_4
aagaatagcattagccccca

SEQ ID NO: 43888 - DNA, 20 bp, Artificial Sequence
  sgRNA
  Olfr679_5
tcagcacgactccattactg

SEQ ID NO: 43889 - DNA, 20 bp, Artificial Sequence
  sgRNA
  Olfr679_6
gtgtgaggataaaaaccaaa

SEQ ID NO: 43890 - DNA, 20 bp, Artificial Sequence
  sgRNA
  Olfr679_7
cagcacagctcttagtataa

SEQ ID NO: 43891 - DNA, 20 bp, Artificial Sequence
  sgRNA
  Olfr679_8
agaactcaggagattaagca

SEQ ID NO: 43892 - DNA, 20 bp, Artificial Sequence
  sgRNA
  Olfr679_9
caatgggattaagggcagca

SEQ ID NO: 43893 - DNA, 20 bp, Artificial Sequence
  sgRNA
  Olfr679_10
cagcacgactccattactgt

SEQ ID NO: 43894 - DNA, 20 bp, Artificial Sequence
  sgRNA
  Olfr679_11
ttagtataagggtataagag

SEQ ID NO: 43895 - DNA, 20 bp, Artificial Sequence
  sgRNA
  Olfr679_12
cgtgctgaaagaatggggat

SEQ ID NO: 43896 - DNA, 20 bp, Artificial Sequence
  sgRNA
  Olfr679_13
attacaagagagtctagaga

SEQ ID NO: 43897 - DNA, 20 bp, Artificial Sequence
  sgRNA
  Olfr679_14
cgtctttatcagtttgctat

SEQ ID NO: 43898 - DNA, 20 bp, Artificial Sequence
  sgRNA
  Olfr679_15
gaggataaaaaccaaaagga

SEQ ID NO: 43899 - DNA, 20 bp, Artificial Sequence
  sgRNA
  Olfr679_16
gctataggctggactttgct

SEQ ID NO: 43900 - DNA, 20 bp, Artificial Sequence
  sgRNA
  Olfr679_17
cagcagggatgacatggtgg

SEQ ID NO: 43901 - DNA, 20 bp, Artificial Sequence
  sgRNA
  Olfr679_18
tggagtcgtgctgaaagaat

SEQ ID NO: 43902 - DNA, 20 bp, Artificial Sequence
  sgRNA
  Olfr679_19
tggaggacattgagcaagat

SEQ ID NO: 43903 - DNA, 20 bp, Artificial Sequence
  sgRNA
  Olfr679_20
tttatcagtttgctataggc

SEQ ID NO: 43904 - DNA, 20 bp, Artificial Sequence
  sgRNA
  Olfr68_1
ttgagctgccagtttcacaa

SEQ ID NO: 43905 - DNA, 20 bp, Artificial Sequence
  sgRNA
  Olfr68_2
caggcatcaaagaaaatctg

SEQ ID NO: 43906 - DNA, 20 bp, Artificial Sequence
  sgRNA
  Olfr68_3
aaatgtacatgggtatgtgg

SEQ ID NO: 43907 - DNA, 20 bp, Artificial Sequence
  sgRNA
  Olfr68_4
tttgatgagtagtatggatg

SEQ ID NO: 43908 - DNA, 20 bp, Artificial Sequence
  sgRNA
  Olfr68_5
ccttctgtgttaacactagt

SEQ ID NO: 43909 - DNA, 20 bp, Artificial Sequence
  sgRNA
  Olfr68_6
actgcactgactccaggcca

SEQ ID NO: 43910 - DNA, 20 bp, Artificial Sequence
  sgRNA
  Olfr68_7
tgagtaatgcaccagctcca

SEQ ID NO: 43911 - DNA, 20 bp, Artificial Sequence
  sgRNA
  Olfr68_8
cttctgtgttaacactagtg

SEQ ID NO: 43912 - DNA, 20 bp, Artificial Sequence
  sgRNA
  Olfr68_9
atagccaagaaaatgtacat

SEQ ID NO: 43913 - DNA, 20 bp, Artificial Sequence
  sgRNA
  Olfr68_10
tgtgatgaagattcgcacat

SEQ ID NO: 43914 - DNA, 20 bp, Artificial Sequence
  sgRNA
  Olfr68_11
gcgacatttgatgagtagta

SEQ ID NO: 43915 - DNA, 20 bp, Artificial Sequence
  sgRNA
  Olfr68_12
cccactagtgttaacacaga

SEQ ID NO: 43916 - DNA, 20 bp, Artificial Sequence
  sgRNA
  Olfr68_13
tggagctggtgcattactca

SEQ ID NO: 43917 - DNA, 20 bp, Artificial Sequence
  sgRNA
  Olfr68_14
catttgatgagtagtatgga

SEQ ID NO: 43918 - DNA, 20 bp, Artificial Sequence
  sgRNA
  Olfr68_15
acacatggccattgtgaaac

SEQ ID NO: 43919 - DNA, 20 bp, Artificial Sequence
  sgRNA
  Olfr68_16
gccttctgtgttaacactag

SEQ ID NO: 43920 - DNA, 20 bp, Artificial Sequence
  sgRNA
  Olfr68_17
aatagccaagaaaatgtaca

SEQ ID NO: 43921 - DNA, 20 bp, Artificial Sequence
  sgRNA
  Olfr68_18
ttggagctggtgcattactc

SEQ ID NO: 43922 - DNA, 20 bp, Artificial Sequence
  sgRNA
  Olfr68_19
atttgatgagtagtatggat

SEQ ID NO: 43923 - DNA, 20 bp, Artificial Sequence
  sgRNA
  Olfr68_20
gagtcagtgcagtgctggat

SEQ ID NO: 43924 - DNA, 20 bp, Artificial Sequence
  sgRNA
  Olfr681_1
ggagtcgtcctgaaagaatg

SEQ ID NO: 43925 - DNA, 20 bp, Artificial Sequence
  sgRNA
  Olfr681_2
ctccagcaaactgataaaga

SEQ ID NO: 43926 - DNA, 20 bp, Artificial Sequence
  sgRNA
  Olfr681_3
tgaccaatttgtagtcaagg

SEQ ID NO: 43927 - DNA, 20 bp, Artificial Sequence
  sgRNA
  Olfr681_4
agaagatggctagtaccttg

SEQ ID NO: 43928 - DNA, 20 bp, Artificial Sequence
  sgRNA
  Olfr681_5
atcacaagagagtctagaga

SEQ ID NO: 43929 - DNA, 20 bp, Artificial Sequence
  sgRNA
  Olfr681_6
cgtctttatcagtttgctgg

SEQ ID NO: 43930 - DNA, 20 bp, Artificial Sequence
  sgRNA
  Olfr681_7
tcaggacgactccattactg

SEQ ID NO: 43931 - DNA, 20 bp, Artificial Sequence
  sgRNA
  Olfr681_8
tgagtctcagcacagctctt

SEQ ID NO: 43932 - DNA, 20 bp, Artificial Sequence
  sgRNA
  Olfr681_9
ataaacaatgggattaaggg

SEQ ID NO: 43933 - DNA, 20 bp, Artificial Sequence
  sgRNA
  Olfr681_10
ttaggataagggtataagag

SEQ ID NO: 43934 - DNA, 20 bp, Artificial Sequence
  sgRNA
  Olfr681_11
cagcacagctcttaggataa

SEQ ID NO: 43935 - DNA, 20 bp, Artificial Sequence
  sgRNA
  Olfr681_12
ttgcccatccccattctttc

SEQ ID NO: 43936 - DNA, 20 bp, Artificial Sequence
  sgRNA
  Olfr681_13
gctggaggctggactttgct

SEQ ID NO: 43937 - DNA, 20 bp, Artificial Sequence
  sgRNA
  Olfr681_14
agaactcaggagatcaagca

SEQ ID NO: 43938 - DNA, 20 bp, Artificial Sequence
  sgRNA
  Olfr681_15
tggaggacattgagcaaaat

SEQ ID NO: 43939 - DNA, 20 bp, Artificial Sequence
  sgRNA
  Olfr681_16
gaggataaaaaccaaaagaa

SEQ ID NO: 43940 - DNA, 20 bp, Artificial Sequence
  sgRNA
  Olfr681_17
cgtcctgaaagaatggggat

SEQ ID NO: 43941 - DNA, 20 bp, Artificial Sequence
  sgRNA
  Olfr681_18
cggcaggaatgacatggtgg

SEQ ID NO: 43942 - DNA, 20 bp, Artificial Sequence
  sgRNA
  Olfr681_19
gaaagaatggggatgggcaa

SEQ ID NO: 43943 - DNA, 20 bp, Artificial Sequence
  sgRNA
  Olfr681_20
tggagtcgtcctgaaagaat

SEQ ID NO: 43944 - DNA, 20 bp, Artificial Sequence
  sgRNA
  Olfr683_1
actgatcagtgatgatggat

SEQ ID NO: 43945 - DNA, 20 bp, Artificial Sequence
  sgRNA
  Olfr683_2
tgggaagaaagtatggggat

SEQ ID NO: 43946 - DNA, 20 bp, Artificial Sequence
  sgRNA
  Olfr683_3
ccttctcatcaccatcagga

SEQ ID NO: 43947 - DNA, 20 bp, Artificial Sequence
  sgRNA
  Olfr683_4
gcagatgaggaggaagtcag

SEQ ID NO: 43948 - DNA, 20 bp, Artificial Sequence
  sgRNA
  Olfr683_5
gggtccaacctataacaaac

SEQ ID NO: 43949 - DNA, 20 bp, Artificial Sequence
  sgRNA
  Olfr683_6
cagagaggcctccatcctga

SEQ ID NO: 43950 - DNA, 20 bp, Artificial Sequence
  sgRNA
  Olfr683_7
gttataggttggaccctgct

SEQ ID NO: 43951 - DNA, 20 bp, Artificial Sequence
  sgRNA
  Olfr683_8
tacggaaccttcttaggagg

SEQ ID NO: 43952 - DNA, 20 bp, Artificial Sequence
  sgRNA
  Olfr683_9
atttctggctgctacaaaga

SEQ ID NO: 43953 - DNA, 20 bp, Artificial Sequence
  sgRNA
  Olfr683_10
tcttgcacaatatctcagtt

SEQ ID NO: 43954 - DNA, 20 bp, Artificial Sequence
  sgRNA
  Olfr683_11
gaatacggaaccttcttagg

SEQ ID NO: 43955 - DNA, 20 bp, Artificial Sequence
  sgRNA
  Olfr683_12
tctaccagtttgttataggt

SEQ ID NO: 43956 - DNA, 20 bp, Artificial Sequence
  sgRNA
  Olfr683_13
catcctgatggtgatgagaa

SEQ ID NO: 43957 - DNA, 20 bp, Artificial Sequence
  sgRNA
  Olfr683_14
gatgaggtcagaacccagca

SEQ ID NO: 43958 - DNA, 20 bp, Artificial Sequence
  sgRNA
  Olfr683_15
gatgtcatcacaggagagtt

SEQ ID NO: 43959 - DNA, 20 bp, Artificial Sequence
  sgRNA
  Olfr683_16
gggagatcaagcagggaata

SEQ ID NO: 43960 - DNA, 20 bp, Artificial Sequence
  sgRNA
  Olfr683_17
cattggctcccatggccagg

SEQ ID NO: 43961 - DNA, 20 bp, Artificial Sequence
  sgRNA
  Olfr683_18
aactgatcagtgatgatgga

SEQ ID NO: 43962 - DNA, 20 bp, Artificial Sequence
  sgRNA
  Olfr683_19
tctttgtagcagccagaaat

SEQ ID NO: 43963 - DNA, 20 bp, Artificial Sequence
  sgRNA
  Olfr683_20
tattccctgcttgatctccc

SEQ ID NO: 43964 - DNA, 20 bp, Artificial Sequence
  sgRNA
  Olfr684_1
atgacggtcgggtactgtag

SEQ ID NO: 43965 - DNA, 20 bp, Artificial Sequence
  sgRNA
  Olfr684_2
cattggcccccatggccagg

SEQ ID NO: 43966 - DNA, 20 bp, Artificial Sequence
  sgRNA
  Olfr684_3
ctgctatcttcattataagc

SEQ ID NO: 43967 - DNA, 20 bp, Artificial Sequence
  sgRNA
  Olfr684_4
gagcctggacactgacaggt

SEQ ID NO: 43968 - DNA, 20 bp, Artificial Sequence
  sgRNA
  Olfr684_5
gtagcaggttggaccctgct

SEQ ID NO: 43969 - DNA, 20 bp, Artificial Sequence
  sgRNA
  Olfr684_6
cagagaggcctccaacctga

SEQ ID NO: 43970 - DNA, 20 bp, Artificial Sequence
  sgRNA
  Olfr684_7
ggccagggagaggattcccc

SEQ ID NO: 43971 - DNA, 20 bp, Artificial Sequence
  sgRNA
  Olfr684_8
aactgatcagtgatgacggt

SEQ ID NO: 43972 - DNA, 20 bp, Artificial Sequence
  sgRNA
  Olfr684_9
gatgggagcttcagaatcgt

SEQ ID NO: 43973 - DNA, 20 bp, Artificial Sequence
  sgRNA
  Olfr684_10
gagcaggatggggatgtccg

SEQ ID NO: 43974 - DNA, 20 bp, Artificial Sequence
  sgRNA
  Olfr684_11
aagttgatatagtttattga

SEQ ID NO: 43975 - DNA, 20 bp, Artificial Sequence
  sgRNA
  Olfr684_12
agcaggatggggatgtccgg

SEQ ID NO: 43976 - DNA, 20 bp, Artificial Sequence
  sgRNA
  Olfr684_13
ctttgatcctgagcacaaca

SEQ ID NO: 43977 - DNA, 20 bp, Artificial Sequence
  sgRNA
  Olfr684_14
ttatcttccgtgttgtgctc

SEQ ID NO: 43978 - DNA, 20 bp, Artificial Sequence
  sgRNA
  Olfr684_15
aatgagatcagaacccagca

SEQ ID NO: 43979 - DNA, 20 bp, Artificial Sequence
  sgRNA
  Olfr684_16
gatgaggaggaattcagaga

SEQ ID NO: 43980 - DNA, 20 bp, Artificial Sequence
  sgRNA
  Olfr684_17
tctcatcaccatcaggttgg

SEQ ID NO: 43981 - DNA, 20 bp, Artificial Sequence
  sgRNA
  Olfr684_18
aatgtcatcacaggagagcc

SEQ ID NO: 43982 - DNA, 20 bp, Artificial Sequence
  sgRNA
  Olfr684_19
tttagtctggcagaaagaat

SEQ ID NO: 43983 - DNA, 20 bp, Artificial Sequence
  sgRNA
  Olfr684_20
gcaccaacctgtcagtgtcc

SEQ ID NO: 43984 - DNA, 20 bp, Artificial Sequence
  sgRNA
  Olfr685_1
accataagctcgattcactg

SEQ ID NO: 43985 - DNA, 20 bp, Artificial Sequence
  sgRNA
  Olfr685_2
aagaggtaaaggatacccag

SEQ ID NO: 43986 - DNA, 20 bp, Artificial Sequence
  sgRNA
  Olfr685_3
ggatggtggaatgacgcaga

SEQ ID NO: 43987 - DNA, 20 bp, Artificial Sequence
  sgRNA
  Olfr685_4
gggctggtagtactggtgcg

SEQ ID NO: 43988 - DNA, 20 bp, Artificial Sequence
  sgRNA
  Olfr685_5
gcagtgctgaaggtgccagg

SEQ ID NO: 43989 - DNA, 20 bp, Artificial Sequence
  sgRNA
  Olfr685_6
tataatccctggatgcagga

SEQ ID NO: 43990 - DNA, 20 bp, Artificial Sequence
  sgRNA
  Olfr685_7
ccaatgcgccctataatccc

SEQ ID NO: 43991 - DNA, 20 bp, Artificial Sequence
  sgRNA
  Olfr685_8
gtcttcaccccataaacaag

SEQ ID NO: 43992 - DNA, 20 bp, Artificial Sequence
  sgRNA
  Olfr685_9
ttaagtctggcttcaccccc

SEQ ID NO: 43993 - DNA, 20 bp, Artificial Sequence
  sgRNA
  Olfr685_10
aagtatgcctgactccatag

SEQ ID NO: 43994 - DNA, 20 bp, Artificial Sequence
  sgRNA
  Olfr685_11
ccaagcctggaacacctact

SEQ ID NO: 43995 - DNA, 20 bp, Artificial Sequence
  sgRNA
  Olfr685_12
tcgagcttatggtctgtcag

SEQ ID NO: 43996 - DNA, 20 bp, Artificial Sequence
  sgRNA
  Olfr685_13
tggtggaatgacgcagaggg

SEQ ID NO: 43997 - DNA, 20 bp, Artificial Sequence
  sgRNA
  Olfr685_14
cactggatagcattgcccct

SEQ ID NO: 43998 - DNA, 20 bp, Artificial Sequence
  sgRNA
  Olfr685_15
cattgcccactagagcaaag

SEQ ID NO: 43999 - DNA, 20 bp, Artificial Sequence
  sgRNA
  Olfr685_16
ttaaagccttcagtacatgt

SEQ ID NO: 44000 - DNA, 20 bp, Artificial Sequence
  sgRNA
  Olfr685_17
ccaggaagaggtacataggt

SEQ ID NO: 44001 - DNA, 20 bp, Artificial Sequence
  sgRNA
  Olfr685_18
gattcgccagcgagtgctca

SEQ ID NO: 44002 - DNA, 20 bp, Artificial Sequence
  sgRNA
  Olfr685_19
gagggcataggaaatgccaa

SEQ ID NO: 44003 - DNA, 20 bp, Artificial Sequence
  sgRNA
  Olfr685_20
agtaggtgttccaggcttgg

SEQ ID NO: 44004 - DNA, 20 bp, Artificial Sequence
  sgRNA
  Olfr688_1
gtaaagcagagccataggca

SEQ ID NO: 44005 - DNA, 20 bp, Artificial Sequence
  sgRNA
  Olfr688_2
actccatgcacataaaagtg

SEQ ID NO: 44006 - DNA, 20 bp, Artificial Sequence
  sgRNA
  Olfr688_3
ctgatacattggctgatgca

SEQ ID NO: 44007 - DNA, 20 bp, Artificial Sequence
  sgRNA
  Olfr688_4
tgttaacagattctaccagt

SEQ ID NO: 44008 - DNA, 20 bp, Artificial Sequence
  sgRNA
  Olfr688_5
gcagaatgaactcagacacg

SEQ ID NO: 44009 - DNA, 20 bp, Artificial Sequence
  sgRNA
  Olfr688_6
gcatgaaaccaacagctcag

SEQ ID NO: 44010 - DNA, 20 bp, Artificial Sequence
  sgRNA
  Olfr688_7
gctgaaagtgggcttccgga

SEQ ID NO: 44011 - DNA, 20 bp, Artificial Sequence
  sgRNA
  Olfr688_8
tcctaagggcatataccacg

SEQ ID NO: 44012 - DNA, 20 bp, Artificial Sequence
  sgRNA
  Olfr688_9
aggacacaggagctgaaagt

SEQ ID NO: 44013 - DNA, 20 bp, Artificial Sequence
  sgRNA
  Olfr688_10
gtgtctgagttcattctgct

SEQ ID NO: 44014 - DNA, 20 bp, Artificial Sequence
  sgRNA
  Olfr688_11
tgagctgttggtttcatgca

SEQ ID NO: 44015 - DNA, 20 bp, Artificial Sequence
  sgRNA
  Olfr688_12
ccacggggttaagggatgga

SEQ ID NO: 44016 - DNA, 20 bp, Artificial Sequence
  sgRNA
  Olfr688_13
ccctccatcccttaaccccg

SEQ ID NO: 44017 - DNA, 20 bp, Artificial Sequence
  sgRNA
  Olfr688_14
ctgagctgttggtttcatgc

SEQ ID NO: 44018 - DNA, 20 bp, Artificial Sequence
  sgRNA
  Olfr688_15
tttcagctcctgtgtcctaa

SEQ ID NO: 44019 - DNA, 20 bp, Artificial Sequence
  sgRNA
  Olfr688_16
ggcatataccacggggttaa

SEQ ID NO: 44020 - DNA, 20 bp, Artificial Sequence
  sgRNA
  Olfr688_17
cgtgtctgagttcattctgc

SEQ ID NO: 44021 - DNA, 20 bp, Artificial Sequence
  sgRNA
  Olfr688_18
cactcaggctaaaaaccttc

SEQ ID NO: 44022 - DNA, 20 bp, Artificial Sequence
  sgRNA
  Olfr688_19
tataccacggggttaaggga

SEQ ID NO: 44023 - DNA, 20 bp, Artificial Sequence
  sgRNA
  Olfr688_20
gcctgagtgagtttgtgtct

SEQ ID NO: 44024 - DNA, 20 bp, Artificial Sequence
  sgRNA
  Olfr689_1
actccatggacataaaagtg

SEQ ID NO: 44025 - DNA, 20 bp, Artificial Sequence
  sgRNA
  Olfr689_2
gtaaagtagagccataggca

SEQ ID NO: 44026 - DNA, 20 bp, Artificial Sequence
  sgRNA
  Olfr689_3
cctgagcatcatggacaatg

SEQ ID NO: 44027 - DNA, 20 bp, Artificial Sequence
  sgRNA
  Olfr689_4
actgccagttgacattggcc

SEQ ID NO: 44028 - DNA, 20 bp, Artificial Sequence
  sgRNA
  Olfr689_5
gtgatgatatcactgttaac

SEQ ID NO: 44029 - DNA, 20 bp, Artificial Sequence
  sgRNA
  Olfr689_6
gactcaagtcaaaaaccttc

SEQ ID NO: 44030 - DNA, 20 bp, Artificial Sequence
  sgRNA
  Olfr689_7
ttgtccatgatgctcaggag

SEQ ID NO: 44031 - DNA, 20 bp, Artificial Sequence
  sgRNA
  Olfr689_8
tgagcgaataatcaaagcat

SEQ ID NO: 44032 - DNA, 20 bp, Artificial Sequence
  sgRNA
  Olfr689_9
gtcaattccaagtatcaacc

SEQ ID NO: 44033 - DNA, 20 bp, Artificial Sequence
  sgRNA
  Olfr689_10
acattggcctggttgatact

SEQ ID NO: 44034 - DNA, 20 bp, Artificial Sequence
  sgRNA
  Olfr689_11
ccaagttagagcaaaggcag

SEQ ID NO: 44035 - DNA, 20 bp, Artificial Sequence
  sgRNA
  Olfr689_12
gtctctgagttcattctact

SEQ ID NO: 44036 - DNA, 20 bp, Artificial Sequence
  sgRNA
  Olfr689_13
acttgagtcattatgtgtcc

SEQ ID NO: 44037 - DNA, 20 bp, Artificial Sequence
  sgRNA
  Olfr689_14
gtagaatgaactcagagact

SEQ ID NO: 44038 - DNA, 20 bp, Artificial Sequence
  sgRNA
  Olfr689_15
actgatgcaggttaggctca

SEQ ID NO: 44039 - DNA, 20 bp, Artificial Sequence
  sgRNA
  Olfr689_16
ggtgggaactgcaggtactg

SEQ ID NO: 44040 - DNA, 20 bp, Artificial Sequence
  sgRNA
  Olfr689_17
gtcaggcgtctttctatgca

SEQ ID NO: 44041 - DNA, 20 bp, Artificial Sequence
  sgRNA
  Olfr689_18
caggaactgccagttgacat

SEQ ID NO: 44042 - DNA, 20 bp, Artificial Sequence
  sgRNA
  Olfr689_19
ctatctgttactcacctagc

SEQ ID NO: 44043 - DNA, 20 bp, Artificial Sequence
  sgRNA
  Olfr689_20
agtctctgagttcattctac

SEQ ID NO: 44044 - DNA, 20 bp, Artificial Sequence
  sgRNA
  Olfr69_1
ttggagctggtgcattactg

SEQ ID NO: 44045 - DNA, 20 bp, Artificial Sequence
  sgRNA
  Olfr69_2
caggcatcaaaggaaatctg

SEQ ID NO: 44046 - DNA, 20 bp, Artificial Sequence
  sgRNA
  Olfr69_3
atagccaagaaaatatacat

SEQ ID NO: 44047 - DNA, 20 bp, Artificial Sequence
  sgRNA
  Olfr69_4
ttgagctgccaatttcacaa

SEQ ID NO: 44048 - DNA, 20 bp, Artificial Sequence
  sgRNA
  Olfr69_5
actgcactgattccaggcca

SEQ ID NO: 44049 - DNA, 20 bp, Artificial Sequence
  sgRNA
  Olfr69_6
ctatgtgcgaatcttcatca

SEQ ID NO: 44050 - DNA, 20 bp, Artificial Sequence
  sgRNA
  Olfr69_7
catttgatgagcaatatcaa

SEQ ID NO: 44051 - DNA, 20 bp, Artificial Sequence
  sgRNA
  Olfr69_8
tcagtaatgcaccagctcca

SEQ ID NO: 44052 - DNA, 20 bp, Artificial Sequence
  sgRNA
  Olfr69_9
cccactagtgttaaaacaga

SEQ ID NO: 44053 - DNA, 20 bp, Artificial Sequence
  sgRNA
  Olfr69_10
aatagccaagaaaatataca

SEQ ID NO: 44054 - DNA, 20 bp, Artificial Sequence
  sgRNA
  Olfr69_11
aaatatacatgggtatgtgg

SEQ ID NO: 44055 - DNA, 20 bp, Artificial Sequence
  sgRNA
  Olfr69_12
cgtgatgaagattcgcacat

SEQ ID NO: 44056 - DNA, 20 bp, Artificial Sequence
  sgRNA
  Olfr69_13
gagcaatatcaatggaaatg

SEQ ID NO: 44057 - DNA, 20 bp, Artificial Sequence
  sgRNA
  Olfr69_14
gaatcagtgcagtgctggat

SEQ ID NO: 44058 - DNA, 20 bp, Artificial Sequence
  sgRNA
  Olfr69_15
tggtagttcgaaagtactta

SEQ ID NO: 44059 - DNA, 20 bp, Artificial Sequence
  sgRNA
  Olfr69_16
ctgcagcaggcaggcatcaa

SEQ ID NO: 44060 - DNA, 20 bp, Artificial Sequence
  sgRNA
  Olfr69_17
acacatggccattgtgaaat

SEQ ID NO: 44061 - DNA, 20 bp, Artificial Sequence
  sgRNA
  Olfr69_18
ggtcttccagctgccccaga

SEQ ID NO: 44062 - DNA, 20 bp, Artificial Sequence
  sgRNA
  Olfr69_19
tccagcactgcactgattcc

SEQ ID NO: 44063 - DNA, 20 bp, Artificial Sequence
  sgRNA
  Olfr69_20
gcctggaatcagtgcagtgc

SEQ ID NO: 44064 - DNA, 20 bp, Artificial Sequence
  sgRNA
  Olfr691_1
ggactgcagtgacatacatg

SEQ ID NO: 44065 - DNA, 20 bp, Artificial Sequence
  sgRNA
  Olfr691_2
cactgttgcatatctcagtg

SEQ ID NO: 44066 - DNA, 20 bp, Artificial Sequence
  sgRNA
  Olfr691_3
ttatatctgcacaagctaag

SEQ ID NO: 44067 - DNA, 20 bp, Artificial Sequence
  sgRNA
  Olfr691_4
taatggtgatcatcacagaa

SEQ ID NO: 44068 - DNA, 20 bp, Artificial Sequence
  sgRNA
  Olfr691_5
tatgataagcctccaaccca

SEQ ID NO: 44069 - DNA, 20 bp, Artificial Sequence
  sgRNA
  Olfr691_6
agggcaagcgaaacactgct

SEQ ID NO: 44070 - DNA, 20 bp, Artificial Sequence
  sgRNA
  Olfr691_7
acgatgttggttcggcagaa

SEQ ID NO: 44071 - DNA, 20 bp, Artificial Sequence
  sgRNA
  Olfr691_8
gaagactaaacagatccggg

SEQ ID NO: 44072 - DNA, 20 bp, Artificial Sequence
  sgRNA
  Olfr691_9
tgtccacacaatgttcgtgg

SEQ ID NO: 44073 - DNA, 20 bp, Artificial Sequence
  sgRNA
  Olfr691_10
gctggccaatctttatgtgg

SEQ ID NO: 44074 - DNA, 20 bp, Artificial Sequence
  sgRNA
  Olfr691_11
tccacaatgaccatgacgat

SEQ ID NO: 44075 - DNA, 20 bp, Artificial Sequence
  sgRNA
  Olfr691_12
gtgacatacatgaggcacag

SEQ ID NO: 44076 - DNA, 20 bp, Artificial Sequence
  sgRNA
  Olfr691_13
ctagcacaaaaaatgcaggg

SEQ ID NO: 44077 - DNA, 20 bp, Artificial Sequence
  sgRNA
  Olfr691_14
agtgacatacatgaggcaca

SEQ ID NO: 44078 - DNA, 20 bp, Artificial Sequence
  sgRNA
  Olfr691_15
actcccccacgaacattgtg

SEQ ID NO: 44079 - DNA, 20 bp, Artificial Sequence
  sgRNA
  Olfr691_16
actttactgacccatcgctt

SEQ ID NO: 44080 - DNA, 20 bp, Artificial Sequence
  sgRNA
  Olfr691_17
agcaggatatgcacgtgtcg

SEQ ID NO: 44081 - DNA, 20 bp, Artificial Sequence
  sgRNA
  Olfr691_18
acagatgcttctgatgacaa

SEQ ID NO: 44082 - DNA, 20 bp, Artificial Sequence
  sgRNA
  Olfr691_19
gggcacagatggctataaag

SEQ ID NO: 44083 - DNA, 20 bp, Artificial Sequence
  sgRNA
  Olfr691_20
aatgaccatgacgatgggca

SEQ ID NO: 44084 - DNA, 20 bp, Artificial Sequence
  sgRNA
  Olfr692_1
gctggtagttggtaacacat

SEQ ID NO: 44085 - DNA, 20 bp, Artificial Sequence
  sgRNA
  Olfr692_2
gtggccaggagtagaaacat

SEQ ID NO: 44086 - DNA, 20 bp, Artificial Sequence
  sgRNA
  Olfr692_3
ttggtaactaaagcccgtgt

SEQ ID NO: 44087 - DNA, 20 bp, Artificial Sequence
  sgRNA
  Olfr692_4
gagtgttgcattgcctagta

SEQ ID NO: 44088 - DNA, 20 bp, Artificial Sequence
  sgRNA
  Olfr692_5
agtgtgacgaccaaagcgat

SEQ ID NO: 44089 - DNA, 20 bp, Artificial Sequence
  sgRNA
  Olfr692_6
acttcggctacctacccagg

SEQ ID NO: 44090 - DNA, 20 bp, Artificial Sequence
  sgRNA
  Olfr692_7
ctatagatgtggctaagccc

SEQ ID NO: 44091 - DNA, 20 bp, Artificial Sequence
  sgRNA
  Olfr692_8
ccatgtgtgcacaataggca

SEQ ID NO: 44092 - DNA, 20 bp, Artificial Sequence
  sgRNA
  Olfr692_9
cctcaaccccctcatctatg

SEQ ID NO: 44093 - DNA, 20 bp, Artificial Sequence
  sgRNA
  Olfr692_10
ggtgcggaccccatagatga

SEQ ID NO: 44094 - DNA, 20 bp, Artificial Sequence
  sgRNA
  Olfr692_11
atacatgagcccaaacacta

SEQ ID NO: 44095 - DNA, 20 bp, Artificial Sequence
  sgRNA
  Olfr692_12
catgggtcaacaacatgtat

SEQ ID NO: 44096 - DNA, 20 bp, Artificial Sequence
  sgRNA
  Olfr692_13
ggaaaggcactataacagcc

SEQ ID NO: 44097 - DNA, 20 bp, Artificial Sequence
  sgRNA
  Olfr692_14
cagtgtgacgaccaaagcga

SEQ ID NO: 44098 - DNA, 20 bp, Artificial Sequence
  sgRNA
  Olfr692_15
gtgcggaccccatagatgag

SEQ ID NO: 44099 - DNA, 20 bp, Artificial Sequence
  sgRNA
  Olfr692_16
gcagttgtagagctggtagt

SEQ ID NO: 44100 - DNA, 20 bp, Artificial Sequence
  sgRNA
  Olfr692_17
taggtagccgaagtactgca

SEQ ID NO: 44101 - DNA, 20 bp, Artificial Sequence
  sgRNA
  Olfr692_18
taaatcgtactaccagcaga

SEQ ID NO: 44102 - DNA, 20 bp, Artificial Sequence
  sgRNA
  Olfr692_19
cagtcaatataaagaaagct

SEQ ID NO: 44103 - DNA, 20 bp, Artificial Sequence
  sgRNA
  Olfr692_20
atttgaacatttctaagaat

SEQ ID NO: 44104 - DNA, 20 bp, Artificial Sequence
  sgRNA
  Olfr693_1
tgaactacatgatattcatg

SEQ ID NO: 44105 - DNA, 20 bp, Artificial Sequence
  sgRNA
  Olfr693_2
cacctccagatatcaactca

SEQ ID NO: 44106 - DNA, 20 bp, Artificial Sequence
  sgRNA
  Olfr693_3
agtgtagatggtatatccca

SEQ ID NO: 44107 - DNA, 20 bp, Artificial Sequence
  sgRNA
  Olfr693_4
agctttgggactgataactg

SEQ ID NO: 44108 - DNA, 20 bp, Artificial Sequence
  sgRNA
  Olfr693_5
ctcaaaatgccctcaaacga

SEQ ID NO: 44109 - DNA, 20 bp, Artificial Sequence
  sgRNA
  Olfr693_6
gtaccccttctgcaaatccc

SEQ ID NO: 44110 - DNA, 20 bp, Artificial Sequence
  sgRNA
  Olfr693_7
caattgtgtacaaaaaagag

SEQ ID NO: 44111 - DNA, 20 bp, Artificial Sequence
  sgRNA
  Olfr693_8
gagatagctgctcaagcaag

SEQ ID NO: 44112 - DNA, 20 bp, Artificial Sequence
  sgRNA
  Olfr693_9
gctcaaaatgccctcaaacg

SEQ ID NO: 44113 - DNA, 20 bp, Artificial Sequence
  sgRNA
  Olfr693_10
ccagtatggcagcaagagga

SEQ ID NO: 44114 - DNA, 20 bp, Artificial Sequence
  sgRNA
  Olfr693_11
tgaagagagtcctaggaaaa

SEQ ID NO: 44115 - DNA, 20 bp, Artificial Sequence
  sgRNA
  Olfr693_12
cagttccaagaacatctgaa

SEQ ID NO: 44116 - DNA, 20 bp, Artificial Sequence
  sgRNA
  Olfr693_13
gtagttcaatggatgacaaa

SEQ ID NO: 44117 - DNA, 20 bp, Artificial Sequence
  sgRNA
  Olfr693_14
ggcacaaccaccaaaggtga

SEQ ID NO: 44118 - DNA, 20 bp, Artificial Sequence
  sgRNA
  Olfr693_15
gaaaaggtgtctaatctccc

SEQ ID NO: 44119 - DNA, 20 bp, Artificial Sequence
  sgRNA
  Olfr693_16
aaccatgagttgatatctgg

SEQ ID NO: 44120 - DNA, 20 bp, Artificial Sequence
  sgRNA
  Olfr693_17
agaggtacatgggaacatgg

SEQ ID NO: 44121 - DNA, 20 bp, Artificial Sequence
  sgRNA
  Olfr693_18
tgctcaagcaagaggtacat

SEQ ID NO: 44122 - DNA, 20 bp, Artificial Sequence
  sgRNA
  Olfr693_19
atgaatatcatgtagttcaa

SEQ ID NO: 44123 - DNA, 20 bp, Artificial Sequence
  sgRNA
  Olfr693_20
cttcccaaggtggagttcca

SEQ ID NO: 44124 - DNA, 20 bp, Artificial Sequence
  sgRNA
  Olfr694_1
gagagatgcaaggatccatg

SEQ ID NO: 44125 - DNA, 20 bp, Artificial Sequence
  sgRNA
  Olfr694_2
ggttatggctaaaaagtaca

SEQ ID NO: 44126 - DNA, 20 bp, Artificial Sequence
  sgRNA
  Olfr694_3
gcagaagatacatggtaaca

SEQ ID NO: 44127 - DNA, 20 bp, Artificial Sequence
  sgRNA
  Olfr694_4
agggaggaatctcacagaag

SEQ ID NO: 44128 - DNA, 20 bp, Artificial Sequence
  sgRNA
  Olfr694_5
cagttccagaaacatctgaa

SEQ ID NO: 44129 - DNA, 20 bp, Artificial Sequence
  sgRNA
  Olfr694_6
ctgcacatgccctcaaatga

SEQ ID NO: 44130 - DNA, 20 bp, Artificial Sequence
  sgRNA
  Olfr694_7
gatgaatccacttcccaggg

SEQ ID NO: 44131 - DNA, 20 bp, Artificial Sequence
  sgRNA
  Olfr694_8
ctagagcactgagagatgca

SEQ ID NO: 44132 - DNA, 20 bp, Artificial Sequence
  sgRNA
  Olfr694_9
ttaccatgtatcttctgcta

SEQ ID NO: 44133 - DNA, 20 bp, Artificial Sequence
  sgRNA
  Olfr694_10
caagatgaatccacttccca

SEQ ID NO: 44134 - DNA, 20 bp, Artificial Sequence
  sgRNA
  Olfr694_11
atacatggtaacatggagcc

SEQ ID NO: 44135 - DNA, 20 bp, Artificial Sequence
  sgRNA
  Olfr694_12
ccaggatggcagcaagaggg

SEQ ID NO: 44136 - DNA, 20 bp, Artificial Sequence
  sgRNA
  Olfr694_13
ccaagatgaatccacttccc

SEQ ID NO: 44137 - DNA, 20 bp, Artificial Sequence
  sgRNA
  Olfr694_14
gctgcttctggtcatcacca

SEQ ID NO: 44138 - DNA, 20 bp, Artificial Sequence
  sgRNA
  Olfr694_15
gggctttgaggcgagtcctg

SEQ ID NO: 44139 - DNA, 20 bp, Artificial Sequence
  sgRNA
  Olfr694_16
atgtttctggaactgacact

SEQ ID NO: 44140 - DNA, 20 bp, Artificial Sequence
  sgRNA
  Olfr694_17
acatgccctcaaatgagggc

SEQ ID NO: 44141 - DNA, 20 bp, Artificial Sequence
  sgRNA
  Olfr694_18
aggccaggatggcagcaaga

SEQ ID NO: 44142 - DNA, 20 bp, Artificial Sequence
  sgRNA
  Olfr694_19
ggaagtggattcatcttggt

SEQ ID NO: 44143 - DNA, 20 bp, Artificial Sequence
  sgRNA
  Olfr694_20
gctatggcagctctctctca

SEQ ID NO: 44144 - DNA, 20 bp, Artificial Sequence
  sgRNA
  Olfr695_1
gccttgggaatgataactga

SEQ ID NO: 44145 - DNA, 20 bp, Artificial Sequence
  sgRNA
  Olfr695_2
agatgcaagaatccatgagg

SEQ ID NO: 44146 - DNA, 20 bp, Artificial Sequence
  sgRNA
  Olfr695_3
cagtgccagaaacatctgaa

SEQ ID NO: 44147 - DNA, 20 bp, Artificial Sequence
  sgRNA
  Olfr695_4
cttgcagaaaggatactgca

SEQ ID NO: 44148 - DNA, 20 bp, Artificial Sequence
  sgRNA
  Olfr695_5
gtaggaattctgaatgacag

SEQ ID NO: 44149 - DNA, 20 bp, Artificial Sequence
  sgRNA
  Olfr695_6
tgtcctttatggcttatgac

SEQ ID NO: 44150 - DNA, 20 bp, Artificial Sequence
  sgRNA
  Olfr695_7
catgccaaccacagtcagat

SEQ ID NO: 44151 - DNA, 20 bp, Artificial Sequence
  sgRNA
  Olfr695_8
gagagatgcaagaatccatg

SEQ ID NO: 44152 - DNA, 20 bp, Artificial Sequence
  sgRNA
  Olfr695_9
tgataactgatggttggagg

SEQ ID NO: 44153 - DNA, 20 bp, Artificial Sequence
  sgRNA
  Olfr695_10
accatcagttatcattccca

SEQ ID NO: 44154 - DNA, 20 bp, Artificial Sequence
  sgRNA
  Olfr695_11
ctacagcctgaggaataatg

SEQ ID NO: 44155 - DNA, 20 bp, Artificial Sequence
  sgRNA
  Olfr695_12
tgggaatgataactgatggt

SEQ ID NO: 44156 - DNA, 20 bp, Artificial Sequence
  sgRNA
  Olfr695_13
acatgccaaccacagtcaga

SEQ ID NO: 44157 - DNA, 20 bp, Artificial Sequence
  sgRNA
  Olfr695_14
atacctgtcataagccataa

SEQ ID NO: 44158 - DNA, 20 bp, Artificial Sequence
  sgRNA
  Olfr695_15
tagtgagtaggaggtcagga

SEQ ID NO: 44159 - DNA, 20 bp, Artificial Sequence
  sgRNA
  Olfr695_16
cataagccataaaggacaga

SEQ ID NO: 44160 - DNA, 20 bp, Artificial Sequence
  sgRNA
  Olfr695_17
gtggttggcatgtggtatgg

SEQ ID NO: 44161 - DNA, 20 bp, Artificial Sequence
  sgRNA
  Olfr695_18
ccacaggccagcttcagcaa

SEQ ID NO: 44162 - DNA, 20 bp, Artificial Sequence
  sgRNA
  Olfr695_19
gaagagatgtctgatctgcc

SEQ ID NO: 44163 - DNA, 20 bp, Artificial Sequence
  sgRNA
  Olfr695_20
catgtggagtcgggcatcca

SEQ ID NO: 44164 - DNA, 20 bp, Artificial Sequence
  sgRNA
  Olfr697_1
tgtgtacaggaatgtaattg

SEQ ID NO: 44165 - DNA, 20 bp, Artificial Sequence
  sgRNA
  Olfr697_2
aaccacaagcttataactag

SEQ ID NO: 44166 - DNA, 20 bp, Artificial Sequence
  sgRNA
  Olfr697_3
agcagactcttggactcatg

SEQ ID NO: 44167 - DNA, 20 bp, Artificial Sequence
  sgRNA
  Olfr697_4
ttgtcatcacagtagatacc

SEQ ID NO: 44168 - DNA, 20 bp, Artificial Sequence
  sgRNA
  Olfr697_5
actgttgtaggcatgtacta

SEQ ID NO: 44169 - DNA, 20 bp, Artificial Sequence
  sgRNA
  Olfr697_6
atgggaagaacaggtaacaa

SEQ ID NO: 44170 - DNA, 20 bp, Artificial Sequence
  sgRNA
  Olfr697_7
atggatcctgtcaatccaga

SEQ ID NO: 44171 - DNA, 20 bp, Artificial Sequence
  sgRNA
  Olfr697_8
acatgcctacaacagtcata

SEQ ID NO: 44172 - DNA, 20 bp, Artificial Sequence
  sgRNA
  Olfr697_9
tcatgagtccaagagtctgc

SEQ ID NO: 44173 - DNA, 20 bp, Artificial Sequence
  sgRNA
  Olfr697_10
gcacaggccaaatccagcaa

SEQ ID NO: 44174 - DNA, 20 bp, Artificial Sequence
  sgRNA
  Olfr697_11
tgcccatgtaccttctactt

SEQ ID NO: 44175 - DNA, 20 bp, Artificial Sequence
  sgRNA
  Olfr697_12
ccgtgcataagagaaaaaga

SEQ ID NO: 44176 - DNA, 20 bp, Artificial Sequence
  sgRNA
  Olfr697_13
ttcattgaattggtactggg

SEQ ID NO: 44177 - DNA, 20 bp, Artificial Sequence
  sgRNA
  Olfr697_14
atcttggtaggaatcctgaa

SEQ ID NO: 44178 - DNA, 20 bp, Artificial Sequence
  sgRNA
  Olfr697_15
caattcaatgaacatctgaa

SEQ ID NO: 44179 - DNA, 20 bp, Artificial Sequence
  sgRNA
  Olfr697_16
gattgtggtaggaacttggt

SEQ ID NO: 44180 - DNA, 20 bp, Artificial Sequence
  sgRNA
  Olfr697_17
acatgccttcaaatgagagc

SEQ ID NO: 44181 - DNA, 20 bp, Artificial Sequence
  sgRNA
  Olfr697_18
agaaaaagatggcagtaaga

SEQ ID NO: 44182 - DNA, 20 bp, Artificial Sequence
  sgRNA
  Olfr697_19
cttccttattcctcaggctg

SEQ ID NO: 44183 - DNA, 20 bp, Artificial Sequence
  sgRNA
  Olfr697_20
ggtggcaacaagtatttccc

SEQ ID NO: 44184 - DNA, 20 bp, Artificial Sequence
  sgRNA
  Olfr698_1
gagggatgccaagatccatg

SEQ ID NO: 44185 - DNA, 20 bp, Artificial Sequence
  sgRNA
  Olfr698_2
tgggagtgataactgatgtg

SEQ ID NO: 44186 - DNA, 20 bp, Artificial Sequence
  sgRNA
  Olfr698_3
tttgcagaaggaatactgca

SEQ ID NO: 44187 - DNA, 20 bp, Artificial Sequence
  sgRNA
  Olfr698_4
gctgcttctagtcatcacca

SEQ ID NO: 44188 - DNA, 20 bp, Artificial Sequence
  sgRNA
  Olfr698_5
tcttagccctgaccagcaat

SEQ ID NO: 44189 - DNA, 20 bp, Artificial Sequence
  sgRNA
  Olfr698_6
gctatatcctagagcactga

SEQ ID NO: 44190 - DNA, 20 bp, Artificial Sequence
  sgRNA
  Olfr698_7
catcccaactacagtcagat

SEQ ID NO: 44191 - DNA, 20 bp, Artificial Sequence
  sgRNA
  Olfr698_8
ggatgccaagatccatgagg

SEQ ID NO: 44192 - DNA, 20 bp, Artificial Sequence
  sgRNA
  Olfr698_9
atgtttctagagctggcact

SEQ ID NO: 44193 - DNA, 20 bp, Artificial Sequence
  sgRNA
  Olfr698_10
actgggtagaacatacatga

SEQ ID NO: 44194 - DNA, 20 bp, Artificial Sequence
  sgRNA
  Olfr698_11
ggtcagggctaagaagtaca

SEQ ID NO: 44195 - DNA, 20 bp, Artificial Sequence
  sgRNA
  Olfr698_12
actcatggtttatttgatgg

SEQ ID NO: 44196 - DNA, 20 bp, Artificial Sequence
  sgRNA
  Olfr698_13
tgtccaagtagaagatacat

SEQ ID NO: 44197 - DNA, 20 bp, Artificial Sequence
  sgRNA
  Olfr698_14
cagctctagaaacatctgaa

SEQ ID NO: 44198 - DNA, 20 bp, Artificial Sequence
  sgRNA
  Olfr698_15
ccagctctagaaacatctga

SEQ ID NO: 44199 - DNA, 20 bp, Artificial Sequence
  sgRNA
  Olfr698_16
ggagctttgaagagagtcct

SEQ ID NO: 44200 - DNA, 20 bp, Artificial Sequence
  sgRNA
  Olfr698_17
tttctacacgattgtcactc

SEQ ID NO: 44201 - DNA, 20 bp, Artificial Sequence
  sgRNA
  Olfr698_18
gtagttcagaggttgacaaa

SEQ ID NO: 44202 - DNA, 20 bp, Artificial Sequence
  sgRNA
  Olfr698_19
tcttgtttggggctgtgaaa

SEQ ID NO: 44203 - DNA, 20 bp, Artificial Sequence
  sgRNA
  Olfr698_20
gatgtttctagagctggcac

SEQ ID NO: 44204 - DNA, 20 bp, Artificial Sequence
  sgRNA
  Olfr699_1
catggtttatgtgatgggtg

SEQ ID NO: 44205 - DNA, 20 bp, Artificial Sequence
  sgRNA
  Olfr699_2
gatcatagctaacatgtaca

SEQ ID NO: 44206 - DNA, 20 bp, Artificial Sequence
  sgRNA
  Olfr699_3
gcagaaggtacataggtacg

SEQ ID NO: 44207 - DNA, 20 bp, Artificial Sequence
  sgRNA
  Olfr699_4
gtagccacatcatggatcct

SEQ ID NO: 44208 - DNA, 20 bp, Artificial Sequence
  sgRNA
  Olfr699_5
cagtgctaggaacatctgaa

SEQ ID NO: 44209 - DNA, 20 bp, Artificial Sequence
  sgRNA
  Olfr699_6
cacatcaattattatcccca

SEQ ID NO: 44210 - DNA, 20 bp, Artificial Sequence
  sgRNA
  Olfr699_7
gacaacaccatatcattaga

SEQ ID NO: 44211 - DNA, 20 bp, Artificial Sequence
  sgRNA
  Olfr699_8
ctagagcactcagaagtccc

SEQ ID NO: 44212 - DNA, 20 bp, Artificial Sequence
  sgRNA
  Olfr699_9
gtacctatgtaccttctgct

SEQ ID NO: 44213 - DNA, 20 bp, Artificial Sequence
  sgRNA
  Olfr699_10
gctaggatggcagcaagtgg

SEQ ID NO: 44214 - DNA, 20 bp, Artificial Sequence
  sgRNA
  Olfr699_11
tgttagctatgatcagcaat

SEQ ID NO: 44215 - DNA, 20 bp, Artificial Sequence
  sgRNA
  Olfr699_12
cttacccaagaccctcctca

SEQ ID NO: 44216 - DNA, 20 bp, Artificial Sequence
  sgRNA
  Olfr699_13
atgaaaatcatatagttcag

SEQ ID NO: 44217 - DNA, 20 bp, Artificial Sequence
  sgRNA
  Olfr699_14
acaagccttcaaatgaagga

SEQ ID NO: 44218 - DNA, 20 bp, Artificial Sequence
  sgRNA
  Olfr699_15
gaggtaccttcatcttggtg

SEQ ID NO: 44219 - DNA, 20 bp, Artificial Sequence
  sgRNA
  Olfr699_16
aagccagcttcagcaatgga

SEQ ID NO: 44220 - DNA, 20 bp, Artificial Sequence
  sgRNA
  Olfr699_17
ttcctagcactgacacttgg

SEQ ID NO: 44221 - DNA, 20 bp, Artificial Sequence
  sgRNA
  Olfr699_18
gtggggattctagatgacag

SEQ ID NO: 44222 - DNA, 20 bp, Artificial Sequence
  sgRNA
  Olfr699_19
ggtcactggggccttgagga

SEQ ID NO: 44223 - DNA, 20 bp, Artificial Sequence
  sgRNA
  Olfr699_20
cgacagtgtagaaaacagag

SEQ ID NO: 44224 - DNA, 20 bp, Artificial Sequence
  sgRNA
  Olfr700_1
agtgttcatatcatggaccc

SEQ ID NO: 44225 - DNA, 20 bp, Artificial Sequence
  sgRNA
  Olfr700_2
tgaaagtcatatagttcaga

SEQ ID NO: 44226 - DNA, 20 bp, Artificial Sequence
  sgRNA
  Olfr700_3
gatcatagccaacatgtaca

SEQ ID NO: 44227 - DNA, 20 bp, Artificial Sequence
  sgRNA
  Olfr700_4
atgttcctggaactgacact

SEQ ID NO: 44228 - DNA, 20 bp, Artificial Sequence
  sgRNA
  Olfr700_5
cagttccaggaacatttgaa

SEQ ID NO: 44229 - DNA, 20 bp, Artificial Sequence
  sgRNA
  Olfr700_6
ctgctcctcacatctaactg

SEQ ID NO: 44230 - DNA, 20 bp, Artificial Sequence
  sgRNA
  Olfr700_7
cctcacatctaactgtggtt

SEQ ID NO: 44231 - DNA, 20 bp, Artificial Sequence
  sgRNA
  Olfr700_8
acatgccttcacatgaaggc

SEQ ID NO: 44232 - DNA, 20 bp, Artificial Sequence
  sgRNA
  Olfr700_9
ttcctggaactgacacttgg

SEQ ID NO: 44233 - DNA, 20 bp, Artificial Sequence
  sgRNA
  Olfr700_10
actgctcctggtcatcacca

SEQ ID NO: 44234 - DNA, 20 bp, Artificial Sequence
  sgRNA
  Olfr700_11
tgccaaagcagaagatacat

SEQ ID NO: 44235 - DNA, 20 bp, Artificial Sequence
  sgRNA
  Olfr700_12
cttgcaaaaagggtattgca

SEQ ID NO: 44236 - DNA, 20 bp, Artificial Sequence
  sgRNA
  Olfr700_13
ctactgcactcagagatgcc

SEQ ID NO: 44237 - DNA, 20 bp, Artificial Sequence
  sgRNA
  Olfr700_14
ttgggggtgtgaaaggaact

SEQ ID NO: 44238 - DNA, 20 bp, Artificial Sequence
  sgRNA
  Olfr700_15
tactgcactcagagatgcca

SEQ ID NO: 44239 - DNA, 20 bp, Artificial Sequence
  sgRNA
  Olfr700_16
gttggaatcctggatgacag

SEQ ID NO: 44240 - DNA, 20 bp, Artificial Sequence
  sgRNA
  Olfr700_17
aggaaaggatggcagcaaga

SEQ ID NO: 44241 - DNA, 20 bp, Artificial Sequence
  sgRNA
  Olfr700_18
atgtgaggagcaggtgacaa

SEQ ID NO: 44242 - DNA, 20 bp, Artificial Sequence
  sgRNA
  Olfr700_19
aatagccacatatctgccat

SEQ ID NO: 44243 - DNA, 20 bp, Artificial Sequence
  sgRNA
  Olfr700_20
gctttgaggagagtcctggg

SEQ ID NO: 44244 - DNA, 20 bp, Artificial Sequence
  sgRNA
  Olfr701_1
tgtgtacactgtgtgaccta

SEQ ID NO: 44245 - DNA, 20 bp, Artificial Sequence
  sgRNA
  Olfr701_2
ttctcagcaatgacattggg

SEQ ID NO: 44246 - DNA, 20 bp, Artificial Sequence
  sgRNA
  Olfr701_3
catgatcttcatgagtccaa

SEQ ID NO: 44247 - DNA, 20 bp, Artificial Sequence
  sgRNA
  Olfr701_4
catgtacagggttgtaactg

SEQ ID NO: 44248 - DNA, 20 bp, Artificial Sequence
  sgRNA
  Olfr701_5
gagctgttagaagagtactg

SEQ ID NO: 44249 - DNA, 20 bp, Artificial Sequence
  sgRNA
  Olfr701_6
ctttccaaggtagaattcca

SEQ ID NO: 44250 - DNA, 20 bp, Artificial Sequence
  sgRNA
  Olfr701_7
ttaggactgtggaaggaact

SEQ ID NO: 44251 - DNA, 20 bp, Artificial Sequence
  sgRNA
  Olfr701_8
tggccttcatggcctatgat

SEQ ID NO: 44252 - DNA, 20 bp, Artificial Sequence
  sgRNA
  Olfr701_9
gcacaagccaatttcaacaa

SEQ ID NO: 44253 - DNA, 20 bp, Artificial Sequence
  sgRNA
  Olfr701_10
gggcagcacatacatgaaag

SEQ ID NO: 44254 - DNA, 20 bp, Artificial Sequence
  sgRNA
  Olfr701_11
ctagggcactaagagatgct

SEQ ID NO: 44255 - DNA, 20 bp, Artificial Sequence
  sgRNA
  Olfr701_12
tcatgagtccaaaggcctgc

SEQ ID NO: 44256 - DNA, 20 bp, Artificial Sequence
  sgRNA
  Olfr701_13
aggtaataatggcagagagg

SEQ ID NO: 44257 - DNA, 20 bp, Artificial Sequence
  sgRNA
  Olfr701_14
cattgctgagaacaattgaa

SEQ ID NO: 44258 - DNA, 20 bp, Artificial Sequence
  sgRNA
  Olfr701_15
ctagcatctcttagtgccct

SEQ ID NO: 44259 - DNA, 20 bp, Artificial Sequence
  sgRNA
  Olfr701_16
tgtaactcccaacactgttg

SEQ ID NO: 44260 - DNA, 20 bp, Artificial Sequence
  sgRNA
  Olfr701_17
tctactcctggtcatcacag

SEQ ID NO: 44261 - DNA, 20 bp, Artificial Sequence
  sgRNA
  Olfr701_18
gagttacaactgatgtgaag

SEQ ID NO: 44262 - DNA, 20 bp, Artificial Sequence
  sgRNA
  Olfr701_19
ctgttcctcccacttgactg

SEQ ID NO: 44263 - DNA, 20 bp, Artificial Sequence
  sgRNA
  Olfr701_20
gaggtaataatggcagagag

SEQ ID NO: 44264 - DNA, 20 bp, Artificial Sequence
  sgRNA
  Olfr703_1
gagtaataactgatgtcagg

SEQ ID NO: 44265 - DNA, 20 bp, Artificial Sequence
  sgRNA
  Olfr703_2
agtgtagatggtaaatccta

SEQ ID NO: 44266 - DNA, 20 bp, Artificial Sequence
  sgRNA
  Olfr703_3
ataaaccatcaactcgtatg

SEQ ID NO: 44267 - DNA, 20 bp, Artificial Sequence
  sgRNA
  Olfr703_4
gtaggagatacatgggcacg

SEQ ID NO: 44268 - DNA, 20 bp, Artificial Sequence
  sgRNA
  Olfr703_5
ggttaaagccaacatgtaca

SEQ ID NO: 44269 - DNA, 20 bp, Artificial Sequence
  sgRNA
  Olfr703_6
gatctgccgggatttacaga

SEQ ID NO: 44270 - DNA, 20 bp, Artificial Sequence
  sgRNA
  Olfr703_7
gcaatggcttcatcttagtg

SEQ ID NO: 44271 - DNA, 20 bp, Artificial Sequence
  sgRNA
  Olfr703_8
ctagggctatcactgatgcc

SEQ ID NO: 44272 - DNA, 20 bp, Artificial Sequence
  sgRNA
  Olfr703_9
gtatgtggatgtatcttcac

SEQ ID NO: 44273 - DNA, 20 bp, Artificial Sequence
  sgRNA
  Olfr703_10
aggaactcgacgatgggcaa

SEQ ID NO: 44274 - DNA, 20 bp, Artificial Sequence
  sgRNA
  Olfr703_11
atgtttctagaactggtact

SEQ ID NO: 44275 - DNA, 20 bp, Artificial Sequence
  sgRNA
  Olfr703_12
gaggaataaggaggtcacag

SEQ ID NO: 44276 - DNA, 20 bp, Artificial Sequence
  sgRNA
  Olfr703_13
tgagagacagctgtccaagt

SEQ ID NO: 44277 - DNA, 20 bp, Artificial Sequence
  sgRNA
  Olfr703_14
aggccataaaggccaaaagg

SEQ ID NO: 44278 - DNA, 20 bp, Artificial Sequence
  sgRNA
  Olfr703_15
ggttcatagttggtactata

SEQ ID NO: 44279 - DNA, 20 bp, Artificial Sequence
  sgRNA
  Olfr703_16
aggccagaataacagcaaga

SEQ ID NO: 44280 - DNA, 20 bp, Artificial Sequence
  sgRNA
  Olfr703_17
cataggccataaaggccaaa

SEQ ID NO: 44281 - DNA, 20 bp, Artificial Sequence
  sgRNA
  Olfr703_18
gctactcctggtcatcacta

SEQ ID NO: 44282 - DNA, 20 bp, Artificial Sequence
  sgRNA
  Olfr703_19
gaacaggtgtctgatctgcc

SEQ ID NO: 44283 - DNA, 20 bp, Artificial Sequence
  sgRNA
  Olfr703_20
actggtactgggtagtgcag

SEQ ID NO: 44284 - DNA, 20 bp, Artificial Sequence
  sgRNA
  Olfr704_1
agacaacactatctcatttg

SEQ ID NO: 44285 - DNA, 20 bp, Artificial Sequence
  sgRNA
  Olfr704_2
agatgcaagactccatgaag

SEQ ID NO: 44286 - DNA, 20 bp, Artificial Sequence
  sgRNA
  Olfr704_3
gcagaagatacatgggcacg

SEQ ID NO: 44287 - DNA, 20 bp, Artificial Sequence
  sgRNA
  Olfr704_4
gaactcatggtttatctgat

SEQ ID NO: 44288 - DNA, 20 bp, Artificial Sequence
  sgRNA
  Olfr704_5
gatgaagccacttctcaagg

SEQ ID NO: 44289 - DNA, 20 bp, Artificial Sequence
  sgRNA
  Olfr704_6
tgtcaaagctaaaaggtaca

SEQ ID NO: 44290 - DNA, 20 bp, Artificial Sequence
  sgRNA
  Olfr704_7
ttcctcctgccctcattaga

SEQ ID NO: 44291 - DNA, 20 bp, Artificial Sequence
  sgRNA
  Olfr704_8
attagaattgtgtagttcag

SEQ ID NO: 44292 - DNA, 20 bp, Artificial Sequence
  sgRNA
  Olfr704_9
tgtcctttatggcctatgac

SEQ ID NO: 44293 - DNA, 20 bp, Artificial Sequence
  sgRNA
  Olfr704_10
ctgcacatgccctctaatga

SEQ ID NO: 44294 - DNA, 20 bp, Artificial Sequence
  sgRNA
  Olfr704_11
caaagccaggaacatctgaa

SEQ ID NO: 44295 - DNA, 20 bp, Artificial Sequence
  sgRNA
  Olfr704_12
tttgacacttggtactgcag

SEQ ID NO: 44296 - DNA, 20 bp, Artificial Sequence
  sgRNA
  Olfr704_13
tgtaactccaccttgagaag

SEQ ID NO: 44297 - DNA, 20 bp, Artificial Sequence
  sgRNA
  Olfr704_14
gagctttgaggagagtcctt

SEQ ID NO: 44298 - DNA, 20 bp, Artificial Sequence
  sgRNA
  Olfr704_15
tggtcatcaccatggatacc

SEQ ID NO: 44299 - DNA, 20 bp, Artificial Sequence
  sgRNA
  Olfr704_16
tgccctctaatgagggcagg

SEQ ID NO: 44300 - DNA, 20 bp, Artificial Sequence
  sgRNA
  Olfr704_17
agaagtggcttcatcttgat

SEQ ID NO: 44301 - DNA, 20 bp, Artificial Sequence
  sgRNA
  Olfr704_18
tagtgagtaggaagccagga

SEQ ID NO: 44302 - DNA, 20 bp, Artificial Sequence
  sgRNA
  Olfr704_19
cagtaccaagtgtcaaagcc

SEQ ID NO: 44303 - DNA, 20 bp, Artificial Sequence
  sgRNA
  Olfr704_20
tgaactcatggtttatctga

SEQ ID NO: 44304 - DNA, 20 bp, Artificial Sequence
  sgRNA
  Olfr705_1
tttgcaataggaatactgca

SEQ ID NO: 44305 - DNA, 20 bp, Artificial Sequence
  sgRNA
  Olfr705_2
catgtacagagctgtgaatg

SEQ ID NO: 44306 - DNA, 20 bp, Artificial Sequence
  sgRNA
  Olfr705_3
agtacatgggtacatgaaga

SEQ ID NO: 44307 - DNA, 20 bp, Artificial Sequence
  sgRNA
  Olfr705_4
agatgctaggacccatgatg

SEQ ID NO: 44308 - DNA, 20 bp, Artificial Sequence
  sgRNA
  Olfr705_5
gatcttccgggatttgcaat

SEQ ID NO: 44309 - DNA, 20 bp, Artificial Sequence
  sgRNA
  Olfr705_6
gcttatggtggccacatcat

SEQ ID NO: 44310 - DNA, 20 bp, Artificial Sequence
  sgRNA
  Olfr705_7
atgttggctctgataagcaa

SEQ ID NO: 44311 - DNA, 20 bp, Artificial Sequence
  sgRNA
  Olfr705_8
gctgatcctggtcatcacca

SEQ ID NO: 44312 - DNA, 20 bp, Artificial Sequence
  sgRNA
  Olfr705_9
ggaacagccctcaaatgaga

SEQ ID NO: 44313 - DNA, 20 bp, Artificial Sequence
  sgRNA
  Olfr705_10
cagtgccaggaacatctgga

SEQ ID NO: 44314 - DNA, 20 bp, Artificial Sequence
  sgRNA
  Olfr705_11
ggaatactgcatggtatagg

SEQ ID NO: 44315 - DNA, 20 bp, Artificial Sequence
  sgRNA
  Olfr705_12
gacaataccatctcatttga

SEQ ID NO: 44316 - DNA, 20 bp, Artificial Sequence
  sgRNA
  Olfr705_13
gttcctaaggtagagttcca

SEQ ID NO: 44317 - DNA, 20 bp, Artificial Sequence
  sgRNA
  Olfr705_14
tgaagatcatgtagttcagc

SEQ ID NO: 44318 - DNA, 20 bp, Artificial Sequence
  sgRNA
  Olfr705_15
gtacccatgtacttcctgct

SEQ ID NO: 44319 - DNA, 20 bp, Artificial Sequence
  sgRNA
  Olfr705_16
ataggaatactgcatggtat

SEQ ID NO: 44320 - DNA, 20 bp, Artificial Sequence
  sgRNA
  Olfr705_17
tgcccaagcaggaagtacat

SEQ ID NO: 44321 - DNA, 20 bp, Artificial Sequence
  sgRNA
  Olfr705_18
ctagggccatcagagatgct

SEQ ID NO: 44322 - DNA, 20 bp, Artificial Sequence
  sgRNA
  Olfr705_19
ggtataggtggtatatccta

SEQ ID NO: 44323 - DNA, 20 bp, Artificial Sequence
  sgRNA
  Olfr705_20
gtagttcagcgggtgacaaa

SEQ ID NO: 44324 - DNA, 20 bp, Artificial Sequence
  sgRNA
  Olfr706_1
atattgggaggtatctacac

SEQ ID NO: 44325 - DNA, 20 bp, Artificial Sequence
  sgRNA
  Olfr706_2
actatcagccagcatactgt

SEQ ID NO: 44326 - DNA, 20 bp, Artificial Sequence
  sgRNA
  Olfr706_3
atggctctagcattgatgct

SEQ ID NO: 44327 - DNA, 20 bp, Artificial Sequence
  sgRNA
  Olfr706_4
gctactccttgtcatcacag

SEQ ID NO: 44328 - DNA, 20 bp, Artificial Sequence
  sgRNA
  Olfr706_5
gggtaggacatacatgaaag

SEQ ID NO: 44329 - DNA, 20 bp, Artificial Sequence
  sgRNA
  Olfr706_6
tcatgagtcctacagtatgc

SEQ ID NO: 44330 - DNA, 20 bp, Artificial Sequence
  sgRNA
  Olfr706_7
atgaagaccatgtaattgag

SEQ ID NO: 44331 - DNA, 20 bp, Artificial Sequence
  sgRNA
  Olfr706_8
tagtgtgtaggaggtaacaa

SEQ ID NO: 44332 - DNA, 20 bp, Artificial Sequence
  sgRNA
  Olfr706_9
gtaattgagaggatgacaaa

SEQ ID NO: 44333 - DNA, 20 bp, Artificial Sequence
  sgRNA
  Olfr706_10
aggtaacaatggcagaaagg

SEQ ID NO: 44334 - DNA, 20 bp, Artificial Sequence
  sgRNA
  Olfr706_11
acacaggacagcttcagcaa

SEQ ID NO: 44335 - DNA, 20 bp, Artificial Sequence
  sgRNA
  Olfr706_12
tgcacatgccttcaaatgaa

SEQ ID NO: 44336 - DNA, 20 bp, Artificial Sequence
  sgRNA
  Olfr706_13
tttgcactgtgcaatgaact

SEQ ID NO: 44337 - DNA, 20 bp, Artificial Sequence
  sgRNA
  Olfr706_14
gggtgacaactgatgtgaag

SEQ ID NO: 44338 - DNA, 20 bp, Artificial Sequence
  sgRNA
  Olfr706_15
attgatgctaggcagtgcag

SEQ ID NO: 44339 - DNA, 20 bp, Artificial Sequence
  sgRNA
  Olfr706_16
cacatcagttgtcaccccca

SEQ ID NO: 44340 - DNA, 20 bp, Artificial Sequence
  sgRNA
  Olfr706_17
aaccatgagctcatattggg

SEQ ID NO: 44341 - DNA, 20 bp, Artificial Sequence
  sgRNA
  Olfr706_18
tcaatgctagagccatctga

SEQ ID NO: 44342 - DNA, 20 bp, Artificial Sequence
  sgRNA
  Olfr706_19
ttgtcatcctctcaattaca

SEQ ID NO: 44343 - DNA, 20 bp, Artificial Sequence
  sgRNA
  Olfr706_20
gctcatggtttatgtgacag

SEQ ID NO: 44344 - DNA, 20 bp, Artificial Sequence
  sgRNA
  Olfr71_1
ccaaaatggaaaggttaccc

SEQ ID NO: 44345 - DNA, 20 bp, Artificial Sequence
  sgRNA
  Olfr71_2
atgagcacggggtacctgag

SEQ ID NO: 44346 - DNA, 20 bp, Artificial Sequence
  sgRNA
  Olfr71_3
aggtacatgactgagcacag

SEQ ID NO: 44347 - DNA, 20 bp, Artificial Sequence
  sgRNA
  Olfr71_4
gctgactgaggtgtcaccac

SEQ ID NO: 44348 - DNA, 20 bp, Artificial Sequence
  sgRNA
  Olfr71_5
gctctgcctcttcaagtcag

SEQ ID NO: 44349 - DNA, 20 bp, Artificial Sequence
  sgRNA
  Olfr71_6
gagactgcagttctgttgct

SEQ ID NO: 44350 - DNA, 20 bp, Artificial Sequence
  sgRNA
  Olfr71_7
cagcacagccaggatctcac

SEQ ID NO: 44351 - DNA, 20 bp, Artificial Sequence
  sgRNA
  Olfr71_8
aggaaagagtagccgctcga

SEQ ID NO: 44352 - DNA, 20 bp, Artificial Sequence
  sgRNA
  Olfr71_9
gctgtgctgaagctgacctg

SEQ ID NO: 44353 - DNA, 20 bp, Artificial Sequence
  sgRNA
  Olfr71_10
gatgtgtctgagcctctcca

SEQ ID NO: 44354 - DNA, 20 bp, Artificial Sequence
  sgRNA
  Olfr71_11
agtcagcgatgccttcctgc

SEQ ID NO: 44355 - DNA, 20 bp, Artificial Sequence
  sgRNA
  Olfr71_12
tcaggggtataggcaacagg

SEQ ID NO: 44356 - DNA, 20 bp, Artificial Sequence
  sgRNA
  Olfr71_13
tgttccccagcagagtcacc

SEQ ID NO: 44357 - DNA, 20 bp, Artificial Sequence
  sgRNA
  Olfr71_14
gctggcaaatggccaagtag

SEQ ID NO: 44358 - DNA, 20 bp, Artificial Sequence
  sgRNA
  Olfr71_15
gtacatgaaacccaagagca

SEQ ID NO: 44359 - DNA, 20 bp, Artificial Sequence
  sgRNA
  Olfr71_16
ggagaaggctttgctgcgcc

SEQ ID NO: 44360 - DNA, 20 bp, Artificial Sequence
  sgRNA
  Olfr71_17
cgtagaggactgtaaagacc

SEQ ID NO: 44361 - DNA, 20 bp, Artificial Sequence
  sgRNA
  Olfr71_18
gaggctcagacacatctgga

SEQ ID NO: 44362 - DNA, 20 bp, Artificial Sequence
  sgRNA
  Olfr71_19
tctctgccactgacttgaag

SEQ ID NO: 44363 - DNA, 20 bp, Artificial Sequence
  sgRNA
  Olfr71_20
tggtcttccgggacgacagg

SEQ ID NO: 44364 - DNA, 20 bp, Artificial Sequence
  sgRNA
  Olfr713_1
gagccatgtggtctgcacgg

SEQ ID NO: 44365 - DNA, 20 bp, Artificial Sequence
  sgRNA
  Olfr713_2
gttggggactctgattgcgc

SEQ ID NO: 44366 - DNA, 20 bp, Artificial Sequence
  sgRNA
  Olfr713_3
catatgccatggtggcaagg

SEQ ID NO: 44367 - DNA, 20 bp, Artificial Sequence
  sgRNA
  Olfr713_4
tctcttggttcatgatgact

SEQ ID NO: 44368 - DNA, 20 bp, Artificial Sequence
  sgRNA
  Olfr713_5
cctcagcaggaccttccaca

SEQ ID NO: 44369 - DNA, 20 bp, Artificial Sequence
  sgRNA
  Olfr713_6
atgttcatacactctcattg

SEQ ID NO: 44370 - DNA, 20 bp, Artificial Sequence
  sgRNA
  Olfr713_7
agagacaacgaggagatgtg

SEQ ID NO: 44371 - DNA, 20 bp, Artificial Sequence
  sgRNA
  Olfr713_8
gaagagccatgtggtctgca

SEQ ID NO: 44372 - DNA, 20 bp, Artificial Sequence
  sgRNA
  Olfr713_9
ctatagcctgagaaataatg

SEQ ID NO: 44373 - DNA, 20 bp, Artificial Sequence
  sgRNA
  Olfr713_10
ggtctgtatttcagtaggta

SEQ ID NO: 44374 - DNA, 20 bp, Artificial Sequence
  sgRNA
  Olfr713_11
catagaaaagagagacaacg

SEQ ID NO: 44375 - DNA, 20 bp, Artificial Sequence
  sgRNA
  Olfr713_12
agggaatcctggaaaccagg

SEQ ID NO: 44376 - DNA, 20 bp, Artificial Sequence
  sgRNA
  Olfr713_13
actttgttggtggcacagaa

SEQ ID NO: 44377 - DNA, 20 bp, Artificial Sequence
  sgRNA
  Olfr713_14
gatatggtttctgagggcca

SEQ ID NO: 44378 - DNA, 20 bp, Artificial Sequence
  sgRNA
  Olfr713_15
cttgtggaaggtcctgctga

SEQ ID NO: 44379 - DNA, 20 bp, Artificial Sequence
  sgRNA
  Olfr713_16
agtaaggtctgtatttcagt

SEQ ID NO: 44380 - DNA, 20 bp, Artificial Sequence
  sgRNA
  Olfr713_17
cttcaagcctcacttacttt

SEQ ID NO: 44381 - DNA, 20 bp, Artificial Sequence
  sgRNA
  Olfr713_18
gtagggaagagaagctcatg

SEQ ID NO: 44382 - DNA, 20 bp, Artificial Sequence
  sgRNA
  Olfr713_19
gagaaatgccaggaagagta

SEQ ID NO: 44383 - DNA, 20 bp, Artificial Sequence
  sgRNA
  Olfr713_20
aacttatccttcttagagat

SEQ ID NO: 44384 - DNA, 20 bp, Artificial Sequence
  sgRNA
  Olfr714_1
catatgccatggtggcgagg

SEQ ID NO: 44385 - DNA, 20 bp, Artificial Sequence
  sgRNA
  Olfr714_2
aatggcatagacctcaaacc

SEQ ID NO: 44386 - DNA, 20 bp, Artificial Sequence
  sgRNA
  Olfr714_3
acccaatcatcatgaaccaa

SEQ ID NO: 44387 - DNA, 20 bp, Artificial Sequence
  sgRNA
  Olfr714_4
gagccatgtggtctgcacag

SEQ ID NO: 44388 - DNA, 20 bp, Artificial Sequence
  sgRNA
  Olfr714_5
actcagcagaactttccaca

SEQ ID NO: 44389 - DNA, 20 bp, Artificial Sequence
  sgRNA
  Olfr714_6
tagataatggggttcaacag

SEQ ID NO: 44390 - DNA, 20 bp, Artificial Sequence
  sgRNA
  Olfr714_7
agagacaacgacgagatgtg

SEQ ID NO: 44391 - DNA, 20 bp, Artificial Sequence
  sgRNA
  Olfr714_8
aggaaaccctggaaaccagg

SEQ ID NO: 44392 - DNA, 20 bp, Artificial Sequence
  sgRNA
  Olfr714_9
gttgaagccgatctccatga

SEQ ID NO: 44393 - DNA, 20 bp, Artificial Sequence
  sgRNA
  Olfr714_10
tccattctgtgccaacaaca

SEQ ID NO: 44394 - DNA, 20 bp, Artificial Sequence
  sgRNA
  Olfr714_11
acagtggctacaggaaaccc

SEQ ID NO: 44395 - DNA, 20 bp, Artificial Sequence
  sgRNA
  Olfr714_12
tggtctgtgcagacacagcc

SEQ ID NO: 44396 - DNA, 20 bp, Artificial Sequence
  sgRNA
  Olfr714_13
gtagggaagagaagcccatg

SEQ ID NO: 44397 - DNA, 20 bp, Artificial Sequence
  sgRNA
  Olfr714_14
gacgagatgtgaggaacagg

SEQ ID NO: 44398 - DNA, 20 bp, Artificial Sequence
  sgRNA
  Olfr714_15
tcattctgcccaaaatgttg

SEQ ID NO: 44399 - DNA, 20 bp, Artificial Sequence
  sgRNA
  Olfr714_16
atagctgaatttatcctcat

SEQ ID NO: 44400 - DNA, 20 bp, Artificial Sequence
  sgRNA
  Olfr714_17
gagaaatgccaggaagagca

SEQ ID NO: 44401 - DNA, 20 bp, Artificial Sequence
  sgRNA
  Olfr714_18
ctgctgcctcctggtttcca

SEQ ID NO: 44402 - DNA, 20 bp, Artificial Sequence
  sgRNA
  Olfr714_19
tagccactgtgcagaccaca

SEQ ID NO: 44403 - DNA, 20 bp, Artificial Sequence
  sgRNA
  Olfr714_20
cagaggagtcacaacagtgt

SEQ ID NO: 44404 - DNA, 20 bp, Artificial Sequence
  sgRNA
  Olfr715_1
ggagaatcacaacccccatg

SEQ ID NO: 44405 - DNA, 20 bp, Artificial Sequence
  sgRNA
  Olfr715_2
attactctagcatcatgaca

SEQ ID NO: 44406 - DNA, 20 bp, Artificial Sequence
  sgRNA
  Olfr715_3
gaacaaggaacatgagaagt

SEQ ID NO: 44407 - DNA, 20 bp, Artificial Sequence
  sgRNA
  Olfr715_4
ataggacatcacagccaaaa

SEQ ID NO: 44408 - DNA, 20 bp, Artificial Sequence
  sgRNA
  Olfr715_5
tgatgctagagtaatgtaaa

SEQ ID NO: 44409 - DNA, 20 bp, Artificial Sequence
  sgRNA
  Olfr715_6
tggctgtgatgtcctatgat

SEQ ID NO: 44410 - DNA, 20 bp, Artificial Sequence
  sgRNA
  Olfr715_7
taatcgctgatccataaaag

SEQ ID NO: 44411 - DNA, 20 bp, Artificial Sequence
  sgRNA
  Olfr715_8
cctgcttgagaagttcttca

SEQ ID NO: 44412 - DNA, 20 bp, Artificial Sequence
  sgRNA
  Olfr715_9
gatagccacataccgatcat

SEQ ID NO: 44413 - DNA, 20 bp, Artificial Sequence
  sgRNA
  Olfr715_10
ccatgaagaacttctcaagc

SEQ ID NO: 44414 - DNA, 20 bp, Artificial Sequence
  sgRNA
  Olfr715_11
gatgtcctatgatcggtatg

SEQ ID NO: 44415 - DNA, 20 bp, Artificial Sequence
  sgRNA
  Olfr715_12
actctagcatcatgacatgg

SEQ ID NO: 44416 - DNA, 20 bp, Artificial Sequence
  sgRNA
  Olfr715_13
atgatgctagagtaatgtaa

SEQ ID NO: 44417 - DNA, 20 bp, Artificial Sequence
  sgRNA
  Olfr715_14
cataggacatcacagccaaa

SEQ ID NO: 44418 - DNA, 20 bp, Artificial Sequence
  sgRNA
  Olfr715_15
ctctagcatcatgacatgga

SEQ ID NO: 44419 - DNA, 20 bp, Artificial Sequence
  sgRNA
  Olfr715_16
tacttctcatgttccttgtt

SEQ ID NO: 44420 - DNA, 20 bp, Artificial Sequence
  sgRNA
  Olfr715_17
acttctcatgttccttgttc

SEQ ID NO: 44421 - DNA, 20 bp, Artificial Sequence
  sgRNA
  Olfr715b_1
tggctgtgatgtcttatgat

SEQ ID NO: 44422 - DNA, 20 bp, Artificial Sequence
  sgRNA
  Olfr715b_2
ataagacatcacagccaaaa

SEQ ID NO: 44423 - DNA, 20 bp, Artificial Sequence
  sgRNA
  Olfr715b_3
tggtgctagagtaatgtaaa

SEQ ID NO: 44424 - DNA, 20 bp, Artificial Sequence
  sgRNA
  Olfr715b_4
taatccctgatccataaaag

SEQ ID NO: 44425 - DNA, 20 bp, Artificial Sequence
  sgRNA
  Olfr715b_5
ggtgtctgtcttctatgcaa

SEQ ID NO: 44426 - DNA, 20 bp, Artificial Sequence
  sgRNA
  Olfr715b_6
cctgcttgagaagttcttcg

SEQ ID NO: 44427 - DNA, 20 bp, Artificial Sequence
  sgRNA
  Olfr715b_7
ggagaatcaccacccccatg

SEQ ID NO: 44428 - DNA, 20 bp, Artificial Sequence
  sgRNA
  Olfr715b_8
gatacacaccctccatgtca

SEQ ID NO: 44429 - DNA, 20 bp, Artificial Sequence
  sgRNA
  Olfr715b_9
cataagacatcacagccaaa

SEQ ID NO: 44430 - DNA, 20 bp, Artificial Sequence
  sgRNA
  Olfr715b_10
ctctagcaccatgacatgga

SEQ ID NO: 44431 - DNA, 20 bp, Artificial Sequence
  sgRNA
  Olfr715b_11
gatgtcttatgatcggtatg

SEQ ID NO: 44432 - DNA, 20 bp, Artificial Sequence
  sgRNA
  Olfr715b_12
attactctagcaccatgaca

SEQ ID NO: 44433 - DNA, 20 bp, Artificial Sequence
  sgRNA
  Olfr715b_13
actctagcaccatgacatgg

SEQ ID NO: 44434 - DNA, 20 bp, Artificial Sequence
  sgRNA
  Olfr715b_14
ccacgaagaacttctcaagc

SEQ ID NO: 44435 - DNA, 20 bp, Artificial Sequence
  sgRNA
  Olfr715b_15
gaacaaggaacatgagaaat

SEQ ID NO: 44436 - DNA, 20 bp, Artificial Sequence
  sgRNA
  Olfr715b_16
tatttctcatgttccttgtt

SEQ ID NO: 44437 - DNA, 20 bp, Artificial Sequence
  sgRNA
  Olfr715b_17
atggtgctagagtaatgtaa

SEQ ID NO: 44438 - DNA, 20 bp, Artificial Sequence
  sgRNA
  Olfr715b_18
atttctcatgttccttgttc

SEQ ID NO: 44439 - DNA, 20 bp, Artificial Sequence
  sgRNA
  Olfr716_1
tgtggagtcgagaatccatg

SEQ ID NO: 44440 - DNA, 20 bp, Artificial Sequence
  sgRNA
  Olfr716_2
ccaacaactatgcctgcagt

SEQ ID NO: 44441 - DNA, 20 bp, Artificial Sequence
  sgRNA
  Olfr716_3
ctctgtacacccaatctgaa

SEQ ID NO: 44442 - DNA, 20 bp, Artificial Sequence
  sgRNA
  Olfr716_4
actatgttctgccctcgata

SEQ ID NO: 44443 - DNA, 20 bp, Artificial Sequence
  sgRNA
  Olfr716_5
ctttccatcttccctatcga

SEQ ID NO: 44444 - DNA, 20 bp, Artificial Sequence
  sgRNA
  Olfr716_6
gtaattgtctcccttcagat

SEQ ID NO: 44445 - DNA, 20 bp, Artificial Sequence
  sgRNA
  Olfr716_7
gagtctgtgcatcttgcgaa

SEQ ID NO: 44446 - DNA, 20 bp, Artificial Sequence
  sgRNA
  Olfr716_8
agtggatatgatgttccagt

SEQ ID NO: 44447 - DNA, 20 bp, Artificial Sequence
  sgRNA
  Olfr716_9
agactgcatctggatcacag

SEQ ID NO: 44448 - DNA, 20 bp, Artificial Sequence
  sgRNA
  Olfr716_10
gcatagttgttgggtcatga

SEQ ID NO: 44449 - DNA, 20 bp, Artificial Sequence
  sgRNA
  Olfr716_11
tctgccctcgatagggaaga

SEQ ID NO: 44450 - DNA, 20 bp, Artificial Sequence
  sgRNA
  Olfr716_12
aggaccctagggccaactgc

SEQ ID NO: 44451 - DNA, 20 bp, Artificial Sequence
  sgRNA
  Olfr716_13
atattgcagacccatagaag

SEQ ID NO: 44452 - DNA, 20 bp, Artificial Sequence
  sgRNA
  Olfr716_14
gtttgcacacagccacatag

SEQ ID NO: 44453 - DNA, 20 bp, Artificial Sequence
  sgRNA
  Olfr716_15
gtagatgaatttgtgttgct

SEQ ID NO: 44454 - DNA, 20 bp, Artificial Sequence
  sgRNA
  Olfr716_16
gaagccaccttcagaagtgc

SEQ ID NO: 44455 - DNA, 20 bp, Artificial Sequence
  sgRNA
  Olfr716_17
tgcagccaaacaccaaaact

SEQ ID NO: 44456 - DNA, 20 bp, Artificial Sequence
  sgRNA
  Olfr716_18
cccactggcccaggacccta

SEQ ID NO: 44457 - DNA, 20 bp, Artificial Sequence
  sgRNA
  Olfr716_19
tgaacttcctgcacttctga

SEQ ID NO: 44458 - DNA, 20 bp, Artificial Sequence
  sgRNA
  Olfr716_20
tcttgcagctagtttcctga

SEQ ID NO: 44459 - DNA, 20 bp, Artificial Sequence
  sgRNA
  Olfr720_1
agcagaccctccgactcatg

SEQ ID NO: 44460 - DNA, 20 bp, Artificial Sequence
  sgRNA
  Olfr720_2
cataggccataagtcccagc

SEQ ID NO: 44461 - DNA, 20 bp, Artificial Sequence
  sgRNA
  Olfr720_3
caatatggccatgaagaacg

SEQ ID NO: 44462 - DNA, 20 bp, Artificial Sequence
  sgRNA
  Olfr720_4
tgcacagaatgggagactca

SEQ ID NO: 44463 - DNA, 20 bp, Artificial Sequence
  sgRNA
  Olfr720_5
tctctacatgggctttgtag

SEQ ID NO: 44464 - DNA, 20 bp, Artificial Sequence
  sgRNA
  Olfr720_6
gcccatgtagagaaagtact

SEQ ID NO: 44465 - DNA, 20 bp, Artificial Sequence
  sgRNA
  Olfr720_7
gcccagtactttctctacat

SEQ ID NO: 44466 - DNA, 20 bp, Artificial Sequence
  sgRNA
  Olfr720_8
ataacggagcggattacaga

SEQ ID NO: 44467 - DNA, 20 bp, Artificial Sequence
  sgRNA
  Olfr720_9
agggtgatagcaagacacag

SEQ ID NO: 44468 - DNA, 20 bp, Artificial Sequence
  sgRNA
  Olfr720_10
ttgattacattgtaggcaaa

SEQ ID NO: 44469 - DNA, 20 bp, Artificial Sequence
  sgRNA
  Olfr720_11
tcctgtcctcatgagtcgga

SEQ ID NO: 44470 - DNA, 20 bp, Artificial Sequence
  sgRNA
  Olfr720_12
gatgtgatcaccacagagaa

SEQ ID NO: 44471 - DNA, 20 bp, Artificial Sequence
  sgRNA
  Olfr720_13
atgtgatcaccacagagaag

SEQ ID NO: 44472 - DNA, 20 bp, Artificial Sequence
  sgRNA
  Olfr720_14
ataggcttggggaagcatat

SEQ ID NO: 44473 - DNA, 20 bp, Artificial Sequence
  sgRNA
  Olfr720_15
atatatggctttgtcaccac

SEQ ID NO: 44474 - DNA, 20 bp, Artificial Sequence
  sgRNA
  Olfr720_16
gcgaggctcccacaatgctg

SEQ ID NO: 44475 - DNA, 20 bp, Artificial Sequence
  sgRNA
  Olfr720_17
gagtggggtgtgataggctt

SEQ ID NO: 44476 - DNA, 20 bp, Artificial Sequence
  sgRNA
  Olfr720_18
tgtggcaggggctttaaaga

SEQ ID NO: 44477 - DNA, 20 bp, Artificial Sequence
  sgRNA
  Olfr720_19
gttatcctgtcctcatgagt

SEQ ID NO: 44478 - DNA, 20 bp, Artificial Sequence
  sgRNA
  Olfr720_20
tggcacatatgacactgaac

SEQ ID NO: 44479 - DNA, 20 bp, Artificial Sequence
  sgRNA
  Olfr721-ps1_1
tctcactcgtaatctctgag

SEQ ID NO: 44480 - DNA, 20 bp, Artificial Sequence
  sgRNA
  Olfr721-ps1_2
acgtggtgaaggctttccga

SEQ ID NO: 44481 - DNA, 20 bp, Artificial Sequence
  sgRNA
  Olfr721-ps1_3
tcatctcagtctcctataca

SEQ ID NO: 44482 - DNA, 20 bp, Artificial Sequence
  sgRNA
  Olfr721-ps1_4
tataatgtgggaggaacacg

SEQ ID NO: 44483 - DNA, 20 bp, Artificial Sequence
  sgRNA
  Olfr721-ps1_5
cgaacctgtcataagccatg

SEQ ID NO: 44484 - DNA, 20 bp, Artificial Sequence
  sgRNA
  Olfr721-ps1_6
tgattatttggtaccgtaga

SEQ ID NO: 44485 - DNA, 20 bp, Artificial Sequence
  sgRNA
  Olfr721-ps1_7
aggatagcttcaatacagct

SEQ ID NO: 44486 - DNA, 20 bp, Artificial Sequence
  sgRNA
  Olfr721-ps1_8
gtaagaatggggcagtacat

SEQ ID NO: 44487 - DNA, 20 bp, Artificial Sequence
  sgRNA
  Olfr721-ps1_9
tcctggactgatctttgctg

SEQ ID NO: 44488 - DNA, 20 bp, Artificial Sequence
  sgRNA
  Olfr721-ps1_10
ttctacctgacattgattgg

SEQ ID NO: 44489 - DNA, 20 bp, Artificial Sequence
  sgRNA
  Olfr721-ps1_11
tttctacctgacattgattg

SEQ ID NO: 44490 - DNA, 20 bp, Artificial Sequence
  sgRNA
  Olfr721-ps1_12
accataagcaaacaaaccct

SEQ ID NO: 44491 - DNA, 20 bp, Artificial Sequence
  sgRNA
  Olfr721-ps1_13
ctaccacatgagctccgctg

SEQ ID NO: 44492 - DNA, 20 bp, Artificial Sequence
  sgRNA
  Olfr721-ps1_14
catggcttatgacaggttcg

SEQ ID NO: 44493 - DNA, 20 bp, Artificial Sequence
  sgRNA
  Olfr721-ps1_15
tgagctccgctgagggccgt

SEQ ID NO: 44494 - DNA, 20 bp, Artificial Sequence
  sgRNA
  Olfr721-ps1_16
tcaggtgtgtggtaagaatg

SEQ ID NO: 44495 - DNA, 20 bp, Artificial Sequence
  sgRNA
  Olfr721-ps1_17
ggtgggtgatgaggcccagg

SEQ ID NO: 44496 - DNA, 20 bp, Artificial Sequence
  sgRNA
  Olfr721-ps1_18
ccaaataatcatgaatccca

SEQ ID NO: 44497 - DNA, 20 bp, Artificial Sequence
  sgRNA
  Olfr721-ps1_19
ggctttccgacggccctcag

SEQ ID NO: 44498 - DNA, 20 bp, Artificial Sequence
  sgRNA
  Olfr721-ps1_20
tggctgtgtgcaaccctcta

SEQ ID NO: 44499 - DNA, 20 bp, Artificial Sequence
  sgRNA
  Olfr722_1
gagtggagtagtataaagga

SEQ ID NO: 44500 - DNA, 20 bp, Artificial Sequence
  sgRNA
  Olfr722_2
aaatgataagaaaatttcca

SEQ ID NO: 44501 - DNA, 20 bp, Artificial Sequence
  sgRNA
  Olfr722_3
gataagagccacttgtacaa

SEQ ID NO: 44502 - DNA, 20 bp, Artificial Sequence
  sgRNA
  Olfr722_4
gaccactgttagaaaccatc

SEQ ID NO: 44503 - DNA, 20 bp, Artificial Sequence
  sgRNA
  Olfr722_5
tatagcgatataacgatcaa

SEQ ID NO: 44504 - DNA, 20 bp, Artificial Sequence
  sgRNA
  Olfr722_6
agctggtttggcccacaaaa

SEQ ID NO: 44505 - DNA, 20 bp, Artificial Sequence
  sgRNA
  Olfr722_7
gatctatacacttcgcaacc

SEQ ID NO: 44506 - DNA, 20 bp, Artificial Sequence
  sgRNA
  Olfr722_8
ttgcgaagtgtatagatcac

SEQ ID NO: 44507 - DNA, 20 bp, Artificial Sequence
  sgRNA
  Olfr722_9
gagttgagcttcttgagact

SEQ ID NO: 44508 - DNA, 20 bp, Artificial Sequence
  sgRNA
  Olfr722_10
agtctgttatgccttattgt

SEQ ID NO: 44509 - DNA, 20 bp, Artificial Sequence
  sgRNA
  Olfr722_11
ataaggcataacagactcta

SEQ ID NO: 44510 - DNA, 20 bp, Artificial Sequence
  sgRNA
  Olfr722_12
cagcttggagagcctggaag

SEQ ID NO: 44511 - DNA, 20 bp, Artificial Sequence
  sgRNA
  Olfr722_13
agctacaatgaaagagtagg

SEQ ID NO: 44512 - DNA, 20 bp, Artificial Sequence
  sgRNA
  Olfr722_14
tcaaaggaaagatgaccgtg

SEQ ID NO: 44513 - DNA, 20 bp, Artificial Sequence
  sgRNA
  Olfr722_15
ggggcgggtatagataaaaa

SEQ ID NO: 44514 - DNA, 20 bp, Artificial Sequence
  sgRNA
  Olfr722_16
tcccagaaagaagtaaagtg

SEQ ID NO: 44515 - DNA, 20 bp, Artificial Sequence
  sgRNA
  Olfr722_17
taaaaggacattcttctgaa

SEQ ID NO: 44516 - DNA, 20 bp, Artificial Sequence
  sgRNA
  Olfr722_18
gagtccagagtctgatctaa

SEQ ID NO: 44517 - DNA, 20 bp, Artificial Sequence
  sgRNA
  Olfr722_19
ctcctgatggtttctaacag

SEQ ID NO: 44518 - DNA, 20 bp, Artificial Sequence
  sgRNA
  Olfr722_20
gaagtcccaagaagcataag

SEQ ID NO: 44519 - DNA, 20 bp, Artificial Sequence
  sgRNA
  Olfr723_1
gaaatgcatgaagaacatct

SEQ ID NO: 44520 - DNA, 20 bp, Artificial Sequence
  sgRNA
  Olfr723_2
catacacacaatgagccaga

SEQ ID NO: 44521 - DNA, 20 bp, Artificial Sequence
  sgRNA
  Olfr723_3
ggaaagacacatgtccagga

SEQ ID NO: 44522 - DNA, 20 bp, Artificial Sequence
  sgRNA
  Olfr723_4
tttgatctatggtgctactg

SEQ ID NO: 44523 - DNA, 20 bp, Artificial Sequence
  sgRNA
  Olfr723_5
gacacatgtccaggaaggag

SEQ ID NO: 44524 - DNA, 20 bp, Artificial Sequence
  sgRNA
  Olfr723_6
tttccaagaagaaagtacat

SEQ ID NO: 44525 - DNA, 20 bp, Artificial Sequence
  sgRNA
  Olfr723_7
cagtggaaagacacatgtcc

SEQ ID NO: 44526 - DNA, 20 bp, Artificial Sequence
  sgRNA
  Olfr723_8
aaagtacatgggagaatgaa

SEQ ID NO: 44527 - DNA, 20 bp, Artificial Sequence
  sgRNA
  Olfr723_9
tctcccatgtactttcttct

SEQ ID NO: 44528 - DNA, 20 bp, Artificial Sequence
  sgRNA
  Olfr723_10
gttcttcatgcatttctttg

SEQ ID NO: 44529 - DNA, 20 bp, Artificial Sequence
  sgRNA
  Olfr723_11
tgttcttcatgcatttcttt

SEQ ID NO: 44530 - DNA, 20 bp, Artificial Sequence
  sgRNA
  Olfr723_12
ttcttcatgcatttctttgg

SEQ ID NO: 44531 - DNA, 20 bp, Artificial Sequence
  sgRNA
  Olfr723_13
gtttccaagaagaaagtaca

SEQ ID NO: 44532 - DNA, 20 bp, Artificial Sequence
  sgRNA
  Olfr723_14
tgagtcacaagttgctgaac

SEQ ID NO: 44533 - DNA, 20 bp, Artificial Sequence
  sgRNA
  Olfr723_15
tatttacacactgagaaatc

SEQ ID NO: 44534 - DNA, 20 bp, Artificial Sequence
  sgRNA
  Olfr723_16
tcttggaaacctctccttcc

SEQ ID NO: 44535 - DNA, 20 bp, Artificial Sequence
  sgRNA
  Olfr723_17
atgttcttcatgcatttctt

SEQ ID NO: 44536 - DNA, 20 bp, Artificial Sequence
  sgRNA
  Olfr723_18
gaaagtacatgggagaatga

SEQ ID NO: 44537 - DNA, 20 bp, Artificial Sequence
  sgRNA
  Olfr723_19
agaaatgcatgaagaacatc

SEQ ID NO: 44538 - DNA, 20 bp, Artificial Sequence
  sgRNA
  Olfr724_1
catacacaccatgagccaga

SEQ ID NO: 44539 - DNA, 20 bp, Artificial Sequence
  sgRNA
  Olfr724_2
ggaaagacacatgtctagga

SEQ ID NO: 44540 - DNA, 20 bp, Artificial Sequence
  sgRNA
  Olfr724_3
acaggataatcatgagtcac

SEQ ID NO: 44541 - DNA, 20 bp, Artificial Sequence
  sgRNA
  Olfr724_4
acaagcaagcttgattacca

SEQ ID NO: 44542 - DNA, 20 bp, Artificial Sequence
  sgRNA
  Olfr724_5
tttccaagaagaaaatacat

SEQ ID NO: 44543 - DNA, 20 bp, Artificial Sequence
  sgRNA
  Olfr724_6
tttcagcaccccccaaaaaa

SEQ ID NO: 44544 - DNA, 20 bp, Artificial Sequence
  sgRNA
  Olfr724_7
gtttccaagaagaaaataca

SEQ ID NO: 44545 - DNA, 20 bp, Artificial Sequence
  sgRNA
  Olfr724_8
gacacatgtctaggaaggag

SEQ ID NO: 44546 - DNA, 20 bp, Artificial Sequence
  sgRNA
  Olfr724_9
cagtggaaagacacatgtct

SEQ ID NO: 44547 - DNA, 20 bp, Artificial Sequence
  sgRNA
  Olfr724_10
aaaatacatgggagaatgaa

SEQ ID NO: 44548 - DNA, 20 bp, Artificial Sequence
  sgRNA
  Olfr724_11
tgtcaatgccatctggctca

SEQ ID NO: 44549 - DNA, 20 bp, Artificial Sequence
  sgRNA
  Olfr724_12
aaaaatggctgaagaacatc

SEQ ID NO: 44550 - DNA, 20 bp, Artificial Sequence
  sgRNA
  Olfr724_13
tgagtcacaggttgctgaac

SEQ ID NO: 44551 - DNA, 20 bp, Artificial Sequence
  sgRNA
  Olfr724_14
gaaaatacatgggagaatga

SEQ ID NO: 44552 - DNA, 20 bp, Artificial Sequence
  sgRNA
  Olfr725_1
catccatacaatgagccagt

SEQ ID NO: 44553 - DNA, 20 bp, Artificial Sequence
  sgRNA
  Olfr725_2
tgaccagagtgatacacaca

SEQ ID NO: 44554 - DNA, 20 bp, Artificial Sequence
  sgRNA
  Olfr725_3
tgtatccatctatttggtgg

SEQ ID NO: 44555 - DNA, 20 bp, Artificial Sequence
  sgRNA
  Olfr725_4
agttgcccagcagtattgct

SEQ ID NO: 44556 - DNA, 20 bp, Artificial Sequence
  sgRNA
  Olfr725_5
tctcaccaccaccaaataga

SEQ ID NO: 44557 - DNA, 20 bp, Artificial Sequence
  sgRNA
  Olfr725_6
agttaacagtgaatgccaac

SEQ ID NO: 44558 - DNA, 20 bp, Artificial Sequence
  sgRNA
  Olfr725_7
cttggtcatctcctacactg

SEQ ID NO: 44559 - DNA, 20 bp, Artificial Sequence
  sgRNA
  Olfr725_8
catgattgtcatgtagtgga

SEQ ID NO: 44560 - DNA, 20 bp, Artificial Sequence
  sgRNA
  Olfr725_9
aataatgtgagcagttaggg

SEQ ID NO: 44561 - DNA, 20 bp, Artificial Sequence
  sgRNA
  Olfr725_10
atcagttcagaaacctgcct

SEQ ID NO: 44562 - DNA, 20 bp, Artificial Sequence
  sgRNA
  Olfr725_11
tcagtatatgaaacctaggc

SEQ ID NO: 44563 - DNA, 20 bp, Artificial Sequence
  sgRNA
  Olfr725_12
ttctgtatccatctatttgg

SEQ ID NO: 44564 - DNA, 20 bp, Artificial Sequence
  sgRNA
  Olfr725_13
gggatcagtatatgaaacct

SEQ ID NO: 44565 - DNA, 20 bp, Artificial Sequence
  sgRNA
  Olfr725_14
gtagataagtgggtttaaaa

SEQ ID NO: 44566 - DNA, 20 bp, Artificial Sequence
  sgRNA
  Olfr725_15
aacataacgatcataggcca

SEQ ID NO: 44567 - DNA, 20 bp, Artificial Sequence
  sgRNA
  Olfr725_16
agtaattaaaaccacagtgt

SEQ ID NO: 44568 - DNA, 20 bp, Artificial Sequence
  sgRNA
  Olfr725_17
tattgcaacataacgatcat

SEQ ID NO: 44569 - DNA, 20 bp, Artificial Sequence
  sgRNA
  Olfr725_18
gtttaaaatgggcgtgaaga

SEQ ID NO: 44570 - DNA, 20 bp, Artificial Sequence
  sgRNA
  Olfr725_19
ctacaataatgtgagcagtt

SEQ ID NO: 44571 - DNA, 20 bp, Artificial Sequence
  sgRNA
  Olfr725_20
tacaataatgtgagcagtta

SEQ ID NO: 44572 - DNA, 20 bp, Artificial Sequence
  sgRNA
  Olfr726_1
tgcaagcaggaagtacatgg

SEQ ID NO: 44573 - DNA, 20 bp, Artificial Sequence
  sgRNA
  Olfr726_2
atgatcgtcatgtagtggag

SEQ ID NO: 44574 - DNA, 20 bp, Artificial Sequence
  sgRNA
  Olfr726_3
ttgtatctagcaatactgct

SEQ ID NO: 44575 - DNA, 20 bp, Artificial Sequence
  sgRNA
  Olfr726_4
tgtgtccatcaatttgctgg

SEQ ID NO: 44576 - DNA, 20 bp, Artificial Sequence
  sgRNA
  Olfr726_5
gcagctatgtcaaagctgag

SEQ ID NO: 44577 - DNA, 20 bp, Artificial Sequence
  sgRNA
  Olfr726_6
atgccaactgactcattgta

SEQ ID NO: 44578 - DNA, 20 bp, Artificial Sequence
  sgRNA
  Olfr726_7
catgatcgtcatgtagtgga

SEQ ID NO: 44579 - DNA, 20 bp, Artificial Sequence
  sgRNA
  Olfr726_8
gactcatgatcgtcatgtag

SEQ ID NO: 44580 - DNA, 20 bp, Artificial Sequence
  sgRNA
  Olfr726_9
aagtcactgtgaggatgatg

SEQ ID NO: 44581 - DNA, 20 bp, Artificial Sequence
  sgRNA
  Olfr726_10
ttgcaagcaggaagtacatg

SEQ ID NO: 44582 - DNA, 20 bp, Artificial Sequence
  sgRNA
  Olfr726_11
tttcaccaccagcaaattga

SEQ ID NO: 44583 - DNA, 20 bp, Artificial Sequence
  sgRNA
  Olfr726_12
ttctgtgtccatcaatttgc

SEQ ID NO: 44584 - DNA, 20 bp, Artificial Sequence
  sgRNA
  Olfr726_13
attaattcagaaacttgtcc

SEQ ID NO: 44585 - DNA, 20 bp, Artificial Sequence
  sgRNA
  Olfr726_14
gttgtatctagcaatactgc

SEQ ID NO: 44586 - DNA, 20 bp, Artificial Sequence
  sgRNA
  Olfr726_15
tcaatttgctggtggtgaaa

SEQ ID NO: 44587 - DNA, 20 bp, Artificial Sequence
  sgRNA
  Olfr726_16
catccatacaatgagtcagt

SEQ ID NO: 44588 - DNA, 20 bp, Artificial Sequence
  sgRNA
  Olfr726_17
gtttaaaataggtgtgaaga

SEQ ID NO: 44589 - DNA, 20 bp, Artificial Sequence
  sgRNA
  Olfr726_18
tcatgatcgtcatgtagtgg

SEQ ID NO: 44590 - DNA, 20 bp, Artificial Sequence
  sgRNA
  Olfr726_19
aggggtcgctatctgaagcc

SEQ ID NO: 44591 - DNA, 20 bp, Artificial Sequence
  sgRNA
  Olfr726_20
actgtagttgtactattctt

SEQ ID NO: 44592 - DNA, 20 bp, Artificial Sequence
  sgRNA
  Olfr727_1
agacgagaatgatacataca

SEQ ID NO: 44593 - DNA, 20 bp, Artificial Sequence
  sgRNA
  Olfr727_2
catccatacaactagtcagt

SEQ ID NO: 44594 - DNA, 20 bp, Artificial Sequence
  sgRNA
  Olfr727_3
caagaggagaaatgaactca

SEQ ID NO: 44595 - DNA, 20 bp, Artificial Sequence
  sgRNA
  Olfr727_4
gtgagtctgaagtcactgtg

SEQ ID NO: 44596 - DNA, 20 bp, Artificial Sequence
  sgRNA
  Olfr727_5
tcaactgaatagctgctaaa

SEQ ID NO: 44597 - DNA, 20 bp, Artificial Sequence
  sgRNA
  Olfr727_6
cagtgtaggagacaaccaag

SEQ ID NO: 44598 - DNA, 20 bp, Artificial Sequence
  sgRNA
  Olfr727_7
atgccaactgactagttgta

SEQ ID NO: 44599 - DNA, 20 bp, Artificial Sequence
  sgRNA
  Olfr727_8
agttagggtggatcgagcct

SEQ ID NO: 44600 - DNA, 20 bp, Artificial Sequence
  sgRNA
  Olfr727_9
gcagcaatgtcaaagctgag

SEQ ID NO: 44601 - DNA, 20 bp, Artificial Sequence
  sgRNA
  Olfr727_10
tcgctatctgaaacctggac

SEQ ID NO: 44602 - DNA, 20 bp, Artificial Sequence
  sgRNA
  Olfr727_11
ttgctaatagttgcagatag

SEQ ID NO: 44603 - DNA, 20 bp, Artificial Sequence
  sgRNA
  Olfr727_12
gtagataactgggtttaaaa

SEQ ID NO: 44604 - DNA, 20 bp, Artificial Sequence
  sgRNA
  Olfr727_13
agccttggccatgctagcag

SEQ ID NO: 44605 - DNA, 20 bp, Artificial Sequence
  sgRNA
  Olfr727_14
tttgttcatctctttactgg

SEQ ID NO: 44606 - DNA, 20 bp, Artificial Sequence
  sgRNA
  Olfr727_15
atcaatgcagaaacctgtcc

SEQ ID NO: 44607 - DNA, 20 bp, Artificial Sequence
  sgRNA
  Olfr727_16
tagataactgggtttaaaat

SEQ ID NO: 44608 - DNA, 20 bp, Artificial Sequence
  sgRNA
  Olfr727_17
agcagcaatgtcaaagctga

SEQ ID NO: 44609 - DNA, 20 bp, Artificial Sequence
  sgRNA
  Olfr727_18
aggggtcgctatctgaaacc

SEQ ID NO: 44610 - DNA, 20 bp, Artificial Sequence
  sgRNA
  Olfr727_19
catgagttcatttctcctct

SEQ ID NO: 44611 - DNA, 20 bp, Artificial Sequence
  sgRNA
  Olfr727_20
tttctcagagtgtagataac

SEQ ID NO: 44612 - DNA, 20 bp, Artificial Sequence
  sgRNA
  Olfr728_1
gcacgcaagctttatcacca

SEQ ID NO: 44613 - DNA, 20 bp, Artificial Sequence
  sgRNA
  Olfr728_2
tatcataccactgttagcca

SEQ ID NO: 44614 - DNA, 20 bp, Artificial Sequence
  sgRNA
  Olfr728_3
gtccacaagcatcttcggtg

SEQ ID NO: 44615 - DNA, 20 bp, Artificial Sequence
  sgRNA
  Olfr728_4
ccaaatggctcacagaatga

SEQ ID NO: 44616 - DNA, 20 bp, Artificial Sequence
  sgRNA
  Olfr728_5
aagcacaaactcagataccg

SEQ ID NO: 44617 - DNA, 20 bp, Artificial Sequence
  sgRNA
  Olfr728_6
cacgcaagctttatcaccaa

SEQ ID NO: 44618 - DNA, 20 bp, Artificial Sequence
  sgRNA
  Olfr728_7
gattcactgtaaatgccaaa

SEQ ID NO: 44619 - DNA, 20 bp, Artificial Sequence
  sgRNA
  Olfr728_8
gtgcatggatacgtacagaa

SEQ ID NO: 44620 - DNA, 20 bp, Artificial Sequence
  sgRNA
  Olfr728_9
ataattagattgtagtgcag

SEQ ID NO: 44621 - DNA, 20 bp, Artificial Sequence
  sgRNA
  Olfr728_10
ccttcattctgtgagccatt

SEQ ID NO: 44622 - DNA, 20 bp, Artificial Sequence
  sgRNA
  Olfr728_11
actacaatctaattatgaat

SEQ ID NO: 44623 - DNA, 20 bp, Artificial Sequence
  sgRNA
  Olfr728_12
ggcagatgtcaataaatgaa

SEQ ID NO: 44624 - DNA, 20 bp, Artificial Sequence
  sgRNA
  Olfr728_13
tataggagataattaaagcc

SEQ ID NO: 44625 - DNA, 20 bp, Artificial Sequence
  sgRNA
  Olfr728_14
tgtgggccgtgagtgtagaa

SEQ ID NO: 44626 - DNA, 20 bp, Artificial Sequence
  sgRNA
  Olfr728_15
ttactgagcaaaaagtacat

SEQ ID NO: 44627 - DNA, 20 bp, Artificial Sequence
  sgRNA
  Olfr728_16
ggctttggatgacccactag

SEQ ID NO: 44628 - DNA, 20 bp, Artificial Sequence
  sgRNA
  Olfr728_17
ttgtagctatgggatatgac

SEQ ID NO: 44629 - DNA, 20 bp, Artificial Sequence
  sgRNA
  Olfr728_18
gccattctgtggtcccaatg

SEQ ID NO: 44630 - DNA, 20 bp, Artificial Sequence
  sgRNA
  Olfr728_19
gaaacagtcatataaatcct

SEQ ID NO: 44631 - DNA, 20 bp, Artificial Sequence
  sgRNA
  Olfr728_20
aagatgtgaaatcagccttg

SEQ ID NO: 44632 - DNA, 20 bp, Artificial Sequence
  sgRNA
  Olfr729_1
caggcgagtttgaccactcg

SEQ ID NO: 44633 - DNA, 20 bp, Artificial Sequence
  sgRNA
  Olfr729_2
ttcattcacctctttacagg

SEQ ID NO: 44634 - DNA, 20 bp, Artificial Sequence
  sgRNA
  Olfr729_3
atacttattgtggtaaacag

SEQ ID NO: 44635 - DNA, 20 bp, Artificial Sequence
  sgRNA
  Olfr729_4
ggaaatacatcggtgagtgc

SEQ ID NO: 44636 - DNA, 20 bp, Artificial Sequence
  sgRNA
  Olfr729_5
agcccaagagattactacca

SEQ ID NO: 44637 - DNA, 20 bp, Artificial Sequence
  sgRNA
  Olfr729_6
acatgtagtttggttcatga

SEQ ID NO: 44638 - DNA, 20 bp, Artificial Sequence
  sgRNA
  Olfr729_7
atgatggtcatataatgtag

SEQ ID NO: 44639 - DNA, 20 bp, Artificial Sequence
  sgRNA
  Olfr729_8
ccatctctcctcctgtaaag

SEQ ID NO: 44640 - DNA, 20 bp, Artificial Sequence
  sgRNA
  Olfr729_9
agtaatgtatgagtcaatgc

SEQ ID NO: 44641 - DNA, 20 bp, Artificial Sequence
  sgRNA
  Olfr729_10
cacaagactatatcattcag

SEQ ID NO: 44642 - DNA, 20 bp, Artificial Sequence
  sgRNA
  Olfr729_11
tgccttggtagtaatctctt

SEQ ID NO: 44643 - DNA, 20 bp, Artificial Sequence
  sgRNA
  Olfr729_12
tccacaggataggtagtaaa

SEQ ID NO: 44644 - DNA, 20 bp, Artificial Sequence
  sgRNA
  Olfr729_13
tcacagctatgatgatgaga

SEQ ID NO: 44645 - DNA, 20 bp, Artificial Sequence
  sgRNA
  Olfr729_14
tgtgacaagaattatgacat

SEQ ID NO: 44646 - DNA, 20 bp, Artificial Sequence
  sgRNA
  Olfr729_15
tttcccaggaggaaatacat

SEQ ID NO: 44647 - DNA, 20 bp, Artificial Sequence
  sgRNA
  Olfr729_16
ccaaggcagtacatgtagtt

SEQ ID NO: 44648 - DNA, 20 bp, Artificial Sequence
  sgRNA
  Olfr729_17
tcataattcttgtcacagtt

SEQ ID NO: 44649 - DNA, 20 bp, Artificial Sequence
  sgRNA
  Olfr729_18
gacaaatgtcaaaaaaggaa

SEQ ID NO: 44650 - DNA, 20 bp, Artificial Sequence
  sgRNA
  Olfr729_19
agagacatgaaagctgtcat

SEQ ID NO: 44651 - DNA, 20 bp, Artificial Sequence
  sgRNA
  Olfr729_20
gacatttcagctactttggg

SEQ ID NO: 44652 - DNA, 20 bp, Artificial Sequence
  sgRNA
  Olfr73_1
aatctagttacaatgaacag

SEQ ID NO: 44653 - DNA, 20 bp, Artificial Sequence
  sgRNA
  Olfr73_2
caaccctctactctacacag

SEQ ID NO: 44654 - DNA, 20 bp, Artificial Sequence
  sgRNA
  Olfr73_3
gcataccaccccccaagcat

SEQ ID NO: 44655 - DNA, 20 bp, Artificial Sequence
  sgRNA
  Olfr73_4
tgtcagagcgtgaaagtgaa

SEQ ID NO: 44656 - DNA, 20 bp, Artificial Sequence
  sgRNA
  Olfr73_5
gataatctgagaagcccaag

SEQ ID NO: 44657 - DNA, 20 bp, Artificial Sequence
  sgRNA
  Olfr73_6
gtagagtagagggttgcgga

SEQ ID NO: 44658 - DNA, 20 bp, Artificial Sequence
  sgRNA
  Olfr73_7
ataggatcccaataccagca

SEQ ID NO: 44659 - DNA, 20 bp, Artificial Sequence
  sgRNA
  Olfr73_8
gacacagtaaaaaaaataat

SEQ ID NO: 44660 - DNA, 20 bp, Artificial Sequence
  sgRNA
  Olfr73_9
tttctcagactgtatattag

SEQ ID NO: 44661 - DNA, 20 bp, Artificial Sequence
  sgRNA
  Olfr73_10
tgagaaatatcaaaaagaga

SEQ ID NO: 44662 - DNA, 20 bp, Artificial Sequence
  sgRNA
  Olfr73_11
caccactgtgtaaaacacag

SEQ ID NO: 44663 - DNA, 20 bp, Artificial Sequence
  sgRNA
  Olfr73_12
agatggttatagctgtcaga

SEQ ID NO: 44664 - DNA, 20 bp, Artificial Sequence
  sgRNA
  Olfr73_13
tggccactgtgtagagtaga

SEQ ID NO: 44665 - DNA, 20 bp, Artificial Sequence
  sgRNA
  Olfr73_14
ataggaataggattgttcca

SEQ ID NO: 44666 - DNA, 20 bp, Artificial Sequence
  sgRNA
  Olfr73_15
ctgtcagatggaaatcacag

SEQ ID NO: 44667 - DNA, 20 bp, Artificial Sequence
  sgRNA
  Olfr73_16
gtattgggatcctatgcttg

SEQ ID NO: 44668 - DNA, 20 bp, Artificial Sequence
  sgRNA
  Olfr73_17
ataatctgagaagcccaaga

SEQ ID NO: 44669 - DNA, 20 bp, Artificial Sequence
  sgRNA
  Olfr73_18
caccatctacagcatcactg

SEQ ID NO: 44670 - DNA, 20 bp, Artificial Sequence
  sgRNA
  Olfr73_19
acacagtggccatgtcccag

SEQ ID NO: 44671 - DNA, 20 bp, Artificial Sequence
  sgRNA
  Olfr73_20
tgtcagatggaaatcacagt

SEQ ID NO: 44672 - DNA, 20 bp, Artificial Sequence
  sgRNA
  Olfr730_1
acagctggaacaccacagga

SEQ ID NO: 44673 - DNA, 20 bp, Artificial Sequence
  sgRNA
  Olfr730_2
gagagtcagatatgacgatg

SEQ ID NO: 44674 - DNA, 20 bp, Artificial Sequence
  sgRNA
  Olfr730_3
acaaaggcaatacacacctg

SEQ ID NO: 44675 - DNA, 20 bp, Artificial Sequence
  sgRNA
  Olfr730_4
gaccacagaatggtaatgtg

SEQ ID NO: 44676 - DNA, 20 bp, Artificial Sequence
  sgRNA
  Olfr730_5
gctgggactctctaattcct

SEQ ID NO: 44677 - DNA, 20 bp, Artificial Sequence
  sgRNA
  Olfr730_6
gccctcacattaccattctg

SEQ ID NO: 44678 - DNA, 20 bp, Artificial Sequence
  sgRNA
  Olfr730_7
atgattgaggcatagcgcag

SEQ ID NO: 44679 - DNA, 20 bp, Artificial Sequence
  sgRNA
  Olfr730_8
catggttcctacaacccatg

SEQ ID NO: 44680 - DNA, 20 bp, Artificial Sequence
  sgRNA
  Olfr730_9
aagtatctacacaagacagc

SEQ ID NO: 44681 - DNA, 20 bp, Artificial Sequence
  sgRNA
  Olfr730_10
atatatcactgggttcataa

SEQ ID NO: 44682 - DNA, 20 bp, Artificial Sequence
  sgRNA
  Olfr730_11
caagacagctggaacaccac

SEQ ID NO: 44683 - DNA, 20 bp, Artificial Sequence
  sgRNA
  Olfr730_12
aacccatgaggacaccacaa

SEQ ID NO: 44684 - DNA, 20 bp, Artificial Sequence
  sgRNA
  Olfr730_13
cttacttctcagtttcctca

SEQ ID NO: 44685 - DNA, 20 bp, Artificial Sequence
  sgRNA
  Olfr730_14
gatcatcttgggagtagcaa

SEQ ID NO: 44686 - DNA, 20 bp, Artificial Sequence
  sgRNA
  Olfr730_15
tctcagtaccagtgaacagg

SEQ ID NO: 44687 - DNA, 20 bp, Artificial Sequence
  sgRNA
  Olfr730_16
gaaaatacatagcagagtgt

SEQ ID NO: 44688 - DNA, 20 bp, Artificial Sequence
  sgRNA
  Olfr730_17
acatgaagacaacgatgaag

SEQ ID NO: 44689 - DNA, 20 bp, Artificial Sequence
  sgRNA
  Olfr730_18
catgaagacaacgatgaagt

SEQ ID NO: 44690 - DNA, 20 bp, Artificial Sequence
  sgRNA
  Olfr730_19
ttctttctccacctgttcac

SEQ ID NO: 44691 - DNA, 20 bp, Artificial Sequence
  sgRNA
  Olfr730_20
tgcctttgtggtgtcctcat

SEQ ID NO: 44692 - DNA, 20 bp, Artificial Sequence
  sgRNA
  Olfr732_1
ctgaccatcagatcagaccc

SEQ ID NO: 44693 - DNA, 20 bp, Artificial Sequence
  sgRNA
  Olfr732_2
gcgctgaatgtcatgtgact

SEQ ID NO: 44694 - DNA, 20 bp, Artificial Sequence
  sgRNA
  Olfr732_3
gaccacagaaaggcaaacgg

SEQ ID NO: 44695 - DNA, 20 bp, Artificial Sequence
  sgRNA
  Olfr732_4
ataacagtagaataatgtaa

SEQ ID NO: 44696 - DNA, 20 bp, Artificial Sequence
  sgRNA
  Olfr732_5
acttccttggagggggtgaa

SEQ ID NO: 44697 - DNA, 20 bp, Artificial Sequence
  sgRNA
  Olfr732_6
acatcacatagcaggctcta

SEQ ID NO: 44698 - DNA, 20 bp, Artificial Sequence
  sgRNA
  Olfr732_7
atcctgtgatttataccctt

SEQ ID NO: 44699 - DNA, 20 bp, Artificial Sequence
  sgRNA
  Olfr732_8
tcccaagaagaaataaagag

SEQ ID NO: 44700 - DNA, 20 bp, Artificial Sequence
  sgRNA
  Olfr732_9
tcagaagaccaagaaaacaa

SEQ ID NO: 44701 - DNA, 20 bp, Artificial Sequence
  sgRNA
  Olfr732_10
ataatgtaaaggcctgcaga

SEQ ID NO: 44702 - DNA, 20 bp, Artificial Sequence
  sgRNA
  Olfr732_11
gaagaccaagaaaacaaagg

SEQ ID NO: 44703 - DNA, 20 bp, Artificial Sequence
  sgRNA
  Olfr732_12
atcctccgtttgcctttctg

SEQ ID NO: 44704 - DNA, 20 bp, Artificial Sequence
  sgRNA
  Olfr732_13
actccttcattgtggctccc

SEQ ID NO: 44705 - DNA, 20 bp, Artificial Sequence
  sgRNA
  Olfr732_14
ccatgaaaaagttaatcatc

SEQ ID NO: 44706 - DNA, 20 bp, Artificial Sequence
  sgRNA
  Olfr732_15
aagaccaagaaaacaaagga

SEQ ID NO: 44707 - DNA, 20 bp, Artificial Sequence
  sgRNA
  Olfr732_16
gtcacatgacattcagcgct

SEQ ID NO: 44708 - DNA, 20 bp, Artificial Sequence
  sgRNA
  Olfr732_17
gtgactgggtcagtcctatg

SEQ ID NO: 44709 - DNA, 20 bp, Artificial Sequence
  sgRNA
  Olfr732_18
gtaacccttcaccccctcca

SEQ ID NO: 44710 - DNA, 20 bp, Artificial Sequence
  sgRNA
  Olfr732_19
cattgtggctcccaggatgt

SEQ ID NO: 44711 - DNA, 20 bp, Artificial Sequence
  sgRNA
  Olfr732_20
ttctacatcatcatcttgcc

SEQ ID NO: 44712 - DNA, 20 bp, Artificial Sequence
  sgRNA
  Olfr733_1
atgacagtggagtaatacaa

SEQ ID NO: 44713 - DNA, 20 bp, Artificial Sequence
  sgRNA
  Olfr733_2
ctcaccatcatatcagaccc

SEQ ID NO: 44714 - DNA, 20 bp, Artificial Sequence
  sgRNA
  Olfr733_3
catcctaggagccacaatga

SEQ ID NO: 44715 - DNA, 20 bp, Artificial Sequence
  sgRNA
  Olfr733_4
tgaataaatcctccaagcca

SEQ ID NO: 44716 - DNA, 20 bp, Artificial Sequence
  sgRNA
  Olfr733_5
tcccaggaataaataaagag

SEQ ID NO: 44717 - DNA, 20 bp, Artificial Sequence
  sgRNA
  Olfr733_6
ataagggaaatattactgta

SEQ ID NO: 44718 - DNA, 20 bp, Artificial Sequence
  sgRNA
  Olfr733_7
gtcacttgacattcaacgct

SEQ ID NO: 44719 - DNA, 20 bp, Artificial Sequence
  sgRNA
  Olfr733_8
gtaatacaaaggcctgcaga

SEQ ID NO: 44720 - DNA, 20 bp, Artificial Sequence
  sgRNA
  Olfr733_9
aagaccaagaaagcacacaa

SEQ ID NO: 44721 - DNA, 20 bp, Artificial Sequence
  sgRNA
  Olfr733_10
gtaaaaattcccctcctcca

SEQ ID NO: 44722 - DNA, 20 bp, Artificial Sequence
  sgRNA
  Olfr733_11
tatttatacccttcgaaacc

SEQ ID NO: 44723 - DNA, 20 bp, Artificial Sequence
  sgRNA
  Olfr733_12
agtctgctatgtgatgttgt

SEQ ID NO: 44724 - DNA, 20 bp, Artificial Sequence
  sgRNA
  Olfr733_13
actccttcattgtggctcct

SEQ ID NO: 44725 - DNA, 20 bp, Artificial Sequence
  sgRNA
  Olfr733_14
gaccacagaagggcaagcgg

SEQ ID NO: 44726 - DNA, 20 bp, Artificial Sequence
  sgRNA
  Olfr733_15
tgctctatcagctgacaaag

SEQ ID NO: 44727 - DNA, 20 bp, Artificial Sequence
  sgRNA
  Olfr733_16
ttcccaggaataaataaaga

SEQ ID NO: 44728 - DNA, 20 bp, Artificial Sequence
  sgRNA
  Olfr733_17
gactctgggattcatgacag

SEQ ID NO: 44729 - DNA, 20 bp, Artificial Sequence
  sgRNA
  Olfr733_18
tcagctgatagagcagtgaa

SEQ ID NO: 44730 - DNA, 20 bp, Artificial Sequence
  sgRNA
  Olfr733_19
cataaggatctcgactgcaa

SEQ ID NO: 44731 - DNA, 20 bp, Artificial Sequence
  sgRNA
  Olfr733_20
gcccctctttatttattcct

SEQ ID NO: 44732 - DNA, 20 bp, Artificial Sequence
  sgRNA
  Olfr734_1
ttgagcaatacacccaccaa

SEQ ID NO: 44733 - DNA, 20 bp, Artificial Sequence
  sgRNA
  Olfr734_2
cgtacattctataatacagg

SEQ ID NO: 44734 - DNA, 20 bp, Artificial Sequence
  sgRNA
  Olfr734_3
ggaaggctagattagccagc

SEQ ID NO: 44735 - DNA, 20 bp, Artificial Sequence
  sgRNA
  Olfr734_4
cagataataaggatattcac

SEQ ID NO: 44736 - DNA, 20 bp, Artificial Sequence
  sgRNA
  Olfr734_5
gagaataaattcggtcacgg

SEQ ID NO: 44737 - DNA, 20 bp, Artificial Sequence
  sgRNA
  Olfr734_6
ctaagatacaacagagccgg

SEQ ID NO: 44738 - DNA, 20 bp, Artificial Sequence
  sgRNA
  Olfr734_7
tagaccagtgagaataaatt

SEQ ID NO: 44739 - DNA, 20 bp, Artificial Sequence
  sgRNA
  Olfr734_8
atgctaccatcatgaaccgc

SEQ ID NO: 44740 - DNA, 20 bp, Artificial Sequence
  sgRNA
  Olfr734_9
ccggctctgttgtatcttag

SEQ ID NO: 44741 - DNA, 20 bp, Artificial Sequence
  sgRNA
  Olfr734_10
acagagccggcggttcatga

SEQ ID NO: 44742 - DNA, 20 bp, Artificial Sequence
  sgRNA
  Olfr734_11
tgggcgagcataaatgtaga

SEQ ID NO: 44743 - DNA, 20 bp, Artificial Sequence
  sgRNA
  Olfr734_12
gcttgagtgtttcttaagca

SEQ ID NO: 44744 - DNA, 20 bp, Artificial Sequence
  sgRNA
  Olfr734_13
ttagccagcaggaaatacat

SEQ ID NO: 44745 - DNA, 20 bp, Artificial Sequence
  sgRNA
  Olfr734_14
ggaataccaaatatcaagga

SEQ ID NO: 44746 - DNA, 20 bp, Artificial Sequence
  sgRNA
  Olfr734_15
catggtcagaagaaaggcgt

SEQ ID NO: 44747 - DNA, 20 bp, Artificial Sequence
  sgRNA
  Olfr734_16
cgagcataaatgtagatgga

SEQ ID NO: 44748 - DNA, 20 bp, Artificial Sequence
  sgRNA
  Olfr734_17
gtcacggtggtatcatttgc

SEQ ID NO: 44749 - DNA, 20 bp, Artificial Sequence
  sgRNA
  Olfr734_18
ctcaggtgagagcaccagca

SEQ ID NO: 44750 - DNA, 20 bp, Artificial Sequence
  sgRNA
  Olfr734_19
gatgcttgtagacttctttg

SEQ ID NO: 44751 - DNA, 20 bp, Artificial Sequence
  sgRNA
  Olfr734_20
cttcttcttgcactttgtcg

SEQ ID NO: 44752 - DNA, 20 bp, Artificial Sequence
  sgRNA
  Olfr735_1
acaccaaccgaagtcgtagg

SEQ ID NO: 44753 - DNA, 20 bp, Artificial Sequence
  sgRNA
  Olfr735_2
gatttcccaggacaataacc

SEQ ID NO: 44754 - DNA, 20 bp, Artificial Sequence
  sgRNA
  Olfr735_3
gtggctgtacccaaaatgct

SEQ ID NO: 44755 - DNA, 20 bp, Artificial Sequence
  sgRNA
  Olfr735_4
aaagtgaagaaagaatacct

SEQ ID NO: 44756 - DNA, 20 bp, Artificial Sequence
  sgRNA
  Olfr735_5
ggaacaggtgagcatcagcc

SEQ ID NO: 44757 - DNA, 20 bp, Artificial Sequence
  sgRNA
  Olfr735_6
tgaccgtcaggtagtgcaaa

SEQ ID NO: 44758 - DNA, 20 bp, Artificial Sequence
  sgRNA
  Olfr735_7
ggagctcccaggaagacgac

SEQ ID NO: 44759 - DNA, 20 bp, Artificial Sequence
  sgRNA
  Olfr735_8
ctgagaactcacctccaccg

SEQ ID NO: 44760 - DNA, 20 bp, Artificial Sequence
  sgRNA
  Olfr735_9
ctgtgcttctcacttgacgg

SEQ ID NO: 44761 - DNA, 20 bp, Artificial Sequence
  sgRNA
  Olfr735_10
aggccagcttgacaacctgg

SEQ ID NO: 44762 - DNA, 20 bp, Artificial Sequence
  sgRNA
  Olfr735_11
gctaggagatttcctacaga

SEQ ID NO: 44763 - DNA, 20 bp, Artificial Sequence
  sgRNA
  Olfr735_12
aagagtatcaagcgacctag

SEQ ID NO: 44764 - DNA, 20 bp, Artificial Sequence
  sgRNA
  Olfr735_13
agtcaacaggaacatctcac

SEQ ID NO: 44765 - DNA, 20 bp, Artificial Sequence
  sgRNA
  Olfr735_14
gtgctgatggtctctaacag

SEQ ID NO: 44766 - DNA, 20 bp, Artificial Sequence
  sgRNA
  Olfr735_15
tggcttagaaaatagtacat

SEQ ID NO: 44767 - DNA, 20 bp, Artificial Sequence
  sgRNA
  Olfr735_16
caaccctttgcactacctga

SEQ ID NO: 44768 - DNA, 20 bp, Artificial Sequence
  sgRNA
  Olfr735_17
agttcattgggaccacaaaa

SEQ ID NO: 44769 - DNA, 20 bp, Artificial Sequence
  sgRNA
  Olfr735_18
taaccacctacgacttcggt

SEQ ID NO: 44770 - DNA, 20 bp, Artificial Sequence
  sgRNA
  Olfr735_19
tttcattcactctatcacac

SEQ ID NO: 44771 - DNA, 20 bp, Artificial Sequence
  sgRNA
  Olfr735_20
tgaataaccacctacgactt

SEQ ID NO: 44772 - DNA, 20 bp, Artificial Sequence
  sgRNA
  Olfr738_1
agatgaccttcgtgtcagag

SEQ ID NO: 44773 - DNA, 20 bp, Artificial Sequence
  sgRNA
  Olfr738_2
aattaaagaatttctcacac

SEQ ID NO: 44774 - DNA, 20 bp, Artificial Sequence
  sgRNA
  Olfr738_3
ggaggatttgcccctccttg

SEQ ID NO: 44775 - DNA, 20 bp, Artificial Sequence
  sgRNA
  Olfr738_4
ataatgtagaggtctgcaga

SEQ ID NO: 44776 - DNA, 20 bp, Artificial Sequence
  sgRNA
  Olfr738_5
gtatatcacaggattaagga

SEQ ID NO: 44777 - DNA, 20 bp, Artificial Sequence
  sgRNA
  Olfr738_6
ccaacatctgaacatgcagc

SEQ ID NO: 44778 - DNA, 20 bp, Artificial Sequence
  sgRNA
  Olfr738_7
tatatcacaggattaaggag

SEQ ID NO: 44779 - DNA, 20 bp, Artificial Sequence
  sgRNA
  Olfr738_8
agaatttctcacacaggtga

SEQ ID NO: 44780 - DNA, 20 bp, Artificial Sequence
  sgRNA
  Olfr738_9
ggatccacagaaggacattt

SEQ ID NO: 44781 - DNA, 20 bp, Artificial Sequence
  sgRNA
  Olfr738_10
gcttcccctgccccaaggag

SEQ ID NO: 44782 - DNA, 20 bp, Artificial Sequence
  sgRNA
  Olfr738_11
ttcttcgtccagctgctgaa

SEQ ID NO: 44783 - DNA, 20 bp, Artificial Sequence
  sgRNA
  Olfr738_12
gtcttatgctctagtaatga

SEQ ID NO: 44784 - DNA, 20 bp, Artificial Sequence
  sgRNA
  Olfr738_13
ggtcttatgctctagtaatg

SEQ ID NO: 44785 - DNA, 20 bp, Artificial Sequence
  sgRNA
  Olfr738_14
ctgtgggtcacacttgactg

SEQ ID NO: 44786 - DNA, 20 bp, Artificial Sequence
  sgRNA
  Olfr738_15
gtagaggtctgcagatggca

SEQ ID NO: 44787 - DNA, 20 bp, Artificial Sequence
  sgRNA
  Olfr738_16
tgatgatgctggagttgctg

SEQ ID NO: 44788 - DNA, 20 bp, Artificial Sequence
  sgRNA
  Olfr738_17
atagcacacagcacatatga

SEQ ID NO: 44789 - DNA, 20 bp, Artificial Sequence
  sgRNA
  Olfr738_18
acacaggtgagggccaacag

SEQ ID NO: 44790 - DNA, 20 bp, Artificial Sequence
  sgRNA
  Olfr738_19
cacaggtgagggccaacaga

SEQ ID NO: 44791 - DNA, 20 bp, Artificial Sequence
  sgRNA
  Olfr738_20
aaatggaacaaataaaagca

SEQ ID NO: 44792 - DNA, 20 bp, Artificial Sequence
  sgRNA
  Olfr74_1
gaaactctgtatcacactgg

SEQ ID NO: 44793 - DNA, 20 bp, Artificial Sequence
  sgRNA
  Olfr74_2
ggggattaattctgatcacg

SEQ ID NO: 44794 - DNA, 20 bp, Artificial Sequence
  sgRNA
  Olfr74_3
ttgactgatgagagtatcag

SEQ ID NO: 44795 - DNA, 20 bp, Artificial Sequence
  sgRNA
  Olfr74_4
cgagaaacaccaagaagaga

SEQ ID NO: 44796 - DNA, 20 bp, Artificial Sequence
  sgRNA
  Olfr74_5
ttaagatgcgttcagccagt

SEQ ID NO: 44797 - DNA, 20 bp, Artificial Sequence
  sgRNA
  Olfr74_6
gataatctgagaagaccaag

SEQ ID NO: 44798 - DNA, 20 bp, Artificial Sequence
  sgRNA
  Olfr74_7
tccaggctcacagtcaaagt

SEQ ID NO: 44799 - DNA, 20 bp, Artificial Sequence
  sgRNA
  Olfr74_8
ggtaccatggaagatagtga

SEQ ID NO: 44800 - DNA, 20 bp, Artificial Sequence
  sgRNA
  Olfr74_9
cgtcatttacagcatcactg

SEQ ID NO: 44801 - DNA, 20 bp, Artificial Sequence
  sgRNA
  Olfr74_10
agatagtgatggctgccagg

SEQ ID NO: 44802 - DNA, 20 bp, Artificial Sequence
  sgRNA
  Olfr74_11
tatggcatatgaccgatttg

SEQ ID NO: 44803 - DNA, 20 bp, Artificial Sequence
  sgRNA
  Olfr74_12
acatgtgaacccccatgcgt

SEQ ID NO: 44804 - DNA, 20 bp, Artificial Sequence
  sgRNA
  Olfr74_13
ccagaaactctgtatcacac

SEQ ID NO: 44805 - DNA, 20 bp, Artificial Sequence
  sgRNA
  Olfr74_14
atagattatggggttaagca

SEQ ID NO: 44806 - DNA, 20 bp, Artificial Sequence
  sgRNA
  Olfr74_15
ataatctgagaagaccaaga

SEQ ID NO: 44807 - DNA, 20 bp, Artificial Sequence
  sgRNA
  Olfr74_16
gaaagccttacgacgcccac

SEQ ID NO: 44808 - DNA, 20 bp, Artificial Sequence
  sgRNA
  Olfr74_17
tgtctgaaaaaaacaatagt

SEQ ID NO: 44809 - DNA, 20 bp, Artificial Sequence
  sgRNA
  Olfr74_18
gcagccatcactatcttcca

SEQ ID NO: 44810 - DNA, 20 bp, Artificial Sequence
  sgRNA
  Olfr74_19
aaaggaataaaatggtacca

SEQ ID NO: 44811 - DNA, 20 bp, Artificial Sequence
  sgRNA
  Olfr74_20
tggctactgtgtagagcaga

SEQ ID NO: 44812 - DNA, 20 bp, Artificial Sequence
  sgRNA
  Olfr745_1
tcctgggtttcagtaatcag

SEQ ID NO: 44813 - DNA, 20 bp, Artificial Sequence
  sgRNA
  Olfr745_2
acacaggatagtgcaaacaa

SEQ ID NO: 44814 - DNA, 20 bp, Artificial Sequence
  sgRNA
  Olfr745_3
gagatgaggacaattgggac

SEQ ID NO: 44815 - DNA, 20 bp, Artificial Sequence
  sgRNA
  Olfr745_4
acttcctagtcatgatagag

SEQ ID NO: 44816 - DNA, 20 bp, Artificial Sequence
  sgRNA
  Olfr745_5
gtaatggtcgacagatagcc

SEQ ID NO: 44817 - DNA, 20 bp, Artificial Sequence
  sgRNA
  Olfr745_6
ccaacatcagggaatcctgc

SEQ ID NO: 44818 - DNA, 20 bp, Artificial Sequence
  sgRNA
  Olfr745_7
gtactagagtataggatccc

SEQ ID NO: 44819 - DNA, 20 bp, Artificial Sequence
  sgRNA
  Olfr745_8
tttcggagagtatagatgag

SEQ ID NO: 44820 - DNA, 20 bp, Artificial Sequence
  sgRNA
  Olfr745_9
cctgattactgaaacccagg

SEQ ID NO: 44821 - DNA, 20 bp, Artificial Sequence
  sgRNA
  Olfr745_10
caattgggactggatagcag

SEQ ID NO: 44822 - DNA, 20 bp, Artificial Sequence
  sgRNA
  Olfr745_11
tgtatgtgagcccaacatca

SEQ ID NO: 44823 - DNA, 20 bp, Artificial Sequence
  sgRNA
  Olfr745_12
ttagttcgaccagcaccaga

SEQ ID NO: 44824 - DNA, 20 bp, Artificial Sequence
  sgRNA
  Olfr745_13
ggtataacagagaagctcag

SEQ ID NO: 44825 - DNA, 20 bp, Artificial Sequence
  sgRNA
  Olfr745_14
tatggcttatgatcgatacc

SEQ ID NO: 44826 - DNA, 20 bp, Artificial Sequence
  sgRNA
  Olfr745_15
atagtgcaaacaatggtcct

SEQ ID NO: 44827 - DNA, 20 bp, Artificial Sequence
  sgRNA
  Olfr745_16
aacttcctagtcatgataga

SEQ ID NO: 44828 - DNA, 20 bp, Artificial Sequence
  sgRNA
  Olfr745_17
tttacctcctgaccttgctg

SEQ ID NO: 44829 - DNA, 20 bp, Artificial Sequence
  sgRNA
  Olfr745_18
catcctgatttgtatctgct

SEQ ID NO: 44830 - DNA, 20 bp, Artificial Sequence
  sgRNA
  Olfr745_19
gctgtgtttcgagttccttc

SEQ ID NO: 44831 - DNA, 20 bp, Artificial Sequence
  sgRNA
  Olfr745_20
gatgagaggatttaagaggg

SEQ ID NO: 44832 - DNA, 20 bp, Artificial Sequence
  sgRNA
  Olfr746_1
atgccttatgatgtgtgtag

SEQ ID NO: 44833 - DNA, 20 bp, Artificial Sequence
  sgRNA
  Olfr746_2
tctacatgataactttgact

SEQ ID NO: 44834 - DNA, 20 bp, Artificial Sequence
  sgRNA
  Olfr746_3
agaaaccaatgatccaacag

SEQ ID NO: 44835 - DNA, 20 bp, Artificial Sequence
  sgRNA
  Olfr746_4
gaaagtgatcaatgatattg

SEQ ID NO: 44836 - DNA, 20 bp, Artificial Sequence
  sgRNA
  Olfr746_5
gtacccctacacacatcata

SEQ ID NO: 44837 - DNA, 20 bp, Artificial Sequence
  sgRNA
  Olfr746_6
caactgagttgccagatgtg

SEQ ID NO: 44838 - DNA, 20 bp, Artificial Sequence
  sgRNA
  Olfr746_7
gctccaaggcataagatcca

SEQ ID NO: 44839 - DNA, 20 bp, Artificial Sequence
  sgRNA
  Olfr746_8
gctgacatacatcaccatta

SEQ ID NO: 44840 - DNA, 20 bp, Artificial Sequence
  sgRNA
  Olfr746_9
tatcacactgatatattctg

SEQ ID NO: 44841 - DNA, 20 bp, Artificial Sequence
  sgRNA
  Olfr746_10
tacaggacagtgctattagt

SEQ ID NO: 44842 - DNA, 20 bp, Artificial Sequence
  sgRNA
  Olfr746_11
actcttatcattattctcac

SEQ ID NO: 44843 - DNA, 20 bp, Artificial Sequence
  sgRNA
  Olfr746_12
agaacagagacactaccagc

SEQ ID NO: 44844 - DNA, 20 bp, Artificial Sequence
  sgRNA
  Olfr746_13
gtacaggacagtgctattag

SEQ ID NO: 44845 - DNA, 20 bp, Artificial Sequence
  sgRNA
  Olfr746_14
agtatgatttgaatcttcca

SEQ ID NO: 44846 - DNA, 20 bp, Artificial Sequence
  sgRNA
  Olfr746_15
tattcccaaagaagacatga

SEQ ID NO: 44847 - DNA, 20 bp, Artificial Sequence
  sgRNA
  Olfr746_16
catgccttatgatgtgtgta

SEQ ID NO: 44848 - DNA, 20 bp, Artificial Sequence
  sgRNA
  Olfr746_17
aagaacagctctgagctcca

SEQ ID NO: 44849 - DNA, 20 bp, Artificial Sequence
  sgRNA
  Olfr746_18
tctgttctatggaaccataa

SEQ ID NO: 44850 - DNA, 20 bp, Artificial Sequence
  sgRNA
  Olfr746_19
ccatcatttgtgcagtgaga

SEQ ID NO: 44851 - DNA, 20 bp, Artificial Sequence
  sgRNA
  Olfr746_20
ccatctcactgcacaaatga

SEQ ID NO: 44852 - DNA, 20 bp, Artificial Sequence
  sgRNA
  Olfr747_1
attaccctactatcatgact

SEQ ID NO: 44853 - DNA, 20 bp, Artificial Sequence
  sgRNA
  Olfr747_2
tagtatgttaggaatagtgg

SEQ ID NO: 44854 - DNA, 20 bp, Artificial Sequence
  sgRNA
  Olfr747_3
ataaattcagtaataggagc

SEQ ID NO: 44855 - DNA, 20 bp, Artificial Sequence
  sgRNA
  Olfr747_4
gaagcaccctgaaaatgaga

SEQ ID NO: 44856 - DNA, 20 bp, Artificial Sequence
  sgRNA
  Olfr747_5
aggacatgaaacttgctctg

SEQ ID NO: 44857 - DNA, 20 bp, Artificial Sequence
  sgRNA
  Olfr747_6
tagtagggtaatgtaatggg

SEQ ID NO: 44858 - DNA, 20 bp, Artificial Sequence
  sgRNA
  Olfr747_7
gcctcctagtcatgatagta

SEQ ID NO: 44859 - DNA, 20 bp, Artificial Sequence
  sgRNA
  Olfr747_8
agcctcctagtcatgatagt

SEQ ID NO: 44860 - DNA, 20 bp, Artificial Sequence
  sgRNA
  Olfr747_9
agagtgacaccacaactaaa

SEQ ID NO: 44861 - DNA, 20 bp, Artificial Sequence
  sgRNA
  Olfr747_10
accctactatcatgactagg

SEQ ID NO: 44862 - DNA, 20 bp, Artificial Sequence
  sgRNA
  Olfr747_11
gttgtggtgtcactcttcta

SEQ ID NO: 44863 - DNA, 20 bp, Artificial Sequence
  sgRNA
  Olfr747_12
gctctgaggaaagttctgtt

SEQ ID NO: 44864 - DNA, 20 bp, Artificial Sequence
  sgRNA
  Olfr747_13
ttgtggtgtcactcttctat

SEQ ID NO: 44865 - DNA, 20 bp, Artificial Sequence
  sgRNA
  Olfr747_14
gagtgacaccacaactaaat

SEQ ID NO: 44866 - DNA, 20 bp, Artificial Sequence
  sgRNA
  Olfr747_15
atgtacatgagtcctacata

SEQ ID NO: 44867 - DNA, 20 bp, Artificial Sequence
  sgRNA
  Olfr747_16
atgatagtagggtaatgtaa

SEQ ID NO: 44868 - DNA, 20 bp, Artificial Sequence
  sgRNA
  Olfr747_17
aaagttgaaatgccatatgt

SEQ ID NO: 44869 - DNA, 20 bp, Artificial Sequence
  sgRNA
  Olfr747_18
tgatagtagggtaatgtaat

SEQ ID NO: 44870 - DNA, 20 bp, Artificial Sequence
  sgRNA
  Olfr747_19
agccttgagcaacaaaatat

SEQ ID NO: 44871 - DNA, 20 bp, Artificial Sequence
  sgRNA
  Olfr748_1
atgccttatgatgggtgtag

SEQ ID NO: 44872 - DNA, 20 bp, Artificial Sequence
  sgRNA
  Olfr748_2
tggccatcatttgtgcagtg

SEQ ID NO: 44873 - DNA, 20 bp, Artificial Sequence
  sgRNA
  Olfr748_3
gaaaccaatgatccaacaga

SEQ ID NO: 44874 - DNA, 20 bp, Artificial Sequence
  sgRNA
  Olfr748_4
tttgaatcttccagggacca

SEQ ID NO: 44875 - DNA, 20 bp, Artificial Sequence
  sgRNA
  Olfr748_5
gtacccctacacccatcata

SEQ ID NO: 44876 - DNA, 20 bp, Artificial Sequence
  sgRNA
  Olfr748_6
gcaacagagttgctagactt

SEQ ID NO: 44877 - DNA, 20 bp, Artificial Sequence
  sgRNA
  Olfr748_7
tacaggacaggaccattagt

SEQ ID NO: 44878 - DNA, 20 bp, Artificial Sequence
  sgRNA
  Olfr748_8
tatcacactgatatactctg

SEQ ID NO: 44879 - DNA, 20 bp, Artificial Sequence
  sgRNA
  Olfr748_9
gtacaggacaggaccattag

SEQ ID NO: 44880 - DNA, 20 bp, Artificial Sequence
  sgRNA
  Olfr748_10
aagaacagctctgagcacta

SEQ ID NO: 44881 - DNA, 20 bp, Artificial Sequence
  sgRNA
  Olfr748_11
ggatccaaggatgtacaaac

SEQ ID NO: 44882 - DNA, 20 bp, Artificial Sequence
  sgRNA
  Olfr748_12
aaaacagagacactaccagc

SEQ ID NO: 44883 - DNA, 20 bp, Artificial Sequence
  sgRNA
  Olfr748_13
agtcacatacatcaccatta

SEQ ID NO: 44884 - DNA, 20 bp, Artificial Sequence
  sgRNA
  Olfr748_14
agtgtgatttgaatcttcca

SEQ ID NO: 44885 - DNA, 20 bp, Artificial Sequence
  sgRNA
  Olfr748_15
ttcttcagatggacgacaaa

SEQ ID NO: 44886 - DNA, 20 bp, Artificial Sequence
  sgRNA
  Olfr748_16
atagaatacatgccttatga

SEQ ID NO: 44887 - DNA, 20 bp, Artificial Sequence
  sgRNA
  Olfr748_17
tagaatacatgccttatgat

SEQ ID NO: 44888 - DNA, 20 bp, Artificial Sequence
  sgRNA
  Olfr748_18
gcactagggtataggatcca

SEQ ID NO: 44889 - DNA, 20 bp, Artificial Sequence
  sgRNA
  Olfr748_19
ctgtgatgtggacccactaa

SEQ ID NO: 44890 - DNA, 20 bp, Artificial Sequence
  sgRNA
  Olfr748_20
catgccttatgatgggtgta

SEQ ID NO: 44891 - DNA, 20 bp, Artificial Sequence
  sgRNA
  Olfr749_1
attaccctaccatcatgact

SEQ ID NO: 44892 - DNA, 20 bp, Artificial Sequence
  sgRNA
  Olfr749_2
cttggtcttagacagaatgt

SEQ ID NO: 44893 - DNA, 20 bp, Artificial Sequence
  sgRNA
  Olfr749_3
ggaaggcaaaatttcccagg

SEQ ID NO: 44894 - DNA, 20 bp, Artificial Sequence
  sgRNA
  Olfr749_4
tcaatgggtccatgtcacag

SEQ ID NO: 44895 - DNA, 20 bp, Artificial Sequence
  sgRNA
  Olfr749_5
actcttctatggtacagtaa

SEQ ID NO: 44896 - DNA, 20 bp, Artificial Sequence
  sgRNA
  Olfr749_6
acacagcctcctagtcatga

SEQ ID NO: 44897 - DNA, 20 bp, Artificial Sequence
  sgRNA
  Olfr749_7
gttgtggtatcactcttcta

SEQ ID NO: 44898 - DNA, 20 bp, Artificial Sequence
  sgRNA
  Olfr749_8
agagtgataccacaactaaa

SEQ ID NO: 44899 - DNA, 20 bp, Artificial Sequence
  sgRNA
  Olfr749_9
tggtagggtaatgtaatggg

SEQ ID NO: 44900 - DNA, 20 bp, Artificial Sequence
  sgRNA
  Olfr749_10
accctaccatcatgactagg

SEQ ID NO: 44901 - DNA, 20 bp, Artificial Sequence
  sgRNA
  Olfr749_11
agcctcctagtcatgatggt

SEQ ID NO: 44902 - DNA, 20 bp, Artificial Sequence
  sgRNA
  Olfr749_12
gctctgagaaatgttctgtt

SEQ ID NO: 44903 - DNA, 20 bp, Artificial Sequence
  sgRNA
  Olfr749_13
aggatcttctgcatcaaaat

SEQ ID NO: 44904 - DNA, 20 bp, Artificial Sequence
  sgRNA
  Olfr749_14
agccctgagcaacaaaatat

SEQ ID NO: 44905 - DNA, 20 bp, Artificial Sequence
  sgRNA
  Olfr749_15
gagtgataccacaactaaat

SEQ ID NO: 44906 - DNA, 20 bp, Artificial Sequence
  sgRNA
  Olfr749_16
gcctcctagtcatgatggta

SEQ ID NO: 44907 - DNA, 20 bp, Artificial Sequence
  sgRNA
  Olfr749_17
tgatggtagggtaatgtaat

SEQ ID NO: 44908 - DNA, 20 bp, Artificial Sequence
  sgRNA
  Olfr749_18
aaaattggaatgccatatgt

SEQ ID NO: 44909 - DNA, 20 bp, Artificial Sequence
  sgRNA
  Olfr749_19
atgatggtagggtaatgtaa

SEQ ID NO: 44910 - DNA, 20 bp, Artificial Sequence
  sgRNA
  Olfr749_20
atgtatgtgagtcctacata

SEQ ID NO: 44911 - DNA, 20 bp, Artificial Sequence
  sgRNA
  Olfr750_1
taccaacaccacgagactgg

SEQ ID NO: 44912 - DNA, 20 bp, Artificial Sequence
  sgRNA
  Olfr750_2
caggtaaacgaaaaggaaca

SEQ ID NO: 44913 - DNA, 20 bp, Artificial Sequence
  sgRNA
  Olfr750_3
cagacatgacggccaacagt

SEQ ID NO: 44914 - DNA, 20 bp, Artificial Sequence
  sgRNA
  Olfr750_4
acggctccattcattagcaa

SEQ ID NO: 44915 - DNA, 20 bp, Artificial Sequence
  sgRNA
  Olfr750_5
gcatcccctctgcttccggt

SEQ ID NO: 44916 - DNA, 20 bp, Artificial Sequence
  sgRNA
  Olfr750_6
tctgggatggccttacgtag

SEQ ID NO: 44917 - DNA, 20 bp, Artificial Sequence
  sgRNA
  Olfr750_7
ggagaaagccttctgccgac

SEQ ID NO: 44918 - DNA, 20 bp, Artificial Sequence
  sgRNA
  Olfr750_8
cattaccccttgctaatgaa

SEQ ID NO: 44919 - DNA, 20 bp, Artificial Sequence
  sgRNA
  Olfr750_9
ccacgtgcgaaccagagtgt

SEQ ID NO: 44920 - DNA, 20 bp, Artificial Sequence
  sgRNA
  Olfr750_10
gaatctcaacagcacaggag

SEQ ID NO: 44921 - DNA, 20 bp, Artificial Sequence
  sgRNA
  Olfr750_11
tttgaaagagatgttcagga

SEQ ID NO: 44922 - DNA, 20 bp, Artificial Sequence
  sgRNA
  Olfr750_12
gtttacctgttgactctaac

SEQ ID NO: 44923 - DNA, 20 bp, Artificial Sequence
  sgRNA
  Olfr750_13
tgagcaatttcctctcgaga

SEQ ID NO: 44924 - DNA, 20 bp, Artificial Sequence
  sgRNA
  Olfr750_14
ccgacactctggttcgcacg

SEQ ID NO: 44925 - DNA, 20 bp, Artificial Sequence
  sgRNA
  Olfr750_15
cttgacttgatcgttgcgca

SEQ ID NO: 44926 - DNA, 20 bp, Artificial Sequence
  sgRNA
  Olfr750_16
acagcaccctgtttgcagaa

SEQ ID NO: 44927 - DNA, 20 bp, Artificial Sequence
  sgRNA
  Olfr750_17
gtagcgatccacagacatga

SEQ ID NO: 44928 - DNA, 20 bp, Artificial Sequence
  sgRNA
  Olfr750_18
cagaagtgatcagaatctcg

SEQ ID NO: 44929 - DNA, 20 bp, Artificial Sequence
  sgRNA
  Olfr750_19
gctcctgtgctgttgagatt

SEQ ID NO: 44930 - DNA, 20 bp, Artificial Sequence
  sgRNA
  Olfr750_20
gagtcaacaggtaaacgaaa

SEQ ID NO: 44931 - DNA, 20 bp, Artificial Sequence
  sgRNA
  Olfr753-ps1_1
gccaactgctgacataggcg

SEQ ID NO: 44932 - DNA, 20 bp, Artificial Sequence
  sgRNA
  Olfr753-ps1_2
ggatgagtgtgtttcctaag

SEQ ID NO: 44933 - DNA, 20 bp, Artificial Sequence
  sgRNA
  Olfr753-ps1_3
ccaactgctgacataggcgg

SEQ ID NO: 44934 - DNA, 20 bp, Artificial Sequence
  sgRNA
  Olfr753-ps1_4
tgcccctctctcgggcataa

SEQ ID NO: 44935 - DNA, 20 bp, Artificial Sequence
  sgRNA
  Olfr753-ps1_5
atgactgtggcatagtgcag

SEQ ID NO: 44936 - DNA, 20 bp, Artificial Sequence
  sgRNA
  Olfr753-ps1_6
gatgactgtggcatagtgca

SEQ ID NO: 44937 - DNA, 20 bp, Artificial Sequence
  sgRNA
  Olfr753-ps1_7
cacatataatgagatccaga

SEQ ID NO: 44938 - DNA, 20 bp, Artificial Sequence
  sgRNA
  Olfr753-ps1_8
gcagttggcaggtatagctt

SEQ ID NO: 44939 - DNA, 20 bp, Artificial Sequence
  sgRNA
  Olfr753-ps1_9
cgcctatgtcagcagttggc

SEQ ID NO: 44940 - DNA, 20 bp, Artificial Sequence
  sgRNA
  Olfr753-ps1_10
aaacccttatgcccgagaga

SEQ ID NO: 44941 - DNA, 20 bp, Artificial Sequence
  sgRNA
  Olfr753-ps1_11
tacctgccaactgctgacat

SEQ ID NO: 44942 - DNA, 20 bp, Artificial Sequence
  sgRNA
  Olfr753-ps1_12
tgtttcctaagagggtgagg

SEQ ID NO: 44943 - DNA, 20 bp, Artificial Sequence
  sgRNA
  Olfr753-ps1_13
gatgagtgtgtttcctaaga

SEQ ID NO: 44944 - DNA, 20 bp, Artificial Sequence
  sgRNA
  Olfr753-ps1_14
tgccaactgctgacataggc

SEQ ID NO: 44945 - DNA, 20 bp, Artificial Sequence
  sgRNA
  Olfr753-ps1_15
agtgtggagcctgggatcca

SEQ ID NO: 44946 - DNA, 20 bp, Artificial Sequence
  sgRNA
  Olfr753-ps1_16
gtgtgtttcctaagagggtg

SEQ ID NO: 44947 - DNA, 20 bp, Artificial Sequence
  sgRNA
  Olfr753-ps1_17
tgatgactgtggcatagtgc

SEQ ID NO: 44948 - DNA, 20 bp, Artificial Sequence
  sgRNA
  Olfr753-ps1_18
tatacaagagggttgagtat

SEQ ID NO: 44949 - DNA, 20 bp, Artificial Sequence
  sgRNA
  Olfr753-ps1_19
agtctcatccttgtctctta

SEQ ID NO: 44950 - DNA, 20 bp, Artificial Sequence
  sgRNA
  Olfr753-ps1_20
gatccagggtggacagcaag

SEQ ID NO: 44951 - DNA, 20 bp, Artificial Sequence
  sgRNA
  Olfr76_1
ggaagattcggagttctggg

SEQ ID NO: 44952 - DNA, 20 bp, Artificial Sequence
  sgRNA
  Olfr76_2
tacaccaccatcatgcccca

SEQ ID NO: 44953 - DNA, 20 bp, Artificial Sequence
  sgRNA
  Olfr76_3
tggcctgaataaaagaactc

SEQ ID NO: 44954 - DNA, 20 bp, Artificial Sequence
  sgRNA
  Olfr76_4
cacctactgtgatcactatg

SEQ ID NO: 44955 - DNA, 20 bp, Artificial Sequence
  sgRNA
  Olfr76_5
tctctccatcactttccaca

SEQ ID NO: 44956 - DNA, 20 bp, Artificial Sequence
  sgRNA
  Olfr76_6
gccctcatctttctgatcag

SEQ ID NO: 44957 - DNA, 20 bp, Artificial Sequence
  sgRNA
  Olfr76_7
gcaaaagtggagctgaaata

SEQ ID NO: 44958 - DNA, 20 bp, Artificial Sequence
  sgRNA
  Olfr76_8
taacacgttcctcagccaag

SEQ ID NO: 44959 - DNA, 20 bp, Artificial Sequence
  sgRNA
  Olfr76_9
tcatagtgatcacagtaggt

SEQ ID NO: 44960 - DNA, 20 bp, Artificial Sequence
  sgRNA
  Olfr76_10
agatgccctgtggaaagtga

SEQ ID NO: 44961 - DNA, 20 bp, Artificial Sequence
  sgRNA
  Olfr76_11
ggtcactgccatgaggtgcg

SEQ ID NO: 44962 - DNA, 20 bp, Artificial Sequence
  sgRNA
  Olfr76_12
tgttagagcaagaaagtgcc

SEQ ID NO: 44963 - DNA, 20 bp, Artificial Sequence
  sgRNA
  Olfr76_13
ctatgaggaaattcaccact

SEQ ID NO: 44964 - DNA, 20 bp, Artificial Sequence
  sgRNA
  Olfr76_14
gaatcccaagaagatgaaca

SEQ ID NO: 44965 - DNA, 20 bp, Artificial Sequence
  sgRNA
  Olfr76_15
aagaaatcaaagatgccctg

SEQ ID NO: 44966 - DNA, 20 bp, Artificial Sequence
  sgRNA
  Olfr76_16
ggaaattcaccacttggctg

SEQ ID NO: 44967 - DNA, 20 bp, Artificial Sequence
  sgRNA
  Olfr76_17
tgtaactgtaggagatcagc

SEQ ID NO: 44968 - DNA, 20 bp, Artificial Sequence
  sgRNA
  Olfr76_18
acagcatggtcactgccatg

SEQ ID NO: 44969 - DNA, 20 bp, Artificial Sequence
  sgRNA
  Olfr76_19
gagcatcttgggagctacag

SEQ ID NO: 44970 - DNA, 20 bp, Artificial Sequence
  sgRNA
  Olfr76_20
catatgccattgctgtcagc

SEQ ID NO: 44971 - DNA, 20 bp, Artificial Sequence
  sgRNA
  Olfr765_1
taatgctgaccaggaccctg

SEQ ID NO: 44972 - DNA, 20 bp, Artificial Sequence
  sgRNA
  Olfr765_2
tgaaaaagttgtctttctcg

SEQ ID NO: 44973 - DNA, 20 bp, Artificial Sequence
  sgRNA
  Olfr765_3
cagcagggtgaggacgagga

SEQ ID NO: 44974 - DNA, 20 bp, Artificial Sequence
  sgRNA
  Olfr765_4
tgactcatcaaagtgatggg

SEQ ID NO: 44975 - DNA, 20 bp, Artificial Sequence
  sgRNA
  Olfr765_5
cacaaacatcttcatcccca

SEQ ID NO: 44976 - DNA, 20 bp, Artificial Sequence
  sgRNA
  Olfr765_6
ggacatccgtgagtcctaga

SEQ ID NO: 44977 - DNA, 20 bp, Artificial Sequence
  sgRNA
  Olfr765_7
aatccagcagggtgaggacg

SEQ ID NO: 44978 - DNA, 20 bp, Artificial Sequence
  sgRNA
  Olfr765_8
tctggttctctgctcttggc

SEQ ID NO: 44979 - DNA, 20 bp, Artificial Sequence
  sgRNA
  Olfr765_9
gagggagataacaatcatgt

SEQ ID NO: 44980 - DNA, 20 bp, Artificial Sequence
  sgRNA
  Olfr765_10
ttataccctaaggaaccaac

SEQ ID NO: 44981 - DNA, 20 bp, Artificial Sequence
  sgRNA
  Olfr765_11
ttcagcccaacaaaggacaa

SEQ ID NO: 44982 - DNA, 20 bp, Artificial Sequence
  sgRNA
  Olfr765_12
attcatccttctaggactca

SEQ ID NO: 44983 - DNA, 20 bp, Artificial Sequence
  sgRNA
  Olfr765_13
ttgtcctttgttgggctgaa

SEQ ID NO: 44984 - DNA, 20 bp, Artificial Sequence
  sgRNA
  Olfr765_14
agcaactgaagtaatgaaaa

SEQ ID NO: 44985 - DNA, 20 bp, Artificial Sequence
  sgRNA
  Olfr765_15
cgtggcatctgtgaccctgg

SEQ ID NO: 44986 - DNA, 20 bp, Artificial Sequence
  sgRNA
  Olfr765_16
tcacaaacatcttcatcccc

SEQ ID NO: 44987 - DNA, 20 bp, Artificial Sequence
  sgRNA
  Olfr765_17
atcccttcatttatacccta

SEQ ID NO: 44988 - DNA, 20 bp, Artificial Sequence
  sgRNA
  Olfr765_18
agagggagataacaatcatg

SEQ ID NO: 44989 - DNA, 20 bp, Artificial Sequence
  sgRNA
  Olfr765_19
agctcccttcagcccaacaa

SEQ ID NO: 44990 - DNA, 20 bp, Artificial Sequence
  sgRNA
  Olfr765_20
gcttcacctgttggttcctt

SEQ ID NO: 44991 - DNA, 20 bp, Artificial Sequence
  sgRNA
  Olfr767_1
gaacaggagagttctagaag

SEQ ID NO: 44992 - DNA, 20 bp, Artificial Sequence
  sgRNA
  Olfr767_2
cagcagggtgaggatgagga

SEQ ID NO: 44993 - DNA, 20 bp, Artificial Sequence
  sgRNA
  Olfr767_3
ggtcctggtcagcattacaa

SEQ ID NO: 44994 - DNA, 20 bp, Artificial Sequence
  sgRNA
  Olfr767_4
gttctctgctcttggctagg

SEQ ID NO: 44995 - DNA, 20 bp, Artificial Sequence
  sgRNA
  Olfr767_5
ggacatccgtgagacctaga

SEQ ID NO: 44996 - DNA, 20 bp, Artificial Sequence
  sgRNA
  Olfr767_6
cacgaacatcttcattccca

SEQ ID NO: 44997 - DNA, 20 bp, Artificial Sequence
  sgRNA
  Olfr767_7
tgtggcatctgtgaccctgg

SEQ ID NO: 44998 - DNA, 20 bp, Artificial Sequence
  sgRNA
  Olfr767_8
gagggagatgacaatcatgt

SEQ ID NO: 44999 - DNA, 20 bp, Artificial Sequence
  sgRNA
  Olfr767_9
ttgtcatctccctctcttat

SEQ ID NO: 45000 - DNA, 20 bp, Artificial Sequence
  sgRNA
  Olfr767_10
agcaactgaagtaatgagaa

SEQ ID NO: 45001 - DNA, 20 bp, Artificial Sequence
  sgRNA
  Olfr767_11
tcacgaacatcttcattccc

SEQ ID NO: 45002 - DNA, 20 bp, Artificial Sequence
  sgRNA
  Olfr767_12
ttataccttaaggaaccaac

SEQ ID NO: 45003 - DNA, 20 bp, Artificial Sequence
  sgRNA
  Olfr767_13
ttctctgctcttggctaggt

SEQ ID NO: 45004 - DNA, 20 bp, Artificial Sequence
  sgRNA
  Olfr767_14
attcatccttctaggtctca

SEQ ID NO: 45005 - DNA, 20 bp, Artificial Sequence
  sgRNA
  Olfr767_15
ttgtcctttgctgggctgaa

SEQ ID NO: 45006 - DNA, 20 bp, Artificial Sequence
  sgRNA
  Olfr767_16
tgttcgtgaaagaaatttct

SEQ ID NO: 45007 - DNA, 20 bp, Artificial Sequence
  sgRNA
  Olfr767_17
agagggagatgacaatcatg

SEQ ID NO: 45008 - DNA, 20 bp, Artificial Sequence
  sgRNA
  Olfr767_18
tcttgtggcatctgtgaccc

SEQ ID NO: 45009 - DNA, 20 bp, Artificial Sequence
  sgRNA
  Olfr767_19
ttcagcccagcaaaggacaa

SEQ ID NO: 45010 - DNA, 20 bp, Artificial Sequence
  sgRNA
  Olfr767_20
gagcaactgaagtaatgaga

SEQ ID NO: 45011 - DNA, 20 bp, Artificial Sequence
  sgRNA
  Olfr77_1
tatttatgtgggtatcagag

SEQ ID NO: 45012 - DNA, 20 bp, Artificial Sequence
  sgRNA
  Olfr77_2
atcatgaaccctcgaatctg

SEQ ID NO: 45013 - DNA, 20 bp, Artificial Sequence
  sgRNA
  Olfr77_3
ttgagtaaggcactctgtgt

SEQ ID NO: 45014 - DNA, 20 bp, Artificial Sequence
  sgRNA
  Olfr77_4
caacaaatgacaggttgcag

SEQ ID NO: 45015 - DNA, 20 bp, Artificial Sequence
  sgRNA
  Olfr77_5
cttctgaaagaccaataagg

SEQ ID NO: 45016 - DNA, 20 bp, Artificial Sequence
  sgRNA
  Olfr77_6
tggtaatcaggaacatagat

SEQ ID NO: 45017 - DNA, 20 bp, Artificial Sequence
  sgRNA
  Olfr77_7
gatggccacaaaacgatcat

SEQ ID NO: 45018 - DNA, 20 bp, Artificial Sequence
  sgRNA
  Olfr77_8
ccagaaggccacagattcga

SEQ ID NO: 45019 - DNA, 20 bp, Artificial Sequence
  sgRNA
  Olfr77_9
agaacatggataccacacag

SEQ ID NO: 45020 - DNA, 20 bp, Artificial Sequence
  sgRNA
  Olfr77_10
aataaggaggaaatgtacta

SEQ ID NO: 45021 - DNA, 20 bp, Artificial Sequence
  sgRNA
  Olfr77_11
actcactgagcttctcaggg

SEQ ID NO: 45022 - DNA, 20 bp, Artificial Sequence
  sgRNA
  Olfr77_12
tgaactcactgagcttctca

SEQ ID NO: 45023 - DNA, 20 bp, Artificial Sequence
  sgRNA
  Olfr77_13
atgatgactgtgtagttaag

SEQ ID NO: 45024 - DNA, 20 bp, Artificial Sequence
  sgRNA
  Olfr77_14
gtatccatgttctatgggac

SEQ ID NO: 45025 - DNA, 20 bp, Artificial Sequence
  sgRNA
  Olfr77_15
gagaaagctatcccaatgac

SEQ ID NO: 45026 - DNA, 20 bp, Artificial Sequence
  sgRNA
  Olfr77_16
gtagttaagtggatgacaga

SEQ ID NO: 45027 - DNA, 20 bp, Artificial Sequence
  sgRNA
  Olfr77_17
ggaaatgtactatggctgta

SEQ ID NO: 45028 - DNA, 20 bp, Artificial Sequence
  sgRNA
  Olfr77_18
tgtgtggtatccatgttcta

SEQ ID NO: 45029 - DNA, 20 bp, Artificial Sequence
  sgRNA
  Olfr77_19
tccaagataaaagaaccaga

SEQ ID NO: 45030 - DNA, 20 bp, Artificial Sequence
  sgRNA
  Olfr77_20
tttcgcaagctatagatgaa

SEQ ID NO: 45031 - DNA, 20 bp, Artificial Sequence
  sgRNA
  Olfr779_1
ttatggagacaacaaacatg

SEQ ID NO: 45032 - DNA, 20 bp, Artificial Sequence
  sgRNA
  Olfr779_2
tatggagacaacaaacatgt

SEQ ID NO: 45033 - DNA, 20 bp, Artificial Sequence
  sgRNA
  Olfr779_3
tttgttgtctccataacata

SEQ ID NO: 45034 - DNA, 20 bp, Artificial Sequence
  sgRNA
  Olfr779_4
aaacatgtgggatgtgcagg

SEQ ID NO: 45035 - DNA, 20 bp, Artificial Sequence
  sgRNA
  Olfr779_5
aaactacaatttgtaattgt

SEQ ID NO: 45036 - DNA, 20 bp, Artificial Sequence
  sgRNA
  Olfr779_6
tgtgcaggtggagaaggctt

SEQ ID NO: 45037 - DNA, 20 bp, Artificial Sequence
  sgRNA
  Olfr779_7
aaaactacaatttgtaattg

SEQ ID NO: 45038 - DNA, 20 bp, Artificial Sequence
  sgRNA
  Olfr779_8
gtgggatgtgcaggtggaga

SEQ ID NO: 45039 - DNA, 20 bp, Artificial Sequence
  sgRNA
  Olfr779_9
aacaaacatgtgggatgtgc

SEQ ID NO: 45040 - DNA, 20 bp, Artificial Sequence
  sgRNA
  Olfr78_1
aacagtccaaataggcatgg

SEQ ID NO: 45041 - DNA, 20 bp, Artificial Sequence
  sgRNA
  Olfr78_2
attgtttggaaactgcattg

SEQ ID NO: 45042 - DNA, 20 bp, Artificial Sequence
  sgRNA
  Olfr78_3
ggcatcaaaagtaatctccc

SEQ ID NO: 45043 - DNA, 20 bp, Artificial Sequence
  sgRNA
  Olfr78_4
cccactactgatcaagcgac

SEQ ID NO: 45044 - DNA, 20 bp, Artificial Sequence
  sgRNA
  Olfr78_5
ctacttcctgatcatacgaa

SEQ ID NO: 45045 - DNA, 20 bp, Artificial Sequence
  sgRNA
  Olfr78_6
ttagctcgctcagacttgga

SEQ ID NO: 45046 - DNA, 20 bp, Artificial Sequence
  sgRNA
  Olfr78_7
ccaacttcatcacatcctgg

SEQ ID NO: 45047 - DNA, 20 bp, Artificial Sequence
  sgRNA
  Olfr78_8
ccagtcgcttgatcagtagt

SEQ ID NO: 45048 - DNA, 20 bp, Artificial Sequence
  sgRNA
  Olfr78_9
aataagcaggaaggtggcat

SEQ ID NO: 45049 - DNA, 20 bp, Artificial Sequence
  sgRNA
  Olfr78_10
aattgaatctactatcctgc

SEQ ID NO: 45050 - DNA, 20 bp, Artificial Sequence
  sgRNA
  Olfr78_11
ccgggagtcaaaccaaaaga

SEQ ID NO: 45051 - DNA, 20 bp, Artificial Sequence
  sgRNA
  Olfr78_12
ccactcctattgtgtccacc

SEQ ID NO: 45052 - DNA, 20 bp, Artificial Sequence
  sgRNA
  Olfr78_13
atgatgggattgatcacagg

SEQ ID NO: 45053 - DNA, 20 bp, Artificial Sequence
  sgRNA
  Olfr78_14
tcttcatagtgagaacagag

SEQ ID NO: 45054 - DNA, 20 bp, Artificial Sequence
  sgRNA
  Olfr78_15
ggactgttactgtattgttg

SEQ ID NO: 45055 - DNA, 20 bp, Artificial Sequence
  sgRNA
  Olfr78_16
agtaacagtccaaataggca

SEQ ID NO: 45056 - DNA, 20 bp, Artificial Sequence
  sgRNA
  Olfr78_17
cagcagcgtgacgcagtggg

SEQ ID NO: 45057 - DNA, 20 bp, Artificial Sequence
  sgRNA
  Olfr78_18
actgccattctgctagtcat

SEQ ID NO: 45058 - DNA, 20 bp, Artificial Sequence
  sgRNA
  Olfr78_19
cagcatacatggaaagcagg

SEQ ID NO: 45059 - DNA, 20 bp, Artificial Sequence
  sgRNA
  Olfr78_20
gaccaaacagatcagaacac

SEQ ID NO: 45060 - DNA, 20 bp, Artificial Sequence
  sgRNA
  Olfr780_1
tatcattaccctcactacag

SEQ ID NO: 45061 - DNA, 20 bp, Artificial Sequence
  sgRNA
  Olfr780_2
aggtgaaaccccaaactcag

SEQ ID NO: 45062 - DNA, 20 bp, Artificial Sequence
  sgRNA
  Olfr780_3
gtataagaatcttgggacac

SEQ ID NO: 45063 - DNA, 20 bp, Artificial Sequence
  sgRNA
  Olfr780_4
aaatatcgtgctcagacacg

SEQ ID NO: 45064 - DNA, 20 bp, Artificial Sequence
  sgRNA
  Olfr780_5
gtagggatccactgtagtga

SEQ ID NO: 45065 - DNA, 20 bp, Artificial Sequence
  sgRNA
  Olfr780_6
catgtcatatgaccgctacg

SEQ ID NO: 45066 - DNA, 20 bp, Artificial Sequence
  sgRNA
  Olfr780_7
agttaccagttacactcaat

SEQ ID NO: 45067 - DNA, 20 bp, Artificial Sequence
  sgRNA
  Olfr780_8
gatcatcagtgagtcccagg

SEQ ID NO: 45068 - DNA, 20 bp, Artificial Sequence
  sgRNA
  Olfr780_9
tgaatgttgtaattgaagtg

SEQ ID NO: 45069 - DNA, 20 bp, Artificial Sequence
  sgRNA
  Olfr780_10
catgaatgctgccatccaac

SEQ ID NO: 45070 - DNA, 20 bp, Artificial Sequence
  sgRNA
  Olfr780_11
tgagcagatggtaataggct

SEQ ID NO: 45071 - DNA, 20 bp, Artificial Sequence
  sgRNA
  Olfr780_12
ggtagggatccactgtagtg

SEQ ID NO: 45072 - DNA, 20 bp, Artificial Sequence
  sgRNA
  Olfr780_13
attacaacattcatcctcct

SEQ ID NO: 45073 - DNA, 20 bp, Artificial Sequence
  sgRNA
  Olfr780_14
gaagcggtgaccattaataa

SEQ ID NO: 45074 - DNA, 20 bp, Artificial Sequence
  sgRNA
  Olfr780_15
acctacctattgagtgtaac

SEQ ID NO: 45075 - DNA, 20 bp, Artificial Sequence
  sgRNA
  Olfr780_16
ataatgcaaaggtttacaga

SEQ ID NO: 45076 - DNA, 20 bp, Artificial Sequence
  sgRNA
  Olfr780_17
gtttacagatggccacgtag

SEQ ID NO: 45077 - DNA, 20 bp, Artificial Sequence
  sgRNA
  Olfr780_18
caaaccgtctgcaaaagaag

SEQ ID NO: 45078 - DNA, 20 bp, Artificial Sequence
  sgRNA
  Olfr780_19
atgatggtcatataatgcaa

SEQ ID NO: 45079 - DNA, 20 bp, Artificial Sequence
  sgRNA
  Olfr780_20
gaataatggttatctcctgt

SEQ ID NO: 45080 - DNA, 20 bp, Artificial Sequence
  sgRNA
  Olfr782_1
tgacccacaactgcaaattg

SEQ ID NO: 45081 - DNA, 20 bp, Artificial Sequence
  sgRNA
  Olfr782_2
ttcaaacccatggccaatgg

SEQ ID NO: 45082 - DNA, 20 bp, Artificial Sequence
  sgRNA
  Olfr782_3
ttcttgacgaccattgtgac

SEQ ID NO: 45083 - DNA, 20 bp, Artificial Sequence
  sgRNA
  Olfr782_4
tagaacatgagtgtctgtgc

SEQ ID NO: 45084 - DNA, 20 bp, Artificial Sequence
  sgRNA
  Olfr782_5
gtatactaaaccatctgcaa

SEQ ID NO: 45085 - DNA, 20 bp, Artificial Sequence
  sgRNA
  Olfr782_6
tgtatactaaaccatctgca

SEQ ID NO: 45086 - DNA, 20 bp, Artificial Sequence
  sgRNA
  Olfr782_7
aaaccacaatttgcagttgt

SEQ ID NO: 45087 - DNA, 20 bp, Artificial Sequence
  sgRNA
  Olfr782_8
ggaacttgactttattcttt

SEQ ID NO: 45088 - DNA, 20 bp, Artificial Sequence
  sgRNA
  Olfr782_9
aaaaccacaatttgcagttg

SEQ ID NO: 45089 - DNA, 20 bp, Artificial Sequence
  sgRNA
  Olfr786_1
tcacaactgtctgtatacca

SEQ ID NO: 45090 - DNA, 20 bp, Artificial Sequence
  sgRNA
  Olfr786_2
taggaaagaaaccagccagg

SEQ ID NO: 45091 - DNA, 20 bp, Artificial Sequence
  sgRNA
  Olfr786_3
gaaagacaaagatcacaacc

SEQ ID NO: 45092 - DNA, 20 bp, Artificial Sequence
  sgRNA
  Olfr786_4
gaacaggaaagttgaagcag

SEQ ID NO: 45093 - DNA, 20 bp, Artificial Sequence
  sgRNA
  Olfr786_5
gatgctctatctgctgctga

SEQ ID NO: 45094 - DNA, 20 bp, Artificial Sequence
  sgRNA
  Olfr786_6
tagctgccatgtcctatgac

SEQ ID NO: 45095 - DNA, 20 bp, Artificial Sequence
  sgRNA
  Olfr786_7
ataatggtgcccaagaacct

SEQ ID NO: 45096 - DNA, 20 bp, Artificial Sequence
  sgRNA
  Olfr786_8
gatgtaccggtcataggaca

SEQ ID NO: 45097 - DNA, 20 bp, Artificial Sequence
  sgRNA
  Olfr786_9
gcttgcaaatggcgatgtac

SEQ ID NO: 45098 - DNA, 20 bp, Artificial Sequence
  sgRNA
  Olfr786_10
gtctgtataccaaggttctt

SEQ ID NO: 45099 - DNA, 20 bp, Artificial Sequence
  sgRNA
  Olfr786_11
gtaatgcaggggcttgcaaa

SEQ ID NO: 45100 - DNA, 20 bp, Artificial Sequence
  sgRNA
  Olfr786_12
tggtatacagacagttgtga

SEQ ID NO: 45101 - DNA, 20 bp, Artificial Sequence
  sgRNA
  Olfr786_13
gcagaccttctgactcatga

SEQ ID NO: 45102 - DNA, 20 bp, Artificial Sequence
  sgRNA
  Olfr786_14
ctaatgttgcaaaattccta

SEQ ID NO: 45103 - DNA, 20 bp, Artificial Sequence
  sgRNA
  Olfr786_15
aacaggaaagttgaagcaga

SEQ ID NO: 45104 - DNA, 20 bp, Artificial Sequence
  sgRNA
  Olfr786_16
ccatgttcataaacgcttgc

SEQ ID NO: 45105 - DNA, 20 bp, Artificial Sequence
  sgRNA
  Olfr786_17
catgatggtcaggtaatgca

SEQ ID NO: 45106 - DNA, 20 bp, Artificial Sequence
  sgRNA
  Olfr786_18
attcctaaggaagaaataca

SEQ ID NO: 45107 - DNA, 20 bp, Artificial Sequence
  sgRNA
  Olfr786_19
acaaagttcctggagaagat

SEQ ID NO: 45108 - DNA, 20 bp, Artificial Sequence
  sgRNA
  Olfr786_20
tcagaaggtctgcaaaatgt

SEQ ID NO: 45109 - DNA, 20 bp, Artificial Sequence
  sgRNA
  Olfr788_1
ggagcaaaagcataagaggt

SEQ ID NO: 45110 - DNA, 20 bp, Artificial Sequence
  sgRNA
  Olfr788_2
ctgagcaagacagttgcaag

SEQ ID NO: 45111 - DNA, 20 bp, Artificial Sequence
  sgRNA
  Olfr788_3
agaggaaaatcacaatctga

SEQ ID NO: 45112 - DNA, 20 bp, Artificial Sequence
  sgRNA
  Olfr788_4
ttgtagatgggtgtctatga

SEQ ID NO: 45113 - DNA, 20 bp, Artificial Sequence
  sgRNA
  Olfr788_5
gaattccatctaccagccag

SEQ ID NO: 45114 - DNA, 20 bp, Artificial Sequence
  sgRNA
  Olfr788_6
ggcctcattgaccaaaggcg

SEQ ID NO: 45115 - DNA, 20 bp, Artificial Sequence
  sgRNA
  Olfr788_7
atatacagcttccataagag

SEQ ID NO: 45116 - DNA, 20 bp, Artificial Sequence
  sgRNA
  Olfr788_8
ggtcatcagaaaggcctaag

SEQ ID NO: 45117 - DNA, 20 bp, Artificial Sequence
  sgRNA
  Olfr788_9
tatacagcttccataagaga

SEQ ID NO: 45118 - DNA, 20 bp, Artificial Sequence
  sgRNA
  Olfr788_10
atttaacatggggacaacag

SEQ ID NO: 45119 - DNA, 20 bp, Artificial Sequence
  sgRNA
  Olfr788_11
ccaagaaagcaaaattccgg

SEQ ID NO: 45120 - DNA, 20 bp, Artificial Sequence
  sgRNA
  Olfr788_12
tgctggagcaaaagcataag

SEQ ID NO: 45121 - DNA, 20 bp, Artificial Sequence
  sgRNA
  Olfr788_13
tgagcaagacagttgcaaga

SEQ ID NO: 45122 - DNA, 20 bp, Artificial Sequence
  sgRNA
  Olfr788_14
gcagagtttcctgttcatga

SEQ ID NO: 45123 - DNA, 20 bp, Artificial Sequence
  sgRNA
  Olfr788_15
ccaggcacacaacacaaaca

SEQ ID NO: 45124 - DNA, 20 bp, Artificial Sequence
  sgRNA
  Olfr788_16
gtagtgaaggggcttacaga

SEQ ID NO: 45125 - DNA, 20 bp, Artificial Sequence
  sgRNA
  Olfr788_17
gcttacagatggcaacatag

SEQ ID NO: 45126 - DNA, 20 bp, Artificial Sequence
  sgRNA
  Olfr788_18
ggttgctcttctgttcactt

SEQ ID NO: 45127 - DNA, 20 bp, Artificial Sequence
  sgRNA
  Olfr788_19
tatgtatccctagatttctg

SEQ ID NO: 45128 - DNA, 20 bp, Artificial Sequence
  sgRNA
  Olfr788_20
tcttctgttcactttggcat

SEQ ID NO: 45129 - DNA, 20 bp, Artificial Sequence
  sgRNA
  Olfr790_1
agacaagaagaatgcacaca

SEQ ID NO: 45130 - DNA, 20 bp, Artificial Sequence
  sgRNA
  Olfr790_2
atacatgggtgtcatcagat

SEQ ID NO: 45131 - DNA, 20 bp, Artificial Sequence
  sgRNA
  Olfr790_3
aaaaccacaatctgccacag

SEQ ID NO: 45132 - DNA, 20 bp, Artificial Sequence
  sgRNA
  Olfr790_4
tatttcctacaatggttgcg

SEQ ID NO: 45133 - DNA, 20 bp, Artificial Sequence
  sgRNA
  Olfr790_5
ctaggagtgagaaatttcga

SEQ ID NO: 45134 - DNA, 20 bp, Artificial Sequence
  sgRNA
  Olfr790_6
tgtacattaagccttctgca

SEQ ID NO: 45135 - DNA, 20 bp, Artificial Sequence
  sgRNA
  Olfr790_7
gagagggtgactttaagcaa

SEQ ID NO: 45136 - DNA, 20 bp, Artificial Sequence
  sgRNA
  Olfr790_8
tcatcagatgggcatctgag

SEQ ID NO: 45137 - DNA, 20 bp, Artificial Sequence
  sgRNA
  Olfr790_9
catcagatgggcatctgaga

SEQ ID NO: 45138 - DNA, 20 bp, Artificial Sequence
  sgRNA
  Olfr790_10
ttaagccttctgcaagggag

SEQ ID NO: 45139 - DNA, 20 bp, Artificial Sequence
  sgRNA
  Olfr790_11
tgtaacagaaggataattgg

SEQ ID NO: 45140 - DNA, 20 bp, Artificial Sequence
  sgRNA
  Olfr790_12
gtacattaagccttctgcaa

SEQ ID NO: 45141 - DNA, 20 bp, Artificial Sequence
  sgRNA
  Olfr790_13
agatgcagctgccataagag

SEQ ID NO: 45142 - DNA, 20 bp, Artificial Sequence
  sgRNA
  Olfr790_14
ggagacaactatcatatggg

SEQ ID NO: 45143 - DNA, 20 bp, Artificial Sequence
  sgRNA
  Olfr790_15
gacagaactatttcctacaa

SEQ ID NO: 45144 - DNA, 20 bp, Artificial Sequence
  sgRNA
  Olfr790_16
gagaagagtcacagataaag

SEQ ID NO: 45145 - DNA, 20 bp, Artificial Sequence
  sgRNA
  Olfr790_17
agagggagacaactatcata

SEQ ID NO: 45146 - DNA, 20 bp, Artificial Sequence
  sgRNA
  Olfr790_18
gatgcagctgccataagaga

SEQ ID NO: 45147 - DNA, 20 bp, Artificial Sequence
  sgRNA
  Olfr790_19
gactgacagatgatccactg

SEQ ID NO: 45148 - DNA, 20 bp, Artificial Sequence
  sgRNA
  Olfr790_20
taagccttctgcaagggaga

SEQ ID NO: 45149 - DNA, 20 bp, Artificial Sequence
  sgRNA
  Olfr791_1
gattatcatcatccttacgt

SEQ ID NO: 45150 - DNA, 20 bp, Artificial Sequence
  sgRNA
  Olfr791_2
actagtaagatacacaccct

SEQ ID NO: 45151 - DNA, 20 bp, Artificial Sequence
  sgRNA
  Olfr791_3
gatctcgtgctcagacacat

SEQ ID NO: 45152 - DNA, 20 bp, Artificial Sequence
  sgRNA
  Olfr791_4
tggaggcccaagataagagg

SEQ ID NO: 45153 - DNA, 20 bp, Artificial Sequence
  sgRNA
  Olfr791_5
gagcacgagatcttcagaag

SEQ ID NO: 45154 - DNA, 20 bp, Artificial Sequence
  sgRNA
  Olfr791_6
ctagtaagatacacaccctg

SEQ ID NO: 45155 - DNA, 20 bp, Artificial Sequence
  sgRNA
  Olfr791_7
taaaggttgttattgacgag

SEQ ID NO: 45156 - DNA, 20 bp, Artificial Sequence
  sgRNA
  Olfr791_8
gatggggatccaccaacgta

SEQ ID NO: 45157 - DNA, 20 bp, Artificial Sequence
  sgRNA
  Olfr791_9
tgagcacgagatcttcagaa

SEQ ID NO: 45158 - DNA, 20 bp, Artificial Sequence
  sgRNA
  Olfr791_10
gccacttcatccttagccga

SEQ ID NO: 45159 - DNA, 20 bp, Artificial Sequence
  sgRNA
  Olfr791_11
acacaccctggggttcatga

SEQ ID NO: 45160 - DNA, 20 bp, Artificial Sequence
  sgRNA
  Olfr791_12
ggtcatctgttagtcccaga

SEQ ID NO: 45161 - DNA, 20 bp, Artificial Sequence
  sgRNA
  Olfr791_13
gctgaaatgatcaatggcat

SEQ ID NO: 45162 - DNA, 20 bp, Artificial Sequence
  sgRNA
  Olfr791_14
cttcatctacatcaagccat

SEQ ID NO: 45163 - DNA, 20 bp, Artificial Sequence
  sgRNA
  Olfr791_15
atcacagctgaaatgatcaa

SEQ ID NO: 45164 - DNA, 20 bp, Artificial Sequence
  sgRNA
  Olfr791_16
tcagcatgtatgtaagaaat

SEQ ID NO: 45165 - DNA, 20 bp, Artificial Sequence
  sgRNA
  Olfr791_17
gatagaaaccacaatcatat

SEQ ID NO: 45166 - DNA, 20 bp, Artificial Sequence
  sgRNA
  Olfr791_18
tatgaccatcatgaacccca

SEQ ID NO: 45167 - DNA, 20 bp, Artificial Sequence
  sgRNA
  Olfr791_19
atgatggtcatataatgaag

SEQ ID NO: 45168 - DNA, 20 bp, Artificial Sequence
  sgRNA
  Olfr791_20
ctaggaaagaaaaatttctg

SEQ ID NO: 45169 - DNA, 20 bp, Artificial Sequence
  sgRNA
  Olfr796_1
ctctaccctaatgaaccacc

SEQ ID NO: 45170 - DNA, 20 bp, Artificial Sequence
  sgRNA
  Olfr796_2
cctgcgccatctttccatgg

SEQ ID NO: 45171 - DNA, 20 bp, Artificial Sequence
  sgRNA
  Olfr796_3
gacagcactctgagataccc

SEQ ID NO: 45172 - DNA, 20 bp, Artificial Sequence
  sgRNA
  Olfr796_4
gtgacatcctgccagtactg

SEQ ID NO: 45173 - DNA, 20 bp, Artificial Sequence
  sgRNA
  Olfr796_5
tatcacctctttgttccgga

SEQ ID NO: 45174 - DNA, 20 bp, Artificial Sequence
  sgRNA
  Olfr796_6
ccatggctatgcaggcccgg

SEQ ID NO: 45175 - DNA, 20 bp, Artificial Sequence
  sgRNA
  Olfr796_7
ttctagccagagccgccgca

SEQ ID NO: 45176 - DNA, 20 bp, Artificial Sequence
  sgRNA
  Olfr796_8
ggtgtagagaagctccacca

SEQ ID NO: 45177 - DNA, 20 bp, Artificial Sequence
  sgRNA
  Olfr796_9
accccatcatctataccctc

SEQ ID NO: 45178 - DNA, 20 bp, Artificial Sequence
  sgRNA
  Olfr796_10
gcgcaggaagaaatacatgg

SEQ ID NO: 45179 - DNA, 20 bp, Artificial Sequence
  sgRNA
  Olfr796_11
gctgacagatggctgcataa

SEQ ID NO: 45180 - DNA, 20 bp, Artificial Sequence
  sgRNA
  Olfr796_12
gtactggcaggatgtcacag

SEQ ID NO: 45181 - DNA, 20 bp, Artificial Sequence
  sgRNA
  Olfr796_13
ccttagtctcttctacacag

SEQ ID NO: 45182 - DNA, 20 bp, Artificial Sequence
  sgRNA
  Olfr796_14
attagggtagagtagtgcag

SEQ ID NO: 45183 - DNA, 20 bp, Artificial Sequence
  sgRNA
  Olfr796_15
gcaggcccggtggttcatta

SEQ ID NO: 45184 - DNA, 20 bp, Artificial Sequence
  sgRNA
  Olfr796_16
gatccatgaagttcccacca

SEQ ID NO: 45185 - DNA, 20 bp, Artificial Sequence
  sgRNA
  Olfr796_17
ctataccctccggaacaaag

SEQ ID NO: 45186 - DNA, 20 bp, Artificial Sequence
  sgRNA
  Olfr796_18
tctggctagaagcaattgcc

SEQ ID NO: 45187 - DNA, 20 bp, Artificial Sequence
  sgRNA
  Olfr796_19
ggatgtcacagaggaagtgt

SEQ ID NO: 45188 - DNA, 20 bp, Artificial Sequence
  sgRNA
  Olfr796_20
cttgtggtctccctcttctt

SEQ ID NO: 45189 - DNA, 20 bp, Artificial Sequence
  sgRNA
  Olfr8_1
gtacaagattcattatgagg

SEQ ID NO: 45190 - DNA, 20 bp, Artificial Sequence
  sgRNA
  Olfr8_2
aagtacatgggtgtgtgcag

SEQ ID NO: 45191 - DNA, 20 bp, Artificial Sequence
  sgRNA
  Olfr8_3
acaatgaatgtgtaatacaa

SEQ ID NO: 45192 - DNA, 20 bp, Artificial Sequence
  sgRNA
  Olfr8_4
agctctgtaagaaggcatgt

SEQ ID NO: 45193 - DNA, 20 bp, Artificial Sequence
  sgRNA
  Olfr8_5
gctctggagaggctattaga

SEQ ID NO: 45194 - DNA, 20 bp, Artificial Sequence
  sgRNA
  Olfr8_6
cgtgtacttcccttgaactg

SEQ ID NO: 45195 - DNA, 20 bp, Artificial Sequence
  sgRNA
  Olfr8_7
actataaaataagaagacaa

SEQ ID NO: 45196 - DNA, 20 bp, Artificial Sequence
  sgRNA
  Olfr8_8
ccaacatctctgtatactga

SEQ ID NO: 45197 - DNA, 20 bp, Artificial Sequence
  sgRNA
  Olfr8_9
atgtgaagaaagctctggag

SEQ ID NO: 45198 - DNA, 20 bp, Artificial Sequence
  sgRNA
  Olfr8_10
caatgaatgtgtaatacaat

SEQ ID NO: 45199 - DNA, 20 bp, Artificial Sequence
  sgRNA
  Olfr8_11
ccatcagtatacagagatgt

SEQ ID NO: 45200 - DNA, 20 bp, Artificial Sequence
  sgRNA
  Olfr8_12
taaagatgtgaagaaagctc

SEQ ID NO: 45201 - DNA, 20 bp, Artificial Sequence
  sgRNA
  Olfr8_13
caggtacaagattcattatg

SEQ ID NO: 45202 - DNA, 20 bp, Artificial Sequence
  sgRNA
  Olfr8_14
tgatgaccatgatgatgagc

SEQ ID NO: 45203 - DNA, 20 bp, Artificial Sequence
  sgRNA
  Olfr8_15
aaaataagaagacaatggaa

SEQ ID NO: 45204 - DNA, 20 bp, Artificial Sequence
  sgRNA
  Olfr802_1
taagaacttgggtatagtga

SEQ ID NO: 45205 - DNA, 20 bp, Artificial Sequence
  sgRNA
  Olfr802_2
cctgactatcatgagtcaga

SEQ ID NO: 45206 - DNA, 20 bp, Artificial Sequence
  sgRNA
  Olfr802_3
cagatacaaagttcctggag

SEQ ID NO: 45207 - DNA, 20 bp, Artificial Sequence
  sgRNA
  Olfr802_4
aaaattcagtgactcccaaa

SEQ ID NO: 45208 - DNA, 20 bp, Artificial Sequence
  sgRNA
  Olfr802_5
gatgctctatctgtagctga

SEQ ID NO: 45209 - DNA, 20 bp, Artificial Sequence
  sgRNA
  Olfr802_6
ataatggtgcctaagaactt

SEQ ID NO: 45210 - DNA, 20 bp, Artificial Sequence
  sgRNA
  Olfr802_7
aagcctttatgaacatgaca

SEQ ID NO: 45211 - DNA, 20 bp, Artificial Sequence
  sgRNA
  Olfr802_8
catgatagtcaggtaatgca

SEQ ID NO: 45212 - DNA, 20 bp, Artificial Sequence
  sgRNA
  Olfr802_9
gggtatagtgacggttgtga

SEQ ID NO: 45213 - DNA, 20 bp, Artificial Sequence
  sgRNA
  Olfr802_10
tgaactctgtagtttctgta

SEQ ID NO: 45214 - DNA, 20 bp, Artificial Sequence
  sgRNA
  Olfr802_11
cttaggcaccattatctcag

SEQ ID NO: 45215 - DNA, 20 bp, Artificial Sequence
  sgRNA
  Olfr802_12
gtcactatacccaagttctt

SEQ ID NO: 45216 - DNA, 20 bp, Artificial Sequence
  sgRNA
  Olfr802_13
tcttaggcaccattatctca

SEQ ID NO: 45217 - DNA, 20 bp, Artificial Sequence
  sgRNA
  Olfr802_14
cattagggtaaaaacagcac

SEQ ID NO: 45218 - DNA, 20 bp, Artificial Sequence
  sgRNA
  Olfr802_15
atgatagtcaggtaatgcag

SEQ ID NO: 45219 - DNA, 20 bp, Artificial Sequence
  sgRNA
  Olfr802_16
taggaaagaagtcagccagg

SEQ ID NO: 45220 - DNA, 20 bp, Artificial Sequence
  sgRNA
  Olfr802_17
ttaacaccaaagttaacatt

SEQ ID NO: 45221 - DNA, 20 bp, Artificial Sequence
  sgRNA
  Olfr802_18
gtaatgcaggggcttgcaga

SEQ ID NO: 45222 - DNA, 20 bp, Artificial Sequence
  sgRNA
  Olfr802_19
aagcaaggggaaataatcac

SEQ ID NO: 45223 - DNA, 20 bp, Artificial Sequence
  sgRNA
  Olfr802_20
gataatggtgcctaagaact

SEQ ID NO: 45224 - DNA, 20 bp, Artificial Sequence
  sgRNA
  Olfr804_1
ttcagacccatggccaatgg

SEQ ID NO: 45225 - DNA, 20 bp, Artificial Sequence
  sgRNA
  Olfr804_2
tatgacatgagtgtctgtgc

SEQ ID NO: 45226 - DNA, 20 bp, Artificial Sequence
  sgRNA
  Olfr804_3
aaaccacaatttgcaactgt

SEQ ID NO: 45227 - DNA, 20 bp, Artificial Sequence
  sgRNA
  Olfr804_4
acggagaaagaaatacattg

SEQ ID NO: 45228 - DNA, 20 bp, Artificial Sequence
  sgRNA
  Olfr804_5
tgtgaacatgatttccagat

SEQ ID NO: 45229 - DNA, 20 bp, Artificial Sequence
  sgRNA
  Olfr804_6
tgacccacagttgcaaattg

SEQ ID NO: 45230 - DNA, 20 bp, Artificial Sequence
  sgRNA
  Olfr804_7
gatatattacgaaagacttt

SEQ ID NO: 45231 - DNA, 20 bp, Artificial Sequence
  sgRNA
  Olfr804_8
caattacatgatgagcttgg

SEQ ID NO: 45232 - DNA, 20 bp, Artificial Sequence
  sgRNA
  Olfr804_9
tctcaattacatgatgagct

SEQ ID NO: 45233 - DNA, 20 bp, Artificial Sequence
  sgRNA
  Olfr804_10
gcttcagacccatggccaat

SEQ ID NO: 45234 - DNA, 20 bp, Artificial Sequence
  sgRNA
  Olfr804_11
attacatgatgagcttggtg

SEQ ID NO: 45235 - DNA, 20 bp, Artificial Sequence
  sgRNA
  Olfr804_12
gaaatccagcttcagaccca

SEQ ID NO: 45236 - DNA, 20 bp, Artificial Sequence
  sgRNA
  Olfr804_13
aaatgaaaggattcaggaga

SEQ ID NO: 45237 - DNA, 20 bp, Artificial Sequence
  sgRNA
  Olfr804_14
attggccatgggtctgaagc

SEQ ID NO: 45238 - DNA, 20 bp, Artificial Sequence
  sgRNA
  Olfr804_15
tttccagataggagaaatta

SEQ ID NO: 45239 - DNA, 20 bp, Artificial Sequence
  sgRNA
  Olfr804_16
acaatggctgtcaagaattt

SEQ ID NO: 45240 - DNA, 20 bp, Artificial Sequence
  sgRNA
  Olfr804_17
ggatatattacgaaagactt

SEQ ID NO: 45241 - DNA, 20 bp, Artificial Sequence
  sgRNA
  Olfr804_18
aattacatgatgagcttggt

SEQ ID NO: 45242 - DNA, 20 bp, Artificial Sequence
  sgRNA
  Olfr804_19
aatgaaaggattcaggagag

SEQ ID NO: 45243 - DNA, 20 bp, Artificial Sequence
  sgRNA
  Olfr804_20
tacggagaaagaaatacatt

SEQ ID NO: 45244 - DNA, 20 bp, Artificial Sequence
  sgRNA
  Olfr808_1
tgaaggcccatgattacagg

SEQ ID NO: 45245 - DNA, 20 bp, Artificial Sequence
  sgRNA
  Olfr808_2
gtgaacattcgacagtgtca

SEQ ID NO: 45246 - DNA, 20 bp, Artificial Sequence
  sgRNA
  Olfr808_3
ttctgatcagcatcattaca

SEQ ID NO: 45247 - DNA, 20 bp, Artificial Sequence
  sgRNA
  Olfr808_4
atatcacaatttgtaactct

SEQ ID NO: 45248 - DNA, 20 bp, Artificial Sequence
  sgRNA
  Olfr808_5
tttgacttgctggttcctta

SEQ ID NO: 45249 - DNA, 20 bp, Artificial Sequence
  sgRNA
  Olfr808_6
gtatcttcagaattgttcta

SEQ ID NO: 45250 - DNA, 20 bp, Artificial Sequence
  sgRNA
  Olfr808_7
tgtgcaagcgatctgcagca

SEQ ID NO: 45251 - DNA, 20 bp, Artificial Sequence
  sgRNA
  Olfr808_8
acatacctactgagtgtaag

SEQ ID NO: 45252 - DNA, 20 bp, Artificial Sequence
  sgRNA
  Olfr808_9
atgatagctgtatagtgcag

SEQ ID NO: 45253 - DNA, 20 bp, Artificial Sequence
  sgRNA
  Olfr808_10
ctgaaggcccatgattacag

SEQ ID NO: 45254 - DNA, 20 bp, Artificial Sequence
  sgRNA
  Olfr808_11
tgtgtaggacagaatgacca

SEQ ID NO: 45255 - DNA, 20 bp, Artificial Sequence
  sgRNA
  Olfr808_12
gctgaaggcccatgattaca

SEQ ID NO: 45256 - DNA, 20 bp, Artificial Sequence
  sgRNA
  Olfr808_13
gaaggtgtggtgctaagtaa

SEQ ID NO: 45257 - DNA, 20 bp, Artificial Sequence
  sgRNA
  Olfr808_14
gaggaatccagctgaccaag

SEQ ID NO: 45258 - DNA, 20 bp, Artificial Sequence
  sgRNA
  Olfr808_15
cgacagtgtcagggtaatga

SEQ ID NO: 45259 - DNA, 20 bp, Artificial Sequence
  sgRNA
  Olfr808_16
agataccttctgcagagcaa

SEQ ID NO: 45260 - DNA, 20 bp, Artificial Sequence
  sgRNA
  Olfr808_17
tgtaatcatgggccttcagc

SEQ ID NO: 45261 - DNA, 20 bp, Artificial Sequence
  sgRNA
  Olfr808_18
aatgcagcttccatatgaaa

SEQ ID NO: 45262 - DNA, 20 bp, Artificial Sequence
  sgRNA
  Olfr808_19
ttacagggggaaaaacaatg

SEQ ID NO: 45263 - DNA, 20 bp, Artificial Sequence
  sgRNA
  Olfr808_20
gtgcaagcgatctgcagcat

SEQ ID NO: 45264 - DNA, 20 bp, Artificial Sequence
  sgRNA
  Olfr809_1
ctaagaaggagaaattcctg

SEQ ID NO: 45265 - DNA, 20 bp, Artificial Sequence
  sgRNA
  Olfr809_2
atgatggtcgtatagtgcag

SEQ ID NO: 45266 - DNA, 20 bp, Artificial Sequence
  sgRNA
  Olfr809_3
gagcagagtcacatgtgaag

SEQ ID NO: 45267 - DNA, 20 bp, Artificial Sequence
  sgRNA
  Olfr809_4
agatctaagcccatggccag

SEQ ID NO: 45268 - DNA, 20 bp, Artificial Sequence
  sgRNA
  Olfr809_5
gagaattatcagcatcagcg

SEQ ID NO: 45269 - DNA, 20 bp, Artificial Sequence
  sgRNA
  Olfr809_6
ttacttctgtctgtaatcct

SEQ ID NO: 45270 - DNA, 20 bp, Artificial Sequence
  sgRNA
  Olfr809_7
attgttgtctctatatccta

SEQ ID NO: 45271 - DNA, 20 bp, Artificial Sequence
  sgRNA
  Olfr809_8
tataaagctcataagctcca

SEQ ID NO: 45272 - DNA, 20 bp, Artificial Sequence
  sgRNA
  Olfr809_9
gaaatctagatctaagccca

SEQ ID NO: 45273 - DNA, 20 bp, Artificial Sequence
  sgRNA
  Olfr809_10
tctaagcccatggccagtgg

SEQ ID NO: 45274 - DNA, 20 bp, Artificial Sequence
  sgRNA
  Olfr809_11
caacagtgtgagagtaatga

SEQ ID NO: 45275 - DNA, 20 bp, Artificial Sequence
  sgRNA
  Olfr809_12
tgtgaagtggtcaatagtgt

SEQ ID NO: 45276 - DNA, 20 bp, Artificial Sequence
  sgRNA
  Olfr809_13
cagaatagttctgagaatac

SEQ ID NO: 45277 - DNA, 20 bp, Artificial Sequence
  sgRNA
  Olfr809_14
agtaaatgagatttctaaga

SEQ ID NO: 45278 - DNA, 20 bp, Artificial Sequence
  sgRNA
  Olfr809_15
gacagacgatcctgagcttc

SEQ ID NO: 45279 - DNA, 20 bp, Artificial Sequence
  sgRNA
  Olfr809_16
catcattactctcacactgt

SEQ ID NO: 45280 - DNA, 20 bp, Artificial Sequence
  sgRNA
  Olfr809_17
ttgggcagcacaagcattat

SEQ ID NO: 45281 - DNA, 20 bp, Artificial Sequence
  sgRNA
  Olfr809_18
gtgtgaggagcaggttgaga

SEQ ID NO: 45282 - DNA, 20 bp, Artificial Sequence
  sgRNA
  Olfr809_19
aaaatcacaacctgaagctc

SEQ ID NO: 45283 - DNA, 20 bp, Artificial Sequence
  sgRNA
  Olfr809_20
agagacaacaatcatgtgtg

SEQ ID NO: 45284 - DNA, 20 bp, Artificial Sequence
  sgRNA
  Olfr813_1
gaaatctagctctaaaccca

SEQ ID NO: 45285 - DNA, 20 bp, Artificial Sequence
  sgRNA
  Olfr813_2
agatgctgaccaaaaaccta

SEQ ID NO: 45286 - DNA, 20 bp, Artificial Sequence
  sgRNA
  Olfr813_3
ctaggaaggagaaattcctg

SEQ ID NO: 45287 - DNA, 20 bp, Artificial Sequence
  sgRNA
  Olfr813_4
gacagacgatcctgagcttg

SEQ ID NO: 45288 - DNA, 20 bp, Artificial Sequence
  sgRNA
  Olfr813_5
ttacttctgtctgtaaccct

SEQ ID NO: 45289 - DNA, 20 bp, Artificial Sequence
  sgRNA
  Olfr813_6
attgttatctccatatccta

SEQ ID NO: 45290 - DNA, 20 bp, Artificial Sequence
  sgRNA
  Olfr813_7
aagaattatcagcatcaggg

SEQ ID NO: 45291 - DNA, 20 bp, Artificial Sequence
  sgRNA
  Olfr813_8
tctaaacccatggccagtgg

SEQ ID NO: 45292 - DNA, 20 bp, Artificial Sequence
  sgRNA
  Olfr813_9
ggagataacaatcatatgtg

SEQ ID NO: 45293 - DNA, 20 bp, Artificial Sequence
  sgRNA
  Olfr813_10
gagcagagtcacaagtgaag

SEQ ID NO: 45294 - DNA, 20 bp, Artificial Sequence
  sgRNA
  Olfr813_11
atgatggttgtatagtgcag

SEQ ID NO: 45295 - DNA, 20 bp, Artificial Sequence
  sgRNA
  Olfr813_12
cagcagtgtgagagtaatga

SEQ ID NO: 45296 - DNA, 20 bp, Artificial Sequence
  sgRNA
  Olfr813_13
agctctaaacccatggccag

SEQ ID NO: 45297 - DNA, 20 bp, Artificial Sequence
  sgRNA
  Olfr813_14
gatgcagcttccataggata

SEQ ID NO: 45298 - DNA, 20 bp, Artificial Sequence
  sgRNA
  Olfr813_15
tataaagctcatgagctcca

SEQ ID NO: 45299 - DNA, 20 bp, Artificial Sequence
  sgRNA
  Olfr813_16
agtaaatgagatttctagga

SEQ ID NO: 45300 - DNA, 20 bp, Artificial Sequence
  sgRNA
  Olfr813_17
catcattactctcacactgc

SEQ ID NO: 45301 - DNA, 20 bp, Artificial Sequence
  sgRNA
  Olfr813_18
agtgaagtggtcaataatgt

SEQ ID NO: 45302 - DNA, 20 bp, Artificial Sequence
  sgRNA
  Olfr813_19
aagaaagaattatcagcatc

SEQ ID NO: 45303 - DNA, 20 bp, Artificial Sequence
  sgRNA
  Olfr813_20
agtaatgatggttaaatttc

SEQ ID NO: 45304 - DNA, 20 bp, Artificial Sequence
  sgRNA
  Olfr814_1
gagcaagagagttgtaggag

SEQ ID NO: 45305 - DNA, 20 bp, Artificial Sequence
  sgRNA
  Olfr814_2
attacttgctgagtatgcta

SEQ ID NO: 45306 - DNA, 20 bp, Artificial Sequence
  sgRNA
  Olfr814_3
tttaatcactattgtaacac

SEQ ID NO: 45307 - DNA, 20 bp, Artificial Sequence
  sgRNA
  Olfr814_4
tcaaggccaataatcagtgg

SEQ ID NO: 45308 - DNA, 20 bp, Artificial Sequence
  sgRNA
  Olfr814_5
tgacaatgtgagcataagaa

SEQ ID NO: 45309 - DNA, 20 bp, Artificial Sequence
  sgRNA
  Olfr814_6
ctaagaaagagaaattacgg

SEQ ID NO: 45310 - DNA, 20 bp, Artificial Sequence
  sgRNA
  Olfr814_7
gattgtctgtcagtccaaga

SEQ ID NO: 45311 - DNA, 20 bp, Artificial Sequence
  sgRNA
  Olfr814_8
tgtctgagcaagagagttgt

SEQ ID NO: 45312 - DNA, 20 bp, Artificial Sequence
  sgRNA
  Olfr814_9
cacaagtttactagaagtga

SEQ ID NO: 45313 - DNA, 20 bp, Artificial Sequence
  sgRNA
  Olfr814_10
ttctgctcagcaaaagaaaa

SEQ ID NO: 45314 - DNA, 20 bp, Artificial Sequence
  sgRNA
  Olfr814_11
ttgacaaaaacagccattat

SEQ ID NO: 45315 - DNA, 20 bp, Artificial Sequence
  sgRNA
  Olfr814_12
tttctaagaaagagaaatta

SEQ ID NO: 45316 - DNA, 20 bp, Artificial Sequence
  sgRNA
  Olfr814_13
acaatagtgattaaaaatct

SEQ ID NO: 45317 - DNA, 20 bp, Artificial Sequence
  sgRNA
  Olfr814_14
tacaatagtgattaaaaatc

SEQ ID NO: 45318 - DNA, 20 bp, Artificial Sequence
  sgRNA
  Olfr815_1
gattatctgtcagtccaaga

SEQ ID NO: 45319 - DNA, 20 bp, Artificial Sequence
  sgRNA
  Olfr815_2
aaatcaaggccaataatcag

SEQ ID NO: 45320 - DNA, 20 bp, Artificial Sequence
  sgRNA
  Olfr815_3
ccaagaaagagaaattacgg

SEQ ID NO: 45321 - DNA, 20 bp, Artificial Sequence
  sgRNA
  Olfr815_4
attacttgctgagtatgctc

SEQ ID NO: 45322 - DNA, 20 bp, Artificial Sequence
  sgRNA
  Olfr815_5
gagctaagatgaaagccatc

SEQ ID NO: 45323 - DNA, 20 bp, Artificial Sequence
  sgRNA
  Olfr815_6
tgtttgagcaagagagctgt

SEQ ID NO: 45324 - DNA, 20 bp, Artificial Sequence
  sgRNA
  Olfr815_7
gagcaagagagctgtaggag

SEQ ID NO: 45325 - DNA, 20 bp, Artificial Sequence
  sgRNA
  Olfr815_8
tttaatctctattgtaacac

SEQ ID NO: 45326 - DNA, 20 bp, Artificial Sequence
  sgRNA
  Olfr815_9
tttccaagaaagagaaatta

SEQ ID NO: 45327 - DNA, 20 bp, Artificial Sequence
  sgRNA
  Olfr815_10
cacaaatttactagacctga

SEQ ID NO: 45328 - DNA, 20 bp, Artificial Sequence
  sgRNA
  Olfr815_11
cctccgtaatttctctttct

SEQ ID NO: 45329 - DNA, 20 bp, Artificial Sequence
  sgRNA
  Olfr815_12
ttctgttcagcaaaagaaaa

SEQ ID NO: 45330 - DNA, 20 bp, Artificial Sequence
  sgRNA
  Olfr815_13
acaatagagattaaaaatct

SEQ ID NO: 45331 - DNA, 20 bp, Artificial Sequence
  sgRNA
  Olfr815_14
ttgacaaacacagccattat

SEQ ID NO: 45332 - DNA, 20 bp, Artificial Sequence
  sgRNA
  Olfr815_15
tacaatagagattaaaaatc

SEQ ID NO: 45333 - DNA, 20 bp, Artificial Sequence
  sgRNA
  Olfr815_16
agggaatttcataattgtct

SEQ ID NO: 45334 - DNA, 20 bp, Artificial Sequence
  sgRNA
  Olfr821_1
aatctagctggagacccatg

SEQ ID NO: 45335 - DNA, 20 bp, Artificial Sequence
  sgRNA
  Olfr821_2
cccctgtggccatactaaca

SEQ ID NO: 45336 - DNA, 20 bp, Artificial Sequence
  sgRNA
  Olfr821_3
ctaaaaatgagaagtttcgt

SEQ ID NO: 45337 - DNA, 20 bp, Artificial Sequence
  sgRNA
  Olfr821_4
agatgatctacaactgcaag

SEQ ID NO: 45338 - DNA, 20 bp, Artificial Sequence
  sgRNA
  Olfr821_5
catacatgctgagtgttact

SEQ ID NO: 45339 - DNA, 20 bp, Artificial Sequence
  sgRNA
  Olfr821_6
ttaagaatatgacaaaaaga

SEQ ID NO: 45340 - DNA, 20 bp, Artificial Sequence
  sgRNA
  Olfr821_7
ttctacatgttcttcccaca

SEQ ID NO: 45341 - DNA, 20 bp, Artificial Sequence
  sgRNA
  Olfr821_8
tggctgcacagaaatctagc

SEQ ID NO: 45342 - DNA, 20 bp, Artificial Sequence
  sgRNA
  Olfr821_9
gatgcagctgccataagaaa

SEQ ID NO: 45343 - DNA, 20 bp, Artificial Sequence
  sgRNA
  Olfr821_10
gcatgtatgtgagaaagaga

SEQ ID NO: 45344 - DNA, 20 bp, Artificial Sequence
  sgRNA
  Olfr821_11
tttctaagtgtataaatgaa

SEQ ID NO: 45345 - DNA, 20 bp, Artificial Sequence
  sgRNA
  Olfr821_12
gttgtggtgtccatttctta

SEQ ID NO: 45346 - DNA, 20 bp, Artificial Sequence
  sgRNA
  Olfr821_13
tccttgttagtatggccaca

SEQ ID NO: 45347 - DNA, 20 bp, Artificial Sequence
  sgRNA
  Olfr821_14
ggagacccatgaggagtgga

SEQ ID NO: 45348 - DNA, 20 bp, Artificial Sequence
  sgRNA
  Olfr821_15
ccttgttagtatggccacag

SEQ ID NO: 45349 - DNA, 20 bp, Artificial Sequence
  sgRNA
  Olfr821_16
tgaatactgtcaccgttgtg

SEQ ID NO: 45350 - DNA, 20 bp, Artificial Sequence
  sgRNA
  Olfr821_17
aatggacaccacaaccatgt

SEQ ID NO: 45351 - DNA, 20 bp, Artificial Sequence
  sgRNA
  Olfr821_18
aaatggacaccacaaccatg

SEQ ID NO: 45352 - DNA, 20 bp, Artificial Sequence
  sgRNA
  Olfr821_19
tgtaaccaagagtgtcaaaa

SEQ ID NO: 45353 - DNA, 20 bp, Artificial Sequence
  sgRNA
  Olfr821_20
ataaatgaagggattcaaca

SEQ ID NO: 45354 - DNA, 20 bp, Artificial Sequence
  sgRNA
  Olfr825_1
gaacaggagagtctctgaag

SEQ ID NO: 45355 - DNA, 20 bp, Artificial Sequence
  sgRNA
  Olfr825_2
caataacagatgagtagaag

SEQ ID NO: 45356 - DNA, 20 bp, Artificial Sequence
  sgRNA
  Olfr825_3
taatgatggccatcatccca

SEQ ID NO: 45357 - DNA, 20 bp, Artificial Sequence
  sgRNA
  Olfr825_4
atgtgaacagaatacaggag

SEQ ID NO: 45358 - DNA, 20 bp, Artificial Sequence
  sgRNA
  Olfr825_5
acagcacactcacgacaccc

SEQ ID NO: 45359 - DNA, 20 bp, Artificial Sequence
  sgRNA
  Olfr825_6
ctagagaagaaaaaatgcag

SEQ ID NO: 45360 - DNA, 20 bp, Artificial Sequence
  sgRNA
  Olfr825_7
acaatgatgactgtgatagt

SEQ ID NO: 45361 - DNA, 20 bp, Artificial Sequence
  sgRNA
  Olfr825_8
gccgactatcacagtaaaag

SEQ ID NO: 45362 - DNA, 20 bp, Artificial Sequence
  sgRNA
  Olfr825_9
ggtgtcgtgagtgtgctgta

SEQ ID NO: 45363 - DNA, 20 bp, Artificial Sequence
  sgRNA
  Olfr825_10
gtgtatgaaaatgtcagaac

SEQ ID NO: 45364 - DNA, 20 bp, Artificial Sequence
  sgRNA
  Olfr825_11
agcaagtctatctcatttgc

SEQ ID NO: 45365 - DNA, 20 bp, Artificial Sequence
  sgRNA
  Olfr825_12
acagtgcaaagagaaagatc

SEQ ID NO: 45366 - DNA, 20 bp, Artificial Sequence
  sgRNA
  Olfr825_13
cagtgcaaagagaaagatct

SEQ ID NO: 45367 - DNA, 20 bp, Artificial Sequence
  sgRNA
  Olfr825_14
tatctcatttgcaggctgtg

SEQ ID NO: 45368 - DNA, 20 bp, Artificial Sequence
  sgRNA
  Olfr826_1
cacacagcctgcaaatgaga

SEQ ID NO: 45369 - DNA, 20 bp, Artificial Sequence
  sgRNA
  Olfr826_2
gtcgagtatcacagtaaaag

SEQ ID NO: 45370 - DNA, 20 bp, Artificial Sequence
  sgRNA
  Olfr826_3
aatgatgctggataatgaaa

SEQ ID NO: 45371 - DNA, 20 bp, Artificial Sequence
  sgRNA
  Olfr826_4
aaggtttcctagaaggatca

SEQ ID NO: 45372 - DNA, 20 bp, Artificial Sequence
  sgRNA
  Olfr826_5
acagcacactcacaacaccc

SEQ ID NO: 45373 - DNA, 20 bp, Artificial Sequence
  sgRNA
  Olfr826_6
acaatgatgactatgacagt

SEQ ID NO: 45374 - DNA, 20 bp, Artificial Sequence
  sgRNA
  Olfr826_7
ggtgttgtgagtgtgctgta

SEQ ID NO: 45375 - DNA, 20 bp, Artificial Sequence
  sgRNA
  Olfr826_8
ttacaagataatctctgaac

SEQ ID NO: 45376 - DNA, 20 bp, Artificial Sequence
  sgRNA
  Olfr826_9
agttggtaagataatgatgc

SEQ ID NO: 45377 - DNA, 20 bp, Artificial Sequence
  sgRNA
  Olfr826_10
agcaagtccatctcatttgc

SEQ ID NO: 45378 - DNA, 20 bp, Artificial Sequence
  sgRNA
  Olfr826_11
catctcatttgcaggctgtg

SEQ ID NO: 45379 - DNA, 20 bp, Artificial Sequence
  sgRNA
  Olfr828_1
atcatgaatcctcaaacctg

SEQ ID NO: 45380 - DNA, 20 bp, Artificial Sequence
  sgRNA
  Olfr828_2
ttcaaaactacaaaaaagca

SEQ ID NO: 45381 - DNA, 20 bp, Artificial Sequence
  sgRNA
  Olfr828_3
caagttcacagaaaaatagg

SEQ ID NO: 45382 - DNA, 20 bp, Artificial Sequence
  sgRNA
  Olfr828_4
gtgaacatgctgaagatgag

SEQ ID NO: 45383 - DNA, 20 bp, Artificial Sequence
  sgRNA
  Olfr828_5
cttgaggaagcacatcaata

SEQ ID NO: 45384 - DNA, 20 bp, Artificial Sequence
  sgRNA
  Olfr828_6
gcttaagcagatatcattaa

SEQ ID NO: 45385 - DNA, 20 bp, Artificial Sequence
  sgRNA
  Olfr828_7
tatcagaatataatttacta

SEQ ID NO: 45386 - DNA, 20 bp, Artificial Sequence
  sgRNA
  Olfr828_8
tcataagtcttgtgaatagt

SEQ ID NO: 45387 - DNA, 20 bp, Artificial Sequence
  sgRNA
  Olfr828_9
gatgacatatggcaacatag

SEQ ID NO: 45388 - DNA, 20 bp, Artificial Sequence
  sgRNA
  Olfr828_10
ataaagcaatttctacctgt

SEQ ID NO: 45389 - DNA, 20 bp, Artificial Sequence
  sgRNA
  Olfr828_11
gcaagttcacagaaaaatag

SEQ ID NO: 45390 - DNA, 20 bp, Artificial Sequence
  sgRNA
  Olfr828_12
tgcttatgtgatgtgtacat

SEQ ID NO: 45391 - DNA, 20 bp, Artificial Sequence
  sgRNA
  Olfr828_13
atgatcgttgtgtagttcag

SEQ ID NO: 45392 - DNA, 20 bp, Artificial Sequence
  sgRNA
  Olfr828_14
gatggtgatcaagtacatgg

SEQ ID NO: 45393 - DNA, 20 bp, Artificial Sequence
  sgRNA
  Olfr828_15
ttagagagaaatatgtacat

SEQ ID NO: 45394 - DNA, 20 bp, Artificial Sequence
  sgRNA
  Olfr828_16
gtagttcaggggatgacata

SEQ ID NO: 45395 - DNA, 20 bp, Artificial Sequence
  sgRNA
  Olfr828_17
tcagtggtttcattattcta

SEQ ID NO: 45396 - DNA, 20 bp, Artificial Sequence
  sgRNA
  Olfr828_18
ccttgaggaagcacatcaat

SEQ ID NO: 45397 - DNA, 20 bp, Artificial Sequence
  sgRNA
  Olfr828_19
caagatggtgatcaagtaca

SEQ ID NO: 45398 - DNA, 20 bp, Artificial Sequence
  sgRNA
  Olfr828_20
cttgaggaacagagacatgg

SEQ ID NO: 45399 - DNA, 20 bp, Artificial Sequence
  sgRNA
  Olfr829_1
taccattagaccattgacca

SEQ ID NO: 45400 - DNA, 20 bp, Artificial Sequence
  sgRNA
  Olfr829_2
aaccagaacatcacttatgg

SEQ ID NO: 45401 - DNA, 20 bp, Artificial Sequence
  sgRNA
  Olfr829_3
ccattaggatacaaagatag

SEQ ID NO: 45402 - DNA, 20 bp, Artificial Sequence
  sgRNA
  Olfr829_4
gaagataataagttgcagct

SEQ ID NO: 45403 - DNA, 20 bp, Artificial Sequence
  sgRNA
  Olfr829_5
tggtggccagaataatcagg

SEQ ID NO: 45404 - DNA, 20 bp, Artificial Sequence
  sgRNA
  Olfr829_6
tgaatcctgacacaaccgtt

SEQ ID NO: 45405 - DNA, 20 bp, Artificial Sequence
  sgRNA
  Olfr829_7
ggtttcctatgactgttgca

SEQ ID NO: 45406 - DNA, 20 bp, Artificial Sequence
  sgRNA
  Olfr829_8
gctgatatagaccccaaaac

SEQ ID NO: 45407 - DNA, 20 bp, Artificial Sequence
  sgRNA
  Olfr829_9
tgatgacattctcaagacag

SEQ ID NO: 45408 - DNA, 20 bp, Artificial Sequence
  sgRNA
  Olfr829_10
ataccattagaccattgacc

SEQ ID NO: 45409 - DNA, 20 bp, Artificial Sequence
  sgRNA
  Olfr829_11
gagatgagagtcaaagttgg

SEQ ID NO: 45410 - DNA, 20 bp, Artificial Sequence
  sgRNA
  Olfr829_12
catgaaatatataaaccaaa

SEQ ID NO: 45411 - DNA, 20 bp, Artificial Sequence
  sgRNA
  Olfr829_13
gacaaaatgatgccagaaag

SEQ ID NO: 45412 - DNA, 20 bp, Artificial Sequence
  sgRNA
  Olfr829_14
cccctatctttgtatcctaa

SEQ ID NO: 45413 - DNA, 20 bp, Artificial Sequence
  sgRNA
  Olfr829_15
attatgatcctatacctaag

SEQ ID NO: 45414 - DNA, 20 bp, Artificial Sequence
  sgRNA
  Olfr829_16
gatggcaaatagcaacatag

SEQ ID NO: 45415 - DNA, 20 bp, Artificial Sequence
  sgRNA
  Olfr829_17
ccttgaaaaaactcatcagt

SEQ ID NO: 45416 - DNA, 20 bp, Artificial Sequence
  sgRNA
  Olfr829_18
atttcatcttgcatatttgg

SEQ ID NO: 45417 - DNA, 20 bp, Artificial Sequence
  sgRNA
  Olfr829_19
tcatagaaaatgctaccatt

SEQ ID NO: 45418 - DNA, 20 bp, Artificial Sequence
  sgRNA
  Olfr829_20
gtgtcaggattcattctcct

SEQ ID NO: 45419 - DNA, 20 bp, Artificial Sequence
  sgRNA
  Olfr832_1
catgaatcccaaactctgtg

SEQ ID NO: 45420 - DNA, 20 bp, Artificial Sequence
  sgRNA
  Olfr832_2
aggaagactccaaataagac

SEQ ID NO: 45421 - DNA, 20 bp, Artificial Sequence
  sgRNA
  Olfr832_3
ggaaatgaagaaataccttg

SEQ ID NO: 45422 - DNA, 20 bp, Artificial Sequence
  sgRNA
  Olfr832_4
aaatgaaattctggtaatga

SEQ ID NO: 45423 - DNA, 20 bp, Artificial Sequence
  sgRNA
  Olfr832_5
attcgaatctccatacccca

SEQ ID NO: 45424 - DNA, 20 bp, Artificial Sequence
  sgRNA
  Olfr832_6
gactactgtgtacattacag

SEQ ID NO: 45425 - DNA, 20 bp, Artificial Sequence
  sgRNA
  Olfr832_7
gacgcagtgccatcaaagtg

SEQ ID NO: 45426 - DNA, 20 bp, Artificial Sequence
  sgRNA
  Olfr832_8
accatcaccccacagagttt

SEQ ID NO: 45427 - DNA, 20 bp, Artificial Sequence
  sgRNA
  Olfr832_9
gagattcgaatcaaaaattg

SEQ ID NO: 45428 - DNA, 20 bp, Artificial Sequence
  sgRNA
  Olfr832_10
acagtggaagaataccaaac

SEQ ID NO: 45429 - DNA, 20 bp, Artificial Sequence
  sgRNA
  Olfr832_11
atgtgtatcacatttagtag

SEQ ID NO: 45430 - DNA, 20 bp, Artificial Sequence
  sgRNA
  Olfr832_12
gtatataaagggattcatcg

SEQ ID NO: 45431 - DNA, 20 bp, Artificial Sequence
  sgRNA
  Olfr832_13
ggtgtttatttaagttctgc

SEQ ID NO: 45432 - DNA, 20 bp, Artificial Sequence
  sgRNA
  Olfr832_14
aaacagtgtgatcagatata

SEQ ID NO: 45433 - DNA, 20 bp, Artificial Sequence
  sgRNA
  Olfr832_15
tcatgaatcccaaactctgt

SEQ ID NO: 45434 - DNA, 20 bp, Artificial Sequence
  sgRNA
  Olfr832_16
tatctgatagtcccatgaga

SEQ ID NO: 45435 - DNA, 20 bp, Artificial Sequence
  sgRNA
  Olfr832_17
ttgtggccagtattatgaga

SEQ ID NO: 45436 - DNA, 20 bp, Artificial Sequence
  sgRNA
  Olfr832_18
gtgtgatcagatatatggtc

SEQ ID NO: 45437 - DNA, 20 bp, Artificial Sequence
  sgRNA
  Olfr832_19
tatataaagggattcatcgt

SEQ ID NO: 45438 - DNA, 20 bp, Artificial Sequence
  sgRNA
  Olfr832_20
ttggaaatgaagaaatacct

SEQ ID NO: 45439 - DNA, 20 bp, Artificial Sequence
  sgRNA
  Olfr834_1
catgaatcccaaaatctgtg

SEQ ID NO: 45440 - DNA, 20 bp, Artificial Sequence
  sgRNA
  Olfr834_2
gcatttgtcattctgcacaa

SEQ ID NO: 45441 - DNA, 20 bp, Artificial Sequence
  sgRNA
  Olfr834_3
ctgtagccagtattatgaga

SEQ ID NO: 45442 - DNA, 20 bp, Artificial Sequence
  sgRNA
  Olfr834_4
gtcaactcgatcagttatac

SEQ ID NO: 45443 - DNA, 20 bp, Artificial Sequence
  sgRNA
  Olfr834_5
acagtggaagaacacccaac

SEQ ID NO: 45444 - DNA, 20 bp, Artificial Sequence
  sgRNA
  Olfr834_6
aatgcagtgccatcaaagtg

SEQ ID NO: 45445 - DNA, 20 bp, Artificial Sequence
  sgRNA
  Olfr834_7
tcatgaatcccaaaatctgt

SEQ ID NO: 45446 - DNA, 20 bp, Artificial Sequence
  sgRNA
  Olfr834_8
gcgtttgcaggattggaaaa

SEQ ID NO: 45447 - DNA, 20 bp, Artificial Sequence
  sgRNA
  Olfr834_9
gaccactgtgtacatcacag

SEQ ID NO: 45448 - DNA, 20 bp, Artificial Sequence
  sgRNA
  Olfr834_10
gtatttggtgacaagcctgt

SEQ ID NO: 45449 - DNA, 20 bp, Artificial Sequence
  sgRNA
  Olfr834_11
tatataaagggattcatcat

SEQ ID NO: 45450 - DNA, 20 bp, Artificial Sequence
  sgRNA
  Olfr834_12
ttgtgatcagatatatggac

SEQ ID NO: 45451 - DNA, 20 bp, Artificial Sequence
  sgRNA
  Olfr834_13
aggaagactccaaaaagaac

SEQ ID NO: 45452 - DNA, 20 bp, Artificial Sequence
  sgRNA
  Olfr834_14
atctaggatacttatcaaga

SEQ ID NO: 45453 - DNA, 20 bp, Artificial Sequence
  sgRNA
  Olfr834_15
atatatctgatcacaatgtt

SEQ ID NO: 45454 - DNA, 20 bp, Artificial Sequence
  sgRNA
  Olfr834_16
tatctgataatcccatgaga

SEQ ID NO: 45455 - DNA, 20 bp, Artificial Sequence
  sgRNA
  Olfr834_17
tatatctgatcacaatgttt

SEQ ID NO: 45456 - DNA, 20 bp, Artificial Sequence
  sgRNA
  Olfr834_18
atgtgcatcacatttagtag

SEQ ID NO: 45457 - DNA, 20 bp, Artificial Sequence
  sgRNA
  Olfr834_19
ggaaatgaagaagtacattg

SEQ ID NO: 45458 - DNA, 20 bp, Artificial Sequence
  sgRNA
  Olfr834_20
aaacattgtgatcagatata

SEQ ID NO: 45459 - DNA, 20 bp, Artificial Sequence
  sgRNA
  Olfr835_1
gagaataagaacatacagca

SEQ ID NO: 45460 - DNA, 20 bp, Artificial Sequence
  sgRNA
  Olfr835_2
ctgtcattccaaatatgtta

SEQ ID NO: 45461 - DNA, 20 bp, Artificial Sequence
  sgRNA
  Olfr835_3
atcatgactgtataactcag

SEQ ID NO: 45462 - DNA, 20 bp, Artificial Sequence
  sgRNA
  Olfr835_4
catgggacttcttggtctca

SEQ ID NO: 45463 - DNA, 20 bp, Artificial Sequence
  sgRNA
  Olfr835_5
ggataagcagatatcattaa

SEQ ID NO: 45464 - DNA, 20 bp, Artificial Sequence
  sgRNA
  Olfr835_6
tttacccaagaagacttcag

SEQ ID NO: 45465 - DNA, 20 bp, Artificial Sequence
  sgRNA
  Olfr835_7
tatcagaatatcattaataa

SEQ ID NO: 45466 - DNA, 20 bp, Artificial Sequence
  sgRNA
  Olfr835_8
tggtgaccatgtacatcaac

SEQ ID NO: 45467 - DNA, 20 bp, Artificial Sequence
  sgRNA
  Olfr835_9
ctttcatgtccttatttcga

SEQ ID NO: 45468 - DNA, 20 bp, Artificial Sequence
  sgRNA
  Olfr835_10
tttgaaataaaaaagtacat

SEQ ID NO: 45469 - DNA, 20 bp, Artificial Sequence
  sgRNA
  Olfr835_11
tgacaagtgagaaccacaag

SEQ ID NO: 45470 - DNA, 20 bp, Artificial Sequence
  sgRNA
  Olfr835_12
caggccactgaagtcttctt

SEQ ID NO: 45471 - DNA, 20 bp, Artificial Sequence
  sgRNA
  Olfr835_13
gggtaaaatagcaactgaag

SEQ ID NO: 45472 - DNA, 20 bp, Artificial Sequence
  sgRNA
  Olfr835_14
tttggtggcatcccaatctc

SEQ ID NO: 45473 - DNA, 20 bp, Artificial Sequence
  sgRNA
  Olfr835_15
gataacaaatagcaacatat

SEQ ID NO: 45474 - DNA, 20 bp, Artificial Sequence
  sgRNA
  Olfr835_16
gatcagagcatcagttatgc

SEQ ID NO: 45475 - DNA, 20 bp, Artificial Sequence
  sgRNA
  Olfr835_17
aggaagatacaaaagatcac

SEQ ID NO: 45476 - DNA, 20 bp, Artificial Sequence
  sgRNA
  Olfr835_18
tatcttcctgttgatgtaca

SEQ ID NO: 45477 - DNA, 20 bp, Artificial Sequence
  sgRNA
  Olfr835_19
gagaaaataataccagagat

SEQ ID NO: 45478 - DNA, 20 bp, Artificial Sequence
  sgRNA
  Olfr835_20
gttacggactactcaaacac

SEQ ID NO: 45479 - DNA, 20 bp, Artificial Sequence
  sgRNA
  Olfr843_1
tggccatagttcatcctctg

SEQ ID NO: 45480 - DNA, 20 bp, Artificial Sequence
  sgRNA
  Olfr843_2
aatcaatacaaaacacacct

SEQ ID NO: 45481 - DNA, 20 bp, Artificial Sequence
  sgRNA
  Olfr843_3
acttatacagatgtcagtaa

SEQ ID NO: 45482 - DNA, 20 bp, Artificial Sequence
  sgRNA
  Olfr843_4
tggtaacaaaatatatagac

SEQ ID NO: 45483 - DNA, 20 bp, Artificial Sequence
  sgRNA
  Olfr843_5
cttaagatatcatcagtcca

SEQ ID NO: 45484 - DNA, 20 bp, Artificial Sequence
  sgRNA
  Olfr843_6
gatggcctatgaccgttact

SEQ ID NO: 45485 - DNA, 20 bp, Artificial Sequence
  sgRNA
  Olfr843_7
gatgaactatggccaagtaa

SEQ ID NO: 45486 - DNA, 20 bp, Artificial Sequence
  sgRNA
  Olfr843_8
agtcactgtgtaaataagaa

SEQ ID NO: 45487 - DNA, 20 bp, Artificial Sequence
  sgRNA
  Olfr843_9
ttggcaataaaaaagtacat

SEQ ID NO: 45488 - DNA, 20 bp, Artificial Sequence
  sgRNA
  Olfr843_10
gagaaaataatcccagcaag

SEQ ID NO: 45489 - DNA, 20 bp, Artificial Sequence
  sgRNA
  Olfr843_11
atgataactgtatacctcag

SEQ ID NO: 45490 - DNA, 20 bp, Artificial Sequence
  sgRNA
  Olfr843_12
gagacaccttctctttcctg

SEQ ID NO: 45491 - DNA, 20 bp, Artificial Sequence
  sgRNA
  Olfr843_13
atacaaaacacacctgggac

SEQ ID NO: 45492 - DNA, 20 bp, Artificial Sequence
  sgRNA
  Olfr843_14
agatatcatcagtccaggga

SEQ ID NO: 45493 - DNA, 20 bp, Artificial Sequence
  sgRNA
  Olfr843_15
ataagaccacaggaaagaga

SEQ ID NO: 45494 - DNA, 20 bp, Artificial Sequence
  sgRNA
  Olfr843_16
atacctcagaggatgaacta

SEQ ID NO: 45495 - DNA, 20 bp, Artificial Sequence
  sgRNA
  Olfr843_17
acgagcagtacacagagaca

SEQ ID NO: 45496 - DNA, 20 bp, Artificial Sequence
  sgRNA
  Olfr843_18
ttctcagactgtatatgaaa

SEQ ID NO: 45497 - DNA, 20 bp, Artificial Sequence
  sgRNA
  Olfr843_19
tgaaagggtttagcatttga

SEQ ID NO: 45498 - DNA, 20 bp, Artificial Sequence
  sgRNA
  Olfr843_20
acagtgactagtgtatttgc

SEQ ID NO: 45499 - DNA, 20 bp, Artificial Sequence
  sgRNA
  Olfr845_1
gcatctgaatttctgcacag

SEQ ID NO: 45500 - DNA, 20 bp, Artificial Sequence
  sgRNA
  Olfr845_2
gctcttgaacatccaaacac

SEQ ID NO: 45501 - DNA, 20 bp, Artificial Sequence
  sgRNA
  Olfr845_3
attgacagcactaatagcca

SEQ ID NO: 45502 - DNA, 20 bp, Artificial Sequence
  sgRNA
  Olfr845_4
tgactgtgtacctcagaggg

SEQ ID NO: 45503 - DNA, 20 bp, Artificial Sequence
  sgRNA
  Olfr845_5
gtaactctggatcatctgaa

SEQ ID NO: 45504 - DNA, 20 bp, Artificial Sequence
  sgRNA
  Olfr845_6
gaagctttaaggaagcacgt

SEQ ID NO: 45505 - DNA, 20 bp, Artificial Sequence
  sgRNA
  Olfr845_7
gatcacagaataacttactc

SEQ ID NO: 45506 - DNA, 20 bp, Artificial Sequence
  sgRNA
  Olfr845_8
tgatgactgtgtacctcaga

SEQ ID NO: 45507 - DNA, 20 bp, Artificial Sequence
  sgRNA
  Olfr845_9
ggttccccagaaatgtgacc

SEQ ID NO: 45508 - DNA, 20 bp, Artificial Sequence
  sgRNA
  Olfr845_10
gcactcagcactgatggtca

SEQ ID NO: 45509 - DNA, 20 bp, Artificial Sequence
  sgRNA
  Olfr845_11
tgacaggtgagagccacacg

SEQ ID NO: 45510 - DNA, 20 bp, Artificial Sequence
  sgRNA
  Olfr845_12
ctgcagttactgaatctccc

SEQ ID NO: 45511 - DNA, 20 bp, Artificial Sequence
  sgRNA
  Olfr845_13
aggaacagtccgaaaataat

SEQ ID NO: 45512 - DNA, 20 bp, Artificial Sequence
  sgRNA
  Olfr845_14
tattgcatctgtttgattgg

SEQ ID NO: 45513 - DNA, 20 bp, Artificial Sequence
  sgRNA
  Olfr845_15
gatatcagccacagatagat

SEQ ID NO: 45514 - DNA, 20 bp, Artificial Sequence
  sgRNA
  Olfr845_16
agagtacattactgaagcaa

SEQ ID NO: 45515 - DNA, 20 bp, Artificial Sequence
  sgRNA
  Olfr845_17
tgtacctggtcacatttctg

SEQ ID NO: 45516 - DNA, 20 bp, Artificial Sequence
  sgRNA
  Olfr845_18
tgatggtcagggttataatt

SEQ ID NO: 45517 - DNA, 20 bp, Artificial Sequence
  sgRNA
  Olfr845_19
ggagagaaaaaagtacatgg

SEQ ID NO: 45518 - DNA, 20 bp, Artificial Sequence
  sgRNA
  Olfr845_20
agacaaagcaagcctgagtg

SEQ ID NO: 45519 - DNA, 20 bp, Artificial Sequence
  sgRNA
  Olfr846_1
gctaaccagtgatcctacaa

SEQ ID NO: 45520 - DNA, 20 bp, Artificial Sequence
  sgRNA
  Olfr846_2
gctgaagaacattcacacac

SEQ ID NO: 45521 - DNA, 20 bp, Artificial Sequence
  sgRNA
  Olfr846_3
attagcagatcacagaagtg

SEQ ID NO: 45522 - DNA, 20 bp, Artificial Sequence
  sgRNA
  Olfr846_4
agcaaaattcagaacaaagc

SEQ ID NO: 45523 - DNA, 20 bp, Artificial Sequence
  sgRNA
  Olfr846_5
acaagaagaggctaaatatg

SEQ ID NO: 45524 - DNA, 20 bp, Artificial Sequence
  sgRNA
  Olfr846_6
cttagcaatgagctttcgta

SEQ ID NO: 45525 - DNA, 20 bp, Artificial Sequence
  sgRNA
  Olfr846_7
ggctttgtactttcctctaa

SEQ ID NO: 45526 - DNA, 20 bp, Artificial Sequence
  sgRNA
  Olfr846_8
gatcagagcatcagttacac

SEQ ID NO: 45527 - DNA, 20 bp, Artificial Sequence
  sgRNA
  Olfr846_9
ccagatatataaacaagaag

SEQ ID NO: 45528 - DNA, 20 bp, Artificial Sequence
  sgRNA
  Olfr846_10
gagaaaatgattccaaagat

SEQ ID NO: 45529 - DNA, 20 bp, Artificial Sequence
  sgRNA
  Olfr846_11
ataattactgtgtagttcag

SEQ ID NO: 45530 - DNA, 20 bp, Artificial Sequence
  sgRNA
  Olfr846_12
atgacactgtagttgtctga

SEQ ID NO: 45531 - DNA, 20 bp, Artificial Sequence
  sgRNA
  Olfr846_13
ttgaaaatatcttcccttag

SEQ ID NO: 45532 - DNA, 20 bp, Artificial Sequence
  sgRNA
  Olfr846_14
aaaataacgagacaactgaa

SEQ ID NO: 45533 - DNA, 20 bp, Artificial Sequence
  sgRNA
  Olfr846_15
atatatctggtcacaattct

SEQ ID NO: 45534 - DNA, 20 bp, Artificial Sequence
  sgRNA
  Olfr846_16
tttggtggaattccaatctt

SEQ ID NO: 45535 - DNA, 20 bp, Artificial Sequence
  sgRNA
  Olfr846_17
gttcttcagcatatttggaa

SEQ ID NO: 45536 - DNA, 20 bp, Artificial Sequence
  sgRNA
  Olfr846_18
gtgagacccacaagtagaaa

SEQ ID NO: 45537 - DNA, 20 bp, Artificial Sequence
  sgRNA
  Olfr846_19
gttcacaatactaatgatca

SEQ ID NO: 45538 - DNA, 20 bp, Artificial Sequence
  sgRNA
  Olfr846_20
tatgacactgtagttgtctg

SEQ ID NO: 45539 - DNA, 20 bp, Artificial Sequence
  sgRNA
  Olfr847_1
tacagtgtctgatgatactg

SEQ ID NO: 45540 - DNA, 20 bp, Artificial Sequence
  sgRNA
  Olfr847_2
aagatgaggggctctactgt

SEQ ID NO: 45541 - DNA, 20 bp, Artificial Sequence
  sgRNA
  Olfr847_3
ttgggacagtggttgtactt

SEQ ID NO: 45542 - DNA, 20 bp, Artificial Sequence
  sgRNA
  Olfr847_4
atcagcaaaccacagaattg

SEQ ID NO: 45543 - DNA, 20 bp, Artificial Sequence
  sgRNA
  Olfr847_5
gtagttgtatccttattcta

SEQ ID NO: 45544 - DNA, 20 bp, Artificial Sequence
  sgRNA
  Olfr847_6
ataattactgtgtaattcag

SEQ ID NO: 45545 - DNA, 20 bp, Artificial Sequence
  sgRNA
  Olfr847_7
gatcatagcatcagttacac

SEQ ID NO: 45546 - DNA, 20 bp, Artificial Sequence
  sgRNA
  Olfr847_8
aagacactgtagttatctga

SEQ ID NO: 45547 - DNA, 20 bp, Artificial Sequence
  sgRNA
  Olfr847_9
ttattctatggtgcagcagt

SEQ ID NO: 45548 - DNA, 20 bp, Artificial Sequence
  sgRNA
  Olfr847_10
tttgggaaaacttatcacaa

SEQ ID NO: 45549 - DNA, 20 bp, Artificial Sequence
  sgRNA
  Olfr847_11
ggatgttcttcaacatgttt

SEQ ID NO: 45550 - DNA, 20 bp, Artificial Sequence
  sgRNA
  Olfr847_12
ttgaaaatctcttccctgag

SEQ ID NO: 45551 - DNA, 20 bp, Artificial Sequence
  sgRNA
  Olfr847_13
gttgaagaacatccacacac

SEQ ID NO: 45552 - DNA, 20 bp, Artificial Sequence
  sgRNA
  Olfr847_14
agacactgtagttatctgag

SEQ ID NO: 45553 - DNA, 20 bp, Artificial Sequence
  sgRNA
  Olfr847_15
acatatctggttacaattgt

SEQ ID NO: 45554 - DNA, 20 bp, Artificial Sequence
  sgRNA
  Olfr847_16
ataaagaagccaaagatgag

SEQ ID NO: 45555 - DNA, 20 bp, Artificial Sequence
  sgRNA
  Olfr847_17
atgtgacccacacgtagaaa

SEQ ID NO: 45556 - DNA, 20 bp, Artificial Sequence
  sgRNA
  Olfr847_18
acagtagagcccctcatctt

SEQ ID NO: 45557 - DNA, 20 bp, Artificial Sequence
  sgRNA
  Olfr847_19
ggctttgtatcttcctctca

SEQ ID NO: 45558 - DNA, 20 bp, Artificial Sequence
  sgRNA
  Olfr847_20
tcttcatgtctctatttctt

SEQ ID NO: 45559 - DNA, 20 bp, Artificial Sequence
  sgRNA
  Olfr850_1
ggtgtgtgcagaatgacagt

SEQ ID NO: 45560 - DNA, 20 bp, Artificial Sequence
  sgRNA
  Olfr850_2
acttccccagatcctcaagt

SEQ ID NO: 45561 - DNA, 20 bp, Artificial Sequence
  sgRNA
  Olfr850_3
agtcaaagcattacatacaa

SEQ ID NO: 45562 - DNA, 20 bp, Artificial Sequence
  sgRNA
  Olfr850_4
atcagcaggacacaaaaaca

SEQ ID NO: 45563 - DNA, 20 bp, Artificial Sequence
  sgRNA
  Olfr850_5
gcagggacaatagaatcagc

SEQ ID NO: 45564 - DNA, 20 bp, Artificial Sequence
  sgRNA
  Olfr850_6
ctatggggaaattcttcagt

SEQ ID NO: 45565 - DNA, 20 bp, Artificial Sequence
  sgRNA
  Olfr850_7
agattataagaaggtttccc

SEQ ID NO: 45566 - DNA, 20 bp, Artificial Sequence
  sgRNA
  Olfr850_8
atatatctgatcaccatcct

SEQ ID NO: 45567 - DNA, 20 bp, Artificial Sequence
  sgRNA
  Olfr850_9
ggtgacaaatagcaatataa

SEQ ID NO: 45568 - DNA, 20 bp, Artificial Sequence
  sgRNA
  Olfr850_10
atgacagtcggagcaccata

SEQ ID NO: 45569 - DNA, 20 bp, Artificial Sequence
  sgRNA
  Olfr850_11
gggacatgaaagaagctatg

SEQ ID NO: 45570 - DNA, 20 bp, Artificial Sequence
  sgRNA
  Olfr850_12
tggaaatcaagattataaga

SEQ ID NO: 45571 - DNA, 20 bp, Artificial Sequence
  sgRNA
  Olfr850_13
ggggaaattcttcagtcgga

SEQ ID NO: 45572 - DNA, 20 bp, Artificial Sequence
  sgRNA
  Olfr850_14
ccttcttctgggactgacag

SEQ ID NO: 45573 - DNA, 20 bp, Artificial Sequence
  sgRNA
  Olfr850_15
ggagagaaataagtacatag

SEQ ID NO: 45574 - DNA, 20 bp, Artificial Sequence
  sgRNA
  Olfr850_16
ggaatcctggaaaagttgtt

SEQ ID NO: 45575 - DNA, 20 bp, Artificial Sequence
  sgRNA
  Olfr850_17
aaaagctgtcccataaaaca

SEQ ID NO: 45576 - DNA, 20 bp, Artificial Sequence
  sgRNA
  Olfr850_18
atcaacaacactaatgagca

SEQ ID NO: 45577 - DNA, 20 bp, Artificial Sequence
  sgRNA
  Olfr850_19
aatcagcaggacacaaaaac

SEQ ID NO: 45578 - DNA, 20 bp, Artificial Sequence
  sgRNA
  Olfr850_20
tgacaagtgagacccacagg

SEQ ID NO: 45579 - DNA, 20 bp, Artificial Sequence
  sgRNA
  Olfr854_1
agacaaagttcatttgagtg

SEQ ID NO: 45580 - DNA, 20 bp, Artificial Sequence
  sgRNA
  Olfr854_2
atccacaatgctaattagca

SEQ ID NO: 45581 - DNA, 20 bp, Artificial Sequence
  sgRNA
  Olfr854_3
acttcccaagatgctcaagt

SEQ ID NO: 45582 - DNA, 20 bp, Artificial Sequence
  sgRNA
  Olfr854_4
aagaacaagctgaccaagac

SEQ ID NO: 45583 - DNA, 20 bp, Artificial Sequence
  sgRNA
  Olfr854_5
tctactgaagaatttcctca

SEQ ID NO: 45584 - DNA, 20 bp, Artificial Sequence
  sgRNA
  Olfr854_6
atggcagtcttagcaccatc

SEQ ID NO: 45585 - DNA, 20 bp, Artificial Sequence
  sgRNA
  Olfr854_7
ggaagttcacagaagaagct

SEQ ID NO: 45586 - DNA, 20 bp, Artificial Sequence
  sgRNA
  Olfr854_8
ggaatcctggaaaagctgtt

SEQ ID NO: 45587 - DNA, 20 bp, Artificial Sequence
  sgRNA
  Olfr854_9
ggattcatccaggaagactg

SEQ ID NO: 45588 - DNA, 20 bp, Artificial Sequence
  sgRNA
  Olfr854_10
gcagggacaacagaatcagg

SEQ ID NO: 45589 - DNA, 20 bp, Artificial Sequence
  sgRNA
  Olfr854_11
aatcagaatgttatcaatga

SEQ ID NO: 45590 - DNA, 20 bp, Artificial Sequence
  sgRNA
  Olfr854_12
aatggcttatgaccgatatg

SEQ ID NO: 45591 - DNA, 20 bp, Artificial Sequence
  sgRNA
  Olfr854_13
ttcatccaggaagactgcgg

SEQ ID NO: 45592 - DNA, 20 bp, Artificial Sequence
  sgRNA
  Olfr854_14
gggacatgaaggacaccatg

SEQ ID NO: 45593 - DNA, 20 bp, Artificial Sequence
  sgRNA
  Olfr854_15
ggaaagaagtaagtacatag

SEQ ID NO: 45594 - DNA, 20 bp, Artificial Sequence
  sgRNA
  Olfr854_16
agaacaagaacacaactgac

SEQ ID NO: 45595 - DNA, 20 bp, Artificial Sequence
  sgRNA
  Olfr854_17
tttgctggaattcctctctc

SEQ ID NO: 45596 - DNA, 20 bp, Artificial Sequence
  sgRNA
  Olfr854_18
ctatcattatggattcatcc

SEQ ID NO: 45597 - DNA, 20 bp, Artificial Sequence
  sgRNA
  Olfr854_19
ggtgacaaatagccacatat

SEQ ID NO: 45598 - DNA, 20 bp, Artificial Sequence
  sgRNA
  Olfr854_20
tgatgacattctcaaaatag

SEQ ID NO: 45599 - DNA, 20 bp, Artificial Sequence
  sgRNA
  Olfr867_1
ctatatagaatgccttacac

SEQ ID NO: 45600 - DNA, 20 bp, Artificial Sequence
  sgRNA
  Olfr867_2
ctgggtgtgattcctatgac

SEQ ID NO: 45601 - DNA, 20 bp, Artificial Sequence
  sgRNA
  Olfr867_3
ataataacagtgtagttgag

SEQ ID NO: 45602 - DNA, 20 bp, Artificial Sequence
  sgRNA
  Olfr867_4
aatgaactgaacttctccag

SEQ ID NO: 45603 - DNA, 20 bp, Artificial Sequence
  sgRNA
  Olfr867_5
tcagaagtgcacacagtcga

SEQ ID NO: 45604 - DNA, 20 bp, Artificial Sequence
  sgRNA
  Olfr867_6
aagcagcgtgaccagataca

SEQ ID NO: 45605 - DNA, 20 bp, Artificial Sequence
  sgRNA
  Olfr867_7
aaaataaagtgaccacacag

SEQ ID NO: 45606 - DNA, 20 bp, Artificial Sequence
  sgRNA
  Olfr867_8
catcaacagaacatgaatca

SEQ ID NO: 45607 - DNA, 20 bp, Artificial Sequence
  sgRNA
  Olfr867_9
gtatgtagtgacttccttac

SEQ ID NO: 45608 - DNA, 20 bp, Artificial Sequence
  sgRNA
  Olfr867_10
ctgatgtcattgatacatga

SEQ ID NO: 45609 - DNA, 20 bp, Artificial Sequence
  sgRNA
  Olfr867_11
ctaagaaacaaagatgtgaa

SEQ ID NO: 45610 - DNA, 20 bp, Artificial Sequence
  sgRNA
  Olfr867_12
atcagaagtgcacacagtcg

SEQ ID NO: 45611 - DNA, 20 bp, Artificial Sequence
  sgRNA
  Olfr867_13
tttcttagcgtatagatgaa

SEQ ID NO: 45612 - DNA, 20 bp, Artificial Sequence
  sgRNA
  Olfr867_14
gtagttgagggggtgacaga

SEQ ID NO: 45613 - DNA, 20 bp, Artificial Sequence
  sgRNA
  Olfr867_15
ataacaaaatttctcatcct

SEQ ID NO: 45614 - DNA, 20 bp, Artificial Sequence
  sgRNA
  Olfr867_16
tcattctactcagagaagaa

SEQ ID NO: 45615 - DNA, 20 bp, Artificial Sequence
  sgRNA
  Olfr867_17
tcatcaacagaacatgaatc

SEQ ID NO: 45616 - DNA, 20 bp, Artificial Sequence
  sgRNA
  Olfr867_18
gccagttcacagaagaaatg

SEQ ID NO: 45617 - DNA, 20 bp, Artificial Sequence
  sgRNA
  Olfr867_19
ctgcggttctcacctctgtg

SEQ ID NO: 45618 - DNA, 20 bp, Artificial Sequence
  sgRNA
  Olfr867_20
gatatcaataaaggacagat

SEQ ID NO: 45619 - DNA, 20 bp, Artificial Sequence
  sgRNA
  Olfr874_1
agaacatcatctcacactca

SEQ ID NO: 45620 - DNA, 20 bp, Artificial Sequence
  sgRNA
  Olfr874_2
ttgcaagagagctcaagaag

SEQ ID NO: 45621 - DNA, 20 bp, Artificial Sequence
  sgRNA
  Olfr874_3
aaaagaagtaaatatacctg

SEQ ID NO: 45622 - DNA, 20 bp, Artificial Sequence
  sgRNA
  Olfr874_4
gcaggcctgacagaccaacc

SEQ ID NO: 45623 - DNA, 20 bp, Artificial Sequence
  sgRNA
  Olfr874_5
attgcaagagagctcaagaa

SEQ ID NO: 45624 - DNA, 20 bp, Artificial Sequence
  sgRNA
  Olfr874_6
gaggatgaactctatcacag

SEQ ID NO: 45625 - DNA, 20 bp, Artificial Sequence
  sgRNA
  Olfr874_7
ctatgtgatgggcttctctg

SEQ ID NO: 45626 - DNA, 20 bp, Artificial Sequence
  sgRNA
  Olfr874_8
tccttggtcaagaggcaaaa

SEQ ID NO: 45627 - DNA, 20 bp, Artificial Sequence
  sgRNA
  Olfr874_9
ctggggccatggcccataca

SEQ ID NO: 45628 - DNA, 20 bp, Artificial Sequence
  sgRNA
  Olfr874_10
gttggtctgtcaggcctgcg

SEQ ID NO: 45629 - DNA, 20 bp, Artificial Sequence
  sgRNA
  Olfr874_11
gtgactgtggttgggaacct

SEQ ID NO: 45630 - DNA, 20 bp, Artificial Sequence
  sgRNA
  Olfr874_12
tggtcaagaggcaaaatgga

SEQ ID NO: 45631 - DNA, 20 bp, Artificial Sequence
  sgRNA
  Olfr874_13
cctagaaacaagaagaagag

SEQ ID NO: 45632 - DNA, 20 bp, Artificial Sequence
  sgRNA
  Olfr874_14
cttcgcatgcattccacaga

SEQ ID NO: 45633 - DNA, 20 bp, Artificial Sequence
  sgRNA
  Olfr874_15
tggtgactgtgtacatcagg

SEQ ID NO: 45634 - DNA, 20 bp, Artificial Sequence
  sgRNA
  Olfr874_16
cttgtttctaggtttctaca

SEQ ID NO: 45635 - DNA, 20 bp, Artificial Sequence
  sgRNA
  Olfr874_17
gattacgagctcatttatga

SEQ ID NO: 45636 - DNA, 20 bp, Artificial Sequence
  sgRNA
  Olfr874_18
gcatgcgaagaatgctagag

SEQ ID NO: 45637 - DNA, 20 bp, Artificial Sequence
  sgRNA
  Olfr874_19
aggatgtcaaagttgctctg

SEQ ID NO: 45638 - DNA, 20 bp, Artificial Sequence
  sgRNA
  Olfr874_20
aatgggcacaccaatatcaa

SEQ ID NO: 45639 - DNA, 20 bp, Artificial Sequence
  sgRNA
  Olfr875_1
tggtgaccgtgtacatcagg

SEQ ID NO: 45640 - DNA, 20 bp, Artificial Sequence
  sgRNA
  Olfr875_2
gcaggcctgacaaaccaacc

SEQ ID NO: 45641 - DNA, 20 bp, Artificial Sequence
  sgRNA
  Olfr875_3
tgctacaggagagctcaaga

SEQ ID NO: 45642 - DNA, 20 bp, Artificial Sequence
  sgRNA
  Olfr875_4
ctggaggcatagcccataca

SEQ ID NO: 45643 - DNA, 20 bp, Artificial Sequence
  sgRNA
  Olfr875_5
gctacaggagagctcaagaa

SEQ ID NO: 45644 - DNA, 20 bp, Artificial Sequence
  sgRNA
  Olfr875_6
ctacaggagagctcaagaag

SEQ ID NO: 45645 - DNA, 20 bp, Artificial Sequence
  sgRNA
  Olfr875_7
gttggtttgtcaggcctgca

SEQ ID NO: 45646 - DNA, 20 bp, Artificial Sequence
  sgRNA
  Olfr875_8
ggttacagatcgcaacataa

SEQ ID NO: 45647 - DNA, 20 bp, Artificial Sequence
  sgRNA
  Olfr875_9
tgccatggctgacagaatga

SEQ ID NO: 45648 - DNA, 20 bp, Artificial Sequence
  sgRNA
  Olfr875_10
ttgaagataaagaagtacat

SEQ ID NO: 45649 - DNA, 20 bp, Artificial Sequence
  sgRNA
  Olfr875_11
gaagataaagaagtacatag

SEQ ID NO: 45650 - DNA, 20 bp, Artificial Sequence
  sgRNA
  Olfr875_12
gtccttcattctgtcagcca

SEQ ID NO: 45651 - DNA, 20 bp, Artificial Sequence
  sgRNA
  Olfr875_13
tcaaggggcaaaatggaagg

SEQ ID NO: 45652 - DNA, 20 bp, Artificial Sequence
  sgRNA
  Olfr875_14
tccttggtcaaggggcaaaa

SEQ ID NO: 45653 - DNA, 20 bp, Artificial Sequence
  sgRNA
  Olfr875_15
gcaaaagaagtaaacatacc

SEQ ID NO: 45654 - DNA, 20 bp, Artificial Sequence
  sgRNA
  Olfr875_16
aagatgtcaaagttgctctg

SEQ ID NO: 45655 - DNA, 20 bp, Artificial Sequence
  sgRNA
  Olfr875_17
acgaatatcatctcacactc

SEQ ID NO: 45656 - DNA, 20 bp, Artificial Sequence
  sgRNA
  Olfr875_18
aaaagaagtaaacatacctg

SEQ ID NO: 45657 - DNA, 20 bp, Artificial Sequence
  sgRNA
  Olfr875_19
tatgtgatgggcttctctgg

SEQ ID NO: 45658 - DNA, 20 bp, Artificial Sequence
  sgRNA
  Olfr875_20
attgttgtggcatttggtat

SEQ ID NO: 45659 - DNA, 20 bp, Artificial Sequence
  sgRNA
  Olfr876_1
gactaccagttcattcacat

SEQ ID NO: 45660 - DNA, 20 bp, Artificial Sequence
  sgRNA
  Olfr876_2
catggcccacaccatatcca

SEQ ID NO: 45661 - DNA, 20 bp, Artificial Sequence
  sgRNA
  Olfr876_3
aaaaggagtaaacaaacctg

SEQ ID NO: 45662 - DNA, 20 bp, Artificial Sequence
  sgRNA
  Olfr876_4
agaacatcatctcacatcca

SEQ ID NO: 45663 - DNA, 20 bp, Artificial Sequence
  sgRNA
  Olfr876_5
tggtgaccatgtacatcagg

SEQ ID NO: 45664 - DNA, 20 bp, Artificial Sequence
  sgRNA
  Olfr876_6
agtacaggagtgctccagaa

SEQ ID NO: 45665 - DNA, 20 bp, Artificial Sequence
  sgRNA
  Olfr876_7
attcacataggtgctagtac

SEQ ID NO: 45666 - DNA, 20 bp, Artificial Sequence
  sgRNA
  Olfr876_8
ttaaatatacaccaaacaaa

SEQ ID NO: 45667 - DNA, 20 bp, Artificial Sequence
  sgRNA
  Olfr876_9
agttactgtaaggaaaacct

SEQ ID NO: 45668 - DNA, 20 bp, Artificial Sequence
  sgRNA
  Olfr876_10
acagaaggtcagccttgcca

SEQ ID NO: 45669 - DNA, 20 bp, Artificial Sequence
  sgRNA
  Olfr876_11
gtacaggagtgctccagaag

SEQ ID NO: 45670 - DNA, 20 bp, Artificial Sequence
  sgRNA
  Olfr876_12
ggaatagcagaaatcgatta

SEQ ID NO: 45671 - DNA, 20 bp, Artificial Sequence
  sgRNA
  Olfr876_13
ccttgccatggatatggtgt

SEQ ID NO: 45672 - DNA, 20 bp, Artificial Sequence
  sgRNA
  Olfr876_14
aacaactgtgccatgcaccc

SEQ ID NO: 45673 - DNA, 20 bp, Artificial Sequence
  sgRNA
  Olfr876_15
tggtcaagggacaaaacaga

SEQ ID NO: 45674 - DNA, 20 bp, Artificial Sequence
  sgRNA
  Olfr876_16
ctgcagctcccacatgattg

SEQ ID NO: 45675 - DNA, 20 bp, Artificial Sequence
  sgRNA
  Olfr876_17
tcaagggacaaaacagaagg

SEQ ID NO: 45676 - DNA, 20 bp, Artificial Sequence
  sgRNA
  Olfr876_18
tttgtcccttgaccaaggaa

SEQ ID NO: 45677 - DNA, 20 bp, Artificial Sequence
  sgRNA
  Olfr876_19
gccttgccatggatatggtg

SEQ ID NO: 45678 - DNA, 20 bp, Artificial Sequence
  sgRNA
  Olfr876_20
gctggtctgtcaggcctgca

SEQ ID NO: 45679 - DNA, 20 bp, Artificial Sequence
  sgRNA
  Olfr878_1
caattctgaatgctacgtgc

SEQ ID NO: 45680 - DNA, 20 bp, Artificial Sequence
  sgRNA
  Olfr878_2
aataaaaaacacaagctcgt

SEQ ID NO: 45681 - DNA, 20 bp, Artificial Sequence
  sgRNA
  Olfr878_3
gaacttcacagagataatgg

SEQ ID NO: 45682 - DNA, 20 bp, Artificial Sequence
  sgRNA
  Olfr878_4
tgtcagcatgcttccagtat

SEQ ID NO: 45683 - DNA, 20 bp, Artificial Sequence
  sgRNA
  Olfr878_5
ggtgcaggagagctgtaaaa

SEQ ID NO: 45684 - DNA, 20 bp, Artificial Sequence
  sgRNA
  Olfr878_6
ttccctcttccattgaacca

SEQ ID NO: 45685 - DNA, 20 bp, Artificial Sequence
  sgRNA
  Olfr878_7
tgggactgatcaccttaatt

SEQ ID NO: 45686 - DNA, 20 bp, Artificial Sequence
  sgRNA
  Olfr878_8
gttaagcatgggaaccacat

SEQ ID NO: 45687 - DNA, 20 bp, Artificial Sequence
  sgRNA
  Olfr878_9
catgcttccagtatgggcca

SEQ ID NO: 45688 - DNA, 20 bp, Artificial Sequence
  sgRNA
  Olfr878_10
gagataatggtggatcatat

SEQ ID NO: 45689 - DNA, 20 bp, Artificial Sequence
  sgRNA
  Olfr878_11
gaggcagctggagagctggt

SEQ ID NO: 45690 - DNA, 20 bp, Artificial Sequence
  sgRNA
  Olfr878_12
tatttaacaacctctttccc

SEQ ID NO: 45691 - DNA, 20 bp, Artificial Sequence
  sgRNA
  Olfr878_13
gtacagcagaggattgcaaa

SEQ ID NO: 45692 - DNA, 20 bp, Artificial Sequence
  sgRNA
  Olfr878_14
cctctcttcttcgtcttctt

SEQ ID NO: 45693 - DNA, 20 bp, Artificial Sequence
  sgRNA
  Olfr878_15
acagagcaacagcaactaca

SEQ ID NO: 45694 - DNA, 20 bp, Artificial Sequence
  sgRNA
  Olfr878_16
gttggtttgaaaatcccaca

SEQ ID NO: 45695 - DNA, 20 bp, Artificial Sequence
  sgRNA
  Olfr878_17
atagatcagtgggttaagca

SEQ ID NO: 45696 - DNA, 20 bp, Artificial Sequence
  sgRNA
  Olfr878_18
ttccctggttcaatggaaga

SEQ ID NO: 45697 - DNA, 20 bp, Artificial Sequence
  sgRNA
  Olfr878_19
cctaagaagacgaagaagag

SEQ ID NO: 45698 - DNA, 20 bp, Artificial Sequence
  sgRNA
  Olfr878_20
gttggcataggtactggtgc

SEQ ID NO: 45699 - DNA, 20 bp, Artificial Sequence
  sgRNA
  Olfr90_1
acacaaagtcgtcaacctga

SEQ ID NO: 45700 - DNA, 20 bp, Artificial Sequence
  sgRNA
  Olfr90_2
tctgaactactgactccact

SEQ ID NO: 45701 - DNA, 20 bp, Artificial Sequence
  sgRNA
  Olfr90_3
tacaaccaagatgaagacac

SEQ ID NO: 45702 - DNA, 20 bp, Artificial Sequence
  sgRNA
  Olfr90_4
tcttcatcttcttatctctg

SEQ ID NO: 45703 - DNA, 20 bp, Artificial Sequence
  sgRNA
  Olfr90_5
ccagctggcaacacaggcga

SEQ ID NO: 45704 - DNA, 20 bp, Artificial Sequence
  sgRNA
  Olfr90_6
aggacagtcgaatcaaagca

SEQ ID NO: 45705 - DNA, 20 bp, Artificial Sequence
  sgRNA
  Olfr90_7
aagtaaagagggcattcagg

SEQ ID NO: 45706 - DNA, 20 bp, Artificial Sequence
  sgRNA
  Olfr90_8
gattagtgtgtttcctagga

SEQ ID NO: 45707 - DNA, 20 bp, Artificial Sequence
  sgRNA
  Olfr90_9
catttgtatctcattatagg

SEQ ID NO: 45708 - DNA, 20 bp, Artificial Sequence
  sgRNA
  Olfr90_10
ccctcgcctgtgttgccagc

SEQ ID NO: 45709 - DNA, 20 bp, Artificial Sequence
  sgRNA
  Olfr90_11
gcccttctgtccccaccatc

SEQ ID NO: 45710 - DNA, 20 bp, Artificial Sequence
  sgRNA
  Olfr90_12
gctggcaacacaggcgaggg

SEQ ID NO: 45711 - DNA, 20 bp, Artificial Sequence
  sgRNA
  Olfr90_13
cttcttatctctggggacga

SEQ ID NO: 45712 - DNA, 20 bp, Artificial Sequence
  sgRNA
  Olfr90_14
gaatccttatgctcgagaga

SEQ ID NO: 45713 - DNA, 20 bp, Artificial Sequence
  sgRNA
  Olfr90_15
tctcgagcataaggattctt

SEQ ID NO: 45714 - DNA, 20 bp, Artificial Sequence
  sgRNA
  Olfr90_16
caaaggccatcactgctagc

SEQ ID NO: 45715 - DNA, 20 bp, Artificial Sequence
  sgRNA
  Olfr90_17
agaatccttatgctcgagag

SEQ ID NO: 45716 - DNA, 20 bp, Artificial Sequence
  sgRNA
  Olfr90_18
ctttgattcgactgtcctgt

SEQ ID NO: 45717 - DNA, 20 bp, Artificial Sequence
  sgRNA
  Olfr90_19
ctttacttccttgttcctta

SEQ ID NO: 45718 - DNA, 20 bp, Artificial Sequence
  sgRNA
  Olfr90_20
tccaggccacagctgccagc

SEQ ID NO: 45719 - DNA, 20 bp, Artificial Sequence
  sgRNA
  Olfr91_1
tttaattcgactctcctgtg

SEQ ID NO: 45720 - DNA, 20 bp, Artificial Sequence
  sgRNA
  Olfr91_2
aagtcatctatctgcctatg

SEQ ID NO: 45721 - DNA, 20 bp, Artificial Sequence
  sgRNA
  Olfr91_3
caaaagacatcactgtcagg

SEQ ID NO: 45722 - DNA, 20 bp, Artificial Sequence
  sgRNA
  Olfr91_4
tgtgtccagtgttattcttg

SEQ ID NO: 45723 - DNA, 20 bp, Artificial Sequence
  sgRNA
  Olfr91_5
ttaaagatgggacttcacac

SEQ ID NO: 45724 - DNA, 20 bp, Artificial Sequence
  sgRNA
  Olfr91_6
ggataaactccactgaagca

SEQ ID NO: 45725 - DNA, 20 bp, Artificial Sequence
  sgRNA
  Olfr91_7
aggagagtcgaattaaagat

SEQ ID NO: 45726 - DNA, 20 bp, Artificial Sequence
  sgRNA
  Olfr91_8
ccagcttccagcacaggcga

SEQ ID NO: 45727 - DNA, 20 bp, Artificial Sequence
  sgRNA
  Olfr91_9
ctttaattcgactctcctgt

SEQ ID NO: 45728 - DNA, 20 bp, Artificial Sequence
  sgRNA
  Olfr91_10
gccagcttccagcacaggcg

SEQ ID NO: 45729 - DNA, 20 bp, Artificial Sequence
  sgRNA
  Olfr91_11
gggacagaagggcagcttga

SEQ ID NO: 45730 - DNA, 20 bp, Artificial Sequence
  sgRNA
  Olfr91_12
tgtcaggaggatgcactcgg

SEQ ID NO: 45731 - DNA, 20 bp, Artificial Sequence
  sgRNA
  Olfr91_13
gcccaaaaatccctatgccc

SEQ ID NO: 45732 - DNA, 20 bp, Artificial Sequence
  sgRNA
  Olfr91_14
gattactgagctgtagaaga

SEQ ID NO: 45733 - DNA, 20 bp, Artificial Sequence
  sgRNA
  Olfr91_15
tctcttacggagccattgcc

SEQ ID NO: 45734 - DNA, 20 bp, Artificial Sequence
  sgRNA
  Olfr91_16
attaaaagtggtgtccccac

SEQ ID NO: 45735 - DNA, 20 bp, Artificial Sequence
  sgRNA
  Olfr91_17
agctgcccttctgtccccat

SEQ ID NO: 45736 - DNA, 20 bp, Artificial Sequence
  sgRNA
  Olfr91_18
atctgcctatggggacagaa

SEQ ID NO: 45737 - DNA, 20 bp, Artificial Sequence
  sgRNA
  Olfr91_19
gtttatcctcatcactgccc

SEQ ID NO: 45738 - DNA, 20 bp, Artificial Sequence
  sgRNA
  Olfr91_20
ttatactctgaggaacaagg

SEQ ID NO: 45739 - DNA, 20 bp, Artificial Sequence
  sgRNA
  Olfr918_1
agaattccatctcctatgag

SEQ ID NO: 45740 - DNA, 20 bp, Artificial Sequence
  sgRNA
  Olfr918_2
aacaacgacttcattaacat

SEQ ID NO: 45741 - DNA, 20 bp, Artificial Sequence
  sgRNA
  Olfr918_3
atagcattgagcagacctgt

SEQ ID NO: 45742 - DNA, 20 bp, Artificial Sequence
  sgRNA
  Olfr918_4
aaggacaaactcagtcacaa

SEQ ID NO: 45743 - DNA, 20 bp, Artificial Sequence
  sgRNA
  Olfr918_5
cattctggatctatgaacca

SEQ ID NO: 45744 - DNA, 20 bp, Artificial Sequence
  sgRNA
  Olfr918_6
aataatctacactgtcacag

SEQ ID NO: 45745 - DNA, 20 bp, Artificial Sequence
  sgRNA
  Olfr918_7
tcaataataagcatgctgac

SEQ ID NO: 45746 - DNA, 20 bp, Artificial Sequence
  sgRNA
  Olfr918_8
tggcattgcagaagatcagt

SEQ ID NO: 45747 - DNA, 20 bp, Artificial Sequence
  sgRNA
  Olfr918_9
catgcacccctcataggaga

SEQ ID NO: 45748 - DNA, 20 bp, Artificial Sequence
  sgRNA
  Olfr918_10
ggtgcaagaaagttggagga

SEQ ID NO: 45749 - DNA, 20 bp, Artificial Sequence
  sgRNA
  Olfr918_11
tgctggtgcaagaaagttgg

SEQ ID NO: 45750 - DNA, 20 bp, Artificial Sequence
  sgRNA
  Olfr918_12
cagtgtagattattagaaac

SEQ ID NO: 45751 - DNA, 20 bp, Artificial Sequence
  sgRNA
  Olfr918_13
atacagcagtggattacaga

SEQ ID NO: 45752 - DNA, 20 bp, Artificial Sequence
  sgRNA
  Olfr918_14
attcagagataacaaaaaag

SEQ ID NO: 45753 - DNA, 20 bp, Artificial Sequence
  sgRNA
  Olfr918_15
gctggagcctctgcccacac

SEQ ID NO: 45754 - DNA, 20 bp, Artificial Sequence
  sgRNA
  Olfr918_16
tggtgcaagaaagttggagg

SEQ ID NO: 45755 - DNA, 20 bp, Artificial Sequence
  sgRNA
  Olfr918_17
gatagcattgagcagacctg

SEQ ID NO: 45756 - DNA, 20 bp, Artificial Sequence
  sgRNA
  Olfr918_18
ataagcatgctgactggaaa

SEQ ID NO: 45757 - DNA, 20 bp, Artificial Sequence
  sgRNA
  Olfr918_19
tagcattgagcagacctgtg

SEQ ID NO: 45758 - DNA, 20 bp, Artificial Sequence
  sgRNA
  Olfr918_20
gtgcaagaaagttggaggag

SEQ ID NO: 45759 - DNA, 20 bp, Artificial Sequence
  sgRNA
  Olfr92_1
cacctataatgagatccaga

SEQ ID NO: 45760 - DNA, 20 bp, Artificial Sequence
  sgRNA
  Olfr92_2
gtgaagcctggggtccaggg

SEQ ID NO: 45761 - DNA, 20 bp, Artificial Sequence
  sgRNA
  Olfr92_3
cccccacctatgtcgccagt

SEQ ID NO: 45762 - DNA, 20 bp, Artificial Sequence
  sgRNA
  Olfr92_4
gggaacaaaatggcagtttg

SEQ ID NO: 45763 - DNA, 20 bp, Artificial Sequence
  sgRNA
  Olfr92_5
cccaagctatacctgccaac

SEQ ID NO: 45764 - DNA, 20 bp, Artificial Sequence
  sgRNA
  Olfr92_6
aaacctgtatgcccgagaga

SEQ ID NO: 45765 - DNA, 20 bp, Artificial Sequence
  sgRNA
  Olfr92_7
accctcttgtatacaccctg

SEQ ID NO: 45766 - DNA, 20 bp, Artificial Sequence
  sgRNA
  Olfr92_8
catctggatctcattatagg

SEQ ID NO: 45767 - DNA, 20 bp, Artificial Sequence
  sgRNA
  Olfr92_9
ggttgtcagagaagcccagc

SEQ ID NO: 45768 - DNA, 20 bp, Artificial Sequence
  sgRNA
  Olfr92_10
ccaactggcgacataggtgg

SEQ ID NO: 45769 - DNA, 20 bp, Artificial Sequence
  sgRNA
  Olfr92_11
cttctctgacaacccacaac

SEQ ID NO: 45770 - DNA, 20 bp, Artificial Sequence
  sgRNA
  Olfr92_12
tctaattcaactctcttgtg

SEQ ID NO: 45771 - DNA, 20 bp, Artificial Sequence
  sgRNA
  Olfr92_13
atacaccctgaggaacaagg

SEQ ID NO: 45772 - DNA, 20 bp, Artificial Sequence
  sgRNA
  Olfr92_14
aaaacctgtatgcccgagag

SEQ ID NO: 45773 - DNA, 20 bp, Artificial Sequence
  sgRNA
  Olfr92_15
ccagttggcaggtatagctt

SEQ ID NO: 45774 - DNA, 20 bp, Artificial Sequence
  sgRNA
  Olfr92_16
tcctcagggtgtatacaaga

SEQ ID NO: 45775 - DNA, 20 bp, Artificial Sequence
  sgRNA
  Olfr92_17
acattggagagtgaagcctg

SEQ ID NO: 45776 - DNA, 20 bp, Artificial Sequence
  sgRNA
  Olfr92_18
agagtgaagcctggggtcca

SEQ ID NO: 45777 - DNA, 20 bp, Artificial Sequence
  sgRNA
  Olfr92_19
tgacaacccacaactggaaa

SEQ ID NO: 45778 - DNA, 20 bp, Artificial Sequence
  sgRNA
  Olfr92_20
tgccaactggcgacataggt

SEQ ID NO: 45779 - DNA, 20 bp, Artificial Sequence
  sgRNA
  Olfr924_1
ctcaagcacccatatcaacg

SEQ ID NO: 45780 - DNA, 20 bp, Artificial Sequence
  sgRNA
  Olfr924_2
taacattgtcatgtcccaca

SEQ ID NO: 45781 - DNA, 20 bp, Artificial Sequence
  sgRNA
  Olfr924_3
catatattgccagaaacaag

SEQ ID NO: 45782 - DNA, 20 bp, Artificial Sequence
  sgRNA
  Olfr924_4
cttctgcaataacaaaaatg

SEQ ID NO: 45783 - DNA, 20 bp, Artificial Sequence
  sgRNA
  Olfr924_5
gtaggatatcacaaaaatag

SEQ ID NO: 45784 - DNA, 20 bp, Artificial Sequence
  sgRNA
  Olfr924_6
atatatgtgatcacagtagt

SEQ ID NO: 45785 - DNA, 20 bp, Artificial Sequence
  sgRNA
  Olfr924_7
gacagccagtgtaggtgcaa

SEQ ID NO: 45786 - DNA, 20 bp, Artificial Sequence
  sgRNA
  Olfr924_8
aagacagagtcaacaaaggt

SEQ ID NO: 45787 - DNA, 20 bp, Artificial Sequence
  sgRNA
  Olfr924_9
aatgcactgaaaaagatggt

SEQ ID NO: 45788 - DNA, 20 bp, Artificial Sequence
  sgRNA
  Olfr924_10
gccagaaacaagaggaacag

SEQ ID NO: 45789 - DNA, 20 bp, Artificial Sequence
  sgRNA
  Olfr924_11
atgacaatgttataaagcag

SEQ ID NO: 45790 - DNA, 20 bp, Artificial Sequence
  sgRNA
  Olfr924_12
atttagcatagggatcactg

SEQ ID NO: 45791 - DNA, 20 bp, Artificial Sequence
  sgRNA
  Olfr924_13
ttcctcagactgtatataag

SEQ ID NO: 45792 - DNA, 20 bp, Artificial Sequence
  sgRNA
  Olfr924_14
tgacaatgttataaagcagt

SEQ ID NO: 45793 - DNA, 20 bp, Artificial Sequence
  sgRNA
  Olfr924_15
agagtgaagttgagaactaa

SEQ ID NO: 45794 - DNA, 20 bp, Artificial Sequence
  sgRNA
  Olfr924_16
atataaggggatttagcata

SEQ ID NO: 45795 - DNA, 20 bp, Artificial Sequence
  sgRNA
  Olfr924_17
gcactgaaaaagatggttgg

SEQ ID NO: 45796 - DNA, 20 bp, Artificial Sequence
  sgRNA
  Olfr924_18
aatatatgtgatcacagtag

SEQ ID NO: 45797 - DNA, 20 bp, Artificial Sequence
  sgRNA
  Olfr924_19
gttcctcagactgtatataa

SEQ ID NO: 45798 - DNA, 20 bp, Artificial Sequence
  sgRNA
  Olfr924_20
gacaatatgagacccacaga

SEQ ID NO: 45799 - DNA, 20 bp, Artificial Sequence
  sgRNA
  Olfr926_1
gggcatacatgtgattacag

SEQ ID NO: 45800 - DNA, 20 bp, Artificial Sequence
  sgRNA
  Olfr926_2
taacactgtaatgtcccaca

SEQ ID NO: 45801 - DNA, 20 bp, Artificial Sequence
  sgRNA
  Olfr926_3
cttctgaaatagctaaaagg

SEQ ID NO: 45802 - DNA, 20 bp, Artificial Sequence
  sgRNA
  Olfr926_4
tctgtgggtctcatattatc

SEQ ID NO: 45803 - DNA, 20 bp, Artificial Sequence
  sgRNA
  Olfr926_5
catgtatgcccagaaacaag

SEQ ID NO: 45804 - DNA, 20 bp, Artificial Sequence
  sgRNA
  Olfr926_6
actgctctgaaaaagatggt

SEQ ID NO: 45805 - DNA, 20 bp, Artificial Sequence
  sgRNA
  Olfr926_7
gataatatgagacccacaga

SEQ ID NO: 45806 - DNA, 20 bp, Artificial Sequence
  sgRNA
  Olfr926_8
attacagtgttataaagcag

SEQ ID NO: 45807 - DNA, 20 bp, Artificial Sequence
  sgRNA
  Olfr926_9
ttcctcagactgtatatgag

SEQ ID NO: 45808 - DNA, 20 bp, Artificial Sequence
  sgRNA
  Olfr926_10
ttacagtgttataaagcagt

SEQ ID NO: 45809 - DNA, 20 bp, Artificial Sequence
  sgRNA
  Olfr926_11
atacatgtgattacagtggt

SEQ ID NO: 45810 - DNA, 20 bp, Artificial Sequence
  sgRNA
  Olfr926_12
atttagcattgggatcactg

SEQ ID NO: 45811 - DNA, 20 bp, Artificial Sequence
  sgRNA
  Olfr926_13
aaagactgctctgaaaaaga

SEQ ID NO: 45812 - DNA, 20 bp, Artificial Sequence
  sgRNA
  Olfr926_14
gttcctcagactgtatatga

SEQ ID NO: 45813 - DNA, 20 bp, Artificial Sequence
  sgRNA
  Olfr926_15
catacatgtgattacagtgg

SEQ ID NO: 45814 - DNA, 20 bp, Artificial Sequence
  sgRNA
  Olfr926_16
atatgaggggatttagcatt

SEQ ID NO: 45815 - DNA, 20 bp, Artificial Sequence
  sgRNA
  Olfr926_17
agccttctgaaatagctaaa

SEQ ID NO: 45816 - DNA, 20 bp, Artificial Sequence
  sgRNA
  Olfr926_18
gacagccagtgtaggtgcta

SEQ ID NO: 45817 - DNA, 20 bp, Artificial Sequence
  sgRNA
  Olfr926_19
cccagaaacaagaggaacag

SEQ ID NO: 45818 - DNA, 20 bp, Artificial Sequence
  sgRNA
  Olfr926_20
tgaaaaagatggttggtaga

SEQ ID NO: 45819 - DNA, 20 bp, Artificial Sequence
  sgRNA
  Olfr93_1
gaacaacatctggggaacac

SEQ ID NO: 45820 - DNA, 20 bp, Artificial Sequence
  sgRNA
  Olfr93_2
tggtgtccccacaagagagt

SEQ ID NO: 45821 - DNA, 20 bp, Artificial Sequence
  sgRNA
  Olfr93_3
taggcgggggtggattatgg

SEQ ID NO: 45822 - DNA, 20 bp, Artificial Sequence
  sgRNA
  Olfr93_4
atttgcctatgggaacagaa

SEQ ID NO: 45823 - DNA, 20 bp, Artificial Sequence
  sgRNA
  Olfr93_5
tgaggctcagaggtacaagc

SEQ ID NO: 45824 - DNA, 20 bp, Artificial Sequence
  sgRNA
  Olfr93_6
cactgcccttctgttcccat

SEQ ID NO: 45825 - DNA, 20 bp, Artificial Sequence
  sgRNA
  Olfr93_7
ccaactggcgacataggcgg

SEQ ID NO: 45826 - DNA, 20 bp, Artificial Sequence
  sgRNA
  Olfr93_8
ggatgcactctgttgtcccc

SEQ ID NO: 45827 - DNA, 20 bp, Artificial Sequence
  sgRNA
  Olfr93_9
gccaactggcgacataggcg

SEQ ID NO: 45828 - DNA, 20 bp, Artificial Sequence
  sgRNA
  Olfr93_10
aatgactgagctgtaaaaga

SEQ ID NO: 45829 - DNA, 20 bp, Artificial Sequence
  sgRNA
  Olfr93_11
gctgacagacagccacatag

SEQ ID NO: 45830 - DNA, 20 bp, Artificial Sequence
  sgRNA
  Olfr93_12
cagaggttgaacaacatctg

SEQ ID NO: 45831 - DNA, 20 bp, Artificial Sequence
  sgRNA
  Olfr93_13
gattatggtggcatagtgca

SEQ ID NO: 45832 - DNA, 20 bp, Artificial Sequence
  sgRNA
  Olfr93_14
caaaggccattactgtcaac

SEQ ID NO: 45833 - DNA, 20 bp, Artificial Sequence
  sgRNA
  Olfr93_15
gttcagagaagcccaggagg

SEQ ID NO: 45834 - DNA, 20 bp, Artificial Sequence
  sgRNA
  Olfr93_16
attatggtggcatagtgcag

SEQ ID NO: 45835 - DNA, 20 bp, Artificial Sequence
  sgRNA
  Olfr93_17
tctaatccgactctcttgtg

SEQ ID NO: 45836 - DNA, 20 bp, Artificial Sequence
  sgRNA
  Olfr93_18
gagacaatgatgaggctcag

SEQ ID NO: 45837 - DNA, 20 bp, Artificial Sequence
  sgRNA
  Olfr93_19
gagggtaaccacaatgaggt

SEQ ID NO: 45838 - DNA, 20 bp, Artificial Sequence
  sgRNA
  Olfr93_20
ctgttcatcccacctcattg

SEQ ID NO: 45839 - DNA, 20 bp, Artificial Sequence
  sgRNA
  Olfr930_1
catacgccataacagtcagg

SEQ ID NO: 45840 - DNA, 20 bp, Artificial Sequence
  sgRNA
  Olfr930_2
tacagcagaaaaaaggccta

SEQ ID NO: 45841 - DNA, 20 bp, Artificial Sequence
  sgRNA
  Olfr930_3
catcacttattcggagtgca

SEQ ID NO: 45842 - DNA, 20 bp, Artificial Sequence
  sgRNA
  Olfr930_4
caacaaaggataagctgctg

SEQ ID NO: 45843 - DNA, 20 bp, Artificial Sequence
  sgRNA
  Olfr930_5
tatggcgtatgatcactacg

SEQ ID NO: 45844 - DNA, 20 bp, Artificial Sequence
  sgRNA
  Olfr930_6
ggaataggagagatcaacaa

SEQ ID NO: 45845 - DNA, 20 bp, Artificial Sequence
  sgRNA
  Olfr930_7
acatgggagtatgcagcagt

SEQ ID NO: 45846 - DNA, 20 bp, Artificial Sequence
  sgRNA
  Olfr930_8
gatcatacgccataacagtc

SEQ ID NO: 45847 - DNA, 20 bp, Artificial Sequence
  sgRNA
  Olfr930_9
tgtgtactacagcagaaaaa

SEQ ID NO: 45848 - DNA, 20 bp, Artificial Sequence
  sgRNA
  Olfr930_10
ctacagcagaaaaaaggcct

SEQ ID NO: 45849 - DNA, 20 bp, Artificial Sequence
  sgRNA
  Olfr930_11
gaaatggcaacagctagggt

SEQ ID NO: 45850 - DNA, 20 bp, Artificial Sequence
  sgRNA
  Olfr930_12
tattggagggatcaacacct

SEQ ID NO: 45851 - DNA, 20 bp, Artificial Sequence
  sgRNA
  Olfr930_13
ttctcatatttattattgga

SEQ ID NO: 45852 - DNA, 20 bp, Artificial Sequence
  sgRNA
  Olfr930_14
ataggaaatggcaacagcta

SEQ ID NO: 45853 - DNA, 20 bp, Artificial Sequence
  sgRNA
  Olfr930_15
gcggtctttgtggtcactga

SEQ ID NO: 45854 - DNA, 20 bp, Artificial Sequence
  sgRNA
  Olfr930_16
gagcaggaaagtttgaggag

SEQ ID NO: 45855 - DNA, 20 bp, Artificial Sequence
  sgRNA
  Olfr930_17
gggtgtaatgacagtggaat

SEQ ID NO: 45856 - DNA, 20 bp, Artificial Sequence
  sgRNA
  Olfr930_18
cataggaaatggcaacagct

SEQ ID NO: 45857 - DNA, 20 bp, Artificial Sequence
  sgRNA
  Olfr930_19
atcatcacattatacagcaa

SEQ ID NO: 45858 - DNA, 20 bp, Artificial Sequence
  sgRNA
  Olfr930_20
tctttgatgacttgatgtga

SEQ ID NO: 45859 - DNA, 20 bp, Artificial Sequence
  sgRNA
  Olfr933_1
gagcaggagaggtttaggag

SEQ ID NO: 45860 - DNA, 20 bp, Artificial Sequence
  sgRNA
  Olfr933_2
tttctttgtgatcttcgtgg

SEQ ID NO: 45861 - DNA, 20 bp, Artificial Sequence
  sgRNA
  Olfr933_3
tagcagtgagcaaagtctgg

SEQ ID NO: 45862 - DNA, 20 bp, Artificial Sequence
  sgRNA
  Olfr933_4
tacataggagtatgcagcag

SEQ ID NO: 45863 - DNA, 20 bp, Artificial Sequence
  sgRNA
  Olfr933_5
gctttatgtcagagcaggag

SEQ ID NO: 45864 - DNA, 20 bp, Artificial Sequence
  sgRNA
  Olfr933_6
tgctccagagagttacttga

SEQ ID NO: 45865 - DNA, 20 bp, Artificial Sequence
  sgRNA
  Olfr933_7
aggaggcttgaaatacatga

SEQ ID NO: 45866 - DNA, 20 bp, Artificial Sequence
  sgRNA
  Olfr933_8
agagcaggagaggtttagga

SEQ ID NO: 45867 - DNA, 20 bp, Artificial Sequence
  sgRNA
  Olfr933_9
gaaaataaagacataagaga

SEQ ID NO: 45868 - DNA, 20 bp, Artificial Sequence
  sgRNA
  Olfr933_10
gcctccttcaagtaactctc

SEQ ID NO: 45869 - DNA, 20 bp, Artificial Sequence
  sgRNA
  Olfr933_11
gtgatcttcgtggtggctga

SEQ ID NO: 45870 - DNA, 20 bp, Artificial Sequence
  sgRNA
  Olfr933_12
cattgggcaaatgtctggca

SEQ ID NO: 45871 - DNA, 20 bp, Artificial Sequence
  sgRNA
  Olfr933_13
gaaataatggcttatgacgt

SEQ ID NO: 45872 - DNA, 20 bp, Artificial Sequence
  sgRNA
  Olfr933_14
catggcatatgatcgctatg

SEQ ID NO: 45873 - DNA, 20 bp, Artificial Sequence
  sgRNA
  Olfr933_15
cattgcaggcttcaacacct

SEQ ID NO: 45874 - DNA, 20 bp, Artificial Sequence
  sgRNA
  Olfr933_16
cacatagcgatcatatgcca

SEQ ID NO: 45875 - DNA, 20 bp, Artificial Sequence
  sgRNA
  Olfr933_17
tgtcagagcaggagaggttt

SEQ ID NO: 45876 - DNA, 20 bp, Artificial Sequence
  sgRNA
  Olfr933_18
agagatggcaacagctagag

SEQ ID NO: 45877 - DNA, 20 bp, Artificial Sequence
  sgRNA
  Olfr933_19
catatgccatggcagtcagc

SEQ ID NO: 45878 - DNA, 20 bp, Artificial Sequence
  sgRNA
  Olfr933_20
tccagagagttacttgaagg

SEQ ID NO: 45879 - DNA, 20 bp, Artificial Sequence
  sgRNA
  Olfr935_1
aaactcctaaaacaattgaa

SEQ ID NO: 45880 - DNA, 20 bp, Artificial Sequence
  sgRNA
  Olfr935_2
tatttcagaatgttacatgc

SEQ ID NO: 45881 - DNA, 20 bp, Artificial Sequence
  sgRNA
  Olfr935_3
agagcttaaggatagaaata

SEQ ID NO: 45882 - DNA, 20 bp, Artificial Sequence
  sgRNA
  Olfr935_4
ggtagattccaagaaagagg

SEQ ID NO: 45883 - DNA, 20 bp, Artificial Sequence
  sgRNA
  Olfr935_5
ataatgctactataaagtaa

SEQ ID NO: 45884 - DNA, 20 bp, Artificial Sequence
  sgRNA
  Olfr935_6
gttgagcatgggaacaataa

SEQ ID NO: 45885 - DNA, 20 bp, Artificial Sequence
  sgRNA
  Olfr935_7
ttacgcattaaatccactga

SEQ ID NO: 45886 - DNA, 20 bp, Artificial Sequence
  sgRNA
  Olfr935_8
tgatgaaaacataagaactg

SEQ ID NO: 45887 - DNA, 20 bp, Artificial Sequence
  sgRNA
  Olfr935_9
gttgttctgttaagccagag

SEQ ID NO: 45888 - DNA, 20 bp, Artificial Sequence
  sgRNA
  Olfr935_10
gaaaacataagaactgagga

SEQ ID NO: 45889 - DNA, 20 bp, Artificial Sequence
  sgRNA
  Olfr935_11
aacattctgaaatagcaaaa

SEQ ID NO: 45890 - DNA, 20 bp, Artificial Sequence
  sgRNA
  Olfr935_12
taatgctactataaagtaag

SEQ ID NO: 45891 - DNA, 20 bp, Artificial Sequence
  sgRNA
  Olfr935_13
actgaggatggtcagcgttg

SEQ ID NO: 45892 - DNA, 20 bp, Artificial Sequence
  sgRNA
  Olfr935_14
ccatagaattggaagaagat

SEQ ID NO: 45893 - DNA, 20 bp, Artificial Sequence
  sgRNA
  Olfr935_15
ataaagtaaggggctacaga

SEQ ID NO: 45894 - DNA, 20 bp, Artificial Sequence
  sgRNA
  Olfr935_16
aactgaggatggtcagcgtt

SEQ ID NO: 45895 - DNA, 20 bp, Artificial Sequence
  sgRNA
  Olfr935_17
cccatcttcttccaattcta

SEQ ID NO: 45896 - DNA, 20 bp, Artificial Sequence
  sgRNA
  Olfr935_18
catcagagcacgagagctta

SEQ ID NO: 45897 - DNA, 20 bp, Artificial Sequence
  sgRNA
  Olfr935_19
tccatagaattggaagaaga

SEQ ID NO: 45898 - DNA, 20 bp, Artificial Sequence
  sgRNA
  Olfr935_20
aattgaaaggcacttatgtt

SEQ ID NO: 45899 - DNA, 20 bp, Artificial Sequence
  sgRNA
  Olfr936_1
tgatgctactgtaaagcagg

SEQ ID NO: 45900 - DNA, 20 bp, Artificial Sequence
  sgRNA
  Olfr936_2
gaaagtataagaaatgagga

SEQ ID NO: 45901 - DNA, 20 bp, Artificial Sequence
  sgRNA
  Olfr936_3
aaataagatcacagaaacaa

SEQ ID NO: 45902 - DNA, 20 bp, Artificial Sequence
  sgRNA
  Olfr936_4
taatgacagtagattggcag

SEQ ID NO: 45903 - DNA, 20 bp, Artificial Sequence
  sgRNA
  Olfr936_5
ggtagattccaagaaatagg

SEQ ID NO: 45904 - DNA, 20 bp, Artificial Sequence
  sgRNA
  Olfr936_6
gttggtctgttaaaccagag

SEQ ID NO: 45905 - DNA, 20 bp, Artificial Sequence
  sgRNA
  Olfr936_7
gcaggtagattccaagaaat

SEQ ID NO: 45906 - DNA, 20 bp, Artificial Sequence
  sgRNA
  Olfr936_8
catgatgctactgtaaagca

SEQ ID NO: 45907 - DNA, 20 bp, Artificial Sequence
  sgRNA
  Olfr936_9
cctcagtagatttaatgcgc

SEQ ID NO: 45908 - DNA, 20 bp, Artificial Sequence
  sgRNA
  Olfr936_10
ctgcgcattaaatctactga

SEQ ID NO: 45909 - DNA, 20 bp, Artificial Sequence
  sgRNA
  Olfr936_11
atgatgctactgtaaagcag

SEQ ID NO: 45910 - DNA, 20 bp, Artificial Sequence
  sgRNA
  Olfr936_12
gtaaagcagggggctacaga

SEQ ID NO: 45911 - DNA, 20 bp, Artificial Sequence
  sgRNA
  Olfr936_13
gttgagcataggcacaaaga

SEQ ID NO: 45912 - DNA, 20 bp, Artificial Sequence
  sgRNA
  Olfr936_14
tcttcaagctccatagatga

SEQ ID NO: 45913 - DNA, 20 bp, Artificial Sequence
  sgRNA
  Olfr936_15
ataagaaatgaggatggtca

SEQ ID NO: 45914 - DNA, 20 bp, Artificial Sequence
  sgRNA
  Olfr936_16
cctgcgcattaaatctactg

SEQ ID NO: 45915 - DNA, 20 bp, Artificial Sequence
  sgRNA
  Olfr936_17
ccaagaaataggaggaaaag

SEQ ID NO: 45916 - DNA, 20 bp, Artificial Sequence
  sgRNA
  Olfr936_18
tgatgaaagtataagaaatg

SEQ ID NO: 45917 - DNA, 20 bp, Artificial Sequence
  sgRNA
  Olfr936_19
tctatggagcttgaagatga

SEQ ID NO: 45918 - DNA, 20 bp, Artificial Sequence
  sgRNA
  Olfr936_20
tgtttcagaatgtttcatgc

SEQ ID NO: 45919 - DNA, 20 bp, Artificial Sequence
  sgRNA
  Olfr94_1
actaacgctcaccggcaacg

SEQ ID NO: 45920 - DNA, 20 bp, Artificial Sequence
  sgRNA
  Olfr94_2
tgtgggtttcaccactagtg

SEQ ID NO: 45921 - DNA, 20 bp, Artificial Sequence
  sgRNA
  Olfr94_3
tttaatgctagacagtgttg

SEQ ID NO: 45922 - DNA, 20 bp, Artificial Sequence
  sgRNA
  Olfr94_4
agatgaaatggtccagacag

SEQ ID NO: 45923 - DNA, 20 bp, Artificial Sequence
  sgRNA
  Olfr94_5
ggttgcataccgcagccgcg

SEQ ID NO: 45924 - DNA, 20 bp, Artificial Sequence
  sgRNA
  Olfr94_6
gccataaaataggcagaccg

SEQ ID NO: 45925 - DNA, 20 bp, Artificial Sequence
  sgRNA
  Olfr94_7
ccctggttgtaactatgcgt

SEQ ID NO: 45926 - DNA, 20 bp, Artificial Sequence
  sgRNA
  Olfr94_8
tgagccatgcacccagcgcg

SEQ ID NO: 45927 - DNA, 20 bp, Artificial Sequence
  sgRNA
  Olfr94_9
caacaggatgaccacacgcg

SEQ ID NO: 45928 - DNA, 20 bp, Artificial Sequence
  sgRNA
  Olfr94_10
agtgcatgccccagaccgcg

SEQ ID NO: 45929 - DNA, 20 bp, Artificial Sequence
  sgRNA
  Olfr94_11
tgaccgccgaaggcaccaac

SEQ ID NO: 45930 - DNA, 20 bp, Artificial Sequence
  sgRNA
  Olfr94_12
tgctacctactaacgctcac

SEQ ID NO: 45931 - DNA, 20 bp, Artificial Sequence
  sgRNA
  Olfr94_13
ttgtggttagcggtaagaca

SEQ ID NO: 45932 - DNA, 20 bp, Artificial Sequence
  sgRNA
  Olfr94_14
catagttacaaccagggccg

SEQ ID NO: 45933 - DNA, 20 bp, Artificial Sequence
  sgRNA
  Olfr94_15
ctactgtgccgcacgctggc

SEQ ID NO: 45934 - DNA, 20 bp, Artificial Sequence
  sgRNA
  Olfr94_16
atgtggctctcacttgaccg

SEQ ID NO: 45935 - DNA, 20 bp, Artificial Sequence
  sgRNA
  Olfr94_17
cccacgcatagttacaacca

SEQ ID NO: 45936 - DNA, 20 bp, Artificial Sequence
  sgRNA
  Olfr94_18
cctggcctcctacatcgccg

SEQ ID NO: 45937 - DNA, 20 bp, Artificial Sequence
  sgRNA
  Olfr94_19
gtagatgagaggattgagag

SEQ ID NO: 45938 - DNA, 20 bp, Artificial Sequence
  sgRNA
  Olfr94_20
cgtctcgctcttctacacgg

SEQ ID NO: 45939 - DNA, 20 bp, Artificial Sequence
  sgRNA
  Olfr95_1
cctggagatctgctacacgt

SEQ ID NO: 45940 - DNA, 20 bp, Artificial Sequence
  sgRNA
  Olfr95_2
tggagactagcgccacgatg

SEQ ID NO: 45941 - DNA, 20 bp, Artificial Sequence
  sgRNA
  Olfr95_3
tagagccccgcaagaccacg

SEQ ID NO: 45942 - DNA, 20 bp, Artificial Sequence
  sgRNA
  Olfr95_4
cagagcgcgagatgtggcgc

SEQ ID NO: 45943 - DNA, 20 bp, Artificial Sequence
  sgRNA
  Olfr95_5
ggggcacaagatgataaggg

SEQ ID NO: 45944 - DNA, 20 bp, Artificial Sequence
  sgRNA
  Olfr95_6
agagagacaccactaccagg

SEQ ID NO: 45945 - DNA, 20 bp, Artificial Sequence
  sgRNA
  Olfr95_7
ggccagctatgacccaacca

SEQ ID NO: 45946 - DNA, 20 bp, Artificial Sequence
  sgRNA
  Olfr95_8
ccaggtgctgctcagccgca

SEQ ID NO: 45947 - DNA, 20 bp, Artificial Sequence
  sgRNA
  Olfr95_9
tcattcttagctcctacgga

SEQ ID NO: 45948 - DNA, 20 bp, Artificial Sequence
  sgRNA
  Olfr95_10
gctcgcagatcgcagcatag

SEQ ID NO: 45949 - DNA, 20 bp, Artificial Sequence
  sgRNA
  Olfr95_11
ggtgatcacagcatagaaga

SEQ ID NO: 45950 - DNA, 20 bp, Artificial Sequence
  sgRNA
  Olfr95_12
gaccgtctacctgctcactg

SEQ ID NO: 45951 - DNA, 20 bp, Artificial Sequence
  sgRNA
  Olfr95_13
gcagatggtgcagcagcaag

SEQ ID NO: 45952 - DNA, 20 bp, Artificial Sequence
  sgRNA
  Olfr95_14
gagcagcacctggtagcgca

SEQ ID NO: 45953 - DNA, 20 bp, Artificial Sequence
  sgRNA
  Olfr95_15
gggtgatcacagcatagaag

SEQ ID NO: 45954 - DNA, 20 bp, Artificial Sequence
  sgRNA
  Olfr95_16
cgagctgcacacaaaccctg

SEQ ID NO: 45955 - DNA, 20 bp, Artificial Sequence
  sgRNA
  Olfr95_17
cttcttctgtgagatccagc

SEQ ID NO: 45956 - DNA, 20 bp, Artificial Sequence
  sgRNA
  Olfr95_18
tgcaccatctgctcactggc

SEQ ID NO: 45957 - DNA, 20 bp, Artificial Sequence
  sgRNA
  Olfr95_19
ggtcttgcggggctctagtg

SEQ ID NO: 45958 - DNA, 20 bp, Artificial Sequence
  sgRNA
  Olfr95_20
ggtgaccaggatccgtccgt

SEQ ID NO: 45959 - DNA, 20 bp, Artificial Sequence
  sgRNA
  Olfr958_1
atgatgaccgagtaccgaag

SEQ ID NO: 45960 - DNA, 20 bp, Artificial Sequence
  sgRNA
  Olfr958_2
gggaaatgtatctatccttg

SEQ ID NO: 45961 - DNA, 20 bp, Artificial Sequence
  sgRNA
  Olfr958_3
agagtgagcttcactaatgt

SEQ ID NO: 45962 - DNA, 20 bp, Artificial Sequence
  sgRNA
  Olfr958_4
gggaagttaagacgctggag

SEQ ID NO: 45963 - DNA, 20 bp, Artificial Sequence
  sgRNA
  Olfr958_5
tgatgaccgagtaccgaaga

SEQ ID NO: 45964 - DNA, 20 bp, Artificial Sequence
  sgRNA
  Olfr958_6
tgagtattcagtcaactgag

SEQ ID NO: 45965 - DNA, 20 bp, Artificial Sequence
  sgRNA
  Olfr958_7
actagggtacaggcatagaa

SEQ ID NO: 45966 - DNA, 20 bp, Artificial Sequence
  sgRNA
  Olfr958_8
agttgactgaatactcaaga

SEQ ID NO: 45967 - DNA, 20 bp, Artificial Sequence
  sgRNA
  Olfr958_9
gcacgacagttcccagcatg

SEQ ID NO: 45968 - DNA, 20 bp, Artificial Sequence
  sgRNA
  Olfr958_10
ggtgacaaatggcagcaaag

SEQ ID NO: 45969 - DNA, 20 bp, Artificial Sequence
  sgRNA
  Olfr958_11
ggatagatacatttcccact

SEQ ID NO: 45970 - DNA, 20 bp, Artificial Sequence
  sgRNA
  Olfr958_12
gatcaggagaaagcagacaa

SEQ ID NO: 45971 - DNA, 20 bp, Artificial Sequence
  sgRNA
  Olfr958_13
catgaactctaagatctgtg

SEQ ID NO: 45972 - DNA, 20 bp, Artificial Sequence
  sgRNA
  Olfr958_14
ctggggatcccacacacaga

SEQ ID NO: 45973 - DNA, 20 bp, Artificial Sequence
  sgRNA
  Olfr958_15
gtaaggcaaagtgaaggtga

SEQ ID NO: 45974 - DNA, 20 bp, Artificial Sequence
  sgRNA
  Olfr958_16
gatagatacatttcccacta

SEQ ID NO: 45975 - DNA, 20 bp, Artificial Sequence
  sgRNA
  Olfr958_17
ggagattgtgattcgtgtat

SEQ ID NO: 45976 - DNA, 20 bp, Artificial Sequence
  sgRNA
  Olfr958_18
ttataggtccataggcacag

SEQ ID NO: 45977 - DNA, 20 bp, Artificial Sequence
  sgRNA
  Olfr958_19
gttccccaggaaaaaataca

SEQ ID NO: 45978 - DNA, 20 bp, Artificial Sequence
  sgRNA
  Olfr958_20
tcctcaaagtatagatcaaa

SEQ ID NO: 45979 - DNA, 20 bp, Artificial Sequence
  sgRNA
  Olfr96_1
gctggaaggcttcttacagg

SEQ ID NO: 45980 - DNA, 20 bp, Artificial Sequence
  sgRNA
  Olfr96_2
ggcaccattgaggccccatg

SEQ ID NO: 45981 - DNA, 20 bp, Artificial Sequence
  sgRNA
  Olfr96_3
tgaacacagaaaaaaacagg

SEQ ID NO: 45982 - DNA, 20 bp, Artificial Sequence
  sgRNA
  Olfr96_4
aaaagtgatcaactaagttg

SEQ ID NO: 45983 - DNA, 20 bp, Artificial Sequence
  sgRNA
  Olfr96_5
catgagtgttccatagaacg

SEQ ID NO: 45984 - DNA, 20 bp, Artificial Sequence
  sgRNA
  Olfr96_6
tctacgatacccacacctca

SEQ ID NO: 45985 - DNA, 20 bp, Artificial Sequence
  sgRNA
  Olfr96_7
gattgtctatacctccacag

SEQ ID NO: 45986 - DNA, 20 bp, Artificial Sequence
  sgRNA
  Olfr96_8
tgaggtgtgggtatcgtaga

SEQ ID NO: 45987 - DNA, 20 bp, Artificial Sequence
  sgRNA
  Olfr96_9
ggcttgctcagatacccaag

SEQ ID NO: 45988 - DNA, 20 bp, Artificial Sequence
  sgRNA
  Olfr96_10
tctatgcctccatcatcaca

SEQ ID NO: 45989 - DNA, 20 bp, Artificial Sequence
  sgRNA
  Olfr96_11
gtggtgcccaaaatgctgga

SEQ ID NO: 45990 - DNA, 20 bp, Artificial Sequence
  sgRNA
  Olfr96_12
ctacgatacccacacctcat

SEQ ID NO: 45991 - DNA, 20 bp, Artificial Sequence
  sgRNA
  Olfr96_13
gatgatggaggcatagagga

SEQ ID NO: 45992 - DNA, 20 bp, Artificial Sequence
  sgRNA
  Olfr96_14
ggggccacagaatctcaact

SEQ ID NO: 45993 - DNA, 20 bp, Artificial Sequence
  sgRNA
  Olfr96_15
gctgtggtgtccacgttcta

SEQ ID NO: 45994 - DNA, 20 bp, Artificial Sequence
  sgRNA
  Olfr96_16
agtgacagtttgatttcctg

SEQ ID NO: 45995 - DNA, 20 bp, Artificial Sequence
  sgRNA
  Olfr96_17
gtaaaagtgatcaactaagt

SEQ ID NO: 45996 - DNA, 20 bp, Artificial Sequence
  sgRNA
  Olfr96_18
gagctgagaatgaacagcag

SEQ ID NO: 45997 - DNA, 20 bp, Artificial Sequence
  sgRNA
  Olfr96_19
agctgagaatgaacagcaga

SEQ ID NO: 45998 - DNA, 20 bp, Artificial Sequence
  sgRNA
  Olfr96_20
acaggaggccaccatatctg

SEQ ID NO: 45999 - DNA, 20 bp, Artificial Sequence
  sgRNA
  Olfr978_1
ggtcatctttgtgaatatcg

SEQ ID NO: 46000 - DNA, 20 bp, Artificial Sequence
  sgRNA
  Olfr978_2
aggtacagcagcatgatggg

SEQ ID NO: 46001 - DNA, 20 bp, Artificial Sequence
  sgRNA
  Olfr978_3
accacagtagggcaaatgga

SEQ ID NO: 46002 - DNA, 20 bp, Artificial Sequence
  sgRNA
  Olfr978_4
catcctgacggtgatcaggg

SEQ ID NO: 46003 - DNA, 20 bp, Artificial Sequence
  sgRNA
  Olfr978_5
tcaggtagatgaagagacca

SEQ ID NO: 46004 - DNA, 20 bp, Artificial Sequence
  sgRNA
  Olfr978_6
gcatggagtccaggactggt

SEQ ID NO: 46005 - DNA, 20 bp, Artificial Sequence
  sgRNA
  Olfr978_7
gaccagggccaaagaaacag

SEQ ID NO: 46006 - DNA, 20 bp, Artificial Sequence
  sgRNA
  Olfr978_8
tctcatcctgacggtgatca

SEQ ID NO: 46007 - DNA, 20 bp, Artificial Sequence
  sgRNA
  Olfr978_9
aatccaccctgatcaccgtc

SEQ ID NO: 46008 - DNA, 20 bp, Artificial Sequence
  sgRNA
  Olfr978_10
gatggccaagtagcgatcat

SEQ ID NO: 46009 - DNA, 20 bp, Artificial Sequence
  sgRNA
  Olfr978_11
tgtcaacacagtgtagaaaa

SEQ ID NO: 46010 - DNA, 20 bp, Artificial Sequence
  sgRNA
  Olfr978_12
cttcacttctttgttcctca

SEQ ID NO: 46011 - DNA, 20 bp, Artificial Sequence
  sgRNA
  Olfr978_13
tgatcaccgtcaggatgaga

SEQ ID NO: 46012 - DNA, 20 bp, Artificial Sequence
  sgRNA
  Olfr978_14
actcaggtacagcagcatga

SEQ ID NO: 46013 - DNA, 20 bp, Artificial Sequence
  sgRNA
  Olfr978_15
tgaaccatgttcctgctgcc

SEQ ID NO: 46014 - DNA, 20 bp, Artificial Sequence
  sgRNA
  Olfr978_16
catgtcctatgatcgctact

SEQ ID NO: 46015 - DNA, 20 bp, Artificial Sequence
  sgRNA
  Olfr978_17
aattccatctacagcatccc

SEQ ID NO: 46016 - DNA, 20 bp, Artificial Sequence
  sgRNA
  Olfr978_18
accatgttcctgctgccagg

SEQ ID NO: 46017 - DNA, 20 bp, Artificial Sequence
  sgRNA
  Olfr978_19
gcactgttgaaaataaaata

SEQ ID NO: 46018 - DNA, 20 bp, Artificial Sequence
  sgRNA
  Olfr978_20
atatcggggtagtggcttcg

SEQ ID NO: 46019 - DNA, 20 bp, Artificial Sequence
  sgRNA
  Olfr979_1
ggagatagcccctccccttg

SEQ ID NO: 46020 - DNA, 20 bp, Artificial Sequence
  sgRNA
  Olfr979_2
ggtcatctttgtgaacatcg

SEQ ID NO: 46021 - DNA, 20 bp, Artificial Sequence
  sgRNA
  Olfr979_3
accacagtagggcaaacgga

SEQ ID NO: 46022 - DNA, 20 bp, Artificial Sequence
  sgRNA
  Olfr979_4
gacagtgtacaggaaacact

SEQ ID NO: 46023 - DNA, 20 bp, Artificial Sequence
  sgRNA
  Olfr979_5
gattctgatggtaatcaggg

SEQ ID NO: 46024 - DNA, 20 bp, Artificial Sequence
  sgRNA
  Olfr979_6
gatgacgttggtttccccaa

SEQ ID NO: 46025 - DNA, 20 bp, Artificial Sequence
  sgRNA
  Olfr979_7
cctcaggtagataaaaacac

SEQ ID NO: 46026 - DNA, 20 bp, Artificial Sequence
  sgRNA
  Olfr979_8
gcacaagccagcttgaggat

SEQ ID NO: 46027 - DNA, 20 bp, Artificial Sequence
  sgRNA
  Olfr979_9
tgaagtacgaatcctcagga

SEQ ID NO: 46028 - DNA, 20 bp, Artificial Sequence
  sgRNA
  Olfr979_10
tgatgacgttggtttcccca

SEQ ID NO: 46029 - DNA, 20 bp, Artificial Sequence
  sgRNA
  Olfr979_11
ccctgattaccatcagaatc

SEQ ID NO: 46030 - DNA, 20 bp, Artificial Sequence
  sgRNA
  Olfr979_12
agtagtacatgggtgtgtgg

SEQ ID NO: 46031 - DNA, 20 bp, Artificial Sequence
  sgRNA
  Olfr979_13
cctgattctgatggtaatca

SEQ ID NO: 46032 - DNA, 20 bp, Artificial Sequence
  sgRNA
  Olfr979_14
ctcaggtagataaaaacaca

SEQ ID NO: 46033 - DNA, 20 bp, Artificial Sequence
  sgRNA
  Olfr979_15
ggattcgtacttcagagggc

SEQ ID NO: 46034 - DNA, 20 bp, Artificial Sequence
  sgRNA
  Olfr979_16
cgttggtttccccaagggga

SEQ ID NO: 46035 - DNA, 20 bp, Artificial Sequence
  sgRNA
  Olfr979_17
accacatatcaataaaggag

SEQ ID NO: 46036 - DNA, 20 bp, Artificial Sequence
  sgRNA
  Olfr979_18
caagccagcttgaggatggg

SEQ ID NO: 46037 - DNA, 20 bp, Artificial Sequence
  sgRNA
  Olfr979_19
acctctcctttattgatatg

SEQ ID NO: 46038 - DNA, 20 bp, Artificial Sequence
  sgRNA
  Olfr979_20
aatacctgagaggaagaatg

SEQ ID NO: 46039 - DNA, 20 bp, Artificial Sequence
  sgRNA
  Olfr980_1
ggtcatctttgtgaacattg

SEQ ID NO: 46040 - DNA, 20 bp, Artificial Sequence
  sgRNA
  Olfr980_2
gatgactttggtgtccacag

SEQ ID NO: 46041 - DNA, 20 bp, Artificial Sequence
  sgRNA
  Olfr980_3
catcctgatggtgatcaggg

SEQ ID NO: 46042 - DNA, 20 bp, Artificial Sequence
  sgRNA
  Olfr980_4
cagtaagaatataaatcaca

SEQ ID NO: 46043 - DNA, 20 bp, Artificial Sequence
  sgRNA
  Olfr980_5
aatccaccctgatcaccatc

SEQ ID NO: 46044 - DNA, 20 bp, Artificial Sequence
  sgRNA
  Olfr980_6
agacacatctgccatcgaga

SEQ ID NO: 46045 - DNA, 20 bp, Artificial Sequence
  sgRNA
  Olfr980_7
cacaaagatgaccatctcga

SEQ ID NO: 46046 - DNA, 20 bp, Artificial Sequence
  sgRNA
  Olfr980_8
aagacctgagaggaagaacg

SEQ ID NO: 46047 - DNA, 20 bp, Artificial Sequence
  sgRNA
  Olfr980_9
tggaccacccatcctcaagc

SEQ ID NO: 46048 - DNA, 20 bp, Artificial Sequence
  sgRNA
  Olfr980_10
cctcaggtagatgaaaacac

SEQ ID NO: 46049 - DNA, 20 bp, Artificial Sequence
  sgRNA
  Olfr980_11
tgatcaccatcaggatgaga

SEQ ID NO: 46050 - DNA, 20 bp, Artificial Sequence
  sgRNA
  Olfr980_12
gatggcagatgtgtctgcac

SEQ ID NO: 46051 - DNA, 20 bp, Artificial Sequence
  sgRNA
  Olfr980_13
atctcattgggtccacagta

SEQ ID NO: 46052 - DNA, 20 bp, Artificial Sequence
  sgRNA
  Olfr980_14
gtggatggggaagacctgag

SEQ ID NO: 46053 - DNA, 20 bp, Artificial Sequence
  sgRNA
  Olfr980_15
ctcaggtagatgaaaacaca

SEQ ID NO: 46054 - DNA, 20 bp, Artificial Sequence
  sgRNA
  Olfr980_16
gaaataatgctgaatctcat

SEQ ID NO: 46055 - DNA, 20 bp, Artificial Sequence
  sgRNA
  Olfr980_17
tctcatcctgatggtgatca

SEQ ID NO: 46056 - DNA, 20 bp, Artificial Sequence
  sgRNA
  Olfr980_18
tgcagtgtgaggcacatgtt

SEQ ID NO: 46057 - DNA, 20 bp, Artificial Sequence
  sgRNA
  Olfr980_19
aaataatgctgaatctcatt

SEQ ID NO: 46058 - DNA, 20 bp, Artificial Sequence
  sgRNA
  Olfr980_20
aatgaaaaatcagtgtagtc

SEQ ID NO: 46059 - DNA, 20 bp, Artificial Sequence
  sgRNA
  Olfr981_1
agactagacggagaacggca

SEQ ID NO: 46060 - DNA, 20 bp, Artificial Sequence
  sgRNA
  Olfr981_2
gcaccacccacctcagctcg

SEQ ID NO: 46061 - DNA, 20 bp, Artificial Sequence
  sgRNA
  Olfr981_3
gtgacataggaaccagtaca

SEQ ID NO: 46062 - DNA, 20 bp, Artificial Sequence
  sgRNA
  Olfr981_4
caatccaggtgcccaaagca

SEQ ID NO: 46063 - DNA, 20 bp, Artificial Sequence
  sgRNA
  Olfr981_5
tggtcaggtctaagaaggag

SEQ ID NO: 46064 - DNA, 20 bp, Artificial Sequence
  sgRNA
  Olfr981_6
ggatgtccaccaagacagtg

SEQ ID NO: 46065 - DNA, 20 bp, Artificial Sequence
  sgRNA
  Olfr981_7
tggtgtctgcgcagactaga

SEQ ID NO: 46066 - DNA, 20 bp, Artificial Sequence
  sgRNA
  Olfr981_8
gtgtctcacttcattctggt

SEQ ID NO: 46067 - DNA, 20 bp, Artificial Sequence
  sgRNA
  Olfr981_9
ctttgggcacctggattgga

SEQ ID NO: 46068 - DNA, 20 bp, Artificial Sequence
  sgRNA
  Olfr981_10
gcctgaatatgaaactcgtt

SEQ ID NO: 46069 - DNA, 20 bp, Artificial Sequence
  sgRNA
  Olfr981_11
agtagacgatgaccaccgtg

SEQ ID NO: 46070 - DNA, 20 bp, Artificial Sequence
  sgRNA
  Olfr981_12
cacttcctatggctacatcg

SEQ ID NO: 46071 - DNA, 20 bp, Artificial Sequence
  sgRNA
  Olfr981_13
gccaggccgtaggtaaatga

SEQ ID NO: 46072 - DNA, 20 bp, Artificial Sequence
  sgRNA
  Olfr981_14
aagagtggtaccccgagctg

SEQ ID NO: 46073 - DNA, 20 bp, Artificial Sequence
  sgRNA
  Olfr981_15
actcggtttgggccgcagaa

SEQ ID NO: 46074 - DNA, 20 bp, Artificial Sequence
  sgRNA
  Olfr981_16
tgcagaccggattcgcagaa

SEQ ID NO: 46075 - DNA, 20 bp, Artificial Sequence
  sgRNA
  Olfr981_17
cctgtaccttcatttaccta

SEQ ID NO: 46076 - DNA, 20 bp, Artificial Sequence
  sgRNA
  Olfr981_18
tgcgaatccggtctgcagat

SEQ ID NO: 46077 - DNA, 20 bp, Artificial Sequence
  sgRNA
  Olfr981_19
gcttgcagatggccaagaat

SEQ ID NO: 46078 - DNA, 20 bp, Artificial Sequence
  sgRNA
  Olfr981_20
agtagaatcatctcctttgg

SEQ ID NO: 46079 - DNA, 20 bp, Artificial Sequence
  sgRNA
  Olfr982_1
aagaagtaggcaatatgctg

SEQ ID NO: 46080 - DNA, 20 bp, Artificial Sequence
  sgRNA
  Olfr982_2
catgcttgcaaacattggtg

SEQ ID NO: 46081 - DNA, 20 bp, Artificial Sequence
  sgRNA
  Olfr982_3
agacagacacgcatcaagga

SEQ ID NO: 46082 - DNA, 20 bp, Artificial Sequence
  sgRNA
  Olfr982_4
ccgtgtacatcagaccctcc

SEQ ID NO: 46083 - DNA, 20 bp, Artificial Sequence
  sgRNA
  Olfr982_5
cccgcttgttcataaccact

SEQ ID NO: 46084 - DNA, 20 bp, Artificial Sequence
  sgRNA
  Olfr982_6
ttgcacagcacatctcaccg

SEQ ID NO: 46085 - DNA, 20 bp, Artificial Sequence
  sgRNA
  Olfr982_7
gcagtaccttaaccagtctg

SEQ ID NO: 46086 - DNA, 20 bp, Artificial Sequence
  sgRNA
  Olfr982_8
gcaggggctgacagatagcc

SEQ ID NO: 46087 - DNA, 20 bp, Artificial Sequence
  sgRNA
  Olfr982_9
tgcaggtagatacagaccgg

SEQ ID NO: 46088 - DNA, 20 bp, Artificial Sequence
  sgRNA
  Olfr982_10
aggccagcttcagtactgga

SEQ ID NO: 46089 - DNA, 20 bp, Artificial Sequence
  sgRNA
  Olfr982_11
gtacagcaggcggaaggtta

SEQ ID NO: 46090 - DNA, 20 bp, Artificial Sequence
  sgRNA
  Olfr982_12
gctgacagatagccaggtaa

SEQ ID NO: 46091 - DNA, 20 bp, Artificial Sequence
  sgRNA
  Olfr982_13
ataaccactgggtagtgcag

SEQ ID NO: 46092 - DNA, 20 bp, Artificial Sequence
  sgRNA
  Olfr982_14
tgaacaagcgggtgtgcgca

SEQ ID NO: 46093 - DNA, 20 bp, Artificial Sequence
  sgRNA
  Olfr982_15
agccaagctccactggcgca

SEQ ID NO: 46094 - DNA, 20 bp, Artificial Sequence
  sgRNA
  Olfr982_16
gttgcgcattcgcacagcgg

SEQ ID NO: 46095 - DNA, 20 bp, Artificial Sequence
  sgRNA
  Olfr982_17
gctcctgtattacatgcccc

SEQ ID NO: 46096 - DNA, 20 bp, Artificial Sequence
  sgRNA
  Olfr982_18
catgtaatacaggagcacca

SEQ ID NO: 46097 - DNA, 20 bp, Artificial Sequence
  sgRNA
  Olfr982_19
ggtgagccagttcttcctgg

SEQ ID NO: 46098 - DNA, 20 bp, Artificial Sequence
  sgRNA
  Olfr982_20
ggtgttgcgcattcgcacag

SEQ ID NO: 46099 - DNA, 20 bp, Artificial Sequence
  sgRNA
  Olfr984_1
actcgtccatcactgccccc

SEQ ID NO: 46100 - DNA, 20 bp, Artificial Sequence
  sgRNA
  Olfr984_2
ctccgaagtcactcaaaaga

SEQ ID NO: 46101 - DNA, 20 bp, Artificial Sequence
  sgRNA
  Olfr984_3
gataaaaccacccacccacg

SEQ ID NO: 46102 - DNA, 20 bp, Artificial Sequence
  sgRNA
  Olfr984_4
gatggtgtctaacaatggct

SEQ ID NO: 46103 - DNA, 20 bp, Artificial Sequence
  sgRNA
  Olfr984_5
acatagttgtgtgcaaacgc

SEQ ID NO: 46104 - DNA, 20 bp, Artificial Sequence
  sgRNA
  Olfr984_6
gctccgaagtcactcaaaag

SEQ ID NO: 46105 - DNA, 20 bp, Artificial Sequence
  sgRNA
  Olfr984_7
ttatgaatcagacagtctgt

SEQ ID NO: 46106 - DNA, 20 bp, Artificial Sequence
  sgRNA
  Olfr984_8
agtcagtccaacctgtacaa

SEQ ID NO: 46107 - DNA, 20 bp, Artificial Sequence
  sgRNA
  Olfr984_9
gtagcgtaggggctgagaaa

SEQ ID NO: 46108 - DNA, 20 bp, Artificial Sequence
  sgRNA
  Olfr984_10
ataattagtgtgtagcgtag

SEQ ID NO: 46109 - DNA, 20 bp, Artificial Sequence
  sgRNA
  Olfr984_11
gagacccaggaggaagaacg

SEQ ID NO: 46110 - DNA, 20 bp, Artificial Sequence
  sgRNA
  Olfr984_12
aagctctaagacaaaggtat

SEQ ID NO: 46111 - DNA, 20 bp, Artificial Sequence
  sgRNA
  Olfr984_13
caaatcaaccagcatcctgg

SEQ ID NO: 46112 - DNA, 20 bp, Artificial Sequence
  sgRNA
  Olfr984_14
gctgagaaatggctatgtaa

SEQ ID NO: 46113 - DNA, 20 bp, Artificial Sequence
  sgRNA
  Olfr984_15
cttctgatggtgtctaacaa

SEQ ID NO: 46114 - DNA, 20 bp, Artificial Sequence
  sgRNA
  Olfr984_16
atacctgagagagacccagg

SEQ ID NO: 46115 - DNA, 20 bp, Artificial Sequence
  sgRNA
  Olfr984_17
cagaaactgccttgtccatg

SEQ ID NO: 46116 - DNA, 20 bp, Artificial Sequence
  sgRNA
  Olfr984_18
acttcggagcatcacaagca

SEQ ID NO: 46117 - DNA, 20 bp, Artificial Sequence
  sgRNA
  Olfr984_19
acgcgggtcagaggtcacta

SEQ ID NO: 46118 - DNA, 20 bp, Artificial Sequence
  sgRNA
  Olfr984_20
cctgggtctctctcaggtat

SEQ ID NO: 46119 - DNA, 20 bp, Artificial Sequence
  sgRNA
  Olfr985_1
gctcctcagttaatcccaac

SEQ ID NO: 46120 - DNA, 20 bp, Artificial Sequence
  sgRNA
  Olfr985_2
ctccgcatccactctaaaga

SEQ ID NO: 46121 - DNA, 20 bp, Artificial Sequence
  sgRNA
  Olfr985_3
actgatgctgtgattcatgg

SEQ ID NO: 46122 - DNA, 20 bp, Artificial Sequence
  sgRNA
  Olfr985_4
tggacctgccctctttagag

SEQ ID NO: 46123 - DNA, 20 bp, Artificial Sequence
  sgRNA
  Olfr985_5
ataatgacagcatagagcag

SEQ ID NO: 46124 - DNA, 20 bp, Artificial Sequence
  sgRNA
  Olfr985_6
actgaggaaataatacatgg

SEQ ID NO: 46125 - DNA, 20 bp, Artificial Sequence
  sgRNA
  Olfr985_7
atttacatagtcacaatggt

SEQ ID NO: 46126 - DNA, 20 bp, Artificial Sequence
  sgRNA
  Olfr985_8
atataagaacagctgtcagg

SEQ ID NO: 46127 - DNA, 20 bp, Artificial Sequence
  sgRNA
  Olfr985_9
ggggatttacatagtcacaa

SEQ ID NO: 46128 - DNA, 20 bp, Artificial Sequence
  sgRNA
  Olfr985_10
ctaaaaaagacaaactactg

SEQ ID NO: 46129 - DNA, 20 bp, Artificial Sequence
  sgRNA
  Olfr985_11
atgacggaaccattagaagc

SEQ ID NO: 46130 - DNA, 20 bp, Artificial Sequence
  sgRNA
  Olfr985_12
ctatgtaaatccccaagaag

SEQ ID NO: 46131 - DNA, 20 bp, Artificial Sequence
  sgRNA
  Olfr985_13
accagcagagaacagacccg

SEQ ID NO: 46132 - DNA, 20 bp, Artificial Sequence
  sgRNA
  Olfr985_14
tgacaatagtcatttcatat

SEQ ID NO: 46133 - DNA, 20 bp, Artificial Sequence
  sgRNA
  Olfr985_15
gcatccactctaaagagggc

SEQ ID NO: 46134 - DNA, 20 bp, Artificial Sequence
  sgRNA
  Olfr985_16
caggagaaactcagtcaccg

SEQ ID NO: 46135 - DNA, 20 bp, Artificial Sequence
  sgRNA
  Olfr985_17
catctctgaatgctacatgt

SEQ ID NO: 46136 - DNA, 20 bp, Artificial Sequence
  sgRNA
  Olfr985_18
cactgtggtgtaaaacactg

SEQ ID NO: 46137 - DNA, 20 bp, Artificial Sequence
  sgRNA
  Olfr985_19
tatctgaaacccgcttctaa

SEQ ID NO: 46138 - DNA, 20 bp, Artificial Sequence
  sgRNA
  Olfr985_20
ctacagtctaaggaacaagg

SEQ ID NO: 46139 - DNA, 20 bp, Artificial Sequence
  sgRNA
  Olfr986_1
tcataatggttgggtaacgg

SEQ ID NO: 46140 - DNA, 20 bp, Artificial Sequence
  sgRNA
  Olfr986_2
accagcatattggaactact

SEQ ID NO: 46141 - DNA, 20 bp, Artificial Sequence
  sgRNA
  Olfr986_3
caaccatttctactgtgacg

SEQ ID NO: 46142 - DNA, 20 bp, Artificial Sequence
  sgRNA
  Olfr986_4
cattgtctgacaaaagacaa

SEQ ID NO: 46143 - DNA, 20 bp, Artificial Sequence
  sgRNA
  Olfr986_5
ggatcacgagaatcgttgcc

SEQ ID NO: 46144 - DNA, 20 bp, Artificial Sequence
  sgRNA
  Olfr986_6
cataatggttgggtaacgga

SEQ ID NO: 46145 - DNA, 20 bp, Artificial Sequence
  sgRNA
  Olfr986_7
acatcttatccaccatccta

SEQ ID NO: 46146 - DNA, 20 bp, Artificial Sequence
  sgRNA
  Olfr986_8
tcattgtctgggttgagccc

SEQ ID NO: 46147 - DNA, 20 bp, Artificial Sequence
  sgRNA
  Olfr986_9
acagtagtctctctgctcta

SEQ ID NO: 46148 - DNA, 20 bp, Artificial Sequence
  sgRNA
  Olfr986_10
ggtataccagatctctagga

SEQ ID NO: 46149 - DNA, 20 bp, Artificial Sequence
  sgRNA
  Olfr986_11
gcttacagatggccaggtag

SEQ ID NO: 46150 - DNA, 20 bp, Artificial Sequence
  sgRNA
  Olfr986_12
cttggatgccagggaaaccg

SEQ ID NO: 46151 - DNA, 20 bp, Artificial Sequence
  sgRNA
  Olfr986_13
gcacaggcagctttcaagat

SEQ ID NO: 46152 - DNA, 20 bp, Artificial Sequence
  sgRNA
  Olfr986_14
gacccacgtcacagtagaaa

SEQ ID NO: 46153 - DNA, 20 bp, Artificial Sequence
  sgRNA
  Olfr986_15
caacgattctcgtgatccca

SEQ ID NO: 46154 - DNA, 20 bp, Artificial Sequence
  sgRNA
  Olfr986_16
tggtgaagaggagtgaccct

SEQ ID NO: 46155 - DNA, 20 bp, Artificial Sequence
  sgRNA
  Olfr986_17
gtaaataaagggatttagaa

SEQ ID NO: 46156 - DNA, 20 bp, Artificial Sequence
  sgRNA
  Olfr986_18
cagtggctgaagggatccgt

SEQ ID NO: 46157 - DNA, 20 bp, Artificial Sequence
  sgRNA
  Olfr986_19
aggccattacttgtgcaaac

SEQ ID NO: 46158 - DNA, 20 bp, Artificial Sequence
  sgRNA
  Olfr986_20
ctacggatcccttcagccac

SEQ ID NO: 46159 - DNA, 20 bp, Artificial Sequence
  sgRNA
  Olfr993_1
atgagtatgggataacgaag

SEQ ID NO: 46160 - DNA, 20 bp, Artificial Sequence
  sgRNA
  Olfr993_2
caggaaaggctaataattgg

SEQ ID NO: 46161 - DNA, 20 bp, Artificial Sequence
  sgRNA
  Olfr993_3
ataaattcttcagtacacac

SEQ ID NO: 46162 - DNA, 20 bp, Artificial Sequence
  sgRNA
  Olfr993_4
catccatggtgggtaacact

SEQ ID NO: 46163 - DNA, 20 bp, Artificial Sequence
  sgRNA
  Olfr993_5
gtatctgtcttctactacaa

SEQ ID NO: 46164 - DNA, 20 bp, Artificial Sequence
  sgRNA
  Olfr993_6
ccgaaaagtctgcatccaga

SEQ ID NO: 46165 - DNA, 20 bp, Artificial Sequence
  sgRNA
  Olfr993_7
gataggagccagctaccatc

SEQ ID NO: 46166 - DNA, 20 bp, Artificial Sequence
  sgRNA
  Olfr993_8
ggaaacactgaatatcatgt

SEQ ID NO: 46167 - DNA, 20 bp, Artificial Sequence
  sgRNA
  Olfr993_9
gtagctggctcctatctcat

SEQ ID NO: 46168 - DNA, 20 bp, Artificial Sequence
  sgRNA
  Olfr993_10
ttgtaggaagaagtacatgg

SEQ ID NO: 46169 - DNA, 20 bp, Artificial Sequence
  sgRNA
  Olfr993_11
ataacgaagtggtttgcaga

SEQ ID NO: 46170 - DNA, 20 bp, Artificial Sequence
  sgRNA
  Olfr993_12
ggtccactgccatagctgcc

SEQ ID NO: 46171 - DNA, 20 bp, Artificial Sequence
  sgRNA
  Olfr993_13
gtcaagggcttctatctcct

SEQ ID NO: 46172 - DNA, 20 bp, Artificial Sequence
  sgRNA
  Olfr993_14
catcccagtgttacccacca

SEQ ID NO: 46173 - DNA, 20 bp, Artificial Sequence
  sgRNA
  Olfr993_15
agtagaggacatctttaaga

SEQ ID NO: 46174 - DNA, 20 bp, Artificial Sequence
  sgRNA
  Olfr993_16
catgttggactccaaatccc

SEQ ID NO: 46175 - DNA, 20 bp, Artificial Sequence
  sgRNA
  Olfr993_17
tctgaagtctggagtcagtg

SEQ ID NO: 46176 - DNA, 20 bp, Artificial Sequence
  sgRNA
  Olfr993_18
tctcctggcagctatggcag

SEQ ID NO: 46177 - DNA, 20 bp, Artificial Sequence
  sgRNA
  Olfr993_19
acatccatggtgggtaacac

SEQ ID NO: 46178 - DNA, 20 bp, Artificial Sequence
  sgRNA
  Olfr993_20
tacaatgagactgaagtcaa

SEQ ID NO: 46179 - DNA, 20 bp, Artificial Sequence
  sgRNA
  Olfr994_1
tggatgtcacataaataaca

SEQ ID NO: 46180 - DNA, 20 bp, Artificial Sequence
  sgRNA
  Olfr994_2
cttgccgagacatgattatg

SEQ ID NO: 46181 - DNA, 20 bp, Artificial Sequence
  sgRNA
  Olfr994_3
ggtccactgccataacagcg

SEQ ID NO: 46182 - DNA, 20 bp, Artificial Sequence
  sgRNA
  Olfr994_4
ataaattcctctgtacacac

SEQ ID NO: 46183 - DNA, 20 bp, Artificial Sequence
  sgRNA
  Olfr994_5
gcctccttcagacaattccg

SEQ ID NO: 46184 - DNA, 20 bp, Artificial Sequence
  sgRNA
  Olfr994_6
catgaaagagtgacaattgg

SEQ ID NO: 46185 - DNA, 20 bp, Artificial Sequence
  sgRNA
  Olfr994_7
gctaccccataatcatgtct

SEQ ID NO: 46186 - DNA, 20 bp, Artificial Sequence
  sgRNA
  Olfr994_8
tgttatttatgtgacatcca

SEQ ID NO: 46187 - DNA, 20 bp, Artificial Sequence
  sgRNA
  Olfr994_9
ttctcctcggaattgtctga

SEQ ID NO: 46188 - DNA, 20 bp, Artificial Sequence
  sgRNA
  Olfr994_10
gtagatcagaggatttagca

SEQ ID NO: 46189 - DNA, 20 bp, Artificial Sequence
  sgRNA
  Olfr994_11
tatttatgtgacatccatgg

SEQ ID NO: 46190 - DNA, 20 bp, Artificial Sequence
  sgRNA
  Olfr994_12
aagatgctattaaagctaca

SEQ ID NO: 46191 - DNA, 20 bp, Artificial Sequence
  sgRNA
  Olfr994_13
tcctcggaattgtctgaagg

SEQ ID NO: 46192 - DNA, 20 bp, Artificial Sequence
  sgRNA
  Olfr994_14
gtagctgtttcttatctcat

SEQ ID NO: 46193 - DNA, 20 bp, Artificial Sequence
  sgRNA
  Olfr994_15
tctcctcgctgttatggcag

SEQ ID NO: 46194 - DNA, 20 bp, Artificial Sequence
  sgRNA
  Olfr994_16
tagatcagaggatttagcat

SEQ ID NO: 46195 - DNA, 20 bp, Artificial Sequence
  sgRNA
  Olfr994_17
agcgaggagataacagtcac

SEQ ID NO: 46196 - DNA, 20 bp, Artificial Sequence
  sgRNA
  Olfr994_18
tagcatgaaagagtgacaat

SEQ ID NO: 46197 - DNA, 20 bp, Artificial Sequence
  sgRNA
  Olfr994_19
acttgccgagacatgattat

SEQ ID NO: 46198 - DNA, 20 bp, Artificial Sequence
  sgRNA
  Olfr994_20
taacaaggaacacaatgaag

SEQ ID NO: 46199 - DNA, 20 bp, Artificial Sequence
  sgRNA
  Olfr995_1
ggtctatgtaacatccatgg

SEQ ID NO: 46200 - DNA, 20 bp, Artificial Sequence
  sgRNA
  Olfr995_2
acagtcactggtcgcaaatg

SEQ ID NO: 46201 - DNA, 20 bp, Artificial Sequence
  sgRNA
  Olfr995_3
aacagatatcaacaaaagcc

SEQ ID NO: 46202 - DNA, 20 bp, Artificial Sequence
  sgRNA
  Olfr995_4
cttgtcgagacatgattatg

SEQ ID NO: 46203 - DNA, 20 bp, Artificial Sequence
  sgRNA
  Olfr995_5
ccactgccataacagcgagg

SEQ ID NO: 46204 - DNA, 20 bp, Artificial Sequence
  sgRNA
  Olfr995_6
agaaacaaggaggtcaaaga

SEQ ID NO: 46205 - DNA, 20 bp, Artificial Sequence
  sgRNA
  Olfr995_7
ccacaagaaatacaacgaag

SEQ ID NO: 46206 - DNA, 20 bp, Artificial Sequence
  sgRNA
  Olfr995_8
tgtggtctatgtaacatcca

SEQ ID NO: 46207 - DNA, 20 bp, Artificial Sequence
  sgRNA
  Olfr995_9
atagaagtcagtgacttcag

SEQ ID NO: 46208 - DNA, 20 bp, Artificial Sequence
  sgRNA
  Olfr995_10
gtctatgtaacatccatggt

SEQ ID NO: 46209 - DNA, 20 bp, Artificial Sequence
  sgRNA
  Olfr995_11
gagcatgaaaggctgatgat

SEQ ID NO: 46210 - DNA, 20 bp, Artificial Sequence
  sgRNA
  Olfr995_12
tgaccaacacagtgaacgtc

SEQ ID NO: 46211 - DNA, 20 bp, Artificial Sequence
  sgRNA
  Olfr995_13
gacagttccatatcatatac

SEQ ID NO: 46212 - DNA, 20 bp, Artificial Sequence
  sgRNA
  Olfr995_14
cctcctcgctgttatggcag

SEQ ID NO: 46213 - DNA, 20 bp, Artificial Sequence
  sgRNA
  Olfr995_15
acttgtcgagacatgattat

SEQ ID NO: 46214 - DNA, 20 bp, Artificial Sequence
  sgRNA
  Olfr995_16
gtacttcttcttacaaaacc

SEQ ID NO: 46215 - DNA, 20 bp, Artificial Sequence
  sgRNA
  Olfr995_17
cttctcctacatatacatca

SEQ ID NO: 46216 - DNA, 20 bp, Artificial Sequence
  sgRNA
  Olfr995_18
ggcggccatgatgtatatgt

SEQ ID NO: 46217 - DNA, 20 bp, Artificial Sequence
  sgRNA
  Olfr995_19
cctcttcgttgtatttcttg

SEQ ID NO: 46218 - DNA, 20 bp, Artificial Sequence
  sgRNA
  Olfr995_20
tatcaatgttggagcatgaa

SEQ ID NO: 46219 - DNA, 20 bp, Artificial Sequence
  sgRNA
  Olr1_1
cagtgacccttattgtacag

SEQ ID NO: 46220 - DNA, 20 bp, Artificial Sequence
  sgRNA
  Olr1_2
atagcagcagggaaccacca

SEQ ID NO: 46221 - DNA, 20 bp, Artificial Sequence
  sgRNA
  Olr1_3
gaaagatagacaccatcacc

SEQ ID NO: 46222 - DNA, 20 bp, Artificial Sequence
  sgRNA
  Olr1_4
ccaagcgaaccttactcagc

SEQ ID NO: 46223 - DNA, 20 bp, Artificial Sequence
  sgRNA
  Olr1_5
cgttctggattggattgcat

SEQ ID NO: 46224 - DNA, 20 bp, Artificial Sequence
  sgRNA
  Olr1_6
atgcaatccaatccagaacg

SEQ ID NO: 46225 - DNA, 20 bp, Artificial Sequence
  sgRNA
  Olr1_7
gtaactggccacccaaagat

SEQ ID NO: 46226 - DNA, 20 bp, Artificial Sequence
  sgRNA
  Olr1_8
cctttagctgggaaaaaaac

SEQ ID NO: 46227 - DNA, 20 bp, Artificial Sequence
  sgRNA
  Olr1_9
tcactgacaacaccaggcag

SEQ ID NO: 46228 - DNA, 20 bp, Artificial Sequence
  sgRNA
  Olr1_10
cgatgcaatccaatccagaa

SEQ ID NO: 46229 - DNA, 20 bp, Artificial Sequence
  sgRNA
  Olr1_11
tgatcaggctcgtcattcgc

SEQ ID NO: 46230 - DNA, 20 bp, Artificial Sequence
  sgRNA
  Olr1_12
agcaggatcgtatcctggaa

SEQ ID NO: 46231 - DNA, 20 bp, Artificial Sequence
  sgRNA
  Olr1_13
tgaccagagtcatagcagca

SEQ ID NO: 46232 - DNA, 20 bp, Artificial Sequence
  sgRNA
  Olr1_14
ggccagttactacaaattaa

SEQ ID NO: 46233 - DNA, 20 bp, Artificial Sequence
  sgRNA
  Olr1_15
gttccattctcccatagcca

SEQ ID NO: 46234 - DNA, 20 bp, Artificial Sequence
  sgRNA
  Olr1_16
ggaagaagcctggccaacca

SEQ ID NO: 46235 - DNA, 20 bp, Artificial Sequence
  sgRNA
  Olr1_17
aactgtgcataccttcaaga

SEQ ID NO: 46236 - DNA, 20 bp, Artificial Sequence
  sgRNA
  Olr1_18
agagtttgcagctctctgca

SEQ ID NO: 46237 - DNA, 20 bp, Artificial Sequence
  sgRNA
  Olr1_19
ggattgcatcggaagaagcc

SEQ ID NO: 46238 - DNA, 20 bp, Artificial Sequence
  sgRNA
  Olr1_20
tcatgtggcaagaagcctaa

SEQ ID NO: 46239 - DNA, 20 bp, Artificial Sequence
  sgRNA
  Omg_1
aaataccctaagaagtctcg

SEQ ID NO: 46240 - DNA, 20 bp, Artificial Sequence
  sgRNA
  Omg_2
atataccaatctgagaaccc

SEQ ID NO: 46241 - DNA, 20 bp, Artificial Sequence
  sgRNA
  Omg_3
aacttgactacattaccacc

SEQ ID NO: 46242 - DNA, 20 bp, Artificial Sequence
  sgRNA
  Omg_4
acaaggagtccctatcacat

SEQ ID NO: 46243 - DNA, 20 bp, Artificial Sequence
  sgRNA
  Omg_5
gcacaaccctcaacttacgg

SEQ ID NO: 46244 - DNA, 20 bp, Artificial Sequence
  sgRNA
  Omg_6
gcttagagtgacaccaaatg

SEQ ID NO: 46245 - DNA, 20 bp, Artificial Sequence
  sgRNA
  Omg_7
aatctgatactgcttatcag

SEQ ID NO: 46246 - DNA, 20 bp, Artificial Sequence
  sgRNA
  Omg_8
catgccacgagctatgctga

SEQ ID NO: 46247 - DNA, 20 bp, Artificial Sequence
  sgRNA
  Omg_9
ggttatgcagatcagtaaag

SEQ ID NO: 46248 - DNA, 20 bp, Artificial Sequence
  sgRNA
  Omg_10
gcatgccacgagctatgctg

SEQ ID NO: 46249 - DNA, 20 bp, Artificial Sequence
  sgRNA
  Omg_11
aagcttgaggtaaacccagg

SEQ ID NO: 46250 - DNA, 20 bp, Artificial Sequence
  sgRNA
  Omg_12
gacatgttccagagagaccg

SEQ ID NO: 46251 - DNA, 20 bp, Artificial Sequence
  sgRNA
  Omg_13
cacaaccctcaacttacgga

SEQ ID NO: 46252 - DNA, 20 bp, Artificial Sequence
  sgRNA
  Omg_14
gcctctctgtgcatgtacac

SEQ ID NO: 46253 - DNA, 20 bp, Artificial Sequence
  sgRNA
  Omg_15
gagctatgctgagggtcacg

SEQ ID NO: 46254 - DNA, 20 bp, Artificial Sequence
  sgRNA
  Omg_16
ccgagtgtttccatttgcag

SEQ ID NO: 46255 - DNA, 20 bp, Artificial Sequence
  sgRNA
  Omg_17
gcatgtaccccacacctcct

SEQ ID NO: 46256 - DNA, 20 bp, Artificial Sequence
  sgRNA
  Omg_18
atgttctcctgcagtccagg

SEQ ID NO: 46257 - DNA, 20 bp, Artificial Sequence
  sgRNA
  Omg_19
ggtttattaatgtccctgga

SEQ ID NO: 46258 - DNA, 20 bp, Artificial Sequence
  sgRNA
  Omg_20
gtctgcctgctcagttacct

SEQ ID NO: 46259 - DNA, 20 bp, Artificial Sequence
  sgRNA
  Opalin_1
catcgatgatgagcccgtag

SEQ ID NO: 46260 - DNA, 20 bp, Artificial Sequence
  sgRNA
  Opalin_2
tagagttctgaaatttcaca

SEQ ID NO: 46261 - DNA, 20 bp, Artificial Sequence
  sgRNA
  Opalin_3
ccggctgccagtccaataga

SEQ ID NO: 46262 - DNA, 20 bp, Artificial Sequence
  sgRNA
  Opalin_4
actccactcaccgtattcga

SEQ ID NO: 46263 - DNA, 20 bp, Artificial Sequence
  sgRNA
  Opalin_5
acacatgaaatgaacccacg

SEQ ID NO: 46264 - DNA, 20 bp, Artificial Sequence
  sgRNA
  Opalin_6
ggcactcgtgacaactggag

SEQ ID NO: 46265 - DNA, 20 bp, Artificial Sequence
  sgRNA
  Opalin_7
tgcccttcttggctgccccg

SEQ ID NO: 46266 - DNA, 20 bp, Artificial Sequence
  sgRNA
  Opalin_8
tagttcttcaggaggacggt

SEQ ID NO: 46267 - DNA, 20 bp, Artificial Sequence
  sgRNA
  Opalin_9
cgtgggttcatttcatgtgt

SEQ ID NO: 46268 - DNA, 20 bp, Artificial Sequence
  sgRNA
  Opalin_10
gctttggcactcgtgacaac

SEQ ID NO: 46269 - DNA, 20 bp, Artificial Sequence
  sgRNA
  Opalin_11
aggacggtaggtgtccggca

SEQ ID NO: 46270 - DNA, 20 bp, Artificial Sequence
  sgRNA
  Opalin_12
gaagactgtctcgggaagcg

SEQ ID NO: 46271 - DNA, 20 bp, Artificial Sequence
  sgRNA
  Opalin_13
aaacagcaaagccaccagca

SEQ ID NO: 46272 - DNA, 20 bp, Artificial Sequence
  sgRNA
  Opalin_14
gctggccacagccctgctgg

SEQ ID NO: 46273 - DNA, 20 bp, Artificial Sequence
  sgRNA
  Opalin_15
gaagaactagaaaggagaag

SEQ ID NO: 46274 - DNA, 20 bp, Artificial Sequence
  sgRNA
  Opalin_16
taaacagcaaagccaccagc

SEQ ID NO: 46275 - DNA, 20 bp, Artificial Sequence
  sgRNA
  Opalin_17
ctcctttctagttcttcagg

SEQ ID NO: 46276 - DNA, 20 bp, Artificial Sequence
  sgRNA
  Opalin_18
tttctagttcttcaggagga

SEQ ID NO: 46277 - DNA, 20 bp, Artificial Sequence
  sgRNA
  Opalin_19
ccacacatgaaatgaaccca

SEQ ID NO: 46278 - DNA, 20 bp, Artificial Sequence
  sgRNA
  Opalin_20
tcaggaggacggtaggtgtc

SEQ ID NO: 46279 - DNA, 20 bp, Artificial Sequence
  sgRNA
  Opcml_1
tgaccaaaatgatcactcga

SEQ ID NO: 46280 - DNA, 20 bp, Artificial Sequence
  sgRNA
  Opcml_2
aattggcagaccagaaccaa

SEQ ID NO: 46281 - DNA, 20 bp, Artificial Sequence
  sgRNA
  Opcml_3
catagatgatcgggtcaccc

SEQ ID NO: 46282 - DNA, 20 bp, Artificial Sequence
  sgRNA
  Opcml_4
cactatgagatggacccggg

SEQ ID NO: 46283 - DNA, 20 bp, Artificial Sequence
  sgRNA
  Opcml_5
gcagcacaatcctctatgct

SEQ ID NO: 46284 - DNA, 20 bp, Artificial Sequence
  sgRNA
  Opcml_6
gtgtggccacaaacaagctt

SEQ ID NO: 46285 - DNA, 20 bp, Artificial Sequence
  sgRNA
  Opcml_7
agtggttcaaagaagatacc

SEQ ID NO: 46286 - DNA, 20 bp, Artificial Sequence
  sgRNA
  Opcml_8
acaacgtgacggtccggcag

SEQ ID NO: 46287 - DNA, 20 bp, Artificial Sequence
  sgRNA
  Opcml_9
cagcatagaggattgtgctg

SEQ ID NO: 46288 - DNA, 20 bp, Artificial Sequence
  sgRNA
  Opcml_10
ggccgagaagacgatccagt

SEQ ID NO: 46289 - DNA, 20 bp, Artificial Sequence
  sgRNA
  Opcml_11
gccaattgcaagacataaca

SEQ ID NO: 46290 - DNA, 20 bp, Artificial Sequence
  sgRNA
  Opcml_12
ttggctttagatatataggg

SEQ ID NO: 46291 - DNA, 20 bp, Artificial Sequence
  sgRNA
  Opcml_13
gagaagacgatccagtaggc

SEQ ID NO: 46292 - DNA, 20 bp, Artificial Sequence
  sgRNA
  Opcml_14
acgtcgctgcacctgatgtt

SEQ ID NO: 46293 - DNA, 20 bp, Artificial Sequence
  sgRNA
  Opcml_15
ggacaacgtgacggtccggc

SEQ ID NO: 46294 - DNA, 20 bp, Artificial Sequence
  sgRNA
  Opcml_16
catcaaacgtgaccagtctg

SEQ ID NO: 46295 - DNA, 20 bp, Artificial Sequence
  sgRNA
  Opcml_17
ggtgtttcagtgggtcagaa

SEQ ID NO: 46296 - DNA, 20 bp, Artificial Sequence
  sgRNA
  Opcml_18
catcttcactcacaaatccc

SEQ ID NO: 46297 - DNA, 20 bp, Artificial Sequence
  sgRNA
  Opcml_19
cgaagcctctgctgtcccga

SEQ ID NO: 46298 - DNA, 20 bp, Artificial Sequence
  sgRNA
  Opcml_20
tggctttagatatataggga

SEQ ID NO: 46299 - DNA, 20 bp, Artificial Sequence
  sgRNA
  Opn1mw_1
cagcggtacctcgtaccccg

SEQ ID NO: 46300 - DNA, 20 bp, Artificial Sequence
  sgRNA
  Opn1mw_2
gctccaaccaaagattggtg

SEQ ID NO: 46301 - DNA, 20 bp, Artificial Sequence
  sgRNA
  Opn1mw_3
tcaaatctcacattgccaaa

SEQ ID NO: 46302 - DNA, 20 bp, Artificial Sequence
  sgRNA
  Opn1mw_4
cagcttcttgaatctcatgg

SEQ ID NO: 46303 - DNA, 20 bp, Artificial Sequence
  sgRNA
  Opn1mw_5
tcatataagactgaaccccg

SEQ ID NO: 46304 - DNA, 20 bp, Artificial Sequence
  sgRNA
  Opn1mw_6
tgataattggggccttcaaa

SEQ ID NO: 46305 - DNA, 20 bp, Artificial Sequence
  sgRNA
  Opn1mw_7
ataggtgaagatgcttgcat

SEQ ID NO: 46306 - DNA, 20 bp, Artificial Sequence
  sgRNA
  Opn1mw_8
ctatgtctttatgaaccggc

SEQ ID NO: 46307 - DNA, 20 bp, Artificial Sequence
  sgRNA
  Opn1mw_9
catgggtgctatcctcatag

SEQ ID NO: 46308 - DNA, 20 bp, Artificial Sequence
  sgRNA
  Opn1mw_10
tgtggcccagacgtgttcag

SEQ ID NO: 46309 - DNA, 20 bp, Artificial Sequence
  sgRNA
  Opn1mw_11
ggatggccagccacacttgg

SEQ ID NO: 46310 - DNA, 20 bp, Artificial Sequence
  sgRNA
  Opn1mw_12
ggtctgggctgctatatgga

SEQ ID NO: 46311 - DNA, 20 bp, Artificial Sequence
  sgRNA
  Opn1mw_13
attatcacattgctcccagg

SEQ ID NO: 46312 - DNA, 20 bp, Artificial Sequence
  sgRNA
  Opn1mw_14
tggacggccccaccaatctt

SEQ ID NO: 46313 - DNA, 20 bp, Artificial Sequence
  sgRNA
  Opn1mw_15
agccttcaatgacacacaga

SEQ ID NO: 46314 - DNA, 20 bp, Artificial Sequence
  sgRNA
  Opn1mw_16
ttatctatgtctttatgaac

SEQ ID NO: 46315 - DNA, 20 bp, Artificial Sequence
  sgRNA
  Opn1mw_17
tgtcccatccatcaaagctt

SEQ ID NO: 46316 - DNA, 20 bp, Artificial Sequence
  sgRNA
  Opn1mw_18
gagggtggaaggcatagcca

SEQ ID NO: 46317 - DNA, 20 bp, Artificial Sequence
  sgRNA
  Opn1mw_19
ggagaagacgattcccacag

SEQ ID NO: 46318 - DNA, 20 bp, Artificial Sequence
  sgRNA
  Opn1mw_20
tacctgctccaaccaaagat

SEQ ID NO: 46319 - DNA, 20 bp, Artificial Sequence
  sgRNA
  Opn1sw_1
ctggtcaatgtatccctcgg

SEQ ID NO: 46320 - DNA, 20 bp, Artificial Sequence
  sgRNA
  Opn1sw_2
aggcctccagagcacaaaca

SEQ ID NO: 46321 - DNA, 20 bp, Artificial Sequence
  sgRNA
  Opn1sw_3
atcgaagcgagtactacacc

SEQ ID NO: 46322 - DNA, 20 bp, Artificial Sequence
  sgRNA
  Opn1sw_4
cagcactatggcattgagtg

SEQ ID NO: 46323 - DNA, 20 bp, Artificial Sequence
  sgRNA
  Opn1sw_5
ccatgtacatggtcaacaat

SEQ ID NO: 46324 - DNA, 20 bp, Artificial Sequence
  sgRNA
  Opn1sw_6
ttgaagcggatgctgccgaa

SEQ ID NO: 46325 - DNA, 20 bp, Artificial Sequence
  sgRNA
  Opn1sw_7
gcagaagaggaagcccccga

SEQ ID NO: 46326 - DNA, 20 bp, Artificial Sequence
  sgRNA
  Opn1sw_8
caagccgtaagtccagcccg

SEQ ID NO: 46327 - DNA, 20 bp, Artificial Sequence
  sgRNA
  Opn1sw_9
gtagtactcgcttcgatact

SEQ ID NO: 46328 - DNA, 20 bp, Artificial Sequence
  sgRNA
  Opn1sw_10
ggaggtgagtcatatggtgg

SEQ ID NO: 46329 - DNA, 20 bp, Artificial Sequence
  sgRNA
  Opn1sw_11
tggtcaacaatcggaaccac

SEQ ID NO: 46330 - DNA, 20 bp, Artificial Sequence
  sgRNA
  Opn1sw_12
gttgaccatgtacatggcca

SEQ ID NO: 46331 - DNA, 20 bp, Artificial Sequence
  sgRNA
  Opn1sw_13
ccagcactatggcattgagt

SEQ ID NO: 46332 - DNA, 20 bp, Artificial Sequence
  sgRNA
  Opn1sw_14
ttgaccagaatatagttgag

SEQ ID NO: 46333 - DNA, 20 bp, Artificial Sequence
  sgRNA
  Opn1sw_15
agagtctgctacgacacaaa

SEQ ID NO: 46334 - DNA, 20 bp, Artificial Sequence
  sgRNA
  Opn1sw_16
gtgcatgcttggagttgaag

SEQ ID NO: 46335 - DNA, 20 bp, Artificial Sequence
  sgRNA
  Opn1sw_17
tgctccagccaaaaaagggt

SEQ ID NO: 46336 - DNA, 20 bp, Artificial Sequence
  sgRNA
  Opn1sw_18
cattgaccagaatatagttg

SEQ ID NO: 46337 - DNA, 20 bp, Artificial Sequence
  sgRNA
  Opn1sw_19
ccatctccagaatgcaagcc

SEQ ID NO: 46338 - DNA, 20 bp, Artificial Sequence
  sgRNA
  Opn1sw_20
gatggtgtgcaggaagccca

SEQ ID NO: 46339 - DNA, 20 bp, Artificial Sequence
  sgRNA
  Opn3_1
ctatgaacgttatatccgtg

SEQ ID NO: 46340 - DNA, 20 bp, Artificial Sequence
  sgRNA
  Opn3_2
cagcgccaggcgctcgtacg

SEQ ID NO: 46341 - DNA, 20 bp, Artificial Sequence
  sgRNA
  Opn3_3
gttccgcaggcacgacgcga

SEQ ID NO: 46342 - DNA, 20 bp, Artificial Sequence
  sgRNA
  Opn3_4
ttcgaacagaatagagaatg

SEQ ID NO: 46343 - DNA, 20 bp, Artificial Sequence
  sgRNA
  Opn3_5
gcctgctaaaaacctcccag

SEQ ID NO: 46344 - DNA, 20 bp, Artificial Sequence
  sgRNA
  Opn3_6
ttcgcgtcgtgcctgcggaa

SEQ ID NO: 46345 - DNA, 20 bp, Artificial Sequence
  sgRNA
  Opn3_7
tctttctgtgacatcacgat

SEQ ID NO: 46346 - DNA, 20 bp, Artificial Sequence
  sgRNA
  Opn3_8
cacaatgtaaggcatccagc

SEQ ID NO: 46347 - DNA, 20 bp, Artificial Sequence
  sgRNA
  Opn3_9
tgatgcccacgggcaccacc

SEQ ID NO: 46348 - DNA, 20 bp, Artificial Sequence
  sgRNA
  Opn3_10
gtagagccagatataggtaa

SEQ ID NO: 46349 - DNA, 20 bp, Artificial Sequence
  sgRNA
  Opn3_11
ctccgaacagggataccagc

SEQ ID NO: 46350 - DNA, 20 bp, Artificial Sequence
  sgRNA
  Opn3_12
agtagccctggtcgccacta

SEQ ID NO: 46351 - DNA, 20 bp, Artificial Sequence
  sgRNA
  Opn3_13
acatggactgggctgtaccg

SEQ ID NO: 46352 - DNA, 20 bp, Artificial Sequence
  sgRNA
  Opn3_14
gccgctggcatctcagcagg

SEQ ID NO: 46353 - DNA, 20 bp, Artificial Sequence
  sgRNA
  Opn3_15
tacgcggtggggctgaagag

SEQ ID NO: 46354 - DNA, 20 bp, Artificial Sequence
  sgRNA
  Opn3_16
gtcactgtcctcgactgaca

SEQ ID NO: 46355 - DNA, 20 bp, Artificial Sequence
  sgRNA
  Opn3_17
tggcgaccagggctactggg

SEQ ID NO: 46356 - DNA, 20 bp, Artificial Sequence
  sgRNA
  Opn3_18
gaagcataggagctgcagaa

SEQ ID NO: 46357 - DNA, 20 bp, Artificial Sequence
  sgRNA
  Opn3_19
gcatttcactctcagccgct

SEQ ID NO: 46358 - DNA, 20 bp, Artificial Sequence
  sgRNA
  Opn3_20
tcaccttcgcgtcgtgcctg

SEQ ID NO: 46359 - DNA, 20 bp, Artificial Sequence
  sgRNA
  Opn4_1
taggtgcctacgtgcccgag

SEQ ID NO: 46360 - DNA, 20 bp, Artificial Sequence
  sgRNA
  Opn4_2
gggcctgagtgactgacatg

SEQ ID NO: 46361 - DNA, 20 bp, Artificial Sequence
  sgRNA
  Opn4_3
cctgacgccctacatgagct

SEQ ID NO: 46362 - DNA, 20 bp, Artificial Sequence
  sgRNA
  Opn4_4
ggggctaacagagagaagct

SEQ ID NO: 46363 - DNA, 20 bp, Artificial Sequence
  sgRNA
  Opn4_5
cgagttctatgccttctgcg

SEQ ID NO: 46364 - DNA, 20 bp, Artificial Sequence
  sgRNA
  Opn4_6
tcttagatctctgtacctgg

SEQ ID NO: 46365 - DNA, 20 bp, Artificial Sequence
  sgRNA
  Opn4_7
tgctcactataccctaggca

SEQ ID NO: 46366 - DNA, 20 bp, Artificial Sequence
  sgRNA
  Opn4_8
gctgctcaatgtggagcggt

SEQ ID NO: 46367 - DNA, 20 bp, Artificial Sequence
  sgRNA
  Opn4_9
caggggatccaaaagacgaa

SEQ ID NO: 46368 - DNA, 20 bp, Artificial Sequence
  sgRNA
  Opn4_10
acacgtccactggccaccat

SEQ ID NO: 46369 - DNA, 20 bp, Artificial Sequence
  sgRNA
  Opn4_11
tgaggaagtcgctgactgcg

SEQ ID NO: 46370 - DNA, 20 bp, Artificial Sequence
  sgRNA
  Opn4_12
gacgtgtgatcaccagatag

SEQ ID NO: 46371 - DNA, 20 bp, Artificial Sequence
  sgRNA
  Opn4_13
tggctccctgtcctttcata

SEQ ID NO: 46372 - DNA, 20 bp, Artificial Sequence
  sgRNA
  Opn4_14
agccaggccaagtagcctaa

SEQ ID NO: 46373 - DNA, 20 bp, Artificial Sequence
  sgRNA
  Opn4_15
ggtgccagccgtcatcgcca

SEQ ID NO: 46374 - DNA, 20 bp, Artificial Sequence
  sgRNA
  Opn4_16
atacaccgagaagcacccca

SEQ ID NO: 46375 - DNA, 20 bp, Artificial Sequence
  sgRNA
  Opn4_17
ccactggccaccatcggcag

SEQ ID NO: 46376 - DNA, 20 bp, Artificial Sequence
  sgRNA
  Opn4_18
catgtcagtcactcaggccc

SEQ ID NO: 46377 - DNA, 20 bp, Artificial Sequence
  sgRNA
  Opn4_19
acctcagctggatctctgga

SEQ ID NO: 46378 - DNA, 20 bp, Artificial Sequence
  sgRNA
  Opn4_20
cagaagatgatgatgagcag

SEQ ID NO: 46379 - DNA, 20 bp, Artificial Sequence
  sgRNA
  Opn5_1
atatgctaagatcatcgcca

SEQ ID NO: 46380 - DNA, 20 bp, Artificial Sequence
  sgRNA
  Opn5_2
accagccaaacacccagcgg

SEQ ID NO: 46381 - DNA, 20 bp, Artificial Sequence
  sgRNA
  Opn5_3
ccatagcagccatgtacttg

SEQ ID NO: 46382 - DNA, 20 bp, Artificial Sequence
  sgRNA
  Opn5_4
gataacagatcttcagatag

SEQ ID NO: 46383 - DNA, 20 bp, Artificial Sequence
  sgRNA
  Opn5_5
agggtgcatgaggttccgaa

SEQ ID NO: 46384 - DNA, 20 bp, Artificial Sequence
  sgRNA
  Opn5_6
gccccactatcttcgagacg

SEQ ID NO: 46385 - DNA, 20 bp, Artificial Sequence
  sgRNA
  Opn5_7
gctcaggtgcatagtccccc

SEQ ID NO: 46386 - DNA, 20 bp, Artificial Sequence
  sgRNA
  Opn5_8
atccagcccagccataccag

SEQ ID NO: 46387 - DNA, 20 bp, Artificial Sequence
  sgRNA
  Opn5_9
tcacagccgttggcagcagg

SEQ ID NO: 46388 - DNA, 20 bp, Artificial Sequence
  sgRNA
  Opn5_10
gagaaaacaatcacagccgt

SEQ ID NO: 46389 - DNA, 20 bp, Artificial Sequence
  sgRNA
  Opn5_11
gtcctcgtctcgaagatagt

SEQ ID NO: 46390 - DNA, 20 bp, Artificial Sequence
  sgRNA
  Opn5_12
ggtgaagtcttcttctaaag

SEQ ID NO: 46391 - DNA, 20 bp, Artificial Sequence
  sgRNA
  Opn5_13
gtacaatccaatcatctacc

SEQ ID NO: 46392 - DNA, 20 bp, Artificial Sequence
  sgRNA
  Opn5_14
actagtgcccatgttatgga

SEQ ID NO: 46393 - DNA, 20 bp, Artificial Sequence
  sgRNA
  Opn5_15
ttacagatttgcctgttgcc

SEQ ID NO: 46394 - DNA, 20 bp, Artificial Sequence
  sgRNA
  Opn5_16
catccccatacagctctccg

SEQ ID NO: 46395 - DNA, 20 bp, Artificial Sequence
  sgRNA
  Opn5_17
gactctctccatccataaca

SEQ ID NO: 46396 - DNA, 20 bp, Artificial Sequence
  sgRNA
  Opn5_18
tcagcttcacctcaagtaca

SEQ ID NO: 46397 - DNA, 20 bp, Artificial Sequence
  sgRNA
  Opn5_19
cttcggaacctcatgcaccc

SEQ ID NO: 46398 - DNA, 20 bp, Artificial Sequence
  sgRNA
  Opn5_20
tagtcccccaggcccaccaa

SEQ ID NO: 46399 - DNA, 20 bp, Artificial Sequence
  sgRNA
  Oprd1_1
gcacacagccgagtagagcg

SEQ ID NO: 46400 - DNA, 20 bp, Artificial Sequence
  sgRNA
  Oprd1_2
gcgcgggcgccaatgcgtcg

SEQ ID NO: 46401 - DNA, 20 bp, Artificial Sequence
  sgRNA
  Oprd1_3
ccaagtacttgatggaaacg

SEQ ID NO: 46402 - DNA, 20 bp, Artificial Sequence
  sgRNA
  Oprd1_4
tcatggcagtgacccaaccc

SEQ ID NO: 46403 - DNA, 20 bp, Artificial Sequence
  sgRNA
  Oprd1_5
ggcgtccgagaggttgacga

SEQ ID NO: 46404 - DNA, 20 bp, Artificial Sequence
  sgRNA
  Oprd1_6
cgctgggaaaggcgtccgag

SEQ ID NO: 46405 - DNA, 20 bp, Artificial Sequence
  sgRNA
  Oprd1_7
gcgaggactgcagctccgca

SEQ ID NO: 46406 - DNA, 20 bp, Artificial Sequence
  sgRNA
  Oprd1_8
catggcagtgacccaacccc

SEQ ID NO: 46407 - DNA, 20 bp, Artificial Sequence
  sgRNA
  Oprd1_9
gcgtccgagaggttgacgag

SEQ ID NO: 46408 - DNA, 20 bp, Artificial Sequence
  sgRNA
  Oprd1_10
ggacttccggacaccagcca

SEQ ID NO: 46409 - DNA, 20 bp, Artificial Sequence
  sgRNA
  Oprd1_11
ggcagtgacacgctcacgcg

SEQ ID NO: 46410 - DNA, 20 bp, Artificial Sequence
  sgRNA
  Oprd1_12
ggacgctggtggacatcaat

SEQ ID NO: 46411 - DNA, 20 bp, Artificial Sequence
  sgRNA
  Oprd1_13
ggctggtgtccggaagtcca

SEQ ID NO: 46412 - DNA, 20 bp, Artificial Sequence
  sgRNA
  Oprd1_14
aagtacttggcgctctggaa

SEQ ID NO: 46413 - DNA, 20 bp, Artificial Sequence
  sgRNA
  Oprd1_15
gaagatgtagatgttggtgg

SEQ ID NO: 46414 - DNA, 20 bp, Artificial Sequence
  sgRNA
  Oprd1_16
gcagtgcggccaccacaagt

SEQ ID NO: 46415 - DNA, 20 bp, Artificial Sequence
  sgRNA
  Oprd1_17
gtagagcgcggtgatggcga

SEQ ID NO: 46416 - DNA, 20 bp, Artificial Sequence
  sgRNA
  Oprd1_18
cagctctgtcgcacgccctg

SEQ ID NO: 46417 - DNA, 20 bp, Artificial Sequence
  sgRNA
  Oprd1_19
tcgtcatgtttggcatcgtc

SEQ ID NO: 46418 - DNA, 20 bp, Artificial Sequence
  sgRNA
  Oprd1_20
agtgacacgctcacgcgtgg

SEQ ID NO: 46419 - DNA, 20 bp, Artificial Sequence
  sgRNA
  Oprk1_1
tgggcagaatccgacagtaa

SEQ ID NO: 46420 - DNA, 20 bp, Artificial Sequence
  sgRNA
  Oprk1_2
ggaagtccaaagctttcaca

SEQ ID NO: 46421 - DNA, 20 bp, Artificial Sequence
  sgRNA
  Oprk1_3
agcactctgaaagggcatag

SEQ ID NO: 46422 - DNA, 20 bp, Artificial Sequence
  sgRNA
  Oprk1_4
aaataccacagagtagacag

SEQ ID NO: 46423 - DNA, 20 bp, Artificial Sequence
  sgRNA
  Oprk1_5
gcaccagcttggtgatgcgg

SEQ ID NO: 46424 - DNA, 20 bp, Artificial Sequence
  sgRNA
  Oprk1_6
gatggccggagagatgtgcg

SEQ ID NO: 46425 - DNA, 20 bp, Artificial Sequence
  sgRNA
  Oprk1_7
ttctggatgaaaacttcaag

SEQ ID NO: 46426 - DNA, 20 bp, Artificial Sequence
  sgRNA
  Oprk1_8
ggtggcacacagcaatgtag

SEQ ID NO: 46427 - DNA, 20 bp, Artificial Sequence
  sgRNA
  Oprk1_9
gctccattcgcatcttaata

SEQ ID NO: 46428 - DNA, 20 bp, Artificial Sequence
  sgRNA
  Oprk1_10
atataccaacagatgatgcc

SEQ ID NO: 46429 - DNA, 20 bp, Artificial Sequence
  sgRNA
  Oprk1_11
gtgatgataacagggatggc

SEQ ID NO: 46430 - DNA, 20 bp, Artificial Sequence
  sgRNA
  Oprk1_12
tcctcggaagatctgaatgg

SEQ ID NO: 46431 - DNA, 20 bp, Artificial Sequence
  sgRNA
  Oprk1_13
cttccctattaagatgcgaa

SEQ ID NO: 46432 - DNA, 20 bp, Artificial Sequence
  sgRNA
  Oprk1_14
ggcaatacagaaataatagc

SEQ ID NO: 46433 - DNA, 20 bp, Artificial Sequence
  sgRNA
  Oprk1_15
gcttccatgagagatgtggg

SEQ ID NO: 46434 - DNA, 20 bp, Artificial Sequence
  sgRNA
  Oprk1_16
tcccccattcagatcttccg

SEQ ID NO: 46435 - DNA, 20 bp, Artificial Sequence
  sgRNA
  Oprk1_17
ctgatgatgaatattcctgg

SEQ ID NO: 46436 - DNA, 20 bp, Artificial Sequence
  sgRNA
  Oprk1_18
cttcatgaagagatcccacc

SEQ ID NO: 46437 - DNA, 20 bp, Artificial Sequence
  sgRNA
  Oprk1_19
tgcttcccagagcctccacc

SEQ ID NO: 46438 - DNA, 20 bp, Artificial Sequence
  sgRNA
  Oprk1_20
aggtagggcctggatctcct

SEQ ID NO: 46439 - DNA, 20 bp, Artificial Sequence
  sgRNA
  Oprl1_1
actggatgtccgaacatcaa

SEQ ID NO: 46440 - DNA, 20 bp, Artificial Sequence
  sgRNA
  Oprl1_2
cacgaagtcgtcgaatcatg

SEQ ID NO: 46441 - DNA, 20 bp, Artificial Sequence
  sgRNA
  Oprl1_3
cccgcccctcaggactattg

SEQ ID NO: 46442 - DNA, 20 bp, Artificial Sequence
  sgRNA
  Oprl1_4
atggtgaccttgagtccaag

SEQ ID NO: 46443 - DNA, 20 bp, Artificial Sequence
  sgRNA
  Oprl1_5
ggaacctgcgacgcatcaca

SEQ ID NO: 46444 - DNA, 20 bp, Artificial Sequence
  sgRNA
  Oprl1_6
acaactgttgacatagccca

SEQ ID NO: 46445 - DNA, 20 bp, Artificial Sequence
  sgRNA
  Oprl1_7
agatgcagatggcaaataca

SEQ ID NO: 46446 - DNA, 20 bp, Artificial Sequence
  sgRNA
  Oprl1_8
agccaagtagagccccacga

SEQ ID NO: 46447 - DNA, 20 bp, Artificial Sequence
  sgRNA
  Oprl1_9
gctactgcagtctcactacc

SEQ ID NO: 46448 - DNA, 20 bp, Artificial Sequence
  sgRNA
  Oprl1_10
aacaccaaccaccgaagcca

SEQ ID NO: 46449 - DNA, 20 bp, Artificial Sequence
  sgRNA
  Oprl1_11
ctatccgtgcccttgatgtt

SEQ ID NO: 46450 - DNA, 20 bp, Artificial Sequence
  sgRNA
  Oprl1_12
tcgtgtgcgcagcattgcca

SEQ ID NO: 46451 - DNA, 20 bp, Artificial Sequence
  sgRNA
  Oprl1_13
catgggctcagcacaagtgg

SEQ ID NO: 46452 - DNA, 20 bp, Artificial Sequence
  sgRNA
  Oprl1_14
tgtatggcagccactttcaa

SEQ ID NO: 46453 - DNA, 20 bp, Artificial Sequence
  sgRNA
  Oprl1_15
gagacaggttcccttgaaag

SEQ ID NO: 46454 - DNA, 20 bp, Artificial Sequence
  sgRNA
  Oprl1_16
ctacttggctgtgtgcatcg

SEQ ID NO: 46455 - DNA, 20 bp, Artificial Sequence
  sgRNA
  Oprl1_17
ctttcctgccccattctggg

SEQ ID NO: 46456 - DNA, 20 bp, Artificial Sequence
  sgRNA
  Oprl1_18
tatggccacattaacggcct

SEQ ID NO: 46457 - DNA, 20 bp, Artificial Sequence
  sgRNA
  Oprl1_19
cctgaccaatcagttcccca

SEQ ID NO: 46458 - DNA, 20 bp, Artificial Sequence
  sgRNA
  Oprl1_20
tgaggatgacatacatgacg

SEQ ID NO: 46459 - DNA, 20 bp, Artificial Sequence
  sgRNA
  Oprm1_1
ccgtgcggttaggaccgcat

SEQ ID NO: 46460 - DNA, 20 bp, Artificial Sequence
  sgRNA
  Oprm1_2
atgtgggatgagagaacgtg

SEQ ID NO: 46461 - DNA, 20 bp, Artificial Sequence
  sgRNA
  Oprm1_3
ttaactacctgatgggaacg

SEQ ID NO: 46462 - DNA, 20 bp, Artificial Sequence
  sgRNA
  Oprm1_4
ttacaatcacatacatgacc

SEQ ID NO: 46463 - DNA, 20 bp, Artificial Sequence
  sgRNA
  Oprm1_5
catgcggtcctaaccgcacg

SEQ ID NO: 46464 - DNA, 20 bp, Artificial Sequence
  sgRNA
  Oprm1_6
ctgtccatgcaactcttgca

SEQ ID NO: 46465 - DNA, 20 bp, Artificial Sequence
  sgRNA
  Oprm1_7
tcacgttctctcatcccaca

SEQ ID NO: 46466 - DNA, 20 bp, Artificial Sequence
  sgRNA
  Oprm1_8
agtggatcgaactaaccacc

SEQ ID NO: 46467 - DNA, 20 bp, Artificial Sequence
  sgRNA
  Oprm1_9
tcgaatccgtcaaaacacta

SEQ ID NO: 46468 - DNA, 20 bp, Artificial Sequence
  sgRNA
  Oprm1_10
tcgatccactgtattagccg

SEQ ID NO: 46469 - DNA, 20 bp, Artificial Sequence
  sgRNA
  Oprm1_11
tccactgtattagccgtgga

SEQ ID NO: 46470 - DNA, 20 bp, Artificial Sequence
  sgRNA
  Oprm1_12
gcaaccacaaaatacaggca

SEQ ID NO: 46471 - DNA, 20 bp, Artificial Sequence
  sgRNA
  Oprm1_13
cggactggttgccatcaacg

SEQ ID NO: 46472 - DNA, 20 bp, Artificial Sequence
  sgRNA
  Oprm1_14
gccaaccctggcagtcagcg

SEQ ID NO: 46473 - DNA, 20 bp, Artificial Sequence
  sgRNA
  Oprm1_15
cttctgctcccatatttccc

SEQ ID NO: 46474 - DNA, 20 bp, Artificial Sequence
  sgRNA
  Oprm1_16
ggaacctgcgcaggatcacc

SEQ ID NO: 46475 - DNA, 20 bp, Artificial Sequence
  sgRNA
  Oprm1_17
cctgcgcaggatcacccgga

SEQ ID NO: 46476 - DNA, 20 bp, Artificial Sequence
  sgRNA
  Oprm1_18
ggaaatgtaggcatataacc

SEQ ID NO: 46477 - DNA, 20 bp, Artificial Sequence
  sgRNA
  Oprm1_19
agaaccatggacagcagcgc

SEQ ID NO: 46478 - DNA, 20 bp, Artificial Sequence
  sgRNA
  Oprm1_20
gcatataaccaggatggtaa

SEQ ID NO: 46479 - DNA, 20 bp, Artificial Sequence
  sgRNA
  Osmr_1
tatacctggcaaatcactga

SEQ ID NO: 46480 - DNA, 20 bp, Artificial Sequence
  sgRNA
  Osmr_2
cccgtatctggagacacgat

SEQ ID NO: 46481 - DNA, 20 bp, Artificial Sequence
  sgRNA
  Osmr_3
agaggtagtttgcgctcatg

SEQ ID NO: 46482 - DNA, 20 bp, Artificial Sequence
  sgRNA
  Osmr_4
atcaattgtcaagccacgaa

SEQ ID NO: 46483 - DNA, 20 bp, Artificial Sequence
  sgRNA
  Osmr_5
gatgcagtgcaaccaaccct

SEQ ID NO: 46484 - DNA, 20 bp, Artificial Sequence
  sgRNA
  Osmr_6
gtgtccttgtctccgcacat

SEQ ID NO: 46485 - DNA, 20 bp, Artificial Sequence
  sgRNA
  Osmr_7
tcttagaacgaaggagttag

SEQ ID NO: 46486 - DNA, 20 bp, Artificial Sequence
  sgRNA
  Osmr_8
tcaacggtcctcttaggcca

SEQ ID NO: 46487 - DNA, 20 bp, Artificial Sequence
  sgRNA
  Osmr_9
ccttcagagaaggtgatgcg

SEQ ID NO: 46488 - DNA, 20 bp, Artificial Sequence
  sgRNA
  Osmr_10
ctaactccttcgttctaaga

SEQ ID NO: 46489 - DNA, 20 bp, Artificial Sequence
  sgRNA
  Osmr_11
gagtgacgaaaaactcatag

SEQ ID NO: 46490 - DNA, 20 bp, Artificial Sequence
  sgRNA
  Osmr_12
acccaatgaaacgttcacaa

SEQ ID NO: 46491 - DNA, 20 bp, Artificial Sequence
  sgRNA
  Osmr_13
ggatccagacacaaagtaca

SEQ ID NO: 46492 - DNA, 20 bp, Artificial Sequence
  sgRNA
  Osmr_14
tcagttggactttcgaccag

SEQ ID NO: 46493 - DNA, 20 bp, Artificial Sequence
  sgRNA
  Osmr_15
agtgacgaaaaactcataga

SEQ ID NO: 46494 - DNA, 20 bp, Artificial Sequence
  sgRNA
  Osmr_16
agagacaaagacactcaccg

SEQ ID NO: 46495 - DNA, 20 bp, Artificial Sequence
  sgRNA
  Osmr_17
tgtacggattgggaatgtca

SEQ ID NO: 46496 - DNA, 20 bp, Artificial Sequence
  sgRNA
  Osmr_18
tgagccttcagtgatttgcc

SEQ ID NO: 46497 - DNA, 20 bp, Artificial Sequence
  sgRNA
  Osmr_19
gcaaatcactgaaggctcac

SEQ ID NO: 46498 - DNA, 20 bp, Artificial Sequence
  sgRNA
  Osmr_20
ggaaggagggtcctttccca

SEQ ID NO: 46499 - DNA, 20 bp, Artificial Sequence
  sgRNA
  Ostm1_1
catcagccgaaacatcgggg

SEQ ID NO: 46500 - DNA, 20 bp, Artificial Sequence
  sgRNA
  Ostm1_2
ttgcctaacaaacaatggtg

SEQ ID NO: 46501 - DNA, 20 bp, Artificial Sequence
  sgRNA
  Ostm1_3
agcgctgcgcaccatacagg

SEQ ID NO: 46502 - DNA, 20 bp, Artificial Sequence
  sgRNA
  Ostm1_4
cagaatgcagatagttctca

SEQ ID NO: 46503 - DNA, 20 bp, Artificial Sequence
  sgRNA
  Ostm1_5
gacaacatcagccgaaacat

SEQ ID NO: 46504 - DNA, 20 bp, Artificial Sequence
  sgRNA
  Ostm1_6
actcaggctccagatccggc

SEQ ID NO: 46505 - DNA, 20 bp, Artificial Sequence
  sgRNA
  Ostm1_7
gcacttgtgcatcgatgtgg

SEQ ID NO: 46506 - DNA, 20 bp, Artificial Sequence
  sgRNA
  Ostm1_8
tctgcattctgtctgccgtc

SEQ ID NO: 46507 - DNA, 20 bp, Artificial Sequence
  sgRNA
  Ostm1_9
acagcaggtccgcaaagcct

SEQ ID NO: 46508 - DNA, 20 bp, Artificial Sequence
  sgRNA
  Ostm1_10
gggtgccgactgctggtgaa

SEQ ID NO: 46509 - DNA, 20 bp, Artificial Sequence
  sgRNA
  Ostm1_11
ggagacttccgccacagcgc

SEQ ID NO: 46510 - DNA, 20 bp, Artificial Sequence
  sgRNA
  Ostm1_12
ccatcttgattgcgacctgt

SEQ ID NO: 46511 - DNA, 20 bp, Artificial Sequence
  sgRNA
  Ostm1_13
ctactgaggtagaagacgac

SEQ ID NO: 46512 - DNA, 20 bp, Artificial Sequence
  sgRNA
  Ostm1_14
gagtcgaaccttcaactgtt

SEQ ID NO: 46513 - DNA, 20 bp, Artificial Sequence
  sgRNA
  Ostm1_15
tccgccctgcagcaaagaca

SEQ ID NO: 46514 - DNA, 20 bp, Artificial Sequence
  sgRNA
  Ostm1_16
agctggcgcgcagtagcggg

SEQ ID NO: 46515 - DNA, 20 bp, Artificial Sequence
  sgRNA
  Ostm1_17
ttcggtcacctgcagcgaca

SEQ ID NO: 46516 - DNA, 20 bp, Artificial Sequence
  sgRNA
  Ostm1_18
ttgaccctgtctttgctgca

SEQ ID NO: 46517 - DNA, 20 bp, Artificial Sequence
  sgRNA
  Ostm1_19
ctgtctttgctgcagggcgg

SEQ ID NO: 46518 - DNA, 20 bp, Artificial Sequence
  sgRNA
  Ostm1_20
agtgtgcagaaactgtaaag

SEQ ID NO: 46519 - DNA, 20 bp, Artificial Sequence
  sgRNA
  Otoa_1
tgctacttcaggcatcgcgg

SEQ ID NO: 46520 - DNA, 20 bp, Artificial Sequence
  sgRNA
  Otoa_2
gaaggcatttcatggcggtg

SEQ ID NO: 46521 - DNA, 20 bp, Artificial Sequence
  sgRNA
  Otoa_3
gagctgaagtctggtcatag

SEQ ID NO: 46522 - DNA, 20 bp, Artificial Sequence
  sgRNA
  Otoa_4
gctgttccagctttgacgtg

SEQ ID NO: 46523 - DNA, 20 bp, Artificial Sequence
  sgRNA
  Otoa_5
ggaacatctctaccatccac

SEQ ID NO: 46524 - DNA, 20 bp, Artificial Sequence
  sgRNA
  Otoa_6
cttaaatccagctaagacgg

SEQ ID NO: 46525 - DNA, 20 bp, Artificial Sequence
  sgRNA
  Otoa_7
gcacctgccagagatccttg

SEQ ID NO: 46526 - DNA, 20 bp, Artificial Sequence
  sgRNA
  Otoa_8
caatgcctgctgggaccccg

SEQ ID NO: 46527 - DNA, 20 bp, Artificial Sequence
  sgRNA
  Otoa_9
gatggcgctgtgcactgcat

SEQ ID NO: 46528 - DNA, 20 bp, Artificial Sequence
  sgRNA
  Otoa_10
gctaccccaggacctgcacg

SEQ ID NO: 46529 - DNA, 20 bp, Artificial Sequence
  sgRNA
  Otoa_11
aacaccatattgtctccctg

SEQ ID NO: 46530 - DNA, 20 bp, Artificial Sequence
  sgRNA
  Otoa_12
agccaaagcaatgcgcccca

SEQ ID NO: 46531 - DNA, 20 bp, Artificial Sequence
  sgRNA
  Otoa_13
ccttagctccatagacaccg

SEQ ID NO: 46532 - DNA, 20 bp, Artificial Sequence
  sgRNA
  Otoa_14
gatcctctccagaaatgcct

SEQ ID NO: 46533 - DNA, 20 bp, Artificial Sequence
  sgRNA
  Otoa_15
ctacctggccagcctccact

SEQ ID NO: 46534 - DNA, 20 bp, Artificial Sequence
  sgRNA
  Otoa_16
cagcctccttcattgagaga

SEQ ID NO: 46535 - DNA, 20 bp, Artificial Sequence
  sgRNA
  Otoa_17
tcacgtcaaagctggaacag

SEQ ID NO: 46536 - DNA, 20 bp, Artificial Sequence
  sgRNA
  Otoa_18
ggcatcttatggctgacggc

SEQ ID NO: 46537 - DNA, 20 bp, Artificial Sequence
  sgRNA
  Otoa_19
gctccatcttgcaggagctt

SEQ ID NO: 46538 - DNA, 20 bp, Artificial Sequence
  sgRNA
  Otoa_20
attcaatgctacagtcctga

SEQ ID NO: 46539 - DNA, 20 bp, Artificial Sequence
  sgRNA
  Otop1_1
caatagggtatgcactgcat

SEQ ID NO: 46540 - DNA, 20 bp, Artificial Sequence
  sgRNA
  Otop1_2
gttcacgaacctcctactgt

SEQ ID NO: 46541 - DNA, 20 bp, Artificial Sequence
  sgRNA
  Otop1_3
gtatggactgaacgtgttcg

SEQ ID NO: 46542 - DNA, 20 bp, Artificial Sequence
  sgRNA
  Otop1_4
ccgccccaaggacacgcacg

SEQ ID NO: 46543 - DNA, 20 bp, Artificial Sequence
  sgRNA
  Otop1_5
gatgcagtgcagattcgacg

SEQ ID NO: 46544 - DNA, 20 bp, Artificial Sequence
  sgRNA
  Otop1_6
aggttgaccacaattatcca

SEQ ID NO: 46545 - DNA, 20 bp, Artificial Sequence
  sgRNA
  Otop1_7
gatcatgtacaccacaacca

SEQ ID NO: 46546 - DNA, 20 bp, Artificial Sequence
  sgRNA
  Otop1_8
tgctgcttatgggggccgca

SEQ ID NO: 46547 - DNA, 20 bp, Artificial Sequence
  sgRNA
  Otop1_9
tgccgtcccgagtatgacaa

SEQ ID NO: 46548 - DNA, 20 bp, Artificial Sequence
  sgRNA
  Otop1_10
cagctgcagcagcataagcg

SEQ ID NO: 46549 - DNA, 20 bp, Artificial Sequence
  sgRNA
  Otop1_11
gactgaacgtgttcgtggcg

SEQ ID NO: 46550 - DNA, 20 bp, Artificial Sequence
  sgRNA
  Otop1_12
ccagcttccgactagccctg

SEQ ID NO: 46551 - DNA, 20 bp, Artificial Sequence
  sgRNA
  Otop1_13
gcgcggttagaacgcacagc

SEQ ID NO: 46552 - DNA, 20 bp, Artificial Sequence
  sgRNA
  Otop1_14
gagtgcttgtcagccaccga

SEQ ID NO: 46553 - DNA, 20 bp, Artificial Sequence
  sgRNA
  Otop1_15
ggtggtgtgcagttacactg

SEQ ID NO: 46554 - DNA, 20 bp, Artificial Sequence
  sgRNA
  Otop1_16
gtacaccacaaccacggcga

SEQ ID NO: 46555 - DNA, 20 bp, Artificial Sequence
  sgRNA
  Otop1_17
gctggctgccaccatcgccg

SEQ ID NO: 46556 - DNA, 20 bp, Artificial Sequence
  sgRNA
  Otop1_18
tacgtgctgtggaagaacat

SEQ ID NO: 46557 - DNA, 20 bp, Artificial Sequence
  sgRNA
  Otop1_19
gcatccactctcgggagcca

SEQ ID NO: 46558 - DNA, 20 bp, Artificial Sequence
  sgRNA
  Otop1_20
cagcacgtagagcatggtcg

SEQ ID NO: 46559 - DNA, 20 bp, Artificial Sequence
  sgRNA
  Otop2_1
ccacggccacacaccgtcca

SEQ ID NO: 46560 - DNA, 20 bp, Artificial Sequence
  sgRNA
  Otop2_2
gtgcacggactcatccacta

SEQ ID NO: 46561 - DNA, 20 bp, Artificial Sequence
  sgRNA
  Otop2_3
accatcataagaacccgaca

SEQ ID NO: 46562 - DNA, 20 bp, Artificial Sequence
  sgRNA
  Otop2_4
cgtctggacagcgagcggtg

SEQ ID NO: 46563 - DNA, 20 bp, Artificial Sequence
  sgRNA
  Otop2_5
acgtcgccagtggcacctgg

SEQ ID NO: 46564 - DNA, 20 bp, Artificial Sequence
  sgRNA
  Otop2_6
gagcgatcatgagtagagcg

SEQ ID NO: 46565 - DNA, 20 bp, Artificial Sequence
  sgRNA
  Otop2_7
gtagaagactatccatagcg

SEQ ID NO: 46566 - DNA, 20 bp, Artificial Sequence
  sgRNA
  Otop2_8
tgttgacgatggccgcccag

SEQ ID NO: 46567 - DNA, 20 bp, Artificial Sequence
  sgRNA
  Otop2_9
aggtaggcagatgttgacga

SEQ ID NO: 46568 - DNA, 20 bp, Artificial Sequence
  sgRNA
  Otop2_10
agcgatcatgagtagagcgt

SEQ ID NO: 46569 - DNA, 20 bp, Artificial Sequence
  sgRNA
  Otop2_11
gcacttcagcaataccgtgg

SEQ ID NO: 46570 - DNA, 20 bp, Artificial Sequence
  sgRNA
  Otop2_12
gatagcgtattggcccaggg

SEQ ID NO: 46571 - DNA, 20 bp, Artificial Sequence
  sgRNA
  Otop2_13
gatagcatccaggttagcaa

SEQ ID NO: 46572 - DNA, 20 bp, Artificial Sequence
  sgRNA
  Otop2_14
cccgcacttcagcaataccg

SEQ ID NO: 46573 - DNA, 20 bp, Artificial Sequence
  sgRNA
  Otop2_15
tatgatggtccatggcccga

SEQ ID NO: 46574 - DNA, 20 bp, Artificial Sequence
  sgRNA
  Otop2_16
caccgcgtctggacagcgag

SEQ ID NO: 46575 - DNA, 20 bp, Artificial Sequence
  sgRNA
  Otop2_17
ttacggttactccctctggg

SEQ ID NO: 46576 - DNA, 20 bp, Artificial Sequence
  sgRNA
  Otop2_18
aggctgtactcgatgttgaa

SEQ ID NO: 46577 - DNA, 20 bp, Artificial Sequence
  sgRNA
  Otop2_19
tcaggcaccgacgtcgccag

SEQ ID NO: 46578 - DNA, 20 bp, Artificial Sequence
  sgRNA
  Otop2_20
tatctcctactactctatcg

SEQ ID NO: 46579 - DNA, 20 bp, Artificial Sequence
  sgRNA
  Oxgr1_1
ggtgaatgatcacaacgtaa

SEQ ID NO: 46580 - DNA, 20 bp, Artificial Sequence
  sgRNA
  Oxgr1_2
tgatgctatagatgacggga

SEQ ID NO: 46581 - DNA, 20 bp, Artificial Sequence
  sgRNA
  Oxgr1_3
tgtaccacttgatagtagtg

SEQ ID NO: 46582 - DNA, 20 bp, Artificial Sequence
  sgRNA
  Oxgr1_4
cagatacagcaagtccgtca

SEQ ID NO: 46583 - DNA, 20 bp, Artificial Sequence
  sgRNA
  Oxgr1_5
tgttccccgggaagcccacg

SEQ ID NO: 46584 - DNA, 20 bp, Artificial Sequence
  sgRNA
  Oxgr1_6
ggtcagcaataacttccagc

SEQ ID NO: 46585 - DNA, 20 bp, Artificial Sequence
  sgRNA
  Oxgr1_7
tcttcctcgtgggcttcccg

SEQ ID NO: 46586 - DNA, 20 bp, Artificial Sequence
  sgRNA
  Oxgr1_8
ctatagagcagaatgcctgc

SEQ ID NO: 46587 - DNA, 20 bp, Artificial Sequence
  sgRNA
  Oxgr1_9
agcagacctattggtccggg

SEQ ID NO: 46588 - DNA, 20 bp, Artificial Sequence
  sgRNA
  Oxgr1_10
gtgtcactatcaccaatggc

SEQ ID NO: 46589 - DNA, 20 bp, Artificial Sequence
  sgRNA
  Oxgr1_11
atgactgtactgcccctcca

SEQ ID NO: 46590 - DNA, 20 bp, Artificial Sequence
  sgRNA
  Oxgr1_12
catcaaccacccggaccaat

SEQ ID NO: 46591 - DNA, 20 bp, Artificial Sequence
  sgRNA
  Oxgr1_13
tcctgatcacatcaaccacc

SEQ ID NO: 46592 - DNA, 20 bp, Artificial Sequence
  sgRNA
  Oxgr1_14
ttctattcagaaaactcgct

SEQ ID NO: 46593 - DNA, 20 bp, Artificial Sequence
  sgRNA
  Oxgr1_15
ggcagtggtagcttgtgccg

SEQ ID NO: 46594 - DNA, 20 bp, Artificial Sequence
  sgRNA
  Oxgr1_16
aggaaatccgaatcactggc

SEQ ID NO: 46595 - DNA, 20 bp, Artificial Sequence
  sgRNA
  Oxgr1_17
ggttgaagtggaagccgaag

SEQ ID NO: 46596 - DNA, 20 bp, Artificial Sequence
  sgRNA
  Oxgr1_18
tatagcatcatcttcctcgt

SEQ ID NO: 46597 - DNA, 20 bp, Artificial Sequence
  sgRNA
  Oxgr1_19
atgaccctcaagatgtggaa

SEQ ID NO: 46598 - DNA, 20 bp, Artificial Sequence
  sgRNA
  Oxgr1_20
agtaatggatgaggaacggg

SEQ ID NO: 46599 - DNA, 20 bp, Artificial Sequence
  sgRNA
  Oxtr_1
tctggtcaaatacttgcagg

SEQ ID NO: 46600 - DNA, 20 bp, Artificial Sequence
  sgRNA
  Oxtr_2
gcagaatctgcgactcaaga

SEQ ID NO: 46601 - DNA, 20 bp, Artificial Sequence
  sgRNA
  Oxtr_3
gagcgtgatccacgtgacgt

SEQ ID NO: 46602 - DNA, 20 bp, Artificial Sequence
  sgRNA
  Oxtr_4
agggcctcgttgcgtcgtgg

SEQ ID NO: 46603 - DNA, 20 bp, Artificial Sequence
  sgRNA
  Oxtr_5
tgacccgtgccaacgccgca

SEQ ID NO: 46604 - DNA, 20 bp, Artificial Sequence
  sgRNA
  Oxtr_6
gtccaactcgatactccagt

SEQ ID NO: 46605 - DNA, 20 bp, Artificial Sequence
  sgRNA
  Oxtr_7
gcgactcaagacggcagccg

SEQ ID NO: 46606 - DNA, 20 bp, Artificial Sequence
  sgRNA
  Oxtr_8
tcgctgcgcgaagtggcgga

SEQ ID NO: 46607 - DNA, 20 bp, Artificial Sequence
  sgRNA
  Oxtr_9
atttgaccagacgacacagc

SEQ ID NO: 46608 - DNA, 20 bp, Artificial Sequence
  sgRNA
  Oxtr_10
tttctcgctgcgcgaagtgg

SEQ ID NO: 46609 - DNA, 20 bp, Artificial Sequence
  sgRNA
  Oxtr_11
accggctgcgtcactcccct

SEQ ID NO: 46610 - DNA, 20 bp, Artificial Sequence
  sgRNA
  Oxtr_12
acgtaggccttgggtcccca

SEQ ID NO: 46611 - DNA, 20 bp, Artificial Sequence
  sgRNA
  Oxtr_13
gctcgccgtctacattgtac

SEQ ID NO: 46612 - DNA, 20 bp, Artificial Sequence
  sgRNA
  Oxtr_14
gctgatgagaccatagcagg

SEQ ID NO: 46613 - DNA, 20 bp, Artificial Sequence
  sgRNA
  Oxtr_15
gatccacgtgacgtaggcct

SEQ ID NO: 46614 - DNA, 20 bp, Artificial Sequence
  sgRNA
  Oxtr_16
gctgcgacgactcaggacga

SEQ ID NO: 46615 - DNA, 20 bp, Artificial Sequence
  sgRNA
  Oxtr_17
tggagtatcgagttggacct

SEQ ID NO: 46616 - DNA, 20 bp, Artificial Sequence
  sgRNA
  Oxtr_18
cattgtaccggtcatcgtgc

SEQ ID NO: 46617 - DNA, 20 bp, Artificial Sequence
  sgRNA
  Oxtr_19
ggtcaaatacttgcaggtgg

SEQ ID NO: 46618 - DNA, 20 bp, Artificial Sequence
  sgRNA
  Oxtr_20
gatgaccggtacaatgtaga

SEQ ID NO: 46619 - DNA, 20 bp, Artificial Sequence
  sgRNA
  P2rx1_1
actgctgataaggccacttg

SEQ ID NO: 46620 - DNA, 20 bp, Artificial Sequence
  sgRNA
  P2rx1_2
actctcgcaccacatagcca

SEQ ID NO: 46621 - DNA, 20 bp, Artificial Sequence
  sgRNA
  P2rx1_3
gctggtacgaaacaagaagg

SEQ ID NO: 46622 - DNA, 20 bp, Artificial Sequence
  sgRNA
  P2rx1_4
ggcatatgccaagatgacag

SEQ ID NO: 46623 - DNA, 20 bp, Artificial Sequence
  sgRNA
  P2rx1_5
tttcgtaccagcaccatccg

SEQ ID NO: 46624 - DNA, 20 bp, Artificial Sequence
  sgRNA
  P2rx1_6
gattcgctttgatatccttg

SEQ ID NO: 46625 - DNA, 20 bp, Artificial Sequence
  sgRNA
  P2rx1_7
tgagtatgacactccccgga

SEQ ID NO: 46626 - DNA, 20 bp, Artificial Sequence
  sgRNA
  P2rx1_8
tggttggtatcaccatcgac

SEQ ID NO: 46627 - DNA, 20 bp, Artificial Sequence
  sgRNA
  P2rx1_9
cgtagaccagaaccaccaac

SEQ ID NO: 46628 - DNA, 20 bp, Artificial Sequence
  sgRNA
  P2rx1_10
tctttgagtatgacactccc

SEQ ID NO: 46629 - DNA, 20 bp, Artificial Sequence
  sgRNA
  P2rx1_11
acagcgggtgtagaatcttg

SEQ ID NO: 46630 - DNA, 20 bp, Artificial Sequence
  sgRNA
  P2rx1_12
tcagccacgtcccagacctg

SEQ ID NO: 46631 - DNA, 20 bp, Artificial Sequence
  sgRNA
  P2rx1_13
gaaccaccaactggatcaga

SEQ ID NO: 46632 - DNA, 20 bp, Artificial Sequence
  sgRNA
  P2rx1_14
tgtttcgtaccagcaccatc

SEQ ID NO: 46633 - DNA, 20 bp, Artificial Sequence
  sgRNA
  P2rx1_15
acaccttgaagaggtgacga

SEQ ID NO: 46634 - DNA, 20 bp, Artificial Sequence
  sgRNA
  P2rx1_16
gtcttcacagtgccattgaa

SEQ ID NO: 46635 - DNA, 20 bp, Artificial Sequence
  sgRNA
  P2rx1_17
ggtgctggtacgaaacaaga

SEQ ID NO: 46636 - DNA, 20 bp, Artificial Sequence
  sgRNA
  P2rx1_18
agtgtgtcagtgaaactcaa

SEQ ID NO: 46637 - DNA, 20 bp, Artificial Sequence
  sgRNA
  P2rx1_19
aaacccatctaccagttcca

SEQ ID NO: 46638 - DNA, 20 bp, Artificial Sequence
  sgRNA
  P2rx1_20
atccctactatgactaccat

SEQ ID NO: 46639 - DNA, 20 bp, Artificial Sequence
  sgRNA
  P2rx2_1
ggaatacgtaaagcccccgg

SEQ ID NO: 46640 - DNA, 20 bp, Artificial Sequence
  sgRNA
  P2rx2_2
ctgtgtaccctattaccatg

SEQ ID NO: 46641 - DNA, 20 bp, Artificial Sequence
  sgRNA
  P2rx2_3
tttgatgagagttcgagtgg

SEQ ID NO: 46642 - DNA, 20 bp, Artificial Sequence
  sgRNA
  P2rx2_4
atctccaccctagagcatga

SEQ ID NO: 46643 - DNA, 20 bp, Artificial Sequence
  sgRNA
  P2rx2_5
tggggactccaagacctgcg

SEQ ID NO: 46644 - DNA, 20 bp, Artificial Sequence
  sgRNA
  P2rx2_6
acagtcgtcatctaaatggc

SEQ ID NO: 46645 - DNA, 20 bp, Artificial Sequence
  sgRNA
  P2rx2_7
ccaacaggactccacatcca

SEQ ID NO: 46646 - DNA, 20 bp, Artificial Sequence
  sgRNA
  P2rx2_8
cagccataagaagttcgaca

SEQ ID NO: 46647 - DNA, 20 bp, Artificial Sequence
  sgRNA
  P2rx2_9
ggctttgatgagagttcgag

SEQ ID NO: 46648 - DNA, 20 bp, Artificial Sequence
  sgRNA
  P2rx2_10
gatgagagttcgagtggtgg

SEQ ID NO: 46649 - DNA, 20 bp, Artificial Sequence
  sgRNA
  P2rx2_11
gtggccagattgatgatggt

SEQ ID NO: 46650 - DNA, 20 bp, Artificial Sequence
  sgRNA
  P2rx2_12
gtcacaggccatctacttga

SEQ ID NO: 46651 - DNA, 20 bp, Artificial Sequence
  sgRNA
  P2rx2_13
tcacaggccatctacttgag

SEQ ID NO: 46652 - DNA, 20 bp, Artificial Sequence
  sgRNA
  P2rx2_14
cgcaggtcttggagtcccca

SEQ ID NO: 46653 - DNA, 20 bp, Artificial Sequence
  sgRNA
  P2rx2_15
ccacacagtcgtcatctaaa

SEQ ID NO: 46654 - DNA, 20 bp, Artificial Sequence
  sgRNA
  P2rx2_16
cctgggattcgtgcaccgca

SEQ ID NO: 46655 - DNA, 20 bp, Artificial Sequence
  sgRNA
  P2rx2_17
gaactctcatcaaagcctat

SEQ ID NO: 46656 - DNA, 20 bp, Artificial Sequence
  sgRNA
  P2rx2_18
aacgtcaattcgaatcccat

SEQ ID NO: 46657 - DNA, 20 bp, Artificial Sequence
  sgRNA
  P2rx2_19
attccgcaccacgatcacct

SEQ ID NO: 46658 - DNA, 20 bp, Artificial Sequence
  sgRNA
  P2rx2_20
aaagctggtccttcacctga

SEQ ID NO: 46659 - DNA, 20 bp, Artificial Sequence
  sgRNA
  P2rx3_1
cagagctgtagttcacgcag

SEQ ID NO: 46660 - DNA, 20 bp, Artificial Sequence
  sgRNA
  P2rx3_2
ggctcggttgatgatcccaa

SEQ ID NO: 46661 - DNA, 20 bp, Artificial Sequence
  sgRNA
  P2rx3_3
aatgcaaggattctgtccag

SEQ ID NO: 46662 - DNA, 20 bp, Artificial Sequence
  sgRNA
  P2rx3_4
cctcaagatggggcaaaatg

SEQ ID NO: 46663 - DNA, 20 bp, Artificial Sequence
  sgRNA
  P2rx3_5
ctacgagactaccaagtcgg

SEQ ID NO: 46664 - DNA, 20 bp, Artificial Sequence
  sgRNA
  P2rx3_6
ggagttctgggcattaagat

SEQ ID NO: 46665 - DNA, 20 bp, Artificial Sequence
  sgRNA
  P2rx3_7
tctgggcattaagatcggct

SEQ ID NO: 46666 - DNA, 20 bp, Artificial Sequence
  sgRNA
  P2rx3_8
cgtataccagcacatcaaag

SEQ ID NO: 46667 - DNA, 20 bp, Artificial Sequence
  sgRNA
  P2rx3_9
ggtggctgccttcacttccg

SEQ ID NO: 46668 - DNA, 20 bp, Artificial Sequence
  sgRNA
  P2rx3_10
cgaaagccttcaggagcgtg

SEQ ID NO: 46669 - DNA, 20 bp, Artificial Sequence
  sgRNA
  P2rx3_11
gaagcagtccacagactcgg

SEQ ID NO: 46670 - DNA, 20 bp, Artificial Sequence
  sgRNA
  P2rx3_12
cgtcggacctgtgagatcca

SEQ ID NO: 46671 - DNA, 20 bp, Artificial Sequence
  sgRNA
  P2rx3_13
cctggatctcacaggtccga

SEQ ID NO: 46672 - DNA, 20 bp, Artificial Sequence
  sgRNA
  P2rx3_14
tgaactacagctctgtccgt

SEQ ID NO: 46673 - DNA, 20 bp, Artificial Sequence
  sgRNA
  P2rx3_15
acgctatgccaacagagtca

SEQ ID NO: 46674 - DNA, 20 bp, Artificial Sequence
  sgRNA
  P2rx3_16
cggtacttctcctcattctg

SEQ ID NO: 46675 - DNA, 20 bp, Artificial Sequence
  sgRNA
  P2rx3_17
aactccatctagccgagtga

SEQ ID NO: 46676 - DNA, 20 bp, Artificial Sequence
  sgRNA
  P2rx3_18
cctgctcaatttcctcaaag

SEQ ID NO: 46677 - DNA, 20 bp, Artificial Sequence
  sgRNA
  P2rx3_19
gggctgatcactacaaagcc

SEQ ID NO: 46678 - DNA, 20 bp, Artificial Sequence
  sgRNA
  P2rx3_20
gtaacaaaggtaaaaggctt

SEQ ID NO: 46679 - DNA, 20 bp, Artificial Sequence
  sgRNA
  P2rx4_1
agtggggctcatgaaccgcg

SEQ ID NO: 46680 - DNA, 20 bp, Artificial Sequence
  sgRNA
  P2rx4_2
gtcaccgtgaaccagacgca

SEQ ID NO: 46681 - DNA, 20 bp, Artificial Sequence
  sgRNA
  P2rx4_3
ctgagctgggaccacatagt

SEQ ID NO: 46682 - DNA, 20 bp, Artificial Sequence
  sgRNA
  P2rx4_4
ctaccaggaaacggactctg

SEQ ID NO: 46683 - DNA, 20 bp, Artificial Sequence
  sgRNA
  P2rx4_5
ctgcggatgagcacgatgcg

SEQ ID NO: 46684 - DNA, 20 bp, Artificial Sequence
  sgRNA
  P2rx4_6
ggatgagcagctgcaccacg

SEQ ID NO: 46685 - DNA, 20 bp, Artificial Sequence
  sgRNA
  P2rx4_7
gctcatccgcagccgtaaag

SEQ ID NO: 46686 - DNA, 20 bp, Artificial Sequence
  sgRNA
  P2rx4_8
tttggccaagacggaatatg

SEQ ID NO: 46687 - DNA, 20 bp, Artificial Sequence
  sgRNA
  P2rx4_9
gttcacggtgacgatcatgt

SEQ ID NO: 46688 - DNA, 20 bp, Artificial Sequence
  sgRNA
  P2rx4_10
gcagggtctttccggagaga

SEQ ID NO: 46689 - DNA, 20 bp, Artificial Sequence
  sgRNA
  P2rx4_11
gcctgcccagatattccttc

SEQ ID NO: 46690 - DNA, 20 bp, Artificial Sequence
  sgRNA
  P2rx4_12
ccgagtgtcgaggcgccgga

SEQ ID NO: 46691 - DNA, 20 bp, Artificial Sequence
  sgRNA
  P2rx4_13
agtcgtgcatttataatgcg

SEQ ID NO: 46692 - DNA, 20 bp, Artificial Sequence
  sgRNA
  P2rx4_14
agacctgtgaggtggccgca

SEQ ID NO: 46693 - DNA, 20 bp, Artificial Sequence
  sgRNA
  P2rx4_15
gtcttcacagacgcgttgaa

SEQ ID NO: 46694 - DNA, 20 bp, Artificial Sequence
  sgRNA
  P2rx4_16
cgtactcgaacaggaaagcc

SEQ ID NO: 46695 - DNA, 20 bp, Artificial Sequence
  sgRNA
  P2rx4_17
agatgttgttctttaccaag

SEQ ID NO: 46696 - DNA, 20 bp, Artificial Sequence
  sgRNA
  P2rx4_18
tcatccgcagccgtaaagtg

SEQ ID NO: 46697 - DNA, 20 bp, Artificial Sequence
  sgRNA
  P2rx4_19
tgcccagtggagaatgacgc

SEQ ID NO: 46698 - DNA, 20 bp, Artificial Sequence
  sgRNA
  P2rx4_20
gtatgtggaagactacgagc

SEQ ID NO: 46699 - DNA, 20 bp, Artificial Sequence
  sgRNA
  P2rx6_1
ctaaccaggaactgtcgggt

SEQ ID NO: 46700 - DNA, 20 bp, Artificial Sequence
  sgRNA
  P2rx6_2
tcagcccagcagttagccag

SEQ ID NO: 46701 - DNA, 20 bp, Artificial Sequence
  sgRNA
  P2rx6_3
cttgaaatatgtgttgtccc

SEQ ID NO: 46702 - DNA, 20 bp, Artificial Sequence
  sgRNA
  P2rx6_4
ctgcccagtgttccgcatcg

SEQ ID NO: 46703 - DNA, 20 bp, Artificial Sequence
  sgRNA
  P2rx6_5
gctaaccaggaactgtcggg

SEQ ID NO: 46704 - DNA, 20 bp, Artificial Sequence
  sgRNA
  P2rx6_6
gcagtggtagtctacgtgat

SEQ ID NO: 46705 - DNA, 20 bp, Artificial Sequence
  sgRNA
  P2rx6_7
ggacttgagctggtgtcacg

SEQ ID NO: 46706 - DNA, 20 bp, Artificial Sequence
  sgRNA
  P2rx6_8
gctactgtatgtggatagag

SEQ ID NO: 46707 - DNA, 20 bp, Artificial Sequence
  sgRNA
  P2rx6_9
ggggtttctggattacaaga

SEQ ID NO: 46708 - DNA, 20 bp, Artificial Sequence
  sgRNA
  P2rx6_10
tgcccactgtgatggccgta

SEQ ID NO: 46709 - DNA, 20 bp, Artificial Sequence
  sgRNA
  P2rx6_11
ttcttggcctgagctagcag

SEQ ID NO: 46710 - DNA, 20 bp, Artificial Sequence
  sgRNA
  P2rx6_12
gcaccagctccagatctcac

SEQ ID NO: 46711 - DNA, 20 bp, Artificial Sequence
  sgRNA
  P2rx6_13
ctgatgaagactgccccgaa

SEQ ID NO: 46712 - DNA, 20 bp, Artificial Sequence
  sgRNA
  P2rx6_14
tactgcccagtgttccgcat

SEQ ID NO: 46713 - DNA, 20 bp, Artificial Sequence
  sgRNA
  P2rx6_15
gattgcaacctggacacgaa

SEQ ID NO: 46714 - DNA, 20 bp, Artificial Sequence
  sgRNA
  P2rx6_16
cgttcctctggctaactgct

SEQ ID NO: 46715 - DNA, 20 bp, Artificial Sequence
  sgRNA
  P2rx6_17
ggtccccgatgcggaacact

SEQ ID NO: 46716 - DNA, 20 bp, Artificial Sequence
  sgRNA
  P2rx6_18
gtatgtccccgtctcccctt

SEQ ID NO: 46717 - DNA, 20 bp, Artificial Sequence
  sgRNA
  P2rx6_19
gaagttcgcgctcatcccta

SEQ ID NO: 46718 - DNA, 20 bp, Artificial Sequence
  sgRNA
  P2rx6_20
gttctccagctccttaacct

SEQ ID NO: 46719 - DNA, 20 bp, Artificial Sequence
  sgRNA
  P2rx7_1
ctgaccggcgttgtaaaaag

SEQ ID NO: 46720 - DNA, 20 bp, Artificial Sequence
  sgRNA
  P2rx7_2
gttacctgaagttgtagccg

SEQ ID NO: 46721 - DNA, 20 bp, Artificial Sequence
  sgRNA
  P2rx7_3
gtgttccatcttccgactag

SEQ ID NO: 46722 - DNA, 20 bp, Artificial Sequence
  sgRNA
  P2rx7_4
acctcttaccaagccaaagt

SEQ ID NO: 46723 - DNA, 20 bp, Artificial Sequence
  sgRNA
  P2rx7_5
aggagttccccaagaccgag

SEQ ID NO: 46724 - DNA, 20 bp, Artificial Sequence
  sgRNA
  P2rx7_6
ttgccgctggaggatccgga

SEQ ID NO: 46725 - DNA, 20 bp, Artificial Sequence
  sgRNA
  P2rx7_7
tgagcgataagctgtaccag

SEQ ID NO: 46726 - DNA, 20 bp, Artificial Sequence
  sgRNA
  P2rx7_8
gctccggtaggcgagacggg

SEQ ID NO: 46727 - DNA, 20 bp, Artificial Sequence
  sgRNA
  P2rx7_9
ggtgacggagaatgtcacag

SEQ ID NO: 46728 - DNA, 20 bp, Artificial Sequence
  sgRNA
  P2rx7_10
tcgcctaccggagcaacgca

SEQ ID NO: 46729 - DNA, 20 bp, Artificial Sequence
  sgRNA
  P2rx7_11
gtgtgcacggagctgataac

SEQ ID NO: 46730 - DNA, 20 bp, Artificial Sequence
  sgRNA
  P2rx7_12
tatcagctccgtgcacacca

SEQ ID NO: 46731 - DNA, 20 bp, Artificial Sequence
  sgRNA
  P2rx7_13
agcaggagagaactttacag

SEQ ID NO: 46732 - DNA, 20 bp, Artificial Sequence
  sgRNA
  P2rx7_14
aagtctggttactctcctgg

SEQ ID NO: 46733 - DNA, 20 bp, Artificial Sequence
  sgRNA
  P2rx7_15
cgacgagccgcacattcgca

SEQ ID NO: 46734 - DNA, 20 bp, Artificial Sequence
  sgRNA
  P2rx7_16
catgtgcaagacccacttga

SEQ ID NO: 46735 - DNA, 20 bp, Artificial Sequence
  sgRNA
  P2rx7_17
gggccctgcgttgctccggt

SEQ ID NO: 46736 - DNA, 20 bp, Artificial Sequence
  sgRNA
  P2rx7_18
gaagccactatactgcccct

SEQ ID NO: 46737 - DNA, 20 bp, Artificial Sequence
  sgRNA
  P2rx7_19
agaggtggcccctaagtccg

SEQ ID NO: 46738 - DNA, 20 bp, Artificial Sequence
  sgRNA
  P2rx7_20
catactccagtgctttctgc

SEQ ID NO: 46739 - DNA, 20 bp, Artificial Sequence
  sgRNA
  P2ry1_1
tgctaccgtagagatttacg

SEQ ID NO: 46740 - DNA, 20 bp, Artificial Sequence
  sgRNA
  P2ry1_2
agcctgcccagagacttgag

SEQ ID NO: 46741 - DNA, 20 bp, Artificial Sequence
  sgRNA
  P2ry1_3
cggtcttggtcagggcacat

SEQ ID NO: 46742 - DNA, 20 bp, Artificial Sequence
  sgRNA
  P2ry1_4
agccaaattgaacatgtaca

SEQ ID NO: 46743 - DNA, 20 bp, Artificial Sequence
  sgRNA
  P2ry1_5
ccgtcaggacaattatcacc

SEQ ID NO: 46744 - DNA, 20 bp, Artificial Sequence
  sgRNA
  P2ry1_6
ctaaaatgtagacagccggc

SEQ ID NO: 46745 - DNA, 20 bp, Artificial Sequence
  sgRNA
  P2ry1_7
ccaccaggaaagcttccagg

SEQ ID NO: 46746 - DNA, 20 bp, Artificial Sequence
  sgRNA
  P2ry1_8
gccacttatcaggtaacaag

SEQ ID NO: 46747 - DNA, 20 bp, Artificial Sequence
  sgRNA
  P2ry1_9
ataacttcgcaggtaatcat

SEQ ID NO: 46748 - DNA, 20 bp, Artificial Sequence
  sgRNA
  P2ry1_10
agcccaagatcagcaccaaa

SEQ ID NO: 46749 - DNA, 20 bp, Artificial Sequence
  sgRNA
  P2ry1_11
caagactgactggatcttcg

SEQ ID NO: 46750 - DNA, 20 bp, Artificial Sequence
  sgRNA
  P2ry1_12
tttccagttctactacctgc

SEQ ID NO: 46751 - DNA, 20 bp, Artificial Sequence
  sgRNA
  P2ry1_13
gtacctgtgtgcgctgatgc

SEQ ID NO: 46752 - DNA, 20 bp, Artificial Sequence
  sgRNA
  P2ry1_14
gtcggttgtccccaacggga

SEQ ID NO: 46753 - DNA, 20 bp, Artificial Sequence
  sgRNA
  P2ry1_15
tcgcaggtaatcattggacg

SEQ ID NO: 46754 - DNA, 20 bp, Artificial Sequence
  sgRNA
  P2ry1_16
gttgaaatcacacatttctg

SEQ ID NO: 46755 - DNA, 20 bp, Artificial Sequence
  sgRNA
  P2ry1_17
aagacacagcaaacaccgtc

SEQ ID NO: 46756 - DNA, 20 bp, Artificial Sequence
  sgRNA
  P2ry1_18
gccagagtagaagagaatag

SEQ ID NO: 46757 - DNA, 20 bp, Artificial Sequence
  sgRNA
  P2ry1_19
gcctgcccagagacttgaga

SEQ ID NO: 46758 - DNA, 20 bp, Artificial Sequence
  sgRNA
  P2ry1_20
acctcttgttacctgataag

SEQ ID NO: 46759 - DNA, 20 bp, Artificial Sequence
  sgRNA
  P2ry10_1
tgatcttgggtacaaacaga

SEQ ID NO: 46760 - DNA, 20 bp, Artificial Sequence
  sgRNA
  P2ry10_2
tggaagcgtaggtacgatgt

SEQ ID NO: 46761 - DNA, 20 bp, Artificial Sequence
  sgRNA
  P2ry10_3
tttccaggtacaacatgcaa

SEQ ID NO: 46762 - DNA, 20 bp, Artificial Sequence
  sgRNA
  P2ry10_4
gtaaggacaggatatgagca

SEQ ID NO: 46763 - DNA, 20 bp, Artificial Sequence
  sgRNA
  P2ry10_5
tcgttctcgtctcatgagca

SEQ ID NO: 46764 - DNA, 20 bp, Artificial Sequence
  sgRNA
  P2ry10_6
aatgatgctttcctttacca

SEQ ID NO: 46765 - DNA, 20 bp, Artificial Sequence
  sgRNA
  P2ry10_7
gtactgaaatggcaaataag

SEQ ID NO: 46766 - DNA, 20 bp, Artificial Sequence
  sgRNA
  P2ry10_8
aagttcagcaattacaacca

SEQ ID NO: 46767 - DNA, 20 bp, Artificial Sequence
  sgRNA
  P2ry10_9
cgtgaccaactatctcgtca

SEQ ID NO: 46768 - DNA, 20 bp, Artificial Sequence
  sgRNA
  P2ry10_10
acagagacttgcaaggcata

SEQ ID NO: 46769 - DNA, 20 bp, Artificial Sequence
  sgRNA
  P2ry10_11
gaggaaaaaagcattgcgga

SEQ ID NO: 46770 - DNA, 20 bp, Artificial Sequence
  sgRNA
  P2ry10_12
gctgtcatctggattgttgt

SEQ ID NO: 46771 - DNA, 20 bp, Artificial Sequence
  sgRNA
  P2ry10_13
ggaaaaaggatggaaataca

SEQ ID NO: 46772 - DNA, 20 bp, Artificial Sequence
  sgRNA
  P2ry10_14
atatcctgtccttacctctt

SEQ ID NO: 46773 - DNA, 20 bp, Artificial Sequence
  sgRNA
  P2ry10_15
gtacaaacagatggatgcag

SEQ ID NO: 46774 - DNA, 20 bp, Artificial Sequence
  sgRNA
  P2ry10_16
gtgagaggaaaaaagcattg

SEQ ID NO: 46775 - DNA, 20 bp, Artificial Sequence
  sgRNA
  P2ry10_17
ctaatcccttgaaaagcaat

SEQ ID NO: 46776 - DNA, 20 bp, Artificial Sequence
  sgRNA
  P2ry10_18
gcatttctcaggatgggaaa

SEQ ID NO: 46777 - DNA, 20 bp, Artificial Sequence
  sgRNA
  P2ry10_19
caaggcatagggaaaaagga

SEQ ID NO: 46778 - DNA, 20 bp, Artificial Sequence
  sgRNA
  P2ry10_20
gcaaagagatgagagtaaaa

SEQ ID NO: 46779 - DNA, 20 bp, Artificial Sequence
  sgRNA
  P2ry12_1
atatcagtatatcgttcctg

SEQ ID NO: 46780 - DNA, 20 bp, Artificial Sequence
  sgRNA
  P2ry12_2
tggcacaccaaggttctcag

SEQ ID NO: 46781 - DNA, 20 bp, Artificial Sequence
  sgRNA
  P2ry12_3
cttgtagtctctgacgcaca

SEQ ID NO: 46782 - DNA, 20 bp, Artificial Sequence
  sgRNA
  P2ry12_4
tcattaccaaagaactctat

SEQ ID NO: 46783 - DNA, 20 bp, Artificial Sequence
  sgRNA
  P2ry12_5
cagagactacaagatcaccc

SEQ ID NO: 46784 - DNA, 20 bp, Artificial Sequence
  sgRNA
  P2ry12_6
ctacaccctgagccaaactc

SEQ ID NO: 46785 - DNA, 20 bp, Artificial Sequence
  sgRNA
  P2ry12_7
ctaacatgattctcaccaac

SEQ ID NO: 46786 - DNA, 20 bp, Artificial Sequence
  sgRNA
  P2ry12_8
ttgttcccttccactttgca

SEQ ID NO: 46787 - DNA, 20 bp, Artificial Sequence
  sgRNA
  P2ry12_9
tgatgaagttggatttactg

SEQ ID NO: 46788 - DNA, 20 bp, Artificial Sequence
  sgRNA
  P2ry12_10
tgtagggaatccgtgcaaag

SEQ ID NO: 46789 - DNA, 20 bp, Artificial Sequence
  sgRNA
  P2ry12_11
tcggtcttatgtcagaacaa

SEQ ID NO: 46790 - DNA, 20 bp, Artificial Sequence
  sgRNA
  P2ry12_12
acatgattctcaccaacagg

SEQ ID NO: 46791 - DNA, 20 bp, Artificial Sequence
  sgRNA
  P2ry12_13
tgatgagcccagcaaagaac

SEQ ID NO: 46792 - DNA, 20 bp, Artificial Sequence
  sgRNA
  P2ry12_14
gttcagtgacgtcagccata

SEQ ID NO: 46793 - DNA, 20 bp, Artificial Sequence
  sgRNA
  P2ry12_15
gagcccagcaaagaacagga

SEQ ID NO: 46794 - DNA, 20 bp, Artificial Sequence
  sgRNA
  P2ry12_16
accgctacctgaagaccacc

SEQ ID NO: 46795 - DNA, 20 bp, Artificial Sequence
  sgRNA
  P2ry12_17
ggaatccgtgcaaagtggaa

SEQ ID NO: 46796 - DNA, 20 bp, Artificial Sequence
  sgRNA
  P2ry12_18
ataagaccgatagagttctt

SEQ ID NO: 46797 - DNA, 20 bp, Artificial Sequence
  sgRNA
  P2ry12_19
ccaataccaccttctcccct

SEQ ID NO: 46798 - DNA, 20 bp, Artificial Sequence
  sgRNA
  P2ry12_20
acaccgtcctgttctttgct

SEQ ID NO: 46799 - DNA, 20 bp, Artificial Sequence
  sgRNA
  P2ry13_1
gttcccggttctctatactg

SEQ ID NO: 46800 - DNA, 20 bp, Artificial Sequence
  sgRNA
  P2ry13_2
ggaacctgtcgaaagcgatg

SEQ ID NO: 46801 - DNA, 20 bp, Artificial Sequence
  sgRNA
  P2ry13_3
aaacatgatcttgaacaagg

SEQ ID NO: 46802 - DNA, 20 bp, Artificial Sequence
  sgRNA
  P2ry13_4
agagcgtgcacacaaatcct

SEQ ID NO: 46803 - DNA, 20 bp, Artificial Sequence
  sgRNA
  P2ry13_5
cgtctcatagaagaccacgg

SEQ ID NO: 46804 - DNA, 20 bp, Artificial Sequence
  sgRNA
  P2ry13_6
agggcttcaacaagtctgag

SEQ ID NO: 46805 - DNA, 20 bp, Artificial Sequence
  sgRNA
  P2ry13_7
aaaaggtgtacaactcctat

SEQ ID NO: 46806 - DNA, 20 bp, Artificial Sequence
  sgRNA
  P2ry13_8
gcatctttgaagagtcccct

SEQ ID NO: 46807 - DNA, 20 bp, Artificial Sequence
  sgRNA
  P2ry13_9
gttgaagccctgcatcccag

SEQ ID NO: 46808 - DNA, 20 bp, Artificial Sequence
  sgRNA
  P2ry13_10
ccaccaataagactgactgt

SEQ ID NO: 46809 - DNA, 20 bp, Artificial Sequence
  sgRNA
  P2ry13_11
gtgtcatccgagtgtccctg

SEQ ID NO: 46810 - DNA, 20 bp, Artificial Sequence
  sgRNA
  P2ry13_12
cttgaggtagacgataaagg

SEQ ID NO: 46811 - DNA, 20 bp, Artificial Sequence
  sgRNA
  P2ry13_13
gtaaggacagcaggcacaag

SEQ ID NO: 46812 - DNA, 20 bp, Artificial Sequence
  sgRNA
  P2ry13_14
atcaacaccactgggatgca

SEQ ID NO: 46813 - DNA, 20 bp, Artificial Sequence
  sgRNA
  P2ry13_15
tgtctgtctgactactgtgg

SEQ ID NO: 46814 - DNA, 20 bp, Artificial Sequence
  sgRNA
  P2ry13_16
ctacctcaagaacactctgg

SEQ ID NO: 46815 - DNA, 20 bp, Artificial Sequence
  sgRNA
  P2ry13_17
gtattctgacaaaatgcagt

SEQ ID NO: 46816 - DNA, 20 bp, Artificial Sequence
  sgRNA
  P2ry13_18
tgatgccaccacagcccaag

SEQ ID NO: 46817 - DNA, 20 bp, Artificial Sequence
  sgRNA
  P2ry13_19
cctacagtcagtcttattgg

SEQ ID NO: 46818 - DNA, 20 bp, Artificial Sequence
  sgRNA
  P2ry13_20
ggatgtggacgaacacccag

SEQ ID NO: 46819 - DNA, 20 bp, Artificial Sequence
  sgRNA
  P2ry14_1
gaagaccataccgtacaaca

SEQ ID NO: 46820 - DNA, 20 bp, Artificial Sequence
  sgRNA
  P2ry14_2
tggagctcaaaaacgagctg

SEQ ID NO: 46821 - DNA, 20 bp, Artificial Sequence
  sgRNA
  P2ry14_3
ctatctcaagaacatagtgg

SEQ ID NO: 46822 - DNA, 20 bp, Artificial Sequence
  sgRNA
  P2ry14_4
tctgacgtctattgtgcagt

SEQ ID NO: 46823 - DNA, 20 bp, Artificial Sequence
  sgRNA
  P2ry14_5
tcttctacacggccatcacg

SEQ ID NO: 46824 - DNA, 20 bp, Artificial Sequence
  sgRNA
  P2ry14_6
aagaccataccgtacaacac

SEQ ID NO: 46825 - DNA, 20 bp, Artificial Sequence
  sgRNA
  P2ry14_7
gtggtggctgactttctcat

SEQ ID NO: 46826 - DNA, 20 bp, Artificial Sequence
  sgRNA
  P2ry14_8
agaattccacctccgtcaag

SEQ ID NO: 46827 - DNA, 20 bp, Artificial Sequence
  sgRNA
  P2ry14_9
aacatcatcctgacaaacca

SEQ ID NO: 46828 - DNA, 20 bp, Artificial Sequence
  sgRNA
  P2ry14_10
tcctcaatgggatatcagga

SEQ ID NO: 46829 - DNA, 20 bp, Artificial Sequence
  sgRNA
  P2ry14_11
cccctacacaaagagtcaga

SEQ ID NO: 46830 - DNA, 20 bp, Artificial Sequence
  sgRNA
  P2ry14_12
tgcacaatagacgtcagaag

SEQ ID NO: 46831 - DNA, 20 bp, Artificial Sequence
  sgRNA
  P2ry14_13
tcacggggctcctcctcaat

SEQ ID NO: 46832 - DNA, 20 bp, Artificial Sequence
  sgRNA
  P2ry14_14
gatgctgaagatattgcggc

SEQ ID NO: 46833 - DNA, 20 bp, Artificial Sequence
  sgRNA
  P2ry14_15
gcacgatgctgaagatattg

SEQ ID NO: 46834 - DNA, 20 bp, Artificial Sequence
  sgRNA
  P2ry14_16
aatggggtccagacacacat

SEQ ID NO: 46835 - DNA, 20 bp, Artificial Sequence
  sgRNA
  P2ry14_17
caaagtccagaatgacctag

SEQ ID NO: 46836 - DNA, 20 bp, Artificial Sequence
  sgRNA
  P2ry14_18
ctgcacaatagacgtcagaa

SEQ ID NO: 46837 - DNA, 20 bp, Artificial Sequence
  sgRNA
  P2ry14_19
gaattctttcgcatagagca

SEQ ID NO: 46838 - DNA, 20 bp, Artificial Sequence
  sgRNA
  P2ry14_20
cttgaagatcttcctcgtga

SEQ ID NO: 46839 - DNA, 20 bp, Artificial Sequence
  sgRNA
  P2ry2_1
ttggtttattactacgcccg

SEQ ID NO: 46840 - DNA, 20 bp, Artificial Sequence
  sgRNA
  P2ry2_2
atacaagtgtcgtttcaacg

SEQ ID NO: 46841 - DNA, 20 bp, Artificial Sequence
  sgRNA
  P2ry2_3
ccataagcacgtaacagacc

SEQ ID NO: 46842 - DNA, 20 bp, Artificial Sequence
  sgRNA
  P2ry2_4
tgccaggtgaaacatgtagg

SEQ ID NO: 46843 - DNA, 20 bp, Artificial Sequence
  sgRNA
  P2ry2_5
gttacgtgcttatggccagg

SEQ ID NO: 46844 - DNA, 20 bp, Artificial Sequence
  sgRNA
  P2ry2_6
gcgtagtaataaaccaacag

SEQ ID NO: 46845 - DNA, 20 bp, Artificial Sequence
  sgRNA
  P2ry2_7
gttggtttattactacgccc

SEQ ID NO: 46846 - DNA, 20 bp, Artificial Sequence
  sgRNA
  P2ry2_8
gcaccgtgctaaatggccag

SEQ ID NO: 46847 - DNA, 20 bp, Artificial Sequence
  sgRNA
  P2ry2_9
tgaccactggccatttagca

SEQ ID NO: 46848 - DNA, 20 bp, Artificial Sequence
  sgRNA
  P2ry2_10
gttgcccgtgtcctatggcg

SEQ ID NO: 46849 - DNA, 20 bp, Artificial Sequence
  sgRNA
  P2ry2_11
acacaaccgcagccacccgg

SEQ ID NO: 46850 - DNA, 20 bp, Artificial Sequence
  sgRNA
  P2ry2_12
tcagcagtgacgactcaaga

SEQ ID NO: 46851 - DNA, 20 bp, Artificial Sequence
  sgRNA
  P2ry2_13
gctaaagagctctcgggccg

SEQ ID NO: 46852 - DNA, 20 bp, Artificial Sequence
  sgRNA
  P2ry2_14
ccagcttgcgacgagcctgt

SEQ ID NO: 46853 - DNA, 20 bp, Artificial Sequence
  sgRNA
  P2ry2_15
gtggtgacgaagtagagcac

SEQ ID NO: 46854 - DNA, 20 bp, Artificial Sequence
  sgRNA
  P2ry2_16
gatccgggttccccgcacgc

SEQ ID NO: 46855 - DNA, 20 bp, Artificial Sequence
  sgRNA
  P2ry2_17
ccattgatggtgctattcca

SEQ ID NO: 46856 - DNA, 20 bp, Artificial Sequence
  sgRNA
  P2ry2_18
acttcgtcaccaccagcgtg

SEQ ID NO: 46857 - DNA, 20 bp, Artificial Sequence
  sgRNA
  P2ry2_19
gatcacttgccatgacacct

SEQ ID NO: 46858 - DNA, 20 bp, Artificial Sequence
  sgRNA
  P2ry2_20
acatggcatataagatcacc

SEQ ID NO: 46859 - DNA, 20 bp, Artificial Sequence
  sgRNA
  P2ry4_1
ggcagcatagtagtagacga

SEQ ID NO: 46860 - DNA, 20 bp, Artificial Sequence
  sgRNA
  P2ry4_2
ccactgcgggcaatacgctg

SEQ ID NO: 46861 - DNA, 20 bp, Artificial Sequence
  sgRNA
  P2ry4_3
tggaactgaagtatacgtag

SEQ ID NO: 46862 - DNA, 20 bp, Artificial Sequence
  sgRNA
  P2ry4_4
aagacaactgcatagctcag

SEQ ID NO: 46863 - DNA, 20 bp, Artificial Sequence
  sgRNA
  P2ry4_5
agtgctctatctgttcacgg

SEQ ID NO: 46864 - DNA, 20 bp, Artificial Sequence
  sgRNA
  P2ry4_6
gcaaaggtcgatacagtcgc

SEQ ID NO: 46865 - DNA, 20 bp, Artificial Sequence
  sgRNA
  P2ry4_7
ctactaccaaccaaacacct

SEQ ID NO: 46866 - DNA, 20 bp, Artificial Sequence
  sgRNA
  P2ry4_8
actatgctgccagaaaccac

SEQ ID NO: 46867 - DNA, 20 bp, Artificial Sequence
  sgRNA
  P2ry4_9
gaagacctgcaaatcgaggg

SEQ ID NO: 46868 - DNA, 20 bp, Artificial Sequence
  sgRNA
  P2ry4_10
taagtggctgttgcatccca

SEQ ID NO: 46869 - DNA, 20 bp, Artificial Sequence
  sgRNA
  P2ry4_11
tctgctatggactcatggcc

SEQ ID NO: 46870 - DNA, 20 bp, Artificial Sequence
  sgRNA
  P2ry4_12
gcatagtagtagacgagggt

SEQ ID NO: 46871 - DNA, 20 bp, Artificial Sequence
  sgRNA
  P2ry4_13
tcagcaccacagcaatggtg

SEQ ID NO: 46872 - DNA, 20 bp, Artificial Sequence
  sgRNA
  P2ry4_14
tttgtgacaaccaatgccaa

SEQ ID NO: 46873 - DNA, 20 bp, Artificial Sequence
  sgRNA
  P2ry4_15
ttctctccgcaccattgctg

SEQ ID NO: 46874 - DNA, 20 bp, Artificial Sequence
  sgRNA
  P2ry4_16
aggtgtctgacaatgccaaa

SEQ ID NO: 46875 - DNA, 20 bp, Artificial Sequence
  sgRNA
  P2ry4_17
ttgcagaagccagtgccaaa

SEQ ID NO: 46876 - DNA, 20 bp, Artificial Sequence
  sgRNA
  P2ry4_18
gcagagtcgtgtcatggcac

SEQ ID NO: 46877 - DNA, 20 bp, Artificial Sequence
  sgRNA
  P2ry4_19
cagaccagagtgatcaagaa

SEQ ID NO: 46878 - DNA, 20 bp, Artificial Sequence
  sgRNA
  P2ry4_20
gatggcagatgcccatgtag

SEQ ID NO: 46879 - DNA, 20 bp, Artificial Sequence
  sgRNA
  P2ry6_1
cagcaccaccgagtataccg

SEQ ID NO: 46880 - DNA, 20 bp, Artificial Sequence
  sgRNA
  P2ry6_2
tatctataactacgccagag

SEQ ID NO: 46881 - DNA, 20 bp, Artificial Sequence
  sgRNA
  P2ry6_3
aggtagcgagtagacaggat

SEQ ID NO: 46882 - DNA, 20 bp, Artificial Sequence
  sgRNA
  P2ry6_4
caagccagtaaggctatgaa

SEQ ID NO: 46883 - DNA, 20 bp, Artificial Sequence
  sgRNA
  P2ry6_5
acactgttgacactggcgaa

SEQ ID NO: 46884 - DNA, 20 bp, Artificial Sequence
  sgRNA
  P2ry6_6
ttatctataactacgccaga

SEQ ID NO: 46885 - DNA, 20 bp, Artificial Sequence
  sgRNA
  P2ry6_7
tctactcgctacctgcccta

SEQ ID NO: 46886 - DNA, 20 bp, Artificial Sequence
  sgRNA
  P2ry6_8
gcaatgacgcagatgttcag

SEQ ID NO: 46887 - DNA, 20 bp, Artificial Sequence
  sgRNA
  P2ry6_9
gctaaccccggtatactcgg

SEQ ID NO: 46888 - DNA, 20 bp, Artificial Sequence
  sgRNA
  P2ry6_10
tgagggccataccatagggc

SEQ ID NO: 46889 - DNA, 20 bp, Artificial Sequence
  sgRNA
  P2ry6_11
gagcctctgtaagagatcgt

SEQ ID NO: 46890 - DNA, 20 bp, Artificial Sequence
  sgRNA
  P2ry6_12
gaaatcctcacggtagacgc

SEQ ID NO: 46891 - DNA, 20 bp, Artificial Sequence
  sgRNA
  P2ry6_13
cggcaggcgaggtctccgaa

SEQ ID NO: 46892 - DNA, 20 bp, Artificial Sequence
  sgRNA
  P2ry6_14
catcctggcgacacaggcgg

SEQ ID NO: 46893 - DNA, 20 bp, Artificial Sequence
  sgRNA
  P2ry6_15
gtacaccctgaacctggcac

SEQ ID NO: 46894 - DNA, 20 bp, Artificial Sequence
  sgRNA
  P2ry6_16
caccacctgcgtctaccgtg

SEQ ID NO: 46895 - DNA, 20 bp, Artificial Sequence
  sgRNA
  P2ry6_17
gtagcgctggaagctaatgc

SEQ ID NO: 46896 - DNA, 20 bp, Artificial Sequence
  sgRNA
  P2ry6_18
gctgctaaccccggtatact

SEQ ID NO: 46897 - DNA, 20 bp, Artificial Sequence
  sgRNA
  P2ry6_19
cccagatctgcgcatcccgc

SEQ ID NO: 46898 - DNA, 20 bp, Artificial Sequence
  sgRNA
  P2ry6_20
attagcttccagcgctacct

SEQ ID NO: 46899 - DNA, 20 bp, Artificial Sequence
  sgRNA
  Pam_1
atggtgagtatggactcggt

SEQ ID NO: 46900 - DNA, 20 bp, Artificial Sequence
  sgRNA
  Pam_2
agaatcttacccgatgtggg

SEQ ID NO: 46901 - DNA, 20 bp, Artificial Sequence
  sgRNA
  Pam_3
actggatattcgcatgcctg

SEQ ID NO: 46902 - DNA, 20 bp, Artificial Sequence
  sgRNA
  Pam_4
aattcctgtaaaatccgaca

SEQ ID NO: 46903 - DNA, 20 bp, Artificial Sequence
  sgRNA
  Pam_5
gtatctatgctcaaaccatg

SEQ ID NO: 46904 - DNA, 20 bp, Artificial Sequence
  sgRNA
  Pam_6
ggagctgtcttcgtgtcaga

SEQ ID NO: 46905 - DNA, 20 bp, Artificial Sequence
  sgRNA
  Pam_7
ggtcggtctgacgccagaga

SEQ ID NO: 46906 - DNA, 20 bp, Artificial Sequence
  sgRNA
  Pam_8
agtgagggtgaacttccaca

SEQ ID NO: 46907 - DNA, 20 bp, Artificial Sequence
  sgRNA
  Pam_9
tgagtgatgaacttcccgct

SEQ ID NO: 46908 - DNA, 20 bp, Artificial Sequence
  sgRNA
  Pam_10
ttaatacagcagccaaagca

SEQ ID NO: 46909 - DNA, 20 bp, Artificial Sequence
  sgRNA
  Pam_11
gcaacatgccctcatccact

SEQ ID NO: 46910 - DNA, 20 bp, Artificial Sequence
  sgRNA
  Pam_12
gttcgaccgagtgagcacag

SEQ ID NO: 46911 - DNA, 20 bp, Artificial Sequence
  sgRNA
  Pam_13
ggttcccaaggaccttcacc

SEQ ID NO: 46912 - DNA, 20 bp, Artificial Sequence
  sgRNA
  Pam_14
aggtacatgcccgcaatcaa

SEQ ID NO: 46913 - DNA, 20 bp, Artificial Sequence
  sgRNA
  Pam_15
tgtgagatgtaaggacacac

SEQ ID NO: 46914 - DNA, 20 bp, Artificial Sequence
  sgRNA
  Pam_16
tggtcggtctgacgccagag

SEQ ID NO: 46915 - DNA, 20 bp, Artificial Sequence
  sgRNA
  Pam_17
ctaaatggtgagtatggact

SEQ ID NO: 46916 - DNA, 20 bp, Artificial Sequence
  sgRNA
  Pam_18
tcgaccgagtgagcacagag

SEQ ID NO: 46917 - DNA, 20 bp, Artificial Sequence
  sgRNA
  Pam_19
atcgtgcagttctcaccaag

SEQ ID NO: 46918 - DNA, 20 bp, Artificial Sequence
  sgRNA
  Pam_20
tattcgatggaaaaaatcaa

SEQ ID NO: 46919 - DNA, 20 bp, Artificial Sequence
  sgRNA
  Panx1_1
ccacttcaagtacccaatcg

SEQ ID NO: 46920 - DNA, 20 bp, Artificial Sequence
  sgRNA
  Panx1_2
actcgtccgagagtgaagag

SEQ ID NO: 46921 - DNA, 20 bp, Artificial Sequence
  sgRNA
  Panx1_3
gcttgcactggaagcgatcg

SEQ ID NO: 46922 - DNA, 20 bp, Artificial Sequence
  sgRNA
  Panx1_4
gatggtcacatgtattgccg

SEQ ID NO: 46923 - DNA, 20 bp, Artificial Sequence
  sgRNA
  Panx1_5
gcgaggctgcagcaaacaat

SEQ ID NO: 46924 - DNA, 20 bp, Artificial Sequence
  sgRNA
  Panx1_6
gagcagctggaagatgccca

SEQ ID NO: 46925 - DNA, 20 bp, Artificial Sequence
  sgRNA
  Panx1_7
cccacgtccctacagaccaa

SEQ ID NO: 46926 - DNA, 20 bp, Artificial Sequence
  sgRNA
  Panx1_8
atgctactcctgacaaacct

SEQ ID NO: 46927 - DNA, 20 bp, Artificial Sequence
  sgRNA
  Panx1_9
cgagatttggacctaagaga

SEQ ID NO: 46928 - DNA, 20 bp, Artificial Sequence
  sgRNA
  Panx1_10
ggtttgtcaggagtagcatg

SEQ ID NO: 46929 - DNA, 20 bp, Artificial Sequence
  sgRNA
  Panx1_11
gtatgctctgctgattcccg

SEQ ID NO: 46930 - DNA, 20 bp, Artificial Sequence
  sgRNA
  Panx1_12
gagaagcgccagaagagtgc

SEQ ID NO: 46931 - DNA, 20 bp, Artificial Sequence
  sgRNA
  Panx1_13
gtttccagactcgctctgca

SEQ ID NO: 46932 - DNA, 20 bp, Artificial Sequence
  sgRNA
  Panx1_14
tcgccaggagaaagaactcg

SEQ ID NO: 46933 - DNA, 20 bp, Artificial Sequence
  sgRNA
  Panx1_15
tcttggcagccttgatggcg

SEQ ID NO: 46934 - DNA, 20 bp, Artificial Sequence
  sgRNA
  Panx1_16
ccagcagtatgaatccacaa

SEQ ID NO: 46935 - DNA, 20 bp, Artificial Sequence
  sgRNA
  Panx1_17
agagaagcgccagaagagtg

SEQ ID NO: 46936 - DNA, 20 bp, Artificial Sequence
  sgRNA
  Panx1_18
taaacttcaggtctgagcag

SEQ ID NO: 46937 - DNA, 20 bp, Artificial Sequence
  sgRNA
  Panx1_19
gaagaacgtgtagacgacca

SEQ ID NO: 46938 - DNA, 20 bp, Artificial Sequence
  sgRNA
  Panx1_20
gatggagatctcctgagcga

SEQ ID NO: 46939 - DNA, 20 bp, Artificial Sequence
  sgRNA
  Panx2_1
cgacaactgctaccaccgag

SEQ ID NO: 46940 - DNA, 20 bp, Artificial Sequence
  sgRNA
  Panx2_2
aacttgtgctcaaacaacga

SEQ ID NO: 46941 - DNA, 20 bp, Artificial Sequence
  sgRNA
  Panx2_3
gagaagtacctggaacgccg

SEQ ID NO: 46942 - DNA, 20 bp, Artificial Sequence
  sgRNA
  Panx2_4
ggaactgccgttcgaccgcg

SEQ ID NO: 46943 - DNA, 20 bp, Artificial Sequence
  sgRNA
  Panx2_5
gatcaggcgctgtacgcccg

SEQ ID NO: 46944 - DNA, 20 bp, Artificial Sequence
  sgRNA
  Panx2_6
tgatgtcgcagaactgcgag

SEQ ID NO: 46945 - DNA, 20 bp, Artificial Sequence
  sgRNA
  Panx2_7
aggtgggtatcaagacgcgc

SEQ ID NO: 46946 - DNA, 20 bp, Artificial Sequence
  sgRNA
  Panx2_8
gctcaaacaacgatggccag

SEQ ID NO: 46947 - DNA, 20 bp, Artificial Sequence
  sgRNA
  Panx2_9
gcagctggccattatgcgcg

SEQ ID NO: 46948 - DNA, 20 bp, Artificial Sequence
  sgRNA
  Panx2_10
tcatgtacgacaatgtggtg

SEQ ID NO: 46949 - DNA, 20 bp, Artificial Sequence
  sgRNA
  Panx2_11
ggaccccagcatcaaccctg

SEQ ID NO: 46950 - DNA, 20 bp, Artificial Sequence
  sgRNA
  Panx2_12
atggtgaccacgcggtcgaa

SEQ ID NO: 46951 - DNA, 20 bp, Artificial Sequence
  sgRNA
  Panx2_13
gcatacccgccacttctcct

SEQ ID NO: 46952 - DNA, 20 bp, Artificial Sequence
  sgRNA
  Panx2_14
cttacagctgacgcgcaccg

SEQ ID NO: 46953 - DNA, 20 bp, Artificial Sequence
  sgRNA
  Panx2_15
ttacggggccgcttgaccac

SEQ ID NO: 46954 - DNA, 20 bp, Artificial Sequence
  sgRNA
  Panx2_16
tgtccgccgactgctccagg

SEQ ID NO: 46955 - DNA, 20 bp, Artificial Sequence
  sgRNA
  Panx2_17
gtatcaagacgcgccggcag

SEQ ID NO: 46956 - DNA, 20 bp, Artificial Sequence
  sgRNA
  Panx2_18
catcaagtcgctgaaccggc

SEQ ID NO: 46957 - DNA, 20 bp, Artificial Sequence
  sgRNA
  Panx2_19
gggtggcgtagtatgtgcat

SEQ ID NO: 46958 - DNA, 20 bp, Artificial Sequence
  sgRNA
  Panx2_20
cagaaccatcaggctccgca

SEQ ID NO: 46959 - DNA, 20 bp, Artificial Sequence
  sgRNA
  Parm1_1
ctctagccacaactctacgg

SEQ ID NO: 46960 - DNA, 20 bp, Artificial Sequence
  sgRNA
  Parm1_2
actccgatagggaagttgcg

SEQ ID NO: 46961 - DNA, 20 bp, Artificial Sequence
  sgRNA
  Parm1_3
ggtgactgtgacccagtagc

SEQ ID NO: 46962 - DNA, 20 bp, Artificial Sequence
  sgRNA
  Parm1_4
ctctgctccacacactgcta

SEQ ID NO: 46963 - DNA, 20 bp, Artificial Sequence
  sgRNA
  Parm1_5
gttgtggctagaggtaacgg

SEQ ID NO: 46964 - DNA, 20 bp, Artificial Sequence
  sgRNA
  Parm1_6
aggcagagagagactccgat

SEQ ID NO: 46965 - DNA, 20 bp, Artificial Sequence
  sgRNA
  Parm1_7
accatgactacgggtcctgg

SEQ ID NO: 46966 - DNA, 20 bp, Artificial Sequence
  sgRNA
  Parm1_8
tgacatccctcttcaaaggt

SEQ ID NO: 46967 - DNA, 20 bp, Artificial Sequence
  sgRNA
  Parm1_9
tcaggcactcctcctatgga

SEQ ID NO: 46968 - DNA, 20 bp, Artificial Sequence
  sgRNA
  Parm1_10
aagcaactgtgccagctact

SEQ ID NO: 46969 - DNA, 20 bp, Artificial Sequence
  sgRNA
  Parm1_11
gagaactgaggcgttgtgag

SEQ ID NO: 46970 - DNA, 20 bp, Artificial Sequence
  sgRNA
  Parm1_12
tccaaacaccagcaacacta

SEQ ID NO: 46971 - DNA, 20 bp, Artificial Sequence
  sgRNA
  Parm1_13
ctagagctgtgctcttctgt

SEQ ID NO: 46972 - DNA, 20 bp, Artificial Sequence
  sgRNA
  Parm1_14
caccagcccacctttgaaga

SEQ ID NO: 46973 - DNA, 20 bp, Artificial Sequence
  sgRNA
  Parm1_15
ctccgatagggaagttgcgg

SEQ ID NO: 46974 - DNA, 20 bp, Artificial Sequence
  sgRNA
  Parm1_16
ggtgatttctccttgggcac

SEQ ID NO: 46975 - DNA, 20 bp, Artificial Sequence
  sgRNA
  Parm1_17
tgttggccaccgtagagttg

SEQ ID NO: 46976 - DNA, 20 bp, Artificial Sequence
  sgRNA
  Parm1_18
tcaccagcccacctttgaag

SEQ ID NO: 46977 - DNA, 20 bp, Artificial Sequence
  sgRNA
  Parm1_19
gcctgagaagacaggagcat

SEQ ID NO: 46978 - DNA, 20 bp, Artificial Sequence
  sgRNA
  Parm1_20
tggccatcactgcttgttga

SEQ ID NO: 46979 - DNA, 20 bp, Artificial Sequence
  sgRNA
  Pcdh1_1
gactacggtttaccagacgt

SEQ ID NO: 46980 - DNA, 20 bp, Artificial Sequence
  sgRNA
  Pcdh1_2
acaccaacataagccgaacg

SEQ ID NO: 46981 - DNA, 20 bp, Artificial Sequence
  sgRNA
  Pcdh1_3
tacagtcgagcacattgacg

SEQ ID NO: 46982 - DNA, 20 bp, Artificial Sequence
  sgRNA
  Pcdh1_4
ttaaatcctctcggtccacg

SEQ ID NO: 46983 - DNA, 20 bp, Artificial Sequence
  sgRNA
  Pcdh1_5
acaacgcccccaaattcgag

SEQ ID NO: 46984 - DNA, 20 bp, Artificial Sequence
  sgRNA
  Pcdh1_6
gattgactacacgttccacc

SEQ ID NO: 46985 - DNA, 20 bp, Artificial Sequence
  sgRNA
  Pcdh1_7
gggtcatctgtataaactag

SEQ ID NO: 46986 - DNA, 20 bp, Artificial Sequence
  sgRNA
  Pcdh1_8
tggtgttccggtcttccggg

SEQ ID NO: 46987 - DNA, 20 bp, Artificial Sequence
  sgRNA
  Pcdh1_9
ggtcactgaccttcaccacg

SEQ ID NO: 46988 - DNA, 20 bp, Artificial Sequence
  sgRNA
  Pcdh1_10
gagcccctctcgatcaatgg

SEQ ID NO: 46989 - DNA, 20 bp, Artificial Sequence
  sgRNA
  Pcdh1_11
gcaggtgtctgatcgagacg

SEQ ID NO: 46990 - DNA, 20 bp, Artificial Sequence
  sgRNA
  Pcdh1_12
ctaaggctgtgccgtagcga

SEQ ID NO: 46991 - DNA, 20 bp, Artificial Sequence
  sgRNA
  Pcdh1_13
gccccgaccatcgagatccg

SEQ ID NO: 46992 - DNA, 20 bp, Artificial Sequence
  sgRNA
  Pcdh1_14
gatccagtgatgtcttcacc

SEQ ID NO: 46993 - DNA, 20 bp, Artificial Sequence
  sgRNA
  Pcdh1_15
gctgtagtcggagtactgct

SEQ ID NO: 46994 - DNA, 20 bp, Artificial Sequence
  sgRNA
  Pcdh1_16
agacctccattgatcgagag

SEQ ID NO: 46995 - DNA, 20 bp, Artificial Sequence
  sgRNA
  Pcdh1_17
ccacggggccatctggaccg

SEQ ID NO: 46996 - DNA, 20 bp, Artificial Sequence
  sgRNA
  Pcdh1_18
gatccgggtgaagacatcac

SEQ ID NO: 46997 - DNA, 20 bp, Artificial Sequence
  sgRNA
  Pcdh1_19
gcgtgtccaggctatggacg

SEQ ID NO: 46998 - DNA, 20 bp, Artificial Sequence
  sgRNA
  Pcdh1_20
ccagcgatgtcaatatccag

SEQ ID NO: 46999 - DNA, 20 bp, Artificial Sequence
  sgRNA
  Pcdh10_1
gccgggtgcctacatttacg

SEQ ID NO: 47000 - DNA, 20 bp, Artificial Sequence
  sgRNA
  Pcdh10_2
tggatcactagcgtgccagg

SEQ ID NO: 47001 - DNA, 20 bp, Artificial Sequence
  sgRNA
  Pcdh10_3
cactatcaagatgttgaccg

SEQ ID NO: 47002 - DNA, 20 bp, Artificial Sequence
  sgRNA
  Pcdh10_4
gcgccttcgacccagacgtg

SEQ ID NO: 47003 - DNA, 20 bp, Artificial Sequence
  sgRNA
  Pcdh10_5
cagcctggcgtccatccgaa

SEQ ID NO: 47004 - DNA, 20 bp, Artificial Sequence
  sgRNA
  Pcdh10_6
gttctcctctgagtcccgat

SEQ ID NO: 47005 - DNA, 20 bp, Artificial Sequence
  sgRNA
  Pcdh10_7
ggttatctcgtagtctcgca

SEQ ID NO: 47006 - DNA, 20 bp, Artificial Sequence
  sgRNA
  Pcdh10_8
gcaccgctacgtgctgaccg

SEQ ID NO: 47007 - DNA, 20 bp, Artificial Sequence
  sgRNA
  Pcdh10_9
ggactcctacaccctgaccg

SEQ ID NO: 47008 - DNA, 20 bp, Artificial Sequence
  sgRNA
  Pcdh10_10
ggtcatggagacagtgaaca

SEQ ID NO: 47009 - DNA, 20 bp, Artificial Sequence
  sgRNA
  Pcdh10_11
ccggtgacgatggctccgca

SEQ ID NO: 47010 - DNA, 20 bp, Artificial Sequence
  sgRNA
  Pcdh10_12
gatgctgagcacaatccctg

SEQ ID NO: 47011 - DNA, 20 bp, Artificial Sequence
  sgRNA
  Pcdh10_13
gggcttcaggaacatcaggt

SEQ ID NO: 47012 - DNA, 20 bp, Artificial Sequence
  sgRNA
  Pcdh10_14
catacacgtcgtagaccggc

SEQ ID NO: 47013 - DNA, 20 bp, Artificial Sequence
  sgRNA
  Pcdh10_15
actggaccgagaacagcaag

SEQ ID NO: 47014 - DNA, 20 bp, Artificial Sequence
  sgRNA
  Pcdh10_16
ttcagctcgcaggtttcaga

SEQ ID NO: 47015 - DNA, 20 bp, Artificial Sequence
  sgRNA
  Pcdh10_17
cgaagcccccttggaccgag

SEQ ID NO: 47016 - DNA, 20 bp, Artificial Sequence
  sgRNA
  Pcdh10_18
gtgccggtagaggagtccgg

SEQ ID NO: 47017 - DNA, 20 bp, Artificial Sequence
  sgRNA
  Pcdh10_19
ccagattgaggtccaagtaa

SEQ ID NO: 47018 - DNA, 20 bp, Artificial Sequence
  sgRNA
  Pcdh10_20
gatcatgatgtcaccaaccg

SEQ ID NO: 47019 - DNA, 20 bp, Artificial Sequence
  sgRNA
  Pcdh11x_1
gtggcattggacattaaggg

SEQ ID NO: 47020 - DNA, 20 bp, Artificial Sequence
  sgRNA
  Pcdh11x_2
caaattagtttacaaaaccg

SEQ ID NO: 47021 - DNA, 20 bp, Artificial Sequence
  sgRNA
  Pcdh11x_3
aaaaccaataacttgtgact

SEQ ID NO: 47022 - DNA, 20 bp, Artificial Sequence
  sgRNA
  Pcdh11x_4
caccagttcataaatcagtg

SEQ ID NO: 47023 - DNA, 20 bp, Artificial Sequence
  sgRNA
  Pcdh11x_5
ggtgattcttccctatccag

SEQ ID NO: 47024 - DNA, 20 bp, Artificial Sequence
  sgRNA
  Pcdh11x_6
tgtagtgtcgagccaaatca

SEQ ID NO: 47025 - DNA, 20 bp, Artificial Sequence
  sgRNA
  Pcdh11x_7
tttggctcgacactacaaat

SEQ ID NO: 47026 - DNA, 20 bp, Artificial Sequence
  sgRNA
  Pcdh11x_8
gatggaatcacagccaacga

SEQ ID NO: 47027 - DNA, 20 bp, Artificial Sequence
  sgRNA
  Pcdh11x_9
gcagccattgatcctgacat

SEQ ID NO: 47028 - DNA, 20 bp, Artificial Sequence
  sgRNA
  Pcdh11x_10
tagcgacgaactgacaagcg

SEQ ID NO: 47029 - DNA, 20 bp, Artificial Sequence
  sgRNA
  Pcdh11x_11
gcaccaggagagttattctc

SEQ ID NO: 47030 - DNA, 20 bp, Artificial Sequence
  sgRNA
  Pcdh11x_12
gttctaccatccacaaaccc

SEQ ID NO: 47031 - DNA, 20 bp, Artificial Sequence
  sgRNA
  Pcdh11x_13
agttgccatccccttcagtg

SEQ ID NO: 47032 - DNA, 20 bp, Artificial Sequence
  sgRNA
  Pcdh11x_14
ccaacgaaggtattatcaag

SEQ ID NO: 47033 - DNA, 20 bp, Artificial Sequence
  sgRNA
  Pcdh11x_15
ataccagaaaatgctcctat

SEQ ID NO: 47034 - DNA, 20 bp, Artificial Sequence
  sgRNA
  Pcdh11x_16
aggtgattctccaatcatag

SEQ ID NO: 47035 - DNA, 20 bp, Artificial Sequence
  sgRNA
  Pcdh11x_17
gcgaatcaatggtacatccc

SEQ ID NO: 47036 - DNA, 20 bp, Artificial Sequence
  sgRNA
  Pcdh11x_18
tgatccagattgaattcagg

SEQ ID NO: 47037 - DNA, 20 bp, Artificial Sequence
  sgRNA
  Pcdh11x_19
agtgcaacagatgcagacag

SEQ ID NO: 47038 - DNA, 20 bp, Artificial Sequence
  sgRNA
  Pcdh11x_20
tgaccgtctgtgtcactgga

SEQ ID NO: 47039 - DNA, 20 bp, Artificial Sequence
  sgRNA
  Pcdh12_1
aattagagcagacgcccctg

SEQ ID NO: 47040 - DNA, 20 bp, Artificial Sequence
  sgRNA
  Pcdh12_2
gctcttgattcagccaacag

SEQ ID NO: 47041 - DNA, 20 bp, Artificial Sequence
  sgRNA
  Pcdh12_3
aaacgggggagtccttgata

SEQ ID NO: 47042 - DNA, 20 bp, Artificial Sequence
  sgRNA
  Pcdh12_4
actgctacagatcccgacca

SEQ ID NO: 47043 - DNA, 20 bp, Artificial Sequence
  sgRNA
  Pcdh12_5
ccctaagtcaggaatcagcg

SEQ ID NO: 47044 - DNA, 20 bp, Artificial Sequence
  sgRNA
  Pcdh12_6
gtttgagaagagccggtacg

SEQ ID NO: 47045 - DNA, 20 bp, Artificial Sequence
  sgRNA
  Pcdh12_7
atagcttctcccgatccagc

SEQ ID NO: 47046 - DNA, 20 bp, Artificial Sequence
  sgRNA
  Pcdh12_8
aaatacttggccaagcccgg

SEQ ID NO: 47047 - DNA, 20 bp, Artificial Sequence
  sgRNA
  Pcdh12_9
ttccctatcaccgtgccaga

SEQ ID NO: 47048 - DNA, 20 bp, Artificial Sequence
  sgRNA
  Pcdh12_10
ggtggtataccagtacctgc

SEQ ID NO: 47049 - DNA, 20 bp, Artificial Sequence
  sgRNA
  Pcdh12_11
gcctgctcagcacttccagc

SEQ ID NO: 47050 - DNA, 20 bp, Artificial Sequence
  sgRNA
  Pcdh12_12
gcctggtagccccatagcga

SEQ ID NO: 47051 - DNA, 20 bp, Artificial Sequence
  sgRNA
  Pcdh12_13
caccagtgtggaccacctaa

SEQ ID NO: 47052 - DNA, 20 bp, Artificial Sequence
  sgRNA
  Pcdh12_14
gggattcccattgtcatagg

SEQ ID NO: 47053 - DNA, 20 bp, Artificial Sequence
  sgRNA
  Pcdh12_15
cgagagcctccgcaaagccg

SEQ ID NO: 47054 - DNA, 20 bp, Artificial Sequence
  sgRNA
  Pcdh12_16
aggcatttacaagcaccgaa

SEQ ID NO: 47055 - DNA, 20 bp, Artificial Sequence
  sgRNA
  Pcdh12_17
gctgtagaagagttccccat

SEQ ID NO: 47056 - DNA, 20 bp, Artificial Sequence
  sgRNA
  Pcdh12_18
gtctagacctagccaccagt

SEQ ID NO: 47057 - DNA, 20 bp, Artificial Sequence
  sgRNA
  Pcdh12_19
cagcccaaaccaaaccaccg

SEQ ID NO: 47058 - DNA, 20 bp, Artificial Sequence
  sgRNA
  Pcdh12_20
gctcatgagcagaatccctt

SEQ ID NO: 47059 - DNA, 20 bp, Artificial Sequence
  sgRNA
  Pcdh15_1
ctatcatgaagtacgcatcg

SEQ ID NO: 47060 - DNA, 20 bp, Artificial Sequence
  sgRNA
  Pcdh15_2
gaagcgggggtaatcctcag

SEQ ID NO: 47061 - DNA, 20 bp, Artificial Sequence
  sgRNA
  Pcdh15_3
ttagcaaacgcatctacaag

SEQ ID NO: 47062 - DNA, 20 bp, Artificial Sequence
  sgRNA
  Pcdh15_4
cttcctgaatgactacacct

SEQ ID NO: 47063 - DNA, 20 bp, Artificial Sequence
  sgRNA
  Pcdh15_5
tcttccgcatcacatccaac

SEQ ID NO: 47064 - DNA, 20 bp, Artificial Sequence
  sgRNA
  Pcdh15_6
ttggcaccacgatattcacg

SEQ ID NO: 47065 - DNA, 20 bp, Artificial Sequence
  sgRNA
  Pcdh15_7
tcgtgatcaacaagaccaca

SEQ ID NO: 47066 - DNA, 20 bp, Artificial Sequence
  sgRNA
  Pcdh15_8
tctttgccctctttaatcgg

SEQ ID NO: 47067 - DNA, 20 bp, Artificial Sequence
  sgRNA
  Pcdh15_9
gtgacgagcatcaagaagcg

SEQ ID NO: 47068 - DNA, 20 bp, Artificial Sequence
  sgRNA
  Pcdh15_10
actcatgctgactggcaacg

SEQ ID NO: 47069 - DNA, 20 bp, Artificial Sequence
  sgRNA
  Pcdh15_11
tattcctcttgggtgaagcg

SEQ ID NO: 47070 - DNA, 20 bp, Artificial Sequence
  sgRNA
  Pcdh15_12
ggaaaagcatctgtttaacg

SEQ ID NO: 47071 - DNA, 20 bp, Artificial Sequence
  sgRNA
  Pcdh15_13
gtgaatatcgtggtgccaac

SEQ ID NO: 47072 - DNA, 20 bp, Artificial Sequence
  sgRNA
  Pcdh15_14
atcataccgccgattaaaga

SEQ ID NO: 47073 - DNA, 20 bp, Artificial Sequence
  sgRNA
  Pcdh15_15
tgcgtttgctaaacactgga

SEQ ID NO: 47074 - DNA, 20 bp, Artificial Sequence
  sgRNA
  Pcdh15_16
tgtggtcgaggaaatccagg

SEQ ID NO: 47075 - DNA, 20 bp, Artificial Sequence
  sgRNA
  Pcdh15_17
gggtgtcacagtgaagaccg

SEQ ID NO: 47076 - DNA, 20 bp, Artificial Sequence
  sgRNA
  Pcdh15_18
gatgcctcccaagcaaccca

SEQ ID NO: 47077 - DNA, 20 bp, Artificial Sequence
  sgRNA
  Pcdh15_19
catatccagttgattgacca

SEQ ID NO: 47078 - DNA, 20 bp, Artificial Sequence
  sgRNA
  Pcdh15_20
agtggccgcagcaatgtcaa

SEQ ID NO: 47079 - DNA, 20 bp, Artificial Sequence
  sgRNA
  Pcdh17_1
cttcacattgatctgtacgg

SEQ ID NO: 47080 - DNA, 20 bp, Artificial Sequence
  sgRNA
  Pcdh17_2
gtccgtgaaccccactaacg

SEQ ID NO: 47081 - DNA, 20 bp, Artificial Sequence
  sgRNA
  Pcdh17_3
atgagaatgacaatccgcct

SEQ ID NO: 47082 - DNA, 20 bp, Artificial Sequence
  sgRNA
  Pcdh17_4
tggagaagagctcccgcacg

SEQ ID NO: 47083 - DNA, 20 bp, Artificial Sequence
  sgRNA
  Pcdh17_5
ccatttctatctgatccgag

SEQ ID NO: 47084 - DNA, 20 bp, Artificial Sequence
  sgRNA
  Pcdh17_6
gcgcacggagacgaaaccaa

SEQ ID NO: 47085 - DNA, 20 bp, Artificial Sequence
  sgRNA
  Pcdh17_7
agtccaggttgcccttaacg

SEQ ID NO: 47086 - DNA, 20 bp, Artificial Sequence
  sgRNA
  Pcdh17_8
tttgagatcgatccgtccag

SEQ ID NO: 47087 - DNA, 20 bp, Artificial Sequence
  sgRNA
  Pcdh17_9
gtagtcgaagtacatagggg

SEQ ID NO: 47088 - DNA, 20 bp, Artificial Sequence
  sgRNA
  Pcdh17_10
tttcgtctccgtgcgccagg

SEQ ID NO: 47089 - DNA, 20 bp, Artificial Sequence
  sgRNA
  Pcdh17_11
ctatgacaacttctataccg

SEQ ID NO: 47090 - DNA, 20 bp, Artificial Sequence
  sgRNA
  Pcdh17_12
gccctggacgtcaagtcccg

SEQ ID NO: 47091 - DNA, 20 bp, Artificial Sequence
  sgRNA
  Pcdh17_13
gtcgttagcgaaaacctcta

SEQ ID NO: 47092 - DNA, 20 bp, Artificial Sequence
  sgRNA
  Pcdh17_14
gtgcggatctcgccgctgga

SEQ ID NO: 47093 - DNA, 20 bp, Artificial Sequence
  sgRNA
  Pcdh17_15
acaccagcttcaccggacaa

SEQ ID NO: 47094 - DNA, 20 bp, Artificial Sequence
  sgRNA
  Pcdh17_16
agatacatcacctctgaccg

SEQ ID NO: 47095 - DNA, 20 bp, Artificial Sequence
  sgRNA
  Pcdh17_17
gatgctgatgaaggtcccaa

SEQ ID NO: 47096 - DNA, 20 bp, Artificial Sequence
  sgRNA
  Pcdh17_18
gcacggggacagcgatcagg

SEQ ID NO: 47097 - DNA, 20 bp, Artificial Sequence
  sgRNA
  Pcdh17_19
cgagcgagacccctgccact

SEQ ID NO: 47098 - DNA, 20 bp, Artificial Sequence
  sgRNA
  Pcdh17_20
tgtgcattccagagcccgta

SEQ ID NO: 47099 - DNA, 20 bp, Artificial Sequence
  sgRNA
  Pcdh18_1
ggggtcaatggttacatacg

SEQ ID NO: 47100 - DNA, 20 bp, Artificial Sequence
  sgRNA
  Pcdh18_2
aggagaggagaattcccccg

SEQ ID NO: 47101 - DNA, 20 bp, Artificial Sequence
  sgRNA
  Pcdh18_3
tgagagtgcccattccgcag

SEQ ID NO: 47102 - DNA, 20 bp, Artificial Sequence
  sgRNA
  Pcdh18_4
aacagtaaaatgtctcactg

SEQ ID NO: 47103 - DNA, 20 bp, Artificial Sequence
  sgRNA
  Pcdh18_5
tttcctcgaaaacttggccg

SEQ ID NO: 47104 - DNA, 20 bp, Artificial Sequence
  sgRNA
  Pcdh18_6
gcgctctccgatatctcaat

SEQ ID NO: 47105 - DNA, 20 bp, Artificial Sequence
  sgRNA
  Pcdh18_7
gaaggactcccctagcgacg

SEQ ID NO: 47106 - DNA, 20 bp, Artificial Sequence
  sgRNA
  Pcdh18_8
aactctctggaacgtcgaaa

SEQ ID NO: 47107 - DNA, 20 bp, Artificial Sequence
  sgRNA
  Pcdh18_9
agtgacctcttcctcacgga

SEQ ID NO: 47108 - DNA, 20 bp, Artificial Sequence
  sgRNA
  Pcdh18_10
gcagaaatatccatccccaa

SEQ ID NO: 47109 - DNA, 20 bp, Artificial Sequence
  sgRNA
  Pcdh18_11
aatgatggtcagcacaacgg

SEQ ID NO: 47110 - DNA, 20 bp, Artificial Sequence
  sgRNA
  Pcdh18_12
ttcatgatcaaagatcctga

SEQ ID NO: 47111 - DNA, 20 bp, Artificial Sequence
  sgRNA
  Pcdh18_13
ctgtagtcagaggatggcga

SEQ ID NO: 47112 - DNA, 20 bp, Artificial Sequence
  sgRNA
  Pcdh18_14
tggacacatccaaggatgcg

SEQ ID NO: 47113 - DNA, 20 bp, Artificial Sequence
  sgRNA
  Pcdh18_15
acactggtacccaccatcaa

SEQ ID NO: 47114 - DNA, 20 bp, Artificial Sequence
  sgRNA
  Pcdh18_16
gcatagatggcgccattaga

SEQ ID NO: 47115 - DNA, 20 bp, Artificial Sequence
  sgRNA
  Pcdh18_17
tttaggatgatgctggtacg

SEQ ID NO: 47116 - DNA, 20 bp, Artificial Sequence
  sgRNA
  Pcdh18_18
tcatgtcacaagaataaggg

SEQ ID NO: 47117 - DNA, 20 bp, Artificial Sequence
  sgRNA
  Pcdh18_19
gctgttgctgaggttgagct

SEQ ID NO: 47118 - DNA, 20 bp, Artificial Sequence
  sgRNA
  Pcdh18_20
ttgcaggccctataaccaca

SEQ ID NO: 47119 - DNA, 20 bp, Artificial Sequence
  sgRNA
  Pcdh19_1
gctcgctattgaccgacagg

SEQ ID NO: 47120 - DNA, 20 bp, Artificial Sequence
  sgRNA
  Pcdh19_2
gagccgagttggacaccacg

SEQ ID NO: 47121 - DNA, 20 bp, Artificial Sequence
  sgRNA
  Pcdh19_3
ttggcctggaaataaagacg

SEQ ID NO: 47122 - DNA, 20 bp, Artificial Sequence
  sgRNA
  Pcdh19_4
gttctcattaaaggtacgag

SEQ ID NO: 47123 - DNA, 20 bp, Artificial Sequence
  sgRNA
  Pcdh19_5
ggtgcgctagactatgaaga

SEQ ID NO: 47124 - DNA, 20 bp, Artificial Sequence
  sgRNA
  Pcdh19_6
ggcctggaaataaagacgcg

SEQ ID NO: 47125 - DNA, 20 bp, Artificial Sequence
  sgRNA
  Pcdh19_7
aaaggtcgcgaaagtccgct

SEQ ID NO: 47126 - DNA, 20 bp, Artificial Sequence
  sgRNA
  Pcdh19_8
gcgacggtgtaagatataga

SEQ ID NO: 47127 - DNA, 20 bp, Artificial Sequence
  sgRNA
  Pcdh19_9
acgactgcggccccaccaag

SEQ ID NO: 47128 - DNA, 20 bp, Artificial Sequence
  sgRNA
  Pcdh19_10
ggtcatatgcactgtccagt

SEQ ID NO: 47129 - DNA, 20 bp, Artificial Sequence
  sgRNA
  Pcdh19_11
tctgtctcctccacgtcccg

SEQ ID NO: 47130 - DNA, 20 bp, Artificial Sequence
  sgRNA
  Pcdh19_12
ttctcgttgtcggctccacg

SEQ ID NO: 47131 - DNA, 20 bp, Artificial Sequence
  sgRNA
  Pcdh19_13
tttcgcattacggctctcga

SEQ ID NO: 47132 - DNA, 20 bp, Artificial Sequence
  sgRNA
  Pcdh19_14
gcaacagcctgaaggatagt

SEQ ID NO: 47133 - DNA, 20 bp, Artificial Sequence
  sgRNA
  Pcdh19_15
ccacgtcccgaggtacaagg

SEQ ID NO: 47134 - DNA, 20 bp, Artificial Sequence
  sgRNA
  Pcdh19_16
aggtggactcgccaaacact

SEQ ID NO: 47135 - DNA, 20 bp, Artificial Sequence
  sgRNA
  Pcdh19_17
tcagagcgacgacagcccag

SEQ ID NO: 47136 - DNA, 20 bp, Artificial Sequence
  sgRNA
  Pcdh19_18
agtcaacagcgctatccggg

SEQ ID NO: 47137 - DNA, 20 bp, Artificial Sequence
  sgRNA
  Pcdh19_19
tgaggtcaaccctattcgga

SEQ ID NO: 47138 - DNA, 20 bp, Artificial Sequence
  sgRNA
  Pcdh19_20
gggcaatcacatagcccggg

SEQ ID NO: 47139 - DNA, 20 bp, Artificial Sequence
  sgRNA
  Pcdh20_1
cctcatttgcgatataacgt

SEQ ID NO: 47140 - DNA, 20 bp, Artificial Sequence
  sgRNA
  Pcdh20_2
tagcacggctgtaactcgcg

SEQ ID NO: 47141 - DNA, 20 bp, Artificial Sequence
  sgRNA
  Pcdh20_3
ctaccatggcatgtttaccc

SEQ ID NO: 47142 - DNA, 20 bp, Artificial Sequence
  sgRNA
  Pcdh20_4
gtgaccctaaacaaccgctc

SEQ ID NO: 47143 - DNA, 20 bp, Artificial Sequence
  sgRNA
  Pcdh20_5
gcacccatgacaatcaagta

SEQ ID NO: 47144 - DNA, 20 bp, Artificial Sequence
  sgRNA
  Pcdh20_6
gctccatcacactagttaca

SEQ ID NO: 47145 - DNA, 20 bp, Artificial Sequence
  sgRNA
  Pcdh20_7
tttccttagacagtgtcaca

SEQ ID NO: 47146 - DNA, 20 bp, Artificial Sequence
  sgRNA
  Pcdh20_8
actccaatttcaccataccc

SEQ ID NO: 47147 - DNA, 20 bp, Artificial Sequence
  sgRNA
  Pcdh20_9
tcaatggtcaattctatcaa

SEQ ID NO: 47148 - DNA, 20 bp, Artificial Sequence
  sgRNA
  Pcdh20_10
atatacatctgcttacggaa

SEQ ID NO: 47149 - DNA, 20 bp, Artificial Sequence
  sgRNA
  Pcdh20_11
atttaggctgtacagaagct

SEQ ID NO: 47150 - DNA, 20 bp, Artificial Sequence
  sgRNA
  Pcdh20_12
aagtccttgttgatgaacct

SEQ ID NO: 47151 - DNA, 20 bp, Artificial Sequence
  sgRNA
  Pcdh20_13
cttctgttactggtgagcca

SEQ ID NO: 47152 - DNA, 20 bp, Artificial Sequence
  sgRNA
  Pcdh20_14
ccaggcagtgagcttgcgcc

SEQ ID NO: 47153 - DNA, 20 bp, Artificial Sequence
  sgRNA
  Pcdh20_15
atactggccactcagtcccc

SEQ ID NO: 47154 - DNA, 20 bp, Artificial Sequence
  sgRNA
  Pcdh20_16
gcaagctgcgcgcgttccct

SEQ ID NO: 47155 - DNA, 20 bp, Artificial Sequence
  sgRNA
  Pcdh20_17
gtagtggcctggaactcaga

SEQ ID NO: 47156 - DNA, 20 bp, Artificial Sequence
  sgRNA
  Pcdh20_18
aagctttccagtaagattgg

SEQ ID NO: 47157 - DNA, 20 bp, Artificial Sequence
  sgRNA
  Pcdh20_19
ctgtctaaggaaaagtatga

SEQ ID NO: 47158 - DNA, 20 bp, Artificial Sequence
  sgRNA
  Pcdh20_20
gcaaagctcttacactctgt

SEQ ID NO: 47159 - DNA, 20 bp, Artificial Sequence
  sgRNA
  Pcdh7_1
tagccgtcttaccgactcgg

SEQ ID NO: 47160 - DNA, 20 bp, Artificial Sequence
  sgRNA
  Pcdh7_2
gaccacccgggagttcaacg

SEQ ID NO: 47161 - DNA, 20 bp, Artificial Sequence
  sgRNA
  Pcdh7_3
aagatggcctgcgaagaccg

SEQ ID NO: 47162 - DNA, 20 bp, Artificial Sequence
  sgRNA
  Pcdh7_4
attgcgaccaaagtcacgat

SEQ ID NO: 47163 - DNA, 20 bp, Artificial Sequence
  sgRNA
  Pcdh7_5
cttacaccggatcgaccgcg

SEQ ID NO: 47164 - DNA, 20 bp, Artificial Sequence
  sgRNA
  Pcdh7_6
gcgcatcccacttaaggacg

SEQ ID NO: 47165 - DNA, 20 bp, Artificial Sequence
  sgRNA
  Pcdh7_7
acacgctcttctcgaagcgg

SEQ ID NO: 47166 - DNA, 20 bp, Artificial Sequence
  sgRNA
  Pcdh7_8
gggcgcatcccacttaagga

SEQ ID NO: 47167 - DNA, 20 bp, Artificial Sequence
  sgRNA
  Pcdh7_9
ggtagagcgtgcctacaggc

SEQ ID NO: 47168 - DNA, 20 bp, Artificial Sequence
  sgRNA
  Pcdh7_10
agccacctgtacaatcaccg

SEQ ID NO: 47169 - DNA, 20 bp, Artificial Sequence
  sgRNA
  Pcdh7_11
ggggctgttgtcattcacgt

SEQ ID NO: 47170 - DNA, 20 bp, Artificial Sequence
  sgRNA
  Pcdh7_12
ggtggtctcatagtctagtg

SEQ ID NO: 47171 - DNA, 20 bp, Artificial Sequence
  sgRNA
  Pcdh7_13
actagactatgagaccaccc

SEQ ID NO: 47172 - DNA, 20 bp, Artificial Sequence
  sgRNA
  Pcdh7_14
ccgtgaccaaggcgagaacg

SEQ ID NO: 47173 - DNA, 20 bp, Artificial Sequence
  sgRNA
  Pcdh7_15
gggtgcccttccactcccag

SEQ ID NO: 47174 - DNA, 20 bp, Artificial Sequence
  sgRNA
  Pcdh7_16
gtggccttatcagtcttggg

SEQ ID NO: 47175 - DNA, 20 bp, Artificial Sequence
  sgRNA
  Pcdh7_17
ttgttaaaggaatatcctca

SEQ ID NO: 47176 - DNA, 20 bp, Artificial Sequence
  sgRNA
  Pcdh7_18
gatcgtgactttggtcgcaa

SEQ ID NO: 47177 - DNA, 20 bp, Artificial Sequence
  sgRNA
  Pcdh7_19
gcgagctgagcaccagtgag

SEQ ID NO: 47178 - DNA, 20 bp, Artificial Sequence
  sgRNA
  Pcdh7_20
acggtcggacacctgaacca

SEQ ID NO: 47179 - DNA, 20 bp, Artificial Sequence
  sgRNA
  Pcdh8_1
tgctgacgaaggagccaacg

SEQ ID NO: 47180 - DNA, 20 bp, Artificial Sequence
  sgRNA
  Pcdh8_2
gacgtgcgggctcaagaccg

SEQ ID NO: 47181 - DNA, 20 bp, Artificial Sequence
  sgRNA
  Pcdh8_3
gagtctcatagtcaaaacta

SEQ ID NO: 47182 - DNA, 20 bp, Artificial Sequence
  sgRNA
  Pcdh8_4
aggcacacgcatccccctgg

SEQ ID NO: 47183 - DNA, 20 bp, Artificial Sequence
  sgRNA
  Pcdh8_5
gcctcacagccccttccgcg

SEQ ID NO: 47184 - DNA, 20 bp, Artificial Sequence
  sgRNA
  Pcdh8_6
agatacgtgtccccgaagaa

SEQ ID NO: 47185 - DNA, 20 bp, Artificial Sequence
  sgRNA
  Pcdh8_7
ctgctggtcatatccgacgg

SEQ ID NO: 47186 - DNA, 20 bp, Artificial Sequence
  sgRNA
  Pcdh8_8
agtcacctaccgcctggtag

SEQ ID NO: 47187 - DNA, 20 bp, Artificial Sequence
  sgRNA
  Pcdh8_9
gatcccgacgaaggtcccaa

SEQ ID NO: 47188 - DNA, 20 bp, Artificial Sequence
  sgRNA
  Pcdh8_10
tagtaattgtccctgcgcag

SEQ ID NO: 47189 - DNA, 20 bp, Artificial Sequence
  sgRNA
  Pcdh8_11
cagtgactcggacatcagcg

SEQ ID NO: 47190 - DNA, 20 bp, Artificial Sequence
  sgRNA
  Pcdh8_12
gcgtacactctgcagcccgt

SEQ ID NO: 47191 - DNA, 20 bp, Artificial Sequence
  sgRNA
  Pcdh8_13
gctgcagcaggagccacgcg

SEQ ID NO: 47192 - DNA, 20 bp, Artificial Sequence
  sgRNA
  Pcdh8_14
gccctgctggtcatatccga

SEQ ID NO: 47193 - DNA, 20 bp, Artificial Sequence
  sgRNA
  Pcdh8_15
ccgatacagcacgttcgaag

SEQ ID NO: 47194 - DNA, 20 bp, Artificial Sequence
  sgRNA
  Pcdh8_16
acagggactcgggcgccaac

SEQ ID NO: 47195 - DNA, 20 bp, Artificial Sequence
  sgRNA
  Pcdh8_17
cggtcaagtcacctaccgcc

SEQ ID NO: 47196 - DNA, 20 bp, Artificial Sequence
  sgRNA
  Pcdh8_18
gagatgcagcggtcaccacc

SEQ ID NO: 47197 - DNA, 20 bp, Artificial Sequence
  sgRNA
  Pcdh8_19
aaagcgcctgtcacttcgag

SEQ ID NO: 47198 - DNA, 20 bp, Artificial Sequence
  sgRNA
  Pcdh8_20
ccacctccacgtgcaccagg

SEQ ID NO: 47199 - DNA, 20 bp, Artificial Sequence
  sgRNA
  Pcdh9_1
tttctgaaaacaaccgacgt

SEQ ID NO: 47200 - DNA, 20 bp, Artificial Sequence
  sgRNA
  Pcdh9_2
actcgatactttcaccagag

SEQ ID NO: 47201 - DNA, 20 bp, Artificial Sequence
  sgRNA
  Pcdh9_3
tgccaaagtatagtactgtg

SEQ ID NO: 47202 - DNA, 20 bp, Artificial Sequence
  sgRNA
  Pcdh9_4
tgggacttataatgtacctg

SEQ ID NO: 47203 - DNA, 20 bp, Artificial Sequence
  sgRNA
  Pcdh9_5
gatatcgtggaaactccgga

SEQ ID NO: 47204 - DNA, 20 bp, Artificial Sequence
  sgRNA
  Pcdh9_6
ggatatcgtggaaactccgg

SEQ ID NO: 47205 - DNA, 20 bp, Artificial Sequence
  sgRNA
  Pcdh9_7
tggtcaaccttatcagaacg

SEQ ID NO: 47206 - DNA, 20 bp, Artificial Sequence
  sgRNA
  Pcdh9_8
gttacctttcaccttccgga

SEQ ID NO: 47207 - DNA, 20 bp, Artificial Sequence
  sgRNA
  Pcdh9_9
aggcaatcagagcagccaac

SEQ ID NO: 47208 - DNA, 20 bp, Artificial Sequence
  sgRNA
  Pcdh9_10
tcagccacagaccctgacac

SEQ ID NO: 47209 - DNA, 20 bp, Artificial Sequence
  sgRNA
  Pcdh9_11
ccgctcagaggagcaaacaa

SEQ ID NO: 47210 - DNA, 20 bp, Artificial Sequence
  sgRNA
  Pcdh9_12
ggtgacattgatggtcacgg

SEQ ID NO: 47211 - DNA, 20 bp, Artificial Sequence
  sgRNA
  Pcdh9_13
ccaacaaaggtgttgtccaa

SEQ ID NO: 47212 - DNA, 20 bp, Artificial Sequence
  sgRNA
  Pcdh9_14
ggcacaccctgacaagagcg

SEQ ID NO: 47213 - DNA, 20 bp, Artificial Sequence
  sgRNA
  Pcdh9_15
gtttctgaaaacaaccgacg

SEQ ID NO: 47214 - DNA, 20 bp, Artificial Sequence
  sgRNA
  Pcdh9_16
gctaaacctcggggacccag

SEQ ID NO: 47215 - DNA, 20 bp, Artificial Sequence
  sgRNA
  Pcdh9_17
ttgacgtcaaagccaccgac

SEQ ID NO: 47216 - DNA, 20 bp, Artificial Sequence
  sgRNA
  Pcdh9_18
caggctggttgaaaattggt

SEQ ID NO: 47217 - DNA, 20 bp, Artificial Sequence
  sgRNA
  Pcdh9_19
gtgacagtgctggctagtga

SEQ ID NO: 47218 - DNA, 20 bp, Artificial Sequence
  sgRNA
  Pcdh9_20
ttgttaagtataacccacgt

SEQ ID NO: 47219 - DNA, 20 bp, Artificial Sequence
  sgRNA
  Pcdha1_1
gttgacacctgagtcgatgt

SEQ ID NO: 47220 - DNA, 20 bp, Artificial Sequence
  sgRNA
  Pcdha1_2
ttgcgcgcaccacctgtagg

SEQ ID NO: 47221 - DNA, 20 bp, Artificial Sequence
  sgRNA
  Pcdha1_3
gtttccactagagggcgccg

SEQ ID NO: 47222 - DNA, 20 bp, Artificial Sequence
  sgRNA
  Pcdha1_4
gatggcctggtcaaacagtg

SEQ ID NO: 47223 - DNA, 20 bp, Artificial Sequence
  sgRNA
  Pcdha1_5
ctttaaccttcacctccacg

SEQ ID NO: 47224 - DNA, 20 bp, Artificial Sequence
  sgRNA
  Pcdha1_6
gacgccaccctgaataggcg

SEQ ID NO: 47225 - DNA, 20 bp, Artificial Sequence
  sgRNA
  Pcdha1_7
gcgcgcaacccgtttcgcgt

SEQ ID NO: 47226 - DNA, 20 bp, Artificial Sequence
  sgRNA
  Pcdha1_8
ttactgacagccaccgacgg

SEQ ID NO: 47227 - DNA, 20 bp, Artificial Sequence
  sgRNA
  Pcdha1_9
agtgcgatgatagtgttaag

SEQ ID NO: 47228 - DNA, 20 bp, Artificial Sequence
  sgRNA
  Pcdha1_10
gcttgaactgagaaaatctt

SEQ ID NO: 47229 - DNA, 20 bp, Artificial Sequence
  sgRNA
  Pcdha1_11
tcaaacctggggctaaaccc

SEQ ID NO: 47230 - DNA, 20 bp, Artificial Sequence
  sgRNA
  Pcdha1_12
gatctgaatttacttctgcg

SEQ ID NO: 47231 - DNA, 20 bp, Artificial Sequence
  sgRNA
  Pcdha1_13
ggttgttagcaggctcctgc

SEQ ID NO: 47232 - DNA, 20 bp, Artificial Sequence
  sgRNA
  Pcdha1_14
cacggtgtcagcgatggacg

SEQ ID NO: 47233 - DNA, 20 bp, Artificial Sequence
  sgRNA
  Pcdha1_15
tgcaatcatctccatccggc

SEQ ID NO: 47234 - DNA, 20 bp, Artificial Sequence
  sgRNA
  Pcdha1_16
gtgcatgcctgctcttagcg

SEQ ID NO: 47235 - DNA, 20 bp, Artificial Sequence
  sgRNA
  Pcdha1_17
agagaaagggaacagcacga

SEQ ID NO: 47236 - DNA, 20 bp, Artificial Sequence
  sgRNA
  Pcdha1_18
gcttgtgctggacagcaccc

SEQ ID NO: 47237 - DNA, 20 bp, Artificial Sequence
  sgRNA
  Pcdha1_19
ggtgacaaaggtgcgcgcgg

SEQ ID NO: 47238 - DNA, 20 bp, Artificial Sequence
  sgRNA
  Pcdha1_20
ttattactgacagccaccga

SEQ ID NO: 47239 - DNA, 20 bp, Artificial Sequence
  sgRNA
  Pcdha11_1
ccagctccaacagctccatg

SEQ ID NO: 47240 - DNA, 20 bp, Artificial Sequence
  sgRNA
  Pcdha11_2
tgtggctgtggcagtcaacg

SEQ ID NO: 47241 - DNA, 20 bp, Artificial Sequence
  sgRNA
  Pcdha11_3
gggcaatgcagagcatcgca

SEQ ID NO: 47242 - DNA, 20 bp, Artificial Sequence
  sgRNA
  Pcdha11_4
ccagctccgacagctccgtg

SEQ ID NO: 47243 - DNA, 20 bp, Artificial Sequence
  sgRNA
  Pcdha11_5
tgaaccttcgtccaaatccg

SEQ ID NO: 47244 - DNA, 20 bp, Artificial Sequence
  sgRNA
  Pcdha11_6
attcgcacagtcggaataca

SEQ ID NO: 47245 - DNA, 20 bp, Artificial Sequence
  sgRNA
  Pcdha11_7
cattcgacagagcaatctat

SEQ ID NO: 47246 - DNA, 20 bp, Artificial Sequence
  sgRNA
  Pcdha11_8
aacgccacggatctagacga

SEQ ID NO: 47247 - DNA, 20 bp, Artificial Sequence
  sgRNA
  Pcdha11_9
cataagttgacactctctcg

SEQ ID NO: 47248 - DNA, 20 bp, Artificial Sequence
  sgRNA
  Pcdha11_10
ggtccttcaccaacaccaac

SEQ ID NO: 47249 - DNA, 20 bp, Artificial Sequence
  sgRNA
  Pcdha11_11
ccagtggcctcattgaccat

SEQ ID NO: 47250 - DNA, 20 bp, Artificial Sequence
  sgRNA
  Pcdha11_12
ggttgttagcaggctcctgc

SEQ ID NO: 47251 - DNA, 20 bp, Artificial Sequence
  sgRNA
  Pcdha11_13
gtgcatgcctgctcttagcg

SEQ ID NO: 47252 - DNA, 20 bp, Artificial Sequence
  sgRNA
  Pcdha11_14
agagaaagggaacagcacga

SEQ ID NO: 47253 - DNA, 20 bp, Artificial Sequence
  sgRNA
  Pcdha11_15
catgctggtatgttccagcg

SEQ ID NO: 47254 - DNA, 20 bp, Artificial Sequence
  sgRNA
  Pcdha11_16
cgtacgcagccccttccgcg

SEQ ID NO: 47255 - DNA, 20 bp, Artificial Sequence
  sgRNA
  Pcdha11_17
ggcattaagtctaatgacca

SEQ ID NO: 47256 - DNA, 20 bp, Artificial Sequence
  sgRNA
  Pcdha11_18
cacccgtgtatagtcccaca

SEQ ID NO: 47257 - DNA, 20 bp, Artificial Sequence
  sgRNA
  Pcdha11_19
gttcaagaggacgctccagt

SEQ ID NO: 47258 - DNA, 20 bp, Artificial Sequence
  sgRNA
  Pcdha11_20
tctagatcgggagaaaaccc

SEQ ID NO: 47259 - DNA, 20 bp, Artificial Sequence
  sgRNA
  Pcdha12_1
actatatgagatacccgtgg

SEQ ID NO: 47260 - DNA, 20 bp, Artificial Sequence
  sgRNA
  Pcdha12_2
ttactaacagctagtgacgg

SEQ ID NO: 47261 - DNA, 20 bp, Artificial Sequence
  sgRNA
  Pcdha12_3
atccaatcggtaggtcaagg

SEQ ID NO: 47262 - DNA, 20 bp, Artificial Sequence
  sgRNA
  Pcdha12_4
caccaccaccttatagtcag

SEQ ID NO: 47263 - DNA, 20 bp, Artificial Sequence
  sgRNA
  Pcdha12_5
aataatcgctgggatccaat

SEQ ID NO: 47264 - DNA, 20 bp, Artificial Sequence
  sgRNA
  Pcdha12_6
gctctgtgaggcaatagcgt

SEQ ID NO: 47265 - DNA, 20 bp, Artificial Sequence
  sgRNA
  Pcdha12_7
catgcgcagtcccttccgcg

SEQ ID NO: 47266 - DNA, 20 bp, Artificial Sequence
  sgRNA
  Pcdha12_8
taaactatatgagatacccg

SEQ ID NO: 47267 - DNA, 20 bp, Artificial Sequence
  sgRNA
  Pcdha12_9
ttattactaacagctagtga

SEQ ID NO: 47268 - DNA, 20 bp, Artificial Sequence
  sgRNA
  Pcdha12_10
aacgccacagatcctgacga

SEQ ID NO: 47269 - DNA, 20 bp, Artificial Sequence
  sgRNA
  Pcdha12_11
acaatgctccggagtttgat

SEQ ID NO: 47270 - DNA, 20 bp, Artificial Sequence
  sgRNA
  Pcdha12_12
ttccgccttgacctaccgat

SEQ ID NO: 47271 - DNA, 20 bp, Artificial Sequence
  sgRNA
  Pcdha12_13
gcagcagcgtgatcactaac

SEQ ID NO: 47272 - DNA, 20 bp, Artificial Sequence
  sgRNA
  Pcdha12_14
gtgcatgcctgctcttagcg

SEQ ID NO: 47273 - DNA, 20 bp, Artificial Sequence
  sgRNA
  Pcdha12_15
ggttgttagcaggctcctgc

SEQ ID NO: 47274 - DNA, 20 bp, Artificial Sequence
  sgRNA
  Pcdha12_16
agagaaagggaacagcacga

SEQ ID NO: 47275 - DNA, 20 bp, Artificial Sequence
  sgRNA
  Pcdha12_17
ctggccgtggaccacagcga

SEQ ID NO: 47276 - DNA, 20 bp, Artificial Sequence
  sgRNA
  Pcdha12_18
tgcaatcatctccatccggc

SEQ ID NO: 47277 - DNA, 20 bp, Artificial Sequence
  sgRNA
  Pcdha12_19
ggatgcacttaatggaacgt

SEQ ID NO: 47278 - DNA, 20 bp, Artificial Sequence
  sgRNA
  Pcdha12_20
attccaccagaagggtacaa

SEQ ID NO: 47279 - DNA, 20 bp, Artificial Sequence
  sgRNA
  Pcdha2_1
tctgtcattggaaatcgcgg

SEQ ID NO: 47280 - DNA, 20 bp, Artificial Sequence
  sgRNA
  Pcdha2_2
gtactttgtaaacggattgg

SEQ ID NO: 47281 - DNA, 20 bp, Artificial Sequence
  sgRNA
  Pcdha2_3
caggctacgcatgcccactg

SEQ ID NO: 47282 - DNA, 20 bp, Artificial Sequence
  sgRNA
  Pcdha2_4
ataaggtaatggtgacagcg

SEQ ID NO: 47283 - DNA, 20 bp, Artificial Sequence
  sgRNA
  Pcdha2_5
gtaaccagaatccgcatcca

SEQ ID NO: 47284 - DNA, 20 bp, Artificial Sequence
  sgRNA
  Pcdha2_6
cacttcatctagggctcgcg

SEQ ID NO: 47285 - DNA, 20 bp, Artificial Sequence
  sgRNA
  Pcdha2_7
tggcgcatccacttcatcta

SEQ ID NO: 47286 - DNA, 20 bp, Artificial Sequence
  sgRNA
  Pcdha2_8
ggttgttagcaggctcctgc

SEQ ID NO: 47287 - DNA, 20 bp, Artificial Sequence
  sgRNA
  Pcdha2_9
cagtcagcgaaggctcacca

SEQ ID NO: 47288 - DNA, 20 bp, Artificial Sequence
  sgRNA
  Pcdha2_10
gtgcatgcctgctcttagcg

SEQ ID NO: 47289 - DNA, 20 bp, Artificial Sequence
  sgRNA
  Pcdha2_11
tgcaatcatctccatccggc

SEQ ID NO: 47290 - DNA, 20 bp, Artificial Sequence
  sgRNA
  Pcdha2_12
agagaaagggaacagcacga

SEQ ID NO: 47291 - DNA, 20 bp, Artificial Sequence
  sgRNA
  Pcdha2_13
gtgcaagagaatgctcccct

SEQ ID NO: 47292 - DNA, 20 bp, Artificial Sequence
  sgRNA
  Pcdha2_14
atcgtgactcgggagtcaat

SEQ ID NO: 47293 - DNA, 20 bp, Artificial Sequence
  sgRNA
  Pcdha2_15
gaagcttctcctttgcggcg

SEQ ID NO: 47294 - DNA, 20 bp, Artificial Sequence
  sgRNA
  Pcdha2_16
tctcgtgctggacagcgcct

SEQ ID NO: 47295 - DNA, 20 bp, Artificial Sequence
  sgRNA
  Pcdha2_17
catgcgtagcctgttccgcg

SEQ ID NO: 47296 - DNA, 20 bp, Artificial Sequence
  sgRNA
  Pcdha2_18
ctgtcattggaaatcgcggc

SEQ ID NO: 47297 - DNA, 20 bp, Artificial Sequence
  sgRNA
  Pcdha2_19
agatgattgcaggagatcct

SEQ ID NO: 47298 - DNA, 20 bp, Artificial Sequence
  sgRNA
  Pcdha2_20
tataaccttcggcaaaaagg

SEQ ID NO: 47299 - DNA, 20 bp, Artificial Sequence
  sgRNA
  Pcdha3_1
tccaatgacagatcattgca

SEQ ID NO: 47300 - DNA, 20 bp, Artificial Sequence
  sgRNA
  Pcdha3_2
tccaaatggtactgtagtag

SEQ ID NO: 47301 - DNA, 20 bp, Artificial Sequence
  sgRNA
  Pcdha3_3
caacgttgttgtgactgcca

SEQ ID NO: 47302 - DNA, 20 bp, Artificial Sequence
  sgRNA
  Pcdha3_4
tgtcacggacagtgggtgca

SEQ ID NO: 47303 - DNA, 20 bp, Artificial Sequence
  sgRNA
  Pcdha3_5
tggacgtcttcccttccgcg

SEQ ID NO: 47304 - DNA, 20 bp, Artificial Sequence
  sgRNA
  Pcdha3_6
gcaatgatctgtcattggag

SEQ ID NO: 47305 - DNA, 20 bp, Artificial Sequence
  sgRNA
  Pcdha3_7
tgcaatcatctccatccggc

SEQ ID NO: 47306 - DNA, 20 bp, Artificial Sequence
  sgRNA
  Pcdha3_8
gtgcatgcctgctcttagcg

SEQ ID NO: 47307 - DNA, 20 bp, Artificial Sequence
  sgRNA
  Pcdha3_9
ggttgttagcaggctcctgc

SEQ ID NO: 47308 - DNA, 20 bp, Artificial Sequence
  sgRNA
  Pcdha3_10
agagaaagggaacagcacga

SEQ ID NO: 47309 - DNA, 20 bp, Artificial Sequence
  sgRNA
  Pcdha3_11
gcgacagcgcctattggtat

SEQ ID NO: 47310 - DNA, 20 bp, Artificial Sequence
  sgRNA
  Pcdha3_12
taccaataggcgctgtcgcg

SEQ ID NO: 47311 - DNA, 20 bp, Artificial Sequence
  sgRNA
  Pcdha3_13
agcgaaaaccgggagcccag

SEQ ID NO: 47312 - DNA, 20 bp, Artificial Sequence
  sgRNA
  Pcdha3_14
tacaagcgaagcctccctac

SEQ ID NO: 47313 - DNA, 20 bp, Artificial Sequence
  sgRNA
  Pcdha3_15
ttccacttagacccaatcag

SEQ ID NO: 47314 - DNA, 20 bp, Artificial Sequence
  sgRNA
  Pcdha3_16
tactccttcatccaaatcag

SEQ ID NO: 47315 - DNA, 20 bp, Artificial Sequence
  sgRNA
  Pcdha3_17
ggtccttcaccaataccaat

SEQ ID NO: 47316 - DNA, 20 bp, Artificial Sequence
  sgRNA
  Pcdha3_18
agatgattgcaggagatcct

SEQ ID NO: 47317 - DNA, 20 bp, Artificial Sequence
  sgRNA
  Pcdha3_19
tgataactgcagttgatggt

SEQ ID NO: 47318 - DNA, 20 bp, Artificial Sequence
  sgRNA
  Pcdha3_20
tctttgctgcgaatatgacc

SEQ ID NO: 47319 - DNA, 20 bp, Artificial Sequence
  sgRNA
  Pcdha4_1
cctggacagagagacaacag

SEQ ID NO: 47320 - DNA, 20 bp, Artificial Sequence
  sgRNA
  Pcdha4_2
attacggaaatctttagacc

SEQ ID NO: 47321 - DNA, 20 bp, Artificial Sequence
  sgRNA
  Pcdha4_3
tggtggaatcgtgagccggt

SEQ ID NO: 47322 - DNA, 20 bp, Artificial Sequence
  sgRNA
  Pcdha4_4
atgcctcagatttagacgaa

SEQ ID NO: 47323 - DNA, 20 bp, Artificial Sequence
  sgRNA
  Pcdha4_5
ttccacatagaccctgttag

SEQ ID NO: 47324 - DNA, 20 bp, Artificial Sequence
  sgRNA
  Pcdha4_6
acggaaatctttagaccggg

SEQ ID NO: 47325 - DNA, 20 bp, Artificial Sequence
  sgRNA
  Pcdha4_7
acactcgtggatactcgcga

SEQ ID NO: 47326 - DNA, 20 bp, Artificial Sequence
  sgRNA
  Pcdha4_8
ttagtgcttactgtcacgga

SEQ ID NO: 47327 - DNA, 20 bp, Artificial Sequence
  sgRNA
  Pcdha4_9
ttatctctggagtttcctcc

SEQ ID NO: 47328 - DNA, 20 bp, Artificial Sequence
  sgRNA
  Pcdha4_10
atacgagagaattctccagt

SEQ ID NO: 47329 - DNA, 20 bp, Artificial Sequence
  sgRNA
  Pcdha4_11
ggttgttagcaggctcctgc

SEQ ID NO: 47330 - DNA, 20 bp, Artificial Sequence
  sgRNA
  Pcdha4_12
agtgcgatgacagtgcccac

SEQ ID NO: 47331 - DNA, 20 bp, Artificial Sequence
  sgRNA
  Pcdha4_13
tgcaatcatctccatccggc

SEQ ID NO: 47332 - DNA, 20 bp, Artificial Sequence
  sgRNA
  Pcdha4_14
gtgcatgcctgctcttagcg

SEQ ID NO: 47333 - DNA, 20 bp, Artificial Sequence
  sgRNA
  Pcdha4_15
cgcgcaccttagccaccaca

SEQ ID NO: 47334 - DNA, 20 bp, Artificial Sequence
  sgRNA
  Pcdha4_16
aatacgagagaattctccag

SEQ ID NO: 47335 - DNA, 20 bp, Artificial Sequence
  sgRNA
  Pcdha4_17
agagaaagggaacagcacga

SEQ ID NO: 47336 - DNA, 20 bp, Artificial Sequence
  sgRNA
  Pcdha4_18
tttacccgttcgtcgttgga

SEQ ID NO: 47337 - DNA, 20 bp, Artificial Sequence
  sgRNA
  Pcdha4_19
gatccactactccatccctg

SEQ ID NO: 47338 - DNA, 20 bp, Artificial Sequence
  sgRNA
  Pcdha4_20
gaagcttctcctttgcggcg

SEQ ID NO: 47339 - DNA, 20 bp, Artificial Sequence
  sgRNA
  Pcdha5_1
agtcaagaatgccagactcg

SEQ ID NO: 47340 - DNA, 20 bp, Artificial Sequence
  sgRNA
  Pcdha5_2
tttaatgactaatgtcccgt

SEQ ID NO: 47341 - DNA, 20 bp, Artificial Sequence
  sgRNA
  Pcdha5_3
agagcgatgacagtcgccaa

SEQ ID NO: 47342 - DNA, 20 bp, Artificial Sequence
  sgRNA
  Pcdha5_4
gggcgagcctccatcgcgag

SEQ ID NO: 47343 - DNA, 20 bp, Artificial Sequence
  sgRNA
  Pcdha5_5
tgtgcgcagcccgttccgcg

SEQ ID NO: 47344 - DNA, 20 bp, Artificial Sequence
  sgRNA
  Pcdha5_6
agacaccaggaaagtggccg

SEQ ID NO: 47345 - DNA, 20 bp, Artificial Sequence
  sgRNA
  Pcdha5_7
tgcaatcatctccatccggc

SEQ ID NO: 47346 - DNA, 20 bp, Artificial Sequence
  sgRNA
  Pcdha5_8
agcaccaacaagcgttgacg

SEQ ID NO: 47347 - DNA, 20 bp, Artificial Sequence
  sgRNA
  Pcdha5_9
ggttgttagcaggctcctgc

SEQ ID NO: 47348 - DNA, 20 bp, Artificial Sequence
  sgRNA
  Pcdha5_10
agagaaagggaacagcacga

SEQ ID NO: 47349 - DNA, 20 bp, Artificial Sequence
  sgRNA
  Pcdha5_11
gtgcatgcctgctcttagcg

SEQ ID NO: 47350 - DNA, 20 bp, Artificial Sequence
  sgRNA
  Pcdha5_12
tatgagttgcagcctgcgac

SEQ ID NO: 47351 - DNA, 20 bp, Artificial Sequence
  sgRNA
  Pcdha5_13
tcaggtcgtgagaatttagg

SEQ ID NO: 47352 - DNA, 20 bp, Artificial Sequence
  sgRNA
  Pcdha5_14
ttgttagaaaatacacccaa

SEQ ID NO: 47353 - DNA, 20 bp, Artificial Sequence
  sgRNA
  Pcdha5_15
agatgattgcaggagatcct

SEQ ID NO: 47354 - DNA, 20 bp, Artificial Sequence
  sgRNA
  Pcdha5_16
agaggttccaaccaacaccc

SEQ ID NO: 47355 - DNA, 20 bp, Artificial Sequence
  sgRNA
  Pcdha5_17
cacgcaccttcgcaaccaca

SEQ ID NO: 47356 - DNA, 20 bp, Artificial Sequence
  sgRNA
  Pcdha5_18
tgttctccacaagagacacc

SEQ ID NO: 47357 - DNA, 20 bp, Artificial Sequence
  sgRNA
  Pcdha5_19
atcgtgactcaggcgccaat

SEQ ID NO: 47358 - DNA, 20 bp, Artificial Sequence
  sgRNA
  Pcdha5_20
tataaccttcggcaaaaagg

SEQ ID NO: 47359 - DNA, 20 bp, Artificial Sequence
  sgRNA
  Pcdha6_1
gatgtgaaatcaaacagcga

SEQ ID NO: 47360 - DNA, 20 bp, Artificial Sequence
  sgRNA
  Pcdha6_2
aactgctcaagagtcttggg

SEQ ID NO: 47361 - DNA, 20 bp, Artificial Sequence
  sgRNA
  Pcdha6_3
aggcgcattgtcgttcacat

SEQ ID NO: 47362 - DNA, 20 bp, Artificial Sequence
  sgRNA
  Pcdha6_4
cctttactgagaacacaggc

SEQ ID NO: 47363 - DNA, 20 bp, Artificial Sequence
  sgRNA
  Pcdha6_5
tcaccagcactaataggcga

SEQ ID NO: 47364 - DNA, 20 bp, Artificial Sequence
  sgRNA
  Pcdha6_6
tcatggtatacaccgcactg

SEQ ID NO: 47365 - DNA, 20 bp, Artificial Sequence
  sgRNA
  Pcdha6_7
tctagcccaaagtattcgct

SEQ ID NO: 47366 - DNA, 20 bp, Artificial Sequence
  sgRNA
  Pcdha6_8
tgcaatggcccaccatcgga

SEQ ID NO: 47367 - DNA, 20 bp, Artificial Sequence
  sgRNA
  Pcdha6_9
gtgcatgcctgctcttagcg

SEQ ID NO: 47368 - DNA, 20 bp, Artificial Sequence
  sgRNA
  Pcdha6_10
agagaaagggaacagcacga

SEQ ID NO: 47369 - DNA, 20 bp, Artificial Sequence
  sgRNA
  Pcdha6_11
agcgtcctctcgaacaggca

SEQ ID NO: 47370 - DNA, 20 bp, Artificial Sequence
  sgRNA
  Pcdha6_12
ggttgttagcaggctcctgc

SEQ ID NO: 47371 - DNA, 20 bp, Artificial Sequence
  sgRNA
  Pcdha6_13
tttagggtaggtctgtacac

SEQ ID NO: 47372 - DNA, 20 bp, Artificial Sequence
  sgRNA
  Pcdha6_14
tgcaatcatctccatccggc

SEQ ID NO: 47373 - DNA, 20 bp, Artificial Sequence
  sgRNA
  Pcdha6_15
caatcagcgctggctccccg

SEQ ID NO: 47374 - DNA, 20 bp, Artificial Sequence
  sgRNA
  Pcdha6_16
tggaactgagcaccgcagtg

SEQ ID NO: 47375 - DNA, 20 bp, Artificial Sequence
  sgRNA
  Pcdha6_17
tcacccacaaccggacaagg

SEQ ID NO: 47376 - DNA, 20 bp, Artificial Sequence
  sgRNA
  Pcdha6_18
tggaacgcggagtctgttta

SEQ ID NO: 47377 - DNA, 20 bp, Artificial Sequence
  sgRNA
  Pcdha6_19
gaagcttctcctttgcggcg

SEQ ID NO: 47378 - DNA, 20 bp, Artificial Sequence
  sgRNA
  Pcdha6_20
tgaagatgtgcgctccagga

SEQ ID NO: 47379 - DNA, 20 bp, Artificial Sequence
  sgRNA
  Pcdha7_1
aaggaactaaccgtcaactg

SEQ ID NO: 47380 - DNA, 20 bp, Artificial Sequence
  sgRNA
  Pcdha7_2
aatcacatcatagttagcga

SEQ ID NO: 47381 - DNA, 20 bp, Artificial Sequence
  sgRNA
  Pcdha7_3
tttggacgaaggcgtgaatg

SEQ ID NO: 47382 - DNA, 20 bp, Artificial Sequence
  sgRNA
  Pcdha7_4
acaatgcacctaccctgctg

SEQ ID NO: 47383 - DNA, 20 bp, Artificial Sequence
  sgRNA
  Pcdha7_5
aggactctggatacaatgcg

SEQ ID NO: 47384 - DNA, 20 bp, Artificial Sequence
  sgRNA
  Pcdha7_6
gtatccgaggacagtcaacc

SEQ ID NO: 47385 - DNA, 20 bp, Artificial Sequence
  sgRNA
  Pcdha7_7
gaattctcgcatcgaccggg

SEQ ID NO: 47386 - DNA, 20 bp, Artificial Sequence
  sgRNA
  Pcdha7_8
gctggggcctttggctaacg

SEQ ID NO: 47387 - DNA, 20 bp, Artificial Sequence
  sgRNA
  Pcdha7_9
gttagccaaaggccccagca

SEQ ID NO: 47388 - DNA, 20 bp, Artificial Sequence
  sgRNA
  Pcdha7_10
ggttgttagcaggctcctgc

SEQ ID NO: 47389 - DNA, 20 bp, Artificial Sequence
  sgRNA
  Pcdha7_11
accgtgattccggtgccaat

SEQ ID NO: 47390 - DNA, 20 bp, Artificial Sequence
  sgRNA
  Pcdha7_12
tgcaatcatctccatccggc

SEQ ID NO: 47391 - DNA, 20 bp, Artificial Sequence
  sgRNA
  Pcdha7_13
tattcaggctgcgcaaacag

SEQ ID NO: 47392 - DNA, 20 bp, Artificial Sequence
  sgRNA
  Pcdha7_14
ctactcgctggtggaacgga

SEQ ID NO: 47393 - DNA, 20 bp, Artificial Sequence
  sgRNA
  Pcdha7_15
gtgcatgcctgctcttagcg

SEQ ID NO: 47394 - DNA, 20 bp, Artificial Sequence
  sgRNA
  Pcdha7_16
agagaaagggaacagcacga

SEQ ID NO: 47395 - DNA, 20 bp, Artificial Sequence
  sgRNA
  Pcdha7_17
cttgtctctcccagtatccg

SEQ ID NO: 47396 - DNA, 20 bp, Artificial Sequence
  sgRNA
  Pcdha7_18
ggtcacctgcccattggcac

SEQ ID NO: 47397 - DNA, 20 bp, Artificial Sequence
  sgRNA
  Pcdha7_19
gtaaagatgtgcgcaccagg

SEQ ID NO: 47398 - DNA, 20 bp, Artificial Sequence
  sgRNA
  Pcdha7_20
gtatccagagtcctcatcta

SEQ ID NO: 47399 - DNA, 20 bp, Artificial Sequence
  sgRNA
  Pcdha8_1
accgtgcaatgaccaatcag

SEQ ID NO: 47400 - DNA, 20 bp, Artificial Sequence
  sgRNA
  Pcdha8_2
gaaggggacatgattagtca

SEQ ID NO: 47401 - DNA, 20 bp, Artificial Sequence
  sgRNA
  Pcdha8_3
tttccgcaaaacgagcccaa

SEQ ID NO: 47402 - DNA, 20 bp, Artificial Sequence
  sgRNA
  Pcdha8_4
gtcccagatccaagcaacat

SEQ ID NO: 47403 - DNA, 20 bp, Artificial Sequence
  sgRNA
  Pcdha8_5
tgtccacgatcacctccaag

SEQ ID NO: 47404 - DNA, 20 bp, Artificial Sequence
  sgRNA
  Pcdha8_6
tttcgtgtaggattatacac

SEQ ID NO: 47405 - DNA, 20 bp, Artificial Sequence
  sgRNA
  Pcdha8_7
gtgactgtagcagtcagcgg

SEQ ID NO: 47406 - DNA, 20 bp, Artificial Sequence
  sgRNA
  Pcdha8_8
ggttgttagcaggctcctgc

SEQ ID NO: 47407 - DNA, 20 bp, Artificial Sequence
  sgRNA
  Pcdha8_9
gtgcatgcctgctcttagcg

SEQ ID NO: 47408 - DNA, 20 bp, Artificial Sequence
  sgRNA
  Pcdha8_10
acggtgactgtagcagtcag

SEQ ID NO: 47409 - DNA, 20 bp, Artificial Sequence
  sgRNA
  Pcdha8_11
ttaaagaagatgcacaactg

SEQ ID NO: 47410 - DNA, 20 bp, Artificial Sequence
  sgRNA
  Pcdha8_12
tgcaatcatctccatccggc

SEQ ID NO: 47411 - DNA, 20 bp, Artificial Sequence
  sgRNA
  Pcdha8_13
agagaaagggaacagcacga

SEQ ID NO: 47412 - DNA, 20 bp, Artificial Sequence
  sgRNA
  Pcdha8_14
atgcgcagcccatttcgtgt

SEQ ID NO: 47413 - DNA, 20 bp, Artificial Sequence
  sgRNA
  Pcdha8_15
catcttcacagtatcagcgg

SEQ ID NO: 47414 - DNA, 20 bp, Artificial Sequence
  sgRNA
  Pcdha8_16
agatgattgcaggagatcct

SEQ ID NO: 47415 - DNA, 20 bp, Artificial Sequence
  sgRNA
  Pcdha8_17
gtgcaatgaccaatcagtgg

SEQ ID NO: 47416 - DNA, 20 bp, Artificial Sequence
  sgRNA
  Pcdha8_18
ccggtgagatcagcaccaca

SEQ ID NO: 47417 - DNA, 20 bp, Artificial Sequence
  sgRNA
  Pcdha8_19
agacccacaagcgcccccag

SEQ ID NO: 47418 - DNA, 20 bp, Artificial Sequence
  sgRNA
  Pcdha8_20
gcacatcttcacagtatcag

SEQ ID NO: 47419 - DNA, 20 bp, Artificial Sequence
  sgRNA
  Pcdha9_1
ccctccgatattctccgtag

SEQ ID NO: 47420 - DNA, 20 bp, Artificial Sequence
  sgRNA
  Pcdha9_2
taacaattatgaaattcacg

SEQ ID NO: 47421 - DNA, 20 bp, Artificial Sequence
  sgRNA
  Pcdha9_3
ctactgacagcaaccgatgg

SEQ ID NO: 47422 - DNA, 20 bp, Artificial Sequence
  sgRNA
  Pcdha9_4
tgactgatgtccgagcagcg

SEQ ID NO: 47423 - DNA, 20 bp, Artificial Sequence
  sgRNA
  Pcdha9_5
cgatcaacataggttcgccg

SEQ ID NO: 47424 - DNA, 20 bp, Artificial Sequence
  sgRNA
  Pcdha9_6
tttccgtgtcggtctctaca

SEQ ID NO: 47425 - DNA, 20 bp, Artificial Sequence
  sgRNA
  Pcdha9_7
ggatgaaaatgataacgcac

SEQ ID NO: 47426 - DNA, 20 bp, Artificial Sequence
  sgRNA
  Pcdha9_8
aatttagccagcttgtttcg

SEQ ID NO: 47427 - DNA, 20 bp, Artificial Sequence
  sgRNA
  Pcdha9_9
gtgcatgcctgctcttagcg

SEQ ID NO: 47428 - DNA, 20 bp, Artificial Sequence
  sgRNA
  Pcdha9_10
agagaaagggaacagcacga

SEQ ID NO: 47429 - DNA, 20 bp, Artificial Sequence
  sgRNA
  Pcdha9_11
ggttgttagcaggctcctgc

SEQ ID NO: 47430 - DNA, 20 bp, Artificial Sequence
  sgRNA
  Pcdha9_12
ccatcagcgacgcctccctg

SEQ ID NO: 47431 - DNA, 20 bp, Artificial Sequence
  sgRNA
  Pcdha9_13
tccgctacggagaatatcgg

SEQ ID NO: 47432 - DNA, 20 bp, Artificial Sequence
  sgRNA
  Pcdha9_14
attcgcacatcccgaataca

SEQ ID NO: 47433 - DNA, 20 bp, Artificial Sequence
  sgRNA
  Pcdha9_15
tttaccgcgccagcgcctat

SEQ ID NO: 47434 - DNA, 20 bp, Artificial Sequence
  sgRNA
  Pcdha9_16
tgcaatcatctccatccggc

SEQ ID NO: 47435 - DNA, 20 bp, Artificial Sequence
  sgRNA
  Pcdha9_17
tgttccgctacggagaatat

SEQ ID NO: 47436 - DNA, 20 bp, Artificial Sequence
  sgRNA
  Pcdha9_18
cggtaaatcagattcatcca

SEQ ID NO: 47437 - DNA, 20 bp, Artificial Sequence
  sgRNA
  Pcdha9_19
tgccaaaagcttcttcccag

SEQ ID NO: 47438 - DNA, 20 bp, Artificial Sequence
  sgRNA
  Pcdha9_20
gttgcccaactcctcccgca

SEQ ID NO: 47439 - DNA, 20 bp, Artificial Sequence
  sgRNA
  Pcdhac1_1
aaggaagcgaaagttccgca

SEQ ID NO: 47440 - DNA, 20 bp, Artificial Sequence
  sgRNA
  Pcdhac1_2
cttctccagctcaatactcg

SEQ ID NO: 47441 - DNA, 20 bp, Artificial Sequence
  sgRNA
  Pcdhac1_3
tcacgtacatcctaaaagtg

SEQ ID NO: 47442 - DNA, 20 bp, Artificial Sequence
  sgRNA
  Pcdhac1_4
caccgcctaaggaaactcca

SEQ ID NO: 47443 - DNA, 20 bp, Artificial Sequence
  sgRNA
  Pcdhac1_5
gctacaagtgaccttaccat

SEQ ID NO: 47444 - DNA, 20 bp, Artificial Sequence
  sgRNA
  Pcdhac1_6
tgtccagctcgggcaaagcg

SEQ ID NO: 47445 - DNA, 20 bp, Artificial Sequence
  sgRNA
  Pcdhac1_7
gcaaattcattcctacacca

SEQ ID NO: 47446 - DNA, 20 bp, Artificial Sequence
  sgRNA
  Pcdhac1_8
agaatgaaccgggctcccgg

SEQ ID NO: 47447 - DNA, 20 bp, Artificial Sequence
  sgRNA
  Pcdhac1_9
gcactccgtatacagtacta

SEQ ID NO: 47448 - DNA, 20 bp, Artificial Sequence
  sgRNA
  Pcdhac1_10
ggtcatgaagtccatctggg

SEQ ID NO: 47449 - DNA, 20 bp, Artificial Sequence
  sgRNA
  Pcdhac1_11
acttgcttgctcccgatcca

SEQ ID NO: 47450 - DNA, 20 bp, Artificial Sequence
  sgRNA
  Pcdhac1_12
tggaatagcacagttccatt

SEQ ID NO: 47451 - DNA, 20 bp, Artificial Sequence
  sgRNA
  Pcdhac1_13
cgtacatcctaaaagtgggg

SEQ ID NO: 47452 - DNA, 20 bp, Artificial Sequence
  sgRNA
  Pcdhac1_14
cttgcttgctcccgatccag

SEQ ID NO: 47453 - DNA, 20 bp, Artificial Sequence
  sgRNA
  Pcdhac1_15
agagaaagggaacagcacga

SEQ ID NO: 47454 - DNA, 20 bp, Artificial Sequence
  sgRNA
  Pcdhac1_16
tgcaatcatctccatccggc

SEQ ID NO: 47455 - DNA, 20 bp, Artificial Sequence
  sgRNA
  Pcdhac1_17
gtgcatgcctgctcttagcg

SEQ ID NO: 47456 - DNA, 20 bp, Artificial Sequence
  sgRNA
  Pcdhac1_18
ggttgttagcaggctcctgc

SEQ ID NO: 47457 - DNA, 20 bp, Artificial Sequence
  sgRNA
  Pcdhac1_19
tttggcagtgataacaccag

SEQ ID NO: 47458 - DNA, 20 bp, Artificial Sequence
  sgRNA
  Pcdhac1_20
aatgcccaagatgccgatga

SEQ ID NO: 47459 - DNA, 20 bp, Artificial Sequence
  sgRNA
  Pcdhac2_1
ttcactaccaatgtgcccgg

SEQ ID NO: 47460 - DNA, 20 bp, Artificial Sequence
  sgRNA
  Pcdhac2_2
caacgagcggatagatcgcg

SEQ ID NO: 47461 - DNA, 20 bp, Artificial Sequence
  sgRNA
  Pcdhac2_3
ctttggaaactcctataccc

SEQ ID NO: 47462 - DNA, 20 bp, Artificial Sequence
  sgRNA
  Pcdhac2_4
gtttcacatagagagcgcac

SEQ ID NO: 47463 - DNA, 20 bp, Artificial Sequence
  sgRNA
  Pcdhac2_5
gcttcaggtaagcgaatccg

SEQ ID NO: 47464 - DNA, 20 bp, Artificial Sequence
  sgRNA
  Pcdhac2_6
ctacccgctcccgatccaat

SEQ ID NO: 47465 - DNA, 20 bp, Artificial Sequence
  sgRNA
  Pcdhac2_7
gctacgatactccgtgccgg

SEQ ID NO: 47466 - DNA, 20 bp, Artificial Sequence
  sgRNA
  Pcdhac2_8
acaactctccgcgcttcccg

SEQ ID NO: 47467 - DNA, 20 bp, Artificial Sequence
  sgRNA
  Pcdhac2_9
agtgctggctcacaaccctg

SEQ ID NO: 47468 - DNA, 20 bp, Artificial Sequence
  sgRNA
  Pcdhac2_10
ctacttggttctcactgcgg

SEQ ID NO: 47469 - DNA, 20 bp, Artificial Sequence
  sgRNA
  Pcdhac2_11
ggtcaccaaagtcatagcca

SEQ ID NO: 47470 - DNA, 20 bp, Artificial Sequence
  sgRNA
  Pcdhac2_12
tgaagctgataatccggccg

SEQ ID NO: 47471 - DNA, 20 bp, Artificial Sequence
  sgRNA
  Pcdhac2_13
cgatcgcgctcactgccaca

SEQ ID NO: 47472 - DNA, 20 bp, Artificial Sequence
  sgRNA
  Pcdhac2_14
cctcgaacctcaatgaagtg

SEQ ID NO: 47473 - DNA, 20 bp, Artificial Sequence
  sgRNA
  Pcdhac2_15
tccattgtcacggaccacca

SEQ ID NO: 47474 - DNA, 20 bp, Artificial Sequence
  sgRNA
  Pcdhac2_16
tatgtgcaagctactgaccg

SEQ ID NO: 47475 - DNA, 20 bp, Artificial Sequence
  sgRNA
  Pcdhac2_17
gtgcatgcctgctcttagcg

SEQ ID NO: 47476 - DNA, 20 bp, Artificial Sequence
  sgRNA
  Pcdhac2_18
ggttgttagcaggctcctgc

SEQ ID NO: 47477 - DNA, 20 bp, Artificial Sequence
  sgRNA
  Pcdhac2_19
agagaaagggaacagcacga

SEQ ID NO: 47478 - DNA, 20 bp, Artificial Sequence
  sgRNA
  Pcdhac2_20
tcaccgttagaaccctcatc

SEQ ID NO: 47479 - DNA, 20 bp, Artificial Sequence
  sgRNA
  Pcdhb1_1
ccaaatctagatcctcggcg

SEQ ID NO: 47480 - DNA, 20 bp, Artificial Sequence
  sgRNA
  Pcdhb1_2
gttctgcatatttaggaccg

SEQ ID NO: 47481 - DNA, 20 bp, Artificial Sequence
  sgRNA
  Pcdhb1_3
gaaatgcaacctgttaccct

SEQ ID NO: 47482 - DNA, 20 bp, Artificial Sequence
  sgRNA
  Pcdhb1_4
ccggagaagttcgactccgt

SEQ ID NO: 47483 - DNA, 20 bp, Artificial Sequence
  sgRNA
  Pcdhb1_5
tctcctccgccaccgaatag

SEQ ID NO: 47484 - DNA, 20 bp, Artificial Sequence
  sgRNA
  Pcdhb1_6
acaaatctccagtcttgcgg

SEQ ID NO: 47485 - DNA, 20 bp, Artificial Sequence
  sgRNA
  Pcdhb1_7
gccgctgcagtccttccggg

SEQ ID NO: 47486 - DNA, 20 bp, Artificial Sequence
  sgRNA
  Pcdhb1_8
caaatactctgacttccacc

SEQ ID NO: 47487 - DNA, 20 bp, Artificial Sequence
  sgRNA
  Pcdhb1_9
ggggcgcgtctagttgccga

SEQ ID NO: 47488 - DNA, 20 bp, Artificial Sequence
  sgRNA
  Pcdhb1_10
tggcaccgccaacattcgag

SEQ ID NO: 47489 - DNA, 20 bp, Artificial Sequence
  sgRNA
  Pcdhb1_11
tattggcaaagtccacgccg

SEQ ID NO: 47490 - DNA, 20 bp, Artificial Sequence
  sgRNA
  Pcdhb1_12
atatgatatgtgctcagcca

SEQ ID NO: 47491 - DNA, 20 bp, Artificial Sequence
  sgRNA
  Pcdhb1_13
gctctatgcactaagaacca

SEQ ID NO: 47492 - DNA, 20 bp, Artificial Sequence
  sgRNA
  Pcdhb1_14
aatccgctattcggtggcgg

SEQ ID NO: 47493 - DNA, 20 bp, Artificial Sequence
  sgRNA
  Pcdhb1_15
tccggaagtgacaatctcct

SEQ ID NO: 47494 - DNA, 20 bp, Artificial Sequence
  sgRNA
  Pcdhb1_16
gacaaccactcgaatgttgg

SEQ ID NO: 47495 - DNA, 20 bp, Artificial Sequence
  sgRNA
  Pcdhb1_17
cacacacgcttccgaagcca

SEQ ID NO: 47496 - DNA, 20 bp, Artificial Sequence
  sgRNA
  Pcdhb1_18
acttgtgctggataatcccc

SEQ ID NO: 47497 - DNA, 20 bp, Artificial Sequence
  sgRNA
  Pcdhb1_19
cttggtactaggtcattgca

SEQ ID NO: 47498 - DNA, 20 bp, Artificial Sequence
  sgRNA
  Pcdhb1_20
caaagagaaactagatcgcg

SEQ ID NO: 47499 - DNA, 20 bp, Artificial Sequence
  sgRNA
  Pcdhb10_1
tggagagctggctattaggg

SEQ ID NO: 47500 - DNA, 20 bp, Artificial Sequence
  sgRNA
  Pcdhb10_2
attatactttagtaacagag

SEQ ID NO: 47501 - DNA, 20 bp, Artificial Sequence
  sgRNA
  Pcdhb10_3
tgaagatatggtgagcttag

SEQ ID NO: 47502 - DNA, 20 bp, Artificial Sequence
  sgRNA
  Pcdhb10_4
agatgctgggatatatggca

SEQ ID NO: 47503 - DNA, 20 bp, Artificial Sequence
  sgRNA
  Pcdhb10_5
tggcaactaaggcatcaagg

SEQ ID NO: 47504 - DNA, 20 bp, Artificial Sequence
  sgRNA
  Pcdhb10_6
gtatgaggtgtgtttatcgg

SEQ ID NO: 47505 - DNA, 20 bp, Artificial Sequence
  sgRNA
  Pcdhb10_7
atgaaactcgaaggcccgca

SEQ ID NO: 47506 - DNA, 20 bp, Artificial Sequence
  sgRNA
  Pcdhb10_8
gcacgacttcagacaaaggc

SEQ ID NO: 47507 - DNA, 20 bp, Artificial Sequence
  sgRNA
  Pcdhb10_9
ggcaggttacttagtcacca

SEQ ID NO: 47508 - DNA, 20 bp, Artificial Sequence
  sgRNA
  Pcdhb10_10
gctagtacccagagctgcgg

SEQ ID NO: 47509 - DNA, 20 bp, Artificial Sequence
  sgRNA
  Pcdhb10_11
tcaccgacctgggcaccccc

SEQ ID NO: 47510 - DNA, 20 bp, Artificial Sequence
  sgRNA
  Pcdhb10_12
catgttcgcgccacagaccg

SEQ ID NO: 47511 - DNA, 20 bp, Artificial Sequence
  sgRNA
  Pcdhb10_13
gaaggaaagtccgcactgca

SEQ ID NO: 47512 - DNA, 20 bp, Artificial Sequence
  sgRNA
  Pcdhb10_14
ggcgcagaagagttctgcaa

SEQ ID NO: 47513 - DNA, 20 bp, Artificial Sequence
  sgRNA
  Pcdhb10_15
ccaccacgagtaccaaagcc

SEQ ID NO: 47514 - DNA, 20 bp, Artificial Sequence
  sgRNA
  Pcdhb10_16
tatagaatatataattgcat

SEQ ID NO: 47515 - DNA, 20 bp, Artificial Sequence
  sgRNA
  Pcdhb10_17
ggcaactccgtattataaca

SEQ ID NO: 47516 - DNA, 20 bp, Artificial Sequence
  sgRNA
  Pcdhb10_18
tgctaagcgcgggtgaacca

SEQ ID NO: 47517 - DNA, 20 bp, Artificial Sequence
  sgRNA
  Pcdhb10_19
tggatggtggagctccaccc

SEQ ID NO: 47518 - DNA, 20 bp, Artificial Sequence
  sgRNA
  Pcdhb10_20
gtcagctgcggatcatgggg

SEQ ID NO: 47519 - DNA, 20 bp, Artificial Sequence
  sgRNA
  Pcdhb11_1
taacaactaaggtatcaatg

SEQ ID NO: 47520 - DNA, 20 bp, Artificial Sequence
  sgRNA
  Pcdhb11_2
agcgactgtgagtaatgacg

SEQ ID NO: 47521 - DNA, 20 bp, Artificial Sequence
  sgRNA
  Pcdhb11_3
ggtgtagtaattctcaaacg

SEQ ID NO: 47522 - DNA, 20 bp, Artificial Sequence
  sgRNA
  Pcdhb11_4
gttggagaactggccactag

SEQ ID NO: 47523 - DNA, 20 bp, Artificial Sequence
  sgRNA
  Pcdhb11_5
tctccattaaccccgacaac

SEQ ID NO: 47524 - DNA, 20 bp, Artificial Sequence
  sgRNA
  Pcdhb11_6
taacatccatcaggtggcca

SEQ ID NO: 47525 - DNA, 20 bp, Artificial Sequence
  sgRNA
  Pcdhb11_7
gtaacaactaaggtatcaat

SEQ ID NO: 47526 - DNA, 20 bp, Artificial Sequence
  sgRNA
  Pcdhb11_8
actggactatgaatccctgc

SEQ ID NO: 47527 - DNA, 20 bp, Artificial Sequence
  sgRNA
  Pcdhb11_9
ggggttaatggagattagcg

SEQ ID NO: 47528 - DNA, 20 bp, Artificial Sequence
  sgRNA
  Pcdhb11_10
agcaaagagctggatttcga

SEQ ID NO: 47529 - DNA, 20 bp, Artificial Sequence
  sgRNA
  Pcdhb11_11
cggagcacccccatccagag

SEQ ID NO: 47530 - DNA, 20 bp, Artificial Sequence
  sgRNA
  Pcdhb11_12
ggcacaggaccccattcagg

SEQ ID NO: 47531 - DNA, 20 bp, Artificial Sequence
  sgRNA
  Pcdhb11_13
agttgttacagtctctgcca

SEQ ID NO: 47532 - DNA, 20 bp, Artificial Sequence
  sgRNA
  Pcdhb11_14
cttggtctgtggcgcctacg

SEQ ID NO: 47533 - DNA, 20 bp, Artificial Sequence
  sgRNA
  Pcdhb11_15
aatccgtcttagcaaagagc

SEQ ID NO: 47534 - DNA, 20 bp, Artificial Sequence
  sgRNA
  Pcdhb11_16
ccacttccctggccacctga

SEQ ID NO: 47535 - DNA, 20 bp, Artificial Sequence
  sgRNA
  Pcdhb11_17
gtgacactggcagagagctg

SEQ ID NO: 47536 - DNA, 20 bp, Artificial Sequence
  sgRNA
  Pcdhb11_18
aatggagattagcgaggcaa

SEQ ID NO: 47537 - DNA, 20 bp, Artificial Sequence
  sgRNA
  Pcdhb11_19
cagttccgctaacatccatc

SEQ ID NO: 47538 - DNA, 20 bp, Artificial Sequence
  sgRNA
  Pcdhb11_20
gtgacttcatctattacaaa

SEQ ID NO: 47539 - DNA, 20 bp, Artificial Sequence
  sgRNA
  Pcdhb12_1
tcccaacatccatttccatg

SEQ ID NO: 47540 - DNA, 20 bp, Artificial Sequence
  sgRNA
  Pcdhb12_2
ggagctcaaatccattacag

SEQ ID NO: 47541 - DNA, 20 bp, Artificial Sequence
  sgRNA
  Pcdhb12_3
actgatggtgcctatatgca

SEQ ID NO: 47542 - DNA, 20 bp, Artificial Sequence
  sgRNA
  Pcdhb12_4
tatcccagcatctaagtccg

SEQ ID NO: 47543 - DNA, 20 bp, Artificial Sequence
  sgRNA
  Pcdhb12_5
aggtacagagtaatcaccca

SEQ ID NO: 47544 - DNA, 20 bp, Artificial Sequence
  sgRNA
  Pcdhb12_6
gccagctgtgaatcgtgggg

SEQ ID NO: 47545 - DNA, 20 bp, Artificial Sequence
  sgRNA
  Pcdhb12_7
tggtggatgtcagtagagca

SEQ ID NO: 47546 - DNA, 20 bp, Artificial Sequence
  sgRNA
  Pcdhb12_8
ctagcactaccacacgcacg

SEQ ID NO: 47547 - DNA, 20 bp, Artificial Sequence
  sgRNA
  Pcdhb12_9
ggtgattactctgtacctga

SEQ ID NO: 47548 - DNA, 20 bp, Artificial Sequence
  sgRNA
  Pcdhb12_10
gatggagactagcgaggcga

SEQ ID NO: 47549 - DNA, 20 bp, Artificial Sequence
  sgRNA
  Pcdhb12_11
cacgtcataatcgtcctgcg

SEQ ID NO: 47550 - DNA, 20 bp, Artificial Sequence
  sgRNA
  Pcdhb12_12
tagcactaccacacgcacga

SEQ ID NO: 47551 - DNA, 20 bp, Artificial Sequence
  sgRNA
  Pcdhb12_13
ggtggcgcgggattccacgc

SEQ ID NO: 47552 - DNA, 20 bp, Artificial Sequence
  sgRNA
  Pcdhb12_14
acactttcctagccacctgg

SEQ ID NO: 47553 - DNA, 20 bp, Artificial Sequence
  sgRNA
  Pcdhb12_15
gatggtgcctatatgcaggg

SEQ ID NO: 47554 - DNA, 20 bp, Artificial Sequence
  sgRNA
  Pcdhb12_16
ctgctctactgacatccacc

SEQ ID NO: 47555 - DNA, 20 bp, Artificial Sequence
  sgRNA
  Pcdhb12_17
tttgtaatagacaaaatcac

SEQ ID NO: 47556 - DNA, 20 bp, Artificial Sequence
  sgRNA
  Pcdhb12_18
tgaattgatggagactagcg

SEQ ID NO: 47557 - DNA, 20 bp, Artificial Sequence
  sgRNA
  Pcdhb12_19
tatgaggtgtgtcttaatgg

SEQ ID NO: 47558 - DNA, 20 bp, Artificial Sequence
  sgRNA
  Pcdhb12_20
ctgtacggagctattgccca

SEQ ID NO: 47559 - DNA, 20 bp, Artificial Sequence
  sgRNA
  Pcdhb13_1
agatataaatgacaacacgc

SEQ ID NO: 47560 - DNA, 20 bp, Artificial Sequence
  sgRNA
  Pcdhb13_2
aattcgactgaaaagcacgt

SEQ ID NO: 47561 - DNA, 20 bp, Artificial Sequence
  sgRNA
  Pcdhb13_3
ccaacctgactaagcacttg

SEQ ID NO: 47562 - DNA, 20 bp, Artificial Sequence
  sgRNA
  Pcdhb13_4
tgcgattgcgagtgagcacg

SEQ ID NO: 47563 - DNA, 20 bp, Artificial Sequence
  sgRNA
  Pcdhb13_5
cttggtctgtggcgtctacg

SEQ ID NO: 47564 - DNA, 20 bp, Artificial Sequence
  sgRNA
  Pcdhb13_6
cccatccctgaaaatttgcc

SEQ ID NO: 47565 - DNA, 20 bp, Artificial Sequence
  sgRNA
  Pcdhb13_7
ccataagacacctccccaaa

SEQ ID NO: 47566 - DNA, 20 bp, Artificial Sequence
  sgRNA
  Pcdhb13_8
gctgtgcaagaagttcagag

SEQ ID NO: 47567 - DNA, 20 bp, Artificial Sequence
  sgRNA
  Pcdhb13_9
caaacagcaccacagacaag

SEQ ID NO: 47568 - DNA, 20 bp, Artificial Sequence
  sgRNA
  Pcdhb13_10
gcagcttgaccctcagaccc

SEQ ID NO: 47569 - DNA, 20 bp, Artificial Sequence
  sgRNA
  Pcdhb13_11
tgtgtctgagaggagacact

SEQ ID NO: 47570 - DNA, 20 bp, Artificial Sequence
  sgRNA
  Pcdhb13_12
tctccatcaacgcagacaac

SEQ ID NO: 47571 - DNA, 20 bp, Artificial Sequence
  sgRNA
  Pcdhb13_13
gcatcaaatcctgggtctga

SEQ ID NO: 47572 - DNA, 20 bp, Artificial Sequence
  sgRNA
  Pcdhb13_14
ggactctggaaataaccagc

SEQ ID NO: 47573 - DNA, 20 bp, Artificial Sequence
  sgRNA
  Pcdhb13_15
gttcctgagaacagtcccat

SEQ ID NO: 47574 - DNA, 20 bp, Artificial Sequence
  sgRNA
  Pcdhb13_16
agatgcgctcacgttatacc

SEQ ID NO: 47575 - DNA, 20 bp, Artificial Sequence
  sgRNA
  Pcdhb13_17
ctatggaacacataacctgc

SEQ ID NO: 47576 - DNA, 20 bp, Artificial Sequence
  sgRNA
  Pcdhb13_18
agcattccagtcttaccatg

SEQ ID NO: 47577 - DNA, 20 bp, Artificial Sequence
  sgRNA
  Pcdhb13_19
atatcagaaatagctccacc

SEQ ID NO: 47578 - DNA, 20 bp, Artificial Sequence
  sgRNA
  Pcdhb13_20
aattcagtatgccatgctgg

SEQ ID NO: 47579 - DNA, 20 bp, Artificial Sequence
  sgRNA
  Pcdhb15_1
aaattagagacagagattcg

SEQ ID NO: 47580 - DNA, 20 bp, Artificial Sequence
  sgRNA
  Pcdhb15_2
cccacatcacctactcgttg

SEQ ID NO: 47581 - DNA, 20 bp, Artificial Sequence
  sgRNA
  Pcdhb15_3
aagtgactgcacgaattgag

SEQ ID NO: 47582 - DNA, 20 bp, Artificial Sequence
  sgRNA
  Pcdhb15_4
agggcacaggatgccgatgt

SEQ ID NO: 47583 - DNA, 20 bp, Artificial Sequence
  sgRNA
  Pcdhb15_5
tcgctcgcttagtagcctgg

SEQ ID NO: 47584 - DNA, 20 bp, Artificial Sequence
  sgRNA
  Pcdhb15_6
gctcatcatcttcttgtgca

SEQ ID NO: 47585 - DNA, 20 bp, Artificial Sequence
  sgRNA
  Pcdhb15_7
gtatctgtgctgctgttcgt

SEQ ID NO: 47586 - DNA, 20 bp, Artificial Sequence
  sgRNA
  Pcdhb15_8
tttcgtcctgaagccatctg

SEQ ID NO: 47587 - DNA, 20 bp, Artificial Sequence
  sgRNA
  Pcdhb15_9
tatcagaaagtaccactcca

SEQ ID NO: 47588 - DNA, 20 bp, Artificial Sequence
  sgRNA
  Pcdhb15_10
ttactgctcagtccgcttac

SEQ ID NO: 47589 - DNA, 20 bp, Artificial Sequence
  sgRNA
  Pcdhb15_11
gcagcgcgataaatctgaaa

SEQ ID NO: 47590 - DNA, 20 bp, Artificial Sequence
  sgRNA
  Pcdhb15_12
ggcgacgcttctcttggaaa

SEQ ID NO: 47591 - DNA, 20 bp, Artificial Sequence
  sgRNA
  Pcdhb15_13
gcttcagtattctgtggcag

SEQ ID NO: 47592 - DNA, 20 bp, Artificial Sequence
  sgRNA
  Pcdhb15_14
acagatggcttcaggacgaa

SEQ ID NO: 47593 - DNA, 20 bp, Artificial Sequence
  sgRNA
  Pcdhb15_15
acttcctaaccgaaagcaca

SEQ ID NO: 47594 - DNA, 20 bp, Artificial Sequence
  sgRNA
  Pcdhb15_16
aaggctgtcccagatctggg

SEQ ID NO: 47595 - DNA, 20 bp, Artificial Sequence
  sgRNA
  Pcdhb15_17
gcgacaaccaaggagccaac

SEQ ID NO: 47596 - DNA, 20 bp, Artificial Sequence
  sgRNA
  Pcdhb15_18
cgaacagcttcagtattctg

SEQ ID NO: 47597 - DNA, 20 bp, Artificial Sequence
  sgRNA
  Pcdhb15_19
agtaccagttcaggaatgat

SEQ ID NO: 47598 - DNA, 20 bp, Artificial Sequence
  sgRNA
  Pcdhb15_20
aacttcctaaccgaaagcac

SEQ ID NO: 47599 - DNA, 20 bp, Artificial Sequence
  sgRNA
  Pcdhb16_1
ttacaaagcacagatccctg

SEQ ID NO: 47600 - DNA, 20 bp, Artificial Sequence
  sgRNA
  Pcdhb16_2
aaacttaccagaaaccatgg

SEQ ID NO: 47601 - DNA, 20 bp, Artificial Sequence
  sgRNA
  Pcdhb16_3
atcgcacttcccctgtcaag

SEQ ID NO: 47602 - DNA, 20 bp, Artificial Sequence
  sgRNA
  Pcdhb16_4
tcagcttgaaaaatatccaa

SEQ ID NO: 47603 - DNA, 20 bp, Artificial Sequence
  sgRNA
  Pcdhb16_5
gttcccctgcagtcgttaga

SEQ ID NO: 47604 - DNA, 20 bp, Artificial Sequence
  sgRNA
  Pcdhb16_6
cagcttgaaaaatatccaag

SEQ ID NO: 47605 - DNA, 20 bp, Artificial Sequence
  sgRNA
  Pcdhb16_7
gctacactctctctgtccag

SEQ ID NO: 47606 - DNA, 20 bp, Artificial Sequence
  sgRNA
  Pcdhb16_8
atattgaagcaagagacgct

SEQ ID NO: 47607 - DNA, 20 bp, Artificial Sequence
  sgRNA
  Pcdhb16_9
actggtactagacagagcac

SEQ ID NO: 47608 - DNA, 20 bp, Artificial Sequence
  sgRNA
  Pcdhb16_10
ccatcaccgttgcagacatg

SEQ ID NO: 47609 - DNA, 20 bp, Artificial Sequence
  sgRNA
  Pcdhb16_11
gttgttctcacggatgaaca

SEQ ID NO: 47610 - DNA, 20 bp, Artificial Sequence
  sgRNA
  Pcdhb16_12
gcttccctctaacgactgca

SEQ ID NO: 47611 - DNA, 20 bp, Artificial Sequence
  sgRNA
  Pcdhb16_13
gggactccccatgtctgcaa

SEQ ID NO: 47612 - DNA, 20 bp, Artificial Sequence
  sgRNA
  Pcdhb16_14
acttcagtggttccagacct

SEQ ID NO: 47613 - DNA, 20 bp, Artificial Sequence
  sgRNA
  Pcdhb16_15
agcctattggactatcctca

SEQ ID NO: 47614 - DNA, 20 bp, Artificial Sequence
  sgRNA
  Pcdhb16_16
atattggtagctctgagaca

SEQ ID NO: 47615 - DNA, 20 bp, Artificial Sequence
  sgRNA
  Pcdhb16_17
agcgcgatgtgcacaagcac

SEQ ID NO: 47616 - DNA, 20 bp, Artificial Sequence
  sgRNA
  Pcdhb16_18
gtctcagagctaccaatatg

SEQ ID NO: 47617 - DNA, 20 bp, Artificial Sequence
  sgRNA
  Pcdhb16_19
ttcaatccaccccttgacag

SEQ ID NO: 47618 - DNA, 20 bp, Artificial Sequence
  sgRNA
  Pcdhb16_20
tctgcaaatgagcttcctgc

SEQ ID NO: 47619 - DNA, 20 bp, Artificial Sequence
  sgRNA
  Pcdhb17_1
gtagaacacacggctcaatg

SEQ ID NO: 47620 - DNA, 20 bp, Artificial Sequence
  sgRNA
  Pcdhb17_2
gattcggctacgaaaagagg

SEQ ID NO: 47621 - DNA, 20 bp, Artificial Sequence
  sgRNA
  Pcdhb17_3
aacagcaactacctcgtccg

SEQ ID NO: 47622 - DNA, 20 bp, Artificial Sequence
  sgRNA
  Pcdhb17_4
gtgagtaccagagaaccggt

SEQ ID NO: 47623 - DNA, 20 bp, Artificial Sequence
  sgRNA
  Pcdhb17_5
tagagcgtcctcatcgtgcg

SEQ ID NO: 47624 - DNA, 20 bp, Artificial Sequence
  sgRNA
  Pcdhb17_6
ggtacttcctgccatcactg

SEQ ID NO: 47625 - DNA, 20 bp, Artificial Sequence
  sgRNA
  Pcdhb17_7
agtggttattccgtgcctga

SEQ ID NO: 47626 - DNA, 20 bp, Artificial Sequence
  sgRNA
  Pcdhb17_8
ggcagagatatccaatcgca

SEQ ID NO: 47627 - DNA, 20 bp, Artificial Sequence
  sgRNA
  Pcdhb17_9
cacggaataaccactcagag

SEQ ID NO: 47628 - DNA, 20 bp, Artificial Sequence
  sgRNA
  Pcdhb17_10
tcaacaatatccagacctat

SEQ ID NO: 47629 - DNA, 20 bp, Artificial Sequence
  sgRNA
  Pcdhb17_11
ttagaagtaaaccctgtaac

SEQ ID NO: 47630 - DNA, 20 bp, Artificial Sequence
  sgRNA
  Pcdhb17_12
attcccgagaacagtcccac

SEQ ID NO: 47631 - DNA, 20 bp, Artificial Sequence
  sgRNA
  Pcdhb17_13
tgagagacctcccccatccg

SEQ ID NO: 47632 - DNA, 20 bp, Artificial Sequence
  sgRNA
  Pcdhb17_14
acctgtgccgtcccagaccg

SEQ ID NO: 47633 - DNA, 20 bp, Artificial Sequence
  sgRNA
  Pcdhb17_15
atttctctttcactgaacac

SEQ ID NO: 47634 - DNA, 20 bp, Artificial Sequence
  sgRNA
  Pcdhb17_16
gctcctttgtggcaaatctt

SEQ ID NO: 47635 - DNA, 20 bp, Artificial Sequence
  sgRNA
  Pcdhb17_17
ttaactctgacagctttgga

SEQ ID NO: 47636 - DNA, 20 bp, Artificial Sequence
  sgRNA
  Pcdhb17_18
ggagaaagaactggatcgag

SEQ ID NO: 47637 - DNA, 20 bp, Artificial Sequence
  sgRNA
  Pcdhb17_19
agtgccacagactctgacgc

SEQ ID NO: 47638 - DNA, 20 bp, Artificial Sequence
  sgRNA
  Pcdhb17_20
cagcctgaaatacctctaaa

SEQ ID NO: 47639 - DNA, 20 bp, Artificial Sequence
  sgRNA
  Pcdhb18_1
taggatgtaaaaattgtcca

SEQ ID NO: 47640 - DNA, 20 bp, Artificial Sequence
  sgRNA
  Pcdhb18_2
atttgtggcgaacctagcaa

SEQ ID NO: 47641 - DNA, 20 bp, Artificial Sequence
  sgRNA
  Pcdhb18_3
gaaccgtacatctcgccgaa

SEQ ID NO: 47642 - DNA, 20 bp, Artificial Sequence
  sgRNA
  Pcdhb18_4
cagcccggtaaatctgaaag

SEQ ID NO: 47643 - DNA, 20 bp, Artificial Sequence
  sgRNA
  Pcdhb18_5
gggcctttcggcgagatgta

SEQ ID NO: 47644 - DNA, 20 bp, Artificial Sequence
  sgRNA
  Pcdhb18_6
ggacaccttgtggacgtcag

SEQ ID NO: 47645 - DNA, 20 bp, Artificial Sequence
  sgRNA
  Pcdhb18_7
gctccagaaaacagtccaat

SEQ ID NO: 47646 - DNA, 20 bp, Artificial Sequence
  sgRNA
  Pcdhb18_8
atagtggctgtcccagacct

SEQ ID NO: 47647 - DNA, 20 bp, Artificial Sequence
  sgRNA
  Pcdhb18_9
tgatgacatgatcagttcag

SEQ ID NO: 47648 - DNA, 20 bp, Artificial Sequence
  sgRNA
  Pcdhb18_10
ttaatgacaacaaggcctat

SEQ ID NO: 47649 - DNA, 20 bp, Artificial Sequence
  sgRNA
  Pcdhb18_11
tggcgcacaatcccactcaa

SEQ ID NO: 47650 - DNA, 20 bp, Artificial Sequence
  sgRNA
  Pcdhb18_12
tggacgttattcagtgactg

SEQ ID NO: 47651 - DNA, 20 bp, Artificial Sequence
  sgRNA
  Pcdhb18_13
gttgttctcgcgaacgaaca

SEQ ID NO: 47652 - DNA, 20 bp, Artificial Sequence
  sgRNA
  Pcdhb18_14
agagcacaagactcagatgg

SEQ ID NO: 47653 - DNA, 20 bp, Artificial Sequence
  sgRNA
  Pcdhb18_15
ctagccctagatcctttgct

SEQ ID NO: 47654 - DNA, 20 bp, Artificial Sequence
  sgRNA
  Pcdhb18_16
tatgaggtgtgtctaatggg

SEQ ID NO: 47655 - DNA, 20 bp, Artificial Sequence
  sgRNA
  Pcdhb18_17
gatagagaccagcgaggtga

SEQ ID NO: 47656 - DNA, 20 bp, Artificial Sequence
  sgRNA
  Pcdhb18_18
ctatttctcttcctgctcgg

SEQ ID NO: 47657 - DNA, 20 bp, Artificial Sequence
  sgRNA
  Pcdhb18_19
ctgtaccgctgacgtccaca

SEQ ID NO: 47658 - DNA, 20 bp, Artificial Sequence
  sgRNA
  Pcdhb18_20
ggcgcacaatcccactcaag

SEQ ID NO: 47659 - DNA, 20 bp, Artificial Sequence
  sgRNA
  Pcdhb19_1
gattaactctcatggtaacg

SEQ ID NO: 47660 - DNA, 20 bp, Artificial Sequence
  sgRNA
  Pcdhb19_2
atggtgtgtactattccgga

SEQ ID NO: 47661 - DNA, 20 bp, Artificial Sequence
  sgRNA
  Pcdhb19_3
tgagtctaaatcccaagccg

SEQ ID NO: 47662 - DNA, 20 bp, Artificial Sequence
  sgRNA
  Pcdhb19_4
attaaagctactgatcgggg

SEQ ID NO: 47663 - DNA, 20 bp, Artificial Sequence
  sgRNA
  Pcdhb19_5
gaacatgtggtcaaactcgg

SEQ ID NO: 47664 - DNA, 20 bp, Artificial Sequence
  sgRNA
  Pcdhb19_6
gatggtgtgtactattccgg

SEQ ID NO: 47665 - DNA, 20 bp, Artificial Sequence
  sgRNA
  Pcdhb19_7
gtgctccatccgtttctaag

SEQ ID NO: 47666 - DNA, 20 bp, Artificial Sequence
  sgRNA
  Pcdhb19_8
taatatctatgacctccact

SEQ ID NO: 47667 - DNA, 20 bp, Artificial Sequence
  sgRNA
  Pcdhb19_9
tgagagttaatcccgatggc

SEQ ID NO: 47668 - DNA, 20 bp, Artificial Sequence
  sgRNA
  Pcdhb19_10
gcgcaatccagcgcacgaag

SEQ ID NO: 47669 - DNA, 20 bp, Artificial Sequence
  sgRNA
  Pcdhb19_11
gtatttatgttcaattgcaa

SEQ ID NO: 47670 - DNA, 20 bp, Artificial Sequence
  sgRNA
  Pcdhb19_12
aaattactaccacttagaaa

SEQ ID NO: 47671 - DNA, 20 bp, Artificial Sequence
  sgRNA
  Pcdhb19_13
ggacaaggcgctggattacg

SEQ ID NO: 47672 - DNA, 20 bp, Artificial Sequence
  sgRNA
  Pcdhb19_14
ccttagtgaaccgctggaca

SEQ ID NO: 47673 - DNA, 20 bp, Artificial Sequence
  sgRNA
  Pcdhb19_15
agtgcgatcgatttagatgt

SEQ ID NO: 47674 - DNA, 20 bp, Artificial Sequence
  sgRNA
  Pcdhb19_16
gttgttctcatggaaaaaca

SEQ ID NO: 47675 - DNA, 20 bp, Artificial Sequence
  sgRNA
  Pcdhb19_17
taatcattaaagctactgat

SEQ ID NO: 47676 - DNA, 20 bp, Artificial Sequence
  sgRNA
  Pcdhb19_18
cacagctcctccctgtccag

SEQ ID NO: 47677 - DNA, 20 bp, Artificial Sequence
  sgRNA
  Pcdhb19_19
gcgaggagagggccatttga

SEQ ID NO: 47678 - DNA, 20 bp, Artificial Sequence
  sgRNA
  Pcdhb19_20
atttctttcccagggaactg

SEQ ID NO: 47679 - DNA, 20 bp, Artificial Sequence
  sgRNA
  Pcdhb2_1
gaccgcgagtcatttccaaa

SEQ ID NO: 47680 - DNA, 20 bp, Artificial Sequence
  sgRNA
  Pcdhb2_2
tgggatgtgattggtaaatg

SEQ ID NO: 47681 - DNA, 20 bp, Artificial Sequence
  sgRNA
  Pcdhb2_3
aggcgtaagctatatttcca

SEQ ID NO: 47682 - DNA, 20 bp, Artificial Sequence
  sgRNA
  Pcdhb2_4
tagatggtgggaatccaccc

SEQ ID NO: 47683 - DNA, 20 bp, Artificial Sequence
  sgRNA
  Pcdhb2_5
gcgaagctttgaaaacaccg

SEQ ID NO: 47684 - DNA, 20 bp, Artificial Sequence
  sgRNA
  Pcdhb2_6
tgatctggtctctcgatcca

SEQ ID NO: 47685 - DNA, 20 bp, Artificial Sequence
  sgRNA
  Pcdhb2_7
gtagaggaactcgctgcacg

SEQ ID NO: 47686 - DNA, 20 bp, Artificial Sequence
  sgRNA
  Pcdhb2_8
aattaggcgctattccgtgg

SEQ ID NO: 47687 - DNA, 20 bp, Artificial Sequence
  sgRNA
  Pcdhb2_9
gtatgtcctcatcttgggca

SEQ ID NO: 47688 - DNA, 20 bp, Artificial Sequence
  sgRNA
  Pcdhb2_10
tggtagatgttggcggcgcg

SEQ ID NO: 47689 - DNA, 20 bp, Artificial Sequence
  sgRNA
  Pcdhb2_11
gcacagaagagttctgtagt

SEQ ID NO: 47690 - DNA, 20 bp, Artificial Sequence
  sgRNA
  Pcdhb2_12
atattgataactctgggaca

SEQ ID NO: 47691 - DNA, 20 bp, Artificial Sequence
  sgRNA
  Pcdhb2_13
ggaccgcgagtcatttccaa

SEQ ID NO: 47692 - DNA, 20 bp, Artificial Sequence
  sgRNA
  Pcdhb2_14
gtgtaaaagttctcaaatga

SEQ ID NO: 47693 - DNA, 20 bp, Artificial Sequence
  sgRNA
  Pcdhb2_15
gcccacctggtagatgttgg

SEQ ID NO: 47694 - DNA, 20 bp, Artificial Sequence
  sgRNA
  Pcdhb2_16
gtagcaacctgggatccaac

SEQ ID NO: 47695 - DNA, 20 bp, Artificial Sequence
  sgRNA
  Pcdhb2_17
atttggacggtgccagacct

SEQ ID NO: 47696 - DNA, 20 bp, Artificial Sequence
  sgRNA
  Pcdhb2_18
tgatgtctaagacttcaata

SEQ ID NO: 47697 - DNA, 20 bp, Artificial Sequence
  sgRNA
  Pcdhb2_19
ggttgctactgtctctgcta

SEQ ID NO: 47698 - DNA, 20 bp, Artificial Sequence
  sgRNA
  Pcdhb2_20
ccgcgccgccaacatctacc

SEQ ID NO: 47699 - DNA, 20 bp, Artificial Sequence
  sgRNA
  Pcdhb20_1
tggcgatggaaagatatacc

SEQ ID NO: 47700 - DNA, 20 bp, Artificial Sequence
  sgRNA
  Pcdhb20_2
gacactgaatagagcgacca

SEQ ID NO: 47701 - DNA, 20 bp, Artificial Sequence
  sgRNA
  Pcdhb20_3
cagctcgatagaactgtaag

SEQ ID NO: 47702 - DNA, 20 bp, Artificial Sequence
  sgRNA
  Pcdhb20_4
tggcaaaggatttaggactg

SEQ ID NO: 47703 - DNA, 20 bp, Artificial Sequence
  sgRNA
  Pcdhb20_5
ggtcatcctgaatagagcaa

SEQ ID NO: 47704 - DNA, 20 bp, Artificial Sequence
  sgRNA
  Pcdhb20_6
gttcgctcagagtttctatg

SEQ ID NO: 47705 - DNA, 20 bp, Artificial Sequence
  sgRNA
  Pcdhb20_7
aagactctggagacaacgga

SEQ ID NO: 47706 - DNA, 20 bp, Artificial Sequence
  sgRNA
  Pcdhb20_8
ctacctggtcaccaaagtag

SEQ ID NO: 47707 - DNA, 20 bp, Artificial Sequence
  sgRNA
  Pcdhb20_9
attatcatctgacactaccc

SEQ ID NO: 47708 - DNA, 20 bp, Artificial Sequence
  sgRNA
  Pcdhb20_10
tttgcgctattctgtagcag

SEQ ID NO: 47709 - DNA, 20 bp, Artificial Sequence
  sgRNA
  Pcdhb20_11
accagaagtgatcatgtcgt

SEQ ID NO: 47710 - DNA, 20 bp, Artificial Sequence
  sgRNA
  Pcdhb20_12
tatgctcctgaatgagcgac

SEQ ID NO: 47711 - DNA, 20 bp, Artificial Sequence
  sgRNA
  Pcdhb20_13
gtaaatatccaagcaacaga

SEQ ID NO: 47712 - DNA, 20 bp, Artificial Sequence
  sgRNA
  Pcdhb20_14
ctatgaggtgcaggtcccag

SEQ ID NO: 47713 - DNA, 20 bp, Artificial Sequence
  sgRNA
  Pcdhb20_15
tcagctcgatagaactgtaa

SEQ ID NO: 47714 - DNA, 20 bp, Artificial Sequence
  sgRNA
  Pcdhb20_16
atatcagaaagcactactat

SEQ ID NO: 47715 - DNA, 20 bp, Artificial Sequence
  sgRNA
  Pcdhb20_17
catcacctactcgctgctac

SEQ ID NO: 47716 - DNA, 20 bp, Artificial Sequence
  sgRNA
  Pcdhb20_18
gttgttctcgtagatgaaca

SEQ ID NO: 47717 - DNA, 20 bp, Artificial Sequence
  sgRNA
  Pcdhb20_19
ggaggtttgggtgaaggccg

SEQ ID NO: 47718 - DNA, 20 bp, Artificial Sequence
  sgRNA
  Pcdhb20_20
tatgaggtgtgtttcacagg

SEQ ID NO: 47719 - DNA, 20 bp, Artificial Sequence
  sgRNA
  Pcdhb22_1
cagtctatagaagttctcaa

SEQ ID NO: 47720 - DNA, 20 bp, Artificial Sequence
  sgRNA
  Pcdhb22_2
tgacatccaagacaacaatg

SEQ ID NO: 47721 - DNA, 20 bp, Artificial Sequence
  sgRNA
  Pcdhb22_3
gtagaaacgcagtgccaaca

SEQ ID NO: 47722 - DNA, 20 bp, Artificial Sequence
  sgRNA
  Pcdhb22_4
acttggaaatgagtgacaca

SEQ ID NO: 47723 - DNA, 20 bp, Artificial Sequence
  sgRNA
  Pcdhb22_5
ttagcaaccatggaacccga

SEQ ID NO: 47724 - DNA, 20 bp, Artificial Sequence
  sgRNA
  Pcdhb22_6
ggacaaggagctcgatcgcg

SEQ ID NO: 47725 - DNA, 20 bp, Artificial Sequence
  sgRNA
  Pcdhb22_7
agtgtgacgctagcagagcg

SEQ ID NO: 47726 - DNA, 20 bp, Artificial Sequence
  sgRNA
  Pcdhb22_8
catgtttccatccgcaaccg

SEQ ID NO: 47727 - DNA, 20 bp, Artificial Sequence
  sgRNA
  Pcdhb22_9
gtttgcacaggctttctacc

SEQ ID NO: 47728 - DNA, 20 bp, Artificial Sequence
  sgRNA
  Pcdhb22_10
agtgttactgaaaaaaccac

SEQ ID NO: 47729 - DNA, 20 bp, Artificial Sequence
  sgRNA
  Pcdhb22_11
tctacaataccagaaaacac

SEQ ID NO: 47730 - DNA, 20 bp, Artificial Sequence
  sgRNA
  Pcdhb22_12
cctccatcacaaagtagcgg

SEQ ID NO: 47731 - DNA, 20 bp, Artificial Sequence
  sgRNA
  Pcdhb22_13
ctatagaagttctcaacgga

SEQ ID NO: 47732 - DNA, 20 bp, Artificial Sequence
  sgRNA
  Pcdhb22_14
tccatcacaaagtagcggcg

SEQ ID NO: 47733 - DNA, 20 bp, Artificial Sequence
  sgRNA
  Pcdhb22_15
tggagccgcacagctcctcg

SEQ ID NO: 47734 - DNA, 20 bp, Artificial Sequence
  sgRNA
  Pcdhb22_16
ttaactctgacagcgctaga

SEQ ID NO: 47735 - DNA, 20 bp, Artificial Sequence
  sgRNA
  Pcdhb22_17
tgttctctggaatttgcacc

SEQ ID NO: 47736 - DNA, 20 bp, Artificial Sequence
  sgRNA
  Pcdhb22_18
gtgatggaggaaacacccag

SEQ ID NO: 47737 - DNA, 20 bp, Artificial Sequence
  sgRNA
  Pcdhb22_19
gacaacaatgcggatttgcg

SEQ ID NO: 47738 - DNA, 20 bp, Artificial Sequence
  sgRNA
  Pcdhb22_20
ggtattgtagaccaaaacta

SEQ ID NO: 47739 - DNA, 20 bp, Artificial Sequence
  sgRNA
  Pcdhb3_1
acctgggtagttccagaacg

SEQ ID NO: 47740 - DNA, 20 bp, Artificial Sequence
  sgRNA
  Pcdhb3_2
ccaaacttcctacaccatgt

SEQ ID NO: 47741 - DNA, 20 bp, Artificial Sequence
  sgRNA
  Pcdhb3_3
tcatttgtaataaactgcaa

SEQ ID NO: 47742 - DNA, 20 bp, Artificial Sequence
  sgRNA
  Pcdhb3_4
tgatggagatgagtgaatcg

SEQ ID NO: 47743 - DNA, 20 bp, Artificial Sequence
  sgRNA
  Pcdhb3_5
cgactccgtccaaaacgacg

SEQ ID NO: 47744 - DNA, 20 bp, Artificial Sequence
  sgRNA
  Pcdhb3_6
ggtagttccagaacgaggcg

SEQ ID NO: 47745 - DNA, 20 bp, Artificial Sequence
  sgRNA
  Pcdhb3_7
tgttcacacccgccgtcgca

SEQ ID NO: 47746 - DNA, 20 bp, Artificial Sequence
  sgRNA
  Pcdhb3_8
tctatactatagcgtccgaa

SEQ ID NO: 47747 - DNA, 20 bp, Artificial Sequence
  sgRNA
  Pcdhb3_9
cgtaatagccaatttagcga

SEQ ID NO: 47748 - DNA, 20 bp, Artificial Sequence
  sgRNA
  Pcdhb3_10
agttgagaaattggaccggg

SEQ ID NO: 47749 - DNA, 20 bp, Artificial Sequence
  sgRNA
  Pcdhb3_11
gatggagatgagtgaatcga

SEQ ID NO: 47750 - DNA, 20 bp, Artificial Sequence
  sgRNA
  Pcdhb3_12
atttcccgtatccaagtcag

SEQ ID NO: 47751 - DNA, 20 bp, Artificial Sequence
  sgRNA
  Pcdhb3_13
ggtaatatacagctacttaa

SEQ ID NO: 47752 - DNA, 20 bp, Artificial Sequence
  sgRNA
  Pcdhb3_14
gtatagaagttctctacaga

SEQ ID NO: 47753 - DNA, 20 bp, Artificial Sequence
  sgRNA
  Pcdhb3_15
aggtccacggcatttcccaa

SEQ ID NO: 47754 - DNA, 20 bp, Artificial Sequence
  sgRNA
  Pcdhb3_16
tcttccatccctgcgacggc

SEQ ID NO: 47755 - DNA, 20 bp, Artificial Sequence
  sgRNA
  Pcdhb3_17
gtgaacatgaaaatgagacg

SEQ ID NO: 47756 - DNA, 20 bp, Artificial Sequence
  sgRNA
  Pcdhb3_18
aggcggggatcctccatcca

SEQ ID NO: 47757 - DNA, 20 bp, Artificial Sequence
  sgRNA
  Pcdhb3_19
gcctcgttctggaactaccc

SEQ ID NO: 47758 - DNA, 20 bp, Artificial Sequence
  sgRNA
  Pcdhb3_20
gtggtaatgacagagccaat

SEQ ID NO: 47759 - DNA, 20 bp, Artificial Sequence
  sgRNA
  Pcdhb4_1
aactgcaacgacagtctctg

SEQ ID NO: 47760 - DNA, 20 bp, Artificial Sequence
  sgRNA
  Pcdhb4_2
tggatgggggagctccacga

SEQ ID NO: 47761 - DNA, 20 bp, Artificial Sequence
  sgRNA
  Pcdhb4_3
aggaaaaattagaccgtgag

SEQ ID NO: 47762 - DNA, 20 bp, Artificial Sequence
  sgRNA
  Pcdhb4_4
attatactttagcgacagag

SEQ ID NO: 47763 - DNA, 20 bp, Artificial Sequence
  sgRNA
  Pcdhb4_5
gcgatactctctctatccag

SEQ ID NO: 47764 - DNA, 20 bp, Artificial Sequence
  sgRNA
  Pcdhb4_6
gtaggaggtttgcgtgaagg

SEQ ID NO: 47765 - DNA, 20 bp, Artificial Sequence
  sgRNA
  Pcdhb4_7
gtttgtacaatcgctctatg

SEQ ID NO: 47766 - DNA, 20 bp, Artificial Sequence
  sgRNA
  Pcdhb4_8
taatgtggaaatcgcagcca

SEQ ID NO: 47767 - DNA, 20 bp, Artificial Sequence
  sgRNA
  Pcdhb4_9
tgaaagtccccctccatccg

SEQ ID NO: 47768 - DNA, 20 bp, Artificial Sequence
  sgRNA
  Pcdhb4_10
gtgacaagtaaggcatcaag

SEQ ID NO: 47769 - DNA, 20 bp, Artificial Sequence
  sgRNA
  Pcdhb4_11
tgataacgccccagagttga

SEQ ID NO: 47770 - DNA, 20 bp, Artificial Sequence
  sgRNA
  Pcdhb4_12
agaccgtgaggggctttgcg

SEQ ID NO: 47771 - DNA, 20 bp, Artificial Sequence
  sgRNA
  Pcdhb4_13
tgatccccagatcttgtgcc

SEQ ID NO: 47772 - DNA, 20 bp, Artificial Sequence
  sgRNA
  Pcdhb4_14
acttgtcacggtctctgcta

SEQ ID NO: 47773 - DNA, 20 bp, Artificial Sequence
  sgRNA
  Pcdhb4_15
ccacctggtggacgtcagcg

SEQ ID NO: 47774 - DNA, 20 bp, Artificial Sequence
  sgRNA
  Pcdhb4_16
gcgatttccacattatagta

SEQ ID NO: 47775 - DNA, 20 bp, Artificial Sequence
  sgRNA
  Pcdhb4_17
tttcatctattacaaatggt

SEQ ID NO: 47776 - DNA, 20 bp, Artificial Sequence
  sgRNA
  Pcdhb4_18
gaggcacgagtccatcacag

SEQ ID NO: 47777 - DNA, 20 bp, Artificial Sequence
  sgRNA
  Pcdhb4_19
tgacaagtaaggcatcaagg

SEQ ID NO: 47778 - DNA, 20 bp, Artificial Sequence
  sgRNA
  Pcdhb4_20
gcccatgtctgagacagtga

SEQ ID NO: 47779 - DNA, 20 bp, Artificial Sequence
  sgRNA
  Pcdhb5_1
aggggcgttgtcgttaatgt

SEQ ID NO: 47780 - DNA, 20 bp, Artificial Sequence
  sgRNA
  Pcdhb5_2
gtttgtgaacaacccctatg

SEQ ID NO: 47781 - DNA, 20 bp, Artificial Sequence
  sgRNA
  Pcdhb5_3
gctgcccacatccaaatcct

SEQ ID NO: 47782 - DNA, 20 bp, Artificial Sequence
  sgRNA
  Pcdhb5_4
ggtcgctatcatccgaatac

SEQ ID NO: 47783 - DNA, 20 bp, Artificial Sequence
  sgRNA
  Pcdhb5_5
gcagggcttcgaattctacg

SEQ ID NO: 47784 - DNA, 20 bp, Artificial Sequence
  sgRNA
  Pcdhb5_6
cagggcttcgaattctacgt

SEQ ID NO: 47785 - DNA, 20 bp, Artificial Sequence
  sgRNA
  Pcdhb5_7
gcccatagtccccaacctaa

SEQ ID NO: 47786 - DNA, 20 bp, Artificial Sequence
  sgRNA
  Pcdhb5_8
catccggatcatcctgtgcg

SEQ ID NO: 47787 - DNA, 20 bp, Artificial Sequence
  sgRNA
  Pcdhb5_9
gtgtaaaagttcttgtaaga

SEQ ID NO: 47788 - DNA, 20 bp, Artificial Sequence
  sgRNA
  Pcdhb5_10
agaaaattctccagaaactg

SEQ ID NO: 47789 - DNA, 20 bp, Artificial Sequence
  sgRNA
  Pcdhb5_11
catggctcacatccaccagg

SEQ ID NO: 47790 - DNA, 20 bp, Artificial Sequence
  sgRNA
  Pcdhb5_12
tctccatcaatgctgacaat

SEQ ID NO: 47791 - DNA, 20 bp, Artificial Sequence
  sgRNA
  Pcdhb5_13
agtaccgagtaggcaccatg

SEQ ID NO: 47792 - DNA, 20 bp, Artificial Sequence
  sgRNA
  Pcdhb5_14
tccaagacagagtaccgagt

SEQ ID NO: 47793 - DNA, 20 bp, Artificial Sequence
  sgRNA
  Pcdhb5_15
gctctgctctctctatccag

SEQ ID NO: 47794 - DNA, 20 bp, Artificial Sequence
  sgRNA
  Pcdhb5_16
tggtggatgtgagccatgca

SEQ ID NO: 47795 - DNA, 20 bp, Artificial Sequence
  sgRNA
  Pcdhb5_17
gctttgggatcaggtcctca

SEQ ID NO: 47796 - DNA, 20 bp, Artificial Sequence
  sgRNA
  Pcdhb5_18
ctgtggcctcaatttctaca

SEQ ID NO: 47797 - DNA, 20 bp, Artificial Sequence
  sgRNA
  Pcdhb5_19
gatggagatgagcgagtgga

SEQ ID NO: 47798 - DNA, 20 bp, Artificial Sequence
  sgRNA
  Pcdhb5_20
gtagaattcgaagccctgca

SEQ ID NO: 47799 - DNA, 20 bp, Artificial Sequence
  sgRNA
  Pcdhb6_1
agatcgcgaagcactatgtg

SEQ ID NO: 47800 - DNA, 20 bp, Artificial Sequence
  sgRNA
  Pcdhb6_2
cacgacttcaattcgaacag

SEQ ID NO: 47801 - DNA, 20 bp, Artificial Sequence
  sgRNA
  Pcdhb6_3
actacactttagcggcagaa

SEQ ID NO: 47802 - DNA, 20 bp, Artificial Sequence
  sgRNA
  Pcdhb6_4
tgcattgatggagaccagcg

SEQ ID NO: 47803 - DNA, 20 bp, Artificial Sequence
  sgRNA
  Pcdhb6_5
gagtgactgtacaaattcgg

SEQ ID NO: 47804 - DNA, 20 bp, Artificial Sequence
  sgRNA
  Pcdhb6_6
aggacaatggagaacctccg

SEQ ID NO: 47805 - DNA, 20 bp, Artificial Sequence
  sgRNA
  Pcdhb6_7
tgacaactaaggcatcgagg

SEQ ID NO: 47806 - DNA, 20 bp, Artificial Sequence
  sgRNA
  Pcdhb6_8
tgtacagtcactctattcgg

SEQ ID NO: 47807 - DNA, 20 bp, Artificial Sequence
  sgRNA
  Pcdhb6_9
gtgacaactaaggcatcgag

SEQ ID NO: 47808 - DNA, 20 bp, Artificial Sequence
  sgRNA
  Pcdhb6_10
agagtgacgctggcagaccg

SEQ ID NO: 47809 - DNA, 20 bp, Artificial Sequence
  sgRNA
  Pcdhb6_11
acagtcactctattcggtgg

SEQ ID NO: 47810 - DNA, 20 bp, Artificial Sequence
  sgRNA
  Pcdhb6_12
ggtgcctgctctgtgcccga

SEQ ID NO: 47811 - DNA, 20 bp, Artificial Sequence
  sgRNA
  Pcdhb6_13
tcgtgctgcacctcaggcag

SEQ ID NO: 47812 - DNA, 20 bp, Artificial Sequence
  sgRNA
  Pcdhb6_14
gctttgcaggagggtcaggg

SEQ ID NO: 47813 - DNA, 20 bp, Artificial Sequence
  sgRNA
  Pcdhb6_15
tgaaaattactacactttag

SEQ ID NO: 47814 - DNA, 20 bp, Artificial Sequence
  sgRNA
  Pcdhb6_16
cttcatgtgctgctagtgga

SEQ ID NO: 47815 - DNA, 20 bp, Artificial Sequence
  sgRNA
  Pcdhb6_17
agagtgactgtacaaattcg

SEQ ID NO: 47816 - DNA, 20 bp, Artificial Sequence
  sgRNA
  Pcdhb6_18
ccagatcgcgaagcactatg

SEQ ID NO: 47817 - DNA, 20 bp, Artificial Sequence
  sgRNA
  Pcdhb6_19
ggaactagtgagcgaagaga

SEQ ID NO: 47818 - DNA, 20 bp, Artificial Sequence
  sgRNA
  Pcdhb6_20
gctgcacctcaggcagaggc

SEQ ID NO: 47819 - DNA, 20 bp, Artificial Sequence
  sgRNA
  Pcdhb7_1
agcattaatggagattaacg

SEQ ID NO: 47820 - DNA, 20 bp, Artificial Sequence
  sgRNA
  Pcdhb7_2
ggattccggagagaatgcaa

SEQ ID NO: 47821 - DNA, 20 bp, Artificial Sequence
  sgRNA
  Pcdhb7_3
aagtcctgggctaaattcag

SEQ ID NO: 47822 - DNA, 20 bp, Artificial Sequence
  sgRNA
  Pcdhb7_4
tggatggagggtctccaccg

SEQ ID NO: 47823 - DNA, 20 bp, Artificial Sequence
  sgRNA
  Pcdhb7_5
gttaccactgaatttagccc

SEQ ID NO: 47824 - DNA, 20 bp, Artificial Sequence
  sgRNA
  Pcdhb7_6
catgctccagaatttccaga

SEQ ID NO: 47825 - DNA, 20 bp, Artificial Sequence
  sgRNA
  Pcdhb7_7
atatgaagtgtgtctgacca

SEQ ID NO: 47826 - DNA, 20 bp, Artificial Sequence
  sgRNA
  Pcdhb7_8
agaaagccctcccccatccg

SEQ ID NO: 47827 - DNA, 20 bp, Artificial Sequence
  sgRNA
  Pcdhb7_9
tgctgagcgcagatgagccg

SEQ ID NO: 47828 - DNA, 20 bp, Artificial Sequence
  sgRNA
  Pcdhb7_10
gcgactctggtcaaaatgcc

SEQ ID NO: 47829 - DNA, 20 bp, Artificial Sequence
  sgRNA
  Pcdhb7_11
aggataatggcgagcctccg

SEQ ID NO: 47830 - DNA, 20 bp, Artificial Sequence
  sgRNA
  Pcdhb7_12
aaagttgtgcaggagagcca

SEQ ID NO: 47831 - DNA, 20 bp, Artificial Sequence
  sgRNA
  Pcdhb7_13
agagtgacactggcagaccg

SEQ ID NO: 47832 - DNA, 20 bp, Artificial Sequence
  sgRNA
  Pcdhb7_14
aactcaatactctatcttag

SEQ ID NO: 47833 - DNA, 20 bp, Artificial Sequence
  sgRNA
  Pcdhb7_15
ttaaccctcatagctctgga

SEQ ID NO: 47834 - DNA, 20 bp, Artificial Sequence
  sgRNA
  Pcdhb7_16
gattggttgcaagcactcaa

SEQ ID NO: 47835 - DNA, 20 bp, Artificial Sequence
  sgRNA
  Pcdhb7_17
ccatgtgaaaattgaggcca

SEQ ID NO: 47836 - DNA, 20 bp, Artificial Sequence
  sgRNA
  Pcdhb7_18
tcccagcgtcttgaaccaac

SEQ ID NO: 47837 - DNA, 20 bp, Artificial Sequence
  sgRNA
  Pcdhb7_19
cgcggtctgtggcacccacg

SEQ ID NO: 47838 - DNA, 20 bp, Artificial Sequence
  sgRNA
  Pcdhb7_20
gcatcttcagagttggagac

SEQ ID NO: 47839 - DNA, 20 bp, Artificial Sequence
  sgRNA
  Pcdhb8_1
atggtgtgttcaattcagaa

SEQ ID NO: 47840 - DNA, 20 bp, Artificial Sequence
  sgRNA
  Pcdhb8_2
cacgacttcaatccgaacag

SEQ ID NO: 47841 - DNA, 20 bp, Artificial Sequence
  sgRNA
  Pcdhb8_3
aggagaaattcgacttaaag

SEQ ID NO: 47842 - DNA, 20 bp, Artificial Sequence
  sgRNA
  Pcdhb8_4
tggggaactgaccactagag

SEQ ID NO: 47843 - DNA, 20 bp, Artificial Sequence
  sgRNA
  Pcdhb8_5
gcgttgctctctctatccag

SEQ ID NO: 47844 - DNA, 20 bp, Artificial Sequence
  sgRNA
  Pcdhb8_6
gttcttacagtcactctatg

SEQ ID NO: 47845 - DNA, 20 bp, Artificial Sequence
  sgRNA
  Pcdhb8_7
ggggcacgaatccatcacaa

SEQ ID NO: 47846 - DNA, 20 bp, Artificial Sequence
  sgRNA
  Pcdhb8_8
ctactctctgtttcaaggcg

SEQ ID NO: 47847 - DNA, 20 bp, Artificial Sequence
  sgRNA
  Pcdhb8_9
agagcctctgagctgagcgc

SEQ ID NO: 47848 - DNA, 20 bp, Artificial Sequence
  sgRNA
  Pcdhb8_10
tgagttgatggagatcagcg

SEQ ID NO: 47849 - DNA, 20 bp, Artificial Sequence
  sgRNA
  Pcdhb8_11
gcctggctacctgatcacca

SEQ ID NO: 47850 - DNA, 20 bp, Artificial Sequence
  sgRNA
  Pcdhb8_12
gaagttgtgcaagaaggcca

SEQ ID NO: 47851 - DNA, 20 bp, Artificial Sequence
  sgRNA
  Pcdhb8_13
tggtggatgtcagtggtgcg

SEQ ID NO: 47852 - DNA, 20 bp, Artificial Sequence
  sgRNA
  Pcdhb8_14
tctccatcaactcagacaac

SEQ ID NO: 47853 - DNA, 20 bp, Artificial Sequence
  sgRNA
  Pcdhb8_15
gagtgactgtaagaactggg

SEQ ID NO: 47854 - DNA, 20 bp, Artificial Sequence
  sgRNA
  Pcdhb8_16
ttatgaggtctgtctgactg

SEQ ID NO: 47855 - DNA, 20 bp, Artificial Sequence
  sgRNA
  Pcdhb8_17
cttacagtcactctatgcgg

SEQ ID NO: 47856 - DNA, 20 bp, Artificial Sequence
  sgRNA
  Pcdhb8_18
atctccatcaactcagacaa

SEQ ID NO: 47857 - DNA, 20 bp, Artificial Sequence
  sgRNA
  Pcdhb8_19
cagtcagacagacctcataa

SEQ ID NO: 47858 - DNA, 20 bp, Artificial Sequence
  sgRNA
  Pcdhb8_20
gctgactgctctattcctga

SEQ ID NO: 47859 - DNA, 20 bp, Artificial Sequence
  sgRNA
  Pcdhb9_1
aggctctgtaacgatagagg

SEQ ID NO: 47860 - DNA, 20 bp, Artificial Sequence
  sgRNA
  Pcdhb9_2
agtcttgactgtcttagcac

SEQ ID NO: 47861 - DNA, 20 bp, Artificial Sequence
  sgRNA
  Pcdhb9_3
ggacgtgaaaataagggttg

SEQ ID NO: 47862 - DNA, 20 bp, Artificial Sequence
  sgRNA
  Pcdhb9_4
taatcgagattaacgaagag

SEQ ID NO: 47863 - DNA, 20 bp, Artificial Sequence
  sgRNA
  Pcdhb9_5
gtggaactcgaagacctgca

SEQ ID NO: 47864 - DNA, 20 bp, Artificial Sequence
  sgRNA
  Pcdhb9_6
ctaggcagcagctcagtgaa

SEQ ID NO: 47865 - DNA, 20 bp, Artificial Sequence
  sgRNA
  Pcdhb9_7
tctcgattaacgctgacaat

SEQ ID NO: 47866 - DNA, 20 bp, Artificial Sequence
  sgRNA
  Pcdhb9_8
ttacaagcagagattactgc

SEQ ID NO: 47867 - DNA, 20 bp, Artificial Sequence
  sgRNA
  Pcdhb9_9
gccagttccggatcatgggg

SEQ ID NO: 47868 - DNA, 20 bp, Artificial Sequence
  sgRNA
  Pcdhb9_10
gagtgaggacgtgaaaataa

SEQ ID NO: 47869 - DNA, 20 bp, Artificial Sequence
  sgRNA
  Pcdhb9_11
ggacgtgcttacattgtacc

SEQ ID NO: 47870 - DNA, 20 bp, Artificial Sequence
  sgRNA
  Pcdhb9_12
aattcgatactctatcttag

SEQ ID NO: 47871 - DNA, 20 bp, Artificial Sequence
  sgRNA
  Pcdhb9_13
gcgctcactcaacaacctgg

SEQ ID NO: 47872 - DNA, 20 bp, Artificial Sequence
  sgRNA
  Pcdhb9_14
cgtggccttgagcaactgga

SEQ ID NO: 47873 - DNA, 20 bp, Artificial Sequence
  sgRNA
  Pcdhb9_15
ttctcaataaacgcaactag

SEQ ID NO: 47874 - DNA, 20 bp, Artificial Sequence
  sgRNA
  Pcdhb9_16
ctccactgacatcgaccagg

SEQ ID NO: 47875 - DNA, 20 bp, Artificial Sequence
  sgRNA
  Pcdhb9_17
aagcacgtcctcatcttcat

SEQ ID NO: 47876 - DNA, 20 bp, Artificial Sequence
  sgRNA
  Pcdhb9_18
tggtcgatgtcagtggagca

SEQ ID NO: 47877 - DNA, 20 bp, Artificial Sequence
  sgRNA
  Pcdhb9_19
ttaaccctcacagctctgga

SEQ ID NO: 47878 - DNA, 20 bp, Artificial Sequence
  sgRNA
  Pcdhb9_20
ctaccctatgcagaacgcct

SEQ ID NO: 47879 - DNA, 20 bp, Artificial Sequence
  sgRNA
  Pcdhga1_1
tgtggtccggaaatttcagt

SEQ ID NO: 47880 - DNA, 20 bp, Artificial Sequence
  sgRNA
  Pcdhga1_2
gtagtcaggcacgtgctgca

SEQ ID NO: 47881 - DNA, 20 bp, Artificial Sequence
  sgRNA
  Pcdhga1_3
gtgccagaagaaaccgacaa

SEQ ID NO: 47882 - DNA, 20 bp, Artificial Sequence
  sgRNA
  Pcdhga1_4
gggatccgcatcgtttccag

SEQ ID NO: 47883 - DNA, 20 bp, Artificial Sequence
  sgRNA
  Pcdhga1_5
tattgggctgccgccatccg

SEQ ID NO: 47884 - DNA, 20 bp, Artificial Sequence
  sgRNA
  Pcdhga1_6
agagcactattacaaaggct

SEQ ID NO: 47885 - DNA, 20 bp, Artificial Sequence
  sgRNA
  Pcdhga1_7
gtatcgagcgctcagaccca

SEQ ID NO: 47886 - DNA, 20 bp, Artificial Sequence
  sgRNA
  Pcdhga1_8
gagtcctgttcaaaaactgg

SEQ ID NO: 47887 - DNA, 20 bp, Artificial Sequence
  sgRNA
  Pcdhga1_9
actagtgacttacgccctgg

SEQ ID NO: 47888 - DNA, 20 bp, Artificial Sequence
  sgRNA
  Pcdhga1_10
agtaacctactcctttcaca

SEQ ID NO: 47889 - DNA, 20 bp, Artificial Sequence
  sgRNA
  Pcdhga1_11
ccaactttgtaggtgttgat

SEQ ID NO: 47890 - DNA, 20 bp, Artificial Sequence
  sgRNA
  Pcdhga1_12
gcagcatctctgtatcaaac

SEQ ID NO: 47891 - DNA, 20 bp, Artificial Sequence
  sgRNA
  Pcdhga1_13
tcaattatctctacttcgat

SEQ ID NO: 47892 - DNA, 20 bp, Artificial Sequence
  sgRNA
  Pcdhga1_14
aggtccctgttgcacatcca

SEQ ID NO: 47893 - DNA, 20 bp, Artificial Sequence
  sgRNA
  Pcdhga1_15
agtcctgttcaaaaactgga

SEQ ID NO: 47894 - DNA, 20 bp, Artificial Sequence
  sgRNA
  Pcdhga1_16
aatgccgctggcaaacgaga

SEQ ID NO: 47895 - DNA, 20 bp, Artificial Sequence
  sgRNA
  Pcdhga1_17
gatcaagacgctgataacaa

SEQ ID NO: 47896 - DNA, 20 bp, Artificial Sequence
  sgRNA
  Pcdhga1_18
gccagcggcattggtcagcg

SEQ ID NO: 47897 - DNA, 20 bp, Artificial Sequence
  sgRNA
  Pcdhga1_19
ctaccttgtcctcactgcct

SEQ ID NO: 47898 - DNA, 20 bp, Artificial Sequence
  sgRNA
  Pcdhga1_20
ttgttgccattaccacctgc

SEQ ID NO: 47899 - DNA, 20 bp, Artificial Sequence
  sgRNA
  Pcdhga10_1
agtgacagaagattcgccgg

SEQ ID NO: 47900 - DNA, 20 bp, Artificial Sequence
  sgRNA
  Pcdhga10_2
gagtcaacgacacattactg

SEQ ID NO: 47901 - DNA, 20 bp, Artificial Sequence
  sgRNA
  Pcdhga10_3
gttcacgcggtattcagtgg

SEQ ID NO: 47902 - DNA, 20 bp, Artificial Sequence
  sgRNA
  Pcdhga10_4
ttctccctagtcgttcagag

SEQ ID NO: 47903 - DNA, 20 bp, Artificial Sequence
  sgRNA
  Pcdhga10_5
ggttctccggaatgttcacg

SEQ ID NO: 47904 - DNA, 20 bp, Artificial Sequence
  sgRNA
  Pcdhga10_6
gtgacagaagattcgccggt

SEQ ID NO: 47905 - DNA, 20 bp, Artificial Sequence
  sgRNA
  Pcdhga10_7
atagcggatctgccgagctg

SEQ ID NO: 47906 - DNA, 20 bp, Artificial Sequence
  sgRNA
  Pcdhga10_8
gttcctcaggaactgaatag

SEQ ID NO: 47907 - DNA, 20 bp, Artificial Sequence
  sgRNA
  Pcdhga10_9
gatccgctattcagttcctg

SEQ ID NO: 47908 - DNA, 20 bp, Artificial Sequence
  sgRNA
  Pcdhga10_10
gtagtcaggcacgtgctgca

SEQ ID NO: 47909 - DNA, 20 bp, Artificial Sequence
  sgRNA
  Pcdhga10_11
ggctacctctccattctgcc

SEQ ID NO: 47910 - DNA, 20 bp, Artificial Sequence
  sgRNA
  Pcdhga10_12
tctcaagcagagtctagtgg

SEQ ID NO: 47911 - DNA, 20 bp, Artificial Sequence
  sgRNA
  Pcdhga10_13
gtatcgagcgctcagaccca

SEQ ID NO: 47912 - DNA, 20 bp, Artificial Sequence
  sgRNA
  Pcdhga10_14
ggaagaggcgattcaccacc

SEQ ID NO: 47913 - DNA, 20 bp, Artificial Sequence
  sgRNA
  Pcdhga10_15
gtttcactctatcttcaaca

SEQ ID NO: 47914 - DNA, 20 bp, Artificial Sequence
  sgRNA
  Pcdhga10_16
ggaacaggccctagatcgtg

SEQ ID NO: 47915 - DNA, 20 bp, Artificial Sequence
  sgRNA
  Pcdhga10_17
gcaacatcgccaaggacctg

SEQ ID NO: 47916 - DNA, 20 bp, Artificial Sequence
  sgRNA
  Pcdhga10_18
ttacatctagagtttctgct

SEQ ID NO: 47917 - DNA, 20 bp, Artificial Sequence
  sgRNA
  Pcdhga10_19
accgccaccgacaaagacga

SEQ ID NO: 47918 - DNA, 20 bp, Artificial Sequence
  sgRNA
  Pcdhga10_20
ggctgaagacaccattgagg

SEQ ID NO: 47919 - DNA, 20 bp, Artificial Sequence
  sgRNA
  Pcdhga11_1
aaccgtgatcaacaacgtag

SEQ ID NO: 47920 - DNA, 20 bp, Artificial Sequence
  sgRNA
  Pcdhga11_2
tgggtcgccattatcactag

SEQ ID NO: 47921 - DNA, 20 bp, Artificial Sequence
  sgRNA
  Pcdhga11_3
gggcacggttcccattcgcg

SEQ ID NO: 47922 - DNA, 20 bp, Artificial Sequence
  sgRNA
  Pcdhga11_4
cactaaataacccggctctg

SEQ ID NO: 47923 - DNA, 20 bp, Artificial Sequence
  sgRNA
  Pcdhga11_5
cccagatgaggggatcaacg

SEQ ID NO: 47924 - DNA, 20 bp, Artificial Sequence
  sgRNA
  Pcdhga11_6
ctcatagtcgaaggattgca

SEQ ID NO: 47925 - DNA, 20 bp, Artificial Sequence
  sgRNA
  Pcdhga11_7
agatcccgtccgcaagggca

SEQ ID NO: 47926 - DNA, 20 bp, Artificial Sequence
  sgRNA
  Pcdhga11_8
ggaatactcactctatacac

SEQ ID NO: 47927 - DNA, 20 bp, Artificial Sequence
  sgRNA
  Pcdhga11_9
gtagtcaggcacgtgctgca

SEQ ID NO: 47928 - DNA, 20 bp, Artificial Sequence
  sgRNA
  Pcdhga11_10
tttaagttagaaaagacgta

SEQ ID NO: 47929 - DNA, 20 bp, Artificial Sequence
  sgRNA
  Pcdhga11_11
ggacagccaggcgttctgcc

SEQ ID NO: 47930 - DNA, 20 bp, Artificial Sequence
  sgRNA
  Pcdhga11_12
acaccagtggaaccatcggt

SEQ ID NO: 47931 - DNA, 20 bp, Artificial Sequence
  sgRNA
  Pcdhga11_13
gcaattccagaccttacaac

SEQ ID NO: 47932 - DNA, 20 bp, Artificial Sequence
  sgRNA
  Pcdhga11_14
gtatcgagcgctcagaccca

SEQ ID NO: 47933 - DNA, 20 bp, Artificial Sequence
  sgRNA
  Pcdhga11_15
tgatggccaccactaggtag

SEQ ID NO: 47934 - DNA, 20 bp, Artificial Sequence
  sgRNA
  Pcdhga11_16
gatttcctcttcctagcgct

SEQ ID NO: 47935 - DNA, 20 bp, Artificial Sequence
  sgRNA
  Pcdhga11_17
accttggtcactaaataacc

SEQ ID NO: 47936 - DNA, 20 bp, Artificial Sequence
  sgRNA
  Pcdhga11_18
agagcaattactgtgcccga

SEQ ID NO: 47937 - DNA, 20 bp, Artificial Sequence
  sgRNA
  Pcdhga11_19
gacaggacagatccgatact

SEQ ID NO: 47938 - DNA, 20 bp, Artificial Sequence
  sgRNA
  Pcdhga11_20
tcagcgagcataccagtcct

SEQ ID NO: 47939 - DNA, 20 bp, Artificial Sequence
  sgRNA
  Pcdhga12_1
gtgcaagctacagataacgc

SEQ ID NO: 47940 - DNA, 20 bp, Artificial Sequence
  sgRNA
  Pcdhga12_2
agtcacttactccctagctg

SEQ ID NO: 47941 - DNA, 20 bp, Artificial Sequence
  sgRNA
  Pcdhga12_3
gagtggggtacaagatttcg

SEQ ID NO: 47942 - DNA, 20 bp, Artificial Sequence
  sgRNA
  Pcdhga12_4
cccagacgaaggcgccaatg

SEQ ID NO: 47943 - DNA, 20 bp, Artificial Sequence
  sgRNA
  Pcdhga12_5
tgtctgctatgtccagtgcg

SEQ ID NO: 47944 - DNA, 20 bp, Artificial Sequence
  sgRNA
  Pcdhga12_6
cttgtcgtccacgtaccgga

SEQ ID NO: 47945 - DNA, 20 bp, Artificial Sequence
  sgRNA
  Pcdhga12_7
atatctggatcccaagcgtg

SEQ ID NO: 47946 - DNA, 20 bp, Artificial Sequence
  sgRNA
  Pcdhga12_8
actccagtagaaccgtcggt

SEQ ID NO: 47947 - DNA, 20 bp, Artificial Sequence
  sgRNA
  Pcdhga12_9
ctagatctgccaggacgtcg

SEQ ID NO: 47948 - DNA, 20 bp, Artificial Sequence
  sgRNA
  Pcdhga12_10
aaccgaatagcgtatctggg

SEQ ID NO: 47949 - DNA, 20 bp, Artificial Sequence
  sgRNA
  Pcdhga12_11
cgttctcccgcacgctcacg

SEQ ID NO: 47950 - DNA, 20 bp, Artificial Sequence
  sgRNA
  Pcdhga12_12
gaaaaaaccgaatcacccga

SEQ ID NO: 47951 - DNA, 20 bp, Artificial Sequence
  sgRNA
  Pcdhga12_13
ggtgcaagctacagataacg

SEQ ID NO: 47952 - DNA, 20 bp, Artificial Sequence
  sgRNA
  Pcdhga12_14
ggtcctgcacagacactacg

SEQ ID NO: 47953 - DNA, 20 bp, Artificial Sequence
  sgRNA
  Pcdhga12_15
gtagtcaggcacgtgctgca

SEQ ID NO: 47954 - DNA, 20 bp, Artificial Sequence
  sgRNA
  Pcdhga12_16
ctagattgtctagatctgcc

SEQ ID NO: 47955 - DNA, 20 bp, Artificial Sequence
  sgRNA
  Pcdhga12_17
cctcgcttctccagctcgcg

SEQ ID NO: 47956 - DNA, 20 bp, Artificial Sequence
  sgRNA
  Pcdhga12_18
cttgcagacttattcgcacg

SEQ ID NO: 47957 - DNA, 20 bp, Artificial Sequence
  sgRNA
  Pcdhga12_19
cgatatctggatcccaagcg

SEQ ID NO: 47958 - DNA, 20 bp, Artificial Sequence
  sgRNA
  Pcdhga12_20
tcgcatccacaaccatcacg

SEQ ID NO: 47959 - DNA, 20 bp, Artificial Sequence
  sgRNA
  Pcdhga2_1
agtgcaattaccgttcccag

SEQ ID NO: 47960 - DNA, 20 bp, Artificial Sequence
  sgRNA
  Pcdhga2_2
ggatcctctactccaaagcg

SEQ ID NO: 47961 - DNA, 20 bp, Artificial Sequence
  sgRNA
  Pcdhga2_3
cgaacgtgccttggaccgcg

SEQ ID NO: 47962 - DNA, 20 bp, Artificial Sequence
  sgRNA
  Pcdhga2_4
taggcagagtagaccctccg

SEQ ID NO: 47963 - DNA, 20 bp, Artificial Sequence
  sgRNA
  Pcdhga2_5
gatgaacagcctcttcctcg

SEQ ID NO: 47964 - DNA, 20 bp, Artificial Sequence
  sgRNA
  Pcdhga2_6
gtagtcaggcacgtgctgca

SEQ ID NO: 47965 - DNA, 20 bp, Artificial Sequence
  sgRNA
  Pcdhga2_7
ctgtaagcgccaaagatgga

SEQ ID NO: 47966 - DNA, 20 bp, Artificial Sequence
  sgRNA
  Pcdhga2_8
gttctagtcgcctctgacgg

SEQ ID NO: 47967 - DNA, 20 bp, Artificial Sequence
  sgRNA
  Pcdhga2_9
agatgtcatgtaaaattccg

SEQ ID NO: 47968 - DNA, 20 bp, Artificial Sequence
  sgRNA
  Pcdhga2_10
gtatcgagcgctcagaccca

SEQ ID NO: 47969 - DNA, 20 bp, Artificial Sequence
  sgRNA
  Pcdhga2_11
gtatccctcatccgcgtcag

SEQ ID NO: 47970 - DNA, 20 bp, Artificial Sequence
  sgRNA
  Pcdhga2_12
ttactttcgtcctagtcaga

SEQ ID NO: 47971 - DNA, 20 bp, Artificial Sequence
  sgRNA
  Pcdhga2_13
tctggacgtgcgaactggag

SEQ ID NO: 47972 - DNA, 20 bp, Artificial Sequence
  sgRNA
  Pcdhga2_14
gatccgctactccgtgccgg

SEQ ID NO: 47973 - DNA, 20 bp, Artificial Sequence
  sgRNA
  Pcdhga2_15
gtgagtatccgggtgcctac

SEQ ID NO: 47974 - DNA, 20 bp, Artificial Sequence
  sgRNA
  Pcdhga2_16
ggttctagtcgcctctgacg

SEQ ID NO: 47975 - DNA, 20 bp, Artificial Sequence
  sgRNA
  Pcdhga2_17
ggagaactgttccctgtcaa

SEQ ID NO: 47976 - DNA, 20 bp, Artificial Sequence
  sgRNA
  Pcdhga2_18
gtgccggaggagatcgacaa

SEQ ID NO: 47977 - DNA, 20 bp, Artificial Sequence
  sgRNA
  Pcdhga2_19
ttacaaccagagcccttgac

SEQ ID NO: 47978 - DNA, 20 bp, Artificial Sequence
  sgRNA
  Pcdhga2_20
ggtggacagttactaccgac

SEQ ID NO: 47979 - DNA, 20 bp, Artificial Sequence
  sgRNA
  Pcdhga3_1
cccagtagacggttccacag

SEQ ID NO: 47980 - DNA, 20 bp, Artificial Sequence
  sgRNA
  Pcdhga3_2
aggcgtgcgtgaatgtagga

SEQ ID NO: 47981 - DNA, 20 bp, Artificial Sequence
  sgRNA
  Pcdhga3_3
ttgcatccgagactatcacc

SEQ ID NO: 47982 - DNA, 20 bp, Artificial Sequence
  sgRNA
  Pcdhga3_4
ggaagtgactgagacttccg

SEQ ID NO: 47983 - DNA, 20 bp, Artificial Sequence
  sgRNA
  Pcdhga3_5
gtaccaacgtcgaagcctaa

SEQ ID NO: 47984 - DNA, 20 bp, Artificial Sequence
  sgRNA
  Pcdhga3_6
gtagtcaggcacgtgctgca

SEQ ID NO: 47985 - DNA, 20 bp, Artificial Sequence
  sgRNA
  Pcdhga3_7
gttcctccggcaccgagtag

SEQ ID NO: 47986 - DNA, 20 bp, Artificial Sequence
  sgRNA
  Pcdhga3_8
tatccgaccctcccagtaga

SEQ ID NO: 47987 - DNA, 20 bp, Artificial Sequence
  sgRNA
  Pcdhga3_9
tgtcacgctcaccatagcag

SEQ ID NO: 47988 - DNA, 20 bp, Artificial Sequence
  sgRNA
  Pcdhga3_10
gtatcgagcgctcagaccca

SEQ ID NO: 47989 - DNA, 20 bp, Artificial Sequence
  sgRNA
  Pcdhga3_11
tggcccttaggcttcgacgt

SEQ ID NO: 47990 - DNA, 20 bp, Artificial Sequence
  sgRNA
  Pcdhga3_12
taatatcagtctaagagcca

SEQ ID NO: 47991 - DNA, 20 bp, Artificial Sequence
  sgRNA
  Pcdhga3_13
gatccgctactcggtgccgg

SEQ ID NO: 47992 - DNA, 20 bp, Artificial Sequence
  sgRNA
  Pcdhga3_14
tttcaggcagatccgctact

SEQ ID NO: 47993 - DNA, 20 bp, Artificial Sequence
  sgRNA
  Pcdhga3_15
agtgcgatttctcttccagc

SEQ ID NO: 47994 - DNA, 20 bp, Artificial Sequence
  sgRNA
  Pcdhga3_16
atctagacccacaaagtgag

SEQ ID NO: 47995 - DNA, 20 bp, Artificial Sequence
  sgRNA
  Pcdhga3_17
ggtatccaggatctgcagag

SEQ ID NO: 47996 - DNA, 20 bp, Artificial Sequence
  sgRNA
  Pcdhga3_18
tttcctgcagacctactccc

SEQ ID NO: 47997 - DNA, 20 bp, Artificial Sequence
  sgRNA
  Pcdhga3_19
gaatccctcatcaggatcag

SEQ ID NO: 47998 - DNA, 20 bp, Artificial Sequence
  sgRNA
  Pcdhga3_20
gtgccggaggaactggacaa

SEQ ID NO: 47999 - DNA, 20 bp, Artificial Sequence
  sgRNA
  Pcdhga4_1
ggaaaatgccttagaccgcg

SEQ ID NO: 48000 - DNA, 20 bp, Artificial Sequence
  sgRNA
  Pcdhga4_2
acgcagtgcataaaggacac

SEQ ID NO: 48001 - DNA, 20 bp, Artificial Sequence
  sgRNA
  Pcdhga4_3
atcatcggttgttgatacac

SEQ ID NO: 48002 - DNA, 20 bp, Artificial Sequence
  sgRNA
  Pcdhga4_4
tggggacattacagtgttgg

SEQ ID NO: 48003 - DNA, 20 bp, Artificial Sequence
  sgRNA
  Pcdhga4_5
agtaccggatctgttccgcg

SEQ ID NO: 48004 - DNA, 20 bp, Artificial Sequence
  sgRNA
  Pcdhga4_6
atccctatgcgacatccgcg

SEQ ID NO: 48005 - DNA, 20 bp, Artificial Sequence
  sgRNA
  Pcdhga4_7
agatccagattagtcccctg

SEQ ID NO: 48006 - DNA, 20 bp, Artificial Sequence
  sgRNA
  Pcdhga4_8
gtaatctcgccgcggacctg

SEQ ID NO: 48007 - DNA, 20 bp, Artificial Sequence
  sgRNA
  Pcdhga4_9
acaataactgccaccgacca

SEQ ID NO: 48008 - DNA, 20 bp, Artificial Sequence
  sgRNA
  Pcdhga4_10
gtagtcaggcacgtgctgca

SEQ ID NO: 48009 - DNA, 20 bp, Artificial Sequence
  sgRNA
  Pcdhga4_11
agacctatggaaattatcat

SEQ ID NO: 48010 - DNA, 20 bp, Artificial Sequence
  sgRNA
  Pcdhga4_12
gtatcgagcgctcagaccca

SEQ ID NO: 48011 - DNA, 20 bp, Artificial Sequence
  sgRNA
  Pcdhga4_13
gttctcaccgccttcgacgg

SEQ ID NO: 48012 - DNA, 20 bp, Artificial Sequence
  sgRNA
  Pcdhga4_14
tgtggtgggtaatctcgccg

SEQ ID NO: 48013 - DNA, 20 bp, Artificial Sequence
  sgRNA
  Pcdhga4_15
ctgtcagaggacactatcca

SEQ ID NO: 48014 - DNA, 20 bp, Artificial Sequence
  sgRNA
  Pcdhga4_16
cggtccactttgcacatcca

SEQ ID NO: 48015 - DNA, 20 bp, Artificial Sequence
  sgRNA
  Pcdhga4_17
ggtgagaaccaggtgatgaa

SEQ ID NO: 48016 - DNA, 20 bp, Artificial Sequence
  sgRNA
  Pcdhga4_18
caccagtagaaccatcagtg

SEQ ID NO: 48017 - DNA, 20 bp, Artificial Sequence
  sgRNA
  Pcdhga4_19
tccttacaaatcagaccgca

SEQ ID NO: 48018 - DNA, 20 bp, Artificial Sequence
  sgRNA
  Pcdhga4_20
ggatgtaaatgacaatgccc

SEQ ID NO: 48019 - DNA, 20 bp, Artificial Sequence
  sgRNA
  Pcdhga5_1
gttatcgtttgcatcaagaa

SEQ ID NO: 48020 - DNA, 20 bp, Artificial Sequence
  sgRNA
  Pcdhga5_2
atggagacataggatgacac

SEQ ID NO: 48021 - DNA, 20 bp, Artificial Sequence
  sgRNA
  Pcdhga5_3
acagtgaccgttgttgaccg

SEQ ID NO: 48022 - DNA, 20 bp, Artificial Sequence
  sgRNA
  Pcdhga5_4
catccccatctctcgcgaag

SEQ ID NO: 48023 - DNA, 20 bp, Artificial Sequence
  sgRNA
  Pcdhga5_5
gttacaagcttagctccaac

SEQ ID NO: 48024 - DNA, 20 bp, Artificial Sequence
  sgRNA
  Pcdhga5_6
ccactgccaccgaaaccact

SEQ ID NO: 48025 - DNA, 20 bp, Artificial Sequence
  sgRNA
  Pcdhga5_7
aggagttccacggtcaacaa

SEQ ID NO: 48026 - DNA, 20 bp, Artificial Sequence
  sgRNA
  Pcdhga5_8
atattaatgataacttcccc

SEQ ID NO: 48027 - DNA, 20 bp, Artificial Sequence
  sgRNA
  Pcdhga5_9
gtccagagagaagtgccggt

SEQ ID NO: 48028 - DNA, 20 bp, Artificial Sequence
  sgRNA
  Pcdhga5_10
gtagtcaggcacgtgctgca

SEQ ID NO: 48029 - DNA, 20 bp, Artificial Sequence
  sgRNA
  Pcdhga5_11
gctaagcttgtaaccctgga

SEQ ID NO: 48030 - DNA, 20 bp, Artificial Sequence
  sgRNA
  Pcdhga5_12
tctggattcttcatagtcca

SEQ ID NO: 48031 - DNA, 20 bp, Artificial Sequence
  sgRNA
  Pcdhga5_13
ttctcaatagggcttcacac

SEQ ID NO: 48032 - DNA, 20 bp, Artificial Sequence
  sgRNA
  Pcdhga5_14
gctcctcccgcacagagtag

SEQ ID NO: 48033 - DNA, 20 bp, Artificial Sequence
  sgRNA
  Pcdhga5_15
aactcctcatcgcggaaccg

SEQ ID NO: 48034 - DNA, 20 bp, Artificial Sequence
  sgRNA
  Pcdhga5_16
gttccggagaacacacctgt

SEQ ID NO: 48035 - DNA, 20 bp, Artificial Sequence
  sgRNA
  Pcdhga5_17
gtatcgagcgctcagaccca

SEQ ID NO: 48036 - DNA, 20 bp, Artificial Sequence
  sgRNA
  Pcdhga5_18
agacctcacactctacctag

SEQ ID NO: 48037 - DNA, 20 bp, Artificial Sequence
  sgRNA
  Pcdhga5_19
ttccctgtctatcctgcccg

SEQ ID NO: 48038 - DNA, 20 bp, Artificial Sequence
  sgRNA
  Pcdhga5_20
acatccccatctctcgcgaa

SEQ ID NO: 48039 - DNA, 20 bp, Artificial Sequence
  sgRNA
  Pcdhga6_1
tggagttcactcccacatcg

SEQ ID NO: 48040 - DNA, 20 bp, Artificial Sequence
  sgRNA
  Pcdhga6_2
caccagtagaaccatccgtg

SEQ ID NO: 48041 - DNA, 20 bp, Artificial Sequence
  sgRNA
  Pcdhga6_3
gatgaacgggaaaaaacagg

SEQ ID NO: 48042 - DNA, 20 bp, Artificial Sequence
  sgRNA
  Pcdhga6_4
gttaacactcgtgtacccac

SEQ ID NO: 48043 - DNA, 20 bp, Artificial Sequence
  sgRNA
  Pcdhga6_5
gggacactcacacgatagat

SEQ ID NO: 48044 - DNA, 20 bp, Artificial Sequence
  sgRNA
  Pcdhga6_6
gtagtcaggcacgtgctgca

SEQ ID NO: 48045 - DNA, 20 bp, Artificial Sequence
  sgRNA
  Pcdhga6_7
gcagcatcgccaaagacctg

SEQ ID NO: 48046 - DNA, 20 bp, Artificial Sequence
  sgRNA
  Pcdhga6_8
tgatcaaggccagtgagcca

SEQ ID NO: 48047 - DNA, 20 bp, Artificial Sequence
  sgRNA
  Pcdhga6_9
atatctagtgaccaaagtgg

SEQ ID NO: 48048 - DNA, 20 bp, Artificial Sequence
  sgRNA
  Pcdhga6_10
gtatcgagcgctcagaccca

SEQ ID NO: 48049 - DNA, 20 bp, Artificial Sequence
  sgRNA
  Pcdhga6_11
gcgccatgcctgttcggaca

SEQ ID NO: 48050 - DNA, 20 bp, Artificial Sequence
  sgRNA
  Pcdhga6_12
cacacactcatcagtcagga

SEQ ID NO: 48051 - DNA, 20 bp, Artificial Sequence
  sgRNA
  Pcdhga6_13
atgtccacttcacatttcgt

SEQ ID NO: 48052 - DNA, 20 bp, Artificial Sequence
  sgRNA
  Pcdhga6_14
ttctccctaaaccagcgaag

SEQ ID NO: 48053 - DNA, 20 bp, Artificial Sequence
  sgRNA
  Pcdhga6_15
ccagcaggacccttgctgtg

SEQ ID NO: 48054 - DNA, 20 bp, Artificial Sequence
  sgRNA
  Pcdhga6_16
acaccagtagaaccatccgt

SEQ ID NO: 48055 - DNA, 20 bp, Artificial Sequence
  sgRNA
  Pcdhga6_17
ggacatgaacgacaatgcac

SEQ ID NO: 48056 - DNA, 20 bp, Artificial Sequence
  sgRNA
  Pcdhga6_18
aggtgagatccgcacagcaa

SEQ ID NO: 48057 - DNA, 20 bp, Artificial Sequence
  sgRNA
  Pcdhga6_19
aatgccgctggcaaacgaga

SEQ ID NO: 48058 - DNA, 20 bp, Artificial Sequence
  sgRNA
  Pcdhga6_20
ttgttgccattaccacctgc

SEQ ID NO: 48059 - DNA, 20 bp, Artificial Sequence
  sgRNA
  Pcdhga7_1
agtgactgctcgtgacagtg

SEQ ID NO: 48060 - DNA, 20 bp, Artificial Sequence
  sgRNA
  Pcdhga7_2
acctccaagacaaagattcg

SEQ ID NO: 48061 - DNA, 20 bp, Artificial Sequence
  sgRNA
  Pcdhga7_3
ttaaagctcacgagacatcg

SEQ ID NO: 48062 - DNA, 20 bp, Artificial Sequence
  sgRNA
  Pcdhga7_4
cttggatgagggaatctatg

SEQ ID NO: 48063 - DNA, 20 bp, Artificial Sequence
  sgRNA
  Pcdhga7_5
gctcactggctttaagcagg

SEQ ID NO: 48064 - DNA, 20 bp, Artificial Sequence
  sgRNA
  Pcdhga7_6
gtagtcaggcacgtgctgca

SEQ ID NO: 48065 - DNA, 20 bp, Artificial Sequence
  sgRNA
  Pcdhga7_7
gggactgtcgcttgatacag

SEQ ID NO: 48066 - DNA, 20 bp, Artificial Sequence
  sgRNA
  Pcdhga7_8
gtatccacgtaattgggctg

SEQ ID NO: 48067 - DNA, 20 bp, Artificial Sequence
  sgRNA
  Pcdhga7_9
ttagcagaagacaccatcca

SEQ ID NO: 48068 - DNA, 20 bp, Artificial Sequence
  sgRNA
  Pcdhga7_10
gtatcgagcgctcagaccca

SEQ ID NO: 48069 - DNA, 20 bp, Artificial Sequence
  sgRNA
  Pcdhga7_11
gtgtctgaagagacagacaa

SEQ ID NO: 48070 - DNA, 20 bp, Artificial Sequence
  sgRNA
  Pcdhga7_12
agcagaagacaccatccagg

SEQ ID NO: 48071 - DNA, 20 bp, Artificial Sequence
  sgRNA
  Pcdhga7_13
ggtcctgtacaaccaccaca

SEQ ID NO: 48072 - DNA, 20 bp, Artificial Sequence
  sgRNA
  Pcdhga7_14
cttccctcagcccaattacg

SEQ ID NO: 48073 - DNA, 20 bp, Artificial Sequence
  sgRNA
  Pcdhga7_15
cctacaaacatattcccatg

SEQ ID NO: 48074 - DNA, 20 bp, Artificial Sequence
  sgRNA
  Pcdhga7_16
agatatcaccctctacctgg

SEQ ID NO: 48075 - DNA, 20 bp, Artificial Sequence
  sgRNA
  Pcdhga7_17
agtgacacattactgctgag

SEQ ID NO: 48076 - DNA, 20 bp, Artificial Sequence
  sgRNA
  Pcdhga7_18
aggacgacaccggtaccccc

SEQ ID NO: 48077 - DNA, 20 bp, Artificial Sequence
  sgRNA
  Pcdhga7_19
tgaatcatcaggttcactgg

SEQ ID NO: 48078 - DNA, 20 bp, Artificial Sequence
  sgRNA
  Pcdhga7_20
agggactgtcgcttgataca

SEQ ID NO: 48079 - DNA, 20 bp, Artificial Sequence
  sgRNA
  Pcdhga8_1
gtgtctgaggacactataca

SEQ ID NO: 48080 - DNA, 20 bp, Artificial Sequence
  sgRNA
  Pcdhga8_2
aaccggttggtcaaaaacag

SEQ ID NO: 48081 - DNA, 20 bp, Artificial Sequence
  sgRNA
  Pcdhga8_3
agtctctacctacaatatca

SEQ ID NO: 48082 - DNA, 20 bp, Artificial Sequence
  sgRNA
  Pcdhga8_4
gttccatcttcatgaaaaca

SEQ ID NO: 48083 - DNA, 20 bp, Artificial Sequence
  sgRNA
  Pcdhga8_5
gtagtcaggcacgtgctgca

SEQ ID NO: 48084 - DNA, 20 bp, Artificial Sequence
  sgRNA
  Pcdhga8_6
aatacaggctgaagacgtag

SEQ ID NO: 48085 - DNA, 20 bp, Artificial Sequence
  sgRNA
  Pcdhga8_7
gcttatccagatcacagtgt

SEQ ID NO: 48086 - DNA, 20 bp, Artificial Sequence
  sgRNA
  Pcdhga8_8
gcgtacacagcagcaccagc

SEQ ID NO: 48087 - DNA, 20 bp, Artificial Sequence
  sgRNA
  Pcdhga8_9
tctcaaacagaacctggtga

SEQ ID NO: 48088 - DNA, 20 bp, Artificial Sequence
  sgRNA
  Pcdhga8_10
tcacctccagatctccaaca

SEQ ID NO: 48089 - DNA, 20 bp, Artificial Sequence
  sgRNA
  Pcdhga8_11
gtatcgagcgctcagaccca

SEQ ID NO: 48090 - DNA, 20 bp, Artificial Sequence
  sgRNA
  Pcdhga8_12
ggagtggataccgtgctcca

SEQ ID NO: 48091 - DNA, 20 bp, Artificial Sequence
  sgRNA
  Pcdhga8_13
tcaatgcccacaaaatgtga

SEQ ID NO: 48092 - DNA, 20 bp, Artificial Sequence
  sgRNA
  Pcdhga8_14
tagctctcagacttcagcgc

SEQ ID NO: 48093 - DNA, 20 bp, Artificial Sequence
  sgRNA
  Pcdhga8_15
aatgccgctggcaaacgaga

SEQ ID NO: 48094 - DNA, 20 bp, Artificial Sequence
  sgRNA
  Pcdhga8_16
gcagcatctctgtatcaaac

SEQ ID NO: 48095 - DNA, 20 bp, Artificial Sequence
  sgRNA
  Pcdhga8_17
agagcgcactctggaccgag

SEQ ID NO: 48096 - DNA, 20 bp, Artificial Sequence
  sgRNA
  Pcdhga8_18
gccagcggcattggtcagcg

SEQ ID NO: 48097 - DNA, 20 bp, Artificial Sequence
  sgRNA
  Pcdhga8_19
tcaagtcagccaacacttca

SEQ ID NO: 48098 - DNA, 20 bp, Artificial Sequence
  sgRNA
  Pcdhga8_20
acgctgtgcaagatcagcgt

SEQ ID NO: 48099 - DNA, 20 bp, Artificial Sequence
  sgRNA
  Pcdhga9_1
tgccgccatcgtaggcggtg

SEQ ID NO: 48100 - DNA, 20 bp, Artificial Sequence
  sgRNA
  Pcdhga9_2
aggaggattactgtccctgg

SEQ ID NO: 48101 - DNA, 20 bp, Artificial Sequence
  sgRNA
  Pcdhga9_3
ggacagagtgaaactttatg

SEQ ID NO: 48102 - DNA, 20 bp, Artificial Sequence
  sgRNA
  Pcdhga9_4
atccaatagaaacacagaca

SEQ ID NO: 48103 - DNA, 20 bp, Artificial Sequence
  sgRNA
  Pcdhga9_5
ggtcctgcacagctaccacg

SEQ ID NO: 48104 - DNA, 20 bp, Artificial Sequence
  sgRNA
  Pcdhga9_6
agatgtaaatgacaatcggc

SEQ ID NO: 48105 - DNA, 20 bp, Artificial Sequence
  sgRNA
  Pcdhga9_7
ggtggaaaacaccatccagg

SEQ ID NO: 48106 - DNA, 20 bp, Artificial Sequence
  sgRNA
  Pcdhga9_8
atgccagcgccgtagcctaa

SEQ ID NO: 48107 - DNA, 20 bp, Artificial Sequence
  sgRNA
  Pcdhga9_9
gcagcactagcacaaagagt

SEQ ID NO: 48108 - DNA, 20 bp, Artificial Sequence
  sgRNA
  Pcdhga9_10
gtagtcaggcacgtgctgca

SEQ ID NO: 48109 - DNA, 20 bp, Artificial Sequence
  sgRNA
  Pcdhga9_11
agctaccatcactctcacag

SEQ ID NO: 48110 - DNA, 20 bp, Artificial Sequence
  sgRNA
  Pcdhga9_12
gtatcgagcgctcagaccca

SEQ ID NO: 48111 - DNA, 20 bp, Artificial Sequence
  sgRNA
  Pcdhga9_13
gtaccaacatcacatattgt

SEQ ID NO: 48112 - DNA, 20 bp, Artificial Sequence
  sgRNA
  Pcdhga9_14
tgacattactctctacctgg

SEQ ID NO: 48113 - DNA, 20 bp, Artificial Sequence
  sgRNA
  Pcdhga9_15
tatccctccctcccgactga

SEQ ID NO: 48114 - DNA, 20 bp, Artificial Sequence
  sgRNA
  Pcdhga9_16
gagtgcatctctctctagca

SEQ ID NO: 48115 - DNA, 20 bp, Artificial Sequence
  sgRNA
  Pcdhga9_17
tcgtcttgtgtgcactgcta

SEQ ID NO: 48116 - DNA, 20 bp, Artificial Sequence
  sgRNA
  Pcdhga9_18
tctcttctggcacggaatag

SEQ ID NO: 48117 - DNA, 20 bp, Artificial Sequence
  sgRNA
  Pcdhga9_19
tagcattctcctcgtcgtca

SEQ ID NO: 48118 - DNA, 20 bp, Artificial Sequence
  sgRNA
  Pcdhga9_20
acccggatgagggtgccaat

SEQ ID NO: 48119 - DNA, 20 bp, Artificial Sequence
  sgRNA
  Pcdhgb1_1
ctgtgagtcagccttagcag

SEQ ID NO: 48120 - DNA, 20 bp, Artificial Sequence
  sgRNA
  Pcdhgb1_2
tgcagcactaacgttcctgg

SEQ ID NO: 48121 - DNA, 20 bp, Artificial Sequence
  sgRNA
  Pcdhgb1_3
tgacaacgacaatgccccag

SEQ ID NO: 48122 - DNA, 20 bp, Artificial Sequence
  sgRNA
  Pcdhgb1_4
gtgtacagtaacacatgtct

SEQ ID NO: 48123 - DNA, 20 bp, Artificial Sequence
  sgRNA
  Pcdhgb1_5
ggcctcctacttggtccacg

SEQ ID NO: 48124 - DNA, 20 bp, Artificial Sequence
  sgRNA
  Pcdhgb1_6
gctgacagtgtacatcttca

SEQ ID NO: 48125 - DNA, 20 bp, Artificial Sequence
  sgRNA
  Pcdhgb1_7
gtagtcaggcacgtgctgca

SEQ ID NO: 48126 - DNA, 20 bp, Artificial Sequence
  sgRNA
  Pcdhgb1_8
gagcaacctctggtgccacg

SEQ ID NO: 48127 - DNA, 20 bp, Artificial Sequence
  sgRNA
  Pcdhgb1_9
acacttctccttgtcaacga

SEQ ID NO: 48128 - DNA, 20 bp, Artificial Sequence
  sgRNA
  Pcdhgb1_10
gagagggcgccgcagaacaa

SEQ ID NO: 48129 - DNA, 20 bp, Artificial Sequence
  sgRNA
  Pcdhgb1_11
gtatcgagcgctcagaccca

SEQ ID NO: 48130 - DNA, 20 bp, Artificial Sequence
  sgRNA
  Pcdhgb1_12
catcgcacaggagatcctga

SEQ ID NO: 48131 - DNA, 20 bp, Artificial Sequence
  sgRNA
  Pcdhgb1_13
tggcggtcagtattaagtga

SEQ ID NO: 48132 - DNA, 20 bp, Artificial Sequence
  sgRNA
  Pcdhgb1_14
ggttcctcccaactacaatg

SEQ ID NO: 48133 - DNA, 20 bp, Artificial Sequence
  sgRNA
  Pcdhgb1_15
caatagccagaatcaccgcc

SEQ ID NO: 48134 - DNA, 20 bp, Artificial Sequence
  sgRNA
  Pcdhgb1_16
agtggggatttgttagtgag

SEQ ID NO: 48135 - DNA, 20 bp, Artificial Sequence
  sgRNA
  Pcdhgb1_17
catctcgcgcagagtccaga

SEQ ID NO: 48136 - DNA, 20 bp, Artificial Sequence
  sgRNA
  Pcdhgb1_18
cacattctacgactatggca

SEQ ID NO: 48137 - DNA, 20 bp, Artificial Sequence
  sgRNA
  Pcdhgb1_19
gcatctcgcgcagagtccag

SEQ ID NO: 48138 - DNA, 20 bp, Artificial Sequence
  sgRNA
  Pcdhgb1_20
tctgtgagtcagccttagca

SEQ ID NO: 48139 - DNA, 20 bp, Artificial Sequence
  sgRNA
  Pcdhgb2_1
gatagtaggaaacctcgcaa

SEQ ID NO: 48140 - DNA, 20 bp, Artificial Sequence
  sgRNA
  Pcdhgb2_2
agacagaactctagaccggg

SEQ ID NO: 48141 - DNA, 20 bp, Artificial Sequence
  sgRNA
  Pcdhgb2_3
aggatatttacgtccatctg

SEQ ID NO: 48142 - DNA, 20 bp, Artificial Sequence
  sgRNA
  Pcdhgb2_4
cctgaagaattacagctacg

SEQ ID NO: 48143 - DNA, 20 bp, Artificial Sequence
  sgRNA
  Pcdhgb2_5
attacgttagaggagagcgg

SEQ ID NO: 48144 - DNA, 20 bp, Artificial Sequence
  sgRNA
  Pcdhgb2_6
tggtggtacatcctcccgaa

SEQ ID NO: 48145 - DNA, 20 bp, Artificial Sequence
  sgRNA
  Pcdhgb2_7
agaaccagcatctaaatcga

SEQ ID NO: 48146 - DNA, 20 bp, Artificial Sequence
  sgRNA
  Pcdhgb2_8
tcaccattgtagctgccgat

SEQ ID NO: 48147 - DNA, 20 bp, Artificial Sequence
  sgRNA
  Pcdhgb2_9
ggatgagaatgattgtgtac

SEQ ID NO: 48148 - DNA, 20 bp, Artificial Sequence
  sgRNA
  Pcdhgb2_10
gtagtcaggcacgtgctgca

SEQ ID NO: 48149 - DNA, 20 bp, Artificial Sequence
  sgRNA
  Pcdhgb2_11
tctgatccgcgagagctccg

SEQ ID NO: 48150 - DNA, 20 bp, Artificial Sequence
  sgRNA
  Pcdhgb2_12
caatagccagaatcaccgac

SEQ ID NO: 48151 - DNA, 20 bp, Artificial Sequence
  sgRNA
  Pcdhgb2_13
gttcagtgtcacccttcggg

SEQ ID NO: 48152 - DNA, 20 bp, Artificial Sequence
  sgRNA
  Pcdhgb2_14
tagccagaatcaccgacagg

SEQ ID NO: 48153 - DNA, 20 bp, Artificial Sequence
  sgRNA
  Pcdhgb2_15
gctgacccttagcttccggg

SEQ ID NO: 48154 - DNA, 20 bp, Artificial Sequence
  sgRNA
  Pcdhgb2_16
gtatcgagcgctcagaccca

SEQ ID NO: 48155 - DNA, 20 bp, Artificial Sequence
  sgRNA
  Pcdhgb2_17
ctaccagaagattctccact

SEQ ID NO: 48156 - DNA, 20 bp, Artificial Sequence
  sgRNA
  Pcdhgb2_18
acagccaccgaccaggacga

SEQ ID NO: 48157 - DNA, 20 bp, Artificial Sequence
  sgRNA
  Pcdhgb2_19
acccctatcggcagctacaa

SEQ ID NO: 48158 - DNA, 20 bp, Artificial Sequence
  sgRNA
  Pcdhgb2_20
tttcacttggatactacaat

SEQ ID NO: 48159 - DNA, 20 bp, Artificial Sequence
  sgRNA
  Pcdhgb4_1
gtgaccataaacgcgcaaag

SEQ ID NO: 48160 - DNA, 20 bp, Artificial Sequence
  sgRNA
  Pcdhgb4_2
gatgattgcgcaatgtacgg

SEQ ID NO: 48161 - DNA, 20 bp, Artificial Sequence
  sgRNA
  Pcdhgb4_3
ggtggccacagaccaagacg

SEQ ID NO: 48162 - DNA, 20 bp, Artificial Sequence
  sgRNA
  Pcdhgb4_4
ctgatgcgtagctttcgcgt

SEQ ID NO: 48163 - DNA, 20 bp, Artificial Sequence
  sgRNA
  Pcdhgb4_5
gttgcagaaaacaatccgcc

SEQ ID NO: 48164 - DNA, 20 bp, Artificial Sequence
  sgRNA
  Pcdhgb4_6
gtagtcaggcacgtgctgca

SEQ ID NO: 48165 - DNA, 20 bp, Artificial Sequence
  sgRNA
  Pcdhgb4_7
tatccgggctcggcagagcg

SEQ ID NO: 48166 - DNA, 20 bp, Artificial Sequence
  sgRNA
  Pcdhgb4_8
gttcacatcgcctatatgca

SEQ ID NO: 48167 - DNA, 20 bp, Artificial Sequence
  sgRNA
  Pcdhgb4_9
ggccaccactcgaagcacgg

SEQ ID NO: 48168 - DNA, 20 bp, Artificial Sequence
  sgRNA
  Pcdhgb4_10
gtatcgagcgctcagaccca

SEQ ID NO: 48169 - DNA, 20 bp, Artificial Sequence
  sgRNA
  Pcdhgb4_11
aaacacgtataaactagtga

SEQ ID NO: 48170 - DNA, 20 bp, Artificial Sequence
  sgRNA
  Pcdhgb4_12
gttcagccaagacatataca

SEQ ID NO: 48171 - DNA, 20 bp, Artificial Sequence
  sgRNA
  Pcdhgb4_13
ggatctgctcagagagcgtg

SEQ ID NO: 48172 - DNA, 20 bp, Artificial Sequence
  sgRNA
  Pcdhgb4_14
tctagatcgtgagcagaacc

SEQ ID NO: 48173 - DNA, 20 bp, Artificial Sequence
  sgRNA
  Pcdhgb4_15
gcgtccagaatctttgtcac

SEQ ID NO: 48174 - DNA, 20 bp, Artificial Sequence
  sgRNA
  Pcdhgb4_16
actattagagctactgacaa

SEQ ID NO: 48175 - DNA, 20 bp, Artificial Sequence
  sgRNA
  Pcdhgb4_17
acaatttgcagattcagcgg

SEQ ID NO: 48176 - DNA, 20 bp, Artificial Sequence
  sgRNA
  Pcdhgb4_18
aatgccgctggcaaacgaga

SEQ ID NO: 48177 - DNA, 20 bp, Artificial Sequence
  sgRNA
  Pcdhgb4_19
gtggccacagaccaagacga

SEQ ID NO: 48178 - DNA, 20 bp, Artificial Sequence
  sgRNA
  Pcdhgb4_20
ttgttgccattaccacctgc

SEQ ID NO: 48179 - DNA, 20 bp, Artificial Sequence
  sgRNA
  Pcdhgb5_1
ggtagtaattctgttgctcg

SEQ ID NO: 48180 - DNA, 20 bp, Artificial Sequence
  sgRNA
  Pcdhgb5_2
tgtgcgtgaagtttggcgtg

SEQ ID NO: 48181 - DNA, 20 bp, Artificial Sequence
  sgRNA
  Pcdhgb5_3
agcgcgggatacaaaacgcg

SEQ ID NO: 48182 - DNA, 20 bp, Artificial Sequence
  sgRNA
  Pcdhgb5_4
ctgatgcgtagctttcgagt

SEQ ID NO: 48183 - DNA, 20 bp, Artificial Sequence
  sgRNA
  Pcdhgb5_5
acaaaagtcaccctacacgt

SEQ ID NO: 48184 - DNA, 20 bp, Artificial Sequence
  sgRNA
  Pcdhgb5_6
gtagtcaggcacgtgctgca

SEQ ID NO: 48185 - DNA, 20 bp, Artificial Sequence
  sgRNA
  Pcdhgb5_7
gaaagcaattccagaccgag

SEQ ID NO: 48186 - DNA, 20 bp, Artificial Sequence
  sgRNA
  Pcdhgb5_8
cgtagcacggttgtacctgg

SEQ ID NO: 48187 - DNA, 20 bp, Artificial Sequence
  sgRNA
  Pcdhgb5_9
attccagagaacgcaccgcc

SEQ ID NO: 48188 - DNA, 20 bp, Artificial Sequence
  sgRNA
  Pcdhgb5_10
agctatgtacaccaagtagg

SEQ ID NO: 48189 - DNA, 20 bp, Artificial Sequence
  sgRNA
  Pcdhgb5_11
gtatcgagcgctcagaccca

SEQ ID NO: 48190 - DNA, 20 bp, Artificial Sequence
  sgRNA
  Pcdhgb5_12
tctaaaatgaagcgagtgcc

SEQ ID NO: 48191 - DNA, 20 bp, Artificial Sequence
  sgRNA
  Pcdhgb5_13
cattgacgtcaccaacgtgt

SEQ ID NO: 48192 - DNA, 20 bp, Artificial Sequence
  sgRNA
  Pcdhgb5_14
ctagtcctgacagccttaga

SEQ ID NO: 48193 - DNA, 20 bp, Artificial Sequence
  sgRNA
  Pcdhgb5_15
cttcctggttgaacacaggg

SEQ ID NO: 48194 - DNA, 20 bp, Artificial Sequence
  sgRNA
  Pcdhgb5_16
cctgacagccttagacggcg

SEQ ID NO: 48195 - DNA, 20 bp, Artificial Sequence
  sgRNA
  Pcdhgb5_17
aaagcaattagtgttcccgg

SEQ ID NO: 48196 - DNA, 20 bp, Artificial Sequence
  sgRNA
  Pcdhgb5_18
tgaaagcaattccagaccga

SEQ ID NO: 48197 - DNA, 20 bp, Artificial Sequence
  sgRNA
  Pcdhgb5_19
tcagtggtgccacttagggg

SEQ ID NO: 48198 - DNA, 20 bp, Artificial Sequence
  sgRNA
  Pcdhgb5_20
gctttgatcaaaatacacga

SEQ ID NO: 48199 - DNA, 20 bp, Artificial Sequence
  sgRNA
  Pcdhgb6_1
gtcagtgatgtgcagaacga

SEQ ID NO: 48200 - DNA, 20 bp, Artificial Sequence
  sgRNA
  Pcdhgb6_2
agacatagagaggtacacca

SEQ ID NO: 48201 - DNA, 20 bp, Artificial Sequence
  sgRNA
  Pcdhgb6_3
aggacaaccaccactcccgg

SEQ ID NO: 48202 - DNA, 20 bp, Artificial Sequence
  sgRNA
  Pcdhgb6_4
atatctgctcgcgatctatg

SEQ ID NO: 48203 - DNA, 20 bp, Artificial Sequence
  sgRNA
  Pcdhgb6_5
gtttctctcaactatagcga

SEQ ID NO: 48204 - DNA, 20 bp, Artificial Sequence
  sgRNA
  Pcdhgb6_6
gtagtcaggcacgtgctgca

SEQ ID NO: 48205 - DNA, 20 bp, Artificial Sequence
  sgRNA
  Pcdhgb6_7
gtagaagcgaaggacggcgg

SEQ ID NO: 48206 - DNA, 20 bp, Artificial Sequence
  sgRNA
  Pcdhgb6_8
gcgacactcttccagcccct

SEQ ID NO: 48207 - DNA, 20 bp, Artificial Sequence
  sgRNA
  Pcdhgb6_9
gtatcgagcgctcagaccca

SEQ ID NO: 48208 - DNA, 20 bp, Artificial Sequence
  sgRNA
  Pcdhgb6_10
acggcggtggtctctctaca

SEQ ID NO: 48209 - DNA, 20 bp, Artificial Sequence
  sgRNA
  Pcdhgb6_11
ctatagttgagagaaacccc

SEQ ID NO: 48210 - DNA, 20 bp, Artificial Sequence
  sgRNA
  Pcdhgb6_12
atctgagtggtggcactccg

SEQ ID NO: 48211 - DNA, 20 bp, Artificial Sequence
  sgRNA
  Pcdhgb6_13
ggctgtcacttgcaacacag

SEQ ID NO: 48212 - DNA, 20 bp, Artificial Sequence
  sgRNA
  Pcdhgb6_14
ggtttctctcaactatagcg

SEQ ID NO: 48213 - DNA, 20 bp, Artificial Sequence
  sgRNA
  Pcdhgb6_15
gacgccctcatcctcatcag

SEQ ID NO: 48214 - DNA, 20 bp, Artificial Sequence
  sgRNA
  Pcdhgb6_16
gccttaattccgcttcacct

SEQ ID NO: 48215 - DNA, 20 bp, Artificial Sequence
  sgRNA
  Pcdhgb6_17
aatgccgctggcaaacgaga

SEQ ID NO: 48216 - DNA, 20 bp, Artificial Sequence
  sgRNA
  Pcdhgb6_18
gcagcatctctgtatcaaac

SEQ ID NO: 48217 - DNA, 20 bp, Artificial Sequence
  sgRNA
  Pcdhgb6_19
gccagcggcattggtcagcg

SEQ ID NO: 48218 - DNA, 20 bp, Artificial Sequence
  sgRNA
  Pcdhgb6_20
ttgttgccattaccacctgc

SEQ ID NO: 48219 - DNA, 20 bp, Artificial Sequence
  sgRNA
  Pcdhgb7_1
tactcagctccgaatccgag

SEQ ID NO: 48220 - DNA, 20 bp, Artificial Sequence
  sgRNA
  Pcdhgb7_2
ggtacgggatcgagattctg

SEQ ID NO: 48221 - DNA, 20 bp, Artificial Sequence
  sgRNA
  Pcdhgb7_3
actgtgaagaaagagatcct

SEQ ID NO: 48222 - DNA, 20 bp, Artificial Sequence
  sgRNA
  Pcdhgb7_4
tcagcaaaagatcttgacat

SEQ ID NO: 48223 - DNA, 20 bp, Artificial Sequence
  sgRNA
  Pcdhgb7_5
acttccacccaactacagcg

SEQ ID NO: 48224 - DNA, 20 bp, Artificial Sequence
  sgRNA
  Pcdhgb7_6
aagtgaatccgacagcccag

SEQ ID NO: 48225 - DNA, 20 bp, Artificial Sequence
  sgRNA
  Pcdhgb7_7
ccagaattgttctcgcccct

SEQ ID NO: 48226 - DNA, 20 bp, Artificial Sequence
  sgRNA
  Pcdhgb7_8
aaggcaatggatcaagacga

SEQ ID NO: 48227 - DNA, 20 bp, Artificial Sequence
  sgRNA
  Pcdhgb7_9
ctttacaagcgcgagaccag

SEQ ID NO: 48228 - DNA, 20 bp, Artificial Sequence
  sgRNA
  Pcdhgb7_10
ggtctggcaacgcttcttgt

SEQ ID NO: 48229 - DNA, 20 bp, Artificial Sequence
  sgRNA
  Pcdhgb7_11
gtagtcaggcacgtgctgca

SEQ ID NO: 48230 - DNA, 20 bp, Artificial Sequence
  sgRNA
  Pcdhgb7_12
gatagtaacgttgtaccctg

SEQ ID NO: 48231 - DNA, 20 bp, Artificial Sequence
  sgRNA
  Pcdhgb7_13
agctgagtagtaccagtacg

SEQ ID NO: 48232 - DNA, 20 bp, Artificial Sequence
  sgRNA
  Pcdhgb7_14
tctctctgatcagatttcgg

SEQ ID NO: 48233 - DNA, 20 bp, Artificial Sequence
  sgRNA
  Pcdhgb7_15
agggccacaacagttccgga

SEQ ID NO: 48234 - DNA, 20 bp, Artificial Sequence
  sgRNA
  Pcdhgb7_16
gttccctcgctgtagttggg

SEQ ID NO: 48235 - DNA, 20 bp, Artificial Sequence
  sgRNA
  Pcdhgb7_17
gtatcgagcgctcagaccca

SEQ ID NO: 48236 - DNA, 20 bp, Artificial Sequence
  sgRNA
  Pcdhgb7_18
tcgatcccgtaccttgaaga

SEQ ID NO: 48237 - DNA, 20 bp, Artificial Sequence
  sgRNA
  Pcdhgb7_19
aatactagccaacagtgccg

SEQ ID NO: 48238 - DNA, 20 bp, Artificial Sequence
  sgRNA
  Pcdhgb7_20
cttccacccaactacagcga

SEQ ID NO: 48239 - DNA, 20 bp, Artificial Sequence
  sgRNA
  Pcdhgc3_1
acagctcatataaacgacgg

SEQ ID NO: 48240 - DNA, 20 bp, Artificial Sequence
  sgRNA
  Pcdhgc3_2
taggaggattgggacgactg

SEQ ID NO: 48241 - DNA, 20 bp, Artificial Sequence
  sgRNA
  Pcdhgc3_3
gagcgcgcacgatcccgatg

SEQ ID NO: 48242 - DNA, 20 bp, Artificial Sequence
  sgRNA
  Pcdhgc3_4
agggacagggctgtatacag

SEQ ID NO: 48243 - DNA, 20 bp, Artificial Sequence
  sgRNA
  Pcdhgc3_5
ctaccacccgtgagaccacg

SEQ ID NO: 48244 - DNA, 20 bp, Artificial Sequence
  sgRNA
  Pcdhgc3_6
ggatcgtgcgcgctctcgag

SEQ ID NO: 48245 - DNA, 20 bp, Artificial Sequence
  sgRNA
  Pcdhgc3_7
ctaacagctcatataaacga

SEQ ID NO: 48246 - DNA, 20 bp, Artificial Sequence
  sgRNA
  Pcdhgc3_8
cgctttagacctcgtaaccg

SEQ ID NO: 48247 - DNA, 20 bp, Artificial Sequence
  sgRNA
  Pcdhgc3_9
tctctgatcctcatagtcca

SEQ ID NO: 48248 - DNA, 20 bp, Artificial Sequence
  sgRNA
  Pcdhgc3_10
cgtcttctcgagtctgcacg

SEQ ID NO: 48249 - DNA, 20 bp, Artificial Sequence
  sgRNA
  Pcdhgc3_11
gtagtcaggcacgtgctgca

SEQ ID NO: 48250 - DNA, 20 bp, Artificial Sequence
  sgRNA
  Pcdhgc3_12
cattcactatgagatcctgg

SEQ ID NO: 48251 - DNA, 20 bp, Artificial Sequence
  sgRNA
  Pcdhgc3_13
gtaagcccctggagaacggt

SEQ ID NO: 48252 - DNA, 20 bp, Artificial Sequence
  sgRNA
  Pcdhgc3_14
ccgtgaccacgttacccacg

SEQ ID NO: 48253 - DNA, 20 bp, Artificial Sequence
  sgRNA
  Pcdhgc3_15
ggctagctccggacaccacc

SEQ ID NO: 48254 - DNA, 20 bp, Artificial Sequence
  sgRNA
  Pcdhgc3_16
tggggttcctccatccagcg

SEQ ID NO: 48255 - DNA, 20 bp, Artificial Sequence
  sgRNA
  Pcdhgc3_17
gtatcgagcgctcagaccca

SEQ ID NO: 48256 - DNA, 20 bp, Artificial Sequence
  sgRNA
  Pcdhgc3_18
accgaactctggccaggccg

SEQ ID NO: 48257 - DNA, 20 bp, Artificial Sequence
  sgRNA
  Pcdhgc3_19
ccgtggtgaggtacacctga

SEQ ID NO: 48258 - DNA, 20 bp, Artificial Sequence
  sgRNA
  Pcdhgc3_20
tggcatggtctcacgatcca

SEQ ID NO: 48259 - DNA, 20 bp, Artificial Sequence
  sgRNA
  Pcdhgc4_1
atcacgccccccgatttccg

SEQ ID NO: 48260 - DNA, 20 bp, Artificial Sequence
  sgRNA
  Pcdhgc4_2
ctacgatctcaacctccgct

SEQ ID NO: 48261 - DNA, 20 bp, Artificial Sequence
  sgRNA
  Pcdhgc4_3
gaagcaatccgactaccgcc

SEQ ID NO: 48262 - DNA, 20 bp, Artificial Sequence
  sgRNA
  Pcdhgc4_4
gattcgctacccggtcccag

SEQ ID NO: 48263 - DNA, 20 bp, Artificial Sequence
  sgRNA
  Pcdhgc4_5
gatgtcaagaagcgcagcga

SEQ ID NO: 48264 - DNA, 20 bp, Artificial Sequence
  sgRNA
  Pcdhgc4_6
ggatcctccgaatccagcta

SEQ ID NO: 48265 - DNA, 20 bp, Artificial Sequence
  sgRNA
  Pcdhgc4_7
ggagcaacactgcagcctta

SEQ ID NO: 48266 - DNA, 20 bp, Artificial Sequence
  sgRNA
  Pcdhgc4_8
tcgagaatcttcagctccca

SEQ ID NO: 48267 - DNA, 20 bp, Artificial Sequence
  sgRNA
  Pcdhgc4_9
gtagtcaggcacgtgctgca

SEQ ID NO: 48268 - DNA, 20 bp, Artificial Sequence
  sgRNA
  Pcdhgc4_10
ctgctgccgcggaaatcggg

SEQ ID NO: 48269 - DNA, 20 bp, Artificial Sequence
  sgRNA
  Pcdhgc4_11
ttatgggcagattcgctacc

SEQ ID NO: 48270 - DNA, 20 bp, Artificial Sequence
  sgRNA
  Pcdhgc4_12
tttggaaatgtaccgagcgg

SEQ ID NO: 48271 - DNA, 20 bp, Artificial Sequence
  sgRNA
  Pcdhgc4_13
gaaccaaagacacttccgtg

SEQ ID NO: 48272 - DNA, 20 bp, Artificial Sequence
  sgRNA
  Pcdhgc4_14
actgctgccgcggaaatcgg

SEQ ID NO: 48273 - DNA, 20 bp, Artificial Sequence
  sgRNA
  Pcdhgc4_15
ctggattcggaggatcccat

SEQ ID NO: 48274 - DNA, 20 bp, Artificial Sequence
  sgRNA
  Pcdhgc4_16
cctgtctcaccagatctcgg

SEQ ID NO: 48275 - DNA, 20 bp, Artificial Sequence
  sgRNA
  Pcdhgc4_17
gtatcgagcgctcagaccca

SEQ ID NO: 48276 - DNA, 20 bp, Artificial Sequence
  sgRNA
  Pcdhgc4_18
gcctttggaaatgtaccgag

SEQ ID NO: 48277 - DNA, 20 bp, Artificial Sequence
  sgRNA
  Pcdhgc4_19
agcgacctgcagcctgcgag

SEQ ID NO: 48278 - DNA, 20 bp, Artificial Sequence
  sgRNA
  Pcdhgc4_20
ggtttcctatcagctcctgg

SEQ ID NO: 48279 - DNA, 20 bp, Artificial Sequence
  sgRNA
  Pcdhgc5_1
gagtcccacacgtagaaccg

SEQ ID NO: 48280 - DNA, 20 bp, Artificial Sequence
  sgRNA
  Pcdhgc5_2
actgcagatgctgcaaatcg

SEQ ID NO: 48281 - DNA, 20 bp, Artificial Sequence
  sgRNA
  Pcdhgc5_3
gtgctagagagcacacccgt

SEQ ID NO: 48282 - DNA, 20 bp, Artificial Sequence
  sgRNA
  Pcdhgc5_4
tagagctgttgggtgaaatg

SEQ ID NO: 48283 - DNA, 20 bp, Artificial Sequence
  sgRNA
  Pcdhgc5_5
agatacaaggaacagtccgg

SEQ ID NO: 48284 - DNA, 20 bp, Artificial Sequence
  sgRNA
  Pcdhgc5_6
gcttcggtattcagtggtgg

SEQ ID NO: 48285 - DNA, 20 bp, Artificial Sequence
  sgRNA
  Pcdhgc5_7
gtagtcaggcacgtgctgca

SEQ ID NO: 48286 - DNA, 20 bp, Artificial Sequence
  sgRNA
  Pcdhgc5_8
ggtcaccaaggtgacagccg

SEQ ID NO: 48287 - DNA, 20 bp, Artificial Sequence
  sgRNA
  Pcdhgc5_9
actcccagagaacacacccc

SEQ ID NO: 48288 - DNA, 20 bp, Artificial Sequence
  sgRNA
  Pcdhgc5_10
tcagctagtactcactgccg

SEQ ID NO: 48289 - DNA, 20 bp, Artificial Sequence
  sgRNA
  Pcdhgc5_11
ggtcttgggcactatccagt

SEQ ID NO: 48290 - DNA, 20 bp, Artificial Sequence
  sgRNA
  Pcdhgc5_12
tgtcagctaagtgtctgcgg

SEQ ID NO: 48291 - DNA, 20 bp, Artificial Sequence
  sgRNA
  Pcdhgc5_13
ctcatagtcaaaggtccgct

SEQ ID NO: 48292 - DNA, 20 bp, Artificial Sequence
  sgRNA
  Pcdhgc5_14
atggacgaatctttgcccag

SEQ ID NO: 48293 - DNA, 20 bp, Artificial Sequence
  sgRNA
  Pcdhgc5_15
agagagcacacccgtaggca

SEQ ID NO: 48294 - DNA, 20 bp, Artificial Sequence
  sgRNA
  Pcdhgc5_16
ctacccgggtgagctccagt

SEQ ID NO: 48295 - DNA, 20 bp, Artificial Sequence
  sgRNA
  Pcdhgc5_17
gtgaccagcgtcagcatcca

SEQ ID NO: 48296 - DNA, 20 bp, Artificial Sequence
  sgRNA
  Pcdhgc5_18
gctcccgcagcgtactagag

SEQ ID NO: 48297 - DNA, 20 bp, Artificial Sequence
  sgRNA
  Pcdhgc5_19
ctttgtgtatgtcaaccccg

SEQ ID NO: 48298 - DNA, 20 bp, Artificial Sequence
  sgRNA
  Pcdhgc5_20
gtatcgagcgctcagaccca

SEQ ID NO: 48299 - DNA, 20 bp, Artificial Sequence
  sgRNA
  Pcsk5_1
gtgccctgatggatcatacg

SEQ ID NO: 48300 - DNA, 20 bp, Artificial Sequence
  sgRNA
  Pcsk5_2
tgcatcgactgcagacgtgt

SEQ ID NO: 48301 - DNA, 20 bp, Artificial Sequence
  sgRNA
  Pcsk5_3
gctgtacggacgtgccatag

SEQ ID NO: 48302 - DNA, 20 bp, Artificial Sequence
  sgRNA
  Pcsk5_4
tattgtcaggacttcccgtg

SEQ ID NO: 48303 - DNA, 20 bp, Artificial Sequence
  sgRNA
  Pcsk5_5
acgcttccgctacagccgag

SEQ ID NO: 48304 - DNA, 20 bp, Artificial Sequence
  sgRNA
  Pcsk5_6
gcgcgtctacaccaaccact

SEQ ID NO: 48305 - DNA, 20 bp, Artificial Sequence
  sgRNA
  Pcsk5_7
tggatgtattaactgcaccg

SEQ ID NO: 48306 - DNA, 20 bp, Artificial Sequence
  sgRNA
  Pcsk5_8
cagctgtgaaaagtgttccg

SEQ ID NO: 48307 - DNA, 20 bp, Artificial Sequence
  sgRNA
  Pcsk5_9
agttctccagacattccccg

SEQ ID NO: 48308 - DNA, 20 bp, Artificial Sequence
  sgRNA
  Pcsk5_10
gcatcccagaatgtatcgta

SEQ ID NO: 48309 - DNA, 20 bp, Artificial Sequence
  sgRNA
  Pcsk5_11
tattatggagaaagcaccag

SEQ ID NO: 48310 - DNA, 20 bp, Artificial Sequence
  sgRNA
  Pcsk5_12
ccgctgttcggtcacctgcg

SEQ ID NO: 48311 - DNA, 20 bp, Artificial Sequence
  sgRNA
  Pcsk5_13
gcattcccatttcacaccga

SEQ ID NO: 48312 - DNA, 20 bp, Artificial Sequence
  sgRNA
  Pcsk5_14
tagcgttcaaatgtcccgca

SEQ ID NO: 48313 - DNA, 20 bp, Artificial Sequence
  sgRNA
  Pcsk5_15
cttgcatcataacgaggcat

SEQ ID NO: 48314 - DNA, 20 bp, Artificial Sequence
  sgRNA
  Pcsk5_16
ccttgacaagtgtagtggca

SEQ ID NO: 48315 - DNA, 20 bp, Artificial Sequence
  sgRNA
  Pcsk5_17
catcccagaatgtatcgtag

SEQ ID NO: 48316 - DNA, 20 bp, Artificial Sequence
  sgRNA
  Pcsk5_18
agtagtgctcagggcaagcg

SEQ ID NO: 48317 - DNA, 20 bp, Artificial Sequence
  sgRNA
  Pcsk5_19
gctgaggtcataatccctct

SEQ ID NO: 48318 - DNA, 20 bp, Artificial Sequence
  sgRNA
  Pcsk5_20
agtctaaaagatatccactg

SEQ ID NO: 48319 - DNA, 20 bp, Artificial Sequence
  sgRNA
  Pdcd1_1
caatacagggatacccacta

SEQ ID NO: 48320 - DNA, 20 bp, Artificial Sequence
  sgRNA
  Pdcd1_2
gacacacggcgcaatgacag

SEQ ID NO: 48321 - DNA, 20 bp, Artificial Sequence
  sgRNA
  Pdcd1_3
cagcttgtccaactggtcgg

SEQ ID NO: 48322 - DNA, 20 bp, Artificial Sequence
  sgRNA
  Pdcd1_4
gctcaaaccattacagaagg

SEQ ID NO: 48323 - DNA, 20 bp, Artificial Sequence
  sgRNA
  Pdcd1_5
tgttgagcagaagacagcta

SEQ ID NO: 48324 - DNA, 20 bp, Artificial Sequence
  sgRNA
  Pdcd1_6
agttgagctggcaatcaggg

SEQ ID NO: 48325 - DNA, 20 bp, Artificial Sequence
  sgRNA
  Pdcd1_7
gcccctacgtcccatggccg

SEQ ID NO: 48326 - DNA, 20 bp, Artificial Sequence
  sgRNA
  Pdcd1_8
ttaccacgagctctgctcca

SEQ ID NO: 48327 - DNA, 20 bp, Artificial Sequence
  sgRNA
  Pdcd1_9
cataagatcctccgaccagt

SEQ ID NO: 48328 - DNA, 20 bp, Artificial Sequence
  sgRNA
  Pdcd1_10
ggtaccctggtcattcactt

SEQ ID NO: 48329 - DNA, 20 bp, Artificial Sequence
  sgRNA
  Pdcd1_11
tgaatgaccagggtacctgc

SEQ ID NO: 48330 - DNA, 20 bp, Artificial Sequence
  sgRNA
  Pdcd1_12
acatgaacatccttgacaca

SEQ ID NO: 48331 - DNA, 20 bp, Artificial Sequence
  sgRNA
  Pdcd1_13
acagcccaagtgaatgacca

SEQ ID NO: 48332 - DNA, 20 bp, Artificial Sequence
  sgRNA
  Pdcd1_14
aggccagcagcagcaataca

SEQ ID NO: 48333 - DNA, 20 bp, Artificial Sequence
  sgRNA
  Pdcd1_15
gcagggagatggccccacag

SEQ ID NO: 48334 - DNA, 20 bp, Artificial Sequence
  sgRNA
  Pdcd1_16
cctcgcccaaaccagaaggc

SEQ ID NO: 48335 - DNA, 20 bp, Artificial Sequence
  sgRNA
  Pdcd1_17
gcaccccaaggcaaaaatcg

SEQ ID NO: 48336 - DNA, 20 bp, Artificial Sequence
  sgRNA
  Pdcd1_18
gcaaaaatcgaggagagccc

SEQ ID NO: 48337 - DNA, 20 bp, Artificial Sequence
  sgRNA
  Pdcd1_19
agcccctcgcccaaaccaga

SEQ ID NO: 48338 - DNA, 20 bp, Artificial Sequence
  sgRNA
  Pdcd1_20
gcagctgtatgatctggaag

SEQ ID NO: 48339 - DNA, 20 bp, Artificial Sequence
  sgRNA
  Pdcd1lg2_1
ccccgcagatgaccaggcaa

SEQ ID NO: 48340 - DNA, 20 bp, Artificial Sequence
  sgRNA
  Pdcd1lg2_2
gatagacactaggatcctgg

SEQ ID NO: 48341 - DNA, 20 bp, Artificial Sequence
  sgRNA
  Pdcd1lg2_3
ccagttcagtgcattctctg

SEQ ID NO: 48342 - DNA, 20 bp, Artificial Sequence
  sgRNA
  Pdcd1lg2_4
ctaggggataacctctagcc

SEQ ID NO: 48343 - DNA, 20 bp, Artificial Sequence
  sgRNA
  Pdcd1lg2_5
ctgggactacaagtacctga

SEQ ID NO: 48344 - DNA, 20 bp, Artificial Sequence
  sgRNA
  Pdcd1lg2_6
ccgttgcctggtcatctgcg

SEQ ID NO: 48345 - DNA, 20 bp, Artificial Sequence
  sgRNA
  Pdcd1lg2_7
gacctggtagaggccttcgg

SEQ ID NO: 48346 - DNA, 20 bp, Artificial Sequence
  sgRNA
  Pdcd1lg2_8
gaagtgtacaccgtagacgt

SEQ ID NO: 48347 - DNA, 20 bp, Artificial Sequence
  sgRNA
  Pdcd1lg2_9
tgtaagctcaggttcagtat

SEQ ID NO: 48348 - DNA, 20 bp, Artificial Sequence
  sgRNA
  Pdcd1lg2_10
cttacatgaggatagacact

SEQ ID NO: 48349 - DNA, 20 bp, Artificial Sequence
  sgRNA
  Pdcd1lg2_11
ggccaggaagatcaaagcga

SEQ ID NO: 48350 - DNA, 20 bp, Artificial Sequence
  sgRNA
  Pdcd1lg2_12
gggcagctgctcctccagca

SEQ ID NO: 48351 - DNA, 20 bp, Artificial Sequence
  sgRNA
  Pdcd1lg2_13
aacccaaagtccccagaacg

SEQ ID NO: 48352 - DNA, 20 bp, Artificial Sequence
  sgRNA
  Pdcd1lg2_14
tggaacaaagcctttcccag

SEQ ID NO: 48353 - DNA, 20 bp, Artificial Sequence
  sgRNA
  Pdcd1lg2_15
aatctctcacttggacacta

SEQ ID NO: 48354 - DNA, 20 bp, Artificial Sequence
  sgRNA
  Pdcd1lg2_16
ttgccaggacacttctgcta

SEQ ID NO: 48355 - DNA, 20 bp, Artificial Sequence
  sgRNA
  Pdcd1lg2_17
ggaggttccaggtacagggg

SEQ ID NO: 48356 - DNA, 20 bp, Artificial Sequence
  sgRNA
  Pdcd1lg2_18
atgcagctgaagtttctgct

SEQ ID NO: 48357 - DNA, 20 bp, Artificial Sequence
  sgRNA
  Pdcd1lg2_19
ctttctctggattatcacta

SEQ ID NO: 48358 - DNA, 20 bp, Artificial Sequence
  sgRNA
  Pdcd1lg2_20
caggtacttgtagtcccagg

SEQ ID NO: 48359 - DNA, 20 bp, Artificial Sequence
  sgRNA
  Pdgfra_1
taaggcaggagaaacgatcg

SEQ ID NO: 48360 - DNA, 20 bp, Artificial Sequence
  sgRNA
  Pdgfra_2
taaccttgcacaataacggg

SEQ ID NO: 48361 - DNA, 20 bp, Artificial Sequence
  sgRNA
  Pdgfra_3
agatatactcatgtccatcg

SEQ ID NO: 48362 - DNA, 20 bp, Artificial Sequence
  sgRNA
  Pdgfra_4
cacagaatactgcttctatg

SEQ ID NO: 48363 - DNA, 20 bp, Artificial Sequence
  sgRNA
  Pdgfra_5
gtacactttgaccgtcccca

SEQ ID NO: 48364 - DNA, 20 bp, Artificial Sequence
  sgRNA
  Pdgfra_6
gatcaagagtggataccgga

SEQ ID NO: 48365 - DNA, 20 bp, Artificial Sequence
  sgRNA
  Pdgfra_7
ctttcggacgatgactccga

SEQ ID NO: 48366 - DNA, 20 bp, Artificial Sequence
  sgRNA
  Pdgfra_8
aaggaatcggtcatcccgag

SEQ ID NO: 48367 - DNA, 20 bp, Artificial Sequence
  sgRNA
  Pdgfra_9
gtgaggccaccgtcaaaggg

SEQ ID NO: 48368 - DNA, 20 bp, Artificial Sequence
  sgRNA
  Pdgfra_10
gcatgcgtgccacggccgga

SEQ ID NO: 48369 - DNA, 20 bp, Artificial Sequence
  sgRNA
  Pdgfra_11
acggtatgaaattcgctgga

SEQ ID NO: 48370 - DNA, 20 bp, Artificial Sequence
  sgRNA
  Pdgfra_12
ctctccactgtccttcaccg

SEQ ID NO: 48371 - DNA, 20 bp, Artificial Sequence
  sgRNA
  Pdgfra_13
gttgccttacgactccagat

SEQ ID NO: 48372 - DNA, 20 bp, Artificial Sequence
  sgRNA
  Pdgfra_14
ccttcattacaggttgggac

SEQ ID NO: 48373 - DNA, 20 bp, Artificial Sequence
  sgRNA
  Pdgfra_15
ctccagcgaatttcataccg

SEQ ID NO: 48374 - DNA, 20 bp, Artificial Sequence
  sgRNA
  Pdgfra_16
cctccgcagcccacaccgga

SEQ ID NO: 48375 - DNA, 20 bp, Artificial Sequence
  sgRNA
  Pdgfra_17
cccctcttccagaaatcgac

SEQ ID NO: 48376 - DNA, 20 bp, Artificial Sequence
  sgRNA
  Pdgfra_18
gatagtggagaacctgttgc

SEQ ID NO: 48377 - DNA, 20 bp, Artificial Sequence
  sgRNA
  Pdgfra_19
aaagagtgaccatccggccg

SEQ ID NO: 48378 - DNA, 20 bp, Artificial Sequence
  sgRNA
  Pdgfra_20
gaacgtcctccctttgacgg

SEQ ID NO: 48379 - DNA, 20 bp, Artificial Sequence
  sgRNA
  Pdgfrb_1
cggacagtggctgatccacg

SEQ ID NO: 48380 - DNA, 20 bp, Artificial Sequence
  sgRNA
  Pdgfrb_2
ccgcagagaatggctacgtg

SEQ ID NO: 48381 - DNA, 20 bp, Artificial Sequence
  sgRNA
  Pdgfrb_3
atggacgtacccccgcatga

SEQ ID NO: 48382 - DNA, 20 bp, Artificial Sequence
  sgRNA
  Pdgfrb_4
cggtcatgagtacatctacg

SEQ ID NO: 48383 - DNA, 20 bp, Artificial Sequence
  sgRNA
  Pdgfrb_5
gtaccctacgaccaccagcg

SEQ ID NO: 48384 - DNA, 20 bp, Artificial Sequence
  sgRNA
  Pdgfrb_6
tactatgcgagccttccacg

SEQ ID NO: 48385 - DNA, 20 bp, Artificial Sequence
  sgRNA
  Pdgfrb_7
agtccaccagatcaccgtat

SEQ ID NO: 48386 - DNA, 20 bp, Artificial Sequence
  sgRNA
  Pdgfrb_8
cattgcccatcacaatgcac

SEQ ID NO: 48387 - DNA, 20 bp, Artificial Sequence
  sgRNA
  Pdgfrb_9
ggtcccaagcccgctttccg

SEQ ID NO: 48388 - DNA, 20 bp, Artificial Sequence
  sgRNA
  Pdgfrb_10
gcctggctcgagacatcatg

SEQ ID NO: 48389 - DNA, 20 bp, Artificial Sequence
  sgRNA
  Pdgfrb_11
gtgtctacaacaactcacta

SEQ ID NO: 48390 - DNA, 20 bp, Artificial Sequence
  sgRNA
  Pdgfrb_12
aggaatgtgctcatctgcga

SEQ ID NO: 48391 - DNA, 20 bp, Artificial Sequence
  sgRNA
  Pdgfrb_13
ggcgcgataggtcctttcag

SEQ ID NO: 48392 - DNA, 20 bp, Artificial Sequence
  sgRNA
  Pdgfrb_14
gctggacctcatcgtcctcg

SEQ ID NO: 48393 - DNA, 20 bp, Artificial Sequence
  sgRNA
  Pdgfrb_15
cggtcccaggagccataaca

SEQ ID NO: 48394 - DNA, 20 bp, Artificial Sequence
  sgRNA
  Pdgfrb_16
catttggctgaggcatgccc

SEQ ID NO: 48395 - DNA, 20 bp, Artificial Sequence
  sgRNA
  Pdgfrb_17
tcttggaccccacctgaacg

SEQ ID NO: 48396 - DNA, 20 bp, Artificial Sequence
  sgRNA
  Pdgfrb_18
gctgtagacgtagtaagtat

SEQ ID NO: 48397 - DNA, 20 bp, Artificial Sequence
  sgRNA
  Pdgfrb_19
gagatcaccaccactttgaa

SEQ ID NO: 48398 - DNA, 20 bp, Artificial Sequence
  sgRNA
  Pdgfrb_20
tcacggtctgagccattcgc

SEQ ID NO: 48399 - DNA, 20 bp, Artificial Sequence
  sgRNA
  Pear1_1
ctgtgctcctggctatatcg

SEQ ID NO: 48400 - DNA, 20 bp, Artificial Sequence
  sgRNA
  Pear1_2
aggggttactacgagagcag

SEQ ID NO: 48401 - DNA, 20 bp, Artificial Sequence
  sgRNA
  Pear1_3
ggacataggttagcgcagtg

SEQ ID NO: 48402 - DNA, 20 bp, Artificial Sequence
  sgRNA
  Pear1_4
gtttgattgccagtgctatg

SEQ ID NO: 48403 - DNA, 20 bp, Artificial Sequence
  sgRNA
  Pear1_5
agtccatcttcaccacctga

SEQ ID NO: 48404 - DNA, 20 bp, Artificial Sequence
  sgRNA
  Pear1_6
cttgaccgaagcggcccacg

SEQ ID NO: 48405 - DNA, 20 bp, Artificial Sequence
  sgRNA
  Pear1_7
gcgaccatggacacactcct

SEQ ID NO: 48406 - DNA, 20 bp, Artificial Sequence
  sgRNA
  Pear1_8
tcttcctgccacccatcgga

SEQ ID NO: 48407 - DNA, 20 bp, Artificial Sequence
  sgRNA
  Pear1_9
gtgccaagaagagtgccccg

SEQ ID NO: 48408 - DNA, 20 bp, Artificial Sequence
  sgRNA
  Pear1_10
cgtttgccatagcgaccagg

SEQ ID NO: 48409 - DNA, 20 bp, Artificial Sequence
  sgRNA
  Pear1_11
ttgatcccgtaagtgtccgg

SEQ ID NO: 48410 - DNA, 20 bp, Artificial Sequence
  sgRNA
  Pear1_12
gacaggccctgactgctccg

SEQ ID NO: 48411 - DNA, 20 bp, Artificial Sequence
  sgRNA
  Pear1_13
cgctgactggaagcaccgcc

SEQ ID NO: 48412 - DNA, 20 bp, Artificial Sequence
  sgRNA
  Pear1_14
catagcactggcaatcaaac

SEQ ID NO: 48413 - DNA, 20 bp, Artificial Sequence
  sgRNA
  Pear1_15
cctggcagctcagaccatag

SEQ ID NO: 48414 - DNA, 20 bp, Artificial Sequence
  sgRNA
  Pear1_16
gacatggttctcacgcccgt

SEQ ID NO: 48415 - DNA, 20 bp, Artificial Sequence
  sgRNA
  Pear1_17
gttcctgtgatcccaagagt

SEQ ID NO: 48416 - DNA, 20 bp, Artificial Sequence
  sgRNA
  Pear1_18
gcactggcaatcaaactggc

SEQ ID NO: 48417 - DNA, 20 bp, Artificial Sequence
  sgRNA
  Pear1_19
ggggagtcgtagtgaccagg

SEQ ID NO: 48418 - DNA, 20 bp, Artificial Sequence
  sgRNA
  Pear1_20
actgagcgcctctgtccgga

SEQ ID NO: 48419 - DNA, 20 bp, Artificial Sequence
  sgRNA
  Pecam1_1
ggatctcgctgaacaccgcg

SEQ ID NO: 48420 - DNA, 20 bp, Artificial Sequence
  sgRNA
  Pecam1_2
acaggtccaacaactcccct

SEQ ID NO: 48421 - DNA, 20 bp, Artificial Sequence
  sgRNA
  Pecam1_3
tgtcattcacgaccgcttgg

SEQ ID NO: 48422 - DNA, 20 bp, Artificial Sequence
  sgRNA
  Pecam1_4
ttccatcctgtcgagtaacg

SEQ ID NO: 48423 - DNA, 20 bp, Artificial Sequence
  sgRNA
  Pecam1_5
cttcacctcgtactcaatcg

SEQ ID NO: 48424 - DNA, 20 bp, Artificial Sequence
  sgRNA
  Pecam1_6
ccttctatgatcatcccagg

SEQ ID NO: 48425 - DNA, 20 bp, Artificial Sequence
  sgRNA
  Pecam1_7
agtttgaaatcaagccccct

SEQ ID NO: 48426 - DNA, 20 bp, Artificial Sequence
  sgRNA
  Pecam1_8
gaatttcagcaagatcgccg

SEQ ID NO: 48427 - DNA, 20 bp, Artificial Sequence
  sgRNA
  Pecam1_9
ccccttctatgatcatccca

SEQ ID NO: 48428 - DNA, 20 bp, Artificial Sequence
  sgRNA
  Pecam1_10
gttctataaggacgatgcga

SEQ ID NO: 48429 - DNA, 20 bp, Artificial Sequence
  sgRNA
  Pecam1_11
ggtgacgtattcactcctga

SEQ ID NO: 48430 - DNA, 20 bp, Artificial Sequence
  sgRNA
  Pecam1_12
agccaacttcaccatccaga

SEQ ID NO: 48431 - DNA, 20 bp, Artificial Sequence
  sgRNA
  Pecam1_13
ggagaactctaacttcggct

SEQ ID NO: 48432 - DNA, 20 bp, Artificial Sequence
  sgRNA
  Pecam1_14
ggtgtacagtgagatccgga

SEQ ID NO: 48433 - DNA, 20 bp, Artificial Sequence
  sgRNA
  Pecam1_15
taattgccattcccaccccg

SEQ ID NO: 48434 - DNA, 20 bp, Artificial Sequence
  sgRNA
  Pecam1_16
gggtgtcattcacgaccgct

SEQ ID NO: 48435 - DNA, 20 bp, Artificial Sequence
  sgRNA
  Pecam1_17
actgtacctcgttactcgac

SEQ ID NO: 48436 - DNA, 20 bp, Artificial Sequence
  sgRNA
  Pecam1_18
catggaataccagtgcagag

SEQ ID NO: 48437 - DNA, 20 bp, Artificial Sequence
  sgRNA
  Pecam1_19
cccttggtccagacgactgg

SEQ ID NO: 48438 - DNA, 20 bp, Artificial Sequence
  sgRNA
  Pecam1_20
ggacaaagtttgtcaagcga

SEQ ID NO: 48439 - DNA, 20 bp, Artificial Sequence
  sgRNA
  Pfpl_1
gaatagtaaagacatcatca

SEQ ID NO: 48440 - DNA, 20 bp, Artificial Sequence
  sgRNA
  Pfpl_2
agttgtgccgtcaattatca

SEQ ID NO: 48441 - DNA, 20 bp, Artificial Sequence
  sgRNA
  Pfpl_3
atgtacgacagaatatcttg

SEQ ID NO: 48442 - DNA, 20 bp, Artificial Sequence
  sgRNA
  Pfpl_4
tacaactttaatacataccc

SEQ ID NO: 48443 - DNA, 20 bp, Artificial Sequence
  sgRNA
  Pfpl_5
gaggaattcccttctaccca

SEQ ID NO: 48444 - DNA, 20 bp, Artificial Sequence
  sgRNA
  Pfpl_6
tggccatctatggcaaccgg

SEQ ID NO: 48445 - DNA, 20 bp, Artificial Sequence
  sgRNA
  Pfpl_7
gatgtgaaagaaccatacaa

SEQ ID NO: 48446 - DNA, 20 bp, Artificial Sequence
  sgRNA
  Pfpl_8
tttctgccaaagtgtcccgg

SEQ ID NO: 48447 - DNA, 20 bp, Artificial Sequence
  sgRNA
  Pfpl_9
taccctgcaatggaacctag

SEQ ID NO: 48448 - DNA, 20 bp, Artificial Sequence
  sgRNA
  Pfpl_10
tgaggatcaagagttctgcc

SEQ ID NO: 48449 - DNA, 20 bp, Artificial Sequence
  sgRNA
  Pfpl_11
ggtcaacgctccctttggag

SEQ ID NO: 48450 - DNA, 20 bp, Artificial Sequence
  sgRNA
  Pfpl_12
agttgctccaccaagtggcg

SEQ ID NO: 48451 - DNA, 20 bp, Artificial Sequence
  sgRNA
  Pfpl_13
aatactctgaaccctagaac

SEQ ID NO: 48452 - DNA, 20 bp, Artificial Sequence
  sgRNA
  Pfpl_14
aactgataaacccctccaaa

SEQ ID NO: 48453 - DNA, 20 bp, Artificial Sequence
  sgRNA
  Pfpl_15
catgggtctgagatagcaga

SEQ ID NO: 48454 - DNA, 20 bp, Artificial Sequence
  sgRNA
  Pfpl_16
aatcatgccctgataattga

SEQ ID NO: 48455 - DNA, 20 bp, Artificial Sequence
  sgRNA
  Pfpl_17
tcaaaacagaaccggttcta

SEQ ID NO: 48456 - DNA, 20 bp, Artificial Sequence
  sgRNA
  Pfpl_18
ataagagctaacttcagcct

SEQ ID NO: 48457 - DNA, 20 bp, Artificial Sequence
  sgRNA
  Pfpl_19
gtgtaaagatgagttcagag

SEQ ID NO: 48458 - DNA, 20 bp, Artificial Sequence
  sgRNA
  Pfpl_20
ctcctctaggttccattgca

SEQ ID NO: 48459 - DNA, 20 bp, Artificial Sequence
  sgRNA
  Pgap1_1
atagacaacaatatgcgaca

SEQ ID NO: 48460 - DNA, 20 bp, Artificial Sequence
  sgRNA
  Pgap1_2
atatgtaacttaccacacga

SEQ ID NO: 48461 - DNA, 20 bp, Artificial Sequence
  sgRNA
  Pgap1_3
agaatttgctcctacaagtg

SEQ ID NO: 48462 - DNA, 20 bp, Artificial Sequence
  sgRNA
  Pgap1_4
gtcgtcagactgtcagtatg

SEQ ID NO: 48463 - DNA, 20 bp, Artificial Sequence
  sgRNA
  Pgap1_5
catagaacgccagattccag

SEQ ID NO: 48464 - DNA, 20 bp, Artificial Sequence
  sgRNA
  Pgap1_6
gttaggtcagaaattatgga

SEQ ID NO: 48465 - DNA, 20 bp, Artificial Sequence
  sgRNA
  Pgap1_7
aacgatctaatggcatcaca

SEQ ID NO: 48466 - DNA, 20 bp, Artificial Sequence
  sgRNA
  Pgap1_8
tggctcctcccacttataca

SEQ ID NO: 48467 - DNA, 20 bp, Artificial Sequence
  sgRNA
  Pgap1_9
aaggtgacgttaaatacaaa

SEQ ID NO: 48468 - DNA, 20 bp, Artificial Sequence
  sgRNA
  Pgap1_10
ataattggtcactcaatggg

SEQ ID NO: 48469 - DNA, 20 bp, Artificial Sequence
  sgRNA
  Pgap1_11
actctggctagtcaaaacga

SEQ ID NO: 48470 - DNA, 20 bp, Artificial Sequence
  sgRNA
  Pgap1_12
tataaaatggtgattcaaaa

SEQ ID NO: 48471 - DNA, 20 bp, Artificial Sequence
  sgRNA
  Pgap1_13
ttatactcactcctctcaac

SEQ ID NO: 48472 - DNA, 20 bp, Artificial Sequence
  sgRNA
  Pgap1_14
acgatctaatggcatcacag

SEQ ID NO: 48473 - DNA, 20 bp, Artificial Sequence
  sgRNA
  Pgap1_15
gccagaaaatgacagccatg

SEQ ID NO: 48474 - DNA, 20 bp, Artificial Sequence
  sgRNA
  Pgap1_16
acacgggaccctgtataagt

SEQ ID NO: 48475 - DNA, 20 bp, Artificial Sequence
  sgRNA
  Pgap1_17
cgtgattaacttgctgacgt

SEQ ID NO: 48476 - DNA, 20 bp, Artificial Sequence
  sgRNA
  Pgap1_18
gtacagcagagtctttatgg

SEQ ID NO: 48477 - DNA, 20 bp, Artificial Sequence
  sgRNA
  Pgap1_19
aaggatgctagatacaacgt

SEQ ID NO: 48478 - DNA, 20 bp, Artificial Sequence
  sgRNA
  Pgap1_20
gcagctctatgttgtagtat

SEQ ID NO: 48479 - DNA, 20 bp, Artificial Sequence
  sgRNA
  Phex_1
ttaggatattaggtgccgag

SEQ ID NO: 48480 - DNA, 20 bp, Artificial Sequence
  sgRNA
  Phex_2
acatgagaaccgaaccagtg

SEQ ID NO: 48481 - DNA, 20 bp, Artificial Sequence
  sgRNA
  Phex_3
cagaattgctgtattgaccg

SEQ ID NO: 48482 - DNA, 20 bp, Artificial Sequence
  sgRNA
  Phex_4
aaccggaaaaaattctcaca

SEQ ID NO: 48483 - DNA, 20 bp, Artificial Sequence
  sgRNA
  Phex_5
gagcagtgtgcccaacacca

SEQ ID NO: 48484 - DNA, 20 bp, Artificial Sequence
  sgRNA
  Phex_6
tgtgaatgttcacttccagg

SEQ ID NO: 48485 - DNA, 20 bp, Artificial Sequence
  sgRNA
  Phex_7
ccagtgcaatccgaatgcct

SEQ ID NO: 48486 - DNA, 20 bp, Artificial Sequence
  sgRNA
  Phex_8
caaacactggcaacgttccg

SEQ ID NO: 48487 - DNA, 20 bp, Artificial Sequence
  sgRNA
  Phex_9
gcggaccaccacattctccg

SEQ ID NO: 48488 - DNA, 20 bp, Artificial Sequence
  sgRNA
  Phex_10
aaaatggaaaccttgatccg

SEQ ID NO: 48489 - DNA, 20 bp, Artificial Sequence
  sgRNA
  Phex_11
tagcccagccagtcaaactg

SEQ ID NO: 48490 - DNA, 20 bp, Artificial Sequence
  sgRNA
  Phex_12
aagctaatattggtcctgaa

SEQ ID NO: 48491 - DNA, 20 bp, Artificial Sequence
  sgRNA
  Phex_13
catcaggggacacatacaaa

SEQ ID NO: 48492 - DNA, 20 bp, Artificial Sequence
  sgRNA
  Phex_14
gcaggcgctttcaatataga

SEQ ID NO: 48493 - DNA, 20 bp, Artificial Sequence
  sgRNA
  Phex_15
gtatcattcattataaactc

SEQ ID NO: 48494 - DNA, 20 bp, Artificial Sequence
  sgRNA
  Phex_16
gcactggccctgtttattgg

SEQ ID NO: 48495 - DNA, 20 bp, Artificial Sequence
  sgRNA
  Phex_17
ggaccaagcaacactctctc

SEQ ID NO: 48496 - DNA, 20 bp, Artificial Sequence
  sgRNA
  Phex_18
ccacactaaataattggcaa

SEQ ID NO: 48497 - DNA, 20 bp, Artificial Sequence
  sgRNA
  Phex_19
cagggtgccaccaataaaca

SEQ ID NO: 48498 - DNA, 20 bp, Artificial Sequence
  sgRNA
  Phex_20
ccagaattccaaacctcagc

SEQ ID NO: 48499 - DNA, 20 bp, Artificial Sequence
  sgRNA
  Pi16_1
cagggatatgtgttgatgtg

SEQ ID NO: 48500 - DNA, 20 bp, Artificial Sequence
  sgRNA
  Pi16_2
tctacatttctcggtaacaa

SEQ ID NO: 48501 - DNA, 20 bp, Artificial Sequence
  sgRNA
  Pi16_3
ggacgagaagcaaactatgg

SEQ ID NO: 48502 - DNA, 20 bp, Artificial Sequence
  sgRNA
  Pi16_4
aggcgcaggattcgcctcca

SEQ ID NO: 48503 - DNA, 20 bp, Artificial Sequence
  sgRNA
  Pi16_5
actggcccttcatccaccga

SEQ ID NO: 48504 - DNA, 20 bp, Artificial Sequence
  sgRNA
  Pi16_6
gcccgaggccatattgcccg

SEQ ID NO: 48505 - DNA, 20 bp, Artificial Sequence
  sgRNA
  Pi16_7
tggcattacccgaagcacta

SEQ ID NO: 48506 - DNA, 20 bp, Artificial Sequence
  sgRNA
  Pi16_8
gtccgtaccccaaatccagg

SEQ ID NO: 48507 - DNA, 20 bp, Artificial Sequence
  sgRNA
  Pi16_9
ctacgctcagaagtgcgtgt

SEQ ID NO: 48508 - DNA, 20 bp, Artificial Sequence
  sgRNA
  Pi16_10
ttcgcctccaagggtgaccg

SEQ ID NO: 48509 - DNA, 20 bp, Artificial Sequence
  sgRNA
  Pi16_11
tcacaaccagtaccgtgccc

SEQ ID NO: 48510 - DNA, 20 bp, Artificial Sequence
  sgRNA
  Pi16_12
ggggccacaacaaagaacgc

SEQ ID NO: 48511 - DNA, 20 bp, Artificial Sequence
  sgRNA
  Pi16_13
tgcgatccgaaccagatgtg

SEQ ID NO: 48512 - DNA, 20 bp, Artificial Sequence
  sgRNA
  Pi16_14
aggtgaggactcggttgcca

SEQ ID NO: 48513 - DNA, 20 bp, Artificial Sequence
  sgRNA
  Pi16_15
gcggcggcaacatcacccac

SEQ ID NO: 48514 - DNA, 20 bp, Artificial Sequence
  sgRNA
  Pi16_16
aactgaagccccaagctcca

SEQ ID NO: 48515 - DNA, 20 bp, Artificial Sequence
  sgRNA
  Pi16_17
ggcgcaggattcgcctccaa

SEQ ID NO: 48516 - DNA, 20 bp, Artificial Sequence
  sgRNA
  Pi16_18
gcacttctgagcgtaggcct

SEQ ID NO: 48517 - DNA, 20 bp, Artificial Sequence
  sgRNA
  Pi16_19
tgtgccttgcagaaaccaag

SEQ ID NO: 48518 - DNA, 20 bp, Artificial Sequence
  sgRNA
  Pi16_20
agaaccccgaaaaggccgac

SEQ ID NO: 48519 - DNA, 20 bp, Artificial Sequence
  sgRNA
  Piezo1_1
tcctcgtgaggcgtccacag

SEQ ID NO: 48520 - DNA, 20 bp, Artificial Sequence
  sgRNA
  Piezo1_2
tggggctggagtagttaggg

SEQ ID NO: 48521 - DNA, 20 bp, Artificial Sequence
  sgRNA
  Piezo1_3
gatgatacaggtccacacgg

SEQ ID NO: 48522 - DNA, 20 bp, Artificial Sequence
  sgRNA
  Piezo1_4
ggagattgtcaccgacgctg

SEQ ID NO: 48523 - DNA, 20 bp, Artificial Sequence
  sgRNA
  Piezo1_5
aaccagtctttgctgtaccg

SEQ ID NO: 48524 - DNA, 20 bp, Artificial Sequence
  sgRNA
  Piezo1_6
tgaattccgccctcatcaag

SEQ ID NO: 48525 - DNA, 20 bp, Artificial Sequence
  sgRNA
  Piezo1_7
aggacatctttaacaccacc

SEQ ID NO: 48526 - DNA, 20 bp, Artificial Sequence
  sgRNA
  Piezo1_8
ctgatgtgcctcgtgtgccg

SEQ ID NO: 48527 - DNA, 20 bp, Artificial Sequence
  sgRNA
  Piezo1_9
ggaacagctacgttgtgctg

SEQ ID NO: 48528 - DNA, 20 bp, Artificial Sequence
  sgRNA
  Piezo1_10
tgttatccaagatcccccag

SEQ ID NO: 48529 - DNA, 20 bp, Artificial Sequence
  sgRNA
  Piezo1_11
cttccgcaccccaaaccagt

SEQ ID NO: 48530 - DNA, 20 bp, Artificial Sequence
  sgRNA
  Piezo1_12
gcaagcgccgaacgaacacc

SEQ ID NO: 48531 - DNA, 20 bp, Artificial Sequence
  sgRNA
  Piezo1_13
gctcgtccgtgaagcccgtg

SEQ ID NO: 48532 - DNA, 20 bp, Artificial Sequence
  sgRNA
  Piezo1_14
gcgcgtcagcccgtctaccg

SEQ ID NO: 48533 - DNA, 20 bp, Artificial Sequence
  sgRNA
  Piezo1_15
ggctgctgatgacctctgga

SEQ ID NO: 48534 - DNA, 20 bp, Artificial Sequence
  sgRNA
  Piezo1_16
agtacattcgtgctcccaat

SEQ ID NO: 48535 - DNA, 20 bp, Artificial Sequence
  sgRNA
  Piezo1_17
tcatggaagaaacgctgcaa

SEQ ID NO: 48536 - DNA, 20 bp, Artificial Sequence
  sgRNA
  Piezo1_18
gcaccagccagaacaggtag

SEQ ID NO: 48537 - DNA, 20 bp, Artificial Sequence
  sgRNA
  Piezo1_19
gaaggtgtctcaacacatag

SEQ ID NO: 48538 - DNA, 20 bp, Artificial Sequence
  sgRNA
  Piezo1_20
tgatgtcgacaatatcggcc

SEQ ID NO: 48539 - DNA, 20 bp, Artificial Sequence
  sgRNA
  Piezo2_1
ctcgatagtactcctgatgg

SEQ ID NO: 48540 - DNA, 20 bp, Artificial Sequence
  sgRNA
  Piezo2_2
tccttggcgcgaatacagca

SEQ ID NO: 48541 - DNA, 20 bp, Artificial Sequence
  sgRNA
  Piezo2_3
ctggaagcatgatcaaccca

SEQ ID NO: 48542 - DNA, 20 bp, Artificial Sequence
  sgRNA
  Piezo2_4
tcttcattacgggaacaacc

SEQ ID NO: 48543 - DNA, 20 bp, Artificial Sequence
  sgRNA
  Piezo2_5
attgtgacggacacatccag

SEQ ID NO: 48544 - DNA, 20 bp, Artificial Sequence
  sgRNA
  Piezo2_6
gtattcgcgccaaggaacta

SEQ ID NO: 48545 - DNA, 20 bp, Artificial Sequence
  sgRNA
  Piezo2_7
acaagagagaagactccgaa

SEQ ID NO: 48546 - DNA, 20 bp, Artificial Sequence
  sgRNA
  Piezo2_8
tattggatctacgtctgcgg

SEQ ID NO: 48547 - DNA, 20 bp, Artificial Sequence
  sgRNA
  Piezo2_9
gtagccacagcggatttgat

SEQ ID NO: 48548 - DNA, 20 bp, Artificial Sequence
  sgRNA
  Piezo2_10
atatgccaaactccgtcgtg

SEQ ID NO: 48549 - DNA, 20 bp, Artificial Sequence
  sgRNA
  Piezo2_11
gcagatctcgacattgtccc

SEQ ID NO: 48550 - DNA, 20 bp, Artificial Sequence
  sgRNA
  Piezo2_12
gatgctgccatctttgacct

SEQ ID NO: 48551 - DNA, 20 bp, Artificial Sequence
  sgRNA
  Piezo2_13
tatagtacatcaccagcagg

SEQ ID NO: 48552 - DNA, 20 bp, Artificial Sequence
  sgRNA
  Piezo2_14
ccaaaatcgccagcatcagg

SEQ ID NO: 48553 - DNA, 20 bp, Artificial Sequence
  sgRNA
  Piezo2_15
tggccatcatccagaagcgt

SEQ ID NO: 48554 - DNA, 20 bp, Artificial Sequence
  sgRNA
  Piezo2_16
tcaatgataacattatcaag

SEQ ID NO: 48555 - DNA, 20 bp, Artificial Sequence
  sgRNA
  Piezo2_17
gcatgcatctttcaatccgc

SEQ ID NO: 48556 - DNA, 20 bp, Artificial Sequence
  sgRNA
  Piezo2_18
tggcaatatgatcaccacgg

SEQ ID NO: 48557 - DNA, 20 bp, Artificial Sequence
  sgRNA
  Piezo2_19
gctggccgtcatattcatga

SEQ ID NO: 48558 - DNA, 20 bp, Artificial Sequence
  sgRNA
  Piezo2_20
gcgtatagtacatcaccagc

SEQ ID NO: 48559 - DNA, 20 bp, Artificial Sequence
  sgRNA
  Pigo_1
agtgattcggagcatcccgg

SEQ ID NO: 48560 - DNA, 20 bp, Artificial Sequence
  sgRNA
  Pigo_2
ctgccagcatcaatgaaagt

SEQ ID NO: 48561 - DNA, 20 bp, Artificial Sequence
  sgRNA
  Pigo_3
ggaactcctcctgcatgtgg

SEQ ID NO: 48562 - DNA, 20 bp, Artificial Sequence
  sgRNA
  Pigo_4
gcatcaccaatgctatgccc

SEQ ID NO: 48563 - DNA, 20 bp, Artificial Sequence
  sgRNA
  Pigo_5
acttctcctgggcatagcat

SEQ ID NO: 48564 - DNA, 20 bp, Artificial Sequence
  sgRNA
  Pigo_6
actgctcacgatgaaaccta

SEQ ID NO: 48565 - DNA, 20 bp, Artificial Sequence
  sgRNA
  Pigo_7
ttatgctgttgcatgtagag

SEQ ID NO: 48566 - DNA, 20 bp, Artificial Sequence
  sgRNA
  Pigo_8
ccaggcacatgcgagcgctg

SEQ ID NO: 48567 - DNA, 20 bp, Artificial Sequence
  sgRNA
  Pigo_9
cttcagactcacttcccggg

SEQ ID NO: 48568 - DNA, 20 bp, Artificial Sequence
  sgRNA
  Pigo_10
gagcagcagcacgagcccca

SEQ ID NO: 48569 - DNA, 20 bp, Artificial Sequence
  sgRNA
  Pigo_11
cacatgcaggaggagttcca

SEQ ID NO: 48570 - DNA, 20 bp, Artificial Sequence
  sgRNA
  Pigo_12
tttgtgggactacatagtcg

SEQ ID NO: 48571 - DNA, 20 bp, Artificial Sequence
  sgRNA
  Pigo_13
acttccccagtgttcccaaa

SEQ ID NO: 48572 - DNA, 20 bp, Artificial Sequence
  sgRNA
  Pigo_14
ctacaggtattagcagtagt

SEQ ID NO: 48573 - DNA, 20 bp, Artificial Sequence
  sgRNA
  Pigo_15
aatctaccgccacatgcagg

SEQ ID NO: 48574 - DNA, 20 bp, Artificial Sequence
  sgRNA
  Pigo_16
gtacacgcttcccaactgat

SEQ ID NO: 48575 - DNA, 20 bp, Artificial Sequence
  sgRNA
  Pigo_17
ggaaggcgtgtagtcttcat

SEQ ID NO: 48576 - DNA, 20 bp, Artificial Sequence
  sgRNA
  Pigo_18
ttaccgagactccagcatac

SEQ ID NO: 48577 - DNA, 20 bp, Artificial Sequence
  sgRNA
  Pigo_19
gtaatattaggacaggtcta

SEQ ID NO: 48578 - DNA, 20 bp, Artificial Sequence
  sgRNA
  Pigo_20
tggttgcctgccttactagt

SEQ ID NO: 48579 - DNA, 20 bp, Artificial Sequence
  sgRNA
  Pigr_1
atgtgatcattaacaccctg

SEQ ID NO: 48580 - DNA, 20 bp, Artificial Sequence
  sgRNA
  Pigr_2
gacactgggagctacaagtg

SEQ ID NO: 48581 - DNA, 20 bp, Artificial Sequence
  sgRNA
  Pigr_3
gctgatcaaacagtgccagt

SEQ ID NO: 48582 - DNA, 20 bp, Artificial Sequence
  sgRNA
  Pigr_4
aatcgtcgctctgttgtgaa

SEQ ID NO: 48583 - DNA, 20 bp, Artificial Sequence
  sgRNA
  Pigr_5
cctcaaccagctcaccaccg

SEQ ID NO: 48584 - DNA, 20 bp, Artificial Sequence
  sgRNA
  Pigr_6
tggtgcaagtggagcaacaa

SEQ ID NO: 48585 - DNA, 20 bp, Artificial Sequence
  sgRNA
  Pigr_7
ggtcgcagctcacagaagat

SEQ ID NO: 48586 - DNA, 20 bp, Artificial Sequence
  sgRNA
  Pigr_8
cctcaagtactggtgtcgct

SEQ ID NO: 48587 - DNA, 20 bp, Artificial Sequence
  sgRNA
  Pigr_9
cttgcaccagtatttctcct

SEQ ID NO: 48588 - DNA, 20 bp, Artificial Sequence
  sgRNA
  Pigr_10
gtctgggtagtagcacgtga

SEQ ID NO: 48589 - DNA, 20 bp, Artificial Sequence
  sgRNA
  Pigr_11
atagaagccagcatcctcgg

SEQ ID NO: 48590 - DNA, 20 bp, Artificial Sequence
  sgRNA
  Pigr_12
gctcaggcgctagcacctgg

SEQ ID NO: 48591 - DNA, 20 bp, Artificial Sequence
  sgRNA
  Pigr_13
ggcctgggtaccagtaaccg

SEQ ID NO: 48592 - DNA, 20 bp, Artificial Sequence
  sgRNA
  Pigr_14
tcctgggagtagaatttgca

SEQ ID NO: 48593 - DNA, 20 bp, Artificial Sequence
  sgRNA
  Pigr_15
tctatactactcacctcctg

SEQ ID NO: 48594 - DNA, 20 bp, Artificial Sequence
  sgRNA
  Pigr_16
tggcctcgtttgccacctca

SEQ ID NO: 48595 - DNA, 20 bp, Artificial Sequence
  sgRNA
  Pigr_17
atagctgcacaggtccacga

SEQ ID NO: 48596 - DNA, 20 bp, Artificial Sequence
  sgRNA
  Pigr_18
tggctcagcggtgcactccg

SEQ ID NO: 48597 - DNA, 20 bp, Artificial Sequence
  sgRNA
  Pigr_19
agagtcaatgacaagttcgc

SEQ ID NO: 48598 - DNA, 20 bp, Artificial Sequence
  sgRNA
  Pigr_20
gtaaagcaaggccagaccta

SEQ ID NO: 48599 - DNA, 20 bp, Artificial Sequence
  sgRNA
  Pigt_1
gatccgaatcccaacgcgtg

SEQ ID NO: 48600 - DNA, 20 bp, Artificial Sequence
  sgRNA
  Pigt_2
aaacaagtcatagacggcat

SEQ ID NO: 48601 - DNA, 20 bp, Artificial Sequence
  sgRNA
  Pigt_3
ggtaactggtgtggaacaag

SEQ ID NO: 48602 - DNA, 20 bp, Artificial Sequence
  sgRNA
  Pigt_4
tgagagtccgggagaacatg

SEQ ID NO: 48603 - DNA, 20 bp, Artificial Sequence
  sgRNA
  Pigt_5
gtagggcatgctgaagtccg

SEQ ID NO: 48604 - DNA, 20 bp, Artificial Sequence
  sgRNA
  Pigt_6
aaccgcaacggcaaaccgag

SEQ ID NO: 48605 - DNA, 20 bp, Artificial Sequence
  sgRNA
  Pigt_7
cgacaggtggagctcccgca

SEQ ID NO: 48606 - DNA, 20 bp, Artificial Sequence
  sgRNA
  Pigt_8
tcttctcgcaggctgtcgcg

SEQ ID NO: 48607 - DNA, 20 bp, Artificial Sequence
  sgRNA
  Pigt_9
gtagagtcggacaaagtagc

SEQ ID NO: 48608 - DNA, 20 bp, Artificial Sequence
  sgRNA
  Pigt_10
gatctgccttacgtgcacgg

SEQ ID NO: 48609 - DNA, 20 bp, Artificial Sequence
  sgRNA
  Pigt_11
gtgtcattggccagtcccag

SEQ ID NO: 48610 - DNA, 20 bp, Artificial Sequence
  sgRNA
  Pigt_12
aggcatcaaagacaaccgaa

SEQ ID NO: 48611 - DNA, 20 bp, Artificial Sequence
  sgRNA
  Pigt_13
gtaaggcagatcacattgta

SEQ ID NO: 48612 - DNA, 20 bp, Artificial Sequence
  sgRNA
  Pigt_14
tacacaccagaccccaacca

SEQ ID NO: 48613 - DNA, 20 bp, Artificial Sequence
  sgRNA
  Pigt_15
atcgaagagcccaagtcggg

SEQ ID NO: 48614 - DNA, 20 bp, Artificial Sequence
  sgRNA
  Pigt_16
gtactctgtccacttgagca

SEQ ID NO: 48615 - DNA, 20 bp, Artificial Sequence
  sgRNA
  Pigt_17
tttggaggacgcgatactgg

SEQ ID NO: 48616 - DNA, 20 bp, Artificial Sequence
  sgRNA
  Pigt_18
gagcatttctgcagataggc

SEQ ID NO: 48617 - DNA, 20 bp, Artificial Sequence
  sgRNA
  Pigt_19
gttctcccggactctcacag

SEQ ID NO: 48618 - DNA, 20 bp, Artificial Sequence
  sgRNA
  Pigt_20
gatgaggttagccagccgct

SEQ ID NO: 48619 - DNA, 20 bp, Artificial Sequence
  sgRNA
  Pik3ip1_1
agaccggcgtccctgaaaag

SEQ ID NO: 48620 - DNA, 20 bp, Artificial Sequence
  sgRNA
  Pik3ip1_2
tgggctcggtgagcgactcg

SEQ ID NO: 48621 - DNA, 20 bp, Artificial Sequence
  sgRNA
  Pik3ip1_3
cccgatcactggctgcacct

SEQ ID NO: 48622 - DNA, 20 bp, Artificial Sequence
  sgRNA
  Pik3ip1_4
aacccggaccaggacccgcg

SEQ ID NO: 48623 - DNA, 20 bp, Artificial Sequence
  sgRNA
  Pik3ip1_5
gggcaactcacgtcctcgca

SEQ ID NO: 48624 - DNA, 20 bp, Artificial Sequence
  sgRNA
  Pik3ip1_6
atgtagcaccagggcccgcg

SEQ ID NO: 48625 - DNA, 20 bp, Artificial Sequence
  sgRNA
  Pik3ip1_7
tcgtgggctacacttacaag

SEQ ID NO: 48626 - DNA, 20 bp, Artificial Sequence
  sgRNA
  Pik3ip1_8
cctatcccgagagatccagg

SEQ ID NO: 48627 - DNA, 20 bp, Artificial Sequence
  sgRNA
  Pik3ip1_9
taatgccagctccaatagcg

SEQ ID NO: 48628 - DNA, 20 bp, Artificial Sequence
  sgRNA
  Pik3ip1_10
attggagctggcattatcgt

SEQ ID NO: 48629 - DNA, 20 bp, Artificial Sequence
  sgRNA
  Pik3ip1_11
actcctgctgacgtgcagga

SEQ ID NO: 48630 - DNA, 20 bp, Artificial Sequence
  sgRNA
  Pik3ip1_12
caacggccacctgtaccggg

SEQ ID NO: 48631 - DNA, 20 bp, Artificial Sequence
  sgRNA
  Pik3ip1_13
gccctcaattccaagctcag

SEQ ID NO: 48632 - DNA, 20 bp, Artificial Sequence
  sgRNA
  Pik3ip1_14
tctccgctgcctcaactggt

SEQ ID NO: 48633 - DNA, 20 bp, Artificial Sequence
  sgRNA
  Pik3ip1_15
tcgctgctgatgtagcacca

SEQ ID NO: 48634 - DNA, 20 bp, Artificial Sequence
  sgRNA
  Pik3ip1_16
gccgaggtgcagccagtgat

SEQ ID NO: 48635 - DNA, 20 bp, Artificial Sequence
  sgRNA
  Pik3ip1_17
ccacaactactgccggaacc

SEQ ID NO: 48636 - DNA, 20 bp, Artificial Sequence
  sgRNA
  Pik3ip1_18
gctggtcctcccggtacagg

SEQ ID NO: 48637 - DNA, 20 bp, Artificial Sequence
  sgRNA
  Pik3ip1_19
tctggaaactgtcctaagat

SEQ ID NO: 48638 - DNA, 20 bp, Artificial Sequence
  sgRNA
  Pik3ip1_20
tggtcccagggcgagtacct

SEQ ID NO: 48639 - DNA, 20 bp, Artificial Sequence
  sgRNA
  Pilra_1
acccaactcaatgtgaccaa

SEQ ID NO: 48640 - DNA, 20 bp, Artificial Sequence
  sgRNA
  Pilra_2
agccgttgccaacccaactg

SEQ ID NO: 48641 - DNA, 20 bp, Artificial Sequence
  sgRNA
  Pilra_3
ggagatggaaggatttccat

SEQ ID NO: 48642 - DNA, 20 bp, Artificial Sequence
  sgRNA
  Pilra_4
aaaaactctgccaaagtacc

SEQ ID NO: 48643 - DNA, 20 bp, Artificial Sequence
  sgRNA
  Pilra_5
agtacacagtctcttcctgg

SEQ ID NO: 48644 - DNA, 20 bp, Artificial Sequence
  sgRNA
  Pilra_6
gcctgtccatgggaaccccc

SEQ ID NO: 48645 - DNA, 20 bp, Artificial Sequence
  sgRNA
  Pilra_7
gactgtgtactccatcgtaa

SEQ ID NO: 48646 - DNA, 20 bp, Artificial Sequence
  sgRNA
  Pilra_8
tcaatcccaaaaccccaacc

SEQ ID NO: 48647 - DNA, 20 bp, Artificial Sequence
  sgRNA
  Pilra_9
agttgtagatgaattcccca

SEQ ID NO: 48648 - DNA, 20 bp, Artificial Sequence
  sgRNA
  Pilra_10
ggatcccaaagaaaacccca

SEQ ID NO: 48649 - DNA, 20 bp, Artificial Sequence
  sgRNA
  Pilra_11
tggtgcttggaagtgtagtg

SEQ ID NO: 48650 - DNA, 20 bp, Artificial Sequence
  sgRNA
  Pilra_12
gccttcttctcttccaccag

SEQ ID NO: 48651 - DNA, 20 bp, Artificial Sequence
  sgRNA
  Pilra_13
gaaagctgctctggagtcca

SEQ ID NO: 48652 - DNA, 20 bp, Artificial Sequence
  sgRNA
  Pilra_14
tggatctgcaaaccacagtt

SEQ ID NO: 48653 - DNA, 20 bp, Artificial Sequence
  sgRNA
  Pilra_15
aaccacagttgggttggcaa

SEQ ID NO: 48654 - DNA, 20 bp, Artificial Sequence
  sgRNA
  Pilra_16
gaaaaactctgccaaagtac

SEQ ID NO: 48655 - DNA, 20 bp, Artificial Sequence
  sgRNA
  Pilra_17
tgaaggagtctgaccagacc

SEQ ID NO: 48656 - DNA, 20 bp, Artificial Sequence
  sgRNA
  Pilra_18
ctaaagctgaaatcccagcc

SEQ ID NO: 48657 - DNA, 20 bp, Artificial Sequence
  sgRNA
  Pilra_19
tgtttctcactggtttccaa

SEQ ID NO: 48658 - DNA, 20 bp, Artificial Sequence
  sgRNA
  Pilra_20
gctgctgctgtgttcctggt

SEQ ID NO: 48659 - DNA, 20 bp, Artificial Sequence
  sgRNA
  Pilrb1_1
attaactcgactaaagtact

SEQ ID NO: 48660 - DNA, 20 bp, Artificial Sequence
  sgRNA
  Pilrb1_2
agttgtagatgacttcccca

SEQ ID NO: 48661 - DNA, 20 bp, Artificial Sequence
  sgRNA
  Pilrb1_3
aggggaaatagaaggagaag

SEQ ID NO: 48662 - DNA, 20 bp, Artificial Sequence
  sgRNA
  Pilrb1_4
cagaagcaggacctgagcca

SEQ ID NO: 48663 - DNA, 20 bp, Artificial Sequence
  sgRNA
  Pilrb1_5
ctatgaccaaaactttagcc

SEQ ID NO: 48664 - DNA, 20 bp, Artificial Sequence
  sgRNA
  Pilrb1_6
tggagcacacaagcgaccag

SEQ ID NO: 48665 - DNA, 20 bp, Artificial Sequence
  sgRNA
  Pilrb1_7
gaaatggaaggatttccatg

SEQ ID NO: 48666 - DNA, 20 bp, Artificial Sequence
  sgRNA
  Pilrb1_8
gttaatctgcagtcgacaga

SEQ ID NO: 48667 - DNA, 20 bp, Artificial Sequence
  sgRNA
  Pilrb1_9
gattaactcgactaaagtac

SEQ ID NO: 48668 - DNA, 20 bp, Artificial Sequence
  sgRNA
  Pilrb1_10
tcatcagtgaaggattcctc

SEQ ID NO: 48669 - DNA, 20 bp, Artificial Sequence
  sgRNA
  Pilrb1_11
agatgagcatagcctggaaa

SEQ ID NO: 48670 - DNA, 20 bp, Artificial Sequence
  sgRNA
  Pilrb1_12
tttcccctggaagttggcca

SEQ ID NO: 48671 - DNA, 20 bp, Artificial Sequence
  sgRNA
  Pilrb1_13
ggaaatggaaggatttccat

SEQ ID NO: 48672 - DNA, 20 bp, Artificial Sequence
  sgRNA
  Pilrb1_14
gagcatagcctggaaatgga

SEQ ID NO: 48673 - DNA, 20 bp, Artificial Sequence
  sgRNA
  Pilrb1_15
gatgctcctggctaaagttt

SEQ ID NO: 48674 - DNA, 20 bp, Artificial Sequence
  sgRNA
  Pilrb1_16
ccttctccttctatttcccc

SEQ ID NO: 48675 - DNA, 20 bp, Artificial Sequence
  sgRNA
  Pilrb1_17
tcatagtcctagtctatgga

SEQ ID NO: 48676 - DNA, 20 bp, Artificial Sequence
  sgRNA
  Pilrb1_18
tcatcaggctgtctgcatgc

SEQ ID NO: 48677 - DNA, 20 bp, Artificial Sequence
  sgRNA
  Pilrb1_19
caacttccaggggaaataga

SEQ ID NO: 48678 - DNA, 20 bp, Artificial Sequence
  sgRNA
  Pilrb1_20
tgtatctttctgaatttcct

SEQ ID NO: 48679 - DNA, 20 bp, Artificial Sequence
  sgRNA
  Pilrb2_1
aattcagcaagatcaaacgg

SEQ ID NO: 48680 - DNA, 20 bp, Artificial Sequence
  sgRNA
  Pilrb2_2
cttcccctggaagttagcca

SEQ ID NO: 48681 - DNA, 20 bp, Artificial Sequence
  sgRNA
  Pilrb2_3
ctcatgtatgaaaggcatgg

SEQ ID NO: 48682 - DNA, 20 bp, Artificial Sequence
  sgRNA
  Pilrb2_4
ccttaaagttcaggattctg

SEQ ID NO: 48683 - DNA, 20 bp, Artificial Sequence
  sgRNA
  Pilrb2_5
gtagtcataatcctagtcta

SEQ ID NO: 48684 - DNA, 20 bp, Artificial Sequence
  sgRNA
  Pilrb2_6
agctggcctggagcacacaa

SEQ ID NO: 48685 - DNA, 20 bp, Artificial Sequence
  sgRNA
  Pilrb2_7
ttatgactacaactttagcc

SEQ ID NO: 48686 - DNA, 20 bp, Artificial Sequence
  sgRNA
  Pilrb2_8
ggaaattcagcaagatcaaa

SEQ ID NO: 48687 - DNA, 20 bp, Artificial Sequence
  sgRNA
  Pilrb2_9
tcctggagagactccagcca

SEQ ID NO: 48688 - DNA, 20 bp, Artificial Sequence
  sgRNA
  Pilrb2_10
gatccttggctaacttccag

SEQ ID NO: 48689 - DNA, 20 bp, Artificial Sequence
  sgRNA
  Pilrb2_11
tcataatcctagtctatgga

SEQ ID NO: 48690 - DNA, 20 bp, Artificial Sequence
  sgRNA
  Pilrb2_12
ggtcagactccttaaagttc

SEQ ID NO: 48691 - DNA, 20 bp, Artificial Sequence
  sgRNA
  Pilrb2_13
tggagcacacaagggacaag

SEQ ID NO: 48692 - DNA, 20 bp, Artificial Sequence
  sgRNA
  Pilrb2_14
ttaaggagtctgaccagacc

SEQ ID NO: 48693 - DNA, 20 bp, Artificial Sequence
  sgRNA
  Pilrb2_15
ttgatcttgctgaatttcct

SEQ ID NO: 48694 - DNA, 20 bp, Artificial Sequence
  sgRNA
  Pilrb2_16
cctcagaatcctgaacttta

SEQ ID NO: 48695 - DNA, 20 bp, Artificial Sequence
  sgRNA
  Pilrb2_17
ggagatggaaggatttcttt

SEQ ID NO: 48696 - DNA, 20 bp, Artificial Sequence
  sgRNA
  Pilrb2_18
cagctggcctggagcacaca

SEQ ID NO: 48697 - DNA, 20 bp, Artificial Sequence
  sgRNA
  Pilrb2_19
caaacggaggaaatgacttt

SEQ ID NO: 48698 - DNA, 20 bp, Artificial Sequence
  sgRNA
  Pilrb2_20
ggatccttggctaacttcca

SEQ ID NO: 48699 - DNA, 20 bp, Artificial Sequence
  sgRNA
  Pira2_1
ctgtcaccaccagcttcagg

SEQ ID NO: 48700 - DNA, 20 bp, Artificial Sequence
  sgRNA
  Pira2_2
gactcaccaaggccataccc

SEQ ID NO: 48701 - DNA, 20 bp, Artificial Sequence
  sgRNA
  Pira2_3
cagtgaccccctgaagctgg

SEQ ID NO: 48702 - DNA, 20 bp, Artificial Sequence
  sgRNA
  Pira2_4
agtctcagccacagagaaca

SEQ ID NO: 48703 - DNA, 20 bp, Artificial Sequence
  sgRNA
  Pira2_5
aggagcctgggaacaagggc

SEQ ID NO: 48704 - DNA, 20 bp, Artificial Sequence
  sgRNA
  Pira2_6
ctacagtgaccccctgaagc

SEQ ID NO: 48705 - DNA, 20 bp, Artificial Sequence
  sgRNA
  Pira2_7
caaggccataccctggaccc

SEQ ID NO: 48706 - DNA, 20 bp, Artificial Sequence
  sgRNA
  Pira2_8
tcattccagggtccagggta

SEQ ID NO: 48707 - DNA, 20 bp, Artificial Sequence
  sgRNA
  Pira2_9
cagggtccagggtatggcct

SEQ ID NO: 48708 - DNA, 20 bp, Artificial Sequence
  sgRNA
  Pirb_1
catgttgtagtgtcacagaa

SEQ ID NO: 48709 - DNA, 20 bp, Artificial Sequence
  sgRNA
  Pirb_2
tttatcgtagggaaagtctg

SEQ ID NO: 48710 - DNA, 20 bp, Artificial Sequence
  sgRNA
  Pirb_3
tttagcccaagccagccctg

SEQ ID NO: 48711 - DNA, 20 bp, Artificial Sequence
  sgRNA
  Pirb_4
ggacatcctgatcacaggtg

SEQ ID NO: 48712 - DNA, 20 bp, Artificial Sequence
  sgRNA
  Pirb_5
ggcggggtagaggtttcgat

SEQ ID NO: 48713 - DNA, 20 bp, Artificial Sequence
  sgRNA
  Pirb_6
ttcttcttcgacgaagacat

SEQ ID NO: 48714 - DNA, 20 bp, Artificial Sequence
  sgRNA
  Pirb_7
gagcctggagggtttcacct

SEQ ID NO: 48715 - DNA, 20 bp, Artificial Sequence
  sgRNA
  Pirb_8
agtggaggacatgcaaactg

SEQ ID NO: 48716 - DNA, 20 bp, Artificial Sequence
  sgRNA
  Pirb_9
gtgagaatgaatttatcgta

SEQ ID NO: 48717 - DNA, 20 bp, Artificial Sequence
  sgRNA
  Pirb_10
ccagggagagacttatgccc

SEQ ID NO: 48718 - DNA, 20 bp, Artificial Sequence
  sgRNA
  Pirb_11
ggtgagaatgaatttatcgt

SEQ ID NO: 48719 - DNA, 20 bp, Artificial Sequence
  sgRNA
  Pirb_12
gcagcaggacactcagacag

SEQ ID NO: 48720 - DNA, 20 bp, Artificial Sequence
  sgRNA
  Pirb_13
tctggcggctgctcgtccag

SEQ ID NO: 48721 - DNA, 20 bp, Artificial Sequence
  sgRNA
  Pirb_14
cagtgtatatgctactctgg

SEQ ID NO: 48722 - DNA, 20 bp, Artificial Sequence
  sgRNA
  Pirb_15
acaatgtccatgccactagg

SEQ ID NO: 48723 - DNA, 20 bp, Artificial Sequence
  sgRNA
  Pirb_16
gctggcttgggctaaaaggc

SEQ ID NO: 48724 - DNA, 20 bp, Artificial Sequence
  sgRNA
  Pirb_17
tgttcccttgacatgacaga

SEQ ID NO: 48725 - DNA, 20 bp, Artificial Sequence
  sgRNA
  Pirb_18
cccacaatgtccatgccact

SEQ ID NO: 48726 - DNA, 20 bp, Artificial Sequence
  sgRNA
  Pirb_19
tccctccagctgtcaccaca

SEQ ID NO: 48727 - DNA, 20 bp, Artificial Sequence
  sgRNA
  Pirb_20
ggaaaggagaactccagaag

SEQ ID NO: 48728 - DNA, 20 bp, Artificial Sequence
  sgRNA
  Pkd1_1
attcccgtaccgatatacct

SEQ ID NO: 48729 - DNA, 20 bp, Artificial Sequence
  sgRNA
  Pkd1_2
acagttgcgtagatcaacat

SEQ ID NO: 48730 - DNA, 20 bp, Artificial Sequence
  sgRNA
  Pkd1_3
agctcgcagacataactatg

SEQ ID NO: 48731 - DNA, 20 bp, Artificial Sequence
  sgRNA
  Pkd1_4
tgatggtgtcctatatacgt

SEQ ID NO: 48732 - DNA, 20 bp, Artificial Sequence
  sgRNA
  Pkd1_5
gtcgccgtaacgcaaatggg

SEQ ID NO: 48733 - DNA, 20 bp, Artificial Sequence
  sgRNA
  Pkd1_6
ctagtaaagcggctacgagg

SEQ ID NO: 48734 - DNA, 20 bp, Artificial Sequence
  sgRNA
  Pkd1_7
taaggcctacaacctctcgt

SEQ ID NO: 48735 - DNA, 20 bp, Artificial Sequence
  sgRNA
  Pkd1_8
gtgaccacactgctcccacg

SEQ ID NO: 48736 - DNA, 20 bp, Artificial Sequence
  sgRNA
  Pkd1_9
gggcacacgctcacttacag

SEQ ID NO: 48737 - DNA, 20 bp, Artificial Sequence
  sgRNA
  Pkd1_10
cttggcatacggcatcgtgg

SEQ ID NO: 48738 - DNA, 20 bp, Artificial Sequence
  sgRNA
  Pkd1_11
actacaatgtcactgtggag

SEQ ID NO: 48739 - DNA, 20 bp, Artificial Sequence
  sgRNA
  Pkd1_12
ggccacgcacagaatccaat

SEQ ID NO: 48740 - DNA, 20 bp, Artificial Sequence
  sgRNA
  Pkd1_13
gtgtgctgctcacaacagat

SEQ ID NO: 48741 - DNA, 20 bp, Artificial Sequence
  sgRNA
  Pkd1_14
gcaacagagcatataccagt

SEQ ID NO: 48742 - DNA, 20 bp, Artificial Sequence
  sgRNA
  Pkd1_15
actgccttcccgctcatcca

SEQ ID NO: 48743 - DNA, 20 bp, Artificial Sequence
  sgRNA
  Pkd1_16
gcgcactgttcttcccaacg

SEQ ID NO: 48744 - DNA, 20 bp, Artificial Sequence
  sgRNA
  Pkd1_17
ggtccagcaccaagtcacat

SEQ ID NO: 48745 - DNA, 20 bp, Artificial Sequence
  sgRNA
  Pkd1_18
ggttggcgtgatgcagaaga

SEQ ID NO: 48746 - DNA, 20 bp, Artificial Sequence
  sgRNA
  Pkd1_19
gttccagcttcagcgtcgag

SEQ ID NO: 48747 - DNA, 20 bp, Artificial Sequence
  sgRNA
  Pkd1_20
tgtgaacctcacactcatgg

SEQ ID NO: 48748 - DNA, 20 bp, Artificial Sequence
  sgRNA
  Pkd1l1_1
atagctccttcaccatcacg

SEQ ID NO: 48749 - DNA, 20 bp, Artificial Sequence
  sgRNA
  Pkd1l1_2
ggaactctcaggatgatacc

SEQ ID NO: 48750 - DNA, 20 bp, Artificial Sequence
  sgRNA
  Pkd1l1_3
cacatttgtggctattaccg

SEQ ID NO: 48751 - DNA, 20 bp, Artificial Sequence
  sgRNA
  Pkd1l1_4
tcaaggtcattgctgtgcat

SEQ ID NO: 48752 - DNA, 20 bp, Artificial Sequence
  sgRNA
  Pkd1l1_5
gattgagagaaatttcacct

SEQ ID NO: 48753 - DNA, 20 bp, Artificial Sequence
  sgRNA
  Pkd1l1_6
ggtcactctgagcttagcct

SEQ ID NO: 48754 - DNA, 20 bp, Artificial Sequence
  sgRNA
  Pkd1l1_7
tcctctgtaacatttcccaa

SEQ ID NO: 48755 - DNA, 20 bp, Artificial Sequence
  sgRNA
  Pkd1l1_8
tggaagttgtcatcactggt

SEQ ID NO: 48756 - DNA, 20 bp, Artificial Sequence
  sgRNA
  Pkd1l1_9
tcctcacataccctgtaccg

SEQ ID NO: 48757 - DNA, 20 bp, Artificial Sequence
  sgRNA
  Pkd1l1_10
tcagcagtttgaccaccggg

SEQ ID NO: 48758 - DNA, 20 bp, Artificial Sequence
  sgRNA
  Pkd1l1_11
ggtgtcttgaccacggtaca

SEQ ID NO: 48759 - DNA, 20 bp, Artificial Sequence
  sgRNA
  Pkd1l1_12
cagattcgtccacatctcat

SEQ ID NO: 48760 - DNA, 20 bp, Artificial Sequence
  sgRNA
  Pkd1l1_13
ctgaaagcccagtaaaccgg

SEQ ID NO: 48761 - DNA, 20 bp, Artificial Sequence
  sgRNA
  Pkd1l1_14
tctttacaagatgcgaccaa

SEQ ID NO: 48762 - DNA, 20 bp, Artificial Sequence
  sgRNA
  Pkd1l1_15
agtaacaacgcataactccg

SEQ ID NO: 48763 - DNA, 20 bp, Artificial Sequence
  sgRNA
  Pkd1l1_16
caggtgtgagaaatgccagg

SEQ ID NO: 48764 - DNA, 20 bp, Artificial Sequence
  sgRNA
  Pkd1l1_17
gaaagagctgtccagcccag

SEQ ID NO: 48765 - DNA, 20 bp, Artificial Sequence
  sgRNA
  Pkd1l1_18
ttctgctctccacatacaag

SEQ ID NO: 48766 - DNA, 20 bp, Artificial Sequence
  sgRNA
  Pkd1l1_19
ccttgaatctggtctcccac

SEQ ID NO: 48767 - DNA, 20 bp, Artificial Sequence
  sgRNA
  Pkd1l1_20
cctatgaccctgacaaccca

SEQ ID NO: 48768 - DNA, 20 bp, Artificial Sequence
  sgRNA
  Pkd1l2_1
cttagatgacaccgtaccag

SEQ ID NO: 48769 - DNA, 20 bp, Artificial Sequence
  sgRNA
  Pkd1l2_2
gacctccgagttgagttcag

SEQ ID NO: 48770 - DNA, 20 bp, Artificial Sequence
  sgRNA
  Pkd1l2_3
tcccgagtcacagtgcatgg

SEQ ID NO: 48771 - DNA, 20 bp, Artificial Sequence
  sgRNA
  Pkd1l2_4
actttgtagagccgctgtcg

SEQ ID NO: 48772 - DNA, 20 bp, Artificial Sequence
  sgRNA
  Pkd1l2_5
cttcagcaggaaccgccacg

SEQ ID NO: 48773 - DNA, 20 bp, Artificial Sequence
  sgRNA
  Pkd1l2_6
gtgtcttgttccgatcacgg

SEQ ID NO: 48774 - DNA, 20 bp, Artificial Sequence
  sgRNA
  Pkd1l2_7
gtgacagcggagttgagcgg

SEQ ID NO: 48775 - DNA, 20 bp, Artificial Sequence
  sgRNA
  Pkd1l2_8
ccactgtggtaaccaccacg

SEQ ID NO: 48776 - DNA, 20 bp, Artificial Sequence
  sgRNA
  Pkd1l2_9
tctctgttaccaatcgggca

SEQ ID NO: 48777 - DNA, 20 bp, Artificial Sequence
  sgRNA
  Pkd1l2_10
tgccccacatgggataaccg

SEQ ID NO: 48778 - DNA, 20 bp, Artificial Sequence
  sgRNA
  Pkd1l2_11
gtcatctgggaactaccacg

SEQ ID NO: 48779 - DNA, 20 bp, Artificial Sequence
  sgRNA
  Pkd1l2_12
tatgctgcgatcactgtccg

SEQ ID NO: 48780 - DNA, 20 bp, Artificial Sequence
  sgRNA
  Pkd1l2_13
gctttcgcataacagaactc

SEQ ID NO: 48781 - DNA, 20 bp, Artificial Sequence
  sgRNA
  Pkd1l2_14
tgtcaactacagcaactggc

SEQ ID NO: 48782 - DNA, 20 bp, Artificial Sequence
  sgRNA
  Pkd1l2_15
ggaggtagttaatgtccacc

SEQ ID NO: 48783 - DNA, 20 bp, Artificial Sequence
  sgRNA
  Pkd1l2_16
gctgttcagcagtagcacgg

SEQ ID NO: 48784 - DNA, 20 bp, Artificial Sequence
  sgRNA
  Pkd1l2_17
tcaatgtgtgctgaaatccg

SEQ ID NO: 48785 - DNA, 20 bp, Artificial Sequence
  sgRNA
  Pkd1l2_18
tagtagactccttctccgaa

SEQ ID NO: 48786 - DNA, 20 bp, Artificial Sequence
  sgRNA
  Pkd1l2_19
aagcacagcataagtcgccc

SEQ ID NO: 48787 - DNA, 20 bp, Artificial Sequence
  sgRNA
  Pkd1l2_20
tgtctcccatccttccccat

SEQ ID NO: 48788 - DNA, 20 bp, Artificial Sequence
  sgRNA
  Pkd1l3_1
gcgacttcttcatcgtgccg

SEQ ID NO: 48789 - DNA, 20 bp, Artificial Sequence
  sgRNA
  Pkd1l3_2
aagtggagcgtcattaggag

SEQ ID NO: 48790 - DNA, 20 bp, Artificial Sequence
  sgRNA
  Pkd1l3_3
gctgacgagcagctccgaca

SEQ ID NO: 48791 - DNA, 20 bp, Artificial Sequence
  sgRNA
  Pkd1l3_4
gttgttgttagacgtccaag

SEQ ID NO: 48792 - DNA, 20 bp, Artificial Sequence
  sgRNA
  Pkd1l3_5
tcgtcagtgacatgaccacg

SEQ ID NO: 48793 - DNA, 20 bp, Artificial Sequence
  sgRNA
  Pkd1l3_6
gagcgttataaaaaaggccg

SEQ ID NO: 48794 - DNA, 20 bp, Artificial Sequence
  sgRNA
  Pkd1l3_7
tggcaactctggcagtacaa

SEQ ID NO: 48795 - DNA, 20 bp, Artificial Sequence
  sgRNA
  Pkd1l3_8
tgtactgccagagttgccat

SEQ ID NO: 48796 - DNA, 20 bp, Artificial Sequence
  sgRNA
  Pkd1l3_9
gcacaggaagactctcccct

SEQ ID NO: 48797 - DNA, 20 bp, Artificial Sequence
  sgRNA
  Pkd1l3_10
tcttggacgtctaacaacaa

SEQ ID NO: 48798 - DNA, 20 bp, Artificial Sequence
  sgRNA
  Pkd1l3_11
gctttgaagttcccatcaag

SEQ ID NO: 48799 - DNA, 20 bp, Artificial Sequence
  sgRNA
  Pkd1l3_12
cctgaatccacaatacctgc

SEQ ID NO: 48800 - DNA, 20 bp, Artificial Sequence
  sgRNA
  Pkd1l3_13
gtgcaattgttggctggccg

SEQ ID NO: 48801 - DNA, 20 bp, Artificial Sequence
  sgRNA
  Pkd1l3_14
acagcaatgacaccccgaca

SEQ ID NO: 48802 - DNA, 20 bp, Artificial Sequence
  sgRNA
  Pkd1l3_15
ggtgacacatggctaacggg

SEQ ID NO: 48803 - DNA, 20 bp, Artificial Sequence
  sgRNA
  Pkd1l3_16
gctgtcggctgaagcggcag

SEQ ID NO: 48804 - DNA, 20 bp, Artificial Sequence
  sgRNA
  Pkd1l3_17
agagtcctttgcagaataga

SEQ ID NO: 48805 - DNA, 20 bp, Artificial Sequence
  sgRNA
  Pkd1l3_18
gggaggctatcccatccaag

SEQ ID NO: 48806 - DNA, 20 bp, Artificial Sequence
  sgRNA
  Pkd1l3_19
caggttcatcagtttctacg

SEQ ID NO: 48807 - DNA, 20 bp, Artificial Sequence
  sgRNA
  Pkd1l3_20
gtgtctccaggagttcctgg

SEQ ID NO: 48808 - DNA, 20 bp, Artificial Sequence
  sgRNA
  Pkd2_1
gggatcattgcgtcgtacag

SEQ ID NO: 48809 - DNA, 20 bp, Artificial Sequence
  sgRNA
  Pkd2_2
tgcctggagcaggacgaaag

SEQ ID NO: 48810 - DNA, 20 bp, Artificial Sequence
  sgRNA
  Pkd2_3
ttcggttgtcagcttgcgtg

SEQ ID NO: 48811 - DNA, 20 bp, Artificial Sequence
  sgRNA
  Pkd2_4
gctcgggagctaccgcggcg

SEQ ID NO: 48812 - DNA, 20 bp, Artificial Sequence
  sgRNA
  Pkd2_5
actcggagttggcgtagacg

SEQ ID NO: 48813 - DNA, 20 bp, Artificial Sequence
  sgRNA
  Pkd2_6
catctgttgatgctcacgct

SEQ ID NO: 48814 - DNA, 20 bp, Artificial Sequence
  sgRNA
  Pkd2_7
cctggatctgtccagaacca

SEQ ID NO: 48815 - DNA, 20 bp, Artificial Sequence
  sgRNA
  Pkd2_8
tcgggacagtgagatccaca

SEQ ID NO: 48816 - DNA, 20 bp, Artificial Sequence
  sgRNA
  Pkd2_9
ggtgaggcgcgtggaccgca

SEQ ID NO: 48817 - DNA, 20 bp, Artificial Sequence
  sgRNA
  Pkd2_10
gtaccacgccacccgttgct

SEQ ID NO: 48818 - DNA, 20 bp, Artificial Sequence
  sgRNA
  Pkd2_11
tttcaggtacttctctcggt

SEQ ID NO: 48819 - DNA, 20 bp, Artificial Sequence
  sgRNA
  Pkd2_12
ggctgccaggaagaaatcaa

SEQ ID NO: 48820 - DNA, 20 bp, Artificial Sequence
  sgRNA
  Pkd2_13
cgatgtgccaaagacctctt

SEQ ID NO: 48821 - DNA, 20 bp, Artificial Sequence
  sgRNA
  Pkd2_14
gctgcatcgccacctcccgc

SEQ ID NO: 48822 - DNA, 20 bp, Artificial Sequence
  sgRNA
  Pkd2_15
gctccatttggaccgcggaa

SEQ ID NO: 48823 - DNA, 20 bp, Artificial Sequence
  sgRNA
  Pkd2_16
ggccaagctgaagagacgag

SEQ ID NO: 48824 - DNA, 20 bp, Artificial Sequence
  sgRNA
  Pkd2_17
cttctgctgctcatcggacg

SEQ ID NO: 48825 - DNA, 20 bp, Artificial Sequence
  sgRNA
  Pkd2_18
cctcaaagcccgggttgtcg

SEQ ID NO: 48826 - DNA, 20 bp, Artificial Sequence
  sgRNA
  Pkd2_19
tttcatctcgcaggtcctga

SEQ ID NO: 48827 - DNA, 20 bp, Artificial Sequence
  sgRNA
  Pkd2_20
ctggagcaggacgaaagcgg

SEQ ID NO: 48828 - DNA, 20 bp, Artificial Sequence
  sgRNA
  Pkd2l1_1
tcagtacaataacatgaacg

SEQ ID NO: 48829 - DNA, 20 bp, Artificial Sequence
  sgRNA
  Pkd2l1_2
cgtgcgcaatgactcctgtg

SEQ ID NO: 48830 - DNA, 20 bp, Artificial Sequence
  sgRNA
  Pkd2l1_3
cacacagacagatgtccacg

SEQ ID NO: 48831 - DNA, 20 bp, Artificial Sequence
  sgRNA
  Pkd2l1_4
gatccgctatgtgaataact

SEQ ID NO: 48832 - DNA, 20 bp, Artificial Sequence
  sgRNA
  Pkd2l1_5
ggttcatgaagacttccggg

SEQ ID NO: 48833 - DNA, 20 bp, Artificial Sequence
  sgRNA
  Pkd2l1_6
gtgccgttctgaggtccaaa

SEQ ID NO: 48834 - DNA, 20 bp, Artificial Sequence
  sgRNA
  Pkd2l1_7
gtataccacaagctccctca

SEQ ID NO: 48835 - DNA, 20 bp, Artificial Sequence
  sgRNA
  Pkd2l1_8
gatgtgcagaaggtcctgaa

SEQ ID NO: 48836 - DNA, 20 bp, Artificial Sequence
  sgRNA
  Pkd2l1_9
gctacaacaagaccctacta

SEQ ID NO: 48837 - DNA, 20 bp, Artificial Sequence
  sgRNA
  Pkd2l1_10
ggtatacatagtgttcctcg

SEQ ID NO: 48838 - DNA, 20 bp, Artificial Sequence
  sgRNA
  Pkd2l1_11
gcgtcctgttcggggaagga

SEQ ID NO: 48839 - DNA, 20 bp, Artificial Sequence
  sgRNA
  Pkd2l1_12
catcaacgacacatactccg

SEQ ID NO: 48840 - DNA, 20 bp, Artificial Sequence
  sgRNA
  Pkd2l1_13
agaacatgatggcaaagccc

SEQ ID NO: 48841 - DNA, 20 bp, Artificial Sequence
  sgRNA
  Pkd2l1_14
gtccttggcacagcgagcca

SEQ ID NO: 48842 - DNA, 20 bp, Artificial Sequence
  sgRNA
  Pkd2l1_15
catcagtcggttcacttcca

SEQ ID NO: 48843 - DNA, 20 bp, Artificial Sequence
  sgRNA
  Pkd2l1_16
cctcaggcgcagccttagta

SEQ ID NO: 48844 - DNA, 20 bp, Artificial Sequence
  sgRNA
  Pkd2l1_17
atcaggagctacaaaccctg

SEQ ID NO: 48845 - DNA, 20 bp, Artificial Sequence
  sgRNA
  Pkd2l1_18
caggctcacaagctacagcg

SEQ ID NO: 48846 - DNA, 20 bp, Artificial Sequence
  sgRNA
  Pkd2l1_19
tcagttccggataatccttg

SEQ ID NO: 48847 - DNA, 20 bp, Artificial Sequence
  sgRNA
  Pkd2l1_20
gcgcagctgccgcaaccttg

SEQ ID NO: 48848 - DNA, 20 bp, Artificial Sequence
  sgRNA
  Pkdrej_1
ttgcgttcagtgtcgcacgg

SEQ ID NO: 48849 - DNA, 20 bp, Artificial Sequence
  sgRNA
  Pkdrej_2
tatctgacacacctaacgtg

SEQ ID NO: 48850 - DNA, 20 bp, Artificial Sequence
  sgRNA
  Pkdrej_3
aagttatcagtaattgcacg

SEQ ID NO: 48851 - DNA, 20 bp, Artificial Sequence
  sgRNA
  Pkdrej_4
ccctcaatatcactgtgcgt

SEQ ID NO: 48852 - DNA, 20 bp, Artificial Sequence
  sgRNA
  Pkdrej_5
aagcatgtcctacgacccag

SEQ ID NO: 48853 - DNA, 20 bp, Artificial Sequence
  sgRNA
  Pkdrej_6
tcgctagcctcagatccacg

SEQ ID NO: 48854 - DNA, 20 bp, Artificial Sequence
  sgRNA
  Pkdrej_7
tgcgacactgaacgcaagca

SEQ ID NO: 48855 - DNA, 20 bp, Artificial Sequence
  sgRNA
  Pkdrej_8
gggttccgtggtgtattcag

SEQ ID NO: 48856 - DNA, 20 bp, Artificial Sequence
  sgRNA
  Pkdrej_9
gcacggccaggaaagtcgca

SEQ ID NO: 48857 - DNA, 20 bp, Artificial Sequence
  sgRNA
  Pkdrej_10
cctgcggcaagagcacaggt

SEQ ID NO: 48858 - DNA, 20 bp, Artificial Sequence
  sgRNA
  Pkdrej_11
gctatgtaaacacaccacct

SEQ ID NO: 48859 - DNA, 20 bp, Artificial Sequence
  sgRNA
  Pkdrej_12
catctgtcaccgtaccgaca

SEQ ID NO: 48860 - DNA, 20 bp, Artificial Sequence
  sgRNA
  Pkdrej_13
ggtacttgctggaccacgag

SEQ ID NO: 48861 - DNA, 20 bp, Artificial Sequence
  sgRNA
  Pkdrej_14
gccctcacttgcctcacaag

SEQ ID NO: 48862 - DNA, 20 bp, Artificial Sequence
  sgRNA
  Pkdrej_15
tactggctaacaaggttccg

SEQ ID NO: 48863 - DNA, 20 bp, Artificial Sequence
  sgRNA
  Pkdrej_16
ccgtaaggttaaaactcgaa

SEQ ID NO: 48864 - DNA, 20 bp, Artificial Sequence
  sgRNA
  Pkdrej_17
ggtcaacccgagaaacggca

SEQ ID NO: 48865 - DNA, 20 bp, Artificial Sequence
  sgRNA
  Pkdrej_18
gtagccctcgtccacaacat

SEQ ID NO: 48866 - DNA, 20 bp, Artificial Sequence
  sgRNA
  Pkdrej_19
tattcgccatcggttctccg

SEQ ID NO: 48867 - DNA, 20 bp, Artificial Sequence
  sgRNA
  Pkdrej_20
tgcttgcgttcagtgtcgca

SEQ ID NO: 48868 - DNA, 20 bp, Artificial Sequence
  sgRNA
  Pkhd1_1
gagtcagtattcgttcacaa

SEQ ID NO: 48869 - DNA, 20 bp, Artificial Sequence
  sgRNA
  Pkhd1_2
ccagccgtagtagttagaca

SEQ ID NO: 48870 - DNA, 20 bp, Artificial Sequence
  sgRNA
  Pkhd1_3
acagggaactctcttcacaa

SEQ ID NO: 48871 - DNA, 20 bp, Artificial Sequence
  sgRNA
  Pkhd1_4
gctcgcgtggtatatgatgg

SEQ ID NO: 48872 - DNA, 20 bp, Artificial Sequence
  sgRNA
  Pkhd1_5
acattccgagcgatgaacca

SEQ ID NO: 48873 - DNA, 20 bp, Artificial Sequence
  sgRNA
  Pkhd1_6
tcggattgacatccgccccg

SEQ ID NO: 48874 - DNA, 20 bp, Artificial Sequence
  sgRNA
  Pkhd1_7
tcgtcaagagacttccacca

SEQ ID NO: 48875 - DNA, 20 bp, Artificial Sequence
  sgRNA
  Pkhd1_8
gctaggaacttgactccata

SEQ ID NO: 48876 - DNA, 20 bp, Artificial Sequence
  sgRNA
  Pkhd1_9
ctaaccatggtgctgatgag

SEQ ID NO: 48877 - DNA, 20 bp, Artificial Sequence
  sgRNA
  Pkhd1_10
cctcaaagagtgccacacga

SEQ ID NO: 48878 - DNA, 20 bp, Artificial Sequence
  sgRNA
  Pkhd1_11
gaagattgagtgcactacca

SEQ ID NO: 48879 - DNA, 20 bp, Artificial Sequence
  sgRNA
  Pkhd1_12
tcaaaatagttggcaccaga

SEQ ID NO: 48880 - DNA, 20 bp, Artificial Sequence
  sgRNA
  Pkhd1_13
gcttctcaattcatgccagg

SEQ ID NO: 48881 - DNA, 20 bp, Artificial Sequence
  sgRNA
  Pkhd1_14
gtctaactactacggctgga

SEQ ID NO: 48882 - DNA, 20 bp, Artificial Sequence
  sgRNA
  Pkhd1_15
agcttatgctgtagaccgga

SEQ ID NO: 48883 - DNA, 20 bp, Artificial Sequence
  sgRNA
  Pkhd1_16
cttgcaggacaacatacaag

SEQ ID NO: 48884 - DNA, 20 bp, Artificial Sequence
  sgRNA
  Pkhd1_17
acaggttatgatcacagccg

SEQ ID NO: 48885 - DNA, 20 bp, Artificial Sequence
  sgRNA
  Pkhd1_18
gcagcagagccatttcctgc

SEQ ID NO: 48886 - DNA, 20 bp, Artificial Sequence
  sgRNA
  Pkhd1_19
tgtacccaataacagcagag

SEQ ID NO: 48887 - DNA, 20 bp, Artificial Sequence
  sgRNA
  Pkhd1_20
tagctcctgtaacattacca

SEQ ID NO: 48888 - DNA, 20 bp, Artificial Sequence
  sgRNA
  Pkhd1l1_1
tgagaagcggaccatcgcgt

SEQ ID NO: 48889 - DNA, 20 bp, Artificial Sequence
  sgRNA
  Pkhd1l1_2
tgtgactgtgggcgataccg

SEQ ID NO: 48890 - DNA, 20 bp, Artificial Sequence
  sgRNA
  Pkhd1l1_3
gcatatctataacgtgacgc

SEQ ID NO: 48891 - DNA, 20 bp, Artificial Sequence
  sgRNA
  Pkhd1l1_4
gtattgggtatcgtcccaaa

SEQ ID NO: 48892 - DNA, 20 bp, Artificial Sequence
  sgRNA
  Pkhd1l1_5
cctagaacttcgatgtgcag

SEQ ID NO: 48893 - DNA, 20 bp, Artificial Sequence
  sgRNA
  Pkhd1l1_6
attaccaccacacttcccga

SEQ ID NO: 48894 - DNA, 20 bp, Artificial Sequence
  sgRNA
  Pkhd1l1_7
ttaatccagccagaatcagt

SEQ ID NO: 48895 - DNA, 20 bp, Artificial Sequence
  sgRNA
  Pkhd1l1_8
gcttgttgaatgctagccgg

SEQ ID NO: 48896 - DNA, 20 bp, Artificial Sequence
  sgRNA
  Pkhd1l1_9
agtggcacccatgtaccctg

SEQ ID NO: 48897 - DNA, 20 bp, Artificial Sequence
  sgRNA
  Pkhd1l1_10
ttgccaactgtaaatgcgca

SEQ ID NO: 48898 - DNA, 20 bp, Artificial Sequence
  sgRNA
  Pkhd1l1_11
ctaaaactcgatcatgccaa

SEQ ID NO: 48899 - DNA, 20 bp, Artificial Sequence
  sgRNA
  Pkhd1l1_12
aatacaatgagcatacccca

SEQ ID NO: 48900 - DNA, 20 bp, Artificial Sequence
  sgRNA
  Pkhd1l1_13
tcaaagctgccgcttatagg

SEQ ID NO: 48901 - DNA, 20 bp, Artificial Sequence
  sgRNA
  Pkhd1l1_14
ggaatctattactacagcag

SEQ ID NO: 48902 - DNA, 20 bp, Artificial Sequence
  sgRNA
  Pkhd1l1_15
cacttgccgttattacaaaa

SEQ ID NO: 48903 - DNA, 20 bp, Artificial Sequence
  sgRNA
  Pkhd1l1_16
tgaactggaacccatcctga

SEQ ID NO: 48904 - DNA, 20 bp, Artificial Sequence
  sgRNA
  Pkhd1l1_17
gaagcttctccacctataag

SEQ ID NO: 48905 - DNA, 20 bp, Artificial Sequence
  sgRNA
  Pkhd1l1_18
aacgtgacgctggtgaacaa

SEQ ID NO: 48906 - DNA, 20 bp, Artificial Sequence
  sgRNA
  Pkhd1l1_19
ggttatgtgcattccatcag

SEQ ID NO: 48907 - DNA, 20 bp, Artificial Sequence
  sgRNA
  Pkhd1l1_20
ggattgctaaaatcctacat

SEQ ID NO: 48908 - DNA, 20 bp, Artificial Sequence
  sgRNA
  Pla2r1_1
tggatcgcctacacgtccag

SEQ ID NO: 48909 - DNA, 20 bp, Artificial Sequence
  sgRNA
  Pla2r1_2
attcccaatccatatagcag

SEQ ID NO: 48910 - DNA, 20 bp, Artificial Sequence
  sgRNA
  Pla2r1_3
tctgtgatgctacgtggcaa

SEQ ID NO: 48911 - DNA, 20 bp, Artificial Sequence
  sgRNA
  Pla2r1_4
tttgcatatataaggcaagg

SEQ ID NO: 48912 - DNA, 20 bp, Artificial Sequence
  sgRNA
  Pla2r1_5
ggtggagagtccaatccagt

SEQ ID NO: 48913 - DNA, 20 bp, Artificial Sequence
  sgRNA
  Pla2r1_6
gaccagttagagtacaccag

SEQ ID NO: 48914 - DNA, 20 bp, Artificial Sequence
  sgRNA
  Pla2r1_7
gatctaaaccacactgcgca

SEQ ID NO: 48915 - DNA, 20 bp, Artificial Sequence
  sgRNA
  Pla2r1_8
gattcccaatccatatagca

SEQ ID NO: 48916 - DNA, 20 bp, Artificial Sequence
  sgRNA
  Pla2r1_9
gcaaagcatgaaaatgccca

SEQ ID NO: 48917 - DNA, 20 bp, Artificial Sequence
  sgRNA
  Pla2r1_10
gtttcttgtaagcctcctta

SEQ ID NO: 48918 - DNA, 20 bp, Artificial Sequence
  sgRNA
  Pla2r1_11
ctgctgctggggattcacca

SEQ ID NO: 48919 - DNA, 20 bp, Artificial Sequence
  sgRNA
  Pla2r1_12
atgcagccggaaagtcctgc

SEQ ID NO: 48920 - DNA, 20 bp, Artificial Sequence
  sgRNA
  Pla2r1_13
gttgtcctgaggatcccgga

SEQ ID NO: 48921 - DNA, 20 bp, Artificial Sequence
  sgRNA
  Pla2r1_14
agagtacacttggaagaccg

SEQ ID NO: 48922 - DNA, 20 bp, Artificial Sequence
  sgRNA
  Pla2r1_15
tcaacacgctgtcattcgat

SEQ ID NO: 48923 - DNA, 20 bp, Artificial Sequence
  sgRNA
  Pla2r1_16
gtaacggcgcagccagagaa

SEQ ID NO: 48924 - DNA, 20 bp, Artificial Sequence
  sgRNA
  Pla2r1_17
gtagtcaaggaagtgtggat

SEQ ID NO: 48925 - DNA, 20 bp, Artificial Sequence
  sgRNA
  Pla2r1_18
tgtttggaggcacagttcga

SEQ ID NO: 48926 - DNA, 20 bp, Artificial Sequence
  sgRNA
  Pla2r1_19
gcctgctgaggagaaccgtg

SEQ ID NO: 48927 - DNA, 20 bp, Artificial Sequence
  sgRNA
  Pla2r1_20
aattctgtgtcgccaagggt

SEQ ID NO: 48928 - DNA, 20 bp, Artificial Sequence
  sgRNA
  Plaur_1
aggaccatgagttaccgcat

SEQ ID NO: 48929 - DNA, 20 bp, Artificial Sequence
  sgRNA
  Plaur_2
aaggatgaggactacacccg

SEQ ID NO: 48930 - DNA, 20 bp, Artificial Sequence
  sgRNA
  Plaur_3
aggtgcaggacgcacactcg

SEQ ID NO: 48931 - DNA, 20 bp, Artificial Sequence
  sgRNA
  Plaur_4
tgcaactacacccactgcaa

SEQ ID NO: 48932 - DNA, 20 bp, Artificial Sequence
  sgRNA
  Plaur_5
cttcccctgtacacgtcacg

SEQ ID NO: 48933 - DNA, 20 bp, Artificial Sequence
  sgRNA
  Plaur_6
ggaggacgccccatagtccg

SEQ ID NO: 48934 - DNA, 20 bp, Artificial Sequence
  sgRNA
  Plaur_7
aatccacgtgacgtgtacag

SEQ ID NO: 48935 - DNA, 20 bp, Artificial Sequence
  sgRNA
  Plaur_8
taccgtaagaggctgcgcca

SEQ ID NO: 48936 - DNA, 20 bp, Artificial Sequence
  sgRNA
  Plaur_9
cttcagagctttccaccgaa

SEQ ID NO: 48937 - DNA, 20 bp, Artificial Sequence
  sgRNA
  Plaur_10
caggaccatgagttaccgca

SEQ ID NO: 48938 - DNA, 20 bp, Artificial Sequence
  sgRNA
  Plaur_11
gcgtctctcatcaactgccg

SEQ ID NO: 48939 - DNA, 20 bp, Artificial Sequence
  sgRNA
  Plaur_12
gccttggcaccaggaagccg

SEQ ID NO: 48940 - DNA, 20 bp, Artificial Sequence
  sgRNA
  Plaur_13
gaggacgccccatagtccga

SEQ ID NO: 48941 - DNA, 20 bp, Artificial Sequence
  sgRNA
  Plaur_14
ggaccaacattctcagtgac

SEQ ID NO: 48942 - DNA, 20 bp, Artificial Sequence
  sgRNA
  Plaur_15
gtgaggggaacaataccctt

SEQ ID NO: 48943 - DNA, 20 bp, Artificial Sequence
  sgRNA
  Plaur_16
gatgagagacgcctcttcgg

SEQ ID NO: 48944 - DNA, 20 bp, Artificial Sequence
  sgRNA
  Plaur_17
caatgaggctgagttgagca

SEQ ID NO: 48945 - DNA, 20 bp, Artificial Sequence
  sgRNA
  Plaur_18
gctctggtccaaagaggtgc

SEQ ID NO: 48946 - DNA, 20 bp, Artificial Sequence
  sgRNA
  Plaur_19
tctgcaggactaccgtgctt

SEQ ID NO: 48947 - DNA, 20 bp, Artificial Sequence
  sgRNA
  Plaur_20
ctaggagttgcccagcagat

SEQ ID NO: 48948 - DNA, 20 bp, Artificial Sequence
  sgRNA
  Plb1_1
atagcggacgatatgacacg

SEQ ID NO: 48949 - DNA, 20 bp, Artificial Sequence
  sgRNA
  Plb1_2
gatgtcttaactgaataccg

SEQ ID NO: 48950 - DNA, 20 bp, Artificial Sequence
  sgRNA
  Plb1_3
ccaaattcacaaatgctctg

SEQ ID NO: 48951 - DNA, 20 bp, Artificial Sequence
  sgRNA
  Plb1_4
cccttcccaggagaacacgt

SEQ ID NO: 48952 - DNA, 20 bp, Artificial Sequence
  sgRNA
  Plb1_5
ggtagtgctcagaaatggcg

SEQ ID NO: 48953 - DNA, 20 bp, Artificial Sequence
  sgRNA
  Plb1_6
aagaagctgactattccgga

SEQ ID NO: 48954 - DNA, 20 bp, Artificial Sequence
  sgRNA
  Plb1_7
gcaactgtgttctgaccccg

SEQ ID NO: 48955 - DNA, 20 bp, Artificial Sequence
  sgRNA
  Plb1_8
gaagaagctgactattccgg

SEQ ID NO: 48956 - DNA, 20 bp, Artificial Sequence
  sgRNA
  Plb1_9
gccacgagtttaatgtctga

SEQ ID NO: 48957 - DNA, 20 bp, Artificial Sequence
  sgRNA
  Plb1_10
tagcggacgatatgacacga

SEQ ID NO: 48958 - DNA, 20 bp, Artificial Sequence
  sgRNA
  Plb1_11
caagcatgagaccttcgcgg

SEQ ID NO: 48959 - DNA, 20 bp, Artificial Sequence
  sgRNA
  Plb1_12
aaggtcatcacggtgatgat

SEQ ID NO: 48960 - DNA, 20 bp, Artificial Sequence
  sgRNA
  Plb1_13
ggcctttgtgaacatggcaa

SEQ ID NO: 48961 - DNA, 20 bp, Artificial Sequence
  sgRNA
  Plb1_14
cacgagggataatttcactg

SEQ ID NO: 48962 - DNA, 20 bp, Artificial Sequence
  sgRNA
  Plb1_15
ggacagtcctcgatactgtg

SEQ ID NO: 48963 - DNA, 20 bp, Artificial Sequence
  sgRNA
  Plb1_16
gcatctccgagctctcctat

SEQ ID NO: 48964 - DNA, 20 bp, Artificial Sequence
  sgRNA
  Plb1_17
gtttctacttctcagaccgt

SEQ ID NO: 48965 - DNA, 20 bp, Artificial Sequence
  sgRNA
  Plb1_18
ccagagtagcatgctccaac

SEQ ID NO: 48966 - DNA, 20 bp, Artificial Sequence
  sgRNA
  Plb1_19
agtcctctcgagtgtcgtag

SEQ ID NO: 48967 - DNA, 20 bp, Artificial Sequence
  sgRNA
  Plb1_20
attcccatgcatacatcctg

SEQ ID NO: 48968 - DNA, 20 bp, Artificial Sequence
  sgRNA
  Pld5_1
gaagagcggtaagtgaaacg

SEQ ID NO: 48969 - DNA, 20 bp, Artificial Sequence
  sgRNA
  Pld5_2
aacatgaccgcctacaacaa

SEQ ID NO: 48970 - DNA, 20 bp, Artificial Sequence
  sgRNA
  Pld5_3
agcaagactcaccgacacaa

SEQ ID NO: 48971 - DNA, 20 bp, Artificial Sequence
  sgRNA
  Pld5_4
tcgcccagcctgacccgagt

SEQ ID NO: 48972 - DNA, 20 bp, Artificial Sequence
  sgRNA
  Pld5_5
tgaccgcctacaacaagggc

SEQ ID NO: 48973 - DNA, 20 bp, Artificial Sequence
  sgRNA
  Pld5_6
gtgtgtggttgaggtcccaa

SEQ ID NO: 48974 - DNA, 20 bp, Artificial Sequence
  sgRNA
  Pld5_7
catctgctcgaagccctcgt

SEQ ID NO: 48975 - DNA, 20 bp, Artificial Sequence
  sgRNA
  Pld5_8
cagccggcccttgttgtagg

SEQ ID NO: 48976 - DNA, 20 bp, Artificial Sequence
  sgRNA
  Pld5_9
tttccttcggagccagacgc

SEQ ID NO: 48977 - DNA, 20 bp, Artificial Sequence
  sgRNA
  Pld5_10
gctccgaaggaaagataaac

SEQ ID NO: 48978 - DNA, 20 bp, Artificial Sequence
  sgRNA
  Pld5_11
actcgggtcaggctgggcga

SEQ ID NO: 48979 - DNA, 20 bp, Artificial Sequence
  sgRNA
  Pld5_12
attaaaccgcaacaagtaca

SEQ ID NO: 48980 - DNA, 20 bp, Artificial Sequence
  sgRNA
  Pld5_13
gctgctcataagcttctgga

SEQ ID NO: 48981 - DNA, 20 bp, Artificial Sequence
  sgRNA
  Pld5_14
tgttgtctctcacatctgcc

SEQ ID NO: 48982 - DNA, 20 bp, Artificial Sequence
  sgRNA
  Pld5_15
tgtagaagttcgcgcccact

SEQ ID NO: 48983 - DNA, 20 bp, Artificial Sequence
  sgRNA
  Pld5_16
gcctggtcctagatttacaa

SEQ ID NO: 48984 - DNA, 20 bp, Artificial Sequence
  sgRNA
  Pld5_17
tgagcaagttcatccagcct

SEQ ID NO: 48985 - DNA, 20 bp, Artificial Sequence
  sgRNA
  Pld5_18
catggccaatgccaccggga

SEQ ID NO: 48986 - DNA, 20 bp, Artificial Sequence
  sgRNA
  Pld5_19
tctgctcgaagccctcgtgg

SEQ ID NO: 48987 - DNA, 20 bp, Artificial Sequence
  sgRNA
  Pld5_20
ccatggccaatgccaccggg

SEQ ID NO: 48988 - DNA, 20 bp, Artificial Sequence
  sgRNA
  Plet1_1
cactgactgaatcgttcacg

SEQ ID NO: 48989 - DNA, 20 bp, Artificial Sequence
  sgRNA
  Plet1_2
gatgttatcaaggaccacgc

SEQ ID NO: 48990 - DNA, 20 bp, Artificial Sequence
  sgRNA
  Plet1_3
cttgacatcccaaagccagt

SEQ ID NO: 48991 - DNA, 20 bp, Artificial Sequence
  sgRNA
  Plet1_4
tcatccgtgaaaatggaaca

SEQ ID NO: 48992 - DNA, 20 bp, Artificial Sequence
  sgRNA
  Plet1_5
gcactgactgaatcgttcac

SEQ ID NO: 48993 - DNA, 20 bp, Artificial Sequence
  sgRNA
  Plet1_6
agtttgtctggaagaccgac

SEQ ID NO: 48994 - DNA, 20 bp, Artificial Sequence
  sgRNA
  Plet1_7
gctgatttccaagatgtcgg

SEQ ID NO: 48995 - DNA, 20 bp, Artificial Sequence
  sgRNA
  Plet1_8
ttatcactggcagagaggga

SEQ ID NO: 48996 - DNA, 20 bp, Artificial Sequence
  sgRNA
  Plet1_9
ccctctctgccagtgataat

SEQ ID NO: 48997 - DNA, 20 bp, Artificial Sequence
  sgRNA
  Plet1_10
ctatggctaacgtctctggt

SEQ ID NO: 48998 - DNA, 20 bp, Artificial Sequence
  sgRNA
  Plet1_11
ttagtcacatcctcggaagt

SEQ ID NO: 48999 - DNA, 20 bp, Artificial Sequence
  sgRNA
  Plet1_12
ataagtgcagagccaggcac

SEQ ID NO: 49000 - DNA, 20 bp, Artificial Sequence
  sgRNA
  Plet1_13
tatggagggcacctgccagg

SEQ ID NO: 49001 - DNA, 20 bp, Artificial Sequence
  sgRNA
  Plet1_14
ctggacagttcctacttccg

SEQ ID NO: 49002 - DNA, 20 bp, Artificial Sequence
  sgRNA
  Plet1_15
cagtgataatgggtcctgcg

SEQ ID NO: 49003 - DNA, 20 bp, Artificial Sequence
  sgRNA
  Plet1_16
cccccacccatctctccagt

SEQ ID NO: 49004 - DNA, 20 bp, Artificial Sequence
  sgRNA
  Plet1_17
agtcggtcttccagacaaac

SEQ ID NO: 49005 - DNA, 20 bp, Artificial Sequence
  sgRNA
  Plet1_18
ccgactggagagatgggtgg

SEQ ID NO: 49006 - DNA, 20 bp, Artificial Sequence
  sgRNA
  Plet1_19
attatcactggcagagaggg

SEQ ID NO: 49007 - DNA, 20 bp, Artificial Sequence
  sgRNA
  Plet1_20
gaaggaggacgacagcccag

SEQ ID NO: 49008 - DNA, 20 bp, Artificial Sequence
  sgRNA
  Plp1_1
ctgagcgcaacggtaacagg

SEQ ID NO: 49009 - DNA, 20 bp, Artificial Sequence
  sgRNA
  Plp1_2
caggagccatacaacagtca

SEQ ID NO: 49010 - DNA, 20 bp, Artificial Sequence
  sgRNA
  Plp1_3
gtattgaagtaaatgtacac

SEQ ID NO: 49011 - DNA, 20 bp, Artificial Sequence
  sgRNA
  Plp1_4
taatgagatactcatagtcc

SEQ ID NO: 49012 - DNA, 20 bp, Artificial Sequence
  sgRNA
  Plp1_5
gagactgcctatactggcag

SEQ ID NO: 49013 - DNA, 20 bp, Artificial Sequence
  sgRNA
  Plp1_6
gcctgagcgcaacggtaaca

SEQ ID NO: 49014 - DNA, 20 bp, Artificial Sequence
  sgRNA
  Plp1_7
gctgagggcttctacaccac

SEQ ID NO: 49015 - DNA, 20 bp, Artificial Sequence
  sgRNA
  Plp1_8
aaggacggcgaagttgtaag

SEQ ID NO: 49016 - DNA, 20 bp, Artificial Sequence
  sgRNA
  Plp1_9
tcggcccatgagtttaagga

SEQ ID NO: 49017 - DNA, 20 bp, Artificial Sequence
  sgRNA
  Plp1_10
atactggcagaggtcttgct

SEQ ID NO: 49018 - DNA, 20 bp, Artificial Sequence
  sgRNA
  Plp1_11
gatctgcctgacagcgccgg

SEQ ID NO: 49019 - DNA, 20 bp, Artificial Sequence
  sgRNA
  Plp1_12
cctatgccctgactgttgta

SEQ ID NO: 49020 - DNA, 20 bp, Artificial Sequence
  sgRNA
  Plp1_13
caaacgcagcaataaacagg

SEQ ID NO: 49021 - DNA, 20 bp, Artificial Sequence
  sgRNA
  Plp1_14
cctgagcgcaacggtaacag

SEQ ID NO: 49022 - DNA, 20 bp, Artificial Sequence
  sgRNA
  Plp1_15
gaaggcaatagactgacagg

SEQ ID NO: 49023 - DNA, 20 bp, Artificial Sequence
  sgRNA
  Plp1_16
ctatttctccaaaaactacc

SEQ ID NO: 49024 - DNA, 20 bp, Artificial Sequence
  sgRNA
  Plp1_17
tggagccacaaaccttgcca

SEQ ID NO: 49025 - DNA, 20 bp, Artificial Sequence
  sgRNA
  Plp1_18
tgtggacatgaagctctcac

SEQ ID NO: 49026 - DNA, 20 bp, Artificial Sequence
  sgRNA
  Plp1_19
cggcaagggcctgagcgcaa

SEQ ID NO: 49027 - DNA, 20 bp, Artificial Sequence
  sgRNA
  Plp1_20
tcaagctcattctttggagc

SEQ ID NO: 49028 - DNA, 20 bp, Artificial Sequence
  sgRNA
  Plppr1_1
acttaatgaagccttacccg

SEQ ID NO: 49029 - DNA, 20 bp, Artificial Sequence
  sgRNA
  Plppr1_2
gtatttcataaagtcaacaa

SEQ ID NO: 49030 - DNA, 20 bp, Artificial Sequence
  sgRNA
  Plppr1_3
aagtgatagaaaaagctcgg

SEQ ID NO: 49031 - DNA, 20 bp, Artificial Sequence
  sgRNA
  Plppr1_4
ccttactccgaaggatcatc

SEQ ID NO: 49032 - DNA, 20 bp, Artificial Sequence
  sgRNA
  Plppr1_5
tgatgatccttcggagtaag

SEQ ID NO: 49033 - DNA, 20 bp, Artificial Sequence
  sgRNA
  Plppr1_6
caatcaagacgaagagcagt

SEQ ID NO: 49034 - DNA, 20 bp, Artificial Sequence
  sgRNA
  Plppr1_7
cgaaggatcatcaggttcat

SEQ ID NO: 49035 - DNA, 20 bp, Artificial Sequence
  sgRNA
  Plppr1_8
gaacgcagtagagcaccaga

SEQ ID NO: 49036 - DNA, 20 bp, Artificial Sequence
  sgRNA
  Plppr1_9
ggagaaaatgatcctgacag

SEQ ID NO: 49037 - DNA, 20 bp, Artificial Sequence
  sgRNA
  Plppr1_10
ctgatgatccttcggagtaa

SEQ ID NO: 49038 - DNA, 20 bp, Artificial Sequence
  sgRNA
  Plppr1_11
tgtatttcataaagtcaaca

SEQ ID NO: 49039 - DNA, 20 bp, Artificial Sequence
  sgRNA
  Plppr1_12
gaagtagtaggcaagcagca

SEQ ID NO: 49040 - DNA, 20 bp, Artificial Sequence
  sgRNA
  Plppr1_13
tggaagtgatagaaaaagct

SEQ ID NO: 49041 - DNA, 20 bp, Artificial Sequence
  sgRNA
  Plppr1_14
gtcagtgcattcgaagtagt

SEQ ID NO: 49042 - DNA, 20 bp, Artificial Sequence
  sgRNA
  Plppr1_15
caaggattcttctgtcagga

SEQ ID NO: 49043 - DNA, 20 bp, Artificial Sequence
  sgRNA
  Plppr1_16
tgtgtggttcataacttcag

SEQ ID NO: 49044 - DNA, 20 bp, Artificial Sequence
  sgRNA
  Plppr1_17
cgatgaacctgatgatcctt

SEQ ID NO: 49045 - DNA, 20 bp, Artificial Sequence
  sgRNA
  Plppr1_18
agacttaatgaagccttacc

SEQ ID NO: 49046 - DNA, 20 bp, Artificial Sequence
  sgRNA
  Plppr1_19
gctcagagcagcatgtttgg

SEQ ID NO: 49047 - DNA, 20 bp, Artificial Sequence
  sgRNA
  Plppr1_20
gacttaatgaagccttaccc

SEQ ID NO: 49048 - DNA, 20 bp, Artificial Sequence
  sgRNA
  Plppr4_1
gcgatgacctgcatgatgcg

SEQ ID NO: 49049 - DNA, 20 bp, Artificial Sequence
  sgRNA
  Plppr4_2
tatcctcaaccgaaaccaca

SEQ ID NO: 49050 - DNA, 20 bp, Artificial Sequence
  sgRNA
  Plppr4_3
cgctgatgtcacattccccg

SEQ ID NO: 49051 - DNA, 20 bp, Artificial Sequence
  sgRNA
  Plppr4_4
gctgatgtcacattccccgc

SEQ ID NO: 49052 - DNA, 20 bp, Artificial Sequence
  sgRNA
  Plppr4_5
tgtgcaccgtgcggccaccg

SEQ ID NO: 49053 - DNA, 20 bp, Artificial Sequence
  sgRNA
  Plppr4_6
gcagttctgcgcgagccaag

SEQ ID NO: 49054 - DNA, 20 bp, Artificial Sequence
  sgRNA
  Plppr4_7
gtatcctcaaccgaaaccac

SEQ ID NO: 49055 - DNA, 20 bp, Artificial Sequence
  sgRNA
  Plppr4_8
gatgatttctacgtcagcgt

SEQ ID NO: 49056 - DNA, 20 bp, Artificial Sequence
  sgRNA
  Plppr4_9
ggcatactattgttgcaccc

SEQ ID NO: 49057 - DNA, 20 bp, Artificial Sequence
  sgRNA
  Plppr4_10
gaccttacagtcatcaacag

SEQ ID NO: 49058 - DNA, 20 bp, Artificial Sequence
  sgRNA
  Plppr4_11
gcaacaatagtatgccggga

SEQ ID NO: 49059 - DNA, 20 bp, Artificial Sequence
  sgRNA
  Plppr4_12
tcaaggagcttgcatccctg

SEQ ID NO: 49060 - DNA, 20 bp, Artificial Sequence
  sgRNA
  Plppr4_13
gatgttgcccttcctgcgca

SEQ ID NO: 49061 - DNA, 20 bp, Artificial Sequence
  sgRNA
  Plppr4_14
acaaaggaacctcccccacg

SEQ ID NO: 49062 - DNA, 20 bp, Artificial Sequence
  sgRNA
  Plppr4_15
ggaccgggcagaatccatag

SEQ ID NO: 49063 - DNA, 20 bp, Artificial Sequence
  sgRNA
  Plppr4_16
tccactcgcacgatgccgct

SEQ ID NO: 49064 - DNA, 20 bp, Artificial Sequence
  sgRNA
  Plppr4_17
gtacattgagccaacccagg

SEQ ID NO: 49065 - DNA, 20 bp, Artificial Sequence
  sgRNA
  Plppr4_18
gctgggctcatggtcagtca

SEQ ID NO: 49066 - DNA, 20 bp, Artificial Sequence
  sgRNA
  Plppr4_19
gctcgcgcagaactgctctt

SEQ ID NO: 49067 - DNA, 20 bp, Artificial Sequence
  sgRNA
  Plppr4_20
gttcagtgtccataacctgt

SEQ ID NO: 49068 - DNA, 20 bp, Artificial Sequence
  sgRNA
  Plppr5_1
ggacggttcggcgtaccagt

SEQ ID NO: 49069 - DNA, 20 bp, Artificial Sequence
  sgRNA
  Plppr5_2
gcccgggtagggcttacggt

SEQ ID NO: 49070 - DNA, 20 bp, Artificial Sequence
  sgRNA
  Plppr5_3
cagcgagtagaggagcaccg

SEQ ID NO: 49071 - DNA, 20 bp, Artificial Sequence
  sgRNA
  Plppr5_4
cagcatgctctatttccaga

SEQ ID NO: 49072 - DNA, 20 bp, Artificial Sequence
  sgRNA
  Plppr5_5
aagccaaactacacagcgct

SEQ ID NO: 49073 - DNA, 20 bp, Artificial Sequence
  sgRNA
  Plppr5_6
acgttcactgtgaacgtgca

SEQ ID NO: 49074 - DNA, 20 bp, Artificial Sequence
  sgRNA
  Plppr5_7
tactggactcaacagagtag

SEQ ID NO: 49075 - DNA, 20 bp, Artificial Sequence
  sgRNA
  Plppr5_8
gcttacggtaggcgctgtcg

SEQ ID NO: 49076 - DNA, 20 bp, Artificial Sequence
  sgRNA
  Plppr5_9
aacacattaatcccaagcac

SEQ ID NO: 49077 - DNA, 20 bp, Artificial Sequence
  sgRNA
  Plppr5_10
gctttctactcgaggaatgt

SEQ ID NO: 49078 - DNA, 20 bp, Artificial Sequence
  sgRNA
  Plppr5_11
gtgatagcaggcttcctagt

SEQ ID NO: 49079 - DNA, 20 bp, Artificial Sequence
  sgRNA
  Plppr5_12
gcaacaatctccagttaaaa

SEQ ID NO: 49080 - DNA, 20 bp, Artificial Sequence
  sgRNA
  Plppr5_13
cttccgcaaaggcagtgacg

SEQ ID NO: 49081 - DNA, 20 bp, Artificial Sequence
  sgRNA
  Plppr5_14
cagacctcatcatgcgagca

SEQ ID NO: 49082 - DNA, 20 bp, Artificial Sequence
  sgRNA
  Plppr5_15
actcgaggaatgttggtcat

SEQ ID NO: 49083 - DNA, 20 bp, Artificial Sequence
  sgRNA
  Plppr5_16
cattggtcagatgtgatagc

SEQ ID NO: 49084 - DNA, 20 bp, Artificial Sequence
  sgRNA
  Plppr5_17
cgtggcagcgtagacactca

SEQ ID NO: 49085 - DNA, 20 bp, Artificial Sequence
  sgRNA
  Plppr5_18
catgctgctgatgagcgcca

SEQ ID NO: 49086 - DNA, 20 bp, Artificial Sequence
  sgRNA
  Plppr5_19
gtacacacagtttatcagtg

SEQ ID NO: 49087 - DNA, 20 bp, Artificial Sequence
  sgRNA
  Plppr5_20
agaaaatgggcatatacaca

SEQ ID NO: 49088 - DNA, 20 bp, Artificial Sequence
  sgRNA
  Plvap_1
cggacgtgctgagtgcgtgg

SEQ ID NO: 49089 - DNA, 20 bp, Artificial Sequence
  sgRNA
  Plvap_2
gctgtcggcgcggatctccg

SEQ ID NO: 49090 - DNA, 20 bp, Artificial Sequence
  sgRNA
  Plvap_3
cggagtacgcgtccctccgt

SEQ ID NO: 49091 - DNA, 20 bp, Artificial Sequence
  sgRNA
  Plvap_4
cctgtggcaaagcacgcgaa

SEQ ID NO: 49092 - DNA, 20 bp, Artificial Sequence
  sgRNA
  Plvap_5
gctaatgcgcacatccacct

SEQ ID NO: 49093 - DNA, 20 bp, Artificial Sequence
  sgRNA
  Plvap_6
gctggagcaactgcgcaccg

SEQ ID NO: 49094 - DNA, 20 bp, Artificial Sequence
  sgRNA
  Plvap_7
gctctcgcaggtccgacgga

SEQ ID NO: 49095 - DNA, 20 bp, Artificial Sequence
  sgRNA
  Plvap_8
ggtttctcgcgcctgcgcct

SEQ ID NO: 49096 - DNA, 20 bp, Artificial Sequence
  sgRNA
  Plvap_9
ggtgggcctgagactctcgg

SEQ ID NO: 49097 - DNA, 20 bp, Artificial Sequence
  sgRNA
  Plvap_10
ggaacttctcctggtccagt

SEQ ID NO: 49098 - DNA, 20 bp, Artificial Sequence
  sgRNA
  Plvap_11
aggcagatagtccaaccacc

SEQ ID NO: 49099 - DNA, 20 bp, Artificial Sequence
  sgRNA
  Plvap_12
gcgagaaacccagctacggg

SEQ ID NO: 49100 - DNA, 20 bp, Artificial Sequence
  sgRNA
  Plvap_13
tcatgaagaggaccaggccc

SEQ ID NO: 49101 - DNA, 20 bp, Artificial Sequence
  sgRNA
  Plvap_14
ggctgtacaggctgtcggcg

SEQ ID NO: 49102 - DNA, 20 bp, Artificial Sequence
  sgRNA
  Plvap_15
gaccgaggagaacctgcgca

SEQ ID NO: 49103 - DNA, 20 bp, Artificial Sequence
  sgRNA
  Plvap_16
cgacagcctgtacagccagg

SEQ ID NO: 49104 - DNA, 20 bp, Artificial Sequence
  sgRNA
  Plvap_17
actgaatgagcgacacgaag

SEQ ID NO: 49105 - DNA, 20 bp, Artificial Sequence
  sgRNA
  Plvap_18
actccggcatcagctggtag

SEQ ID NO: 49106 - DNA, 20 bp, Artificial Sequence
  sgRNA
  Plvap_19
aagatagaagagctggcccg

SEQ ID NO: 49107 - DNA, 20 bp, Artificial Sequence
  sgRNA
  Plvap_20
ccgcagttctgcattctcac

SEQ ID NO: 49108 - DNA, 20 bp, Artificial Sequence
  sgRNA
  Plxdc1_1
attgtcaaagtaagcaaccg

SEQ ID NO: 49109 - DNA, 20 bp, Artificial Sequence
  sgRNA
  Plxdc1_2
actctgcatggactgccaag

SEQ ID NO: 49110 - DNA, 20 bp, Artificial Sequence
  sgRNA
  Plxdc1_3
ggttagattcgaggacacgc

SEQ ID NO: 49111 - DNA, 20 bp, Artificial Sequence
  sgRNA
  Plxdc1_4
tgtggatcttcacatgactc

SEQ ID NO: 49112 - DNA, 20 bp, Artificial Sequence
  sgRNA
  Plxdc1_5
gcagttgctgctactccgcg

SEQ ID NO: 49113 - DNA, 20 bp, Artificial Sequence
  sgRNA
  Plxdc1_6
caaccactctacctacaccg

SEQ ID NO: 49114 - DNA, 20 bp, Artificial Sequence
  sgRNA
  Plxdc1_7
gcgtagctgtgagcatccgg

SEQ ID NO: 49115 - DNA, 20 bp, Artificial Sequence
  sgRNA
  Plxdc1_8
gattctcaattcatccccag

SEQ ID NO: 49116 - DNA, 20 bp, Artificial Sequence
  sgRNA
  Plxdc1_9
ctgcagttgctgctactccg

SEQ ID NO: 49117 - DNA, 20 bp, Artificial Sequence
  sgRNA
  Plxdc1_10
cgtaggtcagccattcttgg

SEQ ID NO: 49118 - DNA, 20 bp, Artificial Sequence
  sgRNA
  Plxdc1_11
ctggcttcaacacctgcgcg

SEQ ID NO: 49119 - DNA, 20 bp, Artificial Sequence
  sgRNA
  Plxdc1_12
tggagtccagttccacacgg

SEQ ID NO: 49120 - DNA, 20 bp, Artificial Sequence
  sgRNA
  Plxdc1_13
tggagttgtcagagtagccg

SEQ ID NO: 49121 - DNA, 20 bp, Artificial Sequence
  sgRNA
  Plxdc1_14
gtagtggagtcgccattaaa

SEQ ID NO: 49122 - DNA, 20 bp, Artificial Sequence
  sgRNA
  Plxdc1_15
gcctggcttcaacacctgcg

SEQ ID NO: 49123 - DNA, 20 bp, Artificial Sequence
  sgRNA
  Plxdc1_16
ctgatggccaacttcaaccc

SEQ ID NO: 49124 - DNA, 20 bp, Artificial Sequence
  sgRNA
  Plxdc1_17
cagatcaccatagcaaccgg

SEQ ID NO: 49125 - DNA, 20 bp, Artificial Sequence
  sgRNA
  Plxdc1_18
gctggtgccatgtcctgcag

SEQ ID NO: 49126 - DNA, 20 bp, Artificial Sequence
  sgRNA
  Plxdc1_19
tgatatccaggacagccatg

SEQ ID NO: 49127 - DNA, 20 bp, Artificial Sequence
  sgRNA
  Plxdc1_20
gtgcagcattggaattaggg

SEQ ID NO: 49128 - DNA, 20 bp, Artificial Sequence
  sgRNA
  Plxdc2_1
ccggttccagttcgcccacg

SEQ ID NO: 49129 - DNA, 20 bp, Artificial Sequence
  sgRNA
  Plxdc2_2
actctcaagcatacaaccac

SEQ ID NO: 49130 - DNA, 20 bp, Artificial Sequence
  sgRNA
  Plxdc2_3
gcagttgaaaccaatctgcg

SEQ ID NO: 49131 - DNA, 20 bp, Artificial Sequence
  sgRNA
  Plxdc2_4
acaacccgactttcactgga

SEQ ID NO: 49132 - DNA, 20 bp, Artificial Sequence
  sgRNA
  Plxdc2_5
gttaacccacagatcccggc

SEQ ID NO: 49133 - DNA, 20 bp, Artificial Sequence
  sgRNA
  Plxdc2_6
ggatactttccaacactcat

SEQ ID NO: 49134 - DNA, 20 bp, Artificial Sequence
  sgRNA
  Plxdc2_7
gttcaacttctgcataggca

SEQ ID NO: 49135 - DNA, 20 bp, Artificial Sequence
  sgRNA
  Plxdc2_8
gaatggccgctgctataatg

SEQ ID NO: 49136 - DNA, 20 bp, Artificial Sequence
  sgRNA
  Plxdc2_9
ttatctgtgtgaccaagaca

SEQ ID NO: 49137 - DNA, 20 bp, Artificial Sequence
  sgRNA
  Plxdc2_10
gccctacatctcaaagacag

SEQ ID NO: 49138 - DNA, 20 bp, Artificial Sequence
  sgRNA
  Plxdc2_11
tctaccccctcttcattcca

SEQ ID NO: 49139 - DNA, 20 bp, Artificial Sequence
  sgRNA
  Plxdc2_12
gcacagctcttgttgtccag

SEQ ID NO: 49140 - DNA, 20 bp, Artificial Sequence
  sgRNA
  Plxdc2_13
caatctgcgaggacacacaa

SEQ ID NO: 49141 - DNA, 20 bp, Artificial Sequence
  sgRNA
  Plxdc2_14
tatgcagaagttgaaccagt

SEQ ID NO: 49142 - DNA, 20 bp, Artificial Sequence
  sgRNA
  Plxdc2_15
tggacatttgtagttctact

SEQ ID NO: 49143 - DNA, 20 bp, Artificial Sequence
  sgRNA
  Plxdc2_16
gaagtcactgtggcaactgg

SEQ ID NO: 49144 - DNA, 20 bp, Artificial Sequence
  sgRNA
  Plxdc2_17
ttgtgtctactgccttaaaa

SEQ ID NO: 49145 - DNA, 20 bp, Artificial Sequence
  sgRNA
  Plxdc2_18
caggaccctgaattgcatgg

SEQ ID NO: 49146 - DNA, 20 bp, Artificial Sequence
  sgRNA
  Plxdc2_19
acataactcctgctgcggcc

SEQ ID NO: 49147 - DNA, 20 bp, Artificial Sequence
  sgRNA
  Plxdc2_20
tgcagcttgccgatgagtgt

SEQ ID NO: 49148 - DNA, 20 bp, Artificial Sequence
  sgRNA
  Plxna1_1
tgactaccaaggccgcaccg

SEQ ID NO: 49149 - DNA, 20 bp, Artificial Sequence
  sgRNA
  Plxna1_2
tccaacagtactcctatgag

SEQ ID NO: 49150 - DNA, 20 bp, Artificial Sequence
  sgRNA
  Plxna1_3
agtatacgaactgctcgctg

SEQ ID NO: 49151 - DNA, 20 bp, Artificial Sequence
  sgRNA
  Plxna1_4
cggcgcccggcacaccatgg

SEQ ID NO: 49152 - DNA, 20 bp, Artificial Sequence
  sgRNA
  Plxna1_5
gtacctggattggcatcgaa

SEQ ID NO: 49153 - DNA, 20 bp, Artificial Sequence
  sgRNA
  Plxna1_6
gcttctccgtcatagcatag

SEQ ID NO: 49154 - DNA, 20 bp, Artificial Sequence
  sgRNA
  Plxna1_7
gaccaacgtgaaggcgaccg

SEQ ID NO: 49155 - DNA, 20 bp, Artificial Sequence
  sgRNA
  Plxna1_8
tgcccagctctccaaccccg

SEQ ID NO: 49156 - DNA, 20 bp, Artificial Sequence
  sgRNA
  Plxna1_9
tcttacgtggagttccccat

SEQ ID NO: 49157 - DNA, 20 bp, Artificial Sequence
  sgRNA
  Plxna1_10
atggtgactgacacattgcg

SEQ ID NO: 49158 - DNA, 20 bp, Artificial Sequence
  sgRNA
  Plxna1_11
ggttgtctatagacggcgcc

SEQ ID NO: 49159 - DNA, 20 bp, Artificial Sequence
  sgRNA
  Plxna1_12
tgaacatgagaatgcgcccg

SEQ ID NO: 49160 - DNA, 20 bp, Artificial Sequence
  sgRNA
  Plxna1_13
tcatgggtgttcgtgagcgt

SEQ ID NO: 49161 - DNA, 20 bp, Artificial Sequence
  sgRNA
  Plxna1_14
ctacctgtccagtgttcgag

SEQ ID NO: 49162 - DNA, 20 bp, Artificial Sequence
  sgRNA
  Plxna1_15
ccaccgatacccacaatggc

SEQ ID NO: 49163 - DNA, 20 bp, Artificial Sequence
  sgRNA
  Plxna1_16
gtgcggctaggcgtgcacgt

SEQ ID NO: 49164 - DNA, 20 bp, Artificial Sequence
  sgRNA
  Plxna1_17
cgatctgcctgtgaacctgt

SEQ ID NO: 49165 - DNA, 20 bp, Artificial Sequence
  sgRNA
  Plxna1_18
tgtcacatgggcccgaagca

SEQ ID NO: 49166 - DNA, 20 bp, Artificial Sequence
  sgRNA
  Plxna1_19
gtgaagcacccaacctcacg

SEQ ID NO: 49167 - DNA, 20 bp, Artificial Sequence
  sgRNA
  Plxna1_20
tcttccttgtcgacaaaaag

SEQ ID NO: 49168 - DNA, 20 bp, Artificial Sequence
  sgRNA
  Plxna2_1
actgttcacatgattcaaca

SEQ ID NO: 49169 - DNA, 20 bp, Artificial Sequence
  sgRNA
  Plxna2_2
ctgcagactgctatccaccc

SEQ ID NO: 49170 - DNA, 20 bp, Artificial Sequence
  sgRNA
  Plxna2_3
tacaatgcacaggttcacgt

SEQ ID NO: 49171 - DNA, 20 bp, Artificial Sequence
  sgRNA
  Plxna2_4
atgtggtacctataacggca

SEQ ID NO: 49172 - DNA, 20 bp, Artificial Sequence
  sgRNA
  Plxna2_5
gtatccacgacacagatgtg

SEQ ID NO: 49173 - DNA, 20 bp, Artificial Sequence
  sgRNA
  Plxna2_6
actggaactgttgaaacgca

SEQ ID NO: 49174 - DNA, 20 bp, Artificial Sequence
  sgRNA
  Plxna2_7
gaccctgtataccaccagca

SEQ ID NO: 49175 - DNA, 20 bp, Artificial Sequence
  sgRNA
  Plxna2_8
gctcaatacgttggacccgt

SEQ ID NO: 49176 - DNA, 20 bp, Artificial Sequence
  sgRNA
  Plxna2_9
ctactctgagaatcgcctgc

SEQ ID NO: 49177 - DNA, 20 bp, Artificial Sequence
  sgRNA
  Plxna2_10
tcgagtatatagatgaccca

SEQ ID NO: 49178 - DNA, 20 bp, Artificial Sequence
  sgRNA
  Plxna2_11
agaatgtcccctactcccag

SEQ ID NO: 49179 - DNA, 20 bp, Artificial Sequence
  sgRNA
  Plxna2_12
gtatcaggaccacctgaagg

SEQ ID NO: 49180 - DNA, 20 bp, Artificial Sequence
  sgRNA
  Plxna2_13
gtttcacccccatcatccaa

SEQ ID NO: 49181 - DNA, 20 bp, Artificial Sequence
  sgRNA
  Plxna2_14
gtgaacctcccaacctcaca

SEQ ID NO: 49182 - DNA, 20 bp, Artificial Sequence
  sgRNA
  Plxna2_15
tttgtatttgacatccacaa

SEQ ID NO: 49183 - DNA, 20 bp, Artificial Sequence
  sgRNA
  Plxna2_16
ggtgtcagacagatccgtgg

SEQ ID NO: 49184 - DNA, 20 bp, Artificial Sequence
  sgRNA
  Plxna2_17
agatatgaatgcctacctcg

SEQ ID NO: 49185 - DNA, 20 bp, Artificial Sequence
  sgRNA
  Plxna2_18
ggatgtcattcaggagccca

SEQ ID NO: 49186 - DNA, 20 bp, Artificial Sequence
  sgRNA
  Plxna2_19
tcttctacacaagttcctga

SEQ ID NO: 49187 - DNA, 20 bp, Artificial Sequence
  sgRNA
  Plxna2_20
gcaacgactggcctacaagg

SEQ ID NO: 49188 - DNA, 20 bp, Artificial Sequence
  sgRNA
  Plxna3_1
gatgggcactctgcaccaag

SEQ ID NO: 49189 - DNA, 20 bp, Artificial Sequence
  sgRNA
  Plxna3_2
ccgtaagctcatcgacgatg

SEQ ID NO: 49190 - DNA, 20 bp, Artificial Sequence
  sgRNA
  Plxna3_3
tcagcactgacatattcggt

SEQ ID NO: 49191 - DNA, 20 bp, Artificial Sequence
  sgRNA
  Plxna3_4
catgacggtacttacaccag

SEQ ID NO: 49192 - DNA, 20 bp, Artificial Sequence
  sgRNA
  Plxna3_5
agaggcatctcggtccagcg

SEQ ID NO: 49193 - DNA, 20 bp, Artificial Sequence
  sgRNA
  Plxna3_6
gcgtggtgtggagtaccgct

SEQ ID NO: 49194 - DNA, 20 bp, Artificial Sequence
  sgRNA
  Plxna3_7
ggacatcgtaactctccaga

SEQ ID NO: 49195 - DNA, 20 bp, Artificial Sequence
  sgRNA
  Plxna3_8
cgtgtacgagccaagtaccg

SEQ ID NO: 49196 - DNA, 20 bp, Artificial Sequence
  sgRNA
  Plxna3_9
ctatgtcaccaagtaccgtc

SEQ ID NO: 49197 - DNA, 20 bp, Artificial Sequence
  sgRNA
  Plxna3_10
gctcaaggtgtgtgaccgta

SEQ ID NO: 49198 - DNA, 20 bp, Artificial Sequence
  sgRNA
  Plxna3_11
agtttctccatgcgtgaccg

SEQ ID NO: 49199 - DNA, 20 bp, Artificial Sequence
  sgRNA
  Plxna3_12
ggatctggacaccatccatg

SEQ ID NO: 49200 - DNA, 20 bp, Artificial Sequence
  sgRNA
  Plxna3_13
ggacatggacgcctacttag

SEQ ID NO: 49201 - DNA, 20 bp, Artificial Sequence
  sgRNA
  Plxna3_14
tctacatcagagcaccgcct

SEQ ID NO: 49202 - DNA, 20 bp, Artificial Sequence
  sgRNA
  Plxna3_15
tgtgtgtgcccggagagcga

SEQ ID NO: 49203 - DNA, 20 bp, Artificial Sequence
  sgRNA
  Plxna3_16
tcttatgtagagttccctat

SEQ ID NO: 49204 - DNA, 20 bp, Artificial Sequence
  sgRNA
  Plxna3_17
tgagatacacacgattgcct

SEQ ID NO: 49205 - DNA, 20 bp, Artificial Sequence
  sgRNA
  Plxna3_18
gctggagcagatcatcaccc

SEQ ID NO: 49206 - DNA, 20 bp, Artificial Sequence
  sgRNA
  Plxna3_19
atcacgtgtaggccacccaa

SEQ ID NO: 49207 - DNA, 20 bp, Artificial Sequence
  sgRNA
  Plxna3_20
gccacaagctaccaaacgac

SEQ ID NO: 49208 - DNA, 20 bp, Artificial Sequence
  sgRNA
  Plxna4_1
gaaggaacattatctctcgg

SEQ ID NO: 49209 - DNA, 20 bp, Artificial Sequence
  sgRNA
  Plxna4_2
gccacactcgaaatccgggt

SEQ ID NO: 49210 - DNA, 20 bp, Artificial Sequence
  sgRNA
  Plxna4_3
acatgatgtagagttgctcg

SEQ ID NO: 49211 - DNA, 20 bp, Artificial Sequence
  sgRNA
  Plxna4_4
cattggctgtgagcgcaatg

SEQ ID NO: 49212 - DNA, 20 bp, Artificial Sequence
  sgRNA
  Plxna4_5
ggcgatgtataccatcccag

SEQ ID NO: 49213 - DNA, 20 bp, Artificial Sequence
  sgRNA
  Plxna4_6
ttgagctccaggattcccga

SEQ ID NO: 49214 - DNA, 20 bp, Artificial Sequence
  sgRNA
  Plxna4_7
ggttgggcttcagatctgcg

SEQ ID NO: 49215 - DNA, 20 bp, Artificial Sequence
  sgRNA
  Plxna4_8
gttgggcttcagatctgcga

SEQ ID NO: 49216 - DNA, 20 bp, Artificial Sequence
  sgRNA
  Plxna4_9
accatttcggaaactcccag

SEQ ID NO: 49217 - DNA, 20 bp, Artificial Sequence
  sgRNA
  Plxna4_10
gggcgatgtataccatccca

SEQ ID NO: 49218 - DNA, 20 bp, Artificial Sequence
  sgRNA
  Plxna4_11
ggtcgtgagtacaaacatgc

SEQ ID NO: 49219 - DNA, 20 bp, Artificial Sequence
  sgRNA
  Plxna4_12
ttgcaggtctgaacaatccg

SEQ ID NO: 49220 - DNA, 20 bp, Artificial Sequence
  sgRNA
  Plxna4_13
cattgcatcacacgtgaaag

SEQ ID NO: 49221 - DNA, 20 bp, Artificial Sequence
  sgRNA
  Plxna4_14
gagttcctgtggagtcctgt

SEQ ID NO: 49222 - DNA, 20 bp, Artificial Sequence
  sgRNA
  Plxna4_15
cttcctttgtgacattccga

SEQ ID NO: 49223 - DNA, 20 bp, Artificial Sequence
  sgRNA
  Plxna4_16
tcctacgtagaggtgcccat

SEQ ID NO: 49224 - DNA, 20 bp, Artificial Sequence
  sgRNA
  Plxna4_17
ggtggagtatcgcttgttac

SEQ ID NO: 49225 - DNA, 20 bp, Artificial Sequence
  sgRNA
  Plxna4_18
actgaaagaccaggtcctgg

SEQ ID NO: 49226 - DNA, 20 bp, Artificial Sequence
  sgRNA
  Plxna4_19
ggttcaatccgcacaatggt

SEQ ID NO: 49227 - DNA, 20 bp, Artificial Sequence
  sgRNA
  Plxna4_20
gcagatctgaagcccaaccg

SEQ ID NO: 49228 - DNA, 20 bp, Artificial Sequence
  sgRNA
  Plxnb1_1
taagaccgtaacgaccaccc

SEQ ID NO: 49229 - DNA, 20 bp, Artificial Sequence
  sgRNA
  Plxnb1_2
gcttcccgggccacacaacg

SEQ ID NO: 49230 - DNA, 20 bp, Artificial Sequence
  sgRNA
  Plxnb1_3
cttgctgataccggtccatg

SEQ ID NO: 49231 - DNA, 20 bp, Artificial Sequence
  sgRNA
  Plxnb1_4
ggacgtgagatatgggtccg

SEQ ID NO: 49232 - DNA, 20 bp, Artificial Sequence
  sgRNA
  Plxnb1_5
ggtcccttgagcactccgac

SEQ ID NO: 49233 - DNA, 20 bp, Artificial Sequence
  sgRNA
  Plxnb1_6
tgagccctgccaatatcagt

SEQ ID NO: 49234 - DNA, 20 bp, Artificial Sequence
  sgRNA
  Plxnb1_7
tccaccatctgtttgtaacg

SEQ ID NO: 49235 - DNA, 20 bp, Artificial Sequence
  sgRNA
  Plxnb1_8
ggaggtgctggcgatcacca

SEQ ID NO: 49236 - DNA, 20 bp, Artificial Sequence
  sgRNA
  Plxnb1_9
tcgccggtcggagtgctcaa

SEQ ID NO: 49237 - DNA, 20 bp, Artificial Sequence
  sgRNA
  Plxnb1_10
ctaaacagagcatccagccg

SEQ ID NO: 49238 - DNA, 20 bp, Artificial Sequence
  sgRNA
  Plxnb1_11
actaccagtacgacaccccc

SEQ ID NO: 49239 - DNA, 20 bp, Artificial Sequence
  sgRNA
  Plxnb1_12
gtcagtgtctttaccacgca

SEQ ID NO: 49240 - DNA, 20 bp, Artificial Sequence
  sgRNA
  Plxnb1_13
gcttgcacagaagcaacacg

SEQ ID NO: 49241 - DNA, 20 bp, Artificial Sequence
  sgRNA
  Plxnb1_14
tgtcgaggataaactccacc

SEQ ID NO: 49242 - DNA, 20 bp, Artificial Sequence
  sgRNA
  Plxnb1_15
tggtagctccagaattggcg

SEQ ID NO: 49243 - DNA, 20 bp, Artificial Sequence
  sgRNA
  Plxnb1_16
gtacgatggcgagagccccg

SEQ ID NO: 49244 - DNA, 20 bp, Artificial Sequence
  sgRNA
  Plxnb1_17
acggctagaggacatccgtg

SEQ ID NO: 49245 - DNA, 20 bp, Artificial Sequence
  sgRNA
  Plxnb1_18
acatctacaacacttggcaa

SEQ ID NO: 49246 - DNA, 20 bp, Artificial Sequence
  sgRNA
  Plxnb1_19
ctgccacaggaaaagccacg

SEQ ID NO: 49247 - DNA, 20 bp, Artificial Sequence
  sgRNA
  Plxnb1_20
gacgtcacttccgaactcca

SEQ ID NO: 49248 - DNA, 20 bp, Artificial Sequence
  sgRNA
  Plxnb2_1
gcagtactacgagtgtcggg

SEQ ID NO: 49249 - DNA, 20 bp, Artificial Sequence
  sgRNA
  Plxnb2_2
tgacgtcaagaagataactg

SEQ ID NO: 49250 - DNA, 20 bp, Artificial Sequence
  sgRNA
  Plxnb2_3
accgtccatccgtatcagca

SEQ ID NO: 49251 - DNA, 20 bp, Artificial Sequence
  sgRNA
  Plxnb2_4
ttctcacggactttatctag

SEQ ID NO: 49252 - DNA, 20 bp, Artificial Sequence
  sgRNA
  Plxnb2_5
gatcttctcgtactcgcgct

SEQ ID NO: 49253 - DNA, 20 bp, Artificial Sequence
  sgRNA
  Plxnb2_6
tagacatccctgagtcacgg

SEQ ID NO: 49254 - DNA, 20 bp, Artificial Sequence
  sgRNA
  Plxnb2_7
acgatgataccattgtcgtg

SEQ ID NO: 49255 - DNA, 20 bp, Artificial Sequence
  sgRNA
  Plxnb2_8
agtccatcacgactgcccag

SEQ ID NO: 49256 - DNA, 20 bp, Artificial Sequence
  sgRNA
  Plxnb2_9
cgtgttctacaacgacacca

SEQ ID NO: 49257 - DNA, 20 bp, Artificial Sequence
  sgRNA
  Plxnb2_10
gccgcaccaagtgccacacg

SEQ ID NO: 49258 - DNA, 20 bp, Artificial Sequence
  sgRNA
  Plxnb2_11
acatgcgcgccagcagcgtg

SEQ ID NO: 49259 - DNA, 20 bp, Artificial Sequence
  sgRNA
  Plxnb2_12
tgctgctgctcgacccaccg

SEQ ID NO: 49260 - DNA, 20 bp, Artificial Sequence
  sgRNA
  Plxnb2_13
acttggaccttacctcccag

SEQ ID NO: 49261 - DNA, 20 bp, Artificial Sequence
  sgRNA
  Plxnb2_14
gcggcggcagaagcgagaca

SEQ ID NO: 49262 - DNA, 20 bp, Artificial Sequence
  sgRNA
  Plxnb2_15
ggagtcacgacactgagcgc

SEQ ID NO: 49263 - DNA, 20 bp, Artificial Sequence
  sgRNA
  Plxnb2_16
gagcatctgccctatccact

SEQ ID NO: 49264 - DNA, 20 bp, Artificial Sequence
  sgRNA
  Plxnb2_17
ctgtcagattcaggcccccg

SEQ ID NO: 49265 - DNA, 20 bp, Artificial Sequence
  sgRNA
  Plxnb2_18
accgtgctgatacggatgga

SEQ ID NO: 49266 - DNA, 20 bp, Artificial Sequence
  sgRNA
  Plxnb2_19
tctacataggaatagtagga

SEQ ID NO: 49267 - DNA, 20 bp, Artificial Sequence
  sgRNA
  Plxnb2_20
cacgcgtgtcgtactccact

SEQ ID NO: 49268 - DNA, 20 bp, Artificial Sequence
  sgRNA
  Plxnb3_1
ggacgagtgattcgagtcag

SEQ ID NO: 49269 - DNA, 20 bp, Artificial Sequence
  sgRNA
  Plxnb3_2
gggcaccactaggcctactg

SEQ ID NO: 49270 - DNA, 20 bp, Artificial Sequence
  sgRNA
  Plxnb3_3
gtgcccatctatgtaaccag

SEQ ID NO: 49271 - DNA, 20 bp, Artificial Sequence
  sgRNA
  Plxnb3_4
ggggtggtacagaccacatg

SEQ ID NO: 49272 - DNA, 20 bp, Artificial Sequence
  sgRNA
  Plxnb3_5
gatcagggcaaactctacgt

SEQ ID NO: 49273 - DNA, 20 bp, Artificial Sequence
  sgRNA
  Plxnb3_6
gttctcgttctcgatctcgg

SEQ ID NO: 49274 - DNA, 20 bp, Artificial Sequence
  sgRNA
  Plxnb3_7
tgtacaagtgtcagacaacg

SEQ ID NO: 49275 - DNA, 20 bp, Artificial Sequence
  sgRNA
  Plxnb3_8
tccaccatctgcttgtagcg

SEQ ID NO: 49276 - DNA, 20 bp, Artificial Sequence
  sgRNA
  Plxnb3_9
tgactgcagccactgccagg

SEQ ID NO: 49277 - DNA, 20 bp, Artificial Sequence
  sgRNA
  Plxnb3_10
tgcctgtcacagcgtccaca

SEQ ID NO: 49278 - DNA, 20 bp, Artificial Sequence
  sgRNA
  Plxnb3_11
ggtcaagtcctcatctgaca

SEQ ID NO: 49279 - DNA, 20 bp, Artificial Sequence
  sgRNA
  Plxnb3_12
gatccctcgctacaagcaga

SEQ ID NO: 49280 - DNA, 20 bp, Artificial Sequence
  sgRNA
  Plxnb3_13
gtcatccacaaacttctgca

SEQ ID NO: 49281 - DNA, 20 bp, Artificial Sequence
  sgRNA
  Plxnb3_14
tgtgggtgaccagtgccgca

SEQ ID NO: 49282 - DNA, 20 bp, Artificial Sequence
  sgRNA
  Plxnb3_15
gcgagactatcagaaggtgc

SEQ ID NO: 49283 - DNA, 20 bp, Artificial Sequence
  sgRNA
  Plxnb3_16
gtgttggaccaaatctacaa

SEQ ID NO: 49284 - DNA, 20 bp, Artificial Sequence
  sgRNA
  Plxnb3_17
gctcatccaggaagtcaaat

SEQ ID NO: 49285 - DNA, 20 bp, Artificial Sequence
  sgRNA
  Plxnb3_18
agggtgcctgaaccattggt

SEQ ID NO: 49286 - DNA, 20 bp, Artificial Sequence
  sgRNA
  Plxnb3_19
tatttggtacagagaagcga

SEQ ID NO: 49287 - DNA, 20 bp, Artificial Sequence
  sgRNA
  Plxnb3_20
gactaagtggagccaggcga

SEQ ID NO: 49288 - DNA, 20 bp, Artificial Sequence
  sgRNA
  Plxnc1_1
aatatcaccatgatcctgcg

SEQ ID NO: 49289 - DNA, 20 bp, Artificial Sequence
  sgRNA
  Plxnc1_2
cagatttacagggtaccgag

SEQ ID NO: 49290 - DNA, 20 bp, Artificial Sequence
  sgRNA
  Plxnc1_3
tatccctacaactacacgag

SEQ ID NO: 49291 - DNA, 20 bp, Artificial Sequence
  sgRNA
  Plxnc1_4
ggtgtggtgtaccgcgcgag

SEQ ID NO: 49292 - DNA, 20 bp, Artificial Sequence
  sgRNA
  Plxnc1_5
tgtcgcgatcggatgctgcg

SEQ ID NO: 49293 - DNA, 20 bp, Artificial Sequence
  sgRNA
  Plxnc1_6
gctactgctgccctaccgcg

SEQ ID NO: 49294 - DNA, 20 bp, Artificial Sequence
  sgRNA
  Plxnc1_7
aggaatcagttccttccacg

SEQ ID NO: 49295 - DNA, 20 bp, Artificial Sequence
  sgRNA
  Plxnc1_8
cgcgattagaaaataccacg

SEQ ID NO: 49296 - DNA, 20 bp, Artificial Sequence
  sgRNA
  Plxnc1_9
ggaccaagcgggcaactgca

SEQ ID NO: 49297 - DNA, 20 bp, Artificial Sequence
  sgRNA
  Plxnc1_10
ggatataccaacctacaaag

SEQ ID NO: 49298 - DNA, 20 bp, Artificial Sequence
  sgRNA
  Plxnc1_11
gacgtctgtttatggcaccg

SEQ ID NO: 49299 - DNA, 20 bp, Artificial Sequence
  sgRNA
  Plxnc1_12
tcgaggaccccagatttaca

SEQ ID NO: 49300 - DNA, 20 bp, Artificial Sequence
  sgRNA
  Plxnc1_13
agaggtcggtgccactcgcg

SEQ ID NO: 49301 - DNA, 20 bp, Artificial Sequence
  sgRNA
  Plxnc1_14
tcatagtctgatggttcgca

SEQ ID NO: 49302 - DNA, 20 bp, Artificial Sequence
  sgRNA
  Plxnc1_15
gcgaaccatcagactatgag

SEQ ID NO: 49303 - DNA, 20 bp, Artificial Sequence
  sgRNA
  Plxnc1_16
tactggagcaaacttcaccc

SEQ ID NO: 49304 - DNA, 20 bp, Artificial Sequence
  sgRNA
  Plxnc1_17
tcattgagctggagtccgta

SEQ ID NO: 49305 - DNA, 20 bp, Artificial Sequence
  sgRNA
  Plxnc1_18
tcgcctataccgggaccaag

SEQ ID NO: 49306 - DNA, 20 bp, Artificial Sequence
  sgRNA
  Plxnc1_19
ctacctgaccagcatcctgg

SEQ ID NO: 49307 - DNA, 20 bp, Artificial Sequence
  sgRNA
  Plxnc1_20
ctgggccgcctgaaactgcg

SEQ ID NO: 49308 - DNA, 20 bp, Artificial Sequence
  sgRNA
  Plxnd1_1
tcacggcagtgacctcaacg

SEQ ID NO: 49309 - DNA, 20 bp, Artificial Sequence
  sgRNA
  Plxnd1_2
cagacatctcaacggtcacg

SEQ ID NO: 49310 - DNA, 20 bp, Artificial Sequence
  sgRNA
  Plxnd1_3
ggtgctcacatggatgacga

SEQ ID NO: 49311 - DNA, 20 bp, Artificial Sequence
  sgRNA
  Plxnd1_4
gcgcggggaaaaccgacacg

SEQ ID NO: 49312 - DNA, 20 bp, Artificial Sequence
  sgRNA
  Plxnd1_5
ggctatcctgagcatccgag

SEQ ID NO: 49313 - DNA, 20 bp, Artificial Sequence
  sgRNA
  Plxnd1_6
tgtgtgcgcttcgagagccg

SEQ ID NO: 49314 - DNA, 20 bp, Artificial Sequence
  sgRNA
  Plxnd1_7
gcaaagtcccaccgtccaag

SEQ ID NO: 49315 - DNA, 20 bp, Artificial Sequence
  sgRNA
  Plxnd1_8
gatggagtctcagatccgag

SEQ ID NO: 49316 - DNA, 20 bp, Artificial Sequence
  sgRNA
  Plxnd1_9
gcgtgccttcttgcacccgg

SEQ ID NO: 49317 - DNA, 20 bp, Artificial Sequence
  sgRNA
  Plxnd1_10
ctatggaaatggcgttcgaa

SEQ ID NO: 49318 - DNA, 20 bp, Artificial Sequence
  sgRNA
  Plxnd1_11
cggtgcacatcaatctccga

SEQ ID NO: 49319 - DNA, 20 bp, Artificial Sequence
  sgRNA
  Plxnd1_12
gtacctggcgctcaacagcg

SEQ ID NO: 49320 - DNA, 20 bp, Artificial Sequence
  sgRNA
  Plxnd1_13
aatgaacgcacacctggccg

SEQ ID NO: 49321 - DNA, 20 bp, Artificial Sequence
  sgRNA
  Plxnd1_14
agttcttcgctgtcttcgag

SEQ ID NO: 49322 - DNA, 20 bp, Artificial Sequence
  sgRNA
  Plxnd1_15
tagagcctaagaaatctcac

SEQ ID NO: 49323 - DNA, 20 bp, Artificial Sequence
  sgRNA
  Plxnd1_16
ggtcttctgccagtagcgct

SEQ ID NO: 49324 - DNA, 20 bp, Artificial Sequence
  sgRNA
  Plxnd1_17
gcatcacctgcactgtgcca

SEQ ID NO: 49325 - DNA, 20 bp, Artificial Sequence
  sgRNA
  Plxnd1_18
tctatgtcgaagacaaactg

SEQ ID NO: 49326 - DNA, 20 bp, Artificial Sequence
  sgRNA
  Plxnd1_19
tgacagatacaccgtttcag

SEQ ID NO: 49327 - DNA, 20 bp, Artificial Sequence
  sgRNA
  Plxnd1_20
gacccttacagacatctcaa

SEQ ID NO: 49328 - DNA, 20 bp, Artificial Sequence
  sgRNA
  Pmel_1
tgtacaaatgccaaccacag

SEQ ID NO: 49329 - DNA, 20 bp, Artificial Sequence
  sgRNA
  Pmel_2
aatgatgggcctacactggt

SEQ ID NO: 49330 - DNA, 20 bp, Artificial Sequence
  sgRNA
  Pmel_3
ggttgttgcttgtgcaacgg

SEQ ID NO: 49331 - DNA, 20 bp, Artificial Sequence
  sgRNA
  Pmel_4
agtgactgtctaccaccgac

SEQ ID NO: 49332 - DNA, 20 bp, Artificial Sequence
  sgRNA
  Pmel_5
agtcaaaaggtactaccgga

SEQ ID NO: 49333 - DNA, 20 bp, Artificial Sequence
  sgRNA
  Pmel_6
gcacttggtgtagaaccagc

SEQ ID NO: 49334 - DNA, 20 bp, Artificial Sequence
  sgRNA
  Pmel_7
gtgactgtctaccaccgacg

SEQ ID NO: 49335 - DNA, 20 bp, Artificial Sequence
  sgRNA
  Pmel_8
gcagaggtgtcaactacaga

SEQ ID NO: 49336 - DNA, 20 bp, Artificial Sequence
  sgRNA
  Pmel_9
gcccagataacctgaccatc

SEQ ID NO: 49337 - DNA, 20 bp, Artificial Sequence
  sgRNA
  Pmel_10
tgtacaactgtggttccaga

SEQ ID NO: 49338 - DNA, 20 bp, Artificial Sequence
  sgRNA
  Pmel_11
tgaaagtgctgagatcctgc

SEQ ID NO: 49339 - DNA, 20 bp, Artificial Sequence
  sgRNA
  Pmel_12
gcacaagcaacaaccacaga

SEQ ID NO: 49340 - DNA, 20 bp, Artificial Sequence
  sgRNA
  Pmel_13
gctacgggccacgcaaagct

SEQ ID NO: 49341 - DNA, 20 bp, Artificial Sequence
  sgRNA
  Pmel_14
ggtttaggaccagatgggca

SEQ ID NO: 49342 - DNA, 20 bp, Artificial Sequence
  sgRNA
  Pmel_15
tgtggtatctatgaccgctg

SEQ ID NO: 49343 - DNA, 20 bp, Artificial Sequence
  sgRNA
  Pmel_16
cgatatagaacacagtccag

SEQ ID NO: 49344 - DNA, 20 bp, Artificial Sequence
  sgRNA
  Pmel_17
tgtcggtgtcatccagtaga

SEQ ID NO: 49345 - DNA, 20 bp, Artificial Sequence
  sgRNA
  Pmel_18
ggccgacctctcctacacat

SEQ ID NO: 49346 - DNA, 20 bp, Artificial Sequence
  sgRNA
  Pmel_19
agagcactcagcacaagcac

SEQ ID NO: 49347 - DNA, 20 bp, Artificial Sequence
  sgRNA
  Pmel_20
gaggaaccacaggaaacaag

SEQ ID NO: 49348 - DNA, 20 bp, Artificial Sequence
  sgRNA
  Pmepa1_1
ggtgtcaggtggaatgccgg

SEQ ID NO: 49349 - DNA, 20 bp, Artificial Sequence
  sgRNA
  Pmepa1_2
gctggagttcgtgcaaatcg

SEQ ID NO: 49350 - DNA, 20 bp, Artificial Sequence
  sgRNA
  Pmepa1_3
agcgggctgacagcttgtag

SEQ ID NO: 49351 - DNA, 20 bp, Artificial Sequence
  sgRNA
  Pmepa1_4
ccatcagacagtgagatggt

SEQ ID NO: 49352 - DNA, 20 bp, Artificial Sequence
  sgRNA
  Pmepa1_5
agtacaacacagggtgaccg

SEQ ID NO: 49353 - DNA, 20 bp, Artificial Sequence
  sgRNA
  Pmepa1_6
cctgacaccgtactctctga

SEQ ID NO: 49354 - DNA, 20 bp, Artificial Sequence
  sgRNA
  Pmepa1_7
tgtcagagaccagtgtatca

SEQ ID NO: 49355 - DNA, 20 bp, Artificial Sequence
  sgRNA
  Pmepa1_8
tcgaagatggtccggttagg

SEQ ID NO: 49356 - DNA, 20 bp, Artificial Sequence
  sgRNA
  Pmepa1_9
gagccgggtcccctctagca

SEQ ID NO: 49357 - DNA, 20 bp, Artificial Sequence
  sgRNA
  Pmepa1_10
ggagacattgggctgcccgg

SEQ ID NO: 49358 - DNA, 20 bp, Artificial Sequence
  sgRNA
  Pmepa1_11
atgcccgagttactgctggg

SEQ ID NO: 49359 - DNA, 20 bp, Artificial Sequence
  sgRNA
  Pmepa1_12
ctgtgccccccttcatccag

SEQ ID NO: 49360 - DNA, 20 bp, Artificial Sequence
  sgRNA
  Pmepa1_13
tgctggggaacaaagagcgc

SEQ ID NO: 49361 - DNA, 20 bp, Artificial Sequence
  sgRNA
  Pmepa1_14
aatcggctccgctggatgaa

SEQ ID NO: 49362 - DNA, 20 bp, Artificial Sequence
  sgRNA
  Pmepa1_15
ggcaatttcgtgctgcaggt

SEQ ID NO: 49363 - DNA, 20 bp, Artificial Sequence
  sgRNA
  Pmepa1_16
gtgtcggctgatgaaggagc

SEQ ID NO: 49364 - DNA, 20 bp, Artificial Sequence
  sgRNA
  Pmepa1_17
gcgagtcggtcagtgggccg

SEQ ID NO: 49365 - DNA, 20 bp, Artificial Sequence
  sgRNA
  Pmepa1_18
gttactttgctggtgctgga

SEQ ID NO: 49366 - DNA, 20 bp, Artificial Sequence
  sgRNA
  Pmepa1_19
gcgctggcagttgcacgcgc

SEQ ID NO: 49367 - DNA, 20 bp, Artificial Sequence
  sgRNA
  Pmepa1_20
gaggagcccccaccctacca

SEQ ID NO: 49368 - DNA, 20 bp, Artificial Sequence
  sgRNA
  Podxl_1
aagcaagtgtagatgccact

SEQ ID NO: 49369 - DNA, 20 bp, Artificial Sequence
  sgRNA
  Podxl_2
gggcacgtgtactcacgcaa

SEQ ID NO: 49370 - DNA, 20 bp, Artificial Sequence
  sgRNA
  Podxl_3
aaccccacgagcaatcaaag

SEQ ID NO: 49371 - DNA, 20 bp, Artificial Sequence
  sgRNA
  Podxl_4
gtgctcggtgaagaatccac

SEQ ID NO: 49372 - DNA, 20 bp, Artificial Sequence
  sgRNA
  Podxl_5
ttaccatgacaacccaacct

SEQ ID NO: 49373 - DNA, 20 bp, Artificial Sequence
  sgRNA
  Podxl_6
tattctagataaccaggcgg

SEQ ID NO: 49374 - DNA, 20 bp, Artificial Sequence
  sgRNA
  Podxl_7
gtggcttcagaggtgcccaa

SEQ ID NO: 49375 - DNA, 20 bp, Artificial Sequence
  sgRNA
  Podxl_8
tcctcatctggccttatggg

SEQ ID NO: 49376 - DNA, 20 bp, Artificial Sequence
  sgRNA
  Podxl_9
ccctctggacaacttgacca

SEQ ID NO: 49377 - DNA, 20 bp, Artificial Sequence
  sgRNA
  Podxl_10
gtcaccagcggatctcccag

SEQ ID NO: 49378 - DNA, 20 bp, Artificial Sequence
  sgRNA
  Podxl_11
aacaagctctcccagtagca

SEQ ID NO: 49379 - DNA, 20 bp, Artificial Sequence
  sgRNA
  Podxl_12
acatcaacagaagtcacaac

SEQ ID NO: 49380 - DNA, 20 bp, Artificial Sequence
  sgRNA
  Podxl_13
agtcacaactggtcacccag

SEQ ID NO: 49381 - DNA, 20 bp, Artificial Sequence
  sgRNA
  Podxl_14
tccttggtcaagttgtccag

SEQ ID NO: 49382 - DNA, 20 bp, Artificial Sequence
  sgRNA
  Podxl_15
tcaaccttaatggggagctg

SEQ ID NO: 49383 - DNA, 20 bp, Artificial Sequence
  sgRNA
  Podxl_16
gtaatttccaaaggcccaga

SEQ ID NO: 49384 - DNA, 20 bp, Artificial Sequence
  sgRNA
  Podxl_17
ttctcttcactgccaccgcc

SEQ ID NO: 49385 - DNA, 20 bp, Artificial Sequence
  sgRNA
  Podxl_18
gtttctctttctcatccaga

SEQ ID NO: 49386 - DNA, 20 bp, Artificial Sequence
  sgRNA
  Podxl_19
ccaccgctttgattgctcgt

SEQ ID NO: 49387 - DNA, 20 bp, Artificial Sequence
  sgRNA
  Podxl_20
catcatcaccatcgtctgca

SEQ ID NO: 49388 - DNA, 20 bp, Artificial Sequence
  sgRNA
  Podxl2_1
gctatagttctgaacccccg

SEQ ID NO: 49389 - DNA, 20 bp, Artificial Sequence
  sgRNA
  Podxl2_2
cttacctgagtagagtccca

SEQ ID NO: 49390 - DNA, 20 bp, Artificial Sequence
  sgRNA
  Podxl2_3
tcctgcagaggcatatgcca

SEQ ID NO: 49391 - DNA, 20 bp, Artificial Sequence
  sgRNA
  Podxl2_4
tgggactgaggtccccagtg

SEQ ID NO: 49392 - DNA, 20 bp, Artificial Sequence
  sgRNA
  Podxl2_5
gcttctcctgcatctccgac

SEQ ID NO: 49393 - DNA, 20 bp, Artificial Sequence
  sgRNA
  Podxl2_6
aagctcactcactaacaccg

SEQ ID NO: 49394 - DNA, 20 bp, Artificial Sequence
  sgRNA
  Podxl2_7
gaagtatttcggcggcaccg

SEQ ID NO: 49395 - DNA, 20 bp, Artificial Sequence
  sgRNA
  Podxl2_8
ggactcggacgtgttcgagg

SEQ ID NO: 49396 - DNA, 20 bp, Artificial Sequence
  sgRNA
  Podxl2_9
tcttcttcccagaagtactg

SEQ ID NO: 49397 - DNA, 20 bp, Artificial Sequence
  sgRNA
  Podxl2_10
cttccccagtgaggacagcg

SEQ ID NO: 49398 - DNA, 20 bp, Artificial Sequence
  sgRNA
  Podxl2_11
gcactgagtggccaactggg

SEQ ID NO: 49399 - DNA, 20 bp, Artificial Sequence
  sgRNA
  Podxl2_12
gtagtcactgcgcacctggg

SEQ ID NO: 49400 - DNA, 20 bp, Artificial Sequence
  sgRNA
  Podxl2_13
gggcaacaagaggtccagca

SEQ ID NO: 49401 - DNA, 20 bp, Artificial Sequence
  sgRNA
  Podxl2_14
cgaacacgtccgagtcctca

SEQ ID NO: 49402 - DNA, 20 bp, Artificial Sequence
  sgRNA
  Podxl2_15
tttgtagtgctggtgatcat

SEQ ID NO: 49403 - DNA, 20 bp, Artificial Sequence
  sgRNA
  Podxl2_16
cgtccagcgtgggattgtcg

SEQ ID NO: 49404 - DNA, 20 bp, Artificial Sequence
  sgRNA
  Podxl2_17
agaccaggccacatcaggca

SEQ ID NO: 49405 - DNA, 20 bp, Artificial Sequence
  sgRNA
  Podxl2_18
tgaggactcggacgtgttcg

SEQ ID NO: 49406 - DNA, 20 bp, Artificial Sequence
  sgRNA
  Podxl2_19
cgatggccactgcggtggcg

SEQ ID NO: 49407 - DNA, 20 bp, Artificial Sequence
  sgRNA
  Podxl2_20
gtactgccacgccaccgcag

SEQ ID NO: 49408 - DNA, 20 bp, Artificial Sequence
  sgRNA
  Pqlc2_1
caagagcacagaattgatag

SEQ ID NO: 49409 - DNA, 20 bp, Artificial Sequence
  sgRNA
  Pqlc2_2
tggaccaggccctatcactg
